United States Patent 7,374,927 (METHODS OF ANALYSIS OF DEGRADED NUCLEIC ACID SAMPLES) - sequence listing, part 4

SEQ ID NO: 119908 - DNA, 25 bp, Homo sapien
gatctaatcccttcaaggaagtgat

SEQ ID NO: 119909 - DNA, 25 bp, Homo sapien
atctaatcccttcaaggaagtgata

SEQ ID NO: 119910 - DNA, 25 bp, Homo sapien
gaagtgataacactggagtggtaac

SEQ ID NO: 119911 - DNA, 25 bp, Homo sapien
ctggttctccatccccatgtgtttc

SEQ ID NO: 119912 - DNA, 25 bp, Homo sapien
atcgctcggtatgacttctgtgcaa

SEQ ID NO: 119913 - DNA, 25 bp, Homo sapien
ggtatgacttctgtgcaagagatat

SEQ ID NO: 119914 - DNA, 25 bp, Homo sapien
atgagagagttgtccttgttgaaag

SEQ ID NO: 119915 - DNA, 25 bp, Homo sapien
acaaagatgagtgcaaatggctggt

SEQ ID NO: 119916 - DNA, 25 bp, Homo sapien
tggtttccatccacatatgtggaag

SEQ ID NO: 119917 - DNA, 25 bp, Homo sapien
ataaattcaaatcccgtgttgcacc

SEQ ID NO: 119918 - DNA, 25 bp, Homo sapien
gcaccaaaaatttcagagaagggat

SEQ ID NO: 119919 - DNA, 25 bp, Homo sapien
gaagggataaatagaagcctgcaca

SEQ ID NO: 119920 - DNA, 25 bp, Homo sapien
gcctgcacagcatcgtgaattaact

SEQ ID NO: 119921 - DNA, 25 bp, Homo sapien
ctgaagtgtttaaaaagctgcattt

SEQ ID NO: 119922 - DNA, 25 bp, Homo sapien
tgcatttctggctgttcaacatcct

SEQ ID NO: 119923 - DNA, 25 bp, Homo sapien
tctacagccacagggcggaaactgc

SEQ ID NO: 119924 - DNA, 25 bp, Homo sapien
gaaactgctggtgtctgggtggtgg

SEQ ID NO: 119925 - DNA, 25 bp, Homo sapien
ggtatggtccgccatcccaactatc

SEQ ID NO: 119926 - DNA, 25 bp, Homo sapien
atcccaactatcttggagacctcat

SEQ ID NO: 119927 - DNA, 25 bp, Homo sapien
tggagacctcatcatggctctggct

SEQ ID NO: 119928 - DNA, 25 bp, Homo sapien
atggctctggcttggtccttgccct

SEQ ID NO: 119929 - DNA, 25 bp, Homo sapien
tcaccgcgctgctggtgcaccgtga

SEQ ID NO: 119930 - DNA, 25 bp, Homo sapien
agtgcctgcagaagtacggcctggc

SEQ ID NO: 119931 - DNA, 25 bp, Homo sapien
tacggcctggcctggcaggagtact

SEQ ID NO: 119932 - DNA, 25 bp, Homo sapien
agtactgccggcgtgtgccttaccg

SEQ ID NO: 119933 - DNA, 25 bp, Homo sapien
ggcgtgtgccttaccgcatcatgcc

SEQ ID NO: 119934 - DNA, 25 bp, Homo sapien
ccatacttcctgatctgcatctgga

SEQ ID NO: 119935 - DNA, 25 bp, Homo sapien
catacttcctgatctgcatctggaa

SEQ ID NO: 119936 - DNA, 25 bp, Homo sapien
gcatctggaagcttggccagcaaca

SEQ ID NO: 119937 - DNA, 25 bp, Homo sapien
acaggaactgaagtaaacactttag

SEQ ID NO: 119938 - DNA, 25 bp, Homo sapien
aacactttagttgctttcagggatg

SEQ ID NO: 119939 - DNA, 25 bp, Homo sapien
cactttagttgctttcagggatgac

SEQ ID NO: 119940 - DNA, 25 bp, Homo sapien
actttagttgctttcagggatgaca

SEQ ID NO: 119941 - DNA, 25 bp, Homo sapien
tttagttgctttcagggatgacaca

SEQ ID NO: 119942 - DNA, 25 bp, Homo sapien
ttcagggatgacacaagcacacaat

SEQ ID NO: 119943 - DNA, 25 bp, Homo sapien
gggatgacacaagcacacaatgatt

SEQ ID NO: 119944 - DNA, 25 bp, Homo sapien
tttgcttacaatcacttaacttagc

SEQ ID NO: 119945 - DNA, 25 bp, Homo sapien
gacgctgtggacactgcggacgcta

SEQ ID NO: 119946 - DNA, 25 bp, Homo sapien
cgctgtggacactgcggacgctatg

SEQ ID NO: 119947 - DNA, 25 bp, Homo sapien
actgcggacgctatggggacaatga

SEQ ID NO: 119948 - DNA, 25 bp, Homo sapien
gggacaatgacgctgtggacagtga

SEQ ID NO: 119949 - DNA, 25 bp, Homo sapien
ctgtggacagtgaggacgctgtggg

SEQ ID NO: 119950 - DNA, 25 bp, Homo sapien
gggcagtgaggacgctgtggacagt

SEQ ID NO: 119951 - DNA, 25 bp, Homo sapien
ggccgtggaggacgctgtggacggt

SEQ ID NO: 119952 - DNA, 25 bp, Homo sapien
acgctgtggacggtgagaacgctgt

SEQ ID NO: 119953 - DNA, 25 bp, Homo sapien
acactgaggatgctgtgaggacgct

SEQ ID NO: 119954 - DNA, 25 bp, Homo sapien
gggcagtgaggacgctgtggaccgt

SEQ ID NO: 119955 - DNA, 25 bp, Homo sapien
ggacgctgtggaccgtgaggacgct

SEQ ID NO: 119956 - DNA, 25 bp, Homo sapien
gatcaggaaagtcatactgttcact

SEQ ID NO: 119957 - DNA, 25 bp, Homo sapien
agtcatactgttcactttcaagttg

SEQ ID NO: 119958 - DNA, 25 bp, Homo sapien
atactgttcactttcaagttggctg

SEQ ID NO: 119959 - DNA, 25 bp, Homo sapien
gttcactttcaagttggctgtcccc

SEQ ID NO: 119960 - DNA, 25 bp, Homo sapien
ccacccccatatgtacagatgataa

SEQ ID NO: 119961 - DNA, 25 bp, Homo sapien
tgtcgtcagtggcaaacatttcaca

SEQ ID NO: 119962 - DNA, 25 bp, Homo sapien
agtggcaaacatttcacagattatt

SEQ ID NO: 119963 - DNA, 25 bp, Homo sapien
tcaacatttttgacactgtgctaat

SEQ ID NO: 119964 - DNA, 25 bp, Homo sapien
gacactgtgctaatagttatattca

SEQ ID NO: 119965 - DNA, 25 bp, Homo sapien
catgaaaagatactactgtgttgaa

SEQ ID NO: 119966 - DNA, 25 bp, Homo sapien
gaaattttgacagtatttttgtaca

SEQ ID NO: 119967 - DNA, 25 bp, Homo sapien
gttaatggcagaaaaatcactacaa

SEQ ID NO: 119968 - DNA, 25 bp, Homo sapien
atggcagaaaaatcactacaaagag

SEQ ID NO: 119969 - DNA, 25 bp, Homo sapien
ggcagaaaaatcactacaaagagaa

SEQ ID NO: 119970 - DNA, 25 bp, Homo sapien
caaagagaattgtcgagaacggtca

SEQ ID NO: 119971 - DNA, 25 bp, Homo sapien
aagagaattgtcgagaacggtcaag

SEQ ID NO: 119972 - DNA, 25 bp, Homo sapien
gagaattgtcgagaacggtcaagaa

SEQ ID NO: 119973 - DNA, 25 bp, Homo sapien
agaattgtcgagaacggtcaagaaa

SEQ ID NO: 119974 - DNA, 25 bp, Homo sapien
aattgtcgagaacggtcaagaaaga

SEQ ID NO: 119975 - DNA, 25 bp, Homo sapien
tgtcgagaacggtcaagaaagagta

SEQ ID NO: 119976 - DNA, 25 bp, Homo sapien
tcgagaacggtcaagaaagagtaga

SEQ ID NO: 119977 - DNA, 25 bp, Homo sapien
agaacggtcaagaaagagtagaagt

SEQ ID NO: 119978 - DNA, 25 bp, Homo sapien
aactgagtctgtggacactgtggaa

SEQ ID NO: 119979 - DNA, 25 bp, Homo sapien
gtggacactgtggaaagctttgaac

SEQ ID NO: 119980 - DNA, 25 bp, Homo sapien
gaacaattgtgttttcgtcacagga

SEQ ID NO: 119981 - DNA, 25 bp, Homo sapien
gtgttttcgtcacaggagtctttgt

SEQ ID NO: 119982 - DNA, 25 bp, Homo sapien
acaggagtctttgtaatgcttgtac

SEQ ID NO: 119983 - DNA, 25 bp, Homo sapien
atgcttgtacagttgatgtcgatgc

SEQ ID NO: 119984 - DNA, 25 bp, Homo sapien
agttgatgtcgatgctcactgcttc

SEQ ID NO: 119985 - DNA, 25 bp, Homo sapien
atgtcgatgctcactgcttctgctt

SEQ ID NO: 119986 - DNA, 25 bp, Homo sapien
ggttctggtaacctgtggtgtattt

SEQ ID NO: 119987 - DNA, 25 bp, Homo sapien
tacccactatgcacagattaaactt

SEQ ID NO: 119988 - DNA, 25 bp, Homo sapien
gattaaacttcacctacaaactcct

SEQ ID NO: 119989 - DNA, 25 bp, Homo sapien
tccatggtggctgatgttcatcgca

SEQ ID NO: 119990 - DNA, 25 bp, Homo sapien
atcgcactctggtctacggagggat

SEQ ID NO: 119991 - DNA, 25 bp, Homo sapien
gatatttctgtaccccgctaacaag

SEQ ID NO: 119992 - DNA, 25 bp, Homo sapien
gaagagccccaatggaaagctgaga

SEQ ID NO: 119993 - DNA, 25 bp, Homo sapien
aaagctgagactgctgtacgaatgc

SEQ ID NO: 119994 - DNA, 25 bp, Homo sapien
tgtacgaatgcaaccccatggccta

SEQ ID NO: 119995 - DNA, 25 bp, Homo sapien
aaccccatggcctacgtcatggaga

SEQ ID NO: 119996 - DNA, 25 bp, Homo sapien
ccaccactgggaaggaggccgtgtt

SEQ ID NO: 119997 - DNA, 25 bp, Homo sapien
gaggccgtgttagacgtcattccca

SEQ ID NO: 119998 - DNA, 25 bp, Homo sapien
ttagacgtcattcccacagacattc

SEQ ID NO: 119999 - DNA, 25 bp, Homo sapien
acagacattcaccagagggcgccgg

SEQ ID NO: 120000 - DNA, 25 bp, Homo sapien
tggagagtgacatgtgctggacact

SEQ ID NO: 120001 - DNA, 25 bp, Homo sapien
gtgacatgtgctggacactgtccat

SEQ ID NO: 120002 - DNA, 25 bp, Homo sapien
ggacactgtccatgaagcactgagc

SEQ ID NO: 120003 - DNA, 25 bp, Homo sapien
gacactgtccatgaagcactgagca

SEQ ID NO: 120004 - DNA, 25 bp, Homo sapien
gaagctggaggcacaacgcaccaga

SEQ ID NO: 120005 - DNA, 25 bp, Homo sapien
ggaggcacaacgcaccagacactca

SEQ ID NO: 120006 - DNA, 25 bp, Homo sapien
gacactcacagcaaggatggagctg

SEQ ID NO: 120007 - DNA, 25 bp, Homo sapien
ggagctgaaaacataacccactctg

SEQ ID NO: 120008 - DNA, 25 bp, Homo sapien
ctgaaaacataacccactctgtcct

SEQ ID NO: 120009 - DNA, 25 bp, Homo sapien
agtcctccagacaaccctcagattt

SEQ ID NO: 120010 - DNA, 25 bp, Homo sapien
cagacaaccctcagatttgatgatt

SEQ ID NO: 120011 - DNA, 25 bp, Homo sapien
agatcaaagtagcagtcttcctgaa

SEQ ID NO: 120012 - DNA, 25 bp, Homo sapien
ttcagatgaaagtactcctccgagt

SEQ ID NO: 120013 - DNA, 25 bp, Homo sapien
aatcatacatgtgctggagaaggtc

SEQ ID NO: 120014 - DNA, 25 bp, Homo sapien
ggagaaggtccagtatcttgaacaa

SEQ ID NO: 120015 - DNA, 25 bp, Homo sapien
gacaaagcatactggcttctggaag

SEQ ID NO: 120016 - DNA, 25 bp, Homo sapien
gaagaaatgctaaccaaggaacttt

SEQ ID NO: 120017 - DNA, 25 bp, Homo sapien
ggaacttttggaactggattcagtt

SEQ ID NO: 120018 - DNA, 25 bp, Homo sapien
caggactctgtacggcaggccagaa

SEQ ID NO: 120019 - DNA, 25 bp, Homo sapien
cggcaggccagaaaagaggctgttt

SEQ ID NO: 120020 - DNA, 25 bp, Homo sapien
gaggctgtttgtaagattcaggcca

SEQ ID NO: 120021 - DNA, 25 bp, Homo sapien
ttgtaagattcaggccatactggaa

SEQ ID NO: 120022 - DNA, 25 bp, Homo sapien
gcagaagctttattgacctatgaga

SEQ ID NO: 120023 - DNA, 25 bp, Homo sapien
gataactctcttgatatggatgctt

SEQ ID NO: 120024 - DNA, 25 bp, Homo sapien
tgatatggatgcttgctggttttat

SEQ ID NO: 120025 - DNA, 25 bp, Homo sapien
gcagtagtctacttttacaacgctt

SEQ ID NO: 120026 - DNA, 25 bp, Homo sapien
ttttacaacgctttcccctcattct

SEQ ID NO: 120027 - DNA, 25 bp, Homo sapien
ttcccctcattcttgatgtggtgta

SEQ ID NO: 120028 - DNA, 25 bp, Homo sapien
atttgtcacatttatccagtttggg

SEQ ID NO: 120029 - DNA, 25 bp, Homo sapien
atccagtttgggttattctcattat

SEQ ID NO: 120030 - DNA, 25 bp, Homo sapien
ttctcattatgacacctattgcaaa

SEQ ID NO: 120031 - DNA, 25 bp, Homo sapien
tgcaaattagcatcccatggcaaat

SEQ ID NO: 120032 - DNA, 25 bp, Homo sapien
agcatcccatggcaaatatattttg

SEQ ID NO: 120033 - DNA, 25 bp, Homo sapien
ggccttggcccgagaattcagctgt

SEQ ID NO: 120034 - DNA, 25 bp, Homo sapien
gtcccttttttgagacatctgctgc

SEQ ID NO: 120035 - DNA, 25 bp, Homo sapien
gctgcataccgctactatattgatg

SEQ ID NO: 120036 - DNA, 25 bp, Homo sapien
attgatgatgttttccatgcccttg

SEQ ID NO: 120037 - DNA, 25 bp, Homo sapien
gcccttgtacgggagatacgtagga

SEQ ID NO: 120038 - DNA, 25 bp, Homo sapien
aaaaggaggcagtactggccatgga

SEQ ID NO: 120039 - DNA, 25 bp, Homo sapien
aatctaagcccaaaaacagtgtatg

SEQ ID NO: 120040 - DNA, 25 bp, Homo sapien
gtgtttatctgtgaactgcagtgct

SEQ ID NO: 120041 - DNA, 25 bp, Homo sapien
tgcagtgctgtatcaaagcagtcca

SEQ ID NO: 120042 - DNA, 25 bp, Homo sapien
aagcagtccagtaacctgcagtact

SEQ ID NO: 120043 - DNA, 25 bp, Homo sapien
aacctgcagtactgagtatggtgct

SEQ ID NO: 120044 - DNA, 25 bp, Homo sapien
accgctggcgcctgggcaaagtgct

SEQ ID NO: 120045 - DNA, 25 bp, Homo sapien
gagcggaacaccagcaaccacaggg

SEQ ID NO: 120046 - DNA, 25 bp, Homo sapien
gtggtggcagccaggattcatctgc

SEQ ID NO: 120047 - DNA, 25 bp, Homo sapien
cagccaggattcatctgcggagacc

SEQ ID NO: 120048 - DNA, 25 bp, Homo sapien
ggtggcctccctagattggctgaga

SEQ ID NO: 120049 - DNA, 25 bp, Homo sapien
ggcctccctagattggctgagagcc

SEQ ID NO: 120050 - DNA, 25 bp, Homo sapien
ggctgagagccccttctgaaccctg

SEQ ID NO: 120051 - DNA, 25 bp, Homo sapien
gagccccttctgaaccctgctggga

SEQ ID NO: 120052 - DNA, 25 bp, Homo sapien
tgggaccccagctagggctggactc

SEQ ID NO: 120053 - DNA, 25 bp, Homo sapien
agctagggctggactctggcaccca

SEQ ID NO: 120054 - DNA, 25 bp, Homo sapien
actctggcacccagagggcgtcgct

SEQ ID NO: 120055 - DNA, 25 bp, Homo sapien
gagaaaaaatccatatacctgaaag

SEQ ID NO: 120056 - DNA, 25 bp, Homo sapien
aaaagttcgaagacatcttcatgcg

SEQ ID NO: 120057 - DNA, 25 bp, Homo sapien
atcttcacctttctctatagagctt

SEQ ID NO: 120058 - DNA, 25 bp, Homo sapien
tatagagcttgaggaccctcagcct

SEQ ID NO: 120059 - DNA, 25 bp, Homo sapien
gaccacattccttggattacagctg

SEQ ID NO: 120060 - DNA, 25 bp, Homo sapien
tggattacagctgtacttccaacag

SEQ ID NO: 120061 - DNA, 25 bp, Homo sapien
ttctgtctaattctatggaaatgga

SEQ ID NO: 120062 - DNA, 25 bp, Homo sapien
agaagaagcggcctcgcaactctta

SEQ ID NO: 120063 - DNA, 25 bp, Homo sapien
cggcctcgcaactcttataaatgtg

SEQ ID NO: 120064 - DNA, 25 bp, Homo sapien
gcaactcttataaatgtggaaccaa

SEQ ID NO: 120065 - DNA, 25 bp, Homo sapien
atgtggaaccaacacaatggagagg

SEQ ID NO: 120066 - DNA, 25 bp, Homo sapien
ccaatgtgctgagagtaatctgtaa

SEQ ID NO: 120067 - DNA, 25 bp, Homo sapien
aatctgtaatgggaagcagccagac

SEQ ID NO: 120068 - DNA, 25 bp, Homo sapien
aaatctcctgacaaggctggtctag

SEQ ID NO: 120069 - DNA, 25 bp, Homo sapien
agtagctgtgagaatacctgtccca

SEQ ID NO: 120070 - DNA, 25 bp, Homo sapien
tacctgtcccagctatcaatgagca

SEQ ID NO: 120071 - DNA, 25 bp, Homo sapien
atgagcacaacatttcagtagagaa

SEQ ID NO: 120072 - DNA, 25 bp, Homo sapien
tagaatcttccccatgtacatgctg

SEQ ID NO: 120073 - DNA, 25 bp, Homo sapien
catgctgttgatttcaggtctttgt

SEQ ID NO: 120074 - DNA, 25 bp, Homo sapien
taggcttgtgaatatagcacttatt

SEQ ID NO: 120075 - DNA, 25 bp, Homo sapien
attttaatccagtagagacttgcat

SEQ ID NO: 120076 - DNA, 25 bp, Homo sapien
gatcctaaacagatgcattgttgct

SEQ ID NO: 120077 - DNA, 25 bp, Homo sapien
aagaatactatttccaaactcatat

SEQ ID NO: 120078 - DNA, 25 bp, Homo sapien
tactatttccaaactcatattacaa

SEQ ID NO: 120079 - DNA, 25 bp, Homo sapien
gaaagcatgatatttactgttttgt

SEQ ID NO: 120080 - DNA, 25 bp, Homo sapien
tgttttgttgtctgggtttgagaaa

SEQ ID NO: 120081 - DNA, 25 bp, Homo sapien
gttttatgattgttatgtgtattat

SEQ ID NO: 120082 - DNA, 25 bp, Homo sapien
ggcaatttaacatgtgtattctttt

SEQ ID NO: 120083 - DNA, 25 bp, Homo sapien
taattaggtattcgaattttgtctt

SEQ ID NO: 120084 - DNA, 25 bp, Homo sapien
ttcatgtggtttctatgcaaagttc

SEQ ID NO: 120085 - DNA, 25 bp, Homo sapien
atgtggtttctatgcaaagttcttc

SEQ ID NO: 120086 - DNA, 25 bp, Homo sapien
gtggtttctatgcaaagttcttcat

SEQ ID NO: 120087 - DNA, 25 bp, Homo sapien
atgcaaagttcttcatatcatcaca

SEQ ID NO: 120088 - DNA, 25 bp, Homo sapien
gggctactttgcagccaagttcctg

SEQ ID NO: 120089 - DNA, 25 bp, Homo sapien
tgctgcgtttgctggactgatgtac

SEQ ID NO: 120090 - DNA, 25 bp, Homo sapien
actgatgtacttgtttgtgcggcaa

SEQ ID NO: 120091 - DNA, 25 bp, Homo sapien
gtactttgtcggttacctaggagag

SEQ ID NO: 120092 - DNA, 25 bp, Homo sapien
gagagagaacgcagagcacccctgg

SEQ ID NO: 120093 - DNA, 25 bp, Homo sapien
gcacccctggctacatatttgggaa

SEQ ID NO: 120094 - DNA, 25 bp, Homo sapien
ggaaacgcatcatactcttcctgtt

SEQ ID NO: 120095 - DNA, 25 bp, Homo sapien
tcatgtccgttgctggcatattcaa

SEQ ID NO: 120096 - DNA, 25 bp, Homo sapien
ggcatattcaactattacctcatct

SEQ ID NO: 120097 - DNA, 25 bp, Homo sapien
cctcatcttctttttcggaagtgac

SEQ ID NO: 120098 - DNA, 25 bp, Homo sapien
actacataaagacgatctccaccac

SEQ ID NO: 120099 - DNA, 25 bp, Homo sapien
tttccactgggaagattgacctttt

SEQ ID NO: 120100 - DNA, 25 bp, Homo sapien
gggaagattgaccttttgtatttat

SEQ ID NO: 120101 - DNA, 25 bp, Homo sapien
taagcattccagatgcttgcagctt

SEQ ID NO: 120102 - DNA, 25 bp, Homo sapien
tgcttgcagcttcctgcatccagga

SEQ ID NO: 120103 - DNA, 25 bp, Homo sapien
tgtgtcccccgtgatgcagctggaa

SEQ ID NO: 120104 - DNA, 25 bp, Homo sapien
gcagctggaacccaagctgcagcag

SEQ ID NO: 120105 - DNA, 25 bp, Homo sapien
gatgcaagtttcaggatgttcccca

SEQ ID NO: 120106 - DNA, 25 bp, Homo sapien
gatgttccccactgagctggaggaa

SEQ ID NO: 120107 - DNA, 25 bp, Homo sapien
gaggaatatctacagcagtgatgct

SEQ ID NO: 120108 - DNA, 25 bp, Homo sapien
gcagtgatgcttgaaatttttgtat

SEQ ID NO: 120109 - DNA, 25 bp, Homo sapien
tgaattattttgtcgtcctaccctt

SEQ ID NO: 120110 - DNA, 25 bp, Homo sapien
gcgctttcattttttgacctcatca

SEQ ID NO: 120111 - DNA, 25 bp, Homo sapien
tcattttttgacctcatcactgaga

SEQ ID NO: 120112 - DNA, 25 bp, Homo sapien
ctgagaaaggctcaatttggtgctc

SEQ ID NO: 120113 - DNA, 25 bp, Homo sapien
aatttggtgctcacgtgtccttaac

SEQ ID NO: 120114 - DNA, 25 bp, Homo sapien
tcacgtgtccttaacacctgatctg

SEQ ID NO: 120115 - DNA, 25 bp, Homo sapien
ttaacacctgatctggcccaagctg

SEQ ID NO: 120116 - DNA, 25 bp, Homo sapien
tgcgtgccctttaagccaagagagc

SEQ ID NO: 120117 - DNA, 25 bp, Homo sapien
aagagagcctcttgtggaccccgcc

SEQ ID NO: 120118 - DNA, 25 bp, Homo sapien
cgcctgcccgaatgaaatccgaaca

SEQ ID NO: 120119 - DNA, 25 bp, Homo sapien
gggctggtttttcatttccattggt

SEQ ID NO: 120120 - DNA, 25 bp, Homo sapien
taaacaggagttcagcggagtagca

SEQ ID NO: 120121 - DNA, 25 bp, Homo sapien
tgtcagacaagtttgccttcggcct

SEQ ID NO: 120122 - DNA, 25 bp, Homo sapien
acaagtttgccttcggcctctttga

SEQ ID NO: 120123 - DNA, 25 bp, Homo sapien
ttgccttcggcctctttgacctgga

SEQ ID NO: 120124 - DNA, 25 bp, Homo sapien
gactgggaggtgttcacccagcaca

SEQ ID NO: 120125 - DNA, 25 bp, Homo sapien
gtgttcacccagcacattgaaggcg

SEQ ID NO: 120126 - DNA, 25 bp, Homo sapien
cagcacattgaaggcgccatcaaca

SEQ ID NO: 120127 - DNA, 25 bp, Homo sapien
gacaggaatcaagtccacggtctgc

SEQ ID NO: 120128 - DNA, 25 bp, Homo sapien
aagtccacggtctgcggccctgaat

SEQ ID NO: 120129 - DNA, 25 bp, Homo sapien
ggtctgcggccctgaatccttcacg

SEQ ID NO: 120130 - DNA, 25 bp, Homo sapien
aggcacctgagctccgagggttctt

SEQ ID NO: 120131 - DNA, 25 bp, Homo sapien
acctgagctccgagggttcttcctg

SEQ ID NO: 120132 - DNA, 25 bp, Homo sapien
agttcccctgtttgcctctgaaacg

SEQ ID NO: 120133 - DNA, 25 bp, Homo sapien
tttgcctctgaaacgtctggttagt

SEQ ID NO: 120134 - DNA, 25 bp, Homo sapien
gggacccaaagattctagtgagtca

SEQ ID NO: 120135 - DNA, 25 bp, Homo sapien
gattctagtgagtcaacatccataa

SEQ ID NO: 120136 - DNA, 25 bp, Homo sapien
gtgagtcaacatccataactctgta

SEQ ID NO: 120137 - DNA, 25 bp, Homo sapien
ctctgtatctagttgtattattcat

SEQ ID NO: 120138 - DNA, 25 bp, Homo sapien
gaaaatcaatctggtgctaatggtt

SEQ ID NO: 120139 - DNA, 25 bp, Homo sapien
atctggtgctaatggttggccctgg

SEQ ID NO: 120140 - DNA, 25 bp, Homo sapien
ttcgccctcttgtagtgtggctgtg

SEQ ID NO: 120141 - DNA, 25 bp, Homo sapien
tggcctgtggcttgtatccttcagt

SEQ ID NO: 120142 - DNA, 25 bp, Homo sapien
tatccttcagtccaccacagcaaat

SEQ ID NO: 120143 - DNA, 25 bp, Homo sapien
gaaagatagctacacctcacaagga

SEQ ID NO: 120144 - DNA, 25 bp, Homo sapien
tctcttgagcacttccctggagcta

SEQ ID NO: 120145 - DNA, 25 bp, Homo sapien
ttccctggagctaccacgtatctag

SEQ ID NO: 120146 - DNA, 25 bp, Homo sapien
accacgtatctagctaatatgtatg

SEQ ID NO: 120147 - DNA, 25 bp, Homo sapien
tgtatgtgtcagtagtaggctccaa

SEQ ID NO: 120148 - DNA, 25 bp, Homo sapien
gtaggctccaaggattgacaaatat

SEQ ID NO: 120149 - DNA, 25 bp, Homo sapien
tgatctattcagctgcttttactgt

SEQ ID NO: 120150 - DNA, 25 bp, Homo sapien
tgtggattatgccaacagcttgaat

SEQ ID NO: 120151 - DNA, 25 bp, Homo sapien
agcttgaatggattctaacagactc

SEQ ID NO: 120152 - DNA, 25 bp, Homo sapien
ttttaaaagtctgccttgtttatgg

SEQ ID NO: 120153 - DNA, 25 bp, Homo sapien
tgcaaatactttttaacttagaggc

SEQ ID NO: 120154 - DNA, 25 bp, Homo sapien
gctttccgtaaatgcaaattgtcct

SEQ ID NO: 120155 - DNA, 25 bp, Homo sapien
gcaaattgtccttactgcaagtcag

SEQ ID NO: 120156 - DNA, 25 bp, Homo sapien
atgattgctgactcacagtagggct

SEQ ID NO: 120157 - DNA, 25 bp, Homo sapien
gctgctatgcctgtgtgtaaacttg

SEQ ID NO: 120158 - DNA, 25 bp, Homo sapien
gaacatagactcactcttccacatt

SEQ ID NO: 120159 - DNA, 25 bp, Homo sapien
ttcccaagttggtctagtgtgctgc

SEQ ID NO: 120160 - DNA, 25 bp, Homo sapien
agtgtgctgcccagtagcaaaccat

SEQ ID NO: 120161 - DNA, 25 bp, Homo sapien
aaccatggcagactcaccacctatt

SEQ ID NO: 120162 - DNA, 25 bp, Homo sapien
accacctattctgagttccagggct

SEQ ID NO: 120163 - DNA, 25 bp, Homo sapien
gatctttgcccctggtatgcattaa

SEQ ID NO: 120164 - DNA, 25 bp, Homo sapien
ttaatggactccactgaatcctgaa

SEQ ID NO: 120165 - DNA, 25 bp, Homo sapien
ctcgaaatggcgtccgcctctgctt

SEQ ID NO: 120166 - DNA, 25 bp, Homo sapien
ctgcttgtccggtttccaggccctg

SEQ ID NO: 120167 - DNA, 25 bp, Homo sapien
tgcagggcccttctggatcctcggt

SEQ ID NO: 120168 - DNA, 25 bp, Homo sapien
ctggatcctcggtgacgtcttcttg

SEQ ID NO: 120169 - DNA, 25 bp, Homo sapien
tgcgcaggcgcagttccccgggtga

SEQ ID NO: 120170 - DNA, 25 bp, Homo sapien
ttccccgggtgacgcccaagtgaag

SEQ ID NO: 120171 - DNA, 25 bp, Homo sapien
gtgacgcccaagtgaagcgcatgcg

SEQ ID NO: 120172 - DNA, 25 bp, Homo sapien
aagcgcatgcgcagcgggtggtcgc

SEQ ID NO: 120173 - DNA, 25 bp, Homo sapien
gtggtcgcggaggtcctgctaccca

SEQ ID NO: 120174 - DNA, 25 bp, Homo sapien
ggaggtcctgctacccagtaaaaat

SEQ ID NO: 120175 - DNA, 25 bp, Homo sapien
tgctacccagtaaaaatccactatt

SEQ ID NO: 120176 - DNA, 25 bp, Homo sapien
ccgaggccagtacctttccatttat

SEQ ID NO: 120177 - DNA, 25 bp, Homo sapien
ttccatttattctttgatcttcagg

SEQ ID NO: 120178 - DNA, 25 bp, Homo sapien
cagggaactgcatagattgtatcaa

SEQ ID NO: 120179 - DNA, 25 bp, Homo sapien
agtgtaaacaccatagggacccatt

SEQ ID NO: 120180 - DNA, 25 bp, Homo sapien
gggacccattctacacagagcagga

SEQ ID NO: 120181 - DNA, 25 bp, Homo sapien
cagagcaggactgcacaggcgtcct

SEQ ID NO: 120182 - DNA, 25 bp, Homo sapien
gcatttccacaccaagcagcaacag

SEQ ID NO: 120183 - DNA, 25 bp, Homo sapien
gcagcaacagcaaatcacgaccact

SEQ ID NO: 120184 - DNA, 25 bp, Homo sapien
ttctgttctatttgtgcttagtcca

SEQ ID NO: 120185 - DNA, 25 bp, Homo sapien
gcttagtccaattccttgcacatag

SEQ ID NO: 120186 - DNA, 25 bp, Homo sapien
gtaggtacccaattcaattactatt

SEQ ID NO: 120187 - DNA, 25 bp, Homo sapien
atcgacagccggaccatggagcaga

SEQ ID NO: 120188 - DNA, 25 bp, Homo sapien
gccggaccatggagcagaccctgga

SEQ ID NO: 120189 - DNA, 25 bp, Homo sapien
agccccaccgctatgtcctggatga

SEQ ID NO: 120190 - DNA, 25 bp, Homo sapien
gctatgtcctggatgacgcccagct

SEQ ID NO: 120191 - DNA, 25 bp, Homo sapien
acgcccagctgcacatatacatgct

SEQ ID NO: 120192 - DNA, 25 bp, Homo sapien
gctgcacatatacatgctcatgaag

SEQ ID NO: 120193 - DNA, 25 bp, Homo sapien
tcctacccaaggttcctgaagtctg

SEQ ID NO: 120194 - DNA, 25 bp, Homo sapien
ccaaggttcctgaagtctgacatgt

SEQ ID NO: 120195 - DNA, 25 bp, Homo sapien
aagtctgacatgtacaaggccctcc

SEQ ID NO: 120196 - DNA, 25 bp, Homo sapien
atgaagagacgcgtgttcccgttta

SEQ ID NO: 120197 - DNA, 25 bp, Homo sapien
tgttcccgtttacgtggaggccacg

SEQ ID NO: 120198 - DNA, 25 bp, Homo sapien
tggtttctcagtacttccagaccgt

SEQ ID NO: 120199 - DNA, 25 bp, Homo sapien
agtacttccagaccgtgactgacta

SEQ ID NO: 120200 - DNA, 25 bp, Homo sapien
ttccagaccgtgactgactatggca

SEQ ID NO: 120201 - DNA, 25 bp, Homo sapien
agtcaaaggagcagctgacacccct

SEQ ID NO: 120202 - DNA, 25 bp, Homo sapien
ggagcagctgacacccctgatcaag

SEQ ID NO: 120203 - DNA, 25 bp, Homo sapien
tcaagaaggctggaacggaactggt

SEQ ID NO: 120204 - DNA, 25 bp, Homo sapien
cggaactggttaacttcttgagcta

SEQ ID NO: 120205 - DNA, 25 bp, Homo sapien
aacttcttgagctatttcgtggaac

SEQ ID NO: 120206 - DNA, 25 bp, Homo sapien
atttcgtggaacttggaacacagcc

SEQ ID NO: 120207 - DNA, 25 bp, Homo sapien
gccacccagtgaagtgtccagacca

SEQ ID NO: 120208 - DNA, 25 bp, Homo sapien
aagtgtccagaccattgtcttccaa

SEQ ID NO: 120209 - DNA, 25 bp, Homo sapien
ctgtcctgggtcatgttgttgccac

SEQ ID NO: 120210 - DNA, 25 bp, Homo sapien
tcatgttgttgccaccctgtgtgac

SEQ ID NO: 120211 - DNA, 25 bp, Homo sapien
caccctgtgtgacttttgaagctgt

SEQ ID NO: 120212 - DNA, 25 bp, Homo sapien
taaaatgagcttccagggcttgggt

SEQ ID NO: 120213 - DNA, 25 bp, Homo sapien
cttttgctggtgtttctggaatttg

SEQ ID NO: 120214 - DNA, 25 bp, Homo sapien
ttgctggtgtttctggaatttgctt

SEQ ID NO: 120215 - DNA, 25 bp, Homo sapien
cacctctcacttccttctagaagga

SEQ ID NO: 120216 - DNA, 25 bp, Homo sapien
gcttcctgactggaaccagagaatg

SEQ ID NO: 120217 - DNA, 25 bp, Homo sapien
agagaatgcatgtctgtccacttgg

SEQ ID NO: 120218 - DNA, 25 bp, Homo sapien
aatgcatgtctgtccacttggtggc

SEQ ID NO: 120219 - DNA, 25 bp, Homo sapien
atgtctgtccacttggtggctgctg

SEQ ID NO: 120220 - DNA, 25 bp, Homo sapien
ttcactcctggagagttactttgaa

SEQ ID NO: 120221 - DNA, 25 bp, Homo sapien
gagttactttgaaacgaacagcgag

SEQ ID NO: 120222 - DNA, 25 bp, Homo sapien
gggcgacgtttctgtgccaacccca

SEQ ID NO: 120223 - DNA, 25 bp, Homo sapien
tgccaaccccagtgataagcaagtt

SEQ ID NO: 120224 - DNA, 25 bp, Homo sapien
aaccccagtgataagcaagttcagg

SEQ ID NO: 120225 - DNA, 25 bp, Homo sapien
caagttcaggtttgcatgagaatgc

SEQ ID NO: 120226 - DNA, 25 bp, Homo sapien
tgctgaagctggacacacggatcaa

SEQ ID NO: 120227 - DNA, 25 bp, Homo sapien
cacacggatcaagaccaggaagaat

SEQ ID NO: 120228 - DNA, 25 bp, Homo sapien
gaacttgtcaaggtgaagggacaca

SEQ ID NO: 120229 - DNA, 25 bp, Homo sapien
gaagggacacaagttgccagccacc

SEQ ID NO: 120230 - DNA, 25 bp, Homo sapien
acacaagttgccagccaccaacttt

SEQ ID NO: 120231 - DNA, 25 bp, Homo sapien
gaacaggcatgttgtattctataac

SEQ ID NO: 120232 - DNA, 25 bp, Homo sapien
gtattctataacacaatcttgagca

SEQ ID NO: 120233 - DNA, 25 bp, Homo sapien
acaatcttgagcattcttgacagac

SEQ ID NO: 120234 - DNA, 25 bp, Homo sapien
tttctcagtggcaactactttactg

SEQ ID NO: 120235 - DNA, 25 bp, Homo sapien
gtggcaactactttactggttgaaa

SEQ ID NO: 120236 - DNA, 25 bp, Homo sapien
gaccagttttcctctaaagccattt

SEQ ID NO: 120237 - DNA, 25 bp, Homo sapien
caatgttctcagaggcatgggtggt

SEQ ID NO: 120238 - DNA, 25 bp, Homo sapien
catgggtggtgcttttgtgcttgtc

SEQ ID NO: 120239 - DNA, 25 bp, Homo sapien
tgcttttgtgcttgtcttgtatgat

SEQ ID NO: 120240 - DNA, 25 bp, Homo sapien
tgtgcttgtcttgtatgatgaaatc

SEQ ID NO: 120241 - DNA, 25 bp, Homo sapien
gtacacataagttatttcctaggat

SEQ ID NO: 120242 - DNA, 25 bp, Homo sapien
ccaagaaggacaccagtttctttgc

SEQ ID NO: 120243 - DNA, 25 bp, Homo sapien
gtttctttgctccatagaggcctga

SEQ ID NO: 120244 - DNA, 25 bp, Homo sapien
catagaggcctgagctgactggagc

SEQ ID NO: 120245 - DNA, 25 bp, Homo sapien
tgactggagcagagtcatttgcttc

SEQ ID NO: 120246 - DNA, 25 bp, Homo sapien
tccttgtgggccttctaagatgaag

SEQ ID NO: 120247 - DNA, 25 bp, Homo sapien
ttctaagatgaagccaccctcaggt

SEQ ID NO: 120248 - DNA, 25 bp, Homo sapien
tgaagccaccctcaggtccagggaa

SEQ ID NO: 120249 - DNA, 25 bp, Homo sapien
tgtgctggtatttggctcatgacag

SEQ ID NO: 120250 - DNA, 25 bp, Homo sapien
tcatgacagccaagagcagatttgt

SEQ ID NO: 120251 - DNA, 25 bp, Homo sapien
gcagatttgtgaaatcggctcaact

SEQ ID NO: 120252 - DNA, 25 bp, Homo sapien
agcaaaaatcttggctgggtggaaa

SEQ ID NO: 120253 - DNA, 25 bp, Homo sapien
gaagcctcattcctcagctgagtgc

SEQ ID NO: 120254 - DNA, 25 bp, Homo sapien
tcagctgagtgcaacttctgcagga

SEQ ID NO: 120255 - DNA, 25 bp, Homo sapien
ctgagtgcaacttctgcaggaggcc

SEQ ID NO: 120256 - DNA, 25 bp, Homo sapien
gtcctatttctcaggcttgagcaag

SEQ ID NO: 120257 - DNA, 25 bp, Homo sapien
aagttggtatctgctcaggcctgag

SEQ ID NO: 120258 - DNA, 25 bp, Homo sapien
tcaggcctgagcatgacctcaatta

SEQ ID NO: 120259 - DNA, 25 bp, Homo sapien
gcatgacctcaattatttcacttaa

SEQ ID NO: 120260 - DNA, 25 bp, Homo sapien
ttcacttaaccccaggccattatca

SEQ ID NO: 120261 - DNA, 25 bp, Homo sapien
cccaggccattatcatatccagatg

SEQ ID NO: 120262 - DNA, 25 bp, Homo sapien
tccagatggtcttcagagttgtctt

SEQ ID NO: 120263 - DNA, 25 bp, Homo sapien
gatggtcttcagagttgtctttata

SEQ ID NO: 120264 - DNA, 25 bp, Homo sapien
agaacagtgtcaccatctgagccct

SEQ ID NO: 120265 - DNA, 25 bp, Homo sapien
catctgagccctagagtgactctac

SEQ ID NO: 120266 - DNA, 25 bp, Homo sapien
gagtgactctacctgcaagatttca

SEQ ID NO: 120267 - DNA, 25 bp, Homo sapien
aagatttcacatcagctttaggact

SEQ ID NO: 120268 - DNA, 25 bp, Homo sapien
aggactgacatttctatcttgaatt

SEQ ID NO: 120269 - DNA, 25 bp, Homo sapien
tcatgctttcctaaagtctctgctg

SEQ ID NO: 120270 - DNA, 25 bp, Homo sapien
aagtctctgctgctaaggctctatt

SEQ ID NO: 120271 - DNA, 25 bp, Homo sapien
acattagtatcccactagcccaggg

SEQ ID NO: 120272 - DNA, 25 bp, Homo sapien
gactagatccttttttacgctttgc

SEQ ID NO: 120273 - DNA, 25 bp, Homo sapien
ttacgctttgcagaccgcatagtca

SEQ ID NO: 120274 - DNA, 25 bp, Homo sapien
atagtcactgtctcaactactcagc

SEQ ID NO: 120275 - DNA, 25 bp, Homo sapien
tctttggacactggattatgaggaa

SEQ ID NO: 120276 - DNA, 25 bp, Homo sapien
gacactggattatgaggaatggata

SEQ ID NO: 120277 - DNA, 25 bp, Homo sapien
tggataaatggatgagctagggctc

SEQ ID NO: 120278 - DNA, 25 bp, Homo sapien
agcaccctccaggacaggagatctg

SEQ ID NO: 120279 - DNA, 25 bp, Homo sapien
gagatctgggatgcctggctgctgg

SEQ ID NO: 120280 - DNA, 25 bp, Homo sapien
ggctgctggagtacatgtgttcaca

SEQ ID NO: 120281 - DNA, 25 bp, Homo sapien
gctgctggagtacatgtgttcacaa

SEQ ID NO: 120282 - DNA, 25 bp, Homo sapien
tcatgtccccaactcaaggctagaa

SEQ ID NO: 120283 - DNA, 25 bp, Homo sapien
atgtccccaactcaaggctagaaaa

SEQ ID NO: 120284 - DNA, 25 bp, Homo sapien
tccccaactcaaggctagaaaacag

SEQ ID NO: 120285 - DNA, 25 bp, Homo sapien
ataatgttctgctgcgtccccaccg

SEQ ID NO: 120286 - DNA, 25 bp, Homo sapien
gtggatcagcaaacaggaatacgat

SEQ ID NO: 120287 - DNA, 25 bp, Homo sapien
gaatacgatgaagccgggccttcca

SEQ ID NO: 120288 - DNA, 25 bp, Homo sapien
atgaagccgggccttccattgtcca

SEQ ID NO: 120289 - DNA, 25 bp, Homo sapien
atgcttctaaaacactttcctgctc

SEQ ID NO: 120290 - DNA, 25 bp, Homo sapien
ttctaaaacactttcctgctcctct

SEQ ID NO: 120291 - DNA, 25 bp, Homo sapien
tctgtctctagcacacaactgtgaa

SEQ ID NO: 120292 - DNA, 25 bp, Homo sapien
gtctctagcacacaactgtgaatgt

SEQ ID NO: 120293 - DNA, 25 bp, Homo sapien
gaatgtcctgtggaattatgccttc

SEQ ID NO: 120294 - DNA, 25 bp, Homo sapien
gaattatgccttcagttcttttcca

SEQ ID NO: 120295 - DNA, 25 bp, Homo sapien
tagccaaagctctgactcgttacct

SEQ ID NO: 120296 - DNA, 25 bp, Homo sapien
gccaaagctctgactcgttacctat

SEQ ID NO: 120297 - DNA, 25 bp, Homo sapien
tccattttctccacaaaggccctgg

SEQ ID NO: 120298 - DNA, 25 bp, Homo sapien
acaaaggccctggtggtttccacat

SEQ ID NO: 120299 - DNA, 25 bp, Homo sapien
tggtggtttccacattgctacccaa

SEQ ID NO: 120300 - DNA, 25 bp, Homo sapien
ggtttccacattgctacccaatgga

SEQ ID NO: 120301 - DNA, 25 bp, Homo sapien
attgctacccaatggacacactcca

SEQ ID NO: 120302 - DNA, 25 bp, Homo sapien
tacccaatggacacactccaaaatg

SEQ ID NO: 120303 - DNA, 25 bp, Homo sapien
gcagggaatcctggagcacttgttc

SEQ ID NO: 120304 - DNA, 25 bp, Homo sapien
gaatcctggagcacttgttccggga

SEQ ID NO: 120305 - DNA, 25 bp, Homo sapien
cctggagcacttgttccgggatggt

SEQ ID NO: 120306 - DNA, 25 bp, Homo sapien
gggcctgggtcagatttttattgtg

SEQ ID NO: 120307 - DNA, 25 bp, Homo sapien
ggcaaaggccctcaaataagcccct

SEQ ID NO: 120308 - DNA, 25 bp, Homo sapien
ggaaggaccacagctttggaactga

SEQ ID NO: 120309 - DNA, 25 bp, Homo sapien
tttggaactgaactgattttcttga

SEQ ID NO: 120310 - DNA, 25 bp, Homo sapien
ccccttaaggaacctagagccagag

SEQ ID NO: 120311 - DNA, 25 bp, Homo sapien
gaaaaccaaaccaaatgcagctggc

SEQ ID NO: 120312 - DNA, 25 bp, Homo sapien
tgcagctggcattgaagtccccagt

SEQ ID NO: 120313 - DNA, 25 bp, Homo sapien
ctggcattgaagtccccagtgggta

SEQ ID NO: 120314 - DNA, 25 bp, Homo sapien
ggcatctgagatgtatacccacact

SEQ ID NO: 120315 - DNA, 25 bp, Homo sapien
tgtatacccacactctggacttcat

SEQ ID NO: 120316 - DNA, 25 bp, Homo sapien
tggacttcatcccactctagtggat

SEQ ID NO: 120317 - DNA, 25 bp, Homo sapien
atcccactctagtggatggtggaca

SEQ ID NO: 120318 - DNA, 25 bp, Homo sapien
gatggtggacaataccgcaaggcca

SEQ ID NO: 120319 - DNA, 25 bp, Homo sapien
cacacagtggtaacagactgccagt

SEQ ID NO: 120320 - DNA, 25 bp, Homo sapien
agactgccagtgttcatcctgaaat

SEQ ID NO: 120321 - DNA, 25 bp, Homo sapien
gtgttcatcctgaaatgtctcacgg

SEQ ID NO: 120322 - DNA, 25 bp, Homo sapien
atgtctcacggattgatctacctgt

SEQ ID NO: 120323 - DNA, 25 bp, Homo sapien
gatctacctgtctatgtatgtctgc

SEQ ID NO: 120324 - DNA, 25 bp, Homo sapien
gtatgtctgctgagctttctccttg

SEQ ID NO: 120325 - DNA, 25 bp, Homo sapien
gaaccaattctatgcgccaaataca

SEQ ID NO: 120326 - DNA, 25 bp, Homo sapien
gggatgtgtcccagtacacttacaa

SEQ ID NO: 120327 - DNA, 25 bp, Homo sapien
tatgatttgggtgcgtttttgtgtt

SEQ ID NO: 120328 - DNA, 25 bp, Homo sapien
gcgtttttgtgtttatactgggcca

SEQ ID NO: 120329 - DNA, 25 bp, Homo sapien
tttatactgggccaggtcctggtag

SEQ ID NO: 120330 - DNA, 25 bp, Homo sapien
ttcatccagctctgggcatttgatg

SEQ ID NO: 120331 - DNA, 25 bp, Homo sapien
agctctgggcatttgatgctgtcaa

SEQ ID NO: 120332 - DNA, 25 bp, Homo sapien
tctgggcatttgatgctgtcaaggg

SEQ ID NO: 120333 - DNA, 25 bp, Homo sapien
caagttctactcagagaaggagtgc

SEQ ID NO: 120334 - DNA, 25 bp, Homo sapien
agtgcagagagtactgcggtgtccc

SEQ ID NO: 120335 - DNA, 25 bp, Homo sapien
agagtactgcggtgtccctggtgat

SEQ ID NO: 120336 - DNA, 25 bp, Homo sapien
cttctccaactgacaactggccggt

SEQ ID NO: 120337 - DNA, 25 bp, Homo sapien
acaactggccggtctgcaagtcaga

SEQ ID NO: 120338 - DNA, 25 bp, Homo sapien
tcagaggatggccagtgtctgtccc

SEQ ID NO: 120339 - DNA, 25 bp, Homo sapien
tcctgtggcaggcagcgccaagcaa

SEQ ID NO: 120340 - DNA, 25 bp, Homo sapien
ctgccgaactgtggcggcctgcaat

SEQ ID NO: 120341 - DNA, 25 bp, Homo sapien
tccactacacagtatttgccttctc

SEQ ID NO: 120342 - DNA, 25 bp, Homo sapien
tctccccagagaatgtcagcaaaag

SEQ ID NO: 120343 - DNA, 25 bp, Homo sapien
tcagcaaaagggaaagactcgtgtt

SEQ ID NO: 120344 - DNA, 25 bp, Homo sapien
aaagggaaagactcgtgtttgagct

SEQ ID NO: 120345 - DNA, 25 bp, Homo sapien
tactgttttctgaatggtgaggtac

SEQ ID NO: 120346 - DNA, 25 bp, Homo sapien
gaggtacaagcggagatcaagcgaa

SEQ ID NO: 120347 - DNA, 25 bp, Homo sapien
aaatggcgaagctggaaggtgaacc

SEQ ID NO: 120348 - DNA, 25 bp, Homo sapien
aaggtgaaccgttacttcgctgtgg

SEQ ID NO: 120349 - DNA, 25 bp, Homo sapien
gaaccgttacttcgctgtggacttc

SEQ ID NO: 120350 - DNA, 25 bp, Homo sapien
atcctgagcaagagcagctcccaaa

SEQ ID NO: 120351 - DNA, 25 bp, Homo sapien
aagagcagctcccaaatccgcatgt

SEQ ID NO: 120352 - DNA, 25 bp, Homo sapien
acagctctgggcttcctcggagacc

SEQ ID NO: 120353 - DNA, 25 bp, Homo sapien
tctgggcttcctcggagacccctgg

SEQ ID NO: 120354 - DNA, 25 bp, Homo sapien
tctggccacccaaacaggacaagag

SEQ ID NO: 120355 - DNA, 25 bp, Homo sapien
ggccacccaaacaggacaagagcag

SEQ ID NO: 120356 - DNA, 25 bp, Homo sapien
gggcaagtggagccacctctttcct

SEQ ID NO: 120357 - DNA, 25 bp, Homo sapien
gcggatgaagcccagccacatttca

SEQ ID NO: 120358 - DNA, 25 bp, Homo sapien
agcccagccacatttcagccgaggt

SEQ ID NO: 120359 - DNA, 25 bp, Homo sapien
gaggtccaaggcaggaggccattta

SEQ ID NO: 120360 - DNA, 25 bp, Homo sapien
gcaggaggccatttacttgagacag

SEQ ID NO: 120361 - DNA, 25 bp, Homo sapien
atcttctctgggtccctctaacatc

SEQ ID NO: 120362 - DNA, 25 bp, Homo sapien
tgggtccctctaacatctcccatgg

SEQ ID NO: 120363 - DNA, 25 bp, Homo sapien
cacacagtggtaacagactgccagt

SEQ ID NO: 120364 - DNA, 25 bp, Homo sapien
gtggtaacagactgccagtgttcat

SEQ ID NO: 120365 - DNA, 25 bp, Homo sapien
acagactgccagtgttcatcctgaa

SEQ ID NO: 120366 - DNA, 25 bp, Homo sapien
gtgttcatcctgaaatgtctcacgg

SEQ ID NO: 120367 - DNA, 25 bp, Homo sapien
tcctgaaatgtctcacggattgatc

SEQ ID NO: 120368 - DNA, 25 bp, Homo sapien
aatgtctcacggattgatctacctg

SEQ ID NO: 120369 - DNA, 25 bp, Homo sapien
tgtctcacggattgatctacctgtc

SEQ ID NO: 120370 - DNA, 25 bp, Homo sapien
atgtatgtctgctgagctttctcct

SEQ ID NO: 120371 - DNA, 25 bp, Homo sapien
gtatgtctgctgagctttctccttg

SEQ ID NO: 120372 - DNA, 25 bp, Homo sapien
gggatgtgtcccagtacacttacaa

SEQ ID NO: 120373 - DNA, 25 bp, Homo sapien
ggatgtgtcccagtacacttacaaa

SEQ ID NO: 120374 - DNA, 25 bp, Homo sapien
aagagccctgtggtcgtctgtcttt

SEQ ID NO: 120375 - DNA, 25 bp, Homo sapien
gtggtcgtctgtcttttctgaaaga

SEQ ID NO: 120376 - DNA, 25 bp, Homo sapien
gtctgtcttttctgaaagaaccaaa

SEQ ID NO: 120377 - DNA, 25 bp, Homo sapien
aaggactgcctcaaacagcggtttg

SEQ ID NO: 120378 - DNA, 25 bp, Homo sapien
cagcggtttgcaacttaaatatcac

SEQ ID NO: 120379 - DNA, 25 bp, Homo sapien
aaatatcactctgccagcacataaa

SEQ ID NO: 120380 - DNA, 25 bp, Homo sapien
gacgacagagcttcgcatccttagc

SEQ ID NO: 120381 - DNA, 25 bp, Homo sapien
gcttcgcatccttagctttacgtaa

SEQ ID NO: 120382 - DNA, 25 bp, Homo sapien
gcatccttagctttacgtaagcgct

SEQ ID NO: 120383 - DNA, 25 bp, Homo sapien
tttacgtaagcgctacagctacttg

SEQ ID NO: 120384 - DNA, 25 bp, Homo sapien
agcgctacagctacttgactgagcc

SEQ ID NO: 120385 - DNA, 25 bp, Homo sapien
aagaggatctgttgcaggaggctca

SEQ ID NO: 120386 - DNA, 25 bp, Homo sapien
aggctcaggccttggcagaggtact

SEQ ID NO: 120387 - DNA, 25 bp, Homo sapien
aggtactagacctgcaggaccgcga

SEQ ID NO: 120388 - DNA, 25 bp, Homo sapien
cacgtcgctgcgtaaggctgcatga

SEQ ID NO: 120389 - DNA, 25 bp, Homo sapien
aaggctgcatgagtcctgcctggga

SEQ ID NO: 120390 - DNA, 25 bp, Homo sapien
agcaggtgccttgctgtgacccatg

SEQ ID NO: 120391 - DNA, 25 bp, Homo sapien
tgtgacccatgtgccacgtgctact

SEQ ID NO: 120392 - DNA, 25 bp, Homo sapien
ttcttcaatgccttctgctactgcc

SEQ ID NO: 120393 - DNA, 25 bp, Homo sapien
tactgccgcaagctgggtactgcca

SEQ ID NO: 120394 - DNA, 25 bp, Homo sapien
tgggtactgccatgaatccctgcag

SEQ ID NO: 120395 - DNA, 25 bp, Homo sapien
acctagctggccaacgtcagggtcg

SEQ ID NO: 120396 - DNA, 25 bp, Homo sapien
aaaatggtgttttatcttctatata

SEQ ID NO: 120397 - DNA, 25 bp, Homo sapien
atcttctatataattcctgttttta

SEQ ID NO: 120398 - DNA, 25 bp, Homo sapien
aacagtcctaaatagcagccctcaa

SEQ ID NO: 120399 - DNA, 25 bp, Homo sapien
atagcagccctcaattgtgaaaaaa

SEQ ID NO: 120400 - DNA, 25 bp, Homo sapien
gtgaatgcaggttttatcagaacta

SEQ ID NO: 120401 - DNA, 25 bp, Homo sapien
atcagaactatgtttttgttcagtt

SEQ ID NO: 120402 - DNA, 25 bp, Homo sapien
gttcagtttatctgttcatatggat

SEQ ID NO: 120403 - DNA, 25 bp, Homo sapien
tattggttgggatgacttggtgtct

SEQ ID NO: 120404 - DNA, 25 bp, Homo sapien
cttggtgtctaatgtgtagtgctac

SEQ ID NO: 120405 - DNA, 25 bp, Homo sapien
gtagtgctacacacctaacttatgg

SEQ ID NO: 120406 - DNA, 25 bp, Homo sapien
atagcatgtcctaatgcttgctgct

SEQ ID NO: 120407 - DNA, 25 bp, Homo sapien
gccagatcaaagtatgtatgttgtt

SEQ ID NO: 120408 - DNA, 25 bp, Homo sapien
atatgcatagaacgagagatttgga

SEQ ID NO: 120409 - DNA, 25 bp, Homo sapien
caccaaactgttaaatgtggtttct

SEQ ID NO: 120410 - DNA, 25 bp, Homo sapien
tagaggggccttttcactttcgact

SEQ ID NO: 120411 - DNA, 25 bp, Homo sapien
tcactttcgacttttttcattttgt

SEQ ID NO: 120412 - DNA, 25 bp, Homo sapien
ttcattttgttctgttcggattttt

SEQ ID NO: 120413 - DNA, 25 bp, Homo sapien
ttctgttcggattttttataagtat

SEQ ID NO: 120414 - DNA, 25 bp, Homo sapien
tataagtatgtagaccccgaagggt

SEQ ID NO: 120415 - DNA, 25 bp, Homo sapien
gactatcctgtgctcttcctaggga

SEQ ID NO: 120416 - DNA, 25 bp, Homo sapien
tcttcctagggagctgtgttgtttc

SEQ ID NO: 120417 - DNA, 25 bp, Homo sapien
agggagctgtgttgtttcccaccca

SEQ ID NO: 120418 - DNA, 25 bp, Homo sapien
tccccaaggactttcttttgccaag

SEQ ID NO: 120419 - DNA, 25 bp, Homo sapien
aggactttcttttgccaagcgccta

SEQ ID NO: 120420 - DNA, 25 bp, Homo sapien
aagcgcctacagcagctcatagagg

SEQ ID NO: 120421 - DNA, 25 bp, Homo sapien
acagcagctcatagaggtcttgaag

SEQ ID NO: 120422 - DNA, 25 bp, Homo sapien
tattccgacggaaagaaccattatg

SEQ ID NO: 120423 - DNA, 25 bp, Homo sapien
gaaccattatgacatggagaccaca

SEQ ID NO: 120424 - DNA, 25 bp, Homo sapien
gagaccacagagctcccagaactga

SEQ ID NO: 120425 - DNA, 25 bp, Homo sapien
tcgacctcctgatctgacctggttc

SEQ ID NO: 120426 - DNA, 25 bp, Homo sapien
tgatctgacctggttctcaacagac

SEQ ID NO: 120427 - DNA, 25 bp, Homo sapien
tggttctcaacagacccagtgagcc

SEQ ID NO: 120428 - DNA, 25 bp, Homo sapien
tgagcccttcactcctgagaaaaag

SEQ ID NO: 120429 - DNA, 25 bp, Homo sapien
tttagtgtgccttccaaacctgaga

SEQ ID NO: 120430 - DNA, 25 bp, Homo sapien
gtgtgccttccaaacctgagaatat

SEQ ID NO: 120431 - DNA, 25 bp, Homo sapien
gtgccttccaaacctgagaatatat

SEQ ID NO: 120432 - DNA, 25 bp, Homo sapien
tccaaacctgagaatatatgctttt

SEQ ID NO: 120433 - DNA, 25 bp, Homo sapien
tggcttttgccacatacatagatct

SEQ ID NO: 120434 - DNA, 25 bp, Homo sapien
ttgccacatacatagatcttcatga

SEQ ID NO: 120435 - DNA, 25 bp, Homo sapien
atagatcttcatgatgtgtgagtgt

SEQ ID NO: 120436 - DNA, 25 bp, Homo sapien
gtgtgagtgtaattccatgtggata

SEQ ID NO: 120437 - DNA, 25 bp, Homo sapien
gatctttttatattcttctaccaca

SEQ ID NO: 120438 - DNA, 25 bp, Homo sapien
ttttatattcttctaccacacctgg

SEQ ID NO: 120439 - DNA, 25 bp, Homo sapien
tcttctaccacacctggaaacagac

SEQ ID NO: 120440 - DNA, 25 bp, Homo sapien
tggtgctctggaccctcagccgaga

SEQ ID NO: 120441 - DNA, 25 bp, Homo sapien
gagagcctgacgacaggcggcccct

SEQ ID NO: 120442 - DNA, 25 bp, Homo sapien
tcccggacattcacttcgtggagga

SEQ ID NO: 120443 - DNA, 25 bp, Homo sapien
ggaggagcatagaggcgttccgcca

SEQ ID NO: 120444 - DNA, 25 bp, Homo sapien
agcgcctgaaccagatctcacacga

SEQ ID NO: 120445 - DNA, 25 bp, Homo sapien
tgaaccagatctcacacgacatccg

SEQ ID NO: 120446 - DNA, 25 bp, Homo sapien
tactactacctggacccggtgctga

SEQ ID NO: 120447 - DNA, 25 bp, Homo sapien
ctggacccggtgctgattgagaaca

SEQ ID NO: 120448 - DNA, 25 bp, Homo sapien
acagcatttctatttaggagcgcgc

SEQ ID NO: 120449 - DNA, 25 bp, Homo sapien
ttctatttaggagcgcgcttcccgt

SEQ ID NO: 120450 - DNA, 25 bp, Homo sapien
attctgtgccctactattttcaaca

SEQ ID NO: 120451 - DNA, 25 bp, Homo sapien
gcagtggtggcgtcgaagggcgcac

SEQ ID NO: 120452 - DNA, 25 bp, Homo sapien
gaagggcgcacgtgacccgggagaa

SEQ ID NO: 120453 - DNA, 25 bp, Homo sapien
ctggctgtggtcattggcgtttttg

SEQ ID NO: 120454 - DNA, 25 bp, Homo sapien
ggtcattggcgtttttgtgctctgc

SEQ ID NO: 120455 - DNA, 25 bp, Homo sapien
tggcgtttttgtgctctgctggttc

SEQ ID NO: 120456 - DNA, 25 bp, Homo sapien
catctgcccgaagcactgcaaggtg

SEQ ID NO: 120457 - DNA, 25 bp, Homo sapien
gaagcactgcaaggtgccccatggc

SEQ ID NO: 120458 - DNA, 25 bp, Homo sapien
tactgcaacagctcactgaaccctg

SEQ ID NO: 120459 - DNA, 25 bp, Homo sapien
aacagctcactgaaccctgttatct

SEQ ID NO: 120460 - DNA, 25 bp, Homo sapien
ggacttccgccgtgccttccggagg

SEQ ID NO: 120461 - DNA, 25 bp, Homo sapien
gtgccttccggaggatcctgtgccg

SEQ ID NO: 120462 - DNA, 25 bp, Homo sapien
gggaattagtgacccactgaccgta

SEQ ID NO: 120463 - DNA, 25 bp, Homo sapien
gtgacccactgaccgtatttgaaca

SEQ ID NO: 120464 - DNA, 25 bp, Homo sapien
gtatttgaacaaactgaggcagctg

SEQ ID NO: 120465 - DNA, 25 bp, Homo sapien
ggcagctgctagagaagaaatcctt

SEQ ID NO: 120466 - DNA, 25 bp, Homo sapien
aaatccttgctaatggagggagcct

SEQ ID NO: 120467 - DNA, 25 bp, Homo sapien
agggagcctgtcacatcaccatgga

SEQ ID NO: 120468 - DNA, 25 bp, Homo sapien
gggcaagttacggaagcaatggcta

SEQ ID NO: 120469 - DNA, 25 bp, Homo sapien
aggaaagtatctctgatgtcggctt

SEQ ID NO: 120470 - DNA, 25 bp, Homo sapien
ctgatgtcggctttgggatgctgaa

SEQ ID NO: 120471 - DNA, 25 bp, Homo sapien
ggatgctgaagtctgtcaaggaata

SEQ ID NO: 120472 - DNA, 25 bp, Homo sapien
ggaatatgtggaccccaataacatc

SEQ ID NO: 120473 - DNA, 25 bp, Homo sapien
tactgccttgaaacccctaggactc

SEQ ID NO: 120474 - DNA, 25 bp, Homo sapien
gaaacccctaggactcagctaagta

SEQ ID NO: 120475 - DNA, 25 bp, Homo sapien
agctaagtatttgcctaaccctgac

SEQ ID NO: 120476 - DNA, 25 bp, Homo sapien
taagtatttgcctaaccctgaccag

SEQ ID NO: 120477 - DNA, 25 bp, Homo sapien
accctgaccagggaatgccttggtt

SEQ ID NO: 120478 - DNA, 25 bp, Homo sapien
gaatgccttggttctgtcaattgct

SEQ ID NO: 120479 - DNA, 25 bp, Homo sapien
gtcaattgctgacatctgagaacac

SEQ ID NO: 120480 - DNA, 25 bp, Homo sapien
gtatcaaagcaatggcttttctttt

SEQ ID NO: 120481 - DNA, 25 bp, Homo sapien
tatgtcttctataaaccaggctgtt

SEQ ID NO: 120482 - DNA, 25 bp, Homo sapien
accaggctgttaatacaatgatgac

SEQ ID NO: 120483 - DNA, 25 bp, Homo sapien
aaacaaaactggcaagatcactaaa

SEQ ID NO: 120484 - DNA, 25 bp, Homo sapien
ataaatggtaaggagcagctgctgc

SEQ ID NO: 120485 - DNA, 25 bp, Homo sapien
gcagctgctgcgcttggataacaag

SEQ ID NO: 120486 - DNA, 25 bp, Homo sapien
ggataacaagtaattcaacgcacgc

SEQ ID NO: 120487 - DNA, 25 bp, Homo sapien
gtaattcaacgcacgcacttaacag

SEQ ID NO: 120488 - DNA, 25 bp, Homo sapien
caacgcacgcacttaacagaaatgt

SEQ ID NO: 120489 - DNA, 25 bp, Homo sapien
aactataacaagcaccatttgagga

SEQ ID NO: 120490 - DNA, 25 bp, Homo sapien
caccatttgaggattaacaggaaca

SEQ ID NO: 120491 - DNA, 25 bp, Homo sapien
tgaagatttcaaacgaactcgactt

SEQ ID NO: 120492 - DNA, 25 bp, Homo sapien
aaacgaactcgactttcagtataat

SEQ ID NO: 120493 - DNA, 25 bp, Homo sapien
agtatttataaacagctcatcggag

SEQ ID NO: 120494 - DNA, 25 bp, Homo sapien
gctcatcggagcctctatttgtcat

SEQ ID NO: 120495 - DNA, 25 bp, Homo sapien
agctgcacctcaggcatcctggagg

SEQ ID NO: 120496 - DNA, 25 bp, Homo sapien
ctcaggcatcctggaggagcgcagc

SEQ ID NO: 120497 - DNA, 25 bp, Homo sapien
cagggcccgggctgctgtctcaaga

SEQ ID NO: 120498 - DNA, 25 bp, Homo sapien
ggcccgggctgctgtctcaagacag

SEQ ID NO: 120499 - DNA, 25 bp, Homo sapien
tctcaagacagccaccagacaagga

SEQ ID NO: 120500 - DNA, 25 bp, Homo sapien
cagccaccagacaaggagttctcct

SEQ ID NO: 120501 - DNA, 25 bp, Homo sapien
aggagttctccttcatggatgagga

SEQ ID NO: 120502 - DNA, 25 bp, Homo sapien
ctcccctggcaaggcaggaaggcaa

SEQ ID NO: 120503 - DNA, 25 bp, Homo sapien
gaaggcaaggctggcccagacttgc

SEQ ID NO: 120504 - DNA, 25 bp, Homo sapien
ccctcccatgctctggaggatgagg

SEQ ID NO: 120505 - DNA, 25 bp, Homo sapien
gcagccacaccacacgggacagcag

SEQ ID NO: 120506 - DNA, 25 bp, Homo sapien
gaacaggcatgttgtattctataac

SEQ ID NO: 120507 - DNA, 25 bp, Homo sapien
gtattctataacacaatcttgagca

SEQ ID NO: 120508 - DNA, 25 bp, Homo sapien
acaatcttgagcattcttgacagac

SEQ ID NO: 120509 - DNA, 25 bp, Homo sapien
tttctcagtggcaactactttactg

SEQ ID NO: 120510 - DNA, 25 bp, Homo sapien
gtggcaactactttactggttgaaa

SEQ ID NO: 120511 - DNA, 25 bp, Homo sapien
catgggtggtgcttttgtgcttgtc

SEQ ID NO: 120512 - DNA, 25 bp, Homo sapien
tgcttttgtgcttgtcttgtatgat

SEQ ID NO: 120513 - DNA, 25 bp, Homo sapien
tgtgcttgtcttgtatgatgaaatc

SEQ ID NO: 120514 - DNA, 25 bp, Homo sapien
gaagtacacataagttatttcctag

SEQ ID NO: 120515 - DNA, 25 bp, Homo sapien
cacataagttatttcctaggatttt

SEQ ID NO: 120516 - DNA, 25 bp, Homo sapien
cccctgtgaacaggcatgttgtatt

SEQ ID NO: 120517 - DNA, 25 bp, Homo sapien
agacgccacaggtcatcatctggat

SEQ ID NO: 120518 - DNA, 25 bp, Homo sapien
acgccacaggtcatcatctggatca

SEQ ID NO: 120519 - DNA, 25 bp, Homo sapien
atcccattctggttcccgttcaagt

SEQ ID NO: 120520 - DNA, 25 bp, Homo sapien
cattctggttcccgttcaagttcaa

SEQ ID NO: 120521 - DNA, 25 bp, Homo sapien
gctcttcttccccacgaaaaagatc

SEQ ID NO: 120522 - DNA, 25 bp, Homo sapien
tcttccccacgaaaaagatcttatt

SEQ ID NO: 120523 - DNA, 25 bp, Homo sapien
gatcttattcaagttcatcatcttc

SEQ ID NO: 120524 - DNA, 25 bp, Homo sapien
catcatcttctcctgagaggaacag

SEQ ID NO: 120525 - DNA, 25 bp, Homo sapien
gaagtcgttctagatcttcttcatc

SEQ ID NO: 120526 - DNA, 25 bp, Homo sapien
cgttctagatcttcttcatctggtg

SEQ ID NO: 120527 - DNA, 25 bp, Homo sapien
acgaacaagatcacggtcacccgaa

SEQ ID NO: 120528 - DNA, 25 bp, Homo sapien
cccagttcatcagcagggtgagagg

SEQ ID NO: 120529 - DNA, 25 bp, Homo sapien
gagaggacgaggcaccttttgctcc

SEQ ID NO: 120530 - DNA, 25 bp, Homo sapien
gatactcccgatgattccatacgga

SEQ ID NO: 120531 - DNA, 25 bp, Homo sapien
aataagctcattttaattgccagaa

SEQ ID NO: 120532 - DNA, 25 bp, Homo sapien
ggtgacaaatccattcgtttccgtc

SEQ ID NO: 120533 - DNA, 25 bp, Homo sapien
tggtgttcagggatcaccacgctca

SEQ ID NO: 120534 - DNA, 25 bp, Homo sapien
gctcacctgttcctcaatattttca

SEQ ID NO: 120535 - DNA, 25 bp, Homo sapien
ttcagtgacatcttagcagacttca

SEQ ID NO: 120536 - DNA, 25 bp, Homo sapien
aagaagccatttccactacagtgag

SEQ ID NO: 120537 - DNA, 25 bp, Homo sapien
ctacagtgagaaagcccggatccca

SEQ ID NO: 120538 - DNA, 25 bp, Homo sapien
gcccggatcccaacagttgtcaaat

SEQ ID NO: 120539 - DNA, 25 bp, Homo sapien
gttccttttgtttcaggcacggata

SEQ ID NO: 120540 - DNA, 25 bp, Homo sapien
gtttcaggcacggataacagcaaat

SEQ ID NO: 120541 - DNA, 25 bp, Homo sapien
aagtgtagcgcagatgtgtgtgctt

SEQ ID NO: 120542 - DNA, 25 bp, Homo sapien
atgtgtgtgcttgggcgtgtttctc

SEQ ID NO: 120543 - DNA, 25 bp, Homo sapien
gtgtttctcgtgtcgcgtttgcgtg

SEQ ID NO: 120544 - DNA, 25 bp, Homo sapien
gtcgcgtttgcgtgtcggctcttgc

SEQ ID NO: 120545 - DNA, 25 bp, Homo sapien
gctcttgcggtggagtcctgttgct

SEQ ID NO: 120546 - DNA, 25 bp, Homo sapien
gtcaccgccaggctcacaggctgtg

SEQ ID NO: 120547 - DNA, 25 bp, Homo sapien
tccttcctcaggaagcgcgttgaac

SEQ ID NO: 120548 - DNA, 25 bp, Homo sapien
ggaagcgcgttgaacccacagcact

SEQ ID NO: 120549 - DNA, 25 bp, Homo sapien
acagcactccgtggtgtgtttgcag

SEQ ID NO: 120550 - DNA, 25 bp, Homo sapien
agcctcaccataccctgttgaggtg

SEQ ID NO: 120551 - DNA, 25 bp, Homo sapien
tgttgaggtgtgaaatgccccgtca

SEQ ID NO: 120552 - DNA, 25 bp, Homo sapien
gaaatgccccgtcagaaattaaata

SEQ ID NO: 120553 - DNA, 25 bp, Homo sapien
acttaaatgtgcctattggtgtcta

SEQ ID NO: 120554 - DNA, 25 bp, Homo sapien
gtgcctattggtgtctaaacttcat

SEQ ID NO: 120555 - DNA, 25 bp, Homo sapien
aaacttcatacaatgtaaggtcaga

SEQ ID NO: 120556 - DNA, 25 bp, Homo sapien
gtaaggtcagattccttttaggaat

SEQ ID NO: 120557 - DNA, 25 bp, Homo sapien
ttttaggaatactgggtgctgtcac

SEQ ID NO: 120558 - DNA, 25 bp, Homo sapien
ggtgctgtcaccaggtttgatagtt

SEQ ID NO: 120559 - DNA, 25 bp, Homo sapien
caccaggtttgatagttagacttaa

SEQ ID NO: 120560 - DNA, 25 bp, Homo sapien
tagagagttgagacttgccagttgg

SEQ ID NO: 120561 - DNA, 25 bp, Homo sapien
gttcaacccccagattaaacaggtg

SEQ ID NO: 120562 - DNA, 25 bp, Homo sapien
taaacaggtgtttggagaccaaggc

SEQ ID NO: 120563 - DNA, 25 bp, Homo sapien
gaggcttgggtaaactcattccaca

SEQ ID NO: 120564 - DNA, 25 bp, Homo sapien
tgggtaaactcattccacaaaccct

SEQ ID NO: 120565 - DNA, 25 bp, Homo sapien
aggcccaaaggactcttcttcagca

SEQ ID NO: 120566 - DNA, 25 bp, Homo sapien
tcttcttcagcagcatctttgcaaa

SEQ ID NO: 120567 - DNA, 25 bp, Homo sapien
atgtctttctctcaatgaagagcat

SEQ ID NO: 120568 - DNA, 25 bp, Homo sapien
atgaagagcatatctggacgactgt

SEQ ID NO: 120569 - DNA, 25 bp, Homo sapien
tatctggacgactgtgcaatgctgt

SEQ ID NO: 120570 - DNA, 25 bp, Homo sapien
ggacgactgtgcaatgctgtgtgct

SEQ ID NO: 120571 - DNA, 25 bp, Homo sapien
taacccttccgctgttcctgaaata

SEQ ID NO: 120572 - DNA, 25 bp, Homo sapien
ctgcacctcaggcatcctggaggag

SEQ ID NO: 120573 - DNA, 25 bp, Homo sapien
tgcacctcaggcatcctggaggagc

SEQ ID NO: 120574 - DNA, 25 bp, Homo sapien
cagggcccgggctgctgtctcaaga

SEQ ID NO: 120575 - DNA, 25 bp, Homo sapien
agggcccgggctgctgtctcaagac

SEQ ID NO: 120576 - DNA, 25 bp, Homo sapien
ggcccgggctgctgtctcaagacag

SEQ ID NO: 120577 - DNA, 25 bp, Homo sapien
ccgggctgctgtctcaagacagcca

SEQ ID NO: 120578 - DNA, 25 bp, Homo sapien
gcaaggctggcccagacttgccctc

SEQ ID NO: 120579 - DNA, 25 bp, Homo sapien
caaggctggcccagacttgccctcc

SEQ ID NO: 120580 - DNA, 25 bp, Homo sapien
gcagccacaccacacgggacagcag

SEQ ID NO: 120581 - DNA, 25 bp, Homo sapien
cagccacaccacacgggacagcagc

SEQ ID NO: 120582 - DNA, 25 bp, Homo sapien
accacacgggacagcagctccctct

SEQ ID NO: 120583 - DNA, 25 bp, Homo sapien
tcagaggacattcccaacacagcca

SEQ ID NO: 120584 - DNA, 25 bp, Homo sapien
cacacctgggaactccgtgggcttc

SEQ ID NO: 120585 - DNA, 25 bp, Homo sapien
tgggcttcctgctccggccattcaa

SEQ ID NO: 120586 - DNA, 25 bp, Homo sapien
ggccattcaacttcttcccagagga

SEQ ID NO: 120587 - DNA, 25 bp, Homo sapien
tggcatccagagacactgtgatcgt

SEQ ID NO: 120588 - DNA, 25 bp, Homo sapien
actgtgatcgtgtggcctcgggaca

SEQ ID NO: 120589 - DNA, 25 bp, Homo sapien
tgtggcctcgggacaacggccccaa

SEQ ID NO: 120590 - DNA, 25 bp, Homo sapien
ggacagggactgctcgatgcctccc

SEQ ID NO: 120591 - DNA, 25 bp, Homo sapien
cccttttagctacaatgggacctat

SEQ ID NO: 120592 - DNA, 25 bp, Homo sapien
atgggacctatagacctgtgtgacc

SEQ ID NO: 120593 - DNA, 25 bp, Homo sapien
gacctatagacctgtgtgaccagcc

SEQ ID NO: 120594 - DNA, 25 bp, Homo sapien
tatatgttctgtataatgttcagtt

SEQ ID NO: 120595 - DNA, 25 bp, Homo sapien
ctgtataatgttcagtttgtaactt

SEQ ID NO: 120596 - DNA, 25 bp, Homo sapien
aaaagtttggatgtatagagggata

SEQ ID NO: 120597 - DNA, 25 bp, Homo sapien
gaatcaaatcattgttgaacaaaag

SEQ ID NO: 120598 - DNA, 25 bp, Homo sapien
gaacaaaagatttgttgctgtgtaa

SEQ ID NO: 120599 - DNA, 25 bp, Homo sapien
gttgctgtgtaattattgtcttgta

SEQ ID NO: 120600 - DNA, 25 bp, Homo sapien
gctgtgtaattattgtcttgtatgc

SEQ ID NO: 120601 - DNA, 25 bp, Homo sapien
gtgtaattattgtcttgtatgcatt

SEQ ID NO: 120602 - DNA, 25 bp, Homo sapien
aattattgtcttgtatgcatttgag

SEQ ID NO: 120603 - DNA, 25 bp, Homo sapien
attgtcttgtatgcatttgagagaa

SEQ ID NO: 120604 - DNA, 25 bp, Homo sapien
gaaataaatatacccatacttatgt

SEQ ID NO: 120605 - DNA, 25 bp, Homo sapien
aaattggaggattctgtggcgtatg

SEQ ID NO: 120606 - DNA, 25 bp, Homo sapien
tggcgtatgaagaccacgggataac

SEQ ID NO: 120607 - DNA, 25 bp, Homo sapien
gaagaccacgggataaccgtattgc

SEQ ID NO: 120608 - DNA, 25 bp, Homo sapien
cgtattgcccaagatgggatctcat

SEQ ID NO: 120609 - DNA, 25 bp, Homo sapien
atgggatctcatgaacccacgatct

SEQ ID NO: 120610 - DNA, 25 bp, Homo sapien
acccttacatgaatccatggcccta

SEQ ID NO: 120611 - DNA, 25 bp, Homo sapien
accacttctgggtgcctatctaggt

SEQ ID NO: 120612 - DNA, 25 bp, Homo sapien
ttctgggtgcctatctaggtggcat

SEQ ID NO: 120613 - DNA, 25 bp, Homo sapien
atctaggtggcatcatctacctggt

SEQ ID NO: 120614 - DNA, 25 bp, Homo sapien
atcatctacctggtcttcattggct

SEQ ID NO: 120615 - DNA, 25 bp, Homo sapien
acctggtcttcattggctccaccat

SEQ ID NO: 120616 - DNA, 25 bp, Homo sapien
gtcttagcgtccagcgcagcccggg

SEQ ID NO: 120617 - DNA, 25 bp, Homo sapien
aggctctgctcccttagggcatggt

SEQ ID NO: 120618 - DNA, 25 bp, Homo sapien
tagggcatggtagtcaccgcgaagc

SEQ ID NO: 120619 - DNA, 25 bp, Homo sapien
tagtcaccgcgaagccgggcaccgt

SEQ ID NO: 120620 - DNA, 25 bp, Homo sapien
gtcccacagcatctcctagaagcag

SEQ ID NO: 120621 - DNA, 25 bp, Homo sapien
atctcctagaagcagccggcacagg

SEQ ID NO: 120622 - DNA, 25 bp, Homo sapien
aggtggccaggctcgaagcagtctc

SEQ ID NO: 120623 - DNA, 25 bp, Homo sapien
ctcgaagcagtctctgtttccagca

SEQ ID NO: 120624 - DNA, 25 bp, Homo sapien
ctgggtggctgtctcaaggacacat

SEQ ID NO: 120625 - DNA, 25 bp, Homo sapien
gtctcaaggacacattgaatacgtt

SEQ ID NO: 120626 - DNA, 25 bp, Homo sapien
gaatacgttgtgaccatccagaaaa

SEQ ID NO: 120627 - DNA, 25 bp, Homo sapien
tgccaaggaaatcacaactcaaatt

SEQ ID NO: 120628 - DNA, 25 bp, Homo sapien
aaaccaaaggagtacccctgagatg

SEQ ID NO: 120629 - DNA, 25 bp, Homo sapien
ggagtacccctgagatggaaagaca

SEQ ID NO: 120630 - DNA, 25 bp, Homo sapien
gacagagagctgtgtaccatctagc

SEQ ID NO: 120631 - DNA, 25 bp, Homo sapien
gtgtaccatctagccactaggcttg

SEQ ID NO: 120632 - DNA, 25 bp, Homo sapien
actaggcttgttcaaactgctcgaa

SEQ ID NO: 120633 - DNA, 25 bp, Homo sapien
aaactgctcgaaactctcaattgga

SEQ ID NO: 120634 - DNA, 25 bp, Homo sapien
gctcgaaactctcaattggatccag

SEQ ID NO: 120635 - DNA, 25 bp, Homo sapien
ttggatccagacagtttacgaatat

SEQ ID NO: 120636 - DNA, 25 bp, Homo sapien
acaaagaagattttcccaggactga

SEQ ID NO: 120637 - DNA, 25 bp, Homo sapien
tcccaggactgaacaagttccagaa

SEQ ID NO: 120638 - DNA, 25 bp, Homo sapien
taaccggctggctgcagacccggtc

SEQ ID NO: 120639 - DNA, 25 bp, Homo sapien
gtcctctcaggcctagctcagatga

SEQ ID NO: 120640 - DNA, 25 bp, Homo sapien
caggcctagctcagatgatgcggga

SEQ ID NO: 120641 - DNA, 25 bp, Homo sapien
tgatgcgggagtgctggtacccaaa

SEQ ID NO: 120642 - DNA, 25 bp, Homo sapien
ggagtgctggtacccaaacccctct

SEQ ID NO: 120643 - DNA, 25 bp, Homo sapien
gactcaccgcgctgcggatcaagaa

SEQ ID NO: 120644 - DNA, 25 bp, Homo sapien
gctgcggatcaagaagacactacaa

SEQ ID NO: 120645 - DNA, 25 bp, Homo sapien
acagtccagagaagcctaaagtgat

SEQ ID NO: 120646 - DNA, 25 bp, Homo sapien
aaagtgattcaatagcccaggagca

SEQ ID NO: 120647 - DNA, 25 bp, Homo sapien
aggagcacctgattcctttctgcct

SEQ ID NO: 120648 - DNA, 25 bp, Homo sapien
acctgattcctttctgcctgcaggg

SEQ ID NO: 120649 - DNA, 25 bp, Homo sapien
ctgcctacctagaatctgcctgaaa

SEQ ID NO: 120650 - DNA, 25 bp, Homo sapien
tgcctacctagaatctgcctgaaag

SEQ ID NO: 120651 - DNA, 25 bp, Homo sapien
gcctacctagaatctgcctgaaagg

SEQ ID NO: 120652 - DNA, 25 bp, Homo sapien
ctacctagaatctgcctgaaagggc

SEQ ID NO: 120653 - DNA, 25 bp, Homo sapien
cctagaatctgcctgaaagggctgg

SEQ ID NO: 120654 - DNA, 25 bp, Homo sapien
attgggggactgtgctagctttacc

SEQ ID NO: 120655 - DNA, 25 bp, Homo sapien
cccagagtctgtaccgcagatcttt

SEQ ID NO: 120656 - DNA, 25 bp, Homo sapien
ccagagtctgtaccgcagatctttc

SEQ ID NO: 120657 - DNA, 25 bp, Homo sapien
gagtctgtaccgcagatctttccca

SEQ ID NO: 120658 - DNA, 25 bp, Homo sapien
agtctgtaccgcagatctttcccat

SEQ ID NO: 120659 - DNA, 25 bp, Homo sapien
tctgtaccgcagatctttcccatgg

SEQ ID NO: 120660 - DNA, 25 bp, Homo sapien
atgaagtgactcagcttctggcttc

SEQ ID NO: 120661 - DNA, 25 bp, Homo sapien
aagtgactcagcttctggcttctct

SEQ ID NO: 120662 - DNA, 25 bp, Homo sapien
gcttctctgctacatcaaatatctt

SEQ ID NO: 120663 - DNA, 25 bp, Homo sapien
gggcagatatgcattaaatagtttg

SEQ ID NO: 120664 - DNA, 25 bp, Homo sapien
aaatagtttgtacaagcagctttcg

SEQ ID NO: 120665 - DNA, 25 bp, Homo sapien
caagcagctttcgttgaagtttaga

SEQ ID NO: 120666 - DNA, 25 bp, Homo sapien
gaagataagaaacatgtcatcatat

SEQ ID NO: 120667 - DNA, 25 bp, Homo sapien
ttaaatgttccggtaatgtgatgcc

SEQ ID NO: 120668 - DNA, 25 bp, Homo sapien
gtaatgtgatgcctcaggtctgcct

SEQ ID NO: 120669 - DNA, 25 bp, Homo sapien
gtgatgcctcaggtctgcctttttt

SEQ ID NO: 120670 - DNA, 25 bp, Homo sapien
aataaatgcagtaatcctctcccaa

SEQ ID NO: 120671 - DNA, 25 bp, Homo sapien
gggcctgctttctcagatagactga

SEQ ID NO: 120672 - DNA, 25 bp, Homo sapien
gactgctgaggaggctctaggttct

SEQ ID NO: 120673 - DNA, 25 bp, Homo sapien
gaggctctaggttcttggaattcct

SEQ ID NO: 120674 - DNA, 25 bp, Homo sapien
tttgtgctcatcagagaccccagcc

SEQ ID NO: 120675 - DNA, 25 bp, Homo sapien
agtgcaaacaccacaacacgagcgt

SEQ ID NO: 120676 - DNA, 25 bp, Homo sapien
aacacgagcgtgtttcttgagagga

SEQ ID NO: 120677 - DNA, 25 bp, Homo sapien
ttcttgagaggaatgtccccgagtt

SEQ ID NO: 120678 - DNA, 25 bp, Homo sapien
cccgagttggacaaggaggctgttt

SEQ ID NO: 120679 - DNA, 25 bp, Homo sapien
aggctgtttctgcacatcagctcat

SEQ ID NO: 120680 - DNA, 25 bp, Homo sapien
ccgcaccccatttcttgcttgattg

SEQ ID NO: 120681 - DNA, 25 bp, Homo sapien
gcttctcaagctgacaattctcact

SEQ ID NO: 120682 - DNA, 25 bp, Homo sapien
aaacacaagttcacagatttacatg

SEQ ID NO: 120683 - DNA, 25 bp, Homo sapien
acagatttacatgaacttgatctac

SEQ ID NO: 120684 - DNA, 25 bp, Homo sapien
atctacaagttcacagatccattgt

SEQ ID NO: 120685 - DNA, 25 bp, Homo sapien
gttcacagatccattgtgtggttta

SEQ ID NO: 120686 - DNA, 25 bp, Homo sapien
ttgtgtggtttaatagactattcct

SEQ ID NO: 120687 - DNA, 25 bp, Homo sapien
aaaccagactgaaaggaatacctca

SEQ ID NO: 120688 - DNA, 25 bp, Homo sapien
gaatacctcagaagagatgcttcat

SEQ ID NO: 120689 - DNA, 25 bp, Homo sapien
gagatgcttcattgagtgttcatta

SEQ ID NO: 120690 - DNA, 25 bp, Homo sapien
gagtgttcattaaaccacacatgta

SEQ ID NO: 120691 - DNA, 25 bp, Homo sapien
atttaaattcccacagcaaatagaa

SEQ ID NO: 120692 - DNA, 25 bp, Homo sapien
atcatacttgtacaattaactgaag

SEQ ID NO: 120693 - DNA, 25 bp, Homo sapien
ctcatgtgcgaggacgcgctggtac

SEQ ID NO: 120694 - DNA, 25 bp, Homo sapien
gcgaggacgcgctggtacccttcta

SEQ ID NO: 120695 - DNA, 25 bp, Homo sapien
acccttctatgagaggttcagcttc

SEQ ID NO: 120696 - DNA, 25 bp, Homo sapien
tctatgagaggttcagcttccacgc

SEQ ID NO: 120697 - DNA, 25 bp, Homo sapien
agaggttcagcttccacgccgtggg

SEQ ID NO: 120698 - DNA, 25 bp, Homo sapien
aacagcggctgctgaactgggctgc

SEQ ID NO: 120699 - DNA, 25 bp, Homo sapien
agcggctgctgaactgggctgccca

SEQ ID NO: 120700 - DNA, 25 bp, Homo sapien
ggctcctcttagctcagctgagcat

SEQ ID NO: 120701 - DNA, 25 bp, Homo sapien
tcctcttagctcagctgagcataga

SEQ ID NO: 120702 - DNA, 25 bp, Homo sapien
ctgagcatagagacagcagtttcca

SEQ ID NO: 120703 - DNA, 25 bp, Homo sapien
acagcagtttccagagagtggagag

SEQ ID NO: 120704 - DNA, 25 bp, Homo sapien
acattattcgaggtttctctttaat

SEQ ID NO: 120705 - DNA, 25 bp, Homo sapien
attcgaggtttctctttaatgcatt

SEQ ID NO: 120706 - DNA, 25 bp, Homo sapien
aatgcattttgcgtgtttgctgact

SEQ ID NO: 120707 - DNA, 25 bp, Homo sapien
gcattttgcgtgtttgctgacttga

SEQ ID NO: 120708 - DNA, 25 bp, Homo sapien
gagcatttttgattagttcgtgcat

SEQ ID NO: 120709 - DNA, 25 bp, Homo sapien
agttcgtgcatggagatttgtttga

SEQ ID NO: 120710 - DNA, 25 bp, Homo sapien
gagaaaccttaagtttgcacacctg

SEQ ID NO: 120711 - DNA, 25 bp, Homo sapien
gtttgcacacctgttctgtagaagc

SEQ ID NO: 120712 - DNA, 25 bp, Homo sapien
acacctgttctgtagaagcttggaa

SEQ ID NO: 120713 - DNA, 25 bp, Homo sapien
cattgcagtaatgttaaggacaggt

SEQ ID NO: 120714 - DNA, 25 bp, Homo sapien
taaggacaggtatactttttgcaaa

SEQ ID NO: 120715 - DNA, 25 bp, Homo sapien
ctcctgggaataattgtgggcttct

SEQ ID NO: 120716 - DNA, 25 bp, Homo sapien
ttgtgggcttcttcccaaatttcta

SEQ ID NO: 120717 - DNA, 25 bp, Homo sapien
gggcttcttcccaaatttctacagc

SEQ ID NO: 120718 - DNA, 25 bp, Homo sapien
ttcccaaatttctacagcctctttc

SEQ ID NO: 120719 - DNA, 25 bp, Homo sapien
ttctcatgcttgagcttccctgttt

SEQ ID NO: 120720 - DNA, 25 bp, Homo sapien
ttgagcttccctgtttgcacgcatg

SEQ ID NO: 120721 - DNA, 25 bp, Homo sapien
cttccctgtttgcacgcatgcgtgt

SEQ ID NO: 120722 - DNA, 25 bp, Homo sapien
tcggctccaggtggaagcatgcttt

SEQ ID NO: 120723 - DNA, 25 bp, Homo sapien
ggtggaagcatgctttcccttgtta

SEQ ID NO: 120724 - DNA, 25 bp, Homo sapien
cctaggtgtagccattttgtcaagt

SEQ ID NO: 120725 - DNA, 25 bp, Homo sapien
gccattttgtcaagtcatcaactgt

SEQ ID NO: 120726 - DNA, 25 bp, Homo sapien
ggagaggactaattctcagcagcag

SEQ ID NO: 120727 - DNA, 25 bp, Homo sapien
gagttctttcttttgcggaagcttt

SEQ ID NO: 120728 - DNA, 25 bp, Homo sapien
tttgcggaagctttacatatgtttt

SEQ ID NO: 120729 - DNA, 25 bp, Homo sapien
tagtgtgcggtgtgtgttcacccct

SEQ ID NO: 120730 - DNA, 25 bp, Homo sapien
cccctgggattggacagtgtatcct

SEQ ID NO: 120731 - DNA, 25 bp, Homo sapien
gtatcctaacaagtcccatgtctgg

SEQ ID NO: 120732 - DNA, 25 bp, Homo sapien
tctggttctgtgtctaaaggcctgc

SEQ ID NO: 120733 - DNA, 25 bp, Homo sapien
aaaggcctgctccatgacacaggat

SEQ ID NO: 120734 - DNA, 25 bp, Homo sapien
aggatgctacatgcactcctgctag

SEQ ID NO: 120735 - DNA, 25 bp, Homo sapien
ctcctgctagcacatcttgatctgt

SEQ ID NO: 120736 - DNA, 25 bp, Homo sapien
gctcatactgctgtaggctataatt

SEQ ID NO: 120737 - DNA, 25 bp, Homo sapien
taaactttcttagtgctggagtaaa

SEQ ID NO: 120738 - DNA, 25 bp, Homo sapien
taaaaggtcaagtccaacacctgcc

SEQ ID NO: 120739 - DNA, 25 bp, Homo sapien
acttatggtataactgggtccctca

SEQ ID NO: 120740 - DNA, 25 bp, Homo sapien
ggtataactgggtccctcaacagta

SEQ ID NO: 120741 - DNA, 25 bp, Homo sapien
gtccctcaacagtaacctgggctaa

SEQ ID NO: 120742 - DNA, 25 bp, Homo sapien
ataggtcttatgtggttcaactccc

SEQ ID NO: 120743 - DNA, 25 bp, Homo sapien
ttccccatattttcaaccactctga

SEQ ID NO: 120744 - DNA, 25 bp, Homo sapien
tctgattatcttccctgcacaacta

SEQ ID NO: 120745 - DNA, 25 bp, Homo sapien
tccctgcacaactaacatccagtaa

SEQ ID NO: 120746 - DNA, 25 bp, Homo sapien
ctcccatcctgatacatcctgaagt

SEQ ID NO: 120747 - DNA, 25 bp, Homo sapien
tacatcctgaagtaacactgtttta

SEQ ID NO: 120748 - DNA, 25 bp, Homo sapien
tagtagtgatagcagtgacagcagt

SEQ ID NO: 120749 - DNA, 25 bp, Homo sapien
agcagcgacagcagtgacagcaatg

SEQ ID NO: 120750 - DNA, 25 bp, Homo sapien
gacagcaatgaaagcagcgacagca

SEQ ID NO: 120751 - DNA, 25 bp, Homo sapien
gcagtgacagcagcgatagcagtga

SEQ ID NO: 120752 - DNA, 25 bp, Homo sapien
cagcagcgatagcagtgacagcagc

SEQ ID NO: 120753 - DNA, 25 bp, Homo sapien
gcagtgacagcagcgacagcagtga

SEQ ID NO: 120754 - DNA, 25 bp, Homo sapien
tgacagcagcgacagcagtgatagc

SEQ ID NO: 120755 - DNA, 25 bp, Homo sapien
gtgatagcagtgacagcacatctga

SEQ ID NO: 120756 - DNA, 25 bp, Homo sapien
gtgacagcacatctgacagcaatga

SEQ ID NO: 120757 - DNA, 25 bp, Homo sapien
gagcaagtctggtaacggtaacaac

SEQ ID NO: 120758 - DNA, 25 bp, Homo sapien
taacggtaacaacaatggaagtgac

SEQ ID NO: 120759 - DNA, 25 bp, Homo sapien
atcccaaccgagatgccattaacat

SEQ ID NO: 120760 - DNA, 25 bp, Homo sapien
aaatgttaggctctaaatggacgaa

SEQ ID NO: 120761 - DNA, 25 bp, Homo sapien
tggacgaaaaattctctcgccatct

SEQ ID NO: 120762 - DNA, 25 bp, Homo sapien
ttctctcgccatcttaataacaaaa

SEQ ID NO: 120763 - DNA, 25 bp, Homo sapien
cctgacccaaggacactgtgttata

SEQ ID NO: 120764 - DNA, 25 bp, Homo sapien
ttataagaggcgtgggctcccctgg

SEQ ID NO: 120765 - DNA, 25 bp, Homo sapien
agaagggtgtgaccatgccctcagc

SEQ ID NO: 120766 - DNA, 25 bp, Homo sapien
ttgtccccactgaacggcaactgag

SEQ ID NO: 120767 - DNA, 25 bp, Homo sapien
gaacggcaactgagactgggtacct

SEQ ID NO: 120768 - DNA, 25 bp, Homo sapien
agactgggtacctggagattctgaa

SEQ ID NO: 120769 - DNA, 25 bp, Homo sapien
agattctgaagtgcctttgctgtgg

SEQ ID NO: 120770 - DNA, 25 bp, Homo sapien
gcccctaccggtgggtgatggatat

SEQ ID NO: 120771 - DNA, 25 bp, Homo sapien
gatggatatcatccccgaacaggtg

SEQ ID NO: 120772 - DNA, 25 bp, Homo sapien
ggacaactgactagcagccccagag

SEQ ID NO: 120773 - DNA, 25 bp, Homo sapien
ggatcccagcctaaaagacaccaga

SEQ ID NO: 120774 - DNA, 25 bp, Homo sapien
agagacctcagctatggagcccttc

SEQ ID NO: 120775 - DNA, 25 bp, Homo sapien
ttctcacagactctggcactggcca

SEQ ID NO: 120776 - DNA, 25 bp, Homo sapien
gaacactacagtggctgaggcatca

SEQ ID NO: 120777 - DNA, 25 bp, Homo sapien
gcccaggccctgtagggacagcatt

SEQ ID NO: 120778 - DNA, 25 bp, Homo sapien
gggacagcatttgaaggacacatat

SEQ ID NO: 120779 - DNA, 25 bp, Homo sapien
ggacacatattgcagttgcttggtt

SEQ ID NO: 120780 - DNA, 25 bp, Homo sapien
cttggttgaaagtgcctgtgctgga

SEQ ID NO: 120781 - DNA, 25 bp, Homo sapien
acccacagtggcagcgtgttggagc

SEQ ID NO: 120782 - DNA, 25 bp, Homo sapien
tgttggagcgcgagtccagcgacct

SEQ ID NO: 120783 - DNA, 25 bp, Homo sapien
gagtccagcgacctgttgcacatga

SEQ ID NO: 120784 - DNA, 25 bp, Homo sapien
cagcgacctgttgcacatgagcgag

SEQ ID NO: 120785 - DNA, 25 bp, Homo sapien
acctgttgcacatgagcgaggcggc

SEQ ID NO: 120786 - DNA, 25 bp, Homo sapien
aaaggcaggcgacagcatcctgacg

SEQ ID NO: 120787 - DNA, 25 bp, Homo sapien
aggcgacagcatcctgacggttgat

SEQ ID NO: 120788 - DNA, 25 bp, Homo sapien
tcaaccccatcgtttacgcgctggt

SEQ ID NO: 120789 - DNA, 25 bp, Homo sapien
tttacgcgctggtctccaagcactt

SEQ ID NO: 120790 - DNA, 25 bp, Homo sapien
aagcacttccgcaaaggcttccgca

SEQ ID NO: 120791 - DNA, 25 bp, Homo sapien
aaaggcttccgcacgatctgcgcgg

SEQ ID NO: 120792 - DNA, 25 bp, Homo sapien
cagctctcgctggtttgttcttggg

SEQ ID NO: 120793 - DNA, 25 bp, Homo sapien
ctctcgctggtttgttcttgggttg

SEQ ID NO: 120794 - DNA, 25 bp, Homo sapien
tcgctggtttgttcttgggttgttt

SEQ ID NO: 120795 - DNA, 25 bp, Homo sapien
ctgccccatgccttttggttggtga

SEQ ID NO: 120796 - DNA, 25 bp, Homo sapien
atgccttttggttggtgaccccaga

SEQ ID NO: 120797 - DNA, 25 bp, Homo sapien
gccttttggttggtgaccccagact

SEQ ID NO: 120798 - DNA, 25 bp, Homo sapien
tgatcccccagggtccatggtgctg

SEQ ID NO: 120799 - DNA, 25 bp, Homo sapien
gtttacgcgccccatcctgtgtgtc

SEQ ID NO: 120800 - DNA, 25 bp, Homo sapien
ccatcctgtgtgtcccagccttttg

SEQ ID NO: 120801 - DNA, 25 bp, Homo sapien
actgcttttctaaggctcgccgtga

SEQ ID NO: 120802 - DNA, 25 bp, Homo sapien
ttttctaaggctcgccgtgagccag

SEQ ID NO: 120803 - DNA, 25 bp, Homo sapien
gccagcaaacgtttggagtttctgt

SEQ ID NO: 120804 - DNA, 25 bp, Homo sapien
aacagacactttcaccaacaatcac

SEQ ID NO: 120805 - DNA, 25 bp, Homo sapien
gaaactcgaaactactcagaaggat

SEQ ID NO: 120806 - DNA, 25 bp, Homo sapien
gaaggattgaccatgcatacccaca

SEQ ID NO: 120807 - DNA, 25 bp, Homo sapien
atacccacatagttagcaccagcaa

SEQ ID NO: 120808 - DNA, 25 bp, Homo sapien
aacttcagtgagacctctgctttca

SEQ ID NO: 120809 - DNA, 25 bp, Homo sapien
ctgctttcatgccagttctcaaagt

SEQ ID NO: 120810 - DNA, 25 bp, Homo sapien
gccagttctcaaagttgttctcacc

SEQ ID NO: 120811 - DNA, 25 bp, Homo sapien
caggccaataagctgggtgtctaaa

SEQ ID NO: 120812 - DNA, 25 bp, Homo sapien
taaaaggacagcttctcttccactc

SEQ ID NO: 120813 - DNA, 25 bp, Homo sapien
ctcttccactcaatattgccatttt

SEQ ID NO: 120814 - DNA, 25 bp, Homo sapien
tcatccagctctgggcatttgatgc

SEQ ID NO: 120815 - DNA, 25 bp, Homo sapien
agctctgggcatttgatgctgtcaa

SEQ ID NO: 120816 - DNA, 25 bp, Homo sapien
tctgggcatttgatgctgtcaaggg

SEQ ID NO: 120817 - DNA, 25 bp, Homo sapien
caagttctactcagagaaggagtgc

SEQ ID NO: 120818 - DNA, 25 bp, Homo sapien
agtgcagagagtactgcggtgtccc

SEQ ID NO: 120819 - DNA, 25 bp, Homo sapien
agagtactgcggtgtccctggtgat

SEQ ID NO: 120820 - DNA, 25 bp, Homo sapien
gacaactggccggtctgcaagtcag

SEQ ID NO: 120821 - DNA, 25 bp, Homo sapien
acaactggccggtctgcaagtcaga

SEQ ID NO: 120822 - DNA, 25 bp, Homo sapien
tcctgtggcaggcagcgccaagcaa

SEQ ID NO: 120823 - DNA, 25 bp, Homo sapien
ctgccgaactgtggcggcctgcaat

SEQ ID NO: 120824 - DNA, 25 bp, Homo sapien
ccttcatccagctctgggcatttga

SEQ ID NO: 120825 - DNA, 25 bp, Homo sapien
gcagtggtgccatcaccacggctca

SEQ ID NO: 120826 - DNA, 25 bp, Homo sapien
tattttcgtggagacggggcctcac

SEQ ID NO: 120827 - DNA, 25 bp, Homo sapien
ctaggctggaaataggattttgaac

SEQ ID NO: 120828 - DNA, 25 bp, Homo sapien
taggctggaaataggattttgaacc

SEQ ID NO: 120829 - DNA, 25 bp, Homo sapien
ggctggaaataggattttgaaccca

SEQ ID NO: 120830 - DNA, 25 bp, Homo sapien
tggaaataggattttgaacccaaat

SEQ ID NO: 120831 - DNA, 25 bp, Homo sapien
taggattttgaacccaaattgagtt

SEQ ID NO: 120832 - DNA, 25 bp, Homo sapien
ttgaacccaaattgagtttaacaat

SEQ ID NO: 120833 - DNA, 25 bp, Homo sapien
tgaacccaaattgagtttaacaata

SEQ ID NO: 120834 - DNA, 25 bp, Homo sapien
ttgttttacgctaaagatggaaaag

SEQ ID NO: 120835 - DNA, 25 bp, Homo sapien
tgttttacgctaaagatggaaaaga

SEQ ID NO: 120836 - DNA, 25 bp, Homo sapien
ttgtgccaaagtcaggccctacatt

SEQ ID NO: 120837 - DNA, 25 bp, Homo sapien
gtgccaaagtcaggccctacattgc

SEQ ID NO: 120838 - DNA, 25 bp, Homo sapien
caaagtcaggccctacattgcggag

SEQ ID NO: 120839 - DNA, 25 bp, Homo sapien
aagtcaggccctacattgcggaggg

SEQ ID NO: 120840 - DNA, 25 bp, Homo sapien
tcaggccctacattgcggagggaga

SEQ ID NO: 120841 - DNA, 25 bp, Homo sapien
acattgcggagggagagtcagacac

SEQ ID NO: 120842 - DNA, 25 bp, Homo sapien
tcggccaccggcgagggtccctttg

SEQ ID NO: 120843 - DNA, 25 bp, Homo sapien
gagggtccctttggtgacgtgggct

SEQ ID NO: 120844 - DNA, 25 bp, Homo sapien
gggcccaggaagtgaggcggcgctg

SEQ ID NO: 120845 - DNA, 25 bp, Homo sapien
cacggtgcctccgaggttttgaggc

SEQ ID NO: 120846 - DNA, 25 bp, Homo sapien
tggggcccttttcttacagtaactg

SEQ ID NO: 120847 - DNA, 25 bp, Homo sapien
tgacccggctgactacaacaagatt

SEQ ID NO: 120848 - DNA, 25 bp, Homo sapien
agggcctgaaggacttcacccctgg

SEQ ID NO: 120849 - DNA, 25 bp, Homo sapien
cgagacgcagattgagtggttccgc

SEQ ID NO: 120850 - DNA, 25 bp, Homo sapien
cagattgagtggttccgcgctggca

SEQ ID NO: 120851 - DNA, 25 bp, Homo sapien
tggcagtgccctcaacagaatgaag

SEQ ID NO: 120852 - DNA, 25 bp, Homo sapien
actgcaacagtgagggcagtgcctc

SEQ ID NO: 120853 - DNA, 25 bp, Homo sapien
gccgcgctggcgtcaagttcagctc

SEQ ID NO: 120854 - DNA, 25 bp, Homo sapien
ggcgtcaagttcagctccacgtgtg

SEQ ID NO: 120855 - DNA, 25 bp, Homo sapien
cacgtgtgccatcagtggatccgat

SEQ ID NO: 120856 - DNA, 25 bp, Homo sapien
tgtgccatcagtggatccgatccgt

SEQ ID NO: 120857 - DNA, 25 bp, Homo sapien
ccatcagtggatccgatccgtccag

SEQ ID NO: 120858 - DNA, 25 bp, Homo sapien
gaaaaaggcagtggcctaaatcctt

SEQ ID NO: 120859 - DNA, 25 bp, Homo sapien
aaatgacttggctcgatgctgtggg

SEQ ID NO: 120860 - DNA, 25 bp, Homo sapien
tgcaggccgtgtgtctgtcagccca

SEQ ID NO: 120861 - DNA, 25 bp, Homo sapien
cgtgtgtctgtcagcccaaccttca

SEQ ID NO: 120862 - DNA, 25 bp, Homo sapien
acatctgtcacgttctccacacggg

SEQ ID NO: 120863 - DNA, 25 bp, Homo sapien
ggagagacgcagtccgcccaggtcc

SEQ ID NO: 120864 - DNA, 25 bp, Homo sapien
agcagctcccgcagggctgaagtct

SEQ ID NO: 120865 - DNA, 25 bp, Homo sapien
cccgcagggctgaagtctggcgtaa

SEQ ID NO: 120866 - DNA, 25 bp, Homo sapien
gatgatggatttgattcgccctcct

SEQ ID NO: 120867 - DNA, 25 bp, Homo sapien
tacagcttcgctggaaacctctgga

SEQ ID NO: 120868 - DNA, 25 bp, Homo sapien
ggaaacctctggaggtcatctcggc

SEQ ID NO: 120869 - DNA, 25 bp, Homo sapien
aaggcagggcctgatttatctagct

SEQ ID NO: 120870 - DNA, 25 bp, Homo sapien
ttatctagctgtccagccgctgtgg

SEQ ID NO: 120871 - DNA, 25 bp, Homo sapien
gatgggcagctaagcagtcttctct

SEQ ID NO: 120872 - DNA, 25 bp, Homo sapien
agtcttctcttctgcctttatgaga

SEQ ID NO: 120873 - DNA, 25 bp, Homo sapien
tcttctgcctttatgagattgggta

SEQ ID NO: 120874 - DNA, 25 bp, Homo sapien
gaacactataaaaacagctcctcta

SEQ ID NO: 120875 - DNA, 25 bp, Homo sapien
aaaaacagctcctctatatttccac

SEQ ID NO: 120876 - DNA, 25 bp, Homo sapien
atttccacctctttctatttatgca

SEQ ID NO: 120877 - DNA, 25 bp, Homo sapien
tttatgcaactcatcttcacagatt

SEQ ID NO: 120878 - DNA, 25 bp, Homo sapien
agatggtgtatgctgtatccacaaa

SEQ ID NO: 120879 - DNA, 25 bp, Homo sapien
gtgtatgctgtatccacaaatcatc

SEQ ID NO: 120880 - DNA, 25 bp, Homo sapien
gatccctagagctattcagagcctg

SEQ ID NO: 120881 - DNA, 25 bp, Homo sapien
atagtcaatagtgctcagactggta

SEQ ID NO: 120882 - DNA, 25 bp, Homo sapien
ggtagcttcaaacagctcacagtta

SEQ ID NO: 120883 - DNA, 25 bp, Homo sapien
tgtgctgaatggtttggtggccact

SEQ ID NO: 120884 - DNA, 25 bp, Homo sapien
gccactgaggtgttgatgtggtttt

SEQ ID NO: 120885 - DNA, 25 bp, Homo sapien
atgtggttttatgtcggagagatta

SEQ ID NO: 120886 - DNA, 25 bp, Homo sapien
tatgtcggagagattataggcaagc

SEQ ID NO: 120887 - DNA, 25 bp, Homo sapien
tcattggctatgatgtttgaagacc

SEQ ID NO: 120888 - DNA, 25 bp, Homo sapien
gaagaccaatctttaacatctgatt

SEQ ID NO: 120889 - DNA, 25 bp, Homo sapien
atttgagtgttgttggaccatgtgt

SEQ ID NO: 120890 - DNA, 25 bp, Homo sapien
ggaccatgtgtgatcagactgctat

SEQ ID NO: 120891 - DNA, 25 bp, Homo sapien
gtttccttccttcgcagcttttaga

SEQ ID NO: 120892 - DNA, 25 bp, Homo sapien
ttccttcgcagcttttagaccaaaa

SEQ ID NO: 120893 - DNA, 25 bp, Homo sapien
atgaaagacttacaggcctcgctac

SEQ ID NO: 120894 - DNA, 25 bp, Homo sapien
ggcctcgctacaagaacctgctaag

SEQ ID NO: 120895 - DNA, 25 bp, Homo sapien
gctaaggctgcctcagacctgactg

SEQ ID NO: 120896 - DNA, 25 bp, Homo sapien
agacctgactgcctggttcagcctc

SEQ ID NO: 120897 - DNA, 25 bp, Homo sapien
ggttcagcctcttcgctgacctcga

SEQ ID NO: 120898 - DNA, 25 bp, Homo sapien
ccactctcaaatcctgatgctgttg

SEQ ID NO: 120899 - DNA, 25 bp, Homo sapien
tcaaatcctgatgctgttgggaaaa

SEQ ID NO: 120900 - DNA, 25 bp, Homo sapien
gaattgctcaatgcatgaatctgta

SEQ ID NO: 120901 - DNA, 25 bp, Homo sapien
aagtgatcagtatgctgttttaata

SEQ ID NO: 120902 - DNA, 25 bp, Homo sapien
aggcccacacctattggcaatttat

SEQ ID NO: 120903 - DNA, 25 bp, Homo sapien
ggcaatttatagcactgatctgtca

SEQ ID NO: 120904 - DNA, 25 bp, Homo sapien
tgtcatcaataccacttgctgtctt

SEQ ID NO: 120905 - DNA, 25 bp, Homo sapien
accacttgctgtcttggatgtgaag

SEQ ID NO: 120906 - DNA, 25 bp, Homo sapien
tgtgaagatgatttttcctgcaggg

SEQ ID NO: 120907 - DNA, 25 bp, Homo sapien
gcatgtggaaataatattcacgctt

SEQ ID NO: 120908 - DNA, 25 bp, Homo sapien
taatattcacgctttaaattgtctt

SEQ ID NO: 120909 - DNA, 25 bp, Homo sapien
ggcaacagactgtggccctagtgta

SEQ ID NO: 120910 - DNA, 25 bp, Homo sapien
gactgtggccctagtgtagtgaata

SEQ ID NO: 120911 - DNA, 25 bp, Homo sapien
gaatattatttcctcatgcccagtg

SEQ ID NO: 120912 - DNA, 25 bp, Homo sapien
tttcctcatgcccagtgtttttaat

SEQ ID NO: 120913 - DNA, 25 bp, Homo sapien
ctatttccaaatgtcagcaattatg

SEQ ID NO: 120914 - DNA, 25 bp, Homo sapien
ctgtgtcaagtttgcaggaaaattc

SEQ ID NO: 120915 - DNA, 25 bp, Homo sapien
aattcttcaaatgagtttcctgcaa

SEQ ID NO: 120916 - DNA, 25 bp, Homo sapien
gagtttcctgcaaatgcatcagaaa

SEQ ID NO: 120917 - DNA, 25 bp, Homo sapien
gtattattagaacatcaccaggaac

SEQ ID NO: 120918 - DNA, 25 bp, Homo sapien
gaacatcaccaggaactagacaagt

SEQ ID NO: 120919 - DNA, 25 bp, Homo sapien
ttcctaaggatacccctcaagatat

SEQ ID NO: 120920 - DNA, 25 bp, Homo sapien
ggatacccctcaagatatcataata

SEQ ID NO: 120921 - DNA, 25 bp, Homo sapien
aacagctgtggctgaattttcacca

SEQ ID NO: 120922 - DNA, 25 bp, Homo sapien
gaattttcaccactttgaagacagg

SEQ ID NO: 120923 - DNA, 25 bp, Homo sapien
caggagtgtgaagtcaaagtctata

SEQ ID NO: 120924 - DNA, 25 bp, Homo sapien
acctgctaaggctgcctcagacctg

SEQ ID NO: 120925 - DNA, 25 bp, Homo sapien
gctaaggctgcctcagacctgactg

SEQ ID NO: 120926 - DNA, 25 bp, Homo sapien
gcctcagacctgactgcctggttca

SEQ ID NO: 120927 - DNA, 25 bp, Homo sapien
actgcctggttcagcctcttcgctg

SEQ ID NO: 120928 - DNA, 25 bp, Homo sapien
ggttcagcctcttcgctgacctcga

SEQ ID NO: 120929 - DNA, 25 bp, Homo sapien
ccactctcaaatcctgatgctgttg

SEQ ID NO: 120930 - DNA, 25 bp, Homo sapien
tgctgttgggaaaaccgataaagaa

SEQ ID NO: 120931 - DNA, 25 bp, Homo sapien
gaattgctcaatgcatgaatctgta

SEQ ID NO: 120932 - DNA, 25 bp, Homo sapien
gggctagcagaagtataaagtgatc

SEQ ID NO: 120933 - DNA, 25 bp, Homo sapien
agtataaagtgatcagtatgctgtt

SEQ ID NO: 120934 - DNA, 25 bp, Homo sapien
gatcagtatgctgttttaataatta

SEQ ID NO: 120935 - DNA, 25 bp, Homo sapien
attgaccgggccctcaatatcacct

SEQ ID NO: 120936 - DNA, 25 bp, Homo sapien
aatatcacctcccttcagatgcact

SEQ ID NO: 120937 - DNA, 25 bp, Homo sapien
agactcctgagccagaatcctccat

SEQ ID NO: 120938 - DNA, 25 bp, Homo sapien
aatcctccatctcagatcttccaga

SEQ ID NO: 120939 - DNA, 25 bp, Homo sapien
tcagatcttccagagcctcagcggt

SEQ ID NO: 120940 - DNA, 25 bp, Homo sapien
agagcctcagcggtaacagccggcc

SEQ ID NO: 120941 - DNA, 25 bp, Homo sapien
agcccttggcccacagggcactgag

SEQ ID NO: 120942 - DNA, 25 bp, Homo sapien
cccaactaccgcctgcatgtggatg

SEQ ID NO: 120943 - DNA, 25 bp, Homo sapien
accgcctgcatgtggatggtgtccc

SEQ ID NO: 120944 - DNA, 25 bp, Homo sapien
ggtgtcccccatggtcgctgagact

SEQ ID NO: 120945 - DNA, 25 bp, Homo sapien
tgagactccccttcgaggattgcac

SEQ ID NO: 120946 - DNA, 25 bp, Homo sapien
aaacacaggcaggtactgtctgctt

SEQ ID NO: 120947 - DNA, 25 bp, Homo sapien
aggcaggtactgtctgcttctctct

SEQ ID NO: 120948 - DNA, 25 bp, Homo sapien
acacacagtcccattcggatatcac

SEQ ID NO: 120949 - DNA, 25 bp, Homo sapien
gaagattaggcacacagatcccctg

SEQ ID NO: 120950 - DNA, 25 bp, Homo sapien
ttaggcacacagatcccctggaaac

SEQ ID NO: 120951 - DNA, 25 bp, Homo sapien
tggaaacccacctctctggaaggtc

SEQ ID NO: 120952 - DNA, 25 bp, Homo sapien
tctctggaaggtcccttccctggca

SEQ ID NO: 120953 - DNA, 25 bp, Homo sapien
cccttccctggcaggtggtcaggca

SEQ ID NO: 120954 - DNA, 25 bp, Homo sapien
tgttcagcctcatcctgagagacct

SEQ ID NO: 120955 - DNA, 25 bp, Homo sapien
gcaccactttggcttatcgtatcct

SEQ ID NO: 120956 - DNA, 25 bp, Homo sapien
tggcttatcgtatcctcctcctgga

SEQ ID NO: 120957 - DNA, 25 bp, Homo sapien
tggatccatccgtccagccaagagc

SEQ ID NO: 120958 - DNA, 25 bp, Homo sapien
atccgtccagccaagagctcttcat

SEQ ID NO: 120959 - DNA, 25 bp, Homo sapien
ttcatctgctacaagaacatttgaa

SEQ ID NO: 120960 - DNA, 25 bp, Homo sapien
aagaacatttgaatcttgggacctt

SEQ ID NO: 120961 - DNA, 25 bp, Homo sapien
agcagtaactggaacacacttggga

SEQ ID NO: 120962 - DNA, 25 bp, Homo sapien
gaacacacttgggagcagtcctatg

SEQ ID NO: 120963 - DNA, 25 bp, Homo sapien
gggagcagtcctatgtctcagtgcc

SEQ ID NO: 120964 - DNA, 25 bp, Homo sapien
agtgccccttaaatttctgccctga

SEQ ID NO: 120965 - DNA, 25 bp, Homo sapien
acgtcagtgccatcggtctagaacc

SEQ ID NO: 120966 - DNA, 25 bp, Homo sapien
tcgtcacgctcgcatctatagataa

SEQ ID NO: 120967 - DNA, 25 bp, Homo sapien
atctatagataacggctctccagac

SEQ ID NO: 120968 - DNA, 25 bp, Homo sapien
ttttctataggataattgctgggtt

SEQ ID NO: 120969 - DNA, 25 bp, Homo sapien
aattgctgggttataaaatcttagg

SEQ ID NO: 120970 - DNA, 25 bp, Homo sapien
aaatcttaggtttgcttatgcccag

SEQ ID NO: 120971 - DNA, 25 bp, Homo sapien
ttatgcccagtagctcctgcggagg

SEQ ID NO: 120972 - DNA, 25 bp, Homo sapien
gcccagtagctcctgcggaggctta

SEQ ID NO: 120973 - DNA, 25 bp, Homo sapien
gcggaggcttaataataggcaattt

SEQ ID NO: 120974 - DNA, 25 bp, Homo sapien
ggcaattttgaatttgttcaaacct

SEQ ID NO: 120975 - DNA, 25 bp, Homo sapien
aacctgtaatggcttgtaaacaaag

SEQ ID NO: 120976 - DNA, 25 bp, Homo sapien
ggcttgtaaacaaagatgaccatca

SEQ ID NO: 120977 - DNA, 25 bp, Homo sapien
gctgtttctcacatctatagtgaca

SEQ ID NO: 120978 - DNA, 25 bp, Homo sapien
gtctgagatgggtgctgcaaagatc

SEQ ID NO: 120979 - DNA, 25 bp, Homo sapien
gattattaccaaaagcagcagggct

SEQ ID NO: 120980 - DNA, 25 bp, Homo sapien
gcttgccaaacaaccaagaaggtgt

SEQ ID NO: 120981 - DNA, 25 bp, Homo sapien
gaaggtgtcccgattagagtgcaga

SEQ ID NO: 120982 - DNA, 25 bp, Homo sapien
aagcggcggaaatactctttcgaat

SEQ ID NO: 120983 - DNA, 25 bp, Homo sapien
tactctttcgaatgcactgacggct

SEQ ID NO: 120984 - DNA, 25 bp, Homo sapien
tgacggctcctcctttgtggacgag

SEQ ID NO: 120985 - DNA, 25 bp, Homo sapien
ctcctttgtggacgaggttgagaaa

SEQ ID NO: 120986 - DNA, 25 bp, Homo sapien
cggctgtacgaggtgtgtgtcctaa

SEQ ID NO: 120987 - DNA, 25 bp, Homo sapien
gtgtgtgtcctaaacacactcccgg

SEQ ID NO: 120988 - DNA, 25 bp, Homo sapien
tcccggcagctctgtctttggaaaa

SEQ ID NO: 120989 - DNA, 25 bp, Homo sapien
tgtatacttcttgaccatgtgggac

SEQ ID NO: 120990 - DNA, 25 bp, Homo sapien
aagacatctgttctggatttttgat

SEQ ID NO: 120991 - DNA, 25 bp, Homo sapien
ggatttttgatgactaatacctgta

SEQ ID NO: 120992 - DNA, 25 bp, Homo sapien
tgatgactaatacctgtaatgcaga

SEQ ID NO: 120993 - DNA, 25 bp, Homo sapien
cctgtaatgcagaagacggagaact

SEQ ID NO: 120994 - DNA, 25 bp, Homo sapien
gaagacggcagagaacaggaaatca

SEQ ID NO: 120995 - DNA, 25 bp, Homo sapien
ggttctctcaaaatgattcactttg

SEQ ID NO: 120996 - DNA, 25 bp, Homo sapien
ttcactttggtctggtgtaaacatt

SEQ ID NO: 120997 - DNA, 25 bp, Homo sapien
gaaaactgccttcttcatatctaaa

SEQ ID NO: 120998 - DNA, 25 bp, Homo sapien
actgccttcttcatatctaaacttt

SEQ ID NO: 120999 - DNA, 25 bp, Homo sapien
atctaaacttttcatggcctgatac

SEQ ID NO: 121000 - DNA, 25 bp, Homo sapien
ggcctgatacagacttaaaatcccc

SEQ ID NO: 121001 - DNA, 25 bp, Homo sapien
cagtatattggagaatcgcaaggat

SEQ ID NO: 121002 - DNA, 25 bp, Homo sapien
gagaatcgcaaggatatgatatcat

SEQ ID NO: 121003 - DNA, 25 bp, Homo sapien
gatatgatatcatggaaccagcagc

SEQ ID NO: 121004 - DNA, 25 bp, Homo sapien
gatatcatggaaccagcagcaaaga

SEQ ID NO: 121005 - DNA, 25 bp, Homo sapien
ggaaccagcagcaaagaagtgctat

SEQ ID NO: 121006 - DNA, 25 bp, Homo sapien
gcagcaaagaagtgctatctggaaa

SEQ ID NO: 121007 - DNA, 25 bp, Homo sapien
aaattattcaggagttcctgtccaa

SEQ ID NO: 121008 - DNA, 25 bp, Homo sapien
ggagttcctgtccaaggtgaaacaa

SEQ ID NO: 121009 - DNA, 25 bp, Homo sapien
ggtgaaacaaatgccctttactgaa

SEQ ID NO: 121010 - DNA, 25 bp, Homo sapien
tgccctttactgaaatgtcagaaga

SEQ ID NO: 121011 - DNA, 25 bp, Homo sapien
catttcacgaataaaagttactacg

SEQ ID NO: 121012 - DNA, 25 bp, Homo sapien
agtcgaccaagaaattatcaacatt

SEQ ID NO: 121013 - DNA, 25 bp, Homo sapien
atcaacattatgcaggatcggctca

SEQ ID NO: 121014 - DNA, 25 bp, Homo sapien
attatgcaggatcggctcaaagcct

SEQ ID NO: 121015 - DNA, 25 bp, Homo sapien
tgcaggatcggctcaaagcctgtca

SEQ ID NO: 121016 - DNA, 25 bp, Homo sapien
aggatcggctcaaagcctgtcagca

SEQ ID NO: 121017 - DNA, 25 bp, Homo sapien
tcggctcaaagcctgtcagcagagg

SEQ ID NO: 121018 - DNA, 25 bp, Homo sapien
gctcaaagcctgtcagcagagggaa

SEQ ID NO: 121019 - DNA, 25 bp, Homo sapien
agcagagggaaggacagaactacca

SEQ ID NO: 121020 - DNA, 25 bp, Homo sapien
gtggccaaggcctaccaggaccgct

SEQ ID NO: 121021 - DNA, 25 bp, Homo sapien
aggcctaccaggaccgctatcagga

SEQ ID NO: 121022 - DNA, 25 bp, Homo sapien
accaggaccgctatcaggacctggg

SEQ ID NO: 121023 - DNA, 25 bp, Homo sapien
ggtttggacaactttgattctcagt

SEQ ID NO: 121024 - DNA, 25 bp, Homo sapien
gtttactaatgaacctgtccagctc

SEQ ID NO: 121025 - DNA, 25 bp, Homo sapien
tccagctcactccagatgacgatga

SEQ ID NO: 121026 - DNA, 25 bp, Homo sapien
gaaggttttgagtatatcaatcctc

SEQ ID NO: 121027 - DNA, 25 bp, Homo sapien
tatcaatcctcttttgatgtctgca

SEQ ID NO: 121028 - DNA, 25 bp, Homo sapien
gaatgtgtctgatcctcatttttca

SEQ ID NO: 121029 - DNA, 25 bp, Homo sapien
atgtattctactcatgttgccattt

SEQ ID NO: 121030 - DNA, 25 bp, Homo sapien
gcatggataaacttgctgcaagcct

SEQ ID NO: 121031 - DNA, 25 bp, Homo sapien
aacttgctgcaagcctggatacaat

SEQ ID NO: 121032 - DNA, 25 bp, Homo sapien
gcctggatacaattaaccattttat

SEQ ID NO: 121033 - DNA, 25 bp, Homo sapien
acacccaatatcttctcttgtagac

SEQ ID NO: 121034 - DNA, 25 bp, Homo sapien
tgttcctaagcccataacttgcctg

SEQ ID NO: 121035 - DNA, 25 bp, Homo sapien
aagcccataacttgcctgtttgaac

SEQ ID NO: 121036 - DNA, 25 bp, Homo sapien
aacttgcctgtttgaactatggtaa

SEQ ID NO: 121037 - DNA, 25 bp, Homo sapien
gaggagttcaccagtttcaaagatc

SEQ ID NO: 121038 - DNA, 25 bp, Homo sapien
gtatcaaaagtacctttgcccttag

SEQ ID NO: 121039 - DNA, 25 bp, Homo sapien
gtacctttgcccttaggaagagtga

SEQ ID NO: 121040 - DNA, 25 bp, Homo sapien
gtgagtattggagtcatcttatata

SEQ ID NO: 121041 - DNA, 25 bp, Homo sapien
ttatatattactccaaacctccctt

SEQ ID NO: 121042 - DNA, 25 bp, Homo sapien
tccctttttatttcttgagcctggc

SEQ ID NO: 121043 - DNA, 25 bp, Homo sapien
tgagcctggcttggaccttggcatt

SEQ ID NO: 121044 - DNA, 25 bp, Homo sapien
ggcattccgtttgaattccttctaa

SEQ ID NO: 121045 - DNA, 25 bp, Homo sapien
ttctcctttattgatctctgctttt

SEQ ID NO: 121046 - DNA, 25 bp, Homo sapien
ctcctttattgatctctgcttttaa

SEQ ID NO: 121047 - DNA, 25 bp, Homo sapien
tcctttattgatctctgcttttaat

SEQ ID NO: 121048 - DNA, 25 bp, Homo sapien
ctctgcttttaatacaccacttctt

SEQ ID NO: 121049 - DNA, 25 bp, Homo sapien
ctgcttttaatacaccacttctttc

SEQ ID NO: 121050 - DNA, 25 bp, Homo sapien
gcttttaatacaccacttctttctt

SEQ ID NO: 121051 - DNA, 25 bp, Homo sapien
tctttctgcctttttatggatgtct

SEQ ID NO: 121052 - DNA, 25 bp, Homo sapien
ggctctggttctccagttctttccg

SEQ ID NO: 121053 - DNA, 25 bp, Homo sapien
tggttctccagttctttccgtctct

SEQ ID NO: 121054 - DNA, 25 bp, Homo sapien
gttctccagttctttccgtctctgc

SEQ ID NO: 121055 - DNA, 25 bp, Homo sapien
gttgagtgcatggatctgtttcttt

SEQ ID NO: 121056 - DNA, 25 bp, Homo sapien
tcaccgccgctcttgcctggtgagg

SEQ ID NO: 121057 - DNA, 25 bp, Homo sapien
gccgctcttgcctggtgaggcctct

SEQ ID NO: 121058 - DNA, 25 bp, Homo sapien
ctctgatgaatgatgaaggcctgaa

SEQ ID NO: 121059 - DNA, 25 bp, Homo sapien
tgaaggcctgaaggtcagatacccc

SEQ ID NO: 121060 - DNA, 25 bp, Homo sapien
cggccaagatgacccagcactgagg

SEQ ID NO: 121061 - DNA, 25 bp, Homo sapien
caagatgacccagcactgaggaggg

SEQ ID NO: 121062 - DNA, 25 bp, Homo sapien
tggccatactgtgtcccatcggagt

SEQ ID NO: 121063 - DNA, 25 bp, Homo sapien
atactgtgtcccatcggagtgcgga

SEQ ID NO: 121064 - DNA, 25 bp, Homo sapien
tgtgtcccatcggagtgcggaccac

SEQ ID NO: 121065 - DNA, 25 bp, Homo sapien
atcggagtgcggaccaccctcactg

SEQ ID NO: 121066 - DNA, 25 bp, Homo sapien
tggccctggagaatcgctcctgcag

SEQ ID NO: 121067 - DNA, 25 bp, Homo sapien
tggtggcgaccatggagaggaaact

SEQ ID NO: 121068 - DNA, 25 bp, Homo sapien
atggagctgaaagcctggcggccca

SEQ ID NO: 121069 - DNA, 25 bp, Homo sapien
ccagagagaggtccaccccaagcag

SEQ ID NO: 121070 - DNA, 25 bp, Homo sapien
gagagaggtccaccccaagcagcct

SEQ ID NO: 121071 - DNA, 25 bp, Homo sapien
aatgtcagcgccacactggtgtctg

SEQ ID NO: 121072 - DNA, 25 bp, Homo sapien
tgtcagcgccacactggtgtctgaa

SEQ ID NO: 121073 - DNA, 25 bp, Homo sapien
tcagcgccacactggtgtctgaaag

SEQ ID NO: 121074 - DNA, 25 bp, Homo sapien
ggagaacaggacagactaacttttt

SEQ ID NO: 121075 - DNA, 25 bp, Homo sapien
acaggacagactaactttttaaatg

SEQ ID NO: 121076 - DNA, 25 bp, Homo sapien
atcagaggtgaaaattgtacattgg

SEQ ID NO: 121077 - DNA, 25 bp, Homo sapien
ataaagattttctcagtggtctaga

SEQ ID NO: 121078 - DNA, 25 bp, Homo sapien
tctttggacactggattatgaggaa

SEQ ID NO: 121079 - DNA, 25 bp, Homo sapien
gacactggattatgaggaatggata

SEQ ID NO: 121080 - DNA, 25 bp, Homo sapien
tggataaatggatgagctagggctc

SEQ ID NO: 121081 - DNA, 25 bp, Homo sapien
agcaccctccaggacaggagatctg

SEQ ID NO: 121082 - DNA, 25 bp, Homo sapien
gagatctgggatgcctggctgctgg

SEQ ID NO: 121083 - DNA, 25 bp, Homo sapien
ggctgctggagtacatgtgttcaca

SEQ ID NO: 121084 - DNA, 25 bp, Homo sapien
gtgttcacaagggttactcctcaaa

SEQ ID NO: 121085 - DNA, 25 bp, Homo sapien
tcatgtccccaactcaaggctagaa

SEQ ID NO: 121086 - DNA, 25 bp, Homo sapien
tccccaactcaaggctagaaaacag

SEQ ID NO: 121087 - DNA, 25 bp, Homo sapien
ataatgttctgctgcgtccccaccg

SEQ ID NO: 121088 - DNA, 25 bp, Homo sapien
gtctcagggagcaggtcacaggtca

SEQ ID NO: 121089 - DNA, 25 bp, Homo sapien
gcagggcaaggagactccgctcact

SEQ ID NO: 121090 - DNA, 25 bp, Homo sapien
gacccttcttcagagataatgacat

SEQ ID NO: 121091 - DNA, 25 bp, Homo sapien
gacattttatcttctccttttgatg

SEQ ID NO: 121092 - DNA, 25 bp, Homo sapien
aaactgtcactttagcatgtaatcc

SEQ ID NO: 121093 - DNA, 25 bp, Homo sapien
atccattacagaatcccatgcagtg

SEQ ID NO: 121094 - DNA, 25 bp, Homo sapien
tatttgctatcgacattcccgtata

SEQ ID NO: 121095 - DNA, 25 bp, Homo sapien
atcgacattcccgtataaagagaga

SEQ ID NO: 121096 - DNA, 25 bp, Homo sapien
aagagagagacatatcacgctgctg

SEQ ID NO: 121097 - DNA, 25 bp, Homo sapien
gacatatcacgctgctgtcatgatt

SEQ ID NO: 121098 - DNA, 25 bp, Homo sapien
cgctgctgtcatgattttgtgtcaa

SEQ ID NO: 121099 - DNA, 25 bp, Homo sapien
gattttgtgtcaagatgatccaata

SEQ ID NO: 121100 - DNA, 25 bp, Homo sapien
gagactgcctgcctttcaccatttt

SEQ ID NO: 121101 - DNA, 25 bp, Homo sapien
attttctccccacttccagtgactg

SEQ ID NO: 121102 - DNA, 25 bp, Homo sapien
tgtaccataagccaacaaccgctga

SEQ ID NO: 121103 - DNA, 25 bp, Homo sapien
aaccgctgactccaggattgcataa

SEQ ID NO: 121104 - DNA, 25 bp, Homo sapien
aaatcggtgctgtactgcataccct

SEQ ID NO: 121105 - DNA, 25 bp, Homo sapien
ctgccagctgtgacttgttatccta

SEQ ID NO: 121106 - DNA, 25 bp, Homo sapien
gctgtgacttgttatcctactatat

SEQ ID NO: 121107 - DNA, 25 bp, Homo sapien
atattgtccgagtaactaacttatt

SEQ ID NO: 121108 - DNA, 25 bp, Homo sapien
atttccttctgtgggcattgactgt

SEQ ID NO: 121109 - DNA, 25 bp, Homo sapien
gcattgactgtatcccacctgtttt

SEQ ID NO: 121110 - DNA, 25 bp, Homo sapien
aatggtaacctgtttctgagaacac

SEQ ID NO: 121111 - DNA, 25 bp, Homo sapien
attcagttttatgtctccatgcaaa

SEQ ID NO: 121112 - DNA, 25 bp, Homo sapien
aaacattcaaagtgcttccatcaga

SEQ ID NO: 121113 - DNA, 25 bp, Homo sapien
aagtgcttccatcagaacggagtaa

SEQ ID NO: 121114 - DNA, 25 bp, Homo sapien
aatactaaacacctctgaagactgc

SEQ ID NO: 121115 - DNA, 25 bp, Homo sapien
cctctgaagactgcaaactggatta

SEQ ID NO: 121116 - DNA, 25 bp, Homo sapien
ggattagttcttttacttcagtgtt

SEQ ID NO: 121117 - DNA, 25 bp, Homo sapien
gcagatgtatgtatgcatggttata

SEQ ID NO: 121118 - DNA, 25 bp, Homo sapien
tttgttaacatgtacaatttcctga

SEQ ID NO: 121119 - DNA, 25 bp, Homo sapien
gataacagtacacgtgttctgcttg

SEQ ID NO: 121120 - DNA, 25 bp, Homo sapien
acacgtgttctgcttgaatttacta

SEQ ID NO: 121121 - DNA, 25 bp, Homo sapien
gaatttactaaattctactactggg

SEQ ID NO: 121122 - DNA, 25 bp, Homo sapien
cgtgcacgacgctgcccgggagggc

SEQ ID NO: 121123 - DNA, 25 bp, Homo sapien
gaggagctgggccatcgcgatgtcg

SEQ ID NO: 121124 - DNA, 25 bp, Homo sapien
tgggccatcgcgatgtcgcacggta

SEQ ID NO: 121125 - DNA, 25 bp, Homo sapien
atcgcgatgtcgcacggtacctgcg

SEQ ID NO: 121126 - DNA, 25 bp, Homo sapien
aggcagtaaccatgcccgcatagat

SEQ ID NO: 121127 - DNA, 25 bp, Homo sapien
ggcagtaaccatgcccgcatagatg

SEQ ID NO: 121128 - DNA, 25 bp, Homo sapien
aaggtccctcagacatccccgattg

SEQ ID NO: 121129 - DNA, 25 bp, Homo sapien
tccctcagacatccccgattgaaag

SEQ ID NO: 121130 - DNA, 25 bp, Homo sapien
gacatccccgattgaaagaaccaga

SEQ ID NO: 121131 - DNA, 25 bp, Homo sapien
atccccgattgaaagaaccagagag

SEQ ID NO: 121132 - DNA, 25 bp, Homo sapien
cccgattgaaagaaccagagaggct

SEQ ID NO: 121133 - DNA, 25 bp, Homo sapien
agagttttctgtgaacaaacctgtc

SEQ ID NO: 121134 - DNA, 25 bp, Homo sapien
acaaacctgtcataggaagtctgaa

SEQ ID NO: 121135 - DNA, 25 bp, Homo sapien
gaagtctgaaatcgaagctctagtg

SEQ ID NO: 121136 - DNA, 25 bp, Homo sapien
tcgaagctctagtgggactggcaca

SEQ ID NO: 121137 - DNA, 25 bp, Homo sapien
ggaactaatcagacgtggacctcaa

SEQ ID NO: 121138 - DNA, 25 bp, Homo sapien
gtggacctcaacttctgattccaga

SEQ ID NO: 121139 - DNA, 25 bp, Homo sapien
acctgtgcgcctaaactgctgattg

SEQ ID NO: 121140 - DNA, 25 bp, Homo sapien
aaactgctgattggcctcaacttgc

SEQ ID NO: 121141 - DNA, 25 bp, Homo sapien
ctcaacttgcccaggcggacgggag

SEQ ID NO: 121142 - DNA, 25 bp, Homo sapien
cggctggacctaatctgggatcgcg

SEQ ID NO: 121143 - DNA, 25 bp, Homo sapien
gacctaatctgggatcgcggtgatt

SEQ ID NO: 121144 - DNA, 25 bp, Homo sapien
ctgctgccactgacaaccgctatat

SEQ ID NO: 121145 - DNA, 25 bp, Homo sapien
actgacaaccgctatatccgcgcgg

SEQ ID NO: 121146 - DNA, 25 bp, Homo sapien
acaaccgctatatccgcgcggtggg

SEQ ID NO: 121147 - DNA, 25 bp, Homo sapien
tctaggcttctcacccatgaaccgc

SEQ ID NO: 121148 - DNA, 25 bp, Homo sapien
acccatgaaccgcacacctgtgctg

SEQ ID NO: 121149 - DNA, 25 bp, Homo sapien
acacctgtgctgctgcacgaccacg

SEQ ID NO: 121150 - DNA, 25 bp, Homo sapien
atgaacggctgcatgaggctgtgtt

SEQ ID NO: 121151 - DNA, 25 bp, Homo sapien
gaacggctgcatgaggctgtgttcc

SEQ ID NO: 121152 - DNA, 25 bp, Homo sapien
gggtggacatatatacacgcctgct

SEQ ID NO: 121153 - DNA, 25 bp, Homo sapien
tggacatatatacacgcctgctgcc

SEQ ID NO: 121154 - DNA, 25 bp, Homo sapien
gacatatatacacgcctgctgcctg

SEQ ID NO: 121155 - DNA, 25 bp, Homo sapien
aaacgacaacaatactgctagcttt

SEQ ID NO: 121156 - DNA, 25 bp, Homo sapien
acaatactgctagctttcaggatga

SEQ ID NO: 121157 - DNA, 25 bp, Homo sapien
tgctagctttcaggatgatttttaa

SEQ ID NO: 121158 - DNA, 25 bp, Homo sapien
gattcaaatgtgttatcctctctct

SEQ ID NO: 121159 - DNA, 25 bp, Homo sapien
ttcaaatgtgttatcctctctctga

SEQ ID NO: 121160 - DNA, 25 bp, Homo sapien
ctctctctgaaacgcttcctataac

SEQ ID NO: 121161 - DNA, 25 bp, Homo sapien
gcttcctataactcgagtttatagg

SEQ ID NO: 121162 - DNA, 25 bp, Homo sapien
ggaagaaaaagctattgtttacaat

SEQ ID NO: 121163 - DNA, 25 bp, Homo sapien
attgtttacaattatatcaccatta

SEQ ID NO: 121164 - DNA, 25 bp, Homo sapien
taaggcaactgctacaccctgcttt

SEQ ID NO: 121165 - DNA, 25 bp, Homo sapien
ctgctacaccctgctttgtattctg

SEQ ID NO: 121166 - DNA, 25 bp, Homo sapien
accccgtctctacaataaatagcaa

SEQ ID NO: 121167 - DNA, 25 bp, Homo sapien
ccccgtctctacaataaatagcaaa

SEQ ID NO: 121168 - DNA, 25 bp, Homo sapien
attatcctggcggagttatgcacgc

SEQ ID NO: 121169 - DNA, 25 bp, Homo sapien
ttatcctggcggagttatgcacgct

SEQ ID NO: 121170 - DNA, 25 bp, Homo sapien
tatcctggcggagttatgcacgctt

SEQ ID NO: 121171 - DNA, 25 bp, Homo sapien
atcctggcggagttatgcacgcttg

SEQ ID NO: 121172 - DNA, 25 bp, Homo sapien
tcctggcggagttatgcacgcttgt

SEQ ID NO: 121173 - DNA, 25 bp, Homo sapien
cctggcggagttatgcacgcttgta

SEQ ID NO: 121174 - DNA, 25 bp, Homo sapien
ctggcggagttatgcacgcttgtag

SEQ ID NO: 121175 - DNA, 25 bp, Homo sapien
tggcggagttatgcacgcttgtagt

SEQ ID NO: 121176 - DNA, 25 bp, Homo sapien
cggagttatgcacgcttgtagtccc

SEQ ID NO: 121177 - DNA, 25 bp, Homo sapien
gtcaacttctccaagatgaggatga

SEQ ID NO: 121178 - DNA, 25 bp, Homo sapien
gatgatatcccatattatccgagag

SEQ ID NO: 121179 - DNA, 25 bp, Homo sapien
cgagagattcgccagtttcaacaaa

SEQ ID NO: 121180 - DNA, 25 bp, Homo sapien
gagcaccaagcaaaggtaacgcaat

SEQ ID NO: 121181 - DNA, 25 bp, Homo sapien
taacgcaatatttactggaccaatc

SEQ ID NO: 121182 - DNA, 25 bp, Homo sapien
aagaaagcctctacgagtcttctct

SEQ ID NO: 121183 - DNA, 25 bp, Homo sapien
cgagtcttctctccgaatagaacca

SEQ ID NO: 121184 - DNA, 25 bp, Homo sapien
ggacatgtgctagatgatactgtac

SEQ ID NO: 121185 - DNA, 25 bp, Homo sapien
gatactgtacatattcgtttggttt

SEQ ID NO: 121186 - DNA, 25 bp, Homo sapien
tattcgtttggtttcactggatttt

SEQ ID NO: 121187 - DNA, 25 bp, Homo sapien
cttcttcagtatgtgcttctccaag

SEQ ID NO: 121188 - DNA, 25 bp, Homo sapien
aatattgagcagatctataggaaga

SEQ ID NO: 121189 - DNA, 25 bp, Homo sapien
gaagattgaacctgaatattgccat

SEQ ID NO: 121190 - DNA, 25 bp, Homo sapien
gaacctgaatattgccattatgctt

SEQ ID NO: 121191 - DNA, 25 bp, Homo sapien
gaatattgccattatgcttgacatg

SEQ ID NO: 121192 - DNA, 25 bp, Homo sapien
tgccattatgcttgacatggtttcc

SEQ ID NO: 121193 - DNA, 25 bp, Homo sapien
ctccacatacttcagtgagggtaag

SEQ ID NO: 121194 - DNA, 25 bp, Homo sapien
gggtaagtattttcctgttgtcaag

SEQ ID NO: 121195 - DNA, 25 bp, Homo sapien
gtattttcctgttgtcaagaatagc

SEQ ID NO: 121196 - DNA, 25 bp, Homo sapien
ttcctgttgtcaagaatagcattgt

SEQ ID NO: 121197 - DNA, 25 bp, Homo sapien
atagcattgtaaaagcattttgtaa

SEQ ID NO: 121198 - DNA, 25 bp, Homo sapien
gctttaatgatatgcttgtaactaa

SEQ ID NO: 121199 - DNA, 25 bp, Homo sapien
tgttggatatctgtcatgcactatt

SEQ ID NO: 121200 - DNA, 25 bp, Homo sapien
ggatatctgtcatgcactattttca

SEQ ID NO: 121201 - DNA, 25 bp, Homo sapien
tctgtcatgcactattttcagttga

SEQ ID NO: 121202 - DNA, 25 bp, Homo sapien
gtcatgcactattttcagttgacaa

SEQ ID NO: 121203 - DNA, 25 bp, Homo sapien
cagtcatggttattattgcacttta

SEQ ID NO: 121204 - DNA, 25 bp, Homo sapien
ggttattattgcactttatcctgaa

SEQ ID NO: 121205 - DNA, 25 bp, Homo sapien
attgggttttggttcagtgattctc

SEQ ID NO: 121206 - DNA, 25 bp, Homo sapien
tttggttcagtgattctcaagaaaa

SEQ ID NO: 121207 - DNA, 25 bp, Homo sapien
gaaaaagatctcttgcccattaaga

SEQ ID NO: 121208 - DNA, 25 bp, Homo sapien
gatctcttgcccattaagaagtgta

SEQ ID NO: 121209 - DNA, 25 bp, Homo sapien
gaatctattgttttgcaatataggt

SEQ ID NO: 121210 - DNA, 25 bp, Homo sapien
gtggaggaaactaaacattcccttg

SEQ ID NO: 121211 - DNA, 25 bp, Homo sapien
gaaactaaacattcccttgatggtc

SEQ ID NO: 121212 - DNA, 25 bp, Homo sapien
ctaaacattcccttgatggtctcaa

SEQ ID NO: 121213 - DNA, 25 bp, Homo sapien
acattcccttgatggtctcaagcta

SEQ ID NO: 121214 - DNA, 25 bp, Homo sapien
gatggtctcaagctatgatcagaag

SEQ ID NO: 121215 - DNA, 25 bp, Homo sapien
tctcaagctatgatcagaagacttt

SEQ ID NO: 121216 - DNA, 25 bp, Homo sapien
atatattttcatcctataagcttaa

SEQ ID NO: 121217 - DNA, 25 bp, Homo sapien
tcttcaacaggattacagtgtagct

SEQ ID NO: 121218 - DNA, 25 bp, Homo sapien
tcaacaggattacagtgtagctacc

SEQ ID NO: 121219 - DNA, 25 bp, Homo sapien
ctacatgctgaaaaatatagccttt

SEQ ID NO: 121220 - DNA, 25 bp, Homo sapien
ccctatacaagttgttctagtaaca

SEQ ID NO: 121221 - DNA, 25 bp, Homo sapien
acttctgccccaagggtggtcactg

SEQ ID NO: 121222 - DNA, 25 bp, Homo sapien
tgccccaagggtggtcactgcctgt

SEQ ID NO: 121223 - DNA, 25 bp, Homo sapien
tgcctgtgatacattcctcagtgtc

SEQ ID NO: 121224 - DNA, 25 bp, Homo sapien
tgtgatacattcctcagtgtcgcct

SEQ ID NO: 121225 - DNA, 25 bp, Homo sapien
tacattcctcagtgtcgcctctgag

SEQ ID NO: 121226 - DNA, 25 bp, Homo sapien
aggcctcctgccacaaagactgggc

SEQ ID NO: 121227 - DNA, 25 bp, Homo sapien
tgccacaaagactgggccgagagat

SEQ ID NO: 121228 - DNA, 25 bp, Homo sapien
gtgcgcctcctgtttgggtttcttc

SEQ ID NO: 121229 - DNA, 25 bp, Homo sapien
gggtttctctgtagtgtctgctgcc

SEQ ID NO: 121230 - DNA, 25 bp, Homo sapien
gtttctctgtagtgtctgctgccct

SEQ ID NO: 121231 - DNA, 25 bp, Homo sapien
tcagttgtgtctgacagagcattag

SEQ ID NO: 121232 - DNA, 25 bp, Homo sapien
tgtaattgtgcctcagactttttga

SEQ ID NO: 121233 - DNA, 25 bp, Homo sapien
attgtgcctcagactttttgaaagt

SEQ ID NO: 121234 - DNA, 25 bp, Homo sapien
tctaccttctaaattgccccgacga

SEQ ID NO: 121235 - DNA, 25 bp, Homo sapien
taaattgccccgacgatctagattc

SEQ ID NO: 121236 - DNA, 25 bp, Homo sapien
gccccgacgatctagattctacatg

SEQ ID NO: 121237 - DNA, 25 bp, Homo sapien
gattctacatgttaccattggttta

SEQ ID NO: 121238 - DNA, 25 bp, Homo sapien
aaaactttggctgtactaagcaaat

SEQ ID NO: 121239 - DNA, 25 bp, Homo sapien
ggctgtactaagcaaatgcaaggtt

SEQ ID NO: 121240 - DNA, 25 bp, Homo sapien
gtttacagacaattctgatgattat

SEQ ID NO: 121241 - DNA, 25 bp, Homo sapien
ataaagcctgtgagtcaagcatcaa

SEQ ID NO: 121242 - DNA, 25 bp, Homo sapien
gtgagtcaagcatcaagtggtgttt

SEQ ID NO: 121243 - DNA, 25 bp, Homo sapien
gctggatggacaccgccttgcactg

SEQ ID NO: 121244 - DNA, 25 bp, Homo sapien
acaccgccttgcactgttggattct

SEQ ID NO: 121245 - DNA, 25 bp, Homo sapien
gttggattctgggtatgacatactc

SEQ ID NO: 121246 - DNA, 25 bp, Homo sapien
gggtatgacatactcgcagcagtgt

SEQ ID NO: 121247 - DNA, 25 bp, Homo sapien
gacatactcgcagcagtgttactgg

SEQ ID NO: 121248 - DNA, 25 bp, Homo sapien
ctcgcagcagtgttactggaactat

SEQ ID NO: 121249 - DNA, 25 bp, Homo sapien
ctttgggtggtaatgactacggagc

SEQ ID NO: 121250 - DNA, 25 bp, Homo sapien
taatgactacggagctaaagttggg

SEQ ID NO: 121251 - DNA, 25 bp, Homo sapien
atgtcaaagaacacctttcaccacc

SEQ ID NO: 121252 - DNA, 25 bp, Homo sapien
ctttcaccacctgtcagtaaacggg

SEQ ID NO: 121253 - DNA, 25 bp, Homo sapien
taatggacgaaggaacaacacacac

SEQ ID NO: 121254 - DNA, 25 bp, Homo sapien
gcaaggaatatttctccaaacacaa

SEQ ID NO: 121255 - DNA, 25 bp, Homo sapien
caaggaatatttctccaaacacaat

SEQ ID NO: 121256 - DNA, 25 bp, Homo sapien
acctgggtgccctatgctgacccag

SEQ ID NO: 121257 - DNA, 25 bp, Homo sapien
cctgggtgccctatgctgacccagg

SEQ ID NO: 121258 - DNA, 25 bp, Homo sapien
ctgggtgccctatgctgacccagga

SEQ ID NO: 121259 - DNA, 25 bp, Homo sapien
tgggtgccctatgctgacccaggaa

SEQ ID NO: 121260 - DNA, 25 bp, Homo sapien
gggtgccctatgctgacccaggaaa

SEQ ID NO: 121261 - DNA, 25 bp, Homo sapien
ggtgccctatgctgacccaggaaag

SEQ ID NO: 121262 - DNA, 25 bp, Homo sapien
gtgccctatgctgacccaggaaagg

SEQ ID NO: 121263 - DNA, 25 bp, Homo sapien
tatgcactttccctagaaagccata

SEQ ID NO: 121264 - DNA, 25 bp, Homo sapien
gaaagccatattccagcagtgaaac

SEQ ID NO: 121265 - DNA, 25 bp, Homo sapien
attccagcagtgaaacttgtgctat

SEQ ID NO: 121266 - DNA, 25 bp, Homo sapien
gtgctatagtgtataccacctgtac

SEQ ID NO: 121267 - DNA, 25 bp, Homo sapien
acatacattgtataggccatctgta

SEQ ID NO: 121268 - DNA, 25 bp, Homo sapien
gaacaatcactattcttaagcactt

SEQ ID NO: 121269 - DNA, 25 bp, Homo sapien
aactttttcaatggttgggacaatg

SEQ ID NO: 121270 - DNA, 25 bp, Homo sapien
tggcaataggacaaaacgggttact

SEQ ID NO: 121271 - DNA, 25 bp, Homo sapien
acgggttactaagatgaaattgcca

SEQ ID NO: 121272 - DNA, 25 bp, Homo sapien
gaatgatatctttgacctcaatgga

SEQ ID NO: 121273 - DNA, 25 bp, Homo sapien
gaggtttgcaaagactgagtgttca

SEQ ID NO: 121274 - DNA, 25 bp, Homo sapien
gggaaggaccaacccatgccctgcc

SEQ ID NO: 121275 - DNA, 25 bp, Homo sapien
aggtggccgtcggttgaccttctga

SEQ ID NO: 121276 - DNA, 25 bp, Homo sapien
ccgtcggttgaccttctgaacatga

SEQ ID NO: 121277 - DNA, 25 bp, Homo sapien
cggttgaccttctgaacatgagtgt

SEQ ID NO: 121278 - DNA, 25 bp, Homo sapien
accttctgaacatgagtgtcaactc

SEQ ID NO: 121279 - DNA, 25 bp, Homo sapien
gtgtcaactccaggacttgcttcca

SEQ ID NO: 121280 - DNA, 25 bp, Homo sapien
tcaactccaggacttgcttccaagc

SEQ ID NO: 121281 - DNA, 25 bp, Homo sapien
cttccctctgttggaaattgggtgt

SEQ ID NO: 121282 - DNA, 25 bp, Homo sapien
ctctgttggaaattgggtgtgccct

SEQ ID NO: 121283 - DNA, 25 bp, Homo sapien
ttggaaattgggtgtgccctggctc

SEQ ID NO: 121284 - DNA, 25 bp, Homo sapien
gaaattgggtgtgccctggctccca

SEQ ID NO: 121285 - DNA, 25 bp, Homo sapien
gcctcgtgaccaaacgccagatgaa

SEQ ID NO: 121286 - DNA, 25 bp, Homo sapien
tgatcgtcagaattatcgggcactt

SEQ ID NO: 121287 - DNA, 25 bp, Homo sapien
atcgggcacttctttgctagccaga

SEQ ID NO: 121288 - DNA, 25 bp, Homo sapien
tagccagactgcacagcgcaagatc

SEQ ID NO: 121289 - DNA, 25 bp, Homo sapien
agaaataccctcagggagtcgcctc

SEQ ID NO: 121290 - DNA, 25 bp, Homo sapien
agtcgcctcacagcgcagcaagtga

SEQ ID NO: 121291 - DNA, 25 bp, Homo sapien
caggcaccagcaaaacaacggatga

SEQ ID NO: 121292 - DNA, 25 bp, Homo sapien
acggatgaatgtagcccttccaaca

SEQ ID NO: 121293 - DNA, 25 bp, Homo sapien
gaatgagaccaaacgcagccagcca

SEQ ID NO: 121294 - DNA, 25 bp, Homo sapien
gcagccagccagatcgggagcaaac

SEQ ID NO: 121295 - DNA, 25 bp, Homo sapien
tcgggagcaaaccaaagaccatctg

SEQ ID NO: 121296 - DNA, 25 bp, Homo sapien
ttctcctttattgatctctgctttt

SEQ ID NO: 121297 - DNA, 25 bp, Homo sapien
tctcctttattgatctctgctttta

SEQ ID NO: 121298 - DNA, 25 bp, Homo sapien
ctcctttattgatctctgcttttaa

SEQ ID NO: 121299 - DNA, 25 bp, Homo sapien
tcctttattgatctctgcttttaat

SEQ ID NO: 121300 - DNA, 25 bp, Homo sapien
ctctgcttttaatacaccacttctt

SEQ ID NO: 121301 - DNA, 25 bp, Homo sapien
ctgcttttaatacaccacttctttc

SEQ ID NO: 121302 - DNA, 25 bp, Homo sapien
gcttttaatacaccacttctttctt

SEQ ID NO: 121303 - DNA, 25 bp, Homo sapien
ggctctggttctccagttctttccg

SEQ ID NO: 121304 - DNA, 25 bp, Homo sapien
tctggttctccagttctttccgtct

SEQ ID NO: 121305 - DNA, 25 bp, Homo sapien
tggttctccagttctttccgtctct

SEQ ID NO: 121306 - DNA, 25 bp, Homo sapien
gttctccagttctttccgtctctgc

SEQ ID NO: 121307 - DNA, 25 bp, Homo sapien
gaatgcagggtttcctgcctgacaa

SEQ ID NO: 121308 - DNA, 25 bp, Homo sapien
gggtttcctgcctgacaacccttct

SEQ ID NO: 121309 - DNA, 25 bp, Homo sapien
agtcccacttttgaacaagctgatg

SEQ ID NO: 121310 - DNA, 25 bp, Homo sapien
tgaaactggcccaatttcctaaaag

SEQ ID NO: 121311 - DNA, 25 bp, Homo sapien
gtgcttgagaaacctacatttggac

SEQ ID NO: 121312 - DNA, 25 bp, Homo sapien
tggacaatgagaggctgctcctgcg

SEQ ID NO: 121313 - DNA, 25 bp, Homo sapien
tcttccttggctcctgctttctttt

SEQ ID NO: 121314 - DNA, 25 bp, Homo sapien
agactatatcaacctacaactttag

SEQ ID NO: 121315 - DNA, 25 bp, Homo sapien
tcaacctacaactttagtcgggaag

SEQ ID NO: 121316 - DNA, 25 bp, Homo sapien
gggtggacctgagtttcgtctcctg

SEQ ID NO: 121317 - DNA, 25 bp, Homo sapien
tgagtttcgtctcctgtctctctgg

SEQ ID NO: 121318 - DNA, 25 bp, Homo sapien
tcagtgcccagatgattccctgggt

SEQ ID NO: 121319 - DNA, 25 bp, Homo sapien
ctggatcctggacagatggctcagt

SEQ ID NO: 121320 - DNA, 25 bp, Homo sapien
gatggctcagtaaactgtgggacta

SEQ ID NO: 121321 - DNA, 25 bp, Homo sapien
gggactaggtgcagacttttgcctt

SEQ ID NO: 121322 - DNA, 25 bp, Homo sapien
acttttgccttcttggagtcctggg

SEQ ID NO: 121323 - DNA, 25 bp, Homo sapien
tcttggagtcctgggtctcctctga

SEQ ID NO: 121324 - DNA, 25 bp, Homo sapien
agaggtctgggtggtgctcctccta

SEQ ID NO: 121325 - DNA, 25 bp, Homo sapien
ctacgcctctagaggtctctgtgtt

SEQ ID NO: 121326 - DNA, 25 bp, Homo sapien
tgttcctcattttccttcaaaagcg

SEQ ID NO: 121327 - DNA, 25 bp, Homo sapien
tcaaaagcgggctgtatttctcttc

SEQ ID NO: 121328 - DNA, 25 bp, Homo sapien
tgtatttctcttctaccttccagct

SEQ ID NO: 121329 - DNA, 25 bp, Homo sapien
gggtacagtgtaggaggtcttcttc

SEQ ID NO: 121330 - DNA, 25 bp, Homo sapien
gaggtcttcttcaagaggtcatgaa

SEQ ID NO: 121331 - DNA, 25 bp, Homo sapien
agaggtcatgaagtttgccaaggaa

SEQ ID NO: 121332 - DNA, 25 bp, Homo sapien
gtttgccaaggaacggcaaccagat

SEQ ID NO: 121333 - DNA, 25 bp, Homo sapien
gaaaggtggccaggaaacagttgct

SEQ ID NO: 121334 - DNA, 25 bp, Homo sapien
agttgctggactggctgctcgctaa

SEQ ID NO: 121335 - DNA, 25 bp, Homo sapien
gagctgatccttgactcctcttcat

SEQ ID NO: 121336 - DNA, 25 bp, Homo sapien
gccagtcaactgcacaatacacaac

SEQ ID NO: 121337 - DNA, 25 bp, Homo sapien
gtatttcccaatacacttgagcagt

SEQ ID NO: 121338 - DNA, 25 bp, Homo sapien
tacacttgagcagttgcctgtgaat

SEQ ID NO: 121339 - DNA, 25 bp, Homo sapien
gtaagaggtgtcaacaaactgggaa

SEQ ID NO: 121340 - DNA, 25 bp, Homo sapien
attgcatccttagccattgtcacaa

SEQ ID NO: 121341 - DNA, 25 bp, Homo sapien
gcatccttagccattgtcacaaaat

SEQ ID NO: 121342 - DNA, 25 bp, Homo sapien
gtcttgtgtcttatgttctctgtat

SEQ ID NO: 121343 - DNA, 25 bp, Homo sapien
gttctctgtatttatgcagctgatt

SEQ ID NO: 121344 - DNA, 25 bp, Homo sapien
gtgggtccaaggactcctaactact

SEQ ID NO: 121345 - DNA, 25 bp, Homo sapien
aggactcctaactactttgcatctg

SEQ ID NO: 121346 - DNA, 25 bp, Homo sapien
tttgcatctgtaatccacaaagatt

SEQ ID NO: 121347 - DNA, 25 bp, Homo sapien
cacaaagattctgggcagctgccac

SEQ ID NO: 121348 - DNA, 25 bp, Homo sapien
agattctgggcagctgccacctcag

SEQ ID NO: 121349 - DNA, 25 bp, Homo sapien
agtctcttctctgtattatcatagt

SEQ ID NO: 121350 - DNA, 25 bp, Homo sapien
tcttctctgtattatcatagtctgg

SEQ ID NO: 121351 - DNA, 25 bp, Homo sapien
atcgaatggatgtgggtgaccgccc

SEQ ID NO: 121352 - DNA, 25 bp, Homo sapien
gcccgaaggccttcacaggatggaa

SEQ ID NO: 121353 - DNA, 25 bp, Homo sapien
gtagaatgatttcagtagatactca

SEQ ID NO: 121354 - DNA, 25 bp, Homo sapien
gtttccagctttatcaaagacatgt

SEQ ID NO: 121355 - DNA, 25 bp, Homo sapien
agcatccaagtgagagctggtgaga

SEQ ID NO: 121356 - DNA, 25 bp, Homo sapien
agagctggtgagaccacgtgctgct

SEQ ID NO: 121357 - DNA, 25 bp, Homo sapien
accacgtgctgctggcgtagtgtag

SEQ ID NO: 121358 - DNA, 25 bp, Homo sapien
gtagtgtaggccagacattgacagt

SEQ ID NO: 121359 - DNA, 25 bp, Homo sapien
taggccagacattgacagtcctgac

SEQ ID NO: 121360 - DNA, 25 bp, Homo sapien
attgacagtcctgacgggagctcag

SEQ ID NO: 121361 - DNA, 25 bp, Homo sapien
gacggccccacgacagagggagtca

SEQ ID NO: 121362 - DNA, 25 bp, Homo sapien
gtctgggtgccagaactcaaggttc

SEQ ID NO: 121363 - DNA, 25 bp, Homo sapien
ccctgttagagaccctcatgggcta

SEQ ID NO: 121364 - DNA, 25 bp, Homo sapien
accctcatgggctaggacttttcat

SEQ ID NO: 121365 - DNA, 25 bp, Homo sapien
gggctaggacttttcatctaggata

SEQ ID NO: 121366 - DNA, 25 bp, Homo sapien
gatagattcaagacctttacctcag

SEQ ID NO: 121367 - DNA, 25 bp, Homo sapien
tcaagacctttacctcagaattatg

SEQ ID NO: 121368 - DNA, 25 bp, Homo sapien
aaccatttaagtctttgtatatgtg

SEQ ID NO: 121369 - DNA, 25 bp, Homo sapien
gtacaataaagttacacctcaaagt

SEQ ID NO: 121370 - DNA, 25 bp, Homo sapien
cacctcaaagtgtactcttggaatg

SEQ ID NO: 121371 - DNA, 25 bp, Homo sapien
actcttggaatggattctttcctgt

SEQ ID NO: 121372 - DNA, 25 bp, Homo sapien
ggattctttcctgtaaagtcttatc

SEQ ID NO: 121373 - DNA, 25 bp, Homo sapien
ggtttctcactgtgttccctgggaa

SEQ ID NO: 121374 - DNA, 25 bp, Homo sapien
ttctcactgtgttccctgggaacaa

SEQ ID NO: 121375 - DNA, 25 bp, Homo sapien
gggaacaagacccacaacgctgtgt

SEQ ID NO: 121376 - DNA, 25 bp, Homo sapien
acaagacccacaacgctgtgtgcgt

SEQ ID NO: 121377 - DNA, 25 bp, Homo sapien
acaacgctgtgtgcgtcccagggtc

SEQ ID NO: 121378 - DNA, 25 bp, Homo sapien
cgcttgggtggctgaccgtcgtcct

SEQ ID NO: 121379 - DNA, 25 bp, Homo sapien
ggtggctgaccgtcgtcctcctggc

SEQ ID NO: 121380 - DNA, 25 bp, Homo sapien
tgacctcggcccagcttggactgca

SEQ ID NO: 121381 - DNA, 25 bp, Homo sapien
ggcccagcttggactgcacatctgg

SEQ ID NO: 121382 - DNA, 25 bp, Homo sapien
agcttggactgcacatctggcagct

SEQ ID NO: 121383 - DNA, 25 bp, Homo sapien
ggactgcacatctggcagctgagga

SEQ ID NO: 121384 - DNA, 25 bp, Homo sapien
cagtatattggagaatcgcaaggat

SEQ ID NO: 121385 - DNA, 25 bp, Homo sapien
gagaatcgcaaggatatgatatcat

SEQ ID NO: 121386 - DNA, 25 bp, Homo sapien
gatatgatatcatggaaccagcagc

SEQ ID NO: 121387 - DNA, 25 bp, Homo sapien
gatatcatggaaccagcagcaaaga

SEQ ID NO: 121388 - DNA, 25 bp, Homo sapien
ggaaccagcagcaaagaagtgctat

SEQ ID NO: 121389 - DNA, 25 bp, Homo sapien
gcagcaaagaagtgctatctggaaa

SEQ ID NO: 121390 - DNA, 25 bp, Homo sapien
aaattattcaggagttcctgtccaa

SEQ ID NO: 121391 - DNA, 25 bp, Homo sapien
tgccctttactgaaatgtcagaaga

SEQ ID NO: 121392 - DNA, 25 bp, Homo sapien
gaataatagctttgtaaatgaaatc

SEQ ID NO: 121393 - DNA, 25 bp, Homo sapien
catttcacgaataaaagttactacg

SEQ ID NO: 121394 - DNA, 25 bp, Homo sapien
gaaggtaatattgataagctattgt

SEQ ID NO: 121395 - DNA, 25 bp, Homo sapien
gaaaagtgcaatgcgtgttgtacat

SEQ ID NO: 121396 - DNA, 25 bp, Homo sapien
gcgtgttgtacatacagaggtaact

SEQ ID NO: 121397 - DNA, 25 bp, Homo sapien
aagtttgttgctgtcaagatttttt

SEQ ID NO: 121398 - DNA, 25 bp, Homo sapien
aagcaattatattgtcctcccctat

SEQ ID NO: 121399 - DNA, 25 bp, Homo sapien
caattatattgtcctcccctatttt

SEQ ID NO: 121400 - DNA, 25 bp, Homo sapien
taagacgtgaatgtctcagcgaggt

SEQ ID NO: 121401 - DNA, 25 bp, Homo sapien
gtctcagcgaggtgtaaagttgttc

SEQ ID NO: 121402 - DNA, 25 bp, Homo sapien
gtgtaaagttgttcgccgcgtggaa

SEQ ID NO: 121403 - DNA, 25 bp, Homo sapien
agaaagactgattacctcctgtgtg

SEQ ID NO: 121404 - DNA, 25 bp, Homo sapien
gaagaaggaaacaccgagtctctgt

SEQ ID NO: 121405 - DNA, 25 bp, Homo sapien
caccgagtctctgtataatctattt

SEQ ID NO: 121406 - DNA, 25 bp, Homo sapien
ctctgcctgtgagccagtctagttc

SEQ ID NO: 121407 - DNA, 25 bp, Homo sapien
tgtgagccagtctagttcctgatga

SEQ ID NO: 121408 - DNA, 25 bp, Homo sapien
agccagtctagttcctgatgaccca

SEQ ID NO: 121409 - DNA, 25 bp, Homo sapien
ttcctgatgacccaggctgcctgag

SEQ ID NO: 121410 - DNA, 25 bp, Homo sapien
tccagggccagatgagcagaagctc

SEQ ID NO: 121411 - DNA, 25 bp, Homo sapien
gcagaagctctcgatggacaatgaa

SEQ ID NO: 121412 - DNA, 25 bp, Homo sapien
gatggacaatgaacggccttgctgg

SEQ ID NO: 121413 - DNA, 25 bp, Homo sapien
tttccctaaagaccctaaatctgag

SEQ ID NO: 121414 - DNA, 25 bp, Homo sapien
gaccctaaatctgaggaatcaacag

SEQ ID NO: 121415 - DNA, 25 bp, Homo sapien
aatcaacagggcagcagatctgtat

SEQ ID NO: 121416 - DNA, 25 bp, Homo sapien
cagggcagcagatctgtatattttt

SEQ ID NO: 121417 - DNA, 25 bp, Homo sapien
ttcctctgccgtgagaaaagtgctt

SEQ ID NO: 121418 - DNA, 25 bp, Homo sapien
agtgcttggagtacggtttgccaca

SEQ ID NO: 121419 - DNA, 25 bp, Homo sapien
gtttgccacacacgtgactggacag

SEQ ID NO: 121420 - DNA, 25 bp, Homo sapien
ggacagtgtccaattcaaatctttc

SEQ ID NO: 121421 - DNA, 25 bp, Homo sapien
gtccaattcaaatctttcagggcag

SEQ ID NO: 121422 - DNA, 25 bp, Homo sapien
ttcagggcagagtccgagcagcgct

SEQ ID NO: 121423 - DNA, 25 bp, Homo sapien
ctctcactttacagcttgtgtttct

SEQ ID NO: 121424 - DNA, 25 bp, Homo sapien
gcttgtgtttcttctggattcagct

SEQ ID NO: 121425 - DNA, 25 bp, Homo sapien
ggattcagcttctcctaaacagaca

SEQ ID NO: 121426 - DNA, 25 bp, Homo sapien
ttaattatagttgcggcctggcccc

SEQ ID NO: 121427 - DNA, 25 bp, Homo sapien
tcctctttttatttcactgctgcta

SEQ ID NO: 121428 - DNA, 25 bp, Homo sapien
tgccctatgctgacccaggaaaggg

SEQ ID NO: 121429 - DNA, 25 bp, Homo sapien
aaactccacaagtatgggaccctgg

SEQ ID NO: 121430 - DNA, 25 bp, Homo sapien
tagggcaagggccttctcaatgcct

SEQ ID NO: 121431 - DNA, 25 bp, Homo sapien
agggcaagggccttctcaatgcctc

SEQ ID NO: 121432 - DNA, 25 bp, Homo sapien
ggcaagggccttctcaatgcctcca

SEQ ID NO: 121433 - DNA, 25 bp, Homo sapien
ctagaagttgaattgtgaggcctcc

SEQ ID NO: 121434 - DNA, 25 bp, Homo sapien
caagcccaacccaggcggacaaaag

SEQ ID NO: 121435 - DNA, 25 bp, Homo sapien
caacccaggcggacaaaaggcctag

SEQ ID NO: 121436 - DNA, 25 bp, Homo sapien
acccaggcggacaaaaggcctagag

SEQ ID NO: 121437 - DNA, 25 bp, Homo sapien
caggcggacaaaaggcctagaggta

SEQ ID NO: 121438 - DNA, 25 bp, Homo sapien
ggacaaaaggcctagaggtaacaat

SEQ ID NO: 121439 - DNA, 25 bp, Homo sapien
aaaactggacttcctaatgtctgaa

SEQ ID NO: 121440 - DNA, 25 bp, Homo sapien
gatggacacatttgcagattttgat

SEQ ID NO: 121441 - DNA, 25 bp, Homo sapien
gatactatgacggatcggttattgg

SEQ ID NO: 121442 - DNA, 25 bp, Homo sapien
ggatgaaatcattcaacacattcag

SEQ ID NO: 121443 - DNA, 25 bp, Homo sapien
cattcagttgtacaacctctccata

SEQ ID NO: 121444 - DNA, 25 bp, Homo sapien
aacctctccatatcccgaattaggt

SEQ ID NO: 121445 - DNA, 25 bp, Homo sapien
gaaaccacaggtagttaatgctggg

SEQ ID NO: 121446 - DNA, 25 bp, Homo sapien
gggacatttttgagtgtttgctgta

SEQ ID NO: 121447 - DNA, 25 bp, Homo sapien
agcaataatatgatgccttctgtat

SEQ ID NO: 121448 - DNA, 25 bp, Homo sapien
gccttctgtataccactgagctaag

SEQ ID NO: 121449 - DNA, 25 bp, Homo sapien
gagctaagctaacttgtgactttta

SEQ ID NO: 121450 - DNA, 25 bp, Homo sapien
gacacttgtcaagctagcagaaact

SEQ ID NO: 121451 - DNA, 25 bp, Homo sapien
gcagaaactccattttcaatgccaa

SEQ ID NO: 121452 - DNA, 25 bp, Homo sapien
tggaatcatcccaaggcatcccaaa

SEQ ID NO: 121453 - DNA, 25 bp, Homo sapien
aaggcatcccaaaacaccatatctt

SEQ ID NO: 121454 - DNA, 25 bp, Homo sapien
accccaacatcccaggctgtggtgg

SEQ ID NO: 121455 - DNA, 25 bp, Homo sapien
tgtggtggctcctgtgggaactacc

SEQ ID NO: 121456 - DNA, 25 bp, Homo sapien
gctcctgtgggaactacctagatga

SEQ ID NO: 121457 - DNA, 25 bp, Homo sapien
atttataccttctaggagctcctat

SEQ ID NO: 121458 - DNA, 25 bp, Homo sapien
ctcctattgggagacatgaaacata

SEQ ID NO: 121459 - DNA, 25 bp, Homo sapien
gtaatagaacaaaccctgccaagtg

SEQ ID NO: 121460 - DNA, 25 bp, Homo sapien
aacaaaccctgccaagtgctgcttt

SEQ ID NO: 121461 - DNA, 25 bp, Homo sapien
tacttctaggaagtctcaaaagacc

SEQ ID NO: 121462 - DNA, 25 bp, Homo sapien
ggaagtctcaaaagaccatcttaaa

SEQ ID NO: 121463 - DNA, 25 bp, Homo sapien
gtttggacaattagcaacaagtcag

SEQ ID NO: 121464 - DNA, 25 bp, Homo sapien
gaatcgaagtttttcaaatccattg

SEQ ID NO: 121465 - DNA, 25 bp, Homo sapien
gtttttcaaatccattgcttagcta

SEQ ID NO: 121466 - DNA, 25 bp, Homo sapien
ctgtcacttggcttcgatttttata

SEQ ID NO: 121467 - DNA, 25 bp, Homo sapien
ggcttcgatttttatattttcctat

SEQ ID NO: 121468 - DNA, 25 bp, Homo sapien
tatcttttggttgtttgatttttct

SEQ ID NO: 121469 - DNA, 25 bp, Homo sapien
ttctttctttgtaaatagttctgag

SEQ ID NO: 121470 - DNA, 25 bp, Homo sapien
agttctgagttctgtcaaatgccgt

SEQ ID NO: 121471 - DNA, 25 bp, Homo sapien
gttctgtcaaatgccgtgaaagtat

SEQ ID NO: 121472 - DNA, 25 bp, Homo sapien
ggatacttctaaattttgggagctc

SEQ ID NO: 121473 - DNA, 25 bp, Homo sapien
agctcctccatctccaatggctggg

SEQ ID NO: 121474 - DNA, 25 bp, Homo sapien
agggattccactcagaacctctctg

SEQ ID NO: 121475 - DNA, 25 bp, Homo sapien
gattccactcagaacctctctggaa

SEQ ID NO: 121476 - DNA, 25 bp, Homo sapien
tccactcagaacctctctggaattt

SEQ ID NO: 121477 - DNA, 25 bp, Homo sapien
actcagaacctctctggaatttgtg

SEQ ID NO: 121478 - DNA, 25 bp, Homo sapien
tctggaatttgtgcctgatgtgcct

SEQ ID NO: 121479 - DNA, 25 bp, Homo sapien
gaatttgtgcctgatgtgccttcca

SEQ ID NO: 121480 - DNA, 25 bp, Homo sapien
atttgtgcctgatgtgccttccact

SEQ ID NO: 121481 - DNA, 25 bp, Homo sapien
tgtgcctgatgtgccttccactgga

SEQ ID NO: 121482 - DNA, 25 bp, Homo sapien
tgcctgatgtgccttccactggatt

SEQ ID NO: 121483 - DNA, 25 bp, Homo sapien
tttgtgttttgttaagcatgtccct

SEQ ID NO: 121484 - DNA, 25 bp, Homo sapien
gttttgttaagcatgtcccttggcc

SEQ ID NO: 121485 - DNA, 25 bp, Homo sapien
taagcatgtcccttggcccaaatga

SEQ ID NO: 121486 - DNA, 25 bp, Homo sapien
gtcccttggcccaaatgaagaggaa

SEQ ID NO: 121487 - DNA, 25 bp, Homo sapien
taacaatttagtgacccttggtagg

SEQ ID NO: 121488 - DNA, 25 bp, Homo sapien
taaaggttgcattatttatacttga

SEQ ID NO: 121489 - DNA, 25 bp, Homo sapien
gggaaatatcactggtctgtcaaga

SEQ ID NO: 121490 - DNA, 25 bp, Homo sapien
cactggtctgtcaagaaacagcagt

SEQ ID NO: 121491 - DNA, 25 bp, Homo sapien
tgagttaaattgaaaagtccagtgg

SEQ ID NO: 121492 - DNA, 25 bp, Homo sapien
agtggaccaggcatttcttatataa

SEQ ID NO: 121493 - DNA, 25 bp, Homo sapien
ggaccaggcatttcttatataaata

SEQ ID NO: 121494 - DNA, 25 bp, Homo sapien
gcttttctaggaataccagtcacat

SEQ ID NO: 121495 - DNA, 25 bp, Homo sapien
ggaataccagtcacatagtttttat

SEQ ID NO: 121496 - DNA, 25 bp, Homo sapien
taccagtcacatagtttttattttt

SEQ ID NO: 121497 - DNA, 25 bp, Homo sapien
ttatttttgtgtctgtgaaagtgcc

SEQ ID NO: 121498 - DNA, 25 bp, Homo sapien
ctgtgaaagtgccaagaacccctcc

SEQ ID NO: 121499 - DNA, 25 bp, Homo sapien
tgtgaaagtgccaagaacccctccc

SEQ ID NO: 121500 - DNA, 25 bp, Homo sapien
tgaccctttttataagctgtgtgtg

SEQ ID NO: 121501 - DNA, 25 bp, Homo sapien
ctttttataagctgtgtgtgtcctc

SEQ ID NO: 121502 - DNA, 25 bp, Homo sapien
tgtgtcctctgtattattgttatta

SEQ ID NO: 121503 - DNA, 25 bp, Homo sapien
ttaactattttttagcatttgcctg

SEQ ID NO: 121504 - DNA, 25 bp, Homo sapien
aactattttttagcatttgcctgta

SEQ ID NO: 121505 - DNA, 25 bp, Homo sapien
tatatggcacaaaaaaccacttcgc

SEQ ID NO: 121506 - DNA, 25 bp, Homo sapien
tggcacaaaaaaccacttcgccggg

SEQ ID NO: 121507 - DNA, 25 bp, Homo sapien
gccccggcaccttgccaaagtttca

SEQ ID NO: 121508 - DNA, 25 bp, Homo sapien
atgtatccaacctcatgctctatgg

SEQ ID NO: 121509 - DNA, 25 bp, Homo sapien
aggccatccccgtgaggttctccag

SEQ ID NO: 121510 - DNA, 25 bp, Homo sapien
gccatccccgtgaggttctccagat

SEQ ID NO: 121511 - DNA, 25 bp, Homo sapien
ctccatgccttggacgaaaggtgtt

SEQ ID NO: 121512 - DNA, 25 bp, Homo sapien
tgccttggacgaaaggtgttggatc

SEQ ID NO: 121513 - DNA, 25 bp, Homo sapien
ctggtgcatcatgacaccaaatcta

SEQ ID NO: 121514 - DNA, 25 bp, Homo sapien
gtgcatcatgacaccaaatctatag

SEQ ID NO: 121515 - DNA, 25 bp, Homo sapien
gcatcatgacaccaaatctatagtt

SEQ ID NO: 121516 - DNA, 25 bp, Homo sapien
ggttcacacgacagcagaggataaa

SEQ ID NO: 121517 - DNA, 25 bp, Homo sapien
agcagaggataaaaaatttcagttc

SEQ ID NO: 121518 - DNA, 25 bp, Homo sapien
aaatgctactcagcatcgatcataa

SEQ ID NO: 121519 - DNA, 25 bp, Homo sapien
gctactcagcatcgatcataaacca

SEQ ID NO: 121520 - DNA, 25 bp, Homo sapien
atcgatcataaaccagtgctgcaga

SEQ ID NO: 121521 - DNA, 25 bp, Homo sapien
gatcataaaccagtgctgcagatgg

SEQ ID NO: 121522 - DNA, 25 bp, Homo sapien
cggcaagcagaagtgcacactggtc

SEQ ID NO: 121523 - DNA, 25 bp, Homo sapien
gaagtgcacactggtcggaaaggaa

SEQ ID NO: 121524 - DNA, 25 bp, Homo sapien
aggaactgctcacaggaaaaaggtg

SEQ ID NO: 121525 - DNA, 25 bp, Homo sapien
gaaaaaggtggttcacacgacagca

SEQ ID NO: 121526 - DNA, 25 bp, Homo sapien
ggtggttcacacgacagcagaggat

SEQ ID NO: 121527 - DNA, 25 bp, Homo sapien
tccctaccaatgactcacctgaagt

SEQ ID NO: 121528 - DNA, 25 bp, Homo sapien
gactcacctgaagtgcaatacgaaa

SEQ ID NO: 121529 - DNA, 25 bp, Homo sapien
aataaaaggccagcgggcggcgtct

SEQ ID NO: 121530 - DNA, 25 bp, Homo sapien
ttgcgacactcccaaagccgtaagg

SEQ ID NO: 121531 - DNA, 25 bp, Homo sapien
taagggccgacccaggcatcttggc

SEQ ID NO: 121532 - DNA, 25 bp, Homo sapien
gtcgcgggttcaggtccgcccatta

SEQ ID NO: 121533 - DNA, 25 bp, Homo sapien
cattactccttgtcgtgcggtcaag

SEQ ID NO: 121534 - DNA, 25 bp, Homo sapien
tgtcgtgcggtcaaggatacacctt

SEQ ID NO: 121535 - DNA, 25 bp, Homo sapien
tcaaggatacaccttggccccgatt

SEQ ID NO: 121536 - DNA, 25 bp, Homo sapien
gattccggatctctccgttctcagg

SEQ ID NO: 121537 - DNA, 25 bp, Homo sapien
agacccctggtgctgccgttgattt

SEQ ID NO: 121538 - DNA, 25 bp, Homo sapien
ttggtgggaaagtgaatatgtttac

SEQ ID NO: 121539 - DNA, 25 bp, Homo sapien
ttcaccattacaggccatgctgaga

SEQ ID NO: 121540 - DNA, 25 bp, Homo sapien
agaaatgctacccagcatcttaaac

SEQ ID NO: 121541 - DNA, 25 bp, Homo sapien
ctacccagcatcttaaaccagcttg

SEQ ID NO: 121542 - DNA, 25 bp, Homo sapien
taaaccagcttggtgcggatagtct

SEQ ID NO: 121543 - DNA, 25 bp, Homo sapien
ctggccgaagctctgcccaaacaat

SEQ ID NO: 121544 - DNA, 25 bp, Homo sapien
cgaagctctgcccaaacaatctgtg

SEQ ID NO: 121545 - DNA, 25 bp, Homo sapien
atgatgaagttccaggaggcttcca

SEQ ID NO: 121546 - DNA, 25 bp, Homo sapien
atgaagttccaggaggcttccaaga

SEQ ID NO: 121547 - DNA, 25 bp, Homo sapien
gaagttccaggaggcttccaagaat

SEQ ID NO: 121548 - DNA, 25 bp, Homo sapien
agttccaggaggcttccaagaatga

SEQ ID NO: 121549 - DNA, 25 bp, Homo sapien
ctcttttgtttgatggttgctttct

SEQ ID NO: 121550 - DNA, 25 bp, Homo sapien
ttgtttgatggttgctttcttgatt

SEQ ID NO: 121551 - DNA, 25 bp, Homo sapien
aaattactgcttgacatgttggcat

SEQ ID NO: 121552 - DNA, 25 bp, Homo sapien
actgcttgacatgttggcattcata

SEQ ID NO: 121553 - DNA, 25 bp, Homo sapien
gcttgacatgttggcattcatatta

SEQ ID NO: 121554 - DNA, 25 bp, Homo sapien
tgtgtatcttactgtgactccgaaa

SEQ ID NO: 121555 - DNA, 25 bp, Homo sapien
gtatcttactgtgactccgaaaact

SEQ ID NO: 121556 - DNA, 25 bp, Homo sapien
atcttactgtgactccgaaaactgt

SEQ ID NO: 121557 - DNA, 25 bp, Homo sapien
ctgtgactccgaaaactgtagtatt

SEQ ID NO: 121558 - DNA, 25 bp, Homo sapien
aactgtagtattggtgtcatgggaa

SEQ ID NO: 121559 - DNA, 25 bp, Homo sapien
tagtattggtgtcatgggaatgtac

SEQ ID NO: 121560 - DNA, 25 bp, Homo sapien
gaagcactgctcatatcaggacatc

SEQ ID NO: 121561 - DNA, 25 bp, Homo sapien
tcaggacatcctgtgagactcttcc

SEQ ID NO: 121562 - DNA, 25 bp, Homo sapien
ttgtgttaagaacccagcaacccag

SEQ ID NO: 121563 - DNA, 25 bp, Homo sapien
agcaacccaggagcctagtacaata

SEQ ID NO: 121564 - DNA, 25 bp, Homo sapien
atatagtgatgccatcccgtcgact

SEQ ID NO: 121565 - DNA, 25 bp, Homo sapien
ccgtcgactctccatttaaattgtt

SEQ ID NO: 121566 - DNA, 25 bp, Homo sapien
attgtttctctttctgcataataaa

SEQ ID NO: 121567 - DNA, 25 bp, Homo sapien
ctggcctgtcttgtcgagtgagaca

SEQ ID NO: 121568 - DNA, 25 bp, Homo sapien
gagacacagcagtctaggaggccag

SEQ ID NO: 121569 - DNA, 25 bp, Homo sapien
gccttggtagtgatagtgcccttgg

SEQ ID NO: 121570 - DNA, 25 bp, Homo sapien
gtgcccttggtgattctaatagtcc

SEQ ID NO: 121571 - DNA, 25 bp, Homo sapien
cctggctctaggacactctaacaag

SEQ ID NO: 121572 - DNA, 25 bp, Homo sapien
ctctaggacactctaacaagctctg

SEQ ID NO: 121573 - DNA, 25 bp, Homo sapien
tctaacaagctctgtccacgggtct

SEQ ID NO: 121574 - DNA, 25 bp, Homo sapien
taacaagctctgtccacgggtctcc

SEQ ID NO: 121575 - DNA, 25 bp, Homo sapien
ctcagttctgggaggatgactccag

SEQ ID NO: 121576 - DNA, 25 bp, Homo sapien
tcacggttgctacccaggcggccaa

SEQ ID NO: 121577 - DNA, 25 bp, Homo sapien
cggttgctacccaggcggccaagct

SEQ ID NO: 121578 - DNA, 25 bp, Homo sapien
cccagtgcctttgtctatattctgc

SEQ ID NO: 121579 - DNA, 25 bp, Homo sapien
agtgcctttgtctatattctgctcc

SEQ ID NO: 121580 - DNA, 25 bp, Homo sapien
gcctttgtctatattctgctcccag

SEQ ID NO: 121581 - DNA, 25 bp, Homo sapien
ttgtctatattctgctcccagcctg

SEQ ID NO: 121582 - DNA, 25 bp, Homo sapien
gccatccacaagtggtggtaaccct

SEQ ID NO: 121583 - DNA, 25 bp, Homo sapien
taaccctggtggttgctgttttcct

SEQ ID NO: 121584 - DNA, 25 bp, Homo sapien
tcccttctgctactggcaaaaggat

SEQ ID NO: 121585 - DNA, 25 bp, Homo sapien
tggccaaggagctgctatagcctgg

SEQ ID NO: 121586 - DNA, 25 bp, Homo sapien
gaaaatgcagcagggatgccctgga

SEQ ID NO: 121587 - DNA, 25 bp, Homo sapien
agcccctgtctagagagggaggcaa

SEQ ID NO: 121588 - DNA, 25 bp, Homo sapien
gaggcaagccctgttgacacaggtc

SEQ ID NO: 121589 - DNA, 25 bp, Homo sapien
gacacaggtctttcctaaggctgca

SEQ ID NO: 121590 - DNA, 25 bp, Homo sapien
ggtctttcctaaggctgcaaggttt

SEQ ID NO: 121591 - DNA, 25 bp, Homo sapien
ctgcaaggtttaggctggtggccca

SEQ ID NO: 121592 - DNA, 25 bp, Homo sapien
ccaggaccatcatcctactgtaata

SEQ ID NO: 121593 - DNA, 25 bp, Homo sapien
tgactccaaggaagctcagatgcct

SEQ ID NO: 121594 - DNA, 25 bp, Homo sapien
ccaaggaagctcagatgcctgcagt

SEQ ID NO: 121595 - DNA, 25 bp, Homo sapien
cagatgcctgcagtcattaggtttt

SEQ ID NO: 121596 - DNA, 25 bp, Homo sapien
gcagtcattaggttttagcgtccca

SEQ ID NO: 121597 - DNA, 25 bp, Homo sapien
cattaggttttagcgtcccatgagc

SEQ ID NO: 121598 - DNA, 25 bp, Homo sapien
taggttttagcgtcccatgagcctt

SEQ ID NO: 121599 - DNA, 25 bp, Homo sapien
ttttagcgtcccatgagccttggta

SEQ ID NO: 121600 - DNA, 25 bp, Homo sapien
agcgtcccatgagccttggtatcaa

SEQ ID NO: 121601 - DNA, 25 bp, Homo sapien
cgtcccatgagccttggtatcaaga

SEQ ID NO: 121602 - DNA, 25 bp, Homo sapien
gagccttggtatcaagaggccacaa

SEQ ID NO: 121603 - DNA, 25 bp, Homo sapien
aagaggccacaagagtgggacccca

SEQ ID NO: 121604 - DNA, 25 bp, Homo sapien
ggaggagacgctcactttcgaagca

SEQ ID NO: 121605 - DNA, 25 bp, Homo sapien
actttcgaagcagccgtggctacta

SEQ ID NO: 121606 - DNA, 25 bp, Homo sapien
tggctactagcctgggccgttccaa

SEQ ID NO: 121607 - DNA, 25 bp, Homo sapien
atagctggcagatgcccaacgggca

SEQ ID NO: 121608 - DNA, 25 bp, Homo sapien
cccaacgggcactatcggcggcgga

SEQ ID NO: 121609 - DNA, 25 bp, Homo sapien
gggctgtcaacaacctgctaagtga

SEQ ID NO: 121610 - DNA, 25 bp, Homo sapien
aacaacctgctaagtgacacggaag

SEQ ID NO: 121611 - DNA, 25 bp, Homo sapien
tgacaaatgctagaggctgctcccc

SEQ ID NO: 121612 - DNA, 25 bp, Homo sapien
gatgcatgctcttctctcacatgga

SEQ ID NO: 121613 - DNA, 25 bp, Homo sapien
catgctcttctctcacatggagaaa

SEQ ID NO: 121614 - DNA, 25 bp, Homo sapien
cagaattgggaagccagtgcggccc

SEQ ID NO: 121615 - DNA, 25 bp, Homo sapien
agaaatgctacccagcatcttaaac

SEQ ID NO: 121616 - DNA, 25 bp, Homo sapien
gaaatgctacccagcatcttaaacc

SEQ ID NO: 121617 - DNA, 25 bp, Homo sapien
aaatgctacccagcatcttaaacca

SEQ ID NO: 121618 - DNA, 25 bp, Homo sapien
aatgctacccagcatcttaaaccag

SEQ ID NO: 121619 - DNA, 25 bp, Homo sapien
atgctacccagcatcttaaaccagc

SEQ ID NO: 121620 - DNA, 25 bp, Homo sapien
tgctacccagcatcttaaaccagct

SEQ ID NO: 121621 - DNA, 25 bp, Homo sapien
gctacccagcatcttaaaccagctt

SEQ ID NO: 121622 - DNA, 25 bp, Homo sapien
ctacccagcatcttaaaccagcttg

SEQ ID NO: 121623 - DNA, 25 bp, Homo sapien
aacaatttatccattcaatcattta

SEQ ID NO: 121624 - DNA, 25 bp, Homo sapien
aatcatttattcattgggttgtcag

SEQ ID NO: 121625 - DNA, 25 bp, Homo sapien
ttcattgggttgtcagatagtctat

SEQ ID NO: 121626 - DNA, 25 bp, Homo sapien
cagatagtctatgtatgtgtaaaac

SEQ ID NO: 121627 - DNA, 25 bp, Homo sapien
aaaacaatctgttttggctttatgt

SEQ ID NO: 121628 - DNA, 25 bp, Homo sapien
gaactttttagattattccaagcct

SEQ ID NO: 121629 - DNA, 25 bp, Homo sapien
tttagattattccaagccttatttt

SEQ ID NO: 121630 - DNA, 25 bp, Homo sapien
agatttttggcactttgttttcaag

SEQ ID NO: 121631 - DNA, 25 bp, Homo sapien
ttggcactttgttttcaagatggtg

SEQ ID NO: 121632 - DNA, 25 bp, Homo sapien
caagatggtgttatcttttgaattc

SEQ ID NO: 121633 - DNA, 25 bp, Homo sapien
ttttctgcctaatagtaactggtta

SEQ ID NO: 121634 - DNA, 25 bp, Homo sapien
tggccactgaccttgcctattacct

SEQ ID NO: 121635 - DNA, 25 bp, Homo sapien
ttgcctattacctggtccgcaaagg

SEQ ID NO: 121636 - DNA, 25 bp, Homo sapien
ggtccgcaaagggatgccattccgc

SEQ ID NO: 121637 - DNA, 25 bp, Homo sapien
gcaaagggatgccattccgccaggc

SEQ ID NO: 121638 - DNA, 25 bp, Homo sapien
aagggatgccattccgccaggccca

SEQ ID NO: 121639 - DNA, 25 bp, Homo sapien
aggcctccgggaaagctgtgttcat

SEQ ID NO: 121640 - DNA, 25 bp, Homo sapien
aaagctgtgttcatggccgagacca

SEQ ID NO: 121641 - DNA, 25 bp, Homo sapien
agctgtgttcatggccgagaccaag

SEQ ID NO: 121642 - DNA, 25 bp, Homo sapien
tgttctcgggcgacgtgatctgcgt

SEQ ID NO: 121643 - DNA, 25 bp, Homo sapien
tgatctgcgtgtgggactacgggca

SEQ ID NO: 121644 - DNA, 25 bp, Homo sapien
acagtgtggagcagtatggtgccct

SEQ ID NO: 121645 - DNA, 25 bp, Homo sapien
tagcagtccaggtccctcaaccttc

SEQ ID NO: 121646 - DNA, 25 bp, Homo sapien
aaccttcaccaaacactacccatgg

SEQ ID NO: 121647 - DNA, 25 bp, Homo sapien
ttcaccaaacactacccatgggggg

SEQ ID NO: 121648 - DNA, 25 bp, Homo sapien
ggttgggagtcagccggccaaacta

SEQ ID NO: 121649 - DNA, 25 bp, Homo sapien
gagtcagccggccaaactaacactc

SEQ ID NO: 121650 - DNA, 25 bp, Homo sapien
tggctgtctctctggctcctgacct

SEQ ID NO: 121651 - DNA, 25 bp, Homo sapien
ggctaccataccaagaagagagggc

SEQ ID NO: 121652 - DNA, 25 bp, Homo sapien
ctaccataccaagaagagagggctg

SEQ ID NO: 121653 - DNA, 25 bp, Homo sapien
taccgaggctgtgggcctcatcctt

SEQ ID NO: 121654 - DNA, 25 bp, Homo sapien
gaggctgtgggcctcatccttcact

SEQ ID NO: 121655 - DNA, 25 bp, Homo sapien
aggctgtgggcctcatccttcactc

SEQ ID NO: 121656 - DNA, 25 bp, Homo sapien
tgcacagagcacacttatttatgaa

SEQ ID NO: 121657 - DNA, 25 bp, Homo sapien
tttatgaattgtctaaagttactac

SEQ ID NO: 121658 - DNA, 25 bp, Homo sapien
aaggtaactactgctaatgttgatc

SEQ ID NO: 121659 - DNA, 25 bp, Homo sapien
actactgctaatgttgatcagcaaa

SEQ ID NO: 121660 - DNA, 25 bp, Homo sapien
gatcagcaaatttaagagaagacct

SEQ ID NO: 121661 - DNA, 25 bp, Homo sapien
aatttaagagaagacctagctatgt

SEQ ID NO: 121662 - DNA, 25 bp, Homo sapien
ctatgttggctggttgctttctatt

SEQ ID NO: 121663 - DNA, 25 bp, Homo sapien
ttatcatggtatttgaccattttag

SEQ ID NO: 121664 - DNA, 25 bp, Homo sapien
tgaccattttagttttaattccatg

SEQ ID NO: 121665 - DNA, 25 bp, Homo sapien
tttagttttaattccatgtcagata

SEQ ID NO: 121666 - DNA, 25 bp, Homo sapien
tccatgtcagataagtgtaaataga

SEQ ID NO: 121667 - DNA, 25 bp, Homo sapien
cttcccaggctggatactaagcaca

SEQ ID NO: 121668 - DNA, 25 bp, Homo sapien
actaagcacaaagcccatagcactg

SEQ ID NO: 121669 - DNA, 25 bp, Homo sapien
atagcactgggctctgatggctgct

SEQ ID NO: 121670 - DNA, 25 bp, Homo sapien
tggctgctccactgggttacagaat

SEQ ID NO: 121671 - DNA, 25 bp, Homo sapien
ggttacagaatcacagccctcatga

SEQ ID NO: 121672 - DNA, 25 bp, Homo sapien
cagccctcatgatcattctcagtga

SEQ ID NO: 121673 - DNA, 25 bp, Homo sapien
cattctcagtgagggctctggattg

SEQ ID NO: 121674 - DNA, 25 bp, Homo sapien
gagtcttccctaccaggtttctaca

SEQ ID NO: 121675 - DNA, 25 bp, Homo sapien
ccagaggactttattcggaccaagc

SEQ ID NO: 121676 - DNA, 25 bp, Homo sapien
tattcggaccaagcagagctcacag

SEQ ID NO: 121677 - DNA, 25 bp, Homo sapien
gagctcacagctggacaggtgttgt

SEQ ID NO: 121678 - DNA, 25 bp, Homo sapien
tccctccttttcttgcatgtaagtt

SEQ ID NO: 121679 - DNA, 25 bp, Homo sapien
cttttcttgcatgtaagttgtcccc

SEQ ID NO: 121680 - DNA, 25 bp, Homo sapien
gtattccatctacttttctatcgcc

SEQ ID NO: 121681 - DNA, 25 bp, Homo sapien
attccatctacttttctatcgccgt

SEQ ID NO: 121682 - DNA, 25 bp, Homo sapien
tttctatcgccgtccccttttgcag

SEQ ID NO: 121683 - DNA, 25 bp, Homo sapien
ggtaaatgttgacagaggccctgcc

SEQ ID NO: 121684 - DNA, 25 bp, Homo sapien
ccactgtaggccactggatggtcat

SEQ ID NO: 121685 - DNA, 25 bp, Homo sapien
gccactggatggtcatttggcatct

SEQ ID NO: 121686 - DNA, 25 bp, Homo sapien
atggtcatttggcatctccgtatat

SEQ ID NO: 121687 - DNA, 25 bp, Homo sapien
tttggcatctccgtatatgtgctct

SEQ ID NO: 121688 - DNA, 25 bp, Homo sapien
atctccgtatatgtgctctggctcc

SEQ ID NO: 121689 - DNA, 25 bp, Homo sapien
gagaaatgctgctagaaggaattaa

SEQ ID NO: 121690 - DNA, 25 bp, Homo sapien
tgtagtaaacgcgtgctcatcctct

SEQ ID NO: 121691 - DNA, 25 bp, Homo sapien
gtgctcatcctctaagcttgaagaa

SEQ ID NO: 121692 - DNA, 25 bp, Homo sapien
gaagggagacgaaaatccatttgtt

SEQ ID NO: 121693 - DNA, 25 bp, Homo sapien
gtttaaattcacatctcaaggaggg

SEQ ID NO: 121694 - DNA, 25 bp, Homo sapien
atctcaaggagggagaacccgggct

SEQ ID NO: 121695 - DNA, 25 bp, Homo sapien
gtgttgggtggttgccaatttccta

SEQ ID NO: 121696 - DNA, 25 bp, Homo sapien
ttgccaatttcctagaacggaatgt

SEQ ID NO: 121697 - DNA, 25 bp, Homo sapien
gaataagcgttgtttttcaaatagg

SEQ ID NO: 121698 - DNA, 25 bp, Homo sapien
aatagggtccttgtaagttattgat

SEQ ID NO: 121699 - DNA, 25 bp, Homo sapien
atgatttgggaaaacaattgctttt

SEQ ID NO: 121700 - DNA, 25 bp, Homo sapien
gacagctcggacaggaagaactttt

SEQ ID NO: 121701 - DNA, 25 bp, Homo sapien
gaaggcagcggaaagcaccagctcc

SEQ ID NO: 121702 - DNA, 25 bp, Homo sapien
ggatgctgcacaaccattttgacct

SEQ ID NO: 121703 - DNA, 25 bp, Homo sapien
cacaaccattttgacctctcagtaa

SEQ ID NO: 121704 - DNA, 25 bp, Homo sapien
ttgacctctcagtaattgagctgaa

SEQ ID NO: 121705 - DNA, 25 bp, Homo sapien
agctgaaagctgaggatcggagcaa

SEQ ID NO: 121706 - DNA, 25 bp, Homo sapien
atcggagcaagtttctggacgcact

SEQ ID NO: 121707 - DNA, 25 bp, Homo sapien
agtttctggacgcacttatttccct

SEQ ID NO: 121708 - DNA, 25 bp, Homo sapien
tttccctcctgtcctaggaatttga

SEQ ID NO: 121709 - DNA, 25 bp, Homo sapien
tttgattcttccagaatgaccttct

SEQ ID NO: 121710 - DNA, 25 bp, Homo sapien
tgtaactggctttcatttagattgt

SEQ ID NO: 121711 - DNA, 25 bp, Homo sapien
agaatggactgatgacgacctggta

SEQ ID NO: 121712 - DNA, 25 bp, Homo sapien
tggactgatgacgacctggtagaat

SEQ ID NO: 121713 - DNA, 25 bp, Homo sapien
gacgacctggtagaatctctctaac

SEQ ID NO: 121714 - DNA, 25 bp, Homo sapien
gaatctctctaaccatttgaagttg

SEQ ID NO: 121715 - DNA, 25 bp, Homo sapien
gaagttgatttctcaatgctaacta

SEQ ID NO: 121716 - DNA, 25 bp, Homo sapien
aacagaagttggagcgatgtcattc

SEQ ID NO: 121717 - DNA, 25 bp, Homo sapien
ggagcgatgtcattctgctgagctt

SEQ ID NO: 121718 - DNA, 25 bp, Homo sapien
gtcattctgctgagcttgcacttaa

SEQ ID NO: 121719 - DNA, 25 bp, Homo sapien
gagcttgcacttaacgtaatcacga

SEQ ID NO: 121720 - DNA, 25 bp, Homo sapien
aagatgatgattacgtctcaaagaa

SEQ ID NO: 121721 - DNA, 25 bp, Homo sapien
tacgtctcaaagaaatccaaacatg

SEQ ID NO: 121722 - DNA, 25 bp, Homo sapien
gaaatagaacatgctctgaaagata

SEQ ID NO: 121723 - DNA, 25 bp, Homo sapien
taattggaaatatcttagctactgg

SEQ ID NO: 121724 - DNA, 25 bp, Homo sapien
tatcttagctactggattgccttaa

SEQ ID NO: 121725 - DNA, 25 bp, Homo sapien
tactggattgccttaaattcttctc

SEQ ID NO: 121726 - DNA, 25 bp, Homo sapien
accccacccgaaagtattcagctgg

SEQ ID NO: 121727 - DNA, 25 bp, Homo sapien
ggcatttagagagctacagtcttca

SEQ ID NO: 121728 - DNA, 25 bp, Homo sapien
gagagctacagtcttcattttagtg

SEQ ID NO: 121729 - DNA, 25 bp, Homo sapien
agctacagtcttcattttagtgctt

SEQ ID NO: 121730 - DNA, 25 bp, Homo sapien
tttagtgctttacacattcgggcct

SEQ ID NO: 121731 - DNA, 25 bp, Homo sapien
gtgctttacacattcgggcctgaaa

SEQ ID NO: 121732 - DNA, 25 bp, Homo sapien
acattcgggcctgaaaacaaatatg

SEQ ID NO: 121733 - DNA, 25 bp, Homo sapien
caacggttaccactgcaccctggga

SEQ ID NO: 121734 - DNA, 25 bp, Homo sapien
gttaccactgcaccctgggactcag

SEQ ID NO: 121735 - DNA, 25 bp, Homo sapien
tgaccaagaccactggtgctagctg

SEQ ID NO: 121736 - DNA, 25 bp, Homo sapien
gtgctagctgcaccgtgaccgctca

SEQ ID NO: 121737 - DNA, 25 bp, Homo sapien
tgaccgctcagacgcctgcatgcag

SEQ ID NO: 121738 - DNA, 25 bp, Homo sapien
ctgcatgcagcaggcgtgtgttcca

SEQ ID NO: 121739 - DNA, 25 bp, Homo sapien
agcaggcgtgtgttccagtggatga

SEQ ID NO: 121740 - DNA, 25 bp, Homo sapien
gttttatcatccacacggggcagtc

SEQ ID NO: 121741 - DNA, 25 bp, Homo sapien
ttgcccaccttggtgaggctcctgt

SEQ ID NO: 121742 - DNA, 25 bp, Homo sapien
accttggtgaggctcctgtggcccc

SEQ ID NO: 121743 - DNA, 25 bp, Homo sapien
ccctcttttactctagacgacgaat

SEQ ID NO: 121744 - DNA, 25 bp, Homo sapien
ttgctatgccttgcattatggtata

SEQ ID NO: 121745 - DNA, 25 bp, Homo sapien
attatggtatatgaggcgccggtca

SEQ ID NO: 121746 - DNA, 25 bp, Homo sapien
tgaggcgccggtcatatcagaatat

SEQ ID NO: 121747 - DNA, 25 bp, Homo sapien
agaatatcccatgagccatcatcat

SEQ ID NO: 121748 - DNA, 25 bp, Homo sapien
atgagccatcatcatgtctcctctc

SEQ ID NO: 121749 - DNA, 25 bp, Homo sapien
tctcccattcgcaataagctaccaa

SEQ ID NO: 121750 - DNA, 25 bp, Homo sapien
aagcccaagatatcagcccaaaaat

SEQ ID NO: 121751 - DNA, 25 bp, Homo sapien
tcagcccaaaaatcaatcttatcat

SEQ ID NO: 121752 - DNA, 25 bp, Homo sapien
tgtactaacagtgtgattcaccctg

SEQ ID NO: 121753 - DNA, 25 bp, Homo sapien
aataatagtgccttccttgctcctt

SEQ ID NO: 121754 - DNA, 25 bp, Homo sapien
ttgctccttttgctatgccttgcat

SEQ ID NO: 121755 - DNA, 25 bp, Homo sapien
aaagcaactggttaggtagcaacaa

SEQ ID NO: 121756 - DNA, 25 bp, Homo sapien
caactggttaggtagcaacaacaga

SEQ ID NO: 121757 - DNA, 25 bp, Homo sapien
aggtagcaacaacagaagggaaatt

SEQ ID NO: 121758 - DNA, 25 bp, Homo sapien
tttcaataacctttcacttaagtat

SEQ ID NO: 121759 - DNA, 25 bp, Homo sapien
taacctttcacttaagtattgtcac

SEQ ID NO: 121760 - DNA, 25 bp, Homo sapien
ctttcacttaagtattgtcaccagg

SEQ ID NO: 121761 - DNA, 25 bp, Homo sapien
gtattgtcaccaggattactagtca

SEQ ID NO: 121762 - DNA, 25 bp, Homo sapien
gtcaccaggattactagtcaaacaa

SEQ ID NO: 121763 - DNA, 25 bp, Homo sapien
caccaggattactagtcaaacaaaa

SEQ ID NO: 121764 - DNA, 25 bp, Homo sapien
ttaccatgtgctaataagtttgaaa

SEQ ID NO: 121765 - DNA, 25 bp, Homo sapien
tgcaactttagtttgtgttattatt

SEQ ID NO: 121766 - DNA, 25 bp, Homo sapien
gtgccccctgaaacagctgccacca

SEQ ID NO: 121767 - DNA, 25 bp, Homo sapien
agctgccaccatcactcgcaagaga

SEQ ID NO: 121768 - DNA, 25 bp, Homo sapien
gctgccaccatcactcgcaagagaa

SEQ ID NO: 121769 - DNA, 25 bp, Homo sapien
ctgccaccatcactcgcaagagaat

SEQ ID NO: 121770 - DNA, 25 bp, Homo sapien
tgccaccatcactcgcaagagaatc

SEQ ID NO: 121771 - DNA, 25 bp, Homo sapien
gccaccatcactcgcaagagaatcc

SEQ ID NO: 121772 - DNA, 25 bp, Homo sapien
caccatcactcgcaagagaatcccc

SEQ ID NO: 121773 - DNA, 25 bp, Homo sapien
accatcactcgcaagagaatcccct

SEQ ID NO: 121774 - DNA, 25 bp, Homo sapien
ccatcactcgcaagagaatcccctc

SEQ ID NO: 121775 - DNA, 25 bp, Homo sapien
catcactcgcaagagaatcccctcc

SEQ ID NO: 121776 - DNA, 25 bp, Homo sapien
atcactcgcaagagaatcccctcca

SEQ ID NO: 121777 - DNA, 25 bp, Homo sapien
atctgcttatggcacaatttgcctc

SEQ ID NO: 121778 - DNA, 25 bp, Homo sapien
tgcttatggcacaatttgcctcaaa

SEQ ID NO: 121779 - DNA, 25 bp, Homo sapien
ttgttgaagtgtggagttgtaactc

SEQ ID NO: 121780 - DNA, 25 bp, Homo sapien
ggagttgtaactctgcgtggactat

SEQ ID NO: 121781 - DNA, 25 bp, Homo sapien
gagttgtaactctgcgtggactatg

SEQ ID NO: 121782 - DNA, 25 bp, Homo sapien
ttgtaactctgcgtggactatggac

SEQ ID NO: 121783 - DNA, 25 bp, Homo sapien
tgtaactctgcgtggactatggaca

SEQ ID NO: 121784 - DNA, 25 bp, Homo sapien
taactctgcgtggactatggacagt

SEQ ID NO: 121785 - DNA, 25 bp, Homo sapien
aactctgcgtggactatggacagtc

SEQ ID NO: 121786 - DNA, 25 bp, Homo sapien
ctatttttttgtactgctggtcctg

SEQ ID NO: 121787 - DNA, 25 bp, Homo sapien
tttttttgtactgctggtcctgtac

SEQ ID NO: 121788 - DNA, 25 bp, Homo sapien
gcaatgatggcaaatgcagcccaga

SEQ ID NO: 121789 - DNA, 25 bp, Homo sapien
gaaggatattactaccgtcaagtct

SEQ ID NO: 121790 - DNA, 25 bp, Homo sapien
gtcaagtctttgaacgccattaccc

SEQ ID NO: 121791 - DNA, 25 bp, Homo sapien
tttgaacgccattacccaggccggg

SEQ ID NO: 121792 - DNA, 25 bp, Homo sapien
gctgagccattactggatgcccaag

SEQ ID NO: 121793 - DNA, 25 bp, Homo sapien
tggatgcccaagtggatcaatgcca

SEQ ID NO: 121794 - DNA, 25 bp, Homo sapien
gacccactacaagtcagctgtcaaa

SEQ ID NO: 121795 - DNA, 25 bp, Homo sapien
agctgtcaaagcttaggtggtcttt

SEQ ID NO: 121796 - DNA, 25 bp, Homo sapien
gtggtctttatgctgtaatgtgaaa

SEQ ID NO: 121797 - DNA, 25 bp, Homo sapien
agcaaatatttcttcgtgttggatg

SEQ ID NO: 121798 - DNA, 25 bp, Homo sapien
gaacaatgagagtcaactcaggcta

SEQ ID NO: 121799 - DNA, 25 bp, Homo sapien
gtagacattatcttttggctctgaa

SEQ ID NO: 121800 - DNA, 25 bp, Homo sapien
acatgactagagacgcaccttgctg

SEQ ID NO: 121801 - DNA, 25 bp, Homo sapien
gagacgcaccttgctgcagtgtcca

SEQ ID NO: 121802 - DNA, 25 bp, Homo sapien
cagtgtccagaagcggcctgtgcgt

SEQ ID NO: 121803 - DNA, 25 bp, Homo sapien
tgtgcgttcccttcagtactgcagc

SEQ ID NO: 121804 - DNA, 25 bp, Homo sapien
aaggacactcttggctcgtttgggc

SEQ ID NO: 121805 - DNA, 25 bp, Homo sapien
tcgtttgggctcaaggcaccgcagc

SEQ ID NO: 121806 - DNA, 25 bp, Homo sapien
tgtcagccaacattgccttgcattt

SEQ ID NO: 121807 - DNA, 25 bp, Homo sapien
gccttgcatttgtaccttattgatc

SEQ ID NO: 121808 - DNA, 25 bp, Homo sapien
ccttattgatctttgcccatggaag

SEQ ID NO: 121809 - DNA, 25 bp, Homo sapien
atctttcgttggttgtttctctgag

SEQ ID NO: 121810 - DNA, 25 bp, Homo sapien
ggccagctgcctccgcgtgatcaaa

SEQ ID NO: 121811 - DNA, 25 bp, Homo sapien
gtgatcaaagccacactctgggctc

SEQ ID NO: 121812 - DNA, 25 bp, Homo sapien
gggatgacatgcactcagctcttgg

SEQ ID NO: 121813 - DNA, 25 bp, Homo sapien
tcagctcttggctccactgggatgg

SEQ ID NO: 121814 - DNA, 25 bp, Homo sapien
aaggccacgagcttgttctttgttc

SEQ ID NO: 121815 - DNA, 25 bp, Homo sapien
gttctttgttctttgtcacagggac

SEQ ID NO: 121816 - DNA, 25 bp, Homo sapien
acagggactgaaaacctctcctcat

SEQ ID NO: 121817 - DNA, 25 bp, Homo sapien
tcatgttctgctttcgattcgttaa

SEQ ID NO: 121818 - DNA, 25 bp, Homo sapien
gctttcgattcgttaagagagcaac

SEQ ID NO: 121819 - DNA, 25 bp, Homo sapien
agagagcaacattttacccacacac

SEQ ID NO: 121820 - DNA, 25 bp, Homo sapien
agcaacattttacccacacacagat

SEQ ID NO: 121821 - DNA, 25 bp, Homo sapien
tggacagttaaaaagatagctagtg

SEQ ID NO: 121822 - DNA, 25 bp, Homo sapien
gctagtgtatattgttatgggtcag

SEQ ID NO: 121823 - DNA, 25 bp, Homo sapien
attgttatgggtcagtacttattag

SEQ ID NO: 121824 - DNA, 25 bp, Homo sapien
gggtcagtacttattagtacttcca

SEQ ID NO: 121825 - DNA, 25 bp, Homo sapien
tacttattagtacttccaaaattga

SEQ ID NO: 121826 - DNA, 25 bp, Homo sapien
gaatttgaaatgctatgtattcact

SEQ ID NO: 121827 - DNA, 25 bp, Homo sapien
tgtattcacttttcactctgtaaat

SEQ ID NO: 121828 - DNA, 25 bp, Homo sapien
attcacttttcactctgtaaatgta

SEQ ID NO: 121829 - DNA, 25 bp, Homo sapien
cttttcactctgtaaatgtaattct

SEQ ID NO: 121830 - DNA, 25 bp, Homo sapien
tgtaattctttacaatgactttatt

SEQ ID NO: 121831 - DNA, 25 bp, Homo sapien
tttatttattaaagggcagccagtt

SEQ ID NO: 121832 - DNA, 25 bp, Homo sapien
aggctgagcagagtgagcttgtatt

SEQ ID NO: 121833 - DNA, 25 bp, Homo sapien
gtagagattctccaaactctagcct

SEQ ID NO: 121834 - DNA, 25 bp, Homo sapien
caaactctagcctggtttcctagat

SEQ ID NO: 121835 - DNA, 25 bp, Homo sapien
gcctggtttcctagattgagaacta

SEQ ID NO: 121836 - DNA, 25 bp, Homo sapien
ataatttaatatctactctcctaca

SEQ ID NO: 121837 - DNA, 25 bp, Homo sapien
tactctcctacaaaagctcaagcct

SEQ ID NO: 121838 - DNA, 25 bp, Homo sapien
tcaagcctgaagatacaagactatt

SEQ ID NO: 121839 - DNA, 25 bp, Homo sapien
agaaacatgactaccctcagtgtat

SEQ ID NO: 121840 - DNA, 25 bp, Homo sapien
gactaccctcagtgtattagaaaag

SEQ ID NO: 121841 - DNA, 25 bp, Homo sapien
agaaaagaggtcatgcagctttcta

SEQ ID NO: 121842 - DNA, 25 bp, Homo sapien
catgcagctttctaaacattattga

SEQ ID NO: 121843 - DNA, 25 bp, Homo sapien
ggcataagtaattttagctagtttt

SEQ ID NO: 121844 - DNA, 25 bp, Homo sapien
gctagtttttaatagtgttctctgt

SEQ ID NO: 121845 - DNA, 25 bp, Homo sapien
tgttctctgtattgtctattattta

SEQ ID NO: 121846 - DNA, 25 bp, Homo sapien
ttgttttatgctgctcctgatataa

SEQ ID NO: 121847 - DNA, 25 bp, Homo sapien
gctgctcctgatataacactttcca

SEQ ID NO: 121848 - DNA, 25 bp, Homo sapien
ataacactttccagcctatagcaga

SEQ ID NO: 121849 - DNA, 25 bp, Homo sapien
aagcacattttcagactgcaatata

SEQ ID NO: 121850 - DNA, 25 bp, Homo sapien
ctgcaatatagagactgtgttcatg

SEQ ID NO: 121851 - DNA, 25 bp, Homo sapien
tagagactgtgttcatgtgtaaaga

SEQ ID NO: 121852 - DNA, 25 bp, Homo sapien
attacttattggatattcattcttt

SEQ ID NO: 121853 - DNA, 25 bp, Homo sapien
ttctttatattgtcattgtcacaac

SEQ ID NO: 121854 - DNA, 25 bp, Homo sapien
ggttcttctcaagagttgaccatta

SEQ ID NO: 121855 - DNA, 25 bp, Homo sapien
gttgaccattatctctattcttaaa

SEQ ID NO: 121856 - DNA, 25 bp, Homo sapien
taagcttccatttcaagtctgggtc

SEQ ID NO: 121857 - DNA, 25 bp, Homo sapien
ttccatttcaagtctgggtccttgg

SEQ ID NO: 121858 - DNA, 25 bp, Homo sapien
gtctgggtccttggagaatgtgcca

SEQ ID NO: 121859 - DNA, 25 bp, Homo sapien
atttgtccagaaactcttgggccag

SEQ ID NO: 121860 - DNA, 25 bp, Homo sapien
cttgggccagttctctgagaaggaa

SEQ ID NO: 121861 - DNA, 25 bp, Homo sapien
aaaagaaacgcatcctgcactgcct

SEQ ID NO: 121862 - DNA, 25 bp, Homo sapien
gaaatattgctgttcaaggaagtaa

SEQ ID NO: 121863 - DNA, 25 bp, Homo sapien
gtgatgtagcacttccaagatggca

SEQ ID NO: 121864 - DNA, 25 bp, Homo sapien
ggcaccagcatttggttcttctcaa

SEQ ID NO: 121865 - DNA, 25 bp, Homo sapien
gttggccaggatatattggtttttt

SEQ ID NO: 121866 - DNA, 25 bp, Homo sapien
ttatgttaactttggtgaccttttg

SEQ ID NO: 121867 - DNA, 25 bp, Homo sapien
ggtgaccttttgtgtactttacatg

SEQ ID NO: 121868 - DNA, 25 bp, Homo sapien
tactttacatgaaacaccttatata

SEQ ID NO: 121869 - DNA, 25 bp, Homo sapien
gggattcgttctatgttccttcagg

SEQ ID NO: 121870 - DNA, 25 bp, Homo sapien
attcgttctatgttccttcaggtaa

SEQ ID NO: 121871 - DNA, 25 bp, Homo sapien
gttccttcaggtaactattataaca

SEQ ID NO: 121872 - DNA, 25 bp, Homo sapien
tataacatcaaaaatctccggaatg

SEQ ID NO: 121873 - DNA, 25 bp, Homo sapien
tctccggaatgaggaaagtgttctt

SEQ ID NO: 121874 - DNA, 25 bp, Homo sapien
tgaggaaagtgttcttctttttact

SEQ ID NO: 121875 - DNA, 25 bp, Homo sapien
gatgaaagatcaaccaaccttaaat

SEQ ID NO: 121876 - DNA, 25 bp, Homo sapien
accctttgccggcaaatgcagggca

SEQ ID NO: 121877 - DNA, 25 bp, Homo sapien
ctttgccggcaaatgcagggcatgt

SEQ ID NO: 121878 - DNA, 25 bp, Homo sapien
ccggcaaatgcagggcatgtgccca

SEQ ID NO: 121879 - DNA, 25 bp, Homo sapien
aaatgcagggcatgtgcccaagagg

SEQ ID NO: 121880 - DNA, 25 bp, Homo sapien
tgtgcccaggagctctctaggaggg

SEQ ID NO: 121881 - DNA, 25 bp, Homo sapien
gcaggcaggagcagtgtggtagtac

SEQ ID NO: 121882 - DNA, 25 bp, Homo sapien
gggtacccacaggacttgagaacac

SEQ ID NO: 121883 - DNA, 25 bp, Homo sapien
aggacttgagaacacctgtgcctcc

SEQ ID NO: 121884 - DNA, 25 bp, Homo sapien
acttgagaacacctgtgcctccctg

SEQ ID NO: 121885 - DNA, 25 bp, Homo sapien
tcggccagcggccacggtgccagag

SEQ ID NO: 121886 - DNA, 25 bp, Homo sapien
ggtgccagagtcaccaccttgccgg

SEQ ID NO: 121887 - DNA, 25 bp, Homo sapien
tgtcatgtagctgttttaagaaatc

SEQ ID NO: 121888 - DNA, 25 bp, Homo sapien
aaatctggcccagggtgtttgcagc

SEQ ID NO: 121889 - DNA, 25 bp, Homo sapien
cccagggtgtttgcagctgtgagaa

SEQ ID NO: 121890 - DNA, 25 bp, Homo sapien
gagaagtcactcacactggccacaa

SEQ ID NO: 121891 - DNA, 25 bp, Homo sapien
aagtcactcacactggccacaagga

SEQ ID NO: 121892 - DNA, 25 bp, Homo sapien
caaggacgctggctactgtctatta

SEQ ID NO: 121893 - DNA, 25 bp, Homo sapien
acgctggctactgtctattaaaatt

SEQ ID NO: 121894 - DNA, 25 bp, Homo sapien
gtctattaaaattctgatgtttctg

SEQ ID NO: 121895 - DNA, 25 bp, Homo sapien
gatgtttctgtgaaattctcagagt

SEQ ID NO: 121896 - DNA, 25 bp, Homo sapien
aattctcagagtgtttaattgtact

SEQ ID NO: 121897 - DNA, 25 bp, Homo sapien
attgtactcaatggtatcattacaa

SEQ ID NO: 121898 - DNA, 25 bp, Homo sapien
tctgcctgcaggtgtaccgctgggt

SEQ ID NO: 121899 - DNA, 25 bp, Homo sapien
agaaaaggcggaatgccaccggcga

SEQ ID NO: 121900 - DNA, 25 bp, Homo sapien
aatgccaccggcgaggtggcctgac

SEQ ID NO: 121901 - DNA, 25 bp, Homo sapien
ctggcttctctgttgaggattttga

SEQ ID NO: 121902 - DNA, 25 bp, Homo sapien
gcttctctgttgaggattttgagga

SEQ ID NO: 121903 - DNA, 25 bp, Homo sapien
ggtagtttaagagtccctgaccctg

SEQ ID NO: 121904 - DNA, 25 bp, Homo sapien
tagtttaagagtccctgaccctgga

SEQ ID NO: 121905 - DNA, 25 bp, Homo sapien
tggaggactgagatcccacctcctt

SEQ ID NO: 121906 - DNA, 25 bp, Homo sapien
attattataatcgtcagcctcttca

SEQ ID NO: 121907 - DNA, 25 bp, Homo sapien
ataatcgtcagcctcttcaatggcg

SEQ ID NO: 121908 - DNA, 25 bp, Homo sapien
ggaacgatgacttctgcctgcaggt

SEQ ID NO: 121909 - DNA, 25 bp, Homo sapien
atccaacaagccagaatcagcacag

SEQ ID NO: 121910 - DNA, 25 bp, Homo sapien
aagtggaatttcttgtttctccaga

SEQ ID NO: 121911 - DNA, 25 bp, Homo sapien
ttctccagatttttaatacgttaat

SEQ ID NO: 121912 - DNA, 25 bp, Homo sapien
aatacgttaatacgcaggcatctga

SEQ ID NO: 121913 - DNA, 25 bp, Homo sapien
gcaggcatctgatttgcatattcat

SEQ ID NO: 121914 - DNA, 25 bp, Homo sapien
gcatattcattcatggaccactgtt

SEQ ID NO: 121915 - DNA, 25 bp, Homo sapien
atggaccactgtttcttgcttgtac

SEQ ID NO: 121916 - DNA, 25 bp, Homo sapien
cactgtttcttgcttgtacctctgg

SEQ ID NO: 121917 - DNA, 25 bp, Homo sapien
gcttgtacctctggctgactaaatt

SEQ ID NO: 121918 - DNA, 25 bp, Homo sapien
gtacctctggctgactaaatttggg

SEQ ID NO: 121919 - DNA, 25 bp, Homo sapien
gggacagattcagtcttgccttaca

SEQ ID NO: 121920 - DNA, 25 bp, Homo sapien
tggcaggactccagatgaggacaag

SEQ ID NO: 121921 - DNA, 25 bp, Homo sapien
acaattgaggataccccgagctacc

SEQ ID NO: 121922 - DNA, 25 bp, Homo sapien
gaggataccccgagctaccaggaga

SEQ ID NO: 121923 - DNA, 25 bp, Homo sapien
gataccccgagctaccaggagagcc

SEQ ID NO: 121924 - DNA, 25 bp, Homo sapien
cccacacggaggacccaacaggagg

SEQ ID NO: 121925 - DNA, 25 bp, Homo sapien
aggacccaacaggaggccgtggctc

SEQ ID NO: 121926 - DNA, 25 bp, Homo sapien
caacaggaggccgtggctctgatgc

SEQ ID NO: 121927 - DNA, 25 bp, Homo sapien
cgtggctctgatgctgagcgaagct

SEQ ID NO: 121928 - DNA, 25 bp, Homo sapien
atgctgagcgaagctataggctctt

SEQ ID NO: 121929 - DNA, 25 bp, Homo sapien
cgaagctataggctcttgttggata

SEQ ID NO: 121930 - DNA, 25 bp, Homo sapien
agctataggctcttgttggataaaa

SEQ ID NO: 121931 - DNA, 25 bp, Homo sapien
caccccctaaagtgctctagtatgc

SEQ ID NO: 121932 - DNA, 25 bp, Homo sapien
accccctaaagtgctctagtatgcg

SEQ ID NO: 121933 - DNA, 25 bp, Homo sapien
cccctaaagtgctctagtatgcgga

SEQ ID NO: 121934 - DNA, 25 bp, Homo sapien
ccctaaagtgctctagtatgcggat

SEQ ID NO: 121935 - DNA, 25 bp, Homo sapien
cctaaagtgctctagtatgcggatg

SEQ ID NO: 121936 - DNA, 25 bp, Homo sapien
gtttattattaaagatctcgcctgt

SEQ ID NO: 121937 - DNA, 25 bp, Homo sapien
tttattattaaagatctcgcctgtt

SEQ ID NO: 121938 - DNA, 25 bp, Homo sapien
ttattattaaagatctcgcctgttc

SEQ ID NO: 121939 - DNA, 25 bp, Homo sapien
tattattaaagatctcgcctgttcc

SEQ ID NO: 121940 - DNA, 25 bp, Homo sapien
attattaaagatctcgcctgttcct

SEQ ID NO: 121941 - DNA, 25 bp, Homo sapien
ttattaaagatctcgcctgttcctg

SEQ ID NO: 121942 - DNA, 25 bp, Homo sapien
ttttcaaaaaacttcaccatgaagc

SEQ ID NO: 121943 - DNA, 25 bp, Homo sapien
caccatgaagcacaatgtatatatt

SEQ ID NO: 121944 - DNA, 25 bp, Homo sapien
ataacagtctgtttggccattacta

SEQ ID NO: 121945 - DNA, 25 bp, Homo sapien
gtctgtttggccattactacacttt

SEQ ID NO: 121946 - DNA, 25 bp, Homo sapien
tggccattactacactttttacttt

SEQ ID NO: 121947 - DNA, 25 bp, Homo sapien
gtttgttgagctacattcttcattg

SEQ ID NO: 121948 - DNA, 25 bp, Homo sapien
gttgagctacattcttcattgcttt

SEQ ID NO: 121949 - DNA, 25 bp, Homo sapien
tgcagttttctctagaaagctctga

SEQ ID NO: 121950 - DNA, 25 bp, Homo sapien
ttctctagaaagctctgagaagctt

SEQ ID NO: 121951 - DNA, 25 bp, Homo sapien
tgagaagctttctctgctgcagctg

SEQ ID NO: 121952 - DNA, 25 bp, Homo sapien
tctgctgcagctgtgtataaaatat

SEQ ID NO: 121953 - DNA, 25 bp, Homo sapien
aaagtatcatggtgtttctctcctc

SEQ ID NO: 121954 - DNA, 25 bp, Homo sapien
acccaccagagacactaaatctgta

SEQ ID NO: 121955 - DNA, 25 bp, Homo sapien
gagacactaaatctgtaacaatgaa

SEQ ID NO: 121956 - DNA, 25 bp, Homo sapien
tctgtaacaatgaaagactgccttt

SEQ ID NO: 121957 - DNA, 25 bp, Homo sapien
aaagactgcctttgttttctaagat

SEQ ID NO: 121958 - DNA, 25 bp, Homo sapien
gttttctaagatgtaaatcactcaa

SEQ ID NO: 121959 - DNA, 25 bp, Homo sapien
cactcaaagtatatggtgtacagtt

SEQ ID NO: 121960 - DNA, 25 bp, Homo sapien
ttctgaatacagaagttgtggccaa

SEQ ID NO: 121961 - DNA, 25 bp, Homo sapien
aatacagaagttgtggccaagtaca

SEQ ID NO: 121962 - DNA, 25 bp, Homo sapien
gttgtggccaagtacaaattatggt

SEQ ID NO: 121963 - DNA, 25 bp, Homo sapien
caaattatggtatctattacttttt

SEQ ID NO: 121964 - DNA, 25 bp, Homo sapien
tgcacgccgtggagcatcaggccac

SEQ ID NO: 121965 - DNA, 25 bp, Homo sapien
gagcatcaggccacacactctgcat

SEQ ID NO: 121966 - DNA, 25 bp, Homo sapien
ctttgtgtacttcagtcttggagtt

SEQ ID NO: 121967 - DNA, 25 bp, Homo sapien
gtacttcagtcttggagtttggaac

SEQ ID NO: 121968 - DNA, 25 bp, Homo sapien
gagtttggaactctaccctggtagg

SEQ ID NO: 121969 - DNA, 25 bp, Homo sapien
ccctggtaggaaagcaccgcagcat

SEQ ID NO: 121970 - DNA, 25 bp, Homo sapien
gggaagcaagacgtcctggaatgaa

SEQ ID NO: 121971 - DNA, 25 bp, Homo sapien
ctggaatgaagcatgtagctctatg

SEQ ID NO: 121972 - DNA, 25 bp, Homo sapien
gggagggctgcctgaaaaccatcca

SEQ ID NO: 121973 - DNA, 25 bp, Homo sapien
aaccatccatctgtggaaatgacag

SEQ ID NO: 121974 - DNA, 25 bp, Homo sapien
gaacacccggaaagactgaaagaat

SEQ ID NO: 121975 - DNA, 25 bp, Homo sapien
gaagcgttgtttcccaagtttcaca

SEQ ID NO: 121976 - DNA, 25 bp, Homo sapien
gagtcggtcacctggatcatccaga

SEQ ID NO: 121977 - DNA, 25 bp, Homo sapien
gaaggagcccgttgaagtggcccca

SEQ ID NO: 121978 - DNA, 25 bp, Homo sapien
tctgcatttcgtactctcctgtttt

SEQ ID NO: 121979 - DNA, 25 bp, Homo sapien
tctcctgttttctgcacttggtgaa

SEQ ID NO: 121980 - DNA, 25 bp, Homo sapien
gatggtgaacaactatcgcccactt

SEQ ID NO: 121981 - DNA, 25 bp, Homo sapien
cacttcaacccttgatgaaccggaa

SEQ ID NO: 121982 - DNA, 25 bp, Homo sapien
atgaaccggaaggtctgggcgtcct

SEQ ID NO: 121983 - DNA, 25 bp, Homo sapien
gtccttccaggccactaatgagggc

SEQ ID NO: 121984 - DNA, 25 bp, Homo sapien
gagggcacaaggtcctagagacatt

SEQ ID NO: 121985 - DNA, 25 bp, Homo sapien
gagacattaggtccacatgaatagc

SEQ ID NO: 121986 - DNA, 25 bp, Homo sapien
aaccatcatagtacaggtaaggtga

SEQ ID NO: 121987 - DNA, 25 bp, Homo sapien
gaactactcagggaatgaaggtgtc

SEQ ID NO: 121988 - DNA, 25 bp, Homo sapien
agaggtgctactgactttctcagcc

SEQ ID NO: 121989 - DNA, 25 bp, Homo sapien
agcctctgaatatgaacggtgagca

SEQ ID NO: 121990 - DNA, 25 bp, Homo sapien
acggtgagcattgtggctgtcagca

SEQ ID NO: 121991 - DNA, 25 bp, Homo sapien
aatgtctttccttttgctcttaagt

SEQ ID NO: 121992 - DNA, 25 bp, Homo sapien
tccttttgctcttaagttgtggaga

SEQ ID NO: 121993 - DNA, 25 bp, Homo sapien
ttgtggagagtgcaacagtagcata

SEQ ID NO: 121994 - DNA, 25 bp, Homo sapien
agtagcataggaccctaccctctgg

SEQ ID NO: 121995 - DNA, 25 bp, Homo sapien
taccctctgggccaagtcaaagaca

SEQ ID NO: 121996 - DNA, 25 bp, Homo sapien
cattctgacatcttagtatttgcat

SEQ ID NO: 121997 - DNA, 25 bp, Homo sapien
agctccttgactccttgtggtttat

SEQ ID NO: 121998 - DNA, 25 bp, Homo sapien
atcatacatgactcagcatacctgc

SEQ ID NO: 121999 - DNA, 25 bp, Homo sapien
agctgaagattttggagggtcctcc

SEQ ID NO: 122000 - DNA, 25 bp, Homo sapien
gagggtcctccacaataaggtcaat

SEQ ID NO: 122001 - DNA, 25 bp, Homo sapien
tcaatgccagagacggaagcctttt

SEQ ID NO: 122002 - DNA, 25 bp, Homo sapien
atatcatcagcatacctttattgtg

SEQ ID NO: 122003 - DNA, 25 bp, Homo sapien
agacctgacaagtttcttcagtgtg

SEQ ID NO: 122004 - DNA, 25 bp, Homo sapien
aatcctgaggattcatcttgcacat

SEQ ID NO: 122005 - DNA, 25 bp, Homo sapien
tcatcttgcacatctgagatctgag

SEQ ID NO: 122006 - DNA, 25 bp, Homo sapien
gagatctgagccagtcgctgtggtt

SEQ ID NO: 122007 - DNA, 25 bp, Homo sapien
ctgtggttgttttagctccttgact

SEQ ID NO: 122008 - DNA, 25 bp, Homo sapien
tgtggccagtactcgggacagacta

SEQ ID NO: 122009 - DNA, 25 bp, Homo sapien
tactcgggacagactaagggcgctt

SEQ ID NO: 122010 - DNA, 25 bp, Homo sapien
taagggcgcttgtcccatcctggac

SEQ ID NO: 122011 - DNA, 25 bp, Homo sapien
atcctggacttttcctctcatgtct

SEQ ID NO: 122012 - DNA, 25 bp, Homo sapien
ctctcatgtctttgctgcagaactg

SEQ ID NO: 122013 - DNA, 25 bp, Homo sapien
tgcagaactgaagagactaggcgct

SEQ ID NO: 122014 - DNA, 25 bp, Homo sapien
gcttccctcttaagctaagactgat

SEQ ID NO: 122015 - DNA, 25 bp, Homo sapien
gctaagactgatgtcagaggcccca

SEQ ID NO: 122016 - DNA, 25 bp, Homo sapien
gggccactgcctgaggctcacggta

SEQ ID NO: 122017 - DNA, 25 bp, Homo sapien
tgaggctcacggtacagaggcctgc

SEQ ID NO: 122018 - DNA, 25 bp, Homo sapien
caggaggttctcactgttgtgaagg

SEQ ID NO: 122019 - DNA, 25 bp, Homo sapien
cagaagtttctactgtctcgtctac

SEQ ID NO: 122020 - DNA, 25 bp, Homo sapien
tggccccaactgaggacccaatatt

SEQ ID NO: 122021 - DNA, 25 bp, Homo sapien
ttctgtgtctgctacgtgccctacg

SEQ ID NO: 122022 - DNA, 25 bp, Homo sapien
ggccttcgccatgtacatggtcaac

SEQ ID NO: 122023 - DNA, 25 bp, Homo sapien
gtcaacaaccgtaaccatgggctgg

SEQ ID NO: 122024 - DNA, 25 bp, Homo sapien
atgggctggacttacggcttgtcac

SEQ ID NO: 122025 - DNA, 25 bp, Homo sapien
ttacggcttgtcaccattccttcat

SEQ ID NO: 122026 - DNA, 25 bp, Homo sapien
attccttcattcttctccaagagtg

SEQ ID NO: 122027 - DNA, 25 bp, Homo sapien
agagtgcttgcatctacaatcccat

SEQ ID NO: 122028 - DNA, 25 bp, Homo sapien
agcagttccaagcttgcatcatgaa

SEQ ID NO: 122029 - DNA, 25 bp, Homo sapien
agatgaatccgacacatgcagctcc

SEQ ID NO: 122030 - DNA, 25 bp, Homo sapien
gctgaggtcttcacaggtcatatgg

SEQ ID NO: 122031 - DNA, 25 bp, Homo sapien
agctggtacccctgaaggagaccat

SEQ ID NO: 122032 - DNA, 25 bp, Homo sapien
gagaccatcaaaggattccagcaga

SEQ ID NO: 122033 - DNA, 25 bp, Homo sapien
gattccagcagattttggcaggtga

SEQ ID NO: 122034 - DNA, 25 bp, Homo sapien
ggcaggtgaatatgaccatctccca

SEQ ID NO: 122035 - DNA, 25 bp, Homo sapien
caggccttctatatggtgggaccca

SEQ ID NO: 122036 - DNA, 25 bp, Homo sapien
tggtgggacccattgaagaagctgt

SEQ ID NO: 122037 - DNA, 25 bp, Homo sapien
aagctggctgaagagcattcatcgt

SEQ ID NO: 122038 - DNA, 25 bp, Homo sapien
gggtctttgtcctctgtacttgtct

SEQ ID NO: 122039 - DNA, 25 bp, Homo sapien
aaaagcttcatttttctatataggc

SEQ ID NO: 122040 - DNA, 25 bp, Homo sapien
tataggctgcacaagagccttgatt

SEQ ID NO: 122041 - DNA, 25 bp, Homo sapien
gaccctgacaggttgccctgggctc

SEQ ID NO: 122042 - DNA, 25 bp, Homo sapien
tgacaggttgccctgggctccgggt

SEQ ID NO: 122043 - DNA, 25 bp, Homo sapien
acaggttgccctgggctccgggtgg

SEQ ID NO: 122044 - DNA, 25 bp, Homo sapien
ataaagaggacccttcctctcattg

SEQ ID NO: 122045 - DNA, 25 bp, Homo sapien
ccttcctctcattggctctttttct

SEQ ID NO: 122046 - DNA, 25 bp, Homo sapien
gatggagcgtcctcgaagctccagc

SEQ ID NO: 122047 - DNA, 25 bp, Homo sapien
atggagcgtcctcgaagctccagcc

SEQ ID NO: 122048 - DNA, 25 bp, Homo sapien
gcgtcctcgaagctccagccctggg

SEQ ID NO: 122049 - DNA, 25 bp, Homo sapien
gatgggagtccctgctgaatatctg

SEQ ID NO: 122050 - DNA, 25 bp, Homo sapien
tgggagtccctgctgaatatctgga

SEQ ID NO: 122051 - DNA, 25 bp, Homo sapien
gaatatctggagaccctgacaggtt

SEQ ID NO: 122052 - DNA, 25 bp, Homo sapien
agccctgcagtcacgtgaggcccct

SEQ ID NO: 122053 - DNA, 25 bp, Homo sapien
aggcccctgtgcagtagagagcctt

SEQ ID NO: 122054 - DNA, 25 bp, Homo sapien
tggagcctgggcagcacctccggga

SEQ ID NO: 122055 - DNA, 25 bp, Homo sapien
cctccgggactgaccttcggcagtg

SEQ ID NO: 122056 - DNA, 25 bp, Homo sapien
ccgggactgaccttcggcagtggct

SEQ ID NO: 122057 - DNA, 25 bp, Homo sapien
tcagtgcctgctgttcgtgactcag

SEQ ID NO: 122058 - DNA, 25 bp, Homo sapien
agtgcctgctgttcgtgactcagaa

SEQ ID NO: 122059 - DNA, 25 bp, Homo sapien
gtgcctgctgttcgtgactcagaaa

SEQ ID NO: 122060 - DNA, 25 bp, Homo sapien
gcctgctgttcgtgactcagaaaca

SEQ ID NO: 122061 - DNA, 25 bp, Homo sapien
tgttcgtgactcagaaacagaagaa

SEQ ID NO: 122062 - DNA, 25 bp, Homo sapien
taagactattggtaaacacctaaat

SEQ ID NO: 122063 - DNA, 25 bp, Homo sapien
ccttactgggtttccaagcagagga

SEQ ID NO: 122064 - DNA, 25 bp, Homo sapien
gagtcacatgattacaattgccagt

SEQ ID NO: 122065 - DNA, 25 bp, Homo sapien
caattgccagtagagttgttgtttg

SEQ ID NO: 122066 - DNA, 25 bp, Homo sapien
aaaacctacagcctttctacattct

SEQ ID NO: 122067 - DNA, 25 bp, Homo sapien
cattctgacatgctaacagtggttt

SEQ ID NO: 122068 - DNA, 25 bp, Homo sapien
gcagaagcacttatgtttacggata

SEQ ID NO: 122069 - DNA, 25 bp, Homo sapien
agagagcagcctttgaaaatcccca

SEQ ID NO: 122070 - DNA, 25 bp, Homo sapien
gaaaatccccaatttggttctgctt

SEQ ID NO: 122071 - DNA, 25 bp, Homo sapien
ttctgctttttgacctctctctacc

SEQ ID NO: 122072 - DNA, 25 bp, Homo sapien
ctctctctaccttttcagggtaatc

SEQ ID NO: 122073 - DNA, 25 bp, Homo sapien
ttcagggtaatctttgtggcacaaa

SEQ ID NO: 122074 - DNA, 25 bp, Homo sapien
tacatgtgggaattacagataaacg

SEQ ID NO: 122075 - DNA, 25 bp, Homo sapien
acatgtgggaattacagataaacgg

SEQ ID NO: 122076 - DNA, 25 bp, Homo sapien
catgtgggaattacagataaacgga

SEQ ID NO: 122077 - DNA, 25 bp, Homo sapien
gtgggaattacagataaacggaagc

SEQ ID NO: 122078 - DNA, 25 bp, Homo sapien
tgggaattacagataaacggaagcc

SEQ ID NO: 122079 - DNA, 25 bp, Homo sapien
gggaattacagataaacggaagccg

SEQ ID NO: 122080 - DNA, 25 bp, Homo sapien
ggaattacagataaacggaagccgg

SEQ ID NO: 122081 - DNA, 25 bp, Homo sapien
gaattacagataaacggaagccggc

SEQ ID NO: 122082 - DNA, 25 bp, Homo sapien
aattacagataaacggaagccggct

SEQ ID NO: 122083 - DNA, 25 bp, Homo sapien
attacagataaacggaagccggctg

SEQ ID NO: 122084 - DNA, 25 bp, Homo sapien
tacagataaacggaagccggctggg

SEQ ID NO: 122085 - DNA, 25 bp, Homo sapien
atttgcccagagttcagtcctggct

SEQ ID NO: 122086 - DNA, 25 bp, Homo sapien
ggaaaggacaagtcagggaccactt

SEQ ID NO: 122087 - DNA, 25 bp, Homo sapien
gtcagggaccacttgctgaagcacg

SEQ ID NO: 122088 - DNA, 25 bp, Homo sapien
ttgctgaagcacgaagagcccttgt

SEQ ID NO: 122089 - DNA, 25 bp, Homo sapien
gcacgaagagcccttgtggcaatgt

SEQ ID NO: 122090 - DNA, 25 bp, Homo sapien
aactgatgtttaagtgctccaagca

SEQ ID NO: 122091 - DNA, 25 bp, Homo sapien
gtgggctcaaatctaggccctggca

SEQ ID NO: 122092 - DNA, 25 bp, Homo sapien
aaatctaggccctggcactgtcatc

SEQ ID NO: 122093 - DNA, 25 bp, Homo sapien
gcactgtcatcaagcaattcactgc

SEQ ID NO: 122094 - DNA, 25 bp, Homo sapien
aagcaattcactgcatccctctgtg

SEQ ID NO: 122095 - DNA, 25 bp, Homo sapien
gatcatgcatgctacctcaaaggtt

SEQ ID NO: 122096 - DNA, 25 bp, Homo sapien
ctgaatcttgaagactgcaaagtga

SEQ ID NO: 122097 - DNA, 25 bp, Homo sapien
aacactggcatctgttgaaatttgg

SEQ ID NO: 122098 - DNA, 25 bp, Homo sapien
acactggcatctgttgaaatttgga

SEQ ID NO: 122099 - DNA, 25 bp, Homo sapien
ttagataagcatatgttacttacct

SEQ ID NO: 122100 - DNA, 25 bp, Homo sapien
tagataagcatatgttacttacctt

SEQ ID NO: 122101 - DNA, 25 bp, Homo sapien
agataagcatatgttacttaccttg

SEQ ID NO: 122102 - DNA, 25 bp, Homo sapien
gataagcatatgttacttaccttgt

SEQ ID NO: 122103 - DNA, 25 bp, Homo sapien
ataagcatatgttacttaccttgtt

SEQ ID NO: 122104 - DNA, 25 bp, Homo sapien
taagcatatgttacttaccttgtta

SEQ ID NO: 122105 - DNA, 25 bp, Homo sapien
aagcatatgttacttaccttgttat

SEQ ID NO: 122106 - DNA, 25 bp, Homo sapien
agcatatgttacttaccttgttatt

SEQ ID NO: 122107 - DNA, 25 bp, Homo sapien
gcgtaccttgatataccccatcgac

SEQ ID NO: 122108 - DNA, 25 bp, Homo sapien
cccatcgacctcagcaagcaattag

SEQ ID NO: 122109 - DNA, 25 bp, Homo sapien
acaaggcttcaaagtacctgtgtgt

SEQ ID NO: 122110 - DNA, 25 bp, Homo sapien
gtgtgtccctcatggagccacctgc

SEQ ID NO: 122111 - DNA, 25 bp, Homo sapien
gttcttcttctacaataagtttctg

SEQ ID NO: 122112 - DNA, 25 bp, Homo sapien
tggaagcacttccagaacttcacct

SEQ ID NO: 122113 - DNA, 25 bp, Homo sapien
gaacttcacctccatatcagaagtg

SEQ ID NO: 122114 - DNA, 25 bp, Homo sapien
tcagaagtgccaataatcgtcatag

SEQ ID NO: 122115 - DNA, 25 bp, Homo sapien
aatcgtcataggcttctgcacgttg

SEQ ID NO: 122116 - DNA, 25 bp, Homo sapien
aggcttctgcacgttggatcaacta

SEQ ID NO: 122117 - DNA, 25 bp, Homo sapien
tgtaaatgaatttagtttcccttag

SEQ ID NO: 122118 - DNA, 25 bp, Homo sapien
gaatccttaaaggtgagccctcata

SEQ ID NO: 122119 - DNA, 25 bp, Homo sapien
aggtgagccctcatagggagatcca

SEQ ID NO: 122120 - DNA, 25 bp, Homo sapien
ctcatagggagatccaaagtcctgt

SEQ ID NO: 122121 - DNA, 25 bp, Homo sapien
aaagtcctgtggttaacgccttcat

SEQ ID NO: 122122 - DNA, 25 bp, Homo sapien
gtggttaacgccttcatttatagat

SEQ ID NO: 122123 - DNA, 25 bp, Homo sapien
gaacaacctgctcacagtcctcatt

SEQ ID NO: 122124 - DNA, 25 bp, Homo sapien
gctcacagtcctcatttactggatt

SEQ ID NO: 122125 - DNA, 25 bp, Homo sapien
ttactggatttgacttcagccaggt

SEQ ID NO: 122126 - DNA, 25 bp, Homo sapien
gaagggcattaggagtgtttcattt

SEQ ID NO: 122127 - DNA, 25 bp, Homo sapien
gtttcatttgatatgtgaatgctca

SEQ ID NO: 122128 - DNA, 25 bp, Homo sapien
tcagtggtgcctgcatttataatta

SEQ ID NO: 122129 - DNA, 25 bp, Homo sapien
cttccagacagaggtgtgagtgcca

SEQ ID NO: 122130 - DNA, 25 bp, Homo sapien
cagacagaggtgtgagtgccacgct

SEQ ID NO: 122131 - DNA, 25 bp, Homo sapien
tgagtgccacgctggactgcccact

SEQ ID NO: 122132 - DNA, 25 bp, Homo sapien
gctggactgcccactgcatataaat

SEQ ID NO: 122133 - DNA, 25 bp, Homo sapien
attttcacactccactttggaacta

SEQ ID NO: 122134 - DNA, 25 bp, Homo sapien
actccactttggaactacccaggag

SEQ ID NO: 122135 - DNA, 25 bp, Homo sapien
actttggaactacccaggagccagc

SEQ ID NO: 122136 - DNA, 25 bp, Homo sapien
ttggaactacccaggagccagcgcc

SEQ ID NO: 122137 - DNA, 25 bp, Homo sapien
agggaggcgccgtggactcagccag

SEQ ID NO: 122138 - DNA, 25 bp, Homo sapien
ggagccggacatggcttggcctggg

SEQ ID NO: 122139 - DNA, 25 bp, Homo sapien
gcccttccttgtttctcagaggccc

SEQ ID NO: 122140 - DNA, 25 bp, Homo sapien
acatctgcacacacgcagctttgtt

SEQ ID NO: 122141 - DNA, 25 bp, Homo sapien
ctgcacacacgcagctttgttctca

SEQ ID NO: 122142 - DNA, 25 bp, Homo sapien
ttctcacctctacctgtcattccag

SEQ ID NO: 122143 - DNA, 25 bp, Homo sapien
tcttgtcacaaactgccccagcaag

SEQ ID NO: 122144 - DNA, 25 bp, Homo sapien
gcaagaatttgaggttctgacaaca

SEQ ID NO: 122145 - DNA, 25 bp, Homo sapien
gaggttctgacaacagtacccatcc

SEQ ID NO: 122146 - DNA, 25 bp, Homo sapien
gctcagtttctagaaagctcccttt

SEQ ID NO: 122147 - DNA, 25 bp, Homo sapien
ttctagaaagctcccttttctttga

SEQ ID NO: 122148 - DNA, 25 bp, Homo sapien
ctgcatgttgaattgaactttgtga

SEQ ID NO: 122149 - DNA, 25 bp, Homo sapien
ggcaacagtgagtgaagacatattt

SEQ ID NO: 122150 - DNA, 25 bp, Homo sapien
gtgaagacatattttagcactgaat

SEQ ID NO: 122151 - DNA, 25 bp, Homo sapien
cctttgtgtccaagcaggagggcag

SEQ ID NO: 122152 - DNA, 25 bp, Homo sapien
agtgaagagacccaggcgctacctg

SEQ ID NO: 122153 - DNA, 25 bp, Homo sapien
aggcgctacctgtatcaatggctgg

SEQ ID NO: 122154 - DNA, 25 bp, Homo sapien
ctacctgtatcaatggctgggagcc

SEQ ID NO: 122155 - DNA, 25 bp, Homo sapien
aggtgtgtgagctcaatccggactg

SEQ ID NO: 122156 - DNA, 25 bp, Homo sapien
agctcaatccggactgtgacgagtt

SEQ ID NO: 122157 - DNA, 25 bp, Homo sapien
tgacgagttggctgaccacatcggc

SEQ ID NO: 122158 - DNA, 25 bp, Homo sapien
accacatcggctttcaggaggccta

SEQ ID NO: 122159 - DNA, 25 bp, Homo sapien
ttcaggaggcctatcggcgcttcta

SEQ ID NO: 122160 - DNA, 25 bp, Homo sapien
ttctacggcccggtctagggtgtcg

SEQ ID NO: 122161 - DNA, 25 bp, Homo sapien
cccggtctagggtgtcgctctgctg

SEQ ID NO: 122162 - DNA, 25 bp, Homo sapien
gaaaaacaccgcttctgccttttca

SEQ ID NO: 122163 - DNA, 25 bp, Homo sapien
ttctgccttttcactgtgttggagt

SEQ ID NO: 122164 - DNA, 25 bp, Homo sapien
gttggagttttctggagtgagcact

SEQ ID NO: 122165 - DNA, 25 bp, Homo sapien
acgccctaagcgcacattcatgtgg

SEQ ID NO: 122166 - DNA, 25 bp, Homo sapien
tcatgtgggcatttcttgcgagcct

SEQ ID NO: 122167 - DNA, 25 bp, Homo sapien
agcctccggaagctgtcgacttcat

SEQ ID NO: 122168 - DNA, 25 bp, Homo sapien
gaagctgtcgacttcatgacaagca

SEQ ID NO: 122169 - DNA, 25 bp, Homo sapien
gacaagcattttgtgaactagggaa

SEQ ID NO: 122170 - DNA, 25 bp, Homo sapien
gttactggcttctcttgagtcacac

SEQ ID NO: 122171 - DNA, 25 bp, Homo sapien
tgagtcacactgctagcaaatggca

SEQ ID NO: 122172 - DNA, 25 bp, Homo sapien
gcaaatggcagaaccaaagctcaaa

SEQ ID NO: 122173 - DNA, 25 bp, Homo sapien
ctgggagatcagagcaacagctaca

SEQ ID NO: 122174 - DNA, 25 bp, Homo sapien
ggagatcagagcaacagctacaaca

SEQ ID NO: 122175 - DNA, 25 bp, Homo sapien
gatcagagcaacagctacaacaatg

SEQ ID NO: 122176 - DNA, 25 bp, Homo sapien
gagcaacagctacaacaatgaagaa

SEQ ID NO: 122177 - DNA, 25 bp, Homo sapien
acaatgaagaattccctgatctaac

SEQ ID NO: 122178 - DNA, 25 bp, Homo sapien
gaagaattccctgatctaactatgt

SEQ ID NO: 122179 - DNA, 25 bp, Homo sapien
aagaattccctgatctaactatgtt

SEQ ID NO: 122180 - DNA, 25 bp, Homo sapien
gaattccctgatctaactatgtttc

SEQ ID NO: 122181 - DNA, 25 bp, Homo sapien
attccctgatctaactatgtttccc

SEQ ID NO: 122182 - DNA, 25 bp, Homo sapien
ttccctgatctaactatgtttcccc

SEQ ID NO: 122183 - DNA, 25 bp, Homo sapien
ctgatctaactatgtttcccccctt

SEQ ID NO: 122184 - DNA, 25 bp, Homo sapien
cagtccctccatctggtatgagtaa

SEQ ID NO: 122185 - DNA, 25 bp, Homo sapien
gtatgagtaaccagatagagcacaa

SEQ ID NO: 122186 - DNA, 25 bp, Homo sapien
agttaaaagagcttctttcacagtg

SEQ ID NO: 122187 - DNA, 25 bp, Homo sapien
gataacaaatgccttttgtagccaa

SEQ ID NO: 122188 - DNA, 25 bp, Homo sapien
ttttgtagccaaaaccaggcgtctc

SEQ ID NO: 122189 - DNA, 25 bp, Homo sapien
caaaaccaggcgtctcaaccttacg

SEQ ID NO: 122190 - DNA, 25 bp, Homo sapien
gaacattgattgtttggtaccgaaa

SEQ ID NO: 122191 - DNA, 25 bp, Homo sapien
tttggtaccgaaaacagcagtggac

SEQ ID NO: 122192 - DNA, 25 bp, Homo sapien
acagcagtggacgatgttgtgcaat

SEQ ID NO: 122193 - DNA, 25 bp, Homo sapien
gttgtgcaatatccatctactgtag

SEQ ID NO: 122194 - DNA, 25 bp, Homo sapien
tcatatttctgccaaggatgtgcct

SEQ ID NO: 122195 - DNA, 25 bp, Homo sapien
gaggttaccaccattgtgatcaaga

SEQ ID NO: 122196 - DNA, 25 bp, Homo sapien
taactgcatctcttcagtgcaacag

SEQ ID NO: 122197 - DNA, 25 bp, Homo sapien
agtgcaacagtactgcgcaaacaga

SEQ ID NO: 122198 - DNA, 25 bp, Homo sapien
gagaaagtcagtgttatccaggact

SEQ ID NO: 122199 - DNA, 25 bp, Homo sapien
ggactttgtgaaaatgtgcctggaa

SEQ ID NO: 122200 - DNA, 25 bp, Homo sapien
ggaagccaacatcccacttgagaag

SEQ ID NO: 122201 - DNA, 25 bp, Homo sapien
gctttcctatctcgccatgtgaaga

SEQ ID NO: 122202 - DNA, 25 bp, Homo sapien
atggaggctccatacctaagtcaga

SEQ ID NO: 122203 - DNA, 25 bp, Homo sapien
tacctaagtcagaccagctacggag

SEQ ID NO: 122204 - DNA, 25 bp, Homo sapien
atcaactcctcaactcacaagattg

SEQ ID NO: 122205 - DNA, 25 bp, Homo sapien
ttgttgactaggaggttaccaccat

SEQ ID NO: 122206 - DNA, 25 bp, Homo sapien
ttttcaaaaaacttcaccatgaagc

SEQ ID NO: 122207 - DNA, 25 bp, Homo sapien
caccatgaagcacaatgtatatatt

SEQ ID NO: 122208 - DNA, 25 bp, Homo sapien
ataacagtctgtttggccattacta

SEQ ID NO: 122209 - DNA, 25 bp, Homo sapien
aacagtctgtttggccattactaca

SEQ ID NO: 122210 - DNA, 25 bp, Homo sapien
gtctgtttggccattactacacttt

SEQ ID NO: 122211 - DNA, 25 bp, Homo sapien
tggccattactacactttttacttt

SEQ ID NO: 122212 - DNA, 25 bp, Homo sapien
gtttgttgagctacattcttcattg

SEQ ID NO: 122213 - DNA, 25 bp, Homo sapien
gttgagctacattcttcattgcttt

SEQ ID NO: 122214 - DNA, 25 bp, Homo sapien
tattgcagttttctctagaaagctc

SEQ ID NO: 122215 - DNA, 25 bp, Homo sapien
gcagttttctctagaaagctctgag

SEQ ID NO: 122216 - DNA, 25 bp, Homo sapien
ttctctagaaagctctgagaagctt

SEQ ID NO: 122217 - DNA, 25 bp, Homo sapien
gcccactgtaccagcctctgataag

SEQ ID NO: 122218 - DNA, 25 bp, Homo sapien
gcctccagttgtcctttatgaacat

SEQ ID NO: 122219 - DNA, 25 bp, Homo sapien
aacattgcagggacaacctgtgttt

SEQ ID NO: 122220 - DNA, 25 bp, Homo sapien
acctgtgtttgccagctgggtgttc

SEQ ID NO: 122221 - DNA, 25 bp, Homo sapien
gccagctgggtgttccgtgtaaata

SEQ ID NO: 122222 - DNA, 25 bp, Homo sapien
ggtgttccgtgtaaatagccagcct

SEQ ID NO: 122223 - DNA, 25 bp, Homo sapien
gtgtaaatagccagcctgtctcttt

SEQ ID NO: 122224 - DNA, 25 bp, Homo sapien
gcctgtctctttctcggtgataaaa

SEQ ID NO: 122225 - DNA, 25 bp, Homo sapien
tgataaaacacacgcgctcctggag

SEQ ID NO: 122226 - DNA, 25 bp, Homo sapien
ctggaagcatttttaactgggtaga

SEQ ID NO: 122227 - DNA, 25 bp, Homo sapien
aagacgtgagtcctaacctggccac

SEQ ID NO: 122228 - DNA, 25 bp, Homo sapien
attagcaagacagcatgccttcaaa

SEQ ID NO: 122229 - DNA, 25 bp, Homo sapien
gcaagacagcatgccttcaaatcaa

SEQ ID NO: 122230 - DNA, 25 bp, Homo sapien
attttagttcttactgcttaattca

SEQ ID NO: 122231 - DNA, 25 bp, Homo sapien
gttcttactgcttaattcaaataat

SEQ ID NO: 122232 - DNA, 25 bp, Homo sapien
agtaagctagcaaatagtaatctgt

SEQ ID NO: 122233 - DNA, 25 bp, Homo sapien
aatagtaatctgtaagcataagctt

SEQ ID NO: 122234 - DNA, 25 bp, Homo sapien
aagcataagcttatcttaaattcaa

SEQ ID NO: 122235 - DNA, 25 bp, Homo sapien
agtgatttgtatgtctatttttttc

SEQ ID NO: 122236 - DNA, 25 bp, Homo sapien
aacttgtccttcctcaagaacacag

SEQ ID NO: 122237 - DNA, 25 bp, Homo sapien
agccctgcttctgacataatccagt

SEQ ID NO: 122238 - DNA, 25 bp, Homo sapien
gcttctgacataatccagttaaaat

SEQ ID NO: 122239 - DNA, 25 bp, Homo sapien
agccgcacctgttcctgatgggctg

SEQ ID NO: 122240 - DNA, 25 bp, Homo sapien
agatcttaaccaagagccccttgca

SEQ ID NO: 122241 - DNA, 25 bp, Homo sapien
aagagccccttgcaaacttcttcga

SEQ ID NO: 122242 - DNA, 25 bp, Homo sapien
gcaaacttcttcgactcagattcag

SEQ ID NO: 122243 - DNA, 25 bp, Homo sapien
acacgaggaaacattattcattgga

SEQ ID NO: 122244 - DNA, 25 bp, Homo sapien
gcatggtgtgtattttagggattat

SEQ ID NO: 122245 - DNA, 25 bp, Homo sapien
tctttcaagggctaaggctgcagag

SEQ ID NO: 122246 - DNA, 25 bp, Homo sapien
ggctgcagagatatttcctccagga

SEQ ID NO: 122247 - DNA, 25 bp, Homo sapien
tttcctccaggaatcgtgtttcaat

SEQ ID NO: 122248 - DNA, 25 bp, Homo sapien
gaatcgtgtttcaattgtaaccaag

SEQ ID NO: 122249 - DNA, 25 bp, Homo sapien
ccaagaaatttccatttgtgcttca

SEQ ID NO: 122250 - DNA, 25 bp, Homo sapien
ttacacacaccttcagttagcttca

SEQ ID NO: 122251 - DNA, 25 bp, Homo sapien
agttagcttcaactgcctccgtttc

SEQ ID NO: 122252 - DNA, 25 bp, Homo sapien
tcagggtcccctgaatgctgcatca

SEQ ID NO: 122253 - DNA, 25 bp, Homo sapien
aatgctgcatcattgtgttcagtgc

SEQ ID NO: 122254 - DNA, 25 bp, Homo sapien
agctggactgattgcacctgtgtat

SEQ ID NO: 122255 - DNA, 25 bp, Homo sapien
attgcacctgtgtatttgcccctga

SEQ ID NO: 122256 - DNA, 25 bp, Homo sapien
gagcactttcctttacacatgtggc

SEQ ID NO: 122257 - DNA, 25 bp, Homo sapien
ggcttgtcttgccaatagactccag

SEQ ID NO: 122258 - DNA, 25 bp, Homo sapien
tagactccaggcttacaccttccat

SEQ ID NO: 122259 - DNA, 25 bp, Homo sapien
catcgtattctccagtttccaggat

SEQ ID NO: 122260 - DNA, 25 bp, Homo sapien
gtttccaggatagatgttgctcatc

SEQ ID NO: 122261 - DNA, 25 bp, Homo sapien
cagatgggcggacggctgtggaccg

SEQ ID NO: 122262 - DNA, 25 bp, Homo sapien
gcggacggctgtggaccgtggacag

SEQ ID NO: 122263 - DNA, 25 bp, Homo sapien
agcgcggccagcgtcccagggtacc

SEQ ID NO: 122264 - DNA, 25 bp, Homo sapien
cagggtacccgcctgagctcctgct

SEQ ID NO: 122265 - DNA, 25 bp, Homo sapien
ccatccctcgggaagcagccagctc

SEQ ID NO: 122266 - DNA, 25 bp, Homo sapien
gtggagggcacagccctccgaccct

SEQ ID NO: 122267 - DNA, 25 bp, Homo sapien
gggcaggactgagtcccctccagga

SEQ ID NO: 122268 - DNA, 25 bp, Homo sapien
gactgagtcccctccaggaagaagc

SEQ ID NO: 122269 - DNA, 25 bp, Homo sapien
actgagtcccctccaggaagaagca

SEQ ID NO: 122270 - DNA, 25 bp, Homo sapien
tgagtcccctccaggaagaagcagg

SEQ ID NO: 122271 - DNA, 25 bp, Homo sapien
gagtcccctccaggaagaagcaggg

SEQ ID NO: 122272 - DNA, 25 bp, Homo sapien
gtatatacccgtacaacgtgtcctc

SEQ ID NO: 122273 - DNA, 25 bp, Homo sapien
tcacggtgccttttttcacggaagt

SEQ ID NO: 122274 - DNA, 25 bp, Homo sapien
gttttcaatgatgggcgagcgtgca

SEQ ID NO: 122275 - DNA, 25 bp, Homo sapien
agcgtgcaccatccctttttgaagt

SEQ ID NO: 122276 - DNA, 25 bp, Homo sapien
agacacagggacttgaagttgttac

SEQ ID NO: 122277 - DNA, 25 bp, Homo sapien
ggaatgtttgtctcatcccattctg

SEQ ID NO: 122278 - DNA, 25 bp, Homo sapien
cattctgcgtcatgcttgtgtgata

SEQ ID NO: 122279 - DNA, 25 bp, Homo sapien
gcttgtgtgataactactccggaga

SEQ ID NO: 122280 - DNA, 25 bp, Homo sapien
taactactccggagacagggtttgg

SEQ ID NO: 122281 - DNA, 25 bp, Homo sapien
gtttggctgtgtctaaactgcatta

SEQ ID NO: 122282 - DNA, 25 bp, Homo sapien
ctaaactgcattaccgcgttgtaaa

SEQ ID NO: 122283 - DNA, 25 bp, Homo sapien
gtgtgatgccatatcaagtccatgt

SEQ ID NO: 122284 - DNA, 25 bp, Homo sapien
agtccatgttattctctcacagtgt

SEQ ID NO: 122285 - DNA, 25 bp, Homo sapien
gttattctctcacagtgtactctat

SEQ ID NO: 122286 - DNA, 25 bp, Homo sapien
tctcacagtgtactctataagaggt

SEQ ID NO: 122287 - DNA, 25 bp, Homo sapien
ctataagaggtgtgggtgtctgttt

SEQ ID NO: 122288 - DNA, 25 bp, Homo sapien
gtctgtttggtcaggatgttagaaa

SEQ ID NO: 122289 - DNA, 25 bp, Homo sapien
atgttgtattggctatgatggtgac

SEQ ID NO: 122290 - DNA, 25 bp, Homo sapien
atggtgacatgatatagtcagctgc

SEQ ID NO: 122291 - DNA, 25 bp, Homo sapien
gtcagctgccttttaagaggtctta

SEQ ID NO: 122292 - DNA, 25 bp, Homo sapien
agaggtcttatctgttcagtgttaa

SEQ ID NO: 122293 - DNA, 25 bp, Homo sapien
cctgttttctgactagtttaaagat

SEQ ID NO: 122294 - DNA, 25 bp, Homo sapien
gtatctgcttctgtagcccacggca

SEQ ID NO: 122295 - DNA, 25 bp, Homo sapien
attcccaaggttcgcacctcctgga

SEQ ID NO: 122296 - DNA, 25 bp, Homo sapien
agtcctctgggctggcctcgggaaa

SEQ ID NO: 122297 - DNA, 25 bp, Homo sapien
ggctctgacagggagtacagctgac

SEQ ID NO: 122298 - DNA, 25 bp, Homo sapien
ggagtacagctgaccgcttctggag

SEQ ID NO: 122299 - DNA, 25 bp, Homo sapien
gaccgcttctggagggtgtttctgt

SEQ ID NO: 122300 - DNA, 25 bp, Homo sapien
tttctgttcttaggactccagtcca

SEQ ID NO: 122301 - DNA, 25 bp, Homo sapien
ttaggactccagtccaggctggacg

SEQ ID NO: 122302 - DNA, 25 bp, Homo sapien
tgcctgagggcccttcgttaaagac

SEQ ID NO: 122303 - DNA, 25 bp, Homo sapien
gggcccttcgttaaagacacgcttg

SEQ ID NO: 122304 - DNA, 25 bp, Homo sapien
aaagacacgcttgtgtcctgggcga

SEQ ID NO: 122305 - DNA, 25 bp, Homo sapien
caccaccaaccagacggagtttgag

SEQ ID NO: 122306 - DNA, 25 bp, Homo sapien
agtttgagcgcgtcttctgagggcc

SEQ ID NO: 122307 - DNA, 25 bp, Homo sapien
tgccactagggctcttgtgtttttt

SEQ ID NO: 122308 - DNA, 25 bp, Homo sapien
ttttttcttctgctatgtgacttgc

SEQ ID NO: 122309 - DNA, 25 bp, Homo sapien
tctgctatgtgacttgcatcgtgga

SEQ ID NO: 122310 - DNA, 25 bp, Homo sapien
ttgcatcgtggagacagggcatttg

SEQ ID NO: 122311 - DNA, 25 bp, Homo sapien
cagggcatttgagtttatatctctc

SEQ ID NO: 122312 - DNA, 25 bp, Homo sapien
gagtttatatctctcatgcatattt

SEQ ID NO: 122313 - DNA, 25 bp, Homo sapien
agggcactggagctgtcttgtcctt

SEQ ID NO: 122314 - DNA, 25 bp, Homo sapien
agctgtcttgtccttgctggttttc

SEQ ID NO: 122315 - DNA, 25 bp, Homo sapien
ttgctggttttctggatggttccca

SEQ ID NO: 122316 - DNA, 25 bp, Homo sapien
agtgacagcttgtggactttttatt

SEQ ID NO: 122317 - DNA, 25 bp, Homo sapien
gactttttattagagctcgccacga

SEQ ID NO: 122318 - DNA, 25 bp, Homo sapien
agctcgccacgaactagggtaaggt

SEQ ID NO: 122319 - DNA, 25 bp, Homo sapien
aggtgagtgtcttagcatattttaa

SEQ ID NO: 122320 - DNA, 25 bp, Homo sapien
aatgcagttgcttactaaaggtttt

SEQ ID NO: 122321 - DNA, 25 bp, Homo sapien
aggttttaaccgcacacacacacgc

SEQ ID NO: 122322 - DNA, 25 bp, Homo sapien
acacacgcatttcttatgcaatcta

SEQ ID NO: 122323 - DNA, 25 bp, Homo sapien
atctatgtttcgacttgtgctttca

SEQ ID NO: 122324 - DNA, 25 bp, Homo sapien
tgtgctttcagttagccttctgtag

SEQ ID NO: 122325 - DNA, 25 bp, Homo sapien
agtcatatgttgtctttgttgtagt

SEQ ID NO: 122326 - DNA, 25 bp, Homo sapien
gatagagttccatatattgtatttg

SEQ ID NO: 122327 - DNA, 25 bp, Homo sapien
gagcatcaggctcagctagaagatc

SEQ ID NO: 122328 - DNA, 25 bp, Homo sapien
ttaactccccacaggcaatgggttt

SEQ ID NO: 122329 - DNA, 25 bp, Homo sapien
gacattatgtgagtttcctgctata

SEQ ID NO: 122330 - DNA, 25 bp, Homo sapien
ttcctgctatattaacatcatcttg

SEQ ID NO: 122331 - DNA, 25 bp, Homo sapien
catcatcttgagactttgcaagcag

SEQ ID NO: 122332 - DNA, 25 bp, Homo sapien
ttgcaagcagagagtcgtggaatca

SEQ ID NO: 122333 - DNA, 25 bp, Homo sapien
gtcgtggaatcaaatctgtgctctt

SEQ ID NO: 122334 - DNA, 25 bp, Homo sapien
ctctttcatttgctaagtgtatgat

SEQ ID NO: 122335 - DNA, 25 bp, Homo sapien
acacaagctccttaaccttccatgt

SEQ ID NO: 122336 - DNA, 25 bp, Homo sapien
ttaaccttccatgtctccattttct

SEQ ID NO: 122337 - DNA, 25 bp, Homo sapien
aggtataagaagtcctatctcatag

SEQ ID NO: 122338 - DNA, 25 bp, Homo sapien
ctgctcagtgcccagggtgttcagc

SEQ ID NO: 122339 - DNA, 25 bp, Homo sapien
tgcccagggtgttcagcccactcag

SEQ ID NO: 122340 - DNA, 25 bp, Homo sapien
cactcagcccactgcatttgaattt

SEQ ID NO: 122341 - DNA, 25 bp, Homo sapien
agcccactgcatttgaatttgttcg

SEQ ID NO: 122342 - DNA, 25 bp, Homo sapien
gaatttgttcgtccttatagtgact

SEQ ID NO: 122343 - DNA, 25 bp, Homo sapien
tatagtgactatctgaatcctcggt

SEQ ID NO: 122344 - DNA, 25 bp, Homo sapien
actatctgaatcctcggtctggtgg

SEQ ID NO: 122345 - DNA, 25 bp, Homo sapien
gaatcctcggtctggtggaatctcc

SEQ ID NO: 122346 - DNA, 25 bp, Homo sapien
ggtctggtggaatctcctcgagatc

SEQ ID NO: 122347 - DNA, 25 bp, Homo sapien
atctcctcgagatctggcaatacag

SEQ ID NO: 122348 - DNA, 25 bp, Homo sapien
gatctggcaatacagacaaaccccg

SEQ ID NO: 122349 - DNA, 25 bp, Homo sapien
aaacaagacagcagccactaggtac

SEQ ID NO: 122350 - DNA, 25 bp, Homo sapien
agccactaggtaccgccagaagaag

SEQ ID NO: 122351 - DNA, 25 bp, Homo sapien
caggaggctcttactggtgagtgca

SEQ ID NO: 122352 - DNA, 25 bp, Homo sapien
ttactggtgagtgcaaagagctgga

SEQ ID NO: 122353 - DNA, 25 bp, Homo sapien
gctggaaaagaagaacgaggctcta

SEQ ID NO: 122354 - DNA, 25 bp, Homo sapien
aagagagggcggattccctggccaa

SEQ ID NO: 122355 - DNA, 25 bp, Homo sapien
agatccagtacctgaaagatttgat

SEQ ID NO: 122356 - DNA, 25 bp, Homo sapien
ttgatagaagaggtccgcaaggcaa

SEQ ID NO: 122357 - DNA, 25 bp, Homo sapien
cccctagttgaggatagtcaggagc

SEQ ID NO: 122358 - DNA, 25 bp, Homo sapien
caggagcgtcaatgtgcttgtacat

SEQ ID NO: 122359 - DNA, 25 bp, Homo sapien
atgtgcttgtacatagagtgctgta

SEQ ID NO: 122360 - DNA, 25 bp, Homo sapien
ctgaccatgaagaggcaagagcaca

SEQ ID NO: 122361 - DNA, 25 bp, Homo sapien
gagcacagacttacaaggatttcaa

SEQ ID NO: 122362 - DNA, 25 bp, Homo sapien
ggatttcaacttaagcttgacttgg

SEQ ID NO: 122363 - DNA, 25 bp, Homo sapien
agtcaaaccccattcaggtcatggt

SEQ ID NO: 122364 - DNA, 25 bp, Homo sapien
aggtcatggtagaatctactccttg

SEQ ID NO: 122365 - DNA, 25 bp, Homo sapien
actccttggtagtcacttgtcattt

SEQ ID NO: 122366 - DNA, 25 bp, Homo sapien
gaaatgatgacaatcctcttggcat

SEQ ID NO: 122367 - DNA, 25 bp, Homo sapien
gatgttcctctcctgaattctggat

SEQ ID NO: 122368 - DNA, 25 bp, Homo sapien
gaattctggattttgtcctacaagt

SEQ ID NO: 122369 - DNA, 25 bp, Homo sapien
gtcctacaagtctgtgccatttata

SEQ ID NO: 122370 - DNA, 25 bp, Homo sapien
tatccccaagtgaaatatgttgcgg

SEQ ID NO: 122371 - DNA, 25 bp, Homo sapien
ttatgacaggttctgcccattctac

SEQ ID NO: 122372 - DNA, 25 bp, Homo sapien
acagtagggatgctgtccaacatga

SEQ ID NO: 122373 - DNA, 25 bp, Homo sapien
tgcattttatgatatggctcgtaga

SEQ ID NO: 122374 - DNA, 25 bp, Homo sapien
ggctcgtagagctgttgaaaccact

SEQ ID NO: 122375 - DNA, 25 bp, Homo sapien
gaaaccactgcccagagtgacaata

SEQ ID NO: 122376 - DNA, 25 bp, Homo sapien
acatggtccattattcgtgagcaca

SEQ ID NO: 122377 - DNA, 25 bp, Homo sapien
ttcgtgagcacatgggagacatcct

SEQ ID NO: 122378 - DNA, 25 bp, Homo sapien
ggagacatcctctataaactttcct

SEQ ID NO: 122379 - DNA, 25 bp, Homo sapien
gcagaatgcattccgtagccttgaa

SEQ ID NO: 122380 - DNA, 25 bp, Homo sapien
gtagccttgaagattagaagccttg

SEQ ID NO: 122381 - DNA, 25 bp, Homo sapien
gaagccttgaagattacaactgtga

SEQ ID NO: 122382 - DNA, 25 bp, Homo sapien
gggtaatgagcccttaatcgctgcc

SEQ ID NO: 122383 - DNA, 25 bp, Homo sapien
taatgagcccttaatcgctgcctct

SEQ ID NO: 122384 - DNA, 25 bp, Homo sapien
tgagcccttaatcgctgcctctagg

SEQ ID NO: 122385 - DNA, 25 bp, Homo sapien
gagctgattgtagcagcctcgttag

SEQ ID NO: 122386 - DNA, 25 bp, Homo sapien
attgtagcagcctcgttagtgtcac

SEQ ID NO: 122387 - DNA, 25 bp, Homo sapien
gtagcagcctcgttagtgtcacccc

SEQ ID NO: 122388 - DNA, 25 bp, Homo sapien
ctgggggcttccttagtcatattcc

SEQ ID NO: 122389 - DNA, 25 bp, Homo sapien
tccttagtcatattcccccagtggg

SEQ ID NO: 122390 - DNA, 25 bp, Homo sapien
ggtgggagggtaacctcactcttct

SEQ ID NO: 122391 - DNA, 25 bp, Homo sapien
gagggtaacctcactcttctccagg

SEQ ID NO: 122392 - DNA, 25 bp, Homo sapien
ccagcgggtaatgagcccttaatcg

SEQ ID NO: 122393 - DNA, 25 bp, Homo sapien
gggcttacgccattggaaacctcaa

SEQ ID NO: 122394 - DNA, 25 bp, Homo sapien
ggaaacctcaaggaaaactccagat

SEQ ID NO: 122395 - DNA, 25 bp, Homo sapien
atctatgtcagaccacagcacgtga

SEQ ID NO: 122396 - DNA, 25 bp, Homo sapien
acagcacgtgactccagtcagtggt

SEQ ID NO: 122397 - DNA, 25 bp, Homo sapien
agtcagtggtcctggtcccactgtc

SEQ ID NO: 122398 - DNA, 25 bp, Homo sapien
taggaacagagacccgccttaagag

SEQ ID NO: 122399 - DNA, 25 bp, Homo sapien
agagacccgccttaagagactggat

SEQ ID NO: 122400 - DNA, 25 bp, Homo sapien
taagagactggatcgcacacctttg

SEQ ID NO: 122401 - DNA, 25 bp, Homo sapien
gatcgcacacctttgcaacagatgt

SEQ ID NO: 122402 - DNA, 25 bp, Homo sapien
gatgtgttctgattctctgaaccta

SEQ ID NO: 122403 - DNA, 25 bp, Homo sapien
tgattctctgaacctacaaaatagt

SEQ ID NO: 122404 - DNA, 25 bp, Homo sapien
catcttgcaaaactacaatgtagtc

SEQ ID NO: 122405 - DNA, 25 bp, Homo sapien
tacaatgtagtctcataaccaggat

SEQ ID NO: 122406 - DNA, 25 bp, Homo sapien
gtagtctcataaccaggatattgac

SEQ ID NO: 122407 - DNA, 25 bp, Homo sapien
gtgaagatacaggacattctcatca

SEQ ID NO: 122408 - DNA, 25 bp, Homo sapien
aagatacaggacattctcatcacca

SEQ ID NO: 122409 - DNA, 25 bp, Homo sapien
attctcatcaccacagggatcccca

SEQ ID NO: 122410 - DNA, 25 bp, Homo sapien
tggcaaccaggaatccactctccat

SEQ ID NO: 122411 - DNA, 25 bp, Homo sapien
aggaatccactctccatttctataa

SEQ ID NO: 122412 - DNA, 25 bp, Homo sapien
tatagtatgtaacctgttttgagct

SEQ ID NO: 122413 - DNA, 25 bp, Homo sapien
gtatgtaacctgttttgagcttaaa

SEQ ID NO: 122414 - DNA, 25 bp, Homo sapien
agtatacatgactttaatgaggaaa

SEQ ID NO: 122415 - DNA, 25 bp, Homo sapien
ccagttctcagcatagccgagatca

SEQ ID NO: 122416 - DNA, 25 bp, Homo sapien
agccgagatcattaccctcttgtgg

SEQ ID NO: 122417 - DNA, 25 bp, Homo sapien
gtggaagaagattaccctgactcat

SEQ ID NO: 122418 - DNA, 25 bp, Homo sapien
caggacacttacaaaccccatagga

SEQ ID NO: 122419 - DNA, 25 bp, Homo sapien
accccataggaaccgaggatcacct

SEQ ID NO: 122420 - DNA, 25 bp, Homo sapien
gatatagccatgactcccgacatag

SEQ ID NO: 122421 - DNA, 25 bp, Homo sapien
cccgacataggctttgagtctaatg

SEQ ID NO: 122422 - DNA, 25 bp, Homo sapien
gacaatttgccatagcagtgctagg

SEQ ID NO: 122423 - DNA, 25 bp, Homo sapien
aatcatcttaacttggctaacatag

SEQ ID NO: 122424 - DNA, 25 bp, Homo sapien
gtatttactgtgctaatgggctgct

SEQ ID NO: 122425 - DNA, 25 bp, Homo sapien
atgggctgctgtcattttatgctaa

SEQ ID NO: 122426 - DNA, 25 bp, Homo sapien
tcctctggatctgctcgtcattttc

SEQ ID NO: 122427 - DNA, 25 bp, Homo sapien
ctctggatctgctcgtcattttcct

SEQ ID NO: 122428 - DNA, 25 bp, Homo sapien
tttgagatggacacactggtgtgga

SEQ ID NO: 122429 - DNA, 25 bp, Homo sapien
gacacactggtgtggattaacctgc

SEQ ID NO: 122430 - DNA, 25 bp, Homo sapien
acacactggtgtggattaacctgcc

SEQ ID NO: 122431 - DNA, 25 bp, Homo sapien
cacactggtgtggattaacctgcca

SEQ ID NO: 122432 - DNA, 25 bp, Homo sapien
acactggtgtggattaacctgccag

SEQ ID NO: 122433 - DNA, 25 bp, Homo sapien
cactggtgtggattaacctgccagg

SEQ ID NO: 122434 - DNA, 25 bp, Homo sapien
actggtgtggattaacctgccaggg

SEQ ID NO: 122435 - DNA, 25 bp, Homo sapien
ctggtgtggattaacctgccaggga

SEQ ID NO: 122436 - DNA, 25 bp, Homo sapien
gtgtggattaacctgccagggagac

SEQ ID NO: 122437 - DNA, 25 bp, Homo sapien
ctttgataattaaggccagaggccc

SEQ ID NO: 122438 - DNA, 25 bp, Homo sapien
gccagaggcccattagttgagaaag

SEQ ID NO: 122439 - DNA, 25 bp, Homo sapien
aagtcacagatatatttctccaaga

SEQ ID NO: 122440 - DNA, 25 bp, Homo sapien
tttctccaagaaagccaacaaccac

SEQ ID NO: 122441 - DNA, 25 bp, Homo sapien
gacagaaatgacaacaaggcccttt

SEQ ID NO: 122442 - DNA, 25 bp, Homo sapien
gacaacaaggccctttaacttgtct

SEQ ID NO: 122443 - DNA, 25 bp, Homo sapien
cttctagtttagagacatccttcat

SEQ ID NO: 122444 - DNA, 25 bp, Homo sapien
gagacatccttcatttgacatttag

SEQ ID NO: 122445 - DNA, 25 bp, Homo sapien
tagtagaattcctctttggccacaa

SEQ ID NO: 122446 - DNA, 25 bp, Homo sapien
gaattcctctttggccacaagaata

SEQ ID NO: 122447 - DNA, 25 bp, Homo sapien
aactatggctgttgaggttctcatt

SEQ ID NO: 122448 - DNA, 25 bp, Homo sapien
agtatgttagatgcagtagacgata

SEQ ID NO: 122449 - DNA, 25 bp, Homo sapien
cagtagacgatacaggttgcatgtg

SEQ ID NO: 122450 - DNA, 25 bp, Homo sapien
aggttgcatgtggacactcagtcac

SEQ ID NO: 122451 - DNA, 25 bp, Homo sapien
ggacactcagtcacattaacaactt

SEQ ID NO: 122452 - DNA, 25 bp, Homo sapien
ctcagtcacattaacaacttgggaa

SEQ ID NO: 122453 - DNA, 25 bp, Homo sapien
aatggcaatgttacggtgaattctc

SEQ ID NO: 122454 - DNA, 25 bp, Homo sapien
tacggtgaattctcaggtgaacttt

SEQ ID NO: 122455 - DNA, 25 bp, Homo sapien
tctcaggtgaacttttttcagttat

SEQ ID NO: 122456 - DNA, 25 bp, Homo sapien
aaaacatctattttgaatctgtaaa

SEQ ID NO: 122457 - DNA, 25 bp, Homo sapien
ctattctttgaaacttgttgggtag

SEQ ID NO: 122458 - DNA, 25 bp, Homo sapien
aatggtaaaagatggcatactgatt

SEQ ID NO: 122459 - DNA, 25 bp, Homo sapien
ccatgtggtcaacatctggagtttt

SEQ ID NO: 122460 - DNA, 25 bp, Homo sapien
catctggagtttttggtctcctcag

SEQ ID NO: 122461 - DNA, 25 bp, Homo sapien
ttttggtctcctcagagagctccat

SEQ ID NO: 122462 - DNA, 25 bp, Homo sapien
gagagctccatcacaccagtaagga

SEQ ID NO: 122463 - DNA, 25 bp, Homo sapien
gaggaccgagcacagaaatcttaga

SEQ ID NO: 122464 - DNA, 25 bp, Homo sapien
aatcttagagatttcttgtcccctc

SEQ ID NO: 122465 - DNA, 25 bp, Homo sapien
ccctctcaggtcatgtgtagatgcg

SEQ ID NO: 122466 - DNA, 25 bp, Homo sapien
aatcaagtgattggtgtgcctgggt

SEQ ID NO: 122467 - DNA, 25 bp, Homo sapien
tgtgcctgggtctcactacaagcag

SEQ ID NO: 122468 - DNA, 25 bp, Homo sapien
ggtctcactacaagcagcctatctg

SEQ ID NO: 122469 - DNA, 25 bp, Homo sapien
gagtttcttatgtgccctggtggac

SEQ ID NO: 122470 - DNA, 25 bp, Homo sapien
agttctccccgacaggttaagcgag

SEQ ID NO: 122471 - DNA, 25 bp, Homo sapien
tccccgacaggttaagcgagccgtg

SEQ ID NO: 122472 - DNA, 25 bp, Homo sapien
gttaagcgagccgtggttgtttctc

SEQ ID NO: 122473 - DNA, 25 bp, Homo sapien
aagcgagccgtggttgtttctccca

SEQ ID NO: 122474 - DNA, 25 bp, Homo sapien
gccgtggttgtttctcccaaagaag

SEQ ID NO: 122475 - DNA, 25 bp, Homo sapien
gaaaacaacagatgcctcatcacac

SEQ ID NO: 122476 - DNA, 25 bp, Homo sapien
agcctacaccacaagtgccgcaagt

SEQ ID NO: 122477 - DNA, 25 bp, Homo sapien
aagtgccgcaagtacagcagtcaca

SEQ ID NO: 122478 - DNA, 25 bp, Homo sapien
gcaagtacagcagtcacagccgtct

SEQ ID NO: 122479 - DNA, 25 bp, Homo sapien
tacagcagtcacagccgtctcaaag

SEQ ID NO: 122480 - DNA, 25 bp, Homo sapien
gtcacagccgtctcaaagctccgaa

SEQ ID NO: 122481 - DNA, 25 bp, Homo sapien
tgatgaccacatccggatgcacaag

SEQ ID NO: 122482 - DNA, 25 bp, Homo sapien
gaagtacgtggctgtgatgccgcca

SEQ ID NO: 122483 - DNA, 25 bp, Homo sapien
gatgccgccacacataggagaccag

SEQ ID NO: 122484 - DNA, 25 bp, Homo sapien
ggcgtacacagtgaccctggatgga

SEQ ID NO: 122485 - DNA, 25 bp, Homo sapien
gagggccctcaagggtcatctccaa

SEQ ID NO: 122486 - DNA, 25 bp, Homo sapien
atctccaaacatgacctgggccatt

SEQ ID NO: 122487 - DNA, 25 bp, Homo sapien
atgacctgggccatttcatgctgcg

SEQ ID NO: 122488 - DNA, 25 bp, Homo sapien
gctgcctcaccaccgatgagtacga

SEQ ID NO: 122489 - DNA, 25 bp, Homo sapien
atgagtacgacggacacagcaccta

SEQ ID NO: 122490 - DNA, 25 bp, Homo sapien
tccccatctgggagggtggcattct

SEQ ID NO: 122491 - DNA, 25 bp, Homo sapien
gtggcattctggacatgaggagcaa

SEQ ID NO: 122492 - DNA, 25 bp, Homo sapien
ctggaaatgagggtgggcgtcttcc

SEQ ID NO: 122493 - DNA, 25 bp, Homo sapien
tgcttctctggctgcctggtcagtg

SEQ ID NO: 122494 - DNA, 25 bp, Homo sapien
tctctggctgcctggtcagtgcaga

SEQ ID NO: 122495 - DNA, 25 bp, Homo sapien
tgcctggtcagtgcagaggtgcccc

SEQ ID NO: 122496 - DNA, 25 bp, Homo sapien
ctgctttgtgctggacaacgggctc

SEQ ID NO: 122497 - DNA, 25 bp, Homo sapien
gacaacgggctctgtggcaagatct

SEQ ID NO: 122498 - DNA, 25 bp, Homo sapien
aacgggctctgtggcaagatctata

SEQ ID NO: 122499 - DNA, 25 bp, Homo sapien
gggctctgtggcaagatctatatct

SEQ ID NO: 122500 - DNA, 25 bp, Homo sapien
ctctgtggcaagatctatatctgga

SEQ ID NO: 122501 - DNA, 25 bp, Homo sapien
gtggcaagatctatatctggaaggg

SEQ ID NO: 122502 - DNA, 25 bp, Homo sapien
tggccgagggcttcatctcgcgcat

SEQ ID NO: 122503 - DNA, 25 bp, Homo sapien
aagctagtagtgtatagtcagaaac

SEQ ID NO: 122504 - DNA, 25 bp, Homo sapien
tatttactgcatatgaggctttctg

SEQ ID NO: 122505 - DNA, 25 bp, Homo sapien
ctgcatatgaggctttctgttaatt

SEQ ID NO: 122506 - DNA, 25 bp, Homo sapien
aatttatatattgcacattctagga

SEQ ID NO: 122507 - DNA, 25 bp, Homo sapien
attgattgtatgtctactgtgctgc

SEQ ID NO: 122508 - DNA, 25 bp, Homo sapien
gattgtatgtctactgtgctgcatt

SEQ ID NO: 122509 - DNA, 25 bp, Homo sapien
gtatgtctactgtgctgcattaaga

SEQ ID NO: 122510 - DNA, 25 bp, Homo sapien
gtctactgtgctgcattaagaaaat

SEQ ID NO: 122511 - DNA, 25 bp, Homo sapien
taccaaaaatgtgaagttataccaa

SEQ ID NO: 122512 - DNA, 25 bp, Homo sapien
gtgattaatgcatacgaacagctac

SEQ ID NO: 122513 - DNA, 25 bp, Homo sapien
tgcatacgaacagctacatatacat

SEQ ID NO: 122514 - DNA, 25 bp, Homo sapien
ttctcttggtgcctgctgggttgca

SEQ ID NO: 122515 - DNA, 25 bp, Homo sapien
gcaggaagcgtgtggactgcagctt

SEQ ID NO: 122516 - DNA, 25 bp, Homo sapien
ggactgcagcttctgctggtgctcc

SEQ ID NO: 122517 - DNA, 25 bp, Homo sapien
cccgtcctcctggaggcagtatagg

SEQ ID NO: 122518 - DNA, 25 bp, Homo sapien
agtctgagacttaagcactcggtcc

SEQ ID NO: 122519 - DNA, 25 bp, Homo sapien
gagacttaagcactcggtcccagct

SEQ ID NO: 122520 - DNA, 25 bp, Homo sapien
taagcactcggtcccagcttgccag

SEQ ID NO: 122521 - DNA, 25 bp, Homo sapien
ccagcttgccagttcctggttctgt

SEQ ID NO: 122522 - DNA, 25 bp, Homo sapien
aatggggatgatacctacctccagg

SEQ ID NO: 122523 - DNA, 25 bp, Homo sapien
gggttggcgtgaggattcatgggct

SEQ ID NO: 122524 - DNA, 25 bp, Homo sapien
gatgaaaactgcacaaggccagaac

SEQ ID NO: 122525 - DNA, 25 bp, Homo sapien
agctgcaggaaacagcaggccccgc

SEQ ID NO: 122526 - DNA, 25 bp, Homo sapien
ccgccctctcacagaggatgggtga

SEQ ID NO: 122527 - DNA, 25 bp, Homo sapien
cattgtccagatgggcactgctgtg

SEQ ID NO: 122528 - DNA, 25 bp, Homo sapien
atgggcactgctgtggagtctgctt

SEQ ID NO: 122529 - DNA, 25 bp, Homo sapien
gagtctgcttctcccatgtaccagg

SEQ ID NO: 122530 - DNA, 25 bp, Homo sapien
ttctcccatgtaccagggcaccagg

SEQ ID NO: 122531 - DNA, 25 bp, Homo sapien
aggcccacccaactgaaggcatggc

SEQ ID NO: 122532 - DNA, 25 bp, Homo sapien
aaaggtgatgacgatcatcacacct

SEQ ID NO: 122533 - DNA, 25 bp, Homo sapien
tgtcgttacctcagccatcggtcta

SEQ ID NO: 122534 - DNA, 25 bp, Homo sapien
agccatcggtctagcatatcagtca

SEQ ID NO: 122535 - DNA, 25 bp, Homo sapien
ctagcatatcagtcactgggcccaa

SEQ ID NO: 122536 - DNA, 25 bp, Homo sapien
gcgtggatgtcgatgacttcatcaa

SEQ ID NO: 122537 - DNA, 25 bp, Homo sapien
ggaggcagacaatgaccccacggct

SEQ ID NO: 122538 - DNA, 25 bp, Homo sapien
tgactccattcaaatctacggttat

SEQ ID NO: 122539 - DNA, 25 bp, Homo sapien
gggtccctgagctccctagagtcgg

SEQ ID NO: 122540 - DNA, 25 bp, Homo sapien
cggccaccacagattcagacttgga

SEQ ID NO: 122541 - DNA, 25 bp, Homo sapien
gacttggactatgattatctacaga

SEQ ID NO: 122542 - DNA, 25 bp, Homo sapien
aactagcagatttgtatggttccaa

SEQ ID NO: 122543 - DNA, 25 bp, Homo sapien
gtatggttccaaagacacttttgat

SEQ ID NO: 122544 - DNA, 25 bp, Homo sapien
gacacttttgatgacgattcttaac

SEQ ID NO: 122545 - DNA, 25 bp, Homo sapien
aaatttggccttaagaactgtgtct

SEQ ID NO: 122546 - DNA, 25 bp, Homo sapien
aagaactgtgtctggcgttctcaag

SEQ ID NO: 122547 - DNA, 25 bp, Homo sapien
agccagaacacctcggagctgaata

SEQ ID NO: 122548 - DNA, 25 bp, Homo sapien
ggagctgaatacagcctgaggcctc

SEQ ID NO: 122549 - DNA, 25 bp, Homo sapien
tgaggcctcagcagccgccttaagc

SEQ ID NO: 122550 - DNA, 25 bp, Homo sapien
cgccttaagctgatcctgcggagaa

SEQ ID NO: 122551 - DNA, 25 bp, Homo sapien
atcctgcggagaacacccttggtgg

SEQ ID NO: 122552 - DNA, 25 bp, Homo sapien
ctcagcaagccctacagagctgtgg

SEQ ID NO: 122553 - DNA, 25 bp, Homo sapien
acagagctgtggaggattgctatct

SEQ ID NO: 122554 - DNA, 25 bp, Homo sapien
atatcgatgaactaggcaaagacct

SEQ ID NO: 122555 - DNA, 25 bp, Homo sapien
ggcaaagacctacttctgaagtgtt

SEQ ID NO: 122556 - DNA, 25 bp, Homo sapien
agtgtttgacatttaacccagccaa

SEQ ID NO: 122557 - DNA, 25 bp, Homo sapien
atatctgcctacagtgccctgtctc

SEQ ID NO: 122558 - DNA, 25 bp, Homo sapien
aaacattcatagctggtcttatttg

SEQ ID NO: 122559 - DNA, 25 bp, Homo sapien
ggtcttatttgtaaagctcacttta

SEQ ID NO: 122560 - DNA, 25 bp, Homo sapien
ttacttagaattagtggcacttgct

SEQ ID NO: 122561 - DNA, 25 bp, Homo sapien
agtggcacttgcttttattagagaa

SEQ ID NO: 122562 - DNA, 25 bp, Homo sapien
actttctgaaataacatggccttgg

SEQ ID NO: 122563 - DNA, 25 bp, Homo sapien
gggcatgaagacagatactcctcca

SEQ ID NO: 122564 - DNA, 25 bp, Homo sapien
gaagacagatactcctccaaggtta

SEQ ID NO: 122565 - DNA, 25 bp, Homo sapien
tcctccaaggttattggacaccgga

SEQ ID NO: 122566 - DNA, 25 bp, Homo sapien
taaattggaacacctcctcaaacct

SEQ ID NO: 122567 - DNA, 25 bp, Homo sapien
aacctaccactcaggaatgtttgct

SEQ ID NO: 122568 - DNA, 25 bp, Homo sapien
aaaaacatggcctttgcttgaaaga

SEQ ID NO: 122569 - DNA, 25 bp, Homo sapien
caagcagccaagctccttgggaggc

SEQ ID NO: 122570 - DNA, 25 bp, Homo sapien
gggaaataacagctgtggctcacgt

SEQ ID NO: 122571 - DNA, 25 bp, Homo sapien
taacagctgtggctcacgtgagagt

SEQ ID NO: 122572 - DNA, 25 bp, Homo sapien
gtggctcacgtgagagtgtcttcac

SEQ ID NO: 122573 - DNA, 25 bp, Homo sapien
gagagtgtcttcacggcaggacaac

SEQ ID NO: 122574 - DNA, 25 bp, Homo sapien
cggcaggacaacgagaaagccctaa

SEQ ID NO: 122575 - DNA, 25 bp, Homo sapien
tttttctctgagtatctcctcgcaa

SEQ ID NO: 122576 - DNA, 25 bp, Homo sapien
agtatctcctcgcaagctgggtaat

SEQ ID NO: 122577 - DNA, 25 bp, Homo sapien
ctcctcgcaagctgggtaatcgatg

SEQ ID NO: 122578 - DNA, 25 bp, Homo sapien
gaggcagaggatggattttgaattt

SEQ ID NO: 122579 - DNA, 25 bp, Homo sapien
acaggtcaatacagtacaggcagca

SEQ ID NO: 122580 - DNA, 25 bp, Homo sapien
agtgtcatttcttcagaactcccct

SEQ ID NO: 122581 - DNA, 25 bp, Homo sapien
gaactccccttcattgaatagtgat

SEQ ID NO: 122582 - DNA, 25 bp, Homo sapien
aattgcactcgctgaaagagcacgt

SEQ ID NO: 122583 - DNA, 25 bp, Homo sapien
gaaagagcacgtcatgaagcaccat

SEQ ID NO: 122584 - DNA, 25 bp, Homo sapien
gatataaattcgttcccacagcctt

SEQ ID NO: 122585 - DNA, 25 bp, Homo sapien
acagccttcaagctgcagtgtttta

SEQ ID NO: 122586 - DNA, 25 bp, Homo sapien
aagttttgcctttttcgatatagtg

SEQ ID NO: 122587 - DNA, 25 bp, Homo sapien
gatatagtgaccttctttgcatatt

SEQ ID NO: 122588 - DNA, 25 bp, Homo sapien
gtttaccacaatgtcccatttctag

SEQ ID NO: 122589 - DNA, 25 bp, Homo sapien
cccatttctagttaagtcttcgcac

SEQ ID NO: 122590 - DNA, 25 bp, Homo sapien
gtcttcgcacttgaaagctaacatt

SEQ ID NO: 122591 - DNA, 25 bp, Homo sapien
gacgtattggtgtgaggtcttcaac

SEQ ID NO: 122592 - DNA, 25 bp, Homo sapien
tgaggtcttcaacccaatcagtaag

SEQ ID NO: 122593 - DNA, 25 bp, Homo sapien
tcagtaagaaccaaagcgaccccat

SEQ ID NO: 122594 - DNA, 25 bp, Homo sapien
aagcgaccccatcatgctgaacgta

SEQ ID NO: 122595 - DNA, 25 bp, Homo sapien
accacaagaaaatggcctctcacct

SEQ ID NO: 122596 - DNA, 25 bp, Homo sapien
gcattgtgattggagtagtggccct

SEQ ID NO: 122597 - DNA, 25 bp, Homo sapien
tagtggccctggttgctctgatagc

SEQ ID NO: 122598 - DNA, 25 bp, Homo sapien
tctgatagcagtagccctggcatgt

SEQ ID NO: 122599 - DNA, 25 bp, Homo sapien
tggcatgttttctgcatttcgggaa

SEQ ID NO: 122600 - DNA, 25 bp, Homo sapien
gggaagaccggcagctcaggaccac

SEQ ID NO: 122601 - DNA, 25 bp, Homo sapien
tccaatgacccacctaacaagatga

SEQ ID NO: 122602 - DNA, 25 bp, Homo sapien
gaggagaggtgatcccacacgcagc

SEQ ID NO: 122603 - DNA, 25 bp, Homo sapien
gatcccacacgcagctgcacaggaa

SEQ ID NO: 122604 - DNA, 25 bp, Homo sapien
aggagatccagagatttctcaggaa

SEQ ID NO: 122605 - DNA, 25 bp, Homo sapien
agatttctcaggaagcacctcattc

SEQ ID NO: 122606 - DNA, 25 bp, Homo sapien
gaagcacctcattccagatgtgacc

SEQ ID NO: 122607 - DNA, 25 bp, Homo sapien
acctcattccagatgtgaccagtca

SEQ ID NO: 122608 - DNA, 25 bp, Homo sapien
atgtgaccagtcaactctaagaaga

SEQ ID NO: 122609 - DNA, 25 bp, Homo sapien
gaagcaaatctctttaccgggacct

SEQ ID NO: 122610 - DNA, 25 bp, Homo sapien
gcaaatctctttaccgggaccttct

SEQ ID NO: 122611 - DNA, 25 bp, Homo sapien
taccgggaccttctctcaattttca

SEQ ID NO: 122612 - DNA, 25 bp, Homo sapien
ctcaattttcatggcggaatgtctc

SEQ ID NO: 122613 - DNA, 25 bp, Homo sapien
cagtgaacttccaagcaatgctact

SEQ ID NO: 122614 - DNA, 25 bp, Homo sapien
gcaatgctacttcagcccaataaga

SEQ ID NO: 122615 - DNA, 25 bp, Homo sapien
tagacagcagtgcagcagctattat

SEQ ID NO: 122616 - DNA, 25 bp, Homo sapien
gcagctattattgatgctcctatgg

SEQ ID NO: 122617 - DNA, 25 bp, Homo sapien
gatgctcctatggatattccaggtt

SEQ ID NO: 122618 - DNA, 25 bp, Homo sapien
gagtcaacaagaatactacccctat

SEQ ID NO: 122619 - DNA, 25 bp, Homo sapien
atactacccctatgtgtactacaag

SEQ ID NO: 122620 - DNA, 25 bp, Homo sapien
gattgattgcaacttgctggaattc

SEQ ID NO: 122621 - DNA, 25 bp, Homo sapien
attcaagtgaaaatgggctcctccc

SEQ ID NO: 122622 - DNA, 25 bp, Homo sapien
ccccgacaatcctgtccttgtgttt

SEQ ID NO: 122623 - DNA, 25 bp, Homo sapien
gcagtatggtcgtacttttaactct

SEQ ID NO: 122624 - DNA, 25 bp, Homo sapien
taatgctctaccacaagaaaatggc

SEQ ID NO: 122625 - DNA, 25 bp, Homo sapien
accacaagaaaatggcctctcacct

SEQ ID NO: 122626 - DNA, 25 bp, Homo sapien
gcattgtgattggagtagtggccct

SEQ ID NO: 122627 - DNA, 25 bp, Homo sapien
agtagtggccctggttgctctgata

SEQ ID NO: 122628 - DNA, 25 bp, Homo sapien
ggccctggttgctctgatagcagta

SEQ ID NO: 122629 - DNA, 25 bp, Homo sapien
tgctctgatagcagtagccctggca

SEQ ID NO: 122630 - DNA, 25 bp, Homo sapien
tctgatagcagtagccctggcatgt

SEQ ID NO: 122631 - DNA, 25 bp, Homo sapien
agcagtagccctggcatgttttctg

SEQ ID NO: 122632 - DNA, 25 bp, Homo sapien
actccaatgacccacctaacaagat

SEQ ID NO: 122633 - DNA, 25 bp, Homo sapien
aatgacccacctaacaagatgaatg

SEQ ID NO: 122634 - DNA, 25 bp, Homo sapien
gacccacctaacaagatgaatgaag

SEQ ID NO: 122635 - DNA, 25 bp, Homo sapien
tgtctcctccttgacactgactggg

SEQ ID NO: 122636 - DNA, 25 bp, Homo sapien
tccgctggtgccaagccctgtggct

SEQ ID NO: 122637 - DNA, 25 bp, Homo sapien
cctgtggctccagcagtgctggaaa

SEQ ID NO: 122638 - DNA, 25 bp, Homo sapien
ggccccagctagctgaccctgaagt

SEQ ID NO: 122639 - DNA, 25 bp, Homo sapien
tgaagttttcctaccccaaggagag

SEQ ID NO: 122640 - DNA, 25 bp, Homo sapien
ctaccccaaggagagttactcgaca

SEQ ID NO: 122641 - DNA, 25 bp, Homo sapien
gttactcgacagtccataagtcaac

SEQ ID NO: 122642 - DNA, 25 bp, Homo sapien
ataagtcaactgttgtgtgtgtgca

SEQ ID NO: 122643 - DNA, 25 bp, Homo sapien
gtgtgtgtgcatgccttgggcacaa

SEQ ID NO: 122644 - DNA, 25 bp, Homo sapien
ttgggcacaaacaagcacatacact

SEQ ID NO: 122645 - DNA, 25 bp, Homo sapien
gcacatacactatatcccatatggg

SEQ ID NO: 122646 - DNA, 25 bp, Homo sapien
taccgctgggtctgcgagacagagc

SEQ ID NO: 122647 - DNA, 25 bp, Homo sapien
gagccacctctcctttaatttattt

SEQ ID NO: 122648 - DNA, 25 bp, Homo sapien
atttcttcaatgcctcgacctgccg

SEQ ID NO: 122649 - DNA, 25 bp, Homo sapien
cgggattgggaatccgcccatctgg

SEQ ID NO: 122650 - DNA, 25 bp, Homo sapien
gggcctcttctgctttctcgggaat

SEQ ID NO: 122651 - DNA, 25 bp, Homo sapien
tcttctgctttctcgggaattttca

SEQ ID NO: 122652 - DNA, 25 bp, Homo sapien
gctttctcgggaattttcatctagg

SEQ ID NO: 122653 - DNA, 25 bp, Homo sapien
ctcgggaattttcatctaggatttt

SEQ ID NO: 122654 - DNA, 25 bp, Homo sapien
atgttccgaaggtgaggagcttgaa

SEQ ID NO: 122655 - DNA, 25 bp, Homo sapien
tgaggagcttgaaacccgtggcgct

SEQ ID NO: 122656 - DNA, 25 bp, Homo sapien
cttgaaacccgtggcgctttctgca

SEQ ID NO: 122657 - DNA, 25 bp, Homo sapien
aatcaagagaagtaggaagcatatc

SEQ ID NO: 122658 - DNA, 25 bp, Homo sapien
gagaagtaggaagcatatcaaacgt

SEQ ID NO: 122659 - DNA, 25 bp, Homo sapien
gaagtaggaagcatatcaaacgttt

SEQ ID NO: 122660 - DNA, 25 bp, Homo sapien
aagtaggaagcatatcaaacgttta

SEQ ID NO: 122661 - DNA, 25 bp, Homo sapien
agtaggaagcatatcaaacgtttaa

SEQ ID NO: 122662 - DNA, 25 bp, Homo sapien
gtaggaagcatatcaaacgtttaac

SEQ ID NO: 122663 - DNA, 25 bp, Homo sapien
taggaagcatatcaaacgtttaact

SEQ ID NO: 122664 - DNA, 25 bp, Homo sapien
ggaagcatatcaaacgtttaacttt

SEQ ID NO: 122665 - DNA, 25 bp, Homo sapien
gaagcatatcaaacgtttaacttta

SEQ ID NO: 122666 - DNA, 25 bp, Homo sapien
aagcatatcaaacgtttaactttat

SEQ ID NO: 122667 - DNA, 25 bp, Homo sapien
agcatatcaaacgtttaactttatt

SEQ ID NO: 122668 - DNA, 25 bp, Homo sapien
cttgtgtacatcgtacccatccatt

SEQ ID NO: 122669 - DNA, 25 bp, Homo sapien
tacatcgtacccatccattcggctt

SEQ ID NO: 122670 - DNA, 25 bp, Homo sapien
agccaacggcctggaatcgcaaaga

SEQ ID NO: 122671 - DNA, 25 bp, Homo sapien
aacggcctggaatcgcaaagagaca

SEQ ID NO: 122672 - DNA, 25 bp, Homo sapien
gaatcgcaaagagacaccactctgg

SEQ ID NO: 122673 - DNA, 25 bp, Homo sapien
aagagacaccactctgggcagagca

SEQ ID NO: 122674 - DNA, 25 bp, Homo sapien
tgttggagggccagagactagtcct

SEQ ID NO: 122675 - DNA, 25 bp, Homo sapien
agggccagagactagtcctgagatg

SEQ ID NO: 122676 - DNA, 25 bp, Homo sapien
agactagtcctgagatggaaacagc

SEQ ID NO: 122677 - DNA, 25 bp, Homo sapien
ggaaacagcaacttgtacagtggct

SEQ ID NO: 122678 - DNA, 25 bp, Homo sapien
gcaacttgtacagtggctgagaaaa

SEQ ID NO: 122679 - DNA, 25 bp, Homo sapien
ctgctgaacaggctcttcagtgcga

SEQ ID NO: 122680 - DNA, 25 bp, Homo sapien
aacaggctcttcagtgcgagttcct

SEQ ID NO: 122681 - DNA, 25 bp, Homo sapien
cttcagtgcgagttcctccgagatg

SEQ ID NO: 122682 - DNA, 25 bp, Homo sapien
accagatctccctttatggcaagat

SEQ ID NO: 122683 - DNA, 25 bp, Homo sapien
ctccctttatggcaagattgtcatg

SEQ ID NO: 122684 - DNA, 25 bp, Homo sapien
acagaagcagatgggcatgactgat

SEQ ID NO: 122685 - DNA, 25 bp, Homo sapien
tgtctctgggcttggatgacagcag

SEQ ID NO: 122686 - DNA, 25 bp, Homo sapien
ggatgacagcagaaccaacacaccc

SEQ ID NO: 122687 - DNA, 25 bp, Homo sapien
agcagaaccaacacaccccagggtg

SEQ ID NO: 122688 - DNA, 25 bp, Homo sapien
tcacagctgaaatctcagggcagct

SEQ ID NO: 122689 - DNA, 25 bp, Homo sapien
ctcagggcagctcaaatgtggcacc

SEQ ID NO: 122690 - DNA, 25 bp, Homo sapien
catcatttggtttcctctttggctt

SEQ ID NO: 122691 - DNA, 25 bp, Homo sapien
ggatacttctaaattttgggagctc

SEQ ID NO: 122692 - DNA, 25 bp, Homo sapien
agctcctccatctccaatggctggg

SEQ ID NO: 122693 - DNA, 25 bp, Homo sapien
tccatctccaatggctgggatttgt

SEQ ID NO: 122694 - DNA, 25 bp, Homo sapien
agggattccactcagaacctctctg

SEQ ID NO: 122695 - DNA, 25 bp, Homo sapien
tccactcagaacctctctggaattt

SEQ ID NO: 122696 - DNA, 25 bp, Homo sapien
actcagaacctctctggaatttgtg

SEQ ID NO: 122697 - DNA, 25 bp, Homo sapien
tctggaatttgtgcctgatgtgcct

SEQ ID NO: 122698 - DNA, 25 bp, Homo sapien
gaatttgtgcctgatgtgccttcca

SEQ ID NO: 122699 - DNA, 25 bp, Homo sapien
atttgtgcctgatgtgccttccact

SEQ ID NO: 122700 - DNA, 25 bp, Homo sapien
tgcctgatgtgccttccactggatt

SEQ ID NO: 122701 - DNA, 25 bp, Homo sapien
gaatatagtgctgctatgttgacat

SEQ ID NO: 122702 - DNA, 25 bp, Homo sapien
atgttgacattattcttcctagaga

SEQ ID NO: 122703 - DNA, 25 bp, Homo sapien
cttcctagagaagattatcctgtcc

SEQ ID NO: 122704 - DNA, 25 bp, Homo sapien
gattatcctgtcctgcaaactgcaa

SEQ ID NO: 122705 - DNA, 25 bp, Homo sapien
aatagtagttcctgaagtgttcact

SEQ ID NO: 122706 - DNA, 25 bp, Homo sapien
ttccctgtttatccaaacatcttcc

SEQ ID NO: 122707 - DNA, 25 bp, Homo sapien
gtttatccaaacatcttccaattta

SEQ ID NO: 122708 - DNA, 25 bp, Homo sapien
tttattttgtttgttcggcatacaa

SEQ ID NO: 122709 - DNA, 25 bp, Homo sapien
tttcttcatgtgtgtttagtatctg

SEQ ID NO: 122710 - DNA, 25 bp, Homo sapien
tttgaaactcatctggtggaaacca

SEQ ID NO: 122711 - DNA, 25 bp, Homo sapien
gacatgagttttccagcttttatac

SEQ ID NO: 122712 - DNA, 25 bp, Homo sapien
tgatagttcacaagagaagtcgttt

SEQ ID NO: 122713 - DNA, 25 bp, Homo sapien
gatagttcacaagagaagtcgtttc

SEQ ID NO: 122714 - DNA, 25 bp, Homo sapien
atagttcacaagagaagtcgtttca

SEQ ID NO: 122715 - DNA, 25 bp, Homo sapien
tagttcacaagagaagtcgtttcat

SEQ ID NO: 122716 - DNA, 25 bp, Homo sapien
agttcacaagagaagtcgtttcatt

SEQ ID NO: 122717 - DNA, 25 bp, Homo sapien
acctctttcaagtgctgccctggct

SEQ ID NO: 122718 - DNA, 25 bp, Homo sapien
ctctttcaagtgctgccctggctga

SEQ ID NO: 122719 - DNA, 25 bp, Homo sapien
tctttcaagtgctgccctggctgaa

SEQ ID NO: 122720 - DNA, 25 bp, Homo sapien
ctttcaagtgctgccctggctgaag

SEQ ID NO: 122721 - DNA, 25 bp, Homo sapien
tttcaagtgctgccctggctgaagg

SEQ ID NO: 122722 - DNA, 25 bp, Homo sapien
ttcaagtgctgccctggctgaagga

SEQ ID NO: 122723 - DNA, 25 bp, Homo sapien
agagttggcggtcacagagggctcc

SEQ ID NO: 122724 - DNA, 25 bp, Homo sapien
gggactgccctagtccttgccaggt

SEQ ID NO: 122725 - DNA, 25 bp, Homo sapien
ccaaaggccacgactgcctgttggg

SEQ ID NO: 122726 - DNA, 25 bp, Homo sapien
ggagatgcatggacagtgtgctcaa

SEQ ID NO: 122727 - DNA, 25 bp, Homo sapien
tgcatggacagtgtgctcaagctgt

SEQ ID NO: 122728 - DNA, 25 bp, Homo sapien
gtgctcaagctgtgggcatgtgctt

SEQ ID NO: 122729 - DNA, 25 bp, Homo sapien
gcttgcctgcgggagaggtccttca

SEQ ID NO: 122730 - DNA, 25 bp, Homo sapien
ggagaggtccttcactgtgtgtaca

SEQ ID NO: 122731 - DNA, 25 bp, Homo sapien
acagcaagagcatgtgtgtgccact

SEQ ID NO: 122732 - DNA, 25 bp, Homo sapien
gcaagagcatgtgtgtgccacttcc

SEQ ID NO: 122733 - DNA, 25 bp, Homo sapien
gagcatgtgtgtgccacttccccta

SEQ ID NO: 122734 - DNA, 25 bp, Homo sapien
ctctttgactggaccatgaatcctt

SEQ ID NO: 122735 - DNA, 25 bp, Homo sapien
ctttgtatttacagcagaggccgga

SEQ ID NO: 122736 - DNA, 25 bp, Homo sapien
gatgaaactgagcttcaccctactc

SEQ ID NO: 122737 - DNA, 25 bp, Homo sapien
cctactctgaatgcagatgaccaag

SEQ ID NO: 122738 - DNA, 25 bp, Homo sapien
agaatgcaaacgaaatctcagtgat

SEQ ID NO: 122739 - DNA, 25 bp, Homo sapien
tctcagtgatattgaccagagtttc

SEQ ID NO: 122740 - DNA, 25 bp, Homo sapien
agtagctgaacgtgtcttaatgaga

SEQ ID NO: 122741 - DNA, 25 bp, Homo sapien
gcactgtgctcagtgttggtggaca

SEQ ID NO: 122742 - DNA, 25 bp, Homo sapien
atttgctcatacagcaggccataga

SEQ ID NO: 122743 - DNA, 25 bp, Homo sapien
agcaggccatagaccccaaaaatct

SEQ ID NO: 122744 - DNA, 25 bp, Homo sapien
cgacttttcccaggatggaaagctt

SEQ ID NO: 122745 - DNA, 25 bp, Homo sapien
taagcgacagacatctggaggacct

SEQ ID NO: 122746 - DNA, 25 bp, Homo sapien
ctggaggacctgttgatgctagttc

SEQ ID NO: 122747 - DNA, 25 bp, Homo sapien
acctgttgatgctagttcagagtat

SEQ ID NO: 122748 - DNA, 25 bp, Homo sapien
gagggagctttttaagctcaagcaa

SEQ ID NO: 122749 - DNA, 25 bp, Homo sapien
aagcaaatgtttggtaatgcagaca

SEQ ID NO: 122750 - DNA, 25 bp, Homo sapien
gacatgaatacatttcccaccttca

SEQ ID NO: 122751 - DNA, 25 bp, Homo sapien
gatcccaaatttgaagtcatcgaaa

SEQ ID NO: 122752 - DNA, 25 bp, Homo sapien
tgaagtcatcgaaaaaccccaggcc

SEQ ID NO: 122753 - DNA, 25 bp, Homo sapien
attaatctggtaatttgtcacggat

SEQ ID NO: 122754 - DNA, 25 bp, Homo sapien
ttgtcacggattagttgtacaacta

SEQ ID NO: 122755 - DNA, 25 bp, Homo sapien
aaacatgcatttcataactgtcaaa

SEQ ID NO: 122756 - DNA, 25 bp, Homo sapien
ctgtctcaactgtggtgttagcacc

SEQ ID NO: 122757 - DNA, 25 bp, Homo sapien
actgtggtgttagcaccagccagct

SEQ ID NO: 122758 - DNA, 25 bp, Homo sapien
cagccagctctctgtacatttgcta

SEQ ID NO: 122759 - DNA, 25 bp, Homo sapien
acatttgctagcttgtagttttcta

SEQ ID NO: 122760 - DNA, 25 bp, Homo sapien
gcttgtagttttctaagactgagta

SEQ ID NO: 122761 - DNA, 25 bp, Homo sapien
gaggtctggtttgtaactttccttg

SEQ ID NO: 122762 - DNA, 25 bp, Homo sapien
tctggtttgtaactttccttgtact

SEQ ID NO: 122763 - DNA, 25 bp, Homo sapien
ttttccacaaaccaccatctatttt

SEQ ID NO: 122764 - DNA, 25 bp, Homo sapien
gtgaactttgttagtcatcttttat

SEQ ID NO: 122765 - DNA, 25 bp, Homo sapien
gttagtcatcttttatttggtaaat

SEQ ID NO: 122766 - DNA, 25 bp, Homo sapien
cagttcatgtatattgattgtggca

SEQ ID NO: 122767 - DNA, 25 bp, Homo sapien
atgattgtaaagttgactactgtaa

SEQ ID NO: 122768 - DNA, 25 bp, Homo sapien
gttgactactgtaaatttcccataa

SEQ ID NO: 122769 - DNA, 25 bp, Homo sapien
aaaaattactttacacatgtgccta

SEQ ID NO: 122770 - DNA, 25 bp, Homo sapien
ttactttacacatgtgcctacatag

SEQ ID NO: 122771 - DNA, 25 bp, Homo sapien
acatgtgcctacatagacacaccaa

SEQ ID NO: 122772 - DNA, 25 bp, Homo sapien
tgcctacatagacacaccaagaagt

SEQ ID NO: 122773 - DNA, 25 bp, Homo sapien
gacacaccaagaagtggatgtatat

SEQ ID NO: 122774 - DNA, 25 bp, Homo sapien
agcaaagtaattttactctgataat

SEQ ID NO: 122775 - DNA, 25 bp, Homo sapien
aaattgtttgacatgtattttgtta

SEQ ID NO: 122776 - DNA, 25 bp, Homo sapien
gttatgaatagtttatcttccaaaa

SEQ ID NO: 122777 - DNA, 25 bp, Homo sapien
gaagaatacactgctaataaataat

SEQ ID NO: 122778 - DNA, 25 bp, Homo sapien
ctttgtttttatggatggctccctt

SEQ ID NO: 122779 - DNA, 25 bp, Homo sapien
tgtttttatggatggctcccttccc

SEQ ID NO: 122780 - DNA, 25 bp, Homo sapien
gccttcccagaatatccttcaagtt

SEQ ID NO: 122781 - DNA, 25 bp, Homo sapien
ccagtggccaccttggaaacatcgg

SEQ ID NO: 122782 - DNA, 25 bp, Homo sapien
tggccaccttggaaacatcggctgg

SEQ ID NO: 122783 - DNA, 25 bp, Homo sapien
accttggaaacatcggctggctttg

SEQ ID NO: 122784 - DNA, 25 bp, Homo sapien
gaaacatcggctggctttgggacta

SEQ ID NO: 122785 - DNA, 25 bp, Homo sapien
atcggctggctttgggactattcca

SEQ ID NO: 122786 - DNA, 25 bp, Homo sapien
gctggctttgggactattccacctc

SEQ ID NO: 122787 - DNA, 25 bp, Homo sapien
tatcaactaatcactaactccttcc

SEQ ID NO: 122788 - DNA, 25 bp, Homo sapien
taatcactaactccttccttttcct

SEQ ID NO: 122789 - DNA, 25 bp, Homo sapien
aaatgctcttgaaccggaaacccag

SEQ ID NO: 122790 - DNA, 25 bp, Homo sapien
tcttgaaccggaaacccagggatgg

SEQ ID NO: 122791 - DNA, 25 bp, Homo sapien
ggagatgctcactgagctgctgctt

SEQ ID NO: 122792 - DNA, 25 bp, Homo sapien
gcttttatgtgtgctggtgctatgt

SEQ ID NO: 122793 - DNA, 25 bp, Homo sapien
gctggtgctatgtgtgttcatgtcc

SEQ ID NO: 122794 - DNA, 25 bp, Homo sapien
atgtgtgttcatgtccgcggcagct

SEQ ID NO: 122795 - DNA, 25 bp, Homo sapien
ggcagctgtctttttgctactataa

SEQ ID NO: 122796 - DNA, 25 bp, Homo sapien
ataagggaattctggccaccctggg

SEQ ID NO: 122797 - DNA, 25 bp, Homo sapien
gggtgagaacccaagcgttggaact

SEQ ID NO: 122798 - DNA, 25 bp, Homo sapien
agcgttggaactgtagacccgtcct

SEQ ID NO: 122799 - DNA, 25 bp, Homo sapien
actgtagacccgtcctgtcgactgt

SEQ ID NO: 122800 - DNA, 25 bp, Homo sapien
acatttccgctgtccgtcagtaatt

SEQ ID NO: 122801 - DNA, 25 bp, Homo sapien
gctgtccgtcagtaattgtgtcctc

SEQ ID NO: 122802 - DNA, 25 bp, Homo sapien
cgtcagtaattgtgtcctctcttta

SEQ ID NO: 122803 - DNA, 25 bp, Homo sapien
gggaatgttgttttctgactaggct

SEQ ID NO: 122804 - DNA, 25 bp, Homo sapien
gttgttttctgactaggctgatcat

SEQ ID NO: 122805 - DNA, 25 bp, Homo sapien
gactaggctgatcattatctaaaga

SEQ ID NO: 122806 - DNA, 25 bp, Homo sapien
ttaggaccataaacgttgtgttcat

SEQ ID NO: 122807 - DNA, 25 bp, Homo sapien
aacgttgtgttcatatatggacatg

SEQ ID NO: 122808 - DNA, 25 bp, Homo sapien
ataaccttttagatggtcaaagtgt

SEQ ID NO: 122809 - DNA, 25 bp, Homo sapien
gatggtcaaagtgtaaggagttttt

SEQ ID NO: 122810 - DNA, 25 bp, Homo sapien
tcagataatcatttctacttcaaaa

SEQ ID NO: 122811 - DNA, 25 bp, Homo sapien
ttccttttcccgcgctccatgcctc

SEQ ID NO: 122812 - DNA, 25 bp, Homo sapien
tccttttcccgcgctccatgcctcc

SEQ ID NO: 122813 - DNA, 25 bp, Homo sapien
cttttcccgcgctccatgcctcccc

SEQ ID NO: 122814 - DNA, 25 bp, Homo sapien
ttttcccgcgctccatgcctccccc

SEQ ID NO: 122815 - DNA, 25 bp, Homo sapien
tttcccgcgctccatgcctccccct

SEQ ID NO: 122816 - DNA, 25 bp, Homo sapien
tcccggtgctgcggaagaactgaag

SEQ ID NO: 122817 - DNA, 25 bp, Homo sapien
cccggtgctgcggaagaactgaagg

SEQ ID NO: 122818 - DNA, 25 bp, Homo sapien
ccggtgctgcggaagaactgaaggt

SEQ ID NO: 122819 - DNA, 25 bp, Homo sapien
tactctgacgggagcatctgtattt

SEQ ID NO: 122820 - DNA, 25 bp, Homo sapien
actctgacgggagcatctgtatttt

SEQ ID NO: 122821 - DNA, 25 bp, Homo sapien
ctctgacgggagcatctgtattttt

SEQ ID NO: 122822 - DNA, 25 bp, Homo sapien
attttgcttttacgtctcaactgtg

SEQ ID NO: 122823 - DNA, 25 bp, Homo sapien
gcttttacgtctcaactgtgtatgt

SEQ ID NO: 122824 - DNA, 25 bp, Homo sapien
acgtctcaactgtgtatgtaaaaaa

SEQ ID NO: 122825 - DNA, 25 bp, Homo sapien
tatctgtcatgtacattgcattttg

SEQ ID NO: 122826 - DNA, 25 bp, Homo sapien
atctgtaactgcacaaccctggggt

SEQ ID NO: 122827 - DNA, 25 bp, Homo sapien
gggtttgctgcagagctatttcttt

SEQ ID NO: 122828 - DNA, 25 bp, Homo sapien
gctgcagagctatttctttccatgt

SEQ ID NO: 122829 - DNA, 25 bp, Homo sapien
gagctatttctttccatgtaaagta

SEQ ID NO: 122830 - DNA, 25 bp, Homo sapien
tgtaaagtagtggatccatcttgct

SEQ ID NO: 122831 - DNA, 25 bp, Homo sapien
ttttgccttatataaagcctacagt

SEQ ID NO: 122832 - DNA, 25 bp, Homo sapien
atggaagtgtggaaaactgtggctt

SEQ ID NO: 122833 - DNA, 25 bp, Homo sapien
aagtggcatgacaatggaggagcta

SEQ ID NO: 122834 - DNA, 25 bp, Homo sapien
cagctgagcagatgtaatagaaata

SEQ ID NO: 122835 - DNA, 25 bp, Homo sapien
gacaggtactacttagtgggcgtgc

SEQ ID NO: 122836 - DNA, 25 bp, Homo sapien
caggtactacttagtgggcgtgcag

SEQ ID NO: 122837 - DNA, 25 bp, Homo sapien
cgtgcaggagcagcaatgcgttgat

SEQ ID NO: 122838 - DNA, 25 bp, Homo sapien
ggagtggagcagtgcacttccagtc

SEQ ID NO: 122839 - DNA, 25 bp, Homo sapien
aaaccagagtgtgagaaggcacttc

SEQ ID NO: 122840 - DNA, 25 bp, Homo sapien
gtgagaaggcacttcttgcctttca

SEQ ID NO: 122841 - DNA, 25 bp, Homo sapien
aaggcacttcttgcctttcaggaga

SEQ ID NO: 122842 - DNA, 25 bp, Homo sapien
gcacttcttgcctttcaggagagta

SEQ ID NO: 122843 - DNA, 25 bp, Homo sapien
acttcttgcctttcaggagagtaag

SEQ ID NO: 122844 - DNA, 25 bp, Homo sapien
aagctgtctctggaaattgaacaac

SEQ ID NO: 122845 - DNA, 25 bp, Homo sapien
gaactacagagagacagcgcaagac

SEQ ID NO: 122846 - DNA, 25 bp, Homo sapien
gacagcgcaagacaatccactttgg

SEQ ID NO: 122847 - DNA, 25 bp, Homo sapien
ggaaaaggtgtcttgctggcttgcc

SEQ ID NO: 122848 - DNA, 25 bp, Homo sapien
tggcttgcctcttgcaattcaatac

SEQ ID NO: 122849 - DNA, 25 bp, Homo sapien
gcaattcaatacagatcagtttagc

SEQ ID NO: 122850 - DNA, 25 bp, Homo sapien
agtttagcaaatctactgtcaattt

SEQ ID NO: 122851 - DNA, 25 bp, Homo sapien
gtcaatttggcagtgatattcatca

SEQ ID NO: 122852 - DNA, 25 bp, Homo sapien
agtttagtgctttgagattgtgaaa

SEQ ID NO: 122853 - DNA, 25 bp, Homo sapien
catcctctgtgtggctcatgttttt

SEQ ID NO: 122854 - DNA, 25 bp, Homo sapien
tgtggctcatgtttttgcttttcaa

SEQ ID NO: 122855 - DNA, 25 bp, Homo sapien
gagccccagtatccggtccgatctg

SEQ ID NO: 122856 - DNA, 25 bp, Homo sapien
agccccacaccctggagacattggg

SEQ ID NO: 122857 - DNA, 25 bp, Homo sapien
ttaatgagggccttaaagcggctga

SEQ ID NO: 122858 - DNA, 25 bp, Homo sapien
taaagcggctgacaatgaccccaca

SEQ ID NO: 122859 - DNA, 25 bp, Homo sapien
tccaccatatgactccctgttagtg

SEQ ID NO: 122860 - DNA, 25 bp, Homo sapien
gactccctgttagtgtttgactatg

SEQ ID NO: 122861 - DNA, 25 bp, Homo sapien
ggctccactgctgggtccttgagct

SEQ ID NO: 122862 - DNA, 25 bp, Homo sapien
agctcccttaattcctcaagtagtg

SEQ ID NO: 122863 - DNA, 25 bp, Homo sapien
ggactatgattacctgaacgactgg

SEQ ID NO: 122864 - DNA, 25 bp, Homo sapien
gggccacggttcaagaaacttgctg

SEQ ID NO: 122865 - DNA, 25 bp, Homo sapien
aaacttgctgacatgtatggtggag

SEQ ID NO: 122866 - DNA, 25 bp, Homo sapien
gagatatggcacattattcacagac

SEQ ID NO: 122867 - DNA, 25 bp, Homo sapien
tggcacattattcacagaccatgat

SEQ ID NO: 122868 - DNA, 25 bp, Homo sapien
ttcacagaccatgatctttgtgatt

SEQ ID NO: 122869 - DNA, 25 bp, Homo sapien
taacaatgaacatgtaacttctctc

SEQ ID NO: 122870 - DNA, 25 bp, Homo sapien
gtaatcatatacaatgtcaactttt

SEQ ID NO: 122871 - DNA, 25 bp, Homo sapien
gtcaactttttagatgtttcaccac

SEQ ID NO: 122872 - DNA, 25 bp, Homo sapien
agatgtttcaccactcttttgcaaa

SEQ ID NO: 122873 - DNA, 25 bp, Homo sapien
gtttcaccactcttttgcaaataaa

SEQ ID NO: 122874 - DNA, 25 bp, Homo sapien
gcccatatatgagtatctccagaat

SEQ ID NO: 122875 - DNA, 25 bp, Homo sapien
ccagaatgtctacaaatagtttttg

SEQ ID NO: 122876 - DNA, 25 bp, Homo sapien
tcaaataagccttttgtttcaaata

SEQ ID NO: 122877 - DNA, 25 bp, Homo sapien
cctttagaagaagccacactctctg

SEQ ID NO: 122878 - DNA, 25 bp, Homo sapien
tttagaagaagccacactctctgaa

SEQ ID NO: 122879 - DNA, 25 bp, Homo sapien
gccacactctctgaattaaaaactg

SEQ ID NO: 122880 - DNA, 25 bp, Homo sapien
aattggaggctaagactgatccgtc

SEQ ID NO: 122881 - DNA, 25 bp, Homo sapien
tggaggctaagactgatccgtcaat

SEQ ID NO: 122882 - DNA, 25 bp, Homo sapien
gaggctaagactgatccgtcaatct

SEQ ID NO: 122883 - DNA, 25 bp, Homo sapien
ggctaagactgatccgtcaatcttg

SEQ ID NO: 122884 - DNA, 25 bp, Homo sapien
taagactgatccgtcaatcttgggt

SEQ ID NO: 122885 - DNA, 25 bp, Homo sapien
agactgatccgtcaatcttgggtgg

SEQ ID NO: 122886 - DNA, 25 bp, Homo sapien
gactgatccgtcaatcttgggtgga

SEQ ID NO: 122887 - DNA, 25 bp, Homo sapien
actgatccgtcaatcttgggtggaa

SEQ ID NO: 122888 - DNA, 25 bp, Homo sapien
cgtgcccaccttgggtgacactgag

SEQ ID NO: 122889 - DNA, 25 bp, Homo sapien
accttgggtgacactgaggctgccc

SEQ ID NO: 122890 - DNA, 25 bp, Homo sapien
tgactccgaggaagctcagatgctg

SEQ ID NO: 122891 - DNA, 25 bp, Homo sapien
ctccgaggaagctcagatgctgcag

SEQ ID NO: 122892 - DNA, 25 bp, Homo sapien
cagatgctgcagtcattagtttcta

SEQ ID NO: 122893 - DNA, 25 bp, Homo sapien
gatgctgcagtcattagtttctagt

SEQ ID NO: 122894 - DNA, 25 bp, Homo sapien
gcagtcattagtttctagtgtccca

SEQ ID NO: 122895 - DNA, 25 bp, Homo sapien
gtcattagtttctagtgtcccatca

SEQ ID NO: 122896 - DNA, 25 bp, Homo sapien
attagtttctagtgtcccatcagcc

SEQ ID NO: 122897 - DNA, 25 bp, Homo sapien
agtttctagtgtcccatcagccttg

SEQ ID NO: 122898 - DNA, 25 bp, Homo sapien
tagtgtcccatcagccttggtctca

SEQ ID NO: 122899 - DNA, 25 bp, Homo sapien
cacagtgttatgtagtattgttcta

SEQ ID NO: 122900 - DNA, 25 bp, Homo sapien
gaaaacagagtatttctggcagctg

SEQ ID NO: 122901 - DNA, 25 bp, Homo sapien
aaacagagtatttctggcagctgtg

SEQ ID NO: 122902 - DNA, 25 bp, Homo sapien
aatagcttattatagaattgcacat

SEQ ID NO: 122903 - DNA, 25 bp, Homo sapien
agaattgcacatagttctgcccaaa

SEQ ID NO: 122904 - DNA, 25 bp, Homo sapien
ttgcacatagttctgcccaaattat

SEQ ID NO: 122905 - DNA, 25 bp, Homo sapien
atagttctgcccaaattatgtgaaa

SEQ ID NO: 122906 - DNA, 25 bp, Homo sapien
tctgcccaaattatgtgaaatgctt

SEQ ID NO: 122907 - DNA, 25 bp, Homo sapien
gtgaaatgcttatgcttgtgtatat

SEQ ID NO: 122908 - DNA, 25 bp, Homo sapien
gaaatgcttatgcttgtgtatatgt

SEQ ID NO: 122909 - DNA, 25 bp, Homo sapien
taatacagagtacgttaaaagcaaa

SEQ ID NO: 122910 - DNA, 25 bp, Homo sapien
gtttatacagtacagtggttctaca

SEQ ID NO: 122911 - DNA, 25 bp, Homo sapien
acagtggttctacaatctatttatt

SEQ ID NO: 122912 - DNA, 25 bp, Homo sapien
caatctatttattggacatgtccat

SEQ ID NO: 122913 - DNA, 25 bp, Homo sapien
ggacatgtccatgaccagaagggaa

SEQ ID NO: 122914 - DNA, 25 bp, Homo sapien
ggaaacagtcatttgcgcacaactt

SEQ ID NO: 122915 - DNA, 25 bp, Homo sapien
tttgcgcacaacttaaaaagtctgc

SEQ ID NO: 122916 - DNA, 25 bp, Homo sapien
aaaagtctgcattacattccttgat

SEQ ID NO: 122917 - DNA, 25 bp, Homo sapien
tacattccttgataatgttgtggtt

SEQ ID NO: 122918 - DNA, 25 bp, Homo sapien
tgttgtggtttgttgccgttgccaa

SEQ ID NO: 122919 - DNA, 25 bp, Homo sapien
gtttgttgccgttgccaagaactga

SEQ ID NO: 122920 - DNA, 25 bp, Homo sapien
tgttgccgttgccaagaactgaaaa

SEQ ID NO: 122921 - DNA, 25 bp, Homo sapien
aagaagcggctcctcctaggcctgg

SEQ ID NO: 122922 - DNA, 25 bp, Homo sapien
cctaggcctggatcggtgagcactg

SEQ ID NO: 122923 - DNA, 25 bp, Homo sapien
gtgagcactgtagcctgcgtcatgg

SEQ ID NO: 122924 - DNA, 25 bp, Homo sapien
ctgcgtcatggctcaaggattcaat

SEQ ID NO: 122925 - DNA, 25 bp, Homo sapien
tgcaaggaggccttttgggaccgtt

SEQ ID NO: 122926 - DNA, 25 bp, Homo sapien
tttgggaccgttgcctctctgtcat

SEQ ID NO: 122927 - DNA, 25 bp, Homo sapien
ctgtcatcaacctcatgagctcaaa

SEQ ID NO: 122928 - DNA, 25 bp, Homo sapien
gatgctgcagataaatgccgaccca

SEQ ID NO: 122929 - DNA, 25 bp, Homo sapien
agataaatgccgacccacactactt

SEQ ID NO: 122930 - DNA, 25 bp, Homo sapien
actacttcacacaggtcttctccga

SEQ ID NO: 122931 - DNA, 25 bp, Homo sapien
aggtcttctccgacctgaagaacga

SEQ ID NO: 122932 - DNA, 25 bp, Homo sapien
tttagccacttacttaaaagatctg

SEQ ID NO: 122933 - DNA, 25 bp, Homo sapien
gccacttacttaaaagatctgctta

SEQ ID NO: 122934 - DNA, 25 bp, Homo sapien
acttacttaaaagatctgcttatgg

SEQ ID NO: 122935 - DNA, 25 bp, Homo sapien
ggactatggacagtcgactatggac

SEQ ID NO: 122936 - DNA, 25 bp, Homo sapien
actatggacagtcgactatggacac

SEQ ID NO: 122937 - DNA, 25 bp, Homo sapien
tatggacagtcgactatggacactc

SEQ ID NO: 122938 - DNA, 25 bp, Homo sapien
tggacagtcgactatggacactcaa

SEQ ID NO: 122939 - DNA, 25 bp, Homo sapien
gacagtcgactatggacactcaaca

SEQ ID NO: 122940 - DNA, 25 bp, Homo sapien
cagtcgactatggacactcaacaat

SEQ ID NO: 122941 - DNA, 25 bp, Homo sapien
tgtacttaaaaagtgcactatgcaa

SEQ ID NO: 122942 - DNA, 25 bp, Homo sapien
aaagtgcactatgcaaacgggtgta

SEQ ID NO: 122943 - DNA, 25 bp, Homo sapien
aaggacagagaactgtctttcattt

SEQ ID NO: 122944 - DNA, 25 bp, Homo sapien
tctttcatttttgaaccctcggtgt

SEQ ID NO: 122945 - DNA, 25 bp, Homo sapien
gaaccctcggtgtacacagaggcgg

SEQ ID NO: 122946 - DNA, 25 bp, Homo sapien
gaggcgggtctgtaacaggcaatca

SEQ ID NO: 122947 - DNA, 25 bp, Homo sapien
acaggcaatcaacaaacgtttcttg

SEQ ID NO: 122948 - DNA, 25 bp, Homo sapien
aacaaacgtttcttgagctagacca

SEQ ID NO: 122949 - DNA, 25 bp, Homo sapien
gtttcttgagctagaccaaggtcag

SEQ ID NO: 122950 - DNA, 25 bp, Homo sapien
agaccagctgtgtttcttaactaaa

SEQ ID NO: 122951 - DNA, 25 bp, Homo sapien
gtctttcaagtgaaaccagcttcct

SEQ ID NO: 122952 - DNA, 25 bp, Homo sapien
ccagcttccttcatctctaaggcta

SEQ ID NO: 122953 - DNA, 25 bp, Homo sapien
ttagggctgttgatttatgctttaa

SEQ ID NO: 122954 - DNA, 25 bp, Homo sapien
ggatgcaatggaagctaactaaaat

SEQ ID NO: 122955 - DNA, 25 bp, Homo sapien
aataaggcttagttgtcctttctat

SEQ ID NO: 122956 - DNA, 25 bp, Homo sapien
gcttagttgtcctttctatttaaat

SEQ ID NO: 122957 - DNA, 25 bp, Homo sapien
tctatttaaataccccaagttgtct

SEQ ID NO: 122958 - DNA, 25 bp, Homo sapien
caagttgtcttcttacttcctctcc

SEQ ID NO: 122959 - DNA, 25 bp, Homo sapien
cattttgcactgtgtgtcgatgcaa

SEQ ID NO: 122960 - DNA, 25 bp, Homo sapien
gtgtcgatgcaatcttcgctagcac

SEQ ID NO: 122961 - DNA, 25 bp, Homo sapien
tgcaatcttcgctagcacaaaatat

SEQ ID NO: 122962 - DNA, 25 bp, Homo sapien
tattgtcgctaatagtcatttctgt

SEQ ID NO: 122963 - DNA, 25 bp, Homo sapien
gatattctatatctagcggccttta

SEQ ID NO: 122964 - DNA, 25 bp, Homo sapien
atctagcggcctttatatgcaaata

SEQ ID NO: 122965 - DNA, 25 bp, Homo sapien
gacgattatttttctactcaatgtg

SEQ ID NO: 122966 - DNA, 25 bp, Homo sapien
actcaatgtgaatatccctggccag

SEQ ID NO: 122967 - DNA, 25 bp, Homo sapien
caatgtgaatatccctggccagcct

SEQ ID NO: 122968 - DNA, 25 bp, Homo sapien
cctcacttacccttaaacaggtgat

SEQ ID NO: 122969 - DNA, 25 bp, Homo sapien
ttaaacaggtgatcccacctgtctt

SEQ ID NO: 122970 - DNA, 25 bp, Homo sapien
ttttcgcctccttaatggcactgtg

SEQ ID NO: 122971 - DNA, 25 bp, Homo sapien
atggcactgtgcactcaactagagt

SEQ ID NO: 122972 - DNA, 25 bp, Homo sapien
ggcactgtgcactcaactagagtat

SEQ ID NO: 122973 - DNA, 25 bp, Homo sapien
gtgcactcaactagagtattaactg

SEQ ID NO: 122974 - DNA, 25 bp, Homo sapien
tgtgaagtttggaagctctattcgc

SEQ ID NO: 122975 - DNA, 25 bp, Homo sapien
gtttggaagctctattcgctgtatt

SEQ ID NO: 122976 - DNA, 25 bp, Homo sapien
aggacctcgcgcctgacactgcgct

SEQ ID NO: 122977 - DNA, 25 bp, Homo sapien
gtggcaccccaacaccggcaggaac

SEQ ID NO: 122978 - DNA, 25 bp, Homo sapien
caccggcaggaacctaccctcggct

SEQ ID NO: 122979 - DNA, 25 bp, Homo sapien
tccgccctccgtggctccgaggtgg

SEQ ID NO: 122980 - DNA, 25 bp, Homo sapien
ggggggcgccgcagtcatccctttc

SEQ ID NO: 122981 - DNA, 25 bp, Homo sapien
tttcctcgctcgattccttttcccg

SEQ ID NO: 122982 - DNA, 25 bp, Homo sapien
gaaggttcatgcctactctgacggg

SEQ ID NO: 122983 - DNA, 25 bp, Homo sapien
aaggttcatgcctactctgacggga

SEQ ID NO: 122984 - DNA, 25 bp, Homo sapien
aggttcatgcctactctgacgggag

SEQ ID NO: 122985 - DNA, 25 bp, Homo sapien
ggttcatgcctactctgacgggagc

SEQ ID NO: 122986 - DNA, 25 bp, Homo sapien
ctgacgggagcatctgtatttttta

SEQ ID NO: 122987 - DNA, 25 bp, Homo sapien
agtcttcatctcctgtggacgaaca

SEQ ID NO: 122988 - DNA, 25 bp, Homo sapien
catctcctgtggacgaacatctggg

SEQ ID NO: 122989 - DNA, 25 bp, Homo sapien
tttgtagccacacacaggatactgc

SEQ ID NO: 122990 - DNA, 25 bp, Homo sapien
cacacacaggatactgcccaagatc

SEQ ID NO: 122991 - DNA, 25 bp, Homo sapien
atccagcgggtgttttcttctcggt

SEQ ID NO: 122992 - DNA, 25 bp, Homo sapien
tttcttctcggttgttagatgtaca

SEQ ID NO: 122993 - DNA, 25 bp, Homo sapien
gtacaattggattaatgtccatcgt

SEQ ID NO: 122994 - DNA, 25 bp, Homo sapien
taatgtccatcgttttggaagacga

SEQ ID NO: 122995 - DNA, 25 bp, Homo sapien
gaagaacacgaagcacagaccctga

SEQ ID NO: 122996 - DNA, 25 bp, Homo sapien
gaagcacagaccctgatgtgataaa

SEQ ID NO: 122997 - DNA, 25 bp, Homo sapien
tctctgagtcacagataaacttctg

SEQ ID NO: 122998 - DNA, 25 bp, Homo sapien
gagagggcccagaagaccttcgtat

SEQ ID NO: 122999 - DNA, 25 bp, Homo sapien
agaagaccttcgtatcccctctcag

SEQ ID NO: 123000 - DNA, 25 bp, Homo sapien
tggcaggactccagatgaggacaag

SEQ ID NO: 123001 - DNA, 25 bp, Homo sapien
acaattgaggataccccgagctacc

SEQ ID NO: 123002 - DNA, 25 bp, Homo sapien
aggataccccgagctaccaggagag

SEQ ID NO: 123003 - DNA, 25 bp, Homo sapien
cccacacggaggacccaacaggagg

SEQ ID NO: 123004 - DNA, 25 bp, Homo sapien
aggacccaacaggaggccgtggctc

SEQ ID NO: 123005 - DNA, 25 bp, Homo sapien
caacaggaggccgtggctctgatgc

SEQ ID NO: 123006 - DNA, 25 bp, Homo sapien
ggctctgatgctgagcgaagctata

SEQ ID NO: 123007 - DNA, 25 bp, Homo sapien
cgaagctataggctcttgttggata

SEQ ID NO: 123008 - DNA, 25 bp, Homo sapien
agctataggctcttgttggataaaa

SEQ ID NO: 123009 - DNA, 25 bp, Homo sapien
tatacttttgcttcagttgcatatc

SEQ ID NO: 123010 - DNA, 25 bp, Homo sapien
atacttttgcttcagttgcatatct

SEQ ID NO: 123011 - DNA, 25 bp, Homo sapien
gcttcagttgcatatcttaaaacta

SEQ ID NO: 123012 - DNA, 25 bp, Homo sapien
ttcagttgcatatcttaaaactaaa

SEQ ID NO: 123013 - DNA, 25 bp, Homo sapien
aaatctttggatttgatcactacaa

SEQ ID NO: 123014 - DNA, 25 bp, Homo sapien
aatctttggatttgatcactacaag

SEQ ID NO: 123015 - DNA, 25 bp, Homo sapien
atctttggatttgatcactacaagt

SEQ ID NO: 123016 - DNA, 25 bp, Homo sapien
ctttggatttgatcactacaagtat

SEQ ID NO: 123017 - DNA, 25 bp, Homo sapien
ttggatttgatcactacaagtatta

SEQ ID NO: 123018 - DNA, 25 bp, Homo sapien
ggatttgatcactacaagtattatt

SEQ ID NO: 123019 - DNA, 25 bp, Homo sapien
tgatcactacaagtattattttaca

SEQ ID NO: 123020 - DNA, 25 bp, Homo sapien
atcaaacaattcagggagtgggcta

SEQ ID NO: 123021 - DNA, 25 bp, Homo sapien
agtgggctaagcacgggccatatga

SEQ ID NO: 123022 - DNA, 25 bp, Homo sapien
catatgaataacatggtgtgcttct

SEQ ID NO: 123023 - DNA, 25 bp, Homo sapien
catttacccttcttttctgactatt

SEQ ID NO: 123024 - DNA, 25 bp, Homo sapien
gactatttttcagaatctctcttct

SEQ ID NO: 123025 - DNA, 25 bp, Homo sapien
cttcttttcaagttgggtgatatgt

SEQ ID NO: 123026 - DNA, 25 bp, Homo sapien
ggtagattctaatggctttattgca

SEQ ID NO: 123027 - DNA, 25 bp, Homo sapien
aatggctttattgcagcgattaata

SEQ ID NO: 123028 - DNA, 25 bp, Homo sapien
tttgttcttcatctaagccttctgg

SEQ ID NO: 123029 - DNA, 25 bp, Homo sapien
ctaagccttctggttttatgggtca

SEQ ID NO: 123030 - DNA, 25 bp, Homo sapien
ttatgggtcagagttccgactgcca

SEQ ID NO: 123031 - DNA, 25 bp, Homo sapien
acactcccaaggttggagcccaggg

SEQ ID NO: 123032 - DNA, 25 bp, Homo sapien
aggttggagcccagggcatcttgct

SEQ ID NO: 123033 - DNA, 25 bp, Homo sapien
atcttgctggctacgcctcttctgt

SEQ ID NO: 123034 - DNA, 25 bp, Homo sapien
ctcttctgtccctgttagacgtcct

SEQ ID NO: 123035 - DNA, 25 bp, Homo sapien
tagacgtcctccgtccatatcagaa

SEQ ID NO: 123036 - DNA, 25 bp, Homo sapien
atatcagaactgtgccacaatgcag

SEQ ID NO: 123037 - DNA, 25 bp, Homo sapien
actgtgccacaatgcagttctgagc

SEQ ID NO: 123038 - DNA, 25 bp, Homo sapien
atgcagttctgagcaccgtgtcaag

SEQ ID NO: 123039 - DNA, 25 bp, Homo sapien
gagcaccgtgtcaagctgctctgag

SEQ ID NO: 123040 - DNA, 25 bp, Homo sapien
tgctctgagccacagtgggatgaac

SEQ ID NO: 123041 - DNA, 25 bp, Homo sapien
agccacagtgggatgaaccagccgg

SEQ ID NO: 123042 - DNA, 25 bp, Homo sapien
acctcatccagttcgctattttgat

SEQ ID NO: 123043 - DNA, 25 bp, Homo sapien
aactcaagtttaggcctttgtccag

SEQ ID NO: 123044 - DNA, 25 bp, Homo sapien
aggcctttgtccagaggtgcaaaat

SEQ ID NO: 123045 - DNA, 25 bp, Homo sapien
gagtgtggattctcagccaggtcct

SEQ ID NO: 123046 - DNA, 25 bp, Homo sapien
ttggcacgcctcctcaggcaaggat

SEQ ID NO: 123047 - DNA, 25 bp, Homo sapien
aactcagtagactcctctttgtcac

SEQ ID NO: 123048 - DNA, 25 bp, Homo sapien
tttgtcacttctctggagatccagc

SEQ ID NO: 123049 - DNA, 25 bp, Homo sapien
gagatccagcattccttatttggaa

SEQ ID NO: 123050 - DNA, 25 bp, Homo sapien
tttgtttatgtgtctatccctggta

SEQ ID NO: 123051 - DNA, 25 bp, Homo sapien
gtagtgcagcttaatttcaattcag

SEQ ID NO: 123052 - DNA, 25 bp, Homo sapien
aattcagtctttactttgccactag

SEQ ID NO: 123053 - DNA, 25 bp, Homo sapien
ggcgtagccagctcggaacttgcca

SEQ ID NO: 123054 - DNA, 25 bp, Homo sapien
gcgtagccagctcggaacttgccag

SEQ ID NO: 123055 - DNA, 25 bp, Homo sapien
cgtagccagctcggaacttgccagg

SEQ ID NO: 123056 - DNA, 25 bp, Homo sapien
gtagccagctcggaacttgccaggc

SEQ ID NO: 123057 - DNA, 25 bp, Homo sapien
tagccagctcggaacttgccaggcc

SEQ ID NO: 123058 - DNA, 25 bp, Homo sapien
agccagctcggaacttgccaggccc

SEQ ID NO: 123059 - DNA, 25 bp, Homo sapien
gccagctcggaacttgccaggcccc

SEQ ID NO: 123060 - DNA, 25 bp, Homo sapien
ccagctcggaacttgccaggcccca

SEQ ID NO: 123061 - DNA, 25 bp, Homo sapien
cagctcggaacttgccaggccccaa

SEQ ID NO: 123062 - DNA, 25 bp, Homo sapien
agctcggaacttgccaggccccaaa

SEQ ID NO: 123063 - DNA, 25 bp, Homo sapien
ctcggaacttgccaggccccaaagg

SEQ ID NO: 123064 - DNA, 25 bp, Homo sapien
ggactatcaacaccactaggaatcc

SEQ ID NO: 123065 - DNA, 25 bp, Homo sapien
atcaacaccactaggaatcccagag

SEQ ID NO: 123066 - DNA, 25 bp, Homo sapien
ggaatcccagaggtggatcctccct

SEQ ID NO: 123067 - DNA, 25 bp, Homo sapien
agaggtggatcctccctcatggctc

SEQ ID NO: 123068 - DNA, 25 bp, Homo sapien
tggctctggcacagtgtaatccagg

SEQ ID NO: 123069 - DNA, 25 bp, Homo sapien
ctgtgaatacttgaactctgttccc

SEQ ID NO: 123070 - DNA, 25 bp, Homo sapien
tcacctgtctaggtctcctcagggt

SEQ ID NO: 123071 - DNA, 25 bp, Homo sapien
gacagtgccttctctattggcacag

SEQ ID NO: 123072 - DNA, 25 bp, Homo sapien
tctattggcacagcctagggtcttg

SEQ ID NO: 123073 - DNA, 25 bp, Homo sapien
tcttgattcagccaaatgcagggag

SEQ ID NO: 123074 - DNA, 25 bp, Homo sapien
cccctatcctctgagtgtttggaaa

SEQ ID NO: 123075 - DNA, 25 bp, Homo sapien
aatgcacccctaaaagtcttgctcc

SEQ ID NO: 123076 - DNA, 25 bp, Homo sapien
ttgctccaatatcttcatcccatag

SEQ ID NO: 123077 - DNA, 25 bp, Homo sapien
gaattcttattccaggtgcaagcag

SEQ ID NO: 123078 - DNA, 25 bp, Homo sapien
gaggctgcttttgggaggacttcat

SEQ ID NO: 123079 - DNA, 25 bp, Homo sapien
ggacttcattgacctgggcctgcaa

SEQ ID NO: 123080 - DNA, 25 bp, Homo sapien
tgcaattggccaacttctttgcctt

SEQ ID NO: 123081 - DNA, 25 bp, Homo sapien
aacttctttgccttcactaacagct

SEQ ID NO: 123082 - DNA, 25 bp, Homo sapien
ctaacagctccctgaatccagtaat

SEQ ID NO: 123083 - DNA, 25 bp, Homo sapien
aatttatgtctttgtgggccggctc

SEQ ID NO: 123084 - DNA, 25 bp, Homo sapien
caggaccaaggtctgggaactttat

SEQ ID NO: 123085 - DNA, 25 bp, Homo sapien
ggaactttataaacaatgcacccct

SEQ ID NO: 123086 - DNA, 25 bp, Homo sapien
ggtgctgtgtctttatgaatgtttt

SEQ ID NO: 123087 - DNA, 25 bp, Homo sapien
gtgctgtgtctttatgaatgtttta

SEQ ID NO: 123088 - DNA, 25 bp, Homo sapien
gaatgttttaaccattttcatggtg

SEQ ID NO: 123089 - DNA, 25 bp, Homo sapien
gttttaaccattttcatggtggaag

SEQ ID NO: 123090 - DNA, 25 bp, Homo sapien
ccattttcatggtggaagaatttta

SEQ ID NO: 123091 - DNA, 25 bp, Homo sapien
tggtgttaaatgttgtctacagtgc

SEQ ID NO: 123092 - DNA, 25 bp, Homo sapien
gtgttaaatgttgtctacagtgcaa

SEQ ID NO: 123093 - DNA, 25 bp, Homo sapien
aatgttgtctacagtgcaaaatcca

SEQ ID NO: 123094 - DNA, 25 bp, Homo sapien
gttgtctacagtgcaaaatccatgt

SEQ ID NO: 123095 - DNA, 25 bp, Homo sapien
gtctacagtgcaaaatccatgttct

SEQ ID NO: 123096 - DNA, 25 bp, Homo sapien
tctacagtgcaaaatccatgttcta

SEQ ID NO: 123097 - DNA, 25 bp, Homo sapien
tcaaatgtttgctttgttacctgga

SEQ ID NO: 123098 - DNA, 25 bp, Homo sapien
tacctggaggactaaatgtagatgt

SEQ ID NO: 123099 - DNA, 25 bp, Homo sapien
gtagatgtctttagtatactttgta

SEQ ID NO: 123100 - DNA, 25 bp, Homo sapien
gataattttgtgaatctgtagattt

SEQ ID NO: 123101 - DNA, 25 bp, Homo sapien
ttcagtcttaccttacaaatttctt

SEQ ID NO: 123102 - DNA, 25 bp, Homo sapien
taccttacaaatttcttttctatga

SEQ ID NO: 123103 - DNA, 25 bp, Homo sapien
aatagaggaactcacggcactctgc

SEQ ID NO: 123104 - DNA, 25 bp, Homo sapien
aactcacggcactctgccacttgtt

SEQ ID NO: 123105 - DNA, 25 bp, Homo sapien
gtacatgatccccagaccacaacaa

SEQ ID NO: 123106 - DNA, 25 bp, Homo sapien
acataaactcatgtctgtgtcccat

SEQ ID NO: 123107 - DNA, 25 bp, Homo sapien
ctcatgtctgtgtcccatggtcata

SEQ ID NO: 123108 - DNA, 25 bp, Homo sapien
gggattgtagataacactgacttgt

SEQ ID NO: 123109 - DNA, 25 bp, Homo sapien
gtagataacactgacttgtttgttt

SEQ ID NO: 123110 - DNA, 25 bp, Homo sapien
ccaataactagcttcttataatgat

SEQ ID NO: 123111 - DNA, 25 bp, Homo sapien
gatacttacaagtttctagctctca

SEQ ID NO: 123112 - DNA, 25 bp, Homo sapien
acaagtttctagctctcacagacat

SEQ ID NO: 123113 - DNA, 25 bp, Homo sapien
gtttctagctctcacagacatatag

SEQ ID NO: 123114 - DNA, 25 bp, Homo sapien
gaataagggtttttgcataataagc

SEQ ID NO: 123115 - DNA, 25 bp, Homo sapien
ttcctgtaaccttctattttctata

SEQ ID NO: 123116 - DNA, 25 bp, Homo sapien
tagtaattgctctacagataatgtc

SEQ ID NO: 123117 - DNA, 25 bp, Homo sapien
tatattggccaaactggtgcatgac

SEQ ID NO: 123118 - DNA, 25 bp, Homo sapien
aaactggtgcatgacaagtactgta

SEQ ID NO: 123119 - DNA, 25 bp, Homo sapien
attcccattcacttaacagctcttt

SEQ ID NO: 123120 - DNA, 25 bp, Homo sapien
ttaacagctcttttgggattgggtg

SEQ ID NO: 123121 - DNA, 25 bp, Homo sapien
ggattgggtgtttcattccatttct

SEQ ID NO: 123122 - DNA, 25 bp, Homo sapien
tcctctcctctctggtaggtttaat

SEQ ID NO: 123123 - DNA, 25 bp, Homo sapien
ttatgctttccctgattccagcttt

SEQ ID NO: 123124 - DNA, 25 bp, Homo sapien
ccccaaagtttgtctgtggtgttat

SEQ ID NO: 123125 - DNA, 25 bp, Homo sapien
atagtggtaactgcagttcctcctc

SEQ ID NO: 123126 - DNA, 25 bp, Homo sapien
cctcctctggaatgtagactgtata

SEQ ID NO: 123127 - DNA, 25 bp, Homo sapien
gtttaataactcaccttctctatcc

SEQ ID NO: 123128 - DNA, 25 bp, Homo sapien
ttctctatccttgctcaaaatgtgg

SEQ ID NO: 123129 - DNA, 25 bp, Homo sapien
aaatgtgggataacgcgatgactgt

SEQ ID NO: 123130 - DNA, 25 bp, Homo sapien
atagtgggcatttgcctgggcgtcg

SEQ ID NO: 123131 - DNA, 25 bp, Homo sapien
atttgcctgggcgtcggcctactcg

SEQ ID NO: 123132 - DNA, 25 bp, Homo sapien
ggcctactcgagctcgggttcatga

SEQ ID NO: 123133 - DNA, 25 bp, Homo sapien
gagctcgggttcatgacgctctcga

SEQ ID NO: 123134 - DNA, 25 bp, Homo sapien
tcgggttcatgacgctctcgatatt

SEQ ID NO: 123135 - DNA, 25 bp, Homo sapien
ttcatgacgctctcgatattcctgt

SEQ ID NO: 123136 - DNA, 25 bp, Homo sapien
tgacgctctcgatattcctgtgcag

SEQ ID NO: 123137 - DNA, 25 bp, Homo sapien
ctgtgcagaaacctggaccacgtct

SEQ ID NO: 123138 - DNA, 25 bp, Homo sapien
gcagaaacctggaccacgtctacaa

SEQ ID NO: 123139 - DNA, 25 bp, Homo sapien
gaaacctggaccacgtctacaaccg

SEQ ID NO: 123140 - DNA, 25 bp, Homo sapien
aaccggctcgctcgataccgttagg

SEQ ID NO: 123141 - DNA, 25 bp, Homo sapien
gggaacctggtacatccagtcactt

SEQ ID NO: 123142 - DNA, 25 bp, Homo sapien
ggtacatccagtcactttgccagag

SEQ ID NO: 123143 - DNA, 25 bp, Homo sapien
agtcactttgccagagcctgagaga

SEQ ID NO: 123144 - DNA, 25 bp, Homo sapien
gagcctgagagagcgatgtcctcga

SEQ ID NO: 123145 - DNA, 25 bp, Homo sapien
agagcgatgtcctcgaggcgatgat

SEQ ID NO: 123146 - DNA, 25 bp, Homo sapien
gtcctcgaggcgatgatattctcac

SEQ ID NO: 123147 - DNA, 25 bp, Homo sapien
aggcgatgatattctcaccatcctg

SEQ ID NO: 123148 - DNA, 25 bp, Homo sapien
atattctcaccatcctgactgaagt

SEQ ID NO: 123149 - DNA, 25 bp, Homo sapien
accatcctgactgaagtgaactatg

SEQ ID NO: 123150 - DNA, 25 bp, Homo sapien
ggaaacagatgcctcagcctacttt

SEQ ID NO: 123151 - DNA, 25 bp, Homo sapien
cctcagcctactttcacactaagaa

SEQ ID NO: 123152 - DNA, 25 bp, Homo sapien
tccctggtgcacctgatgaagccaa

SEQ ID NO: 123153 - DNA, 25 bp, Homo sapien
aaacgcagtccccaaggcgtgctgt

SEQ ID NO: 123154 - DNA, 25 bp, Homo sapien
tgctgtgcacccaccaagctgagcg

SEQ ID NO: 123155 - DNA, 25 bp, Homo sapien
acctctgtgctctactatgacagca

SEQ ID NO: 123156 - DNA, 25 bp, Homo sapien
tgacagcagcaacaacgtcatcctg

SEQ ID NO: 123157 - DNA, 25 bp, Homo sapien
gcaacaacgtcatcctgcgcaagca

SEQ ID NO: 123158 - DNA, 25 bp, Homo sapien
gcgcaagcaccgcaacatggtggtc

SEQ ID NO: 123159 - DNA, 25 bp, Homo sapien
aacatggtggtcaaggcctgcggct

SEQ ID NO: 123160 - DNA, 25 bp, Homo sapien
ttctcatctggatcgggccctgcag

SEQ ID NO: 123161 - DNA, 25 bp, Homo sapien
gaaaacccttaaatgctgtcacagc

SEQ ID NO: 123162 - DNA, 25 bp, Homo sapien
taaatgctgtcacagctcaagcagg

SEQ ID NO: 123163 - DNA, 25 bp, Homo sapien
gcaaacacttggtaattgtctaaaa

SEQ ID NO: 123164 - DNA, 25 bp, Homo sapien
aaattgggcctttgatttaagatgg

SEQ ID NO: 123165 - DNA, 25 bp, Homo sapien
gatggtataattgggtgtgcttgta

SEQ ID NO: 123166 - DNA, 25 bp, Homo sapien
ggtgtgcttgtatagaaagacagac

SEQ ID NO: 123167 - DNA, 25 bp, Homo sapien
agatacagaacatccaagagtgtgg

SEQ ID NO: 123168 - DNA, 25 bp, Homo sapien
atgtcagtagaggaattttagcaac

SEQ ID NO: 123169 - DNA, 25 bp, Homo sapien
attttagcaacatggccatctgagc

SEQ ID NO: 123170 - DNA, 25 bp, Homo sapien
gccatctgagccactgactaaggag

SEQ ID NO: 123171 - DNA, 25 bp, Homo sapien
gactaaggagatgtaccacttcaat

SEQ ID NO: 123172 - DNA, 25 bp, Homo sapien
taccacttcaattacatacatgcag

SEQ ID NO: 123173 - DNA, 25 bp, Homo sapien
caggacatgctgaactgtattacaa

SEQ ID NO: 123174 - DNA, 25 bp, Homo sapien
acctgggcagatacatcccattcct

SEQ ID NO: 123175 - DNA, 25 bp, Homo sapien
atcccattccttcctagtgagaagc

SEQ ID NO: 123176 - DNA, 25 bp, Homo sapien
ctggaaagaaccagctctgtctctc

SEQ ID NO: 123177 - DNA, 25 bp, Homo sapien
acagcagagccggaactctctattg

SEQ ID NO: 123178 - DNA, 25 bp, Homo sapien
agccggaactctctattgtgtttta

SEQ ID NO: 123179 - DNA, 25 bp, Homo sapien
ttgtgttttaggtcagatgcagaaa

SEQ ID NO: 123180 - DNA, 25 bp, Homo sapien
agcaaacacattaagccttccacac

SEQ ID NO: 123181 - DNA, 25 bp, Homo sapien
ggtgacagaggtgatcgcctactcc

SEQ ID NO: 123182 - DNA, 25 bp, Homo sapien
actgctgcatgaacccggtgatcta

SEQ ID NO: 123183 - DNA, 25 bp, Homo sapien
cccggtgatctacgcctttgttgga

SEQ ID NO: 123184 - DNA, 25 bp, Homo sapien
acaggcacttgctcatgcacctggg

SEQ ID NO: 123185 - DNA, 25 bp, Homo sapien
aatacagttctgtcatatgttaagc

SEQ ID NO: 123186 - DNA, 25 bp, Homo sapien
aaattttctgaaactgcataagtga

SEQ ID NO: 123187 - DNA, 25 bp, Homo sapien
gtgaaaatcttacaacaggtttatg

SEQ ID NO: 123188 - DNA, 25 bp, Homo sapien
aagcaacatctttttaacctgcaaa

SEQ ID NO: 123189 - DNA, 25 bp, Homo sapien
aacctgcaaaatctgttctaacatg

SEQ ID NO: 123190 - DNA, 25 bp, Homo sapien
ctgttctaacatgtaattgcagata

SEQ ID NO: 123191 - DNA, 25 bp, Homo sapien
gcagataactttgactttcttctga

SEQ ID NO: 123192 - DNA, 25 bp, Homo sapien
tctgaatattttatctttccttggc

SEQ ID NO: 123193 - DNA, 25 bp, Homo sapien
ttttgccaatctcaacacccaagtt

SEQ ID NO: 123194 - DNA, 25 bp, Homo sapien
tttaaaatggtttgtcctgatgctt

SEQ ID NO: 123195 - DNA, 25 bp, Homo sapien
tgtcctgatgcttttgtctaattaa

SEQ ID NO: 123196 - DNA, 25 bp, Homo sapien
gcggcgtgaaccccgtggtctccta

SEQ ID NO: 123197 - DNA, 25 bp, Homo sapien
tggtctcctacgccgtggctctcag

SEQ ID NO: 123198 - DNA, 25 bp, Homo sapien
ctcctacgccgtggctctcagctgt

SEQ ID NO: 123199 - DNA, 25 bp, Homo sapien
tctcagctgtcaatgtgcactctgc

SEQ ID NO: 123200 - DNA, 25 bp, Homo sapien
tcagctgtcaatgtgcactctgccg

SEQ ID NO: 123201 - DNA, 25 bp, Homo sapien
cagctgtcaatgtgcactctgccgc

SEQ ID NO: 123202 - DNA, 25 bp, Homo sapien
gctgtcaatgtgcactctgccgccg

SEQ ID NO: 123203 - DNA, 25 bp, Homo sapien
tgtcaatgtgcactctgccgccgca

SEQ ID NO: 123204 - DNA, 25 bp, Homo sapien
gtcaatgtgcactctgccgccgcag

SEQ ID NO: 123205 - DNA, 25 bp, Homo sapien
tgtgatgacccccgcttccaggact

SEQ ID NO: 123206 - DNA, 25 bp, Homo sapien
cgcttccaggactcctcttcctcaa

SEQ ID NO: 123207 - DNA, 25 bp, Homo sapien
agaacatccgcagtcatcagaagct

SEQ ID NO: 123208 - DNA, 25 bp, Homo sapien
atccgcagtcatcagaagctcaaga

SEQ ID NO: 123209 - DNA, 25 bp, Homo sapien
aaatccaaactctggcttctcaaag

SEQ ID NO: 123210 - DNA, 25 bp, Homo sapien
aactctggcttctcaaagaccgtga

SEQ ID NO: 123211 - DNA, 25 bp, Homo sapien
aagaccgtgatttagccaggccgaa

SEQ ID NO: 123212 - DNA, 25 bp, Homo sapien
ttagccaggccgaaagaacaagaga

SEQ ID NO: 123213 - DNA, 25 bp, Homo sapien
gagagaagccatggtgggtaccatt

SEQ ID NO: 123214 - DNA, 25 bp, Homo sapien
tggtgggtaccattgatatgaccct

SEQ ID NO: 123215 - DNA, 25 bp, Homo sapien
gatatgacccttcaaagtgacatta

SEQ ID NO: 123216 - DNA, 25 bp, Homo sapien
attaaccatccacttaaaatgaatg

SEQ ID NO: 123217 - DNA, 25 bp, Homo sapien
aaaatgattgctttcagataacaag

SEQ ID NO: 123218 - DNA, 25 bp, Homo sapien
tgacatccccactcacgaatattat

SEQ ID NO: 123219 - DNA, 25 bp, Homo sapien
acatccccactcacgaatattatgc

SEQ ID NO: 123220 - DNA, 25 bp, Homo sapien
cccactcacgaatattatgcccagt

SEQ ID NO: 123221 - DNA, 25 bp, Homo sapien
cacgaatattatgcccagtttctgc

SEQ ID NO: 123222 - DNA, 25 bp, Homo sapien
gcccagaaaaggacagaaacgaagt

SEQ ID NO: 123223 - DNA, 25 bp, Homo sapien
cagtcctggcctggcttctcctttg

SEQ ID NO: 123224 - DNA, 25 bp, Homo sapien
ctcctttggaagtgaggcattgcac

SEQ ID NO: 123225 - DNA, 25 bp, Homo sapien
ggagacgtacgtatcagcggcccct

SEQ ID NO: 123226 - DNA, 25 bp, Homo sapien
gacgtacgtatcagcggccccttga

SEQ ID NO: 123227 - DNA, 25 bp, Homo sapien
gtatcagcggccccttgactctggg

SEQ ID NO: 123228 - DNA, 25 bp, Homo sapien
gggactccgggtttgagatggacac

SEQ ID NO: 123229 - DNA, 25 bp, Homo sapien
gctactgaccagttcatccagcttt

SEQ ID NO: 123230 - DNA, 25 bp, Homo sapien
tcatccagctttccacacagttgtt

SEQ ID NO: 123231 - DNA, 25 bp, Homo sapien
tttccacacagttgttgctgcctat

SEQ ID NO: 123232 - DNA, 25 bp, Homo sapien
acagttgttgctgcctattgtggtg

SEQ ID NO: 123233 - DNA, 25 bp, Homo sapien
gcctattgtggtgccgcctcaggtt

SEQ ID NO: 123234 - DNA, 25 bp, Homo sapien
ccttctccaatgagggagccacaga

SEQ ID NO: 123235 - DNA, 25 bp, Homo sapien
gccacagaatcctgagaaggtgaat

SEQ ID NO: 123236 - DNA, 25 bp, Homo sapien
gaaggtgaatgtaccctaacctgct

SEQ ID NO: 123237 - DNA, 25 bp, Homo sapien
tgtgcctaggccttacgcatttgct

SEQ ID NO: 123238 - DNA, 25 bp, Homo sapien
cttacgcatttgctgactgactcag

SEQ ID NO: 123239 - DNA, 25 bp, Homo sapien
cattttccgctactgaccagttcat

SEQ ID NO: 123240 - DNA, 25 bp, Homo sapien
taaacaatattgctagaggtggcat

SEQ ID NO: 123241 - DNA, 25 bp, Homo sapien
gaggtggcatgtttagtctaccaaa

SEQ ID NO: 123242 - DNA, 25 bp, Homo sapien
aaacaatacttttcaggcactttag

SEQ ID NO: 123243 - DNA, 25 bp, Homo sapien
tttcaggcactttagaaatatcctt

SEQ ID NO: 123244 - DNA, 25 bp, Homo sapien
gaaatatccttttagaagcagcgag

SEQ ID NO: 123245 - DNA, 25 bp, Homo sapien
gaagcagcgagtgcatgggctaatt

SEQ ID NO: 123246 - DNA, 25 bp, Homo sapien
gagtgcatgggctaattatcatcaa

SEQ ID NO: 123247 - DNA, 25 bp, Homo sapien
tgggctaattatcatcaatctttat

SEQ ID NO: 123248 - DNA, 25 bp, Homo sapien
gaaacatctacaggatctttattgg

SEQ ID NO: 123249 - DNA, 25 bp, Homo sapien
ggatctttattggtgaccttttgta

SEQ ID NO: 123250 - DNA, 25 bp, Homo sapien
ggtgaccttttgtaagacattagtt

SEQ ID NO: 123251 - DNA, 25 bp, Homo sapien
cgacgcctgcgacatgaccatagag

SEQ ID NO: 123252 - DNA, 25 bp, Homo sapien
ctgcgacatgaccatagaggagatg

SEQ ID NO: 123253 - DNA, 25 bp, Homo sapien
agagcgcggccgacaacatcctcag

SEQ ID NO: 123254 - DNA, 25 bp, Homo sapien
aatggcgccctcttaccctttgtga

SEQ ID NO: 123255 - DNA, 25 bp, Homo sapien
taccctttgtgaactgcagggacgc

SEQ ID NO: 123256 - DNA, 25 bp, Homo sapien
tccaggacagcagggtctacgtcag

SEQ ID NO: 123257 - DNA, 25 bp, Homo sapien
gacagcagggtctacgtcagcagcc

SEQ ID NO: 123258 - DNA, 25 bp, Homo sapien
gggtctacgtcagcagcctgtagtg

SEQ ID NO: 123259 - DNA, 25 bp, Homo sapien
ggcgctgccagatgcgggctttttt

SEQ ID NO: 123260 - DNA, 25 bp, Homo sapien
tttgtttcaatgttcctaatgggtt

SEQ ID NO: 123261 - DNA, 25 bp, Homo sapien
aatgttcctaatgggttcgtttcag

SEQ ID NO: 123262 - DNA, 25 bp, Homo sapien
agaggattgactgacctcgcatctt

SEQ ID NO: 123263 - DNA, 25 bp, Homo sapien
tgacctcgcatcttcggaccgaagt

SEQ ID NO: 123264 - DNA, 25 bp, Homo sapien
ttcggaccgaagtgagagccgtgct

SEQ ID NO: 123265 - DNA, 25 bp, Homo sapien
accgaagtgagagccgtgctcggac

SEQ ID NO: 123266 - DNA, 25 bp, Homo sapien
aggactgagcagaggcggccggtct

SEQ ID NO: 123267 - DNA, 25 bp, Homo sapien
tgcggctgtgtccttagtgctgtta

SEQ ID NO: 123268 - DNA, 25 bp, Homo sapien
gtccttagtgctgttaggaggcccc

SEQ ID NO: 123269 - DNA, 25 bp, Homo sapien
aatccccacgttgagctgtctagca

SEQ ID NO: 123270 - DNA, 25 bp, Homo sapien
ttgagctgtctagcatgagcaccca

SEQ ID NO: 123271 - DNA, 25 bp, Homo sapien
caccgcgctggctggcactgaagga

SEQ ID NO: 123272 - DNA, 25 bp, Homo sapien
gctggctggcactgaaggacagcaa

SEQ ID NO: 123273 - DNA, 25 bp, Homo sapien
ggctcccaagggtgcaggtgggcgc

SEQ ID NO: 123274 - DNA, 25 bp, Homo sapien
atcacatgttcccttggcctcagag

SEQ ID NO: 123275 - DNA, 25 bp, Homo sapien
cagaggcaccccatgaagctttttt

SEQ ID NO: 123276 - DNA, 25 bp, Homo sapien
atgaagcttttttctcgttcactcc

SEQ ID NO: 123277 - DNA, 25 bp, Homo sapien
gaagcttttttctcgttcactccca

SEQ ID NO: 123278 - DNA, 25 bp, Homo sapien
aacccaagtgtccaaagctccagtc

SEQ ID NO: 123279 - DNA, 25 bp, Homo sapien
tccagtcctaggagaacagtccctg

SEQ ID NO: 123280 - DNA, 25 bp, Homo sapien
cctaggagaacagtccctgggtcag

SEQ ID NO: 123281 - DNA, 25 bp, Homo sapien
tcagcagccaggaggcggtccataa

SEQ ID NO: 123282 - DNA, 25 bp, Homo sapien
agccaggaggcggtccataagaatg

SEQ ID NO: 123283 - DNA, 25 bp, Homo sapien
ccgcacctgtccagaacaacatgtt

SEQ ID NO: 123284 - DNA, 25 bp, Homo sapien
ttgtctcccagctatctataacctt

SEQ ID NO: 123285 - DNA, 25 bp, Homo sapien
gtctcccagctatctataaccttag

SEQ ID NO: 123286 - DNA, 25 bp, Homo sapien
tctcccagctatctataaccttagc

SEQ ID NO: 123287 - DNA, 25 bp, Homo sapien
gtgtcgccttgtgggttcctgttgc

SEQ ID NO: 123288 - DNA, 25 bp, Homo sapien
tcgccttgtgggttcctgttgctga

SEQ ID NO: 123289 - DNA, 25 bp, Homo sapien
ccttgtgggttcctgttgctgagac

SEQ ID NO: 123290 - DNA, 25 bp, Homo sapien
ccgccccgtgccgtggacatctggg

SEQ ID NO: 123291 - DNA, 25 bp, Homo sapien
gtatgcggatgatttagaattgtca

SEQ ID NO: 123292 - DNA, 25 bp, Homo sapien
gcggatgatttagaattgtcatttc

SEQ ID NO: 123293 - DNA, 25 bp, Homo sapien
tgtcatttctctttactggatgttt

SEQ ID NO: 123294 - DNA, 25 bp, Homo sapien
catttctctttactggatgtttatt

SEQ ID NO: 123295 - DNA, 25 bp, Homo sapien
gtgttcttggtattcttagtctagc

SEQ ID NO: 123296 - DNA, 25 bp, Homo sapien
gtattcttagtctagctcacctcaa

SEQ ID NO: 123297 - DNA, 25 bp, Homo sapien
agctcacctcaatagccttgaatcc

SEQ ID NO: 123298 - DNA, 25 bp, Homo sapien
atagccttgaatcctgcatatgaat

SEQ ID NO: 123299 - DNA, 25 bp, Homo sapien
gaattagacattcatcactggcata

SEQ ID NO: 123300 - DNA, 25 bp, Homo sapien
gacattcatcactggcatatttaga

SEQ ID NO: 123301 - DNA, 25 bp, Homo sapien
gaatatctctaaaaggacttgtttg

SEQ ID NO: 123302 - DNA, 25 bp, Homo sapien
gaattttctatgtttcaaagtgttc

SEQ ID NO: 123303 - DNA, 25 bp, Homo sapien
ggatggtgttgacttctgactctaa

SEQ ID NO: 123304 - DNA, 25 bp, Homo sapien
gacttctgactctaaaagcaatcaa

SEQ ID NO: 123305 - DNA, 25 bp, Homo sapien
gtgaccaagaattatagtaccttct

SEQ ID NO: 123306 - DNA, 25 bp, Homo sapien
ccgggcgagttacgcggcctctctg

SEQ ID NO: 123307 - DNA, 25 bp, Homo sapien
gccccgctacagaagccagactggg

SEQ ID NO: 123308 - DNA, 25 bp, Homo sapien
ccccgctacagaagccagactgggt

SEQ ID NO: 123309 - DNA, 25 bp, Homo sapien
cgctacagaagccagactgggtccc

SEQ ID NO: 123310 - DNA, 25 bp, Homo sapien
gctacagaagccagactgggtcccg

SEQ ID NO: 123311 - DNA, 25 bp, Homo sapien
tacagaagccagactgggtcccgcg

SEQ ID NO: 123312 - DNA, 25 bp, Homo sapien
cagaagccagactgggtcccgcgga

SEQ ID NO: 123313 - DNA, 25 bp, Homo sapien
agaagccagactgggtcccgcggac

SEQ ID NO: 123314 - DNA, 25 bp, Homo sapien
aagccagactgggtcccgcggacgc

SEQ ID NO: 123315 - DNA, 25 bp, Homo sapien
ctgggtcccgcggacgccagcaggg

SEQ ID NO: 123316 - DNA, 25 bp, Homo sapien
ctaggctgcgctccagcactgcggg

SEQ ID NO: 123317 - DNA, 25 bp, Homo sapien
gcctctccccagatatctgagcata

SEQ ID NO: 123318 - DNA, 25 bp, Homo sapien
atatctgagcataactgggagcacc

SEQ ID NO: 123319 - DNA, 25 bp, Homo sapien
actgggagcacctcatttgtggaaa

SEQ ID NO: 123320 - DNA, 25 bp, Homo sapien
ggaaaagcctctttgttatcggcct

SEQ ID NO: 123321 - DNA, 25 bp, Homo sapien
tttgttatcggccttgtgtcagcag

SEQ ID NO: 123322 - DNA, 25 bp, Homo sapien
gtgtcagcaggtcatggtccctaga

SEQ ID NO: 123323 - DNA, 25 bp, Homo sapien
ggtcatggtccctagagactaccta

SEQ ID NO: 123324 - DNA, 25 bp, Homo sapien
tggtccctagagactacctagttgt

SEQ ID NO: 123325 - DNA, 25 bp, Homo sapien
tacctagttgtagtgtgacctacat

SEQ ID NO: 123326 - DNA, 25 bp, Homo sapien
ataattattgtcatgtccgaataga

SEQ ID NO: 123327 - DNA, 25 bp, Homo sapien
tgtatgtattattcaatcctttgga

SEQ ID NO: 123328 - DNA, 25 bp, Homo sapien
ggctcccaagggtgcaggtgggcgc

SEQ ID NO: 123329 - DNA, 25 bp, Homo sapien
tgcaggtgggcgcaaggcccggccc

SEQ ID NO: 123330 - DNA, 25 bp, Homo sapien
cccagaggcaccccatgaagctttt

SEQ ID NO: 123331 - DNA, 25 bp, Homo sapien
ccatgaagcttttttctcgttcact

SEQ ID NO: 123332 - DNA, 25 bp, Homo sapien
catgaagcttttttctcgttcactc

SEQ ID NO: 123333 - DNA, 25 bp, Homo sapien
atgaagcttttttctcgttcactcc

SEQ ID NO: 123334 - DNA, 25 bp, Homo sapien
tgaagcttttttctcgttcactccc

SEQ ID NO: 123335 - DNA, 25 bp, Homo sapien
gaagcttttttctcgttcactccca

SEQ ID NO: 123336 - DNA, 25 bp, Homo sapien
tcagcagccaggaggcggtccataa

SEQ ID NO: 123337 - DNA, 25 bp, Homo sapien
cagcagccaggaggcggtccataag

SEQ ID NO: 123338 - DNA, 25 bp, Homo sapien
agccaggaggcggtccataagaatg

SEQ ID NO: 123339 - DNA, 25 bp, Homo sapien
aggacctcgcgcctgacactgcgct

SEQ ID NO: 123340 - DNA, 25 bp, Homo sapien
gtggcaccccaacaccggcaggaac

SEQ ID NO: 123341 - DNA, 25 bp, Homo sapien
caccggcaggaacctaccctcggct

SEQ ID NO: 123342 - DNA, 25 bp, Homo sapien
taaccagcggctttcgcgccgccct

SEQ ID NO: 123343 - DNA, 25 bp, Homo sapien
tccgccctccgtggctccgaggtgg

SEQ ID NO: 123344 - DNA, 25 bp, Homo sapien
ggggggcgccgcagtcatccctttc

SEQ ID NO: 123345 - DNA, 25 bp, Homo sapien
tttcctcgctcgattccttttcccg

SEQ ID NO: 123346 - DNA, 25 bp, Homo sapien
gaaggttcatgcctactctgacggg

SEQ ID NO: 123347 - DNA, 25 bp, Homo sapien
aaggttcatgcctactctgacggga

SEQ ID NO: 123348 - DNA, 25 bp, Homo sapien
aggttcatgcctactctgacgggag

SEQ ID NO: 123349 - DNA, 25 bp, Homo sapien
ggttcatgcctactctgacgggagc

SEQ ID NO: 123350 - DNA, 25 bp, Homo sapien
cctccagctcctcttggagaagctg

SEQ ID NO: 123351 - DNA, 25 bp, Homo sapien
caagtcaatcagaaccacaacaggt

SEQ ID NO: 123352 - DNA, 25 bp, Homo sapien
acaacaggttggtcatcaggatggc

SEQ ID NO: 123353 - DNA, 25 bp, Homo sapien
ggttggtcatcaggatggccaccct

SEQ ID NO: 123354 - DNA, 25 bp, Homo sapien
tctttccctgccacgtggaaacaat

SEQ ID NO: 123355 - DNA, 25 bp, Homo sapien
tggaaacaatcatcagatccttgcc

SEQ ID NO: 123356 - DNA, 25 bp, Homo sapien
ttttaaagcccatgccccaactctg

SEQ ID NO: 123357 - DNA, 25 bp, Homo sapien
tgccaggacgttctagcaggtcatc

SEQ ID NO: 123358 - DNA, 25 bp, Homo sapien
aggtcatcggtgctttgctgtccat

SEQ ID NO: 123359 - DNA, 25 bp, Homo sapien
tgtccatcttcccatgctgcaattt

SEQ ID NO: 123360 - DNA, 25 bp, Homo sapien
tcccatgctgcaatttcttcctgag

SEQ ID NO: 123361 - DNA, 25 bp, Homo sapien
tagcagtccaggtccctcaaccttc

SEQ ID NO: 123362 - DNA, 25 bp, Homo sapien
accttcaccaaacactacccatggg

SEQ ID NO: 123363 - DNA, 25 bp, Homo sapien
ggttgggagtcagccggccaaacta

SEQ ID NO: 123364 - DNA, 25 bp, Homo sapien
gagtcagccggccaaactaacactc

SEQ ID NO: 123365 - DNA, 25 bp, Homo sapien
tggctgtctctctggctcctgacct

SEQ ID NO: 123366 - DNA, 25 bp, Homo sapien
ctgacctggcctttggctaccatac

SEQ ID NO: 123367 - DNA, 25 bp, Homo sapien
gctaccataccaagaagagagggct

SEQ ID NO: 123368 - DNA, 25 bp, Homo sapien
gaggagctgctactgctgctaccga

SEQ ID NO: 123369 - DNA, 25 bp, Homo sapien
agctgctactgctgctaccgaggct

SEQ ID NO: 123370 - DNA, 25 bp, Homo sapien
taccgaggctgtgggcctcatcctt

SEQ ID NO: 123371 - DNA, 25 bp, Homo sapien
gaggctgtgggcctcatccttcact

SEQ ID NO: 123372 - DNA, 25 bp, Homo sapien
tgaattacgtgcctccataacctga

SEQ ID NO: 123373 - DNA, 25 bp, Homo sapien
tccataacctgaactgtgccgactc

SEQ ID NO: 123374 - DNA, 25 bp, Homo sapien
gtgccgactccacaaaacgattatg

SEQ ID NO: 123375 - DNA, 25 bp, Homo sapien
gatgctgttcttctgagagatacgt

SEQ ID NO: 123376 - DNA, 25 bp, Homo sapien
agagatacgttactctctccttgga

SEQ ID NO: 123377 - DNA, 25 bp, Homo sapien
gatacgttactctctccttggaatc

SEQ ID NO: 123378 - DNA, 25 bp, Homo sapien
ctgccttctcacgtgggaatcagtg

SEQ ID NO: 123379 - DNA, 25 bp, Homo sapien
ctgctgcaagacaaacaagactcca

SEQ ID NO: 123380 - DNA, 25 bp, Homo sapien
gaagagccatctcaacagaatcgca

SEQ ID NO: 123381 - DNA, 25 bp, Homo sapien
acagaatcgcaccaaactatacttt

SEQ ID NO: 123382 - DNA, 25 bp, Homo sapien
gcaccaaactatactttcaggatga

SEQ ID NO: 123383 - DNA, 25 bp, Homo sapien
tgggcctgctgtgactgacctacag

SEQ ID NO: 123384 - DNA, 25 bp, Homo sapien
gctgtgactgacctacagtggactt

SEQ ID NO: 123385 - DNA, 25 bp, Homo sapien
cagtggactttctctctggaatgga

SEQ ID NO: 123386 - DNA, 25 bp, Homo sapien
gaatggaaccttcttaggcctcctg

SEQ ID NO: 123387 - DNA, 25 bp, Homo sapien
ggcctcctggtgcaacttaattttt

SEQ ID NO: 123388 - DNA, 25 bp, Homo sapien
aatgctatcttcaaaacgttagaga

SEQ ID NO: 123389 - DNA, 25 bp, Homo sapien
aagttcttcaaaagtgcagcccaga

SEQ ID NO: 123390 - DNA, 25 bp, Homo sapien
aatgcctcccattcggatggatctc

SEQ ID NO: 123391 - DNA, 25 bp, Homo sapien
ggatggatctctgcgtttttatact

SEQ ID NO: 123392 - DNA, 25 bp, Homo sapien
tatactgagtgtgcctaggttgccc

SEQ ID NO: 123393 - DNA, 25 bp, Homo sapien
tttccctgttgcgttgctatagatg

SEQ ID NO: 123394 - DNA, 25 bp, Homo sapien
gagcccctgtaccacgccgtgatag

SEQ ID NO: 123395 - DNA, 25 bp, Homo sapien
ccacgccgtgatagcaagggtaggt

SEQ ID NO: 123396 - DNA, 25 bp, Homo sapien
cggtgtcggagcatcggcagaccct

SEQ ID NO: 123397 - DNA, 25 bp, Homo sapien
agcatcggcagaccctgagtcctgt

SEQ ID NO: 123398 - DNA, 25 bp, Homo sapien
gcagttttccatgagcaacatcctg

SEQ ID NO: 123399 - DNA, 25 bp, Homo sapien
gcaacatcctgtggaagccgtggct

SEQ ID NO: 123400 - DNA, 25 bp, Homo sapien
tggctgcagccgtgctgcggacatt

SEQ ID NO: 123401 - DNA, 25 bp, Homo sapien
ctgcggacatttcccgttctgttca

SEQ ID NO: 123402 - DNA, 25 bp, Homo sapien
cgttctgttcatgccacgaggatgg

SEQ ID NO: 123403 - DNA, 25 bp, Homo sapien
ggatccaggagagcctgactgcgtt

SEQ ID NO: 123404 - DNA, 25 bp, Homo sapien
gagagcctgactgcgttgcaaacaa

SEQ ID NO: 123405 - DNA, 25 bp, Homo sapien
gtgagagtcccatcttcaagcaatt

SEQ ID NO: 123406 - DNA, 25 bp, Homo sapien
ctggaaatgagggtgggcgtcttcc

SEQ ID NO: 123407 - DNA, 25 bp, Homo sapien
tgcttctctggctgcctggtcagtg

SEQ ID NO: 123408 - DNA, 25 bp, Homo sapien
tgcctggtcagtgcagaggtgcccc

SEQ ID NO: 123409 - DNA, 25 bp, Homo sapien
ctgctttgtgctggacaacgggctc

SEQ ID NO: 123410 - DNA, 25 bp, Homo sapien
gacaacgggctctgtggcaagatct

SEQ ID NO: 123411 - DNA, 25 bp, Homo sapien
aacgggctctgtggcaagatctata

SEQ ID NO: 123412 - DNA, 25 bp, Homo sapien
ggctctgtggcaagatctatatctg

SEQ ID NO: 123413 - DNA, 25 bp, Homo sapien
gtggcaagatctatatctggaaggg

SEQ ID NO: 123414 - DNA, 25 bp, Homo sapien
ctgcaggtggccgagggcttcatct

SEQ ID NO: 123415 - DNA, 25 bp, Homo sapien
tggccgagggcttcatctcgcgcat

SEQ ID NO: 123416 - DNA, 25 bp, Homo sapien
gaaaaagtagtccaccacgatccac

SEQ ID NO: 123417 - DNA, 25 bp, Homo sapien
accacgatccacctttgctctttga

SEQ ID NO: 123418 - DNA, 25 bp, Homo sapien
tttgacctctcaagagacccttctg

SEQ ID NO: 123419 - DNA, 25 bp, Homo sapien
aagagacccttctgagacccacatc

SEQ ID NO: 123420 - DNA, 25 bp, Homo sapien
tcagagcccgtgttctatcaggtga

SEQ ID NO: 123421 - DNA, 25 bp, Homo sapien
gagcccgtgttctatcaggtgatgg

SEQ ID NO: 123422 - DNA, 25 bp, Homo sapien
tgtgggaacaccagcggacactcag

SEQ ID NO: 123423 - DNA, 25 bp, Homo sapien
cagttcctctgcagctggacaggct

SEQ ID NO: 123424 - DNA, 25 bp, Homo sapien
aggctgggcaacatctggagaccgt

SEQ ID NO: 123425 - DNA, 25 bp, Homo sapien
aacatctggagaccgtggctgcagc

SEQ ID NO: 123426 - DNA, 25 bp, Homo sapien
tctgctggtgccttagggaagatga

SEQ ID NO: 123427 - DNA, 25 bp, Homo sapien
gatacttttgtggaactctatggga

SEQ ID NO: 123428 - DNA, 25 bp, Homo sapien
ggaactctatgggaacaatgcagca

SEQ ID NO: 123429 - DNA, 25 bp, Homo sapien
tatgggaacaatgcagcagccgaga

SEQ ID NO: 123430 - DNA, 25 bp, Homo sapien
agccgaaagggccaggaacgcttca

SEQ ID NO: 123431 - DNA, 25 bp, Homo sapien
ggaacgcttcaaccgctggttcctg

SEQ ID NO: 123432 - DNA, 25 bp, Homo sapien
aaccgctggttcctgacgggcatga

SEQ ID NO: 123433 - DNA, 25 bp, Homo sapien
cgctggttcctgacgggcatgactg

SEQ ID NO: 123434 - DNA, 25 bp, Homo sapien
actgtggccggcgtggttctgctgg

SEQ ID NO: 123435 - DNA, 25 bp, Homo sapien
tgggctcactcttcagtcggaaatg

SEQ ID NO: 123436 - DNA, 25 bp, Homo sapien
tcactcttcagtcggaaatgaccag

SEQ ID NO: 123437 - DNA, 25 bp, Homo sapien
aaatgaccagacactgaccatccac

SEQ ID NO: 123438 - DNA, 25 bp, Homo sapien
cttgcaccgttaggattctgtctgg

SEQ ID NO: 123439 - DNA, 25 bp, Homo sapien
accgttaggattctgtctggcatgc

SEQ ID NO: 123440 - DNA, 25 bp, Homo sapien
gtctggcatgcctgcagccgaggaa

SEQ ID NO: 123441 - DNA, 25 bp, Homo sapien
accagccggccctgtgaattggagg

SEQ ID NO: 123442 - DNA, 25 bp, Homo sapien
gggtggcacagggaccgagcgggcc

SEQ ID NO: 123443 - DNA, 25 bp, Homo sapien
ttcttctttgaattaggactggagg

SEQ ID NO: 123444 - DNA, 25 bp, Homo sapien
ggtgggaaccggtagggcctagatg

SEQ ID NO: 123445 - DNA, 25 bp, Homo sapien
aatgggcaagttcagggtcagattc

SEQ ID NO: 123446 - DNA, 25 bp, Homo sapien
caagttcagggtcagattctgtcgt

SEQ ID NO: 123447 - DNA, 25 bp, Homo sapien
cagggtcagattctgtcgttattta

SEQ ID NO: 123448 - DNA, 25 bp, Homo sapien
gtcgttatttaatattttgttcatc

SEQ ID NO: 123449 - DNA, 25 bp, Homo sapien
ggagtcactgccaagtcatagccat

SEQ ID NO: 123450 - DNA, 25 bp, Homo sapien
gtcactgccaagtcatagccataaa

SEQ ID NO: 123451 - DNA, 25 bp, Homo sapien
agccataaatgatgagtcggtcctc

SEQ ID NO: 123452 - DNA, 25 bp, Homo sapien
atgagtcggtcctctttccagtgga

SEQ ID NO: 123453 - DNA, 25 bp, Homo sapien
gtggatcataagacaatggaccctt

SEQ ID NO: 123454 - DNA, 25 bp, Homo sapien
caatggaccctttttgttatgatgg

SEQ ID NO: 123455 - DNA, 25 bp, Homo sapien
aactttcaattgtcactttttatgc

SEQ ID NO: 123456 - DNA, 25 bp, Homo sapien
tcactttttatgctatttctgtata

SEQ ID NO: 123457 - DNA, 25 bp, Homo sapien
ctgtatataaaggtgcacgaaggta

SEQ ID NO: 123458 - DNA, 25 bp, Homo sapien
gaaacttcgacaagagaatggaaat

SEQ ID NO: 123459 - DNA, 25 bp, Homo sapien
attacaggatatcacattggagtca

SEQ ID NO: 123460 - DNA, 25 bp, Homo sapien
aaaattggtggatgtatgtgtcgga

SEQ ID NO: 123461 - DNA, 25 bp, Homo sapien
gtcggagattttgattgtatgtgta

SEQ ID NO: 123462 - DNA, 25 bp, Homo sapien
tgtgtaaaatagtgatcccagtaac

SEQ ID NO: 123463 - DNA, 25 bp, Homo sapien
gtgatcccagtaactgtaaagcttt

SEQ ID NO: 123464 - DNA, 25 bp, Homo sapien
aaagctttagaatacagttactgac

SEQ ID NO: 123465 - DNA, 25 bp, Homo sapien
cagttactgactgtatagttgtaca

SEQ ID NO: 123466 - DNA, 25 bp, Homo sapien
tagttgtacaggtgttgttactttt

SEQ ID NO: 123467 - DNA, 25 bp, Homo sapien
atcctacttctgtgtataaatgtta

SEQ ID NO: 123468 - DNA, 25 bp, Homo sapien
gtgtataaatgttaccattcctcat

SEQ ID NO: 123469 - DNA, 25 bp, Homo sapien
cattcctcatataacataactgtgt

SEQ ID NO: 123470 - DNA, 25 bp, Homo sapien
gaaatacagtcaacttcatgttcat

SEQ ID NO: 123471 - DNA, 25 bp, Homo sapien
gaccctgacaggttgccctgggctc

SEQ ID NO: 123472 - DNA, 25 bp, Homo sapien
accctgacaggttgccctgggctcc

SEQ ID NO: 123473 - DNA, 25 bp, Homo sapien
tgacaggttgccctgggctccgggt

SEQ ID NO: 123474 - DNA, 25 bp, Homo sapien
gacaggttgccctgggctccgggtg

SEQ ID NO: 123475 - DNA, 25 bp, Homo sapien
acaggttgccctgggctccgggtgg

SEQ ID NO: 123476 - DNA, 25 bp, Homo sapien
ccttcctctcattggctctttttct

SEQ ID NO: 123477 - DNA, 25 bp, Homo sapien
gatggagcgtcctcgaagctccagc

SEQ ID NO: 123478 - DNA, 25 bp, Homo sapien
atggagcgtcctcgaagctccagcc

SEQ ID NO: 123479 - DNA, 25 bp, Homo sapien
tggagcgtcctcgaagctccagccc

SEQ ID NO: 123480 - DNA, 25 bp, Homo sapien
gagcgtcctcgaagctccagccctg

SEQ ID NO: 123481 - DNA, 25 bp, Homo sapien
gcgtcctcgaagctccagccctggg

SEQ ID NO: 123482 - DNA, 25 bp, Homo sapien
cagatggcgacaatgcaggacagta

SEQ ID NO: 123483 - DNA, 25 bp, Homo sapien
gcaggacagtagacctcaccctttc

SEQ ID NO: 123484 - DNA, 25 bp, Homo sapien
ccctttccagactttagagcttgtg

SEQ ID NO: 123485 - DNA, 25 bp, Homo sapien
agagcttgtggcttgaatgttaaag

SEQ ID NO: 123486 - DNA, 25 bp, Homo sapien
taaaggtgtgaccaccgacaccact

SEQ ID NO: 123487 - DNA, 25 bp, Homo sapien
caccactcatgtcaatggctgaaag

SEQ ID NO: 123488 - DNA, 25 bp, Homo sapien
tggctgaaagttgtccatttccatg

SEQ ID NO: 123489 - DNA, 25 bp, Homo sapien
ccatttccatgactcaaagacccat

SEQ ID NO: 123490 - DNA, 25 bp, Homo sapien
aagacccattggaggctattttctg

SEQ ID NO: 123491 - DNA, 25 bp, Homo sapien
ggaggctattttctgggatcagcac

SEQ ID NO: 123492 - DNA, 25 bp, Homo sapien
gttagccttgtaattcgaatatctg

SEQ ID NO: 123493 - DNA, 25 bp, Homo sapien
tgtctcccagctatctataacctta

SEQ ID NO: 123494 - DNA, 25 bp, Homo sapien
tataaccttagcttgtgtgtcgcct

SEQ ID NO: 123495 - DNA, 25 bp, Homo sapien
tgtgtcgccttgtgggttcctgttg

SEQ ID NO: 123496 - DNA, 25 bp, Homo sapien
gttgctgagacttttcctggatgga

SEQ ID NO: 123497 - DNA, 25 bp, Homo sapien
cccctaaagtgctctagtatgcgga

SEQ ID NO: 123498 - DNA, 25 bp, Homo sapien
cctaaagtgctctagtatgcggatg

SEQ ID NO: 123499 - DNA, 25 bp, Homo sapien
gaattgtcatttctctttactggat

SEQ ID NO: 123500 - DNA, 25 bp, Homo sapien
gtttattattaaagatctcgcctgt

SEQ ID NO: 123501 - DNA, 25 bp, Homo sapien
tattattaaagatctcgcctgttcc

SEQ ID NO: 123502 - DNA, 25 bp, Homo sapien
attattaaagatctcgcctgttcct

SEQ ID NO: 123503 - DNA, 25 bp, Homo sapien
ttattaaagatctcgcctgttcctg

SEQ ID NO: 123504 - DNA, 25 bp, Homo sapien
gaaatcctgcaatgaaaggtactat

SEQ ID NO: 123505 - DNA, 25 bp, Homo sapien
ggtactatatttgctagactctaga

SEQ ID NO: 123506 - DNA, 25 bp, Homo sapien
gtactatatttgctagactctagac

SEQ ID NO: 123507 - DNA, 25 bp, Homo sapien
gctagactctagacaagatattgta

SEQ ID NO: 123508 - DNA, 25 bp, Homo sapien
tagatacaaatgtctatcaacttta

SEQ ID NO: 123509 - DNA, 25 bp, Homo sapien
gtctatcaactttaatcaagttgta

SEQ ID NO: 123510 - DNA, 25 bp, Homo sapien
gctgaagttactttatgtttgtctt

SEQ ID NO: 123511 - DNA, 25 bp, Homo sapien
gtttgtcttttaatgcttcattcaa

SEQ ID NO: 123512 - DNA, 25 bp, Homo sapien
gcttggtttatatttttcagttgtt

SEQ ID NO: 123513 - DNA, 25 bp, Homo sapien
ttggtttatatttttcagttgtttg

SEQ ID NO: 123514 - DNA, 25 bp, Homo sapien
gtttttgcttgttatattaagcaga

SEQ ID NO: 123515 - DNA, 25 bp, Homo sapien
agaagtcgtttcattcaagttggtg

SEQ ID NO: 123516 - DNA, 25 bp, Homo sapien
gaagtcgtttcattcaagttggtgt

SEQ ID NO: 123517 - DNA, 25 bp, Homo sapien
tcaagttggtgtaatcagctgggga

SEQ ID NO: 123518 - DNA, 25 bp, Homo sapien
gtggatgtctgcaaaaaccagaagc

SEQ ID NO: 123519 - DNA, 25 bp, Homo sapien
tgtctgcaaaaaccagaagcggcaa

SEQ ID NO: 123520 - DNA, 25 bp, Homo sapien
aaccagaagcggcaaaagcaggtac

SEQ ID NO: 123521 - DNA, 25 bp, Homo sapien
agactttcacatcaacctctttcaa

SEQ ID NO: 123522 - DNA, 25 bp, Homo sapien
gactttcacatcaacctctttcaag

SEQ ID NO: 123523 - DNA, 25 bp, Homo sapien
ctttcacatcaacctctttcaagtg

SEQ ID NO: 123524 - DNA, 25 bp, Homo sapien
gaaactccaagatgaggatttgggt

SEQ ID NO: 123525 - DNA, 25 bp, Homo sapien
caagatgaggatttgggttttctat

SEQ ID NO: 123526 - DNA, 25 bp, Homo sapien
tctgatgtgaacttccttcccctta

SEQ ID NO: 123527 - DNA, 25 bp, Homo sapien
atgtgaacttccttccccttacttg

SEQ ID NO: 123528 - DNA, 25 bp, Homo sapien
gagtaagttgacgatgttttaagat

SEQ ID NO: 123529 - DNA, 25 bp, Homo sapien
gttttaagattgcacctggcagtgt

SEQ ID NO: 123530 - DNA, 25 bp, Homo sapien
tttgcacttggagctgcttttaatt

SEQ ID NO: 123531 - DNA, 25 bp, Homo sapien
acttggagctgcttttaattttagc

SEQ ID NO: 123532 - DNA, 25 bp, Homo sapien
aaatgttttatgcaaggcacaatag

SEQ ID NO: 123533 - DNA, 25 bp, Homo sapien
ggcacaataggaagtcagttctcct

SEQ ID NO: 123534 - DNA, 25 bp, Homo sapien
tgcacttcctcctcatgtagtctgg

SEQ ID NO: 123535 - DNA, 25 bp, Homo sapien
acttcctcctcatgtagtctggagt

SEQ ID NO: 123536 - DNA, 25 bp, Homo sapien
ctcctcatgtagtctggagtacttt

SEQ ID NO: 123537 - DNA, 25 bp, Homo sapien
agtgcaagggcctgccccgtagcct

SEQ ID NO: 123538 - DNA, 25 bp, Homo sapien
taggctgccccgtaggctccatggc

SEQ ID NO: 123539 - DNA, 25 bp, Homo sapien
ctgtctccacaggaatgggaagcgg

SEQ ID NO: 123540 - DNA, 25 bp, Homo sapien
ctcacatgctgggacaacgcagtgt

SEQ ID NO: 123541 - DNA, 25 bp, Homo sapien
gctgggacaacgcagtgttcaatcc

SEQ ID NO: 123542 - DNA, 25 bp, Homo sapien
acaacgcagtgttcaatccattctc

SEQ ID NO: 123543 - DNA, 25 bp, Homo sapien
agcagctccagacatctttccagaa

SEQ ID NO: 123544 - DNA, 25 bp, Homo sapien
gacatctttccagaacacaaacctg

SEQ ID NO: 123545 - DNA, 25 bp, Homo sapien
acctctctgcttagccactggctta

SEQ ID NO: 123546 - DNA, 25 bp, Homo sapien
ttagccactggcttaaactgccaat

SEQ ID NO: 123547 - DNA, 25 bp, Homo sapien
aactgccaatggtttgcctgcatgt

SEQ ID NO: 123548 - DNA, 25 bp, Homo sapien
cggagaggtaccttgcacagtgacc

SEQ ID NO: 123549 - DNA, 25 bp, Homo sapien
ggagaggtaccttgcacagtgacct

SEQ ID NO: 123550 - DNA, 25 bp, Homo sapien
gagaggtaccttgcacagtgacctc

SEQ ID NO: 123551 - DNA, 25 bp, Homo sapien
gaggtaccttgcacagtgacctctg

SEQ ID NO: 123552 - DNA, 25 bp, Homo sapien
aggtaccttgcacagtgacctctgc

SEQ ID NO: 123553 - DNA, 25 bp, Homo sapien
gtaccttgcacagtgacctctgcat

SEQ ID NO: 123554 - DNA, 25 bp, Homo sapien
agtgacctctgcatctcctttagaa

SEQ ID NO: 123555 - DNA, 25 bp, Homo sapien
tgacctctgcatctcctttagaaga

SEQ ID NO: 123556 - DNA, 25 bp, Homo sapien
gacctctgcatctcctttagaagaa

SEQ ID NO: 123557 - DNA, 25 bp, Homo sapien
acctctgcatctcctttagaagaag

SEQ ID NO: 123558 - DNA, 25 bp, Homo sapien
cctctgcatctcctttagaagaagc

SEQ ID NO: 123559 - DNA, 25 bp, Homo sapien
tccatgtcgaagaaccgagtccccg

SEQ ID NO: 123560 - DNA, 25 bp, Homo sapien
cccgactcctgctgcattaatgtta

SEQ ID NO: 123561 - DNA, 25 bp, Homo sapien
gctgcattaatgttactgtgggctg

SEQ ID NO: 123562 - DNA, 25 bp, Homo sapien
tgtgggctgtgggattaatttcaac

SEQ ID NO: 123563 - DNA, 25 bp, Homo sapien
aatttcaacgagaaggcgatccata

SEQ ID NO: 123564 - DNA, 25 bp, Homo sapien
tggtagctgcagcagcccttggaat

SEQ ID NO: 123565 - DNA, 25 bp, Homo sapien
gcccttggaattgcttttgtcgagg

SEQ ID NO: 123566 - DNA, 25 bp, Homo sapien
tcgaggttttgggaattgtctttgc

SEQ ID NO: 123567 - DNA, 25 bp, Homo sapien
ggaattgtctttgcctgctgcctcg

SEQ ID NO: 123568 - DNA, 25 bp, Homo sapien
gcctgctgcctcgtgaagagtatca

SEQ ID NO: 123569 - DNA, 25 bp, Homo sapien
tcagaagtggctacgaggtgatgta

SEQ ID NO: 123570 - DNA, 25 bp, Homo sapien
gatatagaatggcagattctctgat

SEQ ID NO: 123571 - DNA, 25 bp, Homo sapien
gaagaatagagtaccaatgtcatta

SEQ ID NO: 123572 - DNA, 25 bp, Homo sapien
atcagaattcctattctgtaccttt

SEQ ID NO: 123573 - DNA, 25 bp, Homo sapien
tattctgtacctttcctctaacttc

SEQ ID NO: 123574 - DNA, 25 bp, Homo sapien
ctaacttctcagatttgtaattctt

SEQ ID NO: 123575 - DNA, 25 bp, Homo sapien
gtaattcttcttttcgggagctgag

SEQ ID NO: 123576 - DNA, 25 bp, Homo sapien
tcttcttttcgggagctgagctagt

SEQ ID NO: 123577 - DNA, 25 bp, Homo sapien
gctgagctagtgcttttaggagaac

SEQ ID NO: 123578 - DNA, 25 bp, Homo sapien
gaacagataaatgtggtctcagcca

SEQ ID NO: 123579 - DNA, 25 bp, Homo sapien
cagccctagagactgcttcttgtgt

SEQ ID NO: 123580 - DNA, 25 bp, Homo sapien
gtttgtgtcattctgtcctgagaaa

SEQ ID NO: 123581 - DNA, 25 bp, Homo sapien
cagatgggcggacggctgtggaccg

SEQ ID NO: 123582 - DNA, 25 bp, Homo sapien
tgtggaccgtggacaggcccagcgc

SEQ ID NO: 123583 - DNA, 25 bp, Homo sapien
agcgcggccagcgtcccagggtacc

SEQ ID NO: 123584 - DNA, 25 bp, Homo sapien
agggtacccgcctgagctcctgctg

SEQ ID NO: 123585 - DNA, 25 bp, Homo sapien
ctcctgctgcggaggagctgcctgc

SEQ ID NO: 123586 - DNA, 25 bp, Homo sapien
ccatccctcgggaagcagccagctc

SEQ ID NO: 123587 - DNA, 25 bp, Homo sapien
ctcctagacccaggtggagggcaca

SEQ ID NO: 123588 - DNA, 25 bp, Homo sapien
gggcaggactgagtcccctccagga

SEQ ID NO: 123589 - DNA, 25 bp, Homo sapien
gactgagtcccctccaggaagaagc

SEQ ID NO: 123590 - DNA, 25 bp, Homo sapien
tgagtcccctccaggaagaagcagg

SEQ ID NO: 123591 - DNA, 25 bp, Homo sapien
gaatctattttttctctccttttct

SEQ ID NO: 123592 - DNA, 25 bp, Homo sapien
cgaggtcatcctgctagactcagac

SEQ ID NO: 123593 - DNA, 25 bp, Homo sapien
gctagactcagacctggatgaaccc

SEQ ID NO: 123594 - DNA, 25 bp, Homo sapien
ggatgaacccatagacttgcgctcg

SEQ ID NO: 123595 - DNA, 25 bp, Homo sapien
atagacttgcgctcggtcaagagcc

SEQ ID NO: 123596 - DNA, 25 bp, Homo sapien
aggtgaagcccgagacaccggcgtc

SEQ ID NO: 123597 - DNA, 25 bp, Homo sapien
gaggcccaggacgaacctgcagagt

SEQ ID NO: 123598 - DNA, 25 bp, Homo sapien
gaacctgcagagtcgctgagcgagt

SEQ ID NO: 123599 - DNA, 25 bp, Homo sapien
tgagcgagttcaagcccttctttgg

SEQ ID NO: 123600 - DNA, 25 bp, Homo sapien
tcaagcccttctttgggaatataat

SEQ ID NO: 123601 - DNA, 25 bp, Homo sapien
atataattatcaccgacgtcaccgc

SEQ ID NO: 123602 - DNA, 25 bp, Homo sapien
tgcctcaccgttactttcaaggagt

SEQ ID NO: 123603 - DNA, 25 bp, Homo sapien
cagctgcaggattctggcattttgc

SEQ ID NO: 123604 - DNA, 25 bp, Homo sapien
attttgcatgccattctccatcaga

SEQ ID NO: 123605 - DNA, 25 bp, Homo sapien
tgccattctccatcagatctgggat

SEQ ID NO: 123606 - DNA, 25 bp, Homo sapien
gatctgggatgatggctcagaacat

SEQ ID NO: 123607 - DNA, 25 bp, Homo sapien
ggctcagaacatgtacacagactaa

SEQ ID NO: 123608 - DNA, 25 bp, Homo sapien
gactaagagtaactgtgtgatctgt

SEQ ID NO: 123609 - DNA, 25 bp, Homo sapien
ataacataatatgcagcttaggatg

SEQ ID NO: 123610 - DNA, 25 bp, Homo sapien
gcagcttaggatgctattttgagat

SEQ ID NO: 123611 - DNA, 25 bp, Homo sapien
gatattcagttcattcacctgatta

SEQ ID NO: 123612 - DNA, 25 bp, Homo sapien
attgtccttaatgcagtgatttata

SEQ ID NO: 123613 - DNA, 25 bp, Homo sapien
actcttcttgttaactagtcatttg

SEQ ID NO: 123614 - DNA, 25 bp, Homo sapien
aaggtaatccggagtgagcaatgga

SEQ ID NO: 123615 - DNA, 25 bp, Homo sapien
tgagcaatggagtggctgccatgga

SEQ ID NO: 123616 - DNA, 25 bp, Homo sapien
catttcccttctggacactgagagg

SEQ ID NO: 123617 - DNA, 25 bp, Homo sapien
tggacactgagagggcaatctttgc

SEQ ID NO: 123618 - DNA, 25 bp, Homo sapien
gagagggcaatctttgcctttatct

SEQ ID NO: 123619 - DNA, 25 bp, Homo sapien
tttgcctttatctctgaggctatgg

SEQ ID NO: 123620 - DNA, 25 bp, Homo sapien
tctgaggctatggagggtcctcctc

SEQ ID NO: 123621 - DNA, 25 bp, Homo sapien
tggagggtcctcctccatctttcta

SEQ ID NO: 123622 - DNA, 25 bp, Homo sapien
ctcctccatctttctacagagatta

SEQ ID NO: 123623 - DNA, 25 bp, Homo sapien
acagagattactttgctgccttaat

SEQ ID NO: 123624 - DNA, 25 bp, Homo sapien
gattactttgctgccttaatgacat

SEQ ID NO: 123625 - DNA, 25 bp, Homo sapien
gcaattagtgacctacaacagctgt

SEQ ID NO: 123626 - DNA, 25 bp, Homo sapien
aaaagatattcacaccctggcacag

SEQ ID NO: 123627 - DNA, 25 bp, Homo sapien
acaccctggcacagcttatttctgc

SEQ ID NO: 123628 - DNA, 25 bp, Homo sapien
ttctgcttactcacttgtagatcca

SEQ ID NO: 123629 - DNA, 25 bp, Homo sapien
tgtagatccagagaaagccaaagct

SEQ ID NO: 123630 - DNA, 25 bp, Homo sapien
agctcttagtaaacacttgccatcg

SEQ ID NO: 123631 - DNA, 25 bp, Homo sapien
gtaaacacttgccatcgtcagatag

SEQ ID NO: 123632 - DNA, 25 bp, Homo sapien
acttgccatcgtcagatagtatgtc

SEQ ID NO: 123633 - DNA, 25 bp, Homo sapien
aaaagtagatgttgaggctcttgaa

SEQ ID NO: 123634 - DNA, 25 bp, Homo sapien
aaattctgctggtgctacatacatt

SEQ ID NO: 123635 - DNA, 25 bp, Homo sapien
gctggtgctacatacattcggaaga

SEQ ID NO: 123636 - DNA, 25 bp, Homo sapien
gcatccagcagcatgagcggaggca

SEQ ID NO: 123637 - DNA, 25 bp, Homo sapien
ccagcagcatgagcggaggcatttt

SEQ ID NO: 123638 - DNA, 25 bp, Homo sapien
gcagcatgagcggaggcattttcct

SEQ ID NO: 123639 - DNA, 25 bp, Homo sapien
tttccttttcttcgtggccaatgcc

SEQ ID NO: 123640 - DNA, 25 bp, Homo sapien
ttcttcgtggccaatgccataatcc

SEQ ID NO: 123641 - DNA, 25 bp, Homo sapien
aatgccataatccacctcttctgct

SEQ ID NO: 123642 - DNA, 25 bp, Homo sapien
tctgcttcagttgaggtgacacgtc

SEQ ID NO: 123643 - DNA, 25 bp, Homo sapien
agttgaggtgacacgtctcagcctt

SEQ ID NO: 123644 - DNA, 25 bp, Homo sapien
gaggtgacacgtctcagccttagcc

SEQ ID NO: 123645 - DNA, 25 bp, Homo sapien
cagacatcaccaggttgtagaagtt

SEQ ID NO: 123646 - DNA, 25 bp, Homo sapien
gtagaagttgacaggcagtgccatg

SEQ ID NO: 123647 - DNA, 25 bp, Homo sapien
ctccaggtgttatacttgccaagtc

SEQ ID NO: 123648 - DNA, 25 bp, Homo sapien
gccaagtcagcaattctgtgagcag

SEQ ID NO: 123649 - DNA, 25 bp, Homo sapien
aagaatggcacggtctgcctcagtc

SEQ ID NO: 123650 - DNA, 25 bp, Homo sapien
tggcccggtcctttggagtagaatg

SEQ ID NO: 123651 - DNA, 25 bp, Homo sapien
ttgcaagttggctagtggtcacggt

SEQ ID NO: 123652 - DNA, 25 bp, Homo sapien
ttggcctgttacttacctgagatga

SEQ ID NO: 123653 - DNA, 25 bp, Homo sapien
gagctcttttaactcaagcgaaact

SEQ ID NO: 123654 - DNA, 25 bp, Homo sapien
atcttgcctgttggtgatcatgctc

SEQ ID NO: 123655 - DNA, 25 bp, Homo sapien
gatcatgctcctcagcaggacagag

SEQ ID NO: 123656 - DNA, 25 bp, Homo sapien
taggctgaccagaagcatgctgctg

SEQ ID NO: 123657 - DNA, 25 bp, Homo sapien
aagcatgctgctgaattatcaacga

SEQ ID NO: 123658 - DNA, 25 bp, Homo sapien
tcaggacctggcttggctttaaccg

SEQ ID NO: 123659 - DNA, 25 bp, Homo sapien
aaatctggattttcagcgaacatgc

SEQ ID NO: 123660 - DNA, 25 bp, Homo sapien
gattttcagcgaacatgcctgattt

SEQ ID NO: 123661 - DNA, 25 bp, Homo sapien
tacaaaatactatgtgggacacctc

SEQ ID NO: 123662 - DNA, 25 bp, Homo sapien
gtgggacacctcaaatacataccta

SEQ ID NO: 123663 - DNA, 25 bp, Homo sapien
aaatacatacctactgactgatgac

SEQ ID NO: 123664 - DNA, 25 bp, Homo sapien
actgactgatgacaaacccaggagt

SEQ ID NO: 123665 - DNA, 25 bp, Homo sapien
aaaaagtttgccctggatgtcatat

SEQ ID NO: 123666 - DNA, 25 bp, Homo sapien
gccctggatgtcatattggcagttg

SEQ ID NO: 123667 - DNA, 25 bp, Homo sapien
ggcagttggaggacacagtttctat

SEQ ID NO: 123668 - DNA, 25 bp, Homo sapien
ggatttacgactgaagaaggacatt

SEQ ID NO: 123669 - DNA, 25 bp, Homo sapien
tgcagaggtgattctggcggcccct

SEQ ID NO: 123670 - DNA, 25 bp, Homo sapien
gcggccccttgatagttcacaagag

SEQ ID NO: 123671 - DNA, 25 bp, Homo sapien
gatagttcacaagagaagtcgtttc

SEQ ID NO: 123672 - DNA, 25 bp, Homo sapien
agttcacaagagaagtcgtttcatt

SEQ ID NO: 123673 - DNA, 25 bp, Homo sapien
aaagcaggtacctgctcacgcccga

SEQ ID NO: 123674 - DNA, 25 bp, Homo sapien
acctctttcaagtgctgccctggct

SEQ ID NO: 123675 - DNA, 25 bp, Homo sapien
tctttcaagtgctgccctggctgaa

SEQ ID NO: 123676 - DNA, 25 bp, Homo sapien
ctttcaagtgctgccctggctgaag

SEQ ID NO: 123677 - DNA, 25 bp, Homo sapien
caagtgctgccctggctgaaggaga

SEQ ID NO: 123678 - DNA, 25 bp, Homo sapien
aagtgctgccctggctgaaggagaa

SEQ ID NO: 123679 - DNA, 25 bp, Homo sapien
gctgccctggctgaaggagaaactc

SEQ ID NO: 123680 - DNA, 25 bp, Homo sapien
ttggtgggaaagtgaatatgtttac

SEQ ID NO: 123681 - DNA, 25 bp, Homo sapien
ctggccgaagctctgcccaaacaat

SEQ ID NO: 123682 - DNA, 25 bp, Homo sapien
tggccgaagctctgcccaaacaatc

SEQ ID NO: 123683 - DNA, 25 bp, Homo sapien
cgaagctctgcccaaacaatctgtg

SEQ ID NO: 123684 - DNA, 25 bp, Homo sapien
atgatgaagttccaggaggcttcca

SEQ ID NO: 123685 - DNA, 25 bp, Homo sapien
tgatgaagttccaggaggcttccaa

SEQ ID NO: 123686 - DNA, 25 bp, Homo sapien
gatgaagttccaggaggcttccaag

SEQ ID NO: 123687 - DNA, 25 bp, Homo sapien
atgaagttccaggaggcttccaaga

SEQ ID NO: 123688 - DNA, 25 bp, Homo sapien
tgaagttccaggaggcttccaagaa

SEQ ID NO: 123689 - DNA, 25 bp, Homo sapien
gaagttccaggaggcttccaagaat

SEQ ID NO: 123690 - DNA, 25 bp, Homo sapien
agttccaggaggcttccaagaatga

SEQ ID NO: 123691 - DNA, 25 bp, Homo sapien
cttggctgacatgaagctgttgtgt

SEQ ID NO: 123692 - DNA, 25 bp, Homo sapien
gctgttgtgtgaggttcgcttatca

SEQ ID NO: 123693 - DNA, 25 bp, Homo sapien
ttgtgtgaggttcgcttatcaacta

SEQ ID NO: 123694 - DNA, 25 bp, Homo sapien
gtgaggttcgcttatcaactaatga

SEQ ID NO: 123695 - DNA, 25 bp, Homo sapien
ggttcgcttatcaactaatgattta

SEQ ID NO: 123696 - DNA, 25 bp, Homo sapien
atttagtgatcaaattgtgcagtac

SEQ ID NO: 123697 - DNA, 25 bp, Homo sapien
gtgcagtactttgtgcattctggat

SEQ ID NO: 123698 - DNA, 25 bp, Homo sapien
cagtactttgtgcattctggatttt

SEQ ID NO: 123699 - DNA, 25 bp, Homo sapien
aagttttttattatgcattatatca

SEQ ID NO: 123700 - DNA, 25 bp, Homo sapien
atatcaaatctaccactgtatgagt

SEQ ID NO: 123701 - DNA, 25 bp, Homo sapien
aatctaccactgtatgagtggaaat

SEQ ID NO: 123702 - DNA, 25 bp, Homo sapien
gttcgacctggaggtgccagatgat

SEQ ID NO: 123703 - DNA, 25 bp, Homo sapien
gtgccagatgatgggcagctgccct

SEQ ID NO: 123704 - DNA, 25 bp, Homo sapien
caaggtggtctttctgatcgactct

SEQ ID NO: 123705 - DNA, 25 bp, Homo sapien
ggtctttctgatcgactctttcaaa

SEQ ID NO: 123706 - DNA, 25 bp, Homo sapien
gtgaagatcaaggtgcgccaggcct

SEQ ID NO: 123707 - DNA, 25 bp, Homo sapien
aagcccaggctgagggtagcaccta

SEQ ID NO: 123708 - DNA, 25 bp, Homo sapien
gctgagggtagcacctaaaggctgt

SEQ ID NO: 123709 - DNA, 25 bp, Homo sapien
agcacctaaaggctgtaactcacag

SEQ ID NO: 123710 - DNA, 25 bp, Homo sapien
ggccccacaacacagatttagagat

SEQ ID NO: 123711 - DNA, 25 bp, Homo sapien
cttctttttcagcttgtggcaatgc

SEQ ID NO: 123712 - DNA, 25 bp, Homo sapien
ctttttcagcttgtggcaatgccag

SEQ ID NO: 123713 - DNA, 25 bp, Homo sapien
gctacattacaacacacatcatgaa

SEQ ID NO: 123714 - DNA, 25 bp, Homo sapien
aaatgatgtccgtgaggttgttgaa

SEQ ID NO: 123715 - DNA, 25 bp, Homo sapien
gattggaaattcatagcccaggttc

SEQ ID NO: 123716 - DNA, 25 bp, Homo sapien
atagcccaggttcttgatcggatgt

SEQ ID NO: 123717 - DNA, 25 bp, Homo sapien
gatcggatgtttctgtggacttttc

SEQ ID NO: 123718 - DNA, 25 bp, Homo sapien
ttcttttcgtttcaattgttggatc

SEQ ID NO: 123719 - DNA, 25 bp, Homo sapien
aattgttggatctcttgggcttttt

SEQ ID NO: 123720 - DNA, 25 bp, Homo sapien
tcttgggctttttgttcctgttatt

SEQ ID NO: 123721 - DNA, 25 bp, Homo sapien
atgcaaataagtgaagcctcccaag

SEQ ID NO: 123722 - DNA, 25 bp, Homo sapien
gcctcccaagggactgaagtataca

SEQ ID NO: 123723 - DNA, 25 bp, Homo sapien
cacacatatatctgatggcacctat

SEQ ID NO: 123724 - DNA, 25 bp, Homo sapien
agattagtattctgccggcgaacag

SEQ ID NO: 123725 - DNA, 25 bp, Homo sapien
acagaacttcgtgttgggaactgcc

SEQ ID NO: 123726 - DNA, 25 bp, Homo sapien
ttgggaactgcctcattggtggtgt

SEQ ID NO: 123727 - DNA, 25 bp, Homo sapien
gtgagtttcacatactgctgcacgc

SEQ ID NO: 123728 - DNA, 25 bp, Homo sapien
tgctgcacgcgtgtcgattaacgtt

SEQ ID NO: 123729 - DNA, 25 bp, Homo sapien
gattaacgttctgctgtccaagaga

SEQ ID NO: 123730 - DNA, 25 bp, Homo sapien
tgtcatgctgggaacgccatcatcg

SEQ ID NO: 123731 - DNA, 25 bp, Homo sapien
gccatcatcggtggtgttagcttca

SEQ ID NO: 123732 - DNA, 25 bp, Homo sapien
gtgttagcttcacatgcttctgcag

SEQ ID NO: 123733 - DNA, 25 bp, Homo sapien
acatgcttctgcagctgagcttgca

SEQ ID NO: 123734 - DNA, 25 bp, Homo sapien
ggaaatggttgtttctcctatactt

SEQ ID NO: 123735 - DNA, 25 bp, Homo sapien
gcattgtcctggttcccaataagaa

SEQ ID NO: 123736 - DNA, 25 bp, Homo sapien
caataagaaagtgggcctgcagttc

SEQ ID NO: 123737 - DNA, 25 bp, Homo sapien
agacagtgctgagctgagtctccgc

SEQ ID NO: 123738 - DNA, 25 bp, Homo sapien
gggcttgtcctagaggctccagctc

SEQ ID NO: 123739 - DNA, 25 bp, Homo sapien
agctctggcacagtggttcctggct

SEQ ID NO: 123740 - DNA, 25 bp, Homo sapien
tggctgctgccatgtctcagatgag

SEQ ID NO: 123741 - DNA, 25 bp, Homo sapien
aggtgggaggaactccttgcacaca

SEQ ID NO: 123742 - DNA, 25 bp, Homo sapien
gagcttttgccacttctatcatttt

SEQ ID NO: 123743 - DNA, 25 bp, Homo sapien
tatcatttttgagcaactccctctc

SEQ ID NO: 123744 - DNA, 25 bp, Homo sapien
aaaaggccacccctttatcgcattg

SEQ ID NO: 123745 - DNA, 25 bp, Homo sapien
atcgcattgctgtccttgggtagaa

SEQ ID NO: 123746 - DNA, 25 bp, Homo sapien
gtccgctgcgggtactaagagccag

SEQ ID NO: 123747 - DNA, 25 bp, Homo sapien
gctgcgggtactaagagccaggcaa

SEQ ID NO: 123748 - DNA, 25 bp, Homo sapien
gcgggtactaagagccaggcaacag

SEQ ID NO: 123749 - DNA, 25 bp, Homo sapien
ctaagagccaggcaacagaccgttg

SEQ ID NO: 123750 - DNA, 25 bp, Homo sapien
aagagccaggcaacagaccgttggg

SEQ ID NO: 123751 - DNA, 25 bp, Homo sapien
ggagaacagaaggtccctggtgaaa

SEQ ID NO: 123752 - DNA, 25 bp, Homo sapien
aacagaaggtccctggtgaaatcca

SEQ ID NO: 123753 - DNA, 25 bp, Homo sapien
atccaggtgtcaagaatcctaggga

SEQ ID NO: 123754 - DNA, 25 bp, Homo sapien
atcctagggatctgtgccaggccat

SEQ ID NO: 123755 - DNA, 25 bp, Homo sapien
agggatctgtgccaggccattcgca

SEQ ID NO: 123756 - DNA, 25 bp, Homo sapien
tgtgccaggccattcgcaccagcca

SEQ ID NO: 123757 - DNA, 25 bp, Homo sapien
gtggctaaccaagagataactgtaa

SEQ ID NO: 123758 - DNA, 25 bp, Homo sapien
gtgacattgatttgctcttactaca

SEQ ID NO: 123759 - DNA, 25 bp, Homo sapien
gctcttactacagctacagtgattg

SEQ ID NO: 123760 - DNA, 25 bp, Homo sapien
gaaaagtcccaacccaatgggctca

SEQ ID NO: 123761 - DNA, 25 bp, Homo sapien
aacccaatgggctcaaacttctaag

SEQ ID NO: 123762 - DNA, 25 bp, Homo sapien
aagccaagggcaacagatcagtaaa

SEQ ID NO: 123763 - DNA, 25 bp, Homo sapien
aacagatcagtaaagaacgtggtca

SEQ ID NO: 123764 - DNA, 25 bp, Homo sapien
gaacgtggtcagagtagaacccctg

SEQ ID NO: 123765 - DNA, 25 bp, Homo sapien
gtcagagtagaacccctgaagtatt

SEQ ID NO: 123766 - DNA, 25 bp, Homo sapien
acagttacctgagagatttaacatt

SEQ ID NO: 123767 - DNA, 25 bp, Homo sapien
taacattatctagttcattgaatca

SEQ ID NO: 123768 - DNA, 25 bp, Homo sapien
accctgcagagatatgaggcttgac

SEQ ID NO: 123769 - DNA, 25 bp, Homo sapien
tatgaggcttgacagagtctgcccc

SEQ ID NO: 123770 - DNA, 25 bp, Homo sapien
gagagagccccagccagcggaacag

SEQ ID NO: 123771 - DNA, 25 bp, Homo sapien
gccagcggaacagtttctattaccc

SEQ ID NO: 123772 - DNA, 25 bp, Homo sapien
ccagacccatgtgatttctgctttc

SEQ ID NO: 123773 - DNA, 25 bp, Homo sapien
tctgctttcttctttagcaagatat

SEQ ID NO: 123774 - DNA, 25 bp, Homo sapien
gcaagatattctggtttctagataa

SEQ ID NO: 123775 - DNA, 25 bp, Homo sapien
gtctcttcagactcatggattggtc

SEQ ID NO: 123776 - DNA, 25 bp, Homo sapien
gggtctgaacgtctcctagccaatc

SEQ ID NO: 123777 - DNA, 25 bp, Homo sapien
gaacgtctcctagccaatcagaact

SEQ ID NO: 123778 - DNA, 25 bp, Homo sapien
aatcagaactggctgtggaccaccc

SEQ ID NO: 123779 - DNA, 25 bp, Homo sapien
agggcctgtctctgactaggtgtca

SEQ ID NO: 123780 - DNA, 25 bp, Homo sapien
gtcaccatacacattcttagattga

SEQ ID NO: 123781 - DNA, 25 bp, Homo sapien
gattgaatctgaaccatgtggcaga

SEQ ID NO: 123782 - DNA, 25 bp, Homo sapien
agcagcttacttagtaggctctgtc

SEQ ID NO: 123783 - DNA, 25 bp, Homo sapien
tttgtcttgcccctaggaaggtgaa

SEQ ID NO: 123784 - DNA, 25 bp, Homo sapien
ggtgaatctgccctagcctggttta

SEQ ID NO: 123785 - DNA, 25 bp, Homo sapien
tgccctagcctggtttacggtttct

SEQ ID NO: 123786 - DNA, 25 bp, Homo sapien
tacggtttcttataactctcctttg

SEQ ID NO: 123787 - DNA, 25 bp, Homo sapien
gctctctggccactattaagtgggt

SEQ ID NO: 123788 - DNA, 25 bp, Homo sapien
tgggtttgccccatcacttagttct

SEQ ID NO: 123789 - DNA, 25 bp, Homo sapien
tagttctcaggcagagacatctttg

SEQ ID NO: 123790 - DNA, 25 bp, Homo sapien
tacccagctcttggggtgtctctgt

SEQ ID NO: 123791 - DNA, 25 bp, Homo sapien
ttctcgtggccctgtgtgagcacat

SEQ ID NO: 123792 - DNA, 25 bp, Homo sapien
atgtgtacatctcagccttatctca

SEQ ID NO: 123793 - DNA, 25 bp, Homo sapien
tgtgtacatctcagccttatctcaa

SEQ ID NO: 123794 - DNA, 25 bp, Homo sapien
cagccttatctcaaggaggtgacac

SEQ ID NO: 123795 - DNA, 25 bp, Homo sapien
agccttatctcaaggaggtgacacc

SEQ ID NO: 123796 - DNA, 25 bp, Homo sapien
aaggaggtgacaccttctctccttg

SEQ ID NO: 123797 - DNA, 25 bp, Homo sapien
aggaggtgacaccttctctccttgt

SEQ ID NO: 123798 - DNA, 25 bp, Homo sapien
gaggtgacaccttctctccttgtcc

SEQ ID NO: 123799 - DNA, 25 bp, Homo sapien
gggaaggctactccgcatctcagcc

SEQ ID NO: 123800 - DNA, 25 bp, Homo sapien
gtccctttgatgtcctcctttcctt

SEQ ID NO: 123801 - DNA, 25 bp, Homo sapien
tgacgatttctgcagtgacttgatg

SEQ ID NO: 123802 - DNA, 25 bp, Homo sapien
ttctgcagtgacttgatgctctaaa

SEQ ID NO: 123803 - DNA, 25 bp, Homo sapien
atgctctaaaacagtgtaggattta

SEQ ID NO: 123804 - DNA, 25 bp, Homo sapien
gaatagatggtttttaatcctggaa

SEQ ID NO: 123805 - DNA, 25 bp, Homo sapien
ggaaattgtgattgtgacccatgag

SEQ ID NO: 123806 - DNA, 25 bp, Homo sapien
gacccatgagtggaggaactttcag

SEQ ID NO: 123807 - DNA, 25 bp, Homo sapien
ggaactttcagttctaaagctgata

SEQ ID NO: 123808 - DNA, 25 bp, Homo sapien
ttgtaaccactgtcttgatggcaaa

SEQ ID NO: 123809 - DNA, 25 bp, Homo sapien
agtctcgtgtttattattccttaag

SEQ ID NO: 123810 - DNA, 25 bp, Homo sapien
actctgtgttatattaccatggaac

SEQ ID NO: 123811 - DNA, 25 bp, Homo sapien
attaccatggaacgcctaataaagc

SEQ ID NO: 123812 - DNA, 25 bp, Homo sapien
atttgagagccctaccttttcctga

SEQ ID NO: 123813 - DNA, 25 bp, Homo sapien
agagccctaccttttcctgactgtt

SEQ ID NO: 123814 - DNA, 25 bp, Homo sapien
ttcctgactgttcctctttttaaga

SEQ ID NO: 123815 - DNA, 25 bp, Homo sapien
tgactgttcctctttttaagaacaa

SEQ ID NO: 123816 - DNA, 25 bp, Homo sapien
gattttccacttttaaagttcatgg

SEQ ID NO: 123817 - DNA, 25 bp, Homo sapien
tccacttttaaagttcatgggtgag

SEQ ID NO: 123818 - DNA, 25 bp, Homo sapien
gtgagggataaaatgaggctccaat

SEQ ID NO: 123819 - DNA, 25 bp, Homo sapien
gaggctccaatacatgggaagcttt

SEQ ID NO: 123820 - DNA, 25 bp, Homo sapien
ccaatacatgggaagctttgctgaa

SEQ ID NO: 123821 - DNA, 25 bp, Homo sapien
ggaatttgtctaacacatttcaagg

SEQ ID NO: 123822 - DNA, 25 bp, Homo sapien
agaaaatacttcactgccgggcatg

SEQ ID NO: 123823 - DNA, 25 bp, Homo sapien
ttcttaagacttttgggacatggtt

SEQ ID NO: 123824 - DNA, 25 bp, Homo sapien
ggacatggtttgactcccgaacatc

SEQ ID NO: 123825 - DNA, 25 bp, Homo sapien
tgactcccgaacatcaccgacgtgt

SEQ ID NO: 123826 - DNA, 25 bp, Homo sapien
accgacgtgtctcctgtttttctgg

SEQ ID NO: 123827 - DNA, 25 bp, Homo sapien
tgtttttctgggtggcctcgggaca

SEQ ID NO: 123828 - DNA, 25 bp, Homo sapien
ccccacgagggtcaggactgtgact

SEQ ID NO: 123829 - DNA, 25 bp, Homo sapien
aggactgtgactctttttagggcca

SEQ ID NO: 123830 - DNA, 25 bp, Homo sapien
actgtgactctttttagggccaggc

SEQ ID NO: 123831 - DNA, 25 bp, Homo sapien
ggagcagacaggaggaatcatgtca

SEQ ID NO: 123832 - DNA, 25 bp, Homo sapien
tgaaaggaagctccactgtcaccct

SEQ ID NO: 123833 - DNA, 25 bp, Homo sapien
tgtcccctccactgtcacattgtaa

SEQ ID NO: 123834 - DNA, 25 bp, Homo sapien
tccatgattccaagggccaagaggg

SEQ ID NO: 123835 - DNA, 25 bp, Homo sapien
ttttcccctgcctgtgagtgacatc

SEQ ID NO: 123836 - DNA, 25 bp, Homo sapien
ctgcctgtgagtgacatcggttcag

SEQ ID NO: 123837 - DNA, 25 bp, Homo sapien
acatcggttcaggaggagacagtca

SEQ ID NO: 123838 - DNA, 25 bp, Homo sapien
gagacagtcaggaagcctcctgctg

SEQ ID NO: 123839 - DNA, 25 bp, Homo sapien
agtcaggaagcctcctgctgagtgg

SEQ ID NO: 123840 - DNA, 25 bp, Homo sapien
ctcctgctgagtggtccacattctg

SEQ ID NO: 123841 - DNA, 25 bp, Homo sapien
ttgggctctgcgtcccactgagtct

SEQ ID NO: 123842 - DNA, 25 bp, Homo sapien
tctcctgggccagggtctcgtcagg

SEQ ID NO: 123843 - DNA, 25 bp, Homo sapien
tctcgtcaggaggtgcctgagagca

SEQ ID NO: 123844 - DNA, 25 bp, Homo sapien
gaggtgcctgagagcagaatgaata

SEQ ID NO: 123845 - DNA, 25 bp, Homo sapien
gacactgccgcggtcgcagatgtgt

SEQ ID NO: 123846 - DNA, 25 bp, Homo sapien
cgcagatgtgtacgacatttccaac

SEQ ID NO: 123847 - DNA, 25 bp, Homo sapien
ggtcgatcagaggttgagcttgttc

SEQ ID NO: 123848 - DNA, 25 bp, Homo sapien
gagcttgttcagatagtcatcgatg

SEQ ID NO: 123849 - DNA, 25 bp, Homo sapien
gtcatcgatggagtcaattacctgg

SEQ ID NO: 123850 - DNA, 25 bp, Homo sapien
gatggagtcaattacctggtggatt

SEQ ID NO: 123851 - DNA, 25 bp, Homo sapien
aattacctggtggattgtgaaaaga

SEQ ID NO: 123852 - DNA, 25 bp, Homo sapien
ggccaagatattaaggtgccacccc

SEQ ID NO: 123853 - DNA, 25 bp, Homo sapien
cctctgcctcagtttggcaaaaagt

SEQ ID NO: 123854 - DNA, 25 bp, Homo sapien
gctggtacaacagacataaatctct

SEQ ID NO: 123855 - DNA, 25 bp, Homo sapien
tgagagtttttatacacttggaaaa

SEQ ID NO: 123856 - DNA, 25 bp, Homo sapien
gtagtgattatgcttcttggattaa

SEQ ID NO: 123857 - DNA, 25 bp, Homo sapien
cttcttggattaatggagcagtcat

SEQ ID NO: 123858 - DNA, 25 bp, Homo sapien
gggaattcaacgacctgagaaaggt

SEQ ID NO: 123859 - DNA, 25 bp, Homo sapien
tcaccaaggagcagtgggacaccat

SEQ ID NO: 123860 - DNA, 25 bp, Homo sapien
gggacaccatagaagaactcatcag

SEQ ID NO: 123861 - DNA, 25 bp, Homo sapien
ttcctaagaccactttggccttcat

SEQ ID NO: 123862 - DNA, 25 bp, Homo sapien
ggccttcatcttggttacagaaaag

SEQ ID NO: 123863 - DNA, 25 bp, Homo sapien
gattggcagaattccctgtggtcgc

SEQ ID NO: 123864 - DNA, 25 bp, Homo sapien
gggactgtagaagaactcgcaaatc

SEQ ID NO: 123865 - DNA, 25 bp, Homo sapien
gaactcgcaaatcttgctgctttcc

SEQ ID NO: 123866 - DNA, 25 bp, Homo sapien
tgctgctttcctttgtagtgattat

SEQ ID NO: 123867 - DNA, 25 bp, Homo sapien
atgccctggctaaagctactgtgaa

SEQ ID NO: 123868 - DNA, 25 bp, Homo sapien
actgcacggcaccaagtacacatat

SEQ ID NO: 123869 - DNA, 25 bp, Homo sapien
atatggcccgggagctacaacaatc

SEQ ID NO: 123870 - DNA, 25 bp, Homo sapien
tacaacaatctatcctgctgctggg

SEQ ID NO: 123871 - DNA, 25 bp, Homo sapien
tattccttcacctttgaacttcgag

SEQ ID NO: 123872 - DNA, 25 bp, Homo sapien
acaggcagatatggctttctccttc

SEQ ID NO: 123873 - DNA, 25 bp, Homo sapien
cagatccgggctacctgcgaggaga

SEQ ID NO: 123874 - DNA, 25 bp, Homo sapien
ggagaccttcctggcaatcaagtat

SEQ ID NO: 123875 - DNA, 25 bp, Homo sapien
atcaagtatgttgccagctacgtcc

SEQ ID NO: 123876 - DNA, 25 bp, Homo sapien
tacgtcctggaacacctgtactagt

SEQ ID NO: 123877 - DNA, 25 bp, Homo sapien
gagaaagctgatggccttgtttcaa

SEQ ID NO: 123878 - DNA, 25 bp, Homo sapien
ggattcaagcaaggcccatatattg

SEQ ID NO: 123879 - DNA, 25 bp, Homo sapien
aatgtctgtaagtctctttccatct

SEQ ID NO: 123880 - DNA, 25 bp, Homo sapien
gaacgttgctggttgaaatcccgag

SEQ ID NO: 123881 - DNA, 25 bp, Homo sapien
ttgaaatcccgaggtgtcatttgac

SEQ ID NO: 123882 - DNA, 25 bp, Homo sapien
gtcatttgacatggttctctgaact

SEQ ID NO: 123883 - DNA, 25 bp, Homo sapien
ggttctctgaacttatctttcctat

SEQ ID NO: 123884 - DNA, 25 bp, Homo sapien
tctggaggtctgattttgtggcaaa

SEQ ID NO: 123885 - DNA, 25 bp, Homo sapien
aaatacttcctaggtggtgctgggt

SEQ ID NO: 123886 - DNA, 25 bp, Homo sapien
tacttcttgttgcatcctgtcagga

SEQ ID NO: 123887 - DNA, 25 bp, Homo sapien
ggtgcctctctattggtaatgttaa

SEQ ID NO: 123888 - DNA, 25 bp, Homo sapien
aatgttaagactgctgggtgggttt

SEQ ID NO: 123889 - DNA, 25 bp, Homo sapien
atccgggtccatgggatggaggcgc

SEQ ID NO: 123890 - DNA, 25 bp, Homo sapien
cgctggggagcttctagggcttcct

SEQ ID NO: 123891 - DNA, 25 bp, Homo sapien
ttgggcctgcctcttaaaggcctga

SEQ ID NO: 123892 - DNA, 25 bp, Homo sapien
gcctgcctcttaaaggcctgagcta

SEQ ID NO: 123893 - DNA, 25 bp, Homo sapien
cctcttaaaggcctgagctagctgg

SEQ ID NO: 123894 - DNA, 25 bp, Homo sapien
aaaggcctgagctagctggagaaga

SEQ ID NO: 123895 - DNA, 25 bp, Homo sapien
gggagggtccataagcccatgacta

SEQ ID NO: 123896 - DNA, 25 bp, Homo sapien
gagggtccataagcccatgactaaa

SEQ ID NO: 123897 - DNA, 25 bp, Homo sapien
ggtccataagcccatgactaaaaac

SEQ ID NO: 123898 - DNA, 25 bp, Homo sapien
cataagcccatgactaaaaactacc

SEQ ID NO: 123899 - DNA, 25 bp, Homo sapien
tcccaatctccataggctgggcctc

SEQ ID NO: 123900 - DNA, 25 bp, Homo sapien
tttttggtgctataacattctgaca

SEQ ID NO: 123901 - DNA, 25 bp, Homo sapien
aacattctgacacatatcattctgt

SEQ ID NO: 123902 - DNA, 25 bp, Homo sapien
tctgacacatatcattctgtgatta

SEQ ID NO: 123903 - DNA, 25 bp, Homo sapien
gatatctatattctaaagagctact

SEQ ID NO: 123904 - DNA, 25 bp, Homo sapien
agagctacttctaattattccaata

SEQ ID NO: 123905 - DNA, 25 bp, Homo sapien
gtctttgttggagtgaagcatttaa

SEQ ID NO: 123906 - DNA, 25 bp, Homo sapien
gataaagtcctgaacctttcaaaat

SEQ ID NO: 123907 - DNA, 25 bp, Homo sapien
aaacttagaaatatgcttctgccta

SEQ ID NO: 123908 - DNA, 25 bp, Homo sapien
gaaatatgcttctgcctattgctga

SEQ ID NO: 123909 - DNA, 25 bp, Homo sapien
atatgcttctgcctattgctgatac

SEQ ID NO: 123910 - DNA, 25 bp, Homo sapien
tctgcctattgctgataccgtcttt

SEQ ID NO: 123911 - DNA, 25 bp, Homo sapien
tggatctgcatttgctacacccttc

SEQ ID NO: 123912 - DNA, 25 bp, Homo sapien
agcttccagcggctatgttgggcca

SEQ ID NO: 123913 - DNA, 25 bp, Homo sapien
cttccttgtagtaagacaccaactg

SEQ ID NO: 123914 - DNA, 25 bp, Homo sapien
agacaccaactgcttaaaacataag

SEQ ID NO: 123915 - DNA, 25 bp, Homo sapien
ttccagcggctatgttgggccagag

SEQ ID NO: 123916 - DNA, 25 bp, Homo sapien
tccagcggctatgttgggccagagc

SEQ ID NO: 123917 - DNA, 25 bp, Homo sapien
cataaggatgtttcagttcctccat

SEQ ID NO: 123918 - DNA, 25 bp, Homo sapien
agagcattttaagaggtgcagcctc

SEQ ID NO: 123919 - DNA, 25 bp, Homo sapien
ggtgcagcctctggaagtggatcaa

SEQ ID NO: 123920 - DNA, 25 bp, Homo sapien
caaactagaactcatatgccatact

SEQ ID NO: 123921 - DNA, 25 bp, Homo sapien
tggtccgtaggagccactatgagga

SEQ ID NO: 123922 - DNA, 25 bp, Homo sapien
aaggtcttctctgcctacagcaacg

SEQ ID NO: 123923 - DNA, 25 bp, Homo sapien
tgcctacagcaacgtgactgcggac

SEQ ID NO: 123924 - DNA, 25 bp, Homo sapien
aacgtgactgcggacctcatggact

SEQ ID NO: 123925 - DNA, 25 bp, Homo sapien
acctcatggacttcttccaaactta

SEQ ID NO: 123926 - DNA, 25 bp, Homo sapien
acttatggagccattcaaggacccc

SEQ ID NO: 123927 - DNA, 25 bp, Homo sapien
agagatgggcactccaggacccaaa

SEQ ID NO: 123928 - DNA, 25 bp, Homo sapien
acctggccctcgaggacacaaggga

SEQ ID NO: 123929 - DNA, 25 bp, Homo sapien
gaccaagtctatgctgggcggagaa

SEQ ID NO: 123930 - DNA, 25 bp, Homo sapien
gaagtattgctgtcaagccgtgagc

SEQ ID NO: 123931 - DNA, 25 bp, Homo sapien
agccgtgagctagccatggcaggac

SEQ ID NO: 123932 - DNA, 25 bp, Homo sapien
tggcaggacagctcctggaccaggt

SEQ ID NO: 123933 - DNA, 25 bp, Homo sapien
tactgaagttgtgtgaaatcctaat

SEQ ID NO: 123934 - DNA, 25 bp, Homo sapien
gtgaaatcctaattctgtcatctcc

SEQ ID NO: 123935 - DNA, 25 bp, Homo sapien
agttgtgcctcctgcacattgatga

SEQ ID NO: 123936 - DNA, 25 bp, Homo sapien
gcctcctgcacattgatgagtgcct

SEQ ID NO: 123937 - DNA, 25 bp, Homo sapien
atgagtgcctgctgttgtctttgcc

SEQ ID NO: 123938 - DNA, 25 bp, Homo sapien
ttgatgtagctgtgaccctattgtt

SEQ ID NO: 123939 - DNA, 25 bp, Homo sapien
atgtagctgtgaccctattgttcct

SEQ ID NO: 123940 - DNA, 25 bp, Homo sapien
tagctgtgaccctattgttcctcac

SEQ ID NO: 123941 - DNA, 25 bp, Homo sapien
acagccagcccatcaggaagccttc

SEQ ID NO: 123942 - DNA, 25 bp, Homo sapien
caaccttctgactgtcttttcagtc

SEQ ID NO: 123943 - DNA, 25 bp, Homo sapien
tctgactgtcttttcagtcatgccc

SEQ ID NO: 123944 - DNA, 25 bp, Homo sapien
tgtcgcctgacagcatacctcaaaa

SEQ ID NO: 123945 - DNA, 25 bp, Homo sapien
gcatacctcaaaaggccctagctaa

SEQ ID NO: 123946 - DNA, 25 bp, Homo sapien
aggccctagctaataaacctgtaag

SEQ ID NO: 123947 - DNA, 25 bp, Homo sapien
tagctaataaacctgtaagcccagc

SEQ ID NO: 123948 - DNA, 25 bp, Homo sapien
taagcccagcatttgagagaaggta

SEQ ID NO: 123949 - DNA, 25 bp, Homo sapien
ggttgtgtacaactccacgaggtga

SEQ ID NO: 123950 - DNA, 25 bp, Homo sapien
attcagtaacttgtttgcatagcat

SEQ ID NO: 123951 - DNA, 25 bp, Homo sapien
gtttgcatagcatttgtgtaaagac

SEQ ID NO: 123952 - DNA, 25 bp, Homo sapien
gtaaagactatgatctcatcccaat

SEQ ID NO: 123953 - DNA, 25 bp, Homo sapien
aatcttcagattaatgactggctac

SEQ ID NO: 123954 - DNA, 25 bp, Homo sapien
taatgactggctacagagtaacaaa

SEQ ID NO: 123955 - DNA, 25 bp, Homo sapien
tggtggacggagtgaagctgctcat

SEQ ID NO: 123956 - DNA, 25 bp, Homo sapien
catcgagatggaacagcggctggag

SEQ ID NO: 123957 - DNA, 25 bp, Homo sapien
atgcctgcccagaaatgaagcccgg

SEQ ID NO: 123958 - DNA, 25 bp, Homo sapien
ctgctgcttcctaacttattgcctg

SEQ ID NO: 123959 - DNA, 25 bp, Homo sapien
gcttcctaacttattgcctgcagtg

SEQ ID NO: 123960 - DNA, 25 bp, Homo sapien
taacttattgcctgcagtgcccacc

SEQ ID NO: 123961 - DNA, 25 bp, Homo sapien
atgcacccctcgatgttgccgtctg

SEQ ID NO: 123962 - DNA, 25 bp, Homo sapien
atgttgccgtctggcgagcccttag

SEQ ID NO: 123963 - DNA, 25 bp, Homo sapien
gagcccttagccttgctgtaaggaa

SEQ ID NO: 123964 - DNA, 25 bp, Homo sapien
taaggaaggcttccgtcacccttgg

SEQ ID NO: 123965 - DNA, 25 bp, Homo sapien
ttccgtcacccttggtagagtttat

SEQ ID NO: 123966 - DNA, 25 bp, Homo sapien
cttccttgtagtaagacaccaactg

SEQ ID NO: 123967 - DNA, 25 bp, Homo sapien
ttccttgtagtaagacaccaactgc

SEQ ID NO: 123968 - DNA, 25 bp, Homo sapien
ccttgtagtaagacaccaactgctt

SEQ ID NO: 123969 - DNA, 25 bp, Homo sapien
agacaccaactgcttaaaacataag

SEQ ID NO: 123970 - DNA, 25 bp, Homo sapien
gacaccaactgcttaaaacataagg

SEQ ID NO: 123971 - DNA, 25 bp, Homo sapien
accaactgcttaaaacataaggatg

SEQ ID NO: 123972 - DNA, 25 bp, Homo sapien
agagcattttaagaggtgcagcctc

SEQ ID NO: 123973 - DNA, 25 bp, Homo sapien
gcattttaagaggtgcagcctctgg

SEQ ID NO: 123974 - DNA, 25 bp, Homo sapien
ggtgcagcctctggaagtggatcaa

SEQ ID NO: 123975 - DNA, 25 bp, Homo sapien
tcaaactagaactcatatgccatac

SEQ ID NO: 123976 - DNA, 25 bp, Homo sapien
caaactagaactcatatgccatact

SEQ ID NO: 123977 - DNA, 25 bp, Homo sapien
tggctctgaggaatggcccaacagt

SEQ ID NO: 123978 - DNA, 25 bp, Homo sapien
caacagtggccccttcagggtggca

SEQ ID NO: 123979 - DNA, 25 bp, Homo sapien
gtggcagccacccttcagtgaggcc

SEQ ID NO: 123980 - DNA, 25 bp, Homo sapien
gcatggacacgtgatgtgctgctct

SEQ ID NO: 123981 - DNA, 25 bp, Homo sapien
acacgtgatgtgctgctctgtacct

SEQ ID NO: 123982 - DNA, 25 bp, Homo sapien
gaggaattcggcctggaccagactc

SEQ ID NO: 123983 - DNA, 25 bp, Homo sapien
tggaccagactcaggctcttgccat

SEQ ID NO: 123984 - DNA, 25 bp, Homo sapien
aggctcttgccatcagcgaccactt

SEQ ID NO: 123985 - DNA, 25 bp, Homo sapien
gaccactttccagtggaggtgaccc

SEQ ID NO: 123986 - DNA, 25 bp, Homo sapien
tgaccctcaagttccaccgatgact

SEQ ID NO: 123987 - DNA, 25 bp, Homo sapien
accgatgactcgaggcctgactggg

SEQ ID NO: 123988 - DNA, 25 bp, Homo sapien
tatatttttgagttccgtgattgca

SEQ ID NO: 123989 - DNA, 25 bp, Homo sapien
gttccgtgattgcaaattatgacct

SEQ ID NO: 123990 - DNA, 25 bp, Homo sapien
attatgacctcaaattccatccttc

SEQ ID NO: 123991 - DNA, 25 bp, Homo sapien
ctcaaattccatccttcacttatgt

SEQ ID NO: 123992 - DNA, 25 bp, Homo sapien
catccttcacttatgtaacatgttg

SEQ ID NO: 123993 - DNA, 25 bp, Homo sapien
gtaacatgttgcaaattacccaaag

SEQ ID NO: 123994 - DNA, 25 bp, Homo sapien
tacccaaagatgagtctttcttctt

SEQ ID NO: 123995 - DNA, 25 bp, Homo sapien
ctcttttcctcctcaaaatgtatat

SEQ ID NO: 123996 - DNA, 25 bp, Homo sapien
aagccttaactgttagttatgcctg

SEQ ID NO: 123997 - DNA, 25 bp, Homo sapien
taactgttagttatgcctgcattca

SEQ ID NO: 123998 - DNA, 25 bp, Homo sapien
atgcctgcattcatatttgcacagg

SEQ ID NO: 123999 - DNA, 25 bp, Homo sapien
gtccagcttctacagctgtgcagcg

SEQ ID NO: 124000 - DNA, 25 bp, Homo sapien
aaagctgcccgacaggcctggtgtt

SEQ ID NO: 124001 - DNA, 25 bp, Homo sapien
agcaactcctgcaaatgctgcacct

SEQ ID NO: 124002 - DNA, 25 bp, Homo sapien
tcctgcaaatgctgcacctggaatt

SEQ ID NO: 124003 - DNA, 25 bp, Homo sapien
cctggaattgagtcgtaaagcccct

SEQ ID NO: 124004 - DNA, 25 bp, Homo sapien
aattgagtcgtaaagcccctccagt

SEQ ID NO: 124005 - DNA, 25 bp, Homo sapien
aagcccctccagtccagctttgagg

SEQ ID NO: 124006 - DNA, 25 bp, Homo sapien
gggcccaggatcactctacagcctg

SEQ ID NO: 124007 - DNA, 25 bp, Homo sapien
tgtggtcttcctttatccaggcttt

SEQ ID NO: 124008 - DNA, 25 bp, Homo sapien
gccttccttttttctgggtctcctg

SEQ ID NO: 124009 - DNA, 25 bp, Homo sapien
cttttttctgggtctcctgggctgc

SEQ ID NO: 124010 - DNA, 25 bp, Homo sapien
ttttgtgcctttcatcagaaagtca

SEQ ID NO: 124011 - DNA, 25 bp, Homo sapien
caatcttcagttatccccaaatgca

SEQ ID NO: 124012 - DNA, 25 bp, Homo sapien
aaatgcagcttctatttcacctgaa

SEQ ID NO: 124013 - DNA, 25 bp, Homo sapien
atttcacctgaatccttctcttgct

SEQ ID NO: 124014 - DNA, 25 bp, Homo sapien
ttctcttgctcatttaagtcccatg

SEQ ID NO: 124015 - DNA, 25 bp, Homo sapien
aagtcccatgttactgctgtttgct

SEQ ID NO: 124016 - DNA, 25 bp, Homo sapien
tgctgtttgcttttacttactttca

SEQ ID NO: 124017 - DNA, 25 bp, Homo sapien
agtagcaccataacgaagtagcttt

SEQ ID NO: 124018 - DNA, 25 bp, Homo sapien
caagtgaagtttggacccagcagaa

SEQ ID NO: 124019 - DNA, 25 bp, Homo sapien
agtttctcacagattttcaccatgt

SEQ ID NO: 124020 - DNA, 25 bp, Homo sapien
ttcaccatgtggcttcatcaattta

SEQ ID NO: 124021 - DNA, 25 bp, Homo sapien
aaagctgctgattccattagataca

SEQ ID NO: 124022 - DNA, 25 bp, Homo sapien
gaacattttatcagccaggtagtac

SEQ ID NO: 124023 - DNA, 25 bp, Homo sapien
gactggaaatttgtagctcaagttc

SEQ ID NO: 124024 - DNA, 25 bp, Homo sapien
gctcaagttcttgaccgaatcttcc

SEQ ID NO: 124025 - DNA, 25 bp, Homo sapien
cctgtggctctttctgatagtgtca

SEQ ID NO: 124026 - DNA, 25 bp, Homo sapien
tagtgtcagtaacaggctcggttct

SEQ ID NO: 124027 - DNA, 25 bp, Homo sapien
taacaggctcggttctgatttttac

SEQ ID NO: 124028 - DNA, 25 bp, Homo sapien
tgatttttacccctgctttgaagat

SEQ ID NO: 124029 - DNA, 25 bp, Homo sapien
atgtggctacatagttaccattagg

SEQ ID NO: 124030 - DNA, 25 bp, Homo sapien
attacaccttagacctgacatctgg

SEQ ID NO: 124031 - DNA, 25 bp, Homo sapien
gacctgacatctggctatcacacag

SEQ ID NO: 124032 - DNA, 25 bp, Homo sapien
gaatccaatcacagaggaaacagga

SEQ ID NO: 124033 - DNA, 25 bp, Homo sapien
gagaaaaacatccaagactacagtg

SEQ ID NO: 124034 - DNA, 25 bp, Homo sapien
aactggaaatggtctgttttcgtga

SEQ ID NO: 124035 - DNA, 25 bp, Homo sapien
aatggtctgttttcgtgatattcgt

SEQ ID NO: 124036 - DNA, 25 bp, Homo sapien
gttttcgtgatattcgtatgattaa

SEQ ID NO: 124037 - DNA, 25 bp, Homo sapien
gtgattgttaactagcattctgttt

SEQ ID NO: 124038 - DNA, 25 bp, Homo sapien
gttaactagcattctgttttacatg

SEQ ID NO: 124039 - DNA, 25 bp, Homo sapien
catgttgacatttctaacacacaca

SEQ ID NO: 124040 - DNA, 25 bp, Homo sapien
cacacaccactgatttgaacttcaa

SEQ ID NO: 124041 - DNA, 25 bp, Homo sapien
ttctgattatatatgctaggtctga

SEQ ID NO: 124042 - DNA, 25 bp, Homo sapien
atatgctaggtctgattctgaagat

SEQ ID NO: 124043 - DNA, 25 bp, Homo sapien
cacaatcatattttagtatggtgtc

SEQ ID NO: 124044 - DNA, 25 bp, Homo sapien
attttagtatggtgtctgtttatgt

SEQ ID NO: 124045 - DNA, 25 bp, Homo sapien
tgtctgtttatgtaactctgacttg

SEQ ID NO: 124046 - DNA, 25 bp, Homo sapien
gtaactctgacttgctggaaaagtt

SEQ ID NO: 124047 - DNA, 25 bp, Homo sapien
taactctgacttgctggaaaagttg

SEQ ID NO: 124048 - DNA, 25 bp, Homo sapien
aactccaaataatctgaaactagaa

SEQ ID NO: 124049 - DNA, 25 bp, Homo sapien
atagcacataattactaccttcccc

SEQ ID NO: 124050 - DNA, 25 bp, Homo sapien
tagcacataattactaccttcccct

SEQ ID NO: 124051 - DNA, 25 bp, Homo sapien
agcacataattactaccttcccctt

SEQ ID NO: 124052 - DNA, 25 bp, Homo sapien
cacataattactaccttccccttgg

SEQ ID NO: 124053 - DNA, 25 bp, Homo sapien
cataattactaccttccccttggcg

SEQ ID NO: 124054 - DNA, 25 bp, Homo sapien
ttgcccataacgcagtattctgagt

SEQ ID NO: 124055 - DNA, 25 bp, Homo sapien
gcccataacgcagtattctgagttt

SEQ ID NO: 124056 - DNA, 25 bp, Homo sapien
taacgcagtattctgagtttgcaac

SEQ ID NO: 124057 - DNA, 25 bp, Homo sapien
gttcaacacagtaacccctgcattc

SEQ ID NO: 124058 - DNA, 25 bp, Homo sapien
gcattctgctctgctctaatacact

SEQ ID NO: 124059 - DNA, 25 bp, Homo sapien
tacactacctggagaaagtcttttc

SEQ ID NO: 124060 - DNA, 25 bp, Homo sapien
agaaacctcttgtgttcttgcctag

SEQ ID NO: 124061 - DNA, 25 bp, Homo sapien
tgttcttgcctaggcccaggtgttc

SEQ ID NO: 124062 - DNA, 25 bp, Homo sapien
aggtgttcctggcagccaaatcgag

SEQ ID NO: 124063 - DNA, 25 bp, Homo sapien
gttcctggcagccaaatcgagtctc

SEQ ID NO: 124064 - DNA, 25 bp, Homo sapien
gccaaatcgagtctctcattttctc

SEQ ID NO: 124065 - DNA, 25 bp, Homo sapien
aaggaggtgaccaaatcagtgtgag

SEQ ID NO: 124066 - DNA, 25 bp, Homo sapien
gtgaccaaatcagtgtgaggaggta

SEQ ID NO: 124067 - DNA, 25 bp, Homo sapien
accaaatcagtgtgaggaggtagat

SEQ ID NO: 124068 - DNA, 25 bp, Homo sapien
tcctctgcttctcacgggactattt

SEQ ID NO: 124069 - DNA, 25 bp, Homo sapien
cctctgcttctcacgggactatttc

SEQ ID NO: 124070 - DNA, 25 bp, Homo sapien
gcttctcacgggactatttccacca

SEQ ID NO: 124071 - DNA, 25 bp, Homo sapien
aatttcctccacaaattattaatga

SEQ ID NO: 124072 - DNA, 25 bp, Homo sapien
atttatatcacatgttttctctgga

SEQ ID NO: 124073 - DNA, 25 bp, Homo sapien
ttatatcacatgttttctctggagt

SEQ ID NO: 124074 - DNA, 25 bp, Homo sapien
ttttctctggagtattctataagtt

SEQ ID NO: 124075 - DNA, 25 bp, Homo sapien
ctctggagtattctataagttttat

SEQ ID NO: 124076 - DNA, 25 bp, Homo sapien
gacaagatccatgatggctctctta

SEQ ID NO: 124077 - DNA, 25 bp, Homo sapien
atccatgatggctctcttagtccaa

SEQ ID NO: 124078 - DNA, 25 bp, Homo sapien
atgatggctctcttagtccaacttc

SEQ ID NO: 124079 - DNA, 25 bp, Homo sapien
ggctctcttagtccaacttctttca

SEQ ID NO: 124080 - DNA, 25 bp, Homo sapien
gatggaaaataacggatgggtctca

SEQ ID NO: 124081 - DNA, 25 bp, Homo sapien
aacggatgggtctcagttacaaata

SEQ ID NO: 124082 - DNA, 25 bp, Homo sapien
ggtctcagttacaaataaggacact

SEQ ID NO: 124083 - DNA, 25 bp, Homo sapien
ggtcagatctctggaacatcatgtg

SEQ ID NO: 124084 - DNA, 25 bp, Homo sapien
catcatgtgatgaagctgacatttt

SEQ ID NO: 124085 - DNA, 25 bp, Homo sapien
caaatgatcctttatcttttcagaa

SEQ ID NO: 124086 - DNA, 25 bp, Homo sapien
attttgctctattttctgatcatga

SEQ ID NO: 124087 - DNA, 25 bp, Homo sapien
gatgatgatatctgaaattcaccag

SEQ ID NO: 124088 - DNA, 25 bp, Homo sapien
gaaattcaccagctgagtttctatt

SEQ ID NO: 124089 - DNA, 25 bp, Homo sapien
tcaccagctgagtttctatttcttc

SEQ ID NO: 124090 - DNA, 25 bp, Homo sapien
cagctgagtttctatttcttctata

SEQ ID NO: 124091 - DNA, 25 bp, Homo sapien
agtgaaagaaatgcttatctgtaat

SEQ ID NO: 124092 - DNA, 25 bp, Homo sapien
aattttgtatgcatcttggtggact

SEQ ID NO: 124093 - DNA, 25 bp, Homo sapien
gtatgcatcttggtggacttgtcat

SEQ ID NO: 124094 - DNA, 25 bp, Homo sapien
gcatcttggtggacttgtcattggt

SEQ ID NO: 124095 - DNA, 25 bp, Homo sapien
ggtggacttgtcattggtattctag

SEQ ID NO: 124096 - DNA, 25 bp, Homo sapien
acatgtaaaaactgtctctttgaac

SEQ ID NO: 124097 - DNA, 25 bp, Homo sapien
aactgtctctttgaactattgaaaa

SEQ ID NO: 124098 - DNA, 25 bp, Homo sapien
accattgtggaattgcctcagcagc

SEQ ID NO: 124099 - DNA, 25 bp, Homo sapien
accccactgtgtgagctggtggacg

SEQ ID NO: 124100 - DNA, 25 bp, Homo sapien
ggaggaattcatcttcagtctacca

SEQ ID NO: 124101 - DNA, 25 bp, Homo sapien
ggaattcatcttcagtctaccagcc

SEQ ID NO: 124102 - DNA, 25 bp, Homo sapien
cgctgtgtcggatacacactcgaat

SEQ ID NO: 124103 - DNA, 25 bp, Homo sapien
gtcggatacacactcgaatcattga

SEQ ID NO: 124104 - DNA, 25 bp, Homo sapien
gaatcattgaagatccgagtgtgat

SEQ ID NO: 124105 - DNA, 25 bp, Homo sapien
gtgatattttcacactggtaaatgt

SEQ ID NO: 124106 - DNA, 25 bp, Homo sapien
cactggtaaatgttacctctatttt

SEQ ID NO: 124107 - DNA, 25 bp, Homo sapien
tattgattcacttactgactttgca

SEQ ID NO: 124108 - DNA, 25 bp, Homo sapien
tactgactttgcattttcgttttta

SEQ ID NO: 124109 - DNA, 25 bp, Homo sapien
actaaacggacagactccaagagct

SEQ ID NO: 124110 - DNA, 25 bp, Homo sapien
gcagagaatcagactccttttccag

SEQ ID NO: 124111 - DNA, 25 bp, Homo sapien
cagagaatcagactccttttccagg

SEQ ID NO: 124112 - DNA, 25 bp, Homo sapien
tgtactccctgacgattccactgta

SEQ ID NO: 124113 - DNA, 25 bp, Homo sapien
ctgacgattccactgtaactaccaa

SEQ ID NO: 124114 - DNA, 25 bp, Homo sapien
tgacgattccactgtaactaccaat

SEQ ID NO: 124115 - DNA, 25 bp, Homo sapien
gtaactaccaatcttctacttggtt

SEQ ID NO: 124116 - DNA, 25 bp, Homo sapien
ccaatcttctacttggttaagacag

SEQ ID NO: 124117 - DNA, 25 bp, Homo sapien
cttctacttggttaagacagttttg

SEQ ID NO: 124118 - DNA, 25 bp, Homo sapien
gacagttttgtatcattttgctaaa

SEQ ID NO: 124119 - DNA, 25 bp, Homo sapien
aattattggcttaaatctgtgtaaa

SEQ ID NO: 124120 - DNA, 25 bp, Homo sapien
tggcttcccatgtctttctccaaag

SEQ ID NO: 124121 - DNA, 25 bp, Homo sapien
gccatccagagggttgtgattttgt

SEQ ID NO: 124122 - DNA, 25 bp, Homo sapien
gggttgtgattttgtctgcttagta

SEQ ID NO: 124123 - DNA, 25 bp, Homo sapien
taaaaagttaatcttcatggccata

SEQ ID NO: 124124 - DNA, 25 bp, Homo sapien
catggccatagcttttattcattag

SEQ ID NO: 124125 - DNA, 25 bp, Homo sapien
gattttcatgttcttgcagtcatca

SEQ ID NO: 124126 - DNA, 25 bp, Homo sapien
gttcttgcagtcatcagaagtggta

SEQ ID NO: 124127 - DNA, 25 bp, Homo sapien
aagcctcactgatatattttccagg

SEQ ID NO: 124128 - DNA, 25 bp, Homo sapien
attttccagggcaatcaatgttcac

SEQ ID NO: 124129 - DNA, 25 bp, Homo sapien
gggcaatcaatgttcacgcaacttg

SEQ ID NO: 124130 - DNA, 25 bp, Homo sapien
atatctgtggtcttcaaattgtctt

SEQ ID NO: 124131 - DNA, 25 bp, Homo sapien
gaggaagactcagttgggaaatttt

SEQ ID NO: 124132 - DNA, 25 bp, Homo sapien
gtgctttggtgcaaggtacagccca

SEQ ID NO: 124133 - DNA, 25 bp, Homo sapien
ttggtgcaaggtacagcccacacct

SEQ ID NO: 124134 - DNA, 25 bp, Homo sapien
cctctctgagagatactatgattaa

SEQ ID NO: 124135 - DNA, 25 bp, Homo sapien
atctgggatttttcacaactgataa

SEQ ID NO: 124136 - DNA, 25 bp, Homo sapien
taacttgtcagtgtctgtattttct

SEQ ID NO: 124137 - DNA, 25 bp, Homo sapien
gattttttcacatacgctcatttta

SEQ ID NO: 124138 - DNA, 25 bp, Homo sapien
gaataagtagccctcactttcatgc

SEQ ID NO: 124139 - DNA, 25 bp, Homo sapien
tcactttcatgccatttccattgtt

SEQ ID NO: 124140 - DNA, 25 bp, Homo sapien
catgccatttccattgttgagtgaa

SEQ ID NO: 124141 - DNA, 25 bp, Homo sapien
tccattgttgagtgaagcgtatttg

SEQ ID NO: 124142 - DNA, 25 bp, Homo sapien
aaatgtgggaagacgctgacctctg

SEQ ID NO: 124143 - DNA, 25 bp, Homo sapien
acgctgagcacgaaggcaaacccta

SEQ ID NO: 124144 - DNA, 25 bp, Homo sapien
agcacgaaggcaaaccctactgcaa

SEQ ID NO: 124145 - DNA, 25 bp, Homo sapien
ctgctacgcagccatgtttgggcct

SEQ ID NO: 124146 - DNA, 25 bp, Homo sapien
ccatgtttgggcctaaaggctttgg

SEQ ID NO: 124147 - DNA, 25 bp, Homo sapien
cccaagtgcaacaaggaggtgtact

SEQ ID NO: 124148 - DNA, 25 bp, Homo sapien
gtacttcgccgagagggtgacctct

SEQ ID NO: 124149 - DNA, 25 bp, Homo sapien
gacctctctgggcaaggactggcat

SEQ ID NO: 124150 - DNA, 25 bp, Homo sapien
aaggactggcatcggccctgcctga

SEQ ID NO: 124151 - DNA, 25 bp, Homo sapien
atcggccctgcctgaagtgcgagaa

SEQ ID NO: 124152 - DNA, 25 bp, Homo sapien
gccctgcctgaagtgcgagaaatgt

SEQ ID NO: 124153 - DNA, 25 bp, Homo sapien
agggtgctgagctgtatggtccagc

SEQ ID NO: 124154 - DNA, 25 bp, Homo sapien
ggagtaataagggctcttccggaag

SEQ ID NO: 124155 - DNA, 25 bp, Homo sapien
gaggcaggcctgcacctgatgtgga

SEQ ID NO: 124156 - DNA, 25 bp, Homo sapien
tggaggtacaggcagatcttcccta

SEQ ID NO: 124157 - DNA, 25 bp, Homo sapien
ggtacaggcagatcttccctaccgg

SEQ ID NO: 124158 - DNA, 25 bp, Homo sapien
tgggctattccatccatctggaagc

SEQ ID NO: 124159 - DNA, 25 bp, Homo sapien
tattccatccatctggaagcacatt

SEQ ID NO: 124160 - DNA, 25 bp, Homo sapien
aagcacatttgagcctccaggcttc

SEQ ID NO: 124161 - DNA, 25 bp, Homo sapien
tccaggcttctccttgacgtcattc

SEQ ID NO: 124162 - DNA, 25 bp, Homo sapien
tccttccttgctgcaaaatggctct

SEQ ID NO: 124163 - DNA, 25 bp, Homo sapien
tgcaaaatggctctgcaccagccgg

SEQ ID NO: 124164 - DNA, 25 bp, Homo sapien
gctttcagaaccgagtgcgcgagaa

SEQ ID NO: 124165 - DNA, 25 bp, Homo sapien
tgcgcgagaaacagaagctcttcca

SEQ ID NO: 124166 - DNA, 25 bp, Homo sapien
ggaggacaatgacatcccgttgtac

SEQ ID NO: 124167 - DNA, 25 bp, Homo sapien
atcccgttgtacctgaagggcggca

SEQ ID NO: 124168 - DNA, 25 bp, Homo sapien
aagggcggcatcgttgacaacatcc

SEQ ID NO: 124169 - DNA, 25 bp, Homo sapien
gacaacatcctgtaccgagtgacaa

SEQ ID NO: 124170 - DNA, 25 bp, Homo sapien
acaatgacgctgtgtctgggcggca

SEQ ID NO: 124171 - DNA, 25 bp, Homo sapien
tgggcggcactgtctacagcttgta

SEQ ID NO: 124172 - DNA, 25 bp, Homo sapien
tacagcttgtactcccttggctggg

SEQ ID NO: 124173 - DNA, 25 bp, Homo sapien
aaggcagaatgcaggcccttcgggt

SEQ ID NO: 124174 - DNA, 25 bp, Homo sapien
ttcgggtgtcccaggcgctgatccg

SEQ ID NO: 124175 - DNA, 25 bp, Homo sapien
tcaatgtgctccttcataagccatt

SEQ ID NO: 124176 - DNA, 25 bp, Homo sapien
tgctccttcataagccattgcttct

SEQ ID NO: 124177 - DNA, 25 bp, Homo sapien
gaagcatgaggtgagagaaagccac

SEQ ID NO: 124178 - DNA, 25 bp, Homo sapien
agtgcctggagaagggttcagccca

SEQ ID NO: 124179 - DNA, 25 bp, Homo sapien
cttctctgggtctggcattataaag

SEQ ID NO: 124180 - DNA, 25 bp, Homo sapien
gaacagctgaggctgtcattccatg

SEQ ID NO: 124181 - DNA, 25 bp, Homo sapien
ggctgtcattccatgagtcttcaga

SEQ ID NO: 124182 - DNA, 25 bp, Homo sapien
gacagctcagaaagtcaaagaggcc

SEQ ID NO: 124183 - DNA, 25 bp, Homo sapien
gtcaaagaggccaactgcccagagc

SEQ ID NO: 124184 - DNA, 25 bp, Homo sapien
attgaggctaagtaacctgattaca

SEQ ID NO: 124185 - DNA, 25 bp, Homo sapien
agtaacctgattacaagttgtacta

SEQ ID NO: 124186 - DNA, 25 bp, Homo sapien
aagcaagaagacatggcacgtgttc

SEQ ID NO: 124187 - DNA, 25 bp, Homo sapien
tggcacgtgttctgaaaccactggt

SEQ ID NO: 124188 - DNA, 25 bp, Homo sapien
gtctgctcagatgtgttgggacaaa

SEQ ID NO: 124189 - DNA, 25 bp, Homo sapien
tttgactcagagaaaactagatcca

SEQ ID NO: 124190 - DNA, 25 bp, Homo sapien
aaactagatccaaatcccagctcta

SEQ ID NO: 124191 - DNA, 25 bp, Homo sapien
agctctactgtctctcccgaattag

SEQ ID NO: 124192 - DNA, 25 bp, Homo sapien
gtctctcccgaattagccttgggaa

SEQ ID NO: 124193 - DNA, 25 bp, Homo sapien
cccgaattagccttgggaaaatcat

SEQ ID NO: 124194 - DNA, 25 bp, Homo sapien
aatttacctttttatctaggagatg

SEQ ID NO: 124195 - DNA, 25 bp, Homo sapien
aaaagaggataatgtttccttccat

SEQ ID NO: 124196 - DNA, 25 bp, Homo sapien
aatggtgagctttaagtggtttgta

SEQ ID NO: 124197 - DNA, 25 bp, Homo sapien
acttcagcttctcggtgcccactgg

SEQ ID NO: 124198 - DNA, 25 bp, Homo sapien
tcagcttctcggtgcccactggaca

SEQ ID NO: 124199 - DNA, 25 bp, Homo sapien
cagcttctcggtgcccactggacag

SEQ ID NO: 124200 - DNA, 25 bp, Homo sapien
agcttctcggtgcccactggacagc

SEQ ID NO: 124201 - DNA, 25 bp, Homo sapien
gcttctcggtgcccactggacagcc

SEQ ID NO: 124202 - DNA, 25 bp, Homo sapien
cttctcggtgcccactggacagccc

SEQ ID NO: 124203 - DNA, 25 bp, Homo sapien
ttctcggtgcccactggacagcccc

SEQ ID NO: 124204 - DNA, 25 bp, Homo sapien
tctcggtgcccactggacagccccg

SEQ ID NO: 124205 - DNA, 25 bp, Homo sapien
ctcggtgcccactggacagccccgg

SEQ ID NO: 124206 - DNA, 25 bp, Homo sapien
tcggtgcccactggacagccccggc

SEQ ID NO: 124207 - DNA, 25 bp, Homo sapien
cagcctgctcctagcccagaggctc

SEQ ID NO: 124208 - DNA, 25 bp, Homo sapien
tcctggctgccgtgcttggatggca

SEQ ID NO: 124209 - DNA, 25 bp, Homo sapien
gagagcagcatacttactgcccttg

SEQ ID NO: 124210 - DNA, 25 bp, Homo sapien
agcatacttactgcccttgaggaaa

SEQ ID NO: 124211 - DNA, 25 bp, Homo sapien
ttactgcccttgaggaaatgactgg

SEQ ID NO: 124212 - DNA, 25 bp, Homo sapien
aaatgactggcatgaatgaccttgg

SEQ ID NO: 124213 - DNA, 25 bp, Homo sapien
atgaccttggagagaggcagtctga

SEQ ID NO: 124214 - DNA, 25 bp, Homo sapien
ggcagtctgagaactaccctaacaa

SEQ ID NO: 124215 - DNA, 25 bp, Homo sapien
taaatcagcctgagtgaccaaattt

SEQ ID NO: 124216 - DNA, 25 bp, Homo sapien
ccaaattttggtctggtgggaacag

SEQ ID NO: 124217 - DNA, 25 bp, Homo sapien
tgtatgccttctccagtcaccgctt

SEQ ID NO: 124218 - DNA, 25 bp, Homo sapien
agtacctgaaggctttcctggctgc

SEQ ID NO: 124219 - DNA, 25 bp, Homo sapien
gaagacatttcagtgccgagtagtc

SEQ ID NO: 124220 - DNA, 25 bp, Homo sapien
tttcagtgccgagtagtccacatac

SEQ ID NO: 124221 - DNA, 25 bp, Homo sapien
atacagcatagttcggtcagcacat

SEQ ID NO: 124222 - DNA, 25 bp, Homo sapien
agttcggtcagcacatccaatggag

SEQ ID NO: 124223 - DNA, 25 bp, Homo sapien
acatccaatggagtcagttcaacct

SEQ ID NO: 124224 - DNA, 25 bp, Homo sapien
tcagttcaacctccaaggcagaagc

SEQ ID NO: 124225 - DNA, 25 bp, Homo sapien
tcctcacccagatggcggaccagag

SEQ ID NO: 124226 - DNA, 25 bp, Homo sapien
ggaccagagtacagagcctgctctt

SEQ ID NO: 124227 - DNA, 25 bp, Homo sapien
gagcctgctctttcacagatcgtta

SEQ ID NO: 124228 - DNA, 25 bp, Homo sapien
tttcacagatcgttatggctccttc

SEQ ID NO: 124229 - DNA, 25 bp, Homo sapien
gaagttgattaaaaacctgcagtac

SEQ ID NO: 124230 - DNA, 25 bp, Homo sapien
tgaaaaggactgaatcgccactaca

SEQ ID NO: 124231 - DNA, 25 bp, Homo sapien
gactgaatcgccactacagcctggg

SEQ ID NO: 124232 - DNA, 25 bp, Homo sapien
acagcctgggtgcaaaatcagcaag

SEQ ID NO: 124233 - DNA, 25 bp, Homo sapien
ttgtatgcctttggccttgcacaac

SEQ ID NO: 124234 - DNA, 25 bp, Homo sapien
tggccttgcacaacccatttgtgag

SEQ ID NO: 124235 - DNA, 25 bp, Homo sapien
agcagaagtggaccaccatcagctc

SEQ ID NO: 124236 - DNA, 25 bp, Homo sapien
cccagcgatttttccttggaggtca

SEQ ID NO: 124237 - DNA, 25 bp, Homo sapien
gatttttccttggaggtcagcccgt

SEQ ID NO: 124238 - DNA, 25 bp, Homo sapien
actgatttacctacttaccatactg

SEQ ID NO: 124239 - DNA, 25 bp, Homo sapien
acctacttaccatactgggaggtag

SEQ ID NO: 124240 - DNA, 25 bp, Homo sapien
aaatgtggaatttgtggacctatgg

SEQ ID NO: 124241 - DNA, 25 bp, Homo sapien
gacctcctgccgaaggagcaacgca

SEQ ID NO: 124242 - DNA, 25 bp, Homo sapien
ggtctgctgagcctggcgagggtct

SEQ ID NO: 124243 - DNA, 25 bp, Homo sapien
gagggaccaggaggaaggcgtgctc

SEQ ID NO: 124244 - DNA, 25 bp, Homo sapien
ggaaggcactcgcaccgtgctcttg

SEQ ID NO: 124245 - DNA, 25 bp, Homo sapien
aaggcactcgcaccgtgctcttggg

SEQ ID NO: 124246 - DNA, 25 bp, Homo sapien
ggcactcgcaccgtgctcttgggaa

SEQ ID NO: 124247 - DNA, 25 bp, Homo sapien
aggaaggagacctggccctgctcac

SEQ ID NO: 124248 - DNA, 25 bp, Homo sapien
gctcaccacggactgggtgcctcga

SEQ ID NO: 124249 - DNA, 25 bp, Homo sapien
ggactgggtgcctcgacctcctgaa

SEQ ID NO: 124250 - DNA, 25 bp, Homo sapien
gactgggtgcctcgacctcctgaat

SEQ ID NO: 124251 - DNA, 25 bp, Homo sapien
ctcgacctcctgaatccccagaaca

SEQ ID NO: 124252 - DNA, 25 bp, Homo sapien
tgtgccaggccagtcacaccgacca

SEQ ID NO: 124253 - DNA, 25 bp, Homo sapien
tccccatgtgcctgtgccaagagac

SEQ ID NO: 124254 - DNA, 25 bp, Homo sapien
ccatgtgcctgtgccaagagacaga

SEQ ID NO: 124255 - DNA, 25 bp, Homo sapien
gtgcctgtgccaagagacagacaga

SEQ ID NO: 124256 - DNA, 25 bp, Homo sapien
agaaggctgcaggagtcctttgttg

SEQ ID NO: 124257 - DNA, 25 bp, Homo sapien
aaggctgcaggagtcctttgttgct

SEQ ID NO: 124258 - DNA, 25 bp, Homo sapien
ctgcaggagtcctttgttgctcagc

SEQ ID NO: 124259 - DNA, 25 bp, Homo sapien
tccttcttgcttctaatagacctgg

SEQ ID NO: 124260 - DNA, 25 bp, Homo sapien
tcttgcttctaatagacctggtaca

SEQ ID NO: 124261 - DNA, 25 bp, Homo sapien
gcttctaatagacctggtacatggt

SEQ ID NO: 124262 - DNA, 25 bp, Homo sapien
acctggtacatggtacacacacccc

SEQ ID NO: 124263 - DNA, 25 bp, Homo sapien
taatttccttctttaaagcaagtat

SEQ ID NO: 124264 - DNA, 25 bp, Homo sapien
acttggaggcatttcatacacacat

SEQ ID NO: 124265 - DNA, 25 bp, Homo sapien
ttcatacacacatttcttaggaaaa

SEQ ID NO: 124266 - DNA, 25 bp, Homo sapien
ttagagattctgcagctctttgctc

SEQ ID NO: 124267 - DNA, 25 bp, Homo sapien
attctgcagctctttgctcttaaga

SEQ ID NO: 124268 - DNA, 25 bp, Homo sapien
gagcaaatcacaacaggattcttaa

SEQ ID NO: 124269 - DNA, 25 bp, Homo sapien
caggattcttaatgtatgatttctt

SEQ ID NO: 124270 - DNA, 25 bp, Homo sapien
aagtttataaggaagagcatctcat

SEQ ID NO: 124271 - DNA, 25 bp, Homo sapien
gagcatctcatacatatcattatcg

SEQ ID NO: 124272 - DNA, 25 bp, Homo sapien
tacatatcattatcgtggaacacgt

SEQ ID NO: 124273 - DNA, 25 bp, Homo sapien
cgtggaacacgttgaacgtttgtga

SEQ ID NO: 124274 - DNA, 25 bp, Homo sapien
ggctccatgaaggatgcaggcttcc

SEQ ID NO: 124275 - DNA, 25 bp, Homo sapien
atgaaggatgcaggcttccaggcct

SEQ ID NO: 124276 - DNA, 25 bp, Homo sapien
ttctctgcctagtccacagattagg

SEQ ID NO: 124277 - DNA, 25 bp, Homo sapien
ttaggcaatcaaggaagacgccatc

SEQ ID NO: 124278 - DNA, 25 bp, Homo sapien
aggaagacgccatcagggaagccac

SEQ ID NO: 124279 - DNA, 25 bp, Homo sapien
ggaagccacatccttagtcaaccag

SEQ ID NO: 124280 - DNA, 25 bp, Homo sapien
cacatccttagtcaaccagttgcat

SEQ ID NO: 124281 - DNA, 25 bp, Homo sapien
tagtcaaccagttgcatcgtgcggg

SEQ ID NO: 124282 - DNA, 25 bp, Homo sapien
gggaatagcagaaccaccatgtctt

SEQ ID NO: 124283 - DNA, 25 bp, Homo sapien
gaaccaccatgtcttcagtgattga

SEQ ID NO: 124284 - DNA, 25 bp, Homo sapien
tgattgaaactcataccccattgcc

SEQ ID NO: 124285 - DNA, 25 bp, Homo sapien
aaccaggtgcgcaagaagcggcaga

SEQ ID NO: 124286 - DNA, 25 bp, Homo sapien
gtgacacgaacgatctttgccattc

SEQ ID NO: 124287 - DNA, 25 bp, Homo sapien
tctttgccattctgctagccttcat

SEQ ID NO: 124288 - DNA, 25 bp, Homo sapien
gtcatggtcctggtgaacaccttct

SEQ ID NO: 124289 - DNA, 25 bp, Homo sapien
agagctgcatccctgacacggtgtg

SEQ ID NO: 124290 - DNA, 25 bp, Homo sapien
gacacggtgtggtccattggctact

SEQ ID NO: 124291 - DNA, 25 bp, Homo sapien
ggtccattggctactggctctgcta

SEQ ID NO: 124292 - DNA, 25 bp, Homo sapien
tctgtgcaacgccacctttaaaaag

SEQ ID NO: 124293 - DNA, 25 bp, Homo sapien
taaaaagaccttccggcacctgctg

SEQ ID NO: 124294 - DNA, 25 bp, Homo sapien
tgctgctgtgccagtatcggaacat

SEQ ID NO: 124295 - DNA, 25 bp, Homo sapien
gtatcggaacatcggcactgccagg

SEQ ID NO: 124296 - DNA, 25 bp, Homo sapien
acaacctctctgatcttgtgctcag

SEQ ID NO: 124297 - DNA, 25 bp, Homo sapien
ttgtgctcagcatgattctttaata

SEQ ID NO: 124298 - DNA, 25 bp, Homo sapien
tttttcgtgcactctgctaatcatg

SEQ ID NO: 124299 - DNA, 25 bp, Homo sapien
cgtgcactctgctaatcatgtgggt

SEQ ID NO: 124300 - DNA, 25 bp, Homo sapien
ctgctaatcatgtgggtgagccagt

SEQ ID NO: 124301 - DNA, 25 bp, Homo sapien
cagattgcctcctaatgacgcggct

SEQ ID NO: 124302 - DNA, 25 bp, Homo sapien
tgcctcctaatgacgcggctcaaaa

SEQ ID NO: 124303 - DNA, 25 bp, Homo sapien
taatgacgcggctcaaaaggaaacc

SEQ ID NO: 124304 - DNA, 25 bp, Homo sapien
ccaagtggtcaggagttgtttctga

SEQ ID NO: 124305 - DNA, 25 bp, Homo sapien
ttgtttctgacccactgatctctac

SEQ ID NO: 124306 - DNA, 25 bp, Homo sapien
cactgatctctactaccacaaggaa

SEQ ID NO: 124307 - DNA, 25 bp, Homo sapien
tgatacagagattggccattacgct

SEQ ID NO: 124308 - DNA, 25 bp, Homo sapien
gccattacgctagctctcaggagaa

SEQ ID NO: 124309 - DNA, 25 bp, Homo sapien
actaggatgtcttgaaacccgtgca

SEQ ID NO: 124310 - DNA, 25 bp, Homo sapien
gtcttgaaacccgtgcatttaattt

SEQ ID NO: 124311 - DNA, 25 bp, Homo sapien
atggcaaatttgtaagcgtgtcatt

SEQ ID NO: 124312 - DNA, 25 bp, Homo sapien
gtaagcgtgtcatttaagtaatttg

SEQ ID NO: 124313 - DNA, 25 bp, Homo sapien
gtaatttgatgctcagttttagggt

SEQ ID NO: 124314 - DNA, 25 bp, Homo sapien
aagttgacctcgagtgagccatgca

SEQ ID NO: 124315 - DNA, 25 bp, Homo sapien
gagtgagccatgcaaaaatagcttt

SEQ ID NO: 124316 - DNA, 25 bp, Homo sapien
ttaaaattatacatgagcagctcaa

SEQ ID NO: 124317 - DNA, 25 bp, Homo sapien
gagcagctcaaagtaaacgtgtatt

SEQ ID NO: 124318 - DNA, 25 bp, Homo sapien
atttgccgcggcctttccagctgtg

SEQ ID NO: 124319 - DNA, 25 bp, Homo sapien
attcgcctgtgagcgatgaggccca

SEQ ID NO: 124320 - DNA, 25 bp, Homo sapien
atgaggcccacccatgtgggttgct

SEQ ID NO: 124321 - DNA, 25 bp, Homo sapien
atgtgggttgctacgtccccttctt

SEQ ID NO: 124322 - DNA, 25 bp, Homo sapien
ttcttggtccacagtctgccctcat

SEQ ID NO: 124323 - DNA, 25 bp, Homo sapien
atctgtgccccgtctgcagggcaga

SEQ ID NO: 124324 - DNA, 25 bp, Homo sapien
cagaggcagatgtggcatgtctttt

SEQ ID NO: 124325 - DNA, 25 bp, Homo sapien
tgtctttttgtacccacagagcttg

SEQ ID NO: 124326 - DNA, 25 bp, Homo sapien
gtacccacagagcttgttctatggc

SEQ ID NO: 124327 - DNA, 25 bp, Homo sapien
ttgttctatggcacgcccttttcta

SEQ ID NO: 124328 - DNA, 25 bp, Homo sapien
gcacgcccttttctaggctttttgt

SEQ ID NO: 124329 - DNA, 25 bp, Homo sapien
gatgtctgtctctgaagcgtgattt

SEQ ID NO: 124330 - DNA, 25 bp, Homo sapien
tgattttaaaatccccatgcctgtg

SEQ ID NO: 124331 - DNA, 25 bp, Homo sapien
gcgcttcctatttctagggctggga

SEQ ID NO: 124332 - DNA, 25 bp, Homo sapien
tagggctgggaaacactccttgcat

SEQ ID NO: 124333 - DNA, 25 bp, Homo sapien
gacagctttgactggagggtccatt

SEQ ID NO: 124334 - DNA, 25 bp, Homo sapien
gggtccatttttcttccaggatggt

SEQ ID NO: 124335 - DNA, 25 bp, Homo sapien
cttccaggatggtgttactgcagtt

SEQ ID NO: 124336 - DNA, 25 bp, Homo sapien
gttactttcttaatgtgacctagca

SEQ ID NO: 124337 - DNA, 25 bp, Homo sapien
gcaataggcatagctacgtggcact

SEQ ID NO: 124338 - DNA, 25 bp, Homo sapien
gctacgtggcactatattctggcca

SEQ ID NO: 124339 - DNA, 25 bp, Homo sapien
tattctggccagactcgatgtgtac

SEQ ID NO: 124340 - DNA, 25 bp, Homo sapien
tttccgtttccaggtgtttatagtg

SEQ ID NO: 124341 - DNA, 25 bp, Homo sapien
gtagacctgtgagaaaacgttttgt

SEQ ID NO: 124342 - DNA, 25 bp, Homo sapien
gacagaagtcactcaattgtttttg

SEQ ID NO: 124343 - DNA, 25 bp, Homo sapien
ggtctgagccaaagagaatgccatt

SEQ ID NO: 124344 - DNA, 25 bp, Homo sapien
gaatgccattctcttgggtgggtaa

SEQ ID NO: 124345 - DNA, 25 bp, Homo sapien
cttgggtgggtaagactaaatctgt

SEQ ID NO: 124346 - DNA, 25 bp, Homo sapien
caactttctcttgtaaacgtttcag

SEQ ID NO: 124347 - DNA, 25 bp, Homo sapien
ataaaacatctttccagtccttggt

SEQ ID NO: 124348 - DNA, 25 bp, Homo sapien
gtccttggtcagtttggttgtgtaa

SEQ ID NO: 124349 - DNA, 25 bp, Homo sapien
gcagcagcaacacaatgttattcgt

SEQ ID NO: 124350 - DNA, 25 bp, Homo sapien
tgttattcgttttgtctacgtttag

SEQ ID NO: 124351 - DNA, 25 bp, Homo sapien
gtggtgcacatcacgcaggcgctgt

SEQ ID NO: 124352 - DNA, 25 bp, Homo sapien
gtgcacatcacgcaggcgctgtgtc

SEQ ID NO: 124353 - DNA, 25 bp, Homo sapien
atcacgcaggcgctgtgtcctgcct

SEQ ID NO: 124354 - DNA, 25 bp, Homo sapien
acgcaggcgctgtgtcctgcctgct

SEQ ID NO: 124355 - DNA, 25 bp, Homo sapien
tggtcagcgccgtcacctggctggg

SEQ ID NO: 124356 - DNA, 25 bp, Homo sapien
tcatctacactgtcttcaacgccga

SEQ ID NO: 124357 - DNA, 25 bp, Homo sapien
tctacactgtcttcaacgccgagtt

SEQ ID NO: 124358 - DNA, 25 bp, Homo sapien
acactgtcttcaacgccgagttccg

SEQ ID NO: 124359 - DNA, 25 bp, Homo sapien
tcttcaacgccgagttccgcaacgt

SEQ ID NO: 124360 - DNA, 25 bp, Homo sapien
tcaacgccgagttccgcaacgtctt

SEQ ID NO: 124361 - DNA, 25 bp, Homo sapien
aacgtcttccgcaaggccctgcgtg

SEQ ID NO: 124362 - DNA, 25 bp, Homo sapien
tgagaactttaaattagtcccctat

SEQ ID NO: 124363 - DNA, 25 bp, Homo sapien
taaattagtcccctattagaatagg

SEQ ID NO: 124364 - DNA, 25 bp, Homo sapien
gaatagggttgctactcatcttttt

SEQ ID NO: 124365 - DNA, 25 bp, Homo sapien
taactggtcttgttaagagtgcaat

SEQ ID NO: 124366 - DNA, 25 bp, Homo sapien
tattcagcatgaaacctaatatgta

SEQ ID NO: 124367 - DNA, 25 bp, Homo sapien
aatacttcataatgtgcatgttgta

SEQ ID NO: 124368 - DNA, 25 bp, Homo sapien
gcatgttgtagcaaacatttctgta

SEQ ID NO: 124369 - DNA, 25 bp, Homo sapien
ttctgtaaattatcacaagctctgt

SEQ ID NO: 124370 - DNA, 25 bp, Homo sapien
attatcacaagctctgttaccttta

SEQ ID NO: 124371 - DNA, 25 bp, Homo sapien
tgttacctttatatacgctgcctct

SEQ ID NO: 124372 - DNA, 25 bp, Homo sapien
atacgctgcctcttcaatttggaaa

SEQ ID NO: 124373 - DNA, 25 bp, Homo sapien
ctgcagagaactggaacctgcctga

SEQ ID NO: 124374 - DNA, 25 bp, Homo sapien
gagaactggaacctgcctgaggaca

SEQ ID NO: 124375 - DNA, 25 bp, Homo sapien
gaactggaacctgcctgaggacagg

SEQ ID NO: 124376 - DNA, 25 bp, Homo sapien
gggatgtgattgctgcctccccaga

SEQ ID NO: 124377 - DNA, 25 bp, Homo sapien
ccccaggcaaggtagagggcgagtt

SEQ ID NO: 124378 - DNA, 25 bp, Homo sapien
tggaagaggagctggccgacatctt

SEQ ID NO: 124379 - DNA, 25 bp, Homo sapien
gagctggccgacatcttgcagggcc

SEQ ID NO: 124380 - DNA, 25 bp, Homo sapien
tggccgacatcttgcagggccccag

SEQ ID NO: 124381 - DNA, 25 bp, Homo sapien
cagcctgcgatccacagacgaggag

SEQ ID NO: 124382 - DNA, 25 bp, Homo sapien
tgcgatccacagacgaggaggatga

SEQ ID NO: 124383 - DNA, 25 bp, Homo sapien
gaggatgaactgatcctttgacccc

SEQ ID NO: 124384 - DNA, 25 bp, Homo sapien
taattgtgagcatcctctgcagcat

SEQ ID NO: 124385 - DNA, 25 bp, Homo sapien
gcagcatgccccttaagattttcta

SEQ ID NO: 124386 - DNA, 25 bp, Homo sapien
acccaaaccaagtgtatgtattgat

SEQ ID NO: 124387 - DNA, 25 bp, Homo sapien
gtatgtattgatttctaggaacccc

SEQ ID NO: 124388 - DNA, 25 bp, Homo sapien
gaacttattcagacacgtaaatgtt

SEQ ID NO: 124389 - DNA, 25 bp, Homo sapien
gtttaattctgtaggtaaccatttg

SEQ ID NO: 124390 - DNA, 25 bp, Homo sapien
ggtaaccatttgagctgcaattcag

SEQ ID NO: 124391 - DNA, 25 bp, Homo sapien
gctgcaattcaggatcttttttata

SEQ ID NO: 124392 - DNA, 25 bp, Homo sapien
atcttttttataacaccagtgtagc

SEQ ID NO: 124393 - DNA, 25 bp, Homo sapien
taacaccagtgtagccaaaagagaa

SEQ ID NO: 124394 - DNA, 25 bp, Homo sapien
aagattcagagcacttgggattgta

SEQ ID NO: 124395 - DNA, 25 bp, Homo sapien
tttccagatctacgctgtgccttgg

SEQ ID NO: 124396 - DNA, 25 bp, Homo sapien
agatctacgctgtgccttggcaggg

SEQ ID NO: 124397 - DNA, 25 bp, Homo sapien
tacgctgtgccttggcagggcacaa

SEQ ID NO: 124398 - DNA, 25 bp, Homo sapien
gcagggcacaatgaccttgtcgaaa

SEQ ID NO: 124399 - DNA, 25 bp, Homo sapien
aatgaccttgtcgaaatccacctgt

SEQ ID NO: 124400 - DNA, 25 bp, Homo sapien
ttgtcgaaatccacctgtcaggacg

SEQ ID NO: 124401 - DNA, 25 bp, Homo sapien
aatccacctgtcaggacgcctaggg

SEQ ID NO: 124402 - DNA, 25 bp, Homo sapien
tgtgcctatcacctcttatgcacac

SEQ ID NO: 124403 - DNA, 25 bp, Homo sapien
cagcaggcggcctttgttgctcagc

SEQ ID NO: 124404 - DNA, 25 bp, Homo sapien
ttcttgcttctcatagccccggtgt

SEQ ID NO: 124405 - DNA, 25 bp, Homo sapien
tcatagccccggtgtgcggtgcata

SEQ ID NO: 124406 - DNA, 25 bp, Homo sapien
ttcttggtcgtcctttgagtgacaa

SEQ ID NO: 124407 - DNA, 25 bp, Homo sapien
tgagtgacaacttctccgtgaacct

SEQ ID NO: 124408 - DNA, 25 bp, Homo sapien
ttctccgtgaacctgctgaagaggc

SEQ ID NO: 124409 - DNA, 25 bp, Homo sapien
gtatttccattcttgggtttctgcg

SEQ ID NO: 124410 - DNA, 25 bp, Homo sapien
attcttgggtttctgcgccgtcggt

SEQ ID NO: 124411 - DNA, 25 bp, Homo sapien
gtcggtgggcacttgttattttcca

SEQ ID NO: 124412 - DNA, 25 bp, Homo sapien
gcacttgttattttccaggaacctt

SEQ ID NO: 124413 - DNA, 25 bp, Homo sapien
aggaaccttctcctggtgtctacat

SEQ ID NO: 124414 - DNA, 25 bp, Homo sapien
ctcctggtgtctacatgtttgctta

SEQ ID NO: 124415 - DNA, 25 bp, Homo sapien
gtctacatgtttgcttagaggcggc

SEQ ID NO: 124416 - DNA, 25 bp, Homo sapien
tgcctgcatagcacaccttagatgt

SEQ ID NO: 124417 - DNA, 25 bp, Homo sapien
gtgtagcctttttgtataaaataga

SEQ ID NO: 124418 - DNA, 25 bp, Homo sapien
tagaaaatggtccaattagtttcct

SEQ ID NO: 124419 - DNA, 25 bp, Homo sapien
ataagcaggtggatctatttcatgt

SEQ ID NO: 124420 - DNA, 25 bp, Homo sapien
aaactatttgggatatgtatgggta

SEQ ID NO: 124421 - DNA, 25 bp, Homo sapien
gtatgggtagggtaaatcagtaaga

SEQ ID NO: 124422 - DNA, 25 bp, Homo sapien
atcagtaagaggtgttatttggaac

SEQ ID NO: 124423 - DNA, 25 bp, Homo sapien
tgttttggacagtttaccagttgcc

SEQ ID NO: 124424 - DNA, 25 bp, Homo sapien
atcccaaagttgttgtaacctgctg

SEQ ID NO: 124425 - DNA, 25 bp, Homo sapien
agttgttgtaacctgctgtgatacg

SEQ ID NO: 124426 - DNA, 25 bp, Homo sapien
aacctgctgtgatacgatgcttcaa

SEQ ID NO: 124427 - DNA, 25 bp, Homo sapien
gctgtgatacgatgcttcaagagaa

SEQ ID NO: 124428 - DNA, 25 bp, Homo sapien
gcctgggacagggtcagtacaagtc

SEQ ID NO: 124429 - DNA, 25 bp, Homo sapien
acaagtcaggacaggcttcatgcct

SEQ ID NO: 124430 - DNA, 25 bp, Homo sapien
aatgggttgttctcttgggaagtca

SEQ ID NO: 124431 - DNA, 25 bp, Homo sapien
gttctcttgggaagtcagggtatca

SEQ ID NO: 124432 - DNA, 25 bp, Homo sapien
tcagggtatcagatgggatggacat

SEQ ID NO: 124433 - DNA, 25 bp, Homo sapien
gatggacatccaggtcttctctctg

SEQ ID NO: 124434 - DNA, 25 bp, Homo sapien
tcttctctctgcctaattgtcaagg

SEQ ID NO: 124435 - DNA, 25 bp, Homo sapien
aattgtcaaggcctccttggctctg

SEQ ID NO: 124436 - DNA, 25 bp, Homo sapien
ctggagctatgaaaggccccacttt

SEQ ID NO: 124437 - DNA, 25 bp, Homo sapien
cttgccactgaggaccgaggactat

SEQ ID NO: 124438 - DNA, 25 bp, Homo sapien
aggaccgaggactatgctatgatga

SEQ ID NO: 124439 - DNA, 25 bp, Homo sapien
tcagctaagcctctcttcatctgga

SEQ ID NO: 124440 - DNA, 25 bp, Homo sapien
agctaagcctctcttcatctggaag

SEQ ID NO: 124441 - DNA, 25 bp, Homo sapien
ctaagcctctcttcatctggaagaa

SEQ ID NO: 124442 - DNA, 25 bp, Homo sapien
gggcaggagaccaggctctagctct

SEQ ID NO: 124443 - DNA, 25 bp, Homo sapien
tggtgcccctggtctacaccataaa

SEQ ID NO: 124444 - DNA, 25 bp, Homo sapien
tggtctacaccataaagcggcacaa

SEQ ID NO: 124445 - DNA, 25 bp, Homo sapien
gtctacaccataaagcggcacaagt

SEQ ID NO: 124446 - DNA, 25 bp, Homo sapien
accataaagcggcacaagtggtcag

SEQ ID NO: 124447 - DNA, 25 bp, Homo sapien
ggaagctggcatatcggccgcccaa

SEQ ID NO: 124448 - DNA, 25 bp, Homo sapien
gaagctggcatatcggccgcccaag

SEQ ID NO: 124449 - DNA, 25 bp, Homo sapien
gcccaagtgaccctgtccagtgtct

SEQ ID NO: 124450 - DNA, 25 bp, Homo sapien
tatgcctggccttccctatcttcta

SEQ ID NO: 124451 - DNA, 25 bp, Homo sapien
ttctacctgaaccttcttcctcttc

SEQ ID NO: 124452 - DNA, 25 bp, Homo sapien
agccacatcagtcagggcatggctc

SEQ ID NO: 124453 - DNA, 25 bp, Homo sapien
atcagtcagggcatggctccaatcc

SEQ ID NO: 124454 - DNA, 25 bp, Homo sapien
gtcagggcatggctccaatccattc

SEQ ID NO: 124455 - DNA, 25 bp, Homo sapien
agggcatggctccaatccattcttt

SEQ ID NO: 124456 - DNA, 25 bp, Homo sapien
gcatggctccaatccattctttgct

SEQ ID NO: 124457 - DNA, 25 bp, Homo sapien
tccaatccattctttgctccaatgt

SEQ ID NO: 124458 - DNA, 25 bp, Homo sapien
aatccattctttgctccaatgtcac

SEQ ID NO: 124459 - DNA, 25 bp, Homo sapien
ctaaccacccaatcattctaaagca

SEQ ID NO: 124460 - DNA, 25 bp, Homo sapien
aaccacccaatcattctaaagcagc

SEQ ID NO: 124461 - DNA, 25 bp, Homo sapien
taggaggtgactgcatcctccagca

SEQ ID NO: 124462 - DNA, 25 bp, Homo sapien
aactccgtctgtctactgtgtgaga

SEQ ID NO: 124463 - DNA, 25 bp, Homo sapien
tactgtgtgagacttcggcggacca

SEQ ID NO: 124464 - DNA, 25 bp, Homo sapien
gacttcggcggaccattaggaatga

SEQ ID NO: 124465 - DNA, 25 bp, Homo sapien
gaatgagatccgtgagatccttcca

SEQ ID NO: 124466 - DNA, 25 bp, Homo sapien
agatccttccatcttcttgaagtcg

SEQ ID NO: 124467 - DNA, 25 bp, Homo sapien
atcttcttgaagtcgcctttagggt

SEQ ID NO: 124468 - DNA, 25 bp, Homo sapien
tcttgaagtcgcctttagggtggct

SEQ ID NO: 124469 - DNA, 25 bp, Homo sapien
ctgtcacggagcgactgtcgagatc

SEQ ID NO: 124470 - DNA, 25 bp, Homo sapien
gtcgagatcgcctagtatgttctgt

SEQ ID NO: 124471 - DNA, 25 bp, Homo sapien
ggacgtcccggctgggatgaagtct

SEQ ID NO: 124472 - DNA, 25 bp, Homo sapien
gtttccagccatctcgccctgccag

SEQ ID NO: 124473 - DNA, 25 bp, Homo sapien
agcccagcaccactgggaatcatgg

SEQ ID NO: 124474 - DNA, 25 bp, Homo sapien
gcccagcaccactgggaatcatggt

SEQ ID NO: 124475 - DNA, 25 bp, Homo sapien
cagcaccactgggaatcatggtgaa

SEQ ID NO: 124476 - DNA, 25 bp, Homo sapien
agcaccactgggaatcatggtgaag

SEQ ID NO: 124477 - DNA, 25 bp, Homo sapien
accactgggaatcatggtgaagctg

SEQ ID NO: 124478 - DNA, 25 bp, Homo sapien
catggtgaagctgatgcagcgttgc

SEQ ID NO: 124479 - DNA, 25 bp, Homo sapien
atggtgaagctgatgcagcgttgcc

SEQ ID NO: 124480 - DNA, 25 bp, Homo sapien
gaagctgatgcagcgttgccgaggg

SEQ ID NO: 124481 - DNA, 25 bp, Homo sapien
gggatgcccacggccgttcatcatc

SEQ ID NO: 124482 - DNA, 25 bp, Homo sapien
cgccgccctttaacacagtctggat

SEQ ID NO: 124483 - DNA, 25 bp, Homo sapien
gtataaaccttatgaactacagtgg

SEQ ID NO: 124484 - DNA, 25 bp, Homo sapien
aaaccttatgaactacagtggagct

SEQ ID NO: 124485 - DNA, 25 bp, Homo sapien
accttatgaactacagtggagctac

SEQ ID NO: 124486 - DNA, 25 bp, Homo sapien
gaactacagtggagctacactcatt

SEQ ID NO: 124487 - DNA, 25 bp, Homo sapien
tacagtggagctacactcattgaaa

SEQ ID NO: 124488 - DNA, 25 bp, Homo sapien
gtggagctacactcattgaaatgta

SEQ ID NO: 124489 - DNA, 25 bp, Homo sapien
gagctacactcattgaaatgtaatt

SEQ ID NO: 124490 - DNA, 25 bp, Homo sapien
atgtaatttcagttctaaaaagatg

SEQ ID NO: 124491 - DNA, 25 bp, Homo sapien
attactttgattccattttaagtgg

SEQ ID NO: 124492 - DNA, 25 bp, Homo sapien
actttgattccattttaagtggaga

SEQ ID NO: 124493 - DNA, 25 bp, Homo sapien
taagtggagacatatttcagtgatt

SEQ ID NO: 124494 - DNA, 25 bp, Homo sapien
tcactgatcagctcacgcctgtgca

SEQ ID NO: 124495 - DNA, 25 bp, Homo sapien
tgtgcacctgcaccatgctgatgct

SEQ ID NO: 124496 - DNA, 25 bp, Homo sapien
accatgctgatgctgatcgggcttg

SEQ ID NO: 124497 - DNA, 25 bp, Homo sapien
gggtcccctccaggtgtagactgta

SEQ ID NO: 124498 - DNA, 25 bp, Homo sapien
gtagactgtactccaaggactctgg

SEQ ID NO: 124499 - DNA, 25 bp, Homo sapien
ggactctgggcctccagcagatgga

SEQ ID NO: 124500 - DNA, 25 bp, Homo sapien
gggcctccagcagatggaccttaag

SEQ ID NO: 124501 - DNA, 25 bp, Homo sapien
agggccacctgccttagcttgctag

SEQ ID NO: 124502 - DNA, 25 bp, Homo sapien
ggtgctgagggcatccagcaagccc

SEQ ID NO: 124503 - DNA, 25 bp, Homo sapien
acagctcttgcttgccgattatgta

SEQ ID NO: 124504 - DNA, 25 bp, Homo sapien
gccgattatgtaaccaccagcctgg

SEQ ID NO: 124505 - DNA, 25 bp, Homo sapien
accatcttatctgaagactggactg

SEQ ID NO: 124506 - DNA, 25 bp, Homo sapien
gaagactggactgttgttttagaat

SEQ ID NO: 124507 - DNA, 25 bp, Homo sapien
aattgttctttttgagttatctact

SEQ ID NO: 124508 - DNA, 25 bp, Homo sapien
taagctaaattttcctagagagttt

SEQ ID NO: 124509 - DNA, 25 bp, Homo sapien
aaatttcagttgtgtcttgccatat

SEQ ID NO: 124510 - DNA, 25 bp, Homo sapien
gtgtcttgccatatggagggcacct

SEQ ID NO: 124511 - DNA, 25 bp, Homo sapien
gagggcacctaatcagagggtatta

SEQ ID NO: 124512 - DNA, 25 bp, Homo sapien
gtttactaagttttctagtggacat

SEQ ID NO: 124513 - DNA, 25 bp, Homo sapien
aaagtctttgaattgccagttctgt

SEQ ID NO: 124514 - DNA, 25 bp, Homo sapien
gccagttctgtaagtgccatcaatt

SEQ ID NO: 124515 - DNA, 25 bp, Homo sapien
tttgtgcagtgacagagattttctt

SEQ ID NO: 124516 - DNA, 25 bp, Homo sapien
aaatgttggtgttttgtatggatca

SEQ ID NO: 124517 - DNA, 25 bp, Homo sapien
agtgcagcattccttaattccttct

SEQ ID NO: 124518 - DNA, 25 bp, Homo sapien
cattccttaattccttctgctatat

SEQ ID NO: 124519 - DNA, 25 bp, Homo sapien
aattccttctgctatatgtcacaca

SEQ ID NO: 124520 - DNA, 25 bp, Homo sapien
acacagttgttatttggagaaccaa

SEQ ID NO: 124521 - DNA, 25 bp, Homo sapien
tggagaaccaagtatgtattgcatg

SEQ ID NO: 124522 - DNA, 25 bp, Homo sapien
taaactccaaggtaactggacttct

SEQ ID NO: 124523 - DNA, 25 bp, Homo sapien
actggacttctaaagcacctttctg

SEQ ID NO: 124524 - DNA, 25 bp, Homo sapien
ctaaagcacctttctgtttgcctga

SEQ ID NO: 124525 - DNA, 25 bp, Homo sapien
tctgtttgcctgatatctactttag

SEQ ID NO: 124526 - DNA, 25 bp, Homo sapien
tttttacaaccctctgactcaacaa

SEQ ID NO: 124527 - DNA, 25 bp, Homo sapien
gatggccttacctttattaggaagt

SEQ ID NO: 124528 - DNA, 25 bp, Homo sapien
tgatagtagcttcctcctctggtgg

SEQ ID NO: 124529 - DNA, 25 bp, Homo sapien
ctcctctggtggtgttaatcatttc

SEQ ID NO: 124530 - DNA, 25 bp, Homo sapien
ttcatttttacccttactgtttgag

SEQ ID NO: 124531 - DNA, 25 bp, Homo sapien
acccttactgtttgagtttctctca

SEQ ID NO: 124532 - DNA, 25 bp, Homo sapien
gagtttctctcacattactgtatat

SEQ ID NO: 124533 - DNA, 25 bp, Homo sapien
atcactcagtgattgcaatttgcac

SEQ ID NO: 124534 - DNA, 25 bp, Homo sapien
gagatttggtgtacaattcaggctt

SEQ ID NO: 124535 - DNA, 25 bp, Homo sapien
attcaggctttggatgtttctttag

SEQ ID NO: 124536 - DNA, 25 bp, Homo sapien
ggatgtttctttagcagttttgtga

SEQ ID NO: 124537 - DNA, 25 bp, Homo sapien
gtgataagttctagttgcttgtaaa

SEQ ID NO: 124538 - DNA, 25 bp, Homo sapien
cagcttgggcccagctgggctctgc

SEQ ID NO: 124539 - DNA, 25 bp, Homo sapien
ggctctgccaccctacctgttcagt

SEQ ID NO: 124540 - DNA, 25 bp, Homo sapien
gcccgttgaggatgaggccgctaga

SEQ ID NO: 124541 - DNA, 25 bp, Homo sapien
gccgctagaggcctgaggatgagct

SEQ ID NO: 124542 - DNA, 25 bp, Homo sapien
tgagaggggacaaaacccaccttgt

SEQ ID NO: 124543 - DNA, 25 bp, Homo sapien
tggtgctgggactgagccagtccca

SEQ ID NO: 124544 - DNA, 25 bp, Homo sapien
ggtgccagccttcctctgcagctga

SEQ ID NO: 124545 - DNA, 25 bp, Homo sapien
tctgcagctgacctctgttgtcctc

SEQ ID NO: 124546 - DNA, 25 bp, Homo sapien
tgtcctccccttgggcggctgagag

SEQ ID NO: 124547 - DNA, 25 bp, Homo sapien
ttgggcggctgagagccccagctga

SEQ ID NO: 124548 - DNA, 25 bp, Homo sapien
ggctgagagccccagctgacatgga

SEQ ID NO: 124549 - DNA, 25 bp, Homo sapien
tggtctcttactttcctttccccag

SEQ ID NO: 124550 - DNA, 25 bp, Homo sapien
cccagcccagggtggacttagaaag

SEQ ID NO: 124551 - DNA, 25 bp, Homo sapien
ccagcccagggtggacttagaaagc

SEQ ID NO: 124552 - DNA, 25 bp, Homo sapien
cagcccagggtggacttagaaagca

SEQ ID NO: 124553 - DNA, 25 bp, Homo sapien
agcccagggtggacttagaaagcag

SEQ ID NO: 124554 - DNA, 25 bp, Homo sapien
gtggacttagaaagcaggggctaca

SEQ ID NO: 124555 - DNA, 25 bp, Homo sapien
tggacttagaaagcaggggctacaa

SEQ ID NO: 124556 - DNA, 25 bp, Homo sapien
ggacttagaaagcaggggctacaag

SEQ ID NO: 124557 - DNA, 25 bp, Homo sapien
gacttagaaagcaggggctacaaga

SEQ ID NO: 124558 - DNA, 25 bp, Homo sapien
agggaatccccgaaggtgctggagg

SEQ ID NO: 124559 - DNA, 25 bp, Homo sapien
gggaatccccgaaggtgctggaggt

SEQ ID NO: 124560 - DNA, 25 bp, Homo sapien
tcagttcaccttgataaggtgcttc

SEQ ID NO: 124561 - DNA, 25 bp, Homo sapien
agttcaccttgataaggtgcttccg

SEQ ID NO: 124562 - DNA, 25 bp, Homo sapien
gttcaccttgataaggtgcttccga

SEQ ID NO: 124563 - DNA, 25 bp, Homo sapien
ttcaccttgataaggtgcttccgag

SEQ ID NO: 124564 - DNA, 25 bp, Homo sapien
accttgataaggtgcttccgagctg

SEQ ID NO: 124565 - DNA, 25 bp, Homo sapien
ccttgataaggtgcttccgagctgg

SEQ ID NO: 124566 - DNA, 25 bp, Homo sapien
ttgataaggtgcttccgagctggga

SEQ ID NO: 124567 - DNA, 25 bp, Homo sapien
tgataaggtgcttccgagctgggat

SEQ ID NO: 124568 - DNA, 25 bp, Homo sapien
gataaggtgcttccgagctgggatg

SEQ ID NO: 124569 - DNA, 25 bp, Homo sapien
aaggtgcttccgagctgggatgaga

SEQ ID NO: 124570 - DNA, 25 bp, Homo sapien
ggtgcttccgagctgggatgagagg

SEQ ID NO: 124571 - DNA, 25 bp, Homo sapien
gagtttctctcacattactgtatat

SEQ ID NO: 124572 - DNA, 25 bp, Homo sapien
tcacattactgtatatactttgcct

SEQ ID NO: 124573 - DNA, 25 bp, Homo sapien
atcactcagtgattgcaatttgcac

SEQ ID NO: 124574 - DNA, 25 bp, Homo sapien
gtgattgcaatttgcacaagttttt

SEQ ID NO: 124575 - DNA, 25 bp, Homo sapien
gggaatcaagatttaatcctagaga

SEQ ID NO: 124576 - DNA, 25 bp, Homo sapien
gagatttggtgtacaattcaggctt

SEQ ID NO: 124577 - DNA, 25 bp, Homo sapien
ttggtgtacaattcaggctttggat

SEQ ID NO: 124578 - DNA, 25 bp, Homo sapien
attcaggctttggatgtttctttag

SEQ ID NO: 124579 - DNA, 25 bp, Homo sapien
ggatgtttctttagcagttttgtga

SEQ ID NO: 124580 - DNA, 25 bp, Homo sapien
gtttctttagcagttttgtgataag

SEQ ID NO: 124581 - DNA, 25 bp, Homo sapien
gtgataagttctagttgcttgtaaa

SEQ ID NO: 124582 - DNA, 25 bp, Homo sapien
gtgctcagattgcaaaagtgggcca

SEQ ID NO: 124583 - DNA, 25 bp, Homo sapien
aagtgggccagatatttgctgcctg

SEQ ID NO: 124584 - DNA, 25 bp, Homo sapien
tttgctgcctggaaaattctcggat

SEQ ID NO: 124585 - DNA, 25 bp, Homo sapien
aattctcggatatgaccgctgtgat

SEQ ID NO: 124586 - DNA, 25 bp, Homo sapien
ttggcggatggcagcgtccgctacc

SEQ ID NO: 124587 - DNA, 25 bp, Homo sapien
taccccatctctaggccaagaaggc

SEQ ID NO: 124588 - DNA, 25 bp, Homo sapien
aagaaggcgctgcagtcctactgag

SEQ ID NO: 124589 - DNA, 25 bp, Homo sapien
gctgcagtcctactgaggctgcagt

SEQ ID NO: 124590 - DNA, 25 bp, Homo sapien
agctgtatggtgtctactgcttcag

SEQ ID NO: 124591 - DNA, 25 bp, Homo sapien
ggtgtctactgcttcagagcataca

SEQ ID NO: 124592 - DNA, 25 bp, Homo sapien
agagcatacaactgaatgtgccctt

SEQ ID NO: 124593 - DNA, 25 bp, Homo sapien
gaatttctttggtgctgtagaaaac

SEQ ID NO: 124594 - DNA, 25 bp, Homo sapien
aaaaatatggtgctcattctcatcc

SEQ ID NO: 124595 - DNA, 25 bp, Homo sapien
aatatggtgctcattctcatccatc

SEQ ID NO: 124596 - DNA, 25 bp, Homo sapien
tatggtgctcattctcatccatcca

SEQ ID NO: 124597 - DNA, 25 bp, Homo sapien
attctcatccatccaggatgtacta

SEQ ID NO: 124598 - DNA, 25 bp, Homo sapien
tccatccaggatgtactaaaacagt

SEQ ID NO: 124599 - DNA, 25 bp, Homo sapien
caggatgtactaaaacagtgtgttt

SEQ ID NO: 124600 - DNA, 25 bp, Homo sapien
attttgtgtacagttctatactgtt

SEQ ID NO: 124601 - DNA, 25 bp, Homo sapien
gttctatactgttatctgtgtccat

SEQ ID NO: 124602 - DNA, 25 bp, Homo sapien
atttccaaaacttgcacgtgtccct

SEQ ID NO: 124603 - DNA, 25 bp, Homo sapien
aaaacttgcacgtgtccctgaattc

SEQ ID NO: 124604 - DNA, 25 bp, Homo sapien
aaatatgatgccttttccgtctttg

SEQ ID NO: 124605 - DNA, 25 bp, Homo sapien
tatgatgccttttccgtctttgtat

SEQ ID NO: 124606 - DNA, 25 bp, Homo sapien
atgccttttccgtctttgtatcacg

SEQ ID NO: 124607 - DNA, 25 bp, Homo sapien
gtctttgtatcacgttaccccaaat

SEQ ID NO: 124608 - DNA, 25 bp, Homo sapien
tcacgttaccccaaattaagtatgt

SEQ ID NO: 124609 - DNA, 25 bp, Homo sapien
gaaatttgactcatgaactatttac

SEQ ID NO: 124610 - DNA, 25 bp, Homo sapien
gactcatgaactatttacattttcc

SEQ ID NO: 124611 - DNA, 25 bp, Homo sapien
aatcttaattcaactagtaccacag

SEQ ID NO: 124612 - DNA, 25 bp, Homo sapien
attcaactagtaccacagaagttca

SEQ ID NO: 124613 - DNA, 25 bp, Homo sapien
cagaagttcaatactcatttggaaa

SEQ ID NO: 124614 - DNA, 25 bp, Homo sapien
ggaaatgctacaaacatatcaaaca

SEQ ID NO: 124615 - DNA, 25 bp, Homo sapien
cgaccttccaggtgcagagcatccg

SEQ ID NO: 124616 - DNA, 25 bp, Homo sapien
agagcatccgcaggatccagcagtg

SEQ ID NO: 124617 - DNA, 25 bp, Homo sapien
atccgcaggatccagcagtgaacag

SEQ ID NO: 124618 - DNA, 25 bp, Homo sapien
acggaggagcgcatgcgtgccttat

SEQ ID NO: 124619 - DNA, 25 bp, Homo sapien
gcatgcgtgccttatctgcaatgga

SEQ ID NO: 124620 - DNA, 25 bp, Homo sapien
ttatctgcaatggaggcgctctgga

SEQ ID NO: 124621 - DNA, 25 bp, Homo sapien
ggctgtggtgtgttctctccttctg

SEQ ID NO: 124622 - DNA, 25 bp, Homo sapien
tgtggtgtgttctctccttctgcct

SEQ ID NO: 124623 - DNA, 25 bp, Homo sapien
cagcacccatgtgaactggtccgtg

SEQ ID NO: 124624 - DNA, 25 bp, Homo sapien
atgtgaactggtccgtgcacagtca

SEQ ID NO: 124625 - DNA, 25 bp, Homo sapien
tggtccgtgcacagtcagcacaaaa

SEQ ID NO: 124626 - DNA, 25 bp, Homo sapien
cagagttaccccaaaggaatggagg

SEQ ID NO: 124627 - DNA, 25 bp, Homo sapien
ggaggaatcagtaatcatcccagct

SEQ ID NO: 124628 - DNA, 25 bp, Homo sapien
gaatcagtaatcatcccagctggtg

SEQ ID NO: 124629 - DNA, 25 bp, Homo sapien
atcagtaatcatcccagctggtgta

SEQ ID NO: 124630 - DNA, 25 bp, Homo sapien
gtaatcatcccagctggtgtaataa

SEQ ID NO: 124631 - DNA, 25 bp, Homo sapien
atcccagctggtgtaataatgaatt

SEQ ID NO: 124632 - DNA, 25 bp, Homo sapien
ccagctggtgtaataatgaattgtt

SEQ ID NO: 124633 - DNA, 25 bp, Homo sapien
aaaacagctcataattgatgccaaa

SEQ ID NO: 124634 - DNA, 25 bp, Homo sapien
gatgccaaattaaagcactgtgtac

SEQ ID NO: 124635 - DNA, 25 bp, Homo sapien
taaagcactgtgtacccattaagat

SEQ ID NO: 124636 - DNA, 25 bp, Homo sapien
aagcactgtgtacccattaagatat

SEQ ID NO: 124637 - DNA, 25 bp, Homo sapien
gtccgctgcgggtactaagagccag

SEQ ID NO: 124638 - DNA, 25 bp, Homo sapien
tccgctgcgggtactaagagccagg

SEQ ID NO: 124639 - DNA, 25 bp, Homo sapien
gctgcgggtactaagagccaggcaa

SEQ ID NO: 124640 - DNA, 25 bp, Homo sapien
gcgggtactaagagccaggcaacag

SEQ ID NO: 124641 - DNA, 25 bp, Homo sapien
tactaagagccaggcaacagaccgt

SEQ ID NO: 124642 - DNA, 25 bp, Homo sapien
taagagccaggcaacagaccgttgg

SEQ ID NO: 124643 - DNA, 25 bp, Homo sapien
aagagccaggcaacagaccgttggg

SEQ ID NO: 124644 - DNA, 25 bp, Homo sapien
ggagaacagaaggtccctggtgaaa

SEQ ID NO: 124645 - DNA, 25 bp, Homo sapien
aacagaaggtccctggtgaaatcca

SEQ ID NO: 124646 - DNA, 25 bp, Homo sapien
atccaggtgtcaagaatcctaggga

SEQ ID NO: 124647 - DNA, 25 bp, Homo sapien
tgtgccaggccattcgcaccagcca

SEQ ID NO: 124648 - DNA, 25 bp, Homo sapien
ttagtgccacagcacctgggtatga

SEQ ID NO: 124649 - DNA, 25 bp, Homo sapien
gacagtaactgtgaccgtgggtcct

SEQ ID NO: 124650 - DNA, 25 bp, Homo sapien
agaagcatccctcaagtaagccctg

SEQ ID NO: 124651 - DNA, 25 bp, Homo sapien
gtaagccctgtgaggagagctccca

SEQ ID NO: 124652 - DNA, 25 bp, Homo sapien
gagctcccagcagaaggcacggagt

SEQ ID NO: 124653 - DNA, 25 bp, Homo sapien
gagccaaagtgcagccccaagccag

SEQ ID NO: 124654 - DNA, 25 bp, Homo sapien
agaggccctgcctgaaacccacagt

SEQ ID NO: 124655 - DNA, 25 bp, Homo sapien
agtgccaggcaacccttcagaaagg

SEQ ID NO: 124656 - DNA, 25 bp, Homo sapien
ttcagaaaggctttgctcctgctct

SEQ ID NO: 124657 - DNA, 25 bp, Homo sapien
gctcctgctctcagatcagatcaag

SEQ ID NO: 124658 - DNA, 25 bp, Homo sapien
gatcagatcaagcattctttctatt

SEQ ID NO: 124659 - DNA, 25 bp, Homo sapien
aaaaggctgcccaatctctgagaag

SEQ ID NO: 124660 - DNA, 25 bp, Homo sapien
caatctctgagaagcctgcatggca

SEQ ID NO: 124661 - DNA, 25 bp, Homo sapien
gcctgcatggcaccaagtacaaagt

SEQ ID NO: 124662 - DNA, 25 bp, Homo sapien
aaagtgggaccaatctgctctgtca

SEQ ID NO: 124663 - DNA, 25 bp, Homo sapien
tctgtcatctaccaagccagtggag

SEQ ID NO: 124664 - DNA, 25 bp, Homo sapien
tgactggtcctatgattatggcatc

SEQ ID NO: 124665 - DNA, 25 bp, Homo sapien
aagtactcatttgcctttgaactga

SEQ ID NO: 124666 - DNA, 25 bp, Homo sapien
ctgagagacacagggcgctacggct

SEQ ID NO: 124667 - DNA, 25 bp, Homo sapien
acctggcttggcttgaaggcaatca

SEQ ID NO: 124668 - DNA, 25 bp, Homo sapien
atgtgcgagaccacccctattaggg

SEQ ID NO: 124669 - DNA, 25 bp, Homo sapien
agtgaagtggcccaaaaggctgccc

SEQ ID NO: 124670 - DNA, 25 bp, Homo sapien
aaaattcaccactataggcttcttt

SEQ ID NO: 124671 - DNA, 25 bp, Homo sapien
aattcaccactataggcttctttga

SEQ ID NO: 124672 - DNA, 25 bp, Homo sapien
ctttgattttctttcagaagcaatt

SEQ ID NO: 124673 - DNA, 25 bp, Homo sapien
ttctttcagaagcaattgctgtctt

SEQ ID NO: 124674 - DNA, 25 bp, Homo sapien
tattattgtgatggaaaggctgtgt

SEQ ID NO: 124675 - DNA, 25 bp, Homo sapien
ggctgtgtggaaattcattgatgat

SEQ ID NO: 124676 - DNA, 25 bp, Homo sapien
catctttgcttgtactagatttctt

SEQ ID NO: 124677 - DNA, 25 bp, Homo sapien
ctttgcttgtactagatttcttact

SEQ ID NO: 124678 - DNA, 25 bp, Homo sapien
gcttgtactagatttcttacttaga

SEQ ID NO: 124679 - DNA, 25 bp, Homo sapien
cattagttttaaaatagctctgtga

SEQ ID NO: 124680 - DNA, 25 bp, Homo sapien
aaaatagctctgtgattttactttt

SEQ ID NO: 124681 - DNA, 25 bp, Homo sapien
tggcagcatcatcaaggcaatttat

SEQ ID NO: 124682 - DNA, 25 bp, Homo sapien
gcaatttatcaagccagtggaagca

SEQ ID NO: 124683 - DNA, 25 bp, Homo sapien
ggaagcactattgactggacctaca

SEQ ID NO: 124684 - DNA, 25 bp, Homo sapien
ggcatcaagtactccttcaccttcg

SEQ ID NO: 124685 - DNA, 25 bp, Homo sapien
tcaagtactccttcaccttcgagct

SEQ ID NO: 124686 - DNA, 25 bp, Homo sapien
gacactgggcgctatggcttcctgc

SEQ ID NO: 124687 - DNA, 25 bp, Homo sapien
ccaaggagacgtggctggcgcttct

SEQ ID NO: 124688 - DNA, 25 bp, Homo sapien
tggcgcttctgaccatcatggagca

SEQ ID NO: 124689 - DNA, 25 bp, Homo sapien
actgagctgaccctttgacaccctt

SEQ ID NO: 124690 - DNA, 25 bp, Homo sapien
tggccccatccaggcaaccaaataa

SEQ ID NO: 124691 - DNA, 25 bp, Homo sapien
aaagtttgagtgtaccaggaacaga

SEQ ID NO: 124692 - DNA, 25 bp, Homo sapien
tttactccataagcgcttcagtggg

SEQ ID NO: 124693 - DNA, 25 bp, Homo sapien
gggttatcctagtggctcttgtgga

SEQ ID NO: 124694 - DNA, 25 bp, Homo sapien
gtggaagtgtgtcttagttacatca

SEQ ID NO: 124695 - DNA, 25 bp, Homo sapien
tacccaaaatgcagacagatactaa

SEQ ID NO: 124696 - DNA, 25 bp, Homo sapien
cttctgttcagtaagaatcatgtct

SEQ ID NO: 124697 - DNA, 25 bp, Homo sapien
catgtcttactgatctaaccctaaa

SEQ ID NO: 124698 - DNA, 25 bp, Homo sapien
taaaatgttgataccttccctccca

SEQ ID NO: 124699 - DNA, 25 bp, Homo sapien
tcccaggctccttaccttggtcttt

SEQ ID NO: 124700 - DNA, 25 bp, Homo sapien
ttggtcttttccctgttcatctccc

SEQ ID NO: 124701 - DNA, 25 bp, Homo sapien
aacatgctgtgctccatagctggta

SEQ ID NO: 124702 - DNA, 25 bp, Homo sapien
ggagagggaaggcaaaatctttctt

SEQ ID NO: 124703 - DNA, 25 bp, Homo sapien
ggaagttttatctgagccttggaga

SEQ ID NO: 124704 - DNA, 25 bp, Homo sapien
atctgagccttggagattatcaaca

SEQ ID NO: 124705 - DNA, 25 bp, Homo sapien
gagattatcaacaagccagacccct

SEQ ID NO: 124706 - DNA, 25 bp, Homo sapien
cagacccctcagcagcaagtggagc

SEQ ID NO: 124707 - DNA, 25 bp, Homo sapien
agtggagctgtttgacttggagaat

SEQ ID NO: 124708 - DNA, 25 bp, Homo sapien
aataacccagagtacgtgtccagcg

SEQ ID NO: 124709 - DNA, 25 bp, Homo sapien
tttggaccggttgctgatgacggct

SEQ ID NO: 124710 - DNA, 25 bp, Homo sapien
gatgacggctatggtgtgtcgtaca

SEQ ID NO: 124711 - DNA, 25 bp, Homo sapien
ctatggtgtgtcgtacatccttgtg

SEQ ID NO: 124712 - DNA, 25 bp, Homo sapien
catccttgtgggagagaacctcatc

SEQ ID NO: 124713 - DNA, 25 bp, Homo sapien
gtgggagagaacctcatcaatttcc

SEQ ID NO: 124714 - DNA, 25 bp, Homo sapien
gatattctcagctattgaacagtta

SEQ ID NO: 124715 - DNA, 25 bp, Homo sapien
gaagataagtgttcgttcttttctg

SEQ ID NO: 124716 - DNA, 25 bp, Homo sapien
gaaaaaagagtatgtgtaccacaag

SEQ ID NO: 124717 - DNA, 25 bp, Homo sapien
gtgtaccacaagagctggttttaat

SEQ ID NO: 124718 - DNA, 25 bp, Homo sapien
aattgtttttgtcctcattctgtac

SEQ ID NO: 124719 - DNA, 25 bp, Homo sapien
gtttttgtcctcattctgtacagaa

SEQ ID NO: 124720 - DNA, 25 bp, Homo sapien
gtatatatgatggttcttagaactt

SEQ ID NO: 124721 - DNA, 25 bp, Homo sapien
ttttgtggtccttctgtttattata

SEQ ID NO: 124722 - DNA, 25 bp, Homo sapien
gtttattataataggcgtccaccaa

SEQ ID NO: 124723 - DNA, 25 bp, Homo sapien
taggcgtccaccaatgattatccat

SEQ ID NO: 124724 - DNA, 25 bp, Homo sapien
caatgattatccatatgtgttctta

SEQ ID NO: 124725 - DNA, 25 bp, Homo sapien
acgacccccgaaggcagatttgtgt

SEQ ID NO: 124726 - DNA, 25 bp, Homo sapien
ccctgctgtgtaacaatgtggccca

SEQ ID NO: 124727 - DNA, 25 bp, Homo sapien
gtgtaacaatgtggcccacggcatc

SEQ ID NO: 124728 - DNA, 25 bp, Homo sapien
cacggcatcgtctcctatggaaagt

SEQ ID NO: 124729 - DNA, 25 bp, Homo sapien
tcgtctcctatggaaagtcgtcagg

SEQ ID NO: 124730 - DNA, 25 bp, Homo sapien
gggttcctccagaagtcttcaccag

SEQ ID NO: 124731 - DNA, 25 bp, Homo sapien
ttcctccagaagtcttcaccagggt

SEQ ID NO: 124732 - DNA, 25 bp, Homo sapien
ttcaccagggtctcaagtttcctgc

SEQ ID NO: 124733 - DNA, 25 bp, Homo sapien
ggtctcaagtttcctgccctggata

SEQ ID NO: 124734 - DNA, 25 bp, Homo sapien
gaagcttcaaactgctggatcagat

SEQ ID NO: 124735 - DNA, 25 bp, Homo sapien
ggatcagatggagacccccctgtga

SEQ ID NO: 124736 - DNA, 25 bp, Homo sapien
tgctgcctccaagtcatgggagaag

SEQ ID NO: 124737 - DNA, 25 bp, Homo sapien
tggaagggcaggagctcacaccgca

SEQ ID NO: 124738 - DNA, 25 bp, Homo sapien
cgggctggcctgacacaatggtagc

SEQ ID NO: 124739 - DNA, 25 bp, Homo sapien
gacacaatggtagctctgaagggag

SEQ ID NO: 124740 - DNA, 25 bp, Homo sapien
agaggcctgggtgtgacctgacacc

SEQ ID NO: 124741 - DNA, 25 bp, Homo sapien
acacctgccgctgcttgagtggaca

SEQ ID NO: 124742 - DNA, 25 bp, Homo sapien
gtgggccccacagtggtcagcgatt

SEQ ID NO: 124743 - DNA, 25 bp, Homo sapien
agtggtcagcgattcctgccaagta

SEQ ID NO: 124744 - DNA, 25 bp, Homo sapien
attcctgccaagtagggtttagccg

SEQ ID NO: 124745 - DNA, 25 bp, Homo sapien
ttagccgggccccatggtcacagac

SEQ ID NO: 124746 - DNA, 25 bp, Homo sapien
ttgcttctaagggatccagagacct

SEQ ID NO: 124747 - DNA, 25 bp, Homo sapien
tgacctgtggtaagcaacctggcat

SEQ ID NO: 124748 - DNA, 25 bp, Homo sapien
gcagtccttgagaaggcatgttcca

SEQ ID NO: 124749 - DNA, 25 bp, Homo sapien
ggacaaactcactcagtaaaacata

SEQ ID NO: 124750 - DNA, 25 bp, Homo sapien
aaaactgattctctatgacatgaaa

SEQ ID NO: 124751 - DNA, 25 bp, Homo sapien
aattactaatgtacgctgctgcagg

SEQ ID NO: 124752 - DNA, 25 bp, Homo sapien
cgctgctgcaggacattaataaagt

SEQ ID NO: 124753 - DNA, 25 bp, Homo sapien
gcttttttaggctacagtgtctcga

SEQ ID NO: 124754 - DNA, 25 bp, Homo sapien
gctacagtgtctcgatgccataatc

SEQ ID NO: 124755 - DNA, 25 bp, Homo sapien
cgatgccataatcagaacacacttt

SEQ ID NO: 124756 - DNA, 25 bp, Homo sapien
tttctcccagcttcaaatgcacaat

SEQ ID NO: 124757 - DNA, 25 bp, Homo sapien
caattcatcattgggctcacttcta

SEQ ID NO: 124758 - DNA, 25 bp, Homo sapien
acgcccatggctaccaggagaaggt

SEQ ID NO: 124759 - DNA, 25 bp, Homo sapien
agaaggtgtcatctgtgcgggtgca

SEQ ID NO: 124760 - DNA, 25 bp, Homo sapien
tggcacgtgggttggctaccagtac

SEQ ID NO: 124761 - DNA, 25 bp, Homo sapien
tgggttggctaccagtaccccggct

SEQ ID NO: 124762 - DNA, 25 bp, Homo sapien
gctaccgtgggctgcagtacctgct

SEQ ID NO: 124763 - DNA, 25 bp, Homo sapien
cccaggtgcagtccgtgcgccgtat

SEQ ID NO: 124764 - DNA, 25 bp, Homo sapien
aggtgcagtccgtgcgccgtatccg

SEQ ID NO: 124765 - DNA, 25 bp, Homo sapien
gccgtatccgcgacatgcagtggca

SEQ ID NO: 124766 - DNA, 25 bp, Homo sapien
tatccgcgacatgcagtggcaccaa

SEQ ID NO: 124767 - DNA, 25 bp, Homo sapien
gcgacatgcagtggcaccaacgtgg

SEQ ID NO: 124768 - DNA, 25 bp, Homo sapien
aggacccaggtctgctgcccaggaa

SEQ ID NO: 124769 - DNA, 25 bp, Homo sapien
gcatcatcaaggcaatttatcaagc

SEQ ID NO: 124770 - DNA, 25 bp, Homo sapien
gcaatttatcaagccagtggaagca

SEQ ID NO: 124771 - DNA, 25 bp, Homo sapien
ggcatcaagtactccttcaccttcg

SEQ ID NO: 124772 - DNA, 25 bp, Homo sapien
tcaagtactccttcaccttcgagct

SEQ ID NO: 124773 - DNA, 25 bp, Homo sapien
ccaaggagacgtggctggcgcttct

SEQ ID NO: 124774 - DNA, 25 bp, Homo sapien
aaggagacgtggctggcgcttctga

SEQ ID NO: 124775 - DNA, 25 bp, Homo sapien
tgaatcacccctactgagctgaccc

SEQ ID NO: 124776 - DNA, 25 bp, Homo sapien
actgagctgaccctttgacaccctt

SEQ ID NO: 124777 - DNA, 25 bp, Homo sapien
tgagctgaccctttgacacccttct

SEQ ID NO: 124778 - DNA, 25 bp, Homo sapien
tggccccatccaggcaaccaaataa

SEQ ID NO: 124779 - DNA, 25 bp, Homo sapien
aaagtttgagtgtaccaggaacaga

SEQ ID NO: 124780 - DNA, 25 bp, Homo sapien
atcctgcaccttgttgtcatgaact

SEQ ID NO: 124781 - DNA, 25 bp, Homo sapien
gaactttgttggctgaatcattctc

SEQ ID NO: 124782 - DNA, 25 bp, Homo sapien
ggctgaatcattctcatttacttaa

SEQ ID NO: 124783 - DNA, 25 bp, Homo sapien
gaatgttcactctttgaatttcctg

SEQ ID NO: 124784 - DNA, 25 bp, Homo sapien
ggagatggcagcttattggacacat

SEQ ID NO: 124785 - DNA, 25 bp, Homo sapien
tattggacacatggattttcttcag

SEQ ID NO: 124786 - DNA, 25 bp, Homo sapien
acttactgctagctctgctttttat

SEQ ID NO: 124787 - DNA, 25 bp, Homo sapien
aaagcccagagttcactgtgtgtca

SEQ ID NO: 124788 - DNA, 25 bp, Homo sapien
tcactgtgtgtcagaacaactttct

SEQ ID NO: 124789 - DNA, 25 bp, Homo sapien
aacatttattaatccagcctctgcc

SEQ ID NO: 124790 - DNA, 25 bp, Homo sapien
cagcctctgcctttcattaaatgta

SEQ ID NO: 124791 - DNA, 25 bp, Homo sapien
gtggcagagcaacacttcgtctcag

SEQ ID NO: 124792 - DNA, 25 bp, Homo sapien
tggcagagcaacacttcgtctcaga

SEQ ID NO: 124793 - DNA, 25 bp, Homo sapien
ggcagagcaacacttcgtctcagaa

SEQ ID NO: 124794 - DNA, 25 bp, Homo sapien
gcagagcaacacttcgtctcagaaa

SEQ ID NO: 124795 - DNA, 25 bp, Homo sapien
caaagctgtagtgagctgtcattgt

SEQ ID NO: 124796 - DNA, 25 bp, Homo sapien
aaagctgtagtgagctgtcattgtg

SEQ ID NO: 124797 - DNA, 25 bp, Homo sapien
gctgtcattgtgccactatcctcca

SEQ ID NO: 124798 - DNA, 25 bp, Homo sapien
ctgtcattgtgccactatcctccag

SEQ ID NO: 124799 - DNA, 25 bp, Homo sapien
tgtcattgtgccactatcctccagt

SEQ ID NO: 124800 - DNA, 25 bp, Homo sapien
gtcattgtgccactatcctccagta

SEQ ID NO: 124801 - DNA, 25 bp, Homo sapien
tcattgtgccactatcctccagtat

SEQ ID NO: 124802 - DNA, 25 bp, Homo sapien
aaggcagagccaccagaaacgtaca

SEQ ID NO: 124803 - DNA, 25 bp, Homo sapien
aacgtacacctgattttcatgacaa

SEQ ID NO: 124804 - DNA, 25 bp, Homo sapien
tacggtaatgctgtattagctagtg

SEQ ID NO: 124805 - DNA, 25 bp, Homo sapien
gagccactttctgtattgttacatg

SEQ ID NO: 124806 - DNA, 25 bp, Homo sapien
gccactttctgtattgttacatgga

SEQ ID NO: 124807 - DNA, 25 bp, Homo sapien
cactttctgtattgttacatggaca

SEQ ID NO: 124808 - DNA, 25 bp, Homo sapien
ctttctgtattgttacatggacata

SEQ ID NO: 124809 - DNA, 25 bp, Homo sapien
gttacatggacatatgtagcaacac

SEQ ID NO: 124810 - DNA, 25 bp, Homo sapien
catggacatatgtagcaacacaagt

SEQ ID NO: 124811 - DNA, 25 bp, Homo sapien
gaatcagtaatcatcccagctggtg

SEQ ID NO: 124812 - DNA, 25 bp, Homo sapien
taaagcactgtgtacccattaagat

SEQ ID NO: 124813 - DNA, 25 bp, Homo sapien
atgtaatcctaaatttaccctcttg

SEQ ID NO: 124814 - DNA, 25 bp, Homo sapien
taccctcttgaatataatccctgga

SEQ ID NO: 124815 - DNA, 25 bp, Homo sapien
taatccctggatgatattttttatc

SEQ ID NO: 124816 - DNA, 25 bp, Homo sapien
gcaagttaagtgtcctccatcaatt

SEQ ID NO: 124817 - DNA, 25 bp, Homo sapien
taagtgtcctccatcaattctgtat

SEQ ID NO: 124818 - DNA, 25 bp, Homo sapien
aattctgtattccagacttgggagg

SEQ ID NO: 124819 - DNA, 25 bp, Homo sapien
cttgggaggatgtacagttgctgtt

SEQ ID NO: 124820 - DNA, 25 bp, Homo sapien
gtacagttgctgttgtgtgatcaaa

SEQ ID NO: 124821 - DNA, 25 bp, Homo sapien
gtgtgatcaaacatgtctctgtgta

SEQ ID NO: 124822 - DNA, 25 bp, Homo sapien
acatgtctctgtgtagttccagcaa

SEQ ID NO: 124823 - DNA, 25 bp, Homo sapien
gttccagcaaatcaagctgagcttt

SEQ ID NO: 124824 - DNA, 25 bp, Homo sapien
tctttagacgacctcttccaaaaga

SEQ ID NO: 124825 - DNA, 25 bp, Homo sapien
gagaaatgtacaaatctttcatcca

SEQ ID NO: 124826 - DNA, 25 bp, Homo sapien
aaatctttcatccatacctgtgcat

SEQ ID NO: 124827 - DNA, 25 bp, Homo sapien
atctttcatccatacctgtgcatga

SEQ ID NO: 124828 - DNA, 25 bp, Homo sapien
catccatacctgtgcatgagctgta

SEQ ID NO: 124829 - DNA, 25 bp, Homo sapien
gcatgagctgtattcttcacagcaa

SEQ ID NO: 124830 - DNA, 25 bp, Homo sapien
acagcaacagagctcagttaaatgc

SEQ ID NO: 124831 - DNA, 25 bp, Homo sapien
gagctcagttaaatgcaactgcaag

SEQ ID NO: 124832 - DNA, 25 bp, Homo sapien
agttaaatgcaactgcaagtaggtt

SEQ ID NO: 124833 - DNA, 25 bp, Homo sapien
gataaaagttcttccagtcagtttt

SEQ ID NO: 124834 - DNA, 25 bp, Homo sapien
tcagtttttctcttaagtgcctgtt

SEQ ID NO: 124835 - DNA, 25 bp, Homo sapien
tcattggagcggtgggcactgttaa

SEQ ID NO: 124836 - DNA, 25 bp, Homo sapien
gcactgttaagaagcagccatcaca

SEQ ID NO: 124837 - DNA, 25 bp, Homo sapien
agcagccatcacatgatctgttttt

SEQ ID NO: 124838 - DNA, 25 bp, Homo sapien
gatctgtttttcaccacttcactga

SEQ ID NO: 124839 - DNA, 25 bp, Homo sapien
ccacttcactgaaagacaccattta

SEQ ID NO: 124840 - DNA, 25 bp, Homo sapien
caccatttatatacccaagggcaga

SEQ ID NO: 124841 - DNA, 25 bp, Homo sapien
ggaattgtctttaatttctgtcaga

SEQ ID NO: 124842 - DNA, 25 bp, Homo sapien
aaatgtgaattgcatgacttgtagc

SEQ ID NO: 124843 - DNA, 25 bp, Homo sapien
gacttgtagcatattcttttctgca

SEQ ID NO: 124844 - DNA, 25 bp, Homo sapien
attaacatgcttatgacaatgactg

SEQ ID NO: 124845 - DNA, 25 bp, Homo sapien
aatgactgtgctactgtctttggaa

SEQ ID NO: 124846 - DNA, 25 bp, Homo sapien
gggtccaacatagaacagggtgtcc

SEQ ID NO: 124847 - DNA, 25 bp, Homo sapien
agaacagggtgtccccaacagcgcc

SEQ ID NO: 124848 - DNA, 25 bp, Homo sapien
aacagcgcccaaaggacgcactgag

SEQ ID NO: 124849 - DNA, 25 bp, Homo sapien
aaaggacgcactgagcaacgctatt

SEQ ID NO: 124850 - DNA, 25 bp, Homo sapien
actgagcaacgctattccagctgtc

SEQ ID NO: 124851 - DNA, 25 bp, Homo sapien
accccattcccgcagtgggagcaaa

SEQ ID NO: 124852 - DNA, 25 bp, Homo sapien
gggagcaaactgcatgcccagagac

SEQ ID NO: 124853 - DNA, 25 bp, Homo sapien
agagacccagcggacacacgcggtt

SEQ ID NO: 124854 - DNA, 25 bp, Homo sapien
acacgcggtttggtttgcagcgact

SEQ ID NO: 124855 - DNA, 25 bp, Homo sapien
gcagcgactggcatactatgtggat

SEQ ID NO: 124856 - DNA, 25 bp, Homo sapien
ctatgtggatgtgacagtggcgttt

SEQ ID NO: 124857 - DNA, 25 bp, Homo sapien
tgaggagcggtccttccacaccagc

SEQ ID NO: 124858 - DNA, 25 bp, Homo sapien
cagccgcaacccaagcagatgacag

SEQ ID NO: 124859 - DNA, 25 bp, Homo sapien
agccgcaacccaagcagatgacagg

SEQ ID NO: 124860 - DNA, 25 bp, Homo sapien
acaggccaccgcatgaggagatgga

SEQ ID NO: 124861 - DNA, 25 bp, Homo sapien
atggagggcgggactgggccgccca

SEQ ID NO: 124862 - DNA, 25 bp, Homo sapien
agagccacccaatgaacagtgcaat

SEQ ID NO: 124863 - DNA, 25 bp, Homo sapien
gccacccaatgaacagtgcaatgtg

SEQ ID NO: 124864 - DNA, 25 bp, Homo sapien
tgaacagtgcaatgtgaaggaaggc

SEQ ID NO: 124865 - DNA, 25 bp, Homo sapien
gcccagctgccagaaagcacagatt

SEQ ID NO: 124866 - DNA, 25 bp, Homo sapien
tgccagaaagcacagatttgaccca

SEQ ID NO: 124867 - DNA, 25 bp, Homo sapien
ccagaaagcacagatttgacccaag

SEQ ID NO: 124868 - DNA, 25 bp, Homo sapien
aattgtgactgtccctcctgatgta

SEQ ID NO: 124869 - DNA, 25 bp, Homo sapien
tgcgctcggtgctcatgtccctgaa

SEQ ID NO: 124870 - DNA, 25 bp, Homo sapien
tcggtgctcatgtccctgaagcaga

SEQ ID NO: 124871 - DNA, 25 bp, Homo sapien
gtgctcatgtccctgaagcagacgc

SEQ ID NO: 124872 - DNA, 25 bp, Homo sapien
atgtccctgaagcagacgccactgt

SEQ ID NO: 124873 - DNA, 25 bp, Homo sapien
tgaagcagacgccactgtcccgcta

SEQ ID NO: 124874 - DNA, 25 bp, Homo sapien
tgtcccgctaggtgcctgctaggtg

SEQ ID NO: 124875 - DNA, 25 bp, Homo sapien
tgcctgctaggtgcatggccacaga

SEQ ID NO: 124876 - DNA, 25 bp, Homo sapien
tgctaggtgcatggccacagagcat

SEQ ID NO: 124877 - DNA, 25 bp, Homo sapien
ctcctctcagtctactcaattgtga

SEQ ID NO: 124878 - DNA, 25 bp, Homo sapien
gtctactcaattgtgactgtccctc

SEQ ID NO: 124879 - DNA, 25 bp, Homo sapien
ggtgtcagactgaggatttcgcttc

SEQ ID NO: 124880 - DNA, 25 bp, Homo sapien
tgtcagactgaggatttcgcttccc

SEQ ID NO: 124881 - DNA, 25 bp, Homo sapien
tcagactgaggatttcgcttcccct

SEQ ID NO: 124882 - DNA, 25 bp, Homo sapien
tgaggatttcgcttcccctccaaga

SEQ ID NO: 124883 - DNA, 25 bp, Homo sapien
ccggaagatgtgtacagctggtctt

SEQ ID NO: 124884 - DNA, 25 bp, Homo sapien
gatgtgtacagctggtctttactcc

SEQ ID NO: 124885 - DNA, 25 bp, Homo sapien
tgtgtacagctggtctttactccat

SEQ ID NO: 124886 - DNA, 25 bp, Homo sapien
gtacagctggtctttactccatcgg

SEQ ID NO: 124887 - DNA, 25 bp, Homo sapien
agctggtctttactccatcggcagg

SEQ ID NO: 124888 - DNA, 25 bp, Homo sapien
tctttactccatcggcaggcccgag

SEQ ID NO: 124889 - DNA, 25 bp, Homo sapien
ttgtgggcaccggagcttgagagag

SEQ ID NO: 124890 - DNA, 25 bp, Homo sapien
cctgagtggacagcagtgtcccggc

SEQ ID NO: 124891 - DNA, 25 bp, Homo sapien
acaggcccatcgagccgggtccagt

SEQ ID NO: 124892 - DNA, 25 bp, Homo sapien
agtacccaaccttcgcacgagtgtg

SEQ ID NO: 124893 - DNA, 25 bp, Homo sapien
cgcacgagtgtgttgcacgtttaca

SEQ ID NO: 124894 - DNA, 25 bp, Homo sapien
acgtttacacaggtgggctgcccca

SEQ ID NO: 124895 - DNA, 25 bp, Homo sapien
ccctgcactacctattttgtgagtc

SEQ ID NO: 124896 - DNA, 25 bp, Homo sapien
attttgtgagtctcgtgacccgggt

SEQ ID NO: 124897 - DNA, 25 bp, Homo sapien
gggctgcggagttctatattcacat

SEQ ID NO: 124898 - DNA, 25 bp, Homo sapien
attcacatatgcaaacctcctgcct

SEQ ID NO: 124899 - DNA, 25 bp, Homo sapien
tgactcgctagtccctgcaaatatg

SEQ ID NO: 124900 - DNA, 25 bp, Homo sapien
tactactgcacacccgggcagtgct

SEQ ID NO: 124901 - DNA, 25 bp, Homo sapien
aagggaagccctgacaacaactatc

SEQ ID NO: 124902 - DNA, 25 bp, Homo sapien
gccctgacaacaactatcaccaaaa

SEQ ID NO: 124903 - DNA, 25 bp, Homo sapien
tatcaccaaaagacgaggcggcaaa

SEQ ID NO: 124904 - DNA, 25 bp, Homo sapien
attattagcaccagcttgcttctct

SEQ ID NO: 124905 - DNA, 25 bp, Homo sapien
tcagggctgtgctttccgcgtggtt

SEQ ID NO: 124906 - DNA, 25 bp, Homo sapien
tgtgctttccgcgtggttctgccac

SEQ ID NO: 124907 - DNA, 25 bp, Homo sapien
ttctgccacttagggagtgtgcctt

SEQ ID NO: 124908 - DNA, 25 bp, Homo sapien
tgggcgggccatttcacattcctga

SEQ ID NO: 124909 - DNA, 25 bp, Homo sapien
atttcacattcctgaccctcacttt

SEQ ID NO: 124910 - DNA, 25 bp, Homo sapien
atctgtaaaaccaggctgatgccgt

SEQ ID NO: 124911 - DNA, 25 bp, Homo sapien
aaccaggctgatgccgtgcgggcta

SEQ ID NO: 124912 - DNA, 25 bp, Homo sapien
gcataatcaataactcgcatatgaa

SEQ ID NO: 124913 - DNA, 25 bp, Homo sapien
gggagtactcttgtacagccagttc

SEQ ID NO: 124914 - DNA, 25 bp, Homo sapien
gtacagccagttcttttatgcaaaa

SEQ ID NO: 124915 - DNA, 25 bp, Homo sapien
aaatctatgcatttttacaatctta

SEQ ID NO: 124916 - DNA, 25 bp, Homo sapien
acagtttagtgtatctggtttctac

SEQ ID NO: 124917 - DNA, 25 bp, Homo sapien
gtatctggtttctacatggaagact

SEQ ID NO: 124918 - DNA, 25 bp, Homo sapien
tggaagactaaactcatgcttattg

SEQ ID NO: 124919 - DNA, 25 bp, Homo sapien
gtggtctttgccaactaaatttaag

SEQ ID NO: 124920 - DNA, 25 bp, Homo sapien
gccaactaaatttaagatgcagcat

SEQ ID NO: 124921 - DNA, 25 bp, Homo sapien
gatgcagcattttagaaatttacat

SEQ ID NO: 124922 - DNA, 25 bp, Homo sapien
gtttctacagtattgtttgctaatt

SEQ ID NO: 124923 - DNA, 25 bp, Homo sapien
caggtccccttgtggtgttgccaga

SEQ ID NO: 124924 - DNA, 25 bp, Homo sapien
tgtggtgttgccagacgggcctcat

SEQ ID NO: 124925 - DNA, 25 bp, Homo sapien
ggcctcatggtctgctgtgcagaga

SEQ ID NO: 124926 - DNA, 25 bp, Homo sapien
gagaaaaggttctgtgccctcaggt

SEQ ID NO: 124927 - DNA, 25 bp, Homo sapien
gcttaccccctcgtatttataatct

SEQ ID NO: 124928 - DNA, 25 bp, Homo sapien
aatttatatagtgaccaccgtggaa

SEQ ID NO: 124929 - DNA, 25 bp, Homo sapien
caccgtggaaacaaacgcctcttgt

SEQ ID NO: 124930 - DNA, 25 bp, Homo sapien
aaacgcctcttgtattgtcatgtac

SEQ ID NO: 124931 - DNA, 25 bp, Homo sapien
gtcatgtacatagtccatacctgag

SEQ ID NO: 124932 - DNA, 25 bp, Homo sapien
tagtccatacctgagtgctgtacat

SEQ ID NO: 124933 - DNA, 25 bp, Homo sapien
gtgctgtacataagttgttctgtgt

SEQ ID NO: 124934 - DNA, 25 bp, Homo sapien
agcagcaacaggagcgcgcgcatct

SEQ ID NO: 124935 - DNA, 25 bp, Homo sapien
gcgcgcatctgctggcccgcaagtg

SEQ ID NO: 124936 - DNA, 25 bp, Homo sapien
cagctgcagaaggacgtggcgtcct

SEQ ID NO: 124937 - DNA, 25 bp, Homo sapien
gcagaaggacgtggcgtcctaccac

SEQ ID NO: 124938 - DNA, 25 bp, Homo sapien
gagaaacttcctctttttcatgaag

SEQ ID NO: 124939 - DNA, 25 bp, Homo sapien
aacagctgacccaagaagttgcttg

SEQ ID NO: 124940 - DNA, 25 bp, Homo sapien
ctgctggattccctggttaattcag

SEQ ID NO: 124941 - DNA, 25 bp, Homo sapien
tccctggttaattcagcttgagctg

SEQ ID NO: 124942 - DNA, 25 bp, Homo sapien
cagcttgagctgaaaagcttcctgg

SEQ ID NO: 124943 - DNA, 25 bp, Homo sapien
ctggaagtggagagatccttctgct

SEQ ID NO: 124944 - DNA, 25 bp, Homo sapien
taatctgagtagtctgtagcttgag

SEQ ID NO: 124945 - DNA, 25 bp, Homo sapien
ggctctgccaccctacctgttcagt

SEQ ID NO: 124946 - DNA, 25 bp, Homo sapien
cccgggcccgttgaggatgaggccg

SEQ ID NO: 124947 - DNA, 25 bp, Homo sapien
gcccgttgaggatgaggccgctaga

SEQ ID NO: 124948 - DNA, 25 bp, Homo sapien
cccgttgaggatgaggccgctagag

SEQ ID NO: 124949 - DNA, 25 bp, Homo sapien
atgaggccgctagaggcctgaggat

SEQ ID NO: 124950 - DNA, 25 bp, Homo sapien
gccgctagaggcctgaggatgagct

SEQ ID NO: 124951 - DNA, 25 bp, Homo sapien
cgctagaggcctgaggatgagctgg

SEQ ID NO: 124952 - DNA, 25 bp, Homo sapien
ggtgctgggactgagccagtcccag

SEQ ID NO: 124953 - DNA, 25 bp, Homo sapien
tgtcctccccttgggcggctgagag

SEQ ID NO: 124954 - DNA, 25 bp, Homo sapien
ttgggcggctgagagccccagctga

SEQ ID NO: 124955 - DNA, 25 bp, Homo sapien
ggctgagagccccagctgacatgga

SEQ ID NO: 124956 - DNA, 25 bp, Homo sapien
aaggtgctgtaaacaggtttgggca

SEQ ID NO: 124957 - DNA, 25 bp, Homo sapien
agaggcggctcaggttgcccagctc

SEQ ID NO: 124958 - DNA, 25 bp, Homo sapien
aggcggctcaggttgcccagctctg

SEQ ID NO: 124959 - DNA, 25 bp, Homo sapien
tgtggcctcaggactctctgcctca

SEQ ID NO: 124960 - DNA, 25 bp, Homo sapien
gcccctggagactgatcccctctga

SEQ ID NO: 124961 - DNA, 25 bp, Homo sapien
ccttccaaggacactaatgagcctg

SEQ ID NO: 124962 - DNA, 25 bp, Homo sapien
caaggacactaatgagcctgggagg

SEQ ID NO: 124963 - DNA, 25 bp, Homo sapien
cagcttcacccttggaagtcctggg

SEQ ID NO: 124964 - DNA, 25 bp, Homo sapien
cctcttccttctttgtggtttctgt

SEQ ID NO: 124965 - DNA, 25 bp, Homo sapien
gaagagctattcatcactgtaatta

SEQ ID NO: 124966 - DNA, 25 bp, Homo sapien
gagctattcatcactgtaattatta

SEQ ID NO: 124967 - DNA, 25 bp, Homo sapien
tggccgcagcagatgccctcccagg

SEQ ID NO: 124968 - DNA, 25 bp, Homo sapien
aggccttcgggaagaggcttcctgg

SEQ ID NO: 124969 - DNA, 25 bp, Homo sapien
gaaactcagcgcctgctgcacttgc

SEQ ID NO: 124970 - DNA, 25 bp, Homo sapien
tcccctgtcatttcatcgcggactg

SEQ ID NO: 124971 - DNA, 25 bp, Homo sapien
ccctgtcatttcatcgcggactgtg

SEQ ID NO: 124972 - DNA, 25 bp, Homo sapien
ctgtcatttcatcgcggactgtgcg

SEQ ID NO: 124973 - DNA, 25 bp, Homo sapien
atttcatcgcggactgtgcggcctg

SEQ ID NO: 124974 - DNA, 25 bp, Homo sapien
ggcgggactctcacggtgacatgtt

SEQ ID NO: 124975 - DNA, 25 bp, Homo sapien
gcgggactctcacggtgacatgttt

SEQ ID NO: 124976 - DNA, 25 bp, Homo sapien
gggactctcacggtgacatgtttac

SEQ ID NO: 124977 - DNA, 25 bp, Homo sapien
actctcacggtgacatgtttacagc

SEQ ID NO: 124978 - DNA, 25 bp, Homo sapien
acaagcccttgaccttatctaacta

SEQ ID NO: 124979 - DNA, 25 bp, Homo sapien
gaccttatctaactaccagaccaac

SEQ ID NO: 124980 - DNA, 25 bp, Homo sapien
taccagaccaacaaagccaagcatg

SEQ ID NO: 124981 - DNA, 25 bp, Homo sapien
gccaagcatgatgagctgacctatt

SEQ ID NO: 124982 - DNA, 25 bp, Homo sapien
gcatgatgagctgacctatttctga

SEQ ID NO: 124983 - DNA, 25 bp, Homo sapien
atgagctgacctatttctgatcctg

SEQ ID NO: 124984 - DNA, 25 bp, Homo sapien
agctgacctatttctgatcctgact

SEQ ID NO: 124985 - DNA, 25 bp, Homo sapien
gacctatttctgatcctgactttgg

SEQ ID NO: 124986 - DNA, 25 bp, Homo sapien
gatcctaaaataagcttcatctccg

SEQ ID NO: 124987 - DNA, 25 bp, Homo sapien
aaaataagcttcatctccgctgtgc

SEQ ID NO: 124988 - DNA, 25 bp, Homo sapien
gcttcatctccgctgtgcccttggg

SEQ ID NO: 124989 - DNA, 25 bp, Homo sapien
atcaccagtgccacgtcatgagcgt

SEQ ID NO: 124990 - DNA, 25 bp, Homo sapien
accagtgccacgtcatgagcgtcaa

SEQ ID NO: 124991 - DNA, 25 bp, Homo sapien
gtgccacgtcatgagcgtcaaagaa

SEQ ID NO: 124992 - DNA, 25 bp, Homo sapien
gagcgtcaaagaaaatgcctagaga

SEQ ID NO: 124993 - DNA, 25 bp, Homo sapien
cattatgacatttcttaaaacttta

SEQ ID NO: 124994 - DNA, 25 bp, Homo sapien
gaatgagtgaagtattgctgaaaag

SEQ ID NO: 124995 - DNA, 25 bp, Homo sapien
ttgggtaccatgctttttctcccct

SEQ ID NO: 124996 - DNA, 25 bp, Homo sapien
ttttctccccttcacgtttgcagtt

SEQ ID NO: 124997 - DNA, 25 bp, Homo sapien
ccccttcacgtttgcagttgatgtg

SEQ ID NO: 124998 - DNA, 25 bp, Homo sapien
gtaatatgacagataacctaataat

SEQ ID NO: 124999 - DNA, 25 bp, Homo sapien
ataacctaataattgtatctacatt

SEQ ID NO: 125000 - DNA, 25 bp, Homo sapien
aggtcaggccctggaactctatctg

SEQ ID NO: 125001 - DNA, 25 bp, Homo sapien
ggaactctatctgggcctgggctag

SEQ ID NO: 125002 - DNA, 25 bp, Homo sapien
gggctagggacatcagaggttcttt

SEQ ID NO: 125003 - DNA, 25 bp, Homo sapien
tgacgcaaaaccactttccttttct

SEQ ID NO: 125004 - DNA, 25 bp, Homo sapien
actgcctctgccttagaggagccca

SEQ ID NO: 125005 - DNA, 25 bp, Homo sapien
ctgccttagaggagcccacggctaa

SEQ ID NO: 125006 - DNA, 25 bp, Homo sapien
cccacggctaagaggctgctgaaaa

SEQ ID NO: 125007 - DNA, 25 bp, Homo sapien
aagaggctgctgaaaaccatctggc

SEQ ID NO: 125008 - DNA, 25 bp, Homo sapien
gctgctgaaaaccatctggcctggc

SEQ ID NO: 125009 - DNA, 25 bp, Homo sapien
gggcctagactctgtaacatcacta

SEQ ID NO: 125010 - DNA, 25 bp, Homo sapien
ctgtaacatcactatccgatgcacc

SEQ ID NO: 125011 - DNA, 25 bp, Homo sapien
ttcactttgtcatcagcgagtataa

SEQ ID NO: 125012 - DNA, 25 bp, Homo sapien
cactttgtcatcagcgagtataaca

SEQ ID NO: 125013 - DNA, 25 bp, Homo sapien
aacaaggccactgaagatgagtact

SEQ ID NO: 125014 - DNA, 25 bp, Homo sapien
aagatgagtactacagacgcctgct

SEQ ID NO: 125015 - DNA, 25 bp, Homo sapien
atgagtactacagacgcctgctgcg

SEQ ID NO: 125016 - DNA, 25 bp, Homo sapien
tacagacgcctgctgcgggtgctac

SEQ ID NO: 125017 - DNA, 25 bp, Homo sapien
tgctgcgggtgctacgagccaggga

SEQ ID NO: 125018 - DNA, 25 bp, Homo sapien
tgctacgagccagggagcagatcgt

SEQ ID NO: 125019 - DNA, 25 bp, Homo sapien
agccagggagcagatcgtgggcggg

SEQ ID NO: 125020 - DNA, 25 bp, Homo sapien
gggtgaattacttcttcgacataga

SEQ ID NO: 125021 - DNA, 25 bp, Homo sapien
gacagaatgtccctggtgaattcca

SEQ ID NO: 125022 - DNA, 25 bp, Homo sapien
cttacaaatagatttccatgaagat

SEQ ID NO: 125023 - DNA, 25 bp, Homo sapien
tagatttccatgaagatatttgtct

SEQ ID NO: 125024 - DNA, 25 bp, Homo sapien
ttccatgaagatatttgtcttcaga

SEQ ID NO: 125025 - DNA, 25 bp, Homo sapien
aatatacctttcaatcggccactgg

SEQ ID NO: 125026 - DNA, 25 bp, Homo sapien
atatacctttcaatcggccactggc

SEQ ID NO: 125027 - DNA, 25 bp, Homo sapien
tatacctttcaatcggccactggcc

SEQ ID NO: 125028 - DNA, 25 bp, Homo sapien
atacctttcaatcggccactggcca

SEQ ID NO: 125029 - DNA, 25 bp, Homo sapien
caattaagtgggaattttctggaag

SEQ ID NO: 125030 - DNA, 25 bp, Homo sapien
aagtgggaattttctggaagatggt

SEQ ID NO: 125031 - DNA, 25 bp, Homo sapien
aagatggtcagctatgaagtaatag

SEQ ID NO: 125032 - DNA, 25 bp, Homo sapien
taaattgtaccaatcacaagaaaat

SEQ ID NO: 125033 - DNA, 25 bp, Homo sapien
gacaaagtcgaaagtttaacaggct

SEQ ID NO: 125034 - DNA, 25 bp, Homo sapien
agtttaacaggcttttctcatgaag

SEQ ID NO: 125035 - DNA, 25 bp, Homo sapien
ttctcatgaagaactagacgactct

SEQ ID NO: 125036 - DNA, 25 bp, Homo sapien
gaactagacgactcttggtaaccat

SEQ ID NO: 125037 - DNA, 25 bp, Homo sapien
cgactcttggtaaccatgtttgctg

SEQ ID NO: 125038 - DNA, 25 bp, Homo sapien
atgtttgctgcccagcttctaactt

SEQ ID NO: 125039 - DNA, 25 bp, Homo sapien
ccagcttctaacttacataccgtga

SEQ ID NO: 125040 - DNA, 25 bp, Homo sapien
taccgtgagaagttacgtaacattt

SEQ ID NO: 125041 - DNA, 25 bp, Homo sapien
gtaaatgtttccctatcatcagaca

SEQ ID NO: 125042 - DNA, 25 bp, Homo sapien
aaatgtgtgtaatccaatgtgggtt

SEQ ID NO: 125043 - DNA, 25 bp, Homo sapien
gataccatagtgtgtgaaccaagaa

SEQ ID NO: 125044 - DNA, 25 bp, Homo sapien
gaattccgctgactctaatttatga

SEQ ID NO: 125045 - DNA, 25 bp, Homo sapien
actctaatttatgaggatgccgaac

SEQ ID NO: 125046 - DNA, 25 bp, Homo sapien
atttatgaggatgccgaactctgat

SEQ ID NO: 125047 - DNA, 25 bp, Homo sapien
tatgaggatgccgaactctgatggc

SEQ ID NO: 125048 - DNA, 25 bp, Homo sapien
tgaggatgccgaactctgatggcaa

SEQ ID NO: 125049 - DNA, 25 bp, Homo sapien
tgaagttatgatttccgatgaccct

SEQ ID NO: 125050 - DNA, 25 bp, Homo sapien
aagttatgatttccgatgaccctaa

SEQ ID NO: 125051 - DNA, 25 bp, Homo sapien
gttatgatttccgatgaccctaagt

SEQ ID NO: 125052 - DNA, 25 bp, Homo sapien
tatgatttccgatgaccctaagtcc

SEQ ID NO: 125053 - DNA, 25 bp, Homo sapien
atgatttccgatgaccctaagtccc

SEQ ID NO: 125054 - DNA, 25 bp, Homo sapien
gatttccgatgaccctaagtccctt

SEQ ID NO: 125055 - DNA, 25 bp, Homo sapien
tggccaggcattgtgactggcagct

SEQ ID NO: 125056 - DNA, 25 bp, Homo sapien
ttctaaatggacctcctacaatgaa

SEQ ID NO: 125057 - DNA, 25 bp, Homo sapien
aatgaaaaccagtcccaccgtgtat

SEQ ID NO: 125058 - DNA, 25 bp, Homo sapien
caccgtgtatcctgtggacaatctc

SEQ ID NO: 125059 - DNA, 25 bp, Homo sapien
tgtggacaatctccctgcaagattc

SEQ ID NO: 125060 - DNA, 25 bp, Homo sapien
ctgcaagattcacccatttccatgg

SEQ ID NO: 125061 - DNA, 25 bp, Homo sapien
gggaaatctgatgagcttgaatgtt

SEQ ID NO: 125062 - DNA, 25 bp, Homo sapien
gatgagcttgaatgttcaaacctga

SEQ ID NO: 125063 - DNA, 25 bp, Homo sapien
ttaaggagtgttgtgttgactttat

SEQ ID NO: 125064 - DNA, 25 bp, Homo sapien
tttatgtgttttgactatactacca

SEQ ID NO: 125065 - DNA, 25 bp, Homo sapien
gactatactaccacaatctttaaat

SEQ ID NO: 125066 - DNA, 25 bp, Homo sapien
acccttctcagagttccagtttcaa

SEQ ID NO: 125067 - DNA, 25 bp, Homo sapien
cttctcagagttccagtttcaacca

SEQ ID NO: 125068 - DNA, 25 bp, Homo sapien
cagagttccagtttcaaccagagtt

SEQ ID NO: 125069 - DNA, 25 bp, Homo sapien
aaccagagttccaaccaatgggctc

SEQ ID NO: 125070 - DNA, 25 bp, Homo sapien
agagttccaaccaatgggctccatc

SEQ ID NO: 125071 - DNA, 25 bp, Homo sapien
agttccaaccaatgggctccatcct

SEQ ID NO: 125072 - DNA, 25 bp, Homo sapien
gattctggccaatgaaatatctccc

SEQ ID NO: 125073 - DNA, 25 bp, Homo sapien
caatgaaatatctccctggcagggt

SEQ ID NO: 125074 - DNA, 25 bp, Homo sapien
tgaaatatctccctggcagggtcct

SEQ ID NO: 125075 - DNA, 25 bp, Homo sapien
accaggagctctagttaatggagag

SEQ ID NO: 125076 - DNA, 25 bp, Homo sapien
taatggagagctcccagcacactcg

SEQ ID NO: 125077 - DNA, 25 bp, Homo sapien
tccgtggcacttgtaactcaccgtg

SEQ ID NO: 125078 - DNA, 25 bp, Homo sapien
gtaactcaccgtgctgtcttctggt

SEQ ID NO: 125079 - DNA, 25 bp, Homo sapien
tgctgtcttctggtctgtgtgtgtt

SEQ ID NO: 125080 - DNA, 25 bp, Homo sapien
aagccagctctaggcttcaggccga

SEQ ID NO: 125081 - DNA, 25 bp, Homo sapien
ggccgagccaggttcacactcagaa

SEQ ID NO: 125082 - DNA, 25 bp, Homo sapien
agccaggttcacactcagaaagatg

SEQ ID NO: 125083 - DNA, 25 bp, Homo sapien
atggctgcccctgcgtggcctgagt

SEQ ID NO: 125084 - DNA, 25 bp, Homo sapien
gagtcctggtccctctgaggcagtt

SEQ ID NO: 125085 - DNA, 25 bp, Homo sapien
tcctttgtaatcactcccattttta

SEQ ID NO: 125086 - DNA, 25 bp, Homo sapien
taatcactcccatttttacttaaca

SEQ ID NO: 125087 - DNA, 25 bp, Homo sapien
aaccaacttgttgtggctcttattt

SEQ ID NO: 125088 - DNA, 25 bp, Homo sapien
gagccactttctgtattgttacatg

SEQ ID NO: 125089 - DNA, 25 bp, Homo sapien
agccactttctgtattgttacatgg

SEQ ID NO: 125090 - DNA, 25 bp, Homo sapien
gccactttctgtattgttacatgga

SEQ ID NO: 125091 - DNA, 25 bp, Homo sapien
ccactttctgtattgttacatggac

SEQ ID NO: 125092 - DNA, 25 bp, Homo sapien
cactttctgtattgttacatggaca

SEQ ID NO: 125093 - DNA, 25 bp, Homo sapien
actttctgtattgttacatggacat

SEQ ID NO: 125094 - DNA, 25 bp, Homo sapien
ctttctgtattgttacatggacata

SEQ ID NO: 125095 - DNA, 25 bp, Homo sapien
ttctgtattgttacatggacatatg

SEQ ID NO: 125096 - DNA, 25 bp, Homo sapien
gtattgttacatggacatatgtagc

SEQ ID NO: 125097 - DNA, 25 bp, Homo sapien
gttacatggacatatgtagcaacac

SEQ ID NO: 125098 - DNA, 25 bp, Homo sapien
catggacatatgtagcaacacaagt

SEQ ID NO: 125099 - DNA, 25 bp, Homo sapien
agatccccttgaaattagacacgca

SEQ ID NO: 125100 - DNA, 25 bp, Homo sapien
ttagacacgcaaggacttcttcaac

SEQ ID NO: 125101 - DNA, 25 bp, Homo sapien
ccattgttctaaaggtggattcaag

SEQ ID NO: 125102 - DNA, 25 bp, Homo sapien
ggtggattcaagagatggaacccta

SEQ ID NO: 125103 - DNA, 25 bp, Homo sapien
agagatggaaccctaagtggagaat

SEQ ID NO: 125104 - DNA, 25 bp, Homo sapien
accctaagtggagaatgagttattc

SEQ ID NO: 125105 - DNA, 25 bp, Homo sapien
gagttattctaaggacttctacttt

SEQ ID NO: 125106 - DNA, 25 bp, Homo sapien
tctaaggacttctactttggtcttc

SEQ ID NO: 125107 - DNA, 25 bp, Homo sapien
actttggtcttcaagaaagctgtgc

SEQ ID NO: 125108 - DNA, 25 bp, Homo sapien
agaacaccagagatttcaacttagt

SEQ ID NO: 125109 - DNA, 25 bp, Homo sapien
accagagatttcaacttagtcaata

SEQ ID NO: 125110 - DNA, 25 bp, Homo sapien
gttgaaatccaacacctcagcgatg

SEQ ID NO: 125111 - DNA, 25 bp, Homo sapien
aacacctcagcgatgtgggcaccac

SEQ ID NO: 125112 - DNA, 25 bp, Homo sapien
tgtgggcaccacattcaacctcatt

SEQ ID NO: 125113 - DNA, 25 bp, Homo sapien
cacattcaacctcattctgatgcct

SEQ ID NO: 125114 - DNA, 25 bp, Homo sapien
accaggaagcaacccagcagtgatc

SEQ ID NO: 125115 - DNA, 25 bp, Homo sapien
gaagcaacccagcagtgatcagaga

SEQ ID NO: 125116 - DNA, 25 bp, Homo sapien
cagtgatcagagaggatggcctgca

SEQ ID NO: 125117 - DNA, 25 bp, Homo sapien
ggtctctgcatcttcagtcgtctgt

SEQ ID NO: 125118 - DNA, 25 bp, Homo sapien
tcagtcgtctgtcccaagtcctgct

SEQ ID NO: 125119 - DNA, 25 bp, Homo sapien
cctgctcagcaggttgaatgggttc

SEQ ID NO: 125120 - DNA, 25 bp, Homo sapien
ttgaatgggttctcagtggtcacct

SEQ ID NO: 125121 - DNA, 25 bp, Homo sapien
ccatgtagtttgtaccatcactaaa

SEQ ID NO: 125122 - DNA, 25 bp, Homo sapien
accatcactaaatgcttggaacagt

SEQ ID NO: 125123 - DNA, 25 bp, Homo sapien
ggaacagtacacatgcaccacaaca

SEQ ID NO: 125124 - DNA, 25 bp, Homo sapien
atgcaccacaacaaaggctcatcaa

SEQ ID NO: 125125 - DNA, 25 bp, Homo sapien
aaaggctcatcaaacaggtaaagtc

SEQ ID NO: 125126 - DNA, 25 bp, Homo sapien
gaacgaaatctctcattgtgtgccg

SEQ ID NO: 125127 - DNA, 25 bp, Homo sapien
aaatctctcattgtgtgccgtgtgg

SEQ ID NO: 125128 - DNA, 25 bp, Homo sapien
gtgccgtgtggctcaaaaccgaaaa

SEQ ID NO: 125129 - DNA, 25 bp, Homo sapien
tttgttttcctctcagactttatgg

SEQ ID NO: 125130 - DNA, 25 bp, Homo sapien
ctttatggataatgtgaccgggtct

SEQ ID NO: 125131 - DNA, 25 bp, Homo sapien
gtgaccgggtcttatgcaaattttc

SEQ ID NO: 125132 - DNA, 25 bp, Homo sapien
aaatgctcgtgtgatttcctacaga

SEQ ID NO: 125133 - DNA, 25 bp, Homo sapien
aaggtctttgcacatgtgaccacat

SEQ ID NO: 125134 - DNA, 25 bp, Homo sapien
ccacatacgtgttaggaggctgcat

SEQ ID NO: 125135 - DNA, 25 bp, Homo sapien
tgcatgctctggaagcctggactct

SEQ ID NO: 125136 - DNA, 25 bp, Homo sapien
aagcctggactctaagctggagctc

SEQ ID NO: 125137 - DNA, 25 bp, Homo sapien
agagctcttcggtttctgagcataa

SEQ ID NO: 125138 - DNA, 25 bp, Homo sapien
tgagcataatgctcccatctcctga

SEQ ID NO: 125139 - DNA, 25 bp, Homo sapien
ccatctcctgatttctctgaacaga

SEQ ID NO: 125140 - DNA, 25 bp, Homo sapien
tgtattcatgaacttggctgtaatc

SEQ ID NO: 125141 - DNA, 25 bp, Homo sapien
gctgtaatcagttatgccgtatagg

SEQ ID NO: 125142 - DNA, 25 bp, Homo sapien
tatgccgtataggatgtcagacaat

SEQ ID NO: 125143 - DNA, 25 bp, Homo sapien
actagaccaagcgaagggcagccca

SEQ ID NO: 125144 - DNA, 25 bp, Homo sapien
gggcagcccaccaccgtatatcaaa

SEQ ID NO: 125145 - DNA, 25 bp, Homo sapien
gtatatcaaacctcacttccgaatg

SEQ ID NO: 125146 - DNA, 25 bp, Homo sapien
taaaaggctcacttgcctttggctt

SEQ ID NO: 125147 - DNA, 25 bp, Homo sapien
gcctttggcttcctgttgacttctt

SEQ ID NO: 125148 - DNA, 25 bp, Homo sapien
ttcttcccgacccagaaagcatggg

SEQ ID NO: 125149 - DNA, 25 bp, Homo sapien
aatgttgttggttactgttgctccc

SEQ ID NO: 125150 - DNA, 25 bp, Homo sapien
tgtttttccagcaaaccacgctaac

SEQ ID NO: 125151 - DNA, 25 bp, Homo sapien
acgctaactagctgaccacagactc

SEQ ID NO: 125152 - DNA, 25 bp, Homo sapien
cagtatgtggcatggcggcagttac

SEQ ID NO: 125153 - DNA, 25 bp, Homo sapien
gcatggcggcagttacatattatta

SEQ ID NO: 125154 - DNA, 25 bp, Homo sapien
taaagcccctttgtgaaactgttct

SEQ ID NO: 125155 - DNA, 25 bp, Homo sapien
gaaacacaagaaattggccactggt

SEQ ID NO: 125156 - DNA, 25 bp, Homo sapien
ggccactggtaaaactctgcagctt

SEQ ID NO: 125157 - DNA, 25 bp, Homo sapien
ctgtacttcatttaatgccattaat

SEQ ID NO: 125158 - DNA, 25 bp, Homo sapien
atgcaaatatacttcctcttctttt

SEQ ID NO: 125159 - DNA, 25 bp, Homo sapien
cctcttctttttgcatggttttgcc

SEQ ID NO: 125160 - DNA, 25 bp, Homo sapien
tttgcccacctctgcaatagtgata

SEQ ID NO: 125161 - DNA, 25 bp, Homo sapien
aaagcatatttcttggccttgctcc

SEQ ID NO: 125162 - DNA, 25 bp, Homo sapien
ttggccttgctccacaggacatagg

SEQ ID NO: 125163 - DNA, 25 bp, Homo sapien
gctccacaggacataggcaagcctt

SEQ ID NO: 125164 - DNA, 25 bp, Homo sapien
ggcaagccttgatcatagttcatac

SEQ ID NO: 125165 - DNA, 25 bp, Homo sapien
gcacagaaatgcatgcaatacttat

SEQ ID NO: 125166 - DNA, 25 bp, Homo sapien
aatgcatgcaatacttataagactt

SEQ ID NO: 125167 - DNA, 25 bp, Homo sapien
tttacagatggtttatttgtgcata

SEQ ID NO: 125168 - DNA, 25 bp, Homo sapien
tatctaggtatatgctttctctctg

SEQ ID NO: 125169 - DNA, 25 bp, Homo sapien
atctaggtatatgctttctctctgc

SEQ ID NO: 125170 - DNA, 25 bp, Homo sapien
gaattataattcacgtcttgtcata

SEQ ID NO: 125171 - DNA, 25 bp, Homo sapien
aattcacgtcttgtcatatttcatc

SEQ ID NO: 125172 - DNA, 25 bp, Homo sapien
tcacgtcttgtcatatttcatctgt

SEQ ID NO: 125173 - DNA, 25 bp, Homo sapien
cgtcttgtcatatttcatctgtata

SEQ ID NO: 125174 - DNA, 25 bp, Homo sapien
gtcatatttcatctgtataccttca

SEQ ID NO: 125175 - DNA, 25 bp, Homo sapien
ttcatctgtataccttcaaattctc

SEQ ID NO: 125176 - DNA, 25 bp, Homo sapien
cagcctcttcaagtgggcagggtca

SEQ ID NO: 125177 - DNA, 25 bp, Homo sapien
cccacaggcaagcaaactgacaaat

SEQ ID NO: 125178 - DNA, 25 bp, Homo sapien
gcaagcaaactgacaaatccaagag

SEQ ID NO: 125179 - DNA, 25 bp, Homo sapien
ctgacaaatccaagagtaacatgaa

SEQ ID NO: 125180 - DNA, 25 bp, Homo sapien
gtaacatgaaaggtttctaatttct

SEQ ID NO: 125181 - DNA, 25 bp, Homo sapien
gaggaagccccagattacatgtatc

SEQ ID NO: 125182 - DNA, 25 bp, Homo sapien
gaagccccagattacatgtatctga

SEQ ID NO: 125183 - DNA, 25 bp, Homo sapien
atgtatctgaggcagctattccgca

SEQ ID NO: 125184 - DNA, 25 bp, Homo sapien
atctgaggcagctattccgcattct

SEQ ID NO: 125185 - DNA, 25 bp, Homo sapien
agctattccgcattcttttcaggac

SEQ ID NO: 125186 - DNA, 25 bp, Homo sapien
ttcaggaccctgaaccatcaatatg

SEQ ID NO: 125187 - DNA, 25 bp, Homo sapien
gtggccggcatcaagtacttcctga

SEQ ID NO: 125188 - DNA, 25 bp, Homo sapien
aagtacttcctgacgatggagatgg

SEQ ID NO: 125189 - DNA, 25 bp, Homo sapien
ggagcacagactgccgcaagaccag

SEQ ID NO: 125190 - DNA, 25 bp, Homo sapien
agaccagggtcactggagaccacgt

SEQ ID NO: 125191 - DNA, 25 bp, Homo sapien
gaagctgcgctgtgactttgaggtc

SEQ ID NO: 125192 - DNA, 25 bp, Homo sapien
aggtccttgtggttccctggcagaa

SEQ ID NO: 125193 - DNA, 25 bp, Homo sapien
tggcagaactcctctcagctcctaa

SEQ ID NO: 125194 - DNA, 25 bp, Homo sapien
tcagctcctaaagcacaactgtgtg

SEQ ID NO: 125195 - DNA, 25 bp, Homo sapien
gtgtgcagatgtgataagtccccga

SEQ ID NO: 125196 - DNA, 25 bp, Homo sapien
atggtggagggcacttcacgtccgt

SEQ ID NO: 125197 - DNA, 25 bp, Homo sapien
ccgtgggccgtatctgtcacaataa

SEQ ID NO: 125198 - DNA, 25 bp, Homo sapien
gaggaagccccagattacatgtatc

SEQ ID NO: 125199 - DNA, 25 bp, Homo sapien
aggaagccccagattacatgtatct

SEQ ID NO: 125200 - DNA, 25 bp, Homo sapien
gaagccccagattacatgtatctga

SEQ ID NO: 125201 - DNA, 25 bp, Homo sapien
agccccagattacatgtatctgagg

SEQ ID NO: 125202 - DNA, 25 bp, Homo sapien
agattacatgtatctgaggcagcta

SEQ ID NO: 125203 - DNA, 25 bp, Homo sapien
tacatgtatctgaggcagctattcc

SEQ ID NO: 125204 - DNA, 25 bp, Homo sapien
atgtatctgaggcagctattccgca

SEQ ID NO: 125205 - DNA, 25 bp, Homo sapien
tgtatctgaggcagctattccgcat

SEQ ID NO: 125206 - DNA, 25 bp, Homo sapien
gtatctgaggcagctattccgcatt

SEQ ID NO: 125207 - DNA, 25 bp, Homo sapien
tatctgaggcagctattccgcattc

SEQ ID NO: 125208 - DNA, 25 bp, Homo sapien
atctgaggcagctattccgcattct

SEQ ID NO: 125209 - DNA, 25 bp, Homo sapien
ggtgccttaggcaatctttccaaag

SEQ ID NO: 125210 - DNA, 25 bp, Homo sapien
gccttaggcaatctttccaaagtaa

SEQ ID NO: 125211 - DNA, 25 bp, Homo sapien
aaagtaaattcagggccccattgct

SEQ ID NO: 125212 - DNA, 25 bp, Homo sapien
gccccattgctacttatgccatatt

SEQ ID NO: 125213 - DNA, 25 bp, Homo sapien
aacttcctggaaagctgtcttcact

SEQ ID NO: 125214 - DNA, 25 bp, Homo sapien
aagctgtcttcactaagtatcccct

SEQ ID NO: 125215 - DNA, 25 bp, Homo sapien
gtcttcactaagtatcccctagtct

SEQ ID NO: 125216 - DNA, 25 bp, Homo sapien
tgacacataaagtacgccagaagtt

SEQ ID NO: 125217 - DNA, 25 bp, Homo sapien
gtacgccagaagtttgatggaacgt

SEQ ID NO: 125218 - DNA, 25 bp, Homo sapien
aacgtgttagaaactgttttgtgct

SEQ ID NO: 125219 - DNA, 25 bp, Homo sapien
gtcatacttgacaatacatgtgtaa

SEQ ID NO: 125220 - DNA, 25 bp, Homo sapien
ttggctttctccagtccacgtgtag

SEQ ID NO: 125221 - DNA, 25 bp, Homo sapien
tccacgtgtagactttgcgcttgtt

SEQ ID NO: 125222 - DNA, 25 bp, Homo sapien
tagactttgcgcttgtttggatgaa

SEQ ID NO: 125223 - DNA, 25 bp, Homo sapien
cagatcggaagtaactgctccctcc

SEQ ID NO: 125224 - DNA, 25 bp, Homo sapien
cctcctcaaggttgtcttcagacgt

SEQ ID NO: 125225 - DNA, 25 bp, Homo sapien
ggttgtcttcagacgtcttggagac

SEQ ID NO: 125226 - DNA, 25 bp, Homo sapien
gtcttggagacgttcctaaacactg

SEQ ID NO: 125227 - DNA, 25 bp, Homo sapien
ggaagacagccaatagcacccatta

SEQ ID NO: 125228 - DNA, 25 bp, Homo sapien
cactcagctatgctagggcttggct

SEQ ID NO: 125229 - DNA, 25 bp, Homo sapien
ggctgtaggtgtgcactgtctattt

SEQ ID NO: 125230 - DNA, 25 bp, Homo sapien
tgtctatttacatccgtccttacaa

SEQ ID NO: 125231 - DNA, 25 bp, Homo sapien
gaacggactgtgaatccgctctttg

SEQ ID NO: 125232 - DNA, 25 bp, Homo sapien
aacggactgtgaatccgctctttgt

SEQ ID NO: 125233 - DNA, 25 bp, Homo sapien
acggactgtgaatccgctctttgtc

SEQ ID NO: 125234 - DNA, 25 bp, Homo sapien
cggactgtgaatccgctctttgtcg

SEQ ID NO: 125235 - DNA, 25 bp, Homo sapien
ggactgtgaatccgctctttgtcgg

SEQ ID NO: 125236 - DNA, 25 bp, Homo sapien
gactgtgaatccgctctttgtcgga

SEQ ID NO: 125237 - DNA, 25 bp, Homo sapien
actgtgaatccgctctttgtcggaa

SEQ ID NO: 125238 - DNA, 25 bp, Homo sapien
ctgtgaatccgctctttgtcggaag

SEQ ID NO: 125239 - DNA, 25 bp, Homo sapien
ctctttgtcggaagctgagcaagct

SEQ ID NO: 125240 - DNA, 25 bp, Homo sapien
gtaggacccggcgggtgtgcagcaa

SEQ ID NO: 125241 - DNA, 25 bp, Homo sapien
aggcaggtgggctctgcttcccgat

SEQ ID NO: 125242 - DNA, 25 bp, Homo sapien
tctgcttcccgattccctgtgagcg

SEQ ID NO: 125243 - DNA, 25 bp, Homo sapien
gcgcccaccctctcgaaagaatttt

SEQ ID NO: 125244 - DNA, 25 bp, Homo sapien
tgcagactctggctcgagcaacccg

SEQ ID NO: 125245 - DNA, 25 bp, Homo sapien
tccagcgaggaggtctcagtcccag

SEQ ID NO: 125246 - DNA, 25 bp, Homo sapien
aggaggtctcagtcccagcctcggg

SEQ ID NO: 125247 - DNA, 25 bp, Homo sapien
ctttcttccctgaggcattcttcct

SEQ ID NO: 125248 - DNA, 25 bp, Homo sapien
attcttcctcatccctagggtgttg

SEQ ID NO: 125249 - DNA, 25 bp, Homo sapien
tcatccctagggtgttgtgtagaac

SEQ ID NO: 125250 - DNA, 25 bp, Homo sapien
actctttttaaactctatgctccga

SEQ ID NO: 125251 - DNA, 25 bp, Homo sapien
atgctccgagtagagttcatcttta

SEQ ID NO: 125252 - DNA, 25 bp, Homo sapien
aatgagctgagattcagcatcccct

SEQ ID NO: 125253 - DNA, 25 bp, Homo sapien
ctgagattcagcatcccctggagga

SEQ ID NO: 125254 - DNA, 25 bp, Homo sapien
actgtccctccccttggtgctagag

SEQ ID NO: 125255 - DNA, 25 bp, Homo sapien
tagaggcttgtgtgcacgtgagcgt

SEQ ID NO: 125256 - DNA, 25 bp, Homo sapien
tgagcgtgcgagtgcacgtccgtta

SEQ ID NO: 125257 - DNA, 25 bp, Homo sapien
gtgcacgtccgttatttcagtgact

SEQ ID NO: 125258 - DNA, 25 bp, Homo sapien
atttcagtgacttggtcccgtgggt

SEQ ID NO: 125259 - DNA, 25 bp, Homo sapien
gacttggtcccgtgggtctagcctt

SEQ ID NO: 125260 - DNA, 25 bp, Homo sapien
gagcggatgtgactggcgtctgacc

SEQ ID NO: 125261 - DNA, 25 bp, Homo sapien
cttgacccaagcctgtgatgacatg

SEQ ID NO: 125262 - DNA, 25 bp, Homo sapien
tgtgatgacatggtgctgattctgg

SEQ ID NO: 125263 - DNA, 25 bp, Homo sapien
gcatccagccggctggcaatacttc

SEQ ID NO: 125264 - DNA, 25 bp, Homo sapien
tggcaatacttctcccagagcgatc

SEQ ID NO: 125265 - DNA, 25 bp, Homo sapien
tcccagagcgatctcgcgggtcgac

SEQ ID NO: 125266 - DNA, 25 bp, Homo sapien
atctcgcgggtcgaccgggagagga

SEQ ID NO: 125267 - DNA, 25 bp, Homo sapien
ctcagacctcactgggcggcaagag

SEQ ID NO: 125268 - DNA, 25 bp, Homo sapien
tcactgggcggcaagaggtctcccg

SEQ ID NO: 125269 - DNA, 25 bp, Homo sapien
ggcaagaggtctcccggatcccagc

SEQ ID NO: 125270 - DNA, 25 bp, Homo sapien
cggatcccagcctcacagacaagtg

SEQ ID NO: 125271 - DNA, 25 bp, Homo sapien
gacaagtgtgccatttgaccatctc

SEQ ID NO: 125272 - DNA, 25 bp, Homo sapien
gtgtgccatttgaccatctcgggaa

SEQ ID NO: 125273 - DNA, 25 bp, Homo sapien
gccatttgaccatctcgggaagtga

SEQ ID NO: 125274 - DNA, 25 bp, Homo sapien
ttctgagtgtagtgtggtaggaccc

SEQ ID NO: 125275 - DNA, 25 bp, Homo sapien
agcccctgcgtccatctgtgctgtg

SEQ ID NO: 125276 - DNA, 25 bp, Homo sapien
tgtgcgccccacagtagacgtgcag

SEQ ID NO: 125277 - DNA, 25 bp, Homo sapien
agtagacgtgcagacgtccctgaga

SEQ ID NO: 125278 - DNA, 25 bp, Homo sapien
gcagacgtccctgagaggttcttga

SEQ ID NO: 125279 - DNA, 25 bp, Homo sapien
gtccctgagaggttcttgaagatgt

SEQ ID NO: 125280 - DNA, 25 bp, Homo sapien
tattgtccttttttactggaagacg

SEQ ID NO: 125281 - DNA, 25 bp, Homo sapien
ggaagacgtacgcatactccatcga

SEQ ID NO: 125282 - DNA, 25 bp, Homo sapien
agacgtacgcatactccatcgatgt

SEQ ID NO: 125283 - DNA, 25 bp, Homo sapien
tgcagtggctgaggaattcttgtac

SEQ ID NO: 125284 - DNA, 25 bp, Homo sapien
agtggctgaggaattcttgtacgca

SEQ ID NO: 125285 - DNA, 25 bp, Homo sapien
aatctagaagagtctattgtctcct

SEQ ID NO: 125286 - DNA, 25 bp, Homo sapien
tagaagagtctattgtctccttggt

SEQ ID NO: 125287 - DNA, 25 bp, Homo sapien
gaagagtctattgtctccttggtta

SEQ ID NO: 125288 - DNA, 25 bp, Homo sapien
agagtctattgtctccttggttata

SEQ ID NO: 125289 - DNA, 25 bp, Homo sapien
gagtctattgtctccttggttatat

SEQ ID NO: 125290 - DNA, 25 bp, Homo sapien
gtctattgtctccttggttatattt

SEQ ID NO: 125291 - DNA, 25 bp, Homo sapien
tattgtctccttggttatatttttt

SEQ ID NO: 125292 - DNA, 25 bp, Homo sapien
ttttttaactttaccatgctcaatg

SEQ ID NO: 125293 - DNA, 25 bp, Homo sapien
tttaactttaccatgctcaatgaaa

SEQ ID NO: 125294 - DNA, 25 bp, Homo sapien
aactttaccatgctcaatgaaaagg

SEQ ID NO: 125295 - DNA, 25 bp, Homo sapien
taccatgctcaatgaaaaggtgatt

SEQ ID NO: 125296 - DNA, 25 bp, Homo sapien
gttggtacagatgatctgcactgtc

SEQ ID NO: 125297 - DNA, 25 bp, Homo sapien
gtacagatgatctgcactgtcaagt

SEQ ID NO: 125298 - DNA, 25 bp, Homo sapien
cagatgatctgcactgtcaagtaaa

SEQ ID NO: 125299 - DNA, 25 bp, Homo sapien
gatgatctgcactgtcaagtaaact

SEQ ID NO: 125300 - DNA, 25 bp, Homo sapien
gatctgcactgtcaagtaaactaca

SEQ ID NO: 125301 - DNA, 25 bp, Homo sapien
gcactgtcaagtaaactacagttag

SEQ ID NO: 125302 - DNA, 25 bp, Homo sapien
gttaggaatcctcaaagattggttt

SEQ ID NO: 125303 - DNA, 25 bp, Homo sapien
gatcactatcgatttcctggagagt

SEQ ID NO: 125304 - DNA, 25 bp, Homo sapien
atcactatcgatttcctggagagtt

SEQ ID NO: 125305 - DNA, 25 bp, Homo sapien
tttcctggagagttttgtaatctga

SEQ ID NO: 125306 - DNA, 25 bp, Homo sapien
cttaggaatatagattcggcagcct

SEQ ID NO: 125307 - DNA, 25 bp, Homo sapien
atatccaggacaatttattagtttt

SEQ ID NO: 125308 - DNA, 25 bp, Homo sapien
ttttctcagtattttcccaaatatt

SEQ ID NO: 125309 - DNA, 25 bp, Homo sapien
tttacttcattattggttggctgcc

SEQ ID NO: 125310 - DNA, 25 bp, Homo sapien
tggttggctgccaatgaccccatat

SEQ ID NO: 125311 - DNA, 25 bp, Homo sapien
atgaccccatatgttctgtgagaat

SEQ ID NO: 125312 - DNA, 25 bp, Homo sapien
gtgagaatagtagctttatctttga

SEQ ID NO: 125313 - DNA, 25 bp, Homo sapien
gatataatacatagtctccaaatag

SEQ ID NO: 125314 - DNA, 25 bp, Homo sapien
gtctccaaataggtaatacttcgca

SEQ ID NO: 125315 - DNA, 25 bp, Homo sapien
atacttcgcaattgattagattttc

SEQ ID NO: 125316 - DNA, 25 bp, Homo sapien
gatttagagttatctgtttttctgg

SEQ ID NO: 125317 - DNA, 25 bp, Homo sapien
tctgtttttctggtgagggtcaaat

SEQ ID NO: 125318 - DNA, 25 bp, Homo sapien
cagttgctgattcctccacgagggt

SEQ ID NO: 125319 - DNA, 25 bp, Homo sapien
acgagggtggactctcccagccatg

SEQ ID NO: 125320 - DNA, 25 bp, Homo sapien
gagggtggactctcccagccatggc

SEQ ID NO: 125321 - DNA, 25 bp, Homo sapien
ccagccatggcctggtgaccagctc

SEQ ID NO: 125322 - DNA, 25 bp, Homo sapien
cctcggcctggtacttgcaagacaa

SEQ ID NO: 125323 - DNA, 25 bp, Homo sapien
cttgcaagacaagtgtggccacaca

SEQ ID NO: 125324 - DNA, 25 bp, Homo sapien
aagtgtggccacacaatgcgatcca

SEQ ID NO: 125325 - DNA, 25 bp, Homo sapien
gtggccacacaatgcgatccagaag

SEQ ID NO: 125326 - DNA, 25 bp, Homo sapien
ccacacaatgcgatccagaagagat

SEQ ID NO: 125327 - DNA, 25 bp, Homo sapien
cctgcctccagaatgttctgggata

SEQ ID NO: 125328 - DNA, 25 bp, Homo sapien
atgttctgggataacatttggagga

SEQ ID NO: 125329 - DNA, 25 bp, Homo sapien
gcgagtacaacaaggtcattaataa

SEQ ID NO: 125330 - DNA, 25 bp, Homo sapien
attaataaggatgagtactacagcc

SEQ ID NO: 125331 - DNA, 25 bp, Homo sapien
gccctctgcaggtgatggctgccta

SEQ ID NO: 125332 - DNA, 25 bp, Homo sapien
caggtgatggctgcctaccagcaga

SEQ ID NO: 125333 - DNA, 25 bp, Homo sapien
atggctgcctaccagcagatcgtgg

SEQ ID NO: 125334 - DNA, 25 bp, Homo sapien
cttcaatgtgaagttcggtcgaacc

SEQ ID NO: 125335 - DNA, 25 bp, Homo sapien
ttcggtcgaaccacatgcaccaagt

SEQ ID NO: 125336 - DNA, 25 bp, Homo sapien
ctgtcccttcaatgaccagccaaaa

SEQ ID NO: 125337 - DNA, 25 bp, Homo sapien
tcccttcaatgaccagccaaaactg

SEQ ID NO: 125338 - DNA, 25 bp, Homo sapien
cctgggaggataaaatttccattct

SEQ ID NO: 125339 - DNA, 25 bp, Homo sapien
ttccattctgaactacaagtgccgg

SEQ ID NO: 125340 - DNA, 25 bp, Homo sapien
ttgcaccgcgggacgaggctgaccg

SEQ ID NO: 125341 - DNA, 25 bp, Homo sapien
ggctgaccgggctgttctgtagact

SEQ ID NO: 125342 - DNA, 25 bp, Homo sapien
accgggctgttctgtagactcagga

SEQ ID NO: 125343 - DNA, 25 bp, Homo sapien
ggctgttctgtagactcaggaccgt

SEQ ID NO: 125344 - DNA, 25 bp, Homo sapien
gtagactcaggaccgtggctccaga

SEQ ID NO: 125345 - DNA, 25 bp, Homo sapien
gactcaggaccgtggctccagaact

SEQ ID NO: 125346 - DNA, 25 bp, Homo sapien
gggccagcatcccaggaactggacc

SEQ ID NO: 125347 - DNA, 25 bp, Homo sapien
cagcatcccaggaactggacctttc

SEQ ID NO: 125348 - DNA, 25 bp, Homo sapien
cagagcctccgcctgtggctgtgat

SEQ ID NO: 125349 - DNA, 25 bp, Homo sapien
agaaggtcaaactccgaagactgaa

SEQ ID NO: 125350 - DNA, 25 bp, Homo sapien
actccgaagactgaaactctgcctg

SEQ ID NO: 125351 - DNA, 25 bp, Homo sapien
aaaatactgatgttcctagtgaaag

SEQ ID NO: 125352 - DNA, 25 bp, Homo sapien
actgatgttcctagtgaaagaggca

SEQ ID NO: 125353 - DNA, 25 bp, Homo sapien
gaggcagcttgaaactgagatgtga

SEQ ID NO: 125354 - DNA, 25 bp, Homo sapien
gagatgtgaacacatcagcttgccc

SEQ ID NO: 125355 - DNA, 25 bp, Homo sapien
atcagcttgccctgttaaaagatga

SEQ ID NO: 125356 - DNA, 25 bp, Homo sapien
aatcttaacttgaaggagtccttgc

SEQ ID NO: 125357 - DNA, 25 bp, Homo sapien
gaaggagtccttgcatcaatttttc

SEQ ID NO: 125358 - DNA, 25 bp, Homo sapien
gagtccttgcatcaatttttcttat

SEQ ID NO: 125359 - DNA, 25 bp, Homo sapien
catttctttgagtgtcttaattaaa

SEQ ID NO: 125360 - DNA, 25 bp, Homo sapien
gaatattttaacttccttggactca

SEQ ID NO: 125361 - DNA, 25 bp, Homo sapien
tattattcccattctacatactatg

SEQ ID NO: 125362 - DNA, 25 bp, Homo sapien
tagtcctttgtgctcccacgggtct

SEQ ID NO: 125363 - DNA, 25 bp, Homo sapien
tcttgaagcttgacaggatgttttc

SEQ ID NO: 125364 - DNA, 25 bp, Homo sapien
caacatttaaacagagttctctcaa

SEQ ID NO: 125365 - DNA, 25 bp, Homo sapien
ttctctcaaaaatgtctaaagggat

SEQ ID NO: 125366 - DNA, 25 bp, Homo sapien
gtaggtagataacatccaatcactg

SEQ ID NO: 125367 - DNA, 25 bp, Homo sapien
tccaatcactgtttgcacttatctg

SEQ ID NO: 125368 - DNA, 25 bp, Homo sapien
tgcacttatctgaaatcttccctct

SEQ ID NO: 125369 - DNA, 25 bp, Homo sapien
tatctgaaatcttccctcttggctg

SEQ ID NO: 125370 - DNA, 25 bp, Homo sapien
ccccaggtatttactgtggagaaca

SEQ ID NO: 125371 - DNA, 25 bp, Homo sapien
tttactgtggagaacattgcatagg

SEQ ID NO: 125372 - DNA, 25 bp, Homo sapien
gaacattgcataggaatgtctggaa

SEQ ID NO: 125373 - DNA, 25 bp, Homo sapien
gaaagtcaccaggacaatcttggct

SEQ ID NO: 125374 - DNA, 25 bp, Homo sapien
aatcttggctattctgttggctttc

SEQ ID NO: 125375 - DNA, 25 bp, Homo sapien
tgttggctttcatcatcacttgggc

SEQ ID NO: 125376 - DNA, 25 bp, Homo sapien
acttgggccccatacaatgtcatgg

SEQ ID NO: 125377 - DNA, 25 bp, Homo sapien
attaacaccttttgtgcaccttgca

SEQ ID NO: 125378 - DNA, 25 bp, Homo sapien
tgcatccccaacactgtgtggacaa

SEQ ID NO: 125379 - DNA, 25 bp, Homo sapien
gtgtggacaattggttactggcttt

SEQ ID NO: 125380 - DNA, 25 bp, Homo sapien
ggttactggctttgttacatcaaca

SEQ ID NO: 125381 - DNA, 25 bp, Homo sapien
tgcctgctatgcactttgcaatgcc

SEQ ID NO: 125382 - DNA, 25 bp, Homo sapien
ttgcaatgccaccttcaagaagacc

SEQ ID NO: 125383 - DNA, 25 bp, Homo sapien
agacctttaaacaccttctcatgtg

SEQ ID NO: 125384 - DNA, 25 bp, Homo sapien
aaacatgctgtttatgacacaatga

SEQ ID NO: 125385 - DNA, 25 bp, Homo sapien
atgctgtttatgacacaatgacaca

SEQ ID NO: 125386 - DNA, 25 bp, Homo sapien
gacacatttgttgcaccaattaagt

SEQ ID NO: 125387 - DNA, 25 bp, Homo sapien
tttgttgcaccaattaagtgttgaa

SEQ ID NO: 125388 - DNA, 25 bp, Homo sapien
gttgaatgttaacaggtattttcac

SEQ ID NO: 125389 - DNA, 25 bp, Homo sapien
cacaggtttgtttcttgatagttac

SEQ ID NO: 125390 - DNA, 25 bp, Homo sapien
gtttcttgatagttactcagacact

SEQ ID NO: 125391 - DNA, 25 bp, Homo sapien
gttactcagacactagggaaaggta

SEQ ID NO: 125392 - DNA, 25 bp, Homo sapien
aataagcaactaaatgagacctaat

SEQ ID NO: 125393 - DNA, 25 bp, Homo sapien
gagacctaataattggccttcgatt

SEQ ID NO: 125394 - DNA, 25 bp, Homo sapien
attggccttcgattttaaatatttg

SEQ ID NO: 125395 - DNA, 25 bp, Homo sapien
ttcattttgctgtattgagacctat

SEQ ID NO: 125396 - DNA, 25 bp, Homo sapien
ctttcttgaaaggattattgactct

SEQ ID NO: 125397 - DNA, 25 bp, Homo sapien
tattgactctttttgctactacata

SEQ ID NO: 125398 - DNA, 25 bp, Homo sapien
gatactcatttatagttacgttcat

SEQ ID NO: 125399 - DNA, 25 bp, Homo sapien
gttacgttcatttcaggttaaacat

SEQ ID NO: 125400 - DNA, 25 bp, Homo sapien
aaagaagcctggttactgatttgta

SEQ ID NO: 125401 - DNA, 25 bp, Homo sapien
ggtaaggtaaatttcatgcatcttt

SEQ ID NO: 125402 - DNA, 25 bp, Homo sapien
gaagaccacctattttatatttcaa

SEQ ID NO: 125403 - DNA, 25 bp, Homo sapien
ataattttaaagttgctggcctaat

SEQ ID NO: 125404 - DNA, 25 bp, Homo sapien
tggcctaatgagcaatgttctcaat

SEQ ID NO: 125405 - DNA, 25 bp, Homo sapien
gcaatgttctcaattttcgttttca

SEQ ID NO: 125406 - DNA, 25 bp, Homo sapien
gggtttatttaagggagattgcaag

SEQ ID NO: 125407 - DNA, 25 bp, Homo sapien
gattgcaaggaagctatttaacatg

SEQ ID NO: 125408 - DNA, 25 bp, Homo sapien
tatttaacatggtgctgagctagcc

SEQ ID NO: 125409 - DNA, 25 bp, Homo sapien
tggtgctgagctagccaggactgat

SEQ ID NO: 125410 - DNA, 25 bp, Homo sapien
tctgcagccagttcattcccagggc

SEQ ID NO: 125411 - DNA, 25 bp, Homo sapien
agggccccatcttgatgggccaagg

SEQ ID NO: 125412 - DNA, 25 bp, Homo sapien
tgggccaagggctaaacatgcatgt

SEQ ID NO: 125413 - DNA, 25 bp, Homo sapien
acatgcatgtgtcagtggctttgga

SEQ ID NO: 125414 - DNA, 25 bp, Homo sapien
tgcatgtgtcagtggctttggagca

SEQ ID NO: 125415 - DNA, 25 bp, Homo sapien
tcatcgagggtctcaggccgaggcc

SEQ ID NO: 125416 - DNA, 25 bp, Homo sapien
tcgagggtctcaggccgaggccact

SEQ ID NO: 125417 - DNA, 25 bp, Homo sapien
ttgccacaagcttcccaggctttct

SEQ ID NO: 125418 - DNA, 25 bp, Homo sapien
tggaaaactccagcttgagtcccag

SEQ ID NO: 125419 - DNA, 25 bp, Homo sapien
agcttgagtcccagatacactcatg

SEQ ID NO: 125420 - DNA, 25 bp, Homo sapien
gggcagccagcattcattgtaagtt

SEQ ID NO: 125421 - DNA, 25 bp, Homo sapien
tgtaagttccctctttgaaaactgg

SEQ ID NO: 125422 - DNA, 25 bp, Homo sapien
aaactggtgtgtgggtgttcagttc

SEQ ID NO: 125423 - DNA, 25 bp, Homo sapien
gacagtaatctcctgtgatctgtgc

SEQ ID NO: 125424 - DNA, 25 bp, Homo sapien
tgatctgtgctagctgtgaggcagc

SEQ ID NO: 125425 - DNA, 25 bp, Homo sapien
ctgtgaggcagctctggaacgtgaa

SEQ ID NO: 125426 - DNA, 25 bp, Homo sapien
tgaagagctgtttggtttgaaccgt

SEQ ID NO: 125427 - DNA, 25 bp, Homo sapien
aaagttcatcacgtgactgttaatg

SEQ ID NO: 125428 - DNA, 25 bp, Homo sapien
aaacctgtagatgacataaaatgac

SEQ ID NO: 125429 - DNA, 25 bp, Homo sapien
ggttcaaataacttttccactgcat

SEQ ID NO: 125430 - DNA, 25 bp, Homo sapien
aaataacttttccactgcatgaaag

SEQ ID NO: 125431 - DNA, 25 bp, Homo sapien
ttccactgcatgaaagtttaattag

SEQ ID NO: 125432 - DNA, 25 bp, Homo sapien
tcaacattagaagtggtgtaacatg

SEQ ID NO: 125433 - DNA, 25 bp, Homo sapien
agtggtgtaacatgtaagctgagca

SEQ ID NO: 125434 - DNA, 25 bp, Homo sapien
tggacagaggctgcctgtagtccac

SEQ ID NO: 125435 - DNA, 25 bp, Homo sapien
tgtagtccaccactatggccatggg

SEQ ID NO: 125436 - DNA, 25 bp, Homo sapien
agtccaccactatggccatgggagt

SEQ ID NO: 125437 - DNA, 25 bp, Homo sapien
ctggtgagcgagtgtgtccatgccc

SEQ ID NO: 125438 - DNA, 25 bp, Homo sapien
agcgagtgtgtccatgccctcagga

SEQ ID NO: 125439 - DNA, 25 bp, Homo sapien
ggaatattgctgctggttctcataa

SEQ ID NO: 125440 - DNA, 25 bp, Homo sapien
tgctgctggttctcataatttctag

SEQ ID NO: 125441 - DNA, 25 bp, Homo sapien
atgagggagtccagtccccagtgaa

SEQ ID NO: 125442 - DNA, 25 bp, Homo sapien
actctccttttgtgcttatcatgtt

SEQ ID NO: 125443 - DNA, 25 bp, Homo sapien
tttaccttaaatgctgagatcctca

SEQ ID NO: 125444 - DNA, 25 bp, Homo sapien
gcaaagctaggtagccatttcttct

SEQ ID NO: 125445 - DNA, 25 bp, Homo sapien
agccatttcttctgttctaccaagt

SEQ ID NO: 125446 - DNA, 25 bp, Homo sapien
atagcattcatttccctttatattt

SEQ ID NO: 125447 - DNA, 25 bp, Homo sapien
cagtggaagacacagttgcagccaa

SEQ ID NO: 125448 - DNA, 25 bp, Homo sapien
gttgcagccaaactcatctatgatt

SEQ ID NO: 125449 - DNA, 25 bp, Homo sapien
ctatgattcctggtcatctggtaaa

SEQ ID NO: 125450 - DNA, 25 bp, Homo sapien
gacagctgtgtactcttaggctaag

SEQ ID NO: 125451 - DNA, 25 bp, Homo sapien
ctaagagatgtgactacagcctgcc

SEQ ID NO: 125452 - DNA, 25 bp, Homo sapien
ctgactgtgttgtcccagggctgat

SEQ ID NO: 125453 - DNA, 25 bp, Homo sapien
ccagggctgatgctgtacaggtaca

SEQ ID NO: 125454 - DNA, 25 bp, Homo sapien
ggtacaggctggagattttcacata

SEQ ID NO: 125455 - DNA, 25 bp, Homo sapien
aggttagattctcattcacgggact

SEQ ID NO: 125456 - DNA, 25 bp, Homo sapien
tctcattcacgggactagttagctt

SEQ ID NO: 125457 - DNA, 25 bp, Homo sapien
tagttagctttaagcaccctagagg

SEQ ID NO: 125458 - DNA, 25 bp, Homo sapien
tagaggactagggtaatctgacttc

SEQ ID NO: 125459 - DNA, 25 bp, Homo sapien
taagttcccttctatatcctcaagg

SEQ ID NO: 125460 - DNA, 25 bp, Homo sapien
aaatgtctatgttttctactccaat

SEQ ID NO: 125461 - DNA, 25 bp, Homo sapien
ccttgcctgtcggtgaggcaggttt

SEQ ID NO: 125462 - DNA, 25 bp, Homo sapien
tcggtgaggcaggtttttactgtga

SEQ ID NO: 125463 - DNA, 25 bp, Homo sapien
aacgtggacctgtttctgtttccag

SEQ ID NO: 125464 - DNA, 25 bp, Homo sapien
gtttctgtttccagtctgtggtgat

SEQ ID NO: 125465 - DNA, 25 bp, Homo sapien
tttccagtctgtggtgatgctgtct

SEQ ID NO: 125466 - DNA, 25 bp, Homo sapien
gcccctggaccagtgatgactgatg

SEQ ID NO: 125467 - DNA, 25 bp, Homo sapien
gactgatgaatcttatgagcttctg

SEQ ID NO: 125468 - DNA, 25 bp, Homo sapien
ttatgagcttctgattgatctcggg

SEQ ID NO: 125469 - DNA, 25 bp, Homo sapien
gggtccatctgtgatatttctttgt

SEQ ID NO: 125470 - DNA, 25 bp, Homo sapien
ctgtgatatttctttgtgccaaaaa

SEQ ID NO: 125471 - DNA, 25 bp, Homo sapien
gagtggatcagtttgctaaatgaac

SEQ ID NO: 125472 - DNA, 25 bp, Homo sapien
ccagtccactgtatggcatttgtga

SEQ ID NO: 125473 - DNA, 25 bp, Homo sapien
attatgcactgacatgaccctgggt

SEQ ID NO: 125474 - DNA, 25 bp, Homo sapien
ctgggtgacaggaaagcctttcgag

SEQ ID NO: 125475 - DNA, 25 bp, Homo sapien
gaaagcctttcgagaggcccaaggt

SEQ ID NO: 125476 - DNA, 25 bp, Homo sapien
tcgccagccctgcagtattgatgtg

SEQ ID NO: 125477 - DNA, 25 bp, Homo sapien
cagtattgcaccacagctctgcgga

SEQ ID NO: 125478 - DNA, 25 bp, Homo sapien
agctctgcggaccttggccattgcc

SEQ ID NO: 125479 - DNA, 25 bp, Homo sapien
tggccattgccgcagtcgcagcttc

SEQ ID NO: 125480 - DNA, 25 bp, Homo sapien
agcttccttttttctgtttgcactg

SEQ ID NO: 125481 - DNA, 25 bp, Homo sapien
gatgttagctaattccactgtgtat

SEQ ID NO: 125482 - DNA, 25 bp, Homo sapien
gaacttgggagttctcattgtaacc

SEQ ID NO: 125483 - DNA, 25 bp, Homo sapien
gcctgatgggcctggtagttttcca

SEQ ID NO: 125484 - DNA, 25 bp, Homo sapien
ttttccatcttgttctggcctagag

SEQ ID NO: 125485 - DNA, 25 bp, Homo sapien
tggcctagaggtcagtcctttgcac

SEQ ID NO: 125486 - DNA, 25 bp, Homo sapien
ctttgcacttcctcaaagcttgtgt

SEQ ID NO: 125487 - DNA, 25 bp, Homo sapien
aagcttgtgtacagtgctcacctaa

SEQ ID NO: 125488 - DNA, 25 bp, Homo sapien
acagtgctcacctaaatccatctga

SEQ ID NO: 125489 - DNA, 25 bp, Homo sapien
aaatccatctgactacttgttcctg

SEQ ID NO: 125490 - DNA, 25 bp, Homo sapien
tacttgttcctgtgccctcttgttt

SEQ ID NO: 125491 - DNA, 25 bp, Homo sapien
tgccctcttgttttaggcctcgttt

SEQ ID NO: 125492 - DNA, 25 bp, Homo sapien
tgtattcctgttgggttttcttgtt

SEQ ID NO: 125493 - DNA, 25 bp, Homo sapien
tgatctcatgctagcagagcaaaaa

SEQ ID NO: 125494 - DNA, 25 bp, Homo sapien
ttgcccataacgcagtattctgagt

SEQ ID NO: 125495 - DNA, 25 bp, Homo sapien
tgcccataacgcagtattctgagtt

SEQ ID NO: 125496 - DNA, 25 bp, Homo sapien
gcccataacgcagtattctgagttt

SEQ ID NO: 125497 - DNA, 25 bp, Homo sapien
cccataacgcagtattctgagtttg

SEQ ID NO: 125498 - DNA, 25 bp, Homo sapien
cataacgcagtattctgagtttgca

SEQ ID NO: 125499 - DNA, 25 bp, Homo sapien
ataacgcagtattctgagtttgcaa

SEQ ID NO: 125500 - DNA, 25 bp, Homo sapien
taacgcagtattctgagtttgcaac

SEQ ID NO: 125501 - DNA, 25 bp, Homo sapien
aaatgtcagacattattgaaaagaa

SEQ ID NO: 125502 - DNA, 25 bp, Homo sapien
cacccccagaaacctcttgtgttct

SEQ ID NO: 125503 - DNA, 25 bp, Homo sapien
aggtgttcctggcagccaaatcgag

SEQ ID NO: 125504 - DNA, 25 bp, Homo sapien
gttcctggcagccaaatcgagtctc

SEQ ID NO: 125505 - DNA, 25 bp, Homo sapien
gggcactactggtccgtaggattcg

SEQ ID NO: 125506 - DNA, 25 bp, Homo sapien
ggcactactggtccgtaggattcga

SEQ ID NO: 125507 - DNA, 25 bp, Homo sapien
gcactactggtccgtaggattcgat

SEQ ID NO: 125508 - DNA, 25 bp, Homo sapien
cactactggtccgtaggattcgatt

SEQ ID NO: 125509 - DNA, 25 bp, Homo sapien
actactggtccgtaggattcgattg

SEQ ID NO: 125510 - DNA, 25 bp, Homo sapien
ctactggtccgtaggattcgattgg

SEQ ID NO: 125511 - DNA, 25 bp, Homo sapien
tactggtccgtaggattcgattggt

SEQ ID NO: 125512 - DNA, 25 bp, Homo sapien
actggtccgtaggattcgattggtc

SEQ ID NO: 125513 - DNA, 25 bp, Homo sapien
tggtccgtaggattcgattggtcgg

SEQ ID NO: 125514 - DNA, 25 bp, Homo sapien
ggtccgtaggattcgattggtcggg

SEQ ID NO: 125515 - DNA, 25 bp, Homo sapien
gtccgtaggattcgattggtcgggg

SEQ ID NO: 125516 - DNA, 25 bp, Homo sapien
aatcgcttggttcagtttcattcag

SEQ ID NO: 125517 - DNA, 25 bp, Homo sapien
ggaccagtaatctgataaataaccg

SEQ ID NO: 125518 - DNA, 25 bp, Homo sapien
gtaatctgataaataaccgagctct

SEQ ID NO: 125519 - DNA, 25 bp, Homo sapien
taatctgataaataaccgagctctt

SEQ ID NO: 125520 - DNA, 25 bp, Homo sapien
aatctgataaataaccgagctcttc

SEQ ID NO: 125521 - DNA, 25 bp, Homo sapien
atctgataaataaccgagctcttct

SEQ ID NO: 125522 - DNA, 25 bp, Homo sapien
tctgataaataaccgagctcttctt

SEQ ID NO: 125523 - DNA, 25 bp, Homo sapien
tgataaataaccgagctcttctttg

SEQ ID NO: 125524 - DNA, 25 bp, Homo sapien
gataaataaccgagctcttctttgg

SEQ ID NO: 125525 - DNA, 25 bp, Homo sapien
ataaataaccgagctcttctttggg

SEQ ID NO: 125526 - DNA, 25 bp, Homo sapien
taaccgagctcttctttggggatca

SEQ ID NO: 125527 - DNA, 25 bp, Homo sapien
gatcaagaaatgtctctgctcctac

SEQ ID NO: 125528 - DNA, 25 bp, Homo sapien
gaaatgtctctgctcctacatccag

SEQ ID NO: 125529 - DNA, 25 bp, Homo sapien
actgctgtgagtgcgcctcaccaga

SEQ ID NO: 125530 - DNA, 25 bp, Homo sapien
tgcgcctcaccagaaccagttaaga

SEQ ID NO: 125531 - DNA, 25 bp, Homo sapien
gacaactatcaattcttgagaccca

SEQ ID NO: 125532 - DNA, 25 bp, Homo sapien
gacccaaattataagggccctgcct

SEQ ID NO: 125533 - DNA, 25 bp, Homo sapien
ttataagggccctgcctgtactgaa

SEQ ID NO: 125534 - DNA, 25 bp, Homo sapien
ggagcacaaggccttaatggacatt

SEQ ID NO: 125535 - DNA, 25 bp, Homo sapien
aaggccttaatggacattgacttgt

SEQ ID NO: 125536 - DNA, 25 bp, Homo sapien
ggacattgacttgtgaaaacgcaaa

SEQ ID NO: 125537 - DNA, 25 bp, Homo sapien
gtgaaaacgcaaacatgaatatggt

SEQ ID NO: 125538 - DNA, 25 bp, Homo sapien
taccacgaagatctgtgaccctggg

SEQ ID NO: 125539 - DNA, 25 bp, Homo sapien
agcagtctcttgatctgagcccggc

SEQ ID NO: 125540 - DNA, 25 bp, Homo sapien
atctgagcccggcaccccatgagga

SEQ ID NO: 125541 - DNA, 25 bp, Homo sapien
ggcaccccatgaggacatgcagagc

SEQ ID NO: 125542 - DNA, 25 bp, Homo sapien
gaggacatgcagagcacctgcagag

SEQ ID NO: 125543 - DNA, 25 bp, Homo sapien
tgcagaccccggtttctattttgca

SEQ ID NO: 125544 - DNA, 25 bp, Homo sapien
ggtttctattttgcacacgggcagg

SEQ ID NO: 125545 - DNA, 25 bp, Homo sapien
cacgggcaggaggaccttttgcatt

SEQ ID NO: 125546 - DNA, 25 bp, Homo sapien
ccttttgcattctcttcagacacaa

SEQ ID NO: 125547 - DNA, 25 bp, Homo sapien
gcattctcttcagacacaatttgtg

SEQ ID NO: 125548 - DNA, 25 bp, Homo sapien
cacaatttgtggagaccccggcggg

SEQ ID NO: 125549 - DNA, 25 bp, Homo sapien
cgggtgcagagtggcacgtgggttg

SEQ ID NO: 125550 - DNA, 25 bp, Homo sapien
cccaggtgcagtccgtgcgccgtat

SEQ ID NO: 125551 - DNA, 25 bp, Homo sapien
aggtgcagtccgtgcgccgtatccg

SEQ ID NO: 125552 - DNA, 25 bp, Homo sapien
cgtgcgccgtatccgcgacatgcag

SEQ ID NO: 125553 - DNA, 25 bp, Homo sapien
gccgtatccgcgacatgcagtggca

SEQ ID NO: 125554 - DNA, 25 bp, Homo sapien
gtatccgcgacatgcagtggcacca

SEQ ID NO: 125555 - DNA, 25 bp, Homo sapien
tatccgcgacatgcagtggcaccaa

SEQ ID NO: 125556 - DNA, 25 bp, Homo sapien
tccgcgacatgcagtggcaccaacg

SEQ ID NO: 125557 - DNA, 25 bp, Homo sapien
gcgacatgcagtggcaccaacgtgg

SEQ ID NO: 125558 - DNA, 25 bp, Homo sapien
tggcaccaacgtggtgccttccacc

SEQ ID NO: 125559 - DNA, 25 bp, Homo sapien
aggacccaggtctgctgcccaggaa

SEQ ID NO: 125560 - DNA, 25 bp, Homo sapien
aagacattatctttgatggtgatga

SEQ ID NO: 125561 - DNA, 25 bp, Homo sapien
gtgatgataagcagccagaggctcc

SEQ ID NO: 125562 - DNA, 25 bp, Homo sapien
gtaatggccaaactagaatcctctg

SEQ ID NO: 125563 - DNA, 25 bp, Homo sapien
ggccaaactagaatcctctgaggaa

SEQ ID NO: 125564 - DNA, 25 bp, Homo sapien
agcaaaaacctagaaagcccagaga

SEQ ID NO: 125565 - DNA, 25 bp, Homo sapien
gcccagagaagcaccttcaaaatta

SEQ ID NO: 125566 - DNA, 25 bp, Homo sapien
gagcaatctcgaaatgctgttttgg

SEQ ID NO: 125567 - DNA, 25 bp, Homo sapien
ttggacctccttcatggcatcagaa

SEQ ID NO: 125568 - DNA, 25 bp, Homo sapien
cttcatggcatcagaattttctcat

SEQ ID NO: 125569 - DNA, 25 bp, Homo sapien
gaatgctatgcagatgttgtcttta

SEQ ID NO: 125570 - DNA, 25 bp, Homo sapien
tatgcagatgttgtctttaactctc

SEQ ID NO: 125571 - DNA, 25 bp, Homo sapien
aggttaacagatacagctcggagtt

SEQ ID NO: 125572 - DNA, 25 bp, Homo sapien
tacagctcggagttgtgagcactct

SEQ ID NO: 125573 - DNA, 25 bp, Homo sapien
gtgagcactctactgcaagacttaa

SEQ ID NO: 125574 - DNA, 25 bp, Homo sapien
ttttttcttgtgctgactaactata

SEQ ID NO: 125575 - DNA, 25 bp, Homo sapien
gactaactataagcatgatcttgtt

SEQ ID NO: 125576 - DNA, 25 bp, Homo sapien
gaaaaggtacatgtttacaaagagg

SEQ ID NO: 125577 - DNA, 25 bp, Homo sapien
gacttcttgcttgtacatataggag

SEQ ID NO: 125578 - DNA, 25 bp, Homo sapien
tatgtagtccgttaacactacttaa

SEQ ID NO: 125579 - DNA, 25 bp, Homo sapien
tttctcttggttgtagagtggccca

SEQ ID NO: 125580 - DNA, 25 bp, Homo sapien
gtagagtggcccagaattgcattct

SEQ ID NO: 125581 - DNA, 25 bp, Homo sapien
gtggcccagaattgcattctgaatg

SEQ ID NO: 125582 - DNA, 25 bp, Homo sapien
tggacgcccttcttcgtggtgcaca

SEQ ID NO: 125583 - DNA, 25 bp, Homo sapien
gtggtgcacatcacgcaggcgctgt

SEQ ID NO: 125584 - DNA, 25 bp, Homo sapien
gtgcacatcacgcaggcgctgtgtc

SEQ ID NO: 125585 - DNA, 25 bp, Homo sapien
atcacgcaggcgctgtgtcctgcct

SEQ ID NO: 125586 - DNA, 25 bp, Homo sapien
tggtcagcgccgtcacctggctggg

SEQ ID NO: 125587 - DNA, 25 bp, Homo sapien
atctacactgtcttcaacgccgagt

SEQ ID NO: 125588 - DNA, 25 bp, Homo sapien
tacactgtcttcaacgccgagttcc

SEQ ID NO: 125589 - DNA, 25 bp, Homo sapien
tcaacgccgagttccgcaacgtctt

SEQ ID NO: 125590 - DNA, 25 bp, Homo sapien
aacgtcttccgcaaggccctgcgtg

SEQ ID NO: 125591 - DNA, 25 bp, Homo sapien
aaggccctgcgtgcctgctgctgag

SEQ ID NO: 125592 - DNA, 25 bp, Homo sapien
ccaggcctcagggaccaaggagatg

SEQ ID NO: 125593 - DNA, 25 bp, Homo sapien
gggtgtctgctttgggaccagagga

SEQ ID NO: 125594 - DNA, 25 bp, Homo sapien
aagatagcttgagaggcattggcga

SEQ ID NO: 125595 - DNA, 25 bp, Homo sapien
cattggcgaggttcgcagcgcccca

SEQ ID NO: 125596 - DNA, 25 bp, Homo sapien
tcgcagcgccccagggagagagaaa

SEQ ID NO: 125597 - DNA, 25 bp, Homo sapien
gctgagactcctggggaatgacgtt

SEQ ID NO: 125598 - DNA, 25 bp, Homo sapien
tggagggcccctgattcgaaggcca

SEQ ID NO: 125599 - DNA, 25 bp, Homo sapien
agggcccctgattcgaaggccattt

SEQ ID NO: 125600 - DNA, 25 bp, Homo sapien
ccctgattcgaaggccatttggtga

SEQ ID NO: 125601 - DNA, 25 bp, Homo sapien
gattcgaaggccatttggtgagtgt

SEQ ID NO: 125602 - DNA, 25 bp, Homo sapien
tgagtgttttgctggaaatatttcc

SEQ ID NO: 125603 - DNA, 25 bp, Homo sapien
ataaacttctttcaatctacaataa

SEQ ID NO: 125604 - DNA, 25 bp, Homo sapien
atgtgagatcagtgaactctggttt

SEQ ID NO: 125605 - DNA, 25 bp, Homo sapien
gaactctggttttaagataatctga

SEQ ID NO: 125606 - DNA, 25 bp, Homo sapien
agataatctgaaacaaggtccttgg

SEQ ID NO: 125607 - DNA, 25 bp, Homo sapien
atctgaaacaaggtccttgggagta

SEQ ID NO: 125608 - DNA, 25 bp, Homo sapien
tccttgggagtaataaaattggtca

SEQ ID NO: 125609 - DNA, 25 bp, Homo sapien
taaaattggtcacattctgtaaagc

SEQ ID NO: 125610 - DNA, 25 bp, Homo sapien
gtttaggaatcaacttatctcaaat

SEQ ID NO: 125611 - DNA, 25 bp, Homo sapien
taggaatcaacttatctcaaattgt

SEQ ID NO: 125612 - DNA, 25 bp, Homo sapien
tctcaaattgtaactcggggcctaa

SEQ ID NO: 125613 - DNA, 25 bp, Homo sapien
ttcactaggtgatgccaaaatattt

SEQ ID NO: 125614 - DNA, 25 bp, Homo sapien
gctttatgtatattacagttctttt

SEQ ID NO: 125615 - DNA, 25 bp, Homo sapien
gaaaaggtacatgtttacaaagagg

SEQ ID NO: 125616 - DNA, 25 bp, Homo sapien
tgacttcttgcttgtacatatagga

SEQ ID NO: 125617 - DNA, 25 bp, Homo sapien
gacttcttgcttgtacatataggag

SEQ ID NO: 125618 - DNA, 25 bp, Homo sapien
tcttgcttgtacatataggagcaat

SEQ ID NO: 125619 - DNA, 25 bp, Homo sapien
atattatgtagtccgttaacactac

SEQ ID NO: 125620 - DNA, 25 bp, Homo sapien
tatgtagtccgttaacactacttaa

SEQ ID NO: 125621 - DNA, 25 bp, Homo sapien
tttctcttggttgtagagtggccca

SEQ ID NO: 125622 - DNA, 25 bp, Homo sapien
tctcttggttgtagagtggcccaga

SEQ ID NO: 125623 - DNA, 25 bp, Homo sapien
cttggttgtagagtggcccagaatt

SEQ ID NO: 125624 - DNA, 25 bp, Homo sapien
gtagagtggcccagaattgcattct

SEQ ID NO: 125625 - DNA, 25 bp, Homo sapien
agagtggcccagaattgcattctga

SEQ ID NO: 125626 - DNA, 25 bp, Homo sapien
gagattttcctcaagaacctaaagc

SEQ ID NO: 125627 - DNA, 25 bp, Homo sapien
ctaaagctatttactctggccgaga

SEQ ID NO: 125628 - DNA, 25 bp, Homo sapien
gattcgaaagccttgctgagcttcc

SEQ ID NO: 125629 - DNA, 25 bp, Homo sapien
gagcttccggcaatcatgactcatg

SEQ ID NO: 125630 - DNA, 25 bp, Homo sapien
atgactcatgcatcagttcttaaga

SEQ ID NO: 125631 - DNA, 25 bp, Homo sapien
gatgtccttggaattagtgacacac

SEQ ID NO: 125632 - DNA, 25 bp, Homo sapien
gtgacacactgattcgactttctgt

SEQ ID NO: 125633 - DNA, 25 bp, Homo sapien
gattcgactttctgtgggcttagag

SEQ ID NO: 125634 - DNA, 25 bp, Homo sapien
tcaagctttgaaggcagcacaccct

SEQ ID NO: 125635 - DNA, 25 bp, Homo sapien
gctagtattccagagctgctattag

SEQ ID NO: 125636 - DNA, 25 bp, Homo sapien
agaagctgcttcctgtgaagatcaa

SEQ ID NO: 125637 - DNA, 25 bp, Homo sapien
tctaagtcaggtcaccagagggaag

SEQ ID NO: 125638 - DNA, 25 bp, Homo sapien
gagggaagagaacatggcattaaaa

SEQ ID NO: 125639 - DNA, 25 bp, Homo sapien
ggcattaaaagaatcacatcttcag

SEQ ID NO: 125640 - DNA, 25 bp, Homo sapien
gaagacactaatattattacccata

SEQ ID NO: 125641 - DNA, 25 bp, Homo sapien
ttacccatatacatgatttcagaag

SEQ ID NO: 125642 - DNA, 25 bp, Homo sapien
agaagatgacataagattcctctta

SEQ ID NO: 125643 - DNA, 25 bp, Homo sapien
gaggaaatgtcaggaatcaagccac

SEQ ID NO: 125644 - DNA, 25 bp, Homo sapien
gagtcattgtgtctgaaaactgcaa

SEQ ID NO: 125645 - DNA, 25 bp, Homo sapien
aaagtgaacttaactgagatccagc

SEQ ID NO: 125646 - DNA, 25 bp, Homo sapien
gagatccagcaaacaggttctgttt

SEQ ID NO: 125647 - DNA, 25 bp, Homo sapien
aaaatggacttcttattcaaagcat

SEQ ID NO: 125648 - DNA, 25 bp, Homo sapien
gaattatgatcatttgatttggcta

SEQ ID NO: 125649 - DNA, 25 bp, Homo sapien
ctggacttaccttgagttaaaggca

SEQ ID NO: 125650 - DNA, 25 bp, Homo sapien
gaaatcagttgcatattatccatta

SEQ ID NO: 125651 - DNA, 25 bp, Homo sapien
gaggagtcaccttgaattattttct

SEQ ID NO: 125652 - DNA, 25 bp, Homo sapien
gaattattttctgagtcaccttgag

SEQ ID NO: 125653 - DNA, 25 bp, Homo sapien
ctgagtcaccttgagttatttgatc

SEQ ID NO: 125654 - DNA, 25 bp, Homo sapien
agttatttgatctctcagcctgctt

SEQ ID NO: 125655 - DNA, 25 bp, Homo sapien
tttgatctctcagcctgctttctca

SEQ ID NO: 125656 - DNA, 25 bp, Homo sapien
gggaggataactttcacagggtaat

SEQ ID NO: 125657 - DNA, 25 bp, Homo sapien
ctttcacagggtaattggtaggcta

SEQ ID NO: 125658 - DNA, 25 bp, Homo sapien
gtaggctaaataggagttacagaaa

SEQ ID NO: 125659 - DNA, 25 bp, Homo sapien
ttattttggtattaagtcgttgcct

SEQ ID NO: 125660 - DNA, 25 bp, Homo sapien
tttggtattaagtcgttgcctttat

SEQ ID NO: 125661 - DNA, 25 bp, Homo sapien
ggtattaagtcgttgcctttatttg

SEQ ID NO: 125662 - DNA, 25 bp, Homo sapien
tattaagtcgttgcctttatttgta

SEQ ID NO: 125663 - DNA, 25 bp, Homo sapien
gtataattacttgattcacacagtg

SEQ ID NO: 125664 - DNA, 25 bp, Homo sapien
taattacttgattcacacagtgaga

SEQ ID NO: 125665 - DNA, 25 bp, Homo sapien
ctctagggagaggtacagtgtttat

SEQ ID NO: 125666 - DNA, 25 bp, Homo sapien
ctagggagaggtacagtgtttatat

SEQ ID NO: 125667 - DNA, 25 bp, Homo sapien
gtgtttatattttggagccttcctg

SEQ ID NO: 125668 - DNA, 25 bp, Homo sapien
gtttatattttggagccttcctgaa

SEQ ID NO: 125669 - DNA, 25 bp, Homo sapien
ttatattttggagccttcctgaagg

SEQ ID NO: 125670 - DNA, 25 bp, Homo sapien
gaccatcagttacagagaatttcct

SEQ ID NO: 125671 - DNA, 25 bp, Homo sapien
aactacaacttctccttagacactt

SEQ ID NO: 125672 - DNA, 25 bp, Homo sapien
tagacactttggaatctaaccactt

SEQ ID NO: 125673 - DNA, 25 bp, Homo sapien
tggaatctaaccacttaaggacctt

SEQ ID NO: 125674 - DNA, 25 bp, Homo sapien
agatcaatttctcccaaggccaaga

SEQ ID NO: 125675 - DNA, 25 bp, Homo sapien
aggccaagattgtccttttctccca

SEQ ID NO: 125676 - DNA, 25 bp, Homo sapien
ttttctcccatttcttgctagctat

SEQ ID NO: 125677 - DNA, 25 bp, Homo sapien
gaagaacattattcatctctcctcc

SEQ ID NO: 125678 - DNA, 25 bp, Homo sapien
ttttttcagtcagttttgctcctgg

SEQ ID NO: 125679 - DNA, 25 bp, Homo sapien
tcctgggttcaagtagtattaccac

SEQ ID NO: 125680 - DNA, 25 bp, Homo sapien
ttaccaccctttcacaagcaacaga

SEQ ID NO: 125681 - DNA, 25 bp, Homo sapien
gtattgggtttggaggccttacaca

SEQ ID NO: 125682 - DNA, 25 bp, Homo sapien
ggaggccttacacaacaagtggaaa

SEQ ID NO: 125683 - DNA, 25 bp, Homo sapien
gaatgaagaggtgcgccgtttctca

SEQ ID NO: 125684 - DNA, 25 bp, Homo sapien
gtttctcagattttttgcgagccta

SEQ ID NO: 125685 - DNA, 25 bp, Homo sapien
tgcgagcctaaaacacttgccaagt

SEQ ID NO: 125686 - DNA, 25 bp, Homo sapien
aacacttgccaagtaatcctgcaca

SEQ ID NO: 125687 - DNA, 25 bp, Homo sapien
aatcctgcacagatcgatacctttc

SEQ ID NO: 125688 - DNA, 25 bp, Homo sapien
agatcgatacctttccccaaatagc

SEQ ID NO: 125689 - DNA, 25 bp, Homo sapien
aaatagcctctcctttgtagtcgta

SEQ ID NO: 125690 - DNA, 25 bp, Homo sapien
gaagtgatcaggtctttactgaatg

SEQ ID NO: 125691 - DNA, 25 bp, Homo sapien
tactgaatgttagaagaggcctttg

SEQ ID NO: 125692 - DNA, 25 bp, Homo sapien
ggcctgaaggtcagggtcacccaag

SEQ ID NO: 125693 - DNA, 25 bp, Homo sapien
aaggtcagggtcacccaagcaacaa

SEQ ID NO: 125694 - DNA, 25 bp, Homo sapien
caagcaacaaagtcccgagcaatga

SEQ ID NO: 125695 - DNA, 25 bp, Homo sapien
aaagtcccgagcaatgaagtcatcc

SEQ ID NO: 125696 - DNA, 25 bp, Homo sapien
gagcaatgaagtcatccactcctgc

SEQ ID NO: 125697 - DNA, 25 bp, Homo sapien
aatgaagtcatccactcctgcatct

SEQ ID NO: 125698 - DNA, 25 bp, Homo sapien
actcctgcatctggttggtctttat

SEQ ID NO: 125699 - DNA, 25 bp, Homo sapien
gcatctggttggtctttattgagca

SEQ ID NO: 125700 - DNA, 25 bp, Homo sapien
agttggagatcagcatgggccacgt

SEQ ID NO: 125701 - DNA, 25 bp, Homo sapien
gcatgggccacgtagcgcgactcca

SEQ ID NO: 125702 - DNA, 25 bp, Homo sapien
agctgggcaattggcgggcatggag

SEQ ID NO: 125703 - DNA, 25 bp, Homo sapien
ggtaactgctttgcttcttgagtag

SEQ ID NO: 125704 - DNA, 25 bp, Homo sapien
tgcttcttgagtagagccaccacca

SEQ ID NO: 125705 - DNA, 25 bp, Homo sapien
agatgagtgctctgtggacccacag

SEQ ID NO: 125706 - DNA, 25 bp, Homo sapien
acagcctaagctgagtgtgacccca

SEQ ID NO: 125707 - DNA, 25 bp, Homo sapien
gtgtgaccccagaagccacgatgtg

SEQ ID NO: 125708 - DNA, 25 bp, Homo sapien
gccacgatgtgctctgtatccagaa

SEQ ID NO: 125709 - DNA, 25 bp, Homo sapien
gtatccagaacacacttggcagatg

SEQ ID NO: 125710 - DNA, 25 bp, Homo sapien
agaccatggctgttacagggatcat

SEQ ID NO: 125711 - DNA, 25 bp, Homo sapien
cagggatcatgtaaacttgctgttt

SEQ ID NO: 125712 - DNA, 25 bp, Homo sapien
ttgtatgtgtggtgacttgcggatt

SEQ ID NO: 125713 - DNA, 25 bp, Homo sapien
gacttgcggatttatgtttcagtgt

SEQ ID NO: 125714 - DNA, 25 bp, Homo sapien
atttgagaagaaatactcctgtatt

SEQ ID NO: 125715 - DNA, 25 bp, Homo sapien
tcctgtattgagttgtatcgtgtgg

SEQ ID NO: 125716 - DNA, 25 bp, Homo sapien
gttgtatcgtgtggtgtatttttta

SEQ ID NO: 125717 - DNA, 25 bp, Homo sapien
aaaagtatgcagattatttgcccaa

SEQ ID NO: 125718 - DNA, 25 bp, Homo sapien
gattatttgcccaaagttgtcctct

SEQ ID NO: 125719 - DNA, 25 bp, Homo sapien
aaagttgtcctcttcttcagattca

SEQ ID NO: 125720 - DNA, 25 bp, Homo sapien
gttgtcctcttcttcagattcagca

SEQ ID NO: 125721 - DNA, 25 bp, Homo sapien
tcttcttccatggttccacagaagc

SEQ ID NO: 125722 - DNA, 25 bp, Homo sapien
tccatggttccacagaagctttgtt

SEQ ID NO: 125723 - DNA, 25 bp, Homo sapien
ggttccacagaagctttgtttcttg

SEQ ID NO: 125724 - DNA, 25 bp, Homo sapien
ccacagaagctttgtttcttgggca

SEQ ID NO: 125725 - DNA, 25 bp, Homo sapien
cagtgggtgtccagtccaggacact

SEQ ID NO: 125726 - DNA, 25 bp, Homo sapien
ccagtccaggacactggtgcttttt

SEQ ID NO: 125727 - DNA, 25 bp, Homo sapien
tttatacaagagaacgagccagagt

SEQ ID NO: 125728 - DNA, 25 bp, Homo sapien
aacgagccagagttcactccttcct

SEQ ID NO: 125729 - DNA, 25 bp, Homo sapien
tcctggctctctatatacctgtgaa

SEQ ID NO: 125730 - DNA, 25 bp, Homo sapien
ggctctctatatacctgtgaatatg

SEQ ID NO: 125731 - DNA, 25 bp, Homo sapien
agaacttgtacctatcacttcaacc

SEQ ID NO: 125732 - DNA, 25 bp, Homo sapien
aacccctgccttgtacataatacta

SEQ ID NO: 125733 - DNA, 25 bp, Homo sapien
aatactattccatccacacagtttc

SEQ ID NO: 125734 - DNA, 25 bp, Homo sapien
aggtaaccaggtggcatctacccca

SEQ ID NO: 125735 - DNA, 25 bp, Homo sapien
aggtggcatctaccccatgttttat

SEQ ID NO: 125736 - DNA, 25 bp, Homo sapien
aatcatttagttgacaaggtgccta

SEQ ID NO: 125737 - DNA, 25 bp, Homo sapien
caaggtgcctatgccattgttaaat

SEQ ID NO: 125738 - DNA, 25 bp, Homo sapien
gcctatgccattgttaaattttctt

SEQ ID NO: 125739 - DNA, 25 bp, Homo sapien
ttaccaccattttgtaaaggtctga

SEQ ID NO: 125740 - DNA, 25 bp, Homo sapien
aaaggtctgaaaccacattgggcac

SEQ ID NO: 125741 - DNA, 25 bp, Homo sapien
tgaaaccacattgggcaccctttat

SEQ ID NO: 125742 - DNA, 25 bp, Homo sapien
acattgggcaccctttatccaggtc

SEQ ID NO: 125743 - DNA, 25 bp, Homo sapien
ttgggcaccctttatccaggtccct

SEQ ID NO: 125744 - DNA, 25 bp, Homo sapien
acacttaaaattggtgccgagcagg

SEQ ID NO: 125745 - DNA, 25 bp, Homo sapien
ttggtgccgagcagggatataacct

SEQ ID NO: 125746 - DNA, 25 bp, Homo sapien
gggatataacctgcagttaagtgaa

SEQ ID NO: 125747 - DNA, 25 bp, Homo sapien
tgggtctacggcttcagtgaccgcg

SEQ ID NO: 125748 - DNA, 25 bp, Homo sapien
tacggcttcagtgaccgcgtgggca

SEQ ID NO: 125749 - DNA, 25 bp, Homo sapien
agcgtgaaggtctccagtggaacat

SEQ ID NO: 125750 - DNA, 25 bp, Homo sapien
tatcagtatcctggctaccgcgggt

SEQ ID NO: 125751 - DNA, 25 bp, Homo sapien
gggtaccagtacctcctagagcctg

SEQ ID NO: 125752 - DNA, 25 bp, Homo sapien
tagagcctggtgacttccggcactg

SEQ ID NO: 125753 - DNA, 25 bp, Homo sapien
gtgacttccggcactggaatgagtg

SEQ ID NO: 125754 - DNA, 25 bp, Homo sapien
agccacagatgcagtccctgcgtcg

SEQ ID NO: 125755 - DNA, 25 bp, Homo sapien
tgcgtcgcctgcgtgacaagcagtg

SEQ ID NO: 125756 - DNA, 25 bp, Homo sapien
gcgtgacaagcagtggcacctcgag

SEQ ID NO: 125757 - DNA, 25 bp, Homo sapien
aagtgagtccacacctcactctgct

SEQ ID NO: 125758 - DNA, 25 bp, Homo sapien
gcagaagtgcccacacaactggtct

SEQ ID NO: 125759 - DNA, 25 bp, Homo sapien
gaagtgcccacacaactggtctcat

SEQ ID NO: 125760 - DNA, 25 bp, Homo sapien
agtgcccacacaactggtctcatac

SEQ ID NO: 125761 - DNA, 25 bp, Homo sapien
agggttgggccccgctcaagccact

SEQ ID NO: 125762 - DNA, 25 bp, Homo sapien
caccctcagccaaggatcctgcaca

SEQ ID NO: 125763 - DNA, 25 bp, Homo sapien
tgtggcaagtcctcaatcctgtgtc

SEQ ID NO: 125764 - DNA, 25 bp, Homo sapien
ggcaagtcctcaatcctgtgtccca

SEQ ID NO: 125765 - DNA, 25 bp, Homo sapien
ttgatcccacctttgctcctgacaa

SEQ ID NO: 125766 - DNA, 25 bp, Homo sapien
ttgctcctgacaaccctcattcaat

SEQ ID NO: 125767 - DNA, 25 bp, Homo sapien
ctcctgacaaccctcattcaataaa

SEQ ID NO: 125768 - DNA, 25 bp, Homo sapien
tgacaaccctcattcaataaagacc

SEQ ID NO: 125769 - DNA, 25 bp, Homo sapien
tactttttggtgtttatgaaaatca

SEQ ID NO: 125770 - DNA, 25 bp, Homo sapien
aatcatttagttgacaaggtgccta

SEQ ID NO: 125771 - DNA, 25 bp, Homo sapien
tagttgacaaggtgcctatgccatt

SEQ ID NO: 125772 - DNA, 25 bp, Homo sapien
gacaaggtgcctatgccattgttaa

SEQ ID NO: 125773 - DNA, 25 bp, Homo sapien
caaggtgcctatgccattgttaaat

SEQ ID NO: 125774 - DNA, 25 bp, Homo sapien
ggtgcctatgccattgttaaatttt

SEQ ID NO: 125775 - DNA, 25 bp, Homo sapien
gcctatgccattgttaaattttctt

SEQ ID NO: 125776 - DNA, 25 bp, Homo sapien
gtaatttaacaacagatttgctaat

SEQ ID NO: 125777 - DNA, 25 bp, Homo sapien
acacttaaaattggtgccgagcagg

SEQ ID NO: 125778 - DNA, 25 bp, Homo sapien
ttggtgccgagcagggatataacct

SEQ ID NO: 125779 - DNA, 25 bp, Homo sapien
gggatataacctgcagttaagtgaa

SEQ ID NO: 125780 - DNA, 25 bp, Homo sapien
gtatagagccaccatgattcttaca

SEQ ID NO: 125781 - DNA, 25 bp, Homo sapien
gattcttacagttggtggaacagca

SEQ ID NO: 125782 - DNA, 25 bp, Homo sapien
ctggctgtggcttcatttcccaaga

SEQ ID NO: 125783 - DNA, 25 bp, Homo sapien
tcatttcccaagaagcaggagtgac

SEQ ID NO: 125784 - DNA, 25 bp, Homo sapien
atttcccaagaagcaggagtgactt

SEQ ID NO: 125785 - DNA, 25 bp, Homo sapien
ttcccaagaagcaggagtgacttca

SEQ ID NO: 125786 - DNA, 25 bp, Homo sapien
cccaagaagcaggagtgacttcagt

SEQ ID NO: 125787 - DNA, 25 bp, Homo sapien
aagcaggagtgacttcagtcatccc

SEQ ID NO: 125788 - DNA, 25 bp, Homo sapien
tcccagcaatcgcttggttcagttt

SEQ ID NO: 125789 - DNA, 25 bp, Homo sapien
caatcgcttggttcagtttcattca

SEQ ID NO: 125790 - DNA, 25 bp, Homo sapien
ataaataaccgagctcttctttggg

SEQ ID NO: 125791 - DNA, 25 bp, Homo sapien
tccccaataatttttggctattctg

SEQ ID NO: 125792 - DNA, 25 bp, Homo sapien
ttggctattctgcttcttttgtgtt

SEQ ID NO: 125793 - DNA, 25 bp, Homo sapien
gtaaattttatcatcagtgtgtcta

SEQ ID NO: 125794 - DNA, 25 bp, Homo sapien
catcagtgtgtctatttctacaaat

SEQ ID NO: 125795 - DNA, 25 bp, Homo sapien
cctgatagggtttgaattgggattt

SEQ ID NO: 125796 - DNA, 25 bp, Homo sapien
gggatttctgtgaatctatagatca

SEQ ID NO: 125797 - DNA, 25 bp, Homo sapien
tcatgaatatagtatacccctgtat

SEQ ID NO: 125798 - DNA, 25 bp, Homo sapien
tagtatacccctgtatttatttgtt

SEQ ID NO: 125799 - DNA, 25 bp, Homo sapien
gttttgtagttttcaccatgacagt

SEQ ID NO: 125800 - DNA, 25 bp, Homo sapien
tagttttcaccatgacagtcttgca

SEQ ID NO: 125801 - DNA, 25 bp, Homo sapien
catgacagtcttgcacatattttgt

SEQ ID NO: 125802 - DNA, 25 bp, Homo sapien
ggaagcttcccaagagtagcctcaa

SEQ ID NO: 125803 - DNA, 25 bp, Homo sapien
gaagcttcccaagagtagcctcaac

SEQ ID NO: 125804 - DNA, 25 bp, Homo sapien
aagcttcccaagagtagcctcaacc

SEQ ID NO: 125805 - DNA, 25 bp, Homo sapien
agcttcccaagagtagcctcaacct

SEQ ID NO: 125806 - DNA, 25 bp, Homo sapien
gcttcccaagagtagcctcaacctg

SEQ ID NO: 125807 - DNA, 25 bp, Homo sapien
cttcccaagagtagcctcaacctgt

SEQ ID NO: 125808 - DNA, 25 bp, Homo sapien
ttcccaagagtagcctcaacctgtg

SEQ ID NO: 125809 - DNA, 25 bp, Homo sapien
tcccaagagtagcctcaacctgtgc

SEQ ID NO: 125810 - DNA, 25 bp, Homo sapien
cccaagagtagcctcaacctgtgct

SEQ ID NO: 125811 - DNA, 25 bp, Homo sapien
ccaagagtagcctcaacctgtgctt

SEQ ID NO: 125812 - DNA, 25 bp, Homo sapien
caagagtagcctcaacctgtgcttc

SEQ ID NO: 125813 - DNA, 25 bp, Homo sapien
gacagaatgtccctggtgaattcca

SEQ ID NO: 125814 - DNA, 25 bp, Homo sapien
tgtgccaggccagtcacaccgacca

SEQ ID NO: 125815 - DNA, 25 bp, Homo sapien
tccccatgtgcctgtgccaagagac

SEQ ID NO: 125816 - DNA, 25 bp, Homo sapien
ccatgtgcctgtgccaagagacaga

SEQ ID NO: 125817 - DNA, 25 bp, Homo sapien
gtgcctgtgccaagagacagacaga

SEQ ID NO: 125818 - DNA, 25 bp, Homo sapien
aaggctgcaggagtcctttgttgct

SEQ ID NO: 125819 - DNA, 25 bp, Homo sapien
ctgcaggagtcctttgttgctcagc

SEQ ID NO: 125820 - DNA, 25 bp, Homo sapien
tccttcttgcttctaatagacctgg

SEQ ID NO: 125821 - DNA, 25 bp, Homo sapien
tcttgcttctaatagacctggtaca

SEQ ID NO: 125822 - DNA, 25 bp, Homo sapien
gcttctaatagacctggtacatggt

SEQ ID NO: 125823 - DNA, 25 bp, Homo sapien
agacctggtacatggtacacacacc

SEQ ID NO: 125824 - DNA, 25 bp, Homo sapien
gtatgggctcacaagaagatgattc

SEQ ID NO: 125825 - DNA, 25 bp, Homo sapien
gaaacaaaccatccagttattcttg

SEQ ID NO: 125826 - DNA, 25 bp, Homo sapien
aagagaaactaccatcttggccagt

SEQ ID NO: 125827 - DNA, 25 bp, Homo sapien
tcttggccagtgacaagtgttcgga

SEQ ID NO: 125828 - DNA, 25 bp, Homo sapien
gcagagaggaccaagcctgtgtcac

SEQ ID NO: 125829 - DNA, 25 bp, Homo sapien
agcctgtgtcacctggagactaaaa

SEQ ID NO: 125830 - DNA, 25 bp, Homo sapien
ttgttttgacatcttcagtcctgtg

SEQ ID NO: 125831 - DNA, 25 bp, Homo sapien
ttgacatcttcagtcctgtgtgctt

SEQ ID NO: 125832 - DNA, 25 bp, Homo sapien
gtgctttcagaaaaccattttctct

SEQ ID NO: 125833 - DNA, 25 bp, Homo sapien
caaactttaaagtctgtcgtggatt

SEQ ID NO: 125834 - DNA, 25 bp, Homo sapien
ctgtcgtggatttatttatcctcag

SEQ ID NO: 125835 - DNA, 25 bp, Homo sapien
ctcctgtccaatgccgaatgcaaga

SEQ ID NO: 125836 - DNA, 25 bp, Homo sapien
aatgccgaatgcaagaagtcctggg

SEQ ID NO: 125837 - DNA, 25 bp, Homo sapien
atcaccgacgtgatgatctgtgccg

SEQ ID NO: 125838 - DNA, 25 bp, Homo sapien
gccagtggcgtctcctcctgcatgg

SEQ ID NO: 125839 - DNA, 25 bp, Homo sapien
tcctgcatgggcgactctggcggtc

SEQ ID NO: 125840 - DNA, 25 bp, Homo sapien
catgggcgactctggcggtcccctg

SEQ ID NO: 125841 - DNA, 25 bp, Homo sapien
gtcccctggtctgccaaaaggatgg

SEQ ID NO: 125842 - DNA, 25 bp, Homo sapien
cctggaccctggtgggcattgtgtc

SEQ ID NO: 125843 - DNA, 25 bp, Homo sapien
agccctggcgtgtacgcccgtgtca

SEQ ID NO: 125844 - DNA, 25 bp, Homo sapien
gtgtcaccaagctcataccttgggt

SEQ ID NO: 125845 - DNA, 25 bp, Homo sapien
cataccttgggtgcagaagatcctg

SEQ ID NO: 125846 - DNA, 25 bp, Homo sapien
cctctacagagttttatggaatacc

SEQ ID NO: 125847 - DNA, 25 bp, Homo sapien
gaatacctggtactaacgtaggcag

SEQ ID NO: 125848 - DNA, 25 bp, Homo sapien
gcaaaaccacactgagttacagctg

SEQ ID NO: 125849 - DNA, 25 bp, Homo sapien
acactgagttacagctgtcagccct

SEQ ID NO: 125850 - DNA, 25 bp, Homo sapien
ctcattcctaaataacttgccttac

SEQ ID NO: 125851 - DNA, 25 bp, Homo sapien
ataacttgccttacatatcagccct

SEQ ID NO: 125852 - DNA, 25 bp, Homo sapien
agccctcccacttctgaagttcaaa

SEQ ID NO: 125853 - DNA, 25 bp, Homo sapien
gaagttcaaattagtgcctcggaaa

SEQ ID NO: 125854 - DNA, 25 bp, Homo sapien
caaattagtgcctcggaaatgtaga

SEQ ID NO: 125855 - DNA, 25 bp, Homo sapien
gaactcttaaatcctcagatgccag

SEQ ID NO: 125856 - DNA, 25 bp, Homo sapien
gggtctgctctagcatcagtaagta

SEQ ID NO: 125857 - DNA, 25 bp, Homo sapien
ctcctgtccaatgccgaatgcaaga

SEQ ID NO: 125858 - DNA, 25 bp, Homo sapien
ctgtccaatgccgaatgcaagaagt

SEQ ID NO: 125859 - DNA, 25 bp, Homo sapien
tccaatgccgaatgcaagaagtcct

SEQ ID NO: 125860 - DNA, 25 bp, Homo sapien
aatgccgaatgcaagaagtcctggg

SEQ ID NO: 125861 - DNA, 25 bp, Homo sapien
aggaggatcaccgacgtgatgatct

SEQ ID NO: 125862 - DNA, 25 bp, Homo sapien
gaggatcaccgacgtgatgatctgt

SEQ ID NO: 125863 - DNA, 25 bp, Homo sapien
atcaccgacgtgatgatctgtgccg

SEQ ID NO: 125864 - DNA, 25 bp, Homo sapien
tcaccgacgtgatgatctgtgccgg

SEQ ID NO: 125865 - DNA, 25 bp, Homo sapien
caccgacgtgatgatctgtgccggg

SEQ ID NO: 125866 - DNA, 25 bp, Homo sapien
gggccagtggcgtctcctcctgcat

SEQ ID NO: 125867 - DNA, 25 bp, Homo sapien
ccagtggcgtctcctcctgcatggg

SEQ ID NO: 125868 - DNA, 25 bp, Homo sapien
acgacctgccccagcagttggagag

SEQ ID NO: 125869 - DNA, 25 bp, Homo sapien
gaaaatcagcaagccaccagtggtc

SEQ ID NO: 125870 - DNA, 25 bp, Homo sapien
aaaccagccgtctgttcgccgtgga

SEQ ID NO: 125871 - DNA, 25 bp, Homo sapien
gtggataccggcgtccctacaatta

SEQ ID NO: 125872 - DNA, 25 bp, Homo sapien
ggcgtccctacaattaccggcgtcg

SEQ ID NO: 125873 - DNA, 25 bp, Homo sapien
ctaacgctccttcacaagatggcaa

SEQ ID NO: 125874 - DNA, 25 bp, Homo sapien
gtgaagcaccaactgagaaccctgc

SEQ ID NO: 125875 - DNA, 25 bp, Homo sapien
gagcagtgctgagtaacaccaggct

SEQ ID NO: 125876 - DNA, 25 bp, Homo sapien
tgagtaacaccaggctcctcaggca

SEQ ID NO: 125877 - DNA, 25 bp, Homo sapien
aggcaccttcaccatcggcaggtga

SEQ ID NO: 125878 - DNA, 25 bp, Homo sapien
accatcggcaggtgacctaaagaat

SEQ ID NO: 125879 - DNA, 25 bp, Homo sapien
ttcaggcggccatcgtgagaatcat

SEQ ID NO: 125880 - DNA, 25 bp, Homo sapien
gaaggttctgaaacaccagcagtta

SEQ ID NO: 125881 - DNA, 25 bp, Homo sapien
cagcagttacttggcgaggtcctca

SEQ ID NO: 125882 - DNA, 25 bp, Homo sapien
cttggcgaggtcctcactcagctgt

SEQ ID NO: 125883 - DNA, 25 bp, Homo sapien
gtcctccaggttcaaacctcgagtc

SEQ ID NO: 125884 - DNA, 25 bp, Homo sapien
acctcgagtccctgtgatcaagaaa

SEQ ID NO: 125885 - DNA, 25 bp, Homo sapien
acagttacttggcttaacccttctg

SEQ ID NO: 125886 - DNA, 25 bp, Homo sapien
ccttctggaagggtctgactgtgtg

SEQ ID NO: 125887 - DNA, 25 bp, Homo sapien
gtctgactgtgtgacccgcagcaaa

SEQ ID NO: 125888 - DNA, 25 bp, Homo sapien
gacccgcagcaaatagttcatgttg

SEQ ID NO: 125889 - DNA, 25 bp, Homo sapien
acttcaagttcataggcagccagcc

SEQ ID NO: 125890 - DNA, 25 bp, Homo sapien
atattcctttttaatgactcgttgt

SEQ ID NO: 125891 - DNA, 25 bp, Homo sapien
gactcgttgttctaacatttcctag

SEQ ID NO: 125892 - DNA, 25 bp, Homo sapien
agaagtgttcttataaaggtctaat

SEQ ID NO: 125893 - DNA, 25 bp, Homo sapien
aggtctaatgtatccacaggctgtt

SEQ ID NO: 125894 - DNA, 25 bp, Homo sapien
atccacaggctgttgtcttattagt

SEQ ID NO: 125895 - DNA, 25 bp, Homo sapien
ggctgttgtcttattagtaaatgca

SEQ ID NO: 125896 - DNA, 25 bp, Homo sapien
ttgtctgttttactctagtctttag

SEQ ID NO: 125897 - DNA, 25 bp, Homo sapien
tttactctagtctttagtacttcaa

SEQ ID NO: 125898 - DNA, 25 bp, Homo sapien
ttcatatccatgatcttgagtccat

SEQ ID NO: 125899 - DNA, 25 bp, Homo sapien
gtatgagtatgtatgttcctgaagt

SEQ ID NO: 125900 - DNA, 25 bp, Homo sapien
atgttcctgaagttggtcctattta

SEQ ID NO: 125901 - DNA, 25 bp, Homo sapien
aacgtagtagttgtctgctctttgt

SEQ ID NO: 125902 - DNA, 25 bp, Homo sapien
aaagtcccttctgttgtgattccca

SEQ ID NO: 125903 - DNA, 25 bp, Homo sapien
tgattcccaggacttttcctcaaga

SEQ ID NO: 125904 - DNA, 25 bp, Homo sapien
atctggatttccacctaccgcttac

SEQ ID NO: 125905 - DNA, 25 bp, Homo sapien
acctaccgcttacctgaaatgcagg

SEQ ID NO: 125906 - DNA, 25 bp, Homo sapien
gaaatgcaggatcacctacttactg

SEQ ID NO: 125907 - DNA, 25 bp, Homo sapien
ggatcacctacttactgtattctac

SEQ ID NO: 125908 - DNA, 25 bp, Homo sapien
atactaacattcttgtaggagtggt

SEQ ID NO: 125909 - DNA, 25 bp, Homo sapien
gaagctgatgcctcatttctacatt

SEQ ID NO: 125910 - DNA, 25 bp, Homo sapien
atgcctcatttctacattctgtcat

SEQ ID NO: 125911 - DNA, 25 bp, Homo sapien
gctattatcatctaacgtttcagtg

SEQ ID NO: 125912 - DNA, 25 bp, Homo sapien
ctgggtcactgttgcactacctgct

SEQ ID NO: 125913 - DNA, 25 bp, Homo sapien
tgcactacctgctccaggcaatgga

SEQ ID NO: 125914 - DNA, 25 bp, Homo sapien
aatggagagacctggccggagccaa

SEQ ID NO: 125915 - DNA, 25 bp, Homo sapien
gtttcagccccagaggtttggcaga

SEQ ID NO: 125916 - DNA, 25 bp, Homo sapien
tttggcagaaatacccagggatcct

SEQ ID NO: 125917 - DNA, 25 bp, Homo sapien
gaatgaatggctgagtccccgggct

SEQ ID NO: 125918 - DNA, 25 bp, Homo sapien
gaattcccagttctggagcctggct

SEQ ID NO: 125919 - DNA, 25 bp, Homo sapien
tgcccctcaacgctttgggaagaag

SEQ ID NO: 125920 - DNA, 25 bp, Homo sapien
catgtcatcccttgatatgtctgca

SEQ ID NO: 125921 - DNA, 25 bp, Homo sapien
tatgtctgcatgcaaggtccacacc

SEQ ID NO: 125922 - DNA, 25 bp, Homo sapien
ggtccacacccaaaagtgtcaatgt

SEQ ID NO: 125923 - DNA, 25 bp, Homo sapien
gtgaagtacaggcacagcccgactg

SEQ ID NO: 125924 - DNA, 25 bp, Homo sapien
ctgcagggagggatgcacccatcat

SEQ ID NO: 125925 - DNA, 25 bp, Homo sapien
ggatgcacccatcatttacccatgg

SEQ ID NO: 125926 - DNA, 25 bp, Homo sapien
ttacccatgggagcatctgtaggac

SEQ ID NO: 125927 - DNA, 25 bp, Homo sapien
ggagcatctgtaggaccatctctct

SEQ ID NO: 125928 - DNA, 25 bp, Homo sapien
tggccagatggactgtcctacagca

SEQ ID NO: 125929 - DNA, 25 bp, Homo sapien
actgtcctacagcaatcgtttccat

SEQ ID NO: 125930 - DNA, 25 bp, Homo sapien
tacagcaatcgtttccatctgtcac

SEQ ID NO: 125931 - DNA, 25 bp, Homo sapien
ctttcataccagtcactatcttggg

SEQ ID NO: 125932 - DNA, 25 bp, Homo sapien
taccagtcactatcttgggtaacaa

SEQ ID NO: 125933 - DNA, 25 bp, Homo sapien
taacaaatttatacaggacagtggt

SEQ ID NO: 125934 - DNA, 25 bp, Homo sapien
gattatagaaggctgtcttagtgca

SEQ ID NO: 125935 - DNA, 25 bp, Homo sapien
gaaggctgtcttagtgcaaaaaaca

SEQ ID NO: 125936 - DNA, 25 bp, Homo sapien
aaaaacatacttacatttcagacat

SEQ ID NO: 125937 - DNA, 25 bp, Homo sapien
tacatttcagacatatccaaaggga

SEQ ID NO: 125938 - DNA, 25 bp, Homo sapien
tatccaaagggaatactcacatttt

SEQ ID NO: 125939 - DNA, 25 bp, Homo sapien
ggagtaaaccatgtattcccttatc

SEQ ID NO: 125940 - DNA, 25 bp, Homo sapien
catgtattcccttatcttttacttt

SEQ ID NO: 125941 - DNA, 25 bp, Homo sapien
ctctggtggattgttctagtactgt

SEQ ID NO: 125942 - DNA, 25 bp, Homo sapien
ctagtactgtattgggcttcttcgt

SEQ ID NO: 125943 - DNA, 25 bp, Homo sapien
actgtattgggcttcttcgttaata

SEQ ID NO: 125944 - DNA, 25 bp, Homo sapien
gggcttcttcgttaatagattattt

SEQ ID NO: 125945 - DNA, 25 bp, Homo sapien
gaagtttgtttattgattctcacac

SEQ ID NO: 125946 - DNA, 25 bp, Homo sapien
aaaccaccaagattcctgctgcaat

SEQ ID NO: 125947 - DNA, 25 bp, Homo sapien
attcctgctgcaatgaaccaaatca

SEQ ID NO: 125948 - DNA, 25 bp, Homo sapien
aaatgttatgaatgccacagactat

SEQ ID NO: 125949 - DNA, 25 bp, Homo sapien
gccacagactatgtagaacacgcta

SEQ ID NO: 125950 - DNA, 25 bp, Homo sapien
tattgctgtgtcagtggttctggtt

SEQ ID NO: 125951 - DNA, 25 bp, Homo sapien
tcagtggttctggttgtctatcgtc

SEQ ID NO: 125952 - DNA, 25 bp, Homo sapien
ttgtctatcgtctatttggcttgtc

SEQ ID NO: 125953 - DNA, 25 bp, Homo sapien
tcgtctatttggcttgtcgttggaa

SEQ ID NO: 125954 - DNA, 25 bp, Homo sapien
ggcttgtcgttggaatatgttgtac

SEQ ID NO: 125955 - DNA, 25 bp, Homo sapien
gaatatgttgtacgcagtgctgcct

SEQ ID NO: 125956 - DNA, 25 bp, Homo sapien
gcaggaggacctactaatcttgaaa

SEQ ID NO: 125957 - DNA, 25 bp, Homo sapien
aagggacatgttacccgatgaagta

SEQ ID NO: 125958 - DNA, 25 bp, Homo sapien
aactgttgctgagttttgcctctat

SEQ ID NO: 125959 - DNA, 25 bp, Homo sapien
gagttttgcctctatcatagtcagc

SEQ ID NO: 125960 - DNA, 25 bp, Homo sapien
aatatattgccatgaggaccccacc

SEQ ID NO: 125961 - DNA, 25 bp, Homo sapien
accttggagggtctgaccatcttca

SEQ ID NO: 125962 - DNA, 25 bp, Homo sapien
accatcttcacctgttccgcagaga

SEQ ID NO: 125963 - DNA, 25 bp, Homo sapien
gaaatgttgctctccattattccct

SEQ ID NO: 125964 - DNA, 25 bp, Homo sapien
attattcccttctaagccagagacc

SEQ ID NO: 125965 - DNA, 25 bp, Homo sapien
aagccagagacccttatccactgct

SEQ ID NO: 125966 - DNA, 25 bp, Homo sapien
tgctcctctaggtggcccatttatg

SEQ ID NO: 125967 - DNA, 25 bp, Homo sapien
gggaagtcttctgagaccacccagt

SEQ ID NO: 125968 - DNA, 25 bp, Homo sapien
gagaccacccagtgaataggcacta

SEQ ID NO: 125969 - DNA, 25 bp, Homo sapien
gaataggcactaccctgggattcaa

SEQ ID NO: 125970 - DNA, 25 bp, Homo sapien
accctgggattcaagacagtctttt

SEQ ID NO: 125971 - DNA, 25 bp, Homo sapien
cagtcttttgtaactgcacacgccc

SEQ ID NO: 125972 - DNA, 25 bp, Homo sapien
tctcgcgcgggactttgtacagcag

SEQ ID NO: 125973 - DNA, 25 bp, Homo sapien
gtacagcagtgtcttatccagcagc

SEQ ID NO: 125974 - DNA, 25 bp, Homo sapien
agtgtcttatccagcagccgattgg

SEQ ID NO: 125975 - DNA, 25 bp, Homo sapien
gcagccgattggatgtaacgttttg

SEQ ID NO: 125976 - DNA, 25 bp, Homo sapien
tggatgtaacgttttgctttgggtt

SEQ ID NO: 125977 - DNA, 25 bp, Homo sapien
aaagcagacgctactctcaagcagt

SEQ ID NO: 125978 - DNA, 25 bp, Homo sapien
attatgccagtttctgttctctcac

SEQ ID NO: 125979 - DNA, 25 bp, Homo sapien
aaacaatgctttttgtgcactacat

SEQ ID NO: 125980 - DNA, 25 bp, Homo sapien
ttgtgcactacatactcttcagtgt

SEQ ID NO: 125981 - DNA, 25 bp, Homo sapien
tcttcagtgtagagctcttgtttta

SEQ ID NO: 125982 - DNA, 25 bp, Homo sapien
gattaatatgcccttttgccgatgc

SEQ ID NO: 125983 - DNA, 25 bp, Homo sapien
tttgccgatgcatactattactgat

SEQ ID NO: 125984 - DNA, 25 bp, Homo sapien
tactgatgtgactcggttttgtcgc

SEQ ID NO: 125985 - DNA, 25 bp, Homo sapien
tttgtcgcagctttgctttgtttaa

SEQ ID NO: 125986 - DNA, 25 bp, Homo sapien
acacacttgtaaacctcttttgcac

SEQ ID NO: 125987 - DNA, 25 bp, Homo sapien
agaatccagcgggatgctcgagcac

SEQ ID NO: 125988 - DNA, 25 bp, Homo sapien
gatgctcgagcacctgtaaacaatt

SEQ ID NO: 125989 - DNA, 25 bp, Homo sapien
tgctgcctgcggtgcattcagacac

SEQ ID NO: 125990 - DNA, 25 bp, Homo sapien
gcctgcggtgcattcagacacggga

SEQ ID NO: 125991 - DNA, 25 bp, Homo sapien
tgcggtgcattcagacacgggacac

SEQ ID NO: 125992 - DNA, 25 bp, Homo sapien
gtgcattcagacacgggacaccaac

SEQ ID NO: 125993 - DNA, 25 bp, Homo sapien
ttcagacacgggacaccaacttcgg

SEQ ID NO: 125994 - DNA, 25 bp, Homo sapien
gacacgggacaccaacttcgggacg

SEQ ID NO: 125995 - DNA, 25 bp, Homo sapien
gggacaccaacttcgggacgaactg

SEQ ID NO: 125996 - DNA, 25 bp, Homo sapien
aacttcgggacgaactgcatctgcc

SEQ ID NO: 125997 - DNA, 25 bp, Homo sapien
gggacgaactgcatctgccgcgtgc

SEQ ID NO: 125998 - DNA, 25 bp, Homo sapien
gccgcgtgcccaaaagcaagctgga

SEQ ID NO: 125999 - DNA, 25 bp, Homo sapien
gcaagctggaagtgggccgcatcat

SEQ ID NO: 126000 - DNA, 25 bp, Homo sapien
tgacagtatttgttcctggacccca

SEQ ID NO: 126001 - DNA, 25 bp, Homo sapien
gttcctggaccccacaagacttgat

SEQ ID NO: 126002 - DNA, 25 bp, Homo sapien
gaaaattagcttatgtgacaaccct

SEQ ID NO: 126003 - DNA, 25 bp, Homo sapien
tatgtgacaaccctcatcttgatcc

SEQ ID NO: 126004 - DNA, 25 bp, Homo sapien
atccccatcccttctgaaagtagga

SEQ ID NO: 126005 - DNA, 25 bp, Homo sapien
gttggagctcttgcaatggaattca

SEQ ID NO: 126006 - DNA, 25 bp, Homo sapien
gaacagactctggagtgtccattta

SEQ ID NO: 126007 - DNA, 25 bp, Homo sapien
ggagtgtccatttagactacactaa

SEQ ID NO: 126008 - DNA, 25 bp, Homo sapien
gattttgtgtggtttggtgcaagtc

SEQ ID NO: 126009 - DNA, 25 bp, Homo sapien
aaattctggctagttgaatccacaa

SEQ ID NO: 126010 - DNA, 25 bp, Homo sapien
ttcatttatatacaggcttcccttt

SEQ ID NO: 126011 - DNA, 25 bp, Homo sapien
cttcagagggaaactcagatgtcca

SEQ ID NO: 126012 - DNA, 25 bp, Homo sapien
ctcagatgtccaaactaattttaac

SEQ ID NO: 126013 - DNA, 25 bp, Homo sapien
acaaacgcattaagaggtttatttg

SEQ ID NO: 126014 - DNA, 25 bp, Homo sapien
ggtttatttgggtacatggcccgca

SEQ ID NO: 126015 - DNA, 25 bp, Homo sapien
atttgggtacatggcccgcagtggc

SEQ ID NO: 126016 - DNA, 25 bp, Homo sapien
cgcagtggcttttgccccagaaagg

SEQ ID NO: 126017 - DNA, 25 bp, Homo sapien
ggaacacgcgggtagatgatttcta

SEQ ID NO: 126018 - DNA, 25 bp, Homo sapien
acacgcgggtagatgatttctagca

SEQ ID NO: 126019 - DNA, 25 bp, Homo sapien
atgatttctagcaggcaggaagtcc

SEQ ID NO: 126020 - DNA, 25 bp, Homo sapien
tttctagcaggcaggaagtcctgtg

SEQ ID NO: 126021 - DNA, 25 bp, Homo sapien
aggcaggaagtcctgtgcggtgtca

SEQ ID NO: 126022 - DNA, 25 bp, Homo sapien
gctggtttcatgtgctttatgtgta

SEQ ID NO: 126023 - DNA, 25 bp, Homo sapien
taaaactatatctgcctgtgtggct

SEQ ID NO: 126024 - DNA, 25 bp, Homo sapien
tatatctgcctgtgtggctttgcat

SEQ ID NO: 126025 - DNA, 25 bp, Homo sapien
ttgcatttcaaatgtgtggcgcaca

SEQ ID NO: 126026 - DNA, 25 bp, Homo sapien
tgtggcgcacaagcgttttgttggt

SEQ ID NO: 126027 - DNA, 25 bp, Homo sapien
tttgttggtgctttgttctcagtac

SEQ ID NO: 126028 - DNA, 25 bp, Homo sapien
gttctcagtacagtaactctgtgta

SEQ ID NO: 126029 - DNA, 25 bp, Homo sapien
gttttccaacaagatgtctctgtaa

SEQ ID NO: 126030 - DNA, 25 bp, Homo sapien
atgatattggctgagctggtgcgtt

SEQ ID NO: 126031 - DNA, 25 bp, Homo sapien
ctggtgcgttggtttctctcataga

SEQ ID NO: 126032 - DNA, 25 bp, Homo sapien
agaggcattaactatactgccaatg

SEQ ID NO: 126033 - DNA, 25 bp, Homo sapien
gaagtcgttcagatgtgttccttaa

SEQ ID NO: 126034 - DNA, 25 bp, Homo sapien
gatggaattctctgtagagcgtctc

SEQ ID NO: 126035 - DNA, 25 bp, Homo sapien
gtagagcgtctcaatccacttttaa

SEQ ID NO: 126036 - DNA, 25 bp, Homo sapien
gcgtctcaatccacttttaaccatg

SEQ ID NO: 126037 - DNA, 25 bp, Homo sapien
cacttttaaccatggatgagagcag

SEQ ID NO: 126038 - DNA, 25 bp, Homo sapien
atgagagcagactccatttaccctg

SEQ ID NO: 126039 - DNA, 25 bp, Homo sapien
atttaccctgaaatagcagcttctc

SEQ ID NO: 126040 - DNA, 25 bp, Homo sapien
gaaatagcagcttctcttgagagga

SEQ ID NO: 126041 - DNA, 25 bp, Homo sapien
gtgacatggaagcaactccgtctgc

SEQ ID NO: 126042 - DNA, 25 bp, Homo sapien
aagcaactccgtctgctgcagctga

SEQ ID NO: 126043 - DNA, 25 bp, Homo sapien
tcacactgagttcacagtgcgccct

SEQ ID NO: 126044 - DNA, 25 bp, Homo sapien
gggttgtgtcttaactgcaatacat

SEQ ID NO: 126045 - DNA, 25 bp, Homo sapien
aaatgtcactgacttgggtctgggc

SEQ ID NO: 126046 - DNA, 25 bp, Homo sapien
ctgacttgggtctgggctatgaaac

SEQ ID NO: 126047 - DNA, 25 bp, Homo sapien
gatttttaggtactgcagcggctct

SEQ ID NO: 126048 - DNA, 25 bp, Homo sapien
agcggctcttgcgatgcagctgaga

SEQ ID NO: 126049 - DNA, 25 bp, Homo sapien
gatgcagctgagacaacgtacgaca

SEQ ID NO: 126050 - DNA, 25 bp, Homo sapien
tagggcaggcatgttgcagacccat

SEQ ID NO: 126051 - DNA, 25 bp, Homo sapien
agacccatcgcctttgatgatgacc

SEQ ID NO: 126052 - DNA, 25 bp, Homo sapien
gatgacctgtcgtttttagatgata

SEQ ID NO: 126053 - DNA, 25 bp, Homo sapien
gataacctggtttaccatattctaa

SEQ ID NO: 126054 - DNA, 25 bp, Homo sapien
aaagcattccgctaaaaggtgtgga

SEQ ID NO: 126055 - DNA, 25 bp, Homo sapien
aggactcaagttggactatatgtat

SEQ ID NO: 126056 - DNA, 25 bp, Homo sapien
aatgccttaattggagtctaaactc

SEQ ID NO: 126057 - DNA, 25 bp, Homo sapien
gctgaagaagtttttggtgggcttt

SEQ ID NO: 126058 - DNA, 25 bp, Homo sapien
tggtgggctttagtgactgtgcttt

SEQ ID NO: 126059 - DNA, 25 bp, Homo sapien
ggctttagtgactgtgctttgcaaa

SEQ ID NO: 126060 - DNA, 25 bp, Homo sapien
aagaacaaagttactccttctggct

SEQ ID NO: 126061 - DNA, 25 bp, Homo sapien
tactccttctggctattgggaccct

SEQ ID NO: 126062 - DNA, 25 bp, Homo sapien
ccttctggctattgggaccctttgg

SEQ ID NO: 126063 - DNA, 25 bp, Homo sapien
gctattgggaccctttggccaggaa

SEQ ID NO: 126064 - DNA, 25 bp, Homo sapien
gaccctttggccaggaaaaattatg

SEQ ID NO: 126065 - DNA, 25 bp, Homo sapien
ttggccaggaaaaattatgcttaga

SEQ ID NO: 126066 - DNA, 25 bp, Homo sapien
tctgattaagccctggcctcttgat

SEQ ID NO: 126067 - DNA, 25 bp, Homo sapien
tccagttacctagatattcccttga

SEQ ID NO: 126068 - DNA, 25 bp, Homo sapien
agatattcccttgagattttgatac

SEQ ID NO: 126069 - DNA, 25 bp, Homo sapien
tacaatttgagggaggcagaagtct

SEQ ID NO: 126070 - DNA, 25 bp, Homo sapien
aataagtctgtttgtcatatttaag

SEQ ID NO: 126071 - DNA, 25 bp, Homo sapien
gaagaccatgtctactaattacaaa

SEQ ID NO: 126072 - DNA, 25 bp, Homo sapien
tgcttttcctaccacttccagtaag

SEQ ID NO: 126073 - DNA, 25 bp, Homo sapien
ttcctaccacttccagtaagaaaat

SEQ ID NO: 126074 - DNA, 25 bp, Homo sapien
ccacttccagtaagaaaatgggtgt

SEQ ID NO: 126075 - DNA, 25 bp, Homo sapien
aaaatgggtgttttgaagaaatcat

SEQ ID NO: 126076 - DNA, 25 bp, Homo sapien
acggaatctgattaagccctggcct

SEQ ID NO: 126077 - DNA, 25 bp, Homo sapien
gcctaaaagcctctttgtggctgaa

SEQ ID NO: 126078 - DNA, 25 bp, Homo sapien
ctttgtggctgaaaggtccctgtga

SEQ ID NO: 126079 - DNA, 25 bp, Homo sapien
gtggctgaaaggtccctgtgacatt

SEQ ID NO: 126080 - DNA, 25 bp, Homo sapien
gaaaggtccctgtgacattttctgc

SEQ ID NO: 126081 - DNA, 25 bp, Homo sapien
aggtccctgtgacattttctgccac

SEQ ID NO: 126082 - DNA, 25 bp, Homo sapien
ttctgccacccaaacggaggcagct

SEQ ID NO: 126083 - DNA, 25 bp, Homo sapien
caaacggaggcagctgacacatctc

SEQ ID NO: 126084 - DNA, 25 bp, Homo sapien
ggaggcagctgacacatctcccgct

SEQ ID NO: 126085 - DNA, 25 bp, Homo sapien
ttcccaggagtacaccccaacagca

SEQ ID NO: 126086 - DNA, 25 bp, Homo sapien
cagcaccctctccagatgggagtgc

SEQ ID NO: 126087 - DNA, 25 bp, Homo sapien
aggacctgagtatccccagctcagg

SEQ ID NO: 126088 - DNA, 25 bp, Homo sapien
gccgggtcagtcctacatgtgagat

SEQ ID NO: 126089 - DNA, 25 bp, Homo sapien
gtcagtcctacatgtgagatgggtt

SEQ ID NO: 126090 - DNA, 25 bp, Homo sapien
ctacatgtgagatgggttagggcaa

SEQ ID NO: 126091 - DNA, 25 bp, Homo sapien
agggctgggactgctgtcccttgta

SEQ ID NO: 126092 - DNA, 25 bp, Homo sapien
gtcccttgtacagttttctgtcact

SEQ ID NO: 126093 - DNA, 25 bp, Homo sapien
ggacaggcatagcagactctcttgt

SEQ ID NO: 126094 - DNA, 25 bp, Homo sapien
agactctcttgtggccacactaggt

SEQ ID NO: 126095 - DNA, 25 bp, Homo sapien
gtggccacactaggttgtcgccttt

SEQ ID NO: 126096 - DNA, 25 bp, Homo sapien
aggttgtcgcctttcaggcagtgtc

SEQ ID NO: 126097 - DNA, 25 bp, Homo sapien
ttcaggcagtgtcccgccacctttg

SEQ ID NO: 126098 - DNA, 25 bp, Homo sapien
tccttctggacattccagagccctg

SEQ ID NO: 126099 - DNA, 25 bp, Homo sapien
aaactgcttataataatccaggagt

SEQ ID NO: 126100 - DNA, 25 bp, Homo sapien
caggagttgcattatagccagtagt

SEQ ID NO: 126101 - DNA, 25 bp, Homo sapien
aataaaaccatgtctatagctgtag

SEQ ID NO: 126102 - DNA, 25 bp, Homo sapien
ctgtagatgggcttcacatctgtaa

SEQ ID NO: 126103 - DNA, 25 bp, Homo sapien
gggcttcacatctgtaaagcaatca

SEQ ID NO: 126104 - DNA, 25 bp, Homo sapien
tatatttttgtgatgtgtaccatac

SEQ ID NO: 126105 - DNA, 25 bp, Homo sapien
gatgtgtaccatactgtgtgctcca

SEQ ID NO: 126106 - DNA, 25 bp, Homo sapien
tgtgtaccatactgtgtgctccagc

SEQ ID NO: 126107 - DNA, 25 bp, Homo sapien
gagatatgattctgtaactccaatc

SEQ ID NO: 126108 - DNA, 25 bp, Homo sapien
gattctgtaactccaatcagttcag

SEQ ID NO: 126109 - DNA, 25 bp, Homo sapien
actccaatcagttcagatgtgtaac

SEQ ID NO: 126110 - DNA, 25 bp, Homo sapien
ttgccaggattttactgaatataaa

SEQ ID NO: 126111 - DNA, 25 bp, Homo sapien
taaatacacacatcagccgaaccgc

SEQ ID NO: 126112 - DNA, 25 bp, Homo sapien
gaaccgctttcctgatctcatgatg

SEQ ID NO: 126113 - DNA, 25 bp, Homo sapien
ctgatctcatgatgtgcttacctga

SEQ ID NO: 126114 - DNA, 25 bp, Homo sapien
gatgtgcttacctgagattcgatat

SEQ ID NO: 126115 - DNA, 25 bp, Homo sapien
ctgagattcgatatattgcaggaaa

SEQ ID NO: 126116 - DNA, 25 bp, Homo sapien
ctcctctttaaggtggtgctgcatt

SEQ ID NO: 126117 - DNA, 25 bp, Homo sapien
gtggtgctgcattcctgcaagacca

SEQ ID NO: 126118 - DNA, 25 bp, Homo sapien
cagtgtgggcaaggaatgacctgtt

SEQ ID NO: 126119 - DNA, 25 bp, Homo sapien
tcaggccaaccacagcgtcttgggt

SEQ ID NO: 126120 - DNA, 25 bp, Homo sapien
tgtggagcagcatttcccgttgcct

SEQ ID NO: 126121 - DNA, 25 bp, Homo sapien
atgtacaaaggagaacagctgcgaa

SEQ ID NO: 126122 - DNA, 25 bp, Homo sapien
gagaacagctgcgaaagagccaaaa

SEQ ID NO: 126123 - DNA, 25 bp, Homo sapien
gagccaaaaaccagtgcttcagatt

SEQ ID NO: 126124 - DNA, 25 bp, Homo sapien
gtgcttcagattcgcagaactcagt

SEQ ID NO: 126125 - DNA, 25 bp, Homo sapien
tcagattcgcagaactcagtgaagg

SEQ ID NO: 126126 - DNA, 25 bp, Homo sapien
aaggaagctcccgtgaagaatggag

SEQ ID NO: 126127 - DNA, 25 bp, Homo sapien
gaatggaggtgcgaccaccagcagc

SEQ ID NO: 126128 - DNA, 25 bp, Homo sapien
caccagcagctctagtgatagtgat

SEQ ID NO: 126129 - DNA, 25 bp, Homo sapien
gcagctctagtgatagtgatgacga

SEQ ID NO: 126130 - DNA, 25 bp, Homo sapien
gagaagatggtcctcgtgaccgcca

SEQ ID NO: 126131 - DNA, 25 bp, Homo sapien
gtgaccgccagatctgtgtttggga

SEQ ID NO: 126132 - DNA, 25 bp, Homo sapien
gcccttcccgccagtctggagaggg

SEQ ID NO: 126133 - DNA, 25 bp, Homo sapien
agagggccctgaccgaggactcaac

SEQ ID NO: 126134 - DNA, 25 bp, Homo sapien
aaccagtgacacagctaccaattct

SEQ ID NO: 126135 - DNA, 25 bp, Homo sapien
gtgacacagctaccaattctacttt

SEQ ID NO: 126136 - DNA, 25 bp, Homo sapien
caattctactttaccttctgcagag

SEQ ID NO: 126137 - DNA, 25 bp, Homo sapien
agcttcgtctcaccttgagttaggc

SEQ ID NO: 126138 - DNA, 25 bp, Homo sapien
gttaggctgagcacaggcatttcct

SEQ ID NO: 126139 - DNA, 25 bp, Homo sapien
gcttattttaggattacccactcat

SEQ ID NO: 126140 - DNA, 25 bp, Homo sapien
taggattacccactcatcagaaaaa

SEQ ID NO: 126141 - DNA, 25 bp, Homo sapien
aggacttccgggagaggctgatcca

SEQ ID NO: 126142 - DNA, 25 bp, Homo sapien
gggagaggctgatccacgcccttcc

SEQ ID NO: 126143 - DNA, 25 bp, Homo sapien
acctaccacaagcaggtgtccctgt

SEQ ID NO: 126144 - DNA, 25 bp, Homo sapien
caggtgtccctgtcgcacgtgtagg

SEQ ID NO: 126145 - DNA, 25 bp, Homo sapien
cctgtcgcacgtgtaggaggctgcc

SEQ ID NO: 126146 - DNA, 25 bp, Homo sapien
tttggtagttttgccaaggtcactt

SEQ ID NO: 126147 - DNA, 25 bp, Homo sapien
aaggtcacttccgtttaccttcatg

SEQ ID NO: 126148 - DNA, 25 bp, Homo sapien
cgtttaccttcatggtgctgttgcc

SEQ ID NO: 126149 - DNA, 25 bp, Homo sapien
gttttcgaggaagaacctgtcccag

SEQ ID NO: 126150 - DNA, 25 bp, Homo sapien
cgaggaagaacctgtcccaggtctt

SEQ ID NO: 126151 - DNA, 25 bp, Homo sapien
gcccagctcacgtgtattctatttt

SEQ ID NO: 126152 - DNA, 25 bp, Homo sapien
cgtgtattctattttgcgtttctta

SEQ ID NO: 126153 - DNA, 25 bp, Homo sapien
tattttgcgtttcttacctgccttc

SEQ ID NO: 126154 - DNA, 25 bp, Homo sapien
ggctgtcgagtgagctgccccagcc

SEQ ID NO: 126155 - DNA, 25 bp, Homo sapien
gcatggccccgttggaggttgattt

SEQ ID NO: 126156 - DNA, 25 bp, Homo sapien
ttggaggttgatttgctgttttgtt

SEQ ID NO: 126157 - DNA, 25 bp, Homo sapien
cttgtctttgtgttctgtggtactt

SEQ ID NO: 126158 - DNA, 25 bp, Homo sapien
ctttgtgttctgtggtacttgctga

SEQ ID NO: 126159 - DNA, 25 bp, Homo sapien
gttctgtggtacttgctgagagaaa

SEQ ID NO: 126160 - DNA, 25 bp, Homo sapien
ccatgcctttcctttagtggtggga

SEQ ID NO: 126161 - DNA, 25 bp, Homo sapien
agtggtgggaaacccttatcttgca

SEQ ID NO: 126162 - DNA, 25 bp, Homo sapien
gggaaacccttatcttgcaaagtga

SEQ ID NO: 126163 - DNA, 25 bp, Homo sapien
tgcaaagtgaatgtgtccccttccc

SEQ ID NO: 126164 - DNA, 25 bp, Homo sapien
cccaccctctagtgtatttcacaga

SEQ ID NO: 126165 - DNA, 25 bp, Homo sapien
cacgcctggccagatgcatgttcaa

SEQ ID NO: 126166 - DNA, 25 bp, Homo sapien
gatgcatgttcaaaccaatcaaatg

SEQ ID NO: 126167 - DNA, 25 bp, Homo sapien
aatggtgttttcttatgcaggactg

SEQ ID NO: 126168 - DNA, 25 bp, Homo sapien
gtgttttcttatgcaggactgatcg

SEQ ID NO: 126169 - DNA, 25 bp, Homo sapien
gcaggactgatcgatttgcacccac

SEQ ID NO: 126170 - DNA, 25 bp, Homo sapien
gactgatcgatttgcacccaccttt

SEQ ID NO: 126171 - DNA, 25 bp, Homo sapien
acccacctttctgcacataagttat

SEQ ID NO: 126172 - DNA, 25 bp, Homo sapien
ccacctttctgcacataagttatgg

SEQ ID NO: 126173 - DNA, 25 bp, Homo sapien
ataagttatggttttccatcttatc

SEQ ID NO: 126174 - DNA, 25 bp, Homo sapien
ccatcttatctgtcttctgattttt

SEQ ID NO: 126175 - DNA, 25 bp, Homo sapien
gtcttctgattttttatatcctgtt

SEQ ID NO: 126176 - DNA, 25 bp, Homo sapien
cgtctccaattatgaaactaatctt

SEQ ID NO: 126177 - DNA, 25 bp, Homo sapien
gaaactaatcttaaccctgtgctgt

SEQ ID NO: 126178 - DNA, 25 bp, Homo sapien
aactaatcttaaccctgtgctgtca

SEQ ID NO: 126179 - DNA, 25 bp, Homo sapien
taatcttaaccctgtgctgtcagat

SEQ ID NO: 126180 - DNA, 25 bp, Homo sapien
tcttaaccctgtgctgtcagatacc

SEQ ID NO: 126181 - DNA, 25 bp, Homo sapien
ctgtcagataccctggttttctgga

SEQ ID NO: 126182 - DNA, 25 bp, Homo sapien
agataccctggttttctggagtcac

SEQ ID NO: 126183 - DNA, 25 bp, Homo sapien
ataccctggttttctggagtcacag

SEQ ID NO: 126184 - DNA, 25 bp, Homo sapien
ttctggagtcacagtcagtgaggag

SEQ ID NO: 126185 - DNA, 25 bp, Homo sapien
gtggccagcactagtaaaggaggaa

SEQ ID NO: 126186 - DNA, 25 bp, Homo sapien
aaaggaggaatagtgcttgctggcc

SEQ ID NO: 126187 - DNA, 25 bp, Homo sapien
tgcacttgttgccaagtcttccatc

SEQ ID NO: 126188 - DNA, 25 bp, Homo sapien
tgccaagtcttccatcttactagat

SEQ ID NO: 126189 - DNA, 25 bp, Homo sapien
cttactagatgtgaaaccttgggat

SEQ ID NO: 126190 - DNA, 25 bp, Homo sapien
gatgatgagacagatatggcgaaat

SEQ ID NO: 126191 - DNA, 25 bp, Homo sapien
atggcgaaattagaggagtgcgtca

SEQ ID NO: 126192 - DNA, 25 bp, Homo sapien
gagtgcgtcagaagcattcaagcag

SEQ ID NO: 126193 - DNA, 25 bp, Homo sapien
agcattcaagcagacggcttagtct

SEQ ID NO: 126194 - DNA, 25 bp, Homo sapien
agtctggggctcatctaaactagtt

SEQ ID NO: 126195 - DNA, 25 bp, Homo sapien
aacttcaaatacagtgtgtagttga

SEQ ID NO: 126196 - DNA, 25 bp, Homo sapien
tttgaggactatgtgcagtccatgg

SEQ ID NO: 126197 - DNA, 25 bp, Homo sapien
caacaagatctaaaatccatcctgg

SEQ ID NO: 126198 - DNA, 25 bp, Homo sapien
aaatactcagctttcaatgtatcaa

SEQ ID NO: 126199 - DNA, 25 bp, Homo sapien
agtgctagattctgttattttcttc

SEQ ID NO: 126200 - DNA, 25 bp, Homo sapien
tttggatgaagtaccccaacctgtt

SEQ ID NO: 126201 - DNA, 25 bp, Homo sapien
atgaagtaccccaacctgtttacat

SEQ ID NO: 126202 - DNA, 25 bp, Homo sapien
ctgtttacatttagcgataaaatta

SEQ ID NO: 126203 - DNA, 25 bp, Homo sapien
gtaaatgtaaattattccgatctga

SEQ ID NO: 126204 - DNA, 25 bp, Homo sapien
attattccgatctgacatatctgca

SEQ ID NO: 126205 - DNA, 25 bp, Homo sapien
ttccgatctgacatatctgcattat

SEQ ID NO: 126206 - DNA, 25 bp, Homo sapien
gatctgacatatctgcattataata

SEQ ID NO: 126207 - DNA, 25 bp, Homo sapien
gaatagaagaactggtagccacagt

SEQ ID NO: 126208 - DNA, 25 bp, Homo sapien
gaactggtagccacagtggtgaaat

SEQ ID NO: 126209 - DNA, 25 bp, Homo sapien
acctcagcaggattctgaagctcac

SEQ ID NO: 126210 - DNA, 25 bp, Homo sapien
caggattctgaagctcactctttat

SEQ ID NO: 126211 - DNA, 25 bp, Homo sapien
gaagctcactctttataatcagaat

SEQ ID NO: 126212 - DNA, 25 bp, Homo sapien
gaatgatcccaatagatgtgaactt

SEQ ID NO: 126213 - DNA, 25 bp, Homo sapien
gatgtgaacttttgagctttctgtt

SEQ ID NO: 126214 - DNA, 25 bp, Homo sapien
agctttctgttggtattggactata

SEQ ID NO: 126215 - DNA, 25 bp, Homo sapien
gttggtattggactatattggtatc

SEQ ID NO: 126216 - DNA, 25 bp, Homo sapien
tattggtatcaacatggcttcactg

SEQ ID NO: 126217 - DNA, 25 bp, Homo sapien
ggcttcactgaattcctgcattaac

SEQ ID NO: 126218 - DNA, 25 bp, Homo sapien
aattcctgcattaacccaattgctc

SEQ ID NO: 126219 - DNA, 25 bp, Homo sapien
aacccaattgctctgtatttggtga

SEQ ID NO: 126220 - DNA, 25 bp, Homo sapien
ctgagcttcggttctccagaatgta

SEQ ID NO: 126221 - DNA, 25 bp, Homo sapien
aaatctgaactctcaaaagtctatt

SEQ ID NO: 126222 - DNA, 25 bp, Homo sapien
ggaatgttgtagttacctactgagt

SEQ ID NO: 126223 - DNA, 25 bp, Homo sapien
acctactgagtaggcggcgattttt

SEQ ID NO: 126224 - DNA, 25 bp, Homo sapien
agtaggcggcgatttttgtatgtta

SEQ ID NO: 126225 - DNA, 25 bp, Homo sapien
gcagttcattattttgtggttctat

SEQ ID NO: 126226 - DNA, 25 bp, Homo sapien
ggttctattttactttgtacttgtg

SEQ ID NO: 126227 - DNA, 25 bp, Homo sapien
tttactttgtacttgtgtttgctta

SEQ ID NO: 126228 - DNA, 25 bp, Homo sapien
caaagtgactgtttggcttataaac

SEQ ID NO: 126229 - DNA, 25 bp, Homo sapien
tgaatgcgctttattgcccatggga

SEQ ID NO: 126230 - DNA, 25 bp, Homo sapien
atgcgctttattgcccatgggatat

SEQ ID NO: 126231 - DNA, 25 bp, Homo sapien
tggatccttcccaaggtacagctgt

SEQ ID NO: 126232 - DNA, 25 bp, Homo sapien
tccttcccaaggtacagctgtatat

SEQ ID NO: 126233 - DNA, 25 bp, Homo sapien
cagctgtatataaacgtgtcccgag

SEQ ID NO: 126234 - DNA, 25 bp, Homo sapien
gtatataaacgtgtcccgagcttag

SEQ ID NO: 126235 - DNA, 25 bp, Homo sapien
atataaacgtgtcccgagcttagat

SEQ ID NO: 126236 - DNA, 25 bp, Homo sapien
aaacgtgtcccgagcttagattctg

SEQ ID NO: 126237 - DNA, 25 bp, Homo sapien
acgtgtcccgagcttagattctgta

SEQ ID NO: 126238 - DNA, 25 bp, Homo sapien
gtgtcccgagcttagattctgtatg

SEQ ID NO: 126239 - DNA, 25 bp, Homo sapien
gtcccgagcttagattctgtatgcg

SEQ ID NO: 126240 - DNA, 25 bp, Homo sapien
agcttagattctgtatgcggtgacg

SEQ ID NO: 126241 - DNA, 25 bp, Homo sapien
ttagattctgtatgcggtgacggcg

SEQ ID NO: 126242 - DNA, 25 bp, Homo sapien
ctggagactggatggctcccctgag

SEQ ID NO: 126243 - DNA, 25 bp, Homo sapien
agaagggcctgctctgcttttcctg

SEQ ID NO: 126244 - DNA, 25 bp, Homo sapien
taagaactttgagaatcccaattat

SEQ ID NO: 126245 - DNA, 25 bp, Homo sapien
cgtcctgaggagtgtcctgtctgct

SEQ ID NO: 126246 - DNA, 25 bp, Homo sapien
aggagtgtcctgtctgctgggctac

SEQ ID NO: 126247 - DNA, 25 bp, Homo sapien
gtgtcctgtctgctgggctacaaac

SEQ ID NO: 126248 - DNA, 25 bp, Homo sapien
tgtctgctgggctacaaaccaggag

SEQ ID NO: 126249 - DNA, 25 bp, Homo sapien
tgggctacaaaccaggagcaaccgt

SEQ ID NO: 126250 - DNA, 25 bp, Homo sapien
tacaaaccaggagcaaccgtgcagc

SEQ ID NO: 126251 - DNA, 25 bp, Homo sapien
aggagcaaccgtgcagccacgaaca

SEQ ID NO: 126252 - DNA, 25 bp, Homo sapien
aaccgtgcagccacgaacacgcatg

SEQ ID NO: 126253 - DNA, 25 bp, Homo sapien
tgcctcgcctgtcacagcggcccgg

SEQ ID NO: 126254 - DNA, 25 bp, Homo sapien
gcctcggacttcacctgtgcctcca

SEQ ID NO: 126255 - DNA, 25 bp, Homo sapien
ttcgcgccctcggtgctcagcaagg

SEQ ID NO: 126256 - DNA, 25 bp, Homo sapien
ggtgctcagcaaggcctcctccgtc

SEQ ID NO: 126257 - DNA, 25 bp, Homo sapien
cctccgtcgcgctggaccagaggga

SEQ ID NO: 126258 - DNA, 25 bp, Homo sapien
ccgtcgcgctggaccagagggagga

SEQ ID NO: 126259 - DNA, 25 bp, Homo sapien
gaggaggtgcccctcactagataag

SEQ ID NO: 126260 - DNA, 25 bp, Homo sapien
aggaggtgcccctcactagataagg

SEQ ID NO: 126261 - DNA, 25 bp, Homo sapien
gggctggtggctgccggctccatga

SEQ ID NO: 126262 - DNA, 25 bp, Homo sapien
ctgccggctccatgacgcccgtggg

SEQ ID NO: 126263 - DNA, 25 bp, Homo sapien
ctcctcgcccctaggacgccaaggg

SEQ ID NO: 126264 - DNA, 25 bp, Homo sapien
gttttgtttggttaacgtgatacat

SEQ ID NO: 126265 - DNA, 25 bp, Homo sapien
ttggttaacgtgatacattctgtat

SEQ ID NO: 126266 - DNA, 25 bp, Homo sapien
ttggagggaaacatctactgaattt

SEQ ID NO: 126267 - DNA, 25 bp, Homo sapien
ggaaacatctactgaatttctgtaa

SEQ ID NO: 126268 - DNA, 25 bp, Homo sapien
aatattttgctgctagttaactatg

SEQ ID NO: 126269 - DNA, 25 bp, Homo sapien
gctgctagttaactatgaacagata

SEQ ID NO: 126270 - DNA, 25 bp, Homo sapien
gaagaatcttacagatgctgctata

SEQ ID NO: 126271 - DNA, 25 bp, Homo sapien
acagatgctgctataaataagtaga

SEQ ID NO: 126272 - DNA, 25 bp, Homo sapien
taaaatctatttcctatattgtatt

SEQ ID NO: 126273 - DNA, 25 bp, Homo sapien
cctatattgtatttctaatcagatg

SEQ ID NO: 126274 - DNA, 25 bp, Homo sapien
cagatgtattactcttattatttct

SEQ ID NO: 126275 - DNA, 25 bp, Homo sapien
ggtcaccagaggatgtgcaggaata

SEQ ID NO: 126276 - DNA, 25 bp, Homo sapien
gcaggaatatctcacctgtgtgcag

SEQ ID NO: 126277 - DNA, 25 bp, Homo sapien
aaatcaggcaggcagctagcgagtt

SEQ ID NO: 126278 - DNA, 25 bp, Homo sapien
agctagcgagtttgaccccacatgc

SEQ ID NO: 126279 - DNA, 25 bp, Homo sapien
tgtttgttttgcaccttgtctaagg

SEQ ID NO: 126280 - DNA, 25 bp, Homo sapien
ttgcaccttgtctaaggaccctaaa

SEQ ID NO: 126281 - DNA, 25 bp, Homo sapien
ggaccctaaatgaacgataaacaga

SEQ ID NO: 126282 - DNA, 25 bp, Homo sapien
ggtaaatccacttaatcacatacag

SEQ ID NO: 126283 - DNA, 25 bp, Homo sapien
aaactgcttacgacaggtttggaag

SEQ ID NO: 126284 - DNA, 25 bp, Homo sapien
ggtttggaagccacaggcgattcta

SEQ ID NO: 126285 - DNA, 25 bp, Homo sapien
acaggcgattctatggtcaatgtga

SEQ ID NO: 126286 - DNA, 25 bp, Homo sapien
tgctttgcctgagcacagacagtca

SEQ ID NO: 126287 - DNA, 25 bp, Homo sapien
gctttgcctgagcacagacagtcag

SEQ ID NO: 126288 - DNA, 25 bp, Homo sapien
ctttgcctgagcacagacagtcagc

SEQ ID NO: 126289 - DNA, 25 bp, Homo sapien
ttgcctgagcacagacagtcagcat

SEQ ID NO: 126290 - DNA, 25 bp, Homo sapien
gcctgagcacagacagtcagcatgg

SEQ ID NO: 126291 - DNA, 25 bp, Homo sapien
ctgagcacagacagtcagcatggaa

SEQ ID NO: 126292 - DNA, 25 bp, Homo sapien
aacctcaccctatggaacagtcacc

SEQ ID NO: 126293 - DNA, 25 bp, Homo sapien
acctgtgcgcaggttgtcctcaaac

SEQ ID NO: 126294 - DNA, 25 bp, Homo sapien
tgtgcgcaggttgtcctcaaaccct

SEQ ID NO: 126295 - DNA, 25 bp, Homo sapien
tgcgcaggttgtcctcaaaccctct

SEQ ID NO: 126296 - DNA, 25 bp, Homo sapien
ctcaaaccctctcctcacaggaaaa

SEQ ID NO: 126297 - DNA, 25 bp, Homo sapien
aacgcctgaagaaggtgaaaagcaa

SEQ ID NO: 126298 - DNA, 25 bp, Homo sapien
acgcctgaagaaggtgaaaagcaat

SEQ ID NO: 126299 - DNA, 25 bp, Homo sapien
cgcctgaagaaggtgaaaagcaatc

SEQ ID NO: 126300 - DNA, 25 bp, Homo sapien
gcctgaagaaggtgaaaagcaatca

SEQ ID NO: 126301 - DNA, 25 bp, Homo sapien
cctgaagaaggtgaaaagcaatcac

SEQ ID NO: 126302 - DNA, 25 bp, Homo sapien
gaagaaggtgaaaagcaatcacagt

SEQ ID NO: 126303 - DNA, 25 bp, Homo sapien
aagaaggtgaaaagcaatcacagtg

SEQ ID NO: 126304 - DNA, 25 bp, Homo sapien
agaaggtgaaaagcaatcacagtgt

SEQ ID NO: 126305 - DNA, 25 bp, Homo sapien
cacgttgaaatgatgcaggctgctc

SEQ ID NO: 126306 - DNA, 25 bp, Homo sapien
acgttgaaatgatgcaggctgctcc

SEQ ID NO: 126307 - DNA, 25 bp, Homo sapien
cgttgaaatgatgcaggctgctcct

SEQ ID NO: 126308 - DNA, 25 bp, Homo sapien
aacgcgtggattctctttcatggca

SEQ ID NO: 126309 - DNA, 25 bp, Homo sapien
atgctcttggactcggttctccagg

SEQ ID NO: 126310 - DNA, 25 bp, Homo sapien
tggactcggttctccaggcctgatt

SEQ ID NO: 126311 - DNA, 25 bp, Homo sapien
atctgccttagattctatagtgaag

SEQ ID NO: 126312 - DNA, 25 bp, Homo sapien
agagttacctggatcagccatgctc

SEQ ID NO: 126313 - DNA, 25 bp, Homo sapien
agccatgctcagctgtgacgcctga

SEQ ID NO: 126314 - DNA, 25 bp, Homo sapien
gtctactttatcttcactgaaccac

SEQ ID NO: 126315 - DNA, 25 bp, Homo sapien
tgaaccactcactctgtgtaaaggc

SEQ ID NO: 126316 - DNA, 25 bp, Homo sapien
ccactcactctgtgtaaaggccaac

SEQ ID NO: 126317 - DNA, 25 bp, Homo sapien
aatgtggttttcatatcaaaagatc

SEQ ID NO: 126318 - DNA, 25 bp, Homo sapien
aaagatcatgttgggattaacttgc

SEQ ID NO: 126319 - DNA, 25 bp, Homo sapien
aaggcctatgagcagaaaccagcgg

SEQ ID NO: 126320 - DNA, 25 bp, Homo sapien
gaagctagagcaggacttcgtctcc

SEQ ID NO: 126321 - DNA, 25 bp, Homo sapien
tagagcaggacttcgtctcccgggt

SEQ ID NO: 126322 - DNA, 25 bp, Homo sapien
gtctcccgggtgactgaatgtctga

SEQ ID NO: 126323 - DNA, 25 bp, Homo sapien
gactgaatgtctgaccaccgtgaag

SEQ ID NO: 126324 - DNA, 25 bp, Homo sapien
gaccaccgtgaagtcagtcaacaaa

SEQ ID NO: 126325 - DNA, 25 bp, Homo sapien
gaagtcagtcaacaaaacggacagt

SEQ ID NO: 126326 - DNA, 25 bp, Homo sapien
aaaacggacagtcagaccctcctga

SEQ ID NO: 126327 - DNA, 25 bp, Homo sapien
tcctgaccacatttggatctctgga

SEQ ID NO: 126328 - DNA, 25 bp, Homo sapien
ttggatctctggaacagctcatcgc

SEQ ID NO: 126329 - DNA, 25 bp, Homo sapien
tggaacagctcatcgccgcatcaag

SEQ ID NO: 126330 - DNA, 25 bp, Homo sapien
tgtctgaagccatagcctccacgga

SEQ ID NO: 126331 - DNA, 25 bp, Homo sapien
atagcctccacggagagccctgtgg

SEQ ID NO: 126332 - DNA, 25 bp, Homo sapien
tccaccctggctgggatcagagcag

SEQ ID NO: 126333 - DNA, 25 bp, Homo sapien
tctgctggttcctgactggcaaagg

SEQ ID NO: 126334 - DNA, 25 bp, Homo sapien
ctggcaaaggaccagcgtcctcgtt

SEQ ID NO: 126335 - DNA, 25 bp, Homo sapien
gcgtcctcgttcaaaacattccaag

SEQ ID NO: 126336 - DNA, 25 bp, Homo sapien
ggcttccatcagtggtaactgcttt

SEQ ID NO: 126337 - DNA, 25 bp, Homo sapien
taactgctttggtctcttctttcat

SEQ ID NO: 126338 - DNA, 25 bp, Homo sapien
aaaggcaagccctccagagagcgtt

SEQ ID NO: 126339 - DNA, 25 bp, Homo sapien
ccagagagcgttatgtgacccacaa

SEQ ID NO: 126340 - DNA, 25 bp, Homo sapien
gacccacaaccgagcacattggtga

SEQ ID NO: 126341 - DNA, 25 bp, Homo sapien
ggcaagcacgcaactaaatcccgaa

SEQ ID NO: 126342 - DNA, 25 bp, Homo sapien
gcacgcaactaaatcccgaaataca

SEQ ID NO: 126343 - DNA, 25 bp, Homo sapien
aagtaacacagtggacttcctatta

SEQ ID NO: 126344 - DNA, 25 bp, Homo sapien
gtggacttcctattaagacttactt

SEQ ID NO: 126345 - DNA, 25 bp, Homo sapien
ttacttgcattgctggactagcaaa

SEQ ID NO: 126346 - DNA, 25 bp, Homo sapien
ggaaaattgcactattgcacatcat

SEQ ID NO: 126347 - DNA, 25 bp, Homo sapien
gcacatcatattctattgtttacta

SEQ ID NO: 126348 - DNA, 25 bp, Homo sapien
actgattattacttctgtttctctt

SEQ ID NO: 126349 - DNA, 25 bp, Homo sapien
ttctctcaacccctttgtaatggtt

SEQ ID NO: 126350 - DNA, 25 bp, Homo sapien
gggcagactcttaagtatattgtga

SEQ ID NO: 126351 - DNA, 25 bp, Homo sapien
gttttctatttcactaatcatgaga

SEQ ID NO: 126352 - DNA, 25 bp, Homo sapien
aagaagccgcgatggccatagccag

SEQ ID NO: 126353 - DNA, 25 bp, Homo sapien
ttcaaaaccaacaagtcccacaaat

SEQ ID NO: 126354 - DNA, 25 bp, Homo sapien
ccacaaataactcgctcatgctttt

SEQ ID NO: 126355 - DNA, 25 bp, Homo sapien
gagttgaaacttttcttgttagtgt

SEQ ID NO: 126356 - DNA, 25 bp, Homo sapien
agtgtacaactcattttgcgccaat

SEQ ID NO: 126357 - DNA, 25 bp, Homo sapien
ctcattttgcgccaattttcacaag

SEQ ID NO: 126358 - DNA, 25 bp, Homo sapien
atgtttgggccgtttggtgccgtca

SEQ ID NO: 126359 - DNA, 25 bp, Homo sapien
cgtttggtgccgtcaccaatgtgaa

SEQ ID NO: 126360 - DNA, 25 bp, Homo sapien
accaatgtgaaagtgatccgcgact

SEQ ID NO: 126361 - DNA, 25 bp, Homo sapien
aagtgatccgcgacttcaacaccaa

SEQ ID NO: 126362 - DNA, 25 bp, Homo sapien
gggtttggctttgtgaccatgacaa

SEQ ID NO: 126363 - DNA, 25 bp, Homo sapien
ccagggctgctctgcgatctagacg

SEQ ID NO: 126364 - DNA, 25 bp, Homo sapien
ggctgctctgcgatctagacgccct

SEQ ID NO: 126365 - DNA, 25 bp, Homo sapien
gggtgccacccaacaaaagcatcta

SEQ ID NO: 126366 - DNA, 25 bp, Homo sapien
aaagcatctacgacgtttgggtcag

SEQ ID NO: 126367 - DNA, 25 bp, Homo sapien
gcatctacgacgtttgggtcagcca

SEQ ID NO: 126368 - DNA, 25 bp, Homo sapien
atctacgacgtttgggtcagccacc

SEQ ID NO: 126369 - DNA, 25 bp, Homo sapien
caggctggctgctctcctggtgcag

SEQ ID NO: 126370 - DNA, 25 bp, Homo sapien
ctggtgcagcctgtgaggctcttaa

SEQ ID NO: 126371 - DNA, 25 bp, Homo sapien
gtgcagcctgtgaggctcttaagac

SEQ ID NO: 126372 - DNA, 25 bp, Homo sapien
agcctgtgaggctcttaagacaggg

SEQ ID NO: 126373 - DNA, 25 bp, Homo sapien
ccccaccttgttgacagggagcaag

SEQ ID NO: 126374 - DNA, 25 bp, Homo sapien
ggtctgcatcccagtgggcctcaga

SEQ ID NO: 126375 - DNA, 25 bp, Homo sapien
ctgccacctgtcagacttgggtgag

SEQ ID NO: 126376 - DNA, 25 bp, Homo sapien
gtgagcagacacagtgaggctgtta

SEQ ID NO: 126377 - DNA, 25 bp, Homo sapien
acagtgaggctgttaggtcctgcag

SEQ ID NO: 126378 - DNA, 25 bp, Homo sapien
tccagagcagtctagggacaccact

SEQ ID NO: 126379 - DNA, 25 bp, Homo sapien
acaccactgccctgtctttaggaaa

SEQ ID NO: 126380 - DNA, 25 bp, Homo sapien
tgccctgtctttaggaaatcacaac

SEQ ID NO: 126381 - DNA, 25 bp, Homo sapien
tcccatgagcaagaaccactttata

SEQ ID NO: 126382 - DNA, 25 bp, Homo sapien
agaaccactttatagctggcatata

SEQ ID NO: 126383 - DNA, 25 bp, Homo sapien
atagctggcatatatttttccagat

SEQ ID NO: 126384 - DNA, 25 bp, Homo sapien
ttccagattttctctatgcataagt

SEQ ID NO: 126385 - DNA, 25 bp, Homo sapien
gacagtctggagaaggtattagcaa

SEQ ID NO: 126386 - DNA, 25 bp, Homo sapien
ggaacagggaacattggagctgact

SEQ ID NO: 126387 - DNA, 25 bp, Homo sapien
ggagctgactgttcttggtaactga

SEQ ID NO: 126388 - DNA, 25 bp, Homo sapien
gtaactgattacctgccaattgcta

SEQ ID NO: 126389 - DNA, 25 bp, Homo sapien
attacctgccaattgctaccgagaa

SEQ ID NO: 126390 - DNA, 25 bp, Homo sapien
aggctttgtataatcccacccacct

SEQ ID NO: 126391 - DNA, 25 bp, Homo sapien
ggaagtttctggtgccatttctgaa

SEQ ID NO: 126392 - DNA, 25 bp, Homo sapien
ggtgccatttctgaactgttacaac

SEQ ID NO: 126393 - DNA, 25 bp, Homo sapien
tacaacttgtatttccaaacctggt

SEQ ID NO: 126394 - DNA, 25 bp, Homo sapien
ccaaacctggttcatatttatactt

SEQ ID NO: 126395 - DNA, 25 bp, Homo sapien
tcatatttatactttgcaatccaaa

SEQ ID NO: 126396 - DNA, 25 bp, Homo sapien
aatttatcaaaatgccggtacttag

SEQ ID NO: 126397 - DNA, 25 bp, Homo sapien
tcaaaatgccggtacttaggaccta

SEQ ID NO: 126398 - DNA, 25 bp, Homo sapien
aaatttatctatgtctgtcatacgc

SEQ ID NO: 126399 - DNA, 25 bp, Homo sapien
tatctatgtctgtcatacgctaaaa

SEQ ID NO: 126400 - DNA, 25 bp, Homo sapien
tatgtctgtcatacgctaaaatgat

SEQ ID NO: 126401 - DNA, 25 bp, Homo sapien
catacgctaaaatgatattggtctt

SEQ ID NO: 126402 - DNA, 25 bp, Homo sapien
tgatattggtctttgaatttggtat

SEQ ID NO: 126403 - DNA, 25 bp, Homo sapien
attctgttcactatcacaaaatcat

SEQ ID NO: 126404 - DNA, 25 bp, Homo sapien
gttcactatcacaaaatcatctata

SEQ ID NO: 126405 - DNA, 25 bp, Homo sapien
aatagagcttgagctgtctgaacta

SEQ ID NO: 126406 - DNA, 25 bp, Homo sapien
gagcttgagctgtctgaactatttt

SEQ ID NO: 126407 - DNA, 25 bp, Homo sapien
ctttgttggcaatatttgccgtgta

SEQ ID NO: 126408 - DNA, 25 bp, Homo sapien
gaaacaaagaccgatctgtgtaaaa

SEQ ID NO: 126409 - DNA, 25 bp, Homo sapien
taatatgaaggactaccctcctttt

SEQ ID NO: 126410 - DNA, 25 bp, Homo sapien
gtattttggctgctagagtgcagca

SEQ ID NO: 126411 - DNA, 25 bp, Homo sapien
gagtgcagcatttgtgacacgtatt

SEQ ID NO: 126412 - DNA, 25 bp, Homo sapien
agcatttgtgacacgtatttgaaat

SEQ ID NO: 126413 - DNA, 25 bp, Homo sapien
aaatttgaaatttccttctgcactg

SEQ ID NO: 126414 - DNA, 25 bp, Homo sapien
gaaatttccttctgcactgtataaa

SEQ ID NO: 126415 - DNA, 25 bp, Homo sapien
ttctgcactgtataaaaggaccatt

SEQ ID NO: 126416 - DNA, 25 bp, Homo sapien
ggaccatttgaggatgttttgcctt

SEQ ID NO: 126417 - DNA, 25 bp, Homo sapien
tttgaggatgttttgccttttgtgt

SEQ ID NO: 126418 - DNA, 25 bp, Homo sapien
ggagagtaagtcagcatcggtataa

SEQ ID NO: 126419 - DNA, 25 bp, Homo sapien
gcatcggtataaaatcgcttactcc

SEQ ID NO: 126420 - DNA, 25 bp, Homo sapien
taaaatcgcttactccacgtaactc

SEQ ID NO: 126421 - DNA, 25 bp, Homo sapien
tccacgtaactcttcttctgatagg

SEQ ID NO: 126422 - DNA, 25 bp, Homo sapien
cgtaactcttcttctgatagggttt

SEQ ID NO: 126423 - DNA, 25 bp, Homo sapien
gaaataatgttcctacaatagttgt

SEQ ID NO: 126424 - DNA, 25 bp, Homo sapien
agacattttgtttcacttgctattc

SEQ ID NO: 126425 - DNA, 25 bp, Homo sapien
acttgctattcactagtgtacttga

SEQ ID NO: 126426 - DNA, 25 bp, Homo sapien
gtgtacttgaaacatggtcattttt

SEQ ID NO: 126427 - DNA, 25 bp, Homo sapien
ttagcccttttccttaggaaccatg

SEQ ID NO: 126428 - DNA, 25 bp, Homo sapien
ttttccttaggaaccatgtctttat

SEQ ID NO: 126429 - DNA, 25 bp, Homo sapien
aagagacctgccagattatcagacc

SEQ ID NO: 126430 - DNA, 25 bp, Homo sapien
gagacctgccagattatcagacctc

SEQ ID NO: 126431 - DNA, 25 bp, Homo sapien
gacctgccagattatcagacctctt

SEQ ID NO: 126432 - DNA, 25 bp, Homo sapien
tgccagattatcagacctcttcatg

SEQ ID NO: 126433 - DNA, 25 bp, Homo sapien
gccagattatcagacctcttcatgt

SEQ ID NO: 126434 - DNA, 25 bp, Homo sapien
cagattatcagacctcttcatgtta

SEQ ID NO: 126435 - DNA, 25 bp, Homo sapien
gattatcagacctcttcatgttaaa

SEQ ID NO: 126436 - DNA, 25 bp, Homo sapien
ttatcagacctcttcatgttaaaag

SEQ ID NO: 126437 - DNA, 25 bp, Homo sapien
ctgtgaagtaagctgtaacttgtca

SEQ ID NO: 126438 - DNA, 25 bp, Homo sapien
tgaagtaagctgtaacttgtcattt

SEQ ID NO: 126439 - DNA, 25 bp, Homo sapien
ctgacttagatgatgtattaaatac

SEQ ID NO: 126440 - DNA, 25 bp, Homo sapien
ttgtctagctgtttgatttcatttt

SEQ ID NO: 126441 - DNA, 25 bp, Homo sapien
gtctagctgtttgatttcatttttt

SEQ ID NO: 126442 - DNA, 25 bp, Homo sapien
tttaatatagtatgccaattttgtg

SEQ ID NO: 126443 - DNA, 25 bp, Homo sapien
ccatgtgaaagtcctgttgaaatga

SEQ ID NO: 126444 - DNA, 25 bp, Homo sapien
atgtgaaagtcctgttgaaatgaac

SEQ ID NO: 126445 - DNA, 25 bp, Homo sapien
gtgaaagtcctgttgaaatgaacaa

SEQ ID NO: 126446 - DNA, 25 bp, Homo sapien
agtcctgttgaaatgaacaattgtc

SEQ ID NO: 126447 - DNA, 25 bp, Homo sapien
tgccccacaatcaagaatgtatgtg

SEQ ID NO: 126448 - DNA, 25 bp, Homo sapien
aagaatgtatgtgtaaagtgtgaat

SEQ ID NO: 126449 - DNA, 25 bp, Homo sapien
tctcatatcaaatgtcaaactttta

SEQ ID NO: 126450 - DNA, 25 bp, Homo sapien
tcaaatgtcaaacttttacatgtga

SEQ ID NO: 126451 - DNA, 25 bp, Homo sapien
ttcttcttttcctaggccctgtcct

SEQ ID NO: 126452 - DNA, 25 bp, Homo sapien
catccccacctgaagtgaggctatc

SEQ ID NO: 126453 - DNA, 25 bp, Homo sapien
ccacctgaagtgaggctatccctgc

SEQ ID NO: 126454 - DNA, 25 bp, Homo sapien
cagctgcagggcactaatgaccctt

SEQ ID NO: 126455 - DNA, 25 bp, Homo sapien
gcagggcactaatgacccttgactt

SEQ ID NO: 126456 - DNA, 25 bp, Homo sapien
ctaagtcctctcagcagtgggcgac

SEQ ID NO: 126457 - DNA, 25 bp, Homo sapien
aagtcctctcagcagtgggcgactg

SEQ ID NO: 126458 - DNA, 25 bp, Homo sapien
tgccaatacctcagactccagggaa

SEQ ID NO: 126459 - DNA, 25 bp, Homo sapien
ccaatacctcagactccagggaaag

SEQ ID NO: 126460 - DNA, 25 bp, Homo sapien
attctcactgtaccactaggcgcag

SEQ ID NO: 126461 - DNA, 25 bp, Homo sapien
taccactaggcgcagttggatatag

SEQ ID NO: 126462 - DNA, 25 bp, Homo sapien
gggccctctggccttttgcagctga

SEQ ID NO: 126463 - DNA, 25 bp, Homo sapien
tggccttttgcagctgatccagagg

SEQ ID NO: 126464 - DNA, 25 bp, Homo sapien
aggaaaaggcggattgaggctgctg

SEQ ID NO: 126465 - DNA, 25 bp, Homo sapien
acagacagagcttgtgccggatttg

SEQ ID NO: 126466 - DNA, 25 bp, Homo sapien
gacagagcttgtgccggatttggcc

SEQ ID NO: 126467 - DNA, 25 bp, Homo sapien
tgtgccggatttggccctgtcaagg

SEQ ID NO: 126468 - DNA, 25 bp, Homo sapien
gggactggtgccttgttttcatcac

SEQ ID NO: 126469 - DNA, 25 bp, Homo sapien
tggtgccttgttttcatcactcctt

SEQ ID NO: 126470 - DNA, 25 bp, Homo sapien
ttttcatcactccttcctagttcta

SEQ ID NO: 126471 - DNA, 25 bp, Homo sapien
actccttcctagttctactgttcaa

SEQ ID NO: 126472 - DNA, 25 bp, Homo sapien
ctagttctactgttcaagcttctga

SEQ ID NO: 126473 - DNA, 25 bp, Homo sapien
actgcggcctgatgcatgctggaaa

SEQ ID NO: 126474 - DNA, 25 bp, Homo sapien
aaagacacgcttttcatttctgatc

SEQ ID NO: 126475 - DNA, 25 bp, Homo sapien
gacacgcttttcatttctgatcagt

SEQ ID NO: 126476 - DNA, 25 bp, Homo sapien
ttcatcctatatcagcacagctgcc

SEQ ID NO: 126477 - DNA, 25 bp, Homo sapien
agcacagctgccatacttcgactta

SEQ ID NO: 126478 - DNA, 25 bp, Homo sapien
ctgccatacttcgacttatcaggat

SEQ ID NO: 126479 - DNA, 25 bp, Homo sapien
ttatcaggattctggctggtggcct

SEQ ID NO: 126480 - DNA, 25 bp, Homo sapien
ggtgcagtcttacttaaaagacttt

SEQ ID NO: 126481 - DNA, 25 bp, Homo sapien
gttaattctcactggtatcatcgca

SEQ ID NO: 126482 - DNA, 25 bp, Homo sapien
ggtatcatcgcagtgaacttaaagc

SEQ ID NO: 126483 - DNA, 25 bp, Homo sapien
gaacttaaagcaaagacctcttagt

SEQ ID NO: 126484 - DNA, 25 bp, Homo sapien
tgcctcgcctgtcacagcggcccgg

SEQ ID NO: 126485 - DNA, 25 bp, Homo sapien
gcctcggacttcacctgtgcctcca

SEQ ID NO: 126486 - DNA, 25 bp, Homo sapien
ttcgcgccctcggtgctcagcaagg

SEQ ID NO: 126487 - DNA, 25 bp, Homo sapien
gcgccctcggtgctcagcaaggcct

SEQ ID NO: 126488 - DNA, 25 bp, Homo sapien
cctccgtcgcgctggaccagaggga

SEQ ID NO: 126489 - DNA, 25 bp, Homo sapien
ccgtcgcgctggaccagagggagga

SEQ ID NO: 126490 - DNA, 25 bp, Homo sapien
gaggaggtgcccctcactagataag

SEQ ID NO: 126491 - DNA, 25 bp, Homo sapien
aggaggtgcccctcactagataagg

SEQ ID NO: 126492 - DNA, 25 bp, Homo sapien
ggaggtgcccctcactagataaggg

SEQ ID NO: 126493 - DNA, 25 bp, Homo sapien
ctgccggctccatgacgcccgtggg

SEQ ID NO: 126494 - DNA, 25 bp, Homo sapien
ctcctcgcccctaggacgccaaggg

SEQ ID NO: 126495 - DNA, 25 bp, Homo sapien
tgctttggttaaaaatggctcaagt

SEQ ID NO: 126496 - DNA, 25 bp, Homo sapien
ggctcaagtagaaaagcagtcccat

SEQ ID NO: 126497 - DNA, 25 bp, Homo sapien
gaaaagcagtcccattcatattaag

SEQ ID NO: 126498 - DNA, 25 bp, Homo sapien
ccattcatattaagacagtgtacaa

SEQ ID NO: 126499 - DNA, 25 bp, Homo sapien
tagacaactagatttgtccttttat

SEQ ID NO: 126500 - DNA, 25 bp, Homo sapien
gaatttgtacttcttattgcaggca

SEQ ID NO: 126501 - DNA, 25 bp, Homo sapien
ggcaagtctctatattatgtcctct

SEQ ID NO: 126502 - DNA, 25 bp, Homo sapien
tattatgtcctcttttgtggtgtct

SEQ ID NO: 126503 - DNA, 25 bp, Homo sapien
tcttttgtggtgtcttccatgtgaa

SEQ ID NO: 126504 - DNA, 25 bp, Homo sapien
gaacagcataagtttggagcactag

SEQ ID NO: 126505 - DNA, 25 bp, Homo sapien
gtttggagcactagtttgattatta

SEQ ID NO: 126506 - DNA, 25 bp, Homo sapien
gaaggaaaagattgatcgccgttct

SEQ ID NO: 126507 - DNA, 25 bp, Homo sapien
aaggaaaagattgatcgccgttctg

SEQ ID NO: 126508 - DNA, 25 bp, Homo sapien
aggaaaagattgatcgccgttctgg

SEQ ID NO: 126509 - DNA, 25 bp, Homo sapien
ggaaaagattgatcgccgttctggt

SEQ ID NO: 126510 - DNA, 25 bp, Homo sapien
ggaagatggccctaaattcttgaag

SEQ ID NO: 126511 - DNA, 25 bp, Homo sapien
gatatggttcctggcaagcccatgt

SEQ ID NO: 126512 - DNA, 25 bp, Homo sapien
agcttctcagactatccacctttgg

SEQ ID NO: 126513 - DNA, 25 bp, Homo sapien
tctcagactatccacctttgggtcg

SEQ ID NO: 126514 - DNA, 25 bp, Homo sapien
agactatccacctttgggtcgcttt

SEQ ID NO: 126515 - DNA, 25 bp, Homo sapien
tccacctttgggtcgctttgctgtt

SEQ ID NO: 126516 - DNA, 25 bp, Homo sapien
ttcgtgatatgagacagacagttgc

SEQ ID NO: 126517 - DNA, 25 bp, Homo sapien
gaaaaacttgtaaacctgtgaatgg

SEQ ID NO: 126518 - DNA, 25 bp, Homo sapien
ttgtaaacctgtgaatggaccccaa

SEQ ID NO: 126519 - DNA, 25 bp, Homo sapien
aaacctgtgaatggaccccaagcag

SEQ ID NO: 126520 - DNA, 25 bp, Homo sapien
gtgaatggaccccaagcagtacact

SEQ ID NO: 126521 - DNA, 25 bp, Homo sapien
gaatggaccccaagcagtacacttg

SEQ ID NO: 126522 - DNA, 25 bp, Homo sapien
tggaccccaagcagtacacttgctg

SEQ ID NO: 126523 - DNA, 25 bp, Homo sapien
gcagtacacttgctggtctaggtat

SEQ ID NO: 126524 - DNA, 25 bp, Homo sapien
gtacacttgctggtctaggtattaa

SEQ ID NO: 126525 - DNA, 25 bp, Homo sapien
cacttgctggtctaggtattaaccc

SEQ ID NO: 126526 - DNA, 25 bp, Homo sapien
tgagtcacactgagatagtcagttg

SEQ ID NO: 126527 - DNA, 25 bp, Homo sapien
gatagtcagttgtgtgtgactctaa

SEQ ID NO: 126528 - DNA, 25 bp, Homo sapien
ttttacgctgcgtcattgacatctg

SEQ ID NO: 126529 - DNA, 25 bp, Homo sapien
gtcattgacatctgcatgaagctgg

SEQ ID NO: 126530 - DNA, 25 bp, Homo sapien
agggcaaatacctcatcctcaagga

SEQ ID NO: 126531 - DNA, 25 bp, Homo sapien
caaggaccccaacaagcaggtcatc

SEQ ID NO: 126532 - DNA, 25 bp, Homo sapien
aacaagcaggtcatccgtgtctaca

SEQ ID NO: 126533 - DNA, 25 bp, Homo sapien
agcaggtcatccgtgtctacagcct

SEQ ID NO: 126534 - DNA, 25 bp, Homo sapien
tgatggcaccttcagctctgatgaa

SEQ ID NO: 126535 - DNA, 25 bp, Homo sapien
gaagaaacttaaaccagtgatgtgg

SEQ ID NO: 126536 - DNA, 25 bp, Homo sapien
ttgatgcttagtggaatgtgtgtct

SEQ ID NO: 126537 - DNA, 25 bp, Homo sapien
aatgtgtgtctaacttgctctctga

SEQ ID NO: 126538 - DNA, 25 bp, Homo sapien
gtgtctaacttgctctctgacattt

SEQ ID NO: 126539 - DNA, 25 bp, Homo sapien
attgaaggtgctgtttgtagactta

SEQ ID NO: 126540 - DNA, 25 bp, Homo sapien
tgaaggtgctgtttgtagacttaac

SEQ ID NO: 126541 - DNA, 25 bp, Homo sapien
aaggtgctgtttgtagacttaacac

SEQ ID NO: 126542 - DNA, 25 bp, Homo sapien
gtgctgtttgtagacttaacaccca

SEQ ID NO: 126543 - DNA, 25 bp, Homo sapien
gctgtttgtagacttaacacccagt

SEQ ID NO: 126544 - DNA, 25 bp, Homo sapien
gtttgtagacttaacacccagtgaa

SEQ ID NO: 126545 - DNA, 25 bp, Homo sapien
tgtagacttaacacccagtgaaagc

SEQ ID NO: 126546 - DNA, 25 bp, Homo sapien
gacttaacacccagtgaaagcccag

SEQ ID NO: 126547 - DNA, 25 bp, Homo sapien
atcgcagcttcagcatctcctgttt

SEQ ID NO: 126548 - DNA, 25 bp, Homo sapien
atgcttggctccctctgctgatctc

SEQ ID NO: 126549 - DNA, 25 bp, Homo sapien
gcttggctccctctgctgatctcag

SEQ ID NO: 126550 - DNA, 25 bp, Homo sapien
actttccaccaagtgtctagagtca

SEQ ID NO: 126551 - DNA, 25 bp, Homo sapien
ctttccaccaagtgtctagagtcat

SEQ ID NO: 126552 - DNA, 25 bp, Homo sapien
tttccaccaagtgtctagagtcatg

SEQ ID NO: 126553 - DNA, 25 bp, Homo sapien
ttccaccaagtgtctagagtcatgt

SEQ ID NO: 126554 - DNA, 25 bp, Homo sapien
tccaccaagtgtctagagtcatgtg

SEQ ID NO: 126555 - DNA, 25 bp, Homo sapien
ccaccaagtgtctagagtcatgtga

SEQ ID NO: 126556 - DNA, 25 bp, Homo sapien
caccaagtgtctagagtcatgtgag

SEQ ID NO: 126557 - DNA, 25 bp, Homo sapien
accaagtgtctagagtcatgtgagc

SEQ ID NO: 126558 - DNA, 25 bp, Homo sapien
ccaagtgtctagagtcatgtgagcc

SEQ ID NO: 126559 - DNA, 25 bp, Homo sapien
caagtgtctagagtcatgtgagcct

SEQ ID NO: 126560 - DNA, 25 bp, Homo sapien
gcatttggtaaattatcgctgagtt

SEQ ID NO: 126561 - DNA, 25 bp, Homo sapien
atcgctgagtttttttctgttgcca

SEQ ID NO: 126562 - DNA, 25 bp, Homo sapien
ttctgttgccaatagcaaactgctt

SEQ ID NO: 126563 - DNA, 25 bp, Homo sapien
agcaaactgcttttccattaatgga

SEQ ID NO: 126564 - DNA, 25 bp, Homo sapien
aatggagaattcatgcctttcaagc

SEQ ID NO: 126565 - DNA, 25 bp, Homo sapien
ttggaggaatcgtttaaattctctt

SEQ ID NO: 126566 - DNA, 25 bp, Homo sapien
gtaatgactgtgttgacttcaattt

SEQ ID NO: 126567 - DNA, 25 bp, Homo sapien
acttcaattttggagcgcagtagct

SEQ ID NO: 126568 - DNA, 25 bp, Homo sapien
agcgcagtagctatgttaaagatga

SEQ ID NO: 126569 - DNA, 25 bp, Homo sapien
tgaactatttggtctcattgaagcc

SEQ ID NO: 126570 - DNA, 25 bp, Homo sapien
ggtctcattgaagccaacacagaac

SEQ ID NO: 126571 - DNA, 25 bp, Homo sapien
tgctttggttaaaaatggctcaagt

SEQ ID NO: 126572 - DNA, 25 bp, Homo sapien
ggctcaagtagaaaagcagtcccat

SEQ ID NO: 126573 - DNA, 25 bp, Homo sapien
caagtagaaaagcagtcccattcat

SEQ ID NO: 126574 - DNA, 25 bp, Homo sapien
gtagaaaagcagtcccattcatatt

SEQ ID NO: 126575 - DNA, 25 bp, Homo sapien
ccattcatattaagacagtgtacaa

SEQ ID NO: 126576 - DNA, 25 bp, Homo sapien
ttctccatctttatagaaggaattt

SEQ ID NO: 126577 - DNA, 25 bp, Homo sapien
ccatgtgaacagcataagtttggag

SEQ ID NO: 126578 - DNA, 25 bp, Homo sapien
gaacagcataagtttggagcactag

SEQ ID NO: 126579 - DNA, 25 bp, Homo sapien
cagcataagtttggagcactagttt

SEQ ID NO: 126580 - DNA, 25 bp, Homo sapien
cataagtttggagcactagtttgat

SEQ ID NO: 126581 - DNA, 25 bp, Homo sapien
gtttggagcactagtttgattatta

SEQ ID NO: 126582 - DNA, 25 bp, Homo sapien
gccagaacttctcccggtgcctgga

SEQ ID NO: 126583 - DNA, 25 bp, Homo sapien
agaacttctcccggtgcctggagct

SEQ ID NO: 126584 - DNA, 25 bp, Homo sapien
tggtgcctgcactggcagaggacgc

SEQ ID NO: 126585 - DNA, 25 bp, Homo sapien
cctgcactggcagaggacgcggcgg

SEQ ID NO: 126586 - DNA, 25 bp, Homo sapien
gacctgctgcttgtggagcactgac

SEQ ID NO: 126587 - DNA, 25 bp, Homo sapien
ctgctgcttgtggagcactgacctg

SEQ ID NO: 126588 - DNA, 25 bp, Homo sapien
tgctgcttgtggagcactgacctgg

SEQ ID NO: 126589 - DNA, 25 bp, Homo sapien
tgcttgtggagcactgacctggcca

SEQ ID NO: 126590 - DNA, 25 bp, Homo sapien
gcttgtggagcactgacctggccaa

SEQ ID NO: 126591 - DNA, 25 bp, Homo sapien
ttgtggagcactgacctggccaagg

SEQ ID NO: 126592 - DNA, 25 bp, Homo sapien
tgtggagcactgacctggccaaggc

SEQ ID NO: 126593 - DNA, 25 bp, Homo sapien
tttctgttttccgtgttcgtaacag

SEQ ID NO: 126594 - DNA, 25 bp, Homo sapien
tttccgtgttcgtaacagaagggag

SEQ ID NO: 126595 - DNA, 25 bp, Homo sapien
gggaaagcgcagctactgacaagta

SEQ ID NO: 126596 - DNA, 25 bp, Homo sapien
gacaagtagaacactgctacttttt

SEQ ID NO: 126597 - DNA, 25 bp, Homo sapien
gacggaattagtccttggcttccct

SEQ ID NO: 126598 - DNA, 25 bp, Homo sapien
gcttccggctgcgaatgtccctgag

SEQ ID NO: 126599 - DNA, 25 bp, Homo sapien
ggctgcgaatgtccctgagtcaaca

SEQ ID NO: 126600 - DNA, 25 bp, Homo sapien
gaatgtccctgagtcaacaccaata

SEQ ID NO: 126601 - DNA, 25 bp, Homo sapien
gtccctgagtcaacaccaatagaga

SEQ ID NO: 126602 - DNA, 25 bp, Homo sapien
atagagattgctttgtgtattttgt

SEQ ID NO: 126603 - DNA, 25 bp, Homo sapien
gggttctctgttttgaagacagaat

SEQ ID NO: 126604 - DNA, 25 bp, Homo sapien
gttacatatttgattgaaagtcttc

SEQ ID NO: 126605 - DNA, 25 bp, Homo sapien
gttagaataacttgctactcatggc

SEQ ID NO: 126606 - DNA, 25 bp, Homo sapien
ctcatggcaagattaggaagtcaca

SEQ ID NO: 126607 - DNA, 25 bp, Homo sapien
gattcttttctataatgtgcctggc

SEQ ID NO: 126608 - DNA, 25 bp, Homo sapien
cttttctataatgtgcctggctctg

SEQ ID NO: 126609 - DNA, 25 bp, Homo sapien
gcctggctctgattcttcattatgt

SEQ ID NO: 126610 - DNA, 25 bp, Homo sapien
gattcttcattatgtatgtgactat

SEQ ID NO: 126611 - DNA, 25 bp, Homo sapien
taaatagagtgctttttcatggaaa

SEQ ID NO: 126612 - DNA, 25 bp, Homo sapien
atggaaaagccttcttatatctgaa

SEQ ID NO: 126613 - DNA, 25 bp, Homo sapien
cagttcagtccaatttatactggaa

SEQ ID NO: 126614 - DNA, 25 bp, Homo sapien
ttcttcatttcagcaatgttacata

SEQ ID NO: 126615 - DNA, 25 bp, Homo sapien
aacgcagctacgagggtcacatact

SEQ ID NO: 126616 - DNA, 25 bp, Homo sapien
gagggtcacatactatgctctgtac

SEQ ID NO: 126617 - DNA, 25 bp, Homo sapien
tgctctgtacagaggatccttgctc

SEQ ID NO: 126618 - DNA, 25 bp, Homo sapien
cttgctcccgtctaatatgaccaga

SEQ ID NO: 126619 - DNA, 25 bp, Homo sapien
gagctggaataccacactgaccaaa

SEQ ID NO: 126620 - DNA, 25 bp, Homo sapien
gaccaaatctggatctttggactaa

SEQ ID NO: 126621 - DNA, 25 bp, Homo sapien
gcaaagctcactgtattgggctaat

SEQ ID NO: 126622 - DNA, 25 bp, Homo sapien
agcttctctcataaactgatcacga

SEQ ID NO: 126623 - DNA, 25 bp, Homo sapien
gggttcataccccaaaagcaatatg

SEQ ID NO: 126624 - DNA, 25 bp, Homo sapien
aagcaatatgttgtcactcctaatt

SEQ ID NO: 126625 - DNA, 25 bp, Homo sapien
gtcactcctaattctcaagtactat

SEQ ID NO: 126626 - DNA, 25 bp, Homo sapien
aagcaggaaagatcccaagtcaaac

SEQ ID NO: 126627 - DNA, 25 bp, Homo sapien
agtcaaacagtgtggcttaaacatt

SEQ ID NO: 126628 - DNA, 25 bp, Homo sapien
tttgtttcttggtgttgttatggca

SEQ ID NO: 126629 - DNA, 25 bp, Homo sapien
ggcaagtttttggtaatgatgattc

SEQ ID NO: 126630 - DNA, 25 bp, Homo sapien
cattttgggaaattcttgcactgta

SEQ ID NO: 126631 - DNA, 25 bp, Homo sapien
ggaaattcttgcactgtatccaagt

SEQ ID NO: 126632 - DNA, 25 bp, Homo sapien
tgcactgtatccaagttatttgatc

SEQ ID NO: 126633 - DNA, 25 bp, Homo sapien
ttatttgatctggtgcgtgtggccc

SEQ ID NO: 126634 - DNA, 25 bp, Homo sapien
tctctctgttccaagtgtgtgtgca

SEQ ID NO: 126635 - DNA, 25 bp, Homo sapien
tgttccaagtgtgtgtgcaatgttc

SEQ ID NO: 126636 - DNA, 25 bp, Homo sapien
ttctctctgtgtggcaaacatttaa

SEQ ID NO: 126637 - DNA, 25 bp, Homo sapien
cacatgctttctactcttcgattat

SEQ ID NO: 126638 - DNA, 25 bp, Homo sapien
gctttctactcttcgattattagta

SEQ ID NO: 126639 - DNA, 25 bp, Homo sapien
tagctaatggtctttggcatgtttt

SEQ ID NO: 126640 - DNA, 25 bp, Homo sapien
atttctgttgagatatagcctttac

SEQ ID NO: 126641 - DNA, 25 bp, Homo sapien
gagatatagcctttacatttgtaca

SEQ ID NO: 126642 - DNA, 25 bp, Homo sapien
atgtgactatgtcttggcaatgcac

SEQ ID NO: 126643 - DNA, 25 bp, Homo sapien
atgcacttcatacacaatgactaat

SEQ ID NO: 126644 - DNA, 25 bp, Homo sapien
acaatgactaatctatactgtgatg

SEQ ID NO: 126645 - DNA, 25 bp, Homo sapien
ctatactgtgatgatttgactcaaa

SEQ ID NO: 126646 - DNA, 25 bp, Homo sapien
gtttatgaatggaaagctttgtgca

SEQ ID NO: 126647 - DNA, 25 bp, Homo sapien
tacatataagcagagtaagcctttt

SEQ ID NO: 126648 - DNA, 25 bp, Homo sapien
agtgctacgccacccagtaccagga

SEQ ID NO: 126649 - DNA, 25 bp, Homo sapien
gtaccaggactacagcctgtcgtca

SEQ ID NO: 126650 - DNA, 25 bp, Homo sapien
tgtcgtcagcccacaaggtgtcagg

SEQ ID NO: 126651 - DNA, 25 bp, Homo sapien
tcagcccacaaggtgtcaggcatgg

SEQ ID NO: 126652 - DNA, 25 bp, Homo sapien
gtcaggcatggcaagccggctgctc

SEQ ID NO: 126653 - DNA, 25 bp, Homo sapien
tgctcgggccctcatttgagtccta

SEQ ID NO: 126654 - DNA, 25 bp, Homo sapien
ggccctcatttgagtcctacctgct

SEQ ID NO: 126655 - DNA, 25 bp, Homo sapien
tgctgcccgaactgaccagatatga

SEQ ID NO: 126656 - DNA, 25 bp, Homo sapien
gcccgaactgaccagatatgactgt

SEQ ID NO: 126657 - DNA, 25 bp, Homo sapien
tgaacgtgcccgtgctgggaagctc

SEQ ID NO: 126658 - DNA, 25 bp, Homo sapien
gaagctccacgctcctgcaaggagg

SEQ ID NO: 126659 - DNA, 25 bp, Homo sapien
tcccttcgctgacacgggccaagga

SEQ ID NO: 126660 - DNA, 25 bp, Homo sapien
ggaagtgcgtgtgttgggccaggta

SEQ ID NO: 126661 - DNA, 25 bp, Homo sapien
gttgggccaggtaggatacgtacac

SEQ ID NO: 126662 - DNA, 25 bp, Homo sapien
ggtaggatacgtacacctcttgcct

SEQ ID NO: 126663 - DNA, 25 bp, Homo sapien
gatacgtacacctcttgcctcagag

SEQ ID NO: 126664 - DNA, 25 bp, Homo sapien
agcctcatcccaggcagtgggtctt

SEQ ID NO: 126665 - DNA, 25 bp, Homo sapien
caggcagtgggtcttccctctgtcc

SEQ ID NO: 126666 - DNA, 25 bp, Homo sapien
tctgtccaaccactgttttattatt

SEQ ID NO: 126667 - DNA, 25 bp, Homo sapien
tattttactaacatggtgatgggct

SEQ ID NO: 126668 - DNA, 25 bp, Homo sapien
atggtgatgggctccctcccctaac

SEQ ID NO: 126669 - DNA, 25 bp, Homo sapien
ggacagcagccactcagttcttcct

SEQ ID NO: 126670 - DNA, 25 bp, Homo sapien
gaaatacgacactgtagcgactgat

SEQ ID NO: 126671 - DNA, 25 bp, Homo sapien
agcgactgatgttagttgttaccca

SEQ ID NO: 126672 - DNA, 25 bp, Homo sapien
cacactaccagtgttgtgggcacat

SEQ ID NO: 126673 - DNA, 25 bp, Homo sapien
cacccgattagacccttgatgctat

SEQ ID NO: 126674 - DNA, 25 bp, Homo sapien
agacccttgatgctattcacatgaa

SEQ ID NO: 126675 - DNA, 25 bp, Homo sapien
gtcattacattgttcaggctacgtg

SEQ ID NO: 126676 - DNA, 25 bp, Homo sapien
gaacttggaagcaccatcaggccat

SEQ ID NO: 126677 - DNA, 25 bp, Homo sapien
gcaccatcaggccatttgcatgaaa

SEQ ID NO: 126678 - DNA, 25 bp, Homo sapien
aaattcacatgcacctaaatcctca

SEQ ID NO: 126679 - DNA, 25 bp, Homo sapien
gcacctaaatcctcactttgacaga

SEQ ID NO: 126680 - DNA, 25 bp, Homo sapien
aaactcatgcttcagttataaccta

SEQ ID NO: 126681 - DNA, 25 bp, Homo sapien
agagaaaagatttgtcagtgtgttt

SEQ ID NO: 126682 - DNA, 25 bp, Homo sapien
actagtctgtgctactttatgtcaa

SEQ ID NO: 126683 - DNA, 25 bp, Homo sapien
gtctgtgctactttatgtcaatata

SEQ ID NO: 126684 - DNA, 25 bp, Homo sapien
tggtaaactagaagtaacttgtcca

SEQ ID NO: 126685 - DNA, 25 bp, Homo sapien
agtaacttgtccacaaccctcagtt

SEQ ID NO: 126686 - DNA, 25 bp, Homo sapien
acttgtccacaaccctcagttatga

SEQ ID NO: 126687 - DNA, 25 bp, Homo sapien
gtccacaaccctcagttatgatact

SEQ ID NO: 126688 - DNA, 25 bp, Homo sapien
aaccctcagttatgatacttatgtg

SEQ ID NO: 126689 - DNA, 25 bp, Homo sapien
agttatgatacttatgtgcgtgttt

SEQ ID NO: 126690 - DNA, 25 bp, Homo sapien
tatgatacttatgtgcgtgtttttt

SEQ ID NO: 126691 - DNA, 25 bp, Homo sapien
attgatttacttgcagatttttcag

SEQ ID NO: 126692 - DNA, 25 bp, Homo sapien
atcctgaaggaaaattacgggcaga

SEQ ID NO: 126693 - DNA, 25 bp, Homo sapien
aaaattacgggcagaaggaggctga

SEQ ID NO: 126694 - DNA, 25 bp, Homo sapien
ggctgagaaagtggcccgggtgaag

SEQ ID NO: 126695 - DNA, 25 bp, Homo sapien
ggcccgggtgaaggcgctatatgag

SEQ ID NO: 126696 - DNA, 25 bp, Homo sapien
aaggcgctatatgaggagctggatc

SEQ ID NO: 126697 - DNA, 25 bp, Homo sapien
cgctatatgaggagctggatctgcc

SEQ ID NO: 126698 - DNA, 25 bp, Homo sapien
agctggatctgccagcagtgttctt

SEQ ID NO: 126699 - DNA, 25 bp, Homo sapien
tggatctgccagcagtgttcttgca

SEQ ID NO: 126700 - DNA, 25 bp, Homo sapien
gggcttgcgcgcaaaatctacaagc

SEQ ID NO: 126701 - DNA, 25 bp, Homo sapien
ttgcgcgcaaaatctacaagcggag

SEQ ID NO: 126702 - DNA, 25 bp, Homo sapien
atctacaagcggagaaagtgaccta

SEQ ID NO: 126703 - DNA, 25 bp, Homo sapien
gcctggagaccctgcgcctgaagct

SEQ ID NO: 126704 - DNA, 25 bp, Homo sapien
tgcgcctgaagctgccagctgtggt

SEQ ID NO: 126705 - DNA, 25 bp, Homo sapien
tggtgacagctgacctgaggctcaa

SEQ ID NO: 126706 - DNA, 25 bp, Homo sapien
gtgacagctgacctgaggctcaacg

SEQ ID NO: 126707 - DNA, 25 bp, Homo sapien
tgaggctcaacgagccccgctacgc

SEQ ID NO: 126708 - DNA, 25 bp, Homo sapien
gccacgctgcccaacatcatgaaag

SEQ ID NO: 126709 - DNA, 25 bp, Homo sapien
acgctgcccaacatcatgaaagcca

SEQ ID NO: 126710 - DNA, 25 bp, Homo sapien
tgcccaacatcatgaaagccaagaa

SEQ ID NO: 126711 - DNA, 25 bp, Homo sapien
agaagatcgaggtgatcaagcctgg

SEQ ID NO: 126712 - DNA, 25 bp, Homo sapien
ggacctgggtgtggacctgacctcc

SEQ ID NO: 126713 - DNA, 25 bp, Homo sapien
tgtgatcagtgtggaggacccgccc

SEQ ID NO: 126714 - DNA, 25 bp, Homo sapien
tagttagcgccccaccgccgtggag

SEQ ID NO: 126715 - DNA, 25 bp, Homo sapien
ttctacagaagccaagctccctgga

SEQ ID NO: 126716 - DNA, 25 bp, Homo sapien
gctctagcttttgcagtcgtgtaat

SEQ ID NO: 126717 - DNA, 25 bp, Homo sapien
tagcttttgcagtcgtgtaatgggc

SEQ ID NO: 126718 - DNA, 25 bp, Homo sapien
agcttttgcagtcgtgtaatgggcc

SEQ ID NO: 126719 - DNA, 25 bp, Homo sapien
gcttttgcagtcgtgtaatgggccc

SEQ ID NO: 126720 - DNA, 25 bp, Homo sapien
cttttgcagtcgtgtaatgggccca

SEQ ID NO: 126721 - DNA, 25 bp, Homo sapien
ttttgcagtcgtgtaatgggcccaa

SEQ ID NO: 126722 - DNA, 25 bp, Homo sapien
tgtaatgggcccaagtcattgtttt

SEQ ID NO: 126723 - DNA, 25 bp, Homo sapien
ctcactttccaccaagtgtctagag

SEQ ID NO: 126724 - DNA, 25 bp, Homo sapien
caagtgtctagagtcatgtgagcct

SEQ ID NO: 126725 - DNA, 25 bp, Homo sapien
tccgcttcttgttgcgaaagctcta

SEQ ID NO: 126726 - DNA, 25 bp, Homo sapien
gaaagctctatgtctttcgccgcag

SEQ ID NO: 126727 - DNA, 25 bp, Homo sapien
gcagcttcctgatgacttgtatctc

SEQ ID NO: 126728 - DNA, 25 bp, Homo sapien
gacttgtatctcacttcgaaatctg

SEQ ID NO: 126729 - DNA, 25 bp, Homo sapien
cgaaatctgatattaggccgtcctt

SEQ ID NO: 126730 - DNA, 25 bp, Homo sapien
ctggcccaggaggtgacttatgcaa

SEQ ID NO: 126731 - DNA, 25 bp, Homo sapien
aaacttgagaccctttgaggcagtt

SEQ ID NO: 126732 - DNA, 25 bp, Homo sapien
attcttcacattctaatcctcctga

SEQ ID NO: 126733 - DNA, 25 bp, Homo sapien
tcctgagtcaaatcctgatcctgtc

SEQ ID NO: 126734 - DNA, 25 bp, Homo sapien
gatcctgtccactcagagttctgaa

SEQ ID NO: 126735 - DNA, 25 bp, Homo sapien
cagtcacagacccattctatgcaat

SEQ ID NO: 126736 - DNA, 25 bp, Homo sapien
gggaaaactatatccacagaatcgg

SEQ ID NO: 126737 - DNA, 25 bp, Homo sapien
ctatatccacagaatcggtcgaggt

SEQ ID NO: 126738 - DNA, 25 bp, Homo sapien
tcggtcgaggtggacggtttggccg

SEQ ID NO: 126739 - DNA, 25 bp, Homo sapien
tggccgtaaaggtgtggctattaac

SEQ ID NO: 126740 - DNA, 25 bp, Homo sapien
aggtgtggctattaacatggtgaca

SEQ ID NO: 126741 - DNA, 25 bp, Homo sapien
gtggctattaacatggtgacagaag

SEQ ID NO: 126742 - DNA, 25 bp, Homo sapien
ggactcttcgagacattgagacctt

SEQ ID NO: 126743 - DNA, 25 bp, Homo sapien
gacattgagaccttctacaacacct

SEQ ID NO: 126744 - DNA, 25 bp, Homo sapien
ccttctacaacacctccattgagga

SEQ ID NO: 126745 - DNA, 25 bp, Homo sapien
aggaaatgcccctcaatgttgctga

SEQ ID NO: 126746 - DNA, 25 bp, Homo sapien
tcaatgttgctgacctcatctgagg

SEQ ID NO: 126747 - DNA, 25 bp, Homo sapien
gaggactctcctgccctgtagaagg

SEQ ID NO: 126748 - DNA, 25 bp, Homo sapien
aggactctcctgccctgtagaaggg

SEQ ID NO: 126749 - DNA, 25 bp, Homo sapien
gactctcctgccctgtagaaggggc

SEQ ID NO: 126750 - DNA, 25 bp, Homo sapien
actctcctgccctgtagaaggggcc

SEQ ID NO: 126751 - DNA, 25 bp, Homo sapien
tctcctgccctgtagaaggggccgt

SEQ ID NO: 126752 - DNA, 25 bp, Homo sapien
ctcctgccctgtagaaggggccgtg

SEQ ID NO: 126753 - DNA, 25 bp, Homo sapien
cgtggggtcccctccagcatgggac

SEQ ID NO: 126754 - DNA, 25 bp, Homo sapien
gtggggtcccctccagcatgggact

SEQ ID NO: 126755 - DNA, 25 bp, Homo sapien
agcatgggactggcctgcctcctcc

SEQ ID NO: 126756 - DNA, 25 bp, Homo sapien
catgggactggcctgcctcctccgc

SEQ ID NO: 126757 - DNA, 25 bp, Homo sapien
atgggactggcctgcctcctccgcc

SEQ ID NO: 126758 - DNA, 25 bp, Homo sapien
aaggctaagaaatgtcagccacgga

SEQ ID NO: 126759 - DNA, 25 bp, Homo sapien
aaatgtcagccacggaaacaactct

SEQ ID NO: 126760 - DNA, 25 bp, Homo sapien
tatctggtgactttgggtaatgtga

SEQ ID NO: 126761 - DNA, 25 bp, Homo sapien
ctttgggtaatgtgaatcagtgcct

SEQ ID NO: 126762 - DNA, 25 bp, Homo sapien
tgctgtgtccttggtacagaaccat

SEQ ID NO: 126763 - DNA, 25 bp, Homo sapien
gtacagaaccatccacttgacctaa

SEQ ID NO: 126764 - DNA, 25 bp, Homo sapien
agaaccatccacttgacctaactac

SEQ ID NO: 126765 - DNA, 25 bp, Homo sapien
tgttaagccaacaactatcaccctc

SEQ ID NO: 126766 - DNA, 25 bp, Homo sapien
tgtatttactatgcgtgtttccagc

SEQ ID NO: 126767 - DNA, 25 bp, Homo sapien
gcgtgtttccagcagttggcattaa

SEQ ID NO: 126768 - DNA, 25 bp, Homo sapien
tggcattaaagtgcctttttctaat

SEQ ID NO: 126769 - DNA, 25 bp, Homo sapien
gccaggcctggcacattttggagtg

SEQ ID NO: 126770 - DNA, 25 bp, Homo sapien
ggcctggcacattttggagtgtcct

SEQ ID NO: 126771 - DNA, 25 bp, Homo sapien
ggcacattttggagtgtcctggcta

SEQ ID NO: 126772 - DNA, 25 bp, Homo sapien
acattttggagtgtcctggctacca

SEQ ID NO: 126773 - DNA, 25 bp, Homo sapien
ttttggagtgtcctggctaccagct

SEQ ID NO: 126774 - DNA, 25 bp, Homo sapien
cacacactatgctctctcaagaatg

SEQ ID NO: 126775 - DNA, 25 bp, Homo sapien
ctatgctctctcaagaatgtaattt

SEQ ID NO: 126776 - DNA, 25 bp, Homo sapien
tatctatatttttgcccaggtctgg

SEQ ID NO: 126777 - DNA, 25 bp, Homo sapien
tatatttttgcccaggtctgggtat

SEQ ID NO: 126778 - DNA, 25 bp, Homo sapien
aggtctgggtattgctcctgcccag

SEQ ID NO: 126779 - DNA, 25 bp, Homo sapien
gggtattgctcctgcccagaccctg

SEQ ID NO: 126780 - DNA, 25 bp, Homo sapien
ttctctgcctatgggatgggcccag

SEQ ID NO: 126781 - DNA, 25 bp, Homo sapien
gatggcatctcagtcaagggcgcca

SEQ ID NO: 126782 - DNA, 25 bp, Homo sapien
aagggcgccaacaacagtaacacca

SEQ ID NO: 126783 - DNA, 25 bp, Homo sapien
gaggagatgcgaaaactcttcatcc

SEQ ID NO: 126784 - DNA, 25 bp, Homo sapien
aaactcttcatccagagggccaaga

SEQ ID NO: 126785 - DNA, 25 bp, Homo sapien
tccagagggccaagaagatcgacaa

SEQ ID NO: 126786 - DNA, 25 bp, Homo sapien
tcgacaaaatatcccgcattggctt

SEQ ID NO: 126787 - DNA, 25 bp, Homo sapien
ttcaacatgttctactggatcatct

SEQ ID NO: 126788 - DNA, 25 bp, Homo sapien
tggatcatctacaagattgtccgta

SEQ ID NO: 126789 - DNA, 25 bp, Homo sapien
gattgtccgtagagaggacgtccac

SEQ ID NO: 126790 - DNA, 25 bp, Homo sapien
gagaggacgtccacaaccagtgaag

SEQ ID NO: 126791 - DNA, 25 bp, Homo sapien
tatgaagatatctgcccgtcaactc

SEQ ID NO: 126792 - DNA, 25 bp, Homo sapien
tatctgcccgtcaactcataatatg

SEQ ID NO: 126793 - DNA, 25 bp, Homo sapien
atggatgtccccaacatcaaaagga

SEQ ID NO: 126794 - DNA, 25 bp, Homo sapien
atgacttccagctgattggcatcca

SEQ ID NO: 126795 - DNA, 25 bp, Homo sapien
ggcatccaggatgggtacctatcac

SEQ ID NO: 126796 - DNA, 25 bp, Homo sapien
ggtacctatcactgctccaggacag

SEQ ID NO: 126797 - DNA, 25 bp, Homo sapien
gaggtacgagaggaccttcgtctcc

SEQ ID NO: 126798 - DNA, 25 bp, Homo sapien
aggaccttcgtctccctgagggaga

SEQ ID NO: 126799 - DNA, 25 bp, Homo sapien
agagatcctgatcacggtgctgtct

SEQ ID NO: 126800 - DNA, 25 bp, Homo sapien
gaggcagctgttgcaatcaaggcca

SEQ ID NO: 126801 - DNA, 25 bp, Homo sapien
ccatggcaaaataactggctcccag

SEQ ID NO: 126802 - DNA, 25 bp, Homo sapien
atagcagctccatttctggagtctg

SEQ ID NO: 126803 - DNA, 25 bp, Homo sapien
tcttcaagtgaacatctcttgccat

SEQ ID NO: 126804 - DNA, 25 bp, Homo sapien
cttcaagtgaacatctcttgccatc

SEQ ID NO: 126805 - DNA, 25 bp, Homo sapien
ttcaagtgaacatctcttgccatca

SEQ ID NO: 126806 - DNA, 25 bp, Homo sapien
tcaagtgaacatctcttgccatcac

SEQ ID NO: 126807 - DNA, 25 bp, Homo sapien
gtgaacatctcttgccatcacctag

SEQ ID NO: 126808 - DNA, 25 bp, Homo sapien
tgaacatctcttgccatcacctagc

SEQ ID NO: 126809 - DNA, 25 bp, Homo sapien
gaacatctcttgccatcacctagct

SEQ ID NO: 126810 - DNA, 25 bp, Homo sapien
aacatctcttgccatcacctagctg

SEQ ID NO: 126811 - DNA, 25 bp, Homo sapien
acatctcttgccatcacctagctgc

SEQ ID NO: 126812 - DNA, 25 bp, Homo sapien
ctccctgtttgaagcctgcccttgt

SEQ ID NO: 126813 - DNA, 25 bp, Homo sapien
ctgcccttgtctgagatgctggtaa

SEQ ID NO: 126814 - DNA, 25 bp, Homo sapien
gcccttgtctgagatgctggtaatg

SEQ ID NO: 126815 - DNA, 25 bp, Homo sapien
ttgtctgagatgctggtaatggcca

SEQ ID NO: 126816 - DNA, 25 bp, Homo sapien
gatgctggtaatggccatggtaccc

SEQ ID NO: 126817 - DNA, 25 bp, Homo sapien
taatggccatggtacccccttctgg

SEQ ID NO: 126818 - DNA, 25 bp, Homo sapien
ccccttctgggcatctgttctggtt

SEQ ID NO: 126819 - DNA, 25 bp, Homo sapien
gggcacatgctgagtctcccaaggc

SEQ ID NO: 126820 - DNA, 25 bp, Homo sapien
acatgctgagtctcccaaggctgcg

SEQ ID NO: 126821 - DNA, 25 bp, Homo sapien
tgctgagtctcccaaggctgcgtct

SEQ ID NO: 126822 - DNA, 25 bp, Homo sapien
tgagtctcccaaggctgcgtctgga

SEQ ID NO: 126823 - DNA, 25 bp, Homo sapien
aagcctggacagatgggagacagtc

SEQ ID NO: 126824 - DNA, 25 bp, Homo sapien
gggagacagtccacagaatcagaaa

SEQ ID NO: 126825 - DNA, 25 bp, Homo sapien
cacagaatcagaaacgccagcgaag

SEQ ID NO: 126826 - DNA, 25 bp, Homo sapien
cgccagcgaagagtgtgaaatgaaa

SEQ ID NO: 126827 - DNA, 25 bp, Homo sapien
tgccttgccatttctgaacaaaaga

SEQ ID NO: 126828 - DNA, 25 bp, Homo sapien
agaatgacttgacacttccactcta

SEQ ID NO: 126829 - DNA, 25 bp, Homo sapien
cttccactctaggtagatcctcaaa

SEQ ID NO: 126830 - DNA, 25 bp, Homo sapien
gagttgaagtcaaaggacctttctg

SEQ ID NO: 126831 - DNA, 25 bp, Homo sapien
ggacctttctgacataatcaagcaa

SEQ ID NO: 126832 - DNA, 25 bp, Homo sapien
aagtggtgctttgtggtatctgaac

SEQ ID NO: 126833 - DNA, 25 bp, Homo sapien
aaaatagtattgtttagctcccaga

SEQ ID NO: 126834 - DNA, 25 bp, Homo sapien
gagccaggacaaaggcttttgttca

SEQ ID NO: 126835 - DNA, 25 bp, Homo sapien
caaaggcttttgttcaggtttatga

SEQ ID NO: 126836 - DNA, 25 bp, Homo sapien
tgaaaaccccagatgaaatcatgag

SEQ ID NO: 126837 - DNA, 25 bp, Homo sapien
atgagtggccgaacagaccgtctgg

SEQ ID NO: 126838 - DNA, 25 bp, Homo sapien
tggagcacctagagtcccaggagct

SEQ ID NO: 126839 - DNA, 25 bp, Homo sapien
tgaaggaaccaacagtccacctcag

SEQ ID NO: 126840 - DNA, 25 bp, Homo sapien
cctgcccaccaggattgctggaagt

SEQ ID NO: 126841 - DNA, 25 bp, Homo sapien
aaaaggaagcgacccagaaatggca

SEQ ID NO: 126842 - DNA, 25 bp, Homo sapien
gaaatggcagggacacttctcttgc

SEQ ID NO: 126843 - DNA, 25 bp, Homo sapien
agggacacttctcttgcagaccaag

SEQ ID NO: 126844 - DNA, 25 bp, Homo sapien
cttgcagaccaagagggaccctgga

SEQ ID NO: 126845 - DNA, 25 bp, Homo sapien
gagcacaatgctggggttctcttca

SEQ ID NO: 126846 - DNA, 25 bp, Homo sapien
gggttctcttcacactatcactgcc

SEQ ID NO: 126847 - DNA, 25 bp, Homo sapien
ttcacactatcactgccccaaattg

SEQ ID NO: 126848 - DNA, 25 bp, Homo sapien
cactgccccaaattgtctttctaaa

SEQ ID NO: 126849 - DNA, 25 bp, Homo sapien
gtctttctaaatttcaacttcaatg

SEQ ID NO: 126850 - DNA, 25 bp, Homo sapien
ctaaatttcaacttcaatgtcatct

SEQ ID NO: 126851 - DNA, 25 bp, Homo sapien
tcaacttcaatgtcatcttctccat

SEQ ID NO: 126852 - DNA, 25 bp, Homo sapien
agccttaatttcttgctccataact

SEQ ID NO: 126853 - DNA, 25 bp, Homo sapien
ataatgtaacttgatttcttatctg

SEQ ID NO: 126854 - DNA, 25 bp, Homo sapien
ctgtgtttgtgttggcatgcaagat

SEQ ID NO: 126855 - DNA, 25 bp, Homo sapien
ggcatgcaagatttaggtacttatc

SEQ ID NO: 126856 - DNA, 25 bp, Homo sapien
tcctctaggccctgtgagcacaaag

SEQ ID NO: 126857 - DNA, 25 bp, Homo sapien
tttgtcttttaatccatttcaggac

SEQ ID NO: 126858 - DNA, 25 bp, Homo sapien
ttaatccatttcaggactctctcca

SEQ ID NO: 126859 - DNA, 25 bp, Homo sapien
catttcaggactctctccaggaggg

SEQ ID NO: 126860 - DNA, 25 bp, Homo sapien
ctcggggtgtgtcatttctatattc

SEQ ID NO: 126861 - DNA, 25 bp, Homo sapien
ttctatattcctccagctgggattg

SEQ ID NO: 126862 - DNA, 25 bp, Homo sapien
ctatattcctccagctgggattggg

SEQ ID NO: 126863 - DNA, 25 bp, Homo sapien
ctttgttgtgagaatggcctggagc

SEQ ID NO: 126864 - DNA, 25 bp, Homo sapien
gagcaggcccaatgctgcttttggg

SEQ ID NO: 126865 - DNA, 25 bp, Homo sapien
gggtcagcatccagtgtgagatact

SEQ ID NO: 126866 - DNA, 25 bp, Homo sapien
tgcaaataaaacgctttccccgtca

SEQ ID NO: 126867 - DNA, 25 bp, Homo sapien
ggaccatgaggtgaagaccctacag

SEQ ID NO: 126868 - DNA, 25 bp, Homo sapien
gtgaagaccctacaggtccaggctg

SEQ ID NO: 126869 - DNA, 25 bp, Homo sapien
tacaggtccaggctgcccaatttgc

SEQ ID NO: 126870 - DNA, 25 bp, Homo sapien
ggctgcccaatttgccaagcagaca

SEQ ID NO: 126871 - DNA, 25 bp, Homo sapien
ggtggagaacttcaaccaggcactc

SEQ ID NO: 126872 - DNA, 25 bp, Homo sapien
gagaacttcaaccaggcactcaagg

SEQ ID NO: 126873 - DNA, 25 bp, Homo sapien
agcatcgagctggacatgcgcacca

SEQ ID NO: 126874 - DNA, 25 bp, Homo sapien
tggacatgcgcaccattgccactgc

SEQ ID NO: 126875 - DNA, 25 bp, Homo sapien
ttgccactgcactggaatatgtcta

SEQ ID NO: 126876 - DNA, 25 bp, Homo sapien
atatgtctacaaagggcagctgcag

SEQ ID NO: 126877 - DNA, 25 bp, Homo sapien
tctacaaagggcagctgcagtctgc

SEQ ID NO: 126878 - DNA, 25 bp, Homo sapien
aactcactaagtttacttctcgaat

SEQ ID NO: 126879 - DNA, 25 bp, Homo sapien
attgaagcaagtgaggcctgacatg

SEQ ID NO: 126880 - DNA, 25 bp, Homo sapien
ggcctgacatggttgtcatcactag

SEQ ID NO: 126881 - DNA, 25 bp, Homo sapien
actagtggcaaatgaccttccaagt

SEQ ID NO: 126882 - DNA, 25 bp, Homo sapien
tgaccttccaagtaagcagatggga

SEQ ID NO: 126883 - DNA, 25 bp, Homo sapien
gtaggtgatattcattcgtatccag

SEQ ID NO: 126884 - DNA, 25 bp, Homo sapien
tattcattcgtatccagctctttat

SEQ ID NO: 126885 - DNA, 25 bp, Homo sapien
tcgtatccagctctttattacatag

SEQ ID NO: 126886 - DNA, 25 bp, Homo sapien
aaatgatttacataggccgagctgt

SEQ ID NO: 126887 - DNA, 25 bp, Homo sapien
acataggccgagctgtggacaaaaa

SEQ ID NO: 126888 - DNA, 25 bp, Homo sapien
agcagcagcttgtagtatgcttaag

SEQ ID NO: 126889 - DNA, 25 bp, Homo sapien
actccaaagagttaagcatgtgctt

SEQ ID NO: 126890 - DNA, 25 bp, Homo sapien
ttaagcatgtgcttcacagagctca

SEQ ID NO: 126891 - DNA, 25 bp, Homo sapien
gagctcacgacaaatatcatcccag

SEQ ID NO: 126892 - DNA, 25 bp, Homo sapien
acgacaaatatcatcccagggagta

SEQ ID NO: 126893 - DNA, 25 bp, Homo sapien
tcccagggagtaacaaggtgatcaa

SEQ ID NO: 126894 - DNA, 25 bp, Homo sapien
ggtgatcaaacctaactcaggcccc

SEQ ID NO: 126895 - DNA, 25 bp, Homo sapien
agagccagaccgtcggctgccttga

SEQ ID NO: 126896 - DNA, 25 bp, Homo sapien
gccttgaccgtgctgtctgtcctga

SEQ ID NO: 126897 - DNA, 25 bp, Homo sapien
gtaggctgtgggaaccgagtcagaa

SEQ ID NO: 126898 - DNA, 25 bp, Homo sapien
atttttgaaagctacgcagacaaga

SEQ ID NO: 126899 - DNA, 25 bp, Homo sapien
gcagacaagaacagccgcctgacga

SEQ ID NO: 126900 - DNA, 25 bp, Homo sapien
aatgttagtttagctgattgtatgg

SEQ ID NO: 126901 - DNA, 25 bp, Homo sapien
gtttgttttacctatttcacaactg

SEQ ID NO: 126902 - DNA, 25 bp, Homo sapien
gttttacctatttcacaactgtgta

SEQ ID NO: 126903 - DNA, 25 bp, Homo sapien
attgccaataattcctgtccatgaa

SEQ ID NO: 126904 - DNA, 25 bp, Homo sapien
aataattcctgtccatgaaaatgca

SEQ ID NO: 126905 - DNA, 25 bp, Homo sapien
gaaaatgcaaattatccagtgtaga

SEQ ID NO: 126906 - DNA, 25 bp, Homo sapien
gtagatatatttgaccatcacccta

SEQ ID NO: 126907 - DNA, 25 bp, Homo sapien
tgaccatcaccctatggatattggc

SEQ ID NO: 126908 - DNA, 25 bp, Homo sapien
catttcagcctgaatgtctgcctat

SEQ ID NO: 126909 - DNA, 25 bp, Homo sapien
aatgtctgcctatatattctctgct

SEQ ID NO: 126910 - DNA, 25 bp, Homo sapien
gcctatatattctctgctctttgta

SEQ ID NO: 126911 - DNA, 25 bp, Homo sapien
ccagggctgctctgcgatctagacg

SEQ ID NO: 126912 - DNA, 25 bp, Homo sapien
ggctgctctgcgatctagacgccct

SEQ ID NO: 126913 - DNA, 25 bp, Homo sapien
agacgccctcttccaaggggtgcca

SEQ ID NO: 126914 - DNA, 25 bp, Homo sapien
gggtgccacccaacaaaagcatcta

SEQ ID NO: 126915 - DNA, 25 bp, Homo sapien
gtgccacccaacaaaagcatctacg

SEQ ID NO: 126916 - DNA, 25 bp, Homo sapien
aaagcatctacgacgtttgggtcag

SEQ ID NO: 126917 - DNA, 25 bp, Homo sapien
gcatctacgacgtttgggtcagcca

SEQ ID NO: 126918 - DNA, 25 bp, Homo sapien
atctacgacgtttgggtcagccacc

SEQ ID NO: 126919 - DNA, 25 bp, Homo sapien
ctggtgcagcctgtgaggctcttaa

SEQ ID NO: 126920 - DNA, 25 bp, Homo sapien
gtgcagcctgtgaggctcttaagac

SEQ ID NO: 126921 - DNA, 25 bp, Homo sapien
agcctgtgaggctcttaagacaggg

SEQ ID NO: 126922 - DNA, 25 bp, Homo sapien
gtcttcctgtggttgtatgcactga

SEQ ID NO: 126923 - DNA, 25 bp, Homo sapien
gaaatcagacgtttctgctccaaac

SEQ ID NO: 126924 - DNA, 25 bp, Homo sapien
tgctccaaacgaccattttatcttc

SEQ ID NO: 126925 - DNA, 25 bp, Homo sapien
ttcgtgctctgcaacttcttcaatt

SEQ ID NO: 126926 - DNA, 25 bp, Homo sapien
acttcttcaattccagagtttctga

SEQ ID NO: 126927 - DNA, 25 bp, Homo sapien
tgaccaagaacacctggctaccatt

SEQ ID NO: 126928 - DNA, 25 bp, Homo sapien
ctggctaccattttgttttctcctg

SEQ ID NO: 126929 - DNA, 25 bp, Homo sapien
tgcccttgttggtgcatggttctaa

SEQ ID NO: 126930 - DNA, 25 bp, Homo sapien
ggtgcatggttctaagcgtgcccct

SEQ ID NO: 126931 - DNA, 25 bp, Homo sapien
tacgcctgacacagagaacctctca

SEQ ID NO: 126932 - DNA, 25 bp, Homo sapien
atttgtcgcctgtctgactgattta

SEQ ID NO: 126933 - DNA, 25 bp, Homo sapien
taaacggctcagacaggcagatttg

SEQ ID NO: 126934 - DNA, 25 bp, Homo sapien
tgtctccttattcggcagccttatg

SEQ ID NO: 126935 - DNA, 25 bp, Homo sapien
ttattcggcagccttatgattaaac

SEQ ID NO: 126936 - DNA, 25 bp, Homo sapien
agaagccgcagctctgcgggtctac

SEQ ID NO: 126937 - DNA, 25 bp, Homo sapien
agctctgcgggtctactttcagtga

SEQ ID NO: 126938 - DNA, 25 bp, Homo sapien
gcgggtctactttcagtgacacaga

SEQ ID NO: 126939 - DNA, 25 bp, Homo sapien
gaattccagcaaaagagctattgcc

SEQ ID NO: 126940 - DNA, 25 bp, Homo sapien
tctccccaagaggaactgaatcagc

SEQ ID NO: 126941 - DNA, 25 bp, Homo sapien
tcttcatctcaccatcctgtattct

SEQ ID NO: 126942 - DNA, 25 bp, Homo sapien
catcctgtattcttcaaccagtgat

SEQ ID NO: 126943 - DNA, 25 bp, Homo sapien
aaatacctagacctaaacggctcag

SEQ ID NO: 126944 - DNA, 25 bp, Homo sapien
gtatttctacctctagtaatgggct

SEQ ID NO: 126945 - DNA, 25 bp, Homo sapien
acctctagtaatgggctttatgtgc

SEQ ID NO: 126946 - DNA, 25 bp, Homo sapien
atgggctttatgtgctagattttaa

SEQ ID NO: 126947 - DNA, 25 bp, Homo sapien
gattttaatatccttgagcctgggc

SEQ ID NO: 126948 - DNA, 25 bp, Homo sapien
ttaatatccttgagcctgggcaagt

SEQ ID NO: 126949 - DNA, 25 bp, Homo sapien
agaaacatggtttacttgcacaaaa

SEQ ID NO: 126950 - DNA, 25 bp, Homo sapien
tttacttgcacaaaactgatcagtt

SEQ ID NO: 126951 - DNA, 25 bp, Homo sapien
gttttgagagatcgttaatgccctt

SEQ ID NO: 126952 - DNA, 25 bp, Homo sapien
gagagatcgttaatgcccttgaagt

SEQ ID NO: 126953 - DNA, 25 bp, Homo sapien
tcgttaatgcccttgaagtggtttt

SEQ ID NO: 126954 - DNA, 25 bp, Homo sapien
gtctacttaatttatcaagtcatgt

SEQ ID NO: 126955 - DNA, 25 bp, Homo sapien
ggctgtgattgtcagcaatgaccat

SEQ ID NO: 126956 - DNA, 25 bp, Homo sapien
caatgaccatgctgggaaactgtgt

SEQ ID NO: 126957 - DNA, 25 bp, Homo sapien
atgattggcatgactcccaggagaa

SEQ ID NO: 126958 - DNA, 25 bp, Homo sapien
caggagaagccagcgatggagaaat

SEQ ID NO: 126959 - DNA, 25 bp, Homo sapien
aaatggagagcgcaggacttctccc

SEQ ID NO: 126960 - DNA, 25 bp, Homo sapien
gacttctccccatgttatggctgat

SEQ ID NO: 126961 - DNA, 25 bp, Homo sapien
catgttatggctgatcagtcatcca

SEQ ID NO: 126962 - DNA, 25 bp, Homo sapien
gatcagtcatccaccaggaacgaag

SEQ ID NO: 126963 - DNA, 25 bp, Homo sapien
gaaggatgcatcatgtgctcctacc

SEQ ID NO: 126964 - DNA, 25 bp, Homo sapien
tgctctaccgcttttctgggtcaca

SEQ ID NO: 126965 - DNA, 25 bp, Homo sapien
gcttttctgggtcacagaggccaaa

SEQ ID NO: 126966 - DNA, 25 bp, Homo sapien
tggcgcatcatatgcagtgatatat

SEQ ID NO: 126967 - DNA, 25 bp, Homo sapien
aatataagccataggttcacaccat

SEQ ID NO: 126968 - DNA, 25 bp, Homo sapien
ggttcacaccattttgtttagacaa

SEQ ID NO: 126969 - DNA, 25 bp, Homo sapien
gtcatagatttctgaaggcgtcaac

SEQ ID NO: 126970 - DNA, 25 bp, Homo sapien
aggcgtcaacgtgcattttatttat

SEQ ID NO: 126971 - DNA, 25 bp, Homo sapien
cgtgcattttatttatggactggta

SEQ ID NO: 126972 - DNA, 25 bp, Homo sapien
tggactggtaagtaactgtggttta

SEQ ID NO: 126973 - DNA, 25 bp, Homo sapien
gtggtttactagcaggaatatttcc

SEQ ID NO: 126974 - DNA, 25 bp, Homo sapien
tttccaatttctacctttactacat

SEQ ID NO: 126975 - DNA, 25 bp, Homo sapien
tacctttactacatcttttcaacaa

SEQ ID NO: 126976 - DNA, 25 bp, Homo sapien
aaggccctgagttggcagtggccca

SEQ ID NO: 126977 - DNA, 25 bp, Homo sapien
ccattttgtgttttgcgtagaaagt

SEQ ID NO: 126978 - DNA, 25 bp, Homo sapien
tggcaagtttgcagatgtcatagag

SEQ ID NO: 126979 - DNA, 25 bp, Homo sapien
gtcatagaggctatcctggagactt

SEQ ID NO: 126980 - DNA, 25 bp, Homo sapien
tatcctggagacttaatagacattt

SEQ ID NO: 126981 - DNA, 25 bp, Homo sapien
tgttccaaaagagtccatgtggact

SEQ ID NO: 126982 - DNA, 25 bp, Homo sapien
gccatctgtgggaaatcccagggca

SEQ ID NO: 126983 - DNA, 25 bp, Homo sapien
gtgggaaatcccagggcaaatgttt

SEQ ID NO: 126984 - DNA, 25 bp, Homo sapien
acattttgtataccctgaagaactc

SEQ ID NO: 126985 - DNA, 25 bp, Homo sapien
gaagaactctttttcctctaatatg

SEQ ID NO: 126986 - DNA, 25 bp, Homo sapien
ctttttcctctaatatgcctaatct

SEQ ID NO: 126987 - DNA, 25 bp, Homo sapien
gcctaatctgtaatcacatttctga

SEQ ID NO: 126988 - DNA, 25 bp, Homo sapien
gcgggcaagtgaagcgcgggccgcg

SEQ ID NO: 126989 - DNA, 25 bp, Homo sapien
cgcggcgcgaccctccccggcggcg

SEQ ID NO: 126990 - DNA, 25 bp, Homo sapien
cgccaggcgcatgtctgcacctccg

SEQ ID NO: 126991 - DNA, 25 bp, Homo sapien
gccaggcgcatgtctgcacctccgc

SEQ ID NO: 126992 - DNA, 25 bp, Homo sapien
caggcgcatgtctgcacctccgctt

SEQ ID NO: 126993 - DNA, 25 bp, Homo sapien
aggcgcatgtctgcacctccgcttg

SEQ ID NO: 126994 - DNA, 25 bp, Homo sapien
atgtctgcacctccgcttgccagag

SEQ ID NO: 126995 - DNA, 25 bp, Homo sapien
tgtctgcacctccgcttgccagagg

SEQ ID NO: 126996 - DNA, 25 bp, Homo sapien
tctgcacctccgcttgccagaggcc

SEQ ID NO: 126997 - DNA, 25 bp, Homo sapien
ctgcacctccgcttgccagaggccc

SEQ ID NO: 126998 - DNA, 25 bp, Homo sapien
gcccagcgctcgccacgctcagtgc

SEQ ID NO: 126999 - DNA, 25 bp, Homo sapien
agctctacaccatgcgacgaggagg

SEQ ID NO: 127000 - DNA, 25 bp, Homo sapien
gacgaggaggtctcttctatgccac

SEQ ID NO: 127001 - DNA, 25 bp, Homo sapien
ctctgccagctttgcaccagcgtgg

SEQ ID NO: 127002 - DNA, 25 bp, Homo sapien
ttgcaccagcgtggcggtgtttact

SEQ ID NO: 127003 - DNA, 25 bp, Homo sapien
gtttactggcgccttgatctatgcc

SEQ ID NO: 127004 - DNA, 25 bp, Homo sapien
gatctatgccattcacgccgaggag

SEQ ID NO: 127005 - DNA, 25 bp, Homo sapien
gccattcacgccgaggagatcctgg

SEQ ID NO: 127006 - DNA, 25 bp, Homo sapien
agatcctggagaagcacccgcgagg

SEQ ID NO: 127007 - DNA, 25 bp, Homo sapien
gggcagcttcggatactgcttcgcc

SEQ ID NO: 127008 - DNA, 25 bp, Homo sapien
tggtcagcggcatcatctacatcca

SEQ ID NO: 127009 - DNA, 25 bp, Homo sapien
tacatccacctacggaagcgggagt

SEQ ID NO: 127010 - DNA, 25 bp, Homo sapien
ggaaacgtttccagatcctgtccct

SEQ ID NO: 127011 - DNA, 25 bp, Homo sapien
gtttccagatcctgtccctttggct

SEQ ID NO: 127012 - DNA, 25 bp, Homo sapien
tgtcccctttactgagcgcacagac

SEQ ID NO: 127013 - DNA, 25 bp, Homo sapien
tactgagcgcacagacagcctgtct

SEQ ID NO: 127014 - DNA, 25 bp, Homo sapien
gcacagacagcctgtcttctcaggt

SEQ ID NO: 127015 - DNA, 25 bp, Homo sapien
tgtcttctcaggtggacccatgtaa

SEQ ID NO: 127016 - DNA, 25 bp, Homo sapien
ggtggacccatgtaaatagatcctt

SEQ ID NO: 127017 - DNA, 25 bp, Homo sapien
gacccatgtaaatagatcctttttc

SEQ ID NO: 127018 - DNA, 25 bp, Homo sapien
taacccttcaaccccagaaggctgt

SEQ ID NO: 127019 - DNA, 25 bp, Homo sapien
tgtcctgactgggtctcaggtccag

SEQ ID NO: 127020 - DNA, 25 bp, Homo sapien
ctgggtctcaggtccagactttact

SEQ ID NO: 127021 - DNA, 25 bp, Homo sapien
tggtttatgactcttaaccccctag

SEQ ID NO: 127022 - DNA, 25 bp, Homo sapien
ttaaccccctagaaagacagaagct

SEQ ID NO: 127023 - DNA, 25 bp, Homo sapien
gattactatcataattcagcactta

SEQ ID NO: 127024 - DNA, 25 bp, Homo sapien
ttcagcacttaactatgagccaggc

SEQ ID NO: 127025 - DNA, 25 bp, Homo sapien
gcacttaactatgagccaggcatca

SEQ ID NO: 127026 - DNA, 25 bp, Homo sapien
catcatactaaacttcacctacatt

SEQ ID NO: 127027 - DNA, 25 bp, Homo sapien
aacttcacctacattatctcactta

SEQ ID NO: 127028 - DNA, 25 bp, Homo sapien
catccttaaaacaattctgtgacat

SEQ ID NO: 127029 - DNA, 25 bp, Homo sapien
ttctgtgacatacatattatctcat

SEQ ID NO: 127030 - DNA, 25 bp, Homo sapien
tattatctcattttacacaaaggga

SEQ ID NO: 127031 - DNA, 25 bp, Homo sapien
tttacacaaagggaagtcgggcatg

SEQ ID NO: 127032 - DNA, 25 bp, Homo sapien
tgactagcagctgcccagctgtcaa

SEQ ID NO: 127033 - DNA, 25 bp, Homo sapien
cagctgcccagctgtcaaggtcagg

SEQ ID NO: 127034 - DNA, 25 bp, Homo sapien
tcaaggtcaggcaagtgagcaccgg

SEQ ID NO: 127035 - DNA, 25 bp, Homo sapien
ggcgggaccccgtgaggctcattag

SEQ ID NO: 127036 - DNA, 25 bp, Homo sapien
gctgagtccccacagggtcctagtg

SEQ ID NO: 127037 - DNA, 25 bp, Homo sapien
cagaggggtccagccggagtttatt

SEQ ID NO: 127038 - DNA, 25 bp, Homo sapien
tgtaatttattgttgcgttcctctg

SEQ ID NO: 127039 - DNA, 25 bp, Homo sapien
atttattgttgcgttcctctggaag

SEQ ID NO: 127040 - DNA, 25 bp, Homo sapien
ggaagctgtgactggaataaacccc

SEQ ID NO: 127041 - DNA, 25 bp, Homo sapien
gactggaataaacccccgcgtggca

SEQ ID NO: 127042 - DNA, 25 bp, Homo sapien
cgcgtggcactgctgatcctctctg

SEQ ID NO: 127043 - DNA, 25 bp, Homo sapien
attgttttctaattgaaattgtcta

SEQ ID NO: 127044 - DNA, 25 bp, Homo sapien
gttagatatattttggcctaggtat

SEQ ID NO: 127045 - DNA, 25 bp, Homo sapien
gcctaggtatcagggtaatgtatat

SEQ ID NO: 127046 - DNA, 25 bp, Homo sapien
aaattcattaattgcttcttaactc

SEQ ID NO: 127047 - DNA, 25 bp, Homo sapien
tcattaattgcttcttaactcttat

SEQ ID NO: 127048 - DNA, 25 bp, Homo sapien
taattgcttcttaactcttattata

SEQ ID NO: 127049 - DNA, 25 bp, Homo sapien
actcttattataaccaagcaattta

SEQ ID NO: 127050 - DNA, 25 bp, Homo sapien
gaagaagatatttttcctgtcattg

SEQ ID NO: 127051 - DNA, 25 bp, Homo sapien
aagaagatatttttcctgtcattga

SEQ ID NO: 127052 - DNA, 25 bp, Homo sapien
tgtcattgatgagatatatcagagt

SEQ ID NO: 127053 - DNA, 25 bp, Homo sapien
atcagagtaactggagtagctggga

SEQ ID NO: 127054 - DNA, 25 bp, Homo sapien
ccaagtcggcgcagaaggcgcagaa

SEQ ID NO: 127055 - DNA, 25 bp, Homo sapien
caagtcggcgcagaaggcgcagaag

SEQ ID NO: 127056 - DNA, 25 bp, Homo sapien
aagtcggcgcagaaggcgcagaagg

SEQ ID NO: 127057 - DNA, 25 bp, Homo sapien
agtcggcgcagaaggcgcagaaggc

SEQ ID NO: 127058 - DNA, 25 bp, Homo sapien
gcgcagaaggcgcagaaggcgggca

SEQ ID NO: 127059 - DNA, 25 bp, Homo sapien
cgcagaaggcgcagaaggcgggcaa

SEQ ID NO: 127060 - DNA, 25 bp, Homo sapien
cagaaggcgcagaaggcgggcaagt

SEQ ID NO: 127061 - DNA, 25 bp, Homo sapien
agaaggcgcagaaggcgggcaagtg

SEQ ID NO: 127062 - DNA, 25 bp, Homo sapien
gaaggcgcagaaggcgggcaagtga

SEQ ID NO: 127063 - DNA, 25 bp, Homo sapien
aaggcgcagaaggcgggcaagtgaa

SEQ ID NO: 127064 - DNA, 25 bp, Homo sapien
gcggcgccgcgctccgaaccccggc

SEQ ID NO: 127065 - DNA, 25 bp, Homo sapien
ggaggataactcaacatttccagaa

SEQ ID NO: 127066 - DNA, 25 bp, Homo sapien
gataactcaacatttccagaaagaa

SEQ ID NO: 127067 - DNA, 25 bp, Homo sapien
aactgaatggacagccacttgatat

SEQ ID NO: 127068 - DNA, 25 bp, Homo sapien
gacagccacttgatataatccaact

SEQ ID NO: 127069 - DNA, 25 bp, Homo sapien
tttgtaggaaatttgcatacccgta

SEQ ID NO: 127070 - DNA, 25 bp, Homo sapien
tgcatacccgtaaagggagactttt

SEQ ID NO: 127071 - DNA, 25 bp, Homo sapien
ataacagttgagtctttgcaagtaa

SEQ ID NO: 127072 - DNA, 25 bp, Homo sapien
ttatttttcagtgtgcacctactgt

SEQ ID NO: 127073 - DNA, 25 bp, Homo sapien
ttcagtgtgcacctactgtttgtat

SEQ ID NO: 127074 - DNA, 25 bp, Homo sapien
ttgtatttgcaaactgagcttgttg

SEQ ID NO: 127075 - DNA, 25 bp, Homo sapien
tgcaaactgagcttgttggagggaa

SEQ ID NO: 127076 - DNA, 25 bp, Homo sapien
acagatatagttccgcacctctgag

SEQ ID NO: 127077 - DNA, 25 bp, Homo sapien
atatagttccgcacctctgagaggg

SEQ ID NO: 127078 - DNA, 25 bp, Homo sapien
gagagtccagtgagtccaggcccct

SEQ ID NO: 127079 - DNA, 25 bp, Homo sapien
gtccagtgagtccaggcccctgatg

SEQ ID NO: 127080 - DNA, 25 bp, Homo sapien
cagctgggaagacatttctgcacat

SEQ ID NO: 127081 - DNA, 25 bp, Homo sapien
gacatttctgcacatggttcaccat

SEQ ID NO: 127082 - DNA, 25 bp, Homo sapien
gagggcctcgtttattaagatcttt

SEQ ID NO: 127083 - DNA, 25 bp, Homo sapien
taaactgctttatacactgtcacgt

SEQ ID NO: 127084 - DNA, 25 bp, Homo sapien
atacactgtcacgtggcttcatcag

SEQ ID NO: 127085 - DNA, 25 bp, Homo sapien
tcacgtggcttcatcagctgtgtgc

SEQ ID NO: 127086 - DNA, 25 bp, Homo sapien
gaaacctcagaaagctatttcctta

SEQ ID NO: 127087 - DNA, 25 bp, Homo sapien
atcatccagctaatgtcatgtctgt

SEQ ID NO: 127088 - DNA, 25 bp, Homo sapien
gtctgtgtgtcatgattgcggcctc

SEQ ID NO: 127089 - DNA, 25 bp, Homo sapien
ttgcggcctccatttatacagacag

SEQ ID NO: 127090 - DNA, 25 bp, Homo sapien
atacagacaggcgtgaagacattca

SEQ ID NO: 127091 - DNA, 25 bp, Homo sapien
aacgcgaaattctatcccgtgacca

SEQ ID NO: 127092 - DNA, 25 bp, Homo sapien
tatcccgtgaccagagaaggcagct

SEQ ID NO: 127093 - DNA, 25 bp, Homo sapien
gagaaggcagctacggctactccta

SEQ ID NO: 127094 - DNA, 25 bp, Homo sapien
tactcctacatcctggcgtgggtgg

SEQ ID NO: 127095 - DNA, 25 bp, Homo sapien
agcggcatgatgtacctgatactga

SEQ ID NO: 127096 - DNA, 25 bp, Homo sapien
cgcaaatagagttccggagctgggt

SEQ ID NO: 127097 - DNA, 25 bp, Homo sapien
gctgcagtacagaatccacattcag

SEQ ID NO: 127098 - DNA, 25 bp, Homo sapien
ctatttcctgcttagacggcttcta

SEQ ID NO: 127099 - DNA, 25 bp, Homo sapien
agacggcttctaggtgtacgcactg

SEQ ID NO: 127100 - DNA, 25 bp, Homo sapien
ctaggtgtacgcactgaaggagaca

SEQ ID NO: 127101 - DNA, 25 bp, Homo sapien
agctgtctaagaatgaagtgctcat

SEQ ID NO: 127102 - DNA, 25 bp, Homo sapien
gtgctcatggtgaacataggatccc

SEQ ID NO: 127103 - DNA, 25 bp, Homo sapien
tgaacataggatccctgtcaacagg

SEQ ID NO: 127104 - DNA, 25 bp, Homo sapien
gagttagtgctgtcaaggccgattt

SEQ ID NO: 127105 - DNA, 25 bp, Homo sapien
gctgtcaaggccgatttgggtaaaa

SEQ ID NO: 127106 - DNA, 25 bp, Homo sapien
gttttgaccaatccagtgtgcacag

SEQ ID NO: 127107 - DNA, 25 bp, Homo sapien
aaaattgcccttagccgaagagttg

SEQ ID NO: 127108 - DNA, 25 bp, Homo sapien
cgaagagttgaaaaacactggcgtt

SEQ ID NO: 127109 - DNA, 25 bp, Homo sapien
atttgcagtaattacagcattgcag

SEQ ID NO: 127110 - DNA, 25 bp, Homo sapien
gcagtaattacagcattgcaggaaa

SEQ ID NO: 127111 - DNA, 25 bp, Homo sapien
gagaacttcccttgcaaattatttt

SEQ ID NO: 127112 - DNA, 25 bp, Homo sapien
gtatttctttctgactagacttgtg

SEQ ID NO: 127113 - DNA, 25 bp, Homo sapien
ttctgactagacttgtgatatgcgt

SEQ ID NO: 127114 - DNA, 25 bp, Homo sapien
gactagacttgtgatatgcgtgtgt

SEQ ID NO: 127115 - DNA, 25 bp, Homo sapien
tagacttgtgatatgcgtgtgttta

SEQ ID NO: 127116 - DNA, 25 bp, Homo sapien
gttctgttattgacccaaaggccat

SEQ ID NO: 127117 - DNA, 25 bp, Homo sapien
tgttattgacccaaaggccatcttt

SEQ ID NO: 127118 - DNA, 25 bp, Homo sapien
tgacccaaaggccatctttattttc

SEQ ID NO: 127119 - DNA, 25 bp, Homo sapien
tctttattttctataactgttcaaa

SEQ ID NO: 127120 - DNA, 25 bp, Homo sapien
gaaggctgccagtgtaccgaaagtt

SEQ ID NO: 127121 - DNA, 25 bp, Homo sapien
tgccagtgtaccgaaagttgagact

SEQ ID NO: 127122 - DNA, 25 bp, Homo sapien
gttgagactgtaaagtcagacaaca

SEQ ID NO: 127123 - DNA, 25 bp, Homo sapien
gacaacaaggatgacgacatcgata

SEQ ID NO: 127124 - DNA, 25 bp, Homo sapien
gacgacatcgatattgatgccattt

SEQ ID NO: 127125 - DNA, 25 bp, Homo sapien
aagggatggatgcaacctagcttaa

SEQ ID NO: 127126 - DNA, 25 bp, Homo sapien
acctagcttaacagtataatgctgc

SEQ ID NO: 127127 - DNA, 25 bp, Homo sapien
acagtataatgctgcaaattttcct

SEQ ID NO: 127128 - DNA, 25 bp, Homo sapien
gcaacatgtatgtgcaaaagctaaa

SEQ ID NO: 127129 - DNA, 25 bp, Homo sapien
aaatggcttaacatcatgctacact

SEQ ID NO: 127130 - DNA, 25 bp, Homo sapien
acatcatgctacactttacactaaa

SEQ ID NO: 127131 - DNA, 25 bp, Homo sapien
tggattctgaatttgcacggactca

SEQ ID NO: 127132 - DNA, 25 bp, Homo sapien
gaatttgcacggactcagtttgagg

SEQ ID NO: 127133 - DNA, 25 bp, Homo sapien
tttgaggatcttgttccctcaccaa

SEQ ID NO: 127134 - DNA, 25 bp, Homo sapien
cctcaccaacctctgaaaaggcttt

SEQ ID NO: 127135 - DNA, 25 bp, Homo sapien
aaggcttttctagcgcaaatccatg

SEQ ID NO: 127136 - DNA, 25 bp, Homo sapien
atccatgcccgaaaacctgggtaca

SEQ ID NO: 127137 - DNA, 25 bp, Homo sapien
acctgggtacattcacagtggagct

SEQ ID NO: 127138 - DNA, 25 bp, Homo sapien
ccatgcgtggcgacatggttacgga

SEQ ID NO: 127139 - DNA, 25 bp, Homo sapien
ggttacggaggatgcagatccctat

SEQ ID NO: 127140 - DNA, 25 bp, Homo sapien
agatccctatgtgcagcctgaagat

SEQ ID NO: 127141 - DNA, 25 bp, Homo sapien
aaaatgactctgtccggcagctgga

SEQ ID NO: 127142 - DNA, 25 bp, Homo sapien
gcagctgttgagaaaacgaagtctt

SEQ ID NO: 127143 - DNA, 25 bp, Homo sapien
gtctttttcattttgcagaaggaaa

SEQ ID NO: 127144 - DNA, 25 bp, Homo sapien
atgatggaatttttctgtacttcag

SEQ ID NO: 127145 - DNA, 25 bp, Homo sapien
tggaatttttctgtacttcagtatg

SEQ ID NO: 127146 - DNA, 25 bp, Homo sapien
cagtatgtgtcaactgagagtcata

SEQ ID NO: 127147 - DNA, 25 bp, Homo sapien
gtgtcaactgagagtcatatacatt

SEQ ID NO: 127148 - DNA, 25 bp, Homo sapien
ctgagagtcatatacattagtttta

SEQ ID NO: 127149 - DNA, 25 bp, Homo sapien
gtcatatacattagttttaatctct

SEQ ID NO: 127150 - DNA, 25 bp, Homo sapien
cttaatattgagaatcaggttgcaa

SEQ ID NO: 127151 - DNA, 25 bp, Homo sapien
atgtgagaaatgtctaatagcccat

SEQ ID NO: 127152 - DNA, 25 bp, Homo sapien
gtgagaaatgtctaatagcccataa

SEQ ID NO: 127153 - DNA, 25 bp, Homo sapien
ggcgtctccaaggaggtgacactta

SEQ ID NO: 127154 - DNA, 25 bp, Homo sapien
cacttaagccatccccgaaagaggt

SEQ ID NO: 127155 - DNA, 25 bp, Homo sapien
aagccatccccgaaagaggtgaaag

SEQ ID NO: 127156 - DNA, 25 bp, Homo sapien
gaacaggattctaggcggaagcgat

SEQ ID NO: 127157 - DNA, 25 bp, Homo sapien
ctaggcggaagcgatagcataggca

SEQ ID NO: 127158 - DNA, 25 bp, Homo sapien
tagcataggcaaaggcccttgggca

SEQ ID NO: 127159 - DNA, 25 bp, Homo sapien
agccttggctggagtagaattaagt

SEQ ID NO: 127160 - DNA, 25 bp, Homo sapien
gtagaattaagtcagagccaacagg

SEQ ID NO: 127161 - DNA, 25 bp, Homo sapien
acccaagttgggatttcatttcagg

SEQ ID NO: 127162 - DNA, 25 bp, Homo sapien
catttcaggtgcattggagattctt

SEQ ID NO: 127163 - DNA, 25 bp, Homo sapien
gagattcttaggagtgtctcttggg

SEQ ID NO: 127164 - DNA, 25 bp, Homo sapien
caaggtcaccaagtcggcgcagaag

SEQ ID NO: 127165 - DNA, 25 bp, Homo sapien
ccaagtcggcgcagaaggcgcagaa

SEQ ID NO: 127166 - DNA, 25 bp, Homo sapien
gcgggcaagtgaagcgcgggccgcg

SEQ ID NO: 127167 - DNA, 25 bp, Homo sapien
atgtctgcacctccgcttgccagag

SEQ ID NO: 127168 - DNA, 25 bp, Homo sapien
agaggccctcggtcagcgactggat

SEQ ID NO: 127169 - DNA, 25 bp, Homo sapien
gtcagcgactggatgctcgccatca

SEQ ID NO: 127170 - DNA, 25 bp, Homo sapien
tggatgctcgccatcaaggtccagt

SEQ ID NO: 127171 - DNA, 25 bp, Homo sapien
atgctcgccatcaaggtccagtgga

SEQ ID NO: 127172 - DNA, 25 bp, Homo sapien
gccatcaaggtccagtggaagttct

SEQ ID NO: 127173 - DNA, 25 bp, Homo sapien
aaggtccagtggaagttcttcaaga

SEQ ID NO: 127174 - DNA, 25 bp, Homo sapien
tcttcaagaggaaaggcgcccccgc

SEQ ID NO: 127175 - DNA, 25 bp, Homo sapien
gtagacctgtggcttaaaataaaga

SEQ ID NO: 127176 - DNA, 25 bp, Homo sapien
aacatccacagttaaggttgggcca

SEQ ID NO: 127177 - DNA, 25 bp, Homo sapien
taaggttgggccagctacctttggg

SEQ ID NO: 127178 - DNA, 25 bp, Homo sapien
attgccataacatcctgctccattc

SEQ ID NO: 127179 - DNA, 25 bp, Homo sapien
tgctccattccctctaagatgtagg

SEQ ID NO: 127180 - DNA, 25 bp, Homo sapien
ggaagaattcggatccttaccattg

SEQ ID NO: 127181 - DNA, 25 bp, Homo sapien
gaattcggatccttaccattggaat

SEQ ID NO: 127182 - DNA, 25 bp, Homo sapien
ggatccttaccattggaatcttcca

SEQ ID NO: 127183 - DNA, 25 bp, Homo sapien
taccattggaatcttccatcgaaca

SEQ ID NO: 127184 - DNA, 25 bp, Homo sapien
ccaggatttgagtctctgcatgaca

SEQ ID NO: 127185 - DNA, 25 bp, Homo sapien
ggatttgagtctctgcatgacatat

SEQ ID NO: 127186 - DNA, 25 bp, Homo sapien
aggccactgtttccatagtgaccag

SEQ ID NO: 127187 - DNA, 25 bp, Homo sapien
atagtgaccagctgatacctcttcc

SEQ ID NO: 127188 - DNA, 25 bp, Homo sapien
ttcctgccctctagtgtgcaattgg

SEQ ID NO: 127189 - DNA, 25 bp, Homo sapien
caattgggtgttgcctcagtttcct

SEQ ID NO: 127190 - DNA, 25 bp, Homo sapien
ctcccagctcagttttattagatca

SEQ ID NO: 127191 - DNA, 25 bp, Homo sapien
caaagctgttgttgggcaccaggtt

SEQ ID NO: 127192 - DNA, 25 bp, Homo sapien
aagatggttgctttgtccaccagag

SEQ ID NO: 127193 - DNA, 25 bp, Homo sapien
tgctttgtccaccagaggtcaagtt

SEQ ID NO: 127194 - DNA, 25 bp, Homo sapien
aggtcaagttcacctctctggtgct

SEQ ID NO: 127195 - DNA, 25 bp, Homo sapien
tgatttttctaatcgctccttctgg

SEQ ID NO: 127196 - DNA, 25 bp, Homo sapien
aggaagttgatattgccatggtggc

SEQ ID NO: 127197 - DNA, 25 bp, Homo sapien
tacaatggaatcttccctctgttct

SEQ ID NO: 127198 - DNA, 25 bp, Homo sapien
ctctgataacctacttgcttactca

SEQ ID NO: 127199 - DNA, 25 bp, Homo sapien
ttactcaatgcctttaagccaagtc

SEQ ID NO: 127200 - DNA, 25 bp, Homo sapien
ttaagccaagtcaccctgttgccta

SEQ ID NO: 127201 - DNA, 25 bp, Homo sapien
tggcaagctcaaccacatgctattt

SEQ ID NO: 127202 - DNA, 25 bp, Homo sapien
tatttagttagcatcagttgtcacc

SEQ ID NO: 127203 - DNA, 25 bp, Homo sapien
gttgtcaccaacagtctttctgcaa

SEQ ID NO: 127204 - DNA, 25 bp, Homo sapien
aggaaaaggcttaccaggctgctat

SEQ ID NO: 127205 - DNA, 25 bp, Homo sapien
aggctgctatggtcaactcttcaga

SEQ ID NO: 127206 - DNA, 25 bp, Homo sapien
tttcagagcaatctaaaagcgccaa

SEQ ID NO: 127207 - DNA, 25 bp, Homo sapien
gccaaaattcgctatgtttacagtg

SEQ ID NO: 127208 - DNA, 25 bp, Homo sapien
ggtgcttactcaaagagtgtccact

SEQ ID NO: 127209 - DNA, 25 bp, Homo sapien
gagtgtccactattgattgtattat

SEQ ID NO: 127210 - DNA, 25 bp, Homo sapien
tgtattatgctgctcactgatcctt

SEQ ID NO: 127211 - DNA, 25 bp, Homo sapien
gctgctcactgatccttctgcatat

SEQ ID NO: 127212 - DNA, 25 bp, Homo sapien
gttagtcttttgtatattaggccaa

SEQ ID NO: 127213 - DNA, 25 bp, Homo sapien
aggccaagtgcaattgacttccctt

SEQ ID NO: 127214 - DNA, 25 bp, Homo sapien
gtgcaattgacttcccttttttaat

SEQ ID NO: 127215 - DNA, 25 bp, Homo sapien
atgtttcatgaccacccattgattg

SEQ ID NO: 127216 - DNA, 25 bp, Homo sapien
gaccacccattgattgtattataac

SEQ ID NO: 127217 - DNA, 25 bp, Homo sapien
gtattataaccacttacagttgctt

SEQ ID NO: 127218 - DNA, 25 bp, Homo sapien
accacttacagttgcttatattttt

SEQ ID NO: 127219 - DNA, 25 bp, Homo sapien
aaatactcagctttcaatgtatcaa

SEQ ID NO: 127220 - DNA, 25 bp, Homo sapien
agtgctagattctgttattttcttc

SEQ ID NO: 127221 - DNA, 25 bp, Homo sapien
tttggatgaagtaccccaacctgtt

SEQ ID NO: 127222 - DNA, 25 bp, Homo sapien
atgaagtaccccaacctgtttacat

SEQ ID NO: 127223 - DNA, 25 bp, Homo sapien
taccccaacctgtttacatttagcg

SEQ ID NO: 127224 - DNA, 25 bp, Homo sapien
gtaaatgtaaattattccgatctga

SEQ ID NO: 127225 - DNA, 25 bp, Homo sapien
tattccgatctgacatatctgcatt

SEQ ID NO: 127226 - DNA, 25 bp, Homo sapien
cgatctgacatatctgcattataat

SEQ ID NO: 127227 - DNA, 25 bp, Homo sapien
gaatagaagaactggtagccacagt

SEQ ID NO: 127228 - DNA, 25 bp, Homo sapien
gaactggtagccacagtggtgaaat

SEQ ID NO: 127229 - DNA, 25 bp, Homo sapien
gagaactttcttcctgaaacctttg

SEQ ID NO: 127230 - DNA, 25 bp, Homo sapien
tgggcagccgttttcctcatccttt

SEQ ID NO: 127231 - DNA, 25 bp, Homo sapien
catttccaaatgtggcctccatgtg

SEQ ID NO: 127232 - DNA, 25 bp, Homo sapien
cctccatgtgggtgctagggacatg

SEQ ID NO: 127233 - DNA, 25 bp, Homo sapien
tgctagggacatgggaaaaaccact

SEQ ID NO: 127234 - DNA, 25 bp, Homo sapien
ccccgacggtgtggctgatgatgtc

SEQ ID NO: 127235 - DNA, 25 bp, Homo sapien
gatgtcttctggtgtcatggtgacc

SEQ ID NO: 127236 - DNA, 25 bp, Homo sapien
tgttctggtatttcccctgtcagtt

SEQ ID NO: 127237 - DNA, 25 bp, Homo sapien
tctcggccaggttgtgtcccaaaat

SEQ ID NO: 127238 - DNA, 25 bp, Homo sapien
aggttgtgtcccaaaatcccctcag

SEQ ID NO: 127239 - DNA, 25 bp, Homo sapien
ttctctgcacgttgctgaaggtcca

SEQ ID NO: 127240 - DNA, 25 bp, Homo sapien
ttgctgaaggtccaggcttgcctca

SEQ ID NO: 127241 - DNA, 25 bp, Homo sapien
tatcctgtgggcctggtttattttc

SEQ ID NO: 127242 - DNA, 25 bp, Homo sapien
gtttattttctggtggcctcatggg

SEQ ID NO: 127243 - DNA, 25 bp, Homo sapien
tgaggtccaagctgttgctgttgtc

SEQ ID NO: 127244 - DNA, 25 bp, Homo sapien
tgctgttgtcaacatgtctggccca

SEQ ID NO: 127245 - DNA, 25 bp, Homo sapien
ttgtcaacatgtctggcccagcagg

SEQ ID NO: 127246 - DNA, 25 bp, Homo sapien
tggcccagcaggctctggacctgct

SEQ ID NO: 127247 - DNA, 25 bp, Homo sapien
agaagccctggcaattttgcactgt

SEQ ID NO: 127248 - DNA, 25 bp, Homo sapien
aattttgcactgtgtggctacgccc

SEQ ID NO: 127249 - DNA, 25 bp, Homo sapien
tccctgaaggatggtcttctcatct

SEQ ID NO: 127250 - DNA, 25 bp, Homo sapien
ctcatctggacacccttggaagcaa

SEQ ID NO: 127251 - DNA, 25 bp, Homo sapien
aaatcctagttctcttcccacctgt

SEQ ID NO: 127252 - DNA, 25 bp, Homo sapien
acctggattctggttctgacagggc

SEQ ID NO: 127253 - DNA, 25 bp, Homo sapien
gattctggttctgacagggccacaa

SEQ ID NO: 127254 - DNA, 25 bp, Homo sapien
ctggttctgacagggccacaagcta

SEQ ID NO: 127255 - DNA, 25 bp, Homo sapien
ttctgacagggccacaagctaggat

SEQ ID NO: 127256 - DNA, 25 bp, Homo sapien
gacagggccacaagctaggatctct

SEQ ID NO: 127257 - DNA, 25 bp, Homo sapien
cagggccacaagctaggatctctaa

SEQ ID NO: 127258 - DNA, 25 bp, Homo sapien
ggccacaagctaggatctctaacaa

SEQ ID NO: 127259 - DNA, 25 bp, Homo sapien
agctaggatctctaacaaacgcaga

SEQ ID NO: 127260 - DNA, 25 bp, Homo sapien
gatctctaacaaacgcagaaggctt

SEQ ID NO: 127261 - DNA, 25 bp, Homo sapien
aaacgcagaaggctttggctcgtca

SEQ ID NO: 127262 - DNA, 25 bp, Homo sapien
acgcagaaggctttggctcgtcatt

SEQ ID NO: 127263 - DNA, 25 bp, Homo sapien
tggcctggaattggatacaactcaa

SEQ ID NO: 127264 - DNA, 25 bp, Homo sapien
atacaactcaactgggactatctag

SEQ ID NO: 127265 - DNA, 25 bp, Homo sapien
aactgggactatctagtcaacagat

SEQ ID NO: 127266 - DNA, 25 bp, Homo sapien
gtcaacagatatacactcaataaca

SEQ ID NO: 127267 - DNA, 25 bp, Homo sapien
tcaataacagaaaccttggccgaat

SEQ ID NO: 127268 - DNA, 25 bp, Homo sapien
gaaaccttggccgaattgtcacaat

SEQ ID NO: 127269 - DNA, 25 bp, Homo sapien
attgtcacaatagcagagccattca

SEQ ID NO: 127270 - DNA, 25 bp, Homo sapien
attcaacactgaactgcaactgtgg

SEQ ID NO: 127271 - DNA, 25 bp, Homo sapien
acactgaactgcaactgtggcagat

SEQ ID NO: 127272 - DNA, 25 bp, Homo sapien
tttgcaaaatatccacaagctggag

SEQ ID NO: 127273 - DNA, 25 bp, Homo sapien
gaaacaccatcagagaatggttttt

SEQ ID NO: 127274 - DNA, 25 bp, Homo sapien
ggcaccaagtggaagcttgcacggt

SEQ ID NO: 127275 - DNA, 25 bp, Homo sapien
gaagcttgcacggtgggccacggcc

SEQ ID NO: 127276 - DNA, 25 bp, Homo sapien
gccgtggcgggtgccctgtgggtga

SEQ ID NO: 127277 - DNA, 25 bp, Homo sapien
gtgccctgtgggtgaggctgggtga

SEQ ID NO: 127278 - DNA, 25 bp, Homo sapien
aggctgggtgatgacctgaggacca

SEQ ID NO: 127279 - DNA, 25 bp, Homo sapien
tgaggaccagagacacgcgaccatg

SEQ ID NO: 127280 - DNA, 25 bp, Homo sapien
ggaccagagacacgcgaccatgttg

SEQ ID NO: 127281 - DNA, 25 bp, Homo sapien
acgcgaccatgttggggctcttgga

SEQ ID NO: 127282 - DNA, 25 bp, Homo sapien
attccatttcatgttccactgtgat

SEQ ID NO: 127283 - DNA, 25 bp, Homo sapien
tccatttcatgttccactgtgatta

SEQ ID NO: 127284 - DNA, 25 bp, Homo sapien
agttcaactagtatgaaagggttat

SEQ ID NO: 127285 - DNA, 25 bp, Homo sapien
accactacatctggctttgggcagg

SEQ ID NO: 127286 - DNA, 25 bp, Homo sapien
tgggcaggtctgagataaaacgatc

SEQ ID NO: 127287 - DNA, 25 bp, Homo sapien
taaaggtaggcagaccctggaccca

SEQ ID NO: 127288 - DNA, 25 bp, Homo sapien
ccagcctcagatccaggcaggagca

SEQ ID NO: 127289 - DNA, 25 bp, Homo sapien
gttgtcgagatctcaggagcccctt

SEQ ID NO: 127290 - DNA, 25 bp, Homo sapien
cttgctgttttttggagggtgaaag

SEQ ID NO: 127291 - DNA, 25 bp, Homo sapien
tagtcagctctgatcacatcccctg

SEQ ID NO: 127292 - DNA, 25 bp, Homo sapien
cctgtaggcttatcagggagttaca

SEQ ID NO: 127293 - DNA, 25 bp, Homo sapien
gggagttacagttacaattgttaca

SEQ ID NO: 127294 - DNA, 25 bp, Homo sapien
gttacagtactgttcccaactcagc

SEQ ID NO: 127295 - DNA, 25 bp, Homo sapien
caactcagctgccacgggtgagaga

SEQ ID NO: 127296 - DNA, 25 bp, Homo sapien
gcagccaaacagcacaacatgcctt

SEQ ID NO: 127297 - DNA, 25 bp, Homo sapien
aacatgcctttctggaggatcacaa

SEQ ID NO: 127298 - DNA, 25 bp, Homo sapien
tttctggaggatcacaaaccatgga

SEQ ID NO: 127299 - DNA, 25 bp, Homo sapien
aaaccatggagacctagtatccctt

SEQ ID NO: 127300 - DNA, 25 bp, Homo sapien
tagtatcccttcaccaggctttaga

SEQ ID NO: 127301 - DNA, 25 bp, Homo sapien
ccaggctttagagcttgattttctc

SEQ ID NO: 127302 - DNA, 25 bp, Homo sapien
tggaatgaggagccttccccttgag

SEQ ID NO: 127303 - DNA, 25 bp, Homo sapien
gagctccttttcactcctgaaggga

SEQ ID NO: 127304 - DNA, 25 bp, Homo sapien
ggagctggagactggaaccaactga

SEQ ID NO: 127305 - DNA, 25 bp, Homo sapien
gactggaaccaactgagaactttct

SEQ ID NO: 127306 - DNA, 25 bp, Homo sapien
gaaccaactgagaactttctctgtc

SEQ ID NO: 127307 - DNA, 25 bp, Homo sapien
gttgcccagactgggattctctggc

SEQ ID NO: 127308 - DNA, 25 bp, Homo sapien
tctctggcttttaatgaacaattgc

SEQ ID NO: 127309 - DNA, 25 bp, Homo sapien
attgcttcttaaatctttccccacg

SEQ ID NO: 127310 - DNA, 25 bp, Homo sapien
ttccccacggaaaccttgagtgact

SEQ ID NO: 127311 - DNA, 25 bp, Homo sapien
atatcaaatggcgagagaccgttta

SEQ ID NO: 127312 - DNA, 25 bp, Homo sapien
ggcgagagaccgtttagttcctatc

SEQ ID NO: 127313 - DNA, 25 bp, Homo sapien
gaccgtttagttcctatcatctgtg

SEQ ID NO: 127314 - DNA, 25 bp, Homo sapien
tcctatcatctgtggcatgtgaagg

SEQ ID NO: 127315 - DNA, 25 bp, Homo sapien
catgctgaaatgttgcaggctgctc

SEQ ID NO: 127316 - DNA, 25 bp, Homo sapien
tcctatgttggaaaattcttcattg

SEQ ID NO: 127317 - DNA, 25 bp, Homo sapien
ttcttcattgaagttctcccaataa

SEQ ID NO: 127318 - DNA, 25 bp, Homo sapien
agtatcaatggtacctgcggacaag

SEQ ID NO: 127319 - DNA, 25 bp, Homo sapien
tatcaatggtacctgcggacaagct

SEQ ID NO: 127320 - DNA, 25 bp, Homo sapien
tcaatggtacctgcggacaagctgc

SEQ ID NO: 127321 - DNA, 25 bp, Homo sapien
atggtacctgcggacaagctgccca

SEQ ID NO: 127322 - DNA, 25 bp, Homo sapien
tggtacctgcggacaagctgcccag

SEQ ID NO: 127323 - DNA, 25 bp, Homo sapien
gtacctgcggacaagctgcccagct

SEQ ID NO: 127324 - DNA, 25 bp, Homo sapien
tgcggacaagctgcccagctttcta

SEQ ID NO: 127325 - DNA, 25 bp, Homo sapien
gacaagctgcccagctttctagcaa

SEQ ID NO: 127326 - DNA, 25 bp, Homo sapien
aagctgcccagctttctagcaaatg

SEQ ID NO: 127327 - DNA, 25 bp, Homo sapien
gctgcccagctttctagcaaatgtg

SEQ ID NO: 127328 - DNA, 25 bp, Homo sapien
ctgcccagctttctagcaaatgtgc

SEQ ID NO: 127329 - DNA, 25 bp, Homo sapien
ctgcttttgaggacacttgggctat

SEQ ID NO: 127330 - DNA, 25 bp, Homo sapien
acacttgggctatgtgtcacagctc

SEQ ID NO: 127331 - DNA, 25 bp, Homo sapien
gggctatgtgtcacagctctgtaca

SEQ ID NO: 127332 - DNA, 25 bp, Homo sapien
ctatgtgtcacagctctgtacaaac

SEQ ID NO: 127333 - DNA, 25 bp, Homo sapien
aaacaatgtgttgcctcctaccttg

SEQ ID NO: 127334 - DNA, 25 bp, Homo sapien
ggaagattttttggattgtcggatt

SEQ ID NO: 127335 - DNA, 25 bp, Homo sapien
ttggattgtcggatttcctccctca

SEQ ID NO: 127336 - DNA, 25 bp, Homo sapien
cctcacatgataccccttatctttt

SEQ ID NO: 127337 - DNA, 25 bp, Homo sapien
atgataccccttatcttttataatg

SEQ ID NO: 127338 - DNA, 25 bp, Homo sapien
ataatgtcttatgcctatacctgaa

SEQ ID NO: 127339 - DNA, 25 bp, Homo sapien
atgtcttatgcctatacctgaatat

SEQ ID NO: 127340 - DNA, 25 bp, Homo sapien
cctgggctttgcacaggtctggtgc

SEQ ID NO: 127341 - DNA, 25 bp, Homo sapien
gctttgcacaggtctggtgctccgt

SEQ ID NO: 127342 - DNA, 25 bp, Homo sapien
acaggtctggtgctccgtccgcaca

SEQ ID NO: 127343 - DNA, 25 bp, Homo sapien
tgagagctcccacgaaggcctcatc

SEQ ID NO: 127344 - DNA, 25 bp, Homo sapien
ggctccctctccaattccaaggagt

SEQ ID NO: 127345 - DNA, 25 bp, Homo sapien
tccaattccaaggagttctcagaac

SEQ ID NO: 127346 - DNA, 25 bp, Homo sapien
ttccaaggagttctcagaacacttc

SEQ ID NO: 127347 - DNA, 25 bp, Homo sapien
atgaacccgcctcacaagtgcgaag

SEQ ID NO: 127348 - DNA, 25 bp, Homo sapien
cctcacaagtgcgaagtctggtaag

SEQ ID NO: 127349 - DNA, 25 bp, Homo sapien
aagtgcgaagtctggtaaggacgaa

SEQ ID NO: 127350 - DNA, 25 bp, Homo sapien
gggctgaggacgagacccccatcca

SEQ ID NO: 127351 - DNA, 25 bp, Homo sapien
cagaggctgtggtcatgcggaacac

SEQ ID NO: 127352 - DNA, 25 bp, Homo sapien
tggtcatgcggaacactctgttatt

SEQ ID NO: 127353 - DNA, 25 bp, Homo sapien
ctctgttatttaagatggctatcca

SEQ ID NO: 127354 - DNA, 25 bp, Homo sapien
gatggctatccagataatcctgaac

SEQ ID NO: 127355 - DNA, 25 bp, Homo sapien
cagataatcctgaacactgtgtatt

SEQ ID NO: 127356 - DNA, 25 bp, Homo sapien
agtgtatctgtgaaagagctcctac

SEQ ID NO: 127357 - DNA, 25 bp, Homo sapien
gagctcctacactttgaaaacttaa

SEQ ID NO: 127358 - DNA, 25 bp, Homo sapien
gaaaacttaagaatcccttatcatg

SEQ ID NO: 127359 - DNA, 25 bp, Homo sapien
ttatcatgaagtttgcctgttctag

SEQ ID NO: 127360 - DNA, 25 bp, Homo sapien
tgttaatttccttcaatctctagtg

SEQ ID NO: 127361 - DNA, 25 bp, Homo sapien
tagtgacaacacttaatttcttttc

SEQ ID NO: 127362 - DNA, 25 bp, Homo sapien
tagtgacaccagtggttcgtcagct

SEQ ID NO: 127363 - DNA, 25 bp, Homo sapien
tgtgcattctcctctaagaactcac

SEQ ID NO: 127364 - DNA, 25 bp, Homo sapien
taagaactcacctccgttagcgcac

SEQ ID NO: 127365 - DNA, 25 bp, Homo sapien
gttagcgcactgtgtcagcgggcta

SEQ ID NO: 127366 - DNA, 25 bp, Homo sapien
cagcgggctatggacaaggaagaat

SEQ ID NO: 127367 - DNA, 25 bp, Homo sapien
atagtggcagatgcagccagcgctg

SEQ ID NO: 127368 - DNA, 25 bp, Homo sapien
agggttttgctctcctatgcaatat

SEQ ID NO: 127369 - DNA, 25 bp, Homo sapien
caatatttatgccttctcattcaga

SEQ ID NO: 127370 - DNA, 25 bp, Homo sapien
actgtaagatgatcgcgcagggcat

SEQ ID NO: 127371 - DNA, 25 bp, Homo sapien
cgcagggcatcatgtcaccatgtca

SEQ ID NO: 127372 - DNA, 25 bp, Homo sapien
gatattacaccatttcctataggag

SEQ ID NO: 127373 - DNA, 25 bp, Homo sapien
aaatatatggatgcagacgacttga

SEQ ID NO: 127374 - DNA, 25 bp, Homo sapien
gatgcagacgacttgatgaagatct

SEQ ID NO: 127375 - DNA, 25 bp, Homo sapien
gtacaaaatatctatcactactgat

SEQ ID NO: 127376 - DNA, 25 bp, Homo sapien
aggaggttaatatttctgtgtagaa

SEQ ID NO: 127377 - DNA, 25 bp, Homo sapien
gtgtagatgtacacattccagcaaa

SEQ ID NO: 127378 - DNA, 25 bp, Homo sapien
gtacacattccagcaaatgtatttg

SEQ ID NO: 127379 - DNA, 25 bp, Homo sapien
aattatgtggttgatgctttgtgat

SEQ ID NO: 127380 - DNA, 25 bp, Homo sapien
gatgctttgtgatataaatgtactt

SEQ ID NO: 127381 - DNA, 25 bp, Homo sapien
gtactttttcaatgtatactttcac

SEQ ID NO: 127382 - DNA, 25 bp, Homo sapien
tatactttcactttccaaatgcctg

SEQ ID NO: 127383 - DNA, 25 bp, Homo sapien
ctttcactttccaaatgcctgtttt

SEQ ID NO: 127384 - DNA, 25 bp, Homo sapien
gaagcaaatgcggagcctgctccct

SEQ ID NO: 127385 - DNA, 25 bp, Homo sapien
tccctcctaagaagatcccaagaat

SEQ ID NO: 127386 - DNA, 25 bp, Homo sapien
gatcccaagaatccaatggctcagt

SEQ ID NO: 127387 - DNA, 25 bp, Homo sapien
aatggctcagtccttggtgatctaa

SEQ ID NO: 127388 - DNA, 25 bp, Homo sapien
agtccttggtgatctaagacagcaa

SEQ ID NO: 127389 - DNA, 25 bp, Homo sapien
gcaaggagggccctgttagctccca

SEQ ID NO: 127390 - DNA, 25 bp, Homo sapien
gttagctcccactgtcctggtttct

SEQ ID NO: 127391 - DNA, 25 bp, Homo sapien
tggagtctaatttccttggccctct

SEQ ID NO: 127392 - DNA, 25 bp, Homo sapien
ttggccctctgagccttttgagtct

SEQ ID NO: 127393 - DNA, 25 bp, Homo sapien
tgagtctgggccctggtccaatgct

SEQ ID NO: 127394 - DNA, 25 bp, Homo sapien
gtttgttgattcttgtctggctaat

SEQ ID NO: 127395 - DNA, 25 bp, Homo sapien
gtgatactcacgtttgcttaaaccc

SEQ ID NO: 127396 - DNA, 25 bp, Homo sapien
gatactcacgtttgcttaaaccctt

SEQ ID NO: 127397 - DNA, 25 bp, Homo sapien
ttaaaccctttagtgctttgtgata

SEQ ID NO: 127398 - DNA, 25 bp, Homo sapien
taaaccctttagtgctttgtgatag

SEQ ID NO: 127399 - DNA, 25 bp, Homo sapien
ttgtgatagttcagtcccagggaaa

SEQ ID NO: 127400 - DNA, 25 bp, Homo sapien
gtgatagttcagtcccagggaaaga

SEQ ID NO: 127401 - DNA, 25 bp, Homo sapien
cagggaaagagaaaactcgccctag

SEQ ID NO: 127402 - DNA, 25 bp, Homo sapien
aaaatccttttgaatgatgccttta

SEQ ID NO: 127403 - DNA, 25 bp, Homo sapien
atccttttgaatgatgcctttataa

SEQ ID NO: 127404 - DNA, 25 bp, Homo sapien
ttgaatgatgcctttataaatcttt

SEQ ID NO: 127405 - DNA, 25 bp, Homo sapien
ttgcgtcaagtctaaaccaagatta

SEQ ID NO: 127406 - DNA, 25 bp, Homo sapien
acagctggtcaggacgttacacgcg

SEQ ID NO: 127407 - DNA, 25 bp, Homo sapien
gttacacgcggtgccttgtaagagg

SEQ ID NO: 127408 - DNA, 25 bp, Homo sapien
gaaacacttgccgaatctgcatctg

SEQ ID NO: 127409 - DNA, 25 bp, Homo sapien
atctggcttccagtggtaagcacat

SEQ ID NO: 127410 - DNA, 25 bp, Homo sapien
gtggtaagcacattcctcagcagga

SEQ ID NO: 127411 - DNA, 25 bp, Homo sapien
ctcagcaggatcaagccaaacagta

SEQ ID NO: 127412 - DNA, 25 bp, Homo sapien
aagagaacacgaggaaggcagaaac

SEQ ID NO: 127413 - DNA, 25 bp, Homo sapien
ggcagaaacgatgtttagcaacagt

SEQ ID NO: 127414 - DNA, 25 bp, Homo sapien
gcaacagtattctgcatggttcact

SEQ ID NO: 127415 - DNA, 25 bp, Homo sapien
attctgcatggttcactgcttaaga

SEQ ID NO: 127416 - DNA, 25 bp, Homo sapien
tatgtttgggtcctaaacagctttt

SEQ ID NO: 127417 - DNA, 25 bp, Homo sapien
agtatcatcagtgtagaacctaatt

SEQ ID NO: 127418 - DNA, 25 bp, Homo sapien
acctaattcaattcaaagctgtgtg

SEQ ID NO: 127419 - DNA, 25 bp, Homo sapien
gtttggaagactatcttactatttc

SEQ ID NO: 127420 - DNA, 25 bp, Homo sapien
agcctgacaacatttctatagccaa

SEQ ID NO: 127421 - DNA, 25 bp, Homo sapien
gctaaatacctcaatcagtctcaga

SEQ ID NO: 127422 - DNA, 25 bp, Homo sapien
atgtcattttggtactttggtggcc

SEQ ID NO: 127423 - DNA, 25 bp, Homo sapien
tttggtggccacataagccattatt

SEQ ID NO: 127424 - DNA, 25 bp, Homo sapien
agccattattcactagtatgactag

SEQ ID NO: 127425 - DNA, 25 bp, Homo sapien
atgactagttgtgtctggcagttta

SEQ ID NO: 127426 - DNA, 25 bp, Homo sapien
taactctctttatgtctgtggattt

SEQ ID NO: 127427 - DNA, 25 bp, Homo sapien
cttggattcctgataatgtgcttct

SEQ ID NO: 127428 - DNA, 25 bp, Homo sapien
acagaatgtccccttacctagtaag

SEQ ID NO: 127429 - DNA, 25 bp, Homo sapien
gtctttggcgaggatgaacctgatt

SEQ ID NO: 127430 - DNA, 25 bp, Homo sapien
caagggttacaccaagtcatgctaa

SEQ ID NO: 127431 - DNA, 25 bp, Homo sapien
gtcatgctaattctatctccaagta

SEQ ID NO: 127432 - DNA, 25 bp, Homo sapien
aagtatcttgtgcatccctcctctg

SEQ ID NO: 127433 - DNA, 25 bp, Homo sapien
ctgctctccatcataactgctatta

SEQ ID NO: 127434 - DNA, 25 bp, Homo sapien
ttagccaaattcaggcccagtcatc

SEQ ID NO: 127435 - DNA, 25 bp, Homo sapien
ccagtcatctcctatctgaattatt

SEQ ID NO: 127436 - DNA, 25 bp, Homo sapien
tttgttttcagtaccctctttcttg

SEQ ID NO: 127437 - DNA, 25 bp, Homo sapien
ttccaatgcatcttctaccctgcta

SEQ ID NO: 127438 - DNA, 25 bp, Homo sapien
taccctgctacctcagtgattattc

SEQ ID NO: 127439 - DNA, 25 bp, Homo sapien
tgcgcttcatcaagctgtttacaga

SEQ ID NO: 127440 - DNA, 25 bp, Homo sapien
tgtttacagagctctccttcacctc

SEQ ID NO: 127441 - DNA, 25 bp, Homo sapien
ttatactgctttgtcaacaatgagg

SEQ ID NO: 127442 - DNA, 25 bp, Homo sapien
tttgtcaacaatgaggtccagctgg

SEQ ID NO: 127443 - DNA, 25 bp, Homo sapien
atgaggtccagctggaatttcggaa

SEQ ID NO: 127444 - DNA, 25 bp, Homo sapien
gtccagctggaatttcggaagagct

SEQ ID NO: 127445 - DNA, 25 bp, Homo sapien
agcgctggcggcttgagcacttgca

SEQ ID NO: 127446 - DNA, 25 bp, Homo sapien
ttgagcacttgcacatccagaggga

SEQ ID NO: 127447 - DNA, 25 bp, Homo sapien
gcacttgcacatccagagggacagc

SEQ ID NO: 127448 - DNA, 25 bp, Homo sapien
acggcgggcagcagcatgtacacag

SEQ ID NO: 127449 - DNA, 25 bp, Homo sapien
atgtacacagccacttgccaggcct

SEQ ID NO: 127450 - DNA, 25 bp, Homo sapien
agatgctgtgtaactaaactgaaat

SEQ ID NO: 127451 - DNA, 25 bp, Homo sapien
agcttatgatagtcttttctaattc

SEQ ID NO: 127452 - DNA, 25 bp, Homo sapien
ttctaattcttaacactcatacttg

SEQ ID NO: 127453 - DNA, 25 bp, Homo sapien
acactcatacttgaaatctttccga

SEQ ID NO: 127454 - DNA, 25 bp, Homo sapien
tgaaatctttccgagtttccccaga

SEQ ID NO: 127455 - DNA, 25 bp, Homo sapien
tccgagtttccccagaagagaatat

SEQ ID NO: 127456 - DNA, 25 bp, Homo sapien
tgacccatttaataatgctcttgtg

SEQ ID NO: 127457 - DNA, 25 bp, Homo sapien
ttaataatgctcttgtgtttaccta

SEQ ID NO: 127458 - DNA, 25 bp, Homo sapien
gtagactttgtcttatgtgtcaaaa

SEQ ID NO: 127459 - DNA, 25 bp, Homo sapien
gtcttatgtgtcaaaagtcctagga

SEQ ID NO: 127460 - DNA, 25 bp, Homo sapien
agtcctaggaaagtggttgatgttt

SEQ ID NO: 127461 - DNA, 25 bp, Homo sapien
ctttcccccctgaaatgtatagaat

SEQ ID NO: 127462 - DNA, 25 bp, Homo sapien
tgtatagaatccatttgtcatcagg

SEQ ID NO: 127463 - DNA, 25 bp, Homo sapien
gtcatcaggaatcaaaacccacagt

SEQ ID NO: 127464 - DNA, 25 bp, Homo sapien
gaatcaaaacccacagtccattgtg

SEQ ID NO: 127465 - DNA, 25 bp, Homo sapien
aaacccacagtccattgtgaagtgt

SEQ ID NO: 127466 - DNA, 25 bp, Homo sapien
cagtccattgtgaagtgtgctatat

SEQ ID NO: 127467 - DNA, 25 bp, Homo sapien
gtgtgctatatttagaacagtctta

SEQ ID NO: 127468 - DNA, 25 bp, Homo sapien
acagtcttaaaatgtacagtgtatt

SEQ ID NO: 127469 - DNA, 25 bp, Homo sapien
aagagaatttatggacgttgtagaa

SEQ ID NO: 127470 - DNA, 25 bp, Homo sapien
atgcatttccaaactgccttaaacg

SEQ ID NO: 127471 - DNA, 25 bp, Homo sapien
tccaaactgccttaaacgttgtatt

SEQ ID NO: 127472 - DNA, 25 bp, Homo sapien
tattaccaggagctcggacggtgct

SEQ ID NO: 127473 - DNA, 25 bp, Homo sapien
acggtgcttttggtggatgcgtcta

SEQ ID NO: 127474 - DNA, 25 bp, Homo sapien
ggtggatgcgtctagatggataaca

SEQ ID NO: 127475 - DNA, 25 bp, Homo sapien
ttcttctaccctaaaatattcctat

SEQ ID NO: 127476 - DNA, 25 bp, Homo sapien
taatactttgagctgttctggttcc

SEQ ID NO: 127477 - DNA, 25 bp, Homo sapien
ctccagggtgcatggtacccattaa

SEQ ID NO: 127478 - DNA, 25 bp, Homo sapien
ggtacccattaacccaaaatatgat

SEQ ID NO: 127479 - DNA, 25 bp, Homo sapien
gaatgttctctgtgaaccacagttg

SEQ ID NO: 127480 - DNA, 25 bp, Homo sapien
cacatttctttctgtcaccacagag

SEQ ID NO: 127481 - DNA, 25 bp, Homo sapien
accacagagattggcctacggtttc

SEQ ID NO: 127482 - DNA, 25 bp, Homo sapien
ctacggtttctgttttgagggtgct

SEQ ID NO: 127483 - DNA, 25 bp, Homo sapien
tatagtagcaggatgaggaacctca

SEQ ID NO: 127484 - DNA, 25 bp, Homo sapien
gaggaacctcaaactgggtatcatt

SEQ ID NO: 127485 - DNA, 25 bp, Homo sapien
actgggtatcatttgcacgtgctct

SEQ ID NO: 127486 - DNA, 25 bp, Homo sapien
gtgctcttctgttctcaaatgctaa

SEQ ID NO: 127487 - DNA, 25 bp, Homo sapien
gtatttattagttaggtgtgccaaa

SEQ ID NO: 127488 - DNA, 25 bp, Homo sapien
taggtgtgccaaactaccgttccca

SEQ ID NO: 127489 - DNA, 25 bp, Homo sapien
taccgttcccaaattggtgtttctg

SEQ ID NO: 127490 - DNA, 25 bp, Homo sapien
ccccaacattactccattactaaag

SEQ ID NO: 127491 - DNA, 25 bp, Homo sapien
aaacatgtggcaacctgttcttcct

SEQ ID NO: 127492 - DNA, 25 bp, Homo sapien
caacctgttcttcctaccaaatata

SEQ ID NO: 127493 - DNA, 25 bp, Homo sapien
gtattttatctgtgttgtctctcta

SEQ ID NO: 127494 - DNA, 25 bp, Homo sapien
ggaacgtcaaagctctgtataccta

SEQ ID NO: 127495 - DNA, 25 bp, Homo sapien
aaagctctgtatacctactaagtgg

SEQ ID NO: 127496 - DNA, 25 bp, Homo sapien
ggaaaacaagaccatcatctaagtg

SEQ ID NO: 127497 - DNA, 25 bp, Homo sapien
gaccatcatctaagtgatttgagaa

SEQ ID NO: 127498 - DNA, 25 bp, Homo sapien
agtgactacacagcaataattacag

SEQ ID NO: 127499 - DNA, 25 bp, Homo sapien
agattcctttaaggcagacaagggc

SEQ ID NO: 127500 - DNA, 25 bp, Homo sapien
gcagacaagggctaagatttcctta

SEQ ID NO: 127501 - DNA, 25 bp, Homo sapien
tttccttagcagtaataatgacata

SEQ ID NO: 127502 - DNA, 25 bp, Homo sapien
gacatacactgaattgaaaatctat

SEQ ID NO: 127503 - DNA, 25 bp, Homo sapien
gaaaatgtatcacctgttccttaac

SEQ ID NO: 127504 - DNA, 25 bp, Homo sapien
atcacctgttccttaactgtgtaaa

SEQ ID NO: 127505 - DNA, 25 bp, Homo sapien
tgttgtctattatctgtaggtggaa

SEQ ID NO: 127506 - DNA, 25 bp, Homo sapien
ggaagcgaaatattacagtagtgca

SEQ ID NO: 127507 - DNA, 25 bp, Homo sapien
tacagtagtgcattggtgggtctca

SEQ ID NO: 127508 - DNA, 25 bp, Homo sapien
ggtgggtctcaatccttaacatatt

SEQ ID NO: 127509 - DNA, 25 bp, Homo sapien
gcacaattttatagcacaaacttta

SEQ ID NO: 127510 - DNA, 25 bp, Homo sapien
aactttaaattcaagctgctttgga

SEQ ID NO: 127511 - DNA, 25 bp, Homo sapien
caagctgctttggacaactgacaat

SEQ ID NO: 127512 - DNA, 25 bp, Homo sapien
atgtgtacatgttgggtatcctact

SEQ ID NO: 127513 - DNA, 25 bp, Homo sapien
atgttgggtatcctactactttgtg

SEQ ID NO: 127514 - DNA, 25 bp, Homo sapien
tttgtgttttcatctcctaaaagtg

SEQ ID NO: 127515 - DNA, 25 bp, Homo sapien
gactgctgaatgacatattttatct

SEQ ID NO: 127516 - DNA, 25 bp, Homo sapien
aacgtctgcactctcgtgaggggcc

SEQ ID NO: 127517 - DNA, 25 bp, Homo sapien
ccttggtctgcaacgggctaatcca

SEQ ID NO: 127518 - DNA, 25 bp, Homo sapien
ctgcaacgggctaatccacggaatt

SEQ ID NO: 127519 - DNA, 25 bp, Homo sapien
ggctaatccacggaattgcctcctt

SEQ ID NO: 127520 - DNA, 25 bp, Homo sapien
taatccacggaattgcctccttcgt

SEQ ID NO: 127521 - DNA, 25 bp, Homo sapien
cacggaattgcctccttcgtccggg

SEQ ID NO: 127522 - DNA, 25 bp, Homo sapien
ggaggctgcgcctcagggctctacc

SEQ ID NO: 127523 - DNA, 25 bp, Homo sapien
gcctttgccccggtggcacagtttg

SEQ ID NO: 127524 - DNA, 25 bp, Homo sapien
ccggtggcacagtttgtaaactgga

SEQ ID NO: 127525 - DNA, 25 bp, Homo sapien
gtttgtaaactggatcgactctatc

SEQ ID NO: 127526 - DNA, 25 bp, Homo sapien
ttgtaaactggatcgactctatcat

SEQ ID NO: 127527 - DNA, 25 bp, Homo sapien
gactctggcctgtacctaggaatga

SEQ ID NO: 127528 - DNA, 25 bp, Homo sapien
gggtcgaagaaactcacacgtgaat

SEQ ID NO: 127529 - DNA, 25 bp, Homo sapien
cacgtgaatgtgttttccgggaaca

SEQ ID NO: 127530 - DNA, 25 bp, Homo sapien
aaactggtacaacacctatgcctca

SEQ ID NO: 127531 - DNA, 25 bp, Homo sapien
tatgcctcaaccttgtacaaacatt

SEQ ID NO: 127532 - DNA, 25 bp, Homo sapien
gacagtattacgtggccctgaacaa

SEQ ID NO: 127533 - DNA, 25 bp, Homo sapien
gaacaaagatggctcaccccgggag

SEQ ID NO: 127534 - DNA, 25 bp, Homo sapien
tcactttttacccaggcctgtagat

SEQ ID NO: 127535 - DNA, 25 bp, Homo sapien
gcctgtagatccttctaagttgccc

SEQ ID NO: 127536 - DNA, 25 bp, Homo sapien
taagttgccctccatgtccagagac

SEQ ID NO: 127537 - DNA, 25 bp, Homo sapien
gtccagagacctctttcactatagg

SEQ ID NO: 127538 - DNA, 25 bp, Homo sapien
agtgaacatattgcttagtaacaaa

SEQ ID NO: 127539 - DNA, 25 bp, Homo sapien
gaaggacaagcatactacataatat

SEQ ID NO: 127540 - DNA, 25 bp, Homo sapien
aatccatacaattctcttcagttag

SEQ ID NO: 127541 - DNA, 25 bp, Homo sapien
acaattctcttcagttagtgtaaac

SEQ ID NO: 127542 - DNA, 25 bp, Homo sapien
actgcaaatactacagataattctg

SEQ ID NO: 127543 - DNA, 25 bp, Homo sapien
atgatatgcacgctgaatcctgcta

SEQ ID NO: 127544 - DNA, 25 bp, Homo sapien
acgctgaatcctgctatggtaccat

SEQ ID NO: 127545 - DNA, 25 bp, Homo sapien
gaatcctgctatggtaccattctaa

SEQ ID NO: 127546 - DNA, 25 bp, Homo sapien
ggtaccattctaatgtatgtagtat

SEQ ID NO: 127547 - DNA, 25 bp, Homo sapien
gtagtatttcaaatttccttccttg

SEQ ID NO: 127548 - DNA, 25 bp, Homo sapien
gaaagccatcttattcttgtaaaat

SEQ ID NO: 127549 - DNA, 25 bp, Homo sapien
gaggcgtggccctcgccgttgacca

SEQ ID NO: 127550 - DNA, 25 bp, Homo sapien
tcgccgttgaccatgtacagcacgt

SEQ ID NO: 127551 - DNA, 25 bp, Homo sapien
gttgaccatgtacagcacgtagtgc

SEQ ID NO: 127552 - DNA, 25 bp, Homo sapien
tgaccatgtacagcacgtagtgctc

SEQ ID NO: 127553 - DNA, 25 bp, Homo sapien
ccgcctccgagaccaaatagagacg

SEQ ID NO: 127554 - DNA, 25 bp, Homo sapien
gagaccaaatagagacgctgcttct

SEQ ID NO: 127555 - DNA, 25 bp, Homo sapien
aaatagagacgctgcttctccctcg

SEQ ID NO: 127556 - DNA, 25 bp, Homo sapien
gatgcggaccgtggccaggccatct

SEQ ID NO: 127557 - DNA, 25 bp, Homo sapien
ggttgcactcccagcgcttgaagcg

SEQ ID NO: 127558 - DNA, 25 bp, Homo sapien
gcactcccagcgcttgaagcgggct

SEQ ID NO: 127559 - DNA, 25 bp, Homo sapien
agcgggctggcggtggtcgcaggag

SEQ ID NO: 127560 - DNA, 25 bp, Homo sapien
tggcctcttgatggagccagatccc

SEQ ID NO: 127561 - DNA, 25 bp, Homo sapien
agatccccatcctatagttcatagt

SEQ ID NO: 127562 - DNA, 25 bp, Homo sapien
tatagttcatagtcctctcctggtt

SEQ ID NO: 127563 - DNA, 25 bp, Homo sapien
tggttccggtcaaagcctttcctca

SEQ ID NO: 127564 - DNA, 25 bp, Homo sapien
ccccacattcctcaactagtattat

SEQ ID NO: 127565 - DNA, 25 bp, Homo sapien
tattatttgggctctgggcagcagc

SEQ ID NO: 127566 - DNA, 25 bp, Homo sapien
gcatgattcttctgaccctagaaat

SEQ ID NO: 127567 - DNA, 25 bp, Homo sapien
tctgaccctagaaatgttcccttta

SEQ ID NO: 127568 - DNA, 25 bp, Homo sapien
gttccctttaatcttcaagttcgag

SEQ ID NO: 127569 - DNA, 25 bp, Homo sapien
agatcagccctttaagtacctttct

SEQ ID NO: 127570 - DNA, 25 bp, Homo sapien
taagtacctttctgttgcagcccag

SEQ ID NO: 127571 - DNA, 25 bp, Homo sapien
aagcccagcgggaagagcaaagact

SEQ ID NO: 127572 - DNA, 25 bp, Homo sapien
agagcaaagactgcgtgttcacgga

SEQ ID NO: 127573 - DNA, 25 bp, Homo sapien
aagactgcgtgttcacggagatcgt

SEQ ID NO: 127574 - DNA, 25 bp, Homo sapien
gctggagaacaactatacggccttc

SEQ ID NO: 127575 - DNA, 25 bp, Homo sapien
agaacaactatacggccttccagaa

SEQ ID NO: 127576 - DNA, 25 bp, Homo sapien
acgcccggcacgagggctggttcat

SEQ ID NO: 127577 - DNA, 25 bp, Homo sapien
tggttcatggccttcacgcggcagg

SEQ ID NO: 127578 - DNA, 25 bp, Homo sapien
aagcgcctctaccaaggccagctgc

SEQ ID NO: 127579 - DNA, 25 bp, Homo sapien
agaagcagaagcagttcgagtttgt

SEQ ID NO: 127580 - DNA, 25 bp, Homo sapien
aagcagttcgagtttgtgggctccg

SEQ ID NO: 127581 - DNA, 25 bp, Homo sapien
cagttcgagtttgtgggctccgccc

SEQ ID NO: 127582 - DNA, 25 bp, Homo sapien
gaagctgtgtgcacgcagcctcgcc

SEQ ID NO: 127583 - DNA, 25 bp, Homo sapien
gtgcacgcagcctcgcctgtatggg

SEQ ID NO: 127584 - DNA, 25 bp, Homo sapien
agcagggaacgggacaggcccccat

SEQ ID NO: 127585 - DNA, 25 bp, Homo sapien
atggtcttcccggtggcctctcggg

SEQ ID NO: 127586 - DNA, 25 bp, Homo sapien
ggcttctgacgccaaatgggcttcc

SEQ ID NO: 127587 - DNA, 25 bp, Homo sapien
aaatgggcttcccatggtcaccctg

SEQ ID NO: 127588 - DNA, 25 bp, Homo sapien
atggtcaccctggacaaggaggtaa

SEQ ID NO: 127589 - DNA, 25 bp, Homo sapien
acaaccccgcttctgtgtgattctg

SEQ ID NO: 127590 - DNA, 25 bp, Homo sapien
tgggcctcagtagggctcccaggct

SEQ ID NO: 127591 - DNA, 25 bp, Homo sapien
ctcagtagggctcccaggctgcaag

SEQ ID NO: 127592 - DNA, 25 bp, Homo sapien
ggtggactgtgggatgcatgccctg

SEQ ID NO: 127593 - DNA, 25 bp, Homo sapien
gatccaggcgtgcaaactggctcag

SEQ ID NO: 127594 - DNA, 25 bp, Homo sapien
ggcgtgcaaactggctcagtctaat

SEQ ID NO: 127595 - DNA, 25 bp, Homo sapien
aaactggctcagtctaatggctggg

SEQ ID NO: 127596 - DNA, 25 bp, Homo sapien
gagcgtctggccaaatacaaccaac

SEQ ID NO: 127597 - DNA, 25 bp, Homo sapien
ggccaaatacaaccaactcatgagg

SEQ ID NO: 127598 - DNA, 25 bp, Homo sapien
actcatgaggatcgaggaggctctt

SEQ ID NO: 127599 - DNA, 25 bp, Homo sapien
gacaaggcaatctttgctggacgca

SEQ ID NO: 127600 - DNA, 25 bp, Homo sapien
tttgctggacgcaagttccgtaacc

SEQ ID NO: 127601 - DNA, 25 bp, Homo sapien
tggacgcaagttccgtaacccgaag

SEQ ID NO: 127602 - DNA, 25 bp, Homo sapien
ttccgtaacccgaaggccaagtgag

SEQ ID NO: 127603 - DNA, 25 bp, Homo sapien
aacccgaaggccaagtgagaagctg

SEQ ID NO: 127604 - DNA, 25 bp, Homo sapien
tggtgatggtcctggcattctgctt

SEQ ID NO: 127605 - DNA, 25 bp, Homo sapien
ggtgatggtcctggcattctgcttc

SEQ ID NO: 127606 - DNA, 25 bp, Homo sapien
tgatggtcctggcattctgcttctg

SEQ ID NO: 127607 - DNA, 25 bp, Homo sapien
gatggtcctggcattctgcttctgc

SEQ ID NO: 127608 - DNA, 25 bp, Homo sapien
atggtcctggcattctgcttctgct

SEQ ID NO: 127609 - DNA, 25 bp, Homo sapien
attctgcttctgctggggaccatac

SEQ ID NO: 127610 - DNA, 25 bp, Homo sapien
ttctgcttctgctggggaccatacg

SEQ ID NO: 127611 - DNA, 25 bp, Homo sapien
tctgcttctgctggggaccatacgc

SEQ ID NO: 127612 - DNA, 25 bp, Homo sapien
gcttctgctggggaccatacgcctt

SEQ ID NO: 127613 - DNA, 25 bp, Homo sapien
cttctgctggggaccatacgccttc

SEQ ID NO: 127614 - DNA, 25 bp, Homo sapien
ttctgctggggaccatacgccttct

SEQ ID NO: 127615 - DNA, 25 bp, Homo sapien
tcatggcaaatcctgttacttaaat

SEQ ID NO: 127616 - DNA, 25 bp, Homo sapien
ttaaatagcatctgctcttctctta

SEQ ID NO: 127617 - DNA, 25 bp, Homo sapien
ttacgctctctgtctggctgtacgt

SEQ ID NO: 127618 - DNA, 25 bp, Homo sapien
tggctgtacgtctggtgttctcaat

SEQ ID NO: 127619 - DNA, 25 bp, Homo sapien
ctggtgttctcaatgcttttctagc

SEQ ID NO: 127620 - DNA, 25 bp, Homo sapien
ataactagatctcctgtaattttgt

SEQ ID NO: 127621 - DNA, 25 bp, Homo sapien
gtagtagttgatgaccaatctctgt

SEQ ID NO: 127622 - DNA, 25 bp, Homo sapien
aatctctgtgactcgcttagctgaa

SEQ ID NO: 127623 - DNA, 25 bp, Homo sapien
ggcaacatttccgaagaccttctga

SEQ ID NO: 127624 - DNA, 25 bp, Homo sapien
gaccaggctcacaactgtttttgaa

SEQ ID NO: 127625 - DNA, 25 bp, Homo sapien
ttcacactgtgcgttttgagtatgc

SEQ ID NO: 127626 - DNA, 25 bp, Homo sapien
gtctgtcccagagcttattggccac

SEQ ID NO: 127627 - DNA, 25 bp, Homo sapien
tgtcccagagcttattggccactgg

SEQ ID NO: 127628 - DNA, 25 bp, Homo sapien
ccagagcttattggccactgggtct

SEQ ID NO: 127629 - DNA, 25 bp, Homo sapien
agcttattggccactgggtctcgct

SEQ ID NO: 127630 - DNA, 25 bp, Homo sapien
ttggccactgggtctcgctccgagt

SEQ ID NO: 127631 - DNA, 25 bp, Homo sapien
gggcgagcacccacgtgagagaatc

SEQ ID NO: 127632 - DNA, 25 bp, Homo sapien
cacccacgtgagagaatctgcctgt

SEQ ID NO: 127633 - DNA, 25 bp, Homo sapien
cacgtgagagaatctgcctgtggcc

SEQ ID NO: 127634 - DNA, 25 bp, Homo sapien
attccttgtcaccagcaacatctcg

SEQ ID NO: 127635 - DNA, 25 bp, Homo sapien
agcaacatctcgagccccctagatg

SEQ ID NO: 127636 - DNA, 25 bp, Homo sapien
gcagcctctctgctataagaaaagc

SEQ ID NO: 127637 - DNA, 25 bp, Homo sapien
ggaaaacgtctcaggtggcctctga

SEQ ID NO: 127638 - DNA, 25 bp, Homo sapien
gtctcaggtggcctctgaaacacca

SEQ ID NO: 127639 - DNA, 25 bp, Homo sapien
gaaacaccactcctttttgtgtgtg

SEQ ID NO: 127640 - DNA, 25 bp, Homo sapien
tgtgtgcacgcatggctgagcatgt

SEQ ID NO: 127641 - DNA, 25 bp, Homo sapien
gtcagcacattcacgatactgtgca

SEQ ID NO: 127642 - DNA, 25 bp, Homo sapien
tgtgcaatcatcacctctgtctagt

SEQ ID NO: 127643 - DNA, 25 bp, Homo sapien
tctagttacaggacggtttctttct

SEQ ID NO: 127644 - DNA, 25 bp, Homo sapien
tggcaaccacaaatctttccaactc

SEQ ID NO: 127645 - DNA, 25 bp, Homo sapien
atctttccaactctacggatttgcc

SEQ ID NO: 127646 - DNA, 25 bp, Homo sapien
tgttctgggcatttcatgtcaatgg

SEQ ID NO: 127647 - DNA, 25 bp, Homo sapien
gtcaatggaatcatgtactctgtga

SEQ ID NO: 127648 - DNA, 25 bp, Homo sapien
agctcaacctcaaggagtacaacct

SEQ ID NO: 127649 - DNA, 25 bp, Homo sapien
gctcaacctcaaggagtacaacctg

SEQ ID NO: 127650 - DNA, 25 bp, Homo sapien
tcaacctcaaggagtacaacctggt

SEQ ID NO: 127651 - DNA, 25 bp, Homo sapien
caacctcaaggagtacaacctggtc

SEQ ID NO: 127652 - DNA, 25 bp, Homo sapien
cctcaaggagtacaacctggtctga

SEQ ID NO: 127653 - DNA, 25 bp, Homo sapien
aaggagtacaacctggtctgagcgc

SEQ ID NO: 127654 - DNA, 25 bp, Homo sapien
ggagtacaacctggtctgagcgccc

SEQ ID NO: 127655 - DNA, 25 bp, Homo sapien
caggcccagggagacgggatggaga

SEQ ID NO: 127656 - DNA, 25 bp, Homo sapien
gggatgtacatctctccctccgtac

SEQ ID NO: 127657 - DNA, 25 bp, Homo sapien
gcaccttctcaccttttgtcaacgg

SEQ ID NO: 127658 - DNA, 25 bp, Homo sapien
ccttctcaccttttgtcaacggcaa

SEQ ID NO: 127659 - DNA, 25 bp, Homo sapien
gggcagcagcgtgaaaaccagtatg

SEQ ID NO: 127660 - DNA, 25 bp, Homo sapien
gtgaaaaccagtatgatctgtgctg

SEQ ID NO: 127661 - DNA, 25 bp, Homo sapien
atctccagctgcaacggagactctg

SEQ ID NO: 127662 - DNA, 25 bp, Homo sapien
tgcaacggagactctggcgggccac

SEQ ID NO: 127663 - DNA, 25 bp, Homo sapien
aacggagactctggcgggccactga

SEQ ID NO: 127664 - DNA, 25 bp, Homo sapien
ctctggcgggccactgaactgtcag

SEQ ID NO: 127665 - DNA, 25 bp, Homo sapien
cgggccactgaactgtcaggcgtct

SEQ ID NO: 127666 - DNA, 25 bp, Homo sapien
gtctgacggccggtggcaggtgcac

SEQ ID NO: 127667 - DNA, 25 bp, Homo sapien
gcaggtgcacggcatcgtcagcttc

SEQ ID NO: 127668 - DNA, 25 bp, Homo sapien
acggcatcgtcagcttcgggtctcg

SEQ ID NO: 127669 - DNA, 25 bp, Homo sapien
tcgggtctcgcctcggctgcaacta

SEQ ID NO: 127670 - DNA, 25 bp, Homo sapien
atggaacagctgtcaaggccacacc

SEQ ID NO: 127671 - DNA, 25 bp, Homo sapien
tcccacaaccgccaaaagatggaga

SEQ ID NO: 127672 - DNA, 25 bp, Homo sapien
tggaccgggcaaaaaggattgacac

SEQ ID NO: 127673 - DNA, 25 bp, Homo sapien
ttgacacgatatctcgagctgcctt

SEQ ID NO: 127674 - DNA, 25 bp, Homo sapien
aacatcttttactggatcacataca

SEQ ID NO: 127675 - DNA, 25 bp, Homo sapien
acatacaagatcattcggcatgaag

SEQ ID NO: 127676 - DNA, 25 bp, Homo sapien
attcggcatgaagatgtccacaaga

SEQ ID NO: 127677 - DNA, 25 bp, Homo sapien
agaaatagatgtgccctacagaccc

SEQ ID NO: 127678 - DNA, 25 bp, Homo sapien
agatgtgccctacagaccctgggac

SEQ ID NO: 127679 - DNA, 25 bp, Homo sapien
ccttcttgcctcagtgttgtgcttg

SEQ ID NO: 127680 - DNA, 25 bp, Homo sapien
gtgttgtgcttgtaaatacacagtg

SEQ ID NO: 127681 - DNA, 25 bp, Homo sapien
ggtgtagccaatcgtagcgccagca

SEQ ID NO: 127682 - DNA, 25 bp, Homo sapien
aatcgtagcgccagcatacgcattc

SEQ ID NO: 127683 - DNA, 25 bp, Homo sapien
agcatacgcattccccggactgttg

SEQ ID NO: 127684 - DNA, 25 bp, Homo sapien
gaagaagggttactttgaagatcgt

SEQ ID NO: 127685 - DNA, 25 bp, Homo sapien
tttgaagatcgtcgcccctctgcca

SEQ ID NO: 127686 - DNA, 25 bp, Homo sapien
tgcgaccccttttcggtgacagaag

SEQ ID NO: 127687 - DNA, 25 bp, Homo sapien
ttttcggtgacagaagccctcatcc

SEQ ID NO: 127688 - DNA, 25 bp, Homo sapien
atccgcacgtgtcttctcaatgaaa

SEQ ID NO: 127689 - DNA, 25 bp, Homo sapien
cgcacgtgtcttctcaatgaaaccg

SEQ ID NO: 127690 - DNA, 25 bp, Homo sapien
tgaaaccggcgatgagcccttccag

SEQ ID NO: 127691 - DNA, 25 bp, Homo sapien
ttaagtggactagacctccagctgt

SEQ ID NO: 127692 - DNA, 25 bp, Homo sapien
tggttcagtgtctgcaacgggccac

SEQ ID NO: 127693 - DNA, 25 bp, Homo sapien
gggccactccagaacagtaccagat

SEQ ID NO: 127694 - DNA, 25 bp, Homo sapien
atcctgaaggaaaattacgggcaga

SEQ ID NO: 127695 - DNA, 25 bp, Homo sapien
aaaattacgggcagaaggaggctga

SEQ ID NO: 127696 - DNA, 25 bp, Homo sapien
aaggcgctatatgaggagctggatc

SEQ ID NO: 127697 - DNA, 25 bp, Homo sapien
cgctatatgaggagctggatctgcc

SEQ ID NO: 127698 - DNA, 25 bp, Homo sapien
tggatctgccagcagtgttcttgca

SEQ ID NO: 127699 - DNA, 25 bp, Homo sapien
atggctctcattgaacagtacgcag

SEQ ID NO: 127700 - DNA, 25 bp, Homo sapien
gggcttgcgcgcaaaatctacaagc

SEQ ID NO: 127701 - DNA, 25 bp, Homo sapien
ttgcgcgcaaaatctacaagcggag

SEQ ID NO: 127702 - DNA, 25 bp, Homo sapien
atctacaagcggagaaagtgaccta

SEQ ID NO: 127703 - DNA, 25 bp, Homo sapien
ggtggagacggtgaacatcagcaat

SEQ ID NO: 127704 - DNA, 25 bp, Homo sapien
atcagcaatgagctcatctcctaca

SEQ ID NO: 127705 - DNA, 25 bp, Homo sapien
atctcctacaaccaagacatcgtct

SEQ ID NO: 127706 - DNA, 25 bp, Homo sapien
caagacatcgtcttccacaaggaaa

SEQ ID NO: 127707 - DNA, 25 bp, Homo sapien
aggaaatcgcagctgcctacatcca

SEQ ID NO: 127708 - DNA, 25 bp, Homo sapien
gaggagggtcctttcgatcgcatgt

SEQ ID NO: 127709 - DNA, 25 bp, Homo sapien
ggtcctttcgatcgcatgttccaga

SEQ ID NO: 127710 - DNA, 25 bp, Homo sapien
atgttccagatctatcagacgtccc

SEQ ID NO: 127711 - DNA, 25 bp, Homo sapien
agatggtgaccctgttgctgagtct

SEQ ID NO: 127712 - DNA, 25 bp, Homo sapien
ataacacctttcaccccgaatggat

SEQ ID NO: 127713 - DNA, 25 bp, Homo sapien
ctttcaccccgaatggattccatta

SEQ ID NO: 127714 - DNA, 25 bp, Homo sapien
tccagacctcctaggcctgattgtc

SEQ ID NO: 127715 - DNA, 25 bp, Homo sapien
ctcctaggcctgattgtcctgccag

SEQ ID NO: 127716 - DNA, 25 bp, Homo sapien
acagacagatggaccggcccacact

SEQ ID NO: 127717 - DNA, 25 bp, Homo sapien
acactcccagagttgctaacatgga

SEQ ID NO: 127718 - DNA, 25 bp, Homo sapien
gagttgctaacatggagctctgaga

SEQ ID NO: 127719 - DNA, 25 bp, Homo sapien
aacatggagctctgagatcacccca

SEQ ID NO: 127720 - DNA, 25 bp, Homo sapien
ccaacccaacgcttttttggatcag

SEQ ID NO: 127721 - DNA, 25 bp, Homo sapien
aacgcttttttggatcagctcagac

SEQ ID NO: 127722 - DNA, 25 bp, Homo sapien
cttttttggatcagctcagacatat

SEQ ID NO: 127723 - DNA, 25 bp, Homo sapien
ggatcagctcagacatatttcagta

SEQ ID NO: 127724 - DNA, 25 bp, Homo sapien
cagctcagacatatttcagtataaa

SEQ ID NO: 127725 - DNA, 25 bp, Homo sapien
gcatcttgcagcttttcgggaagaa

SEQ ID NO: 127726 - DNA, 25 bp, Homo sapien
aaggttgacgatggctctgaactct

SEQ ID NO: 127727 - DNA, 25 bp, Homo sapien
aaaacggaggtctcatctgtgtcct

SEQ ID NO: 127728 - DNA, 25 bp, Homo sapien
aggtctcatctgtgtcctcggtatc

SEQ ID NO: 127729 - DNA, 25 bp, Homo sapien
tgtgtcctcggtatcgcctgcatga

SEQ ID NO: 127730 - DNA, 25 bp, Homo sapien
tcttcgcatgctttgctgctgccaa

SEQ ID NO: 127731 - DNA, 25 bp, Homo sapien
aaaagtgccactatctacaaccccg

SEQ ID NO: 127732 - DNA, 25 bp, Homo sapien
caaccccgttatctatgtctttatg

SEQ ID NO: 127733 - DNA, 25 bp, Homo sapien
atctatgtctttatgaaccggcagt

SEQ ID NO: 127734 - DNA, 25 bp, Homo sapien
tttatgaaccggcagtttcgaaact

SEQ ID NO: 127735 - DNA, 25 bp, Homo sapien
gtttcgaaactgcatcttgcagctt

SEQ ID NO: 127736 - DNA, 25 bp, Homo sapien
atgcaattccatagcttacttcttt

SEQ ID NO: 127737 - DNA, 25 bp, Homo sapien
catagcttacttctttctcctaaat

SEQ ID NO: 127738 - DNA, 25 bp, Homo sapien
tagcttacttctttctcctaaattt

SEQ ID NO: 127739 - DNA, 25 bp, Homo sapien
catggatgatattatcacttgttgc

SEQ ID NO: 127740 - DNA, 25 bp, Homo sapien
attctctttgtgaagttatgcacag

SEQ ID NO: 127741 - DNA, 25 bp, Homo sapien
gtgaagttatgcacagaactgtaac

SEQ ID NO: 127742 - DNA, 25 bp, Homo sapien
aactgtaacactttcctctgccttt

SEQ ID NO: 127743 - DNA, 25 bp, Homo sapien
ctgcctttttctcttatatgtgggt

SEQ ID NO: 127744 - DNA, 25 bp, Homo sapien
cttatatgtgggttcatggttcagt

SEQ ID NO: 127745 - DNA, 25 bp, Homo sapien
atgaatttactacttgggtgttcta

SEQ ID NO: 127746 - DNA, 25 bp, Homo sapien
actacttgggtgttctaaatacagt

SEQ ID NO: 127747 - DNA, 25 bp, Homo sapien
gaagaggccgatgcataaagtcagc

SEQ ID NO: 127748 - DNA, 25 bp, Homo sapien
aggccgatgcataaagtcagcctgt

SEQ ID NO: 127749 - DNA, 25 bp, Homo sapien
gttccaagtgctcagggacttagca

SEQ ID NO: 127750 - DNA, 25 bp, Homo sapien
atgagaagatgtgacctgtgccaaa

SEQ ID NO: 127751 - DNA, 25 bp, Homo sapien
gatgtgacctgtgccaaaactattt

SEQ ID NO: 127752 - DNA, 25 bp, Homo sapien
gacctgtgccaaaactattttgaga

SEQ ID NO: 127753 - DNA, 25 bp, Homo sapien
gtgaccatttttctggtatgccaat

SEQ ID NO: 127754 - DNA, 25 bp, Homo sapien
aatttatattctgctctaatactgt

SEQ ID NO: 127755 - DNA, 25 bp, Homo sapien
actgtactgtgtagtgtgtctccgt

SEQ ID NO: 127756 - DNA, 25 bp, Homo sapien
tagtgtgtctccgtatgtcatctca

SEQ ID NO: 127757 - DNA, 25 bp, Homo sapien
tctccgtatgtcatctcagggagct

SEQ ID NO: 127758 - DNA, 25 bp, Homo sapien
gtggaggccctgactaccctggaag

SEQ ID NO: 127759 - DNA, 25 bp, Homo sapien
gactaccctggaagtagcaggccgc

SEQ ID NO: 127760 - DNA, 25 bp, Homo sapien
tagcaggccgcatgcttggaggtaa

SEQ ID NO: 127761 - DNA, 25 bp, Homo sapien
tccctggcccgtgctggaaaagtga

SEQ ID NO: 127762 - DNA, 25 bp, Homo sapien
gaggtcagactcctaaggtggccaa

SEQ ID NO: 127763 - DNA, 25 bp, Homo sapien
cagactcctaaggtggccaaacagg

SEQ ID NO: 127764 - DNA, 25 bp, Homo sapien
aagaagaagacaggtcgggctaagc

SEQ ID NO: 127765 - DNA, 25 bp, Homo sapien
ggctaagcggcggatgcagtacaac

SEQ ID NO: 127766 - DNA, 25 bp, Homo sapien
ggatgcagtacaaccggcgctttgt

SEQ ID NO: 127767 - DNA, 25 bp, Homo sapien
aaccggcgctttgtcaacgttgtgc

SEQ ID NO: 127768 - DNA, 25 bp, Homo sapien
gttgtgcccacctttggcaagaaga

SEQ ID NO: 127769 - DNA, 25 bp, Homo sapien
agggctaccactggtattcctgagc

SEQ ID NO: 127770 - DNA, 25 bp, Homo sapien
ccagctccacttctaatgctagaga

SEQ ID NO: 127771 - DNA, 25 bp, Homo sapien
taactaagacttctgtgcatttgaa

SEQ ID NO: 127772 - DNA, 25 bp, Homo sapien
agaaagctgttcttgacagcactct

SEQ ID NO: 127773 - DNA, 25 bp, Homo sapien
ttgacagcactctgagccatcatac

SEQ ID NO: 127774 - DNA, 25 bp, Homo sapien
tgagccatcatacctctttcccata

SEQ ID NO: 127775 - DNA, 25 bp, Homo sapien
taaactattttcacagatctcaact

SEQ ID NO: 127776 - DNA, 25 bp, Homo sapien
tcacagatctcaactaaaacccctt

SEQ ID NO: 127777 - DNA, 25 bp, Homo sapien
taaaaccccttacttcacaaatgat

SEQ ID NO: 127778 - DNA, 25 bp, Homo sapien
gtgttgtgctgaaatggtgctctta

SEQ ID NO: 127779 - DNA, 25 bp, Homo sapien
ggtgctcttatagtactggcttatt

SEQ ID NO: 127780 - DNA, 25 bp, Homo sapien
gacagcatgcagctggccatcaccg

SEQ ID NO: 127781 - DNA, 25 bp, Homo sapien
tggccatcaccggcggcaatgagga

SEQ ID NO: 127782 - DNA, 25 bp, Homo sapien
caatgaggagggctttttcaccacc

SEQ ID NO: 127783 - DNA, 25 bp, Homo sapien
acccggaaggtgagcccccacagtg

SEQ ID NO: 127784 - DNA, 25 bp, Homo sapien
gggacttgctcctgaccgtcaagat

SEQ ID NO: 127785 - DNA, 25 bp, Homo sapien
tgaccgtcaagatggatctctctcg

SEQ ID NO: 127786 - DNA, 25 bp, Homo sapien
aagatggatctctctcgccacggca

SEQ ID NO: 127787 - DNA, 25 bp, Homo sapien
cacggcaccgtcagctcctttgtgg

SEQ ID NO: 127788 - DNA, 25 bp, Homo sapien
tcctttgtggccaagcttttcatct

SEQ ID NO: 127789 - DNA, 25 bp, Homo sapien
tttgtggccaagcttttcatctttg

SEQ ID NO: 127790 - DNA, 25 bp, Homo sapien
agctctgagcactcgcttcgcgtcg

SEQ ID NO: 127791 - DNA, 25 bp, Homo sapien
tacaatccccgcagagtctccggtg

SEQ ID NO: 127792 - DNA, 25 bp, Homo sapien
gagtctccggtgcagacgcgctgcg

SEQ ID NO: 127793 - DNA, 25 bp, Homo sapien
agcggcgtgccaatctgcgggtccc

SEQ ID NO: 127794 - DNA, 25 bp, Homo sapien
gccgccccgccgaggtttgtagcag

SEQ ID NO: 127795 - DNA, 25 bp, Homo sapien
gtagcagccgggatgtgaccctcca

SEQ ID NO: 127796 - DNA, 25 bp, Homo sapien
agccgggatgtgaccctccagggtt

SEQ ID NO: 127797 - DNA, 25 bp, Homo sapien
tccagggtttgggtcgctttgcgtt

SEQ ID NO: 127798 - DNA, 25 bp, Homo sapien
gggtcgctttgcgtttgtcgaagcc

SEQ ID NO: 127799 - DNA, 25 bp, Homo sapien
gtttgtcgaagcctcctctgaatgg

SEQ ID NO: 127800 - DNA, 25 bp, Homo sapien
gtcgaagcctcctctgaatggcttt

SEQ ID NO: 127801 - DNA, 25 bp, Homo sapien
gttttaatcacattcactttacttg

SEQ ID NO: 127802 - DNA, 25 bp, Homo sapien
ctggagactggatggctcccctgag

SEQ ID NO: 127803 - DNA, 25 bp, Homo sapien
cctgaggctggcatcctggctggct

SEQ ID NO: 127804 - DNA, 25 bp, Homo sapien
agaagggcctgctctgcttttcctg

SEQ ID NO: 127805 - DNA, 25 bp, Homo sapien
gcttttcctgtctgtatataactta

SEQ ID NO: 127806 - DNA, 25 bp, Homo sapien
taagaactttgagaatcccaattat

SEQ ID NO: 127807 - DNA, 25 bp, Homo sapien
cgtcctgaggagtgtcctgtctgct

SEQ ID NO: 127808 - DNA, 25 bp, Homo sapien
agtgtcctgtctgctgggctacaaa

SEQ ID NO: 127809 - DNA, 25 bp, Homo sapien
tgtctgctgggctacaaaccaggag

SEQ ID NO: 127810 - DNA, 25 bp, Homo sapien
tacaaaccaggagcaaccgtgcagc

SEQ ID NO: 127811 - DNA, 25 bp, Homo sapien
aggagcaaccgtgcagccacgaaca

SEQ ID NO: 127812 - DNA, 25 bp, Homo sapien
aaccgtgcagccacgaacacgcatg

SEQ ID NO: 127813 - DNA, 25 bp, Homo sapien
gtgaagccaacgctgccagaaagaa

SEQ ID NO: 127814 - DNA, 25 bp, Homo sapien
tctgaagggccagacgggttttcgt

SEQ ID NO: 127815 - DNA, 25 bp, Homo sapien
gacgggttttcgtatcttccagaat

SEQ ID NO: 127816 - DNA, 25 bp, Homo sapien
ttccagaatacccatgccattgaca

SEQ ID NO: 127817 - DNA, 25 bp, Homo sapien
gccattgacaaatactctaggttga

SEQ ID NO: 127818 - DNA, 25 bp, Homo sapien
tactctaggttgatattccctgcct

SEQ ID NO: 127819 - DNA, 25 bp, Homo sapien
atattccctgcctcctacatatttt

SEQ ID NO: 127820 - DNA, 25 bp, Homo sapien
tttattggtcagtgttttcctaggg

SEQ ID NO: 127821 - DNA, 25 bp, Homo sapien
gggctccaaggctgttcctagaaga

SEQ ID NO: 127822 - DNA, 25 bp, Homo sapien
gacagacggacttgttgaccacacg

SEQ ID NO: 127823 - DNA, 25 bp, Homo sapien
aacaatgcagcagctactggaccac

SEQ ID NO: 127824 - DNA, 25 bp, Homo sapien
ttgtcccgcctcatccacagaaagg

SEQ ID NO: 127825 - DNA, 25 bp, Homo sapien
tgtcccgcctcatccacagaaaggg

SEQ ID NO: 127826 - DNA, 25 bp, Homo sapien
aggatgggcgatgacagttgtttct

SEQ ID NO: 127827 - DNA, 25 bp, Homo sapien
ggatgggcgatgacagttgtttcta

SEQ ID NO: 127828 - DNA, 25 bp, Homo sapien
gatgggcgatgacagttgtttctat

SEQ ID NO: 127829 - DNA, 25 bp, Homo sapien
atgggcgatgacagttgtttctatg

SEQ ID NO: 127830 - DNA, 25 bp, Homo sapien
tgggcgatgacagttgtttctatgc

SEQ ID NO: 127831 - DNA, 25 bp, Homo sapien
gggcgatgacagttgtttctatgcc

SEQ ID NO: 127832 - DNA, 25 bp, Homo sapien
gccgagagcctcaactacgtggcgt

SEQ ID NO: 127833 - DNA, 25 bp, Homo sapien
tgagcatgctgcagacccaagacct

SEQ ID NO: 127834 - DNA, 25 bp, Homo sapien
cacgactgagaacaaggaactgaaa

SEQ ID NO: 127835 - DNA, 25 bp, Homo sapien
tgcgcctgaagctgccagctgtggt

SEQ ID NO: 127836 - DNA, 25 bp, Homo sapien
gcctgaagctgccagctgtggtgac

SEQ ID NO: 127837 - DNA, 25 bp, Homo sapien
tggtgacagctgacctgaggctcaa

SEQ ID NO: 127838 - DNA, 25 bp, Homo sapien
gtgacagctgacctgaggctcaacg

SEQ ID NO: 127839 - DNA, 25 bp, Homo sapien
tgaggctcaacgagccccgctacgc

SEQ ID NO: 127840 - DNA, 25 bp, Homo sapien
gccacgctgcccaacatcatgaaag

SEQ ID NO: 127841 - DNA, 25 bp, Homo sapien
acgctgcccaacatcatgaaagcca

SEQ ID NO: 127842 - DNA, 25 bp, Homo sapien
gctgcccaacatcatgaaagccaag

SEQ ID NO: 127843 - DNA, 25 bp, Homo sapien
tgcccaacatcatgaaagccaagaa

SEQ ID NO: 127844 - DNA, 25 bp, Homo sapien
cccaacatcatgaaagccaagaaga

SEQ ID NO: 127845 - DNA, 25 bp, Homo sapien
atcgaggtgatcaagcctggggacc

SEQ ID NO: 127846 - DNA, 25 bp, Homo sapien
gggatttaaggcacccgcttccact

SEQ ID NO: 127847 - DNA, 25 bp, Homo sapien
ggatttaaggcacccgcttccactt

SEQ ID NO: 127848 - DNA, 25 bp, Homo sapien
ttaaggcacccgcttccacttcttt

SEQ ID NO: 127849 - DNA, 25 bp, Homo sapien
cttctttcttgtttggagttttctg

SEQ ID NO: 127850 - DNA, 25 bp, Homo sapien
tggagttttctgttggaaccgccgg

SEQ ID NO: 127851 - DNA, 25 bp, Homo sapien
gagttttctgttggaaccgccggcg

SEQ ID NO: 127852 - DNA, 25 bp, Homo sapien
gaaccgccggcgttggctccgaaga

SEQ ID NO: 127853 - DNA, 25 bp, Homo sapien
gccggcgttggctccgaagacttag

SEQ ID NO: 127854 - DNA, 25 bp, Homo sapien
ggcgttggctccgaagacttagcga

SEQ ID NO: 127855 - DNA, 25 bp, Homo sapien
gcgttggctccgaagacttagcgac

SEQ ID NO: 127856 - DNA, 25 bp, Homo sapien
gttggctccgaagacttagcgacgc

SEQ ID NO: 127857 - DNA, 25 bp, Homo sapien
cgctcggcggcaaaggtgctgacat

SEQ ID NO: 127858 - DNA, 25 bp, Homo sapien
ggtgctgacatctatgtgctaggct

SEQ ID NO: 127859 - DNA, 25 bp, Homo sapien
acatctatgtgctaggctgcctcat

SEQ ID NO: 127860 - DNA, 25 bp, Homo sapien
aggctgcctcatcacgccactggag

SEQ ID NO: 127861 - DNA, 25 bp, Homo sapien
tgaatttgggcagctaccacgggtc

SEQ ID NO: 127862 - DNA, 25 bp, Homo sapien
taccacgggtctgccatgctctgga

SEQ ID NO: 127863 - DNA, 25 bp, Homo sapien
ctgactctcttttgaggtccctgta

SEQ ID NO: 127864 - DNA, 25 bp, Homo sapien
ttttgaggtccctgtatgtctacct

SEQ ID NO: 127865 - DNA, 25 bp, Homo sapien
ctgtatgtctacctctgacttctgt

SEQ ID NO: 127866 - DNA, 25 bp, Homo sapien
tgacttctgtggtccctctgtgtct

SEQ ID NO: 127867 - DNA, 25 bp, Homo sapien
tgtctgctctcatccattcctctta

SEQ ID NO: 127868 - DNA, 25 bp, Homo sapien
gtgtcgggagaacattgacacctcc

SEQ ID NO: 127869 - DNA, 25 bp, Homo sapien
atgtggtgtttgctggcgatggcat

SEQ ID NO: 127870 - DNA, 25 bp, Homo sapien
gcattgagggctcacctgccaaaga

SEQ ID NO: 127871 - DNA, 25 bp, Homo sapien
gccaaagattttgctctactcacac

SEQ ID NO: 127872 - DNA, 25 bp, Homo sapien
aagattttgctctactcacacagtg

SEQ ID NO: 127873 - DNA, 25 bp, Homo sapien
gctctactcacacagtgtaaccaca

SEQ ID NO: 127874 - DNA, 25 bp, Homo sapien
catgaccattgggacgttcgggatc

SEQ ID NO: 127875 - DNA, 25 bp, Homo sapien
gatctgggccgcatacctcacgggc

SEQ ID NO: 127876 - DNA, 25 bp, Homo sapien
tcacgggcggagacaccatctacct

SEQ ID NO: 127877 - DNA, 25 bp, Homo sapien
ctttcctcaaaatctttaagccaga

SEQ ID NO: 127878 - DNA, 25 bp, Homo sapien
aggcagccttcctgccggagtggac

SEQ ID NO: 127879 - DNA, 25 bp, Homo sapien
atatatgtaatgttcacttgagtgg

SEQ ID NO: 127880 - DNA, 25 bp, Homo sapien
tgttcacttgagtggaactgctttt

SEQ ID NO: 127881 - DNA, 25 bp, Homo sapien
gatcttgtgtttcttcaaccttcaa

SEQ ID NO: 127882 - DNA, 25 bp, Homo sapien
cttcaaccttcaaaactatctcatc

SEQ ID NO: 127883 - DNA, 25 bp, Homo sapien
ccttcaaaactatctcatctgtcag

SEQ ID NO: 127884 - DNA, 25 bp, Homo sapien
aaaactatctcatctgtcagatttt

SEQ ID NO: 127885 - DNA, 25 bp, Homo sapien
aaaactccaacacaggttttggcat

SEQ ID NO: 127886 - DNA, 25 bp, Homo sapien
ctccaacacaggttttggcatcttt

SEQ ID NO: 127887 - DNA, 25 bp, Homo sapien
ttggcatcttttgtgctgtatcttt

SEQ ID NO: 127888 - DNA, 25 bp, Homo sapien
ggcatcttttgtgctgtatctttta

SEQ ID NO: 127889 - DNA, 25 bp, Homo sapien
aaaggtctaccccactttatcacat

SEQ ID NO: 127890 - DNA, 25 bp, Homo sapien
ataaccatgatgacctgaagttcac

SEQ ID NO: 127891 - DNA, 25 bp, Homo sapien
ctgaagttcacctatcccattttag

SEQ ID NO: 127892 - DNA, 25 bp, Homo sapien
aagttcacctatcccattttagcat

SEQ ID NO: 127893 - DNA, 25 bp, Homo sapien
ctcttcctttccaattttgcttata

SEQ ID NO: 127894 - DNA, 25 bp, Homo sapien
tccaattttgcttatactgctgtaa

SEQ ID NO: 127895 - DNA, 25 bp, Homo sapien
gcttatactgctgtaatatttttgt

SEQ ID NO: 127896 - DNA, 25 bp, Homo sapien
gaccagctaaaattttcgacttgac

SEQ ID NO: 127897 - DNA, 25 bp, Homo sapien
aaagtgtgactttttctcggagcat

SEQ ID NO: 127898 - DNA, 25 bp, Homo sapien
ttctcggagcatatatgtagctttt

SEQ ID NO: 127899 - DNA, 25 bp, Homo sapien
gtagcttttaggaaaggctgatgat

SEQ ID NO: 127900 - DNA, 25 bp, Homo sapien
gctgatgatggtataaagtttgctc

SEQ ID NO: 127901 - DNA, 25 bp, Homo sapien
cagctgacaatactgtgggccgctt

SEQ ID NO: 127902 - DNA, 25 bp, Homo sapien
agctgacaatactgtgggccgcttc

SEQ ID NO: 127903 - DNA, 25 bp, Homo sapien
gctgacaatactgtgggccgcttcc

SEQ ID NO: 127904 - DNA, 25 bp, Homo sapien
ctgacaatactgtgggccgcttcct

SEQ ID NO: 127905 - DNA, 25 bp, Homo sapien
tgacaatactgtgggccgcttcctg

SEQ ID NO: 127906 - DNA, 25 bp, Homo sapien
gacaatactgtgggccgcttcctga

SEQ ID NO: 127907 - DNA, 25 bp, Homo sapien
acaatactgtgggccgcttcctgat

SEQ ID NO: 127908 - DNA, 25 bp, Homo sapien
aatactgtgggccgcttcctgatga

SEQ ID NO: 127909 - DNA, 25 bp, Homo sapien
tactgtgggccgcttcctgatgagc

SEQ ID NO: 127910 - DNA, 25 bp, Homo sapien
actgtgggccgcttcctgatgagcc

SEQ ID NO: 127911 - DNA, 25 bp, Homo sapien
ctgtgggccgcttcctgatgagcct

SEQ ID NO: 127912 - DNA, 25 bp, Homo sapien
gctggatgtcaagccttgggatgat

SEQ ID NO: 127913 - DNA, 25 bp, Homo sapien
tggaggcctgtgtgcgctctatcca

SEQ ID NO: 127914 - DNA, 25 bp, Homo sapien
gtgtgcgctctatccagctggacgg

SEQ ID NO: 127915 - DNA, 25 bp, Homo sapien
cttccaagctggtgcccgtgggcta

SEQ ID NO: 127916 - DNA, 25 bp, Homo sapien
tgcccgtgggctacggtatccggaa

SEQ ID NO: 127917 - DNA, 25 bp, Homo sapien
tgggctacggtatccggaagctaca

SEQ ID NO: 127918 - DNA, 25 bp, Homo sapien
ctacggtatccggaagctacagatt

SEQ ID NO: 127919 - DNA, 25 bp, Homo sapien
agcacgtgcagagtgtcgatatcgc

SEQ ID NO: 127920 - DNA, 25 bp, Homo sapien
gagtgtcgatatcgcagctttcaac

SEQ ID NO: 127921 - DNA, 25 bp, Homo sapien
tcaacaagatctgaagcctgagtgt

SEQ ID NO: 127922 - DNA, 25 bp, Homo sapien
ctgaagcctgagtgtgtgtacgtgc

SEQ ID NO: 127923 - DNA, 25 bp, Homo sapien
tttggctcgtcatttcctcttaaaa

SEQ ID NO: 127924 - DNA, 25 bp, Homo sapien
ttggctcgtcatttcctcttaaaaa

SEQ ID NO: 127925 - DNA, 25 bp, Homo sapien
taagaacttcattgccctggggatc

SEQ ID NO: 127926 - DNA, 25 bp, Homo sapien
tggagactgagccttgcccgtgcat

SEQ ID NO: 127927 - DNA, 25 bp, Homo sapien
tgagccttgcccgtgcatatttagg

SEQ ID NO: 127928 - DNA, 25 bp, Homo sapien
ccttgcccgtgcatatttaggtcat

SEQ ID NO: 127929 - DNA, 25 bp, Homo sapien
tatttaggtcatttcccacactgtc

SEQ ID NO: 127930 - DNA, 25 bp, Homo sapien
actgtcttagagaacttgtcaccag

SEQ ID NO: 127931 - DNA, 25 bp, Homo sapien
gagaacttgtcaccagaaaccacat

SEQ ID NO: 127932 - DNA, 25 bp, Homo sapien
cttgtcaccagaaaccacatgtatt

SEQ ID NO: 127933 - DNA, 25 bp, Homo sapien
accacatgtatttgcatgttttttg

SEQ ID NO: 127934 - DNA, 25 bp, Homo sapien
ttcatatacatcttacctcatttca

SEQ ID NO: 127935 - DNA, 25 bp, Homo sapien
acatcttacctcatttcaagtgaat

SEQ ID NO: 127936 - DNA, 25 bp, Homo sapien
ttctctctttccaaaaatttacagg

SEQ ID NO: 127937 - DNA, 25 bp, Homo sapien
atgtttagtgtaattggatttcgct

SEQ ID NO: 127938 - DNA, 25 bp, Homo sapien
attggatttcgctatcagttcccat

SEQ ID NO: 127939 - DNA, 25 bp, Homo sapien
tcgctatcagttcccatccttaagt

SEQ ID NO: 127940 - DNA, 25 bp, Homo sapien
gttcccatccttaagttttgatatt

SEQ ID NO: 127941 - DNA, 25 bp, Homo sapien
gatagatacactgcatctttggtca

SEQ ID NO: 127942 - DNA, 25 bp, Homo sapien
ctttggtcatctaagatttgtttac

SEQ ID NO: 127943 - DNA, 25 bp, Homo sapien
tttagagcatagactttataagcat

SEQ ID NO: 127944 - DNA, 25 bp, Homo sapien
gaggtaaaacctaaatgcgatgtga

SEQ ID NO: 127945 - DNA, 25 bp, Homo sapien
tgggtgaccacgtgaccaacttgcg

SEQ ID NO: 127946 - DNA, 25 bp, Homo sapien
gggtgaccacgtgaccaacttgcgc

SEQ ID NO: 127947 - DNA, 25 bp, Homo sapien
ggtgaccacgtgaccaacttgcgca

SEQ ID NO: 127948 - DNA, 25 bp, Homo sapien
gtgaccacgtgaccaacttgcgcaa

SEQ ID NO: 127949 - DNA, 25 bp, Homo sapien
tgaccacgtgaccaacttgcgcaag

SEQ ID NO: 127950 - DNA, 25 bp, Homo sapien
gaccacgtgaccaacttgcgcaaga

SEQ ID NO: 127951 - DNA, 25 bp, Homo sapien
accacgtgaccaacttgcgcaagat

SEQ ID NO: 127952 - DNA, 25 bp, Homo sapien
ccacgtgaccaacttgcgcaagatg

SEQ ID NO: 127953 - DNA, 25 bp, Homo sapien
actgtgcccatgctgaaagaggcct

SEQ ID NO: 127954 - DNA, 25 bp, Homo sapien
tgaaagaggcctgccgagcttacgg

SEQ ID NO: 127955 - DNA, 25 bp, Homo sapien
gcctgccgagcttacgggctgaaga

SEQ ID NO: 127956 - DNA, 25 bp, Homo sapien
tgctggaagccctcaccaagcactt

SEQ ID NO: 127957 - DNA, 25 bp, Homo sapien
caagcacttccaggactgaccagag

SEQ ID NO: 127958 - DNA, 25 bp, Homo sapien
gccttgtcctcagccagttaaaatg

SEQ ID NO: 127959 - DNA, 25 bp, Homo sapien
ctcagccagttaaaatgtgtttctc

SEQ ID NO: 127960 - DNA, 25 bp, Homo sapien
tgtttctcctgagctaggaagagtc

SEQ ID NO: 127961 - DNA, 25 bp, Homo sapien
tgagctaggaagagtctacccgaca

SEQ ID NO: 127962 - DNA, 25 bp, Homo sapien
aggaagagtctacccgacataagtc

SEQ ID NO: 127963 - DNA, 25 bp, Homo sapien
tacccgacataagtcgagggacttt

SEQ ID NO: 127964 - DNA, 25 bp, Homo sapien
aatgaatcaggatcatgccttaaaa

SEQ ID NO: 127965 - DNA, 25 bp, Homo sapien
tgttaaagtattccactgaaatcac

SEQ ID NO: 127966 - DNA, 25 bp, Homo sapien
gtgggtattataacaatcattggaa

SEQ ID NO: 127967 - DNA, 25 bp, Homo sapien
gaaagcatggagagctacatttcat

SEQ ID NO: 127968 - DNA, 25 bp, Homo sapien
ggagagctacatttcataatttgag

SEQ ID NO: 127969 - DNA, 25 bp, Homo sapien
gggaaaatttctaacagatgccaga

SEQ ID NO: 127970 - DNA, 25 bp, Homo sapien
gatgccagaatgcttgtttatggga

SEQ ID NO: 127971 - DNA, 25 bp, Homo sapien
gtttatgggattgctgtgtttcctt

SEQ ID NO: 127972 - DNA, 25 bp, Homo sapien
atttgtggttccaaacaattattgt

SEQ ID NO: 127973 - DNA, 25 bp, Homo sapien
tgcagatttatttaaggtagttcct

SEQ ID NO: 127974 - DNA, 25 bp, Homo sapien
atttaaggtagttcctgaaatgact

SEQ ID NO: 127975 - DNA, 25 bp, Homo sapien
tcaaggagttcactgcccaaaactt

SEQ ID NO: 127976 - DNA, 25 bp, Homo sapien
caaaacttaggcaagctcttcatgg

SEQ ID NO: 127977 - DNA, 25 bp, Homo sapien
cttcatggcccaggctcttcaagaa

SEQ ID NO: 127978 - DNA, 25 bp, Homo sapien
agttaacatgaactcttgaagtcac

SEQ ID NO: 127979 - DNA, 25 bp, Homo sapien
tcacaccagggcaactcttggaaga

SEQ ID NO: 127980 - DNA, 25 bp, Homo sapien
ggatttctttagtgtcattgccgat

SEQ ID NO: 127981 - DNA, 25 bp, Homo sapien
agtgtcattgccgattttggctata

SEQ ID NO: 127982 - DNA, 25 bp, Homo sapien
ataacagtgtctttctagccataat

SEQ ID NO: 127983 - DNA, 25 bp, Homo sapien
tcgctgctcattgcaggccagataa

SEQ ID NO: 127984 - DNA, 25 bp, Homo sapien
ggccagataaacacttactgccaga

SEQ ID NO: 127985 - DNA, 25 bp, Homo sapien
cttactgccagaacatcaaggagtt

SEQ ID NO: 127986 - DNA, 25 bp, Homo sapien
cttcaggcgccttcgggcgtggact

SEQ ID NO: 127987 - DNA, 25 bp, Homo sapien
ggcgtggactctggcgcactctagt

SEQ ID NO: 127988 - DNA, 25 bp, Homo sapien
ctctggcgcactctagtggacagga

SEQ ID NO: 127989 - DNA, 25 bp, Homo sapien
tagtggacaggagaaggaacgcctt

SEQ ID NO: 127990 - DNA, 25 bp, Homo sapien
gaaggaacgccttccaggaacctgt

SEQ ID NO: 127991 - DNA, 25 bp, Homo sapien
gaacgccttccaggaacctgtggac

SEQ ID NO: 127992 - DNA, 25 bp, Homo sapien
ggtaacagaccgctggaaaacactg

SEQ ID NO: 127993 - DNA, 25 bp, Homo sapien
gaccgctggaaaacactgtcacttt

SEQ ID NO: 127994 - DNA, 25 bp, Homo sapien
gctggaaaacactgtcactttcaga

SEQ ID NO: 127995 - DNA, 25 bp, Homo sapien
ggacgagagaaatcgcggcccacaa

SEQ ID NO: 127996 - DNA, 25 bp, Homo sapien
ttttgtatttattccctcaccttct

SEQ ID NO: 127997 - DNA, 25 bp, Homo sapien
aggtcaccaagtctgcccagaaagc

SEQ ID NO: 127998 - DNA, 25 bp, Homo sapien
ttatccctaatcctcccaccccact

SEQ ID NO: 127999 - DNA, 25 bp, Homo sapien
tatccctaatcctcccaccccactc

SEQ ID NO: 128000 - DNA, 25 bp, Homo sapien
cccaccccactcttaatcagtggtg

SEQ ID NO: 128001 - DNA, 25 bp, Homo sapien
taatcagtggtggaagaccggtctc

SEQ ID NO: 128002 - DNA, 25 bp, Homo sapien
tgtttgtttcaattgccatttaagt

SEQ ID NO: 128003 - DNA, 25 bp, Homo sapien
gtttgtttcaattgccatttaagtt

SEQ ID NO: 128004 - DNA, 25 bp, Homo sapien
tcaattgccatttaagtttagtagt

SEQ ID NO: 128005 - DNA, 25 bp, Homo sapien
gaatgttttgtggacacgttggttt

SEQ ID NO: 128006 - DNA, 25 bp, Homo sapien
ttttgcgtgtggcagttttagttat

SEQ ID NO: 128007 - DNA, 25 bp, Homo sapien
aacttgacccccaaatttgtcacag

SEQ ID NO: 128008 - DNA, 25 bp, Homo sapien
gaagacactggctcatattcctgca

SEQ ID NO: 128009 - DNA, 25 bp, Homo sapien
cactggctcatattcctgcagcctg

SEQ ID NO: 128010 - DNA, 25 bp, Homo sapien
ggtgctcagggctgacacgtccacc

SEQ ID NO: 128011 - DNA, 25 bp, Homo sapien
agtgcacccactctgctttgactga

SEQ ID NO: 128012 - DNA, 25 bp, Homo sapien
acccactctgctttgactgagcaga

SEQ ID NO: 128013 - DNA, 25 bp, Homo sapien
tgctttgactgagcagactggtgag

SEQ ID NO: 128014 - DNA, 25 bp, Homo sapien
ctgggagggcccacttcagggttct

SEQ ID NO: 128015 - DNA, 25 bp, Homo sapien
agggcccacttcagggttctcctct

SEQ ID NO: 128016 - DNA, 25 bp, Homo sapien
ctctcccctctaaggccgaagaagg

SEQ ID NO: 128017 - DNA, 25 bp, Homo sapien
ctctccccaagacttggtgtccttt

SEQ ID NO: 128018 - DNA, 25 bp, Homo sapien
caagacttggtgtcctttccctcca

SEQ ID NO: 128019 - DNA, 25 bp, Homo sapien
tgatgccaaaattccaccaaatgca

SEQ ID NO: 128020 - DNA, 25 bp, Homo sapien
attccaccaaatgcaaaactcactt

SEQ ID NO: 128021 - DNA, 25 bp, Homo sapien
gcaaaactcacttttgaagtggaat

SEQ ID NO: 128022 - DNA, 25 bp, Homo sapien
gcagtgcttcagctctaaggatatt

SEQ ID NO: 128023 - DNA, 25 bp, Homo sapien
gcttcagctctaaggatattagcaa

SEQ ID NO: 128024 - DNA, 25 bp, Homo sapien
gcaacaatgataaaacttggccttg

SEQ ID NO: 128025 - DNA, 25 bp, Homo sapien
gaagaaatttacacaactagttaga

SEQ ID NO: 128026 - DNA, 25 bp, Homo sapien
acacaactagttagaacttgttact

SEQ ID NO: 128027 - DNA, 25 bp, Homo sapien
gaacttgttactattgtaaaggaag

SEQ ID NO: 128028 - DNA, 25 bp, Homo sapien
aaatactttcctacagctgtgtaaa

SEQ ID NO: 128029 - DNA, 25 bp, Homo sapien
ttcctacagctgtgtaaaatactgg

SEQ ID NO: 128030 - DNA, 25 bp, Homo sapien
actcagggacagagccatgctggga

SEQ ID NO: 128031 - DNA, 25 bp, Homo sapien
catgctgggaagacgcctgagctca

SEQ ID NO: 128032 - DNA, 25 bp, Homo sapien
ggaagacgcctgagctcactcggca

SEQ ID NO: 128033 - DNA, 25 bp, Homo sapien
actcggcaccctgcaaaatttgatg

SEQ ID NO: 128034 - DNA, 25 bp, Homo sapien
aaatttgatgccaggacacgctttg

SEQ ID NO: 128035 - DNA, 25 bp, Homo sapien
gacacgctttggaggcgatttacct

SEQ ID NO: 128036 - DNA, 25 bp, Homo sapien
aggcgatttacctgttttcgcacct

SEQ ID NO: 128037 - DNA, 25 bp, Homo sapien
tttcgcacctaccatcagggacagg

SEQ ID NO: 128038 - DNA, 25 bp, Homo sapien
ttaggtggcaagctgtgacttctcc

SEQ ID NO: 128039 - DNA, 25 bp, Homo sapien
gctgtgacttctccaggtctcacgg

SEQ ID NO: 128040 - DNA, 25 bp, Homo sapien
atgggcactcccttggtggcaagag

SEQ ID NO: 128041 - DNA, 25 bp, Homo sapien
tgggctgaagatgttatccttcatt

SEQ ID NO: 128042 - DNA, 25 bp, Homo sapien
ctgaagatgttatccttcattgtgg

SEQ ID NO: 128043 - DNA, 25 bp, Homo sapien
cattgtggtgtaaatgaactttcac

SEQ ID NO: 128044 - DNA, 25 bp, Homo sapien
gtggtgtaaatgaactttcacaata

SEQ ID NO: 128045 - DNA, 25 bp, Homo sapien
ttcacctgtgaacccaaataaaatg

SEQ ID NO: 128046 - DNA, 25 bp, Homo sapien
gaatggagtataagttttccgttgt

SEQ ID NO: 128047 - DNA, 25 bp, Homo sapien
aacaaaaaatccaagtgtgccttga

SEQ ID NO: 128048 - DNA, 25 bp, Homo sapien
aagtgtgccttgaattgtacagagc

SEQ ID NO: 128049 - DNA, 25 bp, Homo sapien
tgccttgaattgtacagagcacaat

SEQ ID NO: 128050 - DNA, 25 bp, Homo sapien
gtacagagcacaattattatgtttg

SEQ ID NO: 128051 - DNA, 25 bp, Homo sapien
tatgtttgaaatgtgtactacttaa

SEQ ID NO: 128052 - DNA, 25 bp, Homo sapien
caagctgcagacacacacagtcatt

SEQ ID NO: 128053 - DNA, 25 bp, Homo sapien
tttctgtccacacccctgtgggtgg

SEQ ID NO: 128054 - DNA, 25 bp, Homo sapien
gtgtgcgcacgtgtcggcgctcaca

SEQ ID NO: 128055 - DNA, 25 bp, Homo sapien
acacacacatgctagcccactgatg

SEQ ID NO: 128056 - DNA, 25 bp, Homo sapien
ccagggctggcagtctttgcagcgt

SEQ ID NO: 128057 - DNA, 25 bp, Homo sapien
ctggagcctggagaggatctatgct

SEQ ID NO: 128058 - DNA, 25 bp, Homo sapien
gagaggatctatgcttgtttgtttt

SEQ ID NO: 128059 - DNA, 25 bp, Homo sapien
gtttgtttttgtaatccatatcata

SEQ ID NO: 128060 - DNA, 25 bp, Homo sapien
gtaatccatatcatagttgctttct

SEQ ID NO: 128061 - DNA, 25 bp, Homo sapien
tccatatcatagttgctttctttaa

SEQ ID NO: 128062 - DNA, 25 bp, Homo sapien
taattgttccttctgaataaacagt

SEQ ID NO: 128063 - DNA, 25 bp, Homo sapien
gagcacaatgctggggttctcttca

SEQ ID NO: 128064 - DNA, 25 bp, Homo sapien
gggttctcttcacactatcactgcc

SEQ ID NO: 128065 - DNA, 25 bp, Homo sapien
tcacactatcactgccccaaattgt

SEQ ID NO: 128066 - DNA, 25 bp, Homo sapien
gtctttctaaatttcaacttcaatg

SEQ ID NO: 128067 - DNA, 25 bp, Homo sapien
ctaaatttcaacttcaatgtcatct

SEQ ID NO: 128068 - DNA, 25 bp, Homo sapien
cagccttaatttcttgctccataac

SEQ ID NO: 128069 - DNA, 25 bp, Homo sapien
agccttaatttcttgctccataact

SEQ ID NO: 128070 - DNA, 25 bp, Homo sapien
ataatgtaacttgatttcttatctg

SEQ ID NO: 128071 - DNA, 25 bp, Homo sapien
ctgtgtttgtgttggcatgcaagat

SEQ ID NO: 128072 - DNA, 25 bp, Homo sapien
gttggcatgcaagatttaggtactt

SEQ ID NO: 128073 - DNA, 25 bp, Homo sapien
ggcatgcaagatttaggtacttatc

SEQ ID NO: 128074 - DNA, 25 bp, Homo sapien
tattgagcaggcctatctctttcag

SEQ ID NO: 128075 - DNA, 25 bp, Homo sapien
gcaggcctatctctttcagatagtt

SEQ ID NO: 128076 - DNA, 25 bp, Homo sapien
tagttttatgattcacacaggtttg

SEQ ID NO: 128077 - DNA, 25 bp, Homo sapien
tgattcacacaggtttgaggatgct

SEQ ID NO: 128078 - DNA, 25 bp, Homo sapien
tgtggtggtgttctgttggttacaa

SEQ ID NO: 128079 - DNA, 25 bp, Homo sapien
gttataccatttaaagctggcacca

SEQ ID NO: 128080 - DNA, 25 bp, Homo sapien
gctggcaccagagacccgataggga

SEQ ID NO: 128081 - DNA, 25 bp, Homo sapien
gacccgatagggacttattaactat

SEQ ID NO: 128082 - DNA, 25 bp, Homo sapien
gcctttgaccctatgtatagttacg

SEQ ID NO: 128083 - DNA, 25 bp, Homo sapien
gtatagttacgatgccagattagat

SEQ ID NO: 128084 - DNA, 25 bp, Homo sapien
agattagatttatagcagcctcaag

SEQ ID NO: 128085 - DNA, 25 bp, Homo sapien
agatcccacccgagcggcgacggaa

SEQ ID NO: 128086 - DNA, 25 bp, Homo sapien
ggccgggccagttctcttgagaagt

SEQ ID NO: 128087 - DNA, 25 bp, Homo sapien
tcttgagaagtgaggcccggccccg

SEQ ID NO: 128088 - DNA, 25 bp, Homo sapien
tgtcccatctgcagtggaccccagg

SEQ ID NO: 128089 - DNA, 25 bp, Homo sapien
gtgaactgctccttggcagggattt

SEQ ID NO: 128090 - DNA, 25 bp, Homo sapien
ctccttggcagggatttgtgacact

SEQ ID NO: 128091 - DNA, 25 bp, Homo sapien
atttgtgacactgcattgctgggct

SEQ ID NO: 128092 - DNA, 25 bp, Homo sapien
tgggctgtgttcctcgggctcttct

SEQ ID NO: 128093 - DNA, 25 bp, Homo sapien
tcttctggaccttgcaccgtggata

SEQ ID NO: 128094 - DNA, 25 bp, Homo sapien
tgcaccgtggataccaggccatgtg

SEQ ID NO: 128095 - DNA, 25 bp, Homo sapien
ccatgtgccatggtatttgggtcct

SEQ ID NO: 128096 - DNA, 25 bp, Homo sapien
tgtattttaatgaaaaggtccccat

SEQ ID NO: 128097 - DNA, 25 bp, Homo sapien
catttaaaaaatattggcaaaccag

SEQ ID NO: 128098 - DNA, 25 bp, Homo sapien
aatattggcaaaccagtttatataa

SEQ ID NO: 128099 - DNA, 25 bp, Homo sapien
aacacaaacaggtaagcagggcaaa

SEQ ID NO: 128100 - DNA, 25 bp, Homo sapien
acacaaacaggtaagcagggcaaaa

SEQ ID NO: 128101 - DNA, 25 bp, Homo sapien
cacaaacaggtaagcagggcaaaaa

SEQ ID NO: 128102 - DNA, 25 bp, Homo sapien
aaaaaagtgtgtaaggctgggcgcg

SEQ ID NO: 128103 - DNA, 25 bp, Homo sapien
cgcggtgctcatgcccggtaatcct

SEQ ID NO: 128104 - DNA, 25 bp, Homo sapien
attagcaggcatggtgattcgcacc

SEQ ID NO: 128105 - DNA, 25 bp, Homo sapien
ttagcaggcatggtgattcgcacct

SEQ ID NO: 128106 - DNA, 25 bp, Homo sapien
tagcaggcatggtgattcgcacctg

SEQ ID NO: 128107 - DNA, 25 bp, Homo sapien
ttgacctccaccgtatatttgagcc

SEQ ID NO: 128108 - DNA, 25 bp, Homo sapien
caactgcttggacgcctttccaaat

SEQ ID NO: 128109 - DNA, 25 bp, Homo sapien
gccgcttcctcccaaaacctctgta

SEQ ID NO: 128110 - DNA, 25 bp, Homo sapien
aaacctctgtacacaagggtggctg

SEQ ID NO: 128111 - DNA, 25 bp, Homo sapien
aacctctgtacacaagggtggctgt

SEQ ID NO: 128112 - DNA, 25 bp, Homo sapien
acctctgtacacaagggtggctgtc

SEQ ID NO: 128113 - DNA, 25 bp, Homo sapien
cctctgtacacaagggtggctgtct

SEQ ID NO: 128114 - DNA, 25 bp, Homo sapien
ctctgtacacaagggtggctgtctg

SEQ ID NO: 128115 - DNA, 25 bp, Homo sapien
ctgtacacaagggtggctgtctggg

SEQ ID NO: 128116 - DNA, 25 bp, Homo sapien
ggcaacaagtaatgccttgaaggcc

SEQ ID NO: 128117 - DNA, 25 bp, Homo sapien
gcaacaagtaatgccttgaaggcca

SEQ ID NO: 128118 - DNA, 25 bp, Homo sapien
gagagctactccgtatacgtttaca

SEQ ID NO: 128119 - DNA, 25 bp, Homo sapien
actccgtatacgtttacaaggtgct

SEQ ID NO: 128120 - DNA, 25 bp, Homo sapien
ggcatctcctccaaagccatgggga

SEQ ID NO: 128121 - DNA, 25 bp, Homo sapien
gcatctcctccaaagccatggggat

SEQ ID NO: 128122 - DNA, 25 bp, Homo sapien
catctcctccaaagccatggggatc

SEQ ID NO: 128123 - DNA, 25 bp, Homo sapien
atctcctccaaagccatggggatca

SEQ ID NO: 128124 - DNA, 25 bp, Homo sapien
ctcctccaaagccatggggatcatg

SEQ ID NO: 128125 - DNA, 25 bp, Homo sapien
tcctccaaagccatggggatcatga

SEQ ID NO: 128126 - DNA, 25 bp, Homo sapien
ctccaaagccatggggatcatgaat

SEQ ID NO: 128127 - DNA, 25 bp, Homo sapien
gatcatgaattcctttgtcaacgat

SEQ ID NO: 128128 - DNA, 25 bp, Homo sapien
gcctggggaactggccaagcacgcc

SEQ ID NO: 128129 - DNA, 25 bp, Homo sapien
ctccctgtttgaagcctgcccttgt

SEQ ID NO: 128130 - DNA, 25 bp, Homo sapien
ctgcccttgtctgagatgctggtaa

SEQ ID NO: 128131 - DNA, 25 bp, Homo sapien
ttgtctgagatgctggtaatggcca

SEQ ID NO: 128132 - DNA, 25 bp, Homo sapien
gatgctggtaatggccatggtaccc

SEQ ID NO: 128133 - DNA, 25 bp, Homo sapien
ccccttctgggcatctgttctggtt

SEQ ID NO: 128134 - DNA, 25 bp, Homo sapien
tgggcatctgttctggtttttaacc

SEQ ID NO: 128135 - DNA, 25 bp, Homo sapien
ggtttttaaccattgtcttgttctg

SEQ ID NO: 128136 - DNA, 25 bp, Homo sapien
gggcacatgctgagtctcccaaggc

SEQ ID NO: 128137 - DNA, 25 bp, Homo sapien
acatgctgagtctcccaaggctgcg

SEQ ID NO: 128138 - DNA, 25 bp, Homo sapien
tgagtctcccaaggctgcgtctgga

SEQ ID NO: 128139 - DNA, 25 bp, Homo sapien
gtccaaatgtttacgggagcctcct

SEQ ID NO: 128140 - DNA, 25 bp, Homo sapien
tttacagtgtttctggcttagaaca

SEQ ID NO: 128141 - DNA, 25 bp, Homo sapien
tacagtgtttctggcttagaacaaa

SEQ ID NO: 128142 - DNA, 25 bp, Homo sapien
agtgtttctggcttagaacaaaggg

SEQ ID NO: 128143 - DNA, 25 bp, Homo sapien
tagaggctggcggatccaagcaaat

SEQ ID NO: 128144 - DNA, 25 bp, Homo sapien
agaggctggcggatccaagcaaatg

SEQ ID NO: 128145 - DNA, 25 bp, Homo sapien
tggcggatccaagcaaatggccaat

SEQ ID NO: 128146 - DNA, 25 bp, Homo sapien
aaatggccaatgagatcattgtgaa

SEQ ID NO: 128147 - DNA, 25 bp, Homo sapien
ggaatgtatgtgcacatctgttttg

SEQ ID NO: 128148 - DNA, 25 bp, Homo sapien
gtatgtgcacatctgttttgtaact

SEQ ID NO: 128149 - DNA, 25 bp, Homo sapien
atgtgcacatctgttttgtaactgt

SEQ ID NO: 128150 - DNA, 25 bp, Homo sapien
gtgcacatctgttttgtaactgttt

SEQ ID NO: 128151 - DNA, 25 bp, Homo sapien
taaagactgaatttgtaaacccatt

SEQ ID NO: 128152 - DNA, 25 bp, Homo sapien
atggcagtactttaggacacacaca

SEQ ID NO: 128153 - DNA, 25 bp, Homo sapien
acacacagatacaccttttgatatg

SEQ ID NO: 128154 - DNA, 25 bp, Homo sapien
ttttgatatgtaagcttgacctaaa

SEQ ID NO: 128155 - DNA, 25 bp, Homo sapien
gtcaaaggacctgtgtagcatttca

SEQ ID NO: 128156 - DNA, 25 bp, Homo sapien
gtagcatttcagattgagcacttca

SEQ ID NO: 128157 - DNA, 25 bp, Homo sapien
gattgagcacttcactatcaaaaat

SEQ ID NO: 128158 - DNA, 25 bp, Homo sapien
aatactaacatcacatggcttgaag

SEQ ID NO: 128159 - DNA, 25 bp, Homo sapien
gaagagtaaccatcagagctgaatc

SEQ ID NO: 128160 - DNA, 25 bp, Homo sapien
gagctgaatcatccaagtaagaaca

SEQ ID NO: 128161 - DNA, 25 bp, Homo sapien
catcacagtgtggtaaggttgcaaa

SEQ ID NO: 128162 - DNA, 25 bp, Homo sapien
cagcagtgtaaagaagtgtcgtgta

SEQ ID NO: 128163 - DNA, 25 bp, Homo sapien
gcagtgtaaagaagtgtcgtgtata

SEQ ID NO: 128164 - DNA, 25 bp, Homo sapien
gtaaagaagtgtcgtgtatacctgt

SEQ ID NO: 128165 - DNA, 25 bp, Homo sapien
taaagaagtgtcgtgtatacctgtg

SEQ ID NO: 128166 - DNA, 25 bp, Homo sapien
aaagaagtgtcgtgtatacctgtgc

SEQ ID NO: 128167 - DNA, 25 bp, Homo sapien
aagaagtgtcgtgtatacctgtgca

SEQ ID NO: 128168 - DNA, 25 bp, Homo sapien
agaagtgtcgtgtatacctgtgcag

SEQ ID NO: 128169 - DNA, 25 bp, Homo sapien
gaagtgtcgtgtatacctgtgcagg

SEQ ID NO: 128170 - DNA, 25 bp, Homo sapien
aagtgtcgtgtatacctgtgcaggc

SEQ ID NO: 128171 - DNA, 25 bp, Homo sapien
agtgtcgtgtatacctgtgcaggca

SEQ ID NO: 128172 - DNA, 25 bp, Homo sapien
gtgtcgtgtatacctgtgcaggcac

SEQ ID NO: 128173 - DNA, 25 bp, Homo sapien
tgccatataacacttgcacatgtga

SEQ ID NO: 128174 - DNA, 25 bp, Homo sapien
acacttgcacatgtgactctggtca

SEQ ID NO: 128175 - DNA, 25 bp, Homo sapien
gcacatgtgactctggtcaattcaa

SEQ ID NO: 128176 - DNA, 25 bp, Homo sapien
ctggtcaattcaaaagactcttatt

SEQ ID NO: 128177 - DNA, 25 bp, Homo sapien
agactcttatttcggctttaatcac

SEQ ID NO: 128178 - DNA, 25 bp, Homo sapien
tcggctttaatcacagaattgactg

SEQ ID NO: 128179 - DNA, 25 bp, Homo sapien
gaattgactgaattagttctgcaaa

SEQ ID NO: 128180 - DNA, 25 bp, Homo sapien
tctgcaaatactttgtcggtatatt

SEQ ID NO: 128181 - DNA, 25 bp, Homo sapien
ctttgtcggtatattaagccagtat

SEQ ID NO: 128182 - DNA, 25 bp, Homo sapien
aaagacttaggttcaggggcatcag

SEQ ID NO: 128183 - DNA, 25 bp, Homo sapien
gggcatcagtccctaagatgttatt

SEQ ID NO: 128184 - DNA, 25 bp, Homo sapien
actgcccatggcctcccaagtgatg

SEQ ID NO: 128185 - DNA, 25 bp, Homo sapien
tggcctcccaagtgatgccctggct

SEQ ID NO: 128186 - DNA, 25 bp, Homo sapien
tggacgacagcatgccctgggaggg

SEQ ID NO: 128187 - DNA, 25 bp, Homo sapien
acggcccagtggtcccttcacagga

SEQ ID NO: 128188 - DNA, 25 bp, Homo sapien
agtggtcccttcacaggaagcgaca

SEQ ID NO: 128189 - DNA, 25 bp, Homo sapien
acaggaagcgacacctggcacggac

SEQ ID NO: 128190 - DNA, 25 bp, Homo sapien
gaagcgacacctggcacggacactg

SEQ ID NO: 128191 - DNA, 25 bp, Homo sapien
cgacacctggcacggacactgctga

SEQ ID NO: 128192 - DNA, 25 bp, Homo sapien
ctggcacggacactgctgaccgcag

SEQ ID NO: 128193 - DNA, 25 bp, Homo sapien
cccgccatcctccaataaagtgtga

SEQ ID NO: 128194 - DNA, 25 bp, Homo sapien
ctccaataaagtgtgaggttctccg

SEQ ID NO: 128195 - DNA, 25 bp, Homo sapien
tcttacccttcaatgttaaatctac

SEQ ID NO: 128196 - DNA, 25 bp, Homo sapien
gaagtccatgtgataattgtaaagg

SEQ ID NO: 128197 - DNA, 25 bp, Homo sapien
atatctgtgtaagacacgtgcaaca

SEQ ID NO: 128198 - DNA, 25 bp, Homo sapien
gacacgtgcaacagactgccttata

SEQ ID NO: 128199 - DNA, 25 bp, Homo sapien
cgtgcaacagactgccttatattat

SEQ ID NO: 128200 - DNA, 25 bp, Homo sapien
ttctgtaattcttctcctttgtcaa

SEQ ID NO: 128201 - DNA, 25 bp, Homo sapien
taattcttctcctttgtcaaatggt

SEQ ID NO: 128202 - DNA, 25 bp, Homo sapien
gtgttgtcttattcctaattcctgt

SEQ ID NO: 128203 - DNA, 25 bp, Homo sapien
cctaattcctgtatgttatccacta

SEQ ID NO: 128204 - DNA, 25 bp, Homo sapien
gttatccactacaggttttatgaga

SEQ ID NO: 128205 - DNA, 25 bp, Homo sapien
caggttttatgagacttcctattaa

SEQ ID NO: 128206 - DNA, 25 bp, Homo sapien
tcttttccagttctccttcctctag

SEQ ID NO: 128207 - DNA, 25 bp, Homo sapien
tccttcctctaggagccatgttatc

SEQ ID NO: 128208 - DNA, 25 bp, Homo sapien
taggagccatgttatcctctgtccc

SEQ ID NO: 128209 - DNA, 25 bp, Homo sapien
ccccatagagtcaagcctagtgctt

SEQ ID NO: 128210 - DNA, 25 bp, Homo sapien
aagcctagtgcttgaaggtcctgac

SEQ ID NO: 128211 - DNA, 25 bp, Homo sapien
agtgcttgaaggtcctgacgacacc

SEQ ID NO: 128212 - DNA, 25 bp, Homo sapien
ttgaaggtcctgacgacacccacaa

SEQ ID NO: 128213 - DNA, 25 bp, Homo sapien
tgacgacacccacaacatacatgag

SEQ ID NO: 128214 - DNA, 25 bp, Homo sapien
gacacccacaacatacatgagagta

SEQ ID NO: 128215 - DNA, 25 bp, Homo sapien
gggattgagcatttatggcagcaac

SEQ ID NO: 128216 - DNA, 25 bp, Homo sapien
ttggctccaaaaagactgtcagctt

SEQ ID NO: 128217 - DNA, 25 bp, Homo sapien
gaagatttctcgtttcgaaaggcat

SEQ ID NO: 128218 - DNA, 25 bp, Homo sapien
ttctcgtttcgaaaggcatttatat

SEQ ID NO: 128219 - DNA, 25 bp, Homo sapien
ggcatttatataactctgcagcctt

SEQ ID NO: 128220 - DNA, 25 bp, Homo sapien
gcagccttcaaagctcgaaccaaag

SEQ ID NO: 128221 - DNA, 25 bp, Homo sapien
gctcgaaccaaagctagaagcaaat

SEQ ID NO: 128222 - DNA, 25 bp, Homo sapien
aaagctagaagcaaatgtcgagata

SEQ ID NO: 128223 - DNA, 25 bp, Homo sapien
tgtcgagataagagagcagatgttg

SEQ ID NO: 128224 - DNA, 25 bp, Homo sapien
gttggagaattcttctagattttca

SEQ ID NO: 128225 - DNA, 25 bp, Homo sapien
gaagactattttctaatttctattt

SEQ ID NO: 128226 - DNA, 25 bp, Homo sapien
tagataacttttgtagccagtggtt

SEQ ID NO: 128227 - DNA, 25 bp, Homo sapien
tttgtagccagtggttatattgctt

SEQ ID NO: 128228 - DNA, 25 bp, Homo sapien
atgctgaatcacatccatggtgagc

SEQ ID NO: 128229 - DNA, 25 bp, Homo sapien
catggtgagcattttgatggacaaa

SEQ ID NO: 128230 - DNA, 25 bp, Homo sapien
ccagtggagctgtggcagatcctaa

SEQ ID NO: 128231 - DNA, 25 bp, Homo sapien
gctgtggcagatcctaatagatgtg

SEQ ID NO: 128232 - DNA, 25 bp, Homo sapien
gagtagagacacacaccaacagcca

SEQ ID NO: 128233 - DNA, 25 bp, Homo sapien
agccaccctttctggaaatctgata

SEQ ID NO: 128234 - DNA, 25 bp, Homo sapien
atgtgaaatatcagacacactctgc

SEQ ID NO: 128235 - DNA, 25 bp, Homo sapien
agacacactctgctcattcatgtct

SEQ ID NO: 128236 - DNA, 25 bp, Homo sapien
attcatgtctccttccacagtttat

SEQ ID NO: 128237 - DNA, 25 bp, Homo sapien
acagtttatttcctcgcttcctttg

SEQ ID NO: 128238 - DNA, 25 bp, Homo sapien
ttgcatctaaacctttcttctttcc

SEQ ID NO: 128239 - DNA, 25 bp, Homo sapien
tgacgctgaccacgattcaagcaac

SEQ ID NO: 128240 - DNA, 25 bp, Homo sapien
gcaactgtgcagtgattgtccacgg

SEQ ID NO: 128241 - DNA, 25 bp, Homo sapien
cagtgattgtccacggtgcctggtg

SEQ ID NO: 128242 - DNA, 25 bp, Homo sapien
gtgcctggtggtatgcatcctgtta

SEQ ID NO: 128243 - DNA, 25 bp, Homo sapien
tgcatcctgttaccgatcaaatctc

SEQ ID NO: 128244 - DNA, 25 bp, Homo sapien
gatcaaatctcaatggtcgctatgc

SEQ ID NO: 128245 - DNA, 25 bp, Homo sapien
tggtcgctatgcagtgtctgatgct

SEQ ID NO: 128246 - DNA, 25 bp, Homo sapien
atgctgccgcccacaaatatggcat

SEQ ID NO: 128247 - DNA, 25 bp, Homo sapien
gatgcttcgatagggcactctggca

SEQ ID NO: 128248 - DNA, 25 bp, Homo sapien
cagtgcccttatctctcctgtacag

SEQ ID NO: 128249 - DNA, 25 bp, Homo sapien
tcctgtacagcttccggatcgtcag

SEQ ID NO: 128250 - DNA, 25 bp, Homo sapien
ggcccaacctgggattgctgagcag

SEQ ID NO: 128251 - DNA, 25 bp, Homo sapien
caacctgggattgctgagcagggaa

SEQ ID NO: 128252 - DNA, 25 bp, Homo sapien
tgctgagcagggaagctttgcatgt

SEQ ID NO: 128253 - DNA, 25 bp, Homo sapien
gcagggaagctttgcatgttgctct

SEQ ID NO: 128254 - DNA, 25 bp, Homo sapien
agggaagctttgcatgttgctctaa

SEQ ID NO: 128255 - DNA, 25 bp, Homo sapien
ggaagctttgcatgttgctctaagg

SEQ ID NO: 128256 - DNA, 25 bp, Homo sapien
aagctttgcatgttgctctaaggta

SEQ ID NO: 128257 - DNA, 25 bp, Homo sapien
gctttgcatgttgctctaaggtaca

SEQ ID NO: 128258 - DNA, 25 bp, Homo sapien
tttgcatgttgctctaaggtacatt

SEQ ID NO: 128259 - DNA, 25 bp, Homo sapien
gcatgttgctctaaggtacattttt

SEQ ID NO: 128260 - DNA, 25 bp, Homo sapien
gttgctctaaggtacatttttaaag

SEQ ID NO: 128261 - DNA, 25 bp, Homo sapien
gacaagcaccatagtgacactgaaa

SEQ ID NO: 128262 - DNA, 25 bp, Homo sapien
gaaatggattggttatatatgctta

SEQ ID NO: 128263 - DNA, 25 bp, Homo sapien
gcttaagaaatagcctccccaaagt

SEQ ID NO: 128264 - DNA, 25 bp, Homo sapien
tccccaaagtcttgaggcaaggtct

SEQ ID NO: 128265 - DNA, 25 bp, Homo sapien
gcaaggtctcactaagggctggaat

SEQ ID NO: 128266 - DNA, 25 bp, Homo sapien
taatgcactacagtctgaaactcct

SEQ ID NO: 128267 - DNA, 25 bp, Homo sapien
tcaaacagtcgtcctgcctaagctt

SEQ ID NO: 128268 - DNA, 25 bp, Homo sapien
ggattacaagcgtgcatccctgtgc

SEQ ID NO: 128269 - DNA, 25 bp, Homo sapien
cctgtgccccagtgattaagtttta

SEQ ID NO: 128270 - DNA, 25 bp, Homo sapien
gtgccccagtgattaagttttatta

SEQ ID NO: 128271 - DNA, 25 bp, Homo sapien
gatagcattggtcttgacaagcacc

SEQ ID NO: 128272 - DNA, 25 bp, Homo sapien
tctctcatgctgaatcacatccatg

SEQ ID NO: 128273 - DNA, 25 bp, Homo sapien
tctcatgctgaatcacatccatggt

SEQ ID NO: 128274 - DNA, 25 bp, Homo sapien
tcatgctgaatcacatccatggtga

SEQ ID NO: 128275 - DNA, 25 bp, Homo sapien
atgctgaatcacatccatggtgagc

SEQ ID NO: 128276 - DNA, 25 bp, Homo sapien
gctgaatcacatccatggtgagcat

SEQ ID NO: 128277 - DNA, 25 bp, Homo sapien
tcacatccatggtgagcattttgat

SEQ ID NO: 128278 - DNA, 25 bp, Homo sapien
acatccatggtgagcattttgatgg

SEQ ID NO: 128279 - DNA, 25 bp, Homo sapien
catggtgagcattttgatggacaaa

SEQ ID NO: 128280 - DNA, 25 bp, Homo sapien
cctttgcatctaaacctttcttctt

SEQ ID NO: 128281 - DNA, 25 bp, Homo sapien
ctttgcatctaaacctttcttcttt

SEQ ID NO: 128282 - DNA, 25 bp, Homo sapien
ttgcatctaaacctttcttctttcc

SEQ ID NO: 128283 - DNA, 25 bp, Homo sapien
gccaaggagtacagtcactgtgcct

SEQ ID NO: 128284 - DNA, 25 bp, Homo sapien
gaccatagtcagagtggaaatccta

SEQ ID NO: 128285 - DNA, 25 bp, Homo sapien
ggaacttttacttcattaacagact

SEQ ID NO: 128286 - DNA, 25 bp, Homo sapien
taacagacttacaggttacctccga

SEQ ID NO: 128287 - DNA, 25 bp, Homo sapien
ttacaggttacctccgaaactgaag

SEQ ID NO: 128288 - DNA, 25 bp, Homo sapien
gaaactgaagatctcctagcctgtc

SEQ ID NO: 128289 - DNA, 25 bp, Homo sapien
cctctgggactggacaattgcttca

SEQ ID NO: 128290 - DNA, 25 bp, Homo sapien
gggactggacaattgcttcaagcat

SEQ ID NO: 128291 - DNA, 25 bp, Homo sapien
gcattcttcaaccagcagatgctgt

SEQ ID NO: 128292 - DNA, 25 bp, Homo sapien
gatgctgtttaagtgactgatggct

SEQ ID NO: 128293 - DNA, 25 bp, Homo sapien
gactgatggctaatgtactgcaaat

SEQ ID NO: 128294 - DNA, 25 bp, Homo sapien
ggcccctcgctgtgtggtcacgttc

SEQ ID NO: 128295 - DNA, 25 bp, Homo sapien
tgtggtcacgttcctgcagtcagag

SEQ ID NO: 128296 - DNA, 25 bp, Homo sapien
gcagtcagaggatgggtccggcaaa

SEQ ID NO: 128297 - DNA, 25 bp, Homo sapien
tccggcaaaggtgcggccctggtca

SEQ ID NO: 128298 - DNA, 25 bp, Homo sapien
aaggtgcggccctggtcaccgctgt

SEQ ID NO: 128299 - DNA, 25 bp, Homo sapien
cgcagttgactcgtgtctgaggaaa

SEQ ID NO: 128300 - DNA, 25 bp, Homo sapien
gtgtctgaggaaacctccaggctga

SEQ ID NO: 128301 - DNA, 25 bp, Homo sapien
aggactcctgggacatcccatgtgt

SEQ ID NO: 128302 - DNA, 25 bp, Homo sapien
ggacatcccatgtgtgacccctctg

SEQ ID NO: 128303 - DNA, 25 bp, Homo sapien
gctccctggctttccctgagagaag

SEQ ID NO: 128304 - DNA, 25 bp, Homo sapien
gaagtagcactcaggttagcaatat

SEQ ID NO: 128305 - DNA, 25 bp, Homo sapien
agaattctgttacaaatcacgggca

SEQ ID NO: 128306 - DNA, 25 bp, Homo sapien
aatcacgggcagagtccaaacgcat

SEQ ID NO: 128307 - DNA, 25 bp, Homo sapien
acgggcagagtccaaacgcatgaaa

SEQ ID NO: 128308 - DNA, 25 bp, Homo sapien
gtccaaacgcatgaaactcacaaag

SEQ ID NO: 128309 - DNA, 25 bp, Homo sapien
atgaaactcacaaagaacacccaaa

SEQ ID NO: 128310 - DNA, 25 bp, Homo sapien
gaacacccaaaactttaagcctgct

SEQ ID NO: 128311 - DNA, 25 bp, Homo sapien
atgctacatacagagaaggctacaa

SEQ ID NO: 128312 - DNA, 25 bp, Homo sapien
aaggctacaacgtgtatggaacaga

SEQ ID NO: 128313 - DNA, 25 bp, Homo sapien
caacgtgtatggaacagagagtgtt

SEQ ID NO: 128314 - DNA, 25 bp, Homo sapien
cttcccactggaggcatgtgatgag

SEQ ID NO: 128315 - DNA, 25 bp, Homo sapien
tgatgagaggaaatcaccgaaaacg

SEQ ID NO: 128316 - DNA, 25 bp, Homo sapien
ggaactagaacccacatgttggtct

SEQ ID NO: 128317 - DNA, 25 bp, Homo sapien
atgttggtctaaaccctgagaaggt

SEQ ID NO: 128318 - DNA, 25 bp, Homo sapien
aaggtggcagtgaggaagtatcccc

SEQ ID NO: 128319 - DNA, 25 bp, Homo sapien
aagtatcccctcaggtgactggatc

SEQ ID NO: 128320 - DNA, 25 bp, Homo sapien
tgactggatctgtgttcctccttaa

SEQ ID NO: 128321 - DNA, 25 bp, Homo sapien
cactgttcaggacccctgcttttgt

SEQ ID NO: 128322 - DNA, 25 bp, Homo sapien
tttgtcacctactatttccctttag

SEQ ID NO: 128323 - DNA, 25 bp, Homo sapien
ttccctttagtttttagcagcggct

SEQ ID NO: 128324 - DNA, 25 bp, Homo sapien
gcagcggctggatgtgatatgtcta

SEQ ID NO: 128325 - DNA, 25 bp, Homo sapien
tatgtctagtttaaccagtcccctt

SEQ ID NO: 128326 - DNA, 25 bp, Homo sapien
cagtccccttgatctttctatataa

SEQ ID NO: 128327 - DNA, 25 bp, Homo sapien
tcagggtaagctgctctgaggtaaa

SEQ ID NO: 128328 - DNA, 25 bp, Homo sapien
taagctgctctgaggtaaaggtcca

SEQ ID NO: 128329 - DNA, 25 bp, Homo sapien
gctgctctgaggtaaaggtccatga

SEQ ID NO: 128330 - DNA, 25 bp, Homo sapien
gaggtaaaggtccatgaaccctgcc

SEQ ID NO: 128331 - DNA, 25 bp, Homo sapien
agccttttcagcaggttccagtgcc

SEQ ID NO: 128332 - DNA, 25 bp, Homo sapien
ttttcagcaggttccagtgcctgac

SEQ ID NO: 128333 - DNA, 25 bp, Homo sapien
ttcagcaggttccagtgcctgactt

SEQ ID NO: 128334 - DNA, 25 bp, Homo sapien
aggttccagtgcctgacttgggata

SEQ ID NO: 128335 - DNA, 25 bp, Homo sapien
ttccagtgcctgacttgggatagga

SEQ ID NO: 128336 - DNA, 25 bp, Homo sapien
agtgcctgacttgggataggactga

SEQ ID NO: 128337 - DNA, 25 bp, Homo sapien
agtggaggggcatagcctttcccta

SEQ ID NO: 128338 - DNA, 25 bp, Homo sapien
ttctcctggcgtgggagacgtctac

SEQ ID NO: 128339 - DNA, 25 bp, Homo sapien
gagacgtctacagggaagacaccag

SEQ ID NO: 128340 - DNA, 25 bp, Homo sapien
aagacaccagcgtttgggcttctaa

SEQ ID NO: 128341 - DNA, 25 bp, Homo sapien
gtttgggcttctaaccaccctgtct

SEQ ID NO: 128342 - DNA, 25 bp, Homo sapien
gagagatgctgagcccagcgaatcc

SEQ ID NO: 128343 - DNA, 25 bp, Homo sapien
cagcgaatcctctccattgaaggat

SEQ ID NO: 128344 - DNA, 25 bp, Homo sapien
agaagaaaactcaactcagtgccat

SEQ ID NO: 128345 - DNA, 25 bp, Homo sapien
actcagtgccattttacgaatatat

SEQ ID NO: 128346 - DNA, 25 bp, Homo sapien
gcgtttatatttatacttccttgtc

SEQ ID NO: 128347 - DNA, 25 bp, Homo sapien
ttatacttccttgtctattatatct

SEQ ID NO: 128348 - DNA, 25 bp, Homo sapien
gtattttgacattgtaccttgtata

SEQ ID NO: 128349 - DNA, 25 bp, Homo sapien
tccccaaagtcttgaggcaaggtct

SEQ ID NO: 128350 - DNA, 25 bp, Homo sapien
ccccaaagtcttgaggcaaggtctc

SEQ ID NO: 128351 - DNA, 25 bp, Homo sapien
taatgcactacagtctgaaactcct

SEQ ID NO: 128352 - DNA, 25 bp, Homo sapien
tcaaacagtcgtcctgcctaagctt

SEQ ID NO: 128353 - DNA, 25 bp, Homo sapien
caaacagtcgtcctgcctaagcttc

SEQ ID NO: 128354 - DNA, 25 bp, Homo sapien
gattacaagcgtgcatccctgtgcc

SEQ ID NO: 128355 - DNA, 25 bp, Homo sapien
aagcgtgcatccctgtgccccagtg

SEQ ID NO: 128356 - DNA, 25 bp, Homo sapien
cctgtgccccagtgattaagtttta

SEQ ID NO: 128357 - DNA, 25 bp, Homo sapien
ctgtgccccagtgattaagttttat

SEQ ID NO: 128358 - DNA, 25 bp, Homo sapien
gtgccccagtgattaagttttatta

SEQ ID NO: 128359 - DNA, 25 bp, Homo sapien
gccccagtgattaagttttattatg

SEQ ID NO: 128360 - DNA, 25 bp, Homo sapien
actcctacccgagaggaaggaagtg

SEQ ID NO: 128361 - DNA, 25 bp, Homo sapien
gaagagactgatgagatggaccaag

SEQ ID NO: 128362 - DNA, 25 bp, Homo sapien
ggaccaagtagaactggtggacttt

SEQ ID NO: 128363 - DNA, 25 bp, Homo sapien
ggtggactttgatccaaatcaggaa

SEQ ID NO: 128364 - DNA, 25 bp, Homo sapien
aaatcaggaaagacggcgccactac

SEQ ID NO: 128365 - DNA, 25 bp, Homo sapien
aagacggcgccactacaatggagaa

SEQ ID NO: 128366 - DNA, 25 bp, Homo sapien
ggcgccactacaatggagaagcata

SEQ ID NO: 128367 - DNA, 25 bp, Homo sapien
agtgaataacactcactgctggcat

SEQ ID NO: 128368 - DNA, 25 bp, Homo sapien
gctggcatttaatgtgcagtagtga

SEQ ID NO: 128369 - DNA, 25 bp, Homo sapien
gaaggactgtaatcataatatgctc

SEQ ID NO: 128370 - DNA, 25 bp, Homo sapien
ataatatgctcactacttgctcttg

SEQ ID NO: 128371 - DNA, 25 bp, Homo sapien
tggccttgcgcgaaatccgtcgcta

SEQ ID NO: 128372 - DNA, 25 bp, Homo sapien
ccaggacttcaaaaccgacctgcgt

SEQ ID NO: 128373 - DNA, 25 bp, Homo sapien
ggcctacctggtgggactcttcgaa

SEQ ID NO: 128374 - DNA, 25 bp, Homo sapien
tacctggtgggactcttcgaagaca

SEQ ID NO: 128375 - DNA, 25 bp, Homo sapien
gggactcttcgaagacaccaatctg

SEQ ID NO: 128376 - DNA, 25 bp, Homo sapien
cttcgaagacaccaatctgtgcgct

SEQ ID NO: 128377 - DNA, 25 bp, Homo sapien
atctgtgcgctattcacgctaaacg

SEQ ID NO: 128378 - DNA, 25 bp, Homo sapien
attcacgctaaacgcgtcaccatca

SEQ ID NO: 128379 - DNA, 25 bp, Homo sapien
gcccaaagatatccagctggcacgt

SEQ ID NO: 128380 - DNA, 25 bp, Homo sapien
aagatatccagctggcacgtcgcat

SEQ ID NO: 128381 - DNA, 25 bp, Homo sapien
ccagctggcacgtcgcatccgtggg

SEQ ID NO: 128382 - DNA, 25 bp, Homo sapien
ggaaacttcggagaaaggcattaga

SEQ ID NO: 128383 - DNA, 25 bp, Homo sapien
gatctggaaagcttgagcctccttg

SEQ ID NO: 128384 - DNA, 25 bp, Homo sapien
agcctccttgggttcgtctataaat

SEQ ID NO: 128385 - DNA, 25 bp, Homo sapien
aaatatgaatgaagccctggagtac

SEQ ID NO: 128386 - DNA, 25 bp, Homo sapien
ctggagtactatgagcgggccctga

SEQ ID NO: 128387 - DNA, 25 bp, Homo sapien
gagaactctgtgagacaaggtcctt

SEQ ID NO: 128388 - DNA, 25 bp, Homo sapien
agacaaggtccttaggcacccagat

SEQ ID NO: 128389 - DNA, 25 bp, Homo sapien
aggtccttaggcacccagatatcag

SEQ ID NO: 128390 - DNA, 25 bp, Homo sapien
ccagatatcagccactttcacattt

SEQ ID NO: 128391 - DNA, 25 bp, Homo sapien
tttactaatcatcttttctgcttac

SEQ ID NO: 128392 - DNA, 25 bp, Homo sapien
tctgcttactgttttcagaaacatt

SEQ ID NO: 128393 - DNA, 25 bp, Homo sapien
tgaagactgtcttcctatctgcttc

SEQ ID NO: 128394 - DNA, 25 bp, Homo sapien
tatctgcttcttgcggctgaggaga

SEQ ID NO: 128395 - DNA, 25 bp, Homo sapien
gtgcaaattaccaaactcaaagctt

SEQ ID NO: 128396 - DNA, 25 bp, Homo sapien
agaatgggctcatgggcaatgtgat

SEQ ID NO: 128397 - DNA, 25 bp, Homo sapien
gcaatgtgatgttccctgttaacct

SEQ ID NO: 128398 - DNA, 25 bp, Homo sapien
tgttaaccttctgttactccctggg

SEQ ID NO: 128399 - DNA, 25 bp, Homo sapien
tttgctgtgtttttctccacttcta

SEQ ID NO: 128400 - DNA, 25 bp, Homo sapien
tctaaatggttcctggttcctttct

SEQ ID NO: 128401 - DNA, 25 bp, Homo sapien
ttcttcctcgtttgttactttagag

SEQ ID NO: 128402 - DNA, 25 bp, Homo sapien
tagagcaagtttgcccatagtcttg

SEQ ID NO: 128403 - DNA, 25 bp, Homo sapien
tgcccatagtcttgaatgcaatatt

SEQ ID NO: 128404 - DNA, 25 bp, Homo sapien
gtgagatttaagttcctgctgcctg

SEQ ID NO: 128405 - DNA, 25 bp, Homo sapien
tgctgcctgggtaggccccacaagg

SEQ ID NO: 128406 - DNA, 25 bp, Homo sapien
gcctggtctgggagtatacggaaac

SEQ ID NO: 128407 - DNA, 25 bp, Homo sapien
gtgcaaaatgtcttgtgtatttctc

SEQ ID NO: 128408 - DNA, 25 bp, Homo sapien
gtatttctctgtgaatccatgggtc

SEQ ID NO: 128409 - DNA, 25 bp, Homo sapien
aatccatgggtctggctagagggcc

SEQ ID NO: 128410 - DNA, 25 bp, Homo sapien
ctagagggcccaaagcttgtaaata

SEQ ID NO: 128411 - DNA, 25 bp, Homo sapien
gggatagtctgggtcagacccatct

SEQ ID NO: 128412 - DNA, 25 bp, Homo sapien
cttgcttccaagaccatttgtagtg

SEQ ID NO: 128413 - DNA, 25 bp, Homo sapien
gctgtgctacgtgtgaaatctgtct

SEQ ID NO: 128414 - DNA, 25 bp, Homo sapien
ctgtctcagtgattcgcttttggta

SEQ ID NO: 128415 - DNA, 25 bp, Homo sapien
cgctgggccggctgacaggctacca

SEQ ID NO: 128416 - DNA, 25 bp, Homo sapien
cggctgacaggctaccagctgggca

SEQ ID NO: 128417 - DNA, 25 bp, Homo sapien
ggtcttgtgggacgtggcgctggtc

SEQ ID NO: 128418 - DNA, 25 bp, Homo sapien
ggcctggctcttctggctggcctgc

SEQ ID NO: 128419 - DNA, 25 bp, Homo sapien
tgtgtgccaccacagaggccctgga

SEQ ID NO: 128420 - DNA, 25 bp, Homo sapien
tgccaccacagaggccctggattga

SEQ ID NO: 128421 - DNA, 25 bp, Homo sapien
accacagaggccctggattgagcca

SEQ ID NO: 128422 - DNA, 25 bp, Homo sapien
acagaggccctggattgagccaggc

SEQ ID NO: 128423 - DNA, 25 bp, Homo sapien
gggccagtccctgaggcaggtcccc

SEQ ID NO: 128424 - DNA, 25 bp, Homo sapien
aggcaggtccccagactccaccaag

SEQ ID NO: 128425 - DNA, 25 bp, Homo sapien
ctggtcagcccaaaccaccagaagc

SEQ ID NO: 128426 - DNA, 25 bp, Homo sapien
aagctaggtctaggtctacactcct

SEQ ID NO: 128427 - DNA, 25 bp, Homo sapien
taggtctacactcctaggacgcacg

SEQ ID NO: 128428 - DNA, 25 bp, Homo sapien
ggacgcacgcatatcagcccgtgta

SEQ ID NO: 128429 - DNA, 25 bp, Homo sapien
cgtgtaccctgtgacagtgactgtc

SEQ ID NO: 128430 - DNA, 25 bp, Homo sapien
acctcctgtgttagtggtgccctta

SEQ ID NO: 128431 - DNA, 25 bp, Homo sapien
gctcatccactcgtgtgggacgtag

SEQ ID NO: 128432 - DNA, 25 bp, Homo sapien
gtgtagggaacactgccctggctca

SEQ ID NO: 128433 - DNA, 25 bp, Homo sapien
cctggctcagcgtgcgagctaaggt

SEQ ID NO: 128434 - DNA, 25 bp, Homo sapien
gcgatgtatgcgatgggactctgca

SEQ ID NO: 128435 - DNA, 25 bp, Homo sapien
atgggactctgcatgggatagtaca

SEQ ID NO: 128436 - DNA, 25 bp, Homo sapien
gtacagttgtgtagacgtcttccaa

SEQ ID NO: 128437 - DNA, 25 bp, Homo sapien
attcattaagggagcttgtcctaaa

SEQ ID NO: 128438 - DNA, 25 bp, Homo sapien
aaagctatggctttaatgcagcaag

SEQ ID NO: 128439 - DNA, 25 bp, Homo sapien
gcagcaaggcttgctaatctcccag

SEQ ID NO: 128440 - DNA, 25 bp, Homo sapien
aatctcccagaggaagttattcaaa

SEQ ID NO: 128441 - DNA, 25 bp, Homo sapien
atcagtcactacgattatttcggga

SEQ ID NO: 128442 - DNA, 25 bp, Homo sapien
atttcgggaagtttgcctggctagt

SEQ ID NO: 128443 - DNA, 25 bp, Homo sapien
gcctggctagtgaaaggtcaactgt

SEQ ID NO: 128444 - DNA, 25 bp, Homo sapien
gtcaactgtagatgctgaagctgtc

SEQ ID NO: 128445 - DNA, 25 bp, Homo sapien
gaagctgtccataaattgctgactt

SEQ ID NO: 128446 - DNA, 25 bp, Homo sapien
gactgactacattggaagctttgag

SEQ ID NO: 128447 - DNA, 25 bp, Homo sapien
aagctttgagttgacttctgaccaa

SEQ ID NO: 128448 - DNA, 25 bp, Homo sapien
gaggccgggcggtcacagcatggag

SEQ ID NO: 128449 - DNA, 25 bp, Homo sapien
tggtgttcttattctggcggcagcg

SEQ ID NO: 128450 - DNA, 25 bp, Homo sapien
tattctggcggcagcgcctttcctg

SEQ ID NO: 128451 - DNA, 25 bp, Homo sapien
gcctttcctgccatgtttagtgaat

SEQ ID NO: 128452 - DNA, 25 bp, Homo sapien
gtttagtgaatgacttttctcgcat

SEQ ID NO: 128453 - DNA, 25 bp, Homo sapien
gaatgacttttctcgcattgtagaa

SEQ ID NO: 128454 - DNA, 25 bp, Homo sapien
aattgtatatagactctggtgttct

SEQ ID NO: 128455 - DNA, 25 bp, Homo sapien
ctggtgttctattgctgagaagcaa

SEQ ID NO: 128456 - DNA, 25 bp, Homo sapien
tgctgagaagcaaaccgccctgcag

SEQ ID NO: 128457 - DNA, 25 bp, Homo sapien
agcctgtaccggtttggctggcttg

SEQ ID NO: 128458 - DNA, 25 bp, Homo sapien
tttggctggcttgtttgatttcaac

SEQ ID NO: 128459 - DNA, 25 bp, Homo sapien
atcagttactggtttcagttgacaa

SEQ ID NO: 128460 - DNA, 25 bp, Homo sapien
ggtttactgctgtcattgtccatgc

SEQ ID NO: 128461 - DNA, 25 bp, Homo sapien
gtcattgtccatgcctacagataat

SEQ ID NO: 128462 - DNA, 25 bp, Homo sapien
acatttgtacattcctgatactggg

SEQ ID NO: 128463 - DNA, 25 bp, Homo sapien
ctgatactgggtacaagagccatgt

SEQ ID NO: 128464 - DNA, 25 bp, Homo sapien
taccagtgtactgctttcaacttaa

SEQ ID NO: 128465 - DNA, 25 bp, Homo sapien
ttcaacttaaatcactgaggcattt

SEQ ID NO: 128466 - DNA, 25 bp, Homo sapien
gaggcatttttactactattctgtt

SEQ ID NO: 128467 - DNA, 25 bp, Homo sapien
taaaatcaggattttagtgcttgcc

SEQ ID NO: 128468 - DNA, 25 bp, Homo sapien
gtgcttgccaccaccagatgagaag

SEQ ID NO: 128469 - DNA, 25 bp, Homo sapien
aagttaagcagcctttctgtggaga

SEQ ID NO: 128470 - DNA, 25 bp, Homo sapien
gagctcttggaggtgtctgtatcag

SEQ ID NO: 128471 - DNA, 25 bp, Homo sapien
atcccctgtgggaaattagtaggct

SEQ ID NO: 128472 - DNA, 25 bp, Homo sapien
ttagtaggctcatttactgttttag

SEQ ID NO: 128473 - DNA, 25 bp, Homo sapien
taacatacctaagcaaacccagtgt

SEQ ID NO: 128474 - DNA, 25 bp, Homo sapien
agtgtcaggatggtaattcttattc

SEQ ID NO: 128475 - DNA, 25 bp, Homo sapien
ggtaattcttattctttcgttcagt

SEQ ID NO: 128476 - DNA, 25 bp, Homo sapien
tcatctgggcactgaagggatatgt

SEQ ID NO: 128477 - DNA, 25 bp, Homo sapien
tgttaacatttttggtagtcttcaa

SEQ ID NO: 128478 - DNA, 25 bp, Homo sapien
tggtagtcttcaaccagggattgtt

SEQ ID NO: 128479 - DNA, 25 bp, Homo sapien
acttcttataggaaagcttgagtaa

SEQ ID NO: 128480 - DNA, 25 bp, Homo sapien
aatattgtctttttgtatgtcaagc

SEQ ID NO: 128481 - DNA, 25 bp, Homo sapien
gcccggagggtggagattgccgcca

SEQ ID NO: 128482 - DNA, 25 bp, Homo sapien
attgccgccaccctggagctcaatg

SEQ ID NO: 128483 - DNA, 25 bp, Homo sapien
tggagctcaatgaaacacaggtcaa

SEQ ID NO: 128484 - DNA, 25 bp, Homo sapien
caatgaaacacaggtcaagatttgg

SEQ ID NO: 128485 - DNA, 25 bp, Homo sapien
gaaccgacgaatgaagcagaagaag

SEQ ID NO: 128486 - DNA, 25 bp, Homo sapien
tggagatgcctcagaccagtcgaca

SEQ ID NO: 128487 - DNA, 25 bp, Homo sapien
gagatgcctcagaccagtcgacatg

SEQ ID NO: 128488 - DNA, 25 bp, Homo sapien
atgcctcagaccagtcgacatgcac

SEQ ID NO: 128489 - DNA, 25 bp, Homo sapien
tctgtcacctcctgaactgaaccta

SEQ ID NO: 128490 - DNA, 25 bp, Homo sapien
tgaactgaacctagccaccaatggg

SEQ ID NO: 128491 - DNA, 25 bp, Homo sapien
gcttccaggcactggagcgccccag

SEQ ID NO: 128492 - DNA, 25 bp, Homo sapien
tagctgagtgtagtgacgcatgccc

SEQ ID NO: 128493 - DNA, 25 bp, Homo sapien
agctgagtgtagtgacgcatgccct

SEQ ID NO: 128494 - DNA, 25 bp, Homo sapien
gctgagtgtagtgacgcatgccctc

SEQ ID NO: 128495 - DNA, 25 bp, Homo sapien
ctgagtgtagtgacgcatgccctca

SEQ ID NO: 128496 - DNA, 25 bp, Homo sapien
tgagtgtagtgacgcatgccctcaa

SEQ ID NO: 128497 - DNA, 25 bp, Homo sapien
agtgtagtgacgcatgccctcaatc

SEQ ID NO: 128498 - DNA, 25 bp, Homo sapien
gtgtagtgacgcatgccctcaatcc

SEQ ID NO: 128499 - DNA, 25 bp, Homo sapien
tgtagtgacgcatgccctcaatccc

SEQ ID NO: 128500 - DNA, 25 bp, Homo sapien
aatcacttgcactccggaggtagag

SEQ ID NO: 128501 - DNA, 25 bp, Homo sapien
cacttgcactccggaggtagaggtt

SEQ ID NO: 128502 - DNA, 25 bp, Homo sapien
cttgcactccggaggtagaggttgt

SEQ ID NO: 128503 - DNA, 25 bp, Homo sapien
gagacagtttcttagctttttaatt

SEQ ID NO: 128504 - DNA, 25 bp, Homo sapien
tctttctagtggtctttgtaagagt

SEQ ID NO: 128505 - DNA, 25 bp, Homo sapien
tgtaagagtgtagaagcattccttc

SEQ ID NO: 128506 - DNA, 25 bp, Homo sapien
gagtgtagaagcattccttctttga

SEQ ID NO: 128507 - DNA, 25 bp, Homo sapien
tagaagcattccttctttgataatg

SEQ ID NO: 128508 - DNA, 25 bp, Homo sapien
aaagctattagccaggatcatggtg

SEQ ID NO: 128509 - DNA, 25 bp, Homo sapien
ctattagccaggatcatggtgtaat

SEQ ID NO: 128510 - DNA, 25 bp, Homo sapien
ccaggatcatggtgtaataagacat

SEQ ID NO: 128511 - DNA, 25 bp, Homo sapien
aaaaatttaagtgcgtgtgtagagt

SEQ ID NO: 128512 - DNA, 25 bp, Homo sapien
gcgtgtgtagagttaagaagctgtt

SEQ ID NO: 128513 - DNA, 25 bp, Homo sapien
tagagttaagaagctgttgtacatt

SEQ ID NO: 128514 - DNA, 25 bp, Homo sapien
gaagacaccctaatgtggcagctgt

SEQ ID NO: 128515 - DNA, 25 bp, Homo sapien
tggcagctgtctcaaacctccaaaa

SEQ ID NO: 128516 - DNA, 25 bp, Homo sapien
gtctcaaacctccaaaagccctgag

SEQ ID NO: 128517 - DNA, 25 bp, Homo sapien
aagccctgagtttcaagtatccttg

SEQ ID NO: 128518 - DNA, 25 bp, Homo sapien
agtatccttgttgacacggccatga

SEQ ID NO: 128519 - DNA, 25 bp, Homo sapien
ttccccgtgggccatggcaattttt

SEQ ID NO: 128520 - DNA, 25 bp, Homo sapien
gggccatggcaatttttacacaaac

SEQ ID NO: 128521 - DNA, 25 bp, Homo sapien
gtcttatttttgttggagccactct

SEQ ID NO: 128522 - DNA, 25 bp, Homo sapien
tttgttggagccactctgttcctgg

SEQ ID NO: 128523 - DNA, 25 bp, Homo sapien
tggctcagcctcaaatgcagtattt

SEQ ID NO: 128524 - DNA, 25 bp, Homo sapien
taacggcactgtggccttggtctaa

SEQ ID NO: 128525 - DNA, 25 bp, Homo sapien
gccgtctactggaaaaatcgagcct

SEQ ID NO: 128526 - DNA, 25 bp, Homo sapien
tactggaaaaatcgagcctctccca

SEQ ID NO: 128527 - DNA, 25 bp, Homo sapien
caccctcagtcgcatagacttatgt

SEQ ID NO: 128528 - DNA, 25 bp, Homo sapien
agtcgcatagacttatgtgttttgc

SEQ ID NO: 128529 - DNA, 25 bp, Homo sapien
tactgaattagcgtttaatccactt

SEQ ID NO: 128530 - DNA, 25 bp, Homo sapien
aaaatattgggcactcggttatctt

SEQ ID NO: 128531 - DNA, 25 bp, Homo sapien
tgggcactcggttatcttttaaaat

SEQ ID NO: 128532 - DNA, 25 bp, Homo sapien
ttccgtttggtagactccttccaat

SEQ ID NO: 128533 - DNA, 25 bp, Homo sapien
gactccttccaatgaaatctcagga

SEQ ID NO: 128534 - DNA, 25 bp, Homo sapien
taactagagggacctattttcctct

SEQ ID NO: 128535 - DNA, 25 bp, Homo sapien
tcctcttttttatgttttagactgt

SEQ ID NO: 128536 - DNA, 25 bp, Homo sapien
ttattaacaattcccccagaacatg

SEQ ID NO: 128537 - DNA, 25 bp, Homo sapien
ataaccattgtttacagagctgagc

SEQ ID NO: 128538 - DNA, 25 bp, Homo sapien
tttacagagctgagcattggtgaca

SEQ ID NO: 128539 - DNA, 25 bp, Homo sapien
attggtgacagggtctgacatggtc

SEQ ID NO: 128540 - DNA, 25 bp, Homo sapien
gggtctgacatggtcagtctactaa

SEQ ID NO: 128541 - DNA, 25 bp, Homo sapien
aatacggtggcaatattatgtaacc

SEQ ID NO: 128542 - DNA, 25 bp, Homo sapien
ttatgtaaccttttttcctatgaag

SEQ ID NO: 128543 - DNA, 25 bp, Homo sapien
tgaagttttttgtaggtccttgttg

SEQ ID NO: 128544 - DNA, 25 bp, Homo sapien
tgtaggtccttgttgtaactaattt

SEQ ID NO: 128545 - DNA, 25 bp, Homo sapien
taggatgagtttctatgttgtatat

SEQ ID NO: 128546 - DNA, 25 bp, Homo sapien
agattgattttctcagcacaaaata

SEQ ID NO: 128547 - DNA, 25 bp, Homo sapien
gaagtccactgaactgcttattcgt

SEQ ID NO: 128548 - DNA, 25 bp, Homo sapien
gtccactgaactgcttattcgtaaa

SEQ ID NO: 128549 - DNA, 25 bp, Homo sapien
cactgaactgcttattcgtaaacta

SEQ ID NO: 128550 - DNA, 25 bp, Homo sapien
gaactgcttattcgtaaactacctt

SEQ ID NO: 128551 - DNA, 25 bp, Homo sapien
gcttattcgtaaactacctttccag

SEQ ID NO: 128552 - DNA, 25 bp, Homo sapien
tattcgtaaactacctttccagcgc

SEQ ID NO: 128553 - DNA, 25 bp, Homo sapien
taaactacctttccagcgcctagtg

SEQ ID NO: 128554 - DNA, 25 bp, Homo sapien
tttccagcgcctagtgcgcgagatt

SEQ ID NO: 128555 - DNA, 25 bp, Homo sapien
tagtgcgcgagattgcgcaggactt

SEQ ID NO: 128556 - DNA, 25 bp, Homo sapien
gcgagattgcgcaggactttaaaac

SEQ ID NO: 128557 - DNA, 25 bp, Homo sapien
agggctatttgaggacactaacctg

SEQ ID NO: 128558 - DNA, 25 bp, Homo sapien
gtccctggtaataagtactgtgtac

SEQ ID NO: 128559 - DNA, 25 bp, Homo sapien
gtactgtgtacagaattctgctacc

SEQ ID NO: 128560 - DNA, 25 bp, Homo sapien
tacagaattctgctacctcactggg

SEQ ID NO: 128561 - DNA, 25 bp, Homo sapien
agcctcatccgaggcagggtcagga

SEQ ID NO: 128562 - DNA, 25 bp, Homo sapien
gggcagaacagccgctcctgtctgc

SEQ ID NO: 128563 - DNA, 25 bp, Homo sapien
agccagctctcagccaacgagtaat

SEQ ID NO: 128564 - DNA, 25 bp, Homo sapien
agctctcagccaacgagtaatttat

SEQ ID NO: 128565 - DNA, 25 bp, Homo sapien
ctcagccaacgagtaatttattgtt

SEQ ID NO: 128566 - DNA, 25 bp, Homo sapien
atatagaagggtaccttgaacactg

SEQ ID NO: 128567 - DNA, 25 bp, Homo sapien
agggccccagcactaaagcagtgga

SEQ ID NO: 128568 - DNA, 25 bp, Homo sapien
caggagtccctggtaataagtactg

SEQ ID NO: 128569 - DNA, 25 bp, Homo sapien
gggcaacgcggctcgggacaacaag

SEQ ID NO: 128570 - DNA, 25 bp, Homo sapien
gcccagggcggcgtcttgcctaaca

SEQ ID NO: 128571 - DNA, 25 bp, Homo sapien
caaagggcaagtgaggctgacgtcc

SEQ ID NO: 128572 - DNA, 25 bp, Homo sapien
gcaagtgaggctgacgtccggccca

SEQ ID NO: 128573 - DNA, 25 bp, Homo sapien
caagtgaggctgacgtccggcccaa

SEQ ID NO: 128574 - DNA, 25 bp, Homo sapien
agtgaggctgacgtccggcccaagt

SEQ ID NO: 128575 - DNA, 25 bp, Homo sapien
tgaggctgacgtccggcccaagtgg

SEQ ID NO: 128576 - DNA, 25 bp, Homo sapien
tgacgtccggcccaagtgggcccag

SEQ ID NO: 128577 - DNA, 25 bp, Homo sapien
gcccgcgtctcgaaggggcacctgt

SEQ ID NO: 128578 - DNA, 25 bp, Homo sapien
gcacctgtgaactcaaaaggctctt

SEQ ID NO: 128579 - DNA, 25 bp, Homo sapien
cctgtgaactcaaaaggctcttttc

SEQ ID NO: 128580 - DNA, 25 bp, Homo sapien
actatccggcgcttggcccggcatg

SEQ ID NO: 128581 - DNA, 25 bp, Homo sapien
ggcatggcggtgtcaagcgcatctt

SEQ ID NO: 128582 - DNA, 25 bp, Homo sapien
caagcgcatcttgggcctcatttat

SEQ ID NO: 128583 - DNA, 25 bp, Homo sapien
gtgttcctggaaaatgtgatctggt

SEQ ID NO: 128584 - DNA, 25 bp, Homo sapien
aaatgtgatctggtacgccgtgacc

SEQ ID NO: 128585 - DNA, 25 bp, Homo sapien
tggtacgccgtgaccaacacggagc

SEQ ID NO: 128586 - DNA, 25 bp, Homo sapien
atggccgtggtctacgtgctcaaac

SEQ ID NO: 128587 - DNA, 25 bp, Homo sapien
ggtgccaagtgccatcgcaaggtac

SEQ ID NO: 128588 - DNA, 25 bp, Homo sapien
aagtgccatcgcaaggtactgagcg

SEQ ID NO: 128589 - DNA, 25 bp, Homo sapien
gagcgataatattcagggcattacc

SEQ ID NO: 128590 - DNA, 25 bp, Homo sapien
gggcattaccaagtgcactatccgg

SEQ ID NO: 128591 - DNA, 25 bp, Homo sapien
ttcctgacctcaccgaaaagactaa

SEQ ID NO: 128592 - DNA, 25 bp, Homo sapien
caccgaaaagactaatgtgccttag

SEQ ID NO: 128593 - DNA, 25 bp, Homo sapien
atgtgccttagaacaagcatttgct

SEQ ID NO: 128594 - DNA, 25 bp, Homo sapien
tggttccaggacagaccctcagctt

SEQ ID NO: 128595 - DNA, 25 bp, Homo sapien
gcttcccaagaggatactgctgcca

SEQ ID NO: 128596 - DNA, 25 bp, Homo sapien
caagaggatactgctgccaagaagt

SEQ ID NO: 128597 - DNA, 25 bp, Homo sapien
tgctgccaagaagttgctctgaagt

SEQ ID NO: 128598 - DNA, 25 bp, Homo sapien
gctctgaagtcagtttctatcgttc

SEQ ID NO: 128599 - DNA, 25 bp, Homo sapien
aagtcagtttctatcgttctgctct

SEQ ID NO: 128600 - DNA, 25 bp, Homo sapien
ctatcgttctgctctttgattcaaa

SEQ ID NO: 128601 - DNA, 25 bp, Homo sapien
aaagcactgtttctctcactgggcc

SEQ ID NO: 128602 - DNA, 25 bp, Homo sapien
gggcgctgccagatctcacggtgaa

SEQ ID NO: 128603 - DNA, 25 bp, Homo sapien
gatctcacggtgaaccattttggca

SEQ ID NO: 128604 - DNA, 25 bp, Homo sapien
gaaccattttggcagaatacagcat

SEQ ID NO: 128605 - DNA, 25 bp, Homo sapien
tttggcagaatacagcatggttccc

SEQ ID NO: 128606 - DNA, 25 bp, Homo sapien
acagcatggttcccacatgcattta

SEQ ID NO: 128607 - DNA, 25 bp, Homo sapien
ccacatgcatttatgcacagaagaa

SEQ ID NO: 128608 - DNA, 25 bp, Homo sapien
gatttatcaggatgtgagcactcgt

SEQ ID NO: 128609 - DNA, 25 bp, Homo sapien
tttctagttttcttatcaggatgtg

SEQ ID NO: 128610 - DNA, 25 bp, Homo sapien
tttcttatcaggatgtgagcactcg

SEQ ID NO: 128611 - DNA, 25 bp, Homo sapien
cttatcaggatgtgagcactcgttg

SEQ ID NO: 128612 - DNA, 25 bp, Homo sapien
attttctagttttccactattattg

SEQ ID NO: 128613 - DNA, 25 bp, Homo sapien
ggctggcttcaaaatatagtcatta

SEQ ID NO: 128614 - DNA, 25 bp, Homo sapien
aactaactttatgtgcacctgtgta

SEQ ID NO: 128615 - DNA, 25 bp, Homo sapien
aaatcctgtatgctttctttgcctt

SEQ ID NO: 128616 - DNA, 25 bp, Homo sapien
ctgttctcagggtgacgactgccac

SEQ ID NO: 128617 - DNA, 25 bp, Homo sapien
gtgacgactgccaccaggagatgca

SEQ ID NO: 128618 - DNA, 25 bp, Homo sapien
aggagatgcagttctagttcttaaa

SEQ ID NO: 128619 - DNA, 25 bp, Homo sapien
aatttgcccaggtttctgacaggtg

SEQ ID NO: 128620 - DNA, 25 bp, Homo sapien
tgatacctggaagagagactatgtc

SEQ ID NO: 128621 - DNA, 25 bp, Homo sapien
gtcttctcttacttaatacataacc

SEQ ID NO: 128622 - DNA, 25 bp, Homo sapien
taaccatctttgattaccagctaag

SEQ ID NO: 128623 - DNA, 25 bp, Homo sapien
gctaagatgcgaaatcactgtactg

SEQ ID NO: 128624 - DNA, 25 bp, Homo sapien
gacagtggctatgcatcacagcctt

SEQ ID NO: 128625 - DNA, 25 bp, Homo sapien
aaaagggcagtcaggcaaaaagatg

SEQ ID NO: 128626 - DNA, 25 bp, Homo sapien
agatgcgaaaacagacatgtcaaga

SEQ ID NO: 128627 - DNA, 25 bp, Homo sapien
aaagaggcagctggatctctgctcc

SEQ ID NO: 128628 - DNA, 25 bp, Homo sapien
ccaccttgctggaattcgtacatgt

SEQ ID NO: 128629 - DNA, 25 bp, Homo sapien
gaattcgtacatgtttaggttccct

SEQ ID NO: 128630 - DNA, 25 bp, Homo sapien
taggttccctaataagtactgcaaa

SEQ ID NO: 128631 - DNA, 25 bp, Homo sapien
atacttaaagtgtggcaatactctt

SEQ ID NO: 128632 - DNA, 25 bp, Homo sapien
ggcaatactctttcacttaattctt

SEQ ID NO: 128633 - DNA, 25 bp, Homo sapien
agggatatcaaagccataatggact

SEQ ID NO: 128634 - DNA, 25 bp, Homo sapien
atggacttcattagttttagggtag

SEQ ID NO: 128635 - DNA, 25 bp, Homo sapien
gacaagtagttatggctaaggacat

SEQ ID NO: 128636 - DNA, 25 bp, Homo sapien
aaattgtcagaatggcaggtggctt

SEQ ID NO: 128637 - DNA, 25 bp, Homo sapien
tggcaggtggcttcttaacagccat

SEQ ID NO: 128638 - DNA, 25 bp, Homo sapien
taacagccatgtgagaagcagacag

SEQ ID NO: 128639 - DNA, 25 bp, Homo sapien
aatctggaatccctttctcattagc

SEQ ID NO: 128640 - DNA, 25 bp, Homo sapien
ggaatccctttctcattagcatgaa

SEQ ID NO: 128641 - DNA, 25 bp, Homo sapien
gcatgaatgaacctgatacacaatt

SEQ ID NO: 128642 - DNA, 25 bp, Homo sapien
tatgaccagaaaatatggctccatg

SEQ ID NO: 128643 - DNA, 25 bp, Homo sapien
aagtaatgtatgtgcgctctgtaaa

SEQ ID NO: 128644 - DNA, 25 bp, Homo sapien
gtatgtgcgctctgtaaagtgatta

SEQ ID NO: 128645 - DNA, 25 bp, Homo sapien
gtgattacatttgtttcctgtttgt

SEQ ID NO: 128646 - DNA, 25 bp, Homo sapien
gcattgttgcccatcttctatgtca

SEQ ID NO: 128647 - DNA, 25 bp, Homo sapien
acctccagtgactaccgggtacaga

SEQ ID NO: 128648 - DNA, 25 bp, Homo sapien
gtacagaccaccaccatgtgcgtgt

SEQ ID NO: 128649 - DNA, 25 bp, Homo sapien
atgtgcgtgtcagtcagcctcagcg

SEQ ID NO: 128650 - DNA, 25 bp, Homo sapien
agcctcagcggctccgtggtgcttg

SEQ ID NO: 128651 - DNA, 25 bp, Homo sapien
ttccagccgcagaagaacgtggtta

SEQ ID NO: 128652 - DNA, 25 bp, Homo sapien
gaagaacgtggttagccaccgggca

SEQ ID NO: 128653 - DNA, 25 bp, Homo sapien
accagccgctttggcagtgctgctg

SEQ ID NO: 128654 - DNA, 25 bp, Homo sapien
tccccactgtttgcaatggccgtga

SEQ ID NO: 128655 - DNA, 25 bp, Homo sapien
gaggtggtggactcgacaacgtcat

SEQ ID NO: 128656 - DNA, 25 bp, Homo sapien
ggactcgacaacgtcatcgctttga

SEQ ID NO: 128657 - DNA, 25 bp, Homo sapien
gcaagtgaggctgacgtccggccca

SEQ ID NO: 128658 - DNA, 25 bp, Homo sapien
caagtgaggctgacgtccggcccaa

SEQ ID NO: 128659 - DNA, 25 bp, Homo sapien
aagtgaggctgacgtccggcccaag

SEQ ID NO: 128660 - DNA, 25 bp, Homo sapien
agtgaggctgacgtccggcccaagt

SEQ ID NO: 128661 - DNA, 25 bp, Homo sapien
gtgaggctgacgtccggcccaagtg

SEQ ID NO: 128662 - DNA, 25 bp, Homo sapien
tgaggctgacgtccggcccaagtgg

SEQ ID NO: 128663 - DNA, 25 bp, Homo sapien
gaggctgacgtccggcccaagtggg

SEQ ID NO: 128664 - DNA, 25 bp, Homo sapien
aggctgacgtccggcccaagtgggc

SEQ ID NO: 128665 - DNA, 25 bp, Homo sapien
tgacgtccggcccaagtgggcccag

SEQ ID NO: 128666 - DNA, 25 bp, Homo sapien
gacgtccggcccaagtgggcccagc

SEQ ID NO: 128667 - DNA, 25 bp, Homo sapien
gcccgcgtctcgaaggggcacctgt

SEQ ID NO: 128668 - DNA, 25 bp, Homo sapien
ggagtgttaagcaacatcctgttca

SEQ ID NO: 128669 - DNA, 25 bp, Homo sapien
gagtgttaagcaacatcctgttcag

SEQ ID NO: 128670 - DNA, 25 bp, Homo sapien
aacatcctgttcagctgtatgggca

SEQ ID NO: 128671 - DNA, 25 bp, Homo sapien
acatcctgttcagctgtatgggcac

SEQ ID NO: 128672 - DNA, 25 bp, Homo sapien
atcctgttcagctgtatgggcacta

SEQ ID NO: 128673 - DNA, 25 bp, Homo sapien
cctgttcagctgtatgggcactagt

SEQ ID NO: 128674 - DNA, 25 bp, Homo sapien
tgttcagctgtatgggcactagtcc

SEQ ID NO: 128675 - DNA, 25 bp, Homo sapien
gttcagctgtatgggcactagtccc

SEQ ID NO: 128676 - DNA, 25 bp, Homo sapien
cagctgtatgggcactagtccctta

SEQ ID NO: 128677 - DNA, 25 bp, Homo sapien
tatttagttaactactatagggact

SEQ ID NO: 128678 - DNA, 25 bp, Homo sapien
gtgaacttttacattgtgaattgtg

SEQ ID NO: 128679 - DNA, 25 bp, Homo sapien
accggcatctcctctaaagccatgg

SEQ ID NO: 128680 - DNA, 25 bp, Homo sapien
ccggcatctcctctaaagccatggg

SEQ ID NO: 128681 - DNA, 25 bp, Homo sapien
cggcatctcctctaaagccatgggg

SEQ ID NO: 128682 - DNA, 25 bp, Homo sapien
ggcatctcctctaaagccatgggga

SEQ ID NO: 128683 - DNA, 25 bp, Homo sapien
gcatctcctctaaagccatggggat

SEQ ID NO: 128684 - DNA, 25 bp, Homo sapien
catctcctctaaagccatggggatc

SEQ ID NO: 128685 - DNA, 25 bp, Homo sapien
atctcctctaaagccatggggatca

SEQ ID NO: 128686 - DNA, 25 bp, Homo sapien
tctcctctaaagccatggggatcat

SEQ ID NO: 128687 - DNA, 25 bp, Homo sapien
ctcctctaaagccatggggatcatg

SEQ ID NO: 128688 - DNA, 25 bp, Homo sapien
ctctaaagccatggggatcatgaat

SEQ ID NO: 128689 - DNA, 25 bp, Homo sapien
gatcatgaattcctttgtcaacgac

SEQ ID NO: 128690 - DNA, 25 bp, Homo sapien
tcatcaagcagcagcgcgaggccag

SEQ ID NO: 128691 - DNA, 25 bp, Homo sapien
gcagcgcgaggccagagtccaataa

SEQ ID NO: 128692 - DNA, 25 bp, Homo sapien
gcgcgaggccagagtccaataaact

SEQ ID NO: 128693 - DNA, 25 bp, Homo sapien
ggccagagtccaataaactcgtgct

SEQ ID NO: 128694 - DNA, 25 bp, Homo sapien
gtccaataaactcgtgctcatctgc

SEQ ID NO: 128695 - DNA, 25 bp, Homo sapien
ataaactcgtgctcatctgcagcct

SEQ ID NO: 128696 - DNA, 25 bp, Homo sapien
agccggcactgcatgttcctggaca

SEQ ID NO: 128697 - DNA, 25 bp, Homo sapien
ggcactgcatgttcctggacaccac

SEQ ID NO: 128698 - DNA, 25 bp, Homo sapien
agcaccctctggttgtgggcttgga

SEQ ID NO: 128699 - DNA, 25 bp, Homo sapien
accctctggttgtgggcttggacca

SEQ ID NO: 128700 - DNA, 25 bp, Homo sapien
ctccatgtctatgctccctctgtgt

SEQ ID NO: 128701 - DNA, 25 bp, Homo sapien
tcattggttcacagtcatgcagctc

SEQ ID NO: 128702 - DNA, 25 bp, Homo sapien
agtcatgcagctcatactgtccacc

SEQ ID NO: 128703 - DNA, 25 bp, Homo sapien
tgtccacccttgtattctcagatgc

SEQ ID NO: 128704 - DNA, 25 bp, Homo sapien
tgtattctcagatgcaggacaattg

SEQ ID NO: 128705 - DNA, 25 bp, Homo sapien
tagttttattttgtggaggtgcaga

SEQ ID NO: 128706 - DNA, 25 bp, Homo sapien
atttactctttctgtccaacccttg

SEQ ID NO: 128707 - DNA, 25 bp, Homo sapien
caacccttgattctgccgaggaaga

SEQ ID NO: 128708 - DNA, 25 bp, Homo sapien
ctgccgaggaagacactgatggttt

SEQ ID NO: 128709 - DNA, 25 bp, Homo sapien
tggtttgatgagtgattcagctgtt

SEQ ID NO: 128710 - DNA, 25 bp, Homo sapien
gatgaatccaaatgagctctagaca

SEQ ID NO: 128711 - DNA, 25 bp, Homo sapien
gatcttaactgtctcctacatgtgt

SEQ ID NO: 128712 - DNA, 25 bp, Homo sapien
acttggaatgtgtttagcttgactg

SEQ ID NO: 128713 - DNA, 25 bp, Homo sapien
gtgtttagcttgactgaggaattaa

SEQ ID NO: 128714 - DNA, 25 bp, Homo sapien
tttaaatcgccacacatggctagtg

SEQ ID NO: 128715 - DNA, 25 bp, Homo sapien
gtggctactgtattggagtgcacag

SEQ ID NO: 128716 - DNA, 25 bp, Homo sapien
tggagtgcacagctctagatggctc

SEQ ID NO: 128717 - DNA, 25 bp, Homo sapien
gctctagatggctcctagattattg

SEQ ID NO: 128718 - DNA, 25 bp, Homo sapien
ctcctagattattgagagcctccaa

SEQ ID NO: 128719 - DNA, 25 bp, Homo sapien
aagacactggtaaacaccaatgtaa

SEQ ID NO: 128720 - DNA, 25 bp, Homo sapien
cccaaggtggtcatgactggtctca

SEQ ID NO: 128721 - DNA, 25 bp, Homo sapien
actggtctcatttgcagaagtctaa

SEQ ID NO: 128722 - DNA, 25 bp, Homo sapien
taagaatgtacctttttctggccgg

SEQ ID NO: 128723 - DNA, 25 bp, Homo sapien
aaacacttctcatcatattgtatgt

SEQ ID NO: 128724 - DNA, 25 bp, Homo sapien
gtaattgcatttctgctcttccaaa

SEQ ID NO: 128725 - DNA, 25 bp, Homo sapien
aaagctcctgcgtctgtttttaaag

SEQ ID NO: 128726 - DNA, 25 bp, Homo sapien
gtagtttttcagctagtttgaagga

SEQ ID NO: 128727 - DNA, 25 bp, Homo sapien
gaaggaggacggttaacttgtatat

SEQ ID NO: 128728 - DNA, 25 bp, Homo sapien
tgtatattccaccattcacatttga

SEQ ID NO: 128729 - DNA, 25 bp, Homo sapien
tacataatcaaagctacctgtggtg

SEQ ID NO: 128730 - DNA, 25 bp, Homo sapien
tacctgtggtgatgttgccacctgt

SEQ ID NO: 128731 - DNA, 25 bp, Homo sapien
gatgttgccacctgttaaaatgtac

SEQ ID NO: 128732 - DNA, 25 bp, Homo sapien
atgtacactggatatgttgttaaac

SEQ ID NO: 128733 - DNA, 25 bp, Homo sapien
gttgttaaacacgtgtcgataatgg

SEQ ID NO: 128734 - DNA, 25 bp, Homo sapien
gaggaaattcacagcaaaagtccac

SEQ ID NO: 128735 - DNA, 25 bp, Homo sapien
ggaaattcacagcaaaagtccacat

SEQ ID NO: 128736 - DNA, 25 bp, Homo sapien
tcacagcaaaagtccacattatgtc

SEQ ID NO: 128737 - DNA, 25 bp, Homo sapien
acagcaaaagtccacattatgtcag

SEQ ID NO: 128738 - DNA, 25 bp, Homo sapien
agcaaaagtccacattatgtcagct

SEQ ID NO: 128739 - DNA, 25 bp, Homo sapien
tgctatgccactgttgaatttttcc

SEQ ID NO: 128740 - DNA, 25 bp, Homo sapien
gctatgccactgttgaatttttccc

SEQ ID NO: 128741 - DNA, 25 bp, Homo sapien
ctatgccactgttgaatttttccca

SEQ ID NO: 128742 - DNA, 25 bp, Homo sapien
tgttgaatttttcccaagattcctg

SEQ ID NO: 128743 - DNA, 25 bp, Homo sapien
ttgaatttttcccaagattcctgtc

SEQ ID NO: 128744 - DNA, 25 bp, Homo sapien
tgaatttttcccaagattcctgtcc

SEQ ID NO: 128745 - DNA, 25 bp, Homo sapien
aaatgtctactttttcagcagttct

SEQ ID NO: 128746 - DNA, 25 bp, Homo sapien
aatggctggtgtacttgggaatgta

SEQ ID NO: 128747 - DNA, 25 bp, Homo sapien
tactatcaggattttacagcaatgc

SEQ ID NO: 128748 - DNA, 25 bp, Homo sapien
atgacaggaatgaatctcaccagat

SEQ ID NO: 128749 - DNA, 25 bp, Homo sapien
gattttttatgtactcagcagagcc

SEQ ID NO: 128750 - DNA, 25 bp, Homo sapien
cagcagagccttgagttacggtgtt

SEQ ID NO: 128751 - DNA, 25 bp, Homo sapien
ttacggtgtttattttccaatcaag

SEQ ID NO: 128752 - DNA, 25 bp, Homo sapien
caagtgaagatatctcctacttctc

SEQ ID NO: 128753 - DNA, 25 bp, Homo sapien
tctcctactggaacatctcagcttc

SEQ ID NO: 128754 - DNA, 25 bp, Homo sapien
acatctcagcttctgcagtgaagaa

SEQ ID NO: 128755 - DNA, 25 bp, Homo sapien
aaaattcctgtgatagttcagttct

SEQ ID NO: 128756 - DNA, 25 bp, Homo sapien
taaaaagctcattagatgccgagag

SEQ ID NO: 128757 - DNA, 25 bp, Homo sapien
atgccgagagcatacttagactgta

SEQ ID NO: 128758 - DNA, 25 bp, Homo sapien
tttttccagagcctcatgagtggat

SEQ ID NO: 128759 - DNA, 25 bp, Homo sapien
gggtgcaacttattaattcttgaac

SEQ ID NO: 128760 - DNA, 25 bp, Homo sapien
aattcttgaacatacttggttcagg

SEQ ID NO: 128761 - DNA, 25 bp, Homo sapien
gtaagtatgtgtggtcttgtttcct

SEQ ID NO: 128762 - DNA, 25 bp, Homo sapien
tatgtgtggtcttgtttccttgttt

SEQ ID NO: 128763 - DNA, 25 bp, Homo sapien
gttctgttttgtttgaggattgtta

SEQ ID NO: 128764 - DNA, 25 bp, Homo sapien
gaggattgttatttggcgtgctgtt

SEQ ID NO: 128765 - DNA, 25 bp, Homo sapien
tatttggcgtgctgttttctacctc

SEQ ID NO: 128766 - DNA, 25 bp, Homo sapien
tttctacctctggtcttatctgtga

SEQ ID NO: 128767 - DNA, 25 bp, Homo sapien
tcctcatctgtccagtgggtaggtt

SEQ ID NO: 128768 - DNA, 25 bp, Homo sapien
tcatctgtccagtgggtaggttgga

SEQ ID NO: 128769 - DNA, 25 bp, Homo sapien
acaatctgacattctcaggaagccc

SEQ ID NO: 128770 - DNA, 25 bp, Homo sapien
tcaggaagcccccaagttgatattt

SEQ ID NO: 128771 - DNA, 25 bp, Homo sapien
caagttgatatttctatttcctgga

SEQ ID NO: 128772 - DNA, 25 bp, Homo sapien
gatatttctatttcctggaatggtt

SEQ ID NO: 128773 - DNA, 25 bp, Homo sapien
gaatggttggattttagttacagct

SEQ ID NO: 128774 - DNA, 25 bp, Homo sapien
gttggattttagttacagctgtgat

SEQ ID NO: 128775 - DNA, 25 bp, Homo sapien
attttagttacagctgtgatttgga

SEQ ID NO: 128776 - DNA, 25 bp, Homo sapien
tacagctgtgatttggaagggaaac

SEQ ID NO: 128777 - DNA, 25 bp, Homo sapien
ctgtgatttggaagggaaactttca

SEQ ID NO: 128778 - DNA, 25 bp, Homo sapien
atttaataacattaccttactgtgg

SEQ ID NO: 128779 - DNA, 25 bp, Homo sapien
ttaataacattaccttactgtggag

SEQ ID NO: 128780 - DNA, 25 bp, Homo sapien
taataacattaccttactgtggagg

SEQ ID NO: 128781 - DNA, 25 bp, Homo sapien
aataacattaccttactgtggagga

SEQ ID NO: 128782 - DNA, 25 bp, Homo sapien
ataacattaccttactgtggaggaa

SEQ ID NO: 128783 - DNA, 25 bp, Homo sapien
taacattaccttactgtggaggaag

SEQ ID NO: 128784 - DNA, 25 bp, Homo sapien
aacattaccttactgtggaggaagg

SEQ ID NO: 128785 - DNA, 25 bp, Homo sapien
cattaccttactgtggaggaaggat

SEQ ID NO: 128786 - DNA, 25 bp, Homo sapien
attaccttactgtggaggaaggatt

SEQ ID NO: 128787 - DNA, 25 bp, Homo sapien
taccttactgtggaggaaggattgt

SEQ ID NO: 128788 - DNA, 25 bp, Homo sapien
ccttactgtggaggaaggattgtaa

SEQ ID NO: 128789 - DNA, 25 bp, Homo sapien
tgtgtttagtaaggaaaacctgtca

SEQ ID NO: 128790 - DNA, 25 bp, Homo sapien
gattaaattatatgttccactgttg

SEQ ID NO: 128791 - DNA, 25 bp, Homo sapien
atatgttccactgttgaatataaat

SEQ ID NO: 128792 - DNA, 25 bp, Homo sapien
gtatgtaaactccatatttatgtat

SEQ ID NO: 128793 - DNA, 25 bp, Homo sapien
tagtctttgaaaatgggtctgtcct

SEQ ID NO: 128794 - DNA, 25 bp, Homo sapien
tttgaaaatgggtctgtcctccttg

SEQ ID NO: 128795 - DNA, 25 bp, Homo sapien
aaatgggtctgtcctccttgtgtaa

SEQ ID NO: 128796 - DNA, 25 bp, Homo sapien
gggtctgtcctccttgtgtaagaca

SEQ ID NO: 128797 - DNA, 25 bp, Homo sapien
gtcctccttgtgtaagacagtaact

SEQ ID NO: 128798 - DNA, 25 bp, Homo sapien
gacagtaactttacacttcagacag

SEQ ID NO: 128799 - DNA, 25 bp, Homo sapien
ttacacttcagacagattttctgtg

SEQ ID NO: 128800 - DNA, 25 bp, Homo sapien
gggcgctgccagatctcacggtgaa

SEQ ID NO: 128801 - DNA, 25 bp, Homo sapien
gatctcacggtgaaccattttggca

SEQ ID NO: 128802 - DNA, 25 bp, Homo sapien
gaaccattttggcagaatacagcat

SEQ ID NO: 128803 - DNA, 25 bp, Homo sapien
tttggcagaatacagcatggttccc

SEQ ID NO: 128804 - DNA, 25 bp, Homo sapien
ccacatgcatttatgcacagaagaa

SEQ ID NO: 128805 - DNA, 25 bp, Homo sapien
gatttatcaggatgtgagcactcgt

SEQ ID NO: 128806 - DNA, 25 bp, Homo sapien
tttctagttttcttatcaggatgtg

SEQ ID NO: 128807 - DNA, 25 bp, Homo sapien
ttcttatcaggatgtgagcactcgt

SEQ ID NO: 128808 - DNA, 25 bp, Homo sapien
gcactcgttgtgtctggatgttaca

SEQ ID NO: 128809 - DNA, 25 bp, Homo sapien
ttttccctgtttagcattttctagt

SEQ ID NO: 128810 - DNA, 25 bp, Homo sapien
attttctagttttccactattattg

SEQ ID NO: 128811 - DNA, 25 bp, Homo sapien
ctagtggaagattaccggcgtgtta

SEQ ID NO: 128812 - DNA, 25 bp, Homo sapien
gattaccggcgtgttattgaacgac

SEQ ID NO: 128813 - DNA, 25 bp, Homo sapien
gcgtgttattgaacgacttgctcaa

SEQ ID NO: 128814 - DNA, 25 bp, Homo sapien
gaacgacttgctcaagagtaaagat

SEQ ID NO: 128815 - DNA, 25 bp, Homo sapien
aaagattatactgctctgtacagga

SEQ ID NO: 128816 - DNA, 25 bp, Homo sapien
actgctctgtacaggaagcttgcaa

SEQ ID NO: 128817 - DNA, 25 bp, Homo sapien
tgtacaggaagcttgcaaattttct

SEQ ID NO: 128818 - DNA, 25 bp, Homo sapien
tgtgctgtgaaaaatctgatgactt

SEQ ID NO: 128819 - DNA, 25 bp, Homo sapien
tgtgacattttgcttatactaaaag

SEQ ID NO: 128820 - DNA, 25 bp, Homo sapien
aagataaagcttctgaaatactact

SEQ ID NO: 128821 - DNA, 25 bp, Homo sapien
aatactactgcaattgcttcccttc

SEQ ID NO: 128822 - DNA, 25 bp, Homo sapien
accaagttcctcatcgacaagaacg

SEQ ID NO: 128823 - DNA, 25 bp, Homo sapien
ctgcgtggtgaagcgctacggaccc

SEQ ID NO: 128824 - DNA, 25 bp, Homo sapien
gagcccctggtgatagagaaggacc

SEQ ID NO: 128825 - DNA, 25 bp, Homo sapien
gtgatagagaaggacctgccccact

SEQ ID NO: 128826 - DNA, 25 bp, Homo sapien
gatagagaaggacctgccccactat

SEQ ID NO: 128827 - DNA, 25 bp, Homo sapien
tagagaaggacctgccccactattt

SEQ ID NO: 128828 - DNA, 25 bp, Homo sapien
actatttctagctccacaagtgtgt

SEQ ID NO: 128829 - DNA, 25 bp, Homo sapien
ttctagctccacaagtgtgtggccc

SEQ ID NO: 128830 - DNA, 25 bp, Homo sapien
tggagccttccaccggcactcatga

SEQ ID NO: 128831 - DNA, 25 bp, Homo sapien
agacccgaaaatccagcgtgcaccc

SEQ ID NO: 128832 - DNA, 25 bp, Homo sapien
gcaccccgccggaggaaggtcccat

SEQ ID NO: 128833 - DNA, 25 bp, Homo sapien
taatccgcaagttgcccttccagcg

SEQ ID NO: 128834 - DNA, 25 bp, Homo sapien
aagttgcccttccagcggctgatgc

SEQ ID NO: 128835 - DNA, 25 bp, Homo sapien
ttccagcggctgatgcgcgagatcg

SEQ ID NO: 128836 - DNA, 25 bp, Homo sapien
tgatgcgcgagatcgctcaggactt

SEQ ID NO: 128837 - DNA, 25 bp, Homo sapien
ctgtgtgtcatccatgccaaacggg

SEQ ID NO: 128838 - DNA, 25 bp, Homo sapien
tgtgtcatccatgccaaacgggtca

SEQ ID NO: 128839 - DNA, 25 bp, Homo sapien
tcatccatgccaaacgggtcaccat

SEQ ID NO: 128840 - DNA, 25 bp, Homo sapien
aaacgggtcaccatcatgcctaagg

SEQ ID NO: 128841 - DNA, 25 bp, Homo sapien
gggtcaccatcatgcctaaggacat

SEQ ID NO: 128842 - DNA, 25 bp, Homo sapien
ggtcaccatcatgcctaaggacatc

SEQ ID NO: 128843 - DNA, 25 bp, Homo sapien
taaggacatccagctggcacgccgt

SEQ ID NO: 128844 - DNA, 25 bp, Homo sapien
gggttctacagtcgtaaaagagata

SEQ ID NO: 128845 - DNA, 25 bp, Homo sapien
gattagttggacagtttaaagcttt

SEQ ID NO: 128846 - DNA, 25 bp, Homo sapien
tggacagtttaaagcttttattcgt

SEQ ID NO: 128847 - DNA, 25 bp, Homo sapien
gcttttattcgtcctttgacaaaag

SEQ ID NO: 128848 - DNA, 25 bp, Homo sapien
aaatgggagggcattccatcccttc

SEQ ID NO: 128849 - DNA, 25 bp, Homo sapien
agggcattccatcccttcctgaagg

SEQ ID NO: 128850 - DNA, 25 bp, Homo sapien
acactccatgagtgtctgtgagagg

SEQ ID NO: 128851 - DNA, 25 bp, Homo sapien
gtgtctgtgagaggcagctatctgc

SEQ ID NO: 128852 - DNA, 25 bp, Homo sapien
gtgagaggcagctatctgcactcta

SEQ ID NO: 128853 - DNA, 25 bp, Homo sapien
gaggcagctatctgcactctaaact

SEQ ID NO: 128854 - DNA, 25 bp, Homo sapien
tatctgcactctaaactgcaaacag

SEQ ID NO: 128855 - DNA, 25 bp, Homo sapien
atatgtcaaatttttccatctttca

SEQ ID NO: 128856 - DNA, 25 bp, Homo sapien
tttccatctttcatccagggctgac

SEQ ID NO: 128857 - DNA, 25 bp, Homo sapien
catctttcatccagggctgactgaa

SEQ ID NO: 128858 - DNA, 25 bp, Homo sapien
cagggctgactgaaaccgtggctaa

SEQ ID NO: 128859 - DNA, 25 bp, Homo sapien
ggctgactgaaaccgtggctaagaa

SEQ ID NO: 128860 - DNA, 25 bp, Homo sapien
gtggctaagaattgggagactctct

SEQ ID NO: 128861 - DNA, 25 bp, Homo sapien
ggagactctcttgtttcaagccaat

SEQ ID NO: 128862 - DNA, 25 bp, Homo sapien
atcatttaccagatcatttgtcatg

SEQ ID NO: 128863 - DNA, 25 bp, Homo sapien
agttaatggataccctctgcctttg

SEQ ID NO: 128864 - DNA, 25 bp, Homo sapien
ataccctctgcctttggctcagaaa

SEQ ID NO: 128865 - DNA, 25 bp, Homo sapien
ctgcctttggctcagaaatgttata

SEQ ID NO: 128866 - DNA, 25 bp, Homo sapien
gacaaccaaaaagtgcagcgttcct

SEQ ID NO: 128867 - DNA, 25 bp, Homo sapien
cagcgttccttttgcgagagagata

SEQ ID NO: 128868 - DNA, 25 bp, Homo sapien
aatgaaaccaggtatccccactcag

SEQ ID NO: 128869 - DNA, 25 bp, Homo sapien
aggtatccccactcagtagccaagt

SEQ ID NO: 128870 - DNA, 25 bp, Homo sapien
gaaaacagcccgtttacttgagcaa

SEQ ID NO: 128871 - DNA, 25 bp, Homo sapien
gagcaagactgataccacctgcgtg

SEQ ID NO: 128872 - DNA, 25 bp, Homo sapien
agggcgacttccacagcagcagaac

SEQ ID NO: 128873 - DNA, 25 bp, Homo sapien
agtgcctcctggactgttcacggca

SEQ ID NO: 128874 - DNA, 25 bp, Homo sapien
gttcacggcagaccagaacgtttct

SEQ ID NO: 128875 - DNA, 25 bp, Homo sapien
ctggcctgggttttgtggtcatcta

SEQ ID NO: 128876 - DNA, 25 bp, Homo sapien
gtggtcatctattctagcagggaac

SEQ ID NO: 128877 - DNA, 25 bp, Homo sapien
gcaggtgtccgcacgccgcgcactg

SEQ ID NO: 128878 - DNA, 25 bp, Homo sapien
tcggcgcacttctctagcctcgagt

SEQ ID NO: 128879 - DNA, 25 bp, Homo sapien
tctctagcctcgagtccgaggtatg

SEQ ID NO: 128880 - DNA, 25 bp, Homo sapien
tcgagtccgaggtatgacgcggccc

SEQ ID NO: 128881 - DNA, 25 bp, Homo sapien
ttggtcagcgcaggccacggcccga

SEQ ID NO: 128882 - DNA, 25 bp, Homo sapien
gcagtggacaggacccgcgtgggtt

SEQ ID NO: 128883 - DNA, 25 bp, Homo sapien
gacaggacccgcgtgggttgggaag

SEQ ID NO: 128884 - DNA, 25 bp, Homo sapien
gaaagcagtggaactggccggaccc

SEQ ID NO: 128885 - DNA, 25 bp, Homo sapien
aagcagtggaactggccggaccccg

SEQ ID NO: 128886 - DNA, 25 bp, Homo sapien
cccctggttctggaggaaccgcaag

SEQ ID NO: 128887 - DNA, 25 bp, Homo sapien
ctggttctggaggaaccgcaagccg

SEQ ID NO: 128888 - DNA, 25 bp, Homo sapien
gccagagaacattccctttgaagcc

SEQ ID NO: 128889 - DNA, 25 bp, Homo sapien
aagtgttttctctgacttctgctga

SEQ ID NO: 128890 - DNA, 25 bp, Homo sapien
ttctgctgacagtggctaaaactct

SEQ ID NO: 128891 - DNA, 25 bp, Homo sapien
agtggctaaaactctgaactgtcag

SEQ ID NO: 128892 - DNA, 25 bp, Homo sapien
aagactgccttgtaggtaagcctgt

SEQ ID NO: 128893 - DNA, 25 bp, Homo sapien
acttgagtctttgcttaaatgttac

SEQ ID NO: 128894 - DNA, 25 bp, Homo sapien
taaatgttactttctcaatgaggct

SEQ ID NO: 128895 - DNA, 25 bp, Homo sapien
caagccggattttgggcctgcttaa

SEQ ID NO: 128896 - DNA, 25 bp, Homo sapien
gattttgggcctgcttaaaccactt

SEQ ID NO: 128897 - DNA, 25 bp, Homo sapien
aaagtcttctggagaaagcccgcca

SEQ ID NO: 128898 - DNA, 25 bp, Homo sapien
gagaaagcccgccagagaacattcc

SEQ ID NO: 128899 - DNA, 25 bp, Homo sapien
ccagtggagctgtggcagatcctaa

SEQ ID NO: 128900 - DNA, 25 bp, Homo sapien
ggagctgtggcagatcctaatagat

SEQ ID NO: 128901 - DNA, 25 bp, Homo sapien
gctgtggcagatcctaatagatgtg

SEQ ID NO: 128902 - DNA, 25 bp, Homo sapien
atcctaatagatgtggggctcctgg

SEQ ID NO: 128903 - DNA, 25 bp, Homo sapien
gtagagacacacaccaacagccacc

SEQ ID NO: 128904 - DNA, 25 bp, Homo sapien
agccaccctttctggaaatctgata

SEQ ID NO: 128905 - DNA, 25 bp, Homo sapien
ccctttctggaaatctgatatagta

SEQ ID NO: 128906 - DNA, 25 bp, Homo sapien
gcaccaggagtatgtgaaatatcag

SEQ ID NO: 128907 - DNA, 25 bp, Homo sapien
atgtgaaatatcagacacactctgc

SEQ ID NO: 128908 - DNA, 25 bp, Homo sapien
agacacactctgctcattcatgtct

SEQ ID NO: 128909 - DNA, 25 bp, Homo sapien
acactctgctcattcatgtctcctt

SEQ ID NO: 128910 - DNA, 25 bp, Homo sapien
aagatgccctaagtgttgaagaaga

SEQ ID NO: 128911 - DNA, 25 bp, Homo sapien
atgccctaagtgttgaagaagagtt

SEQ ID NO: 128912 - DNA, 25 bp, Homo sapien
ccctaagtgttgaagaagagtttgc

SEQ ID NO: 128913 - DNA, 25 bp, Homo sapien
agaagagtttgcaaatgcaacaaaa

SEQ ID NO: 128914 - DNA, 25 bp, Homo sapien
gttgttaaaactggtttagcacaat

SEQ ID NO: 128915 - DNA, 25 bp, Homo sapien
aaaactggtttagcacaatttatat

SEQ ID NO: 128916 - DNA, 25 bp, Homo sapien
attttccctctcttgcctttcttat

SEQ ID NO: 128917 - DNA, 25 bp, Homo sapien
tttccctctcttgcctttcttattt

SEQ ID NO: 128918 - DNA, 25 bp, Homo sapien
tgcctttcttatttgcaataaaagg

SEQ ID NO: 128919 - DNA, 25 bp, Homo sapien
gcaataaaaggtattgagccatttt

SEQ ID NO: 128920 - DNA, 25 bp, Homo sapien
aaagcaccaaattcatgtacagcat

SEQ ID NO: 128921 - DNA, 25 bp, Homo sapien
cacttctataaccacgacgcgttga

SEQ ID NO: 128922 - DNA, 25 bp, Homo sapien
cagcagtgtaaagaagtgtcgtgta

SEQ ID NO: 128923 - DNA, 25 bp, Homo sapien
aaagaagtgtcgtgtatacctgtgc

SEQ ID NO: 128924 - DNA, 25 bp, Homo sapien
aagaagtgtcgtgtatacctgtgca

SEQ ID NO: 128925 - DNA, 25 bp, Homo sapien
agaagtgtcgtgtatacctgtgcag

SEQ ID NO: 128926 - DNA, 25 bp, Homo sapien
gaagtgtcgtgtatacctgtgcagg

SEQ ID NO: 128927 - DNA, 25 bp, Homo sapien
aagtgtcgtgtatacctgtgcaggc

SEQ ID NO: 128928 - DNA, 25 bp, Homo sapien
agtgtcgtgtatacctgtgcaggca

SEQ ID NO: 128929 - DNA, 25 bp, Homo sapien
gtgtcgtgtatacctgtgcaggcac

SEQ ID NO: 128930 - DNA, 25 bp, Homo sapien
cattctgatgtctctgttcatcttt

SEQ ID NO: 128931 - DNA, 25 bp, Homo sapien
catgagtcgctttacattgtggtta

SEQ ID NO: 128932 - DNA, 25 bp, Homo sapien
catctcgtccaaggctatggggatt

SEQ ID NO: 128933 - DNA, 25 bp, Homo sapien
tctcgtccaaggctatggggattat

SEQ ID NO: 128934 - DNA, 25 bp, Homo sapien
ctcgtccaaggctatggggattatg

SEQ ID NO: 128935 - DNA, 25 bp, Homo sapien
cgtccaaggctatggggattatgaa

SEQ ID NO: 128936 - DNA, 25 bp, Homo sapien
aacgacattttcgagcgcattgcag

SEQ ID NO: 128937 - DNA, 25 bp, Homo sapien
tttcgagcgcattgcaggcgaggct

SEQ ID NO: 128938 - DNA, 25 bp, Homo sapien
cacttccagggagatccaaacggct

SEQ ID NO: 128939 - DNA, 25 bp, Homo sapien
acttccagggagatccaaacggctg

SEQ ID NO: 128940 - DNA, 25 bp, Homo sapien
cttccagggagatccaaacggctgt

SEQ ID NO: 128941 - DNA, 25 bp, Homo sapien
ttccagggagatccaaacggctgtg

SEQ ID NO: 128942 - DNA, 25 bp, Homo sapien
caaacggctgtgcgcctgctgctac

SEQ ID NO: 128943 - DNA, 25 bp, Homo sapien
ggtctcctgcctagctgcctagcaa

SEQ ID NO: 128944 - DNA, 25 bp, Homo sapien
ctgcctagctgcctagcaagctggc

SEQ ID NO: 128945 - DNA, 25 bp, Homo sapien
gcctagctgcctagcaagctggcct

SEQ ID NO: 128946 - DNA, 25 bp, Homo sapien
cacaagggctctcttaggcatgtag

SEQ ID NO: 128947 - DNA, 25 bp, Homo sapien
acaagggctctcttaggcatgtagg

SEQ ID NO: 128948 - DNA, 25 bp, Homo sapien
gagggcatccataccagctcgcacc

SEQ ID NO: 128949 - DNA, 25 bp, Homo sapien
tactcccttgccctagatagtttat

SEQ ID NO: 128950 - DNA, 25 bp, Homo sapien
actcccttgccctagatagtttatt

SEQ ID NO: 128951 - DNA, 25 bp, Homo sapien
ctcccttgccctagatagtttatta

SEQ ID NO: 128952 - DNA, 25 bp, Homo sapien
cccttgccctagatagtttattatt

SEQ ID NO: 128953 - DNA, 25 bp, Homo sapien
cttgccctagatagtttattattat

SEQ ID NO: 128954 - DNA, 25 bp, Homo sapien
aatttgattgattctttccaagaga

SEQ ID NO: 128955 - DNA, 25 bp, Homo sapien
gatagtcaaagaggttggtcaactg

SEQ ID NO: 128956 - DNA, 25 bp, Homo sapien
ggtcaactggcagaaacccaacgct

SEQ ID NO: 128957 - DNA, 25 bp, Homo sapien
gaaacccaacgcttcgaatgcacca

SEQ ID NO: 128958 - DNA, 25 bp, Homo sapien
ttctcccctccgagacctgaaagga

SEQ ID NO: 128959 - DNA, 25 bp, Homo sapien
acctgaaaggagctctggaaagtct

SEQ ID NO: 128960 - DNA, 25 bp, Homo sapien
ggagctctggaaagtctgattgaag

SEQ ID NO: 128961 - DNA, 25 bp, Homo sapien
gaagatttaaatccattgggccaga

SEQ ID NO: 128962 - DNA, 25 bp, Homo sapien
atccattgggccagaaggaatgacc

SEQ ID NO: 128963 - DNA, 25 bp, Homo sapien
ggaatgaccattactaacatgactt

SEQ ID NO: 128964 - DNA, 25 bp, Homo sapien
gaatttcagaaatccttacaccaag

SEQ ID NO: 128965 - DNA, 25 bp, Homo sapien
cagggttttggagccggcaacttca

SEQ ID NO: 128966 - DNA, 25 bp, Homo sapien
ttttggagccggcaacttcaactca

SEQ ID NO: 128967 - DNA, 25 bp, Homo sapien
gagccggcaacttcaactcactgtt

SEQ ID NO: 128968 - DNA, 25 bp, Homo sapien
ggcaacttcaactcactgttcaagg

SEQ ID NO: 128969 - DNA, 25 bp, Homo sapien
aacttcaactcactgttcaaggctt

SEQ ID NO: 128970 - DNA, 25 bp, Homo sapien
ttcaactcactgttcaaggctttcg

SEQ ID NO: 128971 - DNA, 25 bp, Homo sapien
aactcactgttcaaggctttcgagg

SEQ ID NO: 128972 - DNA, 25 bp, Homo sapien
aaggctttcgaggaggagcagaacc

SEQ ID NO: 128973 - DNA, 25 bp, Homo sapien
tgcggggtaacctcaccaacatgga

SEQ ID NO: 128974 - DNA, 25 bp, Homo sapien
gtggtgcccggcatgtaagccccgc

SEQ ID NO: 128975 - DNA, 25 bp, Homo sapien
ctactggctgctccccaagggtccg

SEQ ID NO: 128976 - DNA, 25 bp, Homo sapien
gactttagatgttttgggatcagga

SEQ ID NO: 128977 - DNA, 25 bp, Homo sapien
aacacaggcaagtccaccccataat

SEQ ID NO: 128978 - DNA, 25 bp, Homo sapien
acaggcaagtccaccccataataac

SEQ ID NO: 128979 - DNA, 25 bp, Homo sapien
actctggcacagtgatgccgggcgc

SEQ ID NO: 128980 - DNA, 25 bp, Homo sapien
atgccgggcgccaggacagcagcac

SEQ ID NO: 128981 - DNA, 25 bp, Homo sapien
caccctacgctcatctctggaaggg

SEQ ID NO: 128982 - DNA, 25 bp, Homo sapien
ggcagccctgagtggtcactggtca

SEQ ID NO: 128983 - DNA, 25 bp, Homo sapien
tggtcactggtcagggcagtggcca

SEQ ID NO: 128984 - DNA, 25 bp, Homo sapien
cccaccgctcagtgtcagcgggtga

SEQ ID NO: 128985 - DNA, 25 bp, Homo sapien
cagcgggtgacgtgtgttcttttga

SEQ ID NO: 128986 - DNA, 25 bp, Homo sapien
cgggtgacgtgtgttcttttgagtc

SEQ ID NO: 128987 - DNA, 25 bp, Homo sapien
tgatgatgaataagttggttctagc

SEQ ID NO: 128988 - DNA, 25 bp, Homo sapien
gatgatgaataagttggttctagcg

SEQ ID NO: 128989 - DNA, 25 bp, Homo sapien
atgatgaataagttggttctagcgc

SEQ ID NO: 128990 - DNA, 25 bp, Homo sapien
tgatgaataagttggttctagcgca

SEQ ID NO: 128991 - DNA, 25 bp, Homo sapien
gatgaataagttggttctagcgcag

SEQ ID NO: 128992 - DNA, 25 bp, Homo sapien
atgaataagttggttctagcgcagt

SEQ ID NO: 128993 - DNA, 25 bp, Homo sapien
tgaataagttggttctagcgcagtt

SEQ ID NO: 128994 - DNA, 25 bp, Homo sapien
gaataagttggttctagcgcagttt

SEQ ID NO: 128995 - DNA, 25 bp, Homo sapien
aaatgtaaggctgtgtaagatttgt

SEQ ID NO: 128996 - DNA, 25 bp, Homo sapien
ttaaactgtacagtgtctttttttg

SEQ ID NO: 128997 - DNA, 25 bp, Homo sapien
gatattttgagcagactgtaaacaa

SEQ ID NO: 128998 - DNA, 25 bp, Homo sapien
attgcctagtatgttaatttgctca

SEQ ID NO: 128999 - DNA, 25 bp, Homo sapien
gtttgattttatgcactttgtcgct

SEQ ID NO: 129000 - DNA, 25 bp, Homo sapien
gcactttgtcgctattaacatcctt

SEQ ID NO: 129001 - DNA, 25 bp, Homo sapien
tttgtcgctattaacatcctttttt

SEQ ID NO: 129002 - DNA, 25 bp, Homo sapien
taggaatatatagttgtcacagtaa

SEQ ID NO: 129003 - DNA, 25 bp, Homo sapien
agttgtcacagtaaatatcttgttt

SEQ ID NO: 129004 - DNA, 25 bp, Homo sapien
caaatttttcattccttttgctctt

SEQ ID NO: 129005 - DNA, 25 bp, Homo sapien
ttcattccttttgctctttgtggtt

SEQ ID NO: 129006 - DNA, 25 bp, Homo sapien
tttgctctttgtggttggatctaac

SEQ ID NO: 129007 - DNA, 25 bp, Homo sapien
tgtggttggatctaacactaactgt

SEQ ID NO: 129008 - DNA, 25 bp, Homo sapien
gccgcttcctcccaaaacctctgta

SEQ ID NO: 129009 - DNA, 25 bp, Homo sapien
aaacctctgtacacaagggtggctg

SEQ ID NO: 129010 - DNA, 25 bp, Homo sapien
aacctctgtacacaagggtggctgt

SEQ ID NO: 129011 - DNA, 25 bp, Homo sapien
acctctgtacacaagggtggctgtc

SEQ ID NO: 129012 - DNA, 25 bp, Homo sapien
cctctgtacacaagggtggctgtct

SEQ ID NO: 129013 - DNA, 25 bp, Homo sapien
ctctgtacacaagggtggctgtctg

SEQ ID NO: 129014 - DNA, 25 bp, Homo sapien
tctgtacacaagggtggctgtctgg

SEQ ID NO: 129015 - DNA, 25 bp, Homo sapien
ctgtacacaagggtggctgtctggg

SEQ ID NO: 129016 - DNA, 25 bp, Homo sapien
gtacacaagggtggctgtctggggc

SEQ ID NO: 129017 - DNA, 25 bp, Homo sapien
ggcaacaagtaatgccttgaaggcc

SEQ ID NO: 129018 - DNA, 25 bp, Homo sapien
gcaacaagtaatgccttgaaggcca

SEQ ID NO: 129019 - DNA, 25 bp, Homo sapien
attcatggcagggtttgttggacac

SEQ ID NO: 129020 - DNA, 25 bp, Homo sapien
ggtttgttggacacctactagcttc

SEQ ID NO: 129021 - DNA, 25 bp, Homo sapien
acacattcttgctctacccaaagct

SEQ ID NO: 129022 - DNA, 25 bp, Homo sapien
ggagacaccctgcagatcctcatgg

SEQ ID NO: 129023 - DNA, 25 bp, Homo sapien
agatcctcatgggtttgtgacagcc

SEQ ID NO: 129024 - DNA, 25 bp, Homo sapien
tgtgacagcccctgcgtgctcagtg

SEQ ID NO: 129025 - DNA, 25 bp, Homo sapien
gtgctcagtgccctttaagtgcatc

SEQ ID NO: 129026 - DNA, 25 bp, Homo sapien
ctttaagtgcatcccgctgtgctga

SEQ ID NO: 129027 - DNA, 25 bp, Homo sapien
cgctgtgctgactttgagtgggatc

SEQ ID NO: 129028 - DNA, 25 bp, Homo sapien
gtgggatcaacatctgtcctacggg

SEQ ID NO: 129029 - DNA, 25 bp, Homo sapien
ttttttggccccagtattcatggca

SEQ ID NO: 129030 - DNA, 25 bp, Homo sapien
aattcaaagagtctcctgccagcac

SEQ ID NO: 129031 - DNA, 25 bp, Homo sapien
gtggtttagagcctttgatttcctg

SEQ ID NO: 129032 - DNA, 25 bp, Homo sapien
atttcctggactggacagacggcga

SEQ ID NO: 129033 - DNA, 25 bp, Homo sapien
gacggcgagtgaattctctagacct

SEQ ID NO: 129034 - DNA, 25 bp, Homo sapien
tctagaccttgggtactttcagtac

SEQ ID NO: 129035 - DNA, 25 bp, Homo sapien
tttcagtacacaacacccctaagat

SEQ ID NO: 129036 - DNA, 25 bp, Homo sapien
taagatttcccagtggtccgagcag

SEQ ID NO: 129037 - DNA, 25 bp, Homo sapien
ccagtggtccgagcagaatcagaaa

SEQ ID NO: 129038 - DNA, 25 bp, Homo sapien
aatacagctacttctgccttatggc

SEQ ID NO: 129039 - DNA, 25 bp, Homo sapien
tgccttatggctagggaactgtcat

SEQ ID NO: 129040 - DNA, 25 bp, Homo sapien
ggaactgtcatgtctaccatgtatt

SEQ ID NO: 129041 - DNA, 25 bp, Homo sapien
aggagccttaggatgcagcatgcct

SEQ ID NO: 129042 - DNA, 25 bp, Homo sapien
tgcagcatgccttcaggagacactg

SEQ ID NO: 129043 - DNA, 25 bp, Homo sapien
tggacctcagcattcccttgatatc

SEQ ID NO: 129044 - DNA, 25 bp, Homo sapien
attcccttgatatcagtccccttca

SEQ ID NO: 129045 - DNA, 25 bp, Homo sapien
caaccctctggttggtgattcaact

SEQ ID NO: 129046 - DNA, 25 bp, Homo sapien
tggtgattcaacttgggctccaaga

SEQ ID NO: 129047 - DNA, 25 bp, Homo sapien
aagacttgggtaagctctgggcctt

SEQ ID NO: 129048 - DNA, 25 bp, Homo sapien
tctgggccttcacagaatgatggca

SEQ ID NO: 129049 - DNA, 25 bp, Homo sapien
aatgatggcaccttcctaaaccctc

SEQ ID NO: 129050 - DNA, 25 bp, Homo sapien
aaaccctcatgggtggtgtctgaga

SEQ ID NO: 129051 - DNA, 25 bp, Homo sapien
ggcctggagccactctgctagaaga

SEQ ID NO: 129052 - DNA, 25 bp, Homo sapien
attctgtcttgaagggcaggtgctt

SEQ ID NO: 129053 - DNA, 25 bp, Homo sapien
gcaggtgcttcaggataccatatac

SEQ ID NO: 129054 - DNA, 25 bp, Homo sapien
ttcaggataccatatacagctcaga

SEQ ID NO: 129055 - DNA, 25 bp, Homo sapien
accatatacagctcagaagtttctt

SEQ ID NO: 129056 - DNA, 25 bp, Homo sapien
gctcagaagtttcttctttaggcat

SEQ ID NO: 129057 - DNA, 25 bp, Homo sapien
tagcaaagatatctcatctcttctt

SEQ ID NO: 129058 - DNA, 25 bp, Homo sapien
tatctcatctcttcttttaaaccat

SEQ ID NO: 129059 - DNA, 25 bp, Homo sapien
aaatgtgatttacgctcattgtaga

SEQ ID NO: 129060 - DNA, 25 bp, Homo sapien
gctgttatttaattagccagtgaaa

SEQ ID NO: 129061 - DNA, 25 bp, Homo sapien
acaacttgtctattacctgttagta

SEQ ID NO: 129062 - DNA, 25 bp, Homo sapien
acctgttagtattattgttgcatta

SEQ ID NO: 129063 - DNA, 25 bp, Homo sapien
atccttggaggagcccgaactgatt

SEQ ID NO: 129064 - DNA, 25 bp, Homo sapien
gcccgaactgattctggagctctgt

SEQ ID NO: 129065 - DNA, 25 bp, Homo sapien
ctcccttctacgtgtacatcattaa

SEQ ID NO: 129066 - DNA, 25 bp, Homo sapien
attgccaagggcattgtccagaaac

SEQ ID NO: 129067 - DNA, 25 bp, Homo sapien
gcattgtccagaaactcccctgaga

SEQ ID NO: 129068 - DNA, 25 bp, Homo sapien
ttacttttctgtggtccagccctac

SEQ ID NO: 129069 - DNA, 25 bp, Homo sapien
cagccctactcctataagtcatgat

SEQ ID NO: 129070 - DNA, 25 bp, Homo sapien
atctccaaagctttctgtcttccaa

SEQ ID NO: 129071 - DNA, 25 bp, Homo sapien
gtcttccaactgcagtctccacagt

SEQ ID NO: 129072 - DNA, 25 bp, Homo sapien
gaagacaaatgctcaggtagtcact

SEQ ID NO: 129073 - DNA, 25 bp, Homo sapien
aggtagtcactgtttccttttcact

SEQ ID NO: 129074 - DNA, 25 bp, Homo sapien
agaaagactaaaattctgtctcttc

SEQ ID NO: 129075 - DNA, 25 bp, Homo sapien
tcttcctgctttagacagccattaa

SEQ ID NO: 129076 - DNA, 25 bp, Homo sapien
gacagccattaagatcccaactaat

SEQ ID NO: 129077 - DNA, 25 bp, Homo sapien
gtttgtgttattgttcaatcttcag

SEQ ID NO: 129078 - DNA, 25 bp, Homo sapien
aattacttgatagctcagggtctac

SEQ ID NO: 129079 - DNA, 25 bp, Homo sapien
gatagctcagggtctacacttcatt

SEQ ID NO: 129080 - DNA, 25 bp, Homo sapien
cagggtctacacttcattcaacttt

SEQ ID NO: 129081 - DNA, 25 bp, Homo sapien
cacttcattcaactttttacaccaa

SEQ ID NO: 129082 - DNA, 25 bp, Homo sapien
attctgcagagtggtcaaaatggaa

SEQ ID NO: 129083 - DNA, 25 bp, Homo sapien
ctgttgtaaacagaggcttaatttt

SEQ ID NO: 129084 - DNA, 25 bp, Homo sapien
gaagtagccagttatttattaaagc

SEQ ID NO: 129085 - DNA, 25 bp, Homo sapien
ctcctcctcagggtagaatccaaga

SEQ ID NO: 129086 - DNA, 25 bp, Homo sapien
ggtagaatccaagaagcgcccaaat

SEQ ID NO: 129087 - DNA, 25 bp, Homo sapien
aagaagcgcccaaattaacacacct

SEQ ID NO: 129088 - DNA, 25 bp, Homo sapien
taacacacctgtgatgggaaagggc

SEQ ID NO: 129089 - DNA, 25 bp, Homo sapien
gcaacctggaggtctgaaaagagga

SEQ ID NO: 129090 - DNA, 25 bp, Homo sapien
ccctggcctgagaggttgcttttaa

SEQ ID NO: 129091 - DNA, 25 bp, Homo sapien
gagaggttgcttttaagtcttccac

SEQ ID NO: 129092 - DNA, 25 bp, Homo sapien
ttaagtcttccaccccttgttccat

SEQ ID NO: 129093 - DNA, 25 bp, Homo sapien
tgcctgccaacccatcggaaaggaa

SEQ ID NO: 129094 - DNA, 25 bp, Homo sapien
aacccatcggaaaggaatccacatc

SEQ ID NO: 129095 - DNA, 25 bp, Homo sapien
aaaggaatccacatcatattggaga

SEQ ID NO: 129096 - DNA, 25 bp, Homo sapien
gagcgagcaacaggttggtgaaaac

SEQ ID NO: 129097 - DNA, 25 bp, Homo sapien
gagaaagctggttcccgttttccag

SEQ ID NO: 129098 - DNA, 25 bp, Homo sapien
cccagagcttgaaaggccgcggttg

SEQ ID NO: 129099 - DNA, 25 bp, Homo sapien
aaggccgcggttggcacttcgagaa

SEQ ID NO: 129100 - DNA, 25 bp, Homo sapien
gaagtggagagtaaagacagcgcct

SEQ ID NO: 129101 - DNA, 25 bp, Homo sapien
aaagacagcgcctggagcgatcgta

SEQ ID NO: 129102 - DNA, 25 bp, Homo sapien
gcgcctggagcgatcgtagaaacac

SEQ ID NO: 129103 - DNA, 25 bp, Homo sapien
gcgatcgtagaaacacagaatggga

SEQ ID NO: 129104 - DNA, 25 bp, Homo sapien
aaacagacaccccaatgctatttac

SEQ ID NO: 129105 - DNA, 25 bp, Homo sapien
agacaccccaatgctatttacatac

SEQ ID NO: 129106 - DNA, 25 bp, Homo sapien
gctatttacatacagctctatatat

SEQ ID NO: 129107 - DNA, 25 bp, Homo sapien
agagcaagttagttatgtatagcag

SEQ ID NO: 129108 - DNA, 25 bp, Homo sapien
atgtatagcagaactggcagttgtc

SEQ ID NO: 129109 - DNA, 25 bp, Homo sapien
gaactggcagttgtcatcaaacata

SEQ ID NO: 129110 - DNA, 25 bp, Homo sapien
ggcagttgtcatcaaacataatgat

SEQ ID NO: 129111 - DNA, 25 bp, Homo sapien
gaatgagatgtaaatgtgcccagaa

SEQ ID NO: 129112 - DNA, 25 bp, Homo sapien
aaatgtgcccagaatatattatata

SEQ ID NO: 129113 - DNA, 25 bp, Homo sapien
tatcaaatcatctctttaacctaag

SEQ ID NO: 129114 - DNA, 25 bp, Homo sapien
atctaattttcctaatttggacaag

SEQ ID NO: 129115 - DNA, 25 bp, Homo sapien
tggacaagattattccatgaggaaa

SEQ ID NO: 129116 - DNA, 25 bp, Homo sapien
aatgaaaacaatccagcactctggt

SEQ ID NO: 129117 - DNA, 25 bp, Homo sapien
ccagcactctggttaaattttaagg

SEQ ID NO: 129118 - DNA, 25 bp, Homo sapien
agccctgaggtctacggcgccgaca

SEQ ID NO: 129119 - DNA, 25 bp, Homo sapien
gacatcagccccaacatgctctgtg

SEQ ID NO: 129120 - DNA, 25 bp, Homo sapien
tgtgccggctacttcgactgcaagt

SEQ ID NO: 129121 - DNA, 25 bp, Homo sapien
actgcaagtccgacgcctgccaggg

SEQ ID NO: 129122 - DNA, 25 bp, Homo sapien
gggcccctggcctgcgagaagaacg

SEQ ID NO: 129123 - DNA, 25 bp, Homo sapien
agaagaacggcgtggcttacctcta

SEQ ID NO: 129124 - DNA, 25 bp, Homo sapien
tggcttacctctacggcatcatcag

SEQ ID NO: 129125 - DNA, 25 bp, Homo sapien
acccgcgtggccaactatgtggact

SEQ ID NO: 129126 - DNA, 25 bp, Homo sapien
tgtggactggatcaacgaccggata

SEQ ID NO: 129127 - DNA, 25 bp, Homo sapien
actggatcaacgaccggatacggcc

SEQ ID NO: 129128 - DNA, 25 bp, Homo sapien
atacggcctcccaggcggcttgtgg

SEQ ID NO: 129129 - DNA, 25 bp, Homo sapien
gctgatccgcaagttgcctttccaa

SEQ ID NO: 129130 - DNA, 25 bp, Homo sapien
tgatccgcaagttgcctttccaacg

SEQ ID NO: 129131 - DNA, 25 bp, Homo sapien
gcaagttgcctttccaacgcctggt

SEQ ID NO: 129132 - DNA, 25 bp, Homo sapien
caagttgcctttccaacgcctggtg

SEQ ID NO: 129133 - DNA, 25 bp, Homo sapien
aagttgcctttccaacgcctggtgc

SEQ ID NO: 129134 - DNA, 25 bp, Homo sapien
agttgcctttccaacgcctggtgcg

SEQ ID NO: 129135 - DNA, 25 bp, Homo sapien
ttgcctttccaacgcctggtgcgag

SEQ ID NO: 129136 - DNA, 25 bp, Homo sapien
caagacagatctgcgctttcagagt

SEQ ID NO: 129137 - DNA, 25 bp, Homo sapien
gacagatctgcgctttcagagttcc

SEQ ID NO: 129138 - DNA, 25 bp, Homo sapien
acagatctgcgctttcagagttccg

SEQ ID NO: 129139 - DNA, 25 bp, Homo sapien
cagatctgcgctttcagagttccgc

SEQ ID NO: 129140 - DNA, 25 bp, Homo sapien
tggtcccatggctggtaccctggag

SEQ ID NO: 129141 - DNA, 25 bp, Homo sapien
gtcccatggctggtaccctggagga

SEQ ID NO: 129142 - DNA, 25 bp, Homo sapien
tcccatggctggtaccctggaggaa

SEQ ID NO: 129143 - DNA, 25 bp, Homo sapien
cccatggctggtaccctggaggaaa

SEQ ID NO: 129144 - DNA, 25 bp, Homo sapien
ctggtaccctggaggaaagcgagcc

SEQ ID NO: 129145 - DNA, 25 bp, Homo sapien
ggtaccctggaggaaagcgagccct

SEQ ID NO: 129146 - DNA, 25 bp, Homo sapien
taccctggaggaaagcgagccctca

SEQ ID NO: 129147 - DNA, 25 bp, Homo sapien
accctggaggaaagcgagccctcag

SEQ ID NO: 129148 - DNA, 25 bp, Homo sapien
tggaggaaagcgagccctcagctca

SEQ ID NO: 129149 - DNA, 25 bp, Homo sapien
ggaggaaagcgagccctcagctcag

SEQ ID NO: 129150 - DNA, 25 bp, Homo sapien
ctcagctcagcccaggatccccaga

SEQ ID NO: 129151 - DNA, 25 bp, Homo sapien
aaatgtgtcaagtgttttcaggagt

SEQ ID NO: 129152 - DNA, 25 bp, Homo sapien
ggagtgttaagcaacatcctgttca

SEQ ID NO: 129153 - DNA, 25 bp, Homo sapien
aacatcctgttcagctgtatgggca

SEQ ID NO: 129154 - DNA, 25 bp, Homo sapien
atcctgttcagctgtatgggcacta

SEQ ID NO: 129155 - DNA, 25 bp, Homo sapien
cctgttcagctgtatgggcactagt

SEQ ID NO: 129156 - DNA, 25 bp, Homo sapien
gttcagctgtatgggcactagtccc

SEQ ID NO: 129157 - DNA, 25 bp, Homo sapien
cagctgtatgggcactagtccctta

SEQ ID NO: 129158 - DNA, 25 bp, Homo sapien
cagatgaccatgctgatggatctat

SEQ ID NO: 129159 - DNA, 25 bp, Homo sapien
tatttagttaactactatagggact

SEQ ID NO: 129160 - DNA, 25 bp, Homo sapien
gtgaacttttacattgtgaattgtg

SEQ ID NO: 129161 - DNA, 25 bp, Homo sapien
ctttaaaattgaactccaacccatg

SEQ ID NO: 129162 - DNA, 25 bp, Homo sapien
tggacatctcccaaactggcgtcta

SEQ ID NO: 129163 - DNA, 25 bp, Homo sapien
tggcgtctacacagagcatgtcttt

SEQ ID NO: 129164 - DNA, 25 bp, Homo sapien
gcatgtctttacagatcctttggga

SEQ ID NO: 129165 - DNA, 25 bp, Homo sapien
gagttcagatcccagaagacctctc

SEQ ID NO: 129166 - DNA, 25 bp, Homo sapien
cagaagacctctccccagtgtatca

SEQ ID NO: 129167 - DNA, 25 bp, Homo sapien
tcagtcgaggtataataatgggtca

SEQ ID NO: 129168 - DNA, 25 bp, Homo sapien
taatgggtcatcaacttaggcaact

SEQ ID NO: 129169 - DNA, 25 bp, Homo sapien
gggtcatcaacttaggcaactgggt

SEQ ID NO: 129170 - DNA, 25 bp, Homo sapien
acttaggcaactgggtgaagtgcac

SEQ ID NO: 129171 - DNA, 25 bp, Homo sapien
ggaaccaaaataatctcaaacagtc

SEQ ID NO: 129172 - DNA, 25 bp, Homo sapien
gtcaaaagatttccactaattagtg

SEQ ID NO: 129173 - DNA, 25 bp, Homo sapien
agtgagattgtcagtgtaagaatgt

SEQ ID NO: 129174 - DNA, 25 bp, Homo sapien
gtagtgcttacaattttgtgtacca

SEQ ID NO: 129175 - DNA, 25 bp, Homo sapien
acaattttgtgtaccaactggatga

SEQ ID NO: 129176 - DNA, 25 bp, Homo sapien
ttttgtgtaccaactggatgactaa

SEQ ID NO: 129177 - DNA, 25 bp, Homo sapien
gtaccaactggatgactaaaaagag

SEQ ID NO: 129178 - DNA, 25 bp, Homo sapien
aatagctcatattttatgtgtgaaa

SEQ ID NO: 129179 - DNA, 25 bp, Homo sapien
gatttcattgctattgcatagtctc

SEQ ID NO: 129180 - DNA, 25 bp, Homo sapien
attgctattgcatagtctctaatac

SEQ ID NO: 129181 - DNA, 25 bp, Homo sapien
gctattgcatagtctctaatacata

SEQ ID NO: 129182 - DNA, 25 bp, Homo sapien
gcatagtctctaatacatagaatga

SEQ ID NO: 129183 - DNA, 25 bp, Homo sapien
ttgcattaaatgcatttcaagttaa

SEQ ID NO: 129184 - DNA, 25 bp, Homo sapien
tcttccatgctgtgcgcccagggct

SEQ ID NO: 129185 - DNA, 25 bp, Homo sapien
aggacttccctgtgtagtttgtgct

SEQ ID NO: 129186 - DNA, 25 bp, Homo sapien
acttccctgtgtagtttgtgctgta

SEQ ID NO: 129187 - DNA, 25 bp, Homo sapien
ttccctgtgtagtttgtgctgtaaa

SEQ ID NO: 129188 - DNA, 25 bp, Homo sapien
ccctgtgtagtttgtgctgtaaaga

SEQ ID NO: 129189 - DNA, 25 bp, Homo sapien
aatgctgtggcatgggtgaagagga

SEQ ID NO: 129190 - DNA, 25 bp, Homo sapien
gaagaggcctgtttggcctctctgt

SEQ ID NO: 129191 - DNA, 25 bp, Homo sapien
caagattgagctctctgcccttgat

SEQ ID NO: 129192 - DNA, 25 bp, Homo sapien
attgagctctctgcccttgatcagc

SEQ ID NO: 129193 - DNA, 25 bp, Homo sapien
accctggcctagaccagcagacaga

SEQ ID NO: 129194 - DNA, 25 bp, Homo sapien
tggcctagaccagcagacagagcca

SEQ ID NO: 129195 - DNA, 25 bp, Homo sapien
gtggtgatcaggcaggttcataaat

SEQ ID NO: 129196 - DNA, 25 bp, Homo sapien
gcaggttcataaatttccttggtca

SEQ ID NO: 129197 - DNA, 25 bp, Homo sapien
agaaaggtgctctgtgccaagttcc

SEQ ID NO: 129198 - DNA, 25 bp, Homo sapien
tgtgccaagttcctcactcattcgc

SEQ ID NO: 129199 - DNA, 25 bp, Homo sapien
actcattcgcgctcctgtaggccgt

SEQ ID NO: 129200 - DNA, 25 bp, Homo sapien
tcctgtaggccgtctagaactggca

SEQ ID NO: 129201 - DNA, 25 bp, Homo sapien
aggcagactgccttctttcaccctg

SEQ ID NO: 129202 - DNA, 25 bp, Homo sapien
tctttcaccctgtcctgatagactt

SEQ ID NO: 129203 - DNA, 25 bp, Homo sapien
tgtcctgatagacttccctgatcta

SEQ ID NO: 129204 - DNA, 25 bp, Homo sapien
gacttccctgatctagatatccttc

SEQ ID NO: 129205 - DNA, 25 bp, Homo sapien
gatctagatatccttcgtcatgaca

SEQ ID NO: 129206 - DNA, 25 bp, Homo sapien
gaaaatgttccaacagcagaagaag

SEQ ID NO: 129207 - DNA, 25 bp, Homo sapien
ctgaagctacagaagggaatgcggg

SEQ ID NO: 129208 - DNA, 25 bp, Homo sapien
acagtggacatctcccaaactggcg

SEQ ID NO: 129209 - DNA, 25 bp, Homo sapien
tggacatctcccaaactggcgtcta

SEQ ID NO: 129210 - DNA, 25 bp, Homo sapien
aaactggcgtctacacagagcatgt

SEQ ID NO: 129211 - DNA, 25 bp, Homo sapien
ctggcgtctacacagagcatgtctt

SEQ ID NO: 129212 - DNA, 25 bp, Homo sapien
ggcgtctacacagagcatgtcttta

SEQ ID NO: 129213 - DNA, 25 bp, Homo sapien
gtctacacagagcatgtctttacag

SEQ ID NO: 129214 - DNA, 25 bp, Homo sapien
acagagcatgtctttacagatcctt

SEQ ID NO: 129215 - DNA, 25 bp, Homo sapien
gagttcagatcccagaagacctctc

SEQ ID NO: 129216 - DNA, 25 bp, Homo sapien
cagaagacctctccccagtgtatca

SEQ ID NO: 129217 - DNA, 25 bp, Homo sapien
gatgagccgagagaaccggatccga

SEQ ID NO: 129218 - DNA, 25 bp, Homo sapien
ggatccgagaactgaccgccaacct

SEQ ID NO: 129219 - DNA, 25 bp, Homo sapien
tcacgttttcttaggtctgaggccg

SEQ ID NO: 129220 - DNA, 25 bp, Homo sapien
ttcttaggtctgaggccggtctgag

SEQ ID NO: 129221 - DNA, 25 bp, Homo sapien
accaaccagcaattggctcactgca

SEQ ID NO: 129222 - DNA, 25 bp, Homo sapien
gaggtgcccttacactaagcaccaa

SEQ ID NO: 129223 - DNA, 25 bp, Homo sapien
actaagcaccaaacgctggaattag

SEQ ID NO: 129224 - DNA, 25 bp, Homo sapien
aaagagttcttgttcaatatgtacc

SEQ ID NO: 129225 - DNA, 25 bp, Homo sapien
gcgagcgccgcctagagatcagtaa

SEQ ID NO: 129226 - DNA, 25 bp, Homo sapien
gtaagagcgttaacctcaccgacag

SEQ ID NO: 129227 - DNA, 25 bp, Homo sapien
gatttggtttcaaaaccgccgaatg

SEQ ID NO: 129228 - DNA, 25 bp, Homo sapien
tactcatgttcctgtagccagttca

SEQ ID NO: 129229 - DNA, 25 bp, Homo sapien
gtagccagttcatcctcataataag

SEQ ID NO: 129230 - DNA, 25 bp, Homo sapien
aatgggcaggatctcttgttctctc

SEQ ID NO: 129231 - DNA, 25 bp, Homo sapien
tgagtgtctttctactctcctgagc

SEQ ID NO: 129232 - DNA, 25 bp, Homo sapien
ttctactctcctgagcgtctttctg

SEQ ID NO: 129233 - DNA, 25 bp, Homo sapien
tccagtctctgcctaatttttagtg

SEQ ID NO: 129234 - DNA, 25 bp, Homo sapien
gtgtttaataacaaccgaatgtcta

SEQ ID NO: 129235 - DNA, 25 bp, Homo sapien
gtctagtaaatgactctcctctgag

SEQ ID NO: 129236 - DNA, 25 bp, Homo sapien
gaatgcaatcagtgttagccaaaat

SEQ ID NO: 129237 - DNA, 25 bp, Homo sapien
gaggctggtatttaagttagatctg

SEQ ID NO: 129238 - DNA, 25 bp, Homo sapien
atctgattgggctactcatgttcct

SEQ ID NO: 129239 - DNA, 25 bp, Homo sapien
tttcaggagtgtaaagaagcatcgt

SEQ ID NO: 129240 - DNA, 25 bp, Homo sapien
taaagaagcatcgtgtttacctgtg

SEQ ID NO: 129241 - DNA, 25 bp, Homo sapien
aaagaagcatcgtgtttacctgtgc

SEQ ID NO: 129242 - DNA, 25 bp, Homo sapien
agaagcatcgtgtttacctgtgcag

SEQ ID NO: 129243 - DNA, 25 bp, Homo sapien
aagcatcgtgtttacctgtgcaggc

SEQ ID NO: 129244 - DNA, 25 bp, Homo sapien
gcatcgtgtttacctgtgcaggcac

SEQ ID NO: 129245 - DNA, 25 bp, Homo sapien
ccatgctgatgtctctattcatcta

SEQ ID NO: 129246 - DNA, 25 bp, Homo sapien
tgctgatgtctctattcatctattt

SEQ ID NO: 129247 - DNA, 25 bp, Homo sapien
catgtgtacctttacattttgctta

SEQ ID NO: 129248 - DNA, 25 bp, Homo sapien
atgtgtacctttacattttgcttaa

SEQ ID NO: 129249 - DNA, 25 bp, Homo sapien
gtgtacctttacattttgcttaatg

SEQ ID NO: 129250 - DNA, 25 bp, Homo sapien
tcaaggcctccaggtgtttggatga

SEQ ID NO: 129251 - DNA, 25 bp, Homo sapien
gaactaccacaagtgctgggagcca

SEQ ID NO: 129252 - DNA, 25 bp, Homo sapien
actccaggaacccagcagaacctaa

SEQ ID NO: 129253 - DNA, 25 bp, Homo sapien
taattgagactggaacattgctacc

SEQ ID NO: 129254 - DNA, 25 bp, Homo sapien
ggaacattgctaccataattaagag

SEQ ID NO: 129255 - DNA, 25 bp, Homo sapien
ttcttcttcagaatctcatgctttc

SEQ ID NO: 129256 - DNA, 25 bp, Homo sapien
gaatctcatgctttctggtagtatt

SEQ ID NO: 129257 - DNA, 25 bp, Homo sapien
cacttttcatagtcaagtaactcag

SEQ ID NO: 129258 - DNA, 25 bp, Homo sapien
gaacttttatggaaacgcatttgca

SEQ ID NO: 129259 - DNA, 25 bp, Homo sapien
aacgcatttgcaaagttctatggct

SEQ ID NO: 129260 - DNA, 25 bp, Homo sapien
aaagttctatggctgtcaccttaat

SEQ ID NO: 129261 - DNA, 25 bp, Homo sapien
gtcgaccgagttgctgattcggaag

SEQ ID NO: 129262 - DNA, 25 bp, Homo sapien
cgaccgagttgctgattcggaagct

SEQ ID NO: 129263 - DNA, 25 bp, Homo sapien
gaccgagttgctgattcggaagctg

SEQ ID NO: 129264 - DNA, 25 bp, Homo sapien
aatcgcccaagacttcaagaccgat

SEQ ID NO: 129265 - DNA, 25 bp, Homo sapien
tcgcccaagacttcaagaccgatct

SEQ ID NO: 129266 - DNA, 25 bp, Homo sapien
cgcccaagacttcaagaccgatctt

SEQ ID NO: 129267 - DNA, 25 bp, Homo sapien
gcccaagacttcaagaccgatcttc

SEQ ID NO: 129268 - DNA, 25 bp, Homo sapien
cccaagacttcaagaccgatcttcg

SEQ ID NO: 129269 - DNA, 25 bp, Homo sapien
ggacacaaacctttgcgccatccat

SEQ ID NO: 129270 - DNA, 25 bp, Homo sapien
gacacaaacctttgcgccatccatg

SEQ ID NO: 129271 - DNA, 25 bp, Homo sapien
aaacctttgcgccatccatgctaag

SEQ ID NO: 129272 - DNA, 25 bp, Homo sapien
tgtcttgaggttttgttcatgcccc

SEQ ID NO: 129273 - DNA, 25 bp, Homo sapien
tgaggttttgttcatgccccctttg

SEQ ID NO: 129274 - DNA, 25 bp, Homo sapien
cccctttgactgatcagtgtgataa

SEQ ID NO: 129275 - DNA, 25 bp, Homo sapien
gactgatcagtgtgataaggacttt

SEQ ID NO: 129276 - DNA, 25 bp, Homo sapien
tactgtttgtaataagtactttcgt

SEQ ID NO: 129277 - DNA, 25 bp, Homo sapien
agtactttcgttaatcttgctgctt

SEQ ID NO: 129278 - DNA, 25 bp, Homo sapien
actttcgttaatcttgctgcttatg

SEQ ID NO: 129279 - DNA, 25 bp, Homo sapien
ttcgttaatcttgctgcttatgtgc

SEQ ID NO: 129280 - DNA, 25 bp, Homo sapien
ctgcttatgtgccaatttagtggaa

SEQ ID NO: 129281 - DNA, 25 bp, Homo sapien
ttgctgaaaaattccctctttccat

SEQ ID NO: 129282 - DNA, 25 bp, Homo sapien
ttccctctttccattctctttcaat

SEQ ID NO: 129283 - DNA, 25 bp, Homo sapien
gggctgttcacgtggtcctaatctt

SEQ ID NO: 129284 - DNA, 25 bp, Homo sapien
cacgtggtcctaatcttctgaactt

SEQ ID NO: 129285 - DNA, 25 bp, Homo sapien
aatcttctgaacttggcgctgcccc

SEQ ID NO: 129286 - DNA, 25 bp, Homo sapien
cagcccctgttctggcagagttgaa

SEQ ID NO: 129287 - DNA, 25 bp, Homo sapien
gcagagttgaagacagagctacaca

SEQ ID NO: 129288 - DNA, 25 bp, Homo sapien
agaatgcacaaacagaggccgccat

SEQ ID NO: 129289 - DNA, 25 bp, Homo sapien
acagaggccgccattttggattctt

SEQ ID NO: 129290 - DNA, 25 bp, Homo sapien
ggacaatgacccagtggttcctaat

SEQ ID NO: 129291 - DNA, 25 bp, Homo sapien
tcctaatcctctaggaggtctctaa

SEQ ID NO: 129292 - DNA, 25 bp, Homo sapien
tcctctaggaggtctctaagaatat

SEQ ID NO: 129293 - DNA, 25 bp, Homo sapien
tcttctccactttctagccagagga

SEQ ID NO: 129294 - DNA, 25 bp, Homo sapien
tagctgagtgtagtgacgcatgccc

SEQ ID NO: 129295 - DNA, 25 bp, Homo sapien
agctgagtgtagtgacgcatgccct

SEQ ID NO: 129296 - DNA, 25 bp, Homo sapien
gctgagtgtagtgacgcatgccctc

SEQ ID NO: 129297 - DNA, 25 bp, Homo sapien
ctgagtgtagtgacgcatgccctca

SEQ ID NO: 129298 - DNA, 25 bp, Homo sapien
tgagtgtagtgacgcatgccctcaa

SEQ ID NO: 129299 - DNA, 25 bp, Homo sapien
agtgtagtgacgcatgccctcaatc

SEQ ID NO: 129300 - DNA, 25 bp, Homo sapien
gtgtagtgacgcatgccctcaatcc

SEQ ID NO: 129301 - DNA, 25 bp, Homo sapien
tgtagtgacgcatgccctcaatccc

SEQ ID NO: 129302 - DNA, 25 bp, Homo sapien
gtagtgacgcatgccctcaatccca

SEQ ID NO: 129303 - DNA, 25 bp, Homo sapien
tcacttgcactccggaggtagaggt

SEQ ID NO: 129304 - DNA, 25 bp, Homo sapien
cacttgcactccggaggtagaggtt

SEQ ID NO: 129305 - DNA, 25 bp, Homo sapien
ctttcagggatttctaagccaccag

SEQ ID NO: 129306 - DNA, 25 bp, Homo sapien
taagccaccagaatctcacatgaga

SEQ ID NO: 129307 - DNA, 25 bp, Homo sapien
atctcacatgagatgtgtgggtggt

SEQ ID NO: 129308 - DNA, 25 bp, Homo sapien
ttggtctctgttgtcactaaagact

SEQ ID NO: 129309 - DNA, 25 bp, Homo sapien
gtcactaaagactaaatgagggttt

SEQ ID NO: 129310 - DNA, 25 bp, Homo sapien
gaggtcaactgagatttggaaatca

SEQ ID NO: 129311 - DNA, 25 bp, Homo sapien
ggaaatcatctttgtaatatttgca

SEQ ID NO: 129312 - DNA, 25 bp, Homo sapien
atacttgttcttatctgtgtcctaa

SEQ ID NO: 129313 - DNA, 25 bp, Homo sapien
gtgtcctaaagatgtgttctctata

SEQ ID NO: 129314 - DNA, 25 bp, Homo sapien
aaaccaacgtgcctaattaattatg

SEQ ID NO: 129315 - DNA, 25 bp, Homo sapien
gaatctaaacaccactgaaaactta

SEQ ID NO: 129316 - DNA, 25 bp, Homo sapien
ccacgctatagtctctggaggtcat

SEQ ID NO: 129317 - DNA, 25 bp, Homo sapien
gaggtcatgaatgtggtgttgccac

SEQ ID NO: 129318 - DNA, 25 bp, Homo sapien
ggtgttgccacaaagcctggaatct

SEQ ID NO: 129319 - DNA, 25 bp, Homo sapien
ggaatctacaccctgttaaccaaga

SEQ ID NO: 129320 - DNA, 25 bp, Homo sapien
tggatcaaaagcaaccttgtcccgc

SEQ ID NO: 129321 - DNA, 25 bp, Homo sapien
tgtcccgcctcatacaaattaagtt

SEQ ID NO: 129322 - DNA, 25 bp, Homo sapien
taattttattggatgcacttgcttc

SEQ ID NO: 129323 - DNA, 25 bp, Homo sapien
ttcttttttcctaatatgctcgcag

SEQ ID NO: 129324 - DNA, 25 bp, Homo sapien
atatgctcgcaggttagagttgggt

SEQ ID NO: 129325 - DNA, 25 bp, Homo sapien
agttctttttcacttgtatcactga

SEQ ID NO: 129326 - DNA, 25 bp, Homo sapien
gtatcactgatgtatttctaccatg

SEQ ID NO: 129327 - DNA, 25 bp, Homo sapien
cgacatctttgagcgtatcgccgga

SEQ ID NO: 129328 - DNA, 25 bp, Homo sapien
acatctttgagcgtatcgccggaga

SEQ ID NO: 129329 - DNA, 25 bp, Homo sapien
catctttgagcgtatcgccggagaa

SEQ ID NO: 129330 - DNA, 25 bp, Homo sapien
atctttgagcgtatcgccggagaag

SEQ ID NO: 129331 - DNA, 25 bp, Homo sapien
tctttgagcgtatcgccggagaagc

SEQ ID NO: 129332 - DNA, 25 bp, Homo sapien
agcgtatcgccggagaagcgtcacg

SEQ ID NO: 129333 - DNA, 25 bp, Homo sapien
gtatcgccggagaagcgtcacgcct

SEQ ID NO: 129334 - DNA, 25 bp, Homo sapien
atcgccggagaagcgtcacgcctgg

SEQ ID NO: 129335 - DNA, 25 bp, Homo sapien
cggagaagcgtcacgcctggcgcat

SEQ ID NO: 129336 - DNA, 25 bp, Homo sapien
agaagcgtcacgcctggcgcattac

SEQ ID NO: 129337 - DNA, 25 bp, Homo sapien
tgcgcctactgctacccggggaatt

SEQ ID NO: 129338 - DNA, 25 bp, Homo sapien
agccgggctgacattcatctggtgg

SEQ ID NO: 129339 - DNA, 25 bp, Homo sapien
gggctgacattcatctggtggaact

SEQ ID NO: 129340 - DNA, 25 bp, Homo sapien
ggaacttctctactacgtcgaggag

SEQ ID NO: 129341 - DNA, 25 bp, Homo sapien
ttctctactacgtcgaggagcttga

SEQ ID NO: 129342 - DNA, 25 bp, Homo sapien
tacgtcgaggagcttgactccagtc

SEQ ID NO: 129343 - DNA, 25 bp, Homo sapien
cgaggagcttgactccagtcttatc

SEQ ID NO: 129344 - DNA, 25 bp, Homo sapien
gaagcctcccatggatgagaaatct

SEQ ID NO: 129345 - DNA, 25 bp, Homo sapien
gcctcccatggatgagaaatcttta

SEQ ID NO: 129346 - DNA, 25 bp, Homo sapien
aataacgcagtcatggaggccaaga

SEQ ID NO: 129347 - DNA, 25 bp, Homo sapien
aacgcagtcatggaggccaagaact

SEQ ID NO: 129348 - DNA, 25 bp, Homo sapien
ggccaagaacttgcaataccaatgt

SEQ ID NO: 129349 - DNA, 25 bp, Homo sapien
gaagtccactgaactgcttattcgt

SEQ ID NO: 129350 - DNA, 25 bp, Homo sapien
gtccactgaactgcttattcgtaaa

SEQ ID NO: 129351 - DNA, 25 bp, Homo sapien
gaactgcttattcgtaaactacctt

SEQ ID NO: 129352 - DNA, 25 bp, Homo sapien
gcttattcgtaaactacctttccag

SEQ ID NO: 129353 - DNA, 25 bp, Homo sapien
tattcgtaaactacctttccagcgc

SEQ ID NO: 129354 - DNA, 25 bp, Homo sapien
taaactacctttccagcgcctagtg

SEQ ID NO: 129355 - DNA, 25 bp, Homo sapien
tttccagcgcctagtgcgcgagatt

SEQ ID NO: 129356 - DNA, 25 bp, Homo sapien
gcgagattgcgcaggactttaaaac

SEQ ID NO: 129357 - DNA, 25 bp, Homo sapien
aacagacctgcgtttccagagctcc

SEQ ID NO: 129358 - DNA, 25 bp, Homo sapien
agctccgctgtgatggctctgcagg

SEQ ID NO: 129359 - DNA, 25 bp, Homo sapien
agggctatttgaggacactaacctg

SEQ ID NO: 129360 - DNA, 25 bp, Homo sapien
cttcagggtgatgccaggttctatt

SEQ ID NO: 129361 - DNA, 25 bp, Homo sapien
gaatttatatacaacctgcttgggt

SEQ ID NO: 129362 - DNA, 25 bp, Homo sapien
cattgtcttcggaaaccttggtgta

SEQ ID NO: 129363 - DNA, 25 bp, Homo sapien
gaactgatagttactgttgtgacct

SEQ ID NO: 129364 - DNA, 25 bp, Homo sapien
agttactgttgtgacctgaagttca

SEQ ID NO: 129365 - DNA, 25 bp, Homo sapien
tacccaagcaaaatcatggaatggt

SEQ ID NO: 129366 - DNA, 25 bp, Homo sapien
atggttataaaagtgattgttggca

SEQ ID NO: 129367 - DNA, 25 bp, Homo sapien
gattgttggcacatcctatgcaata

SEQ ID NO: 129368 - DNA, 25 bp, Homo sapien
ctaaattgaataatggtaccagata

SEQ ID NO: 129369 - DNA, 25 bp, Homo sapien
ggaatgaagcttgtgtatccattat

SEQ ID NO: 129370 - DNA, 25 bp, Homo sapien
gaagcttgtgtatccattatcatgt

SEQ ID NO: 129371 - DNA, 25 bp, Homo sapien
gacttcttcacctggctaggctatt

SEQ ID NO: 129372 - DNA, 25 bp, Homo sapien
ggctaggctatttaaactccctcat

SEQ ID NO: 129373 - DNA, 25 bp, Homo sapien
taaactccctcatcaatccaataat

SEQ ID NO: 129374 - DNA, 25 bp, Homo sapien
caatccaataatctacactgtgttt

SEQ ID NO: 129375 - DNA, 25 bp, Homo sapien
aagagtttcggcaagcttttcagaa

SEQ ID NO: 129376 - DNA, 25 bp, Homo sapien
tcagaaaattgtccctttccggaag

SEQ ID NO: 129377 - DNA, 25 bp, Homo sapien
gaaaatcaagcttgctgacagtgcc

SEQ ID NO: 129378 - DNA, 25 bp, Homo sapien
acagtgccctggaacgcaagaggat

SEQ ID NO: 129379 - DNA, 25 bp, Homo sapien
gaggatttctgctgctcgagaaagg

SEQ ID NO: 129380 - DNA, 25 bp, Homo sapien
gctgctcgagaaaggaaagccacta

SEQ ID NO: 129381 - DNA, 25 bp, Homo sapien
agccactaaaatcctgggcatcatt

SEQ ID NO: 129382 - DNA, 25 bp, Homo sapien
tgcctccctttcatacaatggccaa

SEQ ID NO: 129383 - DNA, 25 bp, Homo sapien
caatggccaacttattgtattcctc

SEQ ID NO: 129384 - DNA, 25 bp, Homo sapien
gtcatcaaaacctgcgcagtcattg

SEQ ID NO: 129385 - DNA, 25 bp, Homo sapien
aaaacctgcgcagtcattggcccaa

SEQ ID NO: 129386 - DNA, 25 bp, Homo sapien
tgcgcagtcattggcccaacaagaa

SEQ ID NO: 129387 - DNA, 25 bp, Homo sapien
attggcccaacaagaaggtttctgt

SEQ ID NO: 129388 - DNA, 25 bp, Homo sapien
aacaagaaggtttctgtcctaatca

SEQ ID NO: 129389 - DNA, 25 bp, Homo sapien
taacttgagggtcgttttgactact

SEQ ID NO: 129390 - DNA, 25 bp, Homo sapien
ggtcgttttgactactagagctcca

SEQ ID NO: 129391 - DNA, 25 bp, Homo sapien
tttaatcttccattccttcacatag

SEQ ID NO: 129392 - DNA, 25 bp, Homo sapien
atcttccattccttcacatagtttg

SEQ ID NO: 129393 - DNA, 25 bp, Homo sapien
actacatcaaggtgcagttcctcga

SEQ ID NO: 129394 - DNA, 25 bp, Homo sapien
atcaaggtgcagttcctcgagctca

SEQ ID NO: 129395 - DNA, 25 bp, Homo sapien
aaggtgcagttcctcgagctcaaca

SEQ ID NO: 129396 - DNA, 25 bp, Homo sapien
atctattcccacatgacgtgcgcca

SEQ ID NO: 129397 - DNA, 25 bp, Homo sapien
gggacaaggagcttccgtctggcaa

SEQ ID NO: 129398 - DNA, 25 bp, Homo sapien
aaggagcttccgtctggcaaggccg

SEQ ID NO: 129399 - DNA, 25 bp, Homo sapien
acaatttgcactcccctcagctaga

SEQ ID NO: 129400 - DNA, 25 bp, Homo sapien
acacctacgaggacgccggcaacta

SEQ ID NO: 129401 - DNA, 25 bp, Homo sapien
gaggacgccggcaactacatcaagg

SEQ ID NO: 129402 - DNA, 25 bp, Homo sapien
ggacgccggcaactacatcaaggtg

SEQ ID NO: 129403 - DNA, 25 bp, Homo sapien
gccggcaactacatcaaggtgcagt

SEQ ID NO: 129404 - DNA, 25 bp, Homo sapien
cgactacatcttggacctgcagatc

SEQ ID NO: 129405 - DNA, 25 bp, Homo sapien
gcatcccactattgtcagcctgcat

SEQ ID NO: 129406 - DNA, 25 bp, Homo sapien
atcccactattgtcagcctgcatca

SEQ ID NO: 129407 - DNA, 25 bp, Homo sapien
tgcatcaccagagacccgggcagaa

SEQ ID NO: 129408 - DNA, 25 bp, Homo sapien
gcatcaccagagacccgggcagaac

SEQ ID NO: 129409 - DNA, 25 bp, Homo sapien
tgaccaccctcaacacggatatcag

SEQ ID NO: 129410 - DNA, 25 bp, Homo sapien
aacacggatatcagcatcctgtcct

SEQ ID NO: 129411 - DNA, 25 bp, Homo sapien
acacggatatcagcatcctgtcctt

SEQ ID NO: 129412 - DNA, 25 bp, Homo sapien
acggatatcagcatcctgtccttgc

SEQ ID NO: 129413 - DNA, 25 bp, Homo sapien
ggatatcagcatcctgtccttgcag

SEQ ID NO: 129414 - DNA, 25 bp, Homo sapien
gatatcagcatcctgtccttgcagg

SEQ ID NO: 129415 - DNA, 25 bp, Homo sapien
tcctttgtgggctggttccttggct

SEQ ID NO: 129416 - DNA, 25 bp, Homo sapien
ggttccttggctgggatgatgatta

SEQ ID NO: 129417 - DNA, 25 bp, Homo sapien
gatgattactggtctgtggacccct

SEQ ID NO: 129418 - DNA, 25 bp, Homo sapien
ctgtggaccccttggacagggccat

SEQ ID NO: 129419 - DNA, 25 bp, Homo sapien
atgtcaccggtcagtgccttttgga

SEQ ID NO: 129420 - DNA, 25 bp, Homo sapien
gtcagtgccttttggaactgtcctt

SEQ ID NO: 129421 - DNA, 25 bp, Homo sapien
ggaactgtccttccctcaaagaggc

SEQ ID NO: 129422 - DNA, 25 bp, Homo sapien
aagaggccttagagcgagcagagca

SEQ ID NO: 129423 - DNA, 25 bp, Homo sapien
gagcagctctgctatgagtgtgtgt

SEQ ID NO: 129424 - DNA, 25 bp, Homo sapien
gtatccaaaaatagccctgcaaaaa

SEQ ID NO: 129425 - DNA, 25 bp, Homo sapien
attcagagtccttgcaaaattgtct

SEQ ID NO: 129426 - DNA, 25 bp, Homo sapien
tgtccgtgcccatgcatctggaaat

SEQ ID NO: 129427 - DNA, 25 bp, Homo sapien
tagagttgtaggtgaattttctttt

SEQ ID NO: 129428 - DNA, 25 bp, Homo sapien
ttcctccaattcatttgttaagtct

SEQ ID NO: 129429 - DNA, 25 bp, Homo sapien
tttctttggtgtttgaagaggctct

SEQ ID NO: 129430 - DNA, 25 bp, Homo sapien
aagaggctctgggatagatggttaa

SEQ ID NO: 129431 - DNA, 25 bp, Homo sapien
tagtttagggaaagccctcccacag

SEQ ID NO: 129432 - DNA, 25 bp, Homo sapien
ttagggaaagccctcccacaggtgg

SEQ ID NO: 129433 - DNA, 25 bp, Homo sapien
gaaagccctcccacaggtgggaaat

SEQ ID NO: 129434 - DNA, 25 bp, Homo sapien
tcccacaggtgggaaattgctctcc

SEQ ID NO: 129435 - DNA, 25 bp, Homo sapien
ctgtggcttggacttacgtttattg

SEQ ID NO: 129436 - DNA, 25 bp, Homo sapien
ggcttggacttacgtttattgtcaa

SEQ ID NO: 129437 - DNA, 25 bp, Homo sapien
aagcctctctgcaaggagcccaatg

SEQ ID NO: 129438 - DNA, 25 bp, Homo sapien
agcccaatgcccaggagatacttca

SEQ ID NO: 129439 - DNA, 25 bp, Homo sapien
atgcccaggagatacttcagaggct

SEQ ID NO: 129440 - DNA, 25 bp, Homo sapien
gaggaaatcgctgaggacccgggca

SEQ ID NO: 129441 - DNA, 25 bp, Homo sapien
catgtgaaatctgtgcctacgctgc

SEQ ID NO: 129442 - DNA, 25 bp, Homo sapien
gaaatctgtgcctacgctgcctgta

SEQ ID NO: 129443 - DNA, 25 bp, Homo sapien
tacgctgcctgtaccggatgctagg

SEQ ID NO: 129444 - DNA, 25 bp, Homo sapien
gggaagctcttttctcctgcagaaa

SEQ ID NO: 129445 - DNA, 25 bp, Homo sapien
tcttttctcctgcagaaagggccac

SEQ ID NO: 129446 - DNA, 25 bp, Homo sapien
aaagggccacccatgatactccact

SEQ ID NO: 129447 - DNA, 25 bp, Homo sapien
taccctggtccagtcgggaggagca

SEQ ID NO: 129448 - DNA, 25 bp, Homo sapien
tcagagaatctctgtggaactgccc

SEQ ID NO: 129449 - DNA, 25 bp, Homo sapien
gaactgcccgttccaatataataat

SEQ ID NO: 129450 - DNA, 25 bp, Homo sapien
tctcctcctttacaagagctttcct

SEQ ID NO: 129451 - DNA, 25 bp, Homo sapien
tctctcttgctctcagagacctata

SEQ ID NO: 129452 - DNA, 25 bp, Homo sapien
taaatccaaccagttaccctgcaag

SEQ ID NO: 129453 - DNA, 25 bp, Homo sapien
catctgctgttccttggtctctaat

SEQ ID NO: 129454 - DNA, 25 bp, Homo sapien
ggtctctaatcacctgagctgggta

SEQ ID NO: 129455 - DNA, 25 bp, Homo sapien
gattctgggagttgagagctctgcc

SEQ ID NO: 129456 - DNA, 25 bp, Homo sapien
agctctgccagggtgagatgtttcc

SEQ ID NO: 129457 - DNA, 25 bp, Homo sapien
tgtttcctgaagagaggttccccac

SEQ ID NO: 129458 - DNA, 25 bp, Homo sapien
tcactgtactgatttactggcgcat

SEQ ID NO: 129459 - DNA, 25 bp, Homo sapien
aaagaactgccccatctcctcccat

SEQ ID NO: 129460 - DNA, 25 bp, Homo sapien
acagcctctcccttaatgagcaagg

SEQ ID NO: 129461 - DNA, 25 bp, Homo sapien
cagcctctcccttaatgagcaagga

SEQ ID NO: 129462 - DNA, 25 bp, Homo sapien
agcctctcccttaatgagcaaggac

SEQ ID NO: 129463 - DNA, 25 bp, Homo sapien
gcaggcccagcagacttgagtctga

SEQ ID NO: 129464 - DNA, 25 bp, Homo sapien
agcagacttgagtctgaggccccag

SEQ ID NO: 129465 - DNA, 25 bp, Homo sapien
agacttgagtctgaggccccaggcc

SEQ ID NO: 129466 - DNA, 25 bp, Homo sapien
cccagagccactacctttgtccagg

SEQ ID NO: 129467 - DNA, 25 bp, Homo sapien
agggcgtttggccctgtgactatgg

SEQ ID NO: 129468 - DNA, 25 bp, Homo sapien
ttcatgctttctcctttttctacct

SEQ ID NO: 129469 - DNA, 25 bp, Homo sapien
catgctttctcctttttctaccttt

SEQ ID NO: 129470 - DNA, 25 bp, Homo sapien
tcacacaatgcccaacttactgtct

SEQ ID NO: 129471 - DNA, 25 bp, Homo sapien
atgcccaacttactgtcttcttcat

SEQ ID NO: 129472 - DNA, 25 bp, Homo sapien
ttcatgtcatcaaaatctgcacagt

SEQ ID NO: 129473 - DNA, 25 bp, Homo sapien
aaaatctgcacagtcactggcccaa

SEQ ID NO: 129474 - DNA, 25 bp, Homo sapien
ggcccaaccagaactttctgtccta

SEQ ID NO: 129475 - DNA, 25 bp, Homo sapien
aacaatatgatttgctgttaccaaa

SEQ ID NO: 129476 - DNA, 25 bp, Homo sapien
gaacaattgtggtctctcttaactt

SEQ ID NO: 129477 - DNA, 25 bp, Homo sapien
gtctctcttaacttgaggttctctt

SEQ ID NO: 129478 - DNA, 25 bp, Homo sapien
ttgactaatagagctccatttcccc

SEQ ID NO: 129479 - DNA, 25 bp, Homo sapien
ttctctttaatctcctattccttca

SEQ ID NO: 129480 - DNA, 25 bp, Homo sapien
tttaatctcctattccttcacacag

SEQ ID NO: 129481 - DNA, 25 bp, Homo sapien
agttctgggaggagacattgtcttc

SEQ ID NO: 129482 - DNA, 25 bp, Homo sapien
ttgtcttcagactacaatgtccagt

SEQ ID NO: 129483 - DNA, 25 bp, Homo sapien
ctagactcaggcttcctttggagat

SEQ ID NO: 129484 - DNA, 25 bp, Homo sapien
tcctttggagattaaggcccctcag

SEQ ID NO: 129485 - DNA, 25 bp, Homo sapien
ggcccctcagagatcaacagaccaa

SEQ ID NO: 129486 - DNA, 25 bp, Homo sapien
agaccaacatttttctcttcctcaa

SEQ ID NO: 129487 - DNA, 25 bp, Homo sapien
atttttctcttcctcaagcaacact

SEQ ID NO: 129488 - DNA, 25 bp, Homo sapien
aagcaacactcctagggcctggctt

SEQ ID NO: 129489 - DNA, 25 bp, Homo sapien
tggcttctgtctgatcaaggcacca

SEQ ID NO: 129490 - DNA, 25 bp, Homo sapien
aggcaccacacaacccagaaaggag

SEQ ID NO: 129491 - DNA, 25 bp, Homo sapien
gagaaaagttcagcccaagtaaaat

SEQ ID NO: 129492 - DNA, 25 bp, Homo sapien
gcgaagcgcaagatggccctggccc

SEQ ID NO: 129493 - DNA, 25 bp, Homo sapien
ttcatcgtggctcttgttctgccct

SEQ ID NO: 129494 - DNA, 25 bp, Homo sapien
ttctgcgagagcagctgccacatgc

SEQ ID NO: 129495 - DNA, 25 bp, Homo sapien
cctgttgggcgccataatcaattgg

SEQ ID NO: 129496 - DNA, 25 bp, Homo sapien
aatcaattggctgggctactccaac

SEQ ID NO: 129497 - DNA, 25 bp, Homo sapien
tgggctactccaactctctgcttaa

SEQ ID NO: 129498 - DNA, 25 bp, Homo sapien
tgcttaaccccgtcatttacgcata

SEQ ID NO: 129499 - DNA, 25 bp, Homo sapien
gtcatttacgcatacttcaacaagg

SEQ ID NO: 129500 - DNA, 25 bp, Homo sapien
tcaacaaggactttcaaaacgcgtt

SEQ ID NO: 129501 - DNA, 25 bp, Homo sapien
attaagtgtaacttctgccgccagt

SEQ ID NO: 129502 - DNA, 25 bp, Homo sapien
caacgccgaggcgaagcgcaagatg

SEQ ID NO: 129503 - DNA, 25 bp, Homo sapien
accaagttcctcatcgacaagaacg

SEQ ID NO: 129504 - DNA, 25 bp, Homo sapien
tcctcatcgacaagaacggctgcgt

SEQ ID NO: 129505 - DNA, 25 bp, Homo sapien
ctgcgtggtgaagcgctacggaccc

SEQ ID NO: 129506 - DNA, 25 bp, Homo sapien
gagcccctggtgatagagaaggacc

SEQ ID NO: 129507 - DNA, 25 bp, Homo sapien
gtgatagagaaggacctgccccact

SEQ ID NO: 129508 - DNA, 25 bp, Homo sapien
tagagaaggacctgccccactattt

SEQ ID NO: 129509 - DNA, 25 bp, Homo sapien
actatttctagctccacaagtgtgt

SEQ ID NO: 129510 - DNA, 25 bp, Homo sapien
ttctagctccacaagtgtgtggccc

SEQ ID NO: 129511 - DNA, 25 bp, Homo sapien
tggagccttccaccggcactcatga

SEQ ID NO: 129512 - DNA, 25 bp, Homo sapien
gggcagacccgaaaatccagcgtgc

SEQ ID NO: 129513 - DNA, 25 bp, Homo sapien
gcaccccgccggaggaaggtcccat

SEQ ID NO: 129514 - DNA, 25 bp, Homo sapien
gaagccccacagctttgatggcagc

SEQ ID NO: 129515 - DNA, 25 bp, Homo sapien
gcagatgacacattcaaagaagaac

SEQ ID NO: 129516 - DNA, 25 bp, Homo sapien
gaaaagctttccctcctggctgtta

SEQ ID NO: 129517 - DNA, 25 bp, Homo sapien
gctttccctcctggctgttattctt

SEQ ID NO: 129518 - DNA, 25 bp, Homo sapien
tttccctcctggctgttattcttcc

SEQ ID NO: 129519 - DNA, 25 bp, Homo sapien
ctcctggctgttattcttccacaag

SEQ ID NO: 129520 - DNA, 25 bp, Homo sapien
attcttccacaagagagggctttct

SEQ ID NO: 129521 - DNA, 25 bp, Homo sapien
acaagagagggctttctcaggacct

SEQ ID NO: 129522 - DNA, 25 bp, Homo sapien
gagagggctttctcaggacctggtt

SEQ ID NO: 129523 - DNA, 25 bp, Homo sapien
gggctttctcaggacctggttgcta

SEQ ID NO: 129524 - DNA, 25 bp, Homo sapien
ctcaggacctggttgctactggttc

SEQ ID NO: 129525 - DNA, 25 bp, Homo sapien
ggcatgcggcccaacgccaagaaca

SEQ ID NO: 129526 - DNA, 25 bp, Homo sapien
gcatgcggcccaacgccaagaacaa

SEQ ID NO: 129527 - DNA, 25 bp, Homo sapien
caacgccaagaacaaccgggacctg

SEQ ID NO: 129528 - DNA, 25 bp, Homo sapien
gggacctggacttcaccatcgacct

SEQ ID NO: 129529 - DNA, 25 bp, Homo sapien
ccatcgacctggacttcaagggcca

SEQ ID NO: 129530 - DNA, 25 bp, Homo sapien
tcaagggccagctgtgcgagctgtc

SEQ ID NO: 129531 - DNA, 25 bp, Homo sapien
accgactaccggatgcgctgaggcc

SEQ ID NO: 129532 - DNA, 25 bp, Homo sapien
gggctgagcgttcctaggcggtttc

SEQ ID NO: 129533 - DNA, 25 bp, Homo sapien
ctgagcgttcctaggcggtttcggg

SEQ ID NO: 129534 - DNA, 25 bp, Homo sapien
ggagggcacatcgtgactgtgtttt

SEQ ID NO: 129535 - DNA, 25 bp, Homo sapien
agatcttcggcaccatcggcatgcg

SEQ ID NO: 129536 - DNA, 25 bp, Homo sapien
gtctctgattctccctttatgaagc

SEQ ID NO: 129537 - DNA, 25 bp, Homo sapien
tttatgaagctgcaggctgacgaga

SEQ ID NO: 129538 - DNA, 25 bp, Homo sapien
tgacgagagatggtcccttcccatt

SEQ ID NO: 129539 - DNA, 25 bp, Homo sapien
tggagtcgaccccaagcgacagagt

SEQ ID NO: 129540 - DNA, 25 bp, Homo sapien
gacagagtgaccagaaaccctttta

SEQ ID NO: 129541 - DNA, 25 bp, Homo sapien
aacccttttacagtcacattcagag

SEQ ID NO: 129542 - DNA, 25 bp, Homo sapien
attcagagtcgctgctggcctcagg

SEQ ID NO: 129543 - DNA, 25 bp, Homo sapien
agaaaacctaccacattcactactg

SEQ ID NO: 129544 - DNA, 25 bp, Homo sapien
actactgcaaaatgtgtcctgtcta

SEQ ID NO: 129545 - DNA, 25 bp, Homo sapien
gtgtcctgtctaaaaatgattctct

SEQ ID NO: 129546 - DNA, 25 bp, Homo sapien
gattctctaaactttccctatactt

SEQ ID NO: 129547 - DNA, 25 bp, Homo sapien
gtgcttacatccttaaaggcaccat

SEQ ID NO: 129548 - DNA, 25 bp, Homo sapien
aaaggcaccatctaatagcgggtta

SEQ ID NO: 129549 - DNA, 25 bp, Homo sapien
tagcgggttactttcacatacagcc

SEQ ID NO: 129550 - DNA, 25 bp, Homo sapien
ccccagcagttgaatgacaacagaa

SEQ ID NO: 129551 - DNA, 25 bp, Homo sapien
atgacaacagaagcttcagaagttt

SEQ ID NO: 129552 - DNA, 25 bp, Homo sapien
aagcttcagaagtttggcaatagtt

SEQ ID NO: 129553 - DNA, 25 bp, Homo sapien
gcaatagtttgcatagaggtaccag

SEQ ID NO: 129554 - DNA, 25 bp, Homo sapien
agaggtaccagcaatatgtaaatag

SEQ ID NO: 129555 - DNA, 25 bp, Homo sapien
gtgcagaatctcataggttgccaat

SEQ ID NO: 129556 - DNA, 25 bp, Homo sapien
ggttgccaataatacactaattcct

SEQ ID NO: 129557 - DNA, 25 bp, Homo sapien
attcctttctatcctacaacaagag

SEQ ID NO: 129558 - DNA, 25 bp, Homo sapien
atcattaaatactctcttcacccaa

SEQ ID NO: 129559 - DNA, 25 bp, Homo sapien
actctcttcacccaaatatgcttga

SEQ ID NO: 129560 - DNA, 25 bp, Homo sapien
aaatatgcttgattattctgcaaaa

SEQ ID NO: 129561 - DNA, 25 bp, Homo sapien
taacattttcagatatcagataact

SEQ ID NO: 129562 - DNA, 25 bp, Homo sapien
tcagatatcagataactgcagattt

SEQ ID NO: 129563 - DNA, 25 bp, Homo sapien
ggaactatatataagctagcacatg

SEQ ID NO: 129564 - DNA, 25 bp, Homo sapien
gctagcacatgattatccttctgtt

SEQ ID NO: 129565 - DNA, 25 bp, Homo sapien
ttatccttctgttcttagatctgta

SEQ ID NO: 129566 - DNA, 25 bp, Homo sapien
ctgttcttagatctgtatcttcata

SEQ ID NO: 129567 - DNA, 25 bp, Homo sapien
tttgcccaagtcctgtttccttaga

SEQ ID NO: 129568 - DNA, 25 bp, Homo sapien
gcccaagtcctgtttccttagaatt

SEQ ID NO: 129569 - DNA, 25 bp, Homo sapien
actgcaccattgctgctccttagct

SEQ ID NO: 129570 - DNA, 25 bp, Homo sapien
attgctgctccttagctgccaagcc

SEQ ID NO: 129571 - DNA, 25 bp, Homo sapien
tgcccttctcatttggaaactaaaa

SEQ ID NO: 129572 - DNA, 25 bp, Homo sapien
actaaaacttcatcttccccaagtg

SEQ ID NO: 129573 - DNA, 25 bp, Homo sapien
aggcatggcgtagagggtgctgccc

SEQ ID NO: 129574 - DNA, 25 bp, Homo sapien
agggtgctgccccatgaagccacag

SEQ ID NO: 129575 - DNA, 25 bp, Homo sapien
tgtggccatggtccccaagacctct

SEQ ID NO: 129576 - DNA, 25 bp, Homo sapien
atggtccccaagacctctatatttg

SEQ ID NO: 129577 - DNA, 25 bp, Homo sapien
tccccaagacctctatatttgctct

SEQ ID NO: 129578 - DNA, 25 bp, Homo sapien
aagacctctatatttgctcttttat

SEQ ID NO: 129579 - DNA, 25 bp, Homo sapien
aataaacaagatcgtcaggaccaaa

SEQ ID NO: 129580 - DNA, 25 bp, Homo sapien
gaaggcacagccagcgttgtggcct

SEQ ID NO: 129581 - DNA, 25 bp, Homo sapien
tgctgggaccctgatctgggccttc

SEQ ID NO: 129582 - DNA, 25 bp, Homo sapien
gggcctatgggcaactgcgttgaaa

SEQ ID NO: 129583 - DNA, 25 bp, Homo sapien
actgcgttgaaaggacgttcgccaa

SEQ ID NO: 129584 - DNA, 25 bp, Homo sapien
gacgttcgccaagggccgtgtgtaa

SEQ ID NO: 129585 - DNA, 25 bp, Homo sapien
gtgtaaatacgaactgcgccatgga

SEQ ID NO: 129586 - DNA, 25 bp, Homo sapien
aggcactgccggagcccttgccaga

SEQ ID NO: 129587 - DNA, 25 bp, Homo sapien
ctctgtgcagtagctgtgtgtccga

SEQ ID NO: 129588 - DNA, 25 bp, Homo sapien
gtccgaggtcagtgtgcggaatcac

SEQ ID NO: 129589 - DNA, 25 bp, Homo sapien
gtgcggaatcacagccaaggacgtg

SEQ ID NO: 129590 - DNA, 25 bp, Homo sapien
cagccaaggacgtgaagagatgtac

SEQ ID NO: 129591 - DNA, 25 bp, Homo sapien
aaactcaatgatgctaccatgcctc

SEQ ID NO: 129592 - DNA, 25 bp, Homo sapien
cccctgacattatcttggatcctat

SEQ ID NO: 129593 - DNA, 25 bp, Homo sapien
tggatcctatggtttctccatccaa

SEQ ID NO: 129594 - DNA, 25 bp, Homo sapien
tggtttctccatccaattctttgaa

SEQ ID NO: 129595 - DNA, 25 bp, Homo sapien
caattctttgaatttcccagtctcc

SEQ ID NO: 129596 - DNA, 25 bp, Homo sapien
tcccagtctcccctatgtaaaactt

SEQ ID NO: 129597 - DNA, 25 bp, Homo sapien
gggacctcattcctgggactatgct

SEQ ID NO: 129598 - DNA, 25 bp, Homo sapien
attcctgggactatgctgtaaccaa

SEQ ID NO: 129599 - DNA, 25 bp, Homo sapien
gtaaccaaattattgtccaaggcta

SEQ ID NO: 129600 - DNA, 25 bp, Homo sapien
gtccaaggctatatttctgggatga

SEQ ID NO: 129601 - DNA, 25 bp, Homo sapien
gggctctcagtgtgccatagaggac

SEQ ID NO: 129602 - DNA, 25 bp, Homo sapien
caaggagagctattccgtgtacgtg

SEQ ID NO: 129603 - DNA, 25 bp, Homo sapien
gagctattccgtgtacgtgtacaag

SEQ ID NO: 129604 - DNA, 25 bp, Homo sapien
cggcatctcatccaaggccatgggc

SEQ ID NO: 129605 - DNA, 25 bp, Homo sapien
atccaaggccatgggcatcatgaac

SEQ ID NO: 129606 - DNA, 25 bp, Homo sapien
aacgatatcttcgagcgcatcgctg

SEQ ID NO: 129607 - DNA, 25 bp, Homo sapien
cgatatcttcgagcgcatcgctggc

SEQ ID NO: 129608 - DNA, 25 bp, Homo sapien
ggagctggctaagcacgccgtgtca

SEQ ID NO: 129609 - DNA, 25 bp, Homo sapien
gagctggctaagcacgccgtgtcag

SEQ ID NO: 129610 - DNA, 25 bp, Homo sapien
agctggctaagcacgccgtgtcaga

SEQ ID NO: 129611 - DNA, 25 bp, Homo sapien
gctggctaagcacgccgtgtcagag

SEQ ID NO: 129612 - DNA, 25 bp, Homo sapien
ctggctaagcacgccgtgtcagagg

SEQ ID NO: 129613 - DNA, 25 bp, Homo sapien
tggtcaaccctcaaacattccggac

SEQ ID NO: 129614 - DNA, 25 bp, Homo sapien
ggactcccctcataacaatagacac

SEQ ID NO: 129615 - DNA, 25 bp, Homo sapien
aacaatagacacatgtgcccagcaa

SEQ ID NO: 129616 - DNA, 25 bp, Homo sapien
aataatccgccccttcctgtgtgcg

SEQ ID NO: 129617 - DNA, 25 bp, Homo sapien
gggtgcgtgctctctgtgtgtacct

SEQ ID NO: 129618 - DNA, 25 bp, Homo sapien
tgcgtgctctctgtgtgtacctgtg

SEQ ID NO: 129619 - DNA, 25 bp, Homo sapien
cgaggctgtgcctgtgccccaggtc

SEQ ID NO: 129620 - DNA, 25 bp, Homo sapien
gactgtgatggccatcctggtccca

SEQ ID NO: 129621 - DNA, 25 bp, Homo sapien
atcctggtcccagtgttagggtagc

SEQ ID NO: 129622 - DNA, 25 bp, Homo sapien
cagtgttagggtagcatgggattac

SEQ ID NO: 129623 - DNA, 25 bp, Homo sapien
agcatgggattacagggccctgttt

SEQ ID NO: 129624 - DNA, 25 bp, Homo sapien
gattcgccgctatcagaagtcgact

SEQ ID NO: 129625 - DNA, 25 bp, Homo sapien
gctgatccgcaagttgcctttccaa

SEQ ID NO: 129626 - DNA, 25 bp, Homo sapien
tgatccgcaagttgcctttccaacg

SEQ ID NO: 129627 - DNA, 25 bp, Homo sapien
gcaagttgcctttccaacgcctggt

SEQ ID NO: 129628 - DNA, 25 bp, Homo sapien
aagttgcctttccaacgcctggtgc

SEQ ID NO: 129629 - DNA, 25 bp, Homo sapien
ttgcctttccaacgcctggtgcgag

SEQ ID NO: 129630 - DNA, 25 bp, Homo sapien
aaatcgctcaggacttcaagacaga

SEQ ID NO: 129631 - DNA, 25 bp, Homo sapien
caagacagatctgcgctttcagagt

SEQ ID NO: 129632 - DNA, 25 bp, Homo sapien
gacagatctgcgctttcagagttcc

SEQ ID NO: 129633 - DNA, 25 bp, Homo sapien
cagatctgcgctttcagagttccgc

SEQ ID NO: 129634 - DNA, 25 bp, Homo sapien
agagttccgcggtgatggccctgca

SEQ ID NO: 129635 - DNA, 25 bp, Homo sapien
atatgctatagggacgttccatgcc

SEQ ID NO: 129636 - DNA, 25 bp, Homo sapien
tatagggacgttccatgcccaggtt

SEQ ID NO: 129637 - DNA, 25 bp, Homo sapien
gggacgttccatgcccaggttaaca

SEQ ID NO: 129638 - DNA, 25 bp, Homo sapien
gcccaggttaacaaagaactgtgat

SEQ ID NO: 129639 - DNA, 25 bp, Homo sapien
tctcttctgtattgtaacttagatg

SEQ ID NO: 129640 - DNA, 25 bp, Homo sapien
ctcttctgtattgtaacttagatga

SEQ ID NO: 129641 - DNA, 25 bp, Homo sapien
tcttctgtattgtaacttagatgat

SEQ ID NO: 129642 - DNA, 25 bp, Homo sapien
cttctgtattgtaacttagatgatt

SEQ ID NO: 129643 - DNA, 25 bp, Homo sapien
gtaacttagatgattcccaaggact

SEQ ID NO: 129644 - DNA, 25 bp, Homo sapien
gatgattcccaaggactctaataaa

SEQ ID NO: 129645 - DNA, 25 bp, Homo sapien
taaaaaatcacttcattgtatttgg

SEQ ID NO: 129646 - DNA, 25 bp, Homo sapien
ataccgcatcacactaccactgctt

SEQ ID NO: 129647 - DNA, 25 bp, Homo sapien
ctaccactgctttttgaagaattat

SEQ ID NO: 129648 - DNA, 25 bp, Homo sapien
accactgctttttgaagaattatca

SEQ ID NO: 129649 - DNA, 25 bp, Homo sapien
gatacttcccttcctaattatcatt

SEQ ID NO: 129650 - DNA, 25 bp, Homo sapien
tacttcccttcctaattatcatttg

SEQ ID NO: 129651 - DNA, 25 bp, Homo sapien
ttcccttcctaattatcatttgatt

SEQ ID NO: 129652 - DNA, 25 bp, Homo sapien
catttgattagatacttgcaattta

SEQ ID NO: 129653 - DNA, 25 bp, Homo sapien
ttaaatgttaagctgttttcactgc

SEQ ID NO: 129654 - DNA, 25 bp, Homo sapien
atgttaagctgttttcactgctgtt

SEQ ID NO: 129655 - DNA, 25 bp, Homo sapien
ttaagctgttttcactgctgtttct

SEQ ID NO: 129656 - DNA, 25 bp, Homo sapien
cactgctgtttctgagtaatagaaa

SEQ ID NO: 129657 - DNA, 25 bp, Homo sapien
accaagcctgccattcggcgtctag

SEQ ID NO: 129658 - DNA, 25 bp, Homo sapien
cattcggcgtctagctcggcgtggc

SEQ ID NO: 129659 - DNA, 25 bp, Homo sapien
gcgttaagcggatctctggcctcat

SEQ ID NO: 129660 - DNA, 25 bp, Homo sapien
ctctggcctcatttacgaggagacc

SEQ ID NO: 129661 - DNA, 25 bp, Homo sapien
agacccgcggtgtgctgaaagtgtt

SEQ ID NO: 129662 - DNA, 25 bp, Homo sapien
atgtgattcgggacgcagtcaccta

SEQ ID NO: 129663 - DNA, 25 bp, Homo sapien
gggacgcagtcacctacaccgagca

SEQ ID NO: 129664 - DNA, 25 bp, Homo sapien
gggagaaccctctacggcttcggag

SEQ ID NO: 129665 - DNA, 25 bp, Homo sapien
tctacggcttcggaggctaggcgcc

SEQ ID NO: 129666 - DNA, 25 bp, Homo sapien
ggctaggcgccgctccagctttgca

SEQ ID NO: 129667 - DNA, 25 bp, Homo sapien
gcgccaccgcaaggtcttgagagac

SEQ ID NO: 129668 - DNA, 25 bp, Homo sapien
ttggtcaactatattccccagggtt

SEQ ID NO: 129669 - DNA, 25 bp, Homo sapien
attccccagggttcaatagattcac

SEQ ID NO: 129670 - DNA, 25 bp, Homo sapien
cagggttcaatagattcactctttg

SEQ ID NO: 129671 - DNA, 25 bp, Homo sapien
cactctttgaaggaacgtggtactt

SEQ ID NO: 129672 - DNA, 25 bp, Homo sapien
cacagaagaacttacgctcggcgtc

SEQ ID NO: 129673 - DNA, 25 bp, Homo sapien
gaaggagtaggacttgtgcattcaa

SEQ ID NO: 129674 - DNA, 25 bp, Homo sapien
gtgcattcaaacatagcaactgagc

SEQ ID NO: 129675 - DNA, 25 bp, Homo sapien
gcaactgagcatattccaagccctg

SEQ ID NO: 129676 - DNA, 25 bp, Homo sapien
attccaagccctgccaagaaagtac

SEQ ID NO: 129677 - DNA, 25 bp, Homo sapien
gcagaacctgaagcagctgtcatta

SEQ ID NO: 129678 - DNA, 25 bp, Homo sapien
atactctgtgaggtgcaagacttca

SEQ ID NO: 129679 - DNA, 25 bp, Homo sapien
acagacaaatgggataacactcatt

SEQ ID NO: 129680 - DNA, 25 bp, Homo sapien
aacactcattaattggtgggcgatg

SEQ ID NO: 129681 - DNA, 25 bp, Homo sapien
ctcattaattggtgggcgatggctc

SEQ ID NO: 129682 - DNA, 25 bp, Homo sapien
gggcgatggctcgtgttatttttga

SEQ ID NO: 129683 - DNA, 25 bp, Homo sapien
gttatttttgaggtgatgcttgttg

SEQ ID NO: 129684 - DNA, 25 bp, Homo sapien
aggtgatgcttgttgttgttggaat

SEQ ID NO: 129685 - DNA, 25 bp, Homo sapien
gcttgttgttgttggaatgatcatc

SEQ ID NO: 129686 - DNA, 25 bp, Homo sapien
gttgttgttggaatgatcatcttaa

SEQ ID NO: 129687 - DNA, 25 bp, Homo sapien
catcttaatttcttactgtattcga

SEQ ID NO: 129688 - DNA, 25 bp, Homo sapien
tttcttactgtattcgatgactgat

SEQ ID NO: 129689 - DNA, 25 bp, Homo sapien
ctgtattcgatgactgataaaggca

SEQ ID NO: 129690 - DNA, 25 bp, Homo sapien
tgtggaaaaccagagttcccaggtt

SEQ ID NO: 129691 - DNA, 25 bp, Homo sapien
tttttacaccaaagtggccaattat

SEQ ID NO: 129692 - DNA, 25 bp, Homo sapien
gtggccaattattttgactggatta

SEQ ID NO: 129693 - DNA, 25 bp, Homo sapien
attttgactggattagctaccatgt

SEQ ID NO: 129694 - DNA, 25 bp, Homo sapien
gattagctaccatgtaggaaggcct

SEQ ID NO: 129695 - DNA, 25 bp, Homo sapien
gtaggaaggccttttatttctcagt

SEQ ID NO: 129696 - DNA, 25 bp, Homo sapien
ggccttttatttctcagtacaatgt

SEQ ID NO: 129697 - DNA, 25 bp, Homo sapien
aattgtgatctctctcttcattcta

SEQ ID NO: 129698 - DNA, 25 bp, Homo sapien
gatctctctcttcattctattcttt

SEQ ID NO: 129699 - DNA, 25 bp, Homo sapien
ctctcttcattctattctttttctc

SEQ ID NO: 129700 - DNA, 25 bp, Homo sapien
ttctctcaagagttccatttaatgg

SEQ ID NO: 129701 - DNA, 25 bp, Homo sapien
gactcactccgaagccagcggcatg

SEQ ID NO: 129702 - DNA, 25 bp, Homo sapien
gaagccagcggcatggtgacccagc

SEQ ID NO: 129703 - DNA, 25 bp, Homo sapien
agcggcatggtgacccagctctgac

SEQ ID NO: 129704 - DNA, 25 bp, Homo sapien
agctctgaccggtggcttctcgctg

SEQ ID NO: 129705 - DNA, 25 bp, Homo sapien
ctccagggcccgaggtgatcccggt

SEQ ID NO: 129706 - DNA, 25 bp, Homo sapien
tgatcccggtggtgggatccacgct

SEQ ID NO: 129707 - DNA, 25 bp, Homo sapien
cgctgggccgaggatgggacgtttt

SEQ ID NO: 129708 - DNA, 25 bp, Homo sapien
tgggcccggtccacaggtccaagga

SEQ ID NO: 129709 - DNA, 25 bp, Homo sapien
ctcctgacccccatgtaaatattgt

SEQ ID NO: 129710 - DNA, 25 bp, Homo sapien
tgggactcctgtctaggtgcccctg

SEQ ID NO: 129711 - DNA, 25 bp, Homo sapien
ctcctgtctaggtgcccctgatgat

SEQ ID NO: 129712 - DNA, 25 bp, Homo sapien
agggtccctgtgtggctactgctcc

SEQ ID NO: 129713 - DNA, 25 bp, Homo sapien
tactgctccttctgcaatcgatgca

SEQ ID NO: 129714 - DNA, 25 bp, Homo sapien
cactgaatgtgagagctgtcactgt

SEQ ID NO: 129715 - DNA, 25 bp, Homo sapien
aacatgggtgagcactgcgaccagt

SEQ ID NO: 129716 - DNA, 25 bp, Homo sapien
tatctctgcccgctggtctgcgaaa

SEQ ID NO: 129717 - DNA, 25 bp, Homo sapien
tgcgaaacggtctgcgctccaggaa

SEQ ID NO: 129718 - DNA, 25 bp, Homo sapien
gctccaggaagctacgttgactatt

SEQ ID NO: 129719 - DNA, 25 bp, Homo sapien
aagctacgttgactatttctcctcg

SEQ ID NO: 129720 - DNA, 25 bp, Homo sapien
ttatcaggccctggcagacatgctg

SEQ ID NO: 129721 - DNA, 25 bp, Homo sapien
agacatgctggaaacgccggaaccc

SEQ ID NO: 129722 - DNA, 25 bp, Homo sapien
agtcgctcgactgcgacgcaggtgt

SEQ ID NO: 129723 - DNA, 25 bp, Homo sapien
acttctctccggtgctgcgggacat

SEQ ID NO: 129724 - DNA, 25 bp, Homo sapien
gacatccagcatgctatcttggcga

SEQ ID NO: 129725 - DNA, 25 bp, Homo sapien
tatcttggcgaagagcccttttgcc

SEQ ID NO: 129726 - DNA, 25 bp, Homo sapien
cttttgcctattacacgccagggaa

SEQ ID NO: 129727 - DNA, 25 bp, Homo sapien
gaaaggcgcttacttgtggatctgc

SEQ ID NO: 129728 - DNA, 25 bp, Homo sapien
ttgtggatctgccttgctcactatt

SEQ ID NO: 129729 - DNA, 25 bp, Homo sapien
ttgctcactatttgcctattggcat

SEQ ID NO: 129730 - DNA, 25 bp, Homo sapien
aagcccatgcccagagctctaagaa

SEQ ID NO: 129731 - DNA, 25 bp, Homo sapien
gagctctaagaatgcctaactacaa

SEQ ID NO: 129732 - DNA, 25 bp, Homo sapien
aaaaggccacctaggcaatggaagc

SEQ ID NO: 129733 - DNA, 25 bp, Homo sapien
gaagccctcaaagaagtcggaatgt

SEQ ID NO: 129734 - DNA, 25 bp, Homo sapien
acgagaagcgcctgcgcgtacatgc

SEQ ID NO: 129735 - DNA, 25 bp, Homo sapien
gcgccagtcctctgcaaggagaact

SEQ ID NO: 129736 - DNA, 25 bp, Homo sapien
taagcacttttcagagcgaggccga

SEQ ID NO: 129737 - DNA, 25 bp, Homo sapien
agagcgaggccgagccccagtctaa

SEQ ID NO: 129738 - DNA, 25 bp, Homo sapien
cccagtctaagtcccagtcattgag

SEQ ID NO: 129739 - DNA, 25 bp, Homo sapien
aagtcccagtcattgagtctcgagt

SEQ ID NO: 129740 - DNA, 25 bp, Homo sapien
tgagtctcgagtcactagagcccaa

SEQ ID NO: 129741 - DNA, 25 bp, Homo sapien
actagagcccaactcaggcgcgaaa

SEQ ID NO: 129742 - DNA, 25 bp, Homo sapien
aactcaggcgcgaaaccagccaatt

SEQ ID NO: 129743 - DNA, 25 bp, Homo sapien
aaaccagccaattctgctgcagaga

SEQ ID NO: 129744 - DNA, 25 bp, Homo sapien
tgcagagaatggttttcaggagcat

SEQ ID NO: 129745 - DNA, 25 bp, Homo sapien
atggctgccccgaggaagacaacaa

SEQ ID NO: 129746 - DNA, 25 bp, Homo sapien
aagacaacaaagaagccagtgccct

SEQ ID NO: 129747 - DNA, 25 bp, Homo sapien
agccagtgccctgggagtggaaaat

SEQ ID NO: 129748 - DNA, 25 bp, Homo sapien
cttcattgttctggctgccggactg

SEQ ID NO: 129749 - DNA, 25 bp, Homo sapien
gccggactggtcctttctgtatttg

SEQ ID NO: 129750 - DNA, 25 bp, Homo sapien
ctttctgtatttgtagctattggag

SEQ ID NO: 129751 - DNA, 25 bp, Homo sapien
tgatattgaacaggctttttgtttc

SEQ ID NO: 129752 - DNA, 25 bp, Homo sapien
aatgtaagcaaacccatccaaccaa

SEQ ID NO: 129753 - DNA, 25 bp, Homo sapien
accaactccacttctggaactactt

SEQ ID NO: 129754 - DNA, 25 bp, Homo sapien
cttctggaactactttatctacgga

SEQ ID NO: 129755 - DNA, 25 bp, Homo sapien
ggaactactttatctacggatttag

SEQ ID NO: 129756 - DNA, 25 bp, Homo sapien
acagcctctcccttaatgagcaagg

SEQ ID NO: 129757 - DNA, 25 bp, Homo sapien
agcctctcccttaatgagcaaggac

SEQ ID NO: 129758 - DNA, 25 bp, Homo sapien
aatgagcaaggacaacctgcccctc

SEQ ID NO: 129759 - DNA, 25 bp, Homo sapien
gcaggcccagcagacttgagtctga

SEQ ID NO: 129760 - DNA, 25 bp, Homo sapien
agcagacttgagtctgaggccccag

SEQ ID NO: 129761 - DNA, 25 bp, Homo sapien
agacttgagtctgaggccccaggcc

SEQ ID NO: 129762 - DNA, 25 bp, Homo sapien
actacctttgtccaggcctgggtgg

SEQ ID NO: 129763 - DNA, 25 bp, Homo sapien
tatagggcgtttggccctgtgacta

SEQ ID NO: 129764 - DNA, 25 bp, Homo sapien
tggccctgtgactatggctctggca

SEQ ID NO: 129765 - DNA, 25 bp, Homo sapien
ttcatgctttctcctttttctacct

SEQ ID NO: 129766 - DNA, 25 bp, Homo sapien
catgctttctcctttttctaccttt

SEQ ID NO: 129767 - DNA, 25 bp, Homo sapien
cgcgacatccaatccatatcaagga

SEQ ID NO: 129768 - DNA, 25 bp, Homo sapien
caaggacggtgactggaatgaattc

SEQ ID NO: 129769 - DNA, 25 bp, Homo sapien
gacgttctatctgaaaacccttgag

SEQ ID NO: 129770 - DNA, 25 bp, Homo sapien
aacccttgagaatgcgcaggctcaa

SEQ ID NO: 129771 - DNA, 25 bp, Homo sapien
tgcgcaggctcaacagacgactttg

SEQ ID NO: 129772 - DNA, 25 bp, Homo sapien
aacagacgactttgagcctcgcgat

SEQ ID NO: 129773 - DNA, 25 bp, Homo sapien
tgagcctcgcgatcttttagtccaa

SEQ ID NO: 129774 - DNA, 25 bp, Homo sapien
gatcttttagtccaacgtccagctc

SEQ ID NO: 129775 - DNA, 25 bp, Homo sapien
aacttctgaaacctctgggtcatct

SEQ ID NO: 129776 - DNA, 25 bp, Homo sapien
gggtcatctctcacacattccagga

SEQ ID NO: 129777 - DNA, 25 bp, Homo sapien
tttcctgcggcatcagatgaattgt

SEQ ID NO: 129778 - DNA, 25 bp, Homo sapien
ggtggcgtgggaatggctgccccga

SEQ ID NO: 129779 - DNA, 25 bp, Homo sapien
atggctgccccgaggaagacaacaa

SEQ ID NO: 129780 - DNA, 25 bp, Homo sapien
gctgccccgaggaagacaacaaaga

SEQ ID NO: 129781 - DNA, 25 bp, Homo sapien
agccagtgccctgggagtggaaaat

SEQ ID NO: 129782 - DNA, 25 bp, Homo sapien
ttctggctgccggactggtcctttc

SEQ ID NO: 129783 - DNA, 25 bp, Homo sapien
ggctgccggactggtcctttctgta

SEQ ID NO: 129784 - DNA, 25 bp, Homo sapien
gccggactggtcctttctgtatttg

SEQ ID NO: 129785 - DNA, 25 bp, Homo sapien
ctttctgtatttgtagctattggag

SEQ ID NO: 129786 - DNA, 25 bp, Homo sapien
gtatttgtagctattggagaattca

SEQ ID NO: 129787 - DNA, 25 bp, Homo sapien
gtagctattggagaattcatataca

SEQ ID NO: 129788 - DNA, 25 bp, Homo sapien
tcatatacaaatcacggaagaataa

SEQ ID NO: 129789 - DNA, 25 bp, Homo sapien
aattctgaaaagcttcctccttgta

SEQ ID NO: 129790 - DNA, 25 bp, Homo sapien
gcttcctccttgtaagaaacccctg

SEQ ID NO: 129791 - DNA, 25 bp, Homo sapien
gtccccagtcagagataacatccaa

SEQ ID NO: 129792 - DNA, 25 bp, Homo sapien
taacatccaactaactccagaagcg

SEQ ID NO: 129793 - DNA, 25 bp, Homo sapien
tatttaacaaacctgaatgtggccg

SEQ ID NO: 129794 - DNA, 25 bp, Homo sapien
gaatgtggccgtgttcaaagagcaa

SEQ ID NO: 129795 - DNA, 25 bp, Homo sapien
gtgttcaaagagcaatattccagta

SEQ ID NO: 129796 - DNA, 25 bp, Homo sapien
gactgctgcaaagcttttgcctgca

SEQ ID NO: 129797 - DNA, 25 bp, Homo sapien
gcctgcaagagaatctgatcaattt

SEQ ID NO: 129798 - DNA, 25 bp, Homo sapien
tccctgtttgggaatgaggcactta

SEQ ID NO: 129799 - DNA, 25 bp, Homo sapien
gaatgaggcacttatcagcatgaag

SEQ ID NO: 129800 - DNA, 25 bp, Homo sapien
tcattgcctcctgttctgcccacga

SEQ ID NO: 129801 - DNA, 25 bp, Homo sapien
attgcctcctgttctgcccacgatc

SEQ ID NO: 129802 - DNA, 25 bp, Homo sapien
cctcccccaagatactctttgtggg

SEQ ID NO: 129803 - DNA, 25 bp, Homo sapien
gcaggctgggtgaccgactacccca

SEQ ID NO: 129804 - DNA, 25 bp, Homo sapien
caggctgggtgaccgactaccccag

SEQ ID NO: 129805 - DNA, 25 bp, Homo sapien
aggctgggtgaccgactaccccagt

SEQ ID NO: 129806 - DNA, 25 bp, Homo sapien
tgggtgaccgactaccccagtccca

SEQ ID NO: 129807 - DNA, 25 bp, Homo sapien
ggtgaccgactaccccagtcccagg

SEQ ID NO: 129808 - DNA, 25 bp, Homo sapien
gggtagccatgatttgtcccagcct

SEQ ID NO: 129809 - DNA, 25 bp, Homo sapien
ggtagccatgatttgtcccagcctg

SEQ ID NO: 129810 - DNA, 25 bp, Homo sapien
gtagccatgatttgtcccagcctgg

SEQ ID NO: 129811 - DNA, 25 bp, Homo sapien
gaaaagcagtaacttgggtccagta

SEQ ID NO: 129812 - DNA, 25 bp, Homo sapien
tgggtccagtatttacggaggcgtt

SEQ ID NO: 129813 - DNA, 25 bp, Homo sapien
cggaggcgttgtgaatgtgtcccat

SEQ ID NO: 129814 - DNA, 25 bp, Homo sapien
tgtcccatgcataacacactactgg

SEQ ID NO: 129815 - DNA, 25 bp, Homo sapien
tactggatagtgagtcgtgcgctaa

SEQ ID NO: 129816 - DNA, 25 bp, Homo sapien
gcgctaatgtactacgtagggcttc

SEQ ID NO: 129817 - DNA, 25 bp, Homo sapien
gtagggcttctaccagagattttcc

SEQ ID NO: 129818 - DNA, 25 bp, Homo sapien
gattttcctctccaattgggttgtg

SEQ ID NO: 129819 - DNA, 25 bp, Homo sapien
gggttgtgaaatactcttccaaaag

SEQ ID NO: 129820 - DNA, 25 bp, Homo sapien
gggattccacctacttatttcagat

SEQ ID NO: 129821 - DNA, 25 bp, Homo sapien
tatttcagattcacctccattaacc

SEQ ID NO: 129822 - DNA, 25 bp, Homo sapien
tgcccactgtgaaaccactaggttc

SEQ ID NO: 129823 - DNA, 25 bp, Homo sapien
actaggttctaggtcctggcttcta

SEQ ID NO: 129824 - DNA, 25 bp, Homo sapien
tggcttctagatctggaaccttacc

SEQ ID NO: 129825 - DNA, 25 bp, Homo sapien
tggaaccttaccacgttactgcata

SEQ ID NO: 129826 - DNA, 25 bp, Homo sapien
acgttactgcatactgatccctttc

SEQ ID NO: 129827 - DNA, 25 bp, Homo sapien
cctttcccatgatccagaactgagg

SEQ ID NO: 129828 - DNA, 25 bp, Homo sapien
atccagaactgaggtcactgggttc

SEQ ID NO: 129829 - DNA, 25 bp, Homo sapien
acatttacctcgaggctcttccatc

SEQ ID NO: 129830 - DNA, 25 bp, Homo sapien
tgccctgccttcagctttggtgaaa

SEQ ID NO: 129831 - DNA, 25 bp, Homo sapien
tttggtgaaagggagggcccctcat

SEQ ID NO: 129832 - DNA, 25 bp, Homo sapien
caccgcttggtttgcagttgagagg

SEQ ID NO: 129833 - DNA, 25 bp, Homo sapien
atcctggatgttgcacggcagctta

SEQ ID NO: 129834 - DNA, 25 bp, Homo sapien
ttgcacggcagcttaacgatgccca

SEQ ID NO: 129835 - DNA, 25 bp, Homo sapien
aacgatgcccattaactggtttgtg

SEQ ID NO: 129836 - DNA, 25 bp, Homo sapien
ggttgctgctgtccagtgcctacat

SEQ ID NO: 129837 - DNA, 25 bp, Homo sapien
agtgccccattctcactgctatctg

SEQ ID NO: 129838 - DNA, 25 bp, Homo sapien
attaccccgggagactgaactgcag

SEQ ID NO: 129839 - DNA, 25 bp, Homo sapien
tgcagggttcaagccttccagggat

SEQ ID NO: 129840 - DNA, 25 bp, Homo sapien
ttccagggatttgcctcaccttggg

SEQ ID NO: 129841 - DNA, 25 bp, Homo sapien
ctgccttgcctcctcagtatgtggg

SEQ ID NO: 129842 - DNA, 25 bp, Homo sapien
atctctttagagaagtccaagcaac

SEQ ID NO: 129843 - DNA, 25 bp, Homo sapien
gtccaagcaacagcctttgaatgta

SEQ ID NO: 129844 - DNA, 25 bp, Homo sapien
tgccctgggtgctggccatgatccg

SEQ ID NO: 129845 - DNA, 25 bp, Homo sapien
gccatgatccggtgagctgggaaac

SEQ ID NO: 129846 - DNA, 25 bp, Homo sapien
tgagctgggaaacctcacccttgca

SEQ ID NO: 129847 - DNA, 25 bp, Homo sapien
tcctcagcagtccacaaagcatttt

SEQ ID NO: 129848 - DNA, 25 bp, Homo sapien
ttttcatttctaatggcccatggga

SEQ ID NO: 129849 - DNA, 25 bp, Homo sapien
tggcccatgggagccaggcccagaa

SEQ ID NO: 129850 - DNA, 25 bp, Homo sapien
aatggcttgcttaagacttgcccaa

SEQ ID NO: 129851 - DNA, 25 bp, Homo sapien
cacagccgcctgaaagccacaatga

SEQ ID NO: 129852 - DNA, 25 bp, Homo sapien
aatgagaatgatgcacactgaggcc

SEQ ID NO: 129853 - DNA, 25 bp, Homo sapien
tgaggccttgtgtcctttaatcact

SEQ ID NO: 129854 - DNA, 25 bp, Homo sapien
gtcctttaatcactgcatttcattt

SEQ ID NO: 129855 - DNA, 25 bp, Homo sapien
aaagggacagactccggttcactga

SEQ ID NO: 129856 - DNA, 25 bp, Homo sapien
ggttcactgagggtgtcctgtataa

SEQ ID NO: 129857 - DNA, 25 bp, Homo sapien
gtgtcctgtataaccagttcctgtc

SEQ ID NO: 129858 - DNA, 25 bp, Homo sapien
agttcctgtcgcaagtggactttga

SEQ ID NO: 129859 - DNA, 25 bp, Homo sapien
tgggcgtgctcgtgttcgagaactc

SEQ ID NO: 129860 - DNA, 25 bp, Homo sapien
agaactcggccaagcggctcatggt

SEQ ID NO: 129861 - DNA, 25 bp, Homo sapien
acagcgacgtcaagcgcttttggaa

SEQ ID NO: 129862 - DNA, 25 bp, Homo sapien
gaagcggcagaaacatagctcctga

SEQ ID NO: 129863 - DNA, 25 bp, Homo sapien
acatagctcctgagagcgcgggact

SEQ ID NO: 129864 - DNA, 25 bp, Homo sapien
agcgcgggacttggacacggacctc

SEQ ID NO: 129865 - DNA, 25 bp, Homo sapien
tcaggtgttttttatttacgcgtca

SEQ ID NO: 129866 - DNA, 25 bp, Homo sapien
ttagaaccagccgtattttacatga

SEQ ID NO: 129867 - DNA, 25 bp, Homo sapien
gaaccagccgtattttacatgaagc

SEQ ID NO: 129868 - DNA, 25 bp, Homo sapien
agccgtattttacatgaagctgtat

SEQ ID NO: 129869 - DNA, 25 bp, Homo sapien
gaagctgtataattaattgtcatta

SEQ ID NO: 129870 - DNA, 25 bp, Homo sapien
aatgtgtcattggaagccatccctt

SEQ ID NO: 129871 - DNA, 25 bp, Homo sapien
gtgtcattggaagccatcccttttt

SEQ ID NO: 129872 - DNA, 25 bp, Homo sapien
ttacatttcatacaacagaaaccag

SEQ ID NO: 129873 - DNA, 25 bp, Homo sapien
cagaaaagcaatactgtttccattt

SEQ ID NO: 129874 - DNA, 25 bp, Homo sapien
tactgtttccattttaaggatatga

SEQ ID NO: 129875 - DNA, 25 bp, Homo sapien
aaaacatttctggacagtacctgat

SEQ ID NO: 129876 - DNA, 25 bp, Homo sapien
ctggacagtacctgattgtattttt

SEQ ID NO: 129877 - DNA, 25 bp, Homo sapien
gcaatgataatgatggcctctctca

SEQ ID NO: 129878 - DNA, 25 bp, Homo sapien
aacccctaagagactgagttctgca

SEQ ID NO: 129879 - DNA, 25 bp, Homo sapien
gagttctgcaagcatcagttctacg

SEQ ID NO: 129880 - DNA, 25 bp, Homo sapien
gcatcagttctacggatcatcaaca

SEQ ID NO: 129881 - DNA, 25 bp, Homo sapien
gactattctgtatctttcatccttg

SEQ ID NO: 129882 - DNA, 25 bp, Homo sapien
ttcatccttgactaaattcgtgatt

SEQ ID NO: 129883 - DNA, 25 bp, Homo sapien
attcgtgattttcaagcagcatctt

SEQ ID NO: 129884 - DNA, 25 bp, Homo sapien
gcagcatcttctggtttaaacttgt

SEQ ID NO: 129885 - DNA, 25 bp, Homo sapien
gagtcttccaattaatgctttttta

SEQ ID NO: 129886 - DNA, 25 bp, Homo sapien
gcttttttatatctaggctacctgt

SEQ ID NO: 129887 - DNA, 25 bp, Homo sapien
ttggttagattcaaggccccgagct

SEQ ID NO: 129888 - DNA, 25 bp, Homo sapien
gcagtaaaggcttcctcagccgctg

SEQ ID NO: 129889 - DNA, 25 bp, Homo sapien
gtaaaggcttcctcagccgctgtct

SEQ ID NO: 129890 - DNA, 25 bp, Homo sapien
ttctttgtcccctgggtctgtgtgg

SEQ ID NO: 129891 - DNA, 25 bp, Homo sapien
tcccctgggtctgtgtggtccctgg

SEQ ID NO: 129892 - DNA, 25 bp, Homo sapien
gctgtgggtggctaattaagataga

SEQ ID NO: 129893 - DNA, 25 bp, Homo sapien
aagatagatcgcgttagccagtttt

SEQ ID NO: 129894 - DNA, 25 bp, Homo sapien
gatcgcgttagccagttttaccagc

SEQ ID NO: 129895 - DNA, 25 bp, Homo sapien
gttagccagttttaccagcgcagct

SEQ ID NO: 129896 - DNA, 25 bp, Homo sapien
agccagttttaccagcgcagctagg

SEQ ID NO: 129897 - DNA, 25 bp, Homo sapien
tttaccagcgcagctaggcgcgatg

SEQ ID NO: 129898 - DNA, 25 bp, Homo sapien
gcgcgatggctgtcgcctgtaatgc

SEQ ID NO: 129899 - DNA, 25 bp, Homo sapien
ctctcagtactttaacatcgtcgct

SEQ ID NO: 129900 - DNA, 25 bp, Homo sapien
ttaacatcgtcgctctgcaactttt

SEQ ID NO: 129901 - DNA, 25 bp, Homo sapien
gcaacttttctatctgagcgcatct

SEQ ID NO: 129902 - DNA, 25 bp, Homo sapien
atctgagcgcatctatcaacccaat

SEQ ID NO: 129903 - DNA, 25 bp, Homo sapien
aagaagtacagagcggcggccttta

SEQ ID NO: 129904 - DNA, 25 bp, Homo sapien
aactgctgctcgcaaggaagtccag

SEQ ID NO: 129905 - DNA, 25 bp, Homo sapien
tccaggccgagaggcttccacagaa

SEQ ID NO: 129906 - DNA, 25 bp, Homo sapien
tgggctacaccgagacaagcgctaa

SEQ ID NO: 129907 - DNA, 25 bp, Homo sapien
tccacgttggcagaatcatttacat

SEQ ID NO: 129908 - DNA, 25 bp, Homo sapien
taaacacggaagattcgcggatgat

SEQ ID NO: 129909 - DNA, 25 bp, Homo sapien
tcgcggatgatgtacttctctcagt

SEQ ID NO: 129910 - DNA, 25 bp, Homo sapien
atggtttagacacagggccttcagc

SEQ ID NO: 129911 - DNA, 25 bp, Homo sapien
atacttcagggactctgtgaacccc

SEQ ID NO: 129912 - DNA, 25 bp, Homo sapien
tgaacccctcacaattgtatgccaa

SEQ ID NO: 129913 - DNA, 25 bp, Homo sapien
atgccaactttgtgtgcttatgtgt

SEQ ID NO: 129914 - DNA, 25 bp, Homo sapien
gggcgagttcataattttaatcaaa

SEQ ID NO: 129915 - DNA, 25 bp, Homo sapien
atgacccacaataggatacaaacga

SEQ ID NO: 129916 - DNA, 25 bp, Homo sapien
aacgaagagtttaagccagcatgat

SEQ ID NO: 129917 - DNA, 25 bp, Homo sapien
agccagcatgatccagatgggttca

SEQ ID NO: 129918 - DNA, 25 bp, Homo sapien
ccgagggtagacaggcagcttctgt

SEQ ID NO: 129919 - DNA, 25 bp, Homo sapien
cagcttctgtggttcagcttgtgac

SEQ ID NO: 129920 - DNA, 25 bp, Homo sapien
gtggttcagcttgtgacatgatata

SEQ ID NO: 129921 - DNA, 25 bp, Homo sapien
gatcacacatcaagactatctacaa

SEQ ID NO: 129922 - DNA, 25 bp, Homo sapien
gaagaaaagcatgcatatcattaaa

SEQ ID NO: 129923 - DNA, 25 bp, Homo sapien
gaaggtgccgagctataaacctcca

SEQ ID NO: 129924 - DNA, 25 bp, Homo sapien
ggtgccgagctataaacctccagaa

SEQ ID NO: 129925 - DNA, 25 bp, Homo sapien
cgagctataaacctccagaatatta

SEQ ID NO: 129926 - DNA, 25 bp, Homo sapien
gaatattattagtctgcatggttaa

SEQ ID NO: 129927 - DNA, 25 bp, Homo sapien
gtcatggataactacattacctgtt

SEQ ID NO: 129928 - DNA, 25 bp, Homo sapien
acctgttcttgcctaataagtttct

SEQ ID NO: 129929 - DNA, 25 bp, Homo sapien
tgcctaataagtttcttttaatcca

SEQ ID NO: 129930 - DNA, 25 bp, Homo sapien
aacactttagttatattcactggtt

SEQ ID NO: 129931 - DNA, 25 bp, Homo sapien
tagttatattcactggttttacaca

SEQ ID NO: 129932 - DNA, 25 bp, Homo sapien
ctctctgcaagtcggtctccttatc

SEQ ID NO: 129933 - DNA, 25 bp, Homo sapien
ggaaattgtatttgccttctccact

SEQ ID NO: 129934 - DNA, 25 bp, Homo sapien
tatttgccttctccactttgggagg

SEQ ID NO: 129935 - DNA, 25 bp, Homo sapien
gctcccacttcttgggagggttaca

SEQ ID NO: 129936 - DNA, 25 bp, Homo sapien
atgtatctatacatccgtatctttt

SEQ ID NO: 129937 - DNA, 25 bp, Homo sapien
atccgtatcttttaatgatccgtgt

SEQ ID NO: 129938 - DNA, 25 bp, Homo sapien
tgatccgtgtgtaccatctttgtga

SEQ ID NO: 129939 - DNA, 25 bp, Homo sapien
gtgtaccatctttgtgattatttcc

SEQ ID NO: 129940 - DNA, 25 bp, Homo sapien
tttctttaagtcagttcattttcgt

SEQ ID NO: 129941 - DNA, 25 bp, Homo sapien
gtcagttcattttcgttgaaataca

SEQ ID NO: 129942 - DNA, 25 bp, Homo sapien
gaaaaatctttgttactctgtaaat

SEQ ID NO: 129943 - DNA, 25 bp, Homo sapien
gggttactagtagccgcccatagcc

SEQ ID NO: 129944 - DNA, 25 bp, Homo sapien
actagtagccgcccatagcctgcaa

SEQ ID NO: 129945 - DNA, 25 bp, Homo sapien
gcccatagcctgcaacctttgcact

SEQ ID NO: 129946 - DNA, 25 bp, Homo sapien
aacctttgcactccactgtgcaatg

SEQ ID NO: 129947 - DNA, 25 bp, Homo sapien
tttgcactccactgtgcaatgctgg

SEQ ID NO: 129948 - DNA, 25 bp, Homo sapien
tgcactccactgtgcaatgctggcc

SEQ ID NO: 129949 - DNA, 25 bp, Homo sapien
actccactgtgcaatgctggccctg

SEQ ID NO: 129950 - DNA, 25 bp, Homo sapien
ccttggtcctgcccctagatacagc

SEQ ID NO: 129951 - DNA, 25 bp, Homo sapien
gcagtttatacccacacacctgtct

SEQ ID NO: 129952 - DNA, 25 bp, Homo sapien
agtttatacccacacacctgtctac

SEQ ID NO: 129953 - DNA, 25 bp, Homo sapien
tttatacccacacacctgtctacag

SEQ ID NO: 129954 - DNA, 25 bp, Homo sapien
attaaggcagctcatccaagcttgt

SEQ ID NO: 129955 - DNA, 25 bp, Homo sapien
ggcagctcatccaagcttgtattta

SEQ ID NO: 129956 - DNA, 25 bp, Homo sapien
atgagtagacattgtggacctcaca

SEQ ID NO: 129957 - DNA, 25 bp, Homo sapien
tgtggacctcacaagattatttaat

SEQ ID NO: 129958 - DNA, 25 bp, Homo sapien
aattcttaagatgtgtagaccttga

SEQ ID NO: 129959 - DNA, 25 bp, Homo sapien
tagaccttgatggtaggtgtgacat

SEQ ID NO: 129960 - DNA, 25 bp, Homo sapien
ggtgtgacatgttagtttttcttac

SEQ ID NO: 129961 - DNA, 25 bp, Homo sapien
gttagtttttcttacttgcatttat

SEQ ID NO: 129962 - DNA, 25 bp, Homo sapien
gcatttatttaagacacactgttac

SEQ ID NO: 129963 - DNA, 25 bp, Homo sapien
agagatactgttgtcaccttctggg

SEQ ID NO: 129964 - DNA, 25 bp, Homo sapien
atttagacttatgtggaacctgtac

SEQ ID NO: 129965 - DNA, 25 bp, Homo sapien
tccaggtgtgagtccagccacgcgg

SEQ ID NO: 129966 - DNA, 25 bp, Homo sapien
ggatgccgcctcaagggtcttcagg

SEQ ID NO: 129967 - DNA, 25 bp, Homo sapien
gggccccgagccacgaacttgctgg

SEQ ID NO: 129968 - DNA, 25 bp, Homo sapien
aacttgctgggtggttctctgggcc

SEQ ID NO: 129969 - DNA, 25 bp, Homo sapien
gggtcagcccaagattcttcagtct

SEQ ID NO: 129970 - DNA, 25 bp, Homo sapien
gcccaagattcttcagtctggacta

SEQ ID NO: 129971 - DNA, 25 bp, Homo sapien
ctggactatattgggactgggactt

SEQ ID NO: 129972 - DNA, 25 bp, Homo sapien
attgggactgggacttctgggtctc

SEQ ID NO: 129973 - DNA, 25 bp, Homo sapien
gggaaagggtcctgctttctcctcg

SEQ ID NO: 129974 - DNA, 25 bp, Homo sapien
ttctcctcgttcttatttaatctcc

SEQ ID NO: 129975 - DNA, 25 bp, Homo sapien
tttaatctccatttctactgtgtga

SEQ ID NO: 129976 - DNA, 25 bp, Homo sapien
tcacccttttcagcaaagaatagtg

SEQ ID NO: 129977 - DNA, 25 bp, Homo sapien
tgtactttatctcggcatcctcttg

SEQ ID NO: 129978 - DNA, 25 bp, Homo sapien
ggcatcctcttgaatgatagtgcaa

SEQ ID NO: 129979 - DNA, 25 bp, Homo sapien
gatagtgcaagtttctccagttggg

SEQ ID NO: 129980 - DNA, 25 bp, Homo sapien
tctccagttgggatgttgtctctgc

SEQ ID NO: 129981 - DNA, 25 bp, Homo sapien
ggatgttgtctctgcccggttggac

SEQ ID NO: 129982 - DNA, 25 bp, Homo sapien
acctcctccctttgttgaatgtggt

SEQ ID NO: 129983 - DNA, 25 bp, Homo sapien
tgaatgtggtgtgcagcctctcatc

SEQ ID NO: 129984 - DNA, 25 bp, Homo sapien
cagcctctcatctcacactgtgagt

SEQ ID NO: 129985 - DNA, 25 bp, Homo sapien
tcacactgtgagtccagcggcgcag

SEQ ID NO: 129986 - DNA, 25 bp, Homo sapien
gatattctaggcttgcgtgctgcta

SEQ ID NO: 129987 - DNA, 25 bp, Homo sapien
tgtgccacaaaaatcctcccttgaa

SEQ ID NO: 129988 - DNA, 25 bp, Homo sapien
atcaagctctgcatacttcttcatg

SEQ ID NO: 129989 - DNA, 25 bp, Homo sapien
ttcttcatgctttcagaattcgggc

SEQ ID NO: 129990 - DNA, 25 bp, Homo sapien
gaattcgggcagtgactattgacag

SEQ ID NO: 129991 - DNA, 25 bp, Homo sapien
gactattgacagagtgacgagctat

SEQ ID NO: 129992 - DNA, 25 bp, Homo sapien
gacgagctatctgaatgcttcctaa

SEQ ID NO: 129993 - DNA, 25 bp, Homo sapien
tgcttcctaaaaagcgaggtccctc

SEQ ID NO: 129994 - DNA, 25 bp, Homo sapien
gaggtccctccaaaccgttgtcatt

SEQ ID NO: 129995 - DNA, 25 bp, Homo sapien
gatgggactattacatccacatgat

SEQ ID NO: 129996 - DNA, 25 bp, Homo sapien
ttacatccacatgatacctctgatc

SEQ ID NO: 129997 - DNA, 25 bp, Homo sapien
gatacctctgatcaagtatttttga

SEQ ID NO: 129998 - DNA, 25 bp, Homo sapien
tgctaccagcgccaaatgttcatcc

SEQ ID NO: 129999 - DNA, 25 bp, Homo sapien
gctaccagcgccaaatgttcatcct

SEQ ID NO: 130000 - DNA, 25 bp, Homo sapien
taccagcgccaaatgttcatcctca

SEQ ID NO: 130001 - DNA, 25 bp, Homo sapien
accagcgccaaatgttcatcctcat

SEQ ID NO: 130002 - DNA, 25 bp, Homo sapien
aaatgttcatcctcattgcctcctg

SEQ ID NO: 130003 - DNA, 25 bp, Homo sapien
tggcaggctgggtgaccgactaccc

SEQ ID NO: 130004 - DNA, 25 bp, Homo sapien
gtcccagggaaggtgccctgcccct

SEQ ID NO: 130005 - DNA, 25 bp, Homo sapien
cctgcccctaggatgctgcagcaga

SEQ ID NO: 130006 - DNA, 25 bp, Homo sapien
cccctaggatgctgcagcagagtga

SEQ ID NO: 130007 - DNA, 25 bp, Homo sapien
ggcccgaatcgaccataaagggtgt

SEQ ID NO: 130008 - DNA, 25 bp, Homo sapien
ggtagccatgatttgtcccagcctg

SEQ ID NO: 130009 - DNA, 25 bp, Homo sapien
gaaacattgaactcatatctgtaag

SEQ ID NO: 130010 - DNA, 25 bp, Homo sapien
tattgttaattataccaccgtgtgt

SEQ ID NO: 130011 - DNA, 25 bp, Homo sapien
taccaccgtgtgttagaaaagtaag

SEQ ID NO: 130012 - DNA, 25 bp, Homo sapien
aagaagcagtcaattttcacatcaa

SEQ ID NO: 130013 - DNA, 25 bp, Homo sapien
attttcacatcaaagacagcatcta

SEQ ID NO: 130014 - DNA, 25 bp, Homo sapien
gaagttttgttctgtcctggaatta

SEQ ID NO: 130015 - DNA, 25 bp, Homo sapien
tagtagtgtttcagtaatgttgact

SEQ ID NO: 130016 - DNA, 25 bp, Homo sapien
tgttgactgtattttccaacttgtt

SEQ ID NO: 130017 - DNA, 25 bp, Homo sapien
caacttgttcaaattattaccagtg

SEQ ID NO: 130018 - DNA, 25 bp, Homo sapien
attaccagtgaatctttgtcagcag

SEQ ID NO: 130019 - DNA, 25 bp, Homo sapien
gaatctttgtcagcagttccctttt

SEQ ID NO: 130020 - DNA, 25 bp, Homo sapien
gttcctctactctcatggcgtgcaa

SEQ ID NO: 130021 - DNA, 25 bp, Homo sapien
atggcgtgcaaggactctatcccct

SEQ ID NO: 130022 - DNA, 25 bp, Homo sapien
atcagtaccactctgtgcacggagt

SEQ ID NO: 130023 - DNA, 25 bp, Homo sapien
catggtgcagagtggagcgacaata

SEQ ID NO: 130024 - DNA, 25 bp, Homo sapien
aagtgaggcctgcttcacaacagac

SEQ ID NO: 130025 - DNA, 25 bp, Homo sapien
gacagtagccaagagaaccccacag

SEQ ID NO: 130026 - DNA, 25 bp, Homo sapien
agacaagatttttcatttcacccaa

SEQ ID NO: 130027 - DNA, 25 bp, Homo sapien
atttcacccaatgttcacatctgca

SEQ ID NO: 130028 - DNA, 25 bp, Homo sapien
acatctgcactcaaggtcgctggat

SEQ ID NO: 130029 - DNA, 25 bp, Homo sapien
aggtcgctggatgctgatctaatca

SEQ ID NO: 130030 - DNA, 25 bp, Homo sapien
gatctaatcagtagcttgaaaccac

SEQ ID NO: 130031 - DNA, 25 bp, Homo sapien
gcttcactgactaggctttcctcct

SEQ ID NO: 130032 - DNA, 25 bp, Homo sapien
taggctttcctcctgcatgttgaat

SEQ ID NO: 130033 - DNA, 25 bp, Homo sapien
gcatgttgaatttccttcagcttta

SEQ ID NO: 130034 - DNA, 25 bp, Homo sapien
gatttaatgcactttgacttgtata

SEQ ID NO: 130035 - DNA, 25 bp, Homo sapien
aaactttctgtgttagcgacggtat

SEQ ID NO: 130036 - DNA, 25 bp, Homo sapien
agcgacggtatctatagccctttat

SEQ ID NO: 130037 - DNA, 25 bp, Homo sapien
atagccctttatacgagcgatggat

SEQ ID NO: 130038 - DNA, 25 bp, Homo sapien
agcgatggatcttgagctctccttc

SEQ ID NO: 130039 - DNA, 25 bp, Homo sapien
gtattcttgaaaactgctgtagcaa

SEQ ID NO: 130040 - DNA, 25 bp, Homo sapien
actgctgtagcaaattcatctgtgg

SEQ ID NO: 130041 - DNA, 25 bp, Homo sapien
tcatctgtggtgcaatacacttttt

SEQ ID NO: 130042 - DNA, 25 bp, Homo sapien
gtgggcatagcattagctgcttcct

SEQ ID NO: 130043 - DNA, 25 bp, Homo sapien
ctgtggcctggcatcgcatcgtggt

SEQ ID NO: 130044 - DNA, 25 bp, Homo sapien
ggcatcgcatcgtggtgtgtcaatg

SEQ ID NO: 130045 - DNA, 25 bp, Homo sapien
gtgtgtcaatgccacaaaatcgtgt

SEQ ID NO: 130046 - DNA, 25 bp, Homo sapien
aaaatcgtgtgtccgtggaaccagt

SEQ ID NO: 130047 - DNA, 25 bp, Homo sapien
tggaaccagtcctagccgcgtgtga

SEQ ID NO: 130048 - DNA, 25 bp, Homo sapien
gcgtgtgacagtcttgcattctgtt

SEQ ID NO: 130049 - DNA, 25 bp, Homo sapien
cagtcctgcggaaatgtgtcttgtc

SEQ ID NO: 130050 - DNA, 25 bp, Homo sapien
tgcggaaatgtgtcttgtcttccat

SEQ ID NO: 130051 - DNA, 25 bp, Homo sapien
caatgccatcactggaatttcccac

SEQ ID NO: 130052 - DNA, 25 bp, Homo sapien
aatttcccaccgctttgtgagccgt

SEQ ID NO: 130053 - DNA, 25 bp, Homo sapien
gagaatttatcattactgttacatt

SEQ ID NO: 130054 - DNA, 25 bp, Homo sapien
aatgcaagcaattagtggatcactg

SEQ ID NO: 130055 - DNA, 25 bp, Homo sapien
tggatcactgttagggtaagggaat

SEQ ID NO: 130056 - DNA, 25 bp, Homo sapien
aagggaatgtatgtacacatctatt

SEQ ID NO: 130057 - DNA, 25 bp, Homo sapien
attcaaattatctcacattatgtgt

SEQ ID NO: 130058 - DNA, 25 bp, Homo sapien
tttatgctgaagtttcccttagaca

SEQ ID NO: 130059 - DNA, 25 bp, Homo sapien
gaagtttcccttagacattttatgt

SEQ ID NO: 130060 - DNA, 25 bp, Homo sapien
gtcttgcttgtagggcataatgcct

SEQ ID NO: 130061 - DNA, 25 bp, Homo sapien
aatgccttgtttaatgtccattctg

SEQ ID NO: 130062 - DNA, 25 bp, Homo sapien
ttaatgtccattctgcagcgtttct

SEQ ID NO: 130063 - DNA, 25 bp, Homo sapien
gcagcgtttctctttcccttggaaa

SEQ ID NO: 130064 - DNA, 25 bp, Homo sapien
atggaggcaccaaagtagttctaga

SEQ ID NO: 130065 - DNA, 25 bp, Homo sapien
ggaggcaccaaagtagttctagatg

SEQ ID NO: 130066 - DNA, 25 bp, Homo sapien
ggcaccaaagtagttctagatgaca

SEQ ID NO: 130067 - DNA, 25 bp, Homo sapien
gttctagatgacaaggattatttcc

SEQ ID NO: 130068 - DNA, 25 bp, Homo sapien
gatgacaaggattatttcctattta

SEQ ID NO: 130069 - DNA, 25 bp, Homo sapien
gtacgtagactgaaataagtcacta

SEQ ID NO: 130070 - DNA, 25 bp, Homo sapien
ataagtcactattgaaatggcatca

SEQ ID NO: 130071 - DNA, 25 bp, Homo sapien
gaaatggcatcaacatgatgctgcc

SEQ ID NO: 130072 - DNA, 25 bp, Homo sapien
atgatgctgcccattccactgaagt

SEQ ID NO: 130073 - DNA, 25 bp, Homo sapien
tgatgctgcccattccactgaagtt

SEQ ID NO: 130074 - DNA, 25 bp, Homo sapien
atctttcgtcatgtaaataatttcc

SEQ ID NO: 130075 - DNA, 25 bp, Homo sapien
aggaggagtttctgtcatcctgtcc

SEQ ID NO: 130076 - DNA, 25 bp, Homo sapien
tggtgagcgctttctttatcttctg

SEQ ID NO: 130077 - DNA, 25 bp, Homo sapien
tctggtccccgtttaacgtggtgct

SEQ ID NO: 130078 - DNA, 25 bp, Homo sapien
tttaacgtggtgctgttggtccatc

SEQ ID NO: 130079 - DNA, 25 bp, Homo sapien
tccatctgtggcgacgggtgatgct

SEQ ID NO: 130080 - DNA, 25 bp, Homo sapien
gatgctcaaggaaatctaccacccc

SEQ ID NO: 130081 - DNA, 25 bp, Homo sapien
atcctccaggctagctttgccttgg

SEQ ID NO: 130082 - DNA, 25 bp, Homo sapien
tttgccttgggctgtgtcaacagca

SEQ ID NO: 130083 - DNA, 25 bp, Homo sapien
ttcctctacgtcttcgttggcagag

SEQ ID NO: 130084 - DNA, 25 bp, Homo sapien
gtcttcgttggcagagatttccaag

SEQ ID NO: 130085 - DNA, 25 bp, Homo sapien
cagtctttgacttctgccctggcga

SEQ ID NO: 130086 - DNA, 25 bp, Homo sapien
acatcaaacagaagcatggtgccat

SEQ ID NO: 130087 - DNA, 25 bp, Homo sapien
ggacttcacggagcagtcacagtgt

SEQ ID NO: 130088 - DNA, 25 bp, Homo sapien
gtgagataccacatgccgcccagaa

SEQ ID NO: 130089 - DNA, 25 bp, Homo sapien
gcccagaaggtgtcggccgtttctc

SEQ ID NO: 130090 - DNA, 25 bp, Homo sapien
caggcccagaactaggctcaagaag

SEQ ID NO: 130091 - DNA, 25 bp, Homo sapien
agaagtgtactctcacgactggcta

SEQ ID NO: 130092 - DNA, 25 bp, Homo sapien
acgactggctaagacttgctggact

SEQ ID NO: 130093 - DNA, 25 bp, Homo sapien
agacttgctggactgacacctatgg

SEQ ID NO: 130094 - DNA, 25 bp, Homo sapien
gacacctatggctggaagatgactt

SEQ ID NO: 130095 - DNA, 25 bp, Homo sapien
agatgacttgttttgctccatgtct

SEQ ID NO: 130096 - DNA, 25 bp, Homo sapien
ctcattcctacacctattttctgct

SEQ ID NO: 130097 - DNA, 25 bp, Homo sapien
gcctcctcgttcctttctcctgttt

SEQ ID NO: 130098 - DNA, 25 bp, Homo sapien
tgggagtgaggagcccatactcagc

SEQ ID NO: 130099 - DNA, 25 bp, Homo sapien
gagtgaggagcccatactcagcctg

SEQ ID NO: 130100 - DNA, 25 bp, Homo sapien
agtgaggagcccatactcagcctgc

SEQ ID NO: 130101 - DNA, 25 bp, Homo sapien
gtgaggagcccatactcagcctgct

SEQ ID NO: 130102 - DNA, 25 bp, Homo sapien
tgaggagcccatactcagcctgctg

SEQ ID NO: 130103 - DNA, 25 bp, Homo sapien
gaggagcccatactcagcctgctgc

SEQ ID NO: 130104 - DNA, 25 bp, Homo sapien
aggagcccatactcagcctgctgcc

SEQ ID NO: 130105 - DNA, 25 bp, Homo sapien
agcccatactcagcctgctgcccag

SEQ ID NO: 130106 - DNA, 25 bp, Homo sapien
agcgcagctggactctgcatcccag

SEQ ID NO: 130107 - DNA, 25 bp, Homo sapien
gcagctggactctgcatcccagcac

SEQ ID NO: 130108 - DNA, 25 bp, Homo sapien
tcaggagtgttaagaagcatcgtgt

SEQ ID NO: 130109 - DNA, 25 bp, Homo sapien
gttaagaagcatcgtgtttacctgt

SEQ ID NO: 130110 - DNA, 25 bp, Homo sapien
taagaagcatcgtgtttacctgtgc

SEQ ID NO: 130111 - DNA, 25 bp, Homo sapien
aagcatcgtgtttacctgtgcaggc

SEQ ID NO: 130112 - DNA, 25 bp, Homo sapien
gcatcgtgtttacctgtgcaggcac

SEQ ID NO: 130113 - DNA, 25 bp, Homo sapien
ccattctgatgtctcctttcatcta

SEQ ID NO: 130114 - DNA, 25 bp, Homo sapien
attctgatgtctcctttcatctatt

SEQ ID NO: 130115 - DNA, 25 bp, Homo sapien
ttctgatgtctcctttcatctattt

SEQ ID NO: 130116 - DNA, 25 bp, Homo sapien
tatcatgagtacctttacattgtgg

SEQ ID NO: 130117 - DNA, 25 bp, Homo sapien
catgagtacctttacattgtggtta

SEQ ID NO: 130118 - DNA, 25 bp, Homo sapien
gagtacctttacattgtggttaatg

SEQ ID NO: 130119 - DNA, 25 bp, Homo sapien
gtgtatacatcttgatcattagcaa

SEQ ID NO: 130120 - DNA, 25 bp, Homo sapien
gacattaagctttaaccattatggc

SEQ ID NO: 130121 - DNA, 25 bp, Homo sapien
atgattgttctttcacttgggctgt

SEQ ID NO: 130122 - DNA, 25 bp, Homo sapien
tcacttgggctgtttgagagcataa

SEQ ID NO: 130123 - DNA, 25 bp, Homo sapien
aatgtttcatgatttctacctccaa

SEQ ID NO: 130124 - DNA, 25 bp, Homo sapien
gatttctacctccaaagtgtgaaga

SEQ ID NO: 130125 - DNA, 25 bp, Homo sapien
gtcttattttgttggcggagaagat

SEQ ID NO: 130126 - DNA, 25 bp, Homo sapien
ggcggagaagattacaatggctatt

SEQ ID NO: 130127 - DNA, 25 bp, Homo sapien
ggctattagtgctacatttggtcaa

SEQ ID NO: 130128 - DNA, 25 bp, Homo sapien
gtaatcacttaaatagcttcttgtc

SEQ ID NO: 130129 - DNA, 25 bp, Homo sapien
agcttcttgtcaccttaaactaaag

SEQ ID NO: 130130 - DNA, 25 bp, Homo sapien
agcccagaacatgggtcaccaatgg

SEQ ID NO: 130131 - DNA, 25 bp, Homo sapien
gtgtctctttcattgctttgttgag

SEQ ID NO: 130132 - DNA, 25 bp, Homo sapien
tctttcattgctttgttgagaacaa

SEQ ID NO: 130133 - DNA, 25 bp, Homo sapien
aatttctgtattatgtcaggcaata

SEQ ID NO: 130134 - DNA, 25 bp, Homo sapien
gtcaggcaataatcctactaaaagg

SEQ ID NO: 130135 - DNA, 25 bp, Homo sapien
tggaggtgaccgctgtcaataaaaa

SEQ ID NO: 130136 - DNA, 25 bp, Homo sapien
accgctgtcaataaaaagccggagg

SEQ ID NO: 130137 - DNA, 25 bp, Homo sapien
gggaaataagatgtgtccattcata

SEQ ID NO: 130138 - DNA, 25 bp, Homo sapien
gtgtccattcatatgagtggttttg

SEQ ID NO: 130139 - DNA, 25 bp, Homo sapien
tacaagtgtgggtcccctttcagaa

SEQ ID NO: 130140 - DNA, 25 bp, Homo sapien
tgttttcttgtttatcacacataca

SEQ ID NO: 130141 - DNA, 25 bp, Homo sapien
attcatcagaggtgccaagagcgac

SEQ ID NO: 130142 - DNA, 25 bp, Homo sapien
agaggtgccaagagcgacccctcca

SEQ ID NO: 130143 - DNA, 25 bp, Homo sapien
agcagtgccagtcagttctgagcga

SEQ ID NO: 130144 - DNA, 25 bp, Homo sapien
gccagtcagttctgagcgagcggcc

SEQ ID NO: 130145 - DNA, 25 bp, Homo sapien
cccctggacagttgcagagaaacac

SEQ ID NO: 130146 - DNA, 25 bp, Homo sapien
gagaaacacaggcttgtcgtgccgt

SEQ ID NO: 130147 - DNA, 25 bp, Homo sapien
aacacaggcttgtcgtgccgtttaa

SEQ ID NO: 130148 - DNA, 25 bp, Homo sapien
gtcgtgccgtttaagctttgcttgc

SEQ ID NO: 130149 - DNA, 25 bp, Homo sapien
gccgtttaagctttgcttgcaagag

SEQ ID NO: 130150 - DNA, 25 bp, Homo sapien
cttgcaagagtggatgccccgcaat

SEQ ID NO: 130151 - DNA, 25 bp, Homo sapien
tggatgccccgcaatcgttcctgct

SEQ ID NO: 130152 - DNA, 25 bp, Homo sapien
caaaatctgagtgagggctatgaag

SEQ ID NO: 130153 - DNA, 25 bp, Homo sapien
agcttcgaggaagaacagagctcaa

SEQ ID NO: 130154 - DNA, 25 bp, Homo sapien
aacagagctcaagggcaaaggcaca

SEQ ID NO: 130155 - DNA, 25 bp, Homo sapien
ggcacagaggaaaccttctggctga

SEQ ID NO: 130156 - DNA, 25 bp, Homo sapien
gaaaccttctggctgattgggaaaa

SEQ ID NO: 130157 - DNA, 25 bp, Homo sapien
tgggccatggcctgcaaccagtgga

SEQ ID NO: 130158 - DNA, 25 bp, Homo sapien
aaccagtggagattgcagccttcca

SEQ ID NO: 130159 - DNA, 25 bp, Homo sapien
gcagttggtgagaaacaagccataa

SEQ ID NO: 130160 - DNA, 25 bp, Homo sapien
ggcaaagggctccaggatttgaatc

SEQ ID NO: 130161 - DNA, 25 bp, Homo sapien
gggctccaggatttgaatcttctct

SEQ ID NO: 130162 - DNA, 25 bp, Homo sapien
tttgaatcttctcttggtgaggcaa

SEQ ID NO: 130163 - DNA, 25 bp, Homo sapien
gcaaggcacactactccgagcgcgt

SEQ ID NO: 130164 - DNA, 25 bp, Homo sapien
aggcacactactccgagcgcgtcgg

SEQ ID NO: 130165 - DNA, 25 bp, Homo sapien
ccccggtgtatctcgcggcggtgct

SEQ ID NO: 130166 - DNA, 25 bp, Homo sapien
atctcgcggcggtgcttgagtacct

SEQ ID NO: 130167 - DNA, 25 bp, Homo sapien
tgcaattggccatccgcaatgacga

SEQ ID NO: 130168 - DNA, 25 bp, Homo sapien
ccgcaatgacgaggagcttaataaa

SEQ ID NO: 130169 - DNA, 25 bp, Homo sapien
gacgaggagcttaataaacttttgg

SEQ ID NO: 130170 - DNA, 25 bp, Homo sapien
ttttggggcgtgtgaccatcgcgca

SEQ ID NO: 130171 - DNA, 25 bp, Homo sapien
gcgcagggtggcgttttgcctaata

SEQ ID NO: 130172 - DNA, 25 bp, Homo sapien
gggtggcgttttgcctaatattcag

SEQ ID NO: 130173 - DNA, 25 bp, Homo sapien
gcctaatattcaggcggtgctgctg

SEQ ID NO: 130174 - DNA, 25 bp, Homo sapien
gaggcagccatagttgagccctgat

SEQ ID NO: 130175 - DNA, 25 bp, Homo sapien
gcagccatagttgagccctgattgc

SEQ ID NO: 130176 - DNA, 25 bp, Homo sapien
ctctctacctcccaaggtgatatgg

SEQ ID NO: 130177 - DNA, 25 bp, Homo sapien
ccaaggtgatatgggcagctgccca

SEQ ID NO: 130178 - DNA, 25 bp, Homo sapien
ctccagaggtagcagcatccttggg

SEQ ID NO: 130179 - DNA, 25 bp, Homo sapien
ggtccacaatgtatggtttggtccc

SEQ ID NO: 130180 - DNA, 25 bp, Homo sapien
atgtatggtttggtcccatgggaca

SEQ ID NO: 130181 - DNA, 25 bp, Homo sapien
gtcccatgggacatgtcatagcctt

SEQ ID NO: 130182 - DNA, 25 bp, Homo sapien
gtcatagccttggtttagttttggg

SEQ ID NO: 130183 - DNA, 25 bp, Homo sapien
gtttagttttgggtggagctgaata

SEQ ID NO: 130184 - DNA, 25 bp, Homo sapien
ggtggagctgaataaacccaaattt

SEQ ID NO: 130185 - DNA, 25 bp, Homo sapien
ggagaggcagcattgcacagtgaaa

SEQ ID NO: 130186 - DNA, 25 bp, Homo sapien
aattctggatatctcaggagccccg

SEQ ID NO: 130187 - DNA, 25 bp, Homo sapien
ggatatctcaggagccccgaaattc

SEQ ID NO: 130188 - DNA, 25 bp, Homo sapien
gccccgaaattctagctctgacttt

SEQ ID NO: 130189 - DNA, 25 bp, Homo sapien
gctgtttccagtggtatgaccttgg

SEQ ID NO: 130190 - DNA, 25 bp, Homo sapien
ggagaagtcacttatcctcttggag

SEQ ID NO: 130191 - DNA, 25 bp, Homo sapien
aagtcacttatcctcttggagcctc

SEQ ID NO: 130192 - DNA, 25 bp, Homo sapien
tcatctgcagaataatgactgactt

SEQ ID NO: 130193 - DNA, 25 bp, Homo sapien
gactgacttgtctaattcataggga

SEQ ID NO: 130194 - DNA, 25 bp, Homo sapien
tcatagggatgtgaggttctgctga

SEQ ID NO: 130195 - DNA, 25 bp, Homo sapien
caaagctctgtcaataagtgataca

SEQ ID NO: 130196 - DNA, 25 bp, Homo sapien
cctggcccaggagttgaatgcctga

SEQ ID NO: 130197 - DNA, 25 bp, Homo sapien
ttccctacttagcatgatccttgag

SEQ ID NO: 130198 - DNA, 25 bp, Homo sapien
ttagcatgatccttgagtctcctct

SEQ ID NO: 130199 - DNA, 25 bp, Homo sapien
ctctggatggaatccgcgagctggc

SEQ ID NO: 130200 - DNA, 25 bp, Homo sapien
tggaatccgcgagctggccacctgg

SEQ ID NO: 130201 - DNA, 25 bp, Homo sapien
aggacacaggtcatggaggttcttc

SEQ ID NO: 130202 - DNA, 25 bp, Homo sapien
atggaggttcttcccaagctggcag

SEQ ID NO: 130203 - DNA, 25 bp, Homo sapien
ctggcagaggccatttgtggaaagt

SEQ ID NO: 130204 - DNA, 25 bp, Homo sapien
atttgtggaaagtggagagctacgt

SEQ ID NO: 130205 - DNA, 25 bp, Homo sapien
gcatctctggaaaatctccacgctg

SEQ ID NO: 130206 - DNA, 25 bp, Homo sapien
atctccacgctgaatgtgatttttg

SEQ ID NO: 130207 - DNA, 25 bp, Homo sapien
cctggatgatctcaagggcaccttt

SEQ ID NO: 130208 - DNA, 25 bp, Homo sapien
gcacctttgcccagctgagtgaact

SEQ ID NO: 130209 - DNA, 25 bp, Homo sapien
acctttgcccagctgagtgaactgc

SEQ ID NO: 130210 - DNA, 25 bp, Homo sapien
tttgcccagctgagtgaactgcact

SEQ ID NO: 130211 - DNA, 25 bp, Homo sapien
tgcccagctgagtgaactgcactgt

SEQ ID NO: 130212 - DNA, 25 bp, Homo sapien
ttggcaatccatttcggcaaagaat

SEQ ID NO: 130213 - DNA, 25 bp, Homo sapien
ggcaatccatttcggcaaagaattc

SEQ ID NO: 130214 - DNA, 25 bp, Homo sapien
aatccatttcggcaaagaattcacc

SEQ ID NO: 130215 - DNA, 25 bp, Homo sapien
caaagaattcacccctgaggtgcag

SEQ ID NO: 130216 - DNA, 25 bp, Homo sapien
gccctgtcctccagataccactgag

SEQ ID NO: 130217 - DNA, 25 bp, Homo sapien
cagagctttcaaggataggctttat

SEQ ID NO: 130218 - DNA, 25 bp, Homo sapien
gaggtcctgaagttgggcttatttc

SEQ ID NO: 130219 - DNA, 25 bp, Homo sapien
gcttatttccctggctgggttatgg

SEQ ID NO: 130220 - DNA, 25 bp, Homo sapien
gtttacacttctatgtatctcacaa

SEQ ID NO: 130221 - DNA, 25 bp, Homo sapien
cagtgttctgaacttttcgaaggaa

SEQ ID NO: 130222 - DNA, 25 bp, Homo sapien
gaaggaatcgtgctctcaatgcaaa

SEQ ID NO: 130223 - DNA, 25 bp, Homo sapien
atgcaaagtgtcattctctggaatt

SEQ ID NO: 130224 - DNA, 25 bp, Homo sapien
aattgcacctggctcaggaaaggac

SEQ ID NO: 130225 - DNA, 25 bp, Homo sapien
aggactgtctttgtacttgaattta

SEQ ID NO: 130226 - DNA, 25 bp, Homo sapien
atggagaactttaacacgggcattt

SEQ ID NO: 130227 - DNA, 25 bp, Homo sapien
acgggcatttgcatgactgagaatt

SEQ ID NO: 130228 - DNA, 25 bp, Homo sapien
aattgctgctgtcttttttccgtat

SEQ ID NO: 130229 - DNA, 25 bp, Homo sapien
catctcgtccaaggctatggggatt

SEQ ID NO: 130230 - DNA, 25 bp, Homo sapien
atctcgtccaaggctatggggatta

SEQ ID NO: 130231 - DNA, 25 bp, Homo sapien
tctcgtccaaggctatggggattat

SEQ ID NO: 130232 - DNA, 25 bp, Homo sapien
ctcgtccaaggctatggggattatg

SEQ ID NO: 130233 - DNA, 25 bp, Homo sapien
tcgtccaaggctatggggattatga

SEQ ID NO: 130234 - DNA, 25 bp, Homo sapien
cgtccaaggctatggggattatgaa

SEQ ID NO: 130235 - DNA, 25 bp, Homo sapien
gtccaaggctatggggattatgaac

SEQ ID NO: 130236 - DNA, 25 bp, Homo sapien
cacttccagggagatccaaacggct

SEQ ID NO: 130237 - DNA, 25 bp, Homo sapien
acttccagggagatccaaacggctg

SEQ ID NO: 130238 - DNA, 25 bp, Homo sapien
cttccagggagatccaaacggctgt

SEQ ID NO: 130239 - DNA, 25 bp, Homo sapien
ttccagggagatccaaacggctgtg

SEQ ID NO: 130240 - DNA, 25 bp, Homo sapien
actgcctcctaggaggacatttagg

SEQ ID NO: 130241 - DNA, 25 bp, Homo sapien
gaggcctgcagtttggcttcacggc

SEQ ID NO: 130242 - DNA, 25 bp, Homo sapien
agtttggcttcacggctggctatgt

SEQ ID NO: 130243 - DNA, 25 bp, Homo sapien
tcacggctggctatgtggacagcaa

SEQ ID NO: 130244 - DNA, 25 bp, Homo sapien
aactcggcaatccaagcacctagat

SEQ ID NO: 130245 - DNA, 25 bp, Homo sapien
agcacctagataccagcacaagtcg

SEQ ID NO: 130246 - DNA, 25 bp, Homo sapien
ctgtctggactgagcctccgttggc

SEQ ID NO: 130247 - DNA, 25 bp, Homo sapien
gactgagcctccgttggcttctgaa

SEQ ID NO: 130248 - DNA, 25 bp, Homo sapien
gaactggaattctgcagctaaccct

SEQ ID NO: 130249 - DNA, 25 bp, Homo sapien
gcagctaacccttccacgactagaa

SEQ ID NO: 130250 - DNA, 25 bp, Homo sapien
ttccacgactagaaccttaggcatt

SEQ ID NO: 130251 - DNA, 25 bp, Homo sapien
ttagacctgcaaacagctaatagga

SEQ ID NO: 130252 - DNA, 25 bp, Homo sapien
tctattaatatgttagcttgccatt

SEQ ID NO: 130253 - DNA, 25 bp, Homo sapien
aatatgttctgagggttgttttgtc

SEQ ID NO: 130254 - DNA, 25 bp, Homo sapien
gttttgtctcgtgttcatgatgtta

SEQ ID NO: 130255 - DNA, 25 bp, Homo sapien
gaaaatgcaggcagtatccctcatc

SEQ ID NO: 130256 - DNA, 25 bp, Homo sapien
ggcagtatccctcatcttatgtaag

SEQ ID NO: 130257 - DNA, 25 bp, Homo sapien
aaagcaaatgctccatagctaaagc

SEQ ID NO: 130258 - DNA, 25 bp, Homo sapien
ttagaccttatttctgctactgttg

SEQ ID NO: 130259 - DNA, 25 bp, Homo sapien
actgttgctgaaatgtggctttggc

SEQ ID NO: 130260 - DNA, 25 bp, Homo sapien
aatttctggcaggaagtcttgttag

SEQ ID NO: 130261 - DNA, 25 bp, Homo sapien
agtcttgttagtatacatcagtctt

SEQ ID NO: 130262 - DNA, 25 bp, Homo sapien
tgcaccctcacctgatgcaggaaca

SEQ ID NO: 130263 - DNA, 25 bp, Homo sapien
accctcacctgatgcaggaacatat

SEQ ID NO: 130264 - DNA, 25 bp, Homo sapien
gatgcaggaacatatgggaaccaac

SEQ ID NO: 130265 - DNA, 25 bp, Homo sapien
acatatgggaaccaacgtcatcgtt

SEQ ID NO: 130266 - DNA, 25 bp, Homo sapien
atgggaaccaacgtcatcgttgcca

SEQ ID NO: 130267 - DNA, 25 bp, Homo sapien
ggaaccaacgtcatcgttgccaaca

SEQ ID NO: 130268 - DNA, 25 bp, Homo sapien
aacgtcatcgttgccaacacaatgc

SEQ ID NO: 130269 - DNA, 25 bp, Homo sapien
gtcatcgttgccaacacaatgccca

SEQ ID NO: 130270 - DNA, 25 bp, Homo sapien
cactcacctcagcaacggacagatg

SEQ ID NO: 130271 - DNA, 25 bp, Homo sapien
tgccgggagccgtcgccacaatcgt

SEQ ID NO: 130272 - DNA, 25 bp, Homo sapien
ggagccgtcgccacaatcgtcaagc

SEQ ID NO: 130273 - DNA, 25 bp, Homo sapien
aacgctctaccctgcagcttggaga

SEQ ID NO: 130274 - DNA, 25 bp, Homo sapien
tgcagcttggagaactccgctggat

SEQ ID NO: 130275 - DNA, 25 bp, Homo sapien
tccgctggatgggagtctcatgcaa

SEQ ID NO: 130276 - DNA, 25 bp, Homo sapien
gtctcatgcaagacttcactgcagc

SEQ ID NO: 130277 - DNA, 25 bp, Homo sapien
tgcagcctttcacaggactctgcag

SEQ ID NO: 130278 - DNA, 25 bp, Homo sapien
gatagtgcctctgcaaactaaggag

SEQ ID NO: 130279 - DNA, 25 bp, Homo sapien
tcaggattgtttctcggcaccagtg

SEQ ID NO: 130280 - DNA, 25 bp, Homo sapien
gtgctgcaattgagggctaaatccc

SEQ ID NO: 130281 - DNA, 25 bp, Homo sapien
aaatcccaagtgtctcttgactggc

SEQ ID NO: 130282 - DNA, 25 bp, Homo sapien
gactggctcaagaattagggcccca

SEQ ID NO: 130283 - DNA, 25 bp, Homo sapien
gccacagggaagcatgtactgtact

SEQ ID NO: 130284 - DNA, 25 bp, Homo sapien
cacacggtcacctgcaaggacgtca

SEQ ID NO: 130285 - DNA, 25 bp, Homo sapien
cccctctaaaggattcgtggtgctc

SEQ ID NO: 130286 - DNA, 25 bp, Homo sapien
aaaggattcgtggtgctcatcccca

SEQ ID NO: 130287 - DNA, 25 bp, Homo sapien
tcatccccaagcttcagagaccctt

SEQ ID NO: 130288 - DNA, 25 bp, Homo sapien
gggttccacacttcacgtggactga

SEQ ID NO: 130289 - DNA, 25 bp, Homo sapien
cacacttcacgtggactgaggtaga

SEQ ID NO: 130290 - DNA, 25 bp, Homo sapien
acgtggactgaggtagaccctgcat

SEQ ID NO: 130291 - DNA, 25 bp, Homo sapien
tggactgaggtagaccctgcatgaa

SEQ ID NO: 130292 - DNA, 25 bp, Homo sapien
gaggtagaccctgcatgaagatgaa

SEQ ID NO: 130293 - DNA, 25 bp, Homo sapien
gtagaccctgcatgaagatgaaatt

SEQ ID NO: 130294 - DNA, 25 bp, Homo sapien
gaaagggagtcattaacaactaggg

SEQ ID NO: 130295 - DNA, 25 bp, Homo sapien
gtgtacatatatggccgtcacctat

SEQ ID NO: 130296 - DNA, 25 bp, Homo sapien
tatggccgtcacctatacttctggg

SEQ ID NO: 130297 - DNA, 25 bp, Homo sapien
aagctgctaaaaaacggatcaccgg

SEQ ID NO: 130298 - DNA, 25 bp, Homo sapien
ggatcaccggtttccgactgagtct

SEQ ID NO: 130299 - DNA, 25 bp, Homo sapien
gattttggccttgttgaccctccta

SEQ ID NO: 130300 - DNA, 25 bp, Homo sapien
ctcctaggtgccctgggaattgcaa

SEQ ID NO: 130301 - DNA, 25 bp, Homo sapien
agctttctggatgaatatctggacc

SEQ ID NO: 130302 - DNA, 25 bp, Homo sapien
atatctggacctcaatattgccaag

SEQ ID NO: 130303 - DNA, 25 bp, Homo sapien
aaactgaggcggcaattctaacttt

SEQ ID NO: 130304 - DNA, 25 bp, Homo sapien
ttttctcttccctttaatgcttgca

SEQ ID NO: 130305 - DNA, 25 bp, Homo sapien
gaagctgttcccaccatgaaggtaa

SEQ ID NO: 130306 - DNA, 25 bp, Homo sapien
gcggcagagaggactgttgacatcc

SEQ ID NO: 130307 - DNA, 25 bp, Homo sapien
gaggactgttgacatccaagcttcc

SEQ ID NO: 130308 - DNA, 25 bp, Homo sapien
gttgacatccaagcttcctttgttt

SEQ ID NO: 130309 - DNA, 25 bp, Homo sapien
ttctctcacctcctaaagtagactt

SEQ ID NO: 130310 - DNA, 25 bp, Homo sapien
gtagacttcatttttcctaacagga

SEQ ID NO: 130311 - DNA, 25 bp, Homo sapien
ttagacagtcaaggagtggcttact

SEQ ID NO: 130312 - DNA, 25 bp, Homo sapien
agtggcttactacatgtgggagctt

SEQ ID NO: 130313 - DNA, 25 bp, Homo sapien
tggtatgtgacatgcgggctgggca

SEQ ID NO: 130314 - DNA, 25 bp, Homo sapien
ttgcgcttttgctggtcactgccat

SEQ ID NO: 130315 - DNA, 25 bp, Homo sapien
tgccatggaggcacacagctgcaga

SEQ ID NO: 130316 - DNA, 25 bp, Homo sapien
acagctgcagagacagagaggacgt

SEQ ID NO: 130317 - DNA, 25 bp, Homo sapien
gttaagtctgagactctaaggaggt

SEQ ID NO: 130318 - DNA, 25 bp, Homo sapien
gaggtgaaatgaatcccaaatgcat

SEQ ID NO: 130319 - DNA, 25 bp, Homo sapien
tcattccataatgactgaatcaagg

SEQ ID NO: 130320 - DNA, 25 bp, Homo sapien
attaaccacaataaggcatgatctg

SEQ ID NO: 130321 - DNA, 25 bp, Homo sapien
aggcatgatctggattaaatgccat

SEQ ID NO: 130322 - DNA, 25 bp, Homo sapien
taaatgccatttattaggcaataat

SEQ ID NO: 130323 - DNA, 25 bp, Homo sapien
aagatgcttcccaagaactttcaag

SEQ ID NO: 130324 - DNA, 25 bp, Homo sapien
cttcccaagaactttcaagccaaca

SEQ ID NO: 130325 - DNA, 25 bp, Homo sapien
aaagtgttcctgtacataagcaaat

SEQ ID NO: 130326 - DNA, 25 bp, Homo sapien
tgagagattcgatcagtgtgcctga

SEQ ID NO: 130327 - DNA, 25 bp, Homo sapien
ttcgatcagtgtgcctgaaacctta

SEQ ID NO: 130328 - DNA, 25 bp, Homo sapien
tggaggcccagttcaccctgattta

SEQ ID NO: 130329 - DNA, 25 bp, Homo sapien
gcccagttcaccctgatttaggaga

SEQ ID NO: 130330 - DNA, 25 bp, Homo sapien
tttaggagaagccaggaatttccca

SEQ ID NO: 130331 - DNA, 25 bp, Homo sapien
agccaggaatttcccaggacctgaa

SEQ ID NO: 130332 - DNA, 25 bp, Homo sapien
atgatggcaacagatctggaacctc

SEQ ID NO: 130333 - DNA, 25 bp, Homo sapien
ggcaacagatctggaacctcagcct

SEQ ID NO: 130334 - DNA, 25 bp, Homo sapien
tgtcctgggcctgcagaatttgggt

SEQ ID NO: 130335 - DNA, 25 bp, Homo sapien
gttctgcctgccagctgcactgatg

SEQ ID NO: 130336 - DNA, 25 bp, Homo sapien
ttggcaccagacacccaggacttat

SEQ ID NO: 130337 - DNA, 25 bp, Homo sapien
gacacccaggacttatttaaactct

SEQ ID NO: 130338 - DNA, 25 bp, Homo sapien
tatttaaactctgttgcaagtgcaa

SEQ ID NO: 130339 - DNA, 25 bp, Homo sapien
aagtcaagggtatcgtgcccattcc

SEQ ID NO: 130340 - DNA, 25 bp, Homo sapien
cccctgtttattcacggacatcaga

SEQ ID NO: 130341 - DNA, 25 bp, Homo sapien
ggacatcagagttctccaggacagt

SEQ ID NO: 130342 - DNA, 25 bp, Homo sapien
ggacagttgctcacactttgtagaa

SEQ ID NO: 130343 - DNA, 25 bp, Homo sapien
gaagacttttgcatcttacatgcct

SEQ ID NO: 130344 - DNA, 25 bp, Homo sapien
catcttacatgcctcaattccaaac

SEQ ID NO: 130345 - DNA, 25 bp, Homo sapien
aattccaaacttgttctactcagac

SEQ ID NO: 130346 - DNA, 25 bp, Homo sapien
gttctactcagactcataagatcat

SEQ ID NO: 130347 - DNA, 25 bp, Homo sapien
caagatgtgtgacctaactgtgtaa

SEQ ID NO: 130348 - DNA, 25 bp, Homo sapien
gacctaactgtgtaatttcactgaa

SEQ ID NO: 130349 - DNA, 25 bp, Homo sapien
gaagaaaccttcagatttgtgttat

SEQ ID NO: 130350 - DNA, 25 bp, Homo sapien
gtaatccattggttttgtgggcagt

SEQ ID NO: 130351 - DNA, 25 bp, Homo sapien
ccattggttttgtgggcagtttaat

SEQ ID NO: 130352 - DNA, 25 bp, Homo sapien
ttttgtgggcagtttaataaacctg

SEQ ID NO: 130353 - DNA, 25 bp, Homo sapien
ttaataaacctgaacctttgtgtgt

SEQ ID NO: 130354 - DNA, 25 bp, Homo sapien
ttttctaattgtacctgagttgacc

SEQ ID NO: 130355 - DNA, 25 bp, Homo sapien
taattgtacctgagttgaccatcct

SEQ ID NO: 130356 - DNA, 25 bp, Homo sapien
attgtacctgagttgaccatccttt

SEQ ID NO: 130357 - DNA, 25 bp, Homo sapien
tgtacctgagttgaccatcctttct

SEQ ID NO: 130358 - DNA, 25 bp, Homo sapien
tacctgagttgaccatcctttcttt

SEQ ID NO: 130359 - DNA, 25 bp, Homo sapien
ctgagttgaccatcctttcttttta

SEQ ID NO: 130360 - DNA, 25 bp, Homo sapien
tgagttgaccatcctttctttttat

SEQ ID NO: 130361 - DNA, 25 bp, Homo sapien
tgcatgcacttcaagggcagccttt

SEQ ID NO: 130362 - DNA, 25 bp, Homo sapien
catgcacttcaagggcagcctttgg

SEQ ID NO: 130363 - DNA, 25 bp, Homo sapien
ggtttctgccacttccgggtctagg

SEQ ID NO: 130364 - DNA, 25 bp, Homo sapien
gggtctaggccctgcccaaatccag

SEQ ID NO: 130365 - DNA, 25 bp, Homo sapien
gacatgctgacagggtccccaggga

SEQ ID NO: 130366 - DNA, 25 bp, Homo sapien
gtccccagggagaccgtgtcagtag

SEQ ID NO: 130367 - DNA, 25 bp, Homo sapien
accgtgtcagtagggatgtgtgcct

SEQ ID NO: 130368 - DNA, 25 bp, Homo sapien
tgcctggctgtgtacgtgggtgtgc

SEQ ID NO: 130369 - DNA, 25 bp, Homo sapien
gtgtgcagtgcacgtgagagcacgt

SEQ ID NO: 130370 - DNA, 25 bp, Homo sapien
gtgagagcacgtggcggcttctggg

SEQ ID NO: 130371 - DNA, 25 bp, Homo sapien
tggcacagctgcatgcacttcaagg

SEQ ID NO: 130372 - DNA, 25 bp, Homo sapien
aatgtacactgattcctttatgatg

SEQ ID NO: 130373 - DNA, 25 bp, Homo sapien
ctttatgatgactgcttaactcccc

SEQ ID NO: 130374 - DNA, 25 bp, Homo sapien
atgatgactgcttaactccccactg

SEQ ID NO: 130375 - DNA, 25 bp, Homo sapien
ctgtcccagagaggctttccaatgt

SEQ ID NO: 130376 - DNA, 25 bp, Homo sapien
gaggctttccaatgtagctcagtaa

SEQ ID NO: 130377 - DNA, 25 bp, Homo sapien
gtagctcagtaattcctgttacttt

SEQ ID NO: 130378 - DNA, 25 bp, Homo sapien
aagaacaaactctgaaagacctatg

SEQ ID NO: 130379 - DNA, 25 bp, Homo sapien
aagacctatgagcaaatggtgctga

SEQ ID NO: 130380 - DNA, 25 bp, Homo sapien
aagccacatttcattgtcttagtca

SEQ ID NO: 130381 - DNA, 25 bp, Homo sapien
tcattgtcttagtcaaagcaggatt

SEQ ID NO: 130382 - DNA, 25 bp, Homo sapien
gcaacttcaagtataacaactttga

SEQ ID NO: 130383 - DNA, 25 bp, Homo sapien
ggcattaatccatactgtgctctca

SEQ ID NO: 130384 - DNA, 25 bp, Homo sapien
aatccatactgtgctctcattgaag

SEQ ID NO: 130385 - DNA, 25 bp, Homo sapien
aatcaggaaatttaccagaaggcat

SEQ ID NO: 130386 - DNA, 25 bp, Homo sapien
gatctgattgaacattactttggtg

SEQ ID NO: 130387 - DNA, 25 bp, Homo sapien
agaagatgaccccagcattgtacct

SEQ ID NO: 130388 - DNA, 25 bp, Homo sapien
cagcattgtacctcaggtggatgaa

SEQ ID NO: 130389 - DNA, 25 bp, Homo sapien
ggtggatgaaaaccaacaacagttt

SEQ ID NO: 130390 - DNA, 25 bp, Homo sapien
caacagtttatatttcagcagcagg

SEQ ID NO: 130391 - DNA, 25 bp, Homo sapien
tttatatttcagcagcaggaagcac

SEQ ID NO: 130392 - DNA, 25 bp, Homo sapien
agcaccaatggatggatttcaactt

SEQ ID NO: 130393 - DNA, 25 bp, Homo sapien
ggatttcaactttaacttactggag

SEQ ID NO: 130394 - DNA, 25 bp, Homo sapien
atacctggtttgcttagattattca

SEQ ID NO: 130395 - DNA, 25 bp, Homo sapien
cctggtttgcttagattattcaaga

SEQ ID NO: 130396 - DNA, 25 bp, Homo sapien
agattattcaagaatgtggaggcct

SEQ ID NO: 130397 - DNA, 25 bp, Homo sapien
gaggcctgggccaaggtcaatgaca

SEQ ID NO: 130398 - DNA, 25 bp, Homo sapien
ggcctgggccaaggtcaatgacagt

SEQ ID NO: 130399 - DNA, 25 bp, Homo sapien
gccaaggtcaatgacagtgtctcca

SEQ ID NO: 130400 - DNA, 25 bp, Homo sapien
gtcaatgacagtgtctccattgtct

SEQ ID NO: 130401 - DNA, 25 bp, Homo sapien
cattgtcttccctccattaagagaa

SEQ ID NO: 130402 - DNA, 25 bp, Homo sapien
tccctccattaagagaagactttaa

SEQ ID NO: 130403 - DNA, 25 bp, Homo sapien
gagagccagagacagtgttgcaact

SEQ ID NO: 130404 - DNA, 25 bp, Homo sapien
agccagagacagtgttgcaactggg

SEQ ID NO: 130405 - DNA, 25 bp, Homo sapien
tgtatcaagaacaacagacataagt

SEQ ID NO: 130406 - DNA, 25 bp, Homo sapien
acaagcaaatataccctgtagttag

SEQ ID NO: 130407 - DNA, 25 bp, Homo sapien
gttagaaactttcaactgaacatgt

SEQ ID NO: 130408 - DNA, 25 bp, Homo sapien
caactgaacatgttagagaccaagt

SEQ ID NO: 130409 - DNA, 25 bp, Homo sapien
gagaccaagtttaacttcaggcatg

SEQ ID NO: 130410 - DNA, 25 bp, Homo sapien
aacttcaggcatgcatttgtttacc

SEQ ID NO: 130411 - DNA, 25 bp, Homo sapien
ggcatgcatttgtttaccatttccc

SEQ ID NO: 130412 - DNA, 25 bp, Homo sapien
gacatgcaactcatgctttcctatt

SEQ ID NO: 130413 - DNA, 25 bp, Homo sapien
gctttcctatttctataaccaacac

SEQ ID NO: 130414 - DNA, 25 bp, Homo sapien
tatttctataaccaacaccgtttgt

SEQ ID NO: 130415 - DNA, 25 bp, Homo sapien
caccgtttgtttagtgtatttatga

SEQ ID NO: 130416 - DNA, 25 bp, Homo sapien
tacagggctaggcagtaccaaagta

SEQ ID NO: 130417 - DNA, 25 bp, Homo sapien
atttcaggaaggtcttcaatcttaa

SEQ ID NO: 130418 - DNA, 25 bp, Homo sapien
tttttcagttttacctcttctctct

SEQ ID NO: 130419 - DNA, 25 bp, Homo sapien
cttctctctcagttctacactgata

SEQ ID NO: 130420 - DNA, 25 bp, Homo sapien
tacactgatacacttgaaggaccat

SEQ ID NO: 130421 - DNA, 25 bp, Homo sapien
ttttttctgtagcaccagagaatcc

SEQ ID NO: 130422 - DNA, 25 bp, Homo sapien
gaatccatccaaagttccctatgaa

SEQ ID NO: 130423 - DNA, 25 bp, Homo sapien
gttccctatgaaaaatgtgttccat

SEQ ID NO: 130424 - DNA, 25 bp, Homo sapien
tccattgccatagctgactacaaat

SEQ ID NO: 130425 - DNA, 25 bp, Homo sapien
ctgcatagagtctttatgtccataa

SEQ ID NO: 130426 - DNA, 25 bp, Homo sapien
tatgtccataagctacgggtaggtc

SEQ ID NO: 130427 - DNA, 25 bp, Homo sapien
tgctgtgcctgatgccaggacagct

SEQ ID NO: 130428 - DNA, 25 bp, Homo sapien
gctgtgcctgatgccaggacagctg

SEQ ID NO: 130429 - DNA, 25 bp, Homo sapien
gccaggacagctgtgctctcagatg

SEQ ID NO: 130430 - DNA, 25 bp, Homo sapien
tctcagatgtaaatagagcaaccta

SEQ ID NO: 130431 - DNA, 25 bp, Homo sapien
agagcaacctatataaacctggatt

SEQ ID NO: 130432 - DNA, 25 bp, Homo sapien
gcaacctatataaacctggattttt

SEQ ID NO: 130433 - DNA, 25 bp, Homo sapien
tttgtacaaccctgacccgtttgct

SEQ ID NO: 130434 - DNA, 25 bp, Homo sapien
ttgtacaaccctgacccgtttgcta

SEQ ID NO: 130435 - DNA, 25 bp, Homo sapien
gtacaaccctgacccgtttgctaca

SEQ ID NO: 130436 - DNA, 25 bp, Homo sapien
aaccctgacccgtttgctacatctt

SEQ ID NO: 130437 - DNA, 25 bp, Homo sapien
cctgacccgtttgctacatcttttt

SEQ ID NO: 130438 - DNA, 25 bp, Homo sapien
tgcagcccgcttatgcgtatgtgca

SEQ ID NO: 130439 - DNA, 25 bp, Homo sapien
gcccgcttatgcgtatgtgcacggg

SEQ ID NO: 130440 - DNA, 25 bp, Homo sapien
tggacctggagaagggacctacgga

SEQ ID NO: 130441 - DNA, 25 bp, Homo sapien
agggacctacggacgcctggaagct

SEQ ID NO: 130442 - DNA, 25 bp, Homo sapien
acctacggacgcctggaagctgcga

SEQ ID NO: 130443 - DNA, 25 bp, Homo sapien
tacggacgcctggaagctgcgacgc

SEQ ID NO: 130444 - DNA, 25 bp, Homo sapien
tggaagctgcgacgccctgcactgc

SEQ ID NO: 130445 - DNA, 25 bp, Homo sapien
agcgcctcccactgatgtcgtggtc

SEQ ID NO: 130446 - DNA, 25 bp, Homo sapien
cactgatgtcgtggtcccgggcctg

SEQ ID NO: 130447 - DNA, 25 bp, Homo sapien
tttacatgccctctcccttttataa

SEQ ID NO: 130448 - DNA, 25 bp, Homo sapien
tacatgccctctcccttttataaaa

SEQ ID NO: 130449 - DNA, 25 bp, Homo sapien
aaacttggcactttttcgtgtggat

SEQ ID NO: 130450 - DNA, 25 bp, Homo sapien
gcactttttcgtgtggatcttgcca

SEQ ID NO: 130451 - DNA, 25 bp, Homo sapien
ggatcttgccacatttctgatcaga

SEQ ID NO: 130452 - DNA, 25 bp, Homo sapien
tttctgatcagaggtgtacactaac

SEQ ID NO: 130453 - DNA, 25 bp, Homo sapien
cagaggtgtacactaacatttcccc

SEQ ID NO: 130454 - DNA, 25 bp, Homo sapien
cgagctcttggcctttgcatttatt

SEQ ID NO: 130455 - DNA, 25 bp, Homo sapien
ctcttggcctttgcatttatttata

SEQ ID NO: 130456 - DNA, 25 bp, Homo sapien
ttatttatacagtgccttgctcggg

SEQ ID NO: 130457 - DNA, 25 bp, Homo sapien
gtgtgagcgccttggtatgacttaa

SEQ ID NO: 130458 - DNA, 25 bp, Homo sapien
tgtcatctaaccattaagtcatgtg

SEQ ID NO: 130459 - DNA, 25 bp, Homo sapien
aaccattaagtcatgtgtgaacaca

SEQ ID NO: 130460 - DNA, 25 bp, Homo sapien
gatctgtcacctatggaatctgagt

SEQ ID NO: 130461 - DNA, 25 bp, Homo sapien
gtcacctatggaatctgagtggttt

SEQ ID NO: 130462 - DNA, 25 bp, Homo sapien
aaaatgcatgaagggatggataccc

SEQ ID NO: 130463 - DNA, 25 bp, Homo sapien
aaaacatctcacgtacctcataaac

SEQ ID NO: 130464 - DNA, 25 bp, Homo sapien
gtacctcataaacatatacacctat

SEQ ID NO: 130465 - DNA, 25 bp, Homo sapien
ttgattttaactcattgtcactctg

SEQ ID NO: 130466 - DNA, 25 bp, Homo sapien
ttgtcactctgatgttcatgtgaac

SEQ ID NO: 130467 - DNA, 25 bp, Homo sapien
tcatgtgaactggttgcttcgggct

SEQ ID NO: 130468 - DNA, 25 bp, Homo sapien
gtgaactggttgcttcgggctcttt

SEQ ID NO: 130469 - DNA, 25 bp, Homo sapien
ttcgggctctttgatctgtcaccta

SEQ ID NO: 130470 - DNA, 25 bp, Homo sapien
gctctttgatctgtcacctatggaa

SEQ ID NO: 130471 - DNA, 25 bp, Homo sapien
actggtaatcagtactgcatagcaa

SEQ ID NO: 130472 - DNA, 25 bp, Homo sapien
agtactgcatagcaaactctttggg

SEQ ID NO: 130473 - DNA, 25 bp, Homo sapien
actgcatagcaaactctttgggaaa

SEQ ID NO: 130474 - DNA, 25 bp, Homo sapien
tatgaaaacttaactctgctgtgtg

SEQ ID NO: 130475 - DNA, 25 bp, Homo sapien
gaaaacttaactctgctgtgtgtta

SEQ ID NO: 130476 - DNA, 25 bp, Homo sapien
aactctgctgtgtgttaggcaatcc

SEQ ID NO: 130477 - DNA, 25 bp, Homo sapien
ctgctgtgtgttaggcaatcctgta

SEQ ID NO: 130478 - DNA, 25 bp, Homo sapien
gtgttaggcaatcctgtaatctttt

SEQ ID NO: 130479 - DNA, 25 bp, Homo sapien
tcatttctgaaatgcttggttggaa

SEQ ID NO: 130480 - DNA, 25 bp, Homo sapien
atgcttggttggaagactgtgacaa

SEQ ID NO: 130481 - DNA, 25 bp, Homo sapien
agtcttctgtattcctgcatattgt

SEQ ID NO: 130482 - DNA, 25 bp, Homo sapien
agaaatcaacacatcttggcctccc

SEQ ID NO: 130483 - DNA, 25 bp, Homo sapien
ggattactgacacaagccaccgccc

SEQ ID NO: 130484 - DNA, 25 bp, Homo sapien
gagtgctcatgtaccatttagcttg

SEQ ID NO: 130485 - DNA, 25 bp, Homo sapien
gtgctcatgtaccatttagcttgtg

SEQ ID NO: 130486 - DNA, 25 bp, Homo sapien
catgtaccatttagcttgtgtttta

SEQ ID NO: 130487 - DNA, 25 bp, Homo sapien
aattacttttccctctctatatagt

SEQ ID NO: 130488 - DNA, 25 bp, Homo sapien
acttttccctctctatatagtttga

SEQ ID NO: 130489 - DNA, 25 bp, Homo sapien
tttccctctctatatagtttgattt

SEQ ID NO: 130490 - DNA, 25 bp, Homo sapien
atatagtttgatttaagcattagtc

SEQ ID NO: 130491 - DNA, 25 bp, Homo sapien
taatattaaaatgcagaccgttatg

SEQ ID NO: 130492 - DNA, 25 bp, Homo sapien
aatgcagaccgttatgattggaaaa

SEQ ID NO: 130493 - DNA, 25 bp, Homo sapien
agaccatttgaaaagtcaggtacaa

SEQ ID NO: 130494 - DNA, 25 bp, Homo sapien
gtcaggtacaaatttcctcaagtgg

SEQ ID NO: 130495 - DNA, 25 bp, Homo sapien
atttcctcaagtggcataaaaatgt

SEQ ID NO: 130496 - DNA, 25 bp, Homo sapien
atgtagtcagttttctcttttacca

SEQ ID NO: 130497 - DNA, 25 bp, Homo sapien
ttttatttccactccaattatttag

SEQ ID NO: 130498 - DNA, 25 bp, Homo sapien
gaactttatttgtacatgtgcagaa

SEQ ID NO: 130499 - DNA, 25 bp, Homo sapien
aggcagctgagaatcttgtttcccc

SEQ ID NO: 130500 - DNA, 25 bp, Homo sapien
cccaagagagttttacaggctgagt

SEQ ID NO: 130501 - DNA, 25 bp, Homo sapien
ggctgagtgttgcaaatgtgttctt

SEQ ID NO: 130502 - DNA, 25 bp, Homo sapien
gtgttctttgtcctgttatatgtat

SEQ ID NO: 130503 - DNA, 25 bp, Homo sapien
aaatttgcataactggatgtactta

SEQ ID NO: 130504 - DNA, 25 bp, Homo sapien
tacttccctgggatcaaatcaagaa

SEQ ID NO: 130505 - DNA, 25 bp, Homo sapien
gaagaagcatatgtcaccatgtcca

SEQ ID NO: 130506 - DNA, 25 bp, Homo sapien
aacccagactgaacttaccgtgagc

SEQ ID NO: 130507 - DNA, 25 bp, Homo sapien
ttaccgtgagcgacaaagatgattt

SEQ ID NO: 130508 - DNA, 25 bp, Homo sapien
gaagtctagagttcctagtctccct

SEQ ID NO: 130509 - DNA, 25 bp, Homo sapien
aaattagcaaaaccccactacacag

SEQ ID NO: 130510 - DNA, 25 bp, Homo sapien
cccactacacagtctgcaagattct

SEQ ID NO: 130511 - DNA, 25 bp, Homo sapien
ctgaaacattgctttgaccactctt

SEQ ID NO: 130512 - DNA, 25 bp, Homo sapien
ttgaccactcttcctgagttcagtg

SEQ ID NO: 130513 - DNA, 25 bp, Homo sapien
aacatgagtcaagagcatcctgctt

SEQ ID NO: 130514 - DNA, 25 bp, Homo sapien
cctgcttctaccatgtggatttggt

SEQ ID NO: 130515 - DNA, 25 bp, Homo sapien
gaaatgctataccttacctacctcg

SEQ ID NO: 130516 - DNA, 25 bp, Homo sapien
tacctacctcgtaaaagtctgatga

SEQ ID NO: 130517 - DNA, 25 bp, Homo sapien
atagatgcatagcacttaacagagt

SEQ ID NO: 130518 - DNA, 25 bp, Homo sapien
gagtgcatagcatacactgttttca

SEQ ID NO: 130519 - DNA, 25 bp, Homo sapien
aaatgcaccttagcagaaggtcgat

SEQ ID NO: 130520 - DNA, 25 bp, Homo sapien
gaaggtcgatgtgtctaccaggcag

SEQ ID NO: 130521 - DNA, 25 bp, Homo sapien
agcattgatcagtgacacacctctc

SEQ ID NO: 130522 - DNA, 25 bp, Homo sapien
tgaccatctccatctgcccttaaat

SEQ ID NO: 130523 - DNA, 25 bp, Homo sapien
aatgctgtatgcttttttgccaccg

SEQ ID NO: 130524 - DNA, 25 bp, Homo sapien
atgcttttttgccaccgtgcaactt

SEQ ID NO: 130525 - DNA, 25 bp, Homo sapien
gtgcaacttgcccaacatcaatctt

SEQ ID NO: 130526 - DNA, 25 bp, Homo sapien
aacactgagtgtctggccagactcc

SEQ ID NO: 130527 - DNA, 25 bp, Homo sapien
tgtctggccagactccatggcaaaa

SEQ ID NO: 130528 - DNA, 25 bp, Homo sapien
gggaccacagtatgtcgcaggcatt

SEQ ID NO: 130529 - DNA, 25 bp, Homo sapien
gtcgcaggcattactaatctgaaaa

SEQ ID NO: 130530 - DNA, 25 bp, Homo sapien
aatctgaaaaagtgctcaacctccc

SEQ ID NO: 130531 - DNA, 25 bp, Homo sapien
tcctggaagcctgtgaattcctcag

SEQ ID NO: 130532 - DNA, 25 bp, Homo sapien
agatggcccagctccccaagaaagc

SEQ ID NO: 130533 - DNA, 25 bp, Homo sapien
caagaaagcctcagccattcactgc

SEQ ID NO: 130534 - DNA, 25 bp, Homo sapien
attgcccatccatctgcttacaatt

SEQ ID NO: 130535 - DNA, 25 bp, Homo sapien
ttacaattccctgctgtcgtcttag

SEQ ID NO: 130536 - DNA, 25 bp, Homo sapien
tccctgctgtcgtcttagcaagaag

SEQ ID NO: 130537 - DNA, 25 bp, Homo sapien
gcagatttcagatcatatttcacaa

SEQ ID NO: 130538 - DNA, 25 bp, Homo sapien
tttcacaatcctgtggatctgggca

SEQ ID NO: 130539 - DNA, 25 bp, Homo sapien
atgtttcaggaagtttctgcagcag

SEQ ID NO: 130540 - DNA, 25 bp, Homo sapien
cagatgcttttggtccaggtactga

SEQ ID NO: 130541 - DNA, 25 bp, Homo sapien
aacagttggcatggaggctgcgact

SEQ ID NO: 130542 - DNA, 25 bp, Homo sapien
gctgcgactgatgaaggcatgccta

SEQ ID NO: 130543 - DNA, 25 bp, Homo sapien
aggcatgcctaaaagttacttacca

SEQ ID NO: 130544 - DNA, 25 bp, Homo sapien
agactgtacggcaaggcggctacat

SEQ ID NO: 130545 - DNA, 25 bp, Homo sapien
cggctacatgcctcagtgaaggact

SEQ ID NO: 130546 - DNA, 25 bp, Homo sapien
ggactagtagttcctgctacaactt

SEQ ID NO: 130547 - DNA, 25 bp, Homo sapien
gctacaacttcagcagtacctataa

SEQ ID NO: 130548 - DNA, 25 bp, Homo sapien
aaaacactctcactatgctgctatg

SEQ ID NO: 130549 - DNA, 25 bp, Homo sapien
aacactctcactatgctgctatgga

SEQ ID NO: 130550 - DNA, 25 bp, Homo sapien
tcactatgctgctatggacgacctc

SEQ ID NO: 130551 - DNA, 25 bp, Homo sapien
tatgctgctatggacgacctccagc

SEQ ID NO: 130552 - DNA, 25 bp, Homo sapien
ctatggacgacctccagctctcagt

SEQ ID NO: 130553 - DNA, 25 bp, Homo sapien
tctcagttacaagtgcaggcgactg

SEQ ID NO: 130554 - DNA, 25 bp, Homo sapien
gcgactggaggcaggactcctgggt

SEQ ID NO: 130555 - DNA, 25 bp, Homo sapien
gattctgggaggcttcagttaccgc

SEQ ID NO: 130556 - DNA, 25 bp, Homo sapien
gaggcttcagttaccgctggccgag

SEQ ID NO: 130557 - DNA, 25 bp, Homo sapien
taccgctggccgagctgaagaactg

SEQ ID NO: 130558 - DNA, 25 bp, Homo sapien
ctggccgagctgaagaactgggtat

SEQ ID NO: 130559 - DNA, 25 bp, Homo sapien
tggctcgatcccacaccaggaagat

SEQ ID NO: 130560 - DNA, 25 bp, Homo sapien
cctccccagagccaacatgaaaggg

SEQ ID NO: 130561 - DNA, 25 bp, Homo sapien
tgtgcttcatgtcctcttgatgaca

SEQ ID NO: 130562 - DNA, 25 bp, Homo sapien
tgatgacattctgcccaagtaaccc

SEQ ID NO: 130563 - DNA, 25 bp, Homo sapien
tgctacatgtctctcttccaggtga

SEQ ID NO: 130564 - DNA, 25 bp, Homo sapien
cttccaggtgaacggcatgttgatc

SEQ ID NO: 130565 - DNA, 25 bp, Homo sapien
ttgatcatgtgcaatgccgtcattg

SEQ ID NO: 130566 - DNA, 25 bp, Homo sapien
gtcattgaccccttcatatatgcct

SEQ ID NO: 130567 - DNA, 25 bp, Homo sapien
tatgccttccggagcccagagctca

SEQ ID NO: 130568 - DNA, 25 bp, Homo sapien
ccagagctcagggacgcattcaaaa

SEQ ID NO: 130569 - DNA, 25 bp, Homo sapien
gatgatcttctgcagcaggtactgg

SEQ ID NO: 130570 - DNA, 25 bp, Homo sapien
ttgggttgccggtcagagcttaaga

SEQ ID NO: 130571 - DNA, 25 bp, Homo sapien
aagaggactagcacctgcaatgccc

SEQ ID NO: 130572 - DNA, 25 bp, Homo sapien
aatgccctcttcactctaaatgtac

SEQ ID NO: 130573 - DNA, 25 bp, Homo sapien
acactgactgctttagagcccttga

SEQ ID NO: 130574 - DNA, 25 bp, Homo sapien
gataatagtcttattcccaccacat

SEQ ID NO: 130575 - DNA, 25 bp, Homo sapien
tgaaccttcatgaccttatcaactt

SEQ ID NO: 130576 - DNA, 25 bp, Homo sapien
ttatcaactttacacccatatccag

SEQ ID NO: 130577 - DNA, 25 bp, Homo sapien
gacacatttgttactctaaccctgc

SEQ ID NO: 130578 - DNA, 25 bp, Homo sapien
taggcttcttgtagctccagctctt

SEQ ID NO: 130579 - DNA, 25 bp, Homo sapien
cagctctttagagactccgggaacc

SEQ ID NO: 130580 - DNA, 25 bp, Homo sapien
tccgggaaccctttatatggtgcct

SEQ ID NO: 130581 - DNA, 25 bp, Homo sapien
gaccggctctactccatgcagagtt

SEQ ID NO: 130582 - DNA, 25 bp, Homo sapien
tactccatgcagagttcctacttcg

SEQ ID NO: 130583 - DNA, 25 bp, Homo sapien
tgtccagccgcatggagggcatgat

SEQ ID NO: 130584 - DNA, 25 bp, Homo sapien
ggagggcatgatggcttcctacacg

SEQ ID NO: 130585 - DNA, 25 bp, Homo sapien
atgatggcttcctacacgccgctgg

SEQ ID NO: 130586 - DNA, 25 bp, Homo sapien
accacagcagcagatcgtggccatg

SEQ ID NO: 130587 - DNA, 25 bp, Homo sapien
aacagagcccctacggcagcagcga

SEQ ID NO: 130588 - DNA, 25 bp, Homo sapien
aaatgccagggaacgactccatctt

SEQ ID NO: 130589 - DNA, 25 bp, Homo sapien
agggaacgactccatcttccatgac

SEQ ID NO: 130590 - DNA, 25 bp, Homo sapien
catcttccatgacatcgacagcgat

SEQ ID NO: 130591 - DNA, 25 bp, Homo sapien
tcgacagcgatacctccttaaccag

SEQ ID NO: 130592 - DNA, 25 bp, Homo sapien
tcggcccacttgacttagttcttgg

SEQ ID NO: 130593 - DNA, 25 bp, Homo sapien
ccacttgacttagttcttgggctgg

SEQ ID NO: 130594 - DNA, 25 bp, Homo sapien
agttcttgggctggacctgcttagc

SEQ ID NO: 130595 - DNA, 25 bp, Homo sapien
ggacctgcttagctgccttgagcta

SEQ ID NO: 130596 - DNA, 25 bp, Homo sapien
tagctgccttgagctaaccccaagg

SEQ ID NO: 130597 - DNA, 25 bp, Homo sapien
aaggctgcctctgggccatgccagg

SEQ ID NO: 130598 - DNA, 25 bp, Homo sapien
actccacagagtgagccagtgaggg

SEQ ID NO: 130599 - DNA, 25 bp, Homo sapien
tgctgtggaccctgtcttctgggca

SEQ ID NO: 130600 - DNA, 25 bp, Homo sapien
tgtcttctgggcacagtggactcag

SEQ ID NO: 130601 - DNA, 25 bp, Homo sapien
tgggcacagtggactcagcagtgac

SEQ ID NO: 130602 - DNA, 25 bp, Homo sapien
tcagcagtgaccacaccaacactga

SEQ ID NO: 130603 - DNA, 25 bp, Homo sapien
gcctgcacagcatcggcaagatcgg

SEQ ID NO: 130604 - DNA, 25 bp, Homo sapien
cacagcatcggcaagatcggcggcg

SEQ ID NO: 130605 - DNA, 25 bp, Homo sapien
acagcatcggcaagatcggcggcgc

SEQ ID NO: 130606 - DNA, 25 bp, Homo sapien
catcggcaagatcggcggcgcgcag

SEQ ID NO: 130607 - DNA, 25 bp, Homo sapien
aagatcggcggcgcgcagaaccgct

SEQ ID NO: 130608 - DNA, 25 bp, Homo sapien
tgtgggctggaacaactccaccttc

SEQ ID NO: 130609 - DNA, 25 bp, Homo sapien
tgggctggaacaactccaccttcgc

SEQ ID NO: 130610 - DNA, 25 bp, Homo sapien
agagccgcagggacccacgctgtct

SEQ ID NO: 130611 - DNA, 25 bp, Homo sapien
agggacccacgctgtctgcgctggc

SEQ ID NO: 130612 - DNA, 25 bp, Homo sapien
gggaacccgccgcacgctgtgttct

SEQ ID NO: 130613 - DNA, 25 bp, Homo sapien
gaacccgccgcacgctgtgttctag

SEQ ID NO: 130614 - DNA, 25 bp, Homo sapien
tggagatggtctgcatcagcttttt

SEQ ID NO: 130615 - DNA, 25 bp, Homo sapien
ggtctgcatcagctttttgtattaa

SEQ ID NO: 130616 - DNA, 25 bp, Homo sapien
aagttactggctctttgtgtgtctc

SEQ ID NO: 130617 - DNA, 25 bp, Homo sapien
tggctctttgtgtgtctccaggtaa

SEQ ID NO: 130618 - DNA, 25 bp, Homo sapien
gtgtctccaggtaactttgcttgat

SEQ ID NO: 130619 - DNA, 25 bp, Homo sapien
gcaaagccatattctaaattcactg

SEQ ID NO: 130620 - DNA, 25 bp, Homo sapien
attcactgttgaatgcctgtcccag

SEQ ID NO: 130621 - DNA, 25 bp, Homo sapien
gaatgcctgtcccagtccaaattgt

SEQ ID NO: 130622 - DNA, 25 bp, Homo sapien
cagtccaaattgtctgtctgctctt

SEQ ID NO: 130623 - DNA, 25 bp, Homo sapien
aatcttggtttggtacagttcataa

SEQ ID NO: 130624 - DNA, 25 bp, Homo sapien
aacatatgtctgtctttgcaaagga

SEQ ID NO: 130625 - DNA, 25 bp, Homo sapien
gacatctttgaaggtcatgagtttg

SEQ ID NO: 130626 - DNA, 25 bp, Homo sapien
gtaatagtgaaacctgtactcaaaa

SEQ ID NO: 130627 - DNA, 25 bp, Homo sapien
agcagcttgaaactggctttaccaa

SEQ ID NO: 130628 - DNA, 25 bp, Homo sapien
gaaactggctttaccaatcttgaaa

SEQ ID NO: 130629 - DNA, 25 bp, Homo sapien
gaaatttgaccacaagtgtcttata

SEQ ID NO: 130630 - DNA, 25 bp, Homo sapien
gtgtcttatatatgcagatctaatg

SEQ ID NO: 130631 - DNA, 25 bp, Homo sapien
acttggactccatcgttaaaattat

SEQ ID NO: 130632 - DNA, 25 bp, Homo sapien
gtgtgcattaaatatgcttccacag

SEQ ID NO: 130633 - DNA, 25 bp, Homo sapien
gaaagctgcctttctatttacttga

SEQ ID NO: 130634 - DNA, 25 bp, Homo sapien
gctgcctttctatttacttgagtct

SEQ ID NO: 130635 - DNA, 25 bp, Homo sapien
acttgagtcttgtacatacatactt

SEQ ID NO: 130636 - DNA, 25 bp, Homo sapien
ttttctttgttgacctatgaagatt

SEQ ID NO: 130637 - DNA, 25 bp, Homo sapien
ctttgttgacctatgaagattttag

SEQ ID NO: 130638 - DNA, 25 bp, Homo sapien
agattttagagtttaccttcatatg

SEQ ID NO: 130639 - DNA, 25 bp, Homo sapien
ttagagtttaccttcatatgtttga

SEQ ID NO: 130640 - DNA, 25 bp, Homo sapien
agagtttaccttcatatgtttgatt

SEQ ID NO: 130641 - DNA, 25 bp, Homo sapien
aatcagtgtataatctagatggtaa

SEQ ID NO: 130642 - DNA, 25 bp, Homo sapien
atttcattaatgctttcaattgaca

SEQ ID NO: 130643 - DNA, 25 bp, Homo sapien
aaagatcttttaactgttggcagtt

SEQ ID NO: 130644 - DNA, 25 bp, Homo sapien
aactgttggcagttgttatctacag

SEQ ID NO: 130645 - DNA, 25 bp, Homo sapien
gttggcagttgttatctacagaatc

SEQ ID NO: 130646 - DNA, 25 bp, Homo sapien
ggcagttgttatctacagaatcata

SEQ ID NO: 130647 - DNA, 25 bp, Homo sapien
caccccttgtttttcaagatactat

SEQ ID NO: 130648 - DNA, 25 bp, Homo sapien
atattttcacagacttttgaagcac

SEQ ID NO: 130649 - DNA, 25 bp, Homo sapien
catttaatattggacatctgggccc

SEQ ID NO: 130650 - DNA, 25 bp, Homo sapien
ctgggcccttggaagtacaaatcta

SEQ ID NO: 130651 - DNA, 25 bp, Homo sapien
gaaaaaccaacccactgtgtaagtg

SEQ ID NO: 130652 - DNA, 25 bp, Homo sapien
tgtgtaagtgactcatcttcctgtt

SEQ ID NO: 130653 - DNA, 25 bp, Homo sapien
tgactcatcttcctgttgttccaat

SEQ ID NO: 130654 - DNA, 25 bp, Homo sapien
ctgttgttccaattctgtgggtttt

SEQ ID NO: 130655 - DNA, 25 bp, Homo sapien
gtgggtttttgattcaacggtgcta

SEQ ID NO: 130656 - DNA, 25 bp, Homo sapien
aacggtgctataaccagggtcctgg

SEQ ID NO: 130657 - DNA, 25 bp, Homo sapien
tgagcaccatgtgtcatcacagaca

SEQ ID NO: 130658 - DNA, 25 bp, Homo sapien
attcaaaattgacattgctttactg

SEQ ID NO: 130659 - DNA, 25 bp, Homo sapien
ataattttatggctcactatgaatc

SEQ ID NO: 130660 - DNA, 25 bp, Homo sapien
ggctcactatgaatctattatactg

SEQ ID NO: 130661 - DNA, 25 bp, Homo sapien
agagtgaaaattgtcttcttctgtg

SEQ ID NO: 130662 - DNA, 25 bp, Homo sapien
tcttcttctgtgctggagatgtttt

SEQ ID NO: 130663 - DNA, 25 bp, Homo sapien
aatgatatatggataatgccggtga

SEQ ID NO: 130664 - DNA, 25 bp, Homo sapien
taatgccggtgagaataagagagtc

SEQ ID NO: 130665 - DNA, 25 bp, Homo sapien
gagagtcataaaccttaagtaagca

SEQ ID NO: 130666 - DNA, 25 bp, Homo sapien
gcaacagcataacaaggtccaagat

SEQ ID NO: 130667 - DNA, 25 bp, Homo sapien
gtccaagatacctaaaagagatttc

SEQ ID NO: 130668 - DNA, 25 bp, Homo sapien
catgaatgtgtaacacagtgccttc

SEQ ID NO: 130669 - DNA, 25 bp, Homo sapien
tttcccacttggtagaaagagccca

SEQ ID NO: 130670 - DNA, 25 bp, Homo sapien
ttggtagaaagagcccagaagcagc

SEQ ID NO: 130671 - DNA, 25 bp, Homo sapien
agaagcagccctggccctgtaagat

SEQ ID NO: 130672 - DNA, 25 bp, Homo sapien
agccctggccctgtaagatggactc

SEQ ID NO: 130673 - DNA, 25 bp, Homo sapien
ggccctgtaagatggactctttcat

SEQ ID NO: 130674 - DNA, 25 bp, Homo sapien
agatggactctttcatccttcagtt

SEQ ID NO: 130675 - DNA, 25 bp, Homo sapien
ggactctttcatccttcagttgtat

SEQ ID NO: 130676 - DNA, 25 bp, Homo sapien
ctctttcatccttcagttgtattta

SEQ ID NO: 130677 - DNA, 25 bp, Homo sapien
ttcatccttcagttgtatttagctt

SEQ ID NO: 130678 - DNA, 25 bp, Homo sapien
gttgtatttagctttgagtttctct

SEQ ID NO: 130679 - DNA, 25 bp, Homo sapien
atttagctttgagtttctctgcatc

SEQ ID NO: 130680 - DNA, 25 bp, Homo sapien
atcagctgttgcaggcagtgtctta

SEQ ID NO: 130681 - DNA, 25 bp, Homo sapien
catggaaaccaaaaggccgtgtgtt

SEQ ID NO: 130682 - DNA, 25 bp, Homo sapien
ggccgtgtgtttagaagcctaattg

SEQ ID NO: 130683 - DNA, 25 bp, Homo sapien
gaagcctaattgtcacatcaagcat

SEQ ID NO: 130684 - DNA, 25 bp, Homo sapien
atcaagcatcattgtccccatgcaa

SEQ ID NO: 130685 - DNA, 25 bp, Homo sapien
caccttatacatcacttcctgtttt

SEQ ID NO: 130686 - DNA, 25 bp, Homo sapien
acttcctgttttaagcagctctaaa

SEQ ID NO: 130687 - DNA, 25 bp, Homo sapien
atgttgactttatttctgagcaaag

SEQ ID NO: 130688 - DNA, 25 bp, Homo sapien
tctgagcaaagcatcggtcatgtgt

SEQ ID NO: 130689 - DNA, 25 bp, Homo sapien
tgtattttttcatagtcccaccttg

SEQ ID NO: 130690 - DNA, 25 bp, Homo sapien
tcccaccttggagcatttatgtaga

SEQ ID NO: 130691 - DNA, 25 bp, Homo sapien
gagattgataacatactgcgcaaca

SEQ ID NO: 130692 - DNA, 25 bp, Homo sapien
taacatactgcgcaacaagccctac

SEQ ID NO: 130693 - DNA, 25 bp, Homo sapien
gcgcaacaagccctacagcaagaag

SEQ ID NO: 130694 - DNA, 25 bp, Homo sapien
agccctacagcaagaaggactatag

SEQ ID NO: 130695 - DNA, 25 bp, Homo sapien
gaaggactatagatcataaggcaat

SEQ ID NO: 130696 - DNA, 25 bp, Homo sapien
gcatgaaccacagaagctgcatggt

SEQ ID NO: 130697 - DNA, 25 bp, Homo sapien
ctgcatggttaaaatagcggcctgt

SEQ ID NO: 130698 - DNA, 25 bp, Homo sapien
taaaatagcggcctgtgcccagtac

SEQ ID NO: 130699 - DNA, 25 bp, Homo sapien
gcctgtgcccagtacagaaaggtgt

SEQ ID NO: 130700 - DNA, 25 bp, Homo sapien
cagaaaggtgttactaaccagtctt

SEQ ID NO: 130701 - DNA, 25 bp, Homo sapien
accagtcttttgaatcacttagcag

SEQ ID NO: 130702 - DNA, 25 bp, Homo sapien
tctcagaccttacacaccattttgt

SEQ ID NO: 130703 - DNA, 25 bp, Homo sapien
gtaagttatgttttacatgccccgt

SEQ ID NO: 130704 - DNA, 25 bp, Homo sapien
acatgccccgtttttgagactgatc

SEQ ID NO: 130705 - DNA, 25 bp, Homo sapien
gagactgatctcgatgcaggtggat

SEQ ID NO: 130706 - DNA, 25 bp, Homo sapien
cgatgcaggtggatctccttgagat

SEQ ID NO: 130707 - DNA, 25 bp, Homo sapien
cttgagatcctgatagcctgttaca

SEQ ID NO: 130708 - DNA, 25 bp, Homo sapien
tttcacagctttgaggaacatgcat

SEQ ID NO: 130709 - DNA, 25 bp, Homo sapien
ggccaaccctcctccaatggaaatt

SEQ ID NO: 130710 - DNA, 25 bp, Homo sapien
atggaaattcccgtgttgcttcaaa

SEQ ID NO: 130711 - DNA, 25 bp, Homo sapien
tcccgtgttgcttcaaactgagaca

SEQ ID NO: 130712 - DNA, 25 bp, Homo sapien
agacagatgggacttaacaggcaat

SEQ ID NO: 130713 - DNA, 25 bp, Homo sapien
gccaagaaccgaggccaaggcacat

SEQ ID NO: 130714 - DNA, 25 bp, Homo sapien
ggccaaggcacatatgaggactact

SEQ ID NO: 130715 - DNA, 25 bp, Homo sapien
gggagcagagctgagacatgttctc

SEQ ID NO: 130716 - DNA, 25 bp, Homo sapien
gacatgttctcaccacccttggaga

SEQ ID NO: 130717 - DNA, 25 bp, Homo sapien
gaccgttctggcaggacacgaggac

SEQ ID NO: 130718 - DNA, 25 bp, Homo sapien
acgaggacagcaacggctgcatcaa

SEQ ID NO: 130719 - DNA, 25 bp, Homo sapien
tgcatcaactacgaggccttcttga

SEQ ID NO: 130720 - DNA, 25 bp, Homo sapien
ggccttcttgaaacacatcctaagc

SEQ ID NO: 130721 - DNA, 25 bp, Homo sapien
acatcctaagcgtctgagtgctgca

SEQ ID NO: 130722 - DNA, 25 bp, Homo sapien
cgtctgagtgctgcagatccagtgg

SEQ ID NO: 130723 - DNA, 25 bp, Homo sapien
gaaagcacgttccagccaccaggag

SEQ ID NO: 130724 - DNA, 25 bp, Homo sapien
cctgggttggtctaatcctagtttg

SEQ ID NO: 130725 - DNA, 25 bp, Homo sapien
gtctaatcctagtttgctgtggcct

SEQ ID NO: 130726 - DNA, 25 bp, Homo sapien
ccttcccggttgtgagagcctgtga

SEQ ID NO: 130727 - DNA, 25 bp, Homo sapien
gagcctgtgatccttagatgtgtct

SEQ ID NO: 130728 - DNA, 25 bp, Homo sapien
agatgtgtctcctgtttcagaccag

SEQ ID NO: 130729 - DNA, 25 bp, Homo sapien
gaggacaatctagctctccatactt

SEQ ID NO: 130730 - DNA, 25 bp, Homo sapien
tagctctccatactttgaacaacca

SEQ ID NO: 130731 - DNA, 25 bp, Homo sapien
gtgcattgaatactctgaaaccgaa

SEQ ID NO: 130732 - DNA, 25 bp, Homo sapien
gaaaccgaagggactggatctgcag

SEQ ID NO: 130733 - DNA, 25 bp, Homo sapien
gacagaccacttttctatattgcag

SEQ ID NO: 130734 - DNA, 25 bp, Homo sapien
attgcagtgtgaatgctgggcccct

SEQ ID NO: 130735 - DNA, 25 bp, Homo sapien
ttgtttagcccaaaaccaagtcaag

SEQ ID NO: 130736 - DNA, 25 bp, Homo sapien
tgtttagcccaaaaccaagtcaagt

SEQ ID NO: 130737 - DNA, 25 bp, Homo sapien
gtttagcccaaaaccaagtcaagtg

SEQ ID NO: 130738 - DNA, 25 bp, Homo sapien
tttagcccaaaaccaagtcaagtga

SEQ ID NO: 130739 - DNA, 25 bp, Homo sapien
ttagcccaaaaccaagtcaagtgaa

SEQ ID NO: 130740 - DNA, 25 bp, Homo sapien
tagcccaaaaccaagtcaagtgaaa

SEQ ID NO: 130741 - DNA, 25 bp, Homo sapien
tgccaggcatggaggcccacgcact

SEQ ID NO: 130742 - DNA, 25 bp, Homo sapien
gcatggaggcccacgcacttcggga

SEQ ID NO: 130743 - DNA, 25 bp, Homo sapien
ggaggcccacgcacttcgggaggtc

SEQ ID NO: 130744 - DNA, 25 bp, Homo sapien
ccaagtgtggtagagtgtgcctgaa

SEQ ID NO: 130745 - DNA, 25 bp, Homo sapien
gtggtagagtgtgcctgaagtccca

SEQ ID NO: 130746 - DNA, 25 bp, Homo sapien
cagccagccactctaccagtgcagg

SEQ ID NO: 130747 - DNA, 25 bp, Homo sapien
tgccacattagaacttctccgtcct

SEQ ID NO: 130748 - DNA, 25 bp, Homo sapien
attagaacttctccgtcctcgatgg

SEQ ID NO: 130749 - DNA, 25 bp, Homo sapien
agaacttctccgtcctcgatgggag

SEQ ID NO: 130750 - DNA, 25 bp, Homo sapien
ttctccgtcctcgatgggagggatg

SEQ ID NO: 130751 - DNA, 25 bp, Homo sapien
tcctcgatgggagggatggcccttc

SEQ ID NO: 130752 - DNA, 25 bp, Homo sapien
aggccgggcctgtacagtctgtctt

SEQ ID NO: 130753 - DNA, 25 bp, Homo sapien
cgggcctgtacagtctgtcttctgt

SEQ ID NO: 130754 - DNA, 25 bp, Homo sapien
gtctgtcttctgtatataaatggga

SEQ ID NO: 130755 - DNA, 25 bp, Homo sapien
gaatcccaagttcagtaacgcccgg

SEQ ID NO: 130756 - DNA, 25 bp, Homo sapien
caagttcagtaacgcccggcgcctg

SEQ ID NO: 130757 - DNA, 25 bp, Homo sapien
ctggggatctccagcagcatcagat

SEQ ID NO: 130758 - DNA, 25 bp, Homo sapien
tcagatgacggcagacgcacgctga

SEQ ID NO: 130759 - DNA, 25 bp, Homo sapien
tgacggcagacgcacgctgagggtt

SEQ ID NO: 130760 - DNA, 25 bp, Homo sapien
agggttcagggcaatgaccactctg

SEQ ID NO: 130761 - DNA, 25 bp, Homo sapien
gttcagggcaatgaccactctgcca

SEQ ID NO: 130762 - DNA, 25 bp, Homo sapien
caatgaccactctgccaccagagag

SEQ ID NO: 130763 - DNA, 25 bp, Homo sapien
tgccaccagagagcgcaggctggat

SEQ ID NO: 130764 - DNA, 25 bp, Homo sapien
accagagagcgcaggctggattacc

SEQ ID NO: 130765 - DNA, 25 bp, Homo sapien
gagtggagatttcctgctggtctgt

SEQ ID NO: 130766 - DNA, 25 bp, Homo sapien
ctggtctgtggagctgtagttctga

SEQ ID NO: 130767 - DNA, 25 bp, Homo sapien
ctgtggagctgtagttctgatggaa

SEQ ID NO: 130768 - DNA, 25 bp, Homo sapien
gagttcatagacgacaatgccacta

SEQ ID NO: 130769 - DNA, 25 bp, Homo sapien
taaccaaacggatgaaactctgagc

SEQ ID NO: 130770 - DNA, 25 bp, Homo sapien
aactctgagcaatgttgaggtgttt

SEQ ID NO: 130771 - DNA, 25 bp, Homo sapien
gcaattaatatatgacagcagtctt

SEQ ID NO: 130772 - DNA, 25 bp, Homo sapien
atgacagcagtctttgtgatttatt

SEQ ID NO: 130773 - DNA, 25 bp, Homo sapien
taactttctgcaagacctttggctc

SEQ ID NO: 130774 - DNA, 25 bp, Homo sapien
agacctttggctcacagaactgcag

SEQ ID NO: 130775 - DNA, 25 bp, Homo sapien
agaactgcagggtatggtgagaaac

SEQ ID NO: 130776 - DNA, 25 bp, Homo sapien
ggtgagaaaccaactacggattgct

SEQ ID NO: 130777 - DNA, 25 bp, Homo sapien
tacggattgctgcaaaccacacctt

SEQ ID NO: 130778 - DNA, 25 bp, Homo sapien
tacaagacaattgttgaaacctgct

SEQ ID NO: 130779 - DNA, 25 bp, Homo sapien
agaagctgagcggtaccgacgccga

SEQ ID NO: 130780 - DNA, 25 bp, Homo sapien
gacgccgaggagaccattcttaacg

SEQ ID NO: 130781 - DNA, 25 bp, Homo sapien
gagaccattcttaacgccttcaaga

SEQ ID NO: 130782 - DNA, 25 bp, Homo sapien
cttaacgccttcaagatgctggacc

SEQ ID NO: 130783 - DNA, 25 bp, Homo sapien
acgccttcaagatgctggacccgga

SEQ ID NO: 130784 - DNA, 25 bp, Homo sapien
tcaagatgctggacccggacgggaa

SEQ ID NO: 130785 - DNA, 25 bp, Homo sapien
aaaatcaacaaggagtacatcaagc

SEQ ID NO: 130786 - DNA, 25 bp, Homo sapien
ggagtacatcaagcgtctgctgatg

SEQ ID NO: 130787 - DNA, 25 bp, Homo sapien
atcaagcgtctgctgatgtcccagg

SEQ ID NO: 130788 - DNA, 25 bp, Homo sapien
gtctgctgatgtcccaggctgacaa

SEQ ID NO: 130789 - DNA, 25 bp, Homo sapien
tcccaggctgacaagatgacggcgg

SEQ ID NO: 130790 - DNA, 25 bp, Homo sapien
ccccagcattgaaatggactctgag

SEQ ID NO: 130791 - DNA, 25 bp, Homo sapien
aaatggactctgagatggcagcgtg

SEQ ID NO: 130792 - DNA, 25 bp, Homo sapien
agcgtggtgccagtgtcagacatcc

SEQ ID NO: 130793 - DNA, 25 bp, Homo sapien
agacatcctgtgtgtgatgatatgc

SEQ ID NO: 130794 - DNA, 25 bp, Homo sapien
gatgatatgcactgattacacaaga

SEQ ID NO: 130795 - DNA, 25 bp, Homo sapien
cactgattacacaagactgcccttt

SEQ ID NO: 130796 - DNA, 25 bp, Homo sapien
acaagactgccctttcctgagaagc

SEQ ID NO: 130797 - DNA, 25 bp, Homo sapien
gctgtgatctcgacaacttactttc

SEQ ID NO: 130798 - DNA, 25 bp, Homo sapien
ataaagcacagatctccgcacaggg

SEQ ID NO: 130799 - DNA, 25 bp, Homo sapien
gttcctgatgtaatttgcataactt

SEQ ID NO: 130800 - DNA, 25 bp, Homo sapien
atttgcataacttttctgtagtttg

SEQ ID NO: 130801 - DNA, 25 bp, Homo sapien
tcctggacattctaggtccctgact

SEQ ID NO: 130802 - DNA, 25 bp, Homo sapien
taggtccctgactcgccagatgcat

SEQ ID NO: 130803 - DNA, 25 bp, Homo sapien
tcgccagatgcatcatgtccatttt

SEQ ID NO: 130804 - DNA, 25 bp, Homo sapien
gatgcatcatgtccattttgggaaa

SEQ ID NO: 130805 - DNA, 25 bp, Homo sapien
aatggactgaagtttctggagccct

SEQ ID NO: 130806 - DNA, 25 bp, Homo sapien
tgaagtttctggagcccttgtctga

SEQ ID NO: 130807 - DNA, 25 bp, Homo sapien
tctggagcccttgtctgagactgaa

SEQ ID NO: 130808 - DNA, 25 bp, Homo sapien
ttgtctgagactgaacctcctgaga

SEQ ID NO: 130809 - DNA, 25 bp, Homo sapien
ctgagactgaacctcctgagaaggg

SEQ ID NO: 130810 - DNA, 25 bp, Homo sapien
ctagcagcggtcagaggtcctgtct

SEQ ID NO: 130811 - DNA, 25 bp, Homo sapien
cagcggtcagaggtcctgtctggat

SEQ ID NO: 130812 - DNA, 25 bp, Homo sapien
ccaggtgttgtattgcaggacccct

SEQ ID NO: 130813 - DNA, 25 bp, Homo sapien
caggtgttgtattgcaggacccctt

SEQ ID NO: 130814 - DNA, 25 bp, Homo sapien
aggtgttgtattgcaggaccccttc

SEQ ID NO: 130815 - DNA, 25 bp, Homo sapien
ggtgttgtattgcaggaccccttcc

SEQ ID NO: 130816 - DNA, 25 bp, Homo sapien
gtgttgtattgcaggaccccttccc

SEQ ID NO: 130817 - DNA, 25 bp, Homo sapien
ctcccaggactggtctgttgtcttt

SEQ ID NO: 130818 - DNA, 25 bp, Homo sapien
tcccaggactggtctgttgtctttt

SEQ ID NO: 130819 - DNA, 25 bp, Homo sapien
gttgtcttttcatctgttcaagagg

SEQ ID NO: 130820 - DNA, 25 bp, Homo sapien
gtcttttcatctgttcaagaggaga

SEQ ID NO: 130821 - DNA, 25 bp, Homo sapien
tttcatctgttcaagaggagattga

SEQ ID NO: 130822 - DNA, 25 bp, Homo sapien
tcgctcgtttttaacttcacaaata

SEQ ID NO: 130823 - DNA, 25 bp, Homo sapien
ggccaacgcctaaagatcataatat

SEQ ID NO: 130824 - DNA, 25 bp, Homo sapien
tgcataggacagatcccatctcctc

SEQ ID NO: 130825 - DNA, 25 bp, Homo sapien
ctccacccaatacattattagactg

SEQ ID NO: 130826 - DNA, 25 bp, Homo sapien
attattagactgaactgtgacctga

SEQ ID NO: 130827 - DNA, 25 bp, Homo sapien
ctgtgacctgaaatgagcaataaac

SEQ ID NO: 130828 - DNA, 25 bp, Homo sapien
ggttgcttgttatagtagtcggtcc

SEQ ID NO: 130829 - DNA, 25 bp, Homo sapien
tgcttgttatagtagtcggtccatc

SEQ ID NO: 130830 - DNA, 25 bp, Homo sapien
gtagtcggtccatcatgaccagtaa

SEQ ID NO: 130831 - DNA, 25 bp, Homo sapien
gtccatcatgaccagtaaaacataa

SEQ ID NO: 130832 - DNA, 25 bp, Homo sapien
atgtaattgttatcccattatttag

SEQ ID NO: 130833 - DNA, 25 bp, Homo sapien
gaatatatggactttctcagattag

SEQ ID NO: 130834 - DNA, 25 bp, Homo sapien
aaaccagccagcgtgaggtggtcct

SEQ ID NO: 130835 - DNA, 25 bp, Homo sapien
accagccagcgtgaggtggtcctga

SEQ ID NO: 130836 - DNA, 25 bp, Homo sapien
tgagctgccccaatggcggctcgct

SEQ ID NO: 130837 - DNA, 25 bp, Homo sapien
atggcggctcgctgacacacaccta

SEQ ID NO: 130838 - DNA, 25 bp, Homo sapien
acacccacatcgagagctgccagtg

SEQ ID NO: 130839 - DNA, 25 bp, Homo sapien
ccacatcgagagctgccagtgccag

SEQ ID NO: 130840 - DNA, 25 bp, Homo sapien
cagtgccaggacaccgtctgcgggc

SEQ ID NO: 130841 - DNA, 25 bp, Homo sapien
taagctcggcttcctctcttcagat

SEQ ID NO: 130842 - DNA, 25 bp, Homo sapien
cggcttcctctcttcagatatttat

SEQ ID NO: 130843 - DNA, 25 bp, Homo sapien
atatttattgtctgagtctttgttc

SEQ ID NO: 130844 - DNA, 25 bp, Homo sapien
tgtctgagtctttgttcagtccttg

SEQ ID NO: 130845 - DNA, 25 bp, Homo sapien
aagccctctgcactgagaagctgga

SEQ ID NO: 130846 - DNA, 25 bp, Homo sapien
acagtggctttgtgagaagttgtga

SEQ ID NO: 130847 - DNA, 25 bp, Homo sapien
agaagttgtgagtgtctgctgtcct

SEQ ID NO: 130848 - DNA, 25 bp, Homo sapien
tggaatacctcttccctaatgccac

SEQ ID NO: 130849 - DNA, 25 bp, Homo sapien
aaagcttatctgtctctgagccttg

SEQ ID NO: 130850 - DNA, 25 bp, Homo sapien
gagccttgggccctgtagtgacatc

SEQ ID NO: 130851 - DNA, 25 bp, Homo sapien
ggccctgtagtgacatcaccgaatt

SEQ ID NO: 130852 - DNA, 25 bp, Homo sapien
gacatcaccgaattcttgaagacta

SEQ ID NO: 130853 - DNA, 25 bp, Homo sapien
aagactattttccagggatgcctga

SEQ ID NO: 130854 - DNA, 25 bp, Homo sapien
ttactcagtgccttcgatggcactt

SEQ ID NO: 130855 - DNA, 25 bp, Homo sapien
atggcactttcactacagcacagat

SEQ ID NO: 130856 - DNA, 25 bp, Homo sapien
ggaacaatccaatgctaatctatct

SEQ ID NO: 130857 - DNA, 25 bp, Homo sapien
gctaatctatctaaattccgcaaac

SEQ ID NO: 130858 - DNA, 25 bp, Homo sapien
gtcccaggtcaacaaattgcgagtg

SEQ ID NO: 130859 - DNA, 25 bp, Homo sapien
acaaattgcgagtgaagagccgaga

SEQ ID NO: 130860 - DNA, 25 bp, Homo sapien
aatcagtgcagagtaaacacacctg

SEQ ID NO: 130861 - DNA, 25 bp, Homo sapien
cagagtaaacacacctgcctgatgc

SEQ ID NO: 130862 - DNA, 25 bp, Homo sapien
acctgcctgatgctatcaagaggct

SEQ ID NO: 130863 - DNA, 25 bp, Homo sapien
cacaaaatgtgctatttttggtcac

SEQ ID NO: 130864 - DNA, 25 bp, Homo sapien
ttggtcacttgctttatgacgttta

SEQ ID NO: 130865 - DNA, 25 bp, Homo sapien
gctttatgacgtttattttcctgtt

SEQ ID NO: 130866 - DNA, 25 bp, Homo sapien
gacgtttattttcctgttaaagctg

SEQ ID NO: 130867 - DNA, 25 bp, Homo sapien
ttcccaaagcaagcaagaggccgtg

SEQ ID NO: 130868 - DNA, 25 bp, Homo sapien
aagcaagcaagaggccgtggctgct

SEQ ID NO: 130869 - DNA, 25 bp, Homo sapien
aatggtactgtacagctggctctac

SEQ ID NO: 130870 - DNA, 25 bp, Homo sapien
ggtactgtacagctggctctacttc

SEQ ID NO: 130871 - DNA, 25 bp, Homo sapien
tgtacagctggctctacttccccat

SEQ ID NO: 130872 - DNA, 25 bp, Homo sapien
gccctgagcgagtggagtctgccac

SEQ ID NO: 130873 - DNA, 25 bp, Homo sapien
tctgctggcctctgcgagtggtttc

SEQ ID NO: 130874 - DNA, 25 bp, Homo sapien
tctgcgagtggtttcttgtgcactg

SEQ ID NO: 130875 - DNA, 25 bp, Homo sapien
gtggtttcttgtgcactggcaccaa

SEQ ID NO: 130876 - DNA, 25 bp, Homo sapien
ttgtgcactggcaccaagtgcgggt

SEQ ID NO: 130877 - DNA, 25 bp, Homo sapien
accaagtgcgggtccggcagcttct

SEQ ID NO: 130878 - DNA, 25 bp, Homo sapien
gttgggatctatgtctatgagcgac

SEQ ID NO: 130879 - DNA, 25 bp, Homo sapien
tgtctatgagcgacatggatcacac

SEQ ID NO: 130880 - DNA, 25 bp, Homo sapien
gatcacacatttattggtgctgcca

SEQ ID NO: 130881 - DNA, 25 bp, Homo sapien
acacatttattggtgctgccagctt

SEQ ID NO: 130882 - DNA, 25 bp, Homo sapien
gtgctgccagctttaagcataagag

SEQ ID NO: 130883 - DNA, 25 bp, Homo sapien
ttgaatcttttttgggttgaagaag

SEQ ID NO: 130884 - DNA, 25 bp, Homo sapien
aaagcatagctttagaatagagatt

SEQ ID NO: 130885 - DNA, 25 bp, Homo sapien
tgaagaacctcacacaacataattg

SEQ ID NO: 130886 - DNA, 25 bp, Homo sapien
ctcacacaacataattggagtctta

SEQ ID NO: 130887 - DNA, 25 bp, Homo sapien
gagtaagcaaagcatgtcaagtttt

SEQ ID NO: 130888 - DNA, 25 bp, Homo sapien
gtcaagtttttgttttctgcattca

SEQ ID NO: 130889 - DNA, 25 bp, Homo sapien
tgatggagcataacgggtcccagcc

SEQ ID NO: 130890 - DNA, 25 bp, Homo sapien
ggtcccagccaattgtgatgatcct

SEQ ID NO: 130891 - DNA, 25 bp, Homo sapien
tgatgatcctttttgctcatttccc

SEQ ID NO: 130892 - DNA, 25 bp, Homo sapien
gggctaccatgggaccagctctggc

SEQ ID NO: 130893 - DNA, 25 bp, Homo sapien
ctggccagagggaactaagcaaatc

SEQ ID NO: 130894 - DNA, 25 bp, Homo sapien
ggaaggttttgcagcccactcccca

SEQ ID NO: 130895 - DNA, 25 bp, Homo sapien
catcttcctgctataaatgtgggtg

SEQ ID NO: 130896 - DNA, 25 bp, Homo sapien
cagccaccttgctaccatgaaggaa

SEQ ID NO: 130897 - DNA, 25 bp, Homo sapien
aaggccaagacaatcatccacagct

SEQ ID NO: 130898 - DNA, 25 bp, Homo sapien
agacaatcatccacagctattccct

SEQ ID NO: 130899 - DNA, 25 bp, Homo sapien
ctccagcatctggttctgtacaaaa

SEQ ID NO: 130900 - DNA, 25 bp, Homo sapien
gagagcgacgaaatgcgcccatgct

SEQ ID NO: 130901 - DNA, 25 bp, Homo sapien
gaaatgcgcccatgctggttccagc

SEQ ID NO: 130902 - DNA, 25 bp, Homo sapien
tgctggttccagctggatcagatcc

SEQ ID NO: 130903 - DNA, 25 bp, Homo sapien
ggttccagctggatcagatcccctt

SEQ ID NO: 130904 - DNA, 25 bp, Homo sapien
ttcaaggacatgtggcccgacgaca

SEQ ID NO: 130905 - DNA, 25 bp, Homo sapien
atgtggcccgacgacagctactggt

SEQ ID NO: 130906 - DNA, 25 bp, Homo sapien
cgacgacagctactggtttccactc

SEQ ID NO: 130907 - DNA, 25 bp, Homo sapien
gtttccactcctgcttcagaagaag

SEQ ID NO: 130908 - DNA, 25 bp, Homo sapien
gaagaaattccacgggtacttcaag

SEQ ID NO: 130909 - DNA, 25 bp, Homo sapien
agacgtggctgctgaacagctgcaa

SEQ ID NO: 130910 - DNA, 25 bp, Homo sapien
acagctgcaaaccatcttcacctgg

SEQ ID NO: 130911 - DNA, 25 bp, Homo sapien
gataaattacaggcgaaggtgaaat

SEQ ID NO: 130912 - DNA, 25 bp, Homo sapien
taaattacaggcgaaggtgaaatca

SEQ ID NO: 130913 - DNA, 25 bp, Homo sapien
aaattacaggcgaaggtgaaatcat

SEQ ID NO: 130914 - DNA, 25 bp, Homo sapien
aattacaggcgaaggtgaaatcata

SEQ ID NO: 130915 - DNA, 25 bp, Homo sapien
attacaggcgaaggtgaaatcatac

SEQ ID NO: 130916 - DNA, 25 bp, Homo sapien
ttacaggcgaaggtgaaatcataca

SEQ ID NO: 130917 - DNA, 25 bp, Homo sapien
tacaggcgaaggtgaaatcatacaa

SEQ ID NO: 130918 - DNA, 25 bp, Homo sapien
acaggcgaaggtgaaatcatacaag

SEQ ID NO: 130919 - DNA, 25 bp, Homo sapien
caggcgaaggtgaaatcatacaaga

SEQ ID NO: 130920 - DNA, 25 bp, Homo sapien
aggcgaaggtgaaatcatacaagag

SEQ ID NO: 130921 - DNA, 25 bp, Homo sapien
ggcgaaggtgaaatcatacaagaga

SEQ ID NO: 130922 - DNA, 25 bp, Homo sapien
tttactgcagtgagaatgagggcca

SEQ ID NO: 130923 - DNA, 25 bp, Homo sapien
ctgcagtgagaatgagggccaagaa

SEQ ID NO: 130924 - DNA, 25 bp, Homo sapien
caagaaagagtcaggccttaatttt

SEQ ID NO: 130925 - DNA, 25 bp, Homo sapien
gagtcaggccttaattttcaatata

SEQ ID NO: 130926 - DNA, 25 bp, Homo sapien
tatttcaggcatactgacactttgc

SEQ ID NO: 130927 - DNA, 25 bp, Homo sapien
ctgacactttgccagaaagcataaa

SEQ ID NO: 130928 - DNA, 25 bp, Homo sapien
atatttcagatatcagaatcattga

SEQ ID NO: 130929 - DNA, 25 bp, Homo sapien
aagtattttcctccaggcaaaattg

SEQ ID NO: 130930 - DNA, 25 bp, Homo sapien
tttcctccaggcaaaattgatatac

SEQ ID NO: 130931 - DNA, 25 bp, Homo sapien
ggcaaaattgatatacttttttctt

SEQ ID NO: 130932 - DNA, 25 bp, Homo sapien
atgtctgttaacttaatagtattta

SEQ ID NO: 130933 - DNA, 25 bp, Homo sapien
gaccagtacaactcactgatcatat

SEQ ID NO: 130934 - DNA, 25 bp, Homo sapien
actgatcatattagggcagggccct

SEQ ID NO: 130935 - DNA, 25 bp, Homo sapien
ggcagggccctcttaagatcaggtg

SEQ ID NO: 130936 - DNA, 25 bp, Homo sapien
ttgggcgggacatcctctgctacca

SEQ ID NO: 130937 - DNA, 25 bp, Homo sapien
accatctcattaaaaggcccttcac

SEQ ID NO: 130938 - DNA, 25 bp, Homo sapien
ttcacctctggacaagtcatctgca

SEQ ID NO: 130939 - DNA, 25 bp, Homo sapien
gcaacaactgacttccaagatcctt

SEQ ID NO: 130940 - DNA, 25 bp, Homo sapien
aagatccttttgtgactcctccaaa

SEQ ID NO: 130941 - DNA, 25 bp, Homo sapien
gtgactcctccaaatgactttggtt

SEQ ID NO: 130942 - DNA, 25 bp, Homo sapien
tttggttcccgtgttgtacctgact

SEQ ID NO: 130943 - DNA, 25 bp, Homo sapien
gtgttgtacctgacttccacatggc

SEQ ID NO: 130944 - DNA, 25 bp, Homo sapien
caacactgtacccagctggttggga

SEQ ID NO: 130945 - DNA, 25 bp, Homo sapien
tacccagctggttgggaggaccaga

SEQ ID NO: 130946 - DNA, 25 bp, Homo sapien
aggaccagagcctgtctcagggaat

SEQ ID NO: 130947 - DNA, 25 bp, Homo sapien
agagcctgtctcagggaattgcctg

SEQ ID NO: 130948 - DNA, 25 bp, Homo sapien
agctgtcaccagcacttttgaccaa

SEQ ID NO: 130949 - DNA, 25 bp, Homo sapien
agcacttttgaccaagtcctgctac

SEQ ID NO: 130950 - DNA, 25 bp, Homo sapien
ctgccctagggcttagagcatggac

SEQ ID NO: 130951 - DNA, 25 bp, Homo sapien
tagagcatggacctcctgccctggg

SEQ ID NO: 130952 - DNA, 25 bp, Homo sapien
gggccagggctctctggatgccttc

SEQ ID NO: 130953 - DNA, 25 bp, Homo sapien
agccagggttggagtcttagcctcg

SEQ ID NO: 130954 - DNA, 25 bp, Homo sapien
ttagcctcgggatccagtgaagcca

SEQ ID NO: 130955 - DNA, 25 bp, Homo sapien
ctcgtacctgtcactgggatgcaga

SEQ ID NO: 130956 - DNA, 25 bp, Homo sapien
gtcactgggatgcagactctcgaca

SEQ ID NO: 130957 - DNA, 25 bp, Homo sapien
ggatgcagactctcgacatccgagt

SEQ ID NO: 130958 - DNA, 25 bp, Homo sapien
tcgacatccgagtccaagcgcaggc

SEQ ID NO: 130959 - DNA, 25 bp, Homo sapien
tcgggcgcaggcagctcacaccagg

SEQ ID NO: 130960 - DNA, 25 bp, Homo sapien
aagagactgtattgcagggtgaaga

SEQ ID NO: 130961 - DNA, 25 bp, Homo sapien
gaagagtgggctcccgtgggcccag

SEQ ID NO: 130962 - DNA, 25 bp, Homo sapien
gaattggtatcttgcacccgtggga

SEQ ID NO: 130963 - DNA, 25 bp, Homo sapien
tatcttgcacccgtgggagtcggga

SEQ ID NO: 130964 - DNA, 25 bp, Homo sapien
gcacccgtgggagtcgggacatata

SEQ ID NO: 130965 - DNA, 25 bp, Homo sapien
agtcgggacatataatggaaaggcc

SEQ ID NO: 130966 - DNA, 25 bp, Homo sapien
aaatgactgttttctctctctatgg

SEQ ID NO: 130967 - DNA, 25 bp, Homo sapien
gactgttttctctctctatggaaat

SEQ ID NO: 130968 - DNA, 25 bp, Homo sapien
ttttttgtttgctcttgcattgcaa

SEQ ID NO: 130969 - DNA, 25 bp, Homo sapien
atttattgtcggaagacttgccact

SEQ ID NO: 130970 - DNA, 25 bp, Homo sapien
tgtcggaagacttgccacttttcat

SEQ ID NO: 130971 - DNA, 25 bp, Homo sapien
gaagacttgccacttttcatgtcat

SEQ ID NO: 130972 - DNA, 25 bp, Homo sapien
ttgccacttttcatgtcatttgaca

SEQ ID NO: 130973 - DNA, 25 bp, Homo sapien
ggttgtacggtggtctttgaattat

SEQ ID NO: 130974 - DNA, 25 bp, Homo sapien
cggtggtctttgaattatatgtcta

SEQ ID NO: 130975 - DNA, 25 bp, Homo sapien
tgtgaaatcaaagcgccatatgtag

SEQ ID NO: 130976 - DNA, 25 bp, Homo sapien
gcgccatatgtagaattatatcttc

SEQ ID NO: 130977 - DNA, 25 bp, Homo sapien
aagtgaccagagagcaaaaggcaaa

SEQ ID NO: 130978 - DNA, 25 bp, Homo sapien
agtgaccagagagcaaaaggcaaag

SEQ ID NO: 130979 - DNA, 25 bp, Homo sapien
gtgaccagagagcaaaaggcaaagg

SEQ ID NO: 130980 - DNA, 25 bp, Homo sapien
tgaccagagagcaaaaggcaaaggg

SEQ ID NO: 130981 - DNA, 25 bp, Homo sapien
gcacgtgcctgggagtcccagcgac

SEQ ID NO: 130982 - DNA, 25 bp, Homo sapien
cacgtgcctgggagtcccagcgact

SEQ ID NO: 130983 - DNA, 25 bp, Homo sapien
acgtgcctgggagtcccagcgactt

SEQ ID NO: 130984 - DNA, 25 bp, Homo sapien
cgtgcctgggagtcccagcgacttg

SEQ ID NO: 130985 - DNA, 25 bp, Homo sapien
gtgcctgggagtcccagcgacttgg

SEQ ID NO: 130986 - DNA, 25 bp, Homo sapien
tgcctgggagtcccagcgacttggg

SEQ ID NO: 130987 - DNA, 25 bp, Homo sapien
ctgggagtcccagcgacttgggagg

SEQ ID NO: 130988 - DNA, 25 bp, Homo sapien
agctggcgcatatccaggcgctgat

SEQ ID NO: 130989 - DNA, 25 bp, Homo sapien
tatccaggcgctgatcagcggtatt

SEQ ID NO: 130990 - DNA, 25 bp, Homo sapien
ttgaagcccagctggcggatgtgcg

SEQ ID NO: 130991 - DNA, 25 bp, Homo sapien
cgagctgatagtgagcggcagaatc

SEQ ID NO: 130992 - DNA, 25 bp, Homo sapien
ggcagaatcaggagtaccagcggct

SEQ ID NO: 130993 - DNA, 25 bp, Homo sapien
gaatcaggagtaccagcggctcatg

SEQ ID NO: 130994 - DNA, 25 bp, Homo sapien
gtaccagcggctcatggacatcaag

SEQ ID NO: 130995 - DNA, 25 bp, Homo sapien
ggctcatggacatcaagtcgcggct

SEQ ID NO: 130996 - DNA, 25 bp, Homo sapien
atggacatcaagtcgcggctggagc

SEQ ID NO: 130997 - DNA, 25 bp, Homo sapien
ggacaggaagatcactacaacaatt

SEQ ID NO: 130998 - DNA, 25 bp, Homo sapien
gatcactacaacaatttgtctgcct

SEQ ID NO: 130999 - DNA, 25 bp, Homo sapien
tgcatgcacttcaagggcagccttt

SEQ ID NO: 131000 - DNA, 25 bp, Homo sapien
catgcacttcaagggcagcctttgg

SEQ ID NO: 131001 - DNA, 25 bp, Homo sapien
ggtttctgccacttccgggtctagg

SEQ ID NO: 131002 - DNA, 25 bp, Homo sapien
gggtctaggccctgcccaaatccag

SEQ ID NO: 131003 - DNA, 25 bp, Homo sapien
ggacatgctgacagggtccccaggg

SEQ ID NO: 131004 - DNA, 25 bp, Homo sapien
tccccagggagaccgtgtcagtagg

SEQ ID NO: 131005 - DNA, 25 bp, Homo sapien
tcagtagggatgtgtgcctggctgt

SEQ ID NO: 131006 - DNA, 25 bp, Homo sapien
tgcctggctgtgtacgtgggtgtgc

SEQ ID NO: 131007 - DNA, 25 bp, Homo sapien
gtgtgcagtgcacgtgagagcacgt

SEQ ID NO: 131008 - DNA, 25 bp, Homo sapien
gtgagagcacgtggcggcttctggg

SEQ ID NO: 131009 - DNA, 25 bp, Homo sapien
tggcacagctgcatgcacttcaagg

SEQ ID NO: 131010 - DNA, 25 bp, Homo sapien
tgcacagctacgactactgggagat

SEQ ID NO: 131011 - DNA, 25 bp, Homo sapien
actactgggagatggccgacaacct

SEQ ID NO: 131012 - DNA, 25 bp, Homo sapien
ctggccaaggaaaaccgagaattct

SEQ ID NO: 131013 - DNA, 25 bp, Homo sapien
cgagaattcttcaacgacctggatc

SEQ ID NO: 131014 - DNA, 25 bp, Homo sapien
tcaacgacctggatctgctcatggg

SEQ ID NO: 131015 - DNA, 25 bp, Homo sapien
ggagcacctggtccagtactcccaa

SEQ ID NO: 131016 - DNA, 25 bp, Homo sapien
cctgtcatagggacctcaccctggg

SEQ ID NO: 131017 - DNA, 25 bp, Homo sapien
agagtgggctctggtctccacagat

SEQ ID NO: 131018 - DNA, 25 bp, Homo sapien
ctccacagatggctcaacgtttttg

SEQ ID NO: 131019 - DNA, 25 bp, Homo sapien
tcaacgtttttggacactgtgctac

SEQ ID NO: 131020 - DNA, 25 bp, Homo sapien
gacactgtgctactgaaactcccag

SEQ ID NO: 131021 - DNA, 25 bp, Homo sapien
accatgagaaggacactcgctgcct

SEQ ID NO: 131022 - DNA, 25 bp, Homo sapien
tgagaaggacactcgctgcctgggt

SEQ ID NO: 131023 - DNA, 25 bp, Homo sapien
tgcctgggtgcgactgcacagcagt

SEQ ID NO: 131024 - DNA, 25 bp, Homo sapien
gggtgcgactgcacagcagttccac

SEQ ID NO: 131025 - DNA, 25 bp, Homo sapien
acaagcagctgatccgattcctgaa

SEQ ID NO: 131026 - DNA, 25 bp, Homo sapien
tgatccgattcctgaaacggctcga

SEQ ID NO: 131027 - DNA, 25 bp, Homo sapien
aaacggctcgacaggaacctctggg

SEQ ID NO: 131028 - DNA, 25 bp, Homo sapien
ggcctggcgggcttgaattcctgtc

SEQ ID NO: 131029 - DNA, 25 bp, Homo sapien
ctggcgggcttgaattcctgtcctg

SEQ ID NO: 131030 - DNA, 25 bp, Homo sapien
tgaaggaagccaaccagagtacgtt

SEQ ID NO: 131031 - DNA, 25 bp, Homo sapien
gaaaggctaaagacgatcatgagag

SEQ ID NO: 131032 - DNA, 25 bp, Homo sapien
gcccaagacgttgccggtggctcga

SEQ ID NO: 131033 - DNA, 25 bp, Homo sapien
gtggctcgaaccctggagcccacaa

SEQ ID NO: 131034 - DNA, 25 bp, Homo sapien
cttgccagaggtgataaccaggctg

SEQ ID NO: 131035 - DNA, 25 bp, Homo sapien
gagaagattctgacaacgacgacga

SEQ ID NO: 131036 - DNA, 25 bp, Homo sapien
aacgacgacgacactcacgtgagaa

SEQ ID NO: 131037 - DNA, 25 bp, Homo sapien
actcacgtgagaatggattttgcca

SEQ ID NO: 131038 - DNA, 25 bp, Homo sapien
attttgccagacgtgataatcagtt

SEQ ID NO: 131039 - DNA, 25 bp, Homo sapien
tgataatcagttcgactctcccaaa

SEQ ID NO: 131040 - DNA, 25 bp, Homo sapien
gactctcccaaaagaggtcggtaat

SEQ ID NO: 131041 - DNA, 25 bp, Homo sapien
ttccctaaagtgaatggtcattgtc

SEQ ID NO: 131042 - DNA, 25 bp, Homo sapien
attgtctaatgattcgatgcgctac

SEQ ID NO: 131043 - DNA, 25 bp, Homo sapien
ctgaccttgaggagtcttgtgtgca

SEQ ID NO: 131044 - DNA, 25 bp, Homo sapien
tgaggagtcttgtgtgcattgctgt

SEQ ID NO: 131045 - DNA, 25 bp, Homo sapien
gtgcattgctgtgaattagctcact

SEQ ID NO: 131046 - DNA, 25 bp, Homo sapien
gctgtgaattagctcacttggtgat

SEQ ID NO: 131047 - DNA, 25 bp, Homo sapien
gctcacttggtgatatgtcctatat

SEQ ID NO: 131048 - DNA, 25 bp, Homo sapien
ggtgatatgtcctatattggctaaa

SEQ ID NO: 131049 - DNA, 25 bp, Homo sapien
atattggctaaattgaaacctggaa

SEQ ID NO: 131050 - DNA, 25 bp, Homo sapien
gggcaatctattaatagctgcctta

SEQ ID NO: 131051 - DNA, 25 bp, Homo sapien
agctgccttaaagtcagtaacttac

SEQ ID NO: 131052 - DNA, 25 bp, Homo sapien
cagtaacttacccttagggaggctg

SEQ ID NO: 131053 - DNA, 25 bp, Homo sapien
ggaggggtttatgctcaatccatgt

SEQ ID NO: 131054 - DNA, 25 bp, Homo sapien
tataatcgctacttcaggaagcgcc

SEQ ID NO: 131055 - DNA, 25 bp, Homo sapien
aatcgctacttcaggaagcgccgag

SEQ ID NO: 131056 - DNA, 25 bp, Homo sapien
tcgctacttcaggaagcgccgaggg

SEQ ID NO: 131057 - DNA, 25 bp, Homo sapien
ccctgtagcagcattactgaaatac

SEQ ID NO: 131058 - DNA, 25 bp, Homo sapien
agcagcattactgaaatacataggc

SEQ ID NO: 131059 - DNA, 25 bp, Homo sapien
gcattactgaaatacataggcttat

SEQ ID NO: 131060 - DNA, 25 bp, Homo sapien
ataggcttatatacaatgcttcttt

SEQ ID NO: 131061 - DNA, 25 bp, Homo sapien
aggcttatatacaatgcttctttcc

SEQ ID NO: 131062 - DNA, 25 bp, Homo sapien
gcttatatacaatgcttctttcctg

SEQ ID NO: 131063 - DNA, 25 bp, Homo sapien
ttatatacaatgcttctttcctgta

SEQ ID NO: 131064 - DNA, 25 bp, Homo sapien
aaagtgcactgcagtgagggtcaaa

SEQ ID NO: 131065 - DNA, 25 bp, Homo sapien
tggacaagctgtgcacgtctcctgt

SEQ ID NO: 131066 - DNA, 25 bp, Homo sapien
aagctgtgcacgtctcctgttctgg

SEQ ID NO: 131067 - DNA, 25 bp, Homo sapien
tgcacgtctcctgttctggtctctt

SEQ ID NO: 131068 - DNA, 25 bp, Homo sapien
tcctgttctggtctcttcccgatgc

SEQ ID NO: 131069 - DNA, 25 bp, Homo sapien
acttttgcagtgaatattgggaacc

SEQ ID NO: 131070 - DNA, 25 bp, Homo sapien
tgaatattgggaaccttccagtggt

SEQ ID NO: 131071 - DNA, 25 bp, Homo sapien
gtgttgtttgtaaagctgccatccg

SEQ ID NO: 131072 - DNA, 25 bp, Homo sapien
gtttgtaaagctgccatccgaccaa

SEQ ID NO: 131073 - DNA, 25 bp, Homo sapien
taaagctgccatccgaccaaggtct

SEQ ID NO: 131074 - DNA, 25 bp, Homo sapien
tgccatccgaccaaggtctcctgtg

SEQ ID NO: 131075 - DNA, 25 bp, Homo sapien
aaggtctcctgtgctgaagttgccg

SEQ ID NO: 131076 - DNA, 25 bp, Homo sapien
gatttgccgcaaactgaatggtatt

SEQ ID NO: 131077 - DNA, 25 bp, Homo sapien
gaatggtattcgtttcacctgttgt

SEQ ID NO: 131078 - DNA, 25 bp, Homo sapien
aagtgccaaagacaggacatcgatg

SEQ ID NO: 131079 - DNA, 25 bp, Homo sapien
gtcagtgacacttgaacaatgctca

SEQ ID NO: 131080 - DNA, 25 bp, Homo sapien
gatgagcaccagttacacaaggact

SEQ ID NO: 131081 - DNA, 25 bp, Homo sapien
aaggacttctttatccgagcgctgg

SEQ ID NO: 131082 - DNA, 25 bp, Homo sapien
ccgagcgctggattgcatgagaaga

SEQ ID NO: 131083 - DNA, 25 bp, Homo sapien
aaagtatgctttcaacatgctacag

SEQ ID NO: 131084 - DNA, 25 bp, Homo sapien
acatgctacagctgatggctttccc

SEQ ID NO: 131085 - DNA, 25 bp, Homo sapien
gatggctttccccaagtactacaga

SEQ ID NO: 131086 - DNA, 25 bp, Homo sapien
aagctgacacctaagtttaccaaca

SEQ ID NO: 131087 - DNA, 25 bp, Homo sapien
gcctagctgtataggaggaattgcc

SEQ ID NO: 131088 - DNA, 25 bp, Homo sapien
aggaattgcctaagggtggcccact

SEQ ID NO: 131089 - DNA, 25 bp, Homo sapien
aagggtggcccactcttgtgattgc

SEQ ID NO: 131090 - DNA, 25 bp, Homo sapien
ttgtgattgccccatttcctctggc

SEQ ID NO: 131091 - DNA, 25 bp, Homo sapien
gccccatttcctctggcaacaaaag

SEQ ID NO: 131092 - DNA, 25 bp, Homo sapien
gccagagtgttgtgggccaagtccc

SEQ ID NO: 131093 - DNA, 25 bp, Homo sapien
agggcatggccctgatttccctggt

SEQ ID NO: 131094 - DNA, 25 bp, Homo sapien
gatttccctggtttgagactcactt

SEQ ID NO: 131095 - DNA, 25 bp, Homo sapien
tggtttgagactcacttcctcatct

SEQ ID NO: 131096 - DNA, 25 bp, Homo sapien
ccctgtcctctgagataatatgagt

SEQ ID NO: 131097 - DNA, 25 bp, Homo sapien
gagtgagcacttaggtatcatatca

SEQ ID NO: 131098 - DNA, 25 bp, Homo sapien
catgcacatttacaatattgaggta

SEQ ID NO: 131099 - DNA, 25 bp, Homo sapien
gataaagtgtttccttctaacgagt

SEQ ID NO: 131100 - DNA, 25 bp, Homo sapien
agtgtttccttctaacgagttgtag

SEQ ID NO: 131101 - DNA, 25 bp, Homo sapien
gtagaaatctgagtaaccacccaaa

SEQ ID NO: 131102 - DNA, 25 bp, Homo sapien
tttgtgtcaccccaaaacactccct

SEQ ID NO: 131103 - DNA, 25 bp, Homo sapien
ttcagacagtccttcagctatttca

SEQ ID NO: 131104 - DNA, 25 bp, Homo sapien
gacagtccttcagctatttcatggc

SEQ ID NO: 131105 - DNA, 25 bp, Homo sapien
agtccttcagctatttcatggctct

SEQ ID NO: 131106 - DNA, 25 bp, Homo sapien
tatttcatggctctcaccctagttt

SEQ ID NO: 131107 - DNA, 25 bp, Homo sapien
ttcatggctctcaccctagtttttt

SEQ ID NO: 131108 - DNA, 25 bp, Homo sapien
gcgacagggtctgtcttgttctgtc

SEQ ID NO: 131109 - DNA, 25 bp, Homo sapien
tggatggacaggtggtttcttccca

SEQ ID NO: 131110 - DNA, 25 bp, Homo sapien
gacaggtggtttcttcccacaagag

SEQ ID NO: 131111 - DNA, 25 bp, Homo sapien
gtggtttcttcccacaagagagaaa

SEQ ID NO: 131112 - DNA, 25 bp, Homo sapien
tcttcccacaagagagaaatctaag

SEQ ID NO: 131113 - DNA, 25 bp, Homo sapien
agaaatctaagtgtctattgcagga

SEQ ID NO: 131114 - DNA, 25 bp, Homo sapien
tccctgccttcagagagctgaaaag

SEQ ID NO: 131115 - DNA, 25 bp, Homo sapien
tccctcggtcttttatttcagggct

SEQ ID NO: 131116 - DNA, 25 bp, Homo sapien
tcggtcttttatttcagggctttgc

SEQ ID NO: 131117 - DNA, 25 bp, Homo sapien
tccccaccttctttggagcaaggag

SEQ ID NO: 131118 - DNA, 25 bp, Homo sapien
gagatgcagctgtattgtgtaacaa

SEQ ID NO: 131119 - DNA, 25 bp, Homo sapien
gtaacaagctcatttgtacagtgtc

SEQ ID NO: 131120 - DNA, 25 bp, Homo sapien
aaatgcactgttattgccatgtgaa

SEQ ID NO: 131121 - DNA, 25 bp, Homo sapien
gaggcatcgactttgataccaccat

SEQ ID NO: 131122 - DNA, 25 bp, Homo sapien
gataccaccatcatgttcagaccat

SEQ ID NO: 131123 - DNA, 25 bp, Homo sapien
accaccatcatgttcagaccatttt

SEQ ID NO: 131124 - DNA, 25 bp, Homo sapien
aaagcgcaaaaccaagtacatagtg

SEQ ID NO: 131125 - DNA, 25 bp, Homo sapien
gtacatagtgacgatggcttttatt

SEQ ID NO: 131126 - DNA, 25 bp, Homo sapien
aaatactacatctttctggcacata

SEQ ID NO: 131127 - DNA, 25 bp, Homo sapien
tggcacataactgtctccttaacca

SEQ ID NO: 131128 - DNA, 25 bp, Homo sapien
aaccactggaacagttcagccattt

SEQ ID NO: 131129 - DNA, 25 bp, Homo sapien
tggaacagttcagccatttgaataa

SEQ ID NO: 131130 - DNA, 25 bp, Homo sapien
gcttatagtagctgattgtattatt

SEQ ID NO: 131131 - DNA, 25 bp, Homo sapien
gaaatcagccaagttttataatcct

SEQ ID NO: 131132 - DNA, 25 bp, Homo sapien
aatccttaaatcttaatgttcctca

SEQ ID NO: 131133 - DNA, 25 bp, Homo sapien
aatcttaatgttcctcaaagcttgg

SEQ ID NO: 131134 - DNA, 25 bp, Homo sapien
taatgttcctcaaagcttggattaa

SEQ ID NO: 131135 - DNA, 25 bp, Homo sapien
atacatatggatgttactctcttgc

SEQ ID NO: 131136 - DNA, 25 bp, Homo sapien
ctctcttgcaccaaattatcttgat

SEQ ID NO: 131137 - DNA, 25 bp, Homo sapien
aataggtggtagatattgaggccaa

SEQ ID NO: 131138 - DNA, 25 bp, Homo sapien
tattgaggccaagaatattgcaaaa

SEQ ID NO: 131139 - DNA, 25 bp, Homo sapien
gcatacttacctagtgaaacttttc

SEQ ID NO: 131140 - DNA, 25 bp, Homo sapien
tatttttcactctaagtcatgtatg

SEQ ID NO: 131141 - DNA, 25 bp, Homo sapien
cactctaagtcatgtatgtttctct

SEQ ID NO: 131142 - DNA, 25 bp, Homo sapien
aactatttctaggtttgtgaatgtg

SEQ ID NO: 131143 - DNA, 25 bp, Homo sapien
tttctaggtttgtgaatgtgaagcc

SEQ ID NO: 131144 - DNA, 25 bp, Homo sapien
gaatgtgaagccccaggccgcaggg

SEQ ID NO: 131145 - DNA, 25 bp, Homo sapien
accagctgagaacaaagtgtctatc

SEQ ID NO: 131146 - DNA, 25 bp, Homo sapien
aaagtgtctatctgggtgtgggccc

SEQ ID NO: 131147 - DNA, 25 bp, Homo sapien
aagtgtctatctgggtgtgggcccc

SEQ ID NO: 131148 - DNA, 25 bp, Homo sapien
tctatctgggtgtgggcccctggcc

SEQ ID NO: 131149 - DNA, 25 bp, Homo sapien
tggaaccatcccgtcctgtatcata

SEQ ID NO: 131150 - DNA, 25 bp, Homo sapien
gaaccatcccgtcctgtatcatatg

SEQ ID NO: 131151 - DNA, 25 bp, Homo sapien
accatcccgtcctgtatcatatgta

SEQ ID NO: 131152 - DNA, 25 bp, Homo sapien
aaatactgtgaggtgatgtgcccac

SEQ ID NO: 131153 - DNA, 25 bp, Homo sapien
ctgaaactggtgtgtggaagtcaca

SEQ ID NO: 131154 - DNA, 25 bp, Homo sapien
ggtgtgtggaagtcacagcttcatc

SEQ ID NO: 131155 - DNA, 25 bp, Homo sapien
gtgtggaagtcacagcttcatcaag

SEQ ID NO: 131156 - DNA, 25 bp, Homo sapien
acaaggaaggaccaatgaatgttaa

SEQ ID NO: 131157 - DNA, 25 bp, Homo sapien
aaatgcaacaaacaacttccgctta

SEQ ID NO: 131158 - DNA, 25 bp, Homo sapien
tgcaacaaacaacttccgcttaaaa

SEQ ID NO: 131159 - DNA, 25 bp, Homo sapien
gttgttaataactgtgattttgtaa

SEQ ID NO: 131160 - DNA, 25 bp, Homo sapien
gatatattctagcatattaagagct

SEQ ID NO: 131161 - DNA, 25 bp, Homo sapien
ttaagagcttttataactgagttat

SEQ ID NO: 131162 - DNA, 25 bp, Homo sapien
tatagattagtttgctttctggaat

SEQ ID NO: 131163 - DNA, 25 bp, Homo sapien
agattagtttgctttctggaataaa

SEQ ID NO: 131164 - DNA, 25 bp, Homo sapien
gcgatgggtcccgtgtcactgttta

SEQ ID NO: 131165 - DNA, 25 bp, Homo sapien
atgggtcccgtgtcactgtttacat

SEQ ID NO: 131166 - DNA, 25 bp, Homo sapien
ggtcccgtgtcactgtttacatgac

SEQ ID NO: 131167 - DNA, 25 bp, Homo sapien
cgtgtcactgtttacatgacctatt

SEQ ID NO: 131168 - DNA, 25 bp, Homo sapien
ttgtgtggttatatagccctttatt

SEQ ID NO: 131169 - DNA, 25 bp, Homo sapien
tgtggttatatagccctttatttaa

SEQ ID NO: 131170 - DNA, 25 bp, Homo sapien
gaaaaaagagctgcagagtatttat

SEQ ID NO: 131171 - DNA, 25 bp, Homo sapien
gcagagtatttataaaactgtcttt

SEQ ID NO: 131172 - DNA, 25 bp, Homo sapien
acaagcaagaagaccatttgaccat

SEQ ID NO: 131173 - DNA, 25 bp, Homo sapien
agaagaccatttgaccatatgaatg

SEQ ID NO: 131174 - DNA, 25 bp, Homo sapien
tcttgtaaacttacggacacctctt

SEQ ID NO: 131175 - DNA, 25 bp, Homo sapien
tgagccggacactgaccaccagcgg

SEQ ID NO: 131176 - DNA, 25 bp, Homo sapien
agccggacactgaccaccagcggaa

SEQ ID NO: 131177 - DNA, 25 bp, Homo sapien
agcggaacccttagcacccacatgg

SEQ ID NO: 131178 - DNA, 25 bp, Homo sapien
ttagcacccacatggaccaacagtt

SEQ ID NO: 131179 - DNA, 25 bp, Homo sapien
ggaccaacagttcttccaaacttga

SEQ ID NO: 131180 - DNA, 25 bp, Homo sapien
aacagttcttccaaacttgaccgca

SEQ ID NO: 131181 - DNA, 25 bp, Homo sapien
agcccacccgcatgcacagagcagg

SEQ ID NO: 131182 - DNA, 25 bp, Homo sapien
gcaaggtccgtcctctgtgggccca

SEQ ID NO: 131183 - DNA, 25 bp, Homo sapien
tctgtgggcccaaacctatttgtaa

SEQ ID NO: 131184 - DNA, 25 bp, Homo sapien
aacctatttgtaaccaaagagctgg

SEQ ID NO: 131185 - DNA, 25 bp, Homo sapien
ttgtaaccaaagagctgggagcagc

SEQ ID NO: 131186 - DNA, 25 bp, Homo sapien
gcatgcgcagcattggaacacggga

SEQ ID NO: 131187 - DNA, 25 bp, Homo sapien
gaacacgggaggtagtcacccagaa

SEQ ID NO: 131188 - DNA, 25 bp, Homo sapien
agaaaaacttgagcggcctggtgcc

SEQ ID NO: 131189 - DNA, 25 bp, Homo sapien
tggtgcccatccgagacttaaggct

SEQ ID NO: 131190 - DNA, 25 bp, Homo sapien
gagacttaaggctagaccccagcct

SEQ ID NO: 131191 - DNA, 25 bp, Homo sapien
gttccatccctttattagctctgag

SEQ ID NO: 131192 - DNA, 25 bp, Homo sapien
tctgagccccaatttactgattgtg

SEQ ID NO: 131193 - DNA, 25 bp, Homo sapien
ttactgattgtgtggctctttctga

SEQ ID NO: 131194 - DNA, 25 bp, Homo sapien
gtgtggctctttctgagcatagcat

SEQ ID NO: 131195 - DNA, 25 bp, Homo sapien
ctgagcatagcatacctggtgacca

SEQ ID NO: 131196 - DNA, 25 bp, Homo sapien
acctggtgaccaaattgcgttgcaa

SEQ ID NO: 131197 - DNA, 25 bp, Homo sapien
gtgcctcagatctgctgtagccagt

SEQ ID NO: 131198 - DNA, 25 bp, Homo sapien
tgctgtagccagtgcagacctcact

SEQ ID NO: 131199 - DNA, 25 bp, Homo sapien
agacctcactgtcgtgtccatgcca

SEQ ID NO: 131200 - DNA, 25 bp, Homo sapien
tggcctggtgactccatgatggacg

SEQ ID NO: 131201 - DNA, 25 bp, Homo sapien
atgatggacgatcttgctcccagga

SEQ ID NO: 131202 - DNA, 25 bp, Homo sapien
ggaagagttgtacgcccaggcaaca

SEQ ID NO: 131203 - DNA, 25 bp, Homo sapien
aacaagggctgagctgcgcttgcgt

SEQ ID NO: 131204 - DNA, 25 bp, Homo sapien
gcgcttgcgtggctgtttcatgacc

SEQ ID NO: 131205 - DNA, 25 bp, Homo sapien
gtttcatgaccgcttgtttttctcc

SEQ ID NO: 131206 - DNA, 25 bp, Homo sapien
tctccttttggtgtaatgttttaca

SEQ ID NO: 131207 - DNA, 25 bp, Homo sapien
tacaaatcctttggcctgagaacta

SEQ ID NO: 131208 - DNA, 25 bp, Homo sapien
ataaatttgttgtgtactacgtttg

SEQ ID NO: 131209 - DNA, 25 bp, Homo sapien
gtgtactacgtttggtattttgtct

SEQ ID NO: 131210 - DNA, 25 bp, Homo sapien
ttgtcttattgtttctctactaaga

SEQ ID NO: 131211 - DNA, 25 bp, Homo sapien
gtttctctactaagaactctttctt

SEQ ID NO: 131212 - DNA, 25 bp, Homo sapien
atgtggtttgttactgtagcacttt

SEQ ID NO: 131213 - DNA, 25 bp, Homo sapien
gtagcactttttacactgaaactat

SEQ ID NO: 131214 - DNA, 25 bp, Homo sapien
aactatacttgaacagttccaactg

SEQ ID NO: 131215 - DNA, 25 bp, Homo sapien
catactgtatgaagcttgtcctctg

SEQ ID NO: 131216 - DNA, 25 bp, Homo sapien
gtatgaagcttgtcctctgactagg

SEQ ID NO: 131217 - DNA, 25 bp, Homo sapien
gtcctctgactaggtttctaatttc

SEQ ID NO: 131218 - DNA, 25 bp, Homo sapien
tctatgtggaatttcctatcttgca

SEQ ID NO: 131219 - DNA, 25 bp, Homo sapien
ctggttggccgtggtccagctcttg

SEQ ID NO: 131220 - DNA, 25 bp, Homo sapien
ttggcccctgtgtgagttgagtctc

SEQ ID NO: 131221 - DNA, 25 bp, Homo sapien
tcctctctgagactgctaagtaggg

SEQ ID NO: 131222 - DNA, 25 bp, Homo sapien
gcagtgatggttgccaggacgaatt

SEQ ID NO: 131223 - DNA, 25 bp, Homo sapien
atatctgtgaggtgctgatgagtga

SEQ ID NO: 131224 - DNA, 25 bp, Homo sapien
tgattgacacacagcactctctaaa

SEQ ID NO: 131225 - DNA, 25 bp, Homo sapien
agcactctctaaatcttccttgtga

SEQ ID NO: 131226 - DNA, 25 bp, Homo sapien
cttccttgtgaggattatgggtcct

SEQ ID NO: 131227 - DNA, 25 bp, Homo sapien
gggtcctgcaattctacagtttctt

SEQ ID NO: 131228 - DNA, 25 bp, Homo sapien
attgccaaggcagcgggatctcgta

SEQ ID NO: 131229 - DNA, 25 bp, Homo sapien
ggcagcgggatctcgtatctttaaa

SEQ ID NO: 131230 - DNA, 25 bp, Homo sapien
atcctctctacaaaagtgccatcac

SEQ ID NO: 131231 - DNA, 25 bp, Homo sapien
accatcaatcctcgctttcaagagg

SEQ ID NO: 131232 - DNA, 25 bp, Homo sapien
ctttcaagaggcagacagtcccact

SEQ ID NO: 131233 - DNA, 25 bp, Homo sapien
agacagtcccactctctgaaggagg

SEQ ID NO: 131234 - DNA, 25 bp, Homo sapien
ggagggacacttacccaaggctctt

SEQ ID NO: 131235 - DNA, 25 bp, Homo sapien
tcttctccttggaggacagtgggaa

SEQ ID NO: 131236 - DNA, 25 bp, Homo sapien
gactaattcactggcgaggtgcggc

SEQ ID NO: 131237 - DNA, 25 bp, Homo sapien
caccaccctacttcattttcagagt

SEQ ID NO: 131238 - DNA, 25 bp, Homo sapien
tttcagagtgacacccaagagggct

SEQ ID NO: 131239 - DNA, 25 bp, Homo sapien
tgcaaccttgcatccatctgggcta

SEQ ID NO: 131240 - DNA, 25 bp, Homo sapien
gctaccccacccaagtatacaataa

SEQ ID NO: 131241 - DNA, 25 bp, Homo sapien
ctggacacgtcggaggtggtcttca

SEQ ID NO: 131242 - DNA, 25 bp, Homo sapien
cgtcggaggtggtcttcaacagcaa

SEQ ID NO: 131243 - DNA, 25 bp, Homo sapien
cgggcgttcctttccagcgcgggca

SEQ ID NO: 131244 - DNA, 25 bp, Homo sapien
tccagcgcgggcagcccttcgaggt

SEQ ID NO: 131245 - DNA, 25 bp, Homo sapien
ttcgaggtgctcatcatcgcgtcag

SEQ ID NO: 131246 - DNA, 25 bp, Homo sapien
aggtgctcatcatcgcgtcagacga

SEQ ID NO: 131247 - DNA, 25 bp, Homo sapien
atcgcgtcagacgacggcttcaagg

SEQ ID NO: 131248 - DNA, 25 bp, Homo sapien
cagacgacggcttcaaggccgtggt

SEQ ID NO: 131249 - DNA, 25 bp, Homo sapien
tgcagctggactccgtgaggatctt

SEQ ID NO: 131250 - DNA, 25 bp, Homo sapien
gactccgtgaggatcttctgagcag

SEQ ID NO: 131251 - DNA, 25 bp, Homo sapien
tcttctgagcagaagcccaggcggc

SEQ ID NO: 131252 - DNA, 25 bp, Homo sapien
gaataaatgattcgtgtttcactct

SEQ ID NO: 131253 - DNA, 25 bp, Homo sapien
gattcgtgtttcactctttcaagag

SEQ ID NO: 131254 - DNA, 25 bp, Homo sapien
gtttcactctttcaagaggtgaaca

SEQ ID NO: 131255 - DNA, 25 bp, Homo sapien
ggtgaacagatacaaccttaatctt

SEQ ID NO: 131256 - DNA, 25 bp, Homo sapien
tgtgtagttttatgcatgtgtgttt

SEQ ID NO: 131257 - DNA, 25 bp, Homo sapien
atgtgtgtttatggtttgcttattt

SEQ ID NO: 131258 - DNA, 25 bp, Homo sapien
gcttatttttgcaagatggatacta

SEQ ID NO: 131259 - DNA, 25 bp, Homo sapien
ggatactaattccagcattctctcc

SEQ ID NO: 131260 - DNA, 25 bp, Homo sapien
atgtatgtcacagatgactggatta

SEQ ID NO: 131261 - DNA, 25 bp, Homo sapien
aagtgctaagttactactgccataa

SEQ ID NO: 131262 - DNA, 25 bp, Homo sapien
gttactactgccataaaaaactaat

SEQ ID NO: 131263 - DNA, 25 bp, Homo sapien
cactgggaatgatctcactgatgaa

SEQ ID NO: 131264 - DNA, 25 bp, Homo sapien
cactgatgaaaaggcctccaggttt

SEQ ID NO: 131265 - DNA, 25 bp, Homo sapien
aggtttttcacctttccgatcatca

SEQ ID NO: 131266 - DNA, 25 bp, Homo sapien
tcacctttccgatcatcacgaatag

SEQ ID NO: 131267 - DNA, 25 bp, Homo sapien
aactagtcacctaaggtcctgcgag

SEQ ID NO: 131268 - DNA, 25 bp, Homo sapien
gtcctgcgagtacaagggtcgaccc

SEQ ID NO: 131269 - DNA, 25 bp, Homo sapien
ccagcatctgagagggaggtctctt

SEQ ID NO: 131270 - DNA, 25 bp, Homo sapien
aggtctcttgaccaatgggcagaat

SEQ ID NO: 131271 - DNA, 25 bp, Homo sapien
atgggcagaatcttcactccaggca

SEQ ID NO: 131272 - DNA, 25 bp, Homo sapien
acctctgccagcaaccttgagagga

SEQ ID NO: 131273 - DNA, 25 bp, Homo sapien
gagaagaatgccattttatcactct

SEQ ID NO: 131274 - DNA, 25 bp, Homo sapien
ccctcagccatgtggcacttctgag

SEQ ID NO: 131275 - DNA, 25 bp, Homo sapien
ctgagctcctgacctaggccaaggg

SEQ ID NO: 131276 - DNA, 25 bp, Homo sapien
cctggccatgggtaggagactgccc

SEQ ID NO: 131277 - DNA, 25 bp, Homo sapien
ggtcatggccgcctgcctgtcattc

SEQ ID NO: 131278 - DNA, 25 bp, Homo sapien
ttctcctcagctgcagtcgaaggct

SEQ ID NO: 131279 - DNA, 25 bp, Homo sapien
agctgcagtcgaaggctttaacttt

SEQ ID NO: 131280 - DNA, 25 bp, Homo sapien
gtcgaaggctttaactttgcacact

SEQ ID NO: 131281 - DNA, 25 bp, Homo sapien
ggctttaactttgcacacttgggat

SEQ ID NO: 131282 - DNA, 25 bp, Homo sapien
taactttgcacacttgggatcacag

SEQ ID NO: 131283 - DNA, 25 bp, Homo sapien
acacttgggatcacagttgcgtcat

SEQ ID NO: 131284 - DNA, 25 bp, Homo sapien
cttgggatcacagttgcgtcattgt

SEQ ID NO: 131285 - DNA, 25 bp, Homo sapien
tggacccctggaaactggtctcctt

SEQ ID NO: 131286 - DNA, 25 bp, Homo sapien
tggaaactggtctccttcggccgga

SEQ ID NO: 131287 - DNA, 25 bp, Homo sapien
gaaactggtctccttcggccggaca

SEQ ID NO: 131288 - DNA, 25 bp, Homo sapien
aactggtctccttcggccggacact

SEQ ID NO: 131289 - DNA, 25 bp, Homo sapien
aggccagacactccggagagccctg

SEQ ID NO: 131290 - DNA, 25 bp, Homo sapien
agacactccggagagccctgggccc

SEQ ID NO: 131291 - DNA, 25 bp, Homo sapien
cacactgctggacatggacatggag

SEQ ID NO: 131292 - DNA, 25 bp, Homo sapien
gggcagaaccaagacagcacagtgc

SEQ ID NO: 131293 - DNA, 25 bp, Homo sapien
gcagaaccaagacagcacagtgccc

SEQ ID NO: 131294 - DNA, 25 bp, Homo sapien
gcccgcctgggcagccatgaatgta

SEQ ID NO: 131295 - DNA, 25 bp, Homo sapien
gcagccatgaatgtagcgccccagg

SEQ ID NO: 131296 - DNA, 25 bp, Homo sapien
gaaaaattcgatcttatttagtgat

SEQ ID NO: 131297 - DNA, 25 bp, Homo sapien
atcttatttagtgatctgttgcaag

SEQ ID NO: 131298 - DNA, 25 bp, Homo sapien
gtgatctgttgcaagataacttgga

SEQ ID NO: 131299 - DNA, 25 bp, Homo sapien
agtcagcagtaaaatgtatggcatt

SEQ ID NO: 131300 - DNA, 25 bp, Homo sapien
aagatggtcaatatttggtttccta

SEQ ID NO: 131301 - DNA, 25 bp, Homo sapien
gatggtcaatatttggtttcctaaa

SEQ ID NO: 131302 - DNA, 25 bp, Homo sapien
gtcaatatttggtttcctaaatgct

SEQ ID NO: 131303 - DNA, 25 bp, Homo sapien
ggtttcctaaatgcttttactctgt

SEQ ID NO: 131304 - DNA, 25 bp, Homo sapien
aaatgcttttactctgtgttttaag

SEQ ID NO: 131305 - DNA, 25 bp, Homo sapien
aataaccatatatgtctggcttact

SEQ ID NO: 131306 - DNA, 25 bp, Homo sapien
atgtctggcttacttaagaatgtag

SEQ ID NO: 131307 - DNA, 25 bp, Homo sapien
gacaaaatcaaagtggcccagggag

SEQ ID NO: 131308 - DNA, 25 bp, Homo sapien
agtgtctggtgctgtgcaggacaaa

SEQ ID NO: 131309 - DNA, 25 bp, Homo sapien
ggacaaagggtcaatccacaaattt

SEQ ID NO: 131310 - DNA, 25 bp, Homo sapien
acaaatttgtcccttacctgattgc

SEQ ID NO: 131311 - DNA, 25 bp, Homo sapien
ttacctgattgctggcatccaacac

SEQ ID NO: 131312 - DNA, 25 bp, Homo sapien
aagagcttgacccaagtccgagcca

SEQ ID NO: 131313 - DNA, 25 bp, Homo sapien
agtccgagccatgatgtactctggg

SEQ ID NO: 131314 - DNA, 25 bp, Homo sapien
agaagagaacgtcctcagcccaggt

SEQ ID NO: 131315 - DNA, 25 bp, Homo sapien
gaaggtggcgtccatagcctccatt

SEQ ID NO: 131316 - DNA, 25 bp, Homo sapien
gcctccattcgtatgagaagcggct

SEQ ID NO: 131317 - DNA, 25 bp, Homo sapien
tgaaaagggatccagcacacctcct

SEQ ID NO: 131318 - DNA, 25 bp, Homo sapien
gggagatctcctgttgacagcttga

SEQ ID NO: 131319 - DNA, 25 bp, Homo sapien
tctcctgttgacagcttgagcagct

SEQ ID NO: 131320 - DNA, 25 bp, Homo sapien
gagcagctgtagcagttcgtacgac

SEQ ID NO: 131321 - DNA, 25 bp, Homo sapien
agcagttcgtacgacgggagcgacc

SEQ ID NO: 131322 - DNA, 25 bp, Homo sapien
gagcgaccgagaggatcaccggaac

SEQ ID NO: 131323 - DNA, 25 bp, Homo sapien
gaggatcaccggaacgaattccact

SEQ ID NO: 131324 - DNA, 25 bp, Homo sapien
tcaccagaccttcgccggacgaaag

SEQ ID NO: 131325 - DNA, 25 bp, Homo sapien
ggaaagtccctcagtcaagcgcatg

SEQ ID NO: 131326 - DNA, 25 bp, Homo sapien
caagcgcatgcgactttctgaagga

SEQ ID NO: 131327 - DNA, 25 bp, Homo sapien
tgcgactttctgaaggatgggcaac

SEQ ID NO: 131328 - DNA, 25 bp, Homo sapien
ggatgggcaacatgatcagattatt

SEQ ID NO: 131329 - DNA, 25 bp, Homo sapien
gggtactcatgtggatgcctacttg

SEQ ID NO: 131330 - DNA, 25 bp, Homo sapien
tcatgtggatgcctacttggaacct

SEQ ID NO: 131331 - DNA, 25 bp, Homo sapien
ggatgcctacttggaacctgggcct

SEQ ID NO: 131332 - DNA, 25 bp, Homo sapien
tacttggaacctgggcctctgagac

SEQ ID NO: 131333 - DNA, 25 bp, Homo sapien
catcttcaccccagattgtgggttt

SEQ ID NO: 131334 - DNA, 25 bp, Homo sapien
tcaccccagattgtgggtttcccat

SEQ ID NO: 131335 - DNA, 25 bp, Homo sapien
tgactttacccctttcaagcctggg

SEQ ID NO: 131336 - DNA, 25 bp, Homo sapien
aagcctggggttgtctatacccaca

SEQ ID NO: 131337 - DNA, 25 bp, Homo sapien
ttcgttgaatgctccttcccctagg

SEQ ID NO: 131338 - DNA, 25 bp, Homo sapien
cttcccctaggcagctggtaataga

SEQ ID NO: 131339 - DNA, 25 bp, Homo sapien
cacttatcccagctccaagtttttt

SEQ ID NO: 131340 - DNA, 25 bp, Homo sapien
tgacggtttaatgggcacagggttt

SEQ ID NO: 131341 - DNA, 25 bp, Homo sapien
atgggcacagggtttatgtttagga

SEQ ID NO: 131342 - DNA, 25 bp, Homo sapien
cagggtttatgtttaggatgttgaa

SEQ ID NO: 131343 - DNA, 25 bp, Homo sapien
ggatgttgaaaaagttctgcagata

SEQ ID NO: 131344 - DNA, 25 bp, Homo sapien
aacagtagtgatagttgtaccgcaa

SEQ ID NO: 131345 - DNA, 25 bp, Homo sapien
gtgatagttgtaccgcaatgtgact

SEQ ID NO: 131346 - DNA, 25 bp, Homo sapien
atagttgtaccgcaatgtgacttaa

SEQ ID NO: 131347 - DNA, 25 bp, Homo sapien
gtaccgcaatgtgacttaatgccac

SEQ ID NO: 131348 - DNA, 25 bp, Homo sapien
accaaggctgattaaaccaaggcta

SEQ ID NO: 131349 - DNA, 25 bp, Homo sapien
ttaaaccaaggctagaaccacctgc

SEQ ID NO: 131350 - DNA, 25 bp, Homo sapien
cacctgcctatattttttgttaaat

SEQ ID NO: 131351 - DNA, 25 bp, Homo sapien
tgcgagacccagagtgcaggcccgt

SEQ ID NO: 131352 - DNA, 25 bp, Homo sapien
acccagagtgcaggcccgtggacaa

SEQ ID NO: 131353 - DNA, 25 bp, Homo sapien
gtgcaggcccgtggacaaggacaga

SEQ ID NO: 131354 - DNA, 25 bp, Homo sapien
acaaggacagaaaggtctgcaggga

SEQ ID NO: 131355 - DNA, 25 bp, Homo sapien
ggagccactggcagacggcccagct

SEQ ID NO: 131356 - DNA, 25 bp, Homo sapien
aggccagcgatgatgaggccctgtt

SEQ ID NO: 131357 - DNA, 25 bp, Homo sapien
cagcgatgatgaggccctgttggtc

SEQ ID NO: 131358 - DNA, 25 bp, Homo sapien
atgaggccctgttggtctgttgacc

SEQ ID NO: 131359 - DNA, 25 bp, Homo sapien
tgttggtctgttgaccgctgggctc

SEQ ID NO: 131360 - DNA, 25 bp, Homo sapien
tctgttgaccgctgggctcgctggt

SEQ ID NO: 131361 - DNA, 25 bp, Homo sapien
tgggctcgctggtgaccgccacagc

SEQ ID NO: 131362 - DNA, 25 bp, Homo sapien
atccaacttgatatttataaaaggt

SEQ ID NO: 131363 - DNA, 25 bp, Homo sapien
tttttccaaaagtgtataagctcaa

SEQ ID NO: 131364 - DNA, 25 bp, Homo sapien
ttccaaaagtgtataagctcaaaga

SEQ ID NO: 131365 - DNA, 25 bp, Homo sapien
aaagaaaaaatgcaacctgtcaatt

SEQ ID NO: 131366 - DNA, 25 bp, Homo sapien
gaaaaaatgcaacctgtcaattaat

SEQ ID NO: 131367 - DNA, 25 bp, Homo sapien
aatgcaacctgtcaattaatatata

SEQ ID NO: 131368 - DNA, 25 bp, Homo sapien
gcaacctgtcaattaatatatacta

SEQ ID NO: 131369 - DNA, 25 bp, Homo sapien
atattattgtgtatttatgattagc

SEQ ID NO: 131370 - DNA, 25 bp, Homo sapien
ttttttgtctgactcatctgagtta

SEQ ID NO: 131371 - DNA, 25 bp, Homo sapien
ttttgtctgactcatctgagttata

SEQ ID NO: 131372 - DNA, 25 bp, Homo sapien
tgtctgactcatctgagttatattt

SEQ ID NO: 131373 - DNA, 25 bp, Homo sapien
ctagaccccgttcacagtgggagga

SEQ ID NO: 131374 - DNA, 25 bp, Homo sapien
aggagtcaatgtcattctacccctc

SEQ ID NO: 131375 - DNA, 25 bp, Homo sapien
ttctacccctcgctaaacgaagata

SEQ ID NO: 131376 - DNA, 25 bp, Homo sapien
ttttcccttcatctgtcacaggaaa

SEQ ID NO: 131377 - DNA, 25 bp, Homo sapien
agaagcccaggcacaatcttttcca

SEQ ID NO: 131378 - DNA, 25 bp, Homo sapien
ggcacaatcttttccagctttgcct

SEQ ID NO: 131379 - DNA, 25 bp, Homo sapien
ctttgcctgttacccctgtttctga

SEQ ID NO: 131380 - DNA, 25 bp, Homo sapien
attttgttgacaatagatcctttat

SEQ ID NO: 131381 - DNA, 25 bp, Homo sapien
gatcctttattcactagttacgcaa

SEQ ID NO: 131382 - DNA, 25 bp, Homo sapien
tagttacgcaaattggttcctaggg

SEQ ID NO: 131383 - DNA, 25 bp, Homo sapien
atactccttaccttcctttgtgatg

SEQ ID NO: 131384 - DNA, 25 bp, Homo sapien
ttttttggaactgcgagtggcttag

SEQ ID NO: 131385 - DNA, 25 bp, Homo sapien
gagtggcttaggtctagcctcattt

SEQ ID NO: 131386 - DNA, 25 bp, Homo sapien
aggtctagcctcattttgtttttgt

SEQ ID NO: 131387 - DNA, 25 bp, Homo sapien
tattaacttttattacggtgatcct

SEQ ID NO: 131388 - DNA, 25 bp, Homo sapien
attacggtgatccttttgtgccatg

SEQ ID NO: 131389 - DNA, 25 bp, Homo sapien
gtgatccttttgtgccatgttcaaa

SEQ ID NO: 131390 - DNA, 25 bp, Homo sapien
gttcaaaagaagttcattcctgtct

SEQ ID NO: 131391 - DNA, 25 bp, Homo sapien
cctgtctgaagtgggaaagttgcat

SEQ ID NO: 131392 - DNA, 25 bp, Homo sapien
tatataaaatgtgcgaggatcctgg

SEQ ID NO: 131393 - DNA, 25 bp, Homo sapien
gctcaaatgaaaacgcctttcggct

SEQ ID NO: 131394 - DNA, 25 bp, Homo sapien
tgaaaacgcctttcggctttgggct

SEQ ID NO: 131395 - DNA, 25 bp, Homo sapien
ttttcccctctgtgactggcagata

SEQ ID NO: 131396 - DNA, 25 bp, Homo sapien
tcccctctgtgactggcagataaca

SEQ ID NO: 131397 - DNA, 25 bp, Homo sapien
gtgactggcagataacacatacttt

SEQ ID NO: 131398 - DNA, 25 bp, Homo sapien
tttcttaggtgcagctcgattctaa

SEQ ID NO: 131399 - DNA, 25 bp, Homo sapien
taggtgcagctcgattctaatcttt

SEQ ID NO: 131400 - DNA, 25 bp, Homo sapien
ggtgcagctcgattctaatcttttc

SEQ ID NO: 131401 - DNA, 25 bp, Homo sapien
gcagctcgattctaatcttttcatg

SEQ ID NO: 131402 - DNA, 25 bp, Homo sapien
tcgattctaatcttttcatgctgca

SEQ ID NO: 131403 - DNA, 25 bp, Homo sapien
gattctaatcttttcatgctgcaca

SEQ ID NO: 131404 - DNA, 25 bp, Homo sapien
tttcatgctgcacacgattccttta

SEQ ID NO: 131405 - DNA, 25 bp, Homo sapien
tcatgctgcacacgattcctttaat

SEQ ID NO: 131406 - DNA, 25 bp, Homo sapien
tggagcagtgcctgatcctgcaaca

SEQ ID NO: 131407 - DNA, 25 bp, Homo sapien
agcagtgcctgatcctgcaacacga

SEQ ID NO: 131408 - DNA, 25 bp, Homo sapien
agtgcctgatcctgcaacacgagca

SEQ ID NO: 131409 - DNA, 25 bp, Homo sapien
tgcctgatcctgcaacacgagcatg

SEQ ID NO: 131410 - DNA, 25 bp, Homo sapien
tgatcctgcaacacgagcatggcat

SEQ ID NO: 131411 - DNA, 25 bp, Homo sapien
atcctgcaacacgagcatggcatgg

SEQ ID NO: 131412 - DNA, 25 bp, Homo sapien
tgcaacacgagcatggcatggcccc

SEQ ID NO: 131413 - DNA, 25 bp, Homo sapien
acacgagcatggcatggccccgcag

SEQ ID NO: 131414 - DNA, 25 bp, Homo sapien
acgagcatggcatggccccgcaggt

SEQ ID NO: 131415 - DNA, 25 bp, Homo sapien
atggcatggccccgcaggtcttcac

SEQ ID NO: 131416 - DNA, 25 bp, Homo sapien
cccaggccctggagtgcatgcgcag

SEQ ID NO: 131417 - DNA, 25 bp, Homo sapien
taatgcctctggtcgccgcacttct

SEQ ID NO: 131418 - DNA, 25 bp, Homo sapien
tcgccgcacttctgatgtccgtagg

SEQ ID NO: 131419 - DNA, 25 bp, Homo sapien
cacttctgatgtccgtaggccttaa

SEQ ID NO: 131420 - DNA, 25 bp, Homo sapien
tctgatgtccgtaggccttaaatct

SEQ ID NO: 131421 - DNA, 25 bp, Homo sapien
tgtccgtaggccttaaatctgcctg

SEQ ID NO: 131422 - DNA, 25 bp, Homo sapien
gtaggccttaaatctgcctggcgtc

SEQ ID NO: 131423 - DNA, 25 bp, Homo sapien
cctgactctctcctgatggtgggcc

SEQ ID NO: 131424 - DNA, 25 bp, Homo sapien
tctcctctctgacctggatacgctt

SEQ ID NO: 131425 - DNA, 25 bp, Homo sapien
ggatacgctttggtttctcaacttc

SEQ ID NO: 131426 - DNA, 25 bp, Homo sapien
acgctttggtttctcaacttctcta

SEQ ID NO: 131427 - DNA, 25 bp, Homo sapien
tggtttctcaacttctctaccccaa

SEQ ID NO: 131428 - DNA, 25 bp, Homo sapien
aagctaatgttttccacaagactga

SEQ ID NO: 131429 - DNA, 25 bp, Homo sapien
tacacgagggtagacggcagatgcc

SEQ ID NO: 131430 - DNA, 25 bp, Homo sapien
gggttggcagacaacacactagcat

SEQ ID NO: 131431 - DNA, 25 bp, Homo sapien
gcattttcacgggtgtgggcacatg

SEQ ID NO: 131432 - DNA, 25 bp, Homo sapien
tggcacctggacgtgtgcagcatgt

SEQ ID NO: 131433 - DNA, 25 bp, Homo sapien
ggcggtctctgtgtgaagccaccgt

SEQ ID NO: 131434 - DNA, 25 bp, Homo sapien
tgaagccaccgtgcttctctttggg

SEQ ID NO: 131435 - DNA, 25 bp, Homo sapien
ggccgcgagatctagcatctctgaa

SEQ ID NO: 131436 - DNA, 25 bp, Homo sapien
gcatctctgaaatcctggctgtcga

SEQ ID NO: 131437 - DNA, 25 bp, Homo sapien
cctggctgtcgaggctttgaagcat

SEQ ID NO: 131438 - DNA, 25 bp, Homo sapien
acctggttaagcttgttttctcttg

SEQ ID NO: 131439 - DNA, 25 bp, Homo sapien
actggtaatcagtactgcatagcaa

SEQ ID NO: 131440 - DNA, 25 bp, Homo sapien
agtactgcatagcaaactctttggg

SEQ ID NO: 131441 - DNA, 25 bp, Homo sapien
actgcatagcaaactctttgggaaa

SEQ ID NO: 131442 - DNA, 25 bp, Homo sapien
tatgaaaacttaactctgctgtgtg

SEQ ID NO: 131443 - DNA, 25 bp, Homo sapien
gaaaacttaactctgctgtgtgtta

SEQ ID NO: 131444 - DNA, 25 bp, Homo sapien
aactctgctgtgtgttaggcaatcc

SEQ ID NO: 131445 - DNA, 25 bp, Homo sapien
tctgctgtgtgttaggcaatcctgt

SEQ ID NO: 131446 - DNA, 25 bp, Homo sapien
tgctgtgtgttaggcaatcctgtaa

SEQ ID NO: 131447 - DNA, 25 bp, Homo sapien
gtgtgttaggcaatcctgtaatctt

SEQ ID NO: 131448 - DNA, 25 bp, Homo sapien
gtgttaggcaatcctgtaatctttt

SEQ ID NO: 131449 - DNA, 25 bp, Homo sapien
tcatttctgaaatgcttggttggaa

SEQ ID NO: 131450 - DNA, 25 bp, Homo sapien
gagctgatcaagttctttgttcctg

SEQ ID NO: 131451 - DNA, 25 bp, Homo sapien
gctgatcaagttctttgttcctggg

SEQ ID NO: 131452 - DNA, 25 bp, Homo sapien
gaaatgcaagtaaccacctggtccg

SEQ ID NO: 131453 - DNA, 25 bp, Homo sapien
tgcaagtaaccacctggtccgtgca

SEQ ID NO: 131454 - DNA, 25 bp, Homo sapien
taaccacctggtccgtgcactggag

SEQ ID NO: 131455 - DNA, 25 bp, Homo sapien
agaaggcgaggtcaagtgcccaact

SEQ ID NO: 131456 - DNA, 25 bp, Homo sapien
gcgaggtcaagtgcccaactgcaga

SEQ ID NO: 131457 - DNA, 25 bp, Homo sapien
caagtgcccaactgcagaccaacta

SEQ ID NO: 131458 - DNA, 25 bp, Homo sapien
gctcggactccagctcggagtctga

SEQ ID NO: 131459 - DNA, 25 bp, Homo sapien
gagtctgagcctgaagagccccaaa

SEQ ID NO: 131460 - DNA, 25 bp, Homo sapien
ctgagcctgaagagccccaaagcag

SEQ ID NO: 131461 - DNA, 25 bp, Homo sapien
gggaacagggcggagatatccttat

SEQ ID NO: 131462 - DNA, 25 bp, Homo sapien
agggcggagatatccttatgccacc

SEQ ID NO: 131463 - DNA, 25 bp, Homo sapien
ggcggagatatccttatgccacccc

SEQ ID NO: 131464 - DNA, 25 bp, Homo sapien
gctggtgagccggtcaggcacacaa

SEQ ID NO: 131465 - DNA, 25 bp, Homo sapien
cccttggagcgtggactggttggtt

SEQ ID NO: 131466 - DNA, 25 bp, Homo sapien
gcttttcttttctaaccaagaggct

SEQ ID NO: 131467 - DNA, 25 bp, Homo sapien
ctggttttggcatctctgtcccatt

SEQ ID NO: 131468 - DNA, 25 bp, Homo sapien
gcatctctgtcccattccctgggat

SEQ ID NO: 131469 - DNA, 25 bp, Homo sapien
attccctgggatctggtggtcagcc

SEQ ID NO: 131470 - DNA, 25 bp, Homo sapien
gatctggtggtcagccctaggataa

SEQ ID NO: 131471 - DNA, 25 bp, Homo sapien
gtcagccctaggataaaaagccagg

SEQ ID NO: 131472 - DNA, 25 bp, Homo sapien
gggcttctgagcttgctcccctgag

SEQ ID NO: 131473 - DNA, 25 bp, Homo sapien
ggcttctgagcttgctcccctgagc

SEQ ID NO: 131474 - DNA, 25 bp, Homo sapien
gcttctgagcttgctcccctgagcc

SEQ ID NO: 131475 - DNA, 25 bp, Homo sapien
gtggctgtggcctgtggctctcact

SEQ ID NO: 131476 - DNA, 25 bp, Homo sapien
ccccgacgtgaagcctccctgtctc

SEQ ID NO: 131477 - DNA, 25 bp, Homo sapien
tgtctctccgccagctctgagtccc

SEQ ID NO: 131478 - DNA, 25 bp, Homo sapien
gcagctggacatctccaggaaacca

SEQ ID NO: 131479 - DNA, 25 bp, Homo sapien
ctggacatctccaggaaaccaggcc

SEQ ID NO: 131480 - DNA, 25 bp, Homo sapien
accaggccatctgggcaggaggcct

SEQ ID NO: 131481 - DNA, 25 bp, Homo sapien
agtgaagcaacagcccagctggaag

SEQ ID NO: 131482 - DNA, 25 bp, Homo sapien
aacagcccagctggaagggcgtctt

SEQ ID NO: 131483 - DNA, 25 bp, Homo sapien
gtactatgtatcaatgagtaacagg

SEQ ID NO: 131484 - DNA, 25 bp, Homo sapien
gatagatatatgctctgcatgttac

SEQ ID NO: 131485 - DNA, 25 bp, Homo sapien
gatatatgctctgcatgttacataa

SEQ ID NO: 131486 - DNA, 25 bp, Homo sapien
tatgctctgcatgttacataagata

SEQ ID NO: 131487 - DNA, 25 bp, Homo sapien
ataaaaatgaggtactctcctggaa

SEQ ID NO: 131488 - DNA, 25 bp, Homo sapien
aaatgaggtactctcctggaaatat

SEQ ID NO: 131489 - DNA, 25 bp, Homo sapien
gaggtactctcctggaaatattaag

SEQ ID NO: 131490 - DNA, 25 bp, Homo sapien
actgtacaaagtataagtcttagat

SEQ ID NO: 131491 - DNA, 25 bp, Homo sapien
atatttcctatattgttttcagtgt

SEQ ID NO: 131492 - DNA, 25 bp, Homo sapien
tcctatattgttttcagtgtacatg

SEQ ID NO: 131493 - DNA, 25 bp, Homo sapien
gttttcagtgtacatggaataacat

SEQ ID NO: 131494 - DNA, 25 bp, Homo sapien
tatgctgtgttcagccgggtcttca

SEQ ID NO: 131495 - DNA, 25 bp, Homo sapien
gttcagccgggtcttcaaaactgta

SEQ ID NO: 131496 - DNA, 25 bp, Homo sapien
gaaatgctttccttactgacaacct

SEQ ID NO: 131497 - DNA, 25 bp, Homo sapien
gctttccttactgacaacctaacat

SEQ ID NO: 131498 - DNA, 25 bp, Homo sapien
gacaacctaacatcatttttctttt

SEQ ID NO: 131499 - DNA, 25 bp, Homo sapien
tttcttcttgcattttgtgaactta

SEQ ID NO: 131500 - DNA, 25 bp, Homo sapien
gaatatttgtgtaggtgaatctcgt

SEQ ID NO: 131501 - DNA, 25 bp, Homo sapien
ggtgaatctcgtttttatttgtgga

SEQ ID NO: 131502 - DNA, 25 bp, Homo sapien
gagatatctaatgttttgtagtcac

SEQ ID NO: 131503 - DNA, 25 bp, Homo sapien
agtcacatgggcaagaattattaca

SEQ ID NO: 131504 - DNA, 25 bp, Homo sapien
gaattattacatgctaagctggtta

SEQ ID NO: 131505 - DNA, 25 bp, Homo sapien
ttaactttggggatgtgggcctctc

SEQ ID NO: 131506 - DNA, 25 bp, Homo sapien
gggatgtgggcctctcggctggact

SEQ ID NO: 131507 - DNA, 25 bp, Homo sapien
atgtgggcctctcggctggactgca

SEQ ID NO: 131508 - DNA, 25 bp, Homo sapien
tgccagccaaggctgacctcctgct

SEQ ID NO: 131509 - DNA, 25 bp, Homo sapien
gccaaggctgacctcctgctcagca

SEQ ID NO: 131510 - DNA, 25 bp, Homo sapien
aaactggagcctcacgaagggctgc

SEQ ID NO: 131511 - DNA, 25 bp, Homo sapien
aactggagcctcacgaagggctgct

SEQ ID NO: 131512 - DNA, 25 bp, Homo sapien
ggagcctcacgaagggctgctgctc

SEQ ID NO: 131513 - DNA, 25 bp, Homo sapien
agggctgctgctccgcttcccctac

SEQ ID NO: 131514 - DNA, 25 bp, Homo sapien
tcagcctgacatggacccactaccc

SEQ ID NO: 131515 - DNA, 25 bp, Homo sapien
gcctgacatggacccactacccttc

SEQ ID NO: 131516 - DNA, 25 bp, Homo sapien
ccaaagtgtcatatttactggtcct

SEQ ID NO: 131517 - DNA, 25 bp, Homo sapien
ttactggtcctggagacaaacttgt

SEQ ID NO: 131518 - DNA, 25 bp, Homo sapien
gttcaaaagaacatcaacgtgcaat

SEQ ID NO: 131519 - DNA, 25 bp, Homo sapien
acgtgcaatgttttaaggtctatct

SEQ ID NO: 131520 - DNA, 25 bp, Homo sapien
ggtctatcttaagaagccctggcca

SEQ ID NO: 131521 - DNA, 25 bp, Homo sapien
gatcctaaccttgaagtatgccttg

SEQ ID NO: 131522 - DNA, 25 bp, Homo sapien
ccttgaacttattaacatggccatt

SEQ ID NO: 131523 - DNA, 25 bp, Homo sapien
ataaatgtcatttcactactggtgt

SEQ ID NO: 131524 - DNA, 25 bp, Homo sapien
atttcactactggtgttctgttttc

SEQ ID NO: 131525 - DNA, 25 bp, Homo sapien
gttctgttttcaatgtataaggact

SEQ ID NO: 131526 - DNA, 25 bp, Homo sapien
ttaaactcatcaatgtgcctttgca

SEQ ID NO: 131527 - DNA, 25 bp, Homo sapien
agaccccagctgaaccatgcgtcag

SEQ ID NO: 131528 - DNA, 25 bp, Homo sapien
ggcctagaggtggagttcttagcta

SEQ ID NO: 131529 - DNA, 25 bp, Homo sapien
ggtggagttcttagctatccttggc

SEQ ID NO: 131530 - DNA, 25 bp, Homo sapien
gagttcttagctatccttggctttc

SEQ ID NO: 131531 - DNA, 25 bp, Homo sapien
catgggctgtgtcctaaggcccatt

SEQ ID NO: 131532 - DNA, 25 bp, Homo sapien
gctgtgtcctaaggcccatttgaga

SEQ ID NO: 131533 - DNA, 25 bp, Homo sapien
tgtcctaaggcccatttgagaagct

SEQ ID NO: 131534 - DNA, 25 bp, Homo sapien
gaagctgaggctagttccaaaaacc

SEQ ID NO: 131535 - DNA, 25 bp, Homo sapien
aggctagttccaaaaacctctcctg

SEQ ID NO: 131536 - DNA, 25 bp, Homo sapien
gctagttccaaaaacctctcctgac

SEQ ID NO: 131537 - DNA, 25 bp, Homo sapien
gtgccttctttgtatataggcttct

SEQ ID NO: 131538 - DNA, 25 bp, Homo sapien
atcctgcatttatggtgtagttctg

SEQ ID NO: 131539 - DNA, 25 bp, Homo sapien
ggtgtagttctgagtcctgagactt

SEQ ID NO: 131540 - DNA, 25 bp, Homo sapien
agttctgagtcctgagacttttctg

SEQ ID NO: 131541 - DNA, 25 bp, Homo sapien
ctgagacttttctgcgtgatggcta

SEQ ID NO: 131542 - DNA, 25 bp, Homo sapien
gacttttctgcgtgatggctatgcc

SEQ ID NO: 131543 - DNA, 25 bp, Homo sapien
gatggctatgccttgcacacaggtg

SEQ ID NO: 131544 - DNA, 25 bp, Homo sapien
tgccttgcacacaggtgttggtgat

SEQ ID NO: 131545 - DNA, 25 bp, Homo sapien
atgcctgttgaaggtacatcgtttg

SEQ ID NO: 131546 - DNA, 25 bp, Homo sapien
gttgaaggtacatcgtttgcaaatg

SEQ ID NO: 131547 - DNA, 25 bp, Homo sapien
ttcctctcctgtccgtgtttgttta

SEQ ID NO: 131548 - DNA, 25 bp, Homo sapien
tcctgtccgtgtttgtttagtactt

SEQ ID NO: 131549 - DNA, 25 bp, Homo sapien
atacccctggccaaggaagatccct

SEQ ID NO: 131550 - DNA, 25 bp, Homo sapien
ggaagatccctttgtccacaagtaa

SEQ ID NO: 131551 - DNA, 25 bp, Homo sapien
accctgaggtgagcatcatcttctg

SEQ ID NO: 131552 - DNA, 25 bp, Homo sapien
catcttctgggttaggccttgccta

SEQ ID NO: 131553 - DNA, 25 bp, Homo sapien
tagcctgcctcaagctatgtgagct

SEQ ID NO: 131554 - DNA, 25 bp, Homo sapien
aagctatgtgagctcaccagtccct

SEQ ID NO: 131555 - DNA, 25 bp, Homo sapien
tgcagttttttcctagtctgttttc

SEQ ID NO: 131556 - DNA, 25 bp, Homo sapien
ctccttggagaacagggccctgtcg

SEQ ID NO: 131557 - DNA, 25 bp, Homo sapien
gccctgtcggtttgttcactgtatg

SEQ ID NO: 131558 - DNA, 25 bp, Homo sapien
tcactgtatgtccttggtgcctgga

SEQ ID NO: 131559 - DNA, 25 bp, Homo sapien
ttggtgcctggagcctactaaatgc

SEQ ID NO: 131560 - DNA, 25 bp, Homo sapien
ggttggccccccagaccatacctct

SEQ ID NO: 131561 - DNA, 25 bp, Homo sapien
ttggccccccagaccatacctctga

SEQ ID NO: 131562 - DNA, 25 bp, Homo sapien
cagaccatacctctgacccacccag

SEQ ID NO: 131563 - DNA, 25 bp, Homo sapien
agaccatacctctgacccacccagc

SEQ ID NO: 131564 - DNA, 25 bp, Homo sapien
agccccagcagttctcagggtgctg

SEQ ID NO: 131565 - DNA, 25 bp, Homo sapien
gccccagcagttctcagggtgctga

SEQ ID NO: 131566 - DNA, 25 bp, Homo sapien
ccccagcagttctcagggtgctgac

SEQ ID NO: 131567 - DNA, 25 bp, Homo sapien
ttctcagggtgctgacctctctctc

SEQ ID NO: 131568 - DNA, 25 bp, Homo sapien
tctcagggtgctgacctctctctcc

SEQ ID NO: 131569 - DNA, 25 bp, Homo sapien
ctcagggtgctgacctctctctccc

SEQ ID NO: 131570 - DNA, 25 bp, Homo sapien
tcagggtgctgacctctctctccca

SEQ ID NO: 131571 - DNA, 25 bp, Homo sapien
tggtctacctgttcgcgcgcctccg

SEQ ID NO: 131572 - DNA, 25 bp, Homo sapien
tccgctacttccagggctacgcgcg

SEQ ID NO: 131573 - DNA, 25 bp, Homo sapien
cgcagctcaggctggcaccgctgta

SEQ ID NO: 131574 - DNA, 25 bp, Homo sapien
ctcaggctggcaccgctgtacgcga

SEQ ID NO: 131575 - DNA, 25 bp, Homo sapien
tggcaccgctgtacgcgagcgcgcg

SEQ ID NO: 131576 - DNA, 25 bp, Homo sapien
tcctcggacggctccggacgctgct

SEQ ID NO: 131577 - DNA, 25 bp, Homo sapien
acgctgctgccgtgggcctgagacc

SEQ ID NO: 131578 - DNA, 25 bp, Homo sapien
ctgccgtgggcctgagaccaaggcc

SEQ ID NO: 131579 - DNA, 25 bp, Homo sapien
cgggaaagaagagccggagcctcca

SEQ ID NO: 131580 - DNA, 25 bp, Homo sapien
aaagaagagccggagcctccagctg

SEQ ID NO: 131581 - DNA, 25 bp, Homo sapien
aagaagagccggagcctccagctgc

SEQ ID NO: 131582 - DNA, 25 bp, Homo sapien
atgagaggcaatcctgtccccatcc

SEQ ID NO: 131583 - DNA, 25 bp, Homo sapien
atcctcatcccgtgccacagagtgg

SEQ ID NO: 131584 - DNA, 25 bp, Homo sapien
tgccacagagtggtctgcagcagcg

SEQ ID NO: 131585 - DNA, 25 bp, Homo sapien
agcagcggagccgtgggcaactact

SEQ ID NO: 131586 - DNA, 25 bp, Homo sapien
aactactccggaggactggccgtga

SEQ ID NO: 131587 - DNA, 25 bp, Homo sapien
gactggccgtgaaggaatggcttct

SEQ ID NO: 131588 - DNA, 25 bp, Homo sapien
gaaggaatggcttctggcccatgaa

SEQ ID NO: 131589 - DNA, 25 bp, Homo sapien
ttctggcccatgaaggccaccggtt

SEQ ID NO: 131590 - DNA, 25 bp, Homo sapien
gcctgctggccgaaactgagtatgt

SEQ ID NO: 131591 - DNA, 25 bp, Homo sapien
gatgtttgagcgacacacacgtgta

SEQ ID NO: 131592 - DNA, 25 bp, Homo sapien
cacgtgtaacactgcatcggatgcg

SEQ ID NO: 131593 - DNA, 25 bp, Homo sapien
gagaattattcctttcctagactaa

SEQ ID NO: 131594 - DNA, 25 bp, Homo sapien
gaaatctgttttgtatatgatctaa

SEQ ID NO: 131595 - DNA, 25 bp, Homo sapien
tgatctaatacaaagatgagctctg

SEQ ID NO: 131596 - DNA, 25 bp, Homo sapien
gagctctgaacaaacactgaatcat

SEQ ID NO: 131597 - DNA, 25 bp, Homo sapien
gaatcatgttaatagacagtagcca

SEQ ID NO: 131598 - DNA, 25 bp, Homo sapien
gacagtagccaagttatattgaata

SEQ ID NO: 131599 - DNA, 25 bp, Homo sapien
atcagaatctgtgtgaagttacaca

SEQ ID NO: 131600 - DNA, 25 bp, Homo sapien
cacaattaattgtccctgtttcaaa

SEQ ID NO: 131601 - DNA, 25 bp, Homo sapien
aattgtccctgtttcaaactgagta

SEQ ID NO: 131602 - DNA, 25 bp, Homo sapien
gtccctgtttcaaactgagtaaatt

SEQ ID NO: 131603 - DNA, 25 bp, Homo sapien
gacatgacaatgcaatgaaacagat

SEQ ID NO: 131604 - DNA, 25 bp, Homo sapien
ctaatgacactttaattgtttttct

SEQ ID NO: 131605 - DNA, 25 bp, Homo sapien
aatgatggtcagagggcagacgaat

SEQ ID NO: 131606 - DNA, 25 bp, Homo sapien
ggcggaattgggatttgctgcagct

SEQ ID NO: 131607 - DNA, 25 bp, Homo sapien
cagctgtgaagccatggccgtgtct

SEQ ID NO: 131608 - DNA, 25 bp, Homo sapien
gaagccatggccgtgtctcgtgtgt

SEQ ID NO: 131609 - DNA, 25 bp, Homo sapien
gccgtgtctcgtgtgttgttacaga

SEQ ID NO: 131610 - DNA, 25 bp, Homo sapien
gttacagaggtgatgtgcttttcga

SEQ ID NO: 131611 - DNA, 25 bp, Homo sapien
aggtgatgtgcttttcgacgggccc

SEQ ID NO: 131612 - DNA, 25 bp, Homo sapien
gatgtgcttttcgacgggccctcgt

SEQ ID NO: 131613 - DNA, 25 bp, Homo sapien
gtggcttggaacctcctctgtatga

SEQ ID NO: 131614 - DNA, 25 bp, Homo sapien
aaacagttttcacgtctgtcctctt

SEQ ID NO: 131615 - DNA, 25 bp, Homo sapien
tggacatctttccagcccgggatac

SEQ ID NO: 131616 - DNA, 25 bp, Homo sapien
gggatacctaccatcctatgagcga

SEQ ID NO: 131617 - DNA, 25 bp, Homo sapien
gatacctaccatcctatgagcgagt

SEQ ID NO: 131618 - DNA, 25 bp, Homo sapien
tacctaccatcctatgagcgagtac

SEQ ID NO: 131619 - DNA, 25 bp, Homo sapien
taccatcctatgagcgagtacccca

SEQ ID NO: 131620 - DNA, 25 bp, Homo sapien
atcctatgagcgagtaccccaccta

SEQ ID NO: 131621 - DNA, 25 bp, Homo sapien
ctaccacacccatgggcgctatgtg

SEQ ID NO: 131622 - DNA, 25 bp, Homo sapien
tatgtgccccctagcagtaccgatc

SEQ ID NO: 131623 - DNA, 25 bp, Homo sapien
tagcagtaccgatcgtagcccctat

SEQ ID NO: 131624 - DNA, 25 bp, Homo sapien
agtaccgatcgtagcccctatgaga

SEQ ID NO: 131625 - DNA, 25 bp, Homo sapien
tggcagcagcctctcttacacaaac

SEQ ID NO: 131626 - DNA, 25 bp, Homo sapien
aagatatcctaactggccagtgtaa

SEQ ID NO: 131627 - DNA, 25 bp, Homo sapien
tcctaactggccagtgtaaatgcta

SEQ ID NO: 131628 - DNA, 25 bp, Homo sapien
ttggaaacttccttcaaactgcagg

SEQ ID NO: 131629 - DNA, 25 bp, Homo sapien
aaacttccttcaaactgcaggaggg

SEQ ID NO: 131630 - DNA, 25 bp, Homo sapien
ctctgagggcacgagaagctaaaac

SEQ ID NO: 131631 - DNA, 25 bp, Homo sapien
aagagtgccagtctttggtcatctc

SEQ ID NO: 131632 - DNA, 25 bp, Homo sapien
tggtcatctctaaacaaggcttatc

SEQ ID NO: 131633 - DNA, 25 bp, Homo sapien
aacaaggcttatcaccaatggagac

SEQ ID NO: 131634 - DNA, 25 bp, Homo sapien
gacagaaaactctagttcaagagct

SEQ ID NO: 131635 - DNA, 25 bp, Homo sapien
agttcaagagctgtacctcctttga

SEQ ID NO: 131636 - DNA, 25 bp, Homo sapien
gagctgtacctcctttgaatcccag

SEQ ID NO: 131637 - DNA, 25 bp, Homo sapien
tagacagtacccttggcctttacag

SEQ ID NO: 131638 - DNA, 25 bp, Homo sapien
tgctgttttctacccttggaaagaa

SEQ ID NO: 131639 - DNA, 25 bp, Homo sapien
gtagatgatatgtttcgtgggttga

SEQ ID NO: 131640 - DNA, 25 bp, Homo sapien
gttctaaccccaggtacccatgaat

SEQ ID NO: 131641 - DNA, 25 bp, Homo sapien
taaccccaggtacccatgaatgtga

SEQ ID NO: 131642 - DNA, 25 bp, Homo sapien
atgaatgtgagcttaccagggtctt

SEQ ID NO: 131643 - DNA, 25 bp, Homo sapien
gtgagcttaccagggtctttgcaga

SEQ ID NO: 131644 - DNA, 25 bp, Homo sapien
gttaaggtgagatcacactgaatta

SEQ ID NO: 131645 - DNA, 25 bp, Homo sapien
ttagggtgggctctaaatccattat

SEQ ID NO: 131646 - DNA, 25 bp, Homo sapien
aaatccattatgactgttgttctta

SEQ ID NO: 131647 - DNA, 25 bp, Homo sapien
aagaagagagcatagccacctaggg

SEQ ID NO: 131648 - DNA, 25 bp, Homo sapien
tgattagccatcataaatgcccatt

SEQ ID NO: 131649 - DNA, 25 bp, Homo sapien
gattagccatcataaatgcccattg

SEQ ID NO: 131650 - DNA, 25 bp, Homo sapien
taaatgcccattgcttggcctttaa

SEQ ID NO: 131651 - DNA, 25 bp, Homo sapien
ttgcagaagtgcctgtgagagaaat

SEQ ID NO: 131652 - DNA, 25 bp, Homo sapien
gcagaagtgcctgtgagagaaatct

SEQ ID NO: 131653 - DNA, 25 bp, Homo sapien
cagaagtgcctgtgagagaaatctt

SEQ ID NO: 131654 - DNA, 25 bp, Homo sapien
aagtgcctgtgagagaaatcttcaa

SEQ ID NO: 131655 - DNA, 25 bp, Homo sapien
agtgcctgtgagagaaatcttcaaa

SEQ ID NO: 131656 - DNA, 25 bp, Homo sapien
aatcttcaaaagacaaacctggtca

SEQ ID NO: 131657 - DNA, 25 bp, Homo sapien
cttcaaaagacaaacctggtcaaat

SEQ ID NO: 131658 - DNA, 25 bp, Homo sapien
ttttttgtctgactcatctgagtta

SEQ ID NO: 131659 - DNA, 25 bp, Homo sapien
ccccagaatcttggctgtttacaaa

SEQ ID NO: 131660 - DNA, 25 bp, Homo sapien
gtttacaaatcacgtgtccatcgag

SEQ ID NO: 131661 - DNA, 25 bp, Homo sapien
gtgtccatcgagcacgtctgaaacc

SEQ ID NO: 131662 - DNA, 25 bp, Homo sapien
gagcacgtctgaaacccctggtagc

SEQ ID NO: 131663 - DNA, 25 bp, Homo sapien
tgttcacggcggattctttgtttta

SEQ ID NO: 131664 - DNA, 25 bp, Homo sapien
aatcttgcgatgtgctttgcttgtt

SEQ ID NO: 131665 - DNA, 25 bp, Homo sapien
tgctgggcggatgatgtttactaac

SEQ ID NO: 131666 - DNA, 25 bp, Homo sapien
tcccatgggatgtgaaaggctggcc

SEQ ID NO: 131667 - DNA, 25 bp, Homo sapien
ggctggccattattaagtccctgta

SEQ ID NO: 131668 - DNA, 25 bp, Homo sapien
gtccctgtaactcaaatgtcaaccc

SEQ ID NO: 131669 - DNA, 25 bp, Homo sapien
aactcaaatgtcaaccccaccgagg

SEQ ID NO: 131670 - DNA, 25 bp, Homo sapien
agtcattcaggtgacctcctgcagg

SEQ ID NO: 131671 - DNA, 25 bp, Homo sapien
ccagactctcaggtggaggcaacag

SEQ ID NO: 131672 - DNA, 25 bp, Homo sapien
aggcaacagggccatgtgctgccct

SEQ ID NO: 131673 - DNA, 25 bp, Homo sapien
tgtgctgccctgttgccgagcccag

SEQ ID NO: 131674 - DNA, 25 bp, Homo sapien
gtgggcggctcctggtgctaacaac

SEQ ID NO: 131675 - DNA, 25 bp, Homo sapien
ggctcctggtgctaacaacaaagtt

SEQ ID NO: 131676 - DNA, 25 bp, Homo sapien
ggtgctaacaacaaagttccacttc

SEQ ID NO: 131677 - DNA, 25 bp, Homo sapien
aagttccacttccaggtctgcctgg

SEQ ID NO: 131678 - DNA, 25 bp, Homo sapien
gggagctccgtcagcttctcccaag

SEQ ID NO: 131679 - DNA, 25 bp, Homo sapien
tggcctcatctcagaccctgcttag

SEQ ID NO: 131680 - DNA, 25 bp, Homo sapien
tgctcaccctctcttggtgcatttt

SEQ ID NO: 131681 - DNA, 25 bp, Homo sapien
aggagtccccaggatcggagtccca

SEQ ID NO: 131682 - DNA, 25 bp, Homo sapien
ggagtcccatcctggcagaggtcaa

SEQ ID NO: 131683 - DNA, 25 bp, Homo sapien
agaggtcaagcattcgttctacccc

SEQ ID NO: 131684 - DNA, 25 bp, Homo sapien
ccacagtcctggaggtgaggcacga

SEQ ID NO: 131685 - DNA, 25 bp, Homo sapien
ggacatcaaggccttaaacgccaaa

SEQ ID NO: 131686 - DNA, 25 bp, Homo sapien
acagctctctgagatactcaggata

SEQ ID NO: 131687 - DNA, 25 bp, Homo sapien
taacttccagaagatcctctcagtc

SEQ ID NO: 131688 - DNA, 25 bp, Homo sapien
ctctcagtctcctcaggagttgttt

SEQ ID NO: 131689 - DNA, 25 bp, Homo sapien
ttgaaatatcgaggccacagtcccc

SEQ ID NO: 131690 - DNA, 25 bp, Homo sapien
gccacagtccccagaatcagagaga

SEQ ID NO: 131691 - DNA, 25 bp, Homo sapien
ggagccagctgagaggtctatttaa

SEQ ID NO: 131692 - DNA, 25 bp, Homo sapien
ttctctgtgaggtcaattaaatgcc

SEQ ID NO: 131693 - DNA, 25 bp, Homo sapien
ggtcaattaaatgccttgttctgaa

SEQ ID NO: 131694 - DNA, 25 bp, Homo sapien
ggtttgtggctacagcttatgcatc

SEQ ID NO: 131695 - DNA, 25 bp, Homo sapien
gtggctacagcttatgcatcattct

SEQ ID NO: 131696 - DNA, 25 bp, Homo sapien
cagcttatgcatcattctgtgtttg

SEQ ID NO: 131697 - DNA, 25 bp, Homo sapien
gtgtttgtcatttactcacattgag

SEQ ID NO: 131698 - DNA, 25 bp, Homo sapien
gtagaatcaaaggtgcagctgactg

SEQ ID NO: 131699 - DNA, 25 bp, Homo sapien
cagctgactgagacgacatgcatgt

SEQ ID NO: 131700 - DNA, 25 bp, Homo sapien
acgacatgcatgtaagatccacaaa

SEQ ID NO: 131701 - DNA, 25 bp, Homo sapien
gatccacaaaatgagacaatgcatg

SEQ ID NO: 131702 - DNA, 25 bp, Homo sapien
aatccatgctcatgttctaaacatg

SEQ ID NO: 131703 - DNA, 25 bp, Homo sapien
aacagatttatctagggtccccagc

SEQ ID NO: 131704 - DNA, 25 bp, Homo sapien
agggtccccagcagaattgacagtt

SEQ ID NO: 131705 - DNA, 25 bp, Homo sapien
gacagttgaacagagctagaggcca

SEQ ID NO: 131706 - DNA, 25 bp, Homo sapien
aacagagctagaggccatgtctcct

SEQ ID NO: 131707 - DNA, 25 bp, Homo sapien
atgtctcctgcatagcttttccctg

SEQ ID NO: 131708 - DNA, 25 bp, Homo sapien
tgcatagcttttccctgtcctgaca

SEQ ID NO: 131709 - DNA, 25 bp, Homo sapien
cctgtcctgacaccaggcaagaaaa

SEQ ID NO: 131710 - DNA, 25 bp, Homo sapien
agaaaagcgcagagaaatcggtgtc

SEQ ID NO: 131711 - DNA, 25 bp, Homo sapien
cggtgtctgacgattttggaaatga

SEQ ID NO: 131712 - DNA, 25 bp, Homo sapien
tagccagccaggaagatgaatccta

SEQ ID NO: 131713 - DNA, 25 bp, Homo sapien
atgaatcctagcttcttccattgga

SEQ ID NO: 131714 - DNA, 25 bp, Homo sapien
gaccccaagaacaacctggaagcct

SEQ ID NO: 131715 - DNA, 25 bp, Homo sapien
acctggaagccttggaggactttga

SEQ ID NO: 131716 - DNA, 25 bp, Homo sapien
gactttgagaaagccgcaggagccc

SEQ ID NO: 131717 - DNA, 25 bp, Homo sapien
gaaagccgcaggagcccgcggactc

SEQ ID NO: 131718 - DNA, 25 bp, Homo sapien
cgcggactcagcacggagagcatcc

SEQ ID NO: 131719 - DNA, 25 bp, Homo sapien
atcctcatccccaggcagagcgaaa

SEQ ID NO: 131720 - DNA, 25 bp, Homo sapien
atccccaggcagagcgaaacctgct

SEQ ID NO: 131721 - DNA, 25 bp, Homo sapien
aaacctgctctccagggagcgatta

SEQ ID NO: 131722 - DNA, 25 bp, Homo sapien
agcagccaaggacggcaccatccag

SEQ ID NO: 131723 - DNA, 25 bp, Homo sapien
agcacctccgtcattcacagggaca

SEQ ID NO: 131724 - DNA, 25 bp, Homo sapien
tccgtcattcacagggacatggaaa

SEQ ID NO: 131725 - DNA, 25 bp, Homo sapien
aaattcatattctgtctggagtgac

SEQ ID NO: 131726 - DNA, 25 bp, Homo sapien
ggagtgacagaccacatctttatct

SEQ ID NO: 131727 - DNA, 25 bp, Homo sapien
tttatctgttcttgctacccatgac

SEQ ID NO: 131728 - DNA, 25 bp, Homo sapien
atgttttactgtgaaactggcactg

SEQ ID NO: 131729 - DNA, 25 bp, Homo sapien
gaacttgcatggagcaggactctat

SEQ ID NO: 131730 - DNA, 25 bp, Homo sapien
gactctattttaaggactgcgggac

SEQ ID NO: 131731 - DNA, 25 bp, Homo sapien
gcgggacttgggtctcatttagaac

SEQ ID NO: 131732 - DNA, 25 bp, Homo sapien
ggtctcatttagaacttgcagctga

SEQ ID NO: 131733 - DNA, 25 bp, Homo sapien
aaagcacgtgtctcagactgcatgt

SEQ ID NO: 131734 - DNA, 25 bp, Homo sapien
gactgcatgtaccatttgcatggct

SEQ ID NO: 131735 - DNA, 25 bp, Homo sapien
tttgcatggctccagaaatgtctaa

SEQ ID NO: 131736 - DNA, 25 bp, Homo sapien
gcaaaaactcttttagctcaagcaa

SEQ ID NO: 131737 - DNA, 25 bp, Homo sapien
gcaaatagcaagctgcaactgctca

SEQ ID NO: 131738 - DNA, 25 bp, Homo sapien
gctgcaactgctcaaagatttagaa

SEQ ID NO: 131739 - DNA, 25 bp, Homo sapien
aagctcaagaattagcaagactgga

SEQ ID NO: 131740 - DNA, 25 bp, Homo sapien
actggaaggagaagtccgttcactc

SEQ ID NO: 131741 - DNA, 25 bp, Homo sapien
gagaagtccgttcactcctaaagga

SEQ ID NO: 131742 - DNA, 25 bp, Homo sapien
aagtccgttcactcctaaaggatat

SEQ ID NO: 131743 - DNA, 25 bp, Homo sapien
gccagaaagttgctgtgtatagcac

SEQ ID NO: 131744 - DNA, 25 bp, Homo sapien
gttgctgtgtatagcacatgcttgt

SEQ ID NO: 131745 - DNA, 25 bp, Homo sapien
agcacatgcttgtaacagaggagaa

SEQ ID NO: 131746 - DNA, 25 bp, Homo sapien
aaaactgacttaatgctcttcaaaa

SEQ ID NO: 131747 - DNA, 25 bp, Homo sapien
gaaaaattcgatcttatttagtgat

SEQ ID NO: 131748 - DNA, 25 bp, Homo sapien
atcttatttagtgatctgttgcaag

SEQ ID NO: 131749 - DNA, 25 bp, Homo sapien
tagtgatctgttgcaagataacttg

SEQ ID NO: 131750 - DNA, 25 bp, Homo sapien
gatctgttgcaagataacttggaat

SEQ ID NO: 131751 - DNA, 25 bp, Homo sapien
agtcagcagtaaaatgtatggcatt

SEQ ID NO: 131752 - DNA, 25 bp, Homo sapien
aagatggtcaatatttggtttccta

SEQ ID NO: 131753 - DNA, 25 bp, Homo sapien
gatggtcaatatttggtttcctaaa

SEQ ID NO: 131754 - DNA, 25 bp, Homo sapien
ggtcaatatttggtttcctaaatgc

SEQ ID NO: 131755 - DNA, 25 bp, Homo sapien
caatatttggtttcctaaatgcttt

SEQ ID NO: 131756 - DNA, 25 bp, Homo sapien
atgtctggcttacttaagaatgtag

SEQ ID NO: 131757 - DNA, 25 bp, Homo sapien
gtctggcttacttaagaatgtagaa

SEQ ID NO: 131758 - DNA, 25 bp, Homo sapien
gccagctaacaataacattttctgt

SEQ ID NO: 131759 - DNA, 25 bp, Homo sapien
gagtggtttgtgacaagcggaatcc

SEQ ID NO: 131760 - DNA, 25 bp, Homo sapien
caagcggaatccaaatggcattcga

SEQ ID NO: 131761 - DNA, 25 bp, Homo sapien
tcctctctataattctttccatgat

SEQ ID NO: 131762 - DNA, 25 bp, Homo sapien
ataaatttaccaatctgctcacttc

SEQ ID NO: 131763 - DNA, 25 bp, Homo sapien
atctgctcacttctatacttgactc

SEQ ID NO: 131764 - DNA, 25 bp, Homo sapien
ctcacttctatacttgactctgcag

SEQ ID NO: 131765 - DNA, 25 bp, Homo sapien
ctatacttgactctgcagaaacaaa

SEQ ID NO: 131766 - DNA, 25 bp, Homo sapien
attagcagtgttttctagaacaact

SEQ ID NO: 131767 - DNA, 25 bp, Homo sapien
aaattatactgaaagctgctgtggt

SEQ ID NO: 131768 - DNA, 25 bp, Homo sapien
gtggttatttcagtattattcgatt

SEQ ID NO: 131769 - DNA, 25 bp, Homo sapien
tagccgtggtgatttagcaggaagc

SEQ ID NO: 131770 - DNA, 25 bp, Homo sapien
gtgagagcagtttggtttctagcat

SEQ ID NO: 131771 - DNA, 25 bp, Homo sapien
gtttctagcatgaagacagagcccc

SEQ ID NO: 131772 - DNA, 25 bp, Homo sapien
accctcagatgcacatgagctggcg

SEQ ID NO: 131773 - DNA, 25 bp, Homo sapien
atgcacatgagctggcgggattgaa

SEQ ID NO: 131774 - DNA, 25 bp, Homo sapien
aaggatgctgtcttcgtactgggaa

SEQ ID NO: 131775 - DNA, 25 bp, Homo sapien
ctgtcttcgtactgggaaagggatt

SEQ ID NO: 131776 - DNA, 25 bp, Homo sapien
gtattcctagaaactgacacatgct

SEQ ID NO: 131777 - DNA, 25 bp, Homo sapien
gaaactgacacatgctgaacatcac

SEQ ID NO: 131778 - DNA, 25 bp, Homo sapien
gaacatcacagcttatttcctcatt

SEQ ID NO: 131779 - DNA, 25 bp, Homo sapien
ttataatgtcccttcacaaacccag

SEQ ID NO: 131780 - DNA, 25 bp, Homo sapien
aataactccacagtaaaataggtag

SEQ ID NO: 131781 - DNA, 25 bp, Homo sapien
ctccacagtaaaataggtagaatct

SEQ ID NO: 131782 - DNA, 25 bp, Homo sapien
aagttgctttattcgtggtttgtct

SEQ ID NO: 131783 - DNA, 25 bp, Homo sapien
gttgctttattcgtggtttgtctta

SEQ ID NO: 131784 - DNA, 25 bp, Homo sapien
ttgctttattcgtggtttgtcttac

SEQ ID NO: 131785 - DNA, 25 bp, Homo sapien
gctttattcgtggtttgtcttactc

SEQ ID NO: 131786 - DNA, 25 bp, Homo sapien
ctttattcgtggtttgtcttactca

SEQ ID NO: 131787 - DNA, 25 bp, Homo sapien
tttattcgtggtttgtcttactcag

SEQ ID NO: 131788 - DNA, 25 bp, Homo sapien
ttattcgtggtttgtcttactcagt

SEQ ID NO: 131789 - DNA, 25 bp, Homo sapien
tattcgtggtttgtcttactcagtt

SEQ ID NO: 131790 - DNA, 25 bp, Homo sapien
attcgtggtttgtcttactcagttc

SEQ ID NO: 131791 - DNA, 25 bp, Homo sapien
ggtttgccactgtgaagcttgattt

SEQ ID NO: 131792 - DNA, 25 bp, Homo sapien
gtgaagcttgatttctgctggtgac

SEQ ID NO: 131793 - DNA, 25 bp, Homo sapien
gctggtgacttctgaccataagcta

SEQ ID NO: 131794 - DNA, 25 bp, Homo sapien
taagctagaaccatggtcgccactg

SEQ ID NO: 131795 - DNA, 25 bp, Homo sapien
tccctctgtagtttctcaagtgaac

SEQ ID NO: 131796 - DNA, 25 bp, Homo sapien
gtgaacactctcaggatacccagtt

SEQ ID NO: 131797 - DNA, 25 bp, Homo sapien
tccctcatagcctctgttctcagag

SEQ ID NO: 131798 - DNA, 25 bp, Homo sapien
ggagttggcccaagaaacataaaca

SEQ ID NO: 131799 - DNA, 25 bp, Homo sapien
atataaccacccatatctatcctgg

SEQ ID NO: 131800 - DNA, 25 bp, Homo sapien
tctatcctggattctgaactcttca

SEQ ID NO: 131801 - DNA, 25 bp, Homo sapien
acctttaaacctatcttccaggcag

SEQ ID NO: 131802 - DNA, 25 bp, Homo sapien
atcattagtgccaaagggattcttc

SEQ ID NO: 131803 - DNA, 25 bp, Homo sapien
cattagtgccaaagggattcttctc

SEQ ID NO: 131804 - DNA, 25 bp, Homo sapien
attagtgccaaagggattcttctcc

SEQ ID NO: 131805 - DNA, 25 bp, Homo sapien
tagtgccaaagggattcttctccaa

SEQ ID NO: 131806 - DNA, 25 bp, Homo sapien
agtgccaaagggattcttctccaaa

SEQ ID NO: 131807 - DNA, 25 bp, Homo sapien
gtgccaaagggattcttctccaaaa

SEQ ID NO: 131808 - DNA, 25 bp, Homo sapien
tgccaaagggattcttctccaaaac

SEQ ID NO: 131809 - DNA, 25 bp, Homo sapien
gccaaagggattcttctccaaaact

SEQ ID NO: 131810 - DNA, 25 bp, Homo sapien
tcttctccaaaactttagatgataa

SEQ ID NO: 131811 - DNA, 25 bp, Homo sapien
aaagctatttctagtttatttcact

SEQ ID NO: 131812 - DNA, 25 bp, Homo sapien
agctatttctagtttatttcactat

SEQ ID NO: 131813 - DNA, 25 bp, Homo sapien
ttgatttaaagctaggtttcctagt

SEQ ID NO: 131814 - DNA, 25 bp, Homo sapien
gtttcctagtgaggaaagcctctga

SEQ ID NO: 131815 - DNA, 25 bp, Homo sapien
gtgaggaaagcctctgatctggcag

SEQ ID NO: 131816 - DNA, 25 bp, Homo sapien
ctgatctggcagactcattgcagca

SEQ ID NO: 131817 - DNA, 25 bp, Homo sapien
atctggcagactcattgcagcaggt

SEQ ID NO: 131818 - DNA, 25 bp, Homo sapien
ggcagactcattgcagcaggtggta

SEQ ID NO: 131819 - DNA, 25 bp, Homo sapien
agactcattgcagcaggtggtaatg

SEQ ID NO: 131820 - DNA, 25 bp, Homo sapien
attgcagcaggtggtaatgataaaa

SEQ ID NO: 131821 - DNA, 25 bp, Homo sapien
atctatgcctaaaaagtatcattac

SEQ ID NO: 131822 - DNA, 25 bp, Homo sapien
taaggttgaaaagacaatagcccaa

SEQ ID NO: 131823 - DNA, 25 bp, Homo sapien
gaaaagacaatagcccaaagccaag

SEQ ID NO: 131824 - DNA, 25 bp, Homo sapien
tcggcccacttgacttagttcttgg

SEQ ID NO: 131825 - DNA, 25 bp, Homo sapien
ccacttgacttagttcttgggctgg

SEQ ID NO: 131826 - DNA, 25 bp, Homo sapien
agttcttgggctggacctgcttagc

SEQ ID NO: 131827 - DNA, 25 bp, Homo sapien
ttgggctggacctgcttagctgcct

SEQ ID NO: 131828 - DNA, 25 bp, Homo sapien
gacctgcttagctgccttgagctaa

SEQ ID NO: 131829 - DNA, 25 bp, Homo sapien
tagctgccttgagctaaccccaagg

SEQ ID NO: 131830 - DNA, 25 bp, Homo sapien
gagtgagccagtgagggcagtcctg

SEQ ID NO: 131831 - DNA, 25 bp, Homo sapien
tgctgtggaccctgtcttctgggca

SEQ ID NO: 131832 - DNA, 25 bp, Homo sapien
tgtcttctgggcacagtggactcag

SEQ ID NO: 131833 - DNA, 25 bp, Homo sapien
ttctgggcacagtggactcagcagt

SEQ ID NO: 131834 - DNA, 25 bp, Homo sapien
tgggcacagtggactcagcagtgac

SEQ ID NO: 131835 - DNA, 25 bp, Homo sapien
tgtggaaatcttagcctgccttagc

SEQ ID NO: 131836 - DNA, 25 bp, Homo sapien
aaatcttagcctgccttagccaggg

SEQ ID NO: 131837 - DNA, 25 bp, Homo sapien
gaatggtgtaccctttatttcttct

SEQ ID NO: 131838 - DNA, 25 bp, Homo sapien
atttcttctgaaatcacactgatga

SEQ ID NO: 131839 - DNA, 25 bp, Homo sapien
tgatgacatcagttgtttaaacggg

SEQ ID NO: 131840 - DNA, 25 bp, Homo sapien
gaggttcccttgtgagcttgaatca

SEQ ID NO: 131841 - DNA, 25 bp, Homo sapien
gagcttgaatcaaccaatctgatct

SEQ ID NO: 131842 - DNA, 25 bp, Homo sapien
aatctgatctgcagtagtgtggact

SEQ ID NO: 131843 - DNA, 25 bp, Homo sapien
gtagtgtggactagaacaacccaaa

SEQ ID NO: 131844 - DNA, 25 bp, Homo sapien
gaacaacccaaatagcatctagaaa

SEQ ID NO: 131845 - DNA, 25 bp, Homo sapien
tagcatctagaaagccatgagtttg

SEQ ID NO: 131846 - DNA, 25 bp, Homo sapien
atcctgttttatgaagaaagcagaa

SEQ ID NO: 131847 - DNA, 25 bp, Homo sapien
ataattactgaaagtgccagacact

SEQ ID NO: 131848 - DNA, 25 bp, Homo sapien
gtgccagacactaaggaatattatt

SEQ ID NO: 131849 - DNA, 25 bp, Homo sapien
aagggattaatctgctaaaatgtaa

SEQ ID NO: 131850 - DNA, 25 bp, Homo sapien
aagtatgtttattcaagacattgaa

SEQ ID NO: 131851 - DNA, 25 bp, Homo sapien
agacattgaaactactttgcacata

SEQ ID NO: 131852 - DNA, 25 bp, Homo sapien
gaaactactttgcacatatgaatat

SEQ ID NO: 131853 - DNA, 25 bp, Homo sapien
aagtaaagtgtttccatgctatttc

SEQ ID NO: 131854 - DNA, 25 bp, Homo sapien
gtaaagtgtttccatgctatttcat

SEQ ID NO: 131855 - DNA, 25 bp, Homo sapien
aagtgtttccatgctatttcatgtt

SEQ ID NO: 131856 - DNA, 25 bp, Homo sapien
catgctatttcatgttttggccaaa

SEQ ID NO: 131857 - DNA, 25 bp, Homo sapien
atatagatcaccctgttattgctgt

SEQ ID NO: 131858 - DNA, 25 bp, Homo sapien
tatagatcaccctgttattgctgtt

SEQ ID NO: 131859 - DNA, 25 bp, Homo sapien
atagatcaccctgttattgctgttt

SEQ ID NO: 131860 - DNA, 25 bp, Homo sapien
tagatcaccctgttattgctgtttt

SEQ ID NO: 131861 - DNA, 25 bp, Homo sapien
gtttttcagggacagtagaaagtgt

SEQ ID NO: 131862 - DNA, 25 bp, Homo sapien
cagggacagtagaaagtgttttgtt

SEQ ID NO: 131863 - DNA, 25 bp, Homo sapien
tgttttttgagtgaaacaacttatt

SEQ ID NO: 131864 - DNA, 25 bp, Homo sapien
aaaatgtggcattagagtagaaata

SEQ ID NO: 131865 - DNA, 25 bp, Homo sapien
aagccagaggtgtaaaagtggtcaa

SEQ ID NO: 131866 - DNA, 25 bp, Homo sapien
aagatacatacctggatttgtttat

SEQ ID NO: 131867 - DNA, 25 bp, Homo sapien
gatacatacctggatttgtttatgt

SEQ ID NO: 131868 - DNA, 25 bp, Homo sapien
gtatgcctcaggctgcacaatttca

SEQ ID NO: 131869 - DNA, 25 bp, Homo sapien
aggctgcacaatttcaccgtattag

SEQ ID NO: 131870 - DNA, 25 bp, Homo sapien
acaatttcaccgtattagaaggcaa

SEQ ID NO: 131871 - DNA, 25 bp, Homo sapien
gaaggcaaagcaaaactcccaatgg

SEQ ID NO: 131872 - DNA, 25 bp, Homo sapien
actcccaatggataaatcagtgcct

SEQ ID NO: 131873 - DNA, 25 bp, Homo sapien
ggataaatcagtgcctggtgttctg

SEQ ID NO: 131874 - DNA, 25 bp, Homo sapien
acttcagtaggatttatgtattttg

SEQ ID NO: 131875 - DNA, 25 bp, Homo sapien
gtttggactgttttcaataacaaag

SEQ ID NO: 131876 - DNA, 25 bp, Homo sapien
cacataactggattttgaacgctta

SEQ ID NO: 131877 - DNA, 25 bp, Homo sapien
ggattttgaacgcttaagtcatcat

SEQ ID NO: 131878 - DNA, 25 bp, Homo sapien
gtcatcattacttgggaaattttta

SEQ ID NO: 131879 - DNA, 25 bp, Homo sapien
tactatcctgtactgcagtggtgcc

SEQ ID NO: 131880 - DNA, 25 bp, Homo sapien
gtgccttcagggactcgaggaatgt

SEQ ID NO: 131881 - DNA, 25 bp, Homo sapien
tcccctttctaaataccctcagatt

SEQ ID NO: 131882 - DNA, 25 bp, Homo sapien
tcagattcctaacatcgagcccatg

SEQ ID NO: 131883 - DNA, 25 bp, Homo sapien
catcgagcccatgctttgtttgatt

SEQ ID NO: 131884 - DNA, 25 bp, Homo sapien
atttgttctattccatccattgtcc

SEQ ID NO: 131885 - DNA, 25 bp, Homo sapien
gttactgacagttgccttggtccta

SEQ ID NO: 131886 - DNA, 25 bp, Homo sapien
gggttcccattgtgctagatcttgg

SEQ ID NO: 131887 - DNA, 25 bp, Homo sapien
tgggaaaccagatgactctccctgt

SEQ ID NO: 131888 - DNA, 25 bp, Homo sapien
actctccctgtcaaaactatggcta

SEQ ID NO: 131889 - DNA, 25 bp, Homo sapien
ggctacgtcactgtaaaccatttct

SEQ ID NO: 131890 - DNA, 25 bp, Homo sapien
gaaggcaaagcaaaactcccaatgg

SEQ ID NO: 131891 - DNA, 25 bp, Homo sapien
ggcaaagcaaaactcccaatggata

SEQ ID NO: 131892 - DNA, 25 bp, Homo sapien
actcccaatggataaatcagtgcct

SEQ ID NO: 131893 - DNA, 25 bp, Homo sapien
atggataaatcagtgcctggtgttc

SEQ ID NO: 131894 - DNA, 25 bp, Homo sapien
ggataaatcagtgcctggtgttctg

SEQ ID NO: 131895 - DNA, 25 bp, Homo sapien
aaaatagactaacttcagtaggatt

SEQ ID NO: 131896 - DNA, 25 bp, Homo sapien
acttcagtaggatttatgtattttg

SEQ ID NO: 131897 - DNA, 25 bp, Homo sapien
tttgtttggactgttttcaataaca

SEQ ID NO: 131898 - DNA, 25 bp, Homo sapien
ttggactgttttcaataacaaagca

SEQ ID NO: 131899 - DNA, 25 bp, Homo sapien
gtgaattaacacagtgtttcaattc

SEQ ID NO: 131900 - DNA, 25 bp, Homo sapien
gtttcaattctgtaattacatattt

SEQ ID NO: 131901 - DNA, 25 bp, Homo sapien
aatgagattcggattctccaggaca

SEQ ID NO: 131902 - DNA, 25 bp, Homo sapien
gctcaactccaccatgaagctggtg

SEQ ID NO: 131903 - DNA, 25 bp, Homo sapien
acggagcagcggaaacgcaggcaac

SEQ ID NO: 131904 - DNA, 25 bp, Homo sapien
gaaacgcaggcaacgcctaggcttt

SEQ ID NO: 131905 - DNA, 25 bp, Homo sapien
aacgcctaggctttgtggatgtcca

SEQ ID NO: 131906 - DNA, 25 bp, Homo sapien
gctttgtggatgtccagaactgcat

SEQ ID NO: 131907 - DNA, 25 bp, Homo sapien
ccagaactgcattagccgctgagga

SEQ ID NO: 131908 - DNA, 25 bp, Homo sapien
gcattagccgctgaggagagccacc

SEQ ID NO: 131909 - DNA, 25 bp, Homo sapien
tgaggagagccaccgaaggccccaa

SEQ ID NO: 131910 - DNA, 25 bp, Homo sapien
tgctcatcactggagactgcgactg

SEQ ID NO: 131911 - DNA, 25 bp, Homo sapien
gactgcgactgggaagaacactgcc

SEQ ID NO: 131912 - DNA, 25 bp, Homo sapien
ctccagtgctggacccggccaggag

SEQ ID NO: 131913 - DNA, 25 bp, Homo sapien
aggagacaagggtacgggcctctct

SEQ ID NO: 131914 - DNA, 25 bp, Homo sapien
acgggcctctctggtacacgagcgt

SEQ ID NO: 131915 - DNA, 25 bp, Homo sapien
ggcgagagggtgtacgtcaacatca

SEQ ID NO: 131916 - DNA, 25 bp, Homo sapien
gagggtgtacgtcaacatcagtcac

SEQ ID NO: 131917 - DNA, 25 bp, Homo sapien
tcaacatcagtcaccccgatatggt

SEQ ID NO: 131918 - DNA, 25 bp, Homo sapien
accccgatatggtggacttcgcgag

SEQ ID NO: 131919 - DNA, 25 bp, Homo sapien
cttcgcgagagggaagaccttcttt

SEQ ID NO: 131920 - DNA, 25 bp, Homo sapien
agtgcgtggtgcgagtgcgtgaata

SEQ ID NO: 131921 - DNA, 25 bp, Homo sapien
ccaggaccccatggcagtgggaaaa

SEQ ID NO: 131922 - DNA, 25 bp, Homo sapien
gaaattgattttgaacctgatgaaa

SEQ ID NO: 131923 - DNA, 25 bp, Homo sapien
gaaccagggagctagcaaaagtaaa

SEQ ID NO: 131924 - DNA, 25 bp, Homo sapien
gctagcaaaagtaaagcagacttat

SEQ ID NO: 131925 - DNA, 25 bp, Homo sapien
taaaattatagctatgtgcagctgc

SEQ ID NO: 131926 - DNA, 25 bp, Homo sapien
atgtgcagctgcacaacacagtcct

SEQ ID NO: 131927 - DNA, 25 bp, Homo sapien
aacacagtccttccactagcagctg

SEQ ID NO: 131928 - DNA, 25 bp, Homo sapien
acagtccttccactagcagctgtgt

SEQ ID NO: 131929 - DNA, 25 bp, Homo sapien
agtccttccactagcagctgtgtta

SEQ ID NO: 131930 - DNA, 25 bp, Homo sapien
gtccttccactagcagctgtgttaa

SEQ ID NO: 131931 - DNA, 25 bp, Homo sapien
aaccatttataagatttggaccttg

SEQ ID NO: 131932 - DNA, 25 bp, Homo sapien
ttataagatttggaccttggagctg

SEQ ID NO: 131933 - DNA, 25 bp, Homo sapien
tggagctgaaccagggagctagcaa

SEQ ID NO: 131934 - DNA, 25 bp, Homo sapien
agggccgctactgaagtccctttgt

SEQ ID NO: 131935 - DNA, 25 bp, Homo sapien
aagtccctttgtgccagtggatcct

SEQ ID NO: 131936 - DNA, 25 bp, Homo sapien
tgggcagcctggtattcagtggcca

SEQ ID NO: 131937 - DNA, 25 bp, Homo sapien
ggccagccccggtcagcaaggaaga

SEQ ID NO: 131938 - DNA, 25 bp, Homo sapien
ccctgagcaggaccgtggatcacct

SEQ ID NO: 131939 - DNA, 25 bp, Homo sapien
ttaagccctcatcacttcaaaactg

SEQ ID NO: 131940 - DNA, 25 bp, Homo sapien
aactgcctcttttttccatgggtga

SEQ ID NO: 131941 - DNA, 25 bp, Homo sapien
atgggtgaactgttctctttggtga

SEQ ID NO: 131942 - DNA, 25 bp, Homo sapien
tctttggtgatgtttctggttgtct

SEQ ID NO: 131943 - DNA, 25 bp, Homo sapien
tggttgtctgtgctgcctcaaagag

SEQ ID NO: 131944 - DNA, 25 bp, Homo sapien
agagcgtgtgttcttagttaactgg

SEQ ID NO: 131945 - DNA, 25 bp, Homo sapien
gtcatgtatgacttaatcacagaac

SEQ ID NO: 131946 - DNA, 25 bp, Homo sapien
gtatgacttaatcacagaactcaat

SEQ ID NO: 131947 - DNA, 25 bp, Homo sapien
cacagaactcaatgaccggagcgaa

SEQ ID NO: 131948 - DNA, 25 bp, Homo sapien
tcaatgaccggagcgaagacctgga

SEQ ID NO: 131949 - DNA, 25 bp, Homo sapien
gagaagcagattggcagcctggagt

SEQ ID NO: 131950 - DNA, 25 bp, Homo sapien
gcctggagtcgaagctggagcatct

SEQ ID NO: 131951 - DNA, 25 bp, Homo sapien
gagtcgaagctggagcatctcaccg

SEQ ID NO: 131952 - DNA, 25 bp, Homo sapien
tcgaagctggagcatctcaccgcca

SEQ ID NO: 131953 - DNA, 25 bp, Homo sapien
tggagcatctcaccgccagcttcaa

SEQ ID NO: 131954 - DNA, 25 bp, Homo sapien
gggtgtcagcgtggcagtgggcacc

SEQ ID NO: 131955 - DNA, 25 bp, Homo sapien
cgaccccgtacacaagttcaagcag

SEQ ID NO: 131956 - DNA, 25 bp, Homo sapien
ggagctgaaagaccctgacattcat

SEQ ID NO: 131957 - DNA, 25 bp, Homo sapien
gaccctgacattcatgatccaaaga

SEQ ID NO: 131958 - DNA, 25 bp, Homo sapien
tgcagcacagaactttgaacctagg

SEQ ID NO: 131959 - DNA, 25 bp, Homo sapien
agcacagaactttgaacctaggagg

SEQ ID NO: 131960 - DNA, 25 bp, Homo sapien
gagaaattcagctgtcattcagtta

SEQ ID NO: 131961 - DNA, 25 bp, Homo sapien
gtcattcagttactcttaattcttt

SEQ ID NO: 131962 - DNA, 25 bp, Homo sapien
taaatgataccacatatttgtttgt

SEQ ID NO: 131963 - DNA, 25 bp, Homo sapien
caaagtagactaaagcagccatctt

SEQ ID NO: 131964 - DNA, 25 bp, Homo sapien
agcagccatctttaaaatccaggat

SEQ ID NO: 131965 - DNA, 25 bp, Homo sapien
taaaatccaggatcatcaatgctat

SEQ ID NO: 131966 - DNA, 25 bp, Homo sapien
caatgctattaacagtatcaggtaa

SEQ ID NO: 131967 - DNA, 25 bp, Homo sapien
tgcatgccggcttgagactggagcc

SEQ ID NO: 131968 - DNA, 25 bp, Homo sapien
gcagggcagttcaccgggtcctgca

SEQ ID NO: 131969 - DNA, 25 bp, Homo sapien
tgcaggaccaggtgccagccactaa

SEQ ID NO: 131970 - DNA, 25 bp, Homo sapien
gagccaaatgacactaacttataga

SEQ ID NO: 131971 - DNA, 25 bp, Homo sapien
ggcaaagggcttcttcctcaggcca

SEQ ID NO: 131972 - DNA, 25 bp, Homo sapien
agctcttctgaggaggctctgccct

SEQ ID NO: 131973 - DNA, 25 bp, Homo sapien
agaggtgccagaccgcggattttat

SEQ ID NO: 131974 - DNA, 25 bp, Homo sapien
gcggattttatttagcaagcccaga

SEQ ID NO: 131975 - DNA, 25 bp, Homo sapien
atttagcaagcccagaccttccggt

SEQ ID NO: 131976 - DNA, 25 bp, Homo sapien
agaccttccggtctaacgtctcaca

SEQ ID NO: 131977 - DNA, 25 bp, Homo sapien
gtctaacgtctcacaccacgacgga

SEQ ID NO: 131978 - DNA, 25 bp, Homo sapien
gagacctcggccggctgccagtcgc

SEQ ID NO: 131979 - DNA, 25 bp, Homo sapien
tggacccctggaaactggtctcctt

SEQ ID NO: 131980 - DNA, 25 bp, Homo sapien
ctggaaactggtctccttcggccgg

SEQ ID NO: 131981 - DNA, 25 bp, Homo sapien
tggaaactggtctccttcggccgga

SEQ ID NO: 131982 - DNA, 25 bp, Homo sapien
gaaactggtctccttcggccggaca

SEQ ID NO: 131983 - DNA, 25 bp, Homo sapien
aactggtctccttcggccggacact

SEQ ID NO: 131984 - DNA, 25 bp, Homo sapien
cagacactccggagagccctgggcc

SEQ ID NO: 131985 - DNA, 25 bp, Homo sapien
gggcagaaccaagacagcacagtgc

SEQ ID NO: 131986 - DNA, 25 bp, Homo sapien
gcagaaccaagacagcacagtgccc

SEQ ID NO: 131987 - DNA, 25 bp, Homo sapien
agaaccaagacagcacagtgcccct

SEQ ID NO: 131988 - DNA, 25 bp, Homo sapien
gggcccacggctcccactaaggcct

SEQ ID NO: 131989 - DNA, 25 bp, Homo sapien
ttgccaactctgttccagcctatgg

SEQ ID NO: 131990 - DNA, 25 bp, Homo sapien
aactctgttccagcctatggcttta

SEQ ID NO: 131991 - DNA, 25 bp, Homo sapien
tctgttccagcctatggctttaggc

SEQ ID NO: 131992 - DNA, 25 bp, Homo sapien
gttccagcctatggctttaggctag

SEQ ID NO: 131993 - DNA, 25 bp, Homo sapien
gcctatggctttaggctagctgtta

SEQ ID NO: 131994 - DNA, 25 bp, Homo sapien
ggctttaggctagctgttaaatatg

SEQ ID NO: 131995 - DNA, 25 bp, Homo sapien
cagagcaagagaccaggtaatttct

SEQ ID NO: 131996 - DNA, 25 bp, Homo sapien
agagaccaggtaatttctaagaaca

SEQ ID NO: 131997 - DNA, 25 bp, Homo sapien
agaacagggttctagcgatgggact

SEQ ID NO: 131998 - DNA, 25 bp, Homo sapien
aacagggttctagcgatgggactgc

SEQ ID NO: 131999 - DNA, 25 bp, Homo sapien
cagggttctagcgatgggactgccc

SEQ ID NO: 132000 - DNA, 25 bp, Homo sapien
aagagttcatagacagtgatgccgc

SEQ ID NO: 132001 - DNA, 25 bp, Homo sapien
acagtgatgccgctgcagaggctat

SEQ ID NO: 132002 - DNA, 25 bp, Homo sapien
gtgtttcctcaaccagtcacataga

SEQ ID NO: 132003 - DNA, 25 bp, Homo sapien
tacagtgtacgacagcatttggtgt

SEQ ID NO: 132004 - DNA, 25 bp, Homo sapien
tttacccaaggcgtttggctcagag

SEQ ID NO: 132005 - DNA, 25 bp, Homo sapien
gtttggctcagagggctacagacta

SEQ ID NO: 132006 - DNA, 25 bp, Homo sapien
gctacagactatggccagaactcat

SEQ ID NO: 132007 - DNA, 25 bp, Homo sapien
ggccagaactcatctgttgattgct

SEQ ID NO: 132008 - DNA, 25 bp, Homo sapien
ccacttttctttcttgtgttgtctt

SEQ ID NO: 132009 - DNA, 25 bp, Homo sapien
gttgtctttttatgtggaaactgct

SEQ ID NO: 132010 - DNA, 25 bp, Homo sapien
gtggaaactgctagacaactgttga

SEQ ID NO: 132011 - DNA, 25 bp, Homo sapien
tgattagccatcataaatgcccatt

SEQ ID NO: 132012 - DNA, 25 bp, Homo sapien
gattagccatcataaatgcccattg

SEQ ID NO: 132013 - DNA, 25 bp, Homo sapien
ttgcagaagtgcctgtgagagaaat

SEQ ID NO: 132014 - DNA, 25 bp, Homo sapien
tgcagaagtgcctgtgagagaaatc

SEQ ID NO: 132015 - DNA, 25 bp, Homo sapien
gcagaagtgcctgtgagagaaatct

SEQ ID NO: 132016 - DNA, 25 bp, Homo sapien
cagaagtgcctgtgagagaaatctt

SEQ ID NO: 132017 - DNA, 25 bp, Homo sapien
aagtgcctgtgagagaaatcttcaa

SEQ ID NO: 132018 - DNA, 25 bp, Homo sapien
agtgcctgtgagagaaatcttcaaa

SEQ ID NO: 132019 - DNA, 25 bp, Homo sapien
aatcttcaaaagacaaacctggtca

SEQ ID NO: 132020 - DNA, 25 bp, Homo sapien
atcttcaaaagacaaacctggtcaa

SEQ ID NO: 132021 - DNA, 25 bp, Homo sapien
cttcaaaagacaaacctggtcaaat

SEQ ID NO: 132022 - DNA, 25 bp, Homo sapien
actcttgacattccactgtgcgttt

SEQ ID NO: 132023 - DNA, 25 bp, Homo sapien
attccactgtgcgttttagaagaga

SEQ ID NO: 132024 - DNA, 25 bp, Homo sapien
agcctttttctaaagggatctgctt

SEQ ID NO: 132025 - DNA, 25 bp, Homo sapien
gttttaacttttatacctatctgag

SEQ ID NO: 132026 - DNA, 25 bp, Homo sapien
gagtgaattacagacaacctatcat

SEQ ID NO: 132027 - DNA, 25 bp, Homo sapien
aacctatcatttattctgcttcgag

SEQ ID NO: 132028 - DNA, 25 bp, Homo sapien
atttattctgcttcgagggtcccca

SEQ ID NO: 132029 - DNA, 25 bp, Homo sapien
cagggcccttgtacaaccgacagct

SEQ ID NO: 132030 - DNA, 25 bp, Homo sapien
aaccgacagctcttacttttaaatg

SEQ ID NO: 132031 - DNA, 25 bp, Homo sapien
atgcaatctcttttctacatacatt

SEQ ID NO: 132032 - DNA, 25 bp, Homo sapien
gcttcaatagaactgtttcaactgt

SEQ ID NO: 132033 - DNA, 25 bp, Homo sapien
gagtcatggccccaggaccagccgt

SEQ ID NO: 132034 - DNA, 25 bp, Homo sapien
gaccagccgtggaccaagaggctcg

SEQ ID NO: 132035 - DNA, 25 bp, Homo sapien
caagaggctcgtgatggtcaaggtt

SEQ ID NO: 132036 - DNA, 25 bp, Homo sapien
gtgatggtcaaggttgtgcccacgt

SEQ ID NO: 132037 - DNA, 25 bp, Homo sapien
atggtcaaggttgtgcccacgtgcc

SEQ ID NO: 132038 - DNA, 25 bp, Homo sapien
aaggttgtgcccacgtgcctcaggg

SEQ ID NO: 132039 - DNA, 25 bp, Homo sapien
ccctggagaatactgtggacctgca

SEQ ID NO: 132040 - DNA, 25 bp, Homo sapien
atactgtggacctgcacatttccaa

SEQ ID NO: 132041 - DNA, 25 bp, Homo sapien
tggacctgcacatttccaacagcca

SEQ ID NO: 132042 - DNA, 25 bp, Homo sapien
gagagctgagccctcgctcctcatg

SEQ ID NO: 132043 - DNA, 25 bp, Homo sapien
tgagccctcgctcctcatggtgtgc

SEQ ID NO: 132044 - DNA, 25 bp, Homo sapien
ttccttcgtgcgctagaacctaggg

SEQ ID NO: 132045 - DNA, 25 bp, Homo sapien
cgctagaacctagggaatgccagag

SEQ ID NO: 132046 - DNA, 25 bp, Homo sapien
tgacctggctctggttcaacaaaag

SEQ ID NO: 132047 - DNA, 25 bp, Homo sapien
aaacatcatttgcatggctggagtt

SEQ ID NO: 132048 - DNA, 25 bp, Homo sapien
tgcatggctggagttgcccgcgtaa

SEQ ID NO: 132049 - DNA, 25 bp, Homo sapien
ggagttgcccgcgtaaggcagccaa

SEQ ID NO: 132050 - DNA, 25 bp, Homo sapien
gcccgcgtaaggcagccaagaaact

SEQ ID NO: 132051 - DNA, 25 bp, Homo sapien
aagaaactcacccaaagcctgtagc

SEQ ID NO: 132052 - DNA, 25 bp, Homo sapien
gggtctgttccttcctatgctcacc

SEQ ID NO: 132053 - DNA, 25 bp, Homo sapien
tatgctcacccagagaactctctga

SEQ ID NO: 132054 - DNA, 25 bp, Homo sapien
tgatgtgccagtggccctccctttt

SEQ ID NO: 132055 - DNA, 25 bp, Homo sapien
ctagccgtttgcagaggccgccacc

SEQ ID NO: 132056 - DNA, 25 bp, Homo sapien
tgaaaaggagcagcctcgtattttt

SEQ ID NO: 132057 - DNA, 25 bp, Homo sapien
gttttaatgaaccatgttgttgctg

SEQ ID NO: 132058 - DNA, 25 bp, Homo sapien
catgttgttgctggttgtcctggca

SEQ ID NO: 132059 - DNA, 25 bp, Homo sapien
tgttgttgctggttgtcctggcatc

SEQ ID NO: 132060 - DNA, 25 bp, Homo sapien
gcacactgtatgtacatactggcaa

SEQ ID NO: 132061 - DNA, 25 bp, Homo sapien
gtatgtacatactggcaacgatgtc

SEQ ID NO: 132062 - DNA, 25 bp, Homo sapien
gtacatactggcaacgatgtcaaat

SEQ ID NO: 132063 - DNA, 25 bp, Homo sapien
actggcaacgatgtcaaatgtaatt

SEQ ID NO: 132064 - DNA, 25 bp, Homo sapien
ggcaacgatgtcaaatgtaatttat

SEQ ID NO: 132065 - DNA, 25 bp, Homo sapien
acaataaaacatgaggtggacaggc

SEQ ID NO: 132066 - DNA, 25 bp, Homo sapien
tcagcatttaacttacatttgtact

SEQ ID NO: 132067 - DNA, 25 bp, Homo sapien
atatagtctacagttgtcctgattt

SEQ ID NO: 132068 - DNA, 25 bp, Homo sapien
gaatttgttagactagttctcttgt

SEQ ID NO: 132069 - DNA, 25 bp, Homo sapien
actagttctcttgtcttgtgatctg

SEQ ID NO: 132070 - DNA, 25 bp, Homo sapien
ttctcttgtcttgtgatctgtgtac

SEQ ID NO: 132071 - DNA, 25 bp, Homo sapien
cttgtcttgtgatctgtgtacaatt

SEQ ID NO: 132072 - DNA, 25 bp, Homo sapien
agtcactaagactttcctccaagaa

SEQ ID NO: 132073 - DNA, 25 bp, Homo sapien
gactttcctccaagaactaagccaa

SEQ ID NO: 132074 - DNA, 25 bp, Homo sapien
aagaactaagccaacttgatgtgaa

SEQ ID NO: 132075 - DNA, 25 bp, Homo sapien
ttgatgtgaaaagcacggctgtata

SEQ ID NO: 132076 - DNA, 25 bp, Homo sapien
acggctgtatataatggtgatgtca

SEQ ID NO: 132077 - DNA, 25 bp, Homo sapien
ttgccaactctgttccagcctatgg

SEQ ID NO: 132078 - DNA, 25 bp, Homo sapien
aactctgttccagcctatggcttta

SEQ ID NO: 132079 - DNA, 25 bp, Homo sapien
tctgttccagcctatggctttaggc

SEQ ID NO: 132080 - DNA, 25 bp, Homo sapien
gttccagcctatggctttaggctag

SEQ ID NO: 132081 - DNA, 25 bp, Homo sapien
gcctatggctttaggctagctgtta

SEQ ID NO: 132082 - DNA, 25 bp, Homo sapien
ggctttaggctagctgttaaatatg

SEQ ID NO: 132083 - DNA, 25 bp, Homo sapien
cagagcaagagaccaggtaatttct

SEQ ID NO: 132084 - DNA, 25 bp, Homo sapien
agagaccaggtaatttctaagaaca

SEQ ID NO: 132085 - DNA, 25 bp, Homo sapien
agaacagggttctagcgatgggact

SEQ ID NO: 132086 - DNA, 25 bp, Homo sapien
cagggttctagcgatgggactgccc

SEQ ID NO: 132087 - DNA, 25 bp, Homo sapien
gtagactaacgctgtttacaccctt

SEQ ID NO: 132088 - DNA, 25 bp, Homo sapien
gaaggctataccacagaacattggc

SEQ ID NO: 132089 - DNA, 25 bp, Homo sapien
gaacattggctggtcaggatataca

SEQ ID NO: 132090 - DNA, 25 bp, Homo sapien
aggacctggataatcgaggcttgtc

SEQ ID NO: 132091 - DNA, 25 bp, Homo sapien
ggataatcgaggcttgtcaaggaca

SEQ ID NO: 132092 - DNA, 25 bp, Homo sapien
acataaatgtcacgtccagctctga

SEQ ID NO: 132093 - DNA, 25 bp, Homo sapien
tccagctctgatatcttcgcactga

SEQ ID NO: 132094 - DNA, 25 bp, Homo sapien
ttcgcactgagcacatcacatttag

SEQ ID NO: 132095 - DNA, 25 bp, Homo sapien
cacatttaggacgttgaagattttt

SEQ ID NO: 132096 - DNA, 25 bp, Homo sapien
tggatggcatccgaattgtctggaa

SEQ ID NO: 132097 - DNA, 25 bp, Homo sapien
aagttttgtcttgggcatgatgggc

SEQ ID NO: 132098 - DNA, 25 bp, Homo sapien
gggctgggccaaatgaaatgatttt

SEQ ID NO: 132099 - DNA, 25 bp, Homo sapien
cacccttccgcaaactggccgagaa

SEQ ID NO: 132100 - DNA, 25 bp, Homo sapien
gctggcccgggagctacgcagtgca

SEQ ID NO: 132101 - DNA, 25 bp, Homo sapien
ggagctacgcagtgcaggtgcccca

SEQ ID NO: 132102 - DNA, 25 bp, Homo sapien
gagctacgcagtgcaggtgccccag

SEQ ID NO: 132103 - DNA, 25 bp, Homo sapien
agcctccgtctcagggcaggacgcc

SEQ ID NO: 132104 - DNA, 25 bp, Homo sapien
cttggccccagaggaccgagagagt

SEQ ID NO: 132105 - DNA, 25 bp, Homo sapien
caaggagggtccaggcgggcaagtc

SEQ ID NO: 132106 - DNA, 25 bp, Homo sapien
gtccaggcgggcaagtcatcctcct

SEQ ID NO: 132107 - DNA, 25 bp, Homo sapien
caggcgggcaagtcatcctcctggt

SEQ ID NO: 132108 - DNA, 25 bp, Homo sapien
gggcaagtcatcctcctggtgccca

SEQ ID NO: 132109 - DNA, 25 bp, Homo sapien
cgtggacaccccagacctgcgaagg

SEQ ID NO: 132110 - DNA, 25 bp, Homo sapien
agcccctgggtcagtgtggtcgaca

SEQ ID NO: 132111 - DNA, 25 bp, Homo sapien
acacacaggcctgagcaaagggcct

SEQ ID NO: 132112 - DNA, 25 bp, Homo sapien
aagggcctgcccagacaagattttt

SEQ ID NO: 132113 - DNA, 25 bp, Homo sapien
gggcctgcccagacaagatttttta

SEQ ID NO: 132114 - DNA, 25 bp, Homo sapien
ggccatcaacaagagctttgaccag

SEQ ID NO: 132115 - DNA, 25 bp, Homo sapien
acaagagctttgaccagagggacct

SEQ ID NO: 132116 - DNA, 25 bp, Homo sapien
gagctttgaccagagggacctggca

SEQ ID NO: 132117 - DNA, 25 bp, Homo sapien
ggacctggcacaggatgaagctgta

SEQ ID NO: 132118 - DNA, 25 bp, Homo sapien
ctgtatggctggagcgtggtcccct

SEQ ID NO: 132119 - DNA, 25 bp, Homo sapien
agcgtggtcccctggagcccagtga

SEQ ID NO: 132120 - DNA, 25 bp, Homo sapien
ggagcccagtgagccggctgtagtg

SEQ ID NO: 132121 - DNA, 25 bp, Homo sapien
gttttagggtaaatgcataagacta

SEQ ID NO: 132122 - DNA, 25 bp, Homo sapien
gataggatgtgacaatgaacagtgt

SEQ ID NO: 132123 - DNA, 25 bp, Homo sapien
acagtgtccaattgaatggtttcac

SEQ ID NO: 132124 - DNA, 25 bp, Homo sapien
tttcatgtgtttcacttacctataa

SEQ ID NO: 132125 - DNA, 25 bp, Homo sapien
tgtgtttcacttacctataaaccaa

SEQ ID NO: 132126 - DNA, 25 bp, Homo sapien
ggaaatggtattgcccaaagtgcag

SEQ ID NO: 132127 - DNA, 25 bp, Homo sapien
atcgaggtagtaaaggccatccaca

SEQ ID NO: 132128 - DNA, 25 bp, Homo sapien
ggtagtaaaggccatccacatttta

SEQ ID NO: 132129 - DNA, 25 bp, Homo sapien
gactattatataatccgtttgcttt

SEQ ID NO: 132130 - DNA, 25 bp, Homo sapien
tatataatccgtttgctttcagaaa

SEQ ID NO: 132131 - DNA, 25 bp, Homo sapien
taatccgtttgctttcagaaaatgt

SEQ ID NO: 132132 - DNA, 25 bp, Homo sapien
tcctgggtggcctgttatgccagcg

SEQ ID NO: 132133 - DNA, 25 bp, Homo sapien
gtggcctgttatgccagcggcctct

SEQ ID NO: 132134 - DNA, 25 bp, Homo sapien
tgttccctgcagtctgtgctgtgtg

SEQ ID NO: 132135 - DNA, 25 bp, Homo sapien
agcgctgcacttgccatgctggaaa

SEQ ID NO: 132136 - DNA, 25 bp, Homo sapien
tgcacttgccatgctggaaaccagc

SEQ ID NO: 132137 - DNA, 25 bp, Homo sapien
ttgccatgctggaaaccagcccagg

SEQ ID NO: 132138 - DNA, 25 bp, Homo sapien
gggcccagccacttccagcttttga

SEQ ID NO: 132139 - DNA, 25 bp, Homo sapien
tccagcttttgatcttggggccaga

SEQ ID NO: 132140 - DNA, 25 bp, Homo sapien
tacacacaccccaggtgtccatggg

SEQ ID NO: 132141 - DNA, 25 bp, Homo sapien
attatgagcgtccttcatctgggca

SEQ ID NO: 132142 - DNA, 25 bp, Homo sapien
tgagcgtccttcatctgggcagacc

SEQ ID NO: 132143 - DNA, 25 bp, Homo sapien
tggacgtcccaaagaaatggtgtca

SEQ ID NO: 132144 - DNA, 25 bp, Homo sapien
aatggtgtcaacctccaacaacaaa

SEQ ID NO: 132145 - DNA, 25 bp, Homo sapien
gatggacaagccttaggtacgacat

SEQ ID NO: 132146 - DNA, 25 bp, Homo sapien
ggtacgacatcagaattcattccta

SEQ ID NO: 132147 - DNA, 25 bp, Homo sapien
cattcctaatttgtcaccagagctg

SEQ ID NO: 132148 - DNA, 25 bp, Homo sapien
gaaaccactgtctgaagggcagcca

SEQ ID NO: 132149 - DNA, 25 bp, Homo sapien
gaagggcagccatcattgaagaaaa

SEQ ID NO: 132150 - DNA, 25 bp, Homo sapien
ggacgtcacagatttgatccattct

SEQ ID NO: 132151 - DNA, 25 bp, Homo sapien
atttgtgacgatggaacttcagtta

SEQ ID NO: 132152 - DNA, 25 bp, Homo sapien
gagtaatcatggactggacatctca

SEQ ID NO: 132153 - DNA, 25 bp, Homo sapien
ggacatctcatccattctcatatgt

SEQ ID NO: 132154 - DNA, 25 bp, Homo sapien
gggctcagcctgtgataggcattca

SEQ ID NO: 132155 - DNA, 25 bp, Homo sapien
atactccaatgctgtcattcctttg

SEQ ID NO: 132156 - DNA, 25 bp, Homo sapien
tgtcattcctttgtctacagcatcc

SEQ ID NO: 132157 - DNA, 25 bp, Homo sapien
agcatccccaaacaatgtaccagtg

SEQ ID NO: 132158 - DNA, 25 bp, Homo sapien
aatgtaccagtgatgggctacctga

SEQ ID NO: 132159 - DNA, 25 bp, Homo sapien
gagctcatctagtcgccaagcagta

SEQ ID NO: 132160 - DNA, 25 bp, Homo sapien
aagcagtatctcctgcttgctgctg

SEQ ID NO: 132161 - DNA, 25 bp, Homo sapien
ttgctgctgctttactacattccag

SEQ ID NO: 132162 - DNA, 25 bp, Homo sapien
tcatccaatttccagagccactatc

SEQ ID NO: 132163 - DNA, 25 bp, Homo sapien
agccactatctctgctgtccacttt

SEQ ID NO: 132164 - DNA, 25 bp, Homo sapien
ggctctgtgaatacttcaacctgct

SEQ ID NO: 132165 - DNA, 25 bp, Homo sapien
gatttcgacttgctgagtaaaatgg

SEQ ID NO: 132166 - DNA, 25 bp, Homo sapien
aaatatctccatcttgctccagtat

SEQ ID NO: 132167 - DNA, 25 bp, Homo sapien
cagtatcagagttcatttgggcatt

SEQ ID NO: 132168 - DNA, 25 bp, Homo sapien
caagtagctcttgcggaaacgtgta

SEQ ID NO: 132169 - DNA, 25 bp, Homo sapien
tgcggaaacgtgtagatactggtct

SEQ ID NO: 132170 - DNA, 25 bp, Homo sapien
atactggtctagtgggtctgtgaac

SEQ ID NO: 132171 - DNA, 25 bp, Homo sapien
gggtctgtgaaccacttaattgaac

SEQ ID NO: 132172 - DNA, 25 bp, Homo sapien
acagggctgttttaagtttcagagt

SEQ ID NO: 132173 - DNA, 25 bp, Homo sapien
gaagaaatcaactccattgcataga

SEQ ID NO: 132174 - DNA, 25 bp, Homo sapien
atagactgcaatatcatctcctgcc

SEQ ID NO: 132175 - DNA, 25 bp, Homo sapien
tctccctagcttcacatcttgtgtt

SEQ ID NO: 132176 - DNA, 25 bp, Homo sapien
atgtcctcagtgtaccactacttag

SEQ ID NO: 132177 - DNA, 25 bp, Homo sapien
gtgtaccactacttagagatatgta

SEQ ID NO: 132178 - DNA, 25 bp, Homo sapien
aactctaattgtccattcttgcttg

SEQ ID NO: 132179 - DNA, 25 bp, Homo sapien
tccattcttgcttgactctactatt

SEQ ID NO: 132180 - DNA, 25 bp, Homo sapien
gcttgactctactattaagtttgaa

SEQ ID NO: 132181 - DNA, 25 bp, Homo sapien
gaaaatagttaccttcaaagcaaga

SEQ ID NO: 132182 - DNA, 25 bp, Homo sapien
taattctatttgaagcatgctctgt

SEQ ID NO: 132183 - DNA, 25 bp, Homo sapien
gcatgctctgtaagttgcttcctaa

SEQ ID NO: 132184 - DNA, 25 bp, Homo sapien
gtaagttgcttcctaacatccttgg

SEQ ID NO: 132185 - DNA, 25 bp, Homo sapien
gcttcctaacatccttggactgaga

SEQ ID NO: 132186 - DNA, 25 bp, Homo sapien
gaaattatacttacttctggcataa

SEQ ID NO: 132187 - DNA, 25 bp, Homo sapien
acagaacggatctagtgtttggaac

SEQ ID NO: 132188 - DNA, 25 bp, Homo sapien
gtgtttggaacggacgttacctgct

SEQ ID NO: 132189 - DNA, 25 bp, Homo sapien
gttacctgctggtttgtgcacaaca

SEQ ID NO: 132190 - DNA, 25 bp, Homo sapien
aaaggattcattgacgggcattaca

SEQ ID NO: 132191 - DNA, 25 bp, Homo sapien
tgacgggcattacaaggattacttc

SEQ ID NO: 132192 - DNA, 25 bp, Homo sapien
aaggattacttcgtgcctcagctct

SEQ ID NO: 132193 - DNA, 25 bp, Homo sapien
tcagctctacagctttctcaaacgg

SEQ ID NO: 132194 - DNA, 25 bp, Homo sapien
tacagctttctcaaacggccttaaa

SEQ ID NO: 132195 - DNA, 25 bp, Homo sapien
tattaatatacatctttcccctgtc

SEQ ID NO: 132196 - DNA, 25 bp, Homo sapien
tcccctgtcacttttgcagatattc

SEQ ID NO: 132197 - DNA, 25 bp, Homo sapien
cttttgcagatattcttcggtttga

SEQ ID NO: 132198 - DNA, 25 bp, Homo sapien
gcctatactttctaccagaagcttg

SEQ ID NO: 132199 - DNA, 25 bp, Homo sapien
ctttctaccagaagcttgaagggtt

SEQ ID NO: 132200 - DNA, 25 bp, Homo sapien
cagaagcttgaagggtttggttaag

SEQ ID NO: 132201 - DNA, 25 bp, Homo sapien
gttaagaatattccccaaagcactg

SEQ ID NO: 132202 - DNA, 25 bp, Homo sapien
caaagcactgagatactaaagaaat

SEQ ID NO: 132203 - DNA, 25 bp, Homo sapien
gatgacaacaaatgagattcagagt

SEQ ID NO: 132204 - DNA, 25 bp, Homo sapien
gagattcagagtaacatttatacat

SEQ ID NO: 132205 - DNA, 25 bp, Homo sapien
atacatgatcttaaacattgttttg

SEQ ID NO: 132206 - DNA, 25 bp, Homo sapien
gtagtgtatattacttgtccattcc

SEQ ID NO: 132207 - DNA, 25 bp, Homo sapien
tgtatattacttgtccattccttta

SEQ ID NO: 132208 - DNA, 25 bp, Homo sapien
gagcagcctgcactcttttgtagat

SEQ ID NO: 132209 - DNA, 25 bp, Homo sapien
ttcccacggggcttctgagcttgct

SEQ ID NO: 132210 - DNA, 25 bp, Homo sapien
tcccacggggcttctgagcttgctc

SEQ ID NO: 132211 - DNA, 25 bp, Homo sapien
gggcttctgagcttgctcccctgag

SEQ ID NO: 132212 - DNA, 25 bp, Homo sapien
ggcttctgagcttgctcccctgagc

SEQ ID NO: 132213 - DNA, 25 bp, Homo sapien
gcttctgagcttgctcccctgagcc

SEQ ID NO: 132214 - DNA, 25 bp, Homo sapien
ccccgacgtgaagcctccctgtctc

SEQ ID NO: 132215 - DNA, 25 bp, Homo sapien
cccgacgtgaagcctccctgtctct

SEQ ID NO: 132216 - DNA, 25 bp, Homo sapien
ctccctgtctctccgccagctctga

SEQ ID NO: 132217 - DNA, 25 bp, Homo sapien
tccctgtctctccgccagctctgag

SEQ ID NO: 132218 - DNA, 25 bp, Homo sapien
ctgtctctccgccagctctgagtcc

SEQ ID NO: 132219 - DNA, 25 bp, Homo sapien
tgtctctccgccagctctgagtccc

SEQ ID NO: 132220 - DNA, 25 bp, Homo sapien
tctccctacactggcagccagtcat

SEQ ID NO: 132221 - DNA, 25 bp, Homo sapien
gctaaaacattacagttgccaagga

SEQ ID NO: 132222 - DNA, 25 bp, Homo sapien
aaaacattacagttgccaaggagga

SEQ ID NO: 132223 - DNA, 25 bp, Homo sapien
aacattacagttgccaaggaggaaa

SEQ ID NO: 132224 - DNA, 25 bp, Homo sapien
agaattaaccttaagaccagttcat

SEQ ID NO: 132225 - DNA, 25 bp, Homo sapien
aattaaccttaagaccagttcatag

SEQ ID NO: 132226 - DNA, 25 bp, Homo sapien
gttaatacaggtttacagttcatgc

SEQ ID NO: 132227 - DNA, 25 bp, Homo sapien
taatacaggtttacagttcatgcct

SEQ ID NO: 132228 - DNA, 25 bp, Homo sapien
tacaggtttacagttcatgcctgtg

SEQ ID NO: 132229 - DNA, 25 bp, Homo sapien
ttatagttgtgaacattgcttgtgt

SEQ ID NO: 132230 - DNA, 25 bp, Homo sapien
agttgtgaacattgcttgtgtgtgt

SEQ ID NO: 132231 - DNA, 25 bp, Homo sapien
tttctgctggaaacagactcgattc

SEQ ID NO: 132232 - DNA, 25 bp, Homo sapien
ttctgctggaaacagactcgattca

SEQ ID NO: 132233 - DNA, 25 bp, Homo sapien
ctgctggaaacagactcgattcata

SEQ ID NO: 132234 - DNA, 25 bp, Homo sapien
tgctggaaacagactcgattcatat

SEQ ID NO: 132235 - DNA, 25 bp, Homo sapien
gccgcctggtactcaagcccgcggg

SEQ ID NO: 132236 - DNA, 25 bp, Homo sapien
cctctctgcaccgtactgtggaaaa

SEQ ID NO: 132237 - DNA, 25 bp, Homo sapien
ctctctgcaccgtactgtggaaaag

SEQ ID NO: 132238 - DNA, 25 bp, Homo sapien
tctctgcaccgtactgtggaaaaga

SEQ ID NO: 132239 - DNA, 25 bp, Homo sapien
ctctgcaccgtactgtggaaaagaa

SEQ ID NO: 132240 - DNA, 25 bp, Homo sapien
ctgtggaaaagaaacacgcacttag

SEQ ID NO: 132241 - DNA, 25 bp, Homo sapien
attttaagacgtgtttgtgtttgtg

SEQ ID NO: 132242 - DNA, 25 bp, Homo sapien
taagtaaatcagtctcaggcagaca

SEQ ID NO: 132243 - DNA, 25 bp, Homo sapien
aaatcagtctcaggcagacagccct

SEQ ID NO: 132244 - DNA, 25 bp, Homo sapien
atcagtctcaggcagacagcccttt

SEQ ID NO: 132245 - DNA, 25 bp, Homo sapien
agtctcaggcagacagccctttata

SEQ ID NO: 132246 - DNA, 25 bp, Homo sapien
gtctcaggcagacagccctttatag

SEQ ID NO: 132247 - DNA, 25 bp, Homo sapien
ctcaggcagacagccctttataggt

SEQ ID NO: 132248 - DNA, 25 bp, Homo sapien
ggcagacagccctttataggtgttt

SEQ ID NO: 132249 - DNA, 25 bp, Homo sapien
cagacagccctttataggtgtttgg

SEQ ID NO: 132250 - DNA, 25 bp, Homo sapien
cagccctttataggtgtttgggcca

SEQ ID NO: 132251 - DNA, 25 bp, Homo sapien
gccctttataggtgtttgggccagg

SEQ ID NO: 132252 - DNA, 25 bp, Homo sapien
gggccgaggtctttgagctcaggag

SEQ ID NO: 132253 - DNA, 25 bp, Homo sapien
tcttcagccgccagaccgtggcgta

SEQ ID NO: 132254 - DNA, 25 bp, Homo sapien
agaccgtggcgtagcctgcaggctc

SEQ ID NO: 132255 - DNA, 25 bp, Homo sapien
ggggcatagccggagccactctgct

SEQ ID NO: 132256 - DNA, 25 bp, Homo sapien
actctgcttggcctgacctgcaggt

SEQ ID NO: 132257 - DNA, 25 bp, Homo sapien
ctctgcttggcctgacctgcaggtc

SEQ ID NO: 132258 - DNA, 25 bp, Homo sapien
agccacaggctgggtgcacgtcctg

SEQ ID NO: 132259 - DNA, 25 bp, Homo sapien
gactgacagacacgctgggacctac

SEQ ID NO: 132260 - DNA, 25 bp, Homo sapien
ctgacagacacgctgggacctacgt

SEQ ID NO: 132261 - DNA, 25 bp, Homo sapien
tctccacgtgcagaccccatgcgtc

SEQ ID NO: 132262 - DNA, 25 bp, Homo sapien
gagcctggtgtgtgggcgtcggcca

SEQ ID NO: 132263 - DNA, 25 bp, Homo sapien
gtgtgtgggcgtcggccaccagcct

SEQ ID NO: 132264 - DNA, 25 bp, Homo sapien
cagcgggagaaggacctgccgaact

SEQ ID NO: 132265 - DNA, 25 bp, Homo sapien
ggagaaggacctgccgaactacaac

SEQ ID NO: 132266 - DNA, 25 bp, Homo sapien
aggacctgccgaactacaactggaa

SEQ ID NO: 132267 - DNA, 25 bp, Homo sapien
tgccgaactacaactggaactcctt

SEQ ID NO: 132268 - DNA, 25 bp, Homo sapien
gaactacaactggaactccttcggc

SEQ ID NO: 132269 - DNA, 25 bp, Homo sapien
acaactggaactccttcggcctgcg

SEQ ID NO: 132270 - DNA, 25 bp, Homo sapien
tcggcctgcgcttcggcaagcggga

SEQ ID NO: 132271 - DNA, 25 bp, Homo sapien
accagggaaccacggcagaagcgct

SEQ ID NO: 132272 - DNA, 25 bp, Homo sapien
gggcagtgaacttcagaccccaaag

SEQ ID NO: 132273 - DNA, 25 bp, Homo sapien
gcagtgaacttcagaccccaaagga

SEQ ID NO: 132274 - DNA, 25 bp, Homo sapien
accccaaaggagtcagagcatgcgg

SEQ ID NO: 132275 - DNA, 25 bp, Homo sapien
acacatattaaagagtaacagctgg

SEQ ID NO: 132276 - DNA, 25 bp, Homo sapien
taacagctggttacattgctaggcg

SEQ ID NO: 132277 - DNA, 25 bp, Homo sapien
gctggttacattgctaggcgagata

SEQ ID NO: 132278 - DNA, 25 bp, Homo sapien
attcatctaatgtattatgagccaa

SEQ ID NO: 132279 - DNA, 25 bp, Homo sapien
aatgtattatgagccaaaatggtta

SEQ ID NO: 132280 - DNA, 25 bp, Homo sapien
ggttaatttttcctgcatgttctgt

SEQ ID NO: 132281 - DNA, 25 bp, Homo sapien
aatttttcctgcatgttctgtgact

SEQ ID NO: 132282 - DNA, 25 bp, Homo sapien
agatgagccttgcagatatctgcat

SEQ ID NO: 132283 - DNA, 25 bp, Homo sapien
agccttgcagatatctgcatgtgtc

SEQ ID NO: 132284 - DNA, 25 bp, Homo sapien
aagaaatactcatgtgcaataggtg

SEQ ID NO: 132285 - DNA, 25 bp, Homo sapien
tcatagatgtgttattacttcctca

SEQ ID NO: 132286 - DNA, 25 bp, Homo sapien
attactcaggaagaacaccctctaa

SEQ ID NO: 132287 - DNA, 25 bp, Homo sapien
gggaaagtattctgtactcttagat

SEQ ID NO: 132288 - DNA, 25 bp, Homo sapien
agatggattctccactcagttgcaa

SEQ ID NO: 132289 - DNA, 25 bp, Homo sapien
tcagttgcaacttggacttgtcctc

SEQ ID NO: 132290 - DNA, 25 bp, Homo sapien
tggacttgtcctcagcagctggtaa

SEQ ID NO: 132291 - DNA, 25 bp, Homo sapien
ctcagcagctggtaatcttgctctg

SEQ ID NO: 132292 - DNA, 25 bp, Homo sapien
tcttgctctgcttgacaacatctga

SEQ ID NO: 132293 - DNA, 25 bp, Homo sapien
aaaaatgcacccaactagctctatg

SEQ ID NO: 132294 - DNA, 25 bp, Homo sapien
gcacccaactagctctatgtttaca

SEQ ID NO: 132295 - DNA, 25 bp, Homo sapien
tggacataggactcaaagtttcaga

SEQ ID NO: 132296 - DNA, 25 bp, Homo sapien
gagaccattgcaatgaatccccaat

SEQ ID NO: 132297 - DNA, 25 bp, Homo sapien
aaggattgtttctggtgactgcagc

SEQ ID NO: 132298 - DNA, 25 bp, Homo sapien
gtagcatttgggtctgagatcggcc

SEQ ID NO: 132299 - DNA, 25 bp, Homo sapien
agatcggcccagctctgactgaagg

SEQ ID NO: 132300 - DNA, 25 bp, Homo sapien
ttggcttccactcagcatcagcgtg

SEQ ID NO: 132301 - DNA, 25 bp, Homo sapien
accaccccagtgaggacctcgatgt

SEQ ID NO: 132302 - DNA, 25 bp, Homo sapien
ccagtgaggacctcgatgtccagct

SEQ ID NO: 132303 - DNA, 25 bp, Homo sapien
tgtcaggtctgatagtcctctgcta

SEQ ID NO: 132304 - DNA, 25 bp, Homo sapien
ggtctgatagtcctctgctaaaaca

SEQ ID NO: 132305 - DNA, 25 bp, Homo sapien
gtcctctgctaaaacaacacgattt

SEQ ID NO: 132306 - DNA, 25 bp, Homo sapien
aatcttacacatctgccaccggaaa

SEQ ID NO: 132307 - DNA, 25 bp, Homo sapien
atctgccaccggaaataccatgcac

SEQ ID NO: 132308 - DNA, 25 bp, Homo sapien
atactagctaccttctctgtaacag

SEQ ID NO: 132309 - DNA, 25 bp, Homo sapien
actagctaccttctctgtaacagaa

SEQ ID NO: 132310 - DNA, 25 bp, Homo sapien
ggacatgtaatttggaagggctcat

SEQ ID NO: 132311 - DNA, 25 bp, Homo sapien
agggctcattaacctcattgaaaca

SEQ ID NO: 132312 - DNA, 25 bp, Homo sapien
taacctcattgaaacaccataaaga

SEQ ID NO: 132313 - DNA, 25 bp, Homo sapien
tgacatttcaattgtcaaaacggga

SEQ ID NO: 132314 - DNA, 25 bp, Homo sapien
aatggattgtggtctcagtttagat

SEQ ID NO: 132315 - DNA, 25 bp, Homo sapien
gattgtggtctcagtttagatgaag

SEQ ID NO: 132316 - DNA, 25 bp, Homo sapien
gggagacagaattgtttgttatgaa

SEQ ID NO: 132317 - DNA, 25 bp, Homo sapien
aagcaaattcaagccaagacttctt

SEQ ID NO: 132318 - DNA, 25 bp, Homo sapien
ccaagacttcttgggatccaggatt

SEQ ID NO: 132319 - DNA, 25 bp, Homo sapien
gtttttctgtgttacttatattaga

SEQ ID NO: 132320 - DNA, 25 bp, Homo sapien
tagagtcagagatcttggtatgggc

SEQ ID NO: 132321 - DNA, 25 bp, Homo sapien
agatcttggtatgggctgttctgtt

SEQ ID NO: 132322 - DNA, 25 bp, Homo sapien
tcctgtgtctccaagcctctgtctt

SEQ ID NO: 132323 - DNA, 25 bp, Homo sapien
cctctgtcttttctgggatgtggta

SEQ ID NO: 132324 - DNA, 25 bp, Homo sapien
atgtggtattggtgctttgtgtcta

SEQ ID NO: 132325 - DNA, 25 bp, Homo sapien
gtctagggcagagtatgttcttgaa

SEQ ID NO: 132326 - DNA, 25 bp, Homo sapien
atctgactttttctgtgcgccttaa

SEQ ID NO: 132327 - DNA, 25 bp, Homo sapien
gactttttctgtgcgccttaaacaa

SEQ ID NO: 132328 - DNA, 25 bp, Homo sapien
ctgtgcgccttaaacaattcttgta

SEQ ID NO: 132329 - DNA, 25 bp, Homo sapien
tcttgtaactttcttcaaaaagcat

SEQ ID NO: 132330 - DNA, 25 bp, Homo sapien
ataggtttatgtgtactggtttgca

SEQ ID NO: 132331 - DNA, 25 bp, Homo sapien
gtgtactggtttgcatgtacccacc

SEQ ID NO: 132332 - DNA, 25 bp, Homo sapien
ctggtttgcatgtacccacccaaaa

SEQ ID NO: 132333 - DNA, 25 bp, Homo sapien
atgtacccacccaaaatgattattt

SEQ ID NO: 132334 - DNA, 25 bp, Homo sapien
ggagaatctaagtcaaactcactat

SEQ ID NO: 132335 - DNA, 25 bp, Homo sapien
gtcaaactcactatttataatgcat

SEQ ID NO: 132336 - DNA, 25 bp, Homo sapien
aggtaaccattaactatgtacatat

SEQ ID NO: 132337 - DNA, 25 bp, Homo sapien
attctgtacatatggtttaggtcac

SEQ ID NO: 132338 - DNA, 25 bp, Homo sapien
gtacatatggtttaggtcaccagat

SEQ ID NO: 132339 - DNA, 25 bp, Homo sapien
ggtcaccagatcctagtgtagttct

SEQ ID NO: 132340 - DNA, 25 bp, Homo sapien
agatcctagtgtagttctgaaacta

SEQ ID NO: 132341 - DNA, 25 bp, Homo sapien
ttgctccagcatccggtagtcttta

SEQ ID NO: 132342 - DNA, 25 bp, Homo sapien
gcatccggtagtctttaaacattct

SEQ ID NO: 132343 - DNA, 25 bp, Homo sapien
aattgtcattgttttatcagtgcta

SEQ ID NO: 132344 - DNA, 25 bp, Homo sapien
aaagtggtggcgttttctgtactgg

SEQ ID NO: 132345 - DNA, 25 bp, Homo sapien
gcgttttctgtactggattgcacca

SEQ ID NO: 132346 - DNA, 25 bp, Homo sapien
actggattgcaccaaggaagctttt

SEQ ID NO: 132347 - DNA, 25 bp, Homo sapien
gacattaaattctttccctggtaat

SEQ ID NO: 132348 - DNA, 25 bp, Homo sapien
tccctggtaatgaaaagagcccttt

SEQ ID NO: 132349 - DNA, 25 bp, Homo sapien
gccctttatcaatacagtgctgcaa

SEQ ID NO: 132350 - DNA, 25 bp, Homo sapien
cagtgctgcaatttctggatatcag

SEQ ID NO: 132351 - DNA, 25 bp, Homo sapien
ctggatatcagctacactttgtttt

SEQ ID NO: 132352 - DNA, 25 bp, Homo sapien
cacccgaacgtcttatctaatcatg

SEQ ID NO: 132353 - DNA, 25 bp, Homo sapien
aatcatgaaactccctagttccttc

SEQ ID NO: 132354 - DNA, 25 bp, Homo sapien
gaaactccctagttccttcatgtaa

SEQ ID NO: 132355 - DNA, 25 bp, Homo sapien
gttccttcatgtaacttccctgaaa

SEQ ID NO: 132356 - DNA, 25 bp, Homo sapien
atttgagagtctgtgacccacttac

SEQ ID NO: 132357 - DNA, 25 bp, Homo sapien
tgtgacccacttaccttgcatctca

SEQ ID NO: 132358 - DNA, 25 bp, Homo sapien
cttgcatctcacaggtagacagtat

SEQ ID NO: 132359 - DNA, 25 bp, Homo sapien
aagactacatattgtcactgacaca

SEQ ID NO: 132360 - DNA, 25 bp, Homo sapien
gcatacactctcaaagcaaataatt

SEQ ID NO: 132361 - DNA, 25 bp, Homo sapien
aacagtattgacttgtataccttgt

SEQ ID NO: 132362 - DNA, 25 bp, Homo sapien
gacttgtataccttgtaatttgaaa

SEQ ID NO: 132363 - DNA, 25 bp, Homo sapien
tcctcatgtgacctcgcagttgaga

SEQ ID NO: 132364 - DNA, 25 bp, Homo sapien
cgcagttgagaagcccattatcgtg

SEQ ID NO: 132365 - DNA, 25 bp, Homo sapien
ggttagggcactttggacaggtctt

SEQ ID NO: 132366 - DNA, 25 bp, Homo sapien
ggacaggtcttgctattcagtgaac

SEQ ID NO: 132367 - DNA, 25 bp, Homo sapien
gctattcagtgaacctttgtacatt

SEQ ID NO: 132368 - DNA, 25 bp, Homo sapien
actgtccaatgcagagctggcggga

SEQ ID NO: 132369 - DNA, 25 bp, Homo sapien
gagagttaagccacttcctgggtct

SEQ ID NO: 132370 - DNA, 25 bp, Homo sapien
tgggtctccttcttatgactgtcta

SEQ ID NO: 132371 - DNA, 25 bp, Homo sapien
gactgtctatgggtgcattgccttc

SEQ ID NO: 132372 - DNA, 25 bp, Homo sapien
tgcattgccttctgggttgtctcga

SEQ ID NO: 132373 - DNA, 25 bp, Homo sapien
gggttgtctcgatctgtgtttcaat

SEQ ID NO: 132374 - DNA, 25 bp, Homo sapien
caacctggaagccttggaggacttt

SEQ ID NO: 132375 - DNA, 25 bp, Homo sapien
acctggaagccttggaggactttga

SEQ ID NO: 132376 - DNA, 25 bp, Homo sapien
agaaagccgcaggagcccgcggact

SEQ ID NO: 132377 - DNA, 25 bp, Homo sapien
cgcggactcagcacggagagcatcc

SEQ ID NO: 132378 - DNA, 25 bp, Homo sapien
atcctcatccccaggcagagcgaaa

SEQ ID NO: 132379 - DNA, 25 bp, Homo sapien
atccccaggcagagcgaaacctgct

SEQ ID NO: 132380 - DNA, 25 bp, Homo sapien
aggggacaccttggctcctcagcag

SEQ ID NO: 132381 - DNA, 25 bp, Homo sapien
agcacctccgtcattcacagggaca

SEQ ID NO: 132382 - DNA, 25 bp, Homo sapien
acctccgtcattcacagggacatgg

SEQ ID NO: 132383 - DNA, 25 bp, Homo sapien
tccgtcattcacagggacatggaaa

SEQ ID NO: 132384 - DNA, 25 bp, Homo sapien
acatggaaaaagctccccacccctg

SEQ ID NO: 132385 - DNA, 25 bp, Homo sapien
aagaaccagtacaagattgactact

SEQ ID NO: 132386 - DNA, 25 bp, Homo sapien
gcacttccacaagacctatgaggtg

SEQ ID NO: 132387 - DNA, 25 bp, Homo sapien
ttccacaagacctatgaggtgccct

SEQ ID NO: 132388 - DNA, 25 bp, Homo sapien
acaagacctatgaggtgccctctac

SEQ ID NO: 132389 - DNA, 25 bp, Homo sapien
tggccttcctgagccgtgacgagga

SEQ ID NO: 132390 - DNA, 25 bp, Homo sapien
caggccaggcatgactttgacagac

SEQ ID NO: 132391 - DNA, 25 bp, Homo sapien
gccaggcatgactttgacagactcc

SEQ ID NO: 132392 - DNA, 25 bp, Homo sapien
ggcatgactttgacagactccaggc

SEQ ID NO: 132393 - DNA, 25 bp, Homo sapien
atgactttgacagactccaggctgg

SEQ ID NO: 132394 - DNA, 25 bp, Homo sapien
agcagcggccctacagacgggagtc

SEQ ID NO: 132395 - DNA, 25 bp, Homo sapien
agcggccctacagacgggagtcaga

SEQ ID NO: 132396 - DNA, 25 bp, Homo sapien
cacctttcctcagactatttttcag

SEQ ID NO: 132397 - DNA, 25 bp, Homo sapien
acctttcctcagactatttttcagc

SEQ ID NO: 132398 - DNA, 25 bp, Homo sapien
ctttcctcagactatttttcagcct

SEQ ID NO: 132399 - DNA, 25 bp, Homo sapien
tatttttcagccttctggcatcagc

SEQ ID NO: 132400 - DNA, 25 bp, Homo sapien
atttttcagccttctggcatcagca

SEQ ID NO: 132401 - DNA, 25 bp, Homo sapien
ttttcagccttctggcatcagcaaa

SEQ ID NO: 132402 - DNA, 25 bp, Homo sapien
tttcagccttctggcatcagcaaac

SEQ ID NO: 132403 - DNA, 25 bp, Homo sapien
agccttctggcatcagcaaacctta

SEQ ID NO: 132404 - DNA, 25 bp, Homo sapien
ccttctggcatcagcaaaccttata

SEQ ID NO: 132405 - DNA, 25 bp, Homo sapien
tctggcatcagcaaaccttataaaa

SEQ ID NO: 132406 - DNA, 25 bp, Homo sapien
ggcatcagcaaaccttataaaattt

SEQ ID NO: 132407 - DNA, 25 bp, Homo sapien
agcagtgtgagcgactctgacgagc

SEQ ID NO: 132408 - DNA, 25 bp, Homo sapien
gcatgcagagcctcggcagtgatga

SEQ ID NO: 132409 - DNA, 25 bp, Homo sapien
agtgatgagggctattccagcacca

SEQ ID NO: 132410 - DNA, 25 bp, Homo sapien
ttccagcaccagcatcaagagaata

SEQ ID NO: 132411 - DNA, 25 bp, Homo sapien
aataaagctgcaggacagtcacaag

SEQ ID NO: 132412 - DNA, 25 bp, Homo sapien
tcacaaggcgtgtcttggtctctaa

SEQ ID NO: 132413 - DNA, 25 bp, Homo sapien
ctctaagagagtgggcactgcggct

SEQ ID NO: 132414 - DNA, 25 bp, Homo sapien
actgcggctgtctccttgaaggttc

SEQ ID NO: 132415 - DNA, 25 bp, Homo sapien
ctccttgaaggttctccctgttggt

SEQ ID NO: 132416 - DNA, 25 bp, Homo sapien
aacgtattggacctgcccacaactc

SEQ ID NO: 132417 - DNA, 25 bp, Homo sapien
aactcccttgcacgtaaacttcagt

SEQ ID NO: 132418 - DNA, 25 bp, Homo sapien
gacaagtcagagtatctagagatgg

SEQ ID NO: 132419 - DNA, 25 bp, Homo sapien
agttaaggaatctctgtgtgcaaag

SEQ ID NO: 132420 - DNA, 25 bp, Homo sapien
aggaatctctgtgtgcaaaggagga

SEQ ID NO: 132421 - DNA, 25 bp, Homo sapien
aacaactgttctaatgcaaaggctg

SEQ ID NO: 132422 - DNA, 25 bp, Homo sapien
atgcaaaggctgtggagactgatgt

SEQ ID NO: 132423 - DNA, 25 bp, Homo sapien
agactgatgtgtgaatctttttcca

SEQ ID NO: 132424 - DNA, 25 bp, Homo sapien
ttatgcatagagagtgcagttatga

SEQ ID NO: 132425 - DNA, 25 bp, Homo sapien
gatccaatgcatacagtagtacact

SEQ ID NO: 132426 - DNA, 25 bp, Homo sapien
agtagtacactatttaatggttata

SEQ ID NO: 132427 - DNA, 25 bp, Homo sapien
ggttatacatggcataattgttact

SEQ ID NO: 132428 - DNA, 25 bp, Homo sapien
tggcataattgttactaaacttgta

SEQ ID NO: 132429 - DNA, 25 bp, Homo sapien
caagaggctcgtgatggtcaaggtt

SEQ ID NO: 132430 - DNA, 25 bp, Homo sapien
gtgatggtcaaggttgtgcccacgt

SEQ ID NO: 132431 - DNA, 25 bp, Homo sapien
atggtcaaggttgtgcccacgtgcc

SEQ ID NO: 132432 - DNA, 25 bp, Homo sapien
aaggttgtgcccacgtgcctcaggg

SEQ ID NO: 132433 - DNA, 25 bp, Homo sapien
ccctggagaatactgtggacctgca

SEQ ID NO: 132434 - DNA, 25 bp, Homo sapien
ggagaatactgtggacctgcacatt

SEQ ID NO: 132435 - DNA, 25 bp, Homo sapien
atactgtggacctgcacatttccaa

SEQ ID NO: 132436 - DNA, 25 bp, Homo sapien
tgtggacctgcacatttccaacagc

SEQ ID NO: 132437 - DNA, 25 bp, Homo sapien
tggacctgcacatttccaacagcca

SEQ ID NO: 132438 - DNA, 25 bp, Homo sapien
gagagctgagccctcgctcctcatg

SEQ ID NO: 132439 - DNA, 25 bp, Homo sapien
tgagccctcgctcctcatggtgtgc

SEQ ID NO: 132440 - DNA, 25 bp, Homo sapien
tggtccaaacatgtaagacttctac

SEQ ID NO: 132441 - DNA, 25 bp, Homo sapien
agacttctaccctaatcagtatcct

SEQ ID NO: 132442 - DNA, 25 bp, Homo sapien
ccctaatcagtatccttcagctttt

SEQ ID NO: 132443 - DNA, 25 bp, Homo sapien
tttacattaacccagtgtcctctga

SEQ ID NO: 132444 - DNA, 25 bp, Homo sapien
aggtgagtcttgtggtagccactcc

SEQ ID NO: 132445 - DNA, 25 bp, Homo sapien
tagccactccaggatcctgattggg

SEQ ID NO: 132446 - DNA, 25 bp, Homo sapien
cagatgccctctggaatggttagca

SEQ ID NO: 132447 - DNA, 25 bp, Homo sapien
gttagcatccaaggtgacagtgact

SEQ ID NO: 132448 - DNA, 25 bp, Homo sapien
tgcattgaggcgctctattcttctt

SEQ ID NO: 132449 - DNA, 25 bp, Homo sapien
tattcttcttcacctctcaggaact

SEQ ID NO: 132450 - DNA, 25 bp, Homo sapien
ttcacctctcaggaactgactttta

SEQ ID NO: 132451 - DNA, 25 bp, Homo sapien
taaaaactagagcacagaaggaata

SEQ ID NO: 132452 - DNA, 25 bp, Homo sapien
aaactagagcacagaaggaataagg

SEQ ID NO: 132453 - DNA, 25 bp, Homo sapien
gaaggaataaggtcatgaaatttaa

SEQ ID NO: 132454 - DNA, 25 bp, Homo sapien
aaaaggttaaatattgtcataggat

SEQ ID NO: 132455 - DNA, 25 bp, Homo sapien
aaatattgtcataggattaagcagt

SEQ ID NO: 132456 - DNA, 25 bp, Homo sapien
tattgtcataggattaagcagttta

SEQ ID NO: 132457 - DNA, 25 bp, Homo sapien
attgtcataggattaagcagtttaa

SEQ ID NO: 132458 - DNA, 25 bp, Homo sapien
agcagtttaaagattgttggatgaa

SEQ ID NO: 132459 - DNA, 25 bp, Homo sapien
agattgttggatgaaattatttgtc

SEQ ID NO: 132460 - DNA, 25 bp, Homo sapien
gatgaaattatttgtcattcattca

SEQ ID NO: 132461 - DNA, 25 bp, Homo sapien
tttgtcattcattcaagtaataaat

SEQ ID NO: 132462 - DNA, 25 bp, Homo sapien
gaaaacagcagcacatcgctggctt

SEQ ID NO: 132463 - DNA, 25 bp, Homo sapien
aacagcagcacatcgctggcttttc

SEQ ID NO: 132464 - DNA, 25 bp, Homo sapien
tggcttttccccttgtgttctgaga

SEQ ID NO: 132465 - DNA, 25 bp, Homo sapien
tttccccttgtgttctgagaataca

SEQ ID NO: 132466 - DNA, 25 bp, Homo sapien
tgttctgagaatacaccatcggctc

SEQ ID NO: 132467 - DNA, 25 bp, Homo sapien
tgagaatacaccatcggctcattcc

SEQ ID NO: 132468 - DNA, 25 bp, Homo sapien
agaatacaccatcggctcattccca

SEQ ID NO: 132469 - DNA, 25 bp, Homo sapien
ggctggggaatagacccattccttc

SEQ ID NO: 132470 - DNA, 25 bp, Homo sapien
ggagaagggccttgcttccctggaa

SEQ ID NO: 132471 - DNA, 25 bp, Homo sapien
ggccttgcttccctggaagaagcac

SEQ ID NO: 132472 - DNA, 25 bp, Homo sapien
aagaagcactgtgagactgttcccc

SEQ ID NO: 132473 - DNA, 25 bp, Homo sapien
gaacacaaataattgcttttcccac

SEQ ID NO: 132474 - DNA, 25 bp, Homo sapien
actccctgtcatagttaccgatggt

SEQ ID NO: 132475 - DNA, 25 bp, Homo sapien
ttaccgatggtgtcccgttgtgtgg

SEQ ID NO: 132476 - DNA, 25 bp, Homo sapien
ttgtgtgggtttactctgtgctaag

SEQ ID NO: 132477 - DNA, 25 bp, Homo sapien
gtgctaagttgtcttacacttctca

SEQ ID NO: 132478 - DNA, 25 bp, Homo sapien
acacttctcaaatgctactcagtat

SEQ ID NO: 132479 - DNA, 25 bp, Homo sapien
gtatatagccttaactcttactgtt

SEQ ID NO: 132480 - DNA, 25 bp, Homo sapien
tcttactgttttgtgcggtgtgtct

SEQ ID NO: 132481 - DNA, 25 bp, Homo sapien
tccttttgtatcctccattgtatct

SEQ ID NO: 132482 - DNA, 25 bp, Homo sapien
gtatcctccattgtatcttcataca

SEQ ID NO: 132483 - DNA, 25 bp, Homo sapien
tcatacaaaggacagtacacacttg

SEQ ID NO: 132484 - DNA, 25 bp, Homo sapien
ggccctgcccttctggaacgaggag

SEQ ID NO: 132485 - DNA, 25 bp, Homo sapien
gaacgaggagattgttccccagatc

SEQ ID NO: 132486 - DNA, 25 bp, Homo sapien
cgaggagattgttccccagatcaag

SEQ ID NO: 132487 - DNA, 25 bp, Homo sapien
ttccccagatcaaggccggcaagcg

SEQ ID NO: 132488 - DNA, 25 bp, Homo sapien
gcaagcgagtgctcattgcagccca

SEQ ID NO: 132489 - DNA, 25 bp, Homo sapien
gagtgctcattgcagcccacgggaa

SEQ ID NO: 132490 - DNA, 25 bp, Homo sapien
tcattgcagcccacgggaacagcct

SEQ ID NO: 132491 - DNA, 25 bp, Homo sapien
aagggatgtcagaccaggcgatcat

SEQ ID NO: 132492 - DNA, 25 bp, Homo sapien
agaccaggcgatcatggagctgaac

SEQ ID NO: 132493 - DNA, 25 bp, Homo sapien
gggatccccattgtgtatgagctga

SEQ ID NO: 132494 - DNA, 25 bp, Homo sapien
atccccattgtgtatgagctgaaca

SEQ ID NO: 132495 - DNA, 25 bp, Homo sapien
gatgtagtttttacccaggttctat

SEQ ID NO: 132496 - DNA, 25 bp, Homo sapien
acccaggttctatccaaatctatgt

SEQ ID NO: 132497 - DNA, 25 bp, Homo sapien
ctatgtgggcatgagttgggttata

SEQ ID NO: 132498 - DNA, 25 bp, Homo sapien
ttgggttataactggatcctactat

SEQ ID NO: 132499 - DNA, 25 bp, Homo sapien
gatcctactatcattgtggctttgg

SEQ ID NO: 132500 - DNA, 25 bp, Homo sapien
ggaaacactacatttgctcacagat

SEQ ID NO: 132501 - DNA, 25 bp, Homo sapien
ttgctcacagatgattcttctgatt

SEQ ID NO: 132502 - DNA, 25 bp, Homo sapien
tctgattcttctgaatgctcccgaa

SEQ ID NO: 132503 - DNA, 25 bp, Homo sapien
tgctcccgaactactgactttgaag

SEQ ID NO: 132504 - DNA, 25 bp, Homo sapien
actttgaagaggtagcctcctgcct

SEQ ID NO: 132505 - DNA, 25 bp, Homo sapien
agcaggaatgtcatgttccagttca

SEQ ID NO: 132506 - DNA, 25 bp, Homo sapien
agcagttaccgagcgaggcactcac

SEQ ID NO: 132507 - DNA, 25 bp, Homo sapien
gttaccgagcgaggcactcactggg

SEQ ID NO: 132508 - DNA, 25 bp, Homo sapien
cgagcgaggcactcactgggcagca

SEQ ID NO: 132509 - DNA, 25 bp, Homo sapien
gtgggtcacagcaaaaggaccagat

SEQ ID NO: 132510 - DNA, 25 bp, Homo sapien
accagatgctggtgtggtccgaagc

SEQ ID NO: 132511 - DNA, 25 bp, Homo sapien
tggtccgaagccactttctcagaga

SEQ ID NO: 132512 - DNA, 25 bp, Homo sapien
gaagccactttctcagagacacttt

SEQ ID NO: 132513 - DNA, 25 bp, Homo sapien
tttctcagagacactttaatcattg

SEQ ID NO: 132514 - DNA, 25 bp, Homo sapien
atcattgagtatttgtacacttttc

SEQ ID NO: 132515 - DNA, 25 bp, Homo sapien
aacatatataaagggcattctctac

SEQ ID NO: 132516 - DNA, 25 bp, Homo sapien
taaagggcattctctacaaatgtgc

SEQ ID NO: 132517 - DNA, 25 bp, Homo sapien
aagggaaatgcaggcacggcctcca

SEQ ID NO: 132518 - DNA, 25 bp, Homo sapien
aattgactattttgacgtccaggac

SEQ ID NO: 132519 - DNA, 25 bp, Homo sapien
gacgtccaggactaagaagatcatg

SEQ ID NO: 132520 - DNA, 25 bp, Homo sapien
ggactaagaagatcatgatgcactt

SEQ ID NO: 132521 - DNA, 25 bp, Homo sapien
agacttatttgccagcagataaatc

SEQ ID NO: 132522 - DNA, 25 bp, Homo sapien
atttgccagcagataaatcatgccc

SEQ ID NO: 132523 - DNA, 25 bp, Homo sapien
tctgcctggcagaatcacagtctca

SEQ ID NO: 132524 - DNA, 25 bp, Homo sapien
tggcagaatcacagtctcacatact

SEQ ID NO: 132525 - DNA, 25 bp, Homo sapien
cagtctcacatactgtcttgtactg

SEQ ID NO: 132526 - DNA, 25 bp, Homo sapien
actgtcttgtactgacacatccaaa

SEQ ID NO: 132527 - DNA, 25 bp, Homo sapien
acatccaaagcatgagtgtgtcaga

SEQ ID NO: 132528 - DNA, 25 bp, Homo sapien
gctgtgactgaagtcggctttcccg

SEQ ID NO: 132529 - DNA, 25 bp, Homo sapien
tgtgactgaagtcggctttcccgtt

SEQ ID NO: 132530 - DNA, 25 bp, Homo sapien
gactgaagtcggctttcccgttgat

SEQ ID NO: 132531 - DNA, 25 bp, Homo sapien
tgaagtcggctttcccgttgatgtc

SEQ ID NO: 132532 - DNA, 25 bp, Homo sapien
gtaggtagggacacgtgtccatgca

SEQ ID NO: 132533 - DNA, 25 bp, Homo sapien
ggtagggacacgtgtccatgcacca

SEQ ID NO: 132534 - DNA, 25 bp, Homo sapien
gggacacgtgtccatgcaccacaga

SEQ ID NO: 132535 - DNA, 25 bp, Homo sapien
gacacgtgtccatgcaccacagaca

SEQ ID NO: 132536 - DNA, 25 bp, Homo sapien
acagacacacccacgacacctgatc

SEQ ID NO: 132537 - DNA, 25 bp, Homo sapien
tcgtatcactagcttgcggccaggt

SEQ ID NO: 132538 - DNA, 25 bp, Homo sapien
cgtatcactagcttgcggccaggtc

SEQ ID NO: 132539 - DNA, 25 bp, Homo sapien
tgtttcctgaaaccatgatgtactt

SEQ ID NO: 132540 - DNA, 25 bp, Homo sapien
ttcctgaaaccatgatgtacttttt

SEQ ID NO: 132541 - DNA, 25 bp, Homo sapien
gtactttttcatacatgagtctgtc

SEQ ID NO: 132542 - DNA, 25 bp, Homo sapien
ttttcatacatgagtctgtccagag

SEQ ID NO: 132543 - DNA, 25 bp, Homo sapien
ttcatacatgagtctgtccagagtg

SEQ ID NO: 132544 - DNA, 25 bp, Homo sapien
catacatgagtctgtccagagtgct

SEQ ID NO: 132545 - DNA, 25 bp, Homo sapien
cagagtgcttgctaccgtgttcgga

SEQ ID NO: 132546 - DNA, 25 bp, Homo sapien
agagtgcttgctaccgtgttcggag

SEQ ID NO: 132547 - DNA, 25 bp, Homo sapien
gtgcttgctaccgtgttcggagtct

SEQ ID NO: 132548 - DNA, 25 bp, Homo sapien
ttgctaccgtgttcggagtctcgct

SEQ ID NO: 132549 - DNA, 25 bp, Homo sapien
taccgtgttcggagtctcgctgcct

SEQ ID NO: 132550 - DNA, 25 bp, Homo sapien
taggacatgtctatgattgttcaaa

SEQ ID NO: 132551 - DNA, 25 bp, Homo sapien
ggacatgtctatgattgttcaaaaa

SEQ ID NO: 132552 - DNA, 25 bp, Homo sapien
atatgttaaatttaggctcagcaca

SEQ ID NO: 132553 - DNA, 25 bp, Homo sapien
atgttaaatttaggctcagcacagt

SEQ ID NO: 132554 - DNA, 25 bp, Homo sapien
aaatttaggctcagcacagtagctc

SEQ ID NO: 132555 - DNA, 25 bp, Homo sapien
atttaggctcagcacagtagctcac

SEQ ID NO: 132556 - DNA, 25 bp, Homo sapien
gatggtgcatgccttttaaacccag

SEQ ID NO: 132557 - DNA, 25 bp, Homo sapien
atggtgcatgccttttaaacccagc

SEQ ID NO: 132558 - DNA, 25 bp, Homo sapien
catgccttttaaacccagctactga

SEQ ID NO: 132559 - DNA, 25 bp, Homo sapien
atgccttttaaacccagctactgag

SEQ ID NO: 132560 - DNA, 25 bp, Homo sapien
gccttttaaacccagctactgagga

SEQ ID NO: 132561 - DNA, 25 bp, Homo sapien
tgccatggccacgactgttgttaca

SEQ ID NO: 132562 - DNA, 25 bp, Homo sapien
gactgttgttacactcgagctgagg

SEQ ID NO: 132563 - DNA, 25 bp, Homo sapien
ttacactcgagctgaggaggccggc

SEQ ID NO: 132564 - DNA, 25 bp, Homo sapien
aagaactgttgtgcaagtgtgacca

SEQ ID NO: 132565 - DNA, 25 bp, Homo sapien
gtgaccaggagattgctaactgctt

SEQ ID NO: 132566 - DNA, 25 bp, Homo sapien
aactgcttagcccaaactgagtaca

SEQ ID NO: 132567 - DNA, 25 bp, Homo sapien
gagtacaacttaaagtacctcttct

SEQ ID NO: 132568 - DNA, 25 bp, Homo sapien
agttcctatgtgagccggactcgcc

SEQ ID NO: 132569 - DNA, 25 bp, Homo sapien
ggactcgcccaagtgtgactgacta

SEQ ID NO: 132570 - DNA, 25 bp, Homo sapien
gactgactaccttgacttgaaatgc

SEQ ID NO: 132571 - DNA, 25 bp, Homo sapien
gaaatgctcttttgcacaaggaaat

SEQ ID NO: 132572 - DNA, 25 bp, Homo sapien
aaatcacagattggtaaatgctata

SEQ ID NO: 132573 - DNA, 25 bp, Homo sapien
aggattgagattaatactgtagtat

SEQ ID NO: 132574 - DNA, 25 bp, Homo sapien
ggacattataacagattccatattt

SEQ ID NO: 132575 - DNA, 25 bp, Homo sapien
tttcctaaaatctaaattcagtctt

SEQ ID NO: 132576 - DNA, 25 bp, Homo sapien
gaaataatattagccaaatggtgga

SEQ ID NO: 132577 - DNA, 25 bp, Homo sapien
gccaaatggtggaactaatttattt

SEQ ID NO: 132578 - DNA, 25 bp, Homo sapien
aattcccagttgtatattcatcacc

SEQ ID NO: 132579 - DNA, 25 bp, Homo sapien
gttgtatattcatcacctttgtagc

SEQ ID NO: 132580 - DNA, 25 bp, Homo sapien
attcatcacctttgtagcatttgac

SEQ ID NO: 132581 - DNA, 25 bp, Homo sapien
ttgacaaattttatgcttagcagct

SEQ ID NO: 132582 - DNA, 25 bp, Homo sapien
tttatgcttagcagcttcttcactg

SEQ ID NO: 132583 - DNA, 25 bp, Homo sapien
ccaacctctttgcacagtgagcagc

SEQ ID NO: 132584 - DNA, 25 bp, Homo sapien
caacctctttgcacagtgagcagca

SEQ ID NO: 132585 - DNA, 25 bp, Homo sapien
acgtcctccccgaagggtcagcagt

SEQ ID NO: 132586 - DNA, 25 bp, Homo sapien
cccgaagggtcagcagtctgtctga

SEQ ID NO: 132587 - DNA, 25 bp, Homo sapien
atgccccggcactgaagtcgggaca

SEQ ID NO: 132588 - DNA, 25 bp, Homo sapien
ccccggcactgaagtcgggacacaa

SEQ ID NO: 132589 - DNA, 25 bp, Homo sapien
cccggcactgaagtcgggacacaat

SEQ ID NO: 132590 - DNA, 25 bp, Homo sapien
ccggcactgaagtcgggacacaatc

SEQ ID NO: 132591 - DNA, 25 bp, Homo sapien
cactgaagtcgggacacaatcagct

SEQ ID NO: 132592 - DNA, 25 bp, Homo sapien
actgaagtcgggacacaatcagctt

SEQ ID NO: 132593 - DNA, 25 bp, Homo sapien
ctgaagtcgggacacaatcagcttt

SEQ ID NO: 132594 - DNA, 25 bp, Homo sapien
attgtcatctcctatatccacgtgg

SEQ ID NO: 132595 - DNA, 25 bp, Homo sapien
atctcctatatccacgtggcagctg

SEQ ID NO: 132596 - DNA, 25 bp, Homo sapien
tgcagtcctgcgaattcgctctgta

SEQ ID NO: 132597 - DNA, 25 bp, Homo sapien
gaattcgctctgtagagggcaggaa

SEQ ID NO: 132598 - DNA, 25 bp, Homo sapien
ccatattctatggttcaggtatctt

SEQ ID NO: 132599 - DNA, 25 bp, Homo sapien
gtatctttaactatatgcgactggg

SEQ ID NO: 132600 - DNA, 25 bp, Homo sapien
aactatatgcgactgggttcaacca

SEQ ID NO: 132601 - DNA, 25 bp, Homo sapien
ctgggttcaaccaagctttcagaca

SEQ ID NO: 132602 - DNA, 25 bp, Homo sapien
atcaatcccatgctgaacccaatca

SEQ ID NO: 132603 - DNA, 25 bp, Homo sapien
gaacccaatcatctacagcttcaga

SEQ ID NO: 132604 - DNA, 25 bp, Homo sapien
gagtgccatctggaggatgctcaca

SEQ ID NO: 132605 - DNA, 25 bp, Homo sapien
accaccaagaaggaaaagcagacgg

SEQ ID NO: 132606 - DNA, 25 bp, Homo sapien
aaagcagacggcgaatattttgtca

SEQ ID NO: 132607 - DNA, 25 bp, Homo sapien
agcagacggcgaatattttgtcagc

SEQ ID NO: 132608 - DNA, 25 bp, Homo sapien
gcagacggcgaatattttgtcagct

SEQ ID NO: 132609 - DNA, 25 bp, Homo sapien
cagacggcgaatattttgtcagcta

SEQ ID NO: 132610 - DNA, 25 bp, Homo sapien
gacggcgaatattttgtcagctaat

SEQ ID NO: 132611 - DNA, 25 bp, Homo sapien
acggcgaatattttgtcagctaatg

SEQ ID NO: 132612 - DNA, 25 bp, Homo sapien
cggcgaatattttgtcagctaatgc

SEQ ID NO: 132613 - DNA, 25 bp, Homo sapien
ggcgaatattttgtcagctaatgca

SEQ ID NO: 132614 - DNA, 25 bp, Homo sapien
gcgaatattttgtcagctaatgcac

SEQ ID NO: 132615 - DNA, 25 bp, Homo sapien
cgaatattttgtcagctaatgcacc

SEQ ID NO: 132616 - DNA, 25 bp, Homo sapien
agttgattattttctgctacagacc

SEQ ID NO: 132617 - DNA, 25 bp, Homo sapien
ttttctgctacagacctggtacact

SEQ ID NO: 132618 - DNA, 25 bp, Homo sapien
gctacagacctggtacactctgatt

SEQ ID NO: 132619 - DNA, 25 bp, Homo sapien
gacctggtacactctgattttagat

SEQ ID NO: 132620 - DNA, 25 bp, Homo sapien
aggccagtgttgtgggcttcctgct

SEQ ID NO: 132621 - DNA, 25 bp, Homo sapien
agaaggctcacgaagggcatccgca

SEQ ID NO: 132622 - DNA, 25 bp, Homo sapien
agggcatccgcaatgttggtttcac

SEQ ID NO: 132623 - DNA, 25 bp, Homo sapien
cgcaatgttggtttcactgagagct

SEQ ID NO: 132624 - DNA, 25 bp, Homo sapien
gctgcttttaaaataagatctcttt

SEQ ID NO: 132625 - DNA, 25 bp, Homo sapien
aataagatctctttgtagccatcct

SEQ ID NO: 132626 - DNA, 25 bp, Homo sapien
gtagccatcctgttaaatttgtaaa

SEQ ID NO: 132627 - DNA, 25 bp, Homo sapien
gaagacggtgaagaattagatacag

SEQ ID NO: 132628 - DNA, 25 bp, Homo sapien
acaatctaaatccaaaaccaccaag

SEQ ID NO: 132629 - DNA, 25 bp, Homo sapien
tggagaattcctccttacctcaagc

SEQ ID NO: 132630 - DNA, 25 bp, Homo sapien
gagaattcctccttacctcaagcag

SEQ ID NO: 132631 - DNA, 25 bp, Homo sapien
gaattcctccttacctcaagcagat

SEQ ID NO: 132632 - DNA, 25 bp, Homo sapien
attcctccttacctcaagcagatga

SEQ ID NO: 132633 - DNA, 25 bp, Homo sapien
ttcctccttacctcaagcagatgag

SEQ ID NO: 132634 - DNA, 25 bp, Homo sapien
cctccttacctcaagcagatgagat

SEQ ID NO: 132635 - DNA, 25 bp, Homo sapien
tccttacctcaagcagatgagattc

SEQ ID NO: 132636 - DNA, 25 bp, Homo sapien
tacctcaagcagatgagattcaggt

SEQ ID NO: 132637 - DNA, 25 bp, Homo sapien
caagcagatgagattcaggtaattg

SEQ ID NO: 132638 - DNA, 25 bp, Homo sapien
ctttttgtcacaccaaaatcaaggg

SEQ ID NO: 132639 - DNA, 25 bp, Homo sapien
aaagtaacatcaacactgtcccatc

SEQ ID NO: 132640 - DNA, 25 bp, Homo sapien
agtaacatcaacactgtcccatcct

SEQ ID NO: 132641 - DNA, 25 bp, Homo sapien
agccctgaactagctaccatctgat

SEQ ID NO: 132642 - DNA, 25 bp, Homo sapien
tgaactagctaccatctgatcccct

SEQ ID NO: 132643 - DNA, 25 bp, Homo sapien
gatcccctcagacattctcaggatt

SEQ ID NO: 132644 - DNA, 25 bp, Homo sapien
cccctcagacattctcaggatttta

SEQ ID NO: 132645 - DNA, 25 bp, Homo sapien
caggattttacaagactgtcagagt

SEQ ID NO: 132646 - DNA, 25 bp, Homo sapien
tcccattaaagatccgggcaggact

SEQ ID NO: 132647 - DNA, 25 bp, Homo sapien
gggctagttctctcctcacttgtaa

SEQ ID NO: 132648 - DNA, 25 bp, Homo sapien
gtaaacttgtgtagtttcacagaaa

SEQ ID NO: 132649 - DNA, 25 bp, Homo sapien
ttaactccttaataaacagattctc

SEQ ID NO: 132650 - DNA, 25 bp, Homo sapien
ggagtttggcttccagtccccaaag

SEQ ID NO: 132651 - DNA, 25 bp, Homo sapien
ttggcttccagtccccaaagaaggt

SEQ ID NO: 132652 - DNA, 25 bp, Homo sapien
gtgaacccctaaaattgtagcaact

SEQ ID NO: 132653 - DNA, 25 bp, Homo sapien
gtagcaactttgaaaggttagtgtt

SEQ ID NO: 132654 - DNA, 25 bp, Homo sapien
tagtgttttatttacctgacaaatg

SEQ ID NO: 132655 - DNA, 25 bp, Homo sapien
tctaataatgttaagcaccagtaat

SEQ ID NO: 132656 - DNA, 25 bp, Homo sapien
atagtattttgtacaaatgcctgta

SEQ ID NO: 132657 - DNA, 25 bp, Homo sapien
atgcctgtactgtagatgtctgtat

SEQ ID NO: 132658 - DNA, 25 bp, Homo sapien
gggcaactcaggattttaagttcca

SEQ ID NO: 132659 - DNA, 25 bp, Homo sapien
ccataaagtattgaaccaactctaa

SEQ ID NO: 132660 - DNA, 25 bp, Homo sapien
tgtctatattagacacccccagcca

SEQ ID NO: 132661 - DNA, 25 bp, Homo sapien
tctatattagacacccccagccagt

SEQ ID NO: 132662 - DNA, 25 bp, Homo sapien
ctatattagacacccccagccagtt

SEQ ID NO: 132663 - DNA, 25 bp, Homo sapien
ttgctgccatgttttttacaagaag

SEQ ID NO: 132664 - DNA, 25 bp, Homo sapien
tgctgccatgttttttacaagaagg

SEQ ID NO: 132665 - DNA, 25 bp, Homo sapien
gctgccatgttttttacaagaagga

SEQ ID NO: 132666 - DNA, 25 bp, Homo sapien
ctgccatgttttttacaagaaggaa

SEQ ID NO: 132667 - DNA, 25 bp, Homo sapien
gggagggaatatttgagggagggct

SEQ ID NO: 132668 - DNA, 25 bp, Homo sapien
gggctgggtcttagggaaaggaatg

SEQ ID NO: 132669 - DNA, 25 bp, Homo sapien
gggaagcaacatttttattaagtgt

SEQ ID NO: 132670 - DNA, 25 bp, Homo sapien
ttgttcagaaatggcaaatacaata

SEQ ID NO: 132671 - DNA, 25 bp, Homo sapien
tattctgtgccatactattgttaaa

SEQ ID NO: 132672 - DNA, 25 bp, Homo sapien
gaactgttgctattgtgagatggat

SEQ ID NO: 132673 - DNA, 25 bp, Homo sapien
agggtttctttcgaatggcactact

SEQ ID NO: 132674 - DNA, 25 bp, Homo sapien
atggcactactttagggacattcta

SEQ ID NO: 132675 - DNA, 25 bp, Homo sapien
gtatttgcttctattgtttgggcct

SEQ ID NO: 132676 - DNA, 25 bp, Homo sapien
gtttgggccttgtggataatgtaca

SEQ ID NO: 132677 - DNA, 25 bp, Homo sapien
gttgctgatttgtccatttctttcc

SEQ ID NO: 132678 - DNA, 25 bp, Homo sapien
atttctttccctgcactttgttaca

SEQ ID NO: 132679 - DNA, 25 bp, Homo sapien
tttccctgcactttgttacatctgg

SEQ ID NO: 132680 - DNA, 25 bp, Homo sapien
atctgggatacagtctaactcatct

SEQ ID NO: 132681 - DNA, 25 bp, Homo sapien
atgccataactattaaacaccttgt

SEQ ID NO: 132682 - DNA, 25 bp, Homo sapien
tcagacagcaaggtttcgataggaa

SEQ ID NO: 132683 - DNA, 25 bp, Homo sapien
gcaaggtttcgataggaacatgctg

SEQ ID NO: 132684 - DNA, 25 bp, Homo sapien
gaacatgctgggaaccttagctggg

SEQ ID NO: 132685 - DNA, 25 bp, Homo sapien
aggaacttcacctcccgattctaag

SEQ ID NO: 132686 - DNA, 25 bp, Homo sapien
ttcacctcccgattctaagaagaga

SEQ ID NO: 132687 - DNA, 25 bp, Homo sapien
gattctaagaagagactgtccaagc

SEQ ID NO: 132688 - DNA, 25 bp, Homo sapien
gagactgtccaagcaagttaggctt

SEQ ID NO: 132689 - DNA, 25 bp, Homo sapien
gcaggaagatatgacccagctgaga

SEQ ID NO: 132690 - DNA, 25 bp, Homo sapien
tgagaagccctcaggcctcgctgga

SEQ ID NO: 132691 - DNA, 25 bp, Homo sapien
cctgtgcagtatttgggaaagttca

SEQ ID NO: 132692 - DNA, 25 bp, Homo sapien
gaaacctaaaaactgtggatagtgg

SEQ ID NO: 132693 - DNA, 25 bp, Homo sapien
aatcactgcttgttccacttgttgt

SEQ ID NO: 132694 - DNA, 25 bp, Homo sapien
gcttgttccacttgttgtacatttt

SEQ ID NO: 132695 - DNA, 25 bp, Homo sapien
gcagaaatgtgctactaatggatgt

SEQ ID NO: 132696 - DNA, 25 bp, Homo sapien
gctactaatggatgtctgagtcacc

SEQ ID NO: 132697 - DNA, 25 bp, Homo sapien
ctgagtcaccagaaattccattctt

SEQ ID NO: 132698 - DNA, 25 bp, Homo sapien
cattcttaaagaggcggttagcacc

SEQ ID NO: 132699 - DNA, 25 bp, Homo sapien
ggcggttagcacctattagacgtaa

SEQ ID NO: 132700 - DNA, 25 bp, Homo sapien
agacgtaacagtgatgtcttttaaa

SEQ ID NO: 132701 - DNA, 25 bp, Homo sapien
taagtttgagactttgtgtgaacaa

SEQ ID NO: 132702 - DNA, 25 bp, Homo sapien
gggaaattcagcctcttatgtcttt

SEQ ID NO: 132703 - DNA, 25 bp, Homo sapien
tcagcctcttatgtctttgtcttta

SEQ ID NO: 132704 - DNA, 25 bp, Homo sapien
acatcccaacccacttcgggagaag

SEQ ID NO: 132705 - DNA, 25 bp, Homo sapien
tagatgccgaccctggctttgtgca

SEQ ID NO: 132706 - DNA, 25 bp, Homo sapien
gaccctggctttgtgcactcagatg

SEQ ID NO: 132707 - DNA, 25 bp, Homo sapien
ggctttgtgcactcagatggcacca

SEQ ID NO: 132708 - DNA, 25 bp, Homo sapien
ttgtgcactcagatggcaccatcag

SEQ ID NO: 132709 - DNA, 25 bp, Homo sapien
gcaccatcagccatcatgacatgta

SEQ ID NO: 132710 - DNA, 25 bp, Homo sapien
tgacatgtatgattacctgcatctg

SEQ ID NO: 132711 - DNA, 25 bp, Homo sapien
gtatgattacctgcatctgagccgc

SEQ ID NO: 132712 - DNA, 25 bp, Homo sapien
attacctgcatctgagccgcctggg

SEQ ID NO: 132713 - DNA, 25 bp, Homo sapien
tgggctacacacctgtttgccgggc

SEQ ID NO: 132714 - DNA, 25 bp, Homo sapien
tgtttgccgggctctgcactccctg

SEQ ID NO: 132715 - DNA, 25 bp, Homo sapien
ataaaaggaggttttcctgatgtgg

SEQ ID NO: 132716 - DNA, 25 bp, Homo sapien
ggtgtaaagaaaacagattccaaga

SEQ ID NO: 132717 - DNA, 25 bp, Homo sapien
ttttgtggtgcttgaggcatattca

SEQ ID NO: 132718 - DNA, 25 bp, Homo sapien
tgtggtgcttgaggcatattcatat

SEQ ID NO: 132719 - DNA, 25 bp, Homo sapien
gcttgaggcatattcatataaccaa

SEQ ID NO: 132720 - DNA, 25 bp, Homo sapien
ggcatattcatataaccaaagtttg

SEQ ID NO: 132721 - DNA, 25 bp, Homo sapien
tttgagaactgggaacttcatgctg

SEQ ID NO: 132722 - DNA, 25 bp, Homo sapien
catattgaagtttctctggtattca

SEQ ID NO: 132723 - DNA, 25 bp, Homo sapien
gaagtttctctggtattcaaaggtt

SEQ ID NO: 132724 - DNA, 25 bp, Homo sapien
gtttctctggtattcaaaggttata

SEQ ID NO: 132725 - DNA, 25 bp, Homo sapien
ctctggtattcaaaggttatatagt

SEQ ID NO: 132726 - DNA, 25 bp, Homo sapien
gccaaacctgtgtaggcattttata

SEQ ID NO: 132727 - DNA, 25 bp, Homo sapien
gcattttataagctacatgttctaa

SEQ ID NO: 132728 - DNA, 25 bp, Homo sapien
catgttctaatttttaccgatgtta

SEQ ID NO: 132729 - DNA, 25 bp, Homo sapien
gaaatgcacagatctgcttgatcaa

SEQ ID NO: 132730 - DNA, 25 bp, Homo sapien
gcttgatcaattcccttgaataggg

SEQ ID NO: 132731 - DNA, 25 bp, Homo sapien
tagggaagtaacatttgccttaaat

SEQ ID NO: 132732 - DNA, 25 bp, Homo sapien
ttcgacctcgtctttctccatattg

SEQ ID NO: 132733 - DNA, 25 bp, Homo sapien
atattgtcctgctcccctgtttgac

SEQ ID NO: 132734 - DNA, 25 bp, Homo sapien
tgtttgacgacagtgcatttgcctt

SEQ ID NO: 132735 - DNA, 25 bp, Homo sapien
agtgcatttgccttgtcacctgtga

SEQ ID NO: 132736 - DNA, 25 bp, Homo sapien
gtcacctgtgagctggagagaaccc

SEQ ID NO: 132737 - DNA, 25 bp, Homo sapien
ggaaacaaagcagctcttttagatc

SEQ ID NO: 132738 - DNA, 25 bp, Homo sapien
aaattagagagggtgctcagctaaa

SEQ ID NO: 132739 - DNA, 25 bp, Homo sapien
gagcagaacagtcggccagtgtcct

SEQ ID NO: 132740 - DNA, 25 bp, Homo sapien
agtgtcctgctctggacgagatgca

SEQ ID NO: 132741 - DNA, 25 bp, Homo sapien
gacgagatgcactgttagaccagat

SEQ ID NO: 132742 - DNA, 25 bp, Homo sapien
tgttagaccagatacgacagggtat

SEQ ID NO: 132743 - DNA, 25 bp, Homo sapien
tacgacagggtatccaactaaaatc

SEQ ID NO: 132744 - DNA, 25 bp, Homo sapien
taaaatctgtggctgatggccaaga

SEQ ID NO: 132745 - DNA, 25 bp, Homo sapien
gatggccaagagtctacaccaccaa

SEQ ID NO: 132746 - DNA, 25 bp, Homo sapien
acctgcacccacttcaggaattgtg

SEQ ID NO: 132747 - DNA, 25 bp, Homo sapien
caggaattgtgggtgcattaatgga

SEQ ID NO: 132748 - DNA, 25 bp, Homo sapien
accagtgattcgagctatatttaag

SEQ ID NO: 132749 - DNA, 25 bp, Homo sapien
tttaagtattcaagaaagccagtct

SEQ ID NO: 132750 - DNA, 25 bp, Homo sapien
agaaagccagtcttaacatttctaa

SEQ ID NO: 132751 - DNA, 25 bp, Homo sapien
tttctaactctgatgtaaatgaagt

SEQ ID NO: 132752 - DNA, 25 bp, Homo sapien
gaaatgcacaatgtcttggtacttg

SEQ ID NO: 132753 - DNA, 25 bp, Homo sapien
caatgtcttggtacttgctgctatt

SEQ ID NO: 132754 - DNA, 25 bp, Homo sapien
gtcttggtacttgctgctattttac

SEQ ID NO: 132755 - DNA, 25 bp, Homo sapien
gttttaaggcttcaatttattgcac

SEQ ID NO: 132756 - DNA, 25 bp, Homo sapien
attttatgtatgtttacactgtcaa

SEQ ID NO: 132757 - DNA, 25 bp, Homo sapien
gtttacactgtcaaacatctggaaa

SEQ ID NO: 132758 - DNA, 25 bp, Homo sapien
tctggaaaataaaaggtctatgctc

SEQ ID NO: 132759 - DNA, 25 bp, Homo sapien
gtgatcatttcctatgtgctgatta

SEQ ID NO: 132760 - DNA, 25 bp, Homo sapien
catttcctatgtgctgattatcaga

SEQ ID NO: 132761 - DNA, 25 bp, Homo sapien
gattatcagagccatcctcagaata

SEQ ID NO: 132762 - DNA, 25 bp, Homo sapien
ctcagaataccctcagtctctaaga

SEQ ID NO: 132763 - DNA, 25 bp, Homo sapien
gaataccctcagtctctaagaaata

SEQ ID NO: 132764 - DNA, 25 bp, Homo sapien
atttgggtgcagtctccctcttcta

SEQ ID NO: 132765 - DNA, 25 bp, Homo sapien
cctcttctatgggacactttgtatg

SEQ ID NO: 132766 - DNA, 25 bp, Homo sapien
atgggacactttgtatggtatacct

SEQ ID NO: 132767 - DNA, 25 bp, Homo sapien
gtatggtatacctaaagcccctcca

SEQ ID NO: 132768 - DNA, 25 bp, Homo sapien
tggtgacacccatgatgaatccctt

SEQ ID NO: 132769 - DNA, 25 bp, Homo sapien
gggctctgggaagactcctagataa

SEQ ID NO: 132770 - DNA, 25 bp, Homo sapien
cagcaatggggctgacctctccggg

SEQ ID NO: 132771 - DNA, 25 bp, Homo sapien
aggccgtgcataaggctgtgctgac

SEQ ID NO: 132772 - DNA, 25 bp, Homo sapien
ggccgtgcataaggctgtgctgacc

SEQ ID NO: 132773 - DNA, 25 bp, Homo sapien
ccgtgcataaggctgtgctgaccat

SEQ ID NO: 132774 - DNA, 25 bp, Homo sapien
cgtgcataaggctgtgctgaccatc

SEQ ID NO: 132775 - DNA, 25 bp, Homo sapien
gtgcataaggctgtgctgaccatcg

SEQ ID NO: 132776 - DNA, 25 bp, Homo sapien
tgcataaggctgtgctgaccatcga

SEQ ID NO: 132777 - DNA, 25 bp, Homo sapien
tgaacaaaataccaagtctcccctc

SEQ ID NO: 132778 - DNA, 25 bp, Homo sapien
gaacaaaataccaagtctcccctct

SEQ ID NO: 132779 - DNA, 25 bp, Homo sapien
aaaaataactgcctctcgctcctca

SEQ ID NO: 132780 - DNA, 25 bp, Homo sapien
aaaataactgcctctcgctcctcaa

SEQ ID NO: 132781 - DNA, 25 bp, Homo sapien
ataaaaggaggttttcctgatgtgg

SEQ ID NO: 132782 - DNA, 25 bp, Homo sapien
ggtgtaaagaaaacagattccaaga

SEQ ID NO: 132783 - DNA, 25 bp, Homo sapien
aggactaatgtttcttttgtggtgc

SEQ ID NO: 132784 - DNA, 25 bp, Homo sapien
tttgtggtgcttgaggcatattcat

SEQ ID NO: 132785 - DNA, 25 bp, Homo sapien
gcttgaggcatattcatataaccaa

SEQ ID NO: 132786 - DNA, 25 bp, Homo sapien
ggcatattcatataaccaaagtttg

SEQ ID NO: 132787 - DNA, 25 bp, Homo sapien
tttgagaactgggaacttcatgctg

SEQ ID NO: 132788 - DNA, 25 bp, Homo sapien
gggaacttcatgctgatttgtacat

SEQ ID NO: 132789 - DNA, 25 bp, Homo sapien
catattgaagtttctctggtattca

SEQ ID NO: 132790 - DNA, 25 bp, Homo sapien
gaagtttctctggtattcaaaggtt

SEQ ID NO: 132791 - DNA, 25 bp, Homo sapien
gtttctctggtattcaaaggttata

SEQ ID NO: 132792 - DNA, 25 bp, Homo sapien
gcgagcctgtcgagaagcacagcat

SEQ ID NO: 132793 - DNA, 25 bp, Homo sapien
gtaatgtgaggttaccctatgtctg

SEQ ID NO: 132794 - DNA, 25 bp, Homo sapien
atgtctgcaagttcactgactagtg

SEQ ID NO: 132795 - DNA, 25 bp, Homo sapien
agcagcctgtgtttggtgtgcaact

SEQ ID NO: 132796 - DNA, 25 bp, Homo sapien
ctgtgtttggtgtgcaactcatcat

SEQ ID NO: 132797 - DNA, 25 bp, Homo sapien
ggtgtgcaactcatcatgggcatga

SEQ ID NO: 132798 - DNA, 25 bp, Homo sapien
gaagagaatattcgcttaattcccc

SEQ ID NO: 132799 - DNA, 25 bp, Homo sapien
ctgaccacctcattcttatctttct

SEQ ID NO: 132800 - DNA, 25 bp, Homo sapien
cgctgtcatttcagtctcttcattt

SEQ ID NO: 132801 - DNA, 25 bp, Homo sapien
gtcatttcagtctcttcattttgtc

SEQ ID NO: 132802 - DNA, 25 bp, Homo sapien
cttcattttgtcatacggcctaagg

SEQ ID NO: 132803 - DNA, 25 bp, Homo sapien
aggtcagtggccgtgctgtgttgcg

SEQ ID NO: 132804 - DNA, 25 bp, Homo sapien
tggtggccacagcagagtcctgctc

SEQ ID NO: 132805 - DNA, 25 bp, Homo sapien
ggccacagcagagtcctgctctggg

SEQ ID NO: 132806 - DNA, 25 bp, Homo sapien
tctggggacgcctgcttcatttaca

SEQ ID NO: 132807 - DNA, 25 bp, Homo sapien
tgcttcatttacaagcctcaagatg

SEQ ID NO: 132808 - DNA, 25 bp, Homo sapien
acaagcctcaagatggctctgtgta

SEQ ID NO: 132809 - DNA, 25 bp, Homo sapien
ctcaagatggctctgtgtagggcct

SEQ ID NO: 132810 - DNA, 25 bp, Homo sapien
atggctctgtgtagggcctgagctt

SEQ ID NO: 132811 - DNA, 25 bp, Homo sapien
gctgcccaacgggaggatggcttca

SEQ ID NO: 132812 - DNA, 25 bp, Homo sapien
caacgggaggatggcttcacagcag

SEQ ID NO: 132813 - DNA, 25 bp, Homo sapien
gaggatggcttcacagcagagccag

SEQ ID NO: 132814 - DNA, 25 bp, Homo sapien
aagaccatggcaggtatggcccatc

SEQ ID NO: 132815 - DNA, 25 bp, Homo sapien
atggcccatctcctgtacgcttgga

SEQ ID NO: 132816 - DNA, 25 bp, Homo sapien
tacgcttggagcgacctttggctac

SEQ ID NO: 132817 - DNA, 25 bp, Homo sapien
gacctttggctacgtggctggcctt

SEQ ID NO: 132818 - DNA, 25 bp, Homo sapien
tggctggccttgttatttcaccact

SEQ ID NO: 132819 - DNA, 25 bp, Homo sapien
atttcaccactctggatatactgga

SEQ ID NO: 132820 - DNA, 25 bp, Homo sapien
gggagatatttctttgtgcagattc

SEQ ID NO: 132821 - DNA, 25 bp, Homo sapien
tgtatggtcaaagccaagcagttcc

SEQ ID NO: 132822 - DNA, 25 bp, Homo sapien
aagcagttccatttacagctctgtt

SEQ ID NO: 132823 - DNA, 25 bp, Homo sapien
cagctctgttttttacgtagttaca

SEQ ID NO: 132824 - DNA, 25 bp, Homo sapien
taaactatgaaacccctgagagatt

SEQ ID NO: 132825 - DNA, 25 bp, Homo sapien
aagagtatctttgttttcactcatg

SEQ ID NO: 132826 - DNA, 25 bp, Homo sapien
atctttgttttcactcatgtacttg

SEQ ID NO: 132827 - DNA, 25 bp, Homo sapien
gttttcactcatgtacttgtacctg

SEQ ID NO: 132828 - DNA, 25 bp, Homo sapien
actcatgtacttgtacctgtctgga

SEQ ID NO: 132829 - DNA, 25 bp, Homo sapien
catgtacttgtacctgtctggatta

SEQ ID NO: 132830 - DNA, 25 bp, Homo sapien
gtacttgtacctgtctggattattc

SEQ ID NO: 132831 - DNA, 25 bp, Homo sapien
tgtacctgtctggattattcattat

SEQ ID NO: 132832 - DNA, 25 bp, Homo sapien
acctgtctggattattcattattac

SEQ ID NO: 132833 - DNA, 25 bp, Homo sapien
gtttctgaaaaaccatatggcatag

SEQ ID NO: 132834 - DNA, 25 bp, Homo sapien
gaaaagaagtccagaatattccctg

SEQ ID NO: 132835 - DNA, 25 bp, Homo sapien
agaagtccagaatattccctggtga

SEQ ID NO: 132836 - DNA, 25 bp, Homo sapien
agaattcacacaactactttcatga

SEQ ID NO: 132837 - DNA, 25 bp, Homo sapien
aacattattccaagagtatcccagt

SEQ ID NO: 132838 - DNA, 25 bp, Homo sapien
agagtatcccagtattagcaatact

SEQ ID NO: 132839 - DNA, 25 bp, Homo sapien
tagcaatactggaatataggcacat

SEQ ID NO: 132840 - DNA, 25 bp, Homo sapien
atataggcacattaccattcatagt

SEQ ID NO: 132841 - DNA, 25 bp, Homo sapien
gaattctggtgtttacacaaccaaa

SEQ ID NO: 132842 - DNA, 25 bp, Homo sapien
caaatttgatgcgatctgctcagta

SEQ ID NO: 132843 - DNA, 25 bp, Homo sapien
tttgatgcgatctgctcagtaatat

SEQ ID NO: 132844 - DNA, 25 bp, Homo sapien
catgtgatgtcatgaaactgtacat

SEQ ID NO: 132845 - DNA, 25 bp, Homo sapien
gaaactgtacatactgcagtgtgaa

SEQ ID NO: 132846 - DNA, 25 bp, Homo sapien
tacttcctgcagtgaatttgaataa

SEQ ID NO: 132847 - DNA, 25 bp, Homo sapien
atgaccatgccgtccagcatgggcc

SEQ ID NO: 132848 - DNA, 25 bp, Homo sapien
atgccgtccagcatgggcccaggcg

SEQ ID NO: 132849 - DNA, 25 bp, Homo sapien
aactcgggcctcaacaacatcaaca

SEQ ID NO: 132850 - DNA, 25 bp, Homo sapien
aactcggccatgtcgccgggcgctt

SEQ ID NO: 132851 - DNA, 25 bp, Homo sapien
taccgggacacgtgcaactcgagcc

SEQ ID NO: 132852 - DNA, 25 bp, Homo sapien
cgggacacgtgcaactcgagcctag

SEQ ID NO: 132853 - DNA, 25 bp, Homo sapien
tcaagtccaaacagcactcgtcgtt

SEQ ID NO: 132854 - DNA, 25 bp, Homo sapien
aaacagcactcgtcgtttggctacg

SEQ ID NO: 132855 - DNA, 25 bp, Homo sapien
cagcactcgtcgtttggctacggcg

SEQ ID NO: 132856 - DNA, 25 bp, Homo sapien
ggcctcaacgcgtgccagtacaaca

SEQ ID NO: 132857 - DNA, 25 bp, Homo sapien
aacgcgtgccagtacaacagctgac

SEQ ID NO: 132858 - DNA, 25 bp, Homo sapien
gccaagtggccattcttctgttcaa

SEQ ID NO: 132859 - DNA, 25 bp, Homo sapien
cacccagtgatccatccagaaacaa

SEQ ID NO: 132860 - DNA, 25 bp, Homo sapien
acaaggactgcagcctaaattccaa

SEQ ID NO: 132861 - DNA, 25 bp, Homo sapien
gagactgaaattttcagccttgcta

SEQ ID NO: 132862 - DNA, 25 bp, Homo sapien
gccttgctaagggaacatctcgatg

SEQ ID NO: 132863 - DNA, 25 bp, Homo sapien
acatctcgatgtttgaacctttgtt

SEQ ID NO: 132864 - DNA, 25 bp, Homo sapien
ttgtacagggcattctctgtactag

SEQ ID NO: 132865 - DNA, 25 bp, Homo sapien
tctgtactagtttgtcgtggttata

SEQ ID NO: 132866 - DNA, 25 bp, Homo sapien
tagcagaatagcctacatttgtatt

SEQ ID NO: 132867 - DNA, 25 bp, Homo sapien
tattttctattccatacttctgccc

SEQ ID NO: 132868 - DNA, 25 bp, Homo sapien
attccatacttctgcccacgttgtt

SEQ ID NO: 132869 - DNA, 25 bp, Homo sapien
gagagtagtctgaagattcctgtgt

SEQ ID NO: 132870 - DNA, 25 bp, Homo sapien
gtctgaagattcctgtgtaaaagca

SEQ ID NO: 132871 - DNA, 25 bp, Homo sapien
aagattcctgtgtaaaagcaaagct

SEQ ID NO: 132872 - DNA, 25 bp, Homo sapien
gacatgaagcaaaatactaatctaa

SEQ ID NO: 132873 - DNA, 25 bp, Homo sapien
aataagttctttctgcttgctgcta

SEQ ID NO: 132874 - DNA, 25 bp, Homo sapien
aagttctttctgcttgctgctaaga

SEQ ID NO: 132875 - DNA, 25 bp, Homo sapien
tctgcttgctgctaagagtttgcta

SEQ ID NO: 132876 - DNA, 25 bp, Homo sapien
gctgctaagagtttgctaaagtgtc

SEQ ID NO: 132877 - DNA, 25 bp, Homo sapien
gctaaagtgtcatgaattattctgg

SEQ ID NO: 132878 - DNA, 25 bp, Homo sapien
tattctggttattactaaagtttct

SEQ ID NO: 132879 - DNA, 25 bp, Homo sapien
atgtttctggaaaaggactatgtta

SEQ ID NO: 132880 - DNA, 25 bp, Homo sapien
cttgaatggaaggtccgagtctttt

SEQ ID NO: 132881 - DNA, 25 bp, Homo sapien
tccgagtctttttagtgtttttgca

SEQ ID NO: 132882 - DNA, 25 bp, Homo sapien
gcaagggaatgaatccattattcta

SEQ ID NO: 132883 - DNA, 25 bp, Homo sapien
gcatctggctaaggcatcattttca

SEQ ID NO: 132884 - DNA, 25 bp, Homo sapien
atcattttcacctccatttcttggt

SEQ ID NO: 132885 - DNA, 25 bp, Homo sapien
acctccatttcttggttttgtattg

SEQ ID NO: 132886 - DNA, 25 bp, Homo sapien
atctctttcatctagctccataatt

SEQ ID NO: 132887 - DNA, 25 bp, Homo sapien
tcatctagctccataattgcaaggg

SEQ ID NO: 132888 - DNA, 25 bp, Homo sapien
aggtaatctgaaacacagtcatgtg

SEQ ID NO: 132889 - DNA, 25 bp, Homo sapien
gtagaaaggttgattctcatgcact

SEQ ID NO: 132890 - DNA, 25 bp, Homo sapien
aatacttccaaagagtcatcatggg

SEQ ID NO: 132891 - DNA, 25 bp, Homo sapien
atccaaggaaacatgcagctcttca

SEQ ID NO: 132892 - DNA, 25 bp, Homo sapien
agctcttcaacatgacatccagaga

SEQ ID NO: 132893 - DNA, 25 bp, Homo sapien
gagatgactattacttttctgttta

SEQ ID NO: 132894 - DNA, 25 bp, Homo sapien
tacactaggaacgtgttgtatctac

SEQ ID NO: 132895 - DNA, 25 bp, Homo sapien
aatgtttactaagtggactggtgtc

SEQ ID NO: 132896 - DNA, 25 bp, Homo sapien
ggactggtgtcataacttctccatt

SEQ ID NO: 132897 - DNA, 25 bp, Homo sapien
cttctccattagacacatgactcct

SEQ ID NO: 132898 - DNA, 25 bp, Homo sapien
gacacatgactccttccaatagaaa

SEQ ID NO: 132899 - DNA, 25 bp, Homo sapien
gaaaactcccaatacaaagatgact

SEQ ID NO: 132900 - DNA, 25 bp, Homo sapien
cctcatagccctcagacatttatat

SEQ ID NO: 132901 - DNA, 25 bp, Homo sapien
atatattggaagctgctgaggcccc

SEQ ID NO: 132902 - DNA, 25 bp, Homo sapien
tgacaacttgttccccgcagtgcac

SEQ ID NO: 132903 - DNA, 25 bp, Homo sapien
ccgcagtgcacacctagaatgctgt

SEQ ID NO: 132904 - DNA, 25 bp, Homo sapien
tagaatgctgtgttcccacgcggca

SEQ ID NO: 132905 - DNA, 25 bp, Homo sapien
gcacgtgagatgcattgccgcttct

SEQ ID NO: 132906 - DNA, 25 bp, Homo sapien
tgcattgccgcttctgtctgtgttg

SEQ ID NO: 132907 - DNA, 25 bp, Homo sapien
ctgctgccagtgtttggacagaacc

SEQ ID NO: 132908 - DNA, 25 bp, Homo sapien
tggacagaacccaaattctttattt

SEQ ID NO: 132909 - DNA, 25 bp, Homo sapien
tattgtgctttacctgtattaacag

SEQ ID NO: 132910 - DNA, 25 bp, Homo sapien
acctgttttgtatacctgagagcct

SEQ ID NO: 132911 - DNA, 25 bp, Homo sapien
ttgtatacctgagagcctgctatgt

SEQ ID NO: 132912 - DNA, 25 bp, Homo sapien
agcctgctatgttcttcttttgttg

SEQ ID NO: 132913 - DNA, 25 bp, Homo sapien
ctctcctttgcttgaagccagaggt

SEQ ID NO: 132914 - DNA, 25 bp, Homo sapien
aggtcagtggccgtgctgtgttgcg

SEQ ID NO: 132915 - DNA, 25 bp, Homo sapien
tggtggccacagcagagtcctgctc

SEQ ID NO: 132916 - DNA, 25 bp, Homo sapien
ggccacagcagagtcctgctctggg

SEQ ID NO: 132917 - DNA, 25 bp, Homo sapien
tgcttcatttacaagcctcaagatg

SEQ ID NO: 132918 - DNA, 25 bp, Homo sapien
acaagcctcaagatggctctgtgta

SEQ ID NO: 132919 - DNA, 25 bp, Homo sapien
atggctctgtgtagggcctgagctt

SEQ ID NO: 132920 - DNA, 25 bp, Homo sapien
gctgcccaacgggaggatggcttca

SEQ ID NO: 132921 - DNA, 25 bp, Homo sapien
caacgggaggatggcttcacagcag

SEQ ID NO: 132922 - DNA, 25 bp, Homo sapien
gaggatggcttcacagcagagccag

SEQ ID NO: 132923 - DNA, 25 bp, Homo sapien
agggcttgcttgagccaaactgcaa

SEQ ID NO: 132924 - DNA, 25 bp, Homo sapien
ggatgtaaataaccccattctttgc

SEQ ID NO: 132925 - DNA, 25 bp, Homo sapien
aataaccccattctttgcttgaaca

SEQ ID NO: 132926 - DNA, 25 bp, Homo sapien
cccattctttgcttgaacacagtat

SEQ ID NO: 132927 - DNA, 25 bp, Homo sapien
ttcccaatagcactttcattgccag

SEQ ID NO: 132928 - DNA, 25 bp, Homo sapien
agcactttcattgccagtgtctttc

SEQ ID NO: 132929 - DNA, 25 bp, Homo sapien
tttctttggtgcctttcctgttcag

SEQ ID NO: 132930 - DNA, 25 bp, Homo sapien
gtgcctttcctgttcagcattctta

SEQ ID NO: 132931 - DNA, 25 bp, Homo sapien
ttcagcattcttagcctgtggcaat

SEQ ID NO: 132932 - DNA, 25 bp, Homo sapien
gagaaactttgtgctacatgacgac

SEQ ID NO: 132933 - DNA, 25 bp, Homo sapien
gtgctacatgacgacaaagctgcta

SEQ ID NO: 132934 - DNA, 25 bp, Homo sapien
gacaaagctgctaaatctcctattt

SEQ ID NO: 132935 - DNA, 25 bp, Homo sapien
attctctacgcctttcttgatgaaa

SEQ ID NO: 132936 - DNA, 25 bp, Homo sapien
tcaagcggtgtttccgggacttctg

SEQ ID NO: 132937 - DNA, 25 bp, Homo sapien
ggcagagcactagcagagtccgaaa

SEQ ID NO: 132938 - DNA, 25 bp, Homo sapien
cgaaatacagttcaggatcctgctt

SEQ ID NO: 132939 - DNA, 25 bp, Homo sapien
aggatcctgcttacctgagggacat

SEQ ID NO: 132940 - DNA, 25 bp, Homo sapien
cttacctgagggacatcgatgggat

SEQ ID NO: 132941 - DNA, 25 bp, Homo sapien
gcggttttcgtcgtctgctggactc

SEQ ID NO: 132942 - DNA, 25 bp, Homo sapien
cacatattcatcctggtggaggctc

SEQ ID NO: 132943 - DNA, 25 bp, Homo sapien
tctccagctattacttctgcatcgc

SEQ ID NO: 132944 - DNA, 25 bp, Homo sapien
atcgccttaggctataccaacagta

SEQ ID NO: 132945 - DNA, 25 bp, Homo sapien
aacagtagcctgaatcccattctct

SEQ ID NO: 132946 - DNA, 25 bp, Homo sapien
ggtcaagctacattagagagctcat

SEQ ID NO: 132947 - DNA, 25 bp, Homo sapien
gagagctcatcaaggcaattggttt

SEQ ID NO: 132948 - DNA, 25 bp, Homo sapien
aggagttgtgtcgagctcacagcgt

SEQ ID NO: 132949 - DNA, 25 bp, Homo sapien
gctcacagcgtttctatcaacttac

SEQ ID NO: 132950 - DNA, 25 bp, Homo sapien
aaaacttcttgataacttgcatgat

SEQ ID NO: 132951 - DNA, 25 bp, Homo sapien
aacttgcatgatcttgtcaaacaac

SEQ ID NO: 132952 - DNA, 25 bp, Homo sapien
aaacaacttcatctgtactgcttga

SEQ ID NO: 132953 - DNA, 25 bp, Homo sapien
cagtcccgggcactgagtgttgaat

SEQ ID NO: 132954 - DNA, 25 bp, Homo sapien
ggcactgagtgttgaatttccagaa

SEQ ID NO: 132955 - DNA, 25 bp, Homo sapien
atgatgtctgaagttattgctgcac

SEQ ID NO: 132956 - DNA, 25 bp, Homo sapien
attgctgcacaattacccaagatat

SEQ ID NO: 132957 - DNA, 25 bp, Homo sapien
gattttatacatagtcacccccatg

SEQ ID NO: 132958 - DNA, 25 bp, Homo sapien
ccccatggtgggttgtcatatattc

SEQ ID NO: 132959 - DNA, 25 bp, Homo sapien
atgtaataaatctgagcctaaatct

SEQ ID NO: 132960 - DNA, 25 bp, Homo sapien
gcctaaatctaatcaggttgttaat

SEQ ID NO: 132961 - DNA, 25 bp, Homo sapien
gtagtcaattagtacagtagcttaa

SEQ ID NO: 132962 - DNA, 25 bp, Homo sapien
atgcagtccagaataagtgctgttt

SEQ ID NO: 132963 - DNA, 25 bp, Homo sapien
aagtgctgtttgagatgtgatgctg

SEQ ID NO: 132964 - DNA, 25 bp, Homo sapien
ctggtaccactggaatcgatctgta

SEQ ID NO: 132965 - DNA, 25 bp, Homo sapien
cactggaatcgatctgtactgtaat

SEQ ID NO: 132966 - DNA, 25 bp, Homo sapien
aattttgtttgtaatcctgtatatt

SEQ ID NO: 132967 - DNA, 25 bp, Homo sapien
tcctgtatattatggtgtaatgcac

SEQ ID NO: 132968 - DNA, 25 bp, Homo sapien
attggcaagattctggaccccaggg

SEQ ID NO: 132969 - DNA, 25 bp, Homo sapien
ggcccctaatatcccagtttaatat

SEQ ID NO: 132970 - DNA, 25 bp, Homo sapien
atatcccagtttaatattccaatac

SEQ ID NO: 132971 - DNA, 25 bp, Homo sapien
aaacccgagggacagcagattccac

SEQ ID NO: 132972 - DNA, 25 bp, Homo sapien
gagggacagcagattccacaggaca

SEQ ID NO: 132973 - DNA, 25 bp, Homo sapien
gacagcagattccacaggacacgaa

SEQ ID NO: 132974 - DNA, 25 bp, Homo sapien
gcagattccacaggacacgaaggct

SEQ ID NO: 132975 - DNA, 25 bp, Homo sapien
ggacacgaaggctgcccctgtaagg

SEQ ID NO: 132976 - DNA, 25 bp, Homo sapien
gctgactcaggtggaacaccgggct

SEQ ID NO: 132977 - DNA, 25 bp, Homo sapien
accgggctggctttgagtggaacga

SEQ ID NO: 132978 - DNA, 25 bp, Homo sapien
tggactatcaccttaaccagccttt

SEQ ID NO: 132979 - DNA, 25 bp, Homo sapien
gaaaatttcttcagtatgaatctaa

SEQ ID NO: 132980 - DNA, 25 bp, Homo sapien
gaggccatgaaacatgtgtactttc

SEQ ID NO: 132981 - DNA, 25 bp, Homo sapien
catgtgtactttcgaagtctgggac

SEQ ID NO: 132982 - DNA, 25 bp, Homo sapien
ccagaaagtgtatcaatattcagtt

SEQ ID NO: 132983 - DNA, 25 bp, Homo sapien
gattcagttgcaaaaggacccgggt

SEQ ID NO: 132984 - DNA, 25 bp, Homo sapien
ggttttcgaaattcttcttatccag

SEQ ID NO: 132985 - DNA, 25 bp, Homo sapien
tcttatccagagacaggacatggga

SEQ ID NO: 132986 - DNA, 25 bp, Homo sapien
gaacagaagacagagcatgctcttt

SEQ ID NO: 132987 - DNA, 25 bp, Homo sapien
gataacatggtttcaagcccagccc

SEQ ID NO: 132988 - DNA, 25 bp, Homo sapien
ccagcctttcttaccaatcaaggac

SEQ ID NO: 132989 - DNA, 25 bp, Homo sapien
accaatcaaggactcagaactgaag

SEQ ID NO: 132990 - DNA, 25 bp, Homo sapien
tttttgcctccaagtttctaagcaa

SEQ ID NO: 132991 - DNA, 25 bp, Homo sapien
gcctccaagtttctaagcaatacat

SEQ ID NO: 132992 - DNA, 25 bp, Homo sapien
aagtttctaagcaatacattttggg

SEQ ID NO: 132993 - DNA, 25 bp, Homo sapien
ccagatcttagctggcaggtctggg

SEQ ID NO: 132994 - DNA, 25 bp, Homo sapien
ctgggggttttcagagccctatgtg

SEQ ID NO: 132995 - DNA, 25 bp, Homo sapien
gagtggattccttcagggcatggta

SEQ ID NO: 132996 - DNA, 25 bp, Homo sapien
tccttcagggcatggtacctttcta

SEQ ID NO: 132997 - DNA, 25 bp, Homo sapien
tcagggcatggtacctttctaggat

SEQ ID NO: 132998 - DNA, 25 bp, Homo sapien
gggcatggtacctttctaggatctg

SEQ ID NO: 132999 - DNA, 25 bp, Homo sapien
atggtacctttctaggatctgggaa

SEQ ID NO: 133000 - DNA, 25 bp, Homo sapien
tacctttctaggatctgggaatggg

SEQ ID NO: 133001 - DNA, 25 bp, Homo sapien
cagccctccagtgtactgagggtac

SEQ ID NO: 133002 - DNA, 25 bp, Homo sapien
gtactgagggtactggcctagccat

SEQ ID NO: 133003 - DNA, 25 bp, Homo sapien
actgagggtactggcctagccatgt

SEQ ID NO: 133004 - DNA, 25 bp, Homo sapien
agggtactggcctagccatgtggaa

SEQ ID NO: 133005 - DNA, 25 bp, Homo sapien
ggtactggcctagccatgtggaatt

SEQ ID NO: 133006 - DNA, 25 bp, Homo sapien
tggcctagccatgtggaattcccta

SEQ ID NO: 133007 - DNA, 25 bp, Homo sapien
agccatgtggaattccctaccctga

SEQ ID NO: 133008 - DNA, 25 bp, Homo sapien
gtggaattccctaccctgactcctt

SEQ ID NO: 133009 - DNA, 25 bp, Homo sapien
aaacccagggaaaagagctctcaat

SEQ ID NO: 133010 - DNA, 25 bp, Homo sapien
ggaaaagagctctcaattttttatt

SEQ ID NO: 133011 - DNA, 25 bp, Homo sapien
ttgaaataaagtccttagttagcca

SEQ ID NO: 133012 - DNA, 25 bp, Homo sapien
aaggcacagaggctgccgcagccac

SEQ ID NO: 133013 - DNA, 25 bp, Homo sapien
gccactgctgtggtcaggaattccc

SEQ ID NO: 133014 - DNA, 25 bp, Homo sapien
caggaattcccggtgcagcagaatg

SEQ ID NO: 133015 - DNA, 25 bp, Homo sapien
aatggagccaagattctgtgcagac

SEQ ID NO: 133016 - DNA, 25 bp, Homo sapien
aagattctgtgcagaccaccctttt

SEQ ID NO: 133017 - DNA, 25 bp, Homo sapien
ttttcttcatcaggcgccacaaaac

SEQ ID NO: 133018 - DNA, 25 bp, Homo sapien
caggttctcttctccgtaaagagga

SEQ ID NO: 133019 - DNA, 25 bp, Homo sapien
gagcaattgctgtacataccctcct

SEQ ID NO: 133020 - DNA, 25 bp, Homo sapien
atcttgccttaattaacattccctg

SEQ ID NO: 133021 - DNA, 25 bp, Homo sapien
ttaattaacattccctgtgacctag

SEQ ID NO: 133022 - DNA, 25 bp, Homo sapien
cctgtgacctagttggtgcagtggc

SEQ ID NO: 133023 - DNA, 25 bp, Homo sapien
gtgttccaggacaagtgttcactca

SEQ ID NO: 133024 - DNA, 25 bp, Homo sapien
aagtgttcactcacatctgtaaaaa

SEQ ID NO: 133025 - DNA, 25 bp, Homo sapien
tattggacaggaggacagtatttca

SEQ ID NO: 133026 - DNA, 25 bp, Homo sapien
aggttgacagtcatccacaaggcat

SEQ ID NO: 133027 - DNA, 25 bp, Homo sapien
gacagtcatccacaaggcatagcct

SEQ ID NO: 133028 - DNA, 25 bp, Homo sapien
aaggcatagcctccaagtatactct

SEQ ID NO: 133029 - DNA, 25 bp, Homo sapien
catagcctccaagtatactctcaaa

SEQ ID NO: 133030 - DNA, 25 bp, Homo sapien
tagaatgagggcctttagtttaaat

SEQ ID NO: 133031 - DNA, 25 bp, Homo sapien
gtcatggtggagaagactcttgctt

SEQ ID NO: 133032 - DNA, 25 bp, Homo sapien
agaagactcttgcttccaccaagtg

SEQ ID NO: 133033 - DNA, 25 bp, Homo sapien
tcttgcttccaccaagtgtttgaaa

SEQ ID NO: 133034 - DNA, 25 bp, Homo sapien
cacagagtctgtgtgtagccaggaa

SEQ ID NO: 133035 - DNA, 25 bp, Homo sapien
agtctgtgtgtagccaggaagcccc

SEQ ID NO: 133036 - DNA, 25 bp, Homo sapien
gtgtagccaggaagccccgctcagg

SEQ ID NO: 133037 - DNA, 25 bp, Homo sapien
ggcactggctgctctgtcttggtcc

SEQ ID NO: 133038 - DNA, 25 bp, Homo sapien
ggctgctctgtcttggtcctgttaa

SEQ ID NO: 133039 - DNA, 25 bp, Homo sapien
tctgtcttggtcctgttaaccctcc

SEQ ID NO: 133040 - DNA, 25 bp, Homo sapien
ttctttctcctttaacccaatggag

SEQ ID NO: 133041 - DNA, 25 bp, Homo sapien
aacccaatggagactttctgatgca

SEQ ID NO: 133042 - DNA, 25 bp, Homo sapien
ggagactttctgatgcatcgttttc

SEQ ID NO: 133043 - DNA, 25 bp, Homo sapien
ctgatgcatcgttttctttgctgtg

SEQ ID NO: 133044 - DNA, 25 bp, Homo sapien
tttgctgtgccaaagcaggtcagaa

SEQ ID NO: 133045 - DNA, 25 bp, Homo sapien
gagagtccccggaaagatgatgcaa

SEQ ID NO: 133046 - DNA, 25 bp, Homo sapien
gaaagccaaacaagagccggaggtg

SEQ ID NO: 133047 - DNA, 25 bp, Homo sapien
agccaaacaagagccggaggtgaac

SEQ ID NO: 133048 - DNA, 25 bp, Homo sapien
ggatgctgtcccgagtggaaatgaa

SEQ ID NO: 133049 - DNA, 25 bp, Homo sapien
atgaagtttcggaaaacatggagga

SEQ ID NO: 133050 - DNA, 25 bp, Homo sapien
ctgagaatcagctgaaacgcggagc

SEQ ID NO: 133051 - DNA, 25 bp, Homo sapien
gagaatcagctgaaacgcggagcag

SEQ ID NO: 133052 - DNA, 25 bp, Homo sapien
aatcagctgaaacgcggagcagcag

SEQ ID NO: 133053 - DNA, 25 bp, Homo sapien
aggctggagctacagttgaaagcac

SEQ ID NO: 133054 - DNA, 25 bp, Homo sapien
gctacagttgaaagcactgcatgtt

SEQ ID NO: 133055 - DNA, 25 bp, Homo sapien
ggcacagcctcctcccaagggaaag

SEQ ID NO: 133056 - DNA, 25 bp, Homo sapien
gtccagcctaatcaagtcaaatgga

SEQ ID NO: 133057 - DNA, 25 bp, Homo sapien
gtggcttaccaagatcacataccag

SEQ ID NO: 133058 - DNA, 25 bp, Homo sapien
accagagtctggagctgagctacct

SEQ ID NO: 133059 - DNA, 25 bp, Homo sapien
cacaggttggccagaaaaccctggt

SEQ ID NO: 133060 - DNA, 25 bp, Homo sapien
gtaatgagggctgagtttgcacagt

SEQ ID NO: 133061 - DNA, 25 bp, Homo sapien
ctgagtttgcacagtggtctggaat

SEQ ID NO: 133062 - DNA, 25 bp, Homo sapien
gtgccacggtggacttagctctgag

SEQ ID NO: 133063 - DNA, 25 bp, Homo sapien
tggacttagctctgaggagtacccc

SEQ ID NO: 133064 - DNA, 25 bp, Homo sapien
ccccagcccaagagatgaacatctg

SEQ ID NO: 133065 - DNA, 25 bp, Homo sapien
ggactaatatcatagacccatctgg

SEQ ID NO: 133066 - DNA, 25 bp, Homo sapien
ccatctggaggctcccatgggctag

SEQ ID NO: 133067 - DNA, 25 bp, Homo sapien
tttaatgtgtgcaaaagcccaaagg

SEQ ID NO: 133068 - DNA, 25 bp, Homo sapien
atgtgtgcaaaagcccaaaggttcc

SEQ ID NO: 133069 - DNA, 25 bp, Homo sapien
gtgcaaaagcccaaaggttcctaag

SEQ ID NO: 133070 - DNA, 25 bp, Homo sapien
gcccaaaggttcctaagcctggctg

SEQ ID NO: 133071 - DNA, 25 bp, Homo sapien
caaaggttcctaagcctggctgcaa

SEQ ID NO: 133072 - DNA, 25 bp, Homo sapien
agcctggctgcaaagaagaatcaac

SEQ ID NO: 133073 - DNA, 25 bp, Homo sapien
gaagaatcaacagggacacttttta

SEQ ID NO: 133074 - DNA, 25 bp, Homo sapien
ttaaaaacactcttatcagcctggg

SEQ ID NO: 133075 - DNA, 25 bp, Homo sapien
gtggaaactgcagagagtcatgatc

SEQ ID NO: 133076 - DNA, 25 bp, Homo sapien
gagagtcatgatcatgtccttacac

SEQ ID NO: 133077 - DNA, 25 bp, Homo sapien
gtcatgatcatgtccttacactcca

SEQ ID NO: 133078 - DNA, 25 bp, Homo sapien
caagagccagtcaaaggtccagtct

SEQ ID NO: 133079 - DNA, 25 bp, Homo sapien
agtcaaaggtccagtctccactaag

SEQ ID NO: 133080 - DNA, 25 bp, Homo sapien
aaggtccagtctccactaagcctgg

SEQ ID NO: 133081 - DNA, 25 bp, Homo sapien
tggctcctgccccattatcttgatc

SEQ ID NO: 133082 - DNA, 25 bp, Homo sapien
tgccccattatcttgatccggtgcg

SEQ ID NO: 133083 - DNA, 25 bp, Homo sapien
cattatcttgatccggtgcgccatg

SEQ ID NO: 133084 - DNA, 25 bp, Homo sapien
tcttgatccggtgcgccatgttgaa

SEQ ID NO: 133085 - DNA, 25 bp, Homo sapien
gatccggtgcgccatgttgaatccc

SEQ ID NO: 133086 - DNA, 25 bp, Homo sapien
ccctaaccgctgcttgaaagatact

SEQ ID NO: 133087 - DNA, 25 bp, Homo sapien
aagtgctgtgaaggctcttgcggga

SEQ ID NO: 133088 - DNA, 25 bp, Homo sapien
ctcttgcgggatggcctgtttcgtt

SEQ ID NO: 133089 - DNA, 25 bp, Homo sapien
caaatattaagtactcttgatacaa

SEQ ID NO: 133090 - DNA, 25 bp, Homo sapien
gtactcttgatacaaaatatacttt

SEQ ID NO: 133091 - DNA, 25 bp, Homo sapien
gcagcaaaataatagcctcggttct

SEQ ID NO: 133092 - DNA, 25 bp, Homo sapien
aaataatagcctcggttctatgcat

SEQ ID NO: 133093 - DNA, 25 bp, Homo sapien
aatagcctcggttctatgcatatat

SEQ ID NO: 133094 - DNA, 25 bp, Homo sapien
gcctcggttctatgcatatatggat

SEQ ID NO: 133095 - DNA, 25 bp, Homo sapien
ggttctatgcatatatggattgcta

SEQ ID NO: 133096 - DNA, 25 bp, Homo sapien
ttagagaaagtcacatttagggttt

SEQ ID NO: 133097 - DNA, 25 bp, Homo sapien
tggccagtaaaatagggtaaatcct

SEQ ID NO: 133098 - DNA, 25 bp, Homo sapien
aatctgtgtgtgtattgtgaagtgg

SEQ ID NO: 133099 - DNA, 25 bp, Homo sapien
gtataagaaatgactttgaaccact

SEQ ID NO: 133100 - DNA, 25 bp, Homo sapien
gctgaagtggcctctccatattcca

SEQ ID NO: 133101 - DNA, 25 bp, Homo sapien
tgaagtggcctctccatattccagc

SEQ ID NO: 133102 - DNA, 25 bp, Homo sapien
aagtggcctctccatattccagctg

SEQ ID NO: 133103 - DNA, 25 bp, Homo sapien
tattgcggggagacagctctctctc

SEQ ID NO: 133104 - DNA, 25 bp, Homo sapien
gatgggaggagagcctgaggcccaa

SEQ ID NO: 133105 - DNA, 25 bp, Homo sapien
agcctgaggcccaagcaggacccgg

SEQ ID NO: 133106 - DNA, 25 bp, Homo sapien
gaggttggtggaccatggagtccct

SEQ ID NO: 133107 - DNA, 25 bp, Homo sapien
gttctcagctgtaccctctgccgat

SEQ ID NO: 133108 - DNA, 25 bp, Homo sapien
agctgtaccctctgccgatggcatt

SEQ ID NO: 133109 - DNA, 25 bp, Homo sapien
gtaccctctgccgatggcatttgtg

SEQ ID NO: 133110 - DNA, 25 bp, Homo sapien
tctgccgatggcatttgtgtttttg

SEQ ID NO: 133111 - DNA, 25 bp, Homo sapien
agagagtccccggaaagatgatgca

SEQ ID NO: 133112 - DNA, 25 bp, Homo sapien
gagagtccccggaaagatgatgcaa

SEQ ID NO: 133113 - DNA, 25 bp, Homo sapien
gaaagccaaacaagagccggaggtg

SEQ ID NO: 133114 - DNA, 25 bp, Homo sapien
aaagccaaacaagagccggaggtga

SEQ ID NO: 133115 - DNA, 25 bp, Homo sapien
aagccaaacaagagccggaggtgaa

SEQ ID NO: 133116 - DNA, 25 bp, Homo sapien
agccaaacaagagccggaggtgaac

SEQ ID NO: 133117 - DNA, 25 bp, Homo sapien
agagccggaggtgaacggaggcagt

SEQ ID NO: 133118 - DNA, 25 bp, Homo sapien
atgaagtttcggaaaacatggagga

SEQ ID NO: 133119 - DNA, 25 bp, Homo sapien
tacagttgaaagcactgcatgttaa

SEQ ID NO: 133120 - DNA, 25 bp, Homo sapien
cagttgaaagcactgcatgttaaga

SEQ ID NO: 133121 - DNA, 25 bp, Homo sapien
agggaaagtgtttttgtatataatg

SEQ ID NO: 133122 - DNA, 25 bp, Homo sapien
ttggtgttctccacaagtggttgac

SEQ ID NO: 133123 - DNA, 25 bp, Homo sapien
gtggttgacatttgactgcttgttc

SEQ ID NO: 133124 - DNA, 25 bp, Homo sapien
gacatttgactgcttgttccaatta

SEQ ID NO: 133125 - DNA, 25 bp, Homo sapien
gactgcttgttccaattatgtatgg

SEQ ID NO: 133126 - DNA, 25 bp, Homo sapien
gtctttgacagtgtgggtcgttcct

SEQ ID NO: 133127 - DNA, 25 bp, Homo sapien
aattctgagtcattgcatcctctac

SEQ ID NO: 133128 - DNA, 25 bp, Homo sapien
agtcattgcatcctctaccagctgt

SEQ ID NO: 133129 - DNA, 25 bp, Homo sapien
taccagctgttaatccatcactctg

SEQ ID NO: 133130 - DNA, 25 bp, Homo sapien
agctgttaatccatcactctgaggg

SEQ ID NO: 133131 - DNA, 25 bp, Homo sapien
gggaggaaatgttgcattgctgttt

SEQ ID NO: 133132 - DNA, 25 bp, Homo sapien
ataattattaaaggcctgactcttt

SEQ ID NO: 133133 - DNA, 25 bp, Homo sapien
attatccttttatctcacaaataag

SEQ ID NO: 133134 - DNA, 25 bp, Homo sapien
gatagataatgcctttttggttttg

SEQ ID NO: 133135 - DNA, 25 bp, Homo sapien
ttggttttgtgtggtattcaactaa

SEQ ID NO: 133136 - DNA, 25 bp, Homo sapien
ttcaactaatacatggtttaaagtc

SEQ ID NO: 133137 - DNA, 25 bp, Homo sapien
gtttaaagtcacagccgtttgaata

SEQ ID NO: 133138 - DNA, 25 bp, Homo sapien
gtcacagccgtttgaatatatttta

SEQ ID NO: 133139 - DNA, 25 bp, Homo sapien
ttatcttggtagtacattttctccc

SEQ ID NO: 133140 - DNA, 25 bp, Homo sapien
ttggtagtacattttctcccttagg

SEQ ID NO: 133141 - DNA, 25 bp, Homo sapien
tggtagtacattttctcccttagga

SEQ ID NO: 133142 - DNA, 25 bp, Homo sapien
tctcccttaggaatatacatagtct

SEQ ID NO: 133143 - DNA, 25 bp, Homo sapien
acatagtctttgtttacatgagttc

SEQ ID NO: 133144 - DNA, 25 bp, Homo sapien
aagccataaaaaacctgcaacgtag

SEQ ID NO: 133145 - DNA, 25 bp, Homo sapien
aatgcagataccctgactagccagc

SEQ ID NO: 133146 - DNA, 25 bp, Homo sapien
ttttccaagatatgcaatggccttt

SEQ ID NO: 133147 - DNA, 25 bp, Homo sapien
aatggcctttgtgcctgcccaaagg

SEQ ID NO: 133148 - DNA, 25 bp, Homo sapien
tccagtgcatgaggaaccctctttc

SEQ ID NO: 133149 - DNA, 25 bp, Homo sapien
tctttcctccgctcagagatgctgc

SEQ ID NO: 133150 - DNA, 25 bp, Homo sapien
agatgctgcttcatttacccaggag

SEQ ID NO: 133151 - DNA, 25 bp, Homo sapien
gctgcttcatttacccaggaggtca

SEQ ID NO: 133152 - DNA, 25 bp, Homo sapien
acccaggaggtcatattctttatat

SEQ ID NO: 133153 - DNA, 25 bp, Homo sapien
tttttgttgcaaagtgtctctctag

SEQ ID NO: 133154 - DNA, 25 bp, Homo sapien
gtgtctctctagagaaactctatat

SEQ ID NO: 133155 - DNA, 25 bp, Homo sapien
ggctggagccaggtagctcagcact

SEQ ID NO: 133156 - DNA, 25 bp, Homo sapien
tagctcagcactgatgctcaccatg

SEQ ID NO: 133157 - DNA, 25 bp, Homo sapien
tcaccatggaggacttgctgcaggc

SEQ ID NO: 133158 - DNA, 25 bp, Homo sapien
tgcaaccctcagtcagtgagcagga

SEQ ID NO: 133159 - DNA, 25 bp, Homo sapien
ggagctgctccggtacaagcgcatc

SEQ ID NO: 133160 - DNA, 25 bp, Homo sapien
gcatccagcgcaagtttgctgcctg

SEQ ID NO: 133161 - DNA, 25 bp, Homo sapien
tgggacccgctcagcatggctgcag

SEQ ID NO: 133162 - DNA, 25 bp, Homo sapien
gcatggctgcaggtaccttgatagc

SEQ ID NO: 133163 - DNA, 25 bp, Homo sapien
ggtaccttgatagcccacagagaga

SEQ ID NO: 133164 - DNA, 25 bp, Homo sapien
tgctgcaaccactggaggcactcta

SEQ ID NO: 133165 - DNA, 25 bp, Homo sapien
gaggcactctagagatccaggtgca

SEQ ID NO: 133166 - DNA, 25 bp, Homo sapien
atcaagtggcttatcatgtatatcg

SEQ ID NO: 133167 - DNA, 25 bp, Homo sapien
ggcttatcatgtatatcgtgtactt

SEQ ID NO: 133168 - DNA, 25 bp, Homo sapien
gtgtgtgtataagctctgtaaaata

SEQ ID NO: 133169 - DNA, 25 bp, Homo sapien
gctctgtaaaatagcaatcacatta

SEQ ID NO: 133170 - DNA, 25 bp, Homo sapien
agcaatcacattatgaagctgcagt

SEQ ID NO: 133171 - DNA, 25 bp, Homo sapien
gaagctgcagtgatactacatttta

SEQ ID NO: 133172 - DNA, 25 bp, Homo sapien
gaagcagactatttattgtccatat

SEQ ID NO: 133173 - DNA, 25 bp, Homo sapien
gactatttattgtccatataccaga

SEQ ID NO: 133174 - DNA, 25 bp, Homo sapien
aattaaataatagtactgcagcttc

SEQ ID NO: 133175 - DNA, 25 bp, Homo sapien
ttcttgtggcctacagtgttatgtt

SEQ ID NO: 133176 - DNA, 25 bp, Homo sapien
gtggcctacagtgttatgtttgctg

SEQ ID NO: 133177 - DNA, 25 bp, Homo sapien
gggccttcttaactaaaatgctcac

SEQ ID NO: 133178 - DNA, 25 bp, Homo sapien
aaatgctcaccacttagcctgtttt

SEQ ID NO: 133179 - DNA, 25 bp, Homo sapien
aaatgacagatgattttgttcagga

SEQ ID NO: 133180 - DNA, 25 bp, Homo sapien
ttgttcaggaattttgctgtttttc

SEQ ID NO: 133181 - DNA, 25 bp, Homo sapien
gctgtttttcttagtgctaatacct

SEQ ID NO: 133182 - DNA, 25 bp, Homo sapien
ttagtgctaataccttgcctcttat

SEQ ID NO: 133183 - DNA, 25 bp, Homo sapien
cttgcctcttattcctgctacagca

SEQ ID NO: 133184 - DNA, 25 bp, Homo sapien
cagcagggtggtaatattggcattc

SEQ ID NO: 133185 - DNA, 25 bp, Homo sapien
attggcattctgattaaatactgtg

SEQ ID NO: 133186 - DNA, 25 bp, Homo sapien
attaaatactgtgccttaggagact

SEQ ID NO: 133187 - DNA, 25 bp, Homo sapien
atgtacaagtcctttcagtgatgag

SEQ ID NO: 133188 - DNA, 25 bp, Homo sapien
tccaagggagggtgcagccctcttg

SEQ ID NO: 133189 - DNA, 25 bp, Homo sapien
aagggagggtgcagccctcttgccc

SEQ ID NO: 133190 - DNA, 25 bp, Homo sapien
tctttgatccttctgagctccacct

SEQ ID NO: 133191 - DNA, 25 bp, Homo sapien
ttctgagctccacctctggtggctc

SEQ ID NO: 133192 - DNA, 25 bp, Homo sapien
tctggtggctcctcctaggaaacca

SEQ ID NO: 133193 - DNA, 25 bp, Homo sapien
gtggctcctcctaggaaaccagctc

SEQ ID NO: 133194 - DNA, 25 bp, Homo sapien
gaaaccagctcgtgggctgggaatg

SEQ ID NO: 133195 - DNA, 25 bp, Homo sapien
cctgcttccttcagtttgtaaagtc

SEQ ID NO: 133196 - DNA, 25 bp, Homo sapien
gcttccttcagtttgtaaagtcggt

SEQ ID NO: 133197 - DNA, 25 bp, Homo sapien
ccttcagtttgtaaagtcggtgatt

SEQ ID NO: 133198 - DNA, 25 bp, Homo sapien
taaagtcggtgattatatttttggg

SEQ ID NO: 133199 - DNA, 25 bp, Homo sapien
gcagtattctctgctacttctgaat

SEQ ID NO: 133200 - DNA, 25 bp, Homo sapien
ttctgaatctgttttgtcttcctaa

SEQ ID NO: 133201 - DNA, 25 bp, Homo sapien
gtcttcctaatctatcacaattgcc

SEQ ID NO: 133202 - DNA, 25 bp, Homo sapien
acaattgccacccatcgggttttgg

SEQ ID NO: 133203 - DNA, 25 bp, Homo sapien
tttgggtgtgtgttttcatagcgtg

SEQ ID NO: 133204 - DNA, 25 bp, Homo sapien
gttttcatagcgtggttactttcta

SEQ ID NO: 133205 - DNA, 25 bp, Homo sapien
gtacccagattctaagaacctggag

SEQ ID NO: 133206 - DNA, 25 bp, Homo sapien
aaggattagcagttcttagtaagtt

SEQ ID NO: 133207 - DNA, 25 bp, Homo sapien
tttactgtgtataggaacggtttgt

SEQ ID NO: 133208 - DNA, 25 bp, Homo sapien
gaacggtttgtatttcattacagct

SEQ ID NO: 133209 - DNA, 25 bp, Homo sapien
tacagctattcatcttttctacatt

SEQ ID NO: 133210 - DNA, 25 bp, Homo sapien
tttatgcaggaagagtagcactcac

SEQ ID NO: 133211 - DNA, 25 bp, Homo sapien
gtagcactcactgaatagttttaaa

SEQ ID NO: 133212 - DNA, 25 bp, Homo sapien
aaatgactgagtggtatgcttacaa

SEQ ID NO: 133213 - DNA, 25 bp, Homo sapien
gtatgcttacaattgtcatgtctag

SEQ ID NO: 133214 - DNA, 25 bp, Homo sapien
tttgagcttagaaaacccagttaga

SEQ ID NO: 133215 - DNA, 25 bp, Homo sapien
acccagttagatgcaatttggtcat

SEQ ID NO: 133216 - DNA, 25 bp, Homo sapien
attaataccatgacatcttgcttat

SEQ ID NO: 133217 - DNA, 25 bp, Homo sapien
aaatattccattgctctgtagttca

SEQ ID NO: 133218 - DNA, 25 bp, Homo sapien
tctgtagttcaaatctgttagcttt

SEQ ID NO: 133219 - DNA, 25 bp, Homo sapien
gaatatgagctgtctgtcatttacc

SEQ ID NO: 133220 - DNA, 25 bp, Homo sapien
agctgtctgtcatttacctacttct

SEQ ID NO: 133221 - DNA, 25 bp, Homo sapien
ggcccctaatatcccagtttaatat

SEQ ID NO: 133222 - DNA, 25 bp, Homo sapien
atatcccagtttaatattccaatac

SEQ ID NO: 133223 - DNA, 25 bp, Homo sapien
aaacccgagggacagcagattccac

SEQ ID NO: 133224 - DNA, 25 bp, Homo sapien
acccgagggacagcagattccacag

SEQ ID NO: 133225 - DNA, 25 bp, Homo sapien
agggacagcagattccacaggacac

SEQ ID NO: 133226 - DNA, 25 bp, Homo sapien
gacagcagattccacaggacacgaa

SEQ ID NO: 133227 - DNA, 25 bp, Homo sapien
gcagattccacaggacacgaaggct

SEQ ID NO: 133228 - DNA, 25 bp, Homo sapien
cagattccacaggacacgaaggctg

SEQ ID NO: 133229 - DNA, 25 bp, Homo sapien
ggaacaccgggctggctttgagtgg

SEQ ID NO: 133230 - DNA, 25 bp, Homo sapien
accgggctggctttgagtggaacga

SEQ ID NO: 133231 - DNA, 25 bp, Homo sapien
ggctggctttgagtggaacgaggat

SEQ ID NO: 133232 - DNA, 25 bp, Homo sapien
gttacgttttacaacaaggctagag

SEQ ID NO: 133233 - DNA, 25 bp, Homo sapien
cgttttacaacaaggctagagtttg

SEQ ID NO: 133234 - DNA, 25 bp, Homo sapien
gagtttgtaaattctgggttcattt

SEQ ID NO: 133235 - DNA, 25 bp, Homo sapien
aattctgggttcatttgtgatgaca

SEQ ID NO: 133236 - DNA, 25 bp, Homo sapien
gggttcatttgtgatgacataagtc

SEQ ID NO: 133237 - DNA, 25 bp, Homo sapien
gacataagtcagcaaactgcgggaa

SEQ ID NO: 133238 - DNA, 25 bp, Homo sapien
agtcagcaaactgcgggaatactgt

SEQ ID NO: 133239 - DNA, 25 bp, Homo sapien
actgtctcttctatgtattttgtga

SEQ ID NO: 133240 - DNA, 25 bp, Homo sapien
tcacttgaaattaaagctgcctttt

SEQ ID NO: 133241 - DNA, 25 bp, Homo sapien
taacctataggataagattccagta

SEQ ID NO: 133242 - DNA, 25 bp, Homo sapien
gattccagtattgtatatgagtttt

SEQ ID NO: 133243 - DNA, 25 bp, Homo sapien
gacaggagtcaatggagattctcga

SEQ ID NO: 133244 - DNA, 25 bp, Homo sapien
agattctcgatacttcctgtggcca

SEQ ID NO: 133245 - DNA, 25 bp, Homo sapien
gtggccactccagcatggcacatta

SEQ ID NO: 133246 - DNA, 25 bp, Homo sapien
ggcacattacacttctgtggattta

SEQ ID NO: 133247 - DNA, 25 bp, Homo sapien
ggatttaaagtccttgcccctcaga

SEQ ID NO: 133248 - DNA, 25 bp, Homo sapien
gctcctgaaattgcatccgaagaag

SEQ ID NO: 133249 - DNA, 25 bp, Homo sapien
atctggaaggaagagcccatcccct

SEQ ID NO: 133250 - DNA, 25 bp, Homo sapien
agcccactggcacttcgggcaataa

SEQ ID NO: 133251 - DNA, 25 bp, Homo sapien
tcgggcaataactctgtggcacgtg

SEQ ID NO: 133252 - DNA, 25 bp, Homo sapien
gtgggcatcacgtaagcagcacact

SEQ ID NO: 133253 - DNA, 25 bp, Homo sapien
taagcagcacactaggaggcccagg

SEQ ID NO: 133254 - DNA, 25 bp, Homo sapien
accacctcagagctgttcaggaagc

SEQ ID NO: 133255 - DNA, 25 bp, Homo sapien
tggcgctggatgtggattccaccaa

SEQ ID NO: 133256 - DNA, 25 bp, Homo sapien
tgtggattccaccaacagccggctg

SEQ ID NO: 133257 - DNA, 25 bp, Homo sapien
ggcactgtgcctacaggtgctacgc

SEQ ID NO: 133258 - DNA, 25 bp, Homo sapien
aggtgctacgccacctggcgcttcg

SEQ ID NO: 133259 - DNA, 25 bp, Homo sapien
tggcgcttcggctcccaggacatgg

SEQ ID NO: 133260 - DNA, 25 bp, Homo sapien
ggctcccaggacatggctgactttg

SEQ ID NO: 133261 - DNA, 25 bp, Homo sapien
gtttccgaagagtgaagggcagtac

SEQ ID NO: 133262 - DNA, 25 bp, Homo sapien
agggcagtacagtggcttcaagagt

SEQ ID NO: 133263 - DNA, 25 bp, Homo sapien
tacagtggcttcaagagtccttact

SEQ ID NO: 133264 - DNA, 25 bp, Homo sapien
caagagtccttactgaagccaggca

SEQ ID NO: 133265 - DNA, 25 bp, Homo sapien
aacatataacaaagggcagccctcc

SEQ ID NO: 133266 - DNA, 25 bp, Homo sapien
aaagggcagccctccacttctggta

SEQ ID NO: 133267 - DNA, 25 bp, Homo sapien
agccctccacttctggtataattgt

SEQ ID NO: 133268 - DNA, 25 bp, Homo sapien
cctccacttctggtataattgtgta

SEQ ID NO: 133269 - DNA, 25 bp, Homo sapien
ctattgaccatgtggttcacgtaca

SEQ ID NO: 133270 - DNA, 25 bp, Homo sapien
gaccatgtggttcacgtacaaaact

SEQ ID NO: 133271 - DNA, 25 bp, Homo sapien
gtggttcacgtacaaaactctgtat

SEQ ID NO: 133272 - DNA, 25 bp, Homo sapien
tgttcatatgtacttgtttgctatg

SEQ ID NO: 133273 - DNA, 25 bp, Homo sapien
gtacttgtttgctatgactacattt

SEQ ID NO: 133274 - DNA, 25 bp, Homo sapien
gtttgctatgactacattttgaggt

SEQ ID NO: 133275 - DNA, 25 bp, Homo sapien
ctatgactacattttgaggttttgt

SEQ ID NO: 133276 - DNA, 25 bp, Homo sapien
tccctctttcggctggtgtagaata

SEQ ID NO: 133277 - DNA, 25 bp, Homo sapien
aatagccagtagtgtagtgcggtgt

SEQ ID NO: 133278 - DNA, 25 bp, Homo sapien
tgtagtgcggtgtgcttttacgtga

SEQ ID NO: 133279 - DNA, 25 bp, Homo sapien
cgcgcagccgtctgtccttgatctg

SEQ ID NO: 133280 - DNA, 25 bp, Homo sapien
tctgtccttgatctgcccgcggcgg

SEQ ID NO: 133281 - DNA, 25 bp, Homo sapien
gcggcggcccgtgttgtgttttgtg

SEQ ID NO: 133282 - DNA, 25 bp, Homo sapien
gtactgacttctcctataagcgctt

SEQ ID NO: 133283 - DNA, 25 bp, Homo sapien
tataagcgcttctcttcgcatagtc

SEQ ID NO: 133284 - DNA, 25 bp, Homo sapien
ttctcttcgcatagtcacgtagctc

SEQ ID NO: 133285 - DNA, 25 bp, Homo sapien
cttcctgtgtctcacgcaagtttta

SEQ ID NO: 133286 - DNA, 25 bp, Homo sapien
gtgtctcacgcaagttttatactct

SEQ ID NO: 133287 - DNA, 25 bp, Homo sapien
gtaaagtttccaagcagcaacaatc

SEQ ID NO: 133288 - DNA, 25 bp, Homo sapien
gtttccaagcagcaacaatctttta

SEQ ID NO: 133289 - DNA, 25 bp, Homo sapien
caacactaactaaaggagccacggt

SEQ ID NO: 133290 - DNA, 25 bp, Homo sapien
aaggagccacggttgctgattcttt

SEQ ID NO: 133291 - DNA, 25 bp, Homo sapien
cacggttgctgattctttggatgaa

SEQ ID NO: 133292 - DNA, 25 bp, Homo sapien
ttggatgaacaggaagctgcctttg

SEQ ID NO: 133293 - DNA, 25 bp, Homo sapien
gaagctgcctttgaatctgtttttg

SEQ ID NO: 133294 - DNA, 25 bp, Homo sapien
aactaataaggttccagttgcacct

SEQ ID NO: 133295 - DNA, 25 bp, Homo sapien
tttgatatctttcatgtttgcctgc

SEQ ID NO: 133296 - DNA, 25 bp, Homo sapien
gcctgcagttgaacaatactttaga

SEQ ID NO: 133297 - DNA, 25 bp, Homo sapien
gttattggctatttcaggtgttttg

SEQ ID NO: 133298 - DNA, 25 bp, Homo sapien
ccggctatcagtacggccagtacgg

SEQ ID NO: 133299 - DNA, 25 bp, Homo sapien
gccagtacggccagagtgagtgcct

SEQ ID NO: 133300 - DNA, 25 bp, Homo sapien
agggcctcctgcttgtttatggaga

SEQ ID NO: 133301 - DNA, 25 bp, Homo sapien
cctgcttgtttatggagagctacaa

SEQ ID NO: 133302 - DNA, 25 bp, Homo sapien
gaaaaattgaagtccagccagatgg

SEQ ID NO: 133303 - DNA, 25 bp, Homo sapien
agccagatggaacagttcacctaaa

SEQ ID NO: 133304 - DNA, 25 bp, Homo sapien
gttcacctaaaatgacactgagttg

SEQ ID NO: 133305 - DNA, 25 bp, Homo sapien
gagttgggcaaaacccaggacatct

SEQ ID NO: 133306 - DNA, 25 bp, Homo sapien
aggacatctcctggctaagcctctg

SEQ ID NO: 133307 - DNA, 25 bp, Homo sapien
ctggctaagcctctgcttccgtact

SEQ ID NO: 133308 - DNA, 25 bp, Homo sapien
cttccgtactatggctccaacagaa

SEQ ID NO: 133309 - DNA, 25 bp, Homo sapien
gctactagctgcctacgtgtgtgca

SEQ ID NO: 133310 - DNA, 25 bp, Homo sapien
tactagctgcctacgtgtgtgcatt

SEQ ID NO: 133311 - DNA, 25 bp, Homo sapien
actagctgcctacgtgtgtgcattt

SEQ ID NO: 133312 - DNA, 25 bp, Homo sapien
tagctgcctacgtgtgtgcatttgc

SEQ ID NO: 133313 - DNA, 25 bp, Homo sapien
gctgcctacgtgtgtgcatttgcta

SEQ ID NO: 133314 - DNA, 25 bp, Homo sapien
ctgcctacgtgtgtgcatttgctat

SEQ ID NO: 133315 - DNA, 25 bp, Homo sapien
gcctacgtgtgtgcatttgctatat

SEQ ID NO: 133316 - DNA, 25 bp, Homo sapien
cctacgtgtgtgcatttgctatata

SEQ ID NO: 133317 - DNA, 25 bp, Homo sapien
acgtgtgtgcatttgctatatagca

SEQ ID NO: 133318 - DNA, 25 bp, Homo sapien
gtgtgtgcatttgctatatagcata

SEQ ID NO: 133319 - DNA, 25 bp, Homo sapien
gcatttgctatatagcatacttctt

SEQ ID NO: 133320 - DNA, 25 bp, Homo sapien
ggtcaccgacagcatgctgatcaag

SEQ ID NO: 133321 - DNA, 25 bp, Homo sapien
agcatgctgatcaaggctgtctcca

SEQ ID NO: 133322 - DNA, 25 bp, Homo sapien
aaggctgtctccacctcggacacag

SEQ ID NO: 133323 - DNA, 25 bp, Homo sapien
acaaccactgctccgaactctggga

SEQ ID NO: 133324 - DNA, 25 bp, Homo sapien
tgtaccgcagctttggcgtccccgt

SEQ ID NO: 133325 - DNA, 25 bp, Homo sapien
gtcttcggccacgtgcaggttgcta

SEQ ID NO: 133326 - DNA, 25 bp, Homo sapien
ggccacgtgcaggttgctatcaata

SEQ ID NO: 133327 - DNA, 25 bp, Homo sapien
aggttgctatcaatacccttgtcct

SEQ ID NO: 133328 - DNA, 25 bp, Homo sapien
tgtcctcctggtcctctggaggaaa

SEQ ID NO: 133329 - DNA, 25 bp, Homo sapien
tggaggaaacctatgccccagagga

SEQ ID NO: 133330 - DNA, 25 bp, Homo sapien
gacaaagtccggtgaccgctgccca

SEQ ID NO: 133331 - DNA, 25 bp, Homo sapien
catcaccatcgaggctgagccaaga

SEQ ID NO: 133332 - DNA, 25 bp, Homo sapien
agccaagagctgatggcagccgccg

SEQ ID NO: 133333 - DNA, 25 bp, Homo sapien
acccgctatgacatcgacatgacca

SEQ ID NO: 133334 - DNA, 25 bp, Homo sapien
gacatgaccaagtgcatctactgcg

SEQ ID NO: 133335 - DNA, 25 bp, Homo sapien
atctactgcggcttctgccaggagg

SEQ ID NO: 133336 - DNA, 25 bp, Homo sapien
aggcctgtcccgtggatgccatcgt

SEQ ID NO: 133337 - DNA, 25 bp, Homo sapien
gtcgagggccccaactttgagttct

SEQ ID NO: 133338 - DNA, 25 bp, Homo sapien
ttgagttctccacggagacccatga

SEQ ID NO: 133339 - DNA, 25 bp, Homo sapien
gggaggccgagatcgccgccaacat

SEQ ID NO: 133340 - DNA, 25 bp, Homo sapien
catccaggctgactacttgtatcgg

SEQ ID NO: 133341 - DNA, 25 bp, Homo sapien
gactacttgtatcggtgacgcccca

SEQ ID NO: 133342 - DNA, 25 bp, Homo sapien
aaagagacggggctctgaggccgag

SEQ ID NO: 133343 - DNA, 25 bp, Homo sapien
aagagacggggctctgaggccgagc

SEQ ID NO: 133344 - DNA, 25 bp, Homo sapien
agagacggggctctgaggccgagca

SEQ ID NO: 133345 - DNA, 25 bp, Homo sapien
gagacggggctctgaggccgagcac

SEQ ID NO: 133346 - DNA, 25 bp, Homo sapien
agacggggctctgaggccgagcaca

SEQ ID NO: 133347 - DNA, 25 bp, Homo sapien
gacggggctctgaggccgagcacag

SEQ ID NO: 133348 - DNA, 25 bp, Homo sapien
acggggctctgaggccgagcacagt

SEQ ID NO: 133349 - DNA, 25 bp, Homo sapien
cggggctctgaggccgagcacagtg

SEQ ID NO: 133350 - DNA, 25 bp, Homo sapien
ggggctctgaggccgagcacagtgg

SEQ ID NO: 133351 - DNA, 25 bp, Homo sapien
gctctgaggccgagcacagtggccc

SEQ ID NO: 133352 - DNA, 25 bp, Homo sapien
tctgaggccgagcacagtggcccat

SEQ ID NO: 133353 - DNA, 25 bp, Homo sapien
gtatgactttgttatgaacccctgc

SEQ ID NO: 133354 - DNA, 25 bp, Homo sapien
ctttgttatgaacccctgcttttag

SEQ ID NO: 133355 - DNA, 25 bp, Homo sapien
gaagggatttgtgggacttgaattc

SEQ ID NO: 133356 - DNA, 25 bp, Homo sapien
tgggacttgaattcactaggcttag

SEQ ID NO: 133357 - DNA, 25 bp, Homo sapien
attcactaggcttaggtctttcagg

SEQ ID NO: 133358 - DNA, 25 bp, Homo sapien
gcttaggtctttcaggaaacaggct

SEQ ID NO: 133359 - DNA, 25 bp, Homo sapien
atcatgtgtgagattggattctact

SEQ ID NO: 133360 - DNA, 25 bp, Homo sapien
gattggattctacttgggtgatttg

SEQ ID NO: 133361 - DNA, 25 bp, Homo sapien
tacttgggtgatttggtggatagac

SEQ ID NO: 133362 - DNA, 25 bp, Homo sapien
gtggatagacccatgaatggcccct

SEQ ID NO: 133363 - DNA, 25 bp, Homo sapien
gggttttcaatcttggattggaggt

SEQ ID NO: 133364 - DNA, 25 bp, Homo sapien
aatcttctgatgtttgtattatcct

SEQ ID NO: 133365 - DNA, 25 bp, Homo sapien
gatgtttgtattatccttcttatat

SEQ ID NO: 133366 - DNA, 25 bp, Homo sapien
aatcaagttgtggtatagtcaatct

SEQ ID NO: 133367 - DNA, 25 bp, Homo sapien
gtggtatagtcaatctatttcttaa

SEQ ID NO: 133368 - DNA, 25 bp, Homo sapien
aatgctgacacatcacaatttcata

SEQ ID NO: 133369 - DNA, 25 bp, Homo sapien
gacacatcacaatttcatattttaa

SEQ ID NO: 133370 - DNA, 25 bp, Homo sapien
agactgattttgttcagtgttatat

SEQ ID NO: 133371 - DNA, 25 bp, Homo sapien
tgttagctgatacatatttgttcat

SEQ ID NO: 133372 - DNA, 25 bp, Homo sapien
atatttgttcatttatgtgattgca

SEQ ID NO: 133373 - DNA, 25 bp, Homo sapien
tatagctacatatttaccttgaatg

SEQ ID NO: 133374 - DNA, 25 bp, Homo sapien
gaatgttacaattagcttgccaata

SEQ ID NO: 133375 - DNA, 25 bp, Homo sapien
actgtgcaccaattccagctggaca

SEQ ID NO: 133376 - DNA, 25 bp, Homo sapien
attccagctggacatcactgtgaaa

SEQ ID NO: 133377 - DNA, 25 bp, Homo sapien
agaatgcccatgtcacagaccccag

SEQ ID NO: 133378 - DNA, 25 bp, Homo sapien
accccagggtggttgatcttctggt

SEQ ID NO: 133379 - DNA, 25 bp, Homo sapien
agtatggaagcagcggacacatgtt

SEQ ID NO: 133380 - DNA, 25 bp, Homo sapien
gacacatgttatgcggttcttccat

SEQ ID NO: 133381 - DNA, 25 bp, Homo sapien
gcgccaaggccaaaggatttcctat

SEQ ID NO: 133382 - DNA, 25 bp, Homo sapien
gatttcctatccaagttctatgttg

SEQ ID NO: 133383 - DNA, 25 bp, Homo sapien
aagttctatgttggccacgatccat

SEQ ID NO: 133384 - DNA, 25 bp, Homo sapien
gttggccacgatccatgaagtcatt

SEQ ID NO: 133385 - DNA, 25 bp, Homo sapien
gatgcacgttgatactattttagag

SEQ ID NO: 133386 - DNA, 25 bp, Homo sapien
atggagacggcattcttggacttca

SEQ ID NO: 133387 - DNA, 25 bp, Homo sapien
gacggcattcttggacttcactggg

SEQ ID NO: 133388 - DNA, 25 bp, Homo sapien
gctgctggattggatgggaaacctt

SEQ ID NO: 133389 - DNA, 25 bp, Homo sapien
attggatgggaaaccttctggaaga

SEQ ID NO: 133390 - DNA, 25 bp, Homo sapien
gggccataggtaggtctgaacaact

SEQ ID NO: 133391 - DNA, 25 bp, Homo sapien
gaccactacatgacttagggaactt

SEQ ID NO: 133392 - DNA, 25 bp, Homo sapien
gggaacttgaaaccaactggctcat

SEQ ID NO: 133393 - DNA, 25 bp, Homo sapien
gaataatgtttggacttgatttccc

SEQ ID NO: 133394 - DNA, 25 bp, Homo sapien
tgatttccccacgtcataatgaaga

SEQ ID NO: 133395 - DNA, 25 bp, Homo sapien
atggaagtttggatctgctcctcgt

SEQ ID NO: 133396 - DNA, 25 bp, Homo sapien
atctgctcctcgtcaggcgcagcat

SEQ ID NO: 133397 - DNA, 25 bp, Homo sapien
tatgtgtatttgtatgtactgttat

SEQ ID NO: 133398 - DNA, 25 bp, Homo sapien
tcttgggcaagatgacctactagtt

SEQ ID NO: 133399 - DNA, 25 bp, Homo sapien
tgggcaagatgacctactagttttc

SEQ ID NO: 133400 - DNA, 25 bp, Homo sapien
gcaagatgacctactagttttcctt

SEQ ID NO: 133401 - DNA, 25 bp, Homo sapien
gatgacctactagttttccttgaaa

SEQ ID NO: 133402 - DNA, 25 bp, Homo sapien
gttgctttgttattaatattgtgct

SEQ ID NO: 133403 - DNA, 25 bp, Homo sapien
ttttatacaccattgttccttacct

SEQ ID NO: 133404 - DNA, 25 bp, Homo sapien
tatacaccattgttccttaccttta

SEQ ID NO: 133405 - DNA, 25 bp, Homo sapien
acaccattgttccttacctttacat

SEQ ID NO: 133406 - DNA, 25 bp, Homo sapien
ccattgttccttacctttacataat

SEQ ID NO: 133407 - DNA, 25 bp, Homo sapien
taattgcaatatttcccccttacta

SEQ ID NO: 133408 - DNA, 25 bp, Homo sapien
gagtagcccggcagatgcgcgtcac

SEQ ID NO: 133409 - DNA, 25 bp, Homo sapien
ggcagatgcgcgtcacagaggctct

SEQ ID NO: 133410 - DNA, 25 bp, Homo sapien
gatgcgcgtcacagaggctctcaca

SEQ ID NO: 133411 - DNA, 25 bp, Homo sapien
acagcgcttggagcatccctttgga

SEQ ID NO: 133412 - DNA, 25 bp, Homo sapien
ttggagcatccctttggacgggctg

SEQ ID NO: 133413 - DNA, 25 bp, Homo sapien
tttggacgggctgctgaacatccac

SEQ ID NO: 133414 - DNA, 25 bp, Homo sapien
tgaacatccacctgtctggacgttg

SEQ ID NO: 133415 - DNA, 25 bp, Homo sapien
ccacctgtctggacgttgcatggag

SEQ ID NO: 133416 - DNA, 25 bp, Homo sapien
aatccctggcgtacagggtttcctg

SEQ ID NO: 133417 - DNA, 25 bp, Homo sapien
gcgtacagggtttcctgcccgagga

SEQ ID NO: 133418 - DNA, 25 bp, Homo sapien
gcgcggctcgcctggaaacgtgcca

SEQ ID NO: 133419 - DNA, 25 bp, Homo sapien
attatgcttttatatgctattcaga

SEQ ID NO: 133420 - DNA, 25 bp, Homo sapien
ttatatgctattcagatttcaaatc

SEQ ID NO: 133421 - DNA, 25 bp, Homo sapien
tcaaatctttccaatttaccctgga

SEQ ID NO: 133422 - DNA, 25 bp, Homo sapien
ctggaatcagttttgagggagctga

SEQ ID NO: 133423 - DNA, 25 bp, Homo sapien
gataaagactttagctgactcgtta

SEQ ID NO: 133424 - DNA, 25 bp, Homo sapien
actttagctgactcgttaagcctga

SEQ ID NO: 133425 - DNA, 25 bp, Homo sapien
ctgactcgttaagcctgatacataa

SEQ ID NO: 133426 - DNA, 25 bp, Homo sapien
aagcctgatacataagccatattta

SEQ ID NO: 133427 - DNA, 25 bp, Homo sapien
attaaaatgtagtctctgggtcata

SEQ ID NO: 133428 - DNA, 25 bp, Homo sapien
gtagtctctgggtcataaaatggat

SEQ ID NO: 133429 - DNA, 25 bp, Homo sapien
gggagatcagtaggttatacgtata

SEQ ID NO: 133430 - DNA, 25 bp, Homo sapien
gaagactatttaccagggaccctgg

SEQ ID NO: 133431 - DNA, 25 bp, Homo sapien
aaacagcagggtttgagcacaatct

SEQ ID NO: 133432 - DNA, 25 bp, Homo sapien
agcacaatctgttctactcttaatg

SEQ ID NO: 133433 - DNA, 25 bp, Homo sapien
aattgcctgaaacccatttacttag

SEQ ID NO: 133434 - DNA, 25 bp, Homo sapien
cttaggactacattttgctctgtga

SEQ ID NO: 133435 - DNA, 25 bp, Homo sapien
gaactatcccctgcgctttgaacgt

SEQ ID NO: 133436 - DNA, 25 bp, Homo sapien
tttgaacgtgccagcagcccttgtt

SEQ ID NO: 133437 - DNA, 25 bp, Homo sapien
cagcagcccttgtttatatgcccat

SEQ ID NO: 133438 - DNA, 25 bp, Homo sapien
ttatatgcccattcttttcacttcc

SEQ ID NO: 133439 - DNA, 25 bp, Homo sapien
ctgcagtcgcttgccaaagcagatt

SEQ ID NO: 133440 - DNA, 25 bp, Homo sapien
gcagattttcctaaggccactgttt

SEQ ID NO: 133441 - DNA, 25 bp, Homo sapien
gtgacaacctactttgcttggctga

SEQ ID NO: 133442 - DNA, 25 bp, Homo sapien
tccatggacatttagttagtgcttt

SEQ ID NO: 133443 - DNA, 25 bp, Homo sapien
gtgctttttatataccaggcatgat

SEQ ID NO: 133444 - DNA, 25 bp, Homo sapien
gctgagtgacactcttgtgtatatt

SEQ ID NO: 133445 - DNA, 25 bp, Homo sapien
ccaaatttttgtatagtcgctgcac

SEQ ID NO: 133446 - DNA, 25 bp, Homo sapien
agtcgctgcacatatttgaaatcat

SEQ ID NO: 133447 - DNA, 25 bp, Homo sapien
gactttccaaagatgaggtccctgg

SEQ ID NO: 133448 - DNA, 25 bp, Homo sapien
gaggtccctggtttttcatggcaac

SEQ ID NO: 133449 - DNA, 25 bp, Homo sapien
ggtttttcatggcaacttgatcagt

SEQ ID NO: 133450 - DNA, 25 bp, Homo sapien
ggatttcacctctgtttgtaactaa

SEQ ID NO: 133451 - DNA, 25 bp, Homo sapien
gttagacatgacattctttttctct

SEQ ID NO: 133452 - DNA, 25 bp, Homo sapien
tgggcaccgcaaaatggtcctctac

SEQ ID NO: 133453 - DNA, 25 bp, Homo sapien
gcaaaatggtcctctacaccctgcg

SEQ ID NO: 133454 - DNA, 25 bp, Homo sapien
ccacgaagccccaagatggtgcaag

SEQ ID NO: 133455 - DNA, 25 bp, Homo sapien
gatggtgcaagggtctggctgcttt

SEQ ID NO: 133456 - DNA, 25 bp, Homo sapien
gaagatggaccggatcagctcctcc

SEQ ID NO: 133457 - DNA, 25 bp, Homo sapien
ctgaggcggcattaagaggaagtcc

SEQ ID NO: 133458 - DNA, 25 bp, Homo sapien
aggaagtcctggctgcagacacctg

SEQ ID NO: 133459 - DNA, 25 bp, Homo sapien
agacacctgcttctgattccacaag

SEQ ID NO: 133460 - DNA, 25 bp, Homo sapien
tgtggccgcctttgaagtgactcat

SEQ ID NO: 133461 - DNA, 25 bp, Homo sapien
aagatggtttcttacctttgagcac

SEQ ID NO: 133462 - DNA, 25 bp, Homo sapien
tggtttcttacctttgagcacaaaa

SEQ ID NO: 133463 - DNA, 25 bp, Homo sapien
cttcgttctcagcaagcagaggtac

SEQ ID NO: 133464 - DNA, 25 bp, Homo sapien
gttctcagcaagcagaggtacccca

SEQ ID NO: 133465 - DNA, 25 bp, Homo sapien
agcaagcagaggtaccccagccagc

SEQ ID NO: 133466 - DNA, 25 bp, Homo sapien
aagatcttcctcaaatattaccccg

SEQ ID NO: 133467 - DNA, 25 bp, Homo sapien
ttcctcaaatattaccccggctggg

SEQ ID NO: 133468 - DNA, 25 bp, Homo sapien
tattaccccggctgggtggccggct

SEQ ID NO: 133469 - DNA, 25 bp, Homo sapien
gtggccggctcttggtgatagattc

SEQ ID NO: 133470 - DNA, 25 bp, Homo sapien
gccggctcttggtgatagattcgcc

SEQ ID NO: 133471 - DNA, 25 bp, Homo sapien
ttggtgatagattcgccaccactgg

SEQ ID NO: 133472 - DNA, 25 bp, Homo sapien
gatagattcgccaccactgggcctt

SEQ ID NO: 133473 - DNA, 25 bp, Homo sapien
attcgccaccactgggccttgtttt

SEQ ID NO: 133474 - DNA, 25 bp, Homo sapien
ttgtcaaagaattcccaacgccagg

SEQ ID NO: 133475 - DNA, 25 bp, Homo sapien
gccaggacccacatccctttggtat

SEQ ID NO: 133476 - DNA, 25 bp, Homo sapien
ggtattgatttcacagtcagctgct

SEQ ID NO: 133477 - DNA, 25 bp, Homo sapien
agtcagctgctcaacggaatggcct

SEQ ID NO: 133478 - DNA, 25 bp, Homo sapien
ggatccttagcacccaaccggtctg

SEQ ID NO: 133479 - DNA, 25 bp, Homo sapien
tctgcctttaattttacccaggaag

SEQ ID NO: 133480 - DNA, 25 bp, Homo sapien
ttttacccaggaaggactcacattg

SEQ ID NO: 133481 - DNA, 25 bp, Homo sapien
atgaaccaagtttcgccatgctgga

SEQ ID NO: 133482 - DNA, 25 bp, Homo sapien
aagtttcgccatgctggatgatgaa

SEQ ID NO: 133483 - DNA, 25 bp, Homo sapien
aaatggattcccatcccaaagtctg

SEQ ID NO: 133484 - DNA, 25 bp, Homo sapien
gtcccagagcctcctaaaattctag

SEQ ID NO: 133485 - DNA, 25 bp, Homo sapien
ttgtacctctaagtacatatgtaga

SEQ ID NO: 133486 - DNA, 25 bp, Homo sapien
ttttttctctattctctccaatttg

SEQ ID NO: 133487 - DNA, 25 bp, Homo sapien
ttctctattctctccaatttgttta

SEQ ID NO: 133488 - DNA, 25 bp, Homo sapien
ctattctctccaatttgtttaaaga

SEQ ID NO: 133489 - DNA, 25 bp, Homo sapien
gaataaagtccaaagtctgatctgg

SEQ ID NO: 133490 - DNA, 25 bp, Homo sapien
taaaactaagctctttgagaactgc

SEQ ID NO: 133491 - DNA, 25 bp, Homo sapien
agctctttgagaactgcttctaaga

SEQ ID NO: 133492 - DNA, 25 bp, Homo sapien
gaactgcttctaagatgccagcata

SEQ ID NO: 133493 - DNA, 25 bp, Homo sapien
tgcttctaagatgccagcatatact

SEQ ID NO: 133494 - DNA, 25 bp, Homo sapien
agcatatactgaagtcttttctgtc

SEQ ID NO: 133495 - DNA, 25 bp, Homo sapien
ttctgtcaccaaatttgtacctcta

SEQ ID NO: 133496 - DNA, 25 bp, Homo sapien
attgatccatctctaggccacatga

SEQ ID NO: 133497 - DNA, 25 bp, Homo sapien
acatgattgtcaccttagttgcccg

SEQ ID NO: 133498 - DNA, 25 bp, Homo sapien
ccgggttctcagttttggcaattct

SEQ ID NO: 133499 - DNA, 25 bp, Homo sapien
ggcaattcttgtgtcaacccatttg

SEQ ID NO: 133500 - DNA, 25 bp, Homo sapien
atttgctctttacctactcagtgaa

SEQ ID NO: 133501 - DNA, 25 bp, Homo sapien
agcttcaggaggcatttcaacagcc

SEQ ID NO: 133502 - DNA, 25 bp, Homo sapien
tttcaacagccaactctgctgtggg

SEQ ID NO: 133503 - DNA, 25 bp, Homo sapien
agagaggaaccagctacctactcag

SEQ ID NO: 133504 - DNA, 25 bp, Homo sapien
agctcttcagcggtgcgtatgacat

SEQ ID NO: 133505 - DNA, 25 bp, Homo sapien
agcggtgcgtatgacatctctgaaa

SEQ ID NO: 133506 - DNA, 25 bp, Homo sapien
catggtgaccaattctgttttacta

SEQ ID NO: 133507 - DNA, 25 bp, Homo sapien
gctgtgatgcacattccttcggctg

SEQ ID NO: 133508 - DNA, 25 bp, Homo sapien
gctgctggacggtataaggcctttt

SEQ ID NO: 133509 - DNA, 25 bp, Homo sapien
acctgtgcctctcatttcaatgttg

SEQ ID NO: 133510 - DNA, 25 bp, Homo sapien
tcttcatttatgctcggccaaaggc

SEQ ID NO: 133511 - DNA, 25 bp, Homo sapien
aaggcactttcagcttttgacacca

SEQ ID NO: 133512 - DNA, 25 bp, Homo sapien
ccaacaagttggtctctgtactgta

SEQ ID NO: 133513 - DNA, 25 bp, Homo sapien
tactgtatgctgtcattgtaccatt

SEQ ID NO: 133514 - DNA, 25 bp, Homo sapien
ttgtaccattgctcaatcccatcat

SEQ ID NO: 133515 - DNA, 25 bp, Homo sapien
atcatttactgcctgcgcaatcaag

SEQ ID NO: 133516 - DNA, 25 bp, Homo sapien
agagagccctatgctgtattttgca

SEQ ID NO: 133517 - DNA, 25 bp, Homo sapien
tgtattttgcacctgtaccagcacc

SEQ ID NO: 133518 - DNA, 25 bp, Homo sapien
agcatccctctacaaggtgcattta

SEQ ID NO: 133519 - DNA, 25 bp, Homo sapien
taagtatactgcctgcctatgtgac

SEQ ID NO: 133520 - DNA, 25 bp, Homo sapien
gcctgcctatgtgacgacaatccaa

SEQ ID NO: 133521 - DNA, 25 bp, Homo sapien
gacaatccaaaaaccttctactggg

SEQ ID NO: 133522 - DNA, 25 bp, Homo sapien
gggacttttacaccaacagaactgt

SEQ ID NO: 133523 - DNA, 25 bp, Homo sapien
aattgcagccgtcgttgatgttatt

SEQ ID NO: 133524 - DNA, 25 bp, Homo sapien
gttattcgggaattaggcatctgcc

SEQ ID NO: 133525 - DNA, 25 bp, Homo sapien
ctgccctgatgatgctgctgtaatc

SEQ ID NO: 133526 - DNA, 25 bp, Homo sapien
atgctgctgtaatccccatcaaaaa

SEQ ID NO: 133527 - DNA, 25 bp, Homo sapien
ataatggaagccctgtctgtttgcc

SEQ ID NO: 133528 - DNA, 25 bp, Homo sapien
cacacccaggtgatttcctctaaag

SEQ ID NO: 133529 - DNA, 25 bp, Homo sapien
atcatgattggtaccctgactgcac

SEQ ID NO: 133530 - DNA, 25 bp, Homo sapien
attggtaccctgactgcactacagt

SEQ ID NO: 133531 - DNA, 25 bp, Homo sapien
taccctgactgcactacagtggttt

SEQ ID NO: 133532 - DNA, 25 bp, Homo sapien
gactgcactacagtggtttatctat

SEQ ID NO: 133533 - DNA, 25 bp, Homo sapien
ggtttatctatgactccgtgaaggt

SEQ ID NO: 133534 - DNA, 25 bp, Homo sapien
ctatgactccgtgaaggtctacttc

SEQ ID NO: 133535 - DNA, 25 bp, Homo sapien
gaaggtctacttcagacttcctcgc

SEQ ID NO: 133536 - DNA, 25 bp, Homo sapien
aagcttgggttaactcagtagttag

SEQ ID NO: 133537 - DNA, 25 bp, Homo sapien
aactcagtagttagatcaaagcaaa

SEQ ID NO: 133538 - DNA, 25 bp, Homo sapien
caaagcaaatgtggactgaatctgc

SEQ ID NO: 133539 - DNA, 25 bp, Homo sapien
ctgaatctgcttgttgatcagtgtt

SEQ ID NO: 133540 - DNA, 25 bp, Homo sapien
cggccgatcctgagccacctttgga

SEQ ID NO: 133541 - DNA, 25 bp, Homo sapien
gaagagctgggctaccacatctact

SEQ ID NO: 133542 - DNA, 25 bp, Homo sapien
tgggctaccacatctactccagcga

SEQ ID NO: 133543 - DNA, 25 bp, Homo sapien
agcgacccaccttttgaagttcgtg

SEQ ID NO: 133544 - DNA, 25 bp, Homo sapien
gggctaccagacagtgttctcaact

SEQ ID NO: 133545 - DNA, 25 bp, Homo sapien
accagacagtgttctcaacttggtt

SEQ ID NO: 133546 - DNA, 25 bp, Homo sapien
ggaggaagaaaacccagtcaatgaa

SEQ ID NO: 133547 - DNA, 25 bp, Homo sapien
aaacccagtcaatgaaattcaatga

SEQ ID NO: 133548 - DNA, 25 bp, Homo sapien
cttccattaagtgtgtagattgagc

SEQ ID NO: 133549 - DNA, 25 bp, Homo sapien
gagcaggtagtaattgcatgcagtt

SEQ ID NO: 133550 - DNA, 25 bp, Homo sapien
gtaattgcatgcagtttgtacatta

SEQ ID NO: 133551 - DNA, 25 bp, Homo sapien
atgtccaatggtaggaatttcaagg

SEQ ID NO: 133552 - DNA, 25 bp, Homo sapien
ggaatttcaaggtgtaggtcagata

SEQ ID NO: 133553 - DNA, 25 bp, Homo sapien
ttttgatgtgccttaaattatacca

SEQ ID NO: 133554 - DNA, 25 bp, Homo sapien
cctctttgcccaaaatacttgcatc

SEQ ID NO: 133555 - DNA, 25 bp, Homo sapien
acttgcatccaaggttctagtctct

SEQ ID NO: 133556 - DNA, 25 bp, Homo sapien
aaggttctagtctctgttgctgtgc

SEQ ID NO: 133557 - DNA, 25 bp, Homo sapien
gttgctgtgctggtctttagcccca

SEQ ID NO: 133558 - DNA, 25 bp, Homo sapien
tgatgtccctcctttttcacggaga

SEQ ID NO: 133559 - DNA, 25 bp, Homo sapien
ttcacggagacctatctgaggtaca

SEQ ID NO: 133560 - DNA, 25 bp, Homo sapien
gggctggcaccagatgatgtcccac

SEQ ID NO: 133561 - DNA, 25 bp, Homo sapien
agaaccaatttacactcaaccatga

SEQ ID NO: 133562 - DNA, 25 bp, Homo sapien
aatcccgctggctccgtggtgatgg

SEQ ID NO: 133563 - DNA, 25 bp, Homo sapien
ggctccgtggtgatggaacgcatcc

SEQ ID NO: 133564 - DNA, 25 bp, Homo sapien
acgcatccggatggacattcgcaaa

SEQ ID NO: 133565 - DNA, 25 bp, Homo sapien
acattcgcaaagtggacgccgtctt

SEQ ID NO: 133566 - DNA, 25 bp, Homo sapien
aagtggacgccgtctttgtgggcac

SEQ ID NO: 133567 - DNA, 25 bp, Homo sapien
tttgctgccatgctcctggcgtgga

SEQ ID NO: 133568 - DNA, 25 bp, Homo sapien
gagaagaccgtgtctaccttgcacc

SEQ ID NO: 133569 - DNA, 25 bp, Homo sapien
accttgcaccacgttctgcagagga

SEQ ID NO: 133570 - DNA, 25 bp, Homo sapien
ttctgcagaggaccatccagtgtgc

SEQ ID NO: 133571 - DNA, 25 bp, Homo sapien
gggacatcgaggacccagagatcgt

SEQ ID NO: 133572 - DNA, 25 bp, Homo sapien
cgaggacccagagatcgtcgtccag

SEQ ID NO: 133573 - DNA, 25 bp, Homo sapien
gaagactaaccagcttagtcagaag

SEQ ID NO: 133574 - DNA, 25 bp, Homo sapien
ccagcttagtcagaagatggttcca

SEQ ID NO: 133575 - DNA, 25 bp, Homo sapien
gatttttcttctagatctagacatc

SEQ ID NO: 133576 - DNA, 25 bp, Homo sapien
gacatctcaaaatgtggtactcata

SEQ ID NO: 133577 - DNA, 25 bp, Homo sapien
tggtactcataccatccacatcaga

SEQ ID NO: 133578 - DNA, 25 bp, Homo sapien
catccacatcagaatcccttgtagg

SEQ ID NO: 133579 - DNA, 25 bp, Homo sapien
attacagattgttgagcctaccata

SEQ ID NO: 133580 - DNA, 25 bp, Homo sapien
gattgttgagcctaccataggtcaa

SEQ ID NO: 133581 - DNA, 25 bp, Homo sapien
acaagtatagtcatggcaccacgta

SEQ ID NO: 133582 - DNA, 25 bp, Homo sapien
gtcatggcaccacgtaacattttgg

SEQ ID NO: 133583 - DNA, 25 bp, Homo sapien
acattgtataaagggtggtctcata

SEQ ID NO: 133584 - DNA, 25 bp, Homo sapien
ttgctgctgcgtgggtatttgtctc

SEQ ID NO: 133585 - DNA, 25 bp, Homo sapien
tgggtatttgtctccttagccatca

SEQ ID NO: 133586 - DNA, 25 bp, Homo sapien
ttagccatcaggtacagtttacact

SEQ ID NO: 133587 - DNA, 25 bp, Homo sapien
tgaggccattcttcatccttaggat

SEQ ID NO: 133588 - DNA, 25 bp, Homo sapien
atgatggtgcaagttcctttctctt

SEQ ID NO: 133589 - DNA, 25 bp, Homo sapien
tttcctgtttacatgtaacccaaca

SEQ ID NO: 133590 - DNA, 25 bp, Homo sapien
atgcaatttctagtgccttctgtcc

SEQ ID NO: 133591 - DNA, 25 bp, Homo sapien
gtgccttctgtccaatcagttcttt

SEQ ID NO: 133592 - DNA, 25 bp, Homo sapien
tcctctgagtgagacgtacttggct

SEQ ID NO: 133593 - DNA, 25 bp, Homo sapien
gtacttggctacagatttctgcctt

SEQ ID NO: 133594 - DNA, 25 bp, Homo sapien
tttctgccttgttttgcgacattgt

SEQ ID NO: 133595 - DNA, 25 bp, Homo sapien
tgaggagatcatgctgcagccactt

SEQ ID NO: 133596 - DNA, 25 bp, Homo sapien
tgcagccactttgggaatcccgaga

SEQ ID NO: 133597 - DNA, 25 bp, Homo sapien
tttgggaatcccgagatcgctacga

SEQ ID NO: 133598 - DNA, 25 bp, Homo sapien
tcccgagatcgctacgaggagctga

SEQ ID NO: 133599 - DNA, 25 bp, Homo sapien
agctgaagcggatagatgacgccat

SEQ ID NO: 133600 - DNA, 25 bp, Homo sapien
gatgacgccatgaaagagttacaga

SEQ ID NO: 133601 - DNA, 25 bp, Homo sapien
agaagactgacagcttgacgtctgg

SEQ ID NO: 133602 - DNA, 25 bp, Homo sapien
ctgcagttctggacgggctggccga

SEQ ID NO: 133603 - DNA, 25 bp, Homo sapien
tgcgcgggatccttgtgcagggaag

SEQ ID NO: 133604 - DNA, 25 bp, Homo sapien
tgggcacctggcaccacaagaccat

SEQ ID NO: 133605 - DNA, 25 bp, Homo sapien
ggcaccacaagaccatgttttctaa

SEQ ID NO: 133606 - DNA, 25 bp, Homo sapien
gaagctctggaggaactgcaactgg

SEQ ID NO: 133607 - DNA, 25 bp, Homo sapien
ggaactgcaactggaatccccgaag

SEQ ID NO: 133608 - DNA, 25 bp, Homo sapien
ggaatccccgaagctccatgctgag

SEQ ID NO: 133609 - DNA, 25 bp, Homo sapien
ccatgctgaggccatcaagcgggat

SEQ ID NO: 133610 - DNA, 25 bp, Homo sapien
atcaagcgggatcctaacctgttcc

SEQ ID NO: 133611 - DNA, 25 bp, Homo sapien
aaggaagggccacattacacaccac

SEQ ID NO: 133612 - DNA, 25 bp, Homo sapien
gaaggcaggtacaatgacatcacca

SEQ ID NO: 133613 - DNA, 25 bp, Homo sapien
gacatcaccaaggtgtacacacaag

SEQ ID NO: 133614 - DNA, 25 bp, Homo sapien
aggctgctatccttaacatgctgcc

SEQ ID NO: 133615 - DNA, 25 bp, Homo sapien
tccttaacatgctgcccctgagagt

SEQ ID NO: 133616 - DNA, 25 bp, Homo sapien
cagaatcaggcatgctgttaataaa

SEQ ID NO: 133617 - DNA, 25 bp, Homo sapien
atgttattgcctaatcactccaacc

SEQ ID NO: 133618 - DNA, 25 bp, Homo sapien
ctgtcccatccttcccaagaagaga

SEQ ID NO: 133619 - DNA, 25 bp, Homo sapien
aacacttacctggaggctcaccttg

SEQ ID NO: 133620 - DNA, 25 bp, Homo sapien
gaggctcaccttgcagaaccagtga

SEQ ID NO: 133621 - DNA, 25 bp, Homo sapien
gaaccagtgacaatcttatgagtat

SEQ ID NO: 133622 - DNA, 25 bp, Homo sapien
tataatgaacactcagccaggcctg

SEQ ID NO: 133623 - DNA, 25 bp, Homo sapien
actcagccaggcctgtcatgattgg

SEQ ID NO: 133624 - DNA, 25 bp, Homo sapien
cctgtcatgattggctttatttctt

SEQ ID NO: 133625 - DNA, 25 bp, Homo sapien
catgtgtttttattctctagatctg

SEQ ID NO: 133626 - DNA, 25 bp, Homo sapien
gatctgttaccaatatagttttcta

SEQ ID NO: 133627 - DNA, 25 bp, Homo sapien
tatagttttctaactcctgtttggg

SEQ ID NO: 133628 - DNA, 25 bp, Homo sapien
tttaaattattgctcactgcctatt

SEQ ID NO: 133629 - DNA, 25 bp, Homo sapien
attgctcactgcctatttaatgtag

SEQ ID NO: 133630 - DNA, 25 bp, Homo sapien
gcagatgatctgttaatttcctatc

SEQ ID NO: 133631 - DNA, 25 bp, Homo sapien
gatctgttaatttcctatctaataa

SEQ ID NO: 133632 - DNA, 25 bp, Homo sapien
tttcctatctaataaatgcctttaa

SEQ ID NO: 133633 - DNA, 25 bp, Homo sapien
atgcctttaattgttctcataatga

SEQ ID NO: 133634 - DNA, 25 bp, Homo sapien
agaataagtaggtaccctccatgcc

SEQ ID NO: 133635 - DNA, 25 bp, Homo sapien
ctccatgcccttctgtaataaatat

SEQ ID NO: 133636 - DNA, 25 bp, Homo sapien
atgcccttctgtaataaatatctgg

SEQ ID NO: 133637 - DNA, 25 bp, Homo sapien
atgttatgtgcatttctagaaatac

SEQ ID NO: 133638 - DNA, 25 bp, Homo sapien
gtctgtatcttatattcaattgcaa

SEQ ID NO: 133639 - DNA, 25 bp, Homo sapien
actggaaaccattcaccatgtgtga

SEQ ID NO: 133640 - DNA, 25 bp, Homo sapien
tcaccatgtgtgactgtcttctgtt

SEQ ID NO: 133641 - DNA, 25 bp, Homo sapien
gtgtgactgtcttctgttatcattt

SEQ ID NO: 133642 - DNA, 25 bp, Homo sapien
ttatcatttgtcttacaggcggcta

SEQ ID NO: 133643 - DNA, 25 bp, Homo sapien
caggcggctattgcagacggctaat

SEQ ID NO: 133644 - DNA, 25 bp, Homo sapien
tgcagacggctaatttatgcttaac

SEQ ID NO: 133645 - DNA, 25 bp, Homo sapien
aagcttcaacttaacttaactacat

SEQ ID NO: 133646 - DNA, 25 bp, Homo sapien
aactacatttctctgtatgatgatg

SEQ ID NO: 133647 - DNA, 25 bp, Homo sapien
gatgatgtctcttacttctacaggt

SEQ ID NO: 133648 - DNA, 25 bp, Homo sapien
ttacttctacaggttccttgagcac

SEQ ID NO: 133649 - DNA, 25 bp, Homo sapien
aactctgtataggtgacagctgctt

SEQ ID NO: 133650 - DNA, 25 bp, Homo sapien
ttatgcgtggcgctgtgttcacttt

SEQ ID NO: 133651 - DNA, 25 bp, Homo sapien
tgtgttcactttccagagtctctgt

SEQ ID NO: 133652 - DNA, 25 bp, Homo sapien
cagagtctctgttcgtttgtttgga

SEQ ID NO: 133653 - DNA, 25 bp, Homo sapien
gttcgtttgtttggatggcggtctc

SEQ ID NO: 133654 - DNA, 25 bp, Homo sapien
gtgtgtgaaatcgtgcaaatctaca

SEQ ID NO: 133655 - DNA, 25 bp, Homo sapien
tgcaaatctacaacatgtcccagcc

SEQ ID NO: 133656 - DNA, 25 bp, Homo sapien
agcccattctccgttgaaacagatc

SEQ ID NO: 133657 - DNA, 25 bp, Homo sapien
ttctccgttgaaacagatcacagca

SEQ ID NO: 133658 - DNA, 25 bp, Homo sapien
gatcacagcaacgacaaacgctcat

SEQ ID NO: 133659 - DNA, 25 bp, Homo sapien
caacgacaaacgctcatggcgctgc

SEQ ID NO: 133660 - DNA, 25 bp, Homo sapien
tccacccgcttcagatagatcattg

SEQ ID NO: 133661 - DNA, 25 bp, Homo sapien
tgcccaactgatagccacgctgaag

SEQ ID NO: 133662 - DNA, 25 bp, Homo sapien
aaatttgcttggacctgcaagcccc

SEQ ID NO: 133663 - DNA, 25 bp, Homo sapien
gcaagccccgctgtacaagaaaata

SEQ ID NO: 133664 - DNA, 25 bp, Homo sapien
gctactagctgcctacgtgtgtgca

SEQ ID NO: 133665 - DNA, 25 bp, Homo sapien
actagctgcctacgtgtgtgcattt

SEQ ID NO: 133666 - DNA, 25 bp, Homo sapien
tagctgcctacgtgtgtgcatttgc

SEQ ID NO: 133667 - DNA, 25 bp, Homo sapien
ctgcctacgtgtgtgcatttgctat

SEQ ID NO: 133668 - DNA, 25 bp, Homo sapien
gcctacgtgtgtgcatttgctatat

SEQ ID NO: 133669 - DNA, 25 bp, Homo sapien
acgtgtgtgcatttgctatatagca

SEQ ID NO: 133670 - DNA, 25 bp, Homo sapien
gcatttgctatatagcatacttctt

SEQ ID NO: 133671 - DNA, 25 bp, Homo sapien
tcttttttccagtttcaatctaact

SEQ ID NO: 133672 - DNA, 25 bp, Homo sapien
agtgtacctctgaccttctcatcaa

SEQ ID NO: 133673 - DNA, 25 bp, Homo sapien
tgaccttctcatcaagagagctggg

SEQ ID NO: 133674 - DNA, 25 bp, Homo sapien
tgcagctgaagcattttacagtggt

SEQ ID NO: 133675 - DNA, 25 bp, Homo sapien
agcattttacagtggtttgccatta

SEQ ID NO: 133676 - DNA, 25 bp, Homo sapien
tttgccattagggtattcattcaga

SEQ ID NO: 133677 - DNA, 25 bp, Homo sapien
gccattagggtattcattcagataa

SEQ ID NO: 133678 - DNA, 25 bp, Homo sapien
ttcagataatgttttcctactagga

SEQ ID NO: 133679 - DNA, 25 bp, Homo sapien
taaagggcctgttaattcttatatt

SEQ ID NO: 133680 - DNA, 25 bp, Homo sapien
tatttttctttactaatcattttgg

SEQ ID NO: 133681 - DNA, 25 bp, Homo sapien
tttctttgaattattggcagggaat

SEQ ID NO: 133682 - DNA, 25 bp, Homo sapien
tgtatggaagattactgctctgagt

SEQ ID NO: 133683 - DNA, 25 bp, Homo sapien
acgcgggcttcctgccgccggtggt

SEQ ID NO: 133684 - DNA, 25 bp, Homo sapien
ggcttcctgccgccggtggtgcggg

SEQ ID NO: 133685 - DNA, 25 bp, Homo sapien
gggcctgtgcacacccggcaccatc

SEQ ID NO: 133686 - DNA, 25 bp, Homo sapien
caccatccgctacggccccgcggag

SEQ ID NO: 133687 - DNA, 25 bp, Homo sapien
agctgggcctggtgtacccgcacct

SEQ ID NO: 133688 - DNA, 25 bp, Homo sapien
tgggcctggtgtacccgcacctgca

SEQ ID NO: 133689 - DNA, 25 bp, Homo sapien
ctggtgtacccgcacctgcagaggc

SEQ ID NO: 133690 - DNA, 25 bp, Homo sapien
tggtgtacccgcacctgcagaggct

SEQ ID NO: 133691 - DNA, 25 bp, Homo sapien
gcagaggctgggtccgggccccgcg

SEQ ID NO: 133692 - DNA, 25 bp, Homo sapien
cccaggacagtaggcccggctctgc

SEQ ID NO: 133693 - DNA, 25 bp, Homo sapien
gacagtaggcccggctctgcccgta

SEQ ID NO: 133694 - DNA, 25 bp, Homo sapien
agcccagtgggcattggaggtgcca

SEQ ID NO: 133695 - DNA, 25 bp, Homo sapien
ggagtcagggttgtagccaagacgc

SEQ ID NO: 133696 - DNA, 25 bp, Homo sapien
gtgggttctcaatacggtaccaaag

SEQ ID NO: 133697 - DNA, 25 bp, Homo sapien
gggttctcaatacggtaccaaagat

SEQ ID NO: 133698 - DNA, 25 bp, Homo sapien
ggtaccaaagatataatcacctagg

SEQ ID NO: 133699 - DNA, 25 bp, Homo sapien
gatataatcacctaggtttacaaat

SEQ ID NO: 133700 - DNA, 25 bp, Homo sapien
aggactcacgttaactcacatttat

SEQ ID NO: 133701 - DNA, 25 bp, Homo sapien
gactcacgttaactcacatttatac

SEQ ID NO: 133702 - DNA, 25 bp, Homo sapien
gttaactcacatttatacagcagaa

SEQ ID NO: 133703 - DNA, 25 bp, Homo sapien
aaatgctattttgtatgctgttaag

SEQ ID NO: 133704 - DNA, 25 bp, Homo sapien
gctattttgtatgctgttaagtttt

SEQ ID NO: 133705 - DNA, 25 bp, Homo sapien
ggtccatttgtgatgaacaccaatg

SEQ ID NO: 133706 - DNA, 25 bp, Homo sapien
ttctcaagctattcttgatttcaga

SEQ ID NO: 133707 - DNA, 25 bp, Homo sapien
gctattcttgatttcagaaacgcaa

SEQ ID NO: 133708 - DNA, 25 bp, Homo sapien
gggccaaaacctggaaatcaaagat

SEQ ID NO: 133709 - DNA, 25 bp, Homo sapien
cggaagagcaggtcttgatgtgtcc

SEQ ID NO: 133710 - DNA, 25 bp, Homo sapien
gattgagccattgaaggcattccat

SEQ ID NO: 133711 - DNA, 25 bp, Homo sapien
tgagccattgaaggcattccatttc

SEQ ID NO: 133712 - DNA, 25 bp, Homo sapien
agccggtgcttctaaagaattccac

SEQ ID NO: 133713 - DNA, 25 bp, Homo sapien
gcttctaaagaattccacactaacg

SEQ ID NO: 133714 - DNA, 25 bp, Homo sapien
ttccacactaacgtgataacatggt

SEQ ID NO: 133715 - DNA, 25 bp, Homo sapien
cgtgataacatggtttttgtaacaa

SEQ ID NO: 133716 - DNA, 25 bp, Homo sapien
gacaactggtggcagatttcgcttt

SEQ ID NO: 133717 - DNA, 25 bp, Homo sapien
aactggtggcagatttcgcttttcg

SEQ ID NO: 133718 - DNA, 25 bp, Homo sapien
ggcagatttcgcttttcgttgtaaa

SEQ ID NO: 133719 - DNA, 25 bp, Homo sapien
tcgcttttcgttgtaaatatcggtg

SEQ ID NO: 133720 - DNA, 25 bp, Homo sapien
ccaaaatgaccttcaggaccggcct

SEQ ID NO: 133721 - DNA, 25 bp, Homo sapien
ttcaggaccggcctgtttcccgtct

SEQ ID NO: 133722 - DNA, 25 bp, Homo sapien
gcctgtttcccgtctgggtccaact

SEQ ID NO: 133723 - DNA, 25 bp, Homo sapien
tctgggtccaactcctttctttgtg

SEQ ID NO: 133724 - DNA, 25 bp, Homo sapien
ttttattgtgcaaacatttctcaaa

SEQ ID NO: 133725 - DNA, 25 bp, Homo sapien
ttcagccccgaacttggagctcagc

SEQ ID NO: 133726 - DNA, 25 bp, Homo sapien
aacttggagctcagctattcggcgc

SEQ ID NO: 133727 - DNA, 25 bp, Homo sapien
cagatggcaagagggtgacagcttc

SEQ ID NO: 133728 - DNA, 25 bp, Homo sapien
gcaagagggtgacagcttcctttcc

SEQ ID NO: 133729 - DNA, 25 bp, Homo sapien
agagggtgacagcttcctttcctgt

SEQ ID NO: 133730 - DNA, 25 bp, Homo sapien
ctttcctgtgtgtactctgtccagt

SEQ ID NO: 133731 - DNA, 25 bp, Homo sapien
gtgtgtactctgtccagttccttta

SEQ ID NO: 133732 - DNA, 25 bp, Homo sapien
gtgtactctgtccagttcctttaga

SEQ ID NO: 133733 - DNA, 25 bp, Homo sapien
agaggactcccaaccctggcttggg

SEQ ID NO: 133734 - DNA, 25 bp, Homo sapien
gctgttgttccattgaagccgactc

SEQ ID NO: 133735 - DNA, 25 bp, Homo sapien
tgttgttccattgaagccgactctg

SEQ ID NO: 133736 - DNA, 25 bp, Homo sapien
attgaagccgactctggccctggcc

SEQ ID NO: 133737 - DNA, 25 bp, Homo sapien
ttacttgcttctctagctctctagg

SEQ ID NO: 133738 - DNA, 25 bp, Homo sapien
ttccaataaacactgcagagggagc

SEQ ID NO: 133739 - DNA, 25 bp, Homo sapien
agggagcacccctcgttgctgagtc

SEQ ID NO: 133740 - DNA, 25 bp, Homo sapien
aaaccttccacccagtgctgaattt

SEQ ID NO: 133741 - DNA, 25 bp, Homo sapien
accaagttccttggccatgcagaaa

SEQ ID NO: 133742 - DNA, 25 bp, Homo sapien
acccatcctagaggccaggcaggag

SEQ ID NO: 133743 - DNA, 25 bp, Homo sapien
atacccacccagaatgagacatcca

SEQ ID NO: 133744 - DNA, 25 bp, Homo sapien
gagacatccagcagatttccagcct

SEQ ID NO: 133745 - DNA, 25 bp, Homo sapien
agcagatttccagccttctactgct

SEQ ID NO: 133746 - DNA, 25 bp, Homo sapien
ctcaactccgtgcttaaccaaagaa

SEQ ID NO: 133747 - DNA, 25 bp, Homo sapien
ttaaccaaagaagctgtactccggg

SEQ ID NO: 133748 - DNA, 25 bp, Homo sapien
tccggggggtctcttctgaataaag

SEQ ID NO: 133749 - DNA, 25 bp, Homo sapien
tgacgggtacagacatgagatgctt

SEQ ID NO: 133750 - DNA, 25 bp, Homo sapien
acagacatgagatgcttccagccag

SEQ ID NO: 133751 - DNA, 25 bp, Homo sapien
agacatgagatgcttccagccagcc

SEQ ID NO: 133752 - DNA, 25 bp, Homo sapien
catgagatgcttccagccagcctca

SEQ ID NO: 133753 - DNA, 25 bp, Homo sapien
agcgggattacttcggggctcacac

SEQ ID NO: 133754 - DNA, 25 bp, Homo sapien
gggctcacacctatgaactcttggc

SEQ ID NO: 133755 - DNA, 25 bp, Homo sapien
tcacacctatgaactcttggccaaa

SEQ ID NO: 133756 - DNA, 25 bp, Homo sapien
acctatgaactcttggccaaaccag

SEQ ID NO: 133757 - DNA, 25 bp, Homo sapien
gaactcttggccaaaccagggcagt

SEQ ID NO: 133758 - DNA, 25 bp, Homo sapien
actcttggccaaaccagggcagttt

SEQ ID NO: 133759 - DNA, 25 bp, Homo sapien
atccacaccaactggacaggccatg

SEQ ID NO: 133760 - DNA, 25 bp, Homo sapien
aggtggccagatggttccaggacta

SEQ ID NO: 133761 - DNA, 25 bp, Homo sapien
cagatggttccaggactacaatgtc

SEQ ID NO: 133762 - DNA, 25 bp, Homo sapien
atttttaactgtttgccactgctgc

SEQ ID NO: 133763 - DNA, 25 bp, Homo sapien
taactgtttgccactgctgccctca

SEQ ID NO: 133764 - DNA, 25 bp, Homo sapien
tggagtaccgtctgccccagacaag

SEQ ID NO: 133765 - DNA, 25 bp, Homo sapien
tctgccccagacaagtgggagtgaa

SEQ ID NO: 133766 - DNA, 25 bp, Homo sapien
gggaagcactgattcccagttaggg

SEQ ID NO: 133767 - DNA, 25 bp, Homo sapien
ggtgcctaactgagcagtagggata

SEQ ID NO: 133768 - DNA, 25 bp, Homo sapien
gtgaacctgggagtgcttttataaa

SEQ ID NO: 133769 - DNA, 25 bp, Homo sapien
tttaatttatctctgtgacctgcca

SEQ ID NO: 133770 - DNA, 25 bp, Homo sapien
ttatctctgtgacctgccagggaga

SEQ ID NO: 133771 - DNA, 25 bp, Homo sapien
tttctttgtccacacgcctaacagg

SEQ ID NO: 133772 - DNA, 25 bp, Homo sapien
ttgtccacacgcctaacaggacgta

SEQ ID NO: 133773 - DNA, 25 bp, Homo sapien
tccacacgcctaacaggacgtatta

SEQ ID NO: 133774 - DNA, 25 bp, Homo sapien
acgcctaacaggacgtattatctga

SEQ ID NO: 133775 - DNA, 25 bp, Homo sapien
aggacgtattatctgatggacccca

SEQ ID NO: 133776 - DNA, 25 bp, Homo sapien
gtattatctgatggaccccagcggg

SEQ ID NO: 133777 - DNA, 25 bp, Homo sapien
ttatctgatggaccccagcgggaac

SEQ ID NO: 133778 - DNA, 25 bp, Homo sapien
tgatggaccccagcgggaacgcaca

SEQ ID NO: 133779 - DNA, 25 bp, Homo sapien
cagcgggaacgcacacaagtggtgc

SEQ ID NO: 133780 - DNA, 25 bp, Homo sapien
atccaggaggtttggaggcagcgat

SEQ ID NO: 133781 - DNA, 25 bp, Homo sapien
ggcagcgataccagagccacccgga

SEQ ID NO: 133782 - DNA, 25 bp, Homo sapien
ttgcaacaccagcttctaaggattt

SEQ ID NO: 133783 - DNA, 25 bp, Homo sapien
caccagcttctaaggattttttaag

SEQ ID NO: 133784 - DNA, 25 bp, Homo sapien
gtgtgtgtatataagctcccacata

SEQ ID NO: 133785 - DNA, 25 bp, Homo sapien
taagctcccacatagatacatgtaa

SEQ ID NO: 133786 - DNA, 25 bp, Homo sapien
aaaacatattcacacccatgcacgc

SEQ ID NO: 133787 - DNA, 25 bp, Homo sapien
acacatacacactgaaggccacgat

SEQ ID NO: 133788 - DNA, 25 bp, Homo sapien
aaggccacgattgctggctccacaa

SEQ ID NO: 133789 - DNA, 25 bp, Homo sapien
gctggctccacaatttagtaacatt

SEQ ID NO: 133790 - DNA, 25 bp, Homo sapien
caaaggagatggtgtggcttagcaa

SEQ ID NO: 133791 - DNA, 25 bp, Homo sapien
aacagtgcaggaaatgtaggttacc

SEQ ID NO: 133792 - DNA, 25 bp, Homo sapien
gtaggttaccaactaagcagctttt

SEQ ID NO: 133793 - DNA, 25 bp, Homo sapien
gagatacttctggtcttactgcaca

SEQ ID NO: 133794 - DNA, 25 bp, Homo sapien
ctggtcttactgcacagtcttttaa

SEQ ID NO: 133795 - DNA, 25 bp, Homo sapien
atacttccattatgccacattgtcc

SEQ ID NO: 133796 - DNA, 25 bp, Homo sapien
gccacattgtccttgatccgtaagt

SEQ ID NO: 133797 - DNA, 25 bp, Homo sapien
aaggtgcttcaaaggaactctgacc

SEQ ID NO: 133798 - DNA, 25 bp, Homo sapien
aaggaactctgacctctgaagtact

SEQ ID NO: 133799 - DNA, 25 bp, Homo sapien
gagctactttagtatgtccagccta

SEQ ID NO: 133800 - DNA, 25 bp, Homo sapien
gtatgtccagcctattgctttttgt

SEQ ID NO: 133801 - DNA, 25 bp, Homo sapien
gctttttgttttagtgtgtcaccat

SEQ ID NO: 133802 - DNA, 25 bp, Homo sapien
gggcataaaaggctatctattctta

SEQ ID NO: 133803 - DNA, 25 bp, Homo sapien
gtggaatttgctactgactcattgg

SEQ ID NO: 133804 - DNA, 25 bp, Homo sapien
cagatggcaagagggtgacagcttc

SEQ ID NO: 133805 - DNA, 25 bp, Homo sapien
atggcaagagggtgacagcttcctt

SEQ ID NO: 133806 - DNA, 25 bp, Homo sapien
gcaagagggtgacagcttcctttcc

SEQ ID NO: 133807 - DNA, 25 bp, Homo sapien
aagagggtgacagcttcctttcctg

SEQ ID NO: 133808 - DNA, 25 bp, Homo sapien
agagggtgacagcttcctttcctgt

SEQ ID NO: 133809 - DNA, 25 bp, Homo sapien
ctttcctgtgtgtactctgtccagt

SEQ ID NO: 133810 - DNA, 25 bp, Homo sapien
ttcctgtgtgtactctgtccagttc

SEQ ID NO: 133811 - DNA, 25 bp, Homo sapien
gtgtgtactctgtccagttccttta

SEQ ID NO: 133812 - DNA, 25 bp, Homo sapien
gtgtactctgtccagttcctttaga

SEQ ID NO: 133813 - DNA, 25 bp, Homo sapien
gctgttgttccattgaagccgactc

SEQ ID NO: 133814 - DNA, 25 bp, Homo sapien
tgttgttccattgaagccgactctg

SEQ ID NO: 133815 - DNA, 25 bp, Homo sapien
aaagctgtcccacaatcatggagcc

SEQ ID NO: 133816 - DNA, 25 bp, Homo sapien
cctgccgccacatgcagtggaggag

SEQ ID NO: 133817 - DNA, 25 bp, Homo sapien
ggcctgtggcccaaagaacctggta

SEQ ID NO: 133818 - DNA, 25 bp, Homo sapien
ggtggcgcagccttggtaacgccat

SEQ ID NO: 133819 - DNA, 25 bp, Homo sapien
ccttggtaacgccatggactgcagc

SEQ ID NO: 133820 - DNA, 25 bp, Homo sapien
tggactgcagcgacaatcaatggat

SEQ ID NO: 133821 - DNA, 25 bp, Homo sapien
aatcaatggatggtgctgtctatgc

SEQ ID NO: 133822 - DNA, 25 bp, Homo sapien
tggtgctgtctatgcacaggtgtga

SEQ ID NO: 133823 - DNA, 25 bp, Homo sapien
gagtcctctgtttgcactggacata

SEQ ID NO: 133824 - DNA, 25 bp, Homo sapien
tttgcactggacatattccctacct

SEQ ID NO: 133825 - DNA, 25 bp, Homo sapien
atattccctacctgtcttatttcat

SEQ ID NO: 133826 - DNA, 25 bp, Homo sapien
ttttccggggttctgcgcggatcca

SEQ ID NO: 133827 - DNA, 25 bp, Homo sapien
ttccggggttctgcgcggatccagc

SEQ ID NO: 133828 - DNA, 25 bp, Homo sapien
gttctgcgcggatccagctccccat

SEQ ID NO: 133829 - DNA, 25 bp, Homo sapien
cttgctagggaccgcagtccctcag

SEQ ID NO: 133830 - DNA, 25 bp, Homo sapien
agggaccgcagtccctcagccgcag

SEQ ID NO: 133831 - DNA, 25 bp, Homo sapien
tcagccgcagctgggtctgtccgcc

SEQ ID NO: 133832 - DNA, 25 bp, Homo sapien
gcggatttggtgaagtcggcctcaa

SEQ ID NO: 133833 - DNA, 25 bp, Homo sapien
cggatttggtgaagtcggcctcaag

SEQ ID NO: 133834 - DNA, 25 bp, Homo sapien
ggatttggtgaagtcggcctcaagt

SEQ ID NO: 133835 - DNA, 25 bp, Homo sapien
gatttggtgaagtcggcctcaagtc

SEQ ID NO: 133836 - DNA, 25 bp, Homo sapien
atttggtgaagtcggcctcaagtcc

SEQ ID NO: 133837 - DNA, 25 bp, Homo sapien
agagctgcagcttgggtactggtta

SEQ ID NO: 133838 - DNA, 25 bp, Homo sapien
gcaggatgtaacagatacaccgtaa

SEQ ID NO: 133839 - DNA, 25 bp, Homo sapien
gatacaccgtaaaggcatcttaaag

SEQ ID NO: 133840 - DNA, 25 bp, Homo sapien
gcatcttaaagccttgaaaaatgtt

SEQ ID NO: 133841 - DNA, 25 bp, Homo sapien
ataatcttttataccttgcaattcc

SEQ ID NO: 133842 - DNA, 25 bp, Homo sapien
tataccttgcaattccatttctggg

SEQ ID NO: 133843 - DNA, 25 bp, Homo sapien
tccatttctgggattttatcctaag

SEQ ID NO: 133844 - DNA, 25 bp, Homo sapien
gagatgttgacggattgcttacaca

SEQ ID NO: 133845 - DNA, 25 bp, Homo sapien
gacggattgcttacacagtgtctac

SEQ ID NO: 133846 - DNA, 25 bp, Homo sapien
gcttacacagtgtctacttattagt

SEQ ID NO: 133847 - DNA, 25 bp, Homo sapien
gtgaaacaaaagtgtccagtgacag

SEQ ID NO: 133848 - DNA, 25 bp, Homo sapien
gcaccagcggaggacatggccagat

SEQ ID NO: 133849 - DNA, 25 bp, Homo sapien
atggccagatactactcggcgctgc

SEQ ID NO: 133850 - DNA, 25 bp, Homo sapien
actactcggcgctgcgacactacat

SEQ ID NO: 133851 - DNA, 25 bp, Homo sapien
atcaacctcatcaccaggcagagat

SEQ ID NO: 133852 - DNA, 25 bp, Homo sapien
gaaaacgatccagcccagagacact

SEQ ID NO: 133853 - DNA, 25 bp, Homo sapien
cactgatttcagacctcttgatgag

SEQ ID NO: 133854 - DNA, 25 bp, Homo sapien
aaatgttcccagaactcggcttgaa

SEQ ID NO: 133855 - DNA, 25 bp, Homo sapien
tcggcttgaagaccctgcaatgtgg

SEQ ID NO: 133856 - DNA, 25 bp, Homo sapien
aaatgagacttgctctctggccttt

SEQ ID NO: 133857 - DNA, 25 bp, Homo sapien
tcagcccatatttcatcgtgtaaaa

SEQ ID NO: 133858 - DNA, 25 bp, Homo sapien
tgtaaaacgagaatccacccatcct

SEQ ID NO: 133859 - DNA, 25 bp, Homo sapien
ccacaatcatggagccctgcgacct

SEQ ID NO: 133860 - DNA, 25 bp, Homo sapien
gccctgccgccacatgcagtggagg

SEQ ID NO: 133861 - DNA, 25 bp, Homo sapien
tggatggtgctgtctatgcacaggt

SEQ ID NO: 133862 - DNA, 25 bp, Homo sapien
tggtgctgtctatgcacaggtgtga

SEQ ID NO: 133863 - DNA, 25 bp, Homo sapien
tgagtcctctgtttgcactggacat

SEQ ID NO: 133864 - DNA, 25 bp, Homo sapien
tcctctgtttgcactggacatattc

SEQ ID NO: 133865 - DNA, 25 bp, Homo sapien
ctctgtttgcactggacatattccc

SEQ ID NO: 133866 - DNA, 25 bp, Homo sapien
gtttgcactggacatattccctacc

SEQ ID NO: 133867 - DNA, 25 bp, Homo sapien
tgcactggacatattccctacctgt

SEQ ID NO: 133868 - DNA, 25 bp, Homo sapien
tcataggtacatgaagtattgtgta

SEQ ID NO: 133869 - DNA, 25 bp, Homo sapien
agagataagatttaaccaacatcaa

SEQ ID NO: 133870 - DNA, 25 bp, Homo sapien
tatgtttttggagtgctggagtgac

SEQ ID NO: 133871 - DNA, 25 bp, Homo sapien
gctggagtgacttgtgaatttctga

SEQ ID NO: 133872 - DNA, 25 bp, Homo sapien
ttttcccttcatctaacattgattg

SEQ ID NO: 133873 - DNA, 25 bp, Homo sapien
gattgaacatctcttatgtgcatag

SEQ ID NO: 133874 - DNA, 25 bp, Homo sapien
tgtgcatagtgggagcttagtattt

SEQ ID NO: 133875 - DNA, 25 bp, Homo sapien
actttaaaagatggcctcttggtgg

SEQ ID NO: 133876 - DNA, 25 bp, Homo sapien
tcttggtgggacagacatttgtata

SEQ ID NO: 133877 - DNA, 25 bp, Homo sapien
gacatttgtataagtcacaggccat

SEQ ID NO: 133878 - DNA, 25 bp, Homo sapien
tcacaggccatgtcatactgtgctt

SEQ ID NO: 133879 - DNA, 25 bp, Homo sapien
ttcttgttcatgtgagcatttaaca

SEQ ID NO: 133880 - DNA, 25 bp, Homo sapien
catttaacaacctgtgatgtgggca

SEQ ID NO: 133881 - DNA, 25 bp, Homo sapien
gcccaggcctgctggcatcaggtct

SEQ ID NO: 133882 - DNA, 25 bp, Homo sapien
tcaggtctgggcaagtagcaggact

SEQ ID NO: 133883 - DNA, 25 bp, Homo sapien
gcaagtagcaggactaggcatgtca

SEQ ID NO: 133884 - DNA, 25 bp, Homo sapien
actaggcatgtcagaggaccccagg

SEQ ID NO: 133885 - DNA, 25 bp, Homo sapien
gttagaggaaaagactcctcctggg

SEQ ID NO: 133886 - DNA, 25 bp, Homo sapien
acgcgcgagtgtgctgtatggccca

SEQ ID NO: 133887 - DNA, 25 bp, Homo sapien
tgctgtatggcccaggcagcctcaa

SEQ ID NO: 133888 - DNA, 25 bp, Homo sapien
agcctcaaggccctcggagctggct

SEQ ID NO: 133889 - DNA, 25 bp, Homo sapien
tgtgtaccacttctgtgggcatggc

SEQ ID NO: 133890 - DNA, 25 bp, Homo sapien
ttctgtgggcatggccgcttctaga

SEQ ID NO: 133891 - DNA, 25 bp, Homo sapien
gggcatggccgcttctagagcctcg

SEQ ID NO: 133892 - DNA, 25 bp, Homo sapien
gctcatcgatgtgggaactgggtac

SEQ ID NO: 133893 - DNA, 25 bp, Homo sapien
gatagattttctaaccaagcagatg

SEQ ID NO: 133894 - DNA, 25 bp, Homo sapien
ggagaaaatccaaccagctcttcag

SEQ ID NO: 133895 - DNA, 25 bp, Homo sapien
agctcttcaggagaagcacgccatg

SEQ ID NO: 133896 - DNA, 25 bp, Homo sapien
agcacgccatgaaacaggccgtcat

SEQ ID NO: 133897 - DNA, 25 bp, Homo sapien
tgaaacaggccgtcatggaaatgat

SEQ ID NO: 133898 - DNA, 25 bp, Homo sapien
atgatgagtcagaagattcagcagc

SEQ ID NO: 133899 - DNA, 25 bp, Homo sapien
ggctactgctaaggcctgagagttt

SEQ ID NO: 133900 - DNA, 25 bp, Homo sapien
taaggcctgagagtttttgcagaaa

SEQ ID NO: 133901 - DNA, 25 bp, Homo sapien
ccctttgggcgtggcttcctggtga

SEQ ID NO: 133902 - DNA, 25 bp, Homo sapien
tgatgggaagggtcttgtgttttaa

SEQ ID NO: 133903 - DNA, 25 bp, Homo sapien
tatgtggtatccatgtgtatcgacc

SEQ ID NO: 133904 - DNA, 25 bp, Homo sapien
ggtatccatgtgtatcgaccatgtg

SEQ ID NO: 133905 - DNA, 25 bp, Homo sapien
atgtgtatcgaccatgtgccatata

SEQ ID NO: 133906 - DNA, 25 bp, Homo sapien
gtatcgaccatgtgccatatatcaa

SEQ ID NO: 133907 - DNA, 25 bp, Homo sapien
gaccatgtgccatatatcaattatg

SEQ ID NO: 133908 - DNA, 25 bp, Homo sapien
tatggtcactagaaagtctctttat

SEQ ID NO: 133909 - DNA, 25 bp, Homo sapien
gtactgtttttcatttcacttgcaa

SEQ ID NO: 133910 - DNA, 25 bp, Homo sapien
tcctcctttctacccataaattaca

SEQ ID NO: 133911 - DNA, 25 bp, Homo sapien
tcccatgtgtactggtattattaaa

SEQ ID NO: 133912 - DNA, 25 bp, Homo sapien
agacatttacatacgcaagtttttc

SEQ ID NO: 133913 - DNA, 25 bp, Homo sapien
acatacgcaagtttttcactgacaa

SEQ ID NO: 133914 - DNA, 25 bp, Homo sapien
aacttaaatgtgtagttccagtcct

SEQ ID NO: 133915 - DNA, 25 bp, Homo sapien
gtagttccagtccttctatgcagag

SEQ ID NO: 133916 - DNA, 25 bp, Homo sapien
ttctatgcagagtctctcctgccct

SEQ ID NO: 133917 - DNA, 25 bp, Homo sapien
ttcctgcaggcaaatatacaagcta

SEQ ID NO: 133918 - DNA, 25 bp, Homo sapien
aatatacaagctagaccctgttccc

SEQ ID NO: 133919 - DNA, 25 bp, Homo sapien
tgtatcctgtctcccctaattgaca

SEQ ID NO: 133920 - DNA, 25 bp, Homo sapien
taattgacattctatcagcccaacc

SEQ ID NO: 133921 - DNA, 25 bp, Homo sapien
catacctcatcatgaacccttgggt

SEQ ID NO: 133922 - DNA, 25 bp, Homo sapien
gaacccttgggtagcttgattctgc

SEQ ID NO: 133923 - DNA, 25 bp, Homo sapien
ttgattctgcctaccatccaggaaa

SEQ ID NO: 133924 - DNA, 25 bp, Homo sapien
ctaccatccaggaaaacttgtgctg

SEQ ID NO: 133925 - DNA, 25 bp, Homo sapien
gtacctttgacccatcatcttggga

SEQ ID NO: 133926 - DNA, 25 bp, Homo sapien
gtattagtccaatgagatttccctc

SEQ ID NO: 133927 - DNA, 25 bp, Homo sapien
tcttcatccgcagcagtgtatctat

SEQ ID NO: 133928 - DNA, 25 bp, Homo sapien
tatctattctatacctggctatggg

SEQ ID NO: 133929 - DNA, 25 bp, Homo sapien
ttgcatgggagggaccccttgctat

SEQ ID NO: 133930 - DNA, 25 bp, Homo sapien
ttgctatggcccctttagccaggca

SEQ ID NO: 133931 - DNA, 25 bp, Homo sapien
tttagccaggcagtgggatctacct

SEQ ID NO: 133932 - DNA, 25 bp, Homo sapien
gtgggatctacctgtggcccggcct

SEQ ID NO: 133933 - DNA, 25 bp, Homo sapien
gcctccctaatgtcattcacattga

SEQ ID NO: 133934 - DNA, 25 bp, Homo sapien
aggtcggacagtggctcatagagcc

SEQ ID NO: 133935 - DNA, 25 bp, Homo sapien
agagccgagtatgagccctagctgt

SEQ ID NO: 133936 - DNA, 25 bp, Homo sapien
tcataccatagaagggaacacaggt

SEQ ID NO: 133937 - DNA, 25 bp, Homo sapien
agaagggaacacaggttaccatatt

SEQ ID NO: 133938 - DNA, 25 bp, Homo sapien
ggaacacaggttaccatattggttt

SEQ ID NO: 133939 - DNA, 25 bp, Homo sapien
cacaggttaccatattggtttgtaa

SEQ ID NO: 133940 - DNA, 25 bp, Homo sapien
ttggtttgtaatatgggtcttggtg

SEQ ID NO: 133941 - DNA, 25 bp, Homo sapien
aaattttgttcccatgagttttgtg

SEQ ID NO: 133942 - DNA, 25 bp, Homo sapien
tgagaacatccccttgacagttgca

SEQ ID NO: 133943 - DNA, 25 bp, Homo sapien
agaacatccccttgacagttgcagc

SEQ ID NO: 133944 - DNA, 25 bp, Homo sapien
aacatccccttgacagttgcagcct

SEQ ID NO: 133945 - DNA, 25 bp, Homo sapien
gcagcctcttgacctcggataacaa

SEQ ID NO: 133946 - DNA, 25 bp, Homo sapien
cggataacaataagagagctcatct

SEQ ID NO: 133947 - DNA, 25 bp, Homo sapien
tatgtcagaccagacctaggtgctt

SEQ ID NO: 133948 - DNA, 25 bp, Homo sapien
cctggggtcctgtggataactgagt

SEQ ID NO: 133949 - DNA, 25 bp, Homo sapien
ctggggtcctgtggataactgagtg

SEQ ID NO: 133950 - DNA, 25 bp, Homo sapien
tggggtcctgtggataactgagtgg

SEQ ID NO: 133951 - DNA, 25 bp, Homo sapien
ggggtcctgtggataactgagtggg

SEQ ID NO: 133952 - DNA, 25 bp, Homo sapien
gggtcctgtggataactgagtgggg

SEQ ID NO: 133953 - DNA, 25 bp, Homo sapien
ggtcctgtggataactgagtgggga

SEQ ID NO: 133954 - DNA, 25 bp, Homo sapien
gggagggcaccttcccattgtgcct

SEQ ID NO: 133955 - DNA, 25 bp, Homo sapien
gtgtgtattgtgcattaacctcttc

SEQ ID NO: 133956 - DNA, 25 bp, Homo sapien
tgtgtattgtgcattaacctcttcc

SEQ ID NO: 133957 - DNA, 25 bp, Homo sapien
gtgtattgtgcattaacctcttcct

SEQ ID NO: 133958 - DNA, 25 bp, Homo sapien
tccttagttagccacttgtgtcatt

SEQ ID NO: 133959 - DNA, 25 bp, Homo sapien
tagccacttgtgtcatttccaggtt

SEQ ID NO: 133960 - DNA, 25 bp, Homo sapien
cacttgtgtcatttccaggttttct

SEQ ID NO: 133961 - DNA, 25 bp, Homo sapien
aggtatgaacggatgcctcagtgtc

SEQ ID NO: 133962 - DNA, 25 bp, Homo sapien
gaacggatgcctcagtgtccaagat

SEQ ID NO: 133963 - DNA, 25 bp, Homo sapien
gatgcctcagtgtccaagatacaaa

SEQ ID NO: 133964 - DNA, 25 bp, Homo sapien
gtccaagatacaaaaggcaccacat

SEQ ID NO: 133965 - DNA, 25 bp, Homo sapien
agatacaaaaggcaccacatagaag

SEQ ID NO: 133966 - DNA, 25 bp, Homo sapien
catagaagtttgctttttccctgcc

SEQ ID NO: 133967 - DNA, 25 bp, Homo sapien
accacctcttccctgagaagggcgg

SEQ ID NO: 133968 - DNA, 25 bp, Homo sapien
tcttccctgagaagggcgggccttc

SEQ ID NO: 133969 - DNA, 25 bp, Homo sapien
aagcctgagaatgtggacatcaccc

SEQ ID NO: 133970 - DNA, 25 bp, Homo sapien
gacatcacccgggaacctgaggaag

SEQ ID NO: 133971 - DNA, 25 bp, Homo sapien
tggatactgtcccagcccactactg

SEQ ID NO: 133972 - DNA, 25 bp, Homo sapien
actactgagccctttccaagaagtc

SEQ ID NO: 133973 - DNA, 25 bp, Homo sapien
ctttccaagaagtcaaactgcctgt

SEQ ID NO: 133974 - DNA, 25 bp, Homo sapien
ggaaatgctatctttgctcttctcc

SEQ ID NO: 133975 - DNA, 25 bp, Homo sapien
gaggcaccccacttccagtgaagaa

SEQ ID NO: 133976 - DNA, 25 bp, Homo sapien
ttccagtgaagaagtcctccgcaac

SEQ ID NO: 133977 - DNA, 25 bp, Homo sapien
tggccgcaaccaaggagctatctag

SEQ ID NO: 133978 - DNA, 25 bp, Homo sapien
agctatctagctctggaggaaactt

SEQ ID NO: 133979 - DNA, 25 bp, Homo sapien
ctttctttcttaattcctattctct

SEQ ID NO: 133980 - DNA, 25 bp, Homo sapien
tttatggtgatgtcactcacctaga

SEQ ID NO: 133981 - DNA, 25 bp, Homo sapien
gtgatgtcactcacctagacaacca

SEQ ID NO: 133982 - DNA, 25 bp, Homo sapien
atgtcactcacctagacaaccagag

SEQ ID NO: 133983 - DNA, 25 bp, Homo sapien
tcacctagacaaccagaggctggca

SEQ ID NO: 133984 - DNA, 25 bp, Homo sapien
ccagaggctggcattgaggctaacc

SEQ ID NO: 133985 - DNA, 25 bp, Homo sapien
ggctggcattgaggctaacctccaa

SEQ ID NO: 133986 - DNA, 25 bp, Homo sapien
ttgaggctaacctccaacacagtgc

SEQ ID NO: 133987 - DNA, 25 bp, Homo sapien
taacctccaacacagtgcatctcag

SEQ ID NO: 133988 - DNA, 25 bp, Homo sapien
tccaacacagtgcatctcagatgcc

SEQ ID NO: 133989 - DNA, 25 bp, Homo sapien
tgcatctcagatgcctcagtaggca

SEQ ID NO: 133990 - DNA, 25 bp, Homo sapien
gatgcctcagtaggcatcagtatgt

SEQ ID NO: 133991 - DNA, 25 bp, Homo sapien
actagtgtccctgcctgaggatagc

SEQ ID NO: 133992 - DNA, 25 bp, Homo sapien
aggacagtagctgctctactcctag

SEQ ID NO: 133993 - DNA, 25 bp, Homo sapien
gctctactcctagggcagatagatt

SEQ ID NO: 133994 - DNA, 25 bp, Homo sapien
actacctggccaggctgttggaagc

SEQ ID NO: 133995 - DNA, 25 bp, Homo sapien
ttggaagctgactgccgagtactga

SEQ ID NO: 133996 - DNA, 25 bp, Homo sapien
actgccgagtactgaacattgtcaa

SEQ ID NO: 133997 - DNA, 25 bp, Homo sapien
gaacattgtcaacgtggtctataaa

SEQ ID NO: 133998 - DNA, 25 bp, Homo sapien
ggtctataaagtgactcggcccctg

SEQ ID NO: 133999 - DNA, 25 bp, Homo sapien
agtgccaacagctgcctggatcctg

SEQ ID NO: 134000 - DNA, 25 bp, Homo sapien
tggatcctgtgctctacttgctcac

SEQ ID NO: 134001 - DNA, 25 bp, Homo sapien
ggacaaatatcgacgtcagctccgt

SEQ ID NO: 134002 - DNA, 25 bp, Homo sapien
ttctcggtgcaatcctgctggcgct

SEQ ID NO: 134003 - DNA, 25 bp, Homo sapien
cggtgcaatcctgctggcgcttttc

SEQ ID NO: 134004 - DNA, 25 bp, Homo sapien
atctctgctcctacacacacaaaag

SEQ ID NO: 134005 - DNA, 25 bp, Homo sapien
ctctgctcctacacacacaaaagaa

SEQ ID NO: 134006 - DNA, 25 bp, Homo sapien
aagaaaacaactctcgattggaagt

SEQ ID NO: 134007 - DNA, 25 bp, Homo sapien
gaagttgtggaattttctcagcccc

SEQ ID NO: 134008 - DNA, 25 bp, Homo sapien
agttgtggaattttctcagccccta

SEQ ID NO: 134009 - DNA, 25 bp, Homo sapien
tggaattttctcagcccctacgagg

SEQ ID NO: 134010 - DNA, 25 bp, Homo sapien
tttctcagcccctacgaggcgcggg

SEQ ID NO: 134011 - DNA, 25 bp, Homo sapien
ttcgctcgcctgccttgctagggac

SEQ ID NO: 134012 - DNA, 25 bp, Homo sapien
atttggtgaagtcggcctcaagtcc

SEQ ID NO: 134013 - DNA, 25 bp, Homo sapien
gggaggccgggcgtggcttgcacgc

SEQ ID NO: 134014 - DNA, 25 bp, Homo sapien
ggaggccgggcgtggcttgcacgcc

SEQ ID NO: 134015 - DNA, 25 bp, Homo sapien
gaggccgggcgtggcttgcacgcct

SEQ ID NO: 134016 - DNA, 25 bp, Homo sapien
gccaaggcaggcagttacctgagat

SEQ ID NO: 134017 - DNA, 25 bp, Homo sapien
ccaaggcaggcagttacctgagatc

SEQ ID NO: 134018 - DNA, 25 bp, Homo sapien
caaggcaggcagttacctgagatca

SEQ ID NO: 134019 - DNA, 25 bp, Homo sapien
aggcaggcagttacctgagatcagg

SEQ ID NO: 134020 - DNA, 25 bp, Homo sapien
ttgaaccctgggagacaagaggttg

SEQ ID NO: 134021 - DNA, 25 bp, Homo sapien
tgaaccctgggagacaagaggttgc

SEQ ID NO: 134022 - DNA, 25 bp, Homo sapien
gaaccctgggagacaagaggttgca

SEQ ID NO: 134023 - DNA, 25 bp, Homo sapien
aaccctgggagacaagaggttgcag

SEQ ID NO: 134024 - DNA, 25 bp, Homo sapien
gtgccagtggactcttcccttatat

SEQ ID NO: 134025 - DNA, 25 bp, Homo sapien
tatatctctgcaccacaagttgttg

SEQ ID NO: 134026 - DNA, 25 bp, Homo sapien
caagttgttggatgtttcctcttcc

SEQ ID NO: 134027 - DNA, 25 bp, Homo sapien
tttggcccttatccttccttgtaca

SEQ ID NO: 134028 - DNA, 25 bp, Homo sapien
gatttctgcttacactttgatttca

SEQ ID NO: 134029 - DNA, 25 bp, Homo sapien
tgatttcagagctttattccccagt

SEQ ID NO: 134030 - DNA, 25 bp, Homo sapien
tgttcttactcctttgtcgcttatc

SEQ ID NO: 134031 - DNA, 25 bp, Homo sapien
gtcgcttatccagaatgatgctatg

SEQ ID NO: 134032 - DNA, 25 bp, Homo sapien
tagcatcttgctgtaaatcctgtac

SEQ ID NO: 134033 - DNA, 25 bp, Homo sapien
gattctgtgtaaatagctgtggcct

SEQ ID NO: 134034 - DNA, 25 bp, Homo sapien
gtggcctatgccaataatgaagagc

SEQ ID NO: 134035 - DNA, 25 bp, Homo sapien
gtggtgcgggattaccagtccaagt

SEQ ID NO: 134036 - DNA, 25 bp, Homo sapien
gggattaccagtccaagttggccat

SEQ ID NO: 134037 - DNA, 25 bp, Homo sapien
gtccaagttggccatgtccaagaaa

SEQ ID NO: 134038 - DNA, 25 bp, Homo sapien
atccttaacaagaactagcgctgca

SEQ ID NO: 134039 - DNA, 25 bp, Homo sapien
aagaactagcgctgcacatccgcct

SEQ ID NO: 134040 - DNA, 25 bp, Homo sapien
tgtcctcgctccacgtttcaggcag

SEQ ID NO: 134041 - DNA, 25 bp, Homo sapien
gtttcaggcaggcacctagcaattc

SEQ ID NO: 134042 - DNA, 25 bp, Homo sapien
gcaattccatcacccgtacaggcaa

SEQ ID NO: 134043 - DNA, 25 bp, Homo sapien
gtacaggcaattccgtcttcttaat

SEQ ID NO: 134044 - DNA, 25 bp, Homo sapien
ggcaattccgtcttcttaatctgaa

SEQ ID NO: 134045 - DNA, 25 bp, Homo sapien
gaagcttcactcactgtcaatgatt

SEQ ID NO: 134046 - DNA, 25 bp, Homo sapien
aatccagatgtttgttgggacagaa

SEQ ID NO: 134047 - DNA, 25 bp, Homo sapien
cagagccctggaacaaactgggtcc

SEQ ID NO: 134048 - DNA, 25 bp, Homo sapien
aactgggtcccaatgatcaatacaa

SEQ ID NO: 134049 - DNA, 25 bp, Homo sapien
tacaagttctactcagtgaatgtgg

SEQ ID NO: 134050 - DNA, 25 bp, Homo sapien
tgaatgtggattacagcaagctgaa

SEQ ID NO: 134051 - DNA, 25 bp, Homo sapien
gaaggaacgtccagatttctaaatg

SEQ ID NO: 134052 - DNA, 25 bp, Homo sapien
gaaatgtttcactataacgctgctt

SEQ ID NO: 134053 - DNA, 25 bp, Homo sapien
ataacgctgctttagaatgaaggtc

SEQ ID NO: 134054 - DNA, 25 bp, Homo sapien
acatccgcacaattttccacttaac

SEQ ID NO: 134055 - DNA, 25 bp, Homo sapien
gcatgaaatcatgttggagatctct

SEQ ID NO: 134056 - DNA, 25 bp, Homo sapien
gatctctattgtaatctctattgga

SEQ ID NO: 134057 - DNA, 25 bp, Homo sapien
ggaacaaactcctctagcttttgac

SEQ ID NO: 134058 - DNA, 25 bp, Homo sapien
tagcttttgacaaccgctttgttcc

SEQ ID NO: 134059 - DNA, 25 bp, Homo sapien
gctttgttcccatctatggaaacca

SEQ ID NO: 134060 - DNA, 25 bp, Homo sapien
tggaaaccattcctctgtcaactca

SEQ ID NO: 134061 - DNA, 25 bp, Homo sapien
tcaactcagtaacccctcaaacaag

SEQ ID NO: 134062 - DNA, 25 bp, Homo sapien
aagaaatcccagaaaactctgctgt

SEQ ID NO: 134063 - DNA, 25 bp, Homo sapien
ggatgaagaagcctaagcccctctg

SEQ ID NO: 134064 - DNA, 25 bp, Homo sapien
gtcttttcttctaagtgacatgttg

SEQ ID NO: 134065 - DNA, 25 bp, Homo sapien
agtgacatgttggaagccttctcat

SEQ ID NO: 134066 - DNA, 25 bp, Homo sapien
atgttggaagccttctcatcccggg

SEQ ID NO: 134067 - DNA, 25 bp, Homo sapien
aaaaccagaataggccaatctcttt

SEQ ID NO: 134068 - DNA, 25 bp, Homo sapien
agatcaatatactaggtctgccttc

SEQ ID NO: 134069 - DNA, 25 bp, Homo sapien
atatactaggtctgccttcacttta

SEQ ID NO: 134070 - DNA, 25 bp, Homo sapien
ctaggtctgccttcactttatagaa

SEQ ID NO: 134071 - DNA, 25 bp, Homo sapien
gtctgccttcactttatagaaaact

SEQ ID NO: 134072 - DNA, 25 bp, Homo sapien
gaaaactagcttctataaagatttt

SEQ ID NO: 134073 - DNA, 25 bp, Homo sapien
gcaaagctatttataaaaggcctta

SEQ ID NO: 134074 - DNA, 25 bp, Homo sapien
ataaaaggccttatgtcgtgtacat

SEQ ID NO: 134075 - DNA, 25 bp, Homo sapien
aggccttatgtcgtgtacatacatt

SEQ ID NO: 134076 - DNA, 25 bp, Homo sapien
gtacatacattgtctttgaaatatt

SEQ ID NO: 134077 - DNA, 25 bp, Homo sapien
atttgtgatctagtttattgcttgt

SEQ ID NO: 134078 - DNA, 25 bp, Homo sapien
gtgatctagtttattgcttgtaaaa

SEQ ID NO: 134079 - DNA, 25 bp, Homo sapien
tttctccagctacctttcaaaataa

SEQ ID NO: 134080 - DNA, 25 bp, Homo sapien
atttgtctcaaatataccttgatgg

SEQ ID NO: 134081 - DNA, 25 bp, Homo sapien
tataccttgatggaggactttttta

SEQ ID NO: 134082 - DNA, 25 bp, Homo sapien
atgatgaactatgttctttgctatt

SEQ ID NO: 134083 - DNA, 25 bp, Homo sapien
gaaagttacatattggtttagaggc

SEQ ID NO: 134084 - DNA, 25 bp, Homo sapien
gttacatattggtttagaggctaaa

SEQ ID NO: 134085 - DNA, 25 bp, Homo sapien
gaggctaaaattgtgttgatgctgt

SEQ ID NO: 134086 - DNA, 25 bp, Homo sapien
gtgttgatgctgtttactcacctaa

SEQ ID NO: 134087 - DNA, 25 bp, Homo sapien
gttgatgctgtttactcacctaatt

SEQ ID NO: 134088 - DNA, 25 bp, Homo sapien
gatgctgtttactcacctaattaca

SEQ ID NO: 134089 - DNA, 25 bp, Homo sapien
gtttactcacctaattacatagttt

SEQ ID NO: 134090 - DNA, 25 bp, Homo sapien
acctgtgtcttggagctgacttact

SEQ ID NO: 134091 - DNA, 25 bp, Homo sapien
gtcttggagctgacttactaagtgg

SEQ ID NO: 134092 - DNA, 25 bp, Homo sapien
tactaagtggaatgagccgaggatt

SEQ ID NO: 134093 - DNA, 25 bp, Homo sapien
gccgaggatttgaatatcagttcta

SEQ ID NO: 134094 - DNA, 25 bp, Homo sapien
ctaaccttgatagaagaaccttggg

SEQ ID NO: 134095 - DNA, 25 bp, Homo sapien
accttgggttacatgtggttcacat

SEQ ID NO: 134096 - DNA, 25 bp, Homo sapien
gaatcctttggaatcttatggcaac

SEQ ID NO: 134097 - DNA, 25 bp, Homo sapien
gcaaccaaatgtggcttgacgaagt

SEQ ID NO: 134098 - DNA, 25 bp, Homo sapien
tgacgaagtcgtggtttcatctctt

SEQ ID NO: 134099 - DNA, 25 bp, Homo sapien
gtaaatttattcaactaacgatggg

SEQ ID NO: 134100 - DNA, 25 bp, Homo sapien
gtggactgaagtgcaatttgttgaa

SEQ ID NO: 134101 - DNA, 25 bp, Homo sapien
ttcttgtggcggttgaaatagtccc

SEQ ID NO: 134102 - DNA, 25 bp, Homo sapien
ggcggttgaaatagtcccacatgtg

SEQ ID NO: 134103 - DNA, 25 bp, Homo sapien
tagtcccacatgtggtcatcagaaa

SEQ ID NO: 134104 - DNA, 25 bp, Homo sapien
ataggatcagctccttgacctctga

SEQ ID NO: 134105 - DNA, 25 bp, Homo sapien
ggtgtgtgtattagaatcccttcct

SEQ ID NO: 134106 - DNA, 25 bp, Homo sapien
gtgtattagaatcccttcctgcctt

SEQ ID NO: 134107 - DNA, 25 bp, Homo sapien
gcagtgaaatgcctcttggtcctgt

SEQ ID NO: 134108 - DNA, 25 bp, Homo sapien
tcatgttctagttgcttgaccctgc

SEQ ID NO: 134109 - DNA, 25 bp, Homo sapien
agttgcttgaccctgccacatgggt

SEQ ID NO: 134110 - DNA, 25 bp, Homo sapien
cctgccacatgggtccagtgttcat

SEQ ID NO: 134111 - DNA, 25 bp, Homo sapien
gcataactgtactaaatcctttttc

SEQ ID NO: 134112 - DNA, 25 bp, Homo sapien
aaataaggatcacactgtattaggg

SEQ ID NO: 134113 - DNA, 25 bp, Homo sapien
cataaagccatatgtttagggtggt

SEQ ID NO: 134114 - DNA, 25 bp, Homo sapien
gtttagggtggtttctatctgtctt

SEQ ID NO: 134115 - DNA, 25 bp, Homo sapien
gtggtttctatctgtcttgtttttc

SEQ ID NO: 134116 - DNA, 25 bp, Homo sapien
ctatctgtcttgtttttcacttata

SEQ ID NO: 134117 - DNA, 25 bp, Homo sapien
tcacttatataacactgtgaacttc

SEQ ID NO: 134118 - DNA, 25 bp, Homo sapien
tgaacttctaaagcaagaggataaa

SEQ ID NO: 134119 - DNA, 25 bp, Homo sapien
tttctaggtaaaccgcttgccttca

SEQ ID NO: 134120 - DNA, 25 bp, Homo sapien
taaaccgcttgccttcatcttgagt

SEQ ID NO: 134121 - DNA, 25 bp, Homo sapien
gcttgccttcatcttgagtcggaat

SEQ ID NO: 134122 - DNA, 25 bp, Homo sapien
gccttcatcttgagtcggaatatat

SEQ ID NO: 134123 - DNA, 25 bp, Homo sapien
gtcggagggctttgggaccgccaga

SEQ ID NO: 134124 - DNA, 25 bp, Homo sapien
gggaccgggccgctagatgggcatg

SEQ ID NO: 134125 - DNA, 25 bp, Homo sapien
gcagaggacagatcaatggcgcagt

SEQ ID NO: 134126 - DNA, 25 bp, Homo sapien
agatcaatggcgcagtgcctctggt

SEQ ID NO: 134127 - DNA, 25 bp, Homo sapien
caatggcgcagtgcctctggtctgg

SEQ ID NO: 134128 - DNA, 25 bp, Homo sapien
agcgggacctgtggctctacaactg

SEQ ID NO: 134129 - DNA, 25 bp, Homo sapien
tgtggctctacaactgagtccttaa

SEQ ID NO: 134130 - DNA, 25 bp, Homo sapien
gagtccttaaacagggcatctccag

SEQ ID NO: 134131 - DNA, 25 bp, Homo sapien
gggcttcaaccttgagacagcttcg

SEQ ID NO: 134132 - DNA, 25 bp, Homo sapien
caaccttgagacagcttcggtttct

SEQ ID NO: 134133 - DNA, 25 bp, Homo sapien
cagcttcggtttctaacttggagcc

SEQ ID NO: 134134 - DNA, 25 bp, Homo sapien
gtcagactggaggtcgaagcaatca

SEQ ID NO: 134135 - DNA, 25 bp, Homo sapien
ggtcgaagcaatcagcaaacacaat

SEQ ID NO: 134136 - DNA, 25 bp, Homo sapien
gcaaacacaataagagtctccttct

SEQ ID NO: 134137 - DNA, 25 bp, Homo sapien
tcttctcttctttgggatgctattt

SEQ ID NO: 134138 - DNA, 25 bp, Homo sapien
gatgctatttcagccaatctggaca

SEQ ID NO: 134139 - DNA, 25 bp, Homo sapien
tctggacacttctttatactctctt

SEQ ID NO: 134140 - DNA, 25 bp, Homo sapien
cacttctttatactctcttcccttt

SEQ ID NO: 134141 - DNA, 25 bp, Homo sapien
cagctgtcagcctggttttcgtcat

SEQ ID NO: 134142 - DNA, 25 bp, Homo sapien
agcctggttttcgtcatcttccctg

SEQ ID NO: 134143 - DNA, 25 bp, Homo sapien
tgtgcctctgtcctagacttcccgg

SEQ ID NO: 134144 - DNA, 25 bp, Homo sapien
gccctctctcatatcactgaaggat

SEQ ID NO: 134145 - DNA, 25 bp, Homo sapien
gtgatttgccaagtccctggaccct

SEQ ID NO: 134146 - DNA, 25 bp, Homo sapien
gatttgccaagtccctggaccctgg

SEQ ID NO: 134147 - DNA, 25 bp, Homo sapien
tggaccagctactgggccttatggg

SEQ ID NO: 134148 - DNA, 25 bp, Homo sapien
gtaagaagtctactccaaacctagg

SEQ ID NO: 134149 - DNA, 25 bp, Homo sapien
tccaaacctaggtctctatgtcaga

SEQ ID NO: 134150 - DNA, 25 bp, Homo sapien
atgtcagaccagacctaggtgcttc

SEQ ID NO: 134151 - DNA, 25 bp, Homo sapien
taggtgcttctctaggagggaaaca

SEQ ID NO: 134152 - DNA, 25 bp, Homo sapien
ttcccattgtgccttctgtgtgtat

SEQ ID NO: 134153 - DNA, 25 bp, Homo sapien
gtgtattgtgcattaacctcttcct

SEQ ID NO: 134154 - DNA, 25 bp, Homo sapien
ttcctcaccactaggcttctggggc

SEQ ID NO: 134155 - DNA, 25 bp, Homo sapien
gcttctggggctgggtcccacatgc

SEQ ID NO: 134156 - DNA, 25 bp, Homo sapien
tctggcttctcccttaagaagagag

SEQ ID NO: 134157 - DNA, 25 bp, Homo sapien
tgaactgtccttccatttgggatat

SEQ ID NO: 134158 - DNA, 25 bp, Homo sapien
ataaggagcctttcttatggaagaa

SEQ ID NO: 134159 - DNA, 25 bp, Homo sapien
agtctagtagtttctctgtaaggca

SEQ ID NO: 134160 - DNA, 25 bp, Homo sapien
taatctaaaaagactaacctgccca

SEQ ID NO: 134161 - DNA, 25 bp, Homo sapien
cacccactccttatattgctgtgag

SEQ ID NO: 134162 - DNA, 25 bp, Homo sapien
tatattgctgtgagattgcccctat

SEQ ID NO: 134163 - DNA, 25 bp, Homo sapien
gtgagattgcccctatcttgtgctc

SEQ ID NO: 134164 - DNA, 25 bp, Homo sapien
tatcttgtgctcttctgtctgcagt

SEQ ID NO: 134165 - DNA, 25 bp, Homo sapien
ttctgtctgcagtgtgcacggcctt

SEQ ID NO: 134166 - DNA, 25 bp, Homo sapien
agtgtgcacggccttgttctaaccc

SEQ ID NO: 134167 - DNA, 25 bp, Homo sapien
gaatatgataaaacactgccctctt

SEQ ID NO: 134168 - DNA, 25 bp, Homo sapien
actgccctcttgtggtgcattgaaa

SEQ ID NO: 134169 - DNA, 25 bp, Homo sapien
aaatgggagacagcctcttacttgc

SEQ ID NO: 134170 - DNA, 25 bp, Homo sapien
gacagcctcttacttgccaagaaaa

SEQ ID NO: 134171 - DNA, 25 bp, Homo sapien
gaaaatgaagggattggaccgagct

SEQ ID NO: 134172 - DNA, 25 bp, Homo sapien
ttggaccgagctggaaaacctcctt

SEQ ID NO: 134173 - DNA, 25 bp, Homo sapien
ggaaaacctcctttaccagatgctg

SEQ ID NO: 134174 - DNA, 25 bp, Homo sapien
ccagatgctgactggcactggtggt

SEQ ID NO: 134175 - DNA, 25 bp, Homo sapien
gcactggtggtttttgctctcgaca

SEQ ID NO: 134176 - DNA, 25 bp, Homo sapien
tatccacaatagctgacggctgggt

SEQ ID NO: 134177 - DNA, 25 bp, Homo sapien
gacggctgggtgtttcagtttgcaa

SEQ ID NO: 134178 - DNA, 25 bp, Homo sapien
cttcctggtaggagggagtccacga

SEQ ID NO: 134179 - DNA, 25 bp, Homo sapien
gagggagtccacgagactcttttct

SEQ ID NO: 134180 - DNA, 25 bp, Homo sapien
ggagtccacgagactcttttctgtc

SEQ ID NO: 134181 - DNA, 25 bp, Homo sapien
acgagactcttttctgtccctcact

SEQ ID NO: 134182 - DNA, 25 bp, Homo sapien
gcagggcgcccctcagtattcgctg

SEQ ID NO: 134183 - DNA, 25 bp, Homo sapien
agtattcgctgccatatgtccctgt

SEQ ID NO: 134184 - DNA, 25 bp, Homo sapien
attcgctgccatatgtccctgtcct

SEQ ID NO: 134185 - DNA, 25 bp, Homo sapien
gggagacagactggacatttccctg

SEQ ID NO: 134186 - DNA, 25 bp, Homo sapien
acatttccctgtttcgagccaggct

SEQ ID NO: 134187 - DNA, 25 bp, Homo sapien
gctgggtccccggagtcagtcctag

SEQ ID NO: 134188 - DNA, 25 bp, Homo sapien
ccccggagtcagtcctaggctggat

SEQ ID NO: 134189 - DNA, 25 bp, Homo sapien
tgaaaaccgaattgtagagcataca

SEQ ID NO: 134190 - DNA, 25 bp, Homo sapien
atacaaacagctctccctgcaaatc

SEQ ID NO: 134191 - DNA, 25 bp, Homo sapien
gtggcctagaagaatcggcagtgac

SEQ ID NO: 134192 - DNA, 25 bp, Homo sapien
aatcggcagtgacaggaattgtcgt

SEQ ID NO: 134193 - DNA, 25 bp, Homo sapien
gctttactaggagctggcttgctaa

SEQ ID NO: 134194 - DNA, 25 bp, Homo sapien
agctggcttgctaatggccttctac

SEQ ID NO: 134195 - DNA, 25 bp, Homo sapien
ataaccattgagaggcgaacccagc

SEQ ID NO: 134196 - DNA, 25 bp, Homo sapien
ttgagaggcgaacccagcaagaaga

SEQ ID NO: 134197 - DNA, 25 bp, Homo sapien
gggaattacgggaagattccatcag

SEQ ID NO: 134198 - DNA, 25 bp, Homo sapien
attccatcagatcccatttttcagt

SEQ ID NO: 134199 - DNA, 25 bp, Homo sapien
gatcccatttttcagtagcttaaag

SEQ ID NO: 134200 - DNA, 25 bp, Homo sapien
gctgttaactgcaagtttagcttga

SEQ ID NO: 134201 - DNA, 25 bp, Homo sapien
gggaccatgtaacttaattactgct

SEQ ID NO: 134202 - DNA, 25 bp, Homo sapien
gtctttgtaagagtagggtcgccat

SEQ ID NO: 134203 - DNA, 25 bp, Homo sapien
agggtcgccatgatgcagccatatg

SEQ ID NO: 134204 - DNA, 25 bp, Homo sapien
gaagactaggatatgggtcacactt

SEQ ID NO: 134205 - DNA, 25 bp, Homo sapien
gggtcacacttatctgtgttcctat

SEQ ID NO: 134206 - DNA, 25 bp, Homo sapien
tttattcactcttcagacacgctac

SEQ ID NO: 134207 - DNA, 25 bp, Homo sapien
agacacgctactcaagagtgcccct

SEQ ID NO: 134208 - DNA, 25 bp, Homo sapien
gcccctcagctgctgaacaagcatt

SEQ ID NO: 134209 - DNA, 25 bp, Homo sapien
agcatttgtagcttgtacaatggca

SEQ ID NO: 134210 - DNA, 25 bp, Homo sapien
gcagaatgggccaaaagcttagtgt

SEQ ID NO: 134211 - DNA, 25 bp, Homo sapien
aaatcaaggaagacttgtccaggtt

SEQ ID NO: 134212 - DNA, 25 bp, Homo sapien
tccaggttcctcagttaaattagga

SEQ ID NO: 134213 - DNA, 25 bp, Homo sapien
taggacatccattacattattaaag

SEQ ID NO: 134214 - DNA, 25 bp, Homo sapien
agcaagctgatagattagcctccta

SEQ ID NO: 134215 - DNA, 25 bp, Homo sapien
tagcctcctaactagtatagaactt

SEQ ID NO: 134216 - DNA, 25 bp, Homo sapien
taaagacagagttccattctggaag

SEQ ID NO: 134217 - DNA, 25 bp, Homo sapien
gttccattctggaagcagcatgtca

SEQ ID NO: 134218 - DNA, 25 bp, Homo sapien
gcagcatgtcattgtggtaagagaa

SEQ ID NO: 134219 - DNA, 25 bp, Homo sapien
aaatgaaccaaaggcttgggtggtg

SEQ ID NO: 134220 - DNA, 25 bp, Homo sapien
tgagggtgcttatcctttctgttat

SEQ ID NO: 134221 - DNA, 25 bp, Homo sapien
gggacctcttgaattacatgctgta

SEQ ID NO: 134222 - DNA, 25 bp, Homo sapien
gaagtgattgttgagcccattccaa

SEQ ID NO: 134223 - DNA, 25 bp, Homo sapien
tgttgagcccattccaattggacaa

SEQ ID NO: 134224 - DNA, 25 bp, Homo sapien
attccaattggacaagctgctaagg

SEQ ID NO: 134225 - DNA, 25 bp, Homo sapien
tacatataatgccaactctgcttga

SEQ ID NO: 134226 - DNA, 25 bp, Homo sapien
gccaactctgcttgaaggactcaca

SEQ ID NO: 134227 - DNA, 25 bp, Homo sapien
gtaagcaaaaaccagcagacccttt

SEQ ID NO: 134228 - DNA, 25 bp, Homo sapien
agaccctttgatttggctagctgat

SEQ ID NO: 134229 - DNA, 25 bp, Homo sapien
ttggctagctgattggctgctgaaa

SEQ ID NO: 134230 - DNA, 25 bp, Homo sapien
ggctgctgaaaaataatcctaacaa

SEQ ID NO: 134231 - DNA, 25 bp, Homo sapien
ccaaactttgtcaccatccaattgt

SEQ ID NO: 134232 - DNA, 25 bp, Homo sapien
aaggctgtacttctactgtttgaga

SEQ ID NO: 134233 - DNA, 25 bp, Homo sapien
ggaaactactgcctttagaaaatat

SEQ ID NO: 134234 - DNA, 25 bp, Homo sapien
gattaaagtgctcacgttaccttga

SEQ ID NO: 134235 - DNA, 25 bp, Homo sapien
gctcacgttaccttgacacatagtt

SEQ ID NO: 134236 - DNA, 25 bp, Homo sapien
tagtttttcagtctatgggtttagt

SEQ ID NO: 134237 - DNA, 25 bp, Homo sapien
ggtttagttactttagatggcaagc

SEQ ID NO: 134238 - DNA, 25 bp, Homo sapien
gatggcaagcatgtaacttatatta

SEQ ID NO: 134239 - DNA, 25 bp, Homo sapien
ataagctatccctgttgccggttca

SEQ ID NO: 134240 - DNA, 25 bp, Homo sapien
gccggttcatggattacttctctat

SEQ ID NO: 134241 - DNA, 25 bp, Homo sapien
catctcttccttgacatgcattgta

SEQ ID NO: 134242 - DNA, 25 bp, Homo sapien
acatgcattgtaaataggttcttct

SEQ ID NO: 134243 - DNA, 25 bp, Homo sapien
aggttcttcttgttctgagattcaa

SEQ ID NO: 134244 - DNA, 25 bp, Homo sapien
gttacgttttacaacaaggctagag

SEQ ID NO: 134245 - DNA, 25 bp, Homo sapien
cgttttacaacaaggctagagtttg

SEQ ID NO: 134246 - DNA, 25 bp, Homo sapien
gagtttgtaaattctgggttcattt

SEQ ID NO: 134247 - DNA, 25 bp, Homo sapien
aattctgggttcatttgtgatgaca

SEQ ID NO: 134248 - DNA, 25 bp, Homo sapien
gggttcatttgtgatgacataagtc

SEQ ID NO: 134249 - DNA, 25 bp, Homo sapien
gacataagtcagcaaactgcgggaa

SEQ ID NO: 134250 - DNA, 25 bp, Homo sapien
agtcagcaaactgcgggaatactgt

SEQ ID NO: 134251 - DNA, 25 bp, Homo sapien
agtaagcataattttagttttgtat

SEQ ID NO: 134252 - DNA, 25 bp, Homo sapien
ttaacctataggataagattccagt

SEQ ID NO: 134253 - DNA, 25 bp, Homo sapien
ggataagattccagtattgtatatg

SEQ ID NO: 134254 - DNA, 25 bp, Homo sapien
gattccagtattgtatatgagtttt

SEQ ID NO: 134255 - DNA, 25 bp, Homo sapien
tgagatcatgcagggattcatcagg

SEQ ID NO: 134256 - DNA, 25 bp, Homo sapien
attcatcagggctttcaggcccctg

SEQ ID NO: 134257 - DNA, 25 bp, Homo sapien
tgcccaggcacctatggtacttgct

SEQ ID NO: 134258 - DNA, 25 bp, Homo sapien
acctatggtacttgctggacttgaa

SEQ ID NO: 134259 - DNA, 25 bp, Homo sapien
ggtacttgctggacttgaaacagat

SEQ ID NO: 134260 - DNA, 25 bp, Homo sapien
aacagatggaagagccgtgccgttt

SEQ ID NO: 134261 - DNA, 25 bp, Homo sapien
gatggaagagccgtgccgtttctag

SEQ ID NO: 134262 - DNA, 25 bp, Homo sapien
ttcctcctgccctttcaaagaataa

SEQ ID NO: 134263 - DNA, 25 bp, Homo sapien
gaataaccacagctcagaagacgat

SEQ ID NO: 134264 - DNA, 25 bp, Homo sapien
gctcagaagacgatgacgtggtcat

SEQ ID NO: 134265 - DNA, 25 bp, Homo sapien
atgacgtggtcatctgtgtcgccat

SEQ ID NO: 134266 - DNA, 25 bp, Homo sapien
ccagcaggaggacagagtgccctgg

SEQ ID NO: 134267 - DNA, 25 bp, Homo sapien
gacagagtgccctggggcatccacc

SEQ ID NO: 134268 - DNA, 25 bp, Homo sapien
accttcctgcccaggggacgtggcg

SEQ ID NO: 134269 - DNA, 25 bp, Homo sapien
gtggcgctgtcggtgtttggaggct

SEQ ID NO: 134270 - DNA, 25 bp, Homo sapien
tttggcgccccatgggccctcagcg

SEQ ID NO: 134271 - DNA, 25 bp, Homo sapien
gccctcagcgtctccccatgctggg

SEQ ID NO: 134272 - DNA, 25 bp, Homo sapien
agcccttgctctacctggccggtag

SEQ ID NO: 134273 - DNA, 25 bp, Homo sapien
gcccttgctctacctggccggtagg

SEQ ID NO: 134274 - DNA, 25 bp, Homo sapien
gctgctggcgcctaggttgtgttga

SEQ ID NO: 134275 - DNA, 25 bp, Homo sapien
gctggcgcctaggttgtgttgagag

SEQ ID NO: 134276 - DNA, 25 bp, Homo sapien
cgtgcagcacctgtcaccttttcta

SEQ ID NO: 134277 - DNA, 25 bp, Homo sapien
gtatgaacgtttgcaggagtccctc

SEQ ID NO: 134278 - DNA, 25 bp, Homo sapien
aggagtccctcagccggtgatgtct

SEQ ID NO: 134279 - DNA, 25 bp, Homo sapien
atgtctccagcagccggcttagagg

SEQ ID NO: 134280 - DNA, 25 bp, Homo sapien
ttagaggagctagcccatcaagccg

SEQ ID NO: 134281 - DNA, 25 bp, Homo sapien
ctagcccatcaagccggcagagaat

SEQ ID NO: 134282 - DNA, 25 bp, Homo sapien
tctgaaggacccactttcagctgga

SEQ ID NO: 134283 - DNA, 25 bp, Homo sapien
ttcagctggacacaggcgcggcctc

SEQ ID NO: 134284 - DNA, 25 bp, Homo sapien
aggcgcggcctcatgtaaacatttt

SEQ ID NO: 134285 - DNA, 25 bp, Homo sapien
tgaagctgaagattcttcccatctg

SEQ ID NO: 134286 - DNA, 25 bp, Homo sapien
atctggccagccttgtgtgaaaatg

SEQ ID NO: 134287 - DNA, 25 bp, Homo sapien
gccttgtgtgaaaatgccttcttcc

SEQ ID NO: 134288 - DNA, 25 bp, Homo sapien
ggagatgaagccatttcttatcctg

SEQ ID NO: 134289 - DNA, 25 bp, Homo sapien
gaagccatttcttatcctgtagatg

SEQ ID NO: 134290 - DNA, 25 bp, Homo sapien
tatcctgtagatgtgaagcactttc

SEQ ID NO: 134291 - DNA, 25 bp, Homo sapien
actttcagttttcagcgatgttgga

SEQ ID NO: 134292 - DNA, 25 bp, Homo sapien
tttcagcgatgttggaatgtagcat

SEQ ID NO: 134293 - DNA, 25 bp, Homo sapien
gtagcatcagaagctcgttccttca

SEQ ID NO: 134294 - DNA, 25 bp, Homo sapien
agaagctcgttccttcacactcagt

SEQ ID NO: 134295 - DNA, 25 bp, Homo sapien
gttccttcacactcagtggcgtctg

SEQ ID NO: 134296 - DNA, 25 bp, Homo sapien
acactcagtggcgtctgtgcttgtc

SEQ ID NO: 134297 - DNA, 25 bp, Homo sapien
agtggcgtctgtgcttgtccacatg

SEQ ID NO: 134298 - DNA, 25 bp, Homo sapien
tgggcgtctgggaccttgaatgcct

SEQ ID NO: 134299 - DNA, 25 bp, Homo sapien
gcatgttatacagaagcgattagga

SEQ ID NO: 134300 - DNA, 25 bp, Homo sapien
gattaggatttttcgcttgcgagca

SEQ ID NO: 134301 - DNA, 25 bp, Homo sapien
aggatttttcgcttgcgagcaaggg

SEQ ID NO: 134302 - DNA, 25 bp, Homo sapien
ttgcgagcaagggagtgtatatact

SEQ ID NO: 134303 - DNA, 25 bp, Homo sapien
gggagtgtatatactaaatgccaca

SEQ ID NO: 134304 - DNA, 25 bp, Homo sapien
aatgccacactgtatgtttctaaca

SEQ ID NO: 134305 - DNA, 25 bp, Homo sapien
gtttctgaaactgctatgtacaacc

SEQ ID NO: 134306 - DNA, 25 bp, Homo sapien
gaaactgctatgtacaacctaccct

SEQ ID NO: 134307 - DNA, 25 bp, Homo sapien
gctatgtacaacctaccctgtgtat

SEQ ID NO: 134308 - DNA, 25 bp, Homo sapien
gtacaacctaccctgtgtataacat

SEQ ID NO: 134309 - DNA, 25 bp, Homo sapien
ctaccctgtgtataacatttcgtac

SEQ ID NO: 134310 - DNA, 25 bp, Homo sapien
ccttgaaaggatcatggtcagagtg

SEQ ID NO: 134311 - DNA, 25 bp, Homo sapien
atcatggtcagagtggagtacctgg

SEQ ID NO: 134312 - DNA, 25 bp, Homo sapien
caccgtttccatggtcgaaggtcag

SEQ ID NO: 134313 - DNA, 25 bp, Homo sapien
tttccatggtcgaaggtcagggcga

SEQ ID NO: 134314 - DNA, 25 bp, Homo sapien
agggcgagaagaacgtgaccttctg

SEQ ID NO: 134315 - DNA, 25 bp, Homo sapien
gctgccacggtgtgaggagctacaa

SEQ ID NO: 134316 - DNA, 25 bp, Homo sapien
gtggaggagaaacgaccatgtctac

SEQ ID NO: 134317 - DNA, 25 bp, Homo sapien
gaaacgaccatgtctacacgtgcct

SEQ ID NO: 134318 - DNA, 25 bp, Homo sapien
atgtctacacgtgcctgcttgcaaa

SEQ ID NO: 134319 - DNA, 25 bp, Homo sapien
acgtgcctgcttgcaaagaccctga

SEQ ID NO: 134320 - DNA, 25 bp, Homo sapien
agaggaactctaacacttctctcct

SEQ ID NO: 134321 - DNA, 25 bp, Homo sapien
gagagtgactctggtcataggactt

SEQ ID NO: 134322 - DNA, 25 bp, Homo sapien
tcataggacttggtagggtcccagg

SEQ ID NO: 134323 - DNA, 25 bp, Homo sapien
gtccctaggcctccacttctgaggg

SEQ ID NO: 134324 - DNA, 25 bp, Homo sapien
aagagctctcctccaactcagggtt

SEQ ID NO: 134325 - DNA, 25 bp, Homo sapien
ttctctgaagacagcgtcctggctc

SEQ ID NO: 134326 - DNA, 25 bp, Homo sapien
gtcctggctccagttggaacacttt

SEQ ID NO: 134327 - DNA, 25 bp, Homo sapien
ggaacactttcctgagatgcactta

SEQ ID NO: 134328 - DNA, 25 bp, Homo sapien
agatgcacttacttctcagcttctg

SEQ ID NO: 134329 - DNA, 25 bp, Homo sapien
tacttctcagcttctgcgatcagat

SEQ ID NO: 134330 - DNA, 25 bp, Homo sapien
ctgcgatcagattatcatcaccacc

SEQ ID NO: 134331 - DNA, 25 bp, Homo sapien
aaattgactctctaaatctggtgta

SEQ ID NO: 134332 - DNA, 25 bp, Homo sapien
gagatgcagtgccaggaacccttaa

SEQ ID NO: 134333 - DNA, 25 bp, Homo sapien
gatgcagtgccaggaacccttaaac

SEQ ID NO: 134334 - DNA, 25 bp, Homo sapien
tgcagtgccaggaacccttaaacag

SEQ ID NO: 134335 - DNA, 25 bp, Homo sapien
cttcactgcaccctggatttgcata

SEQ ID NO: 134336 - DNA, 25 bp, Homo sapien
actgcaccctggatttgcatacatt

SEQ ID NO: 134337 - DNA, 25 bp, Homo sapien
caccctggatttgcatacattcttc

SEQ ID NO: 134338 - DNA, 25 bp, Homo sapien
ctggatttgcatacattcttcaaga

SEQ ID NO: 134339 - DNA, 25 bp, Homo sapien
atttgcatacattcttcaagatccc

SEQ ID NO: 134340 - DNA, 25 bp, Homo sapien
ttgtgcattctagagtgcatatatt

SEQ ID NO: 134341 - DNA, 25 bp, Homo sapien
agcttagttctcttttgatgtaggt

SEQ ID NO: 134342 - DNA, 25 bp, Homo sapien
tagttctcttttgatgtaggttatt

SEQ ID NO: 134343 - DNA, 25 bp, Homo sapien
aaacctcctcttctgacgtgccttt

SEQ ID NO: 134344 - DNA, 25 bp, Homo sapien
ctcctcttctgacgtgccttttgca

SEQ ID NO: 134345 - DNA, 25 bp, Homo sapien
ttttgcacccctcccattaggacaa

SEQ ID NO: 134346 - DNA, 25 bp, Homo sapien
tcccattaggacaatcagtcccctc

SEQ ID NO: 134347 - DNA, 25 bp, Homo sapien
ttttctaccctagccattcctggta

SEQ ID NO: 134348 - DNA, 25 bp, Homo sapien
cggctggttttgtaagatactgggt

SEQ ID NO: 134349 - DNA, 25 bp, Homo sapien
tttgtaagatactgggttggtgcac

SEQ ID NO: 134350 - DNA, 25 bp, Homo sapien
tactgggttggtgcacagtgatttt

SEQ ID NO: 134351 - DNA, 25 bp, Homo sapien
acaggcccagcattgctggttctat

SEQ ID NO: 134352 - DNA, 25 bp, Homo sapien
ccagcattgctggttctatttaatg

SEQ ID NO: 134353 - DNA, 25 bp, Homo sapien
gctggttctatttaatggacatgag

SEQ ID NO: 134354 - DNA, 25 bp, Homo sapien
cttgaaagatactgactgcccagga

SEQ ID NO: 134355 - DNA, 25 bp, Homo sapien
gaaagatactgactgcccaggaatc

SEQ ID NO: 134356 - DNA, 25 bp, Homo sapien
aagatactgactgcccaggaatcaa

SEQ ID NO: 134357 - DNA, 25 bp, Homo sapien
atactgactgcccaggaatcaagaa

SEQ ID NO: 134358 - DNA, 25 bp, Homo sapien
gactgcccaggaatcaagaagtgct

SEQ ID NO: 134359 - DNA, 25 bp, Homo sapien
gcccaggaatcaagaagtgctgtga

SEQ ID NO: 134360 - DNA, 25 bp, Homo sapien
ccagtgaagggagccggtccttgct

SEQ ID NO: 134361 - DNA, 25 bp, Homo sapien
tgaagggagccggtccttgctgcac

SEQ ID NO: 134362 - DNA, 25 bp, Homo sapien
aagggagccggtccttgctgcacct

SEQ ID NO: 134363 - DNA, 25 bp, Homo sapien
tgtgccgtccccagagctacaggcc

SEQ ID NO: 134364 - DNA, 25 bp, Homo sapien
aggccccatctggtcctaagtccct

SEQ ID NO: 134365 - DNA, 25 bp, Homo sapien
ttcccatgccctgttttaccactgc

SEQ ID NO: 134366 - DNA, 25 bp, Homo sapien
atcctcgtcatacaatgcctgatgg

SEQ ID NO: 134367 - DNA, 25 bp, Homo sapien
tcctcgtcatacaatgcctgatggg

SEQ ID NO: 134368 - DNA, 25 bp, Homo sapien
ctcgtcatacaatgcctgatgggct

SEQ ID NO: 134369 - DNA, 25 bp, Homo sapien
gtcatacaatgcctgatgggctcct

SEQ ID NO: 134370 - DNA, 25 bp, Homo sapien
catacaatgcctgatgggctcctgt

SEQ ID NO: 134371 - DNA, 25 bp, Homo sapien
atacaatgcctgatgggctcctgtc

SEQ ID NO: 134372 - DNA, 25 bp, Homo sapien
tacaatgcctgatgggctcctgtca

SEQ ID NO: 134373 - DNA, 25 bp, Homo sapien
acaatgcctgatgggctcctgtcac

SEQ ID NO: 134374 - DNA, 25 bp, Homo sapien
tgatgggctcctgtcaccctccacg

SEQ ID NO: 134375 - DNA, 25 bp, Homo sapien
ctccacgtctccacagaccaggaca

SEQ ID NO: 134376 - DNA, 25 bp, Homo sapien
gggagaccaatccagcagattcaaa

SEQ ID NO: 134377 - DNA, 25 bp, Homo sapien
aatccagcagattcaaagccaggca

SEQ ID NO: 134378 - DNA, 25 bp, Homo sapien
gggacttctgcattcaggttggcag

SEQ ID NO: 134379 - DNA, 25 bp, Homo sapien
ggttggcaggaacatcattcatggc

SEQ ID NO: 134380 - DNA, 25 bp, Homo sapien
tcattcatggcagtgattcagtaaa

SEQ ID NO: 134381 - DNA, 25 bp, Homo sapien
agaaatcagcctatggtttaagcct

SEQ ID NO: 134382 - DNA, 25 bp, Homo sapien
gcctatggtttaagcctgaagaact

SEQ ID NO: 134383 - DNA, 25 bp, Homo sapien
ggttgactacaagtcttgtgctcat

SEQ ID NO: 134384 - DNA, 25 bp, Homo sapien
cttgtgctcatgactgggtctatga

SEQ ID NO: 134385 - DNA, 25 bp, Homo sapien
aggtggacacaacagcagtctcctt

SEQ ID NO: 134386 - DNA, 25 bp, Homo sapien
tccattgacttagaggcaacaggat

SEQ ID NO: 134387 - DNA, 25 bp, Homo sapien
gcacctgctctccacctggactcag

SEQ ID NO: 134388 - DNA, 25 bp, Homo sapien
tgctctccacctggactcaggccgg

SEQ ID NO: 134389 - DNA, 25 bp, Homo sapien
gctctccacctggactcaggccggg

SEQ ID NO: 134390 - DNA, 25 bp, Homo sapien
tctccacctggactcaggccgggct

SEQ ID NO: 134391 - DNA, 25 bp, Homo sapien
tccacctggactcaggccgggctgg

SEQ ID NO: 134392 - DNA, 25 bp, Homo sapien
ccacctggactcaggccgggctggg

SEQ ID NO: 134393 - DNA, 25 bp, Homo sapien
gggaacatgaaaagagactaggtga

SEQ ID NO: 134394 - DNA, 25 bp, Homo sapien
gaacatgaaaagagactaggtgaag

SEQ ID NO: 134395 - DNA, 25 bp, Homo sapien
aagagactaggtgaagagagggcag

SEQ ID NO: 134396 - DNA, 25 bp, Homo sapien
tggggctggcccacaatacctgctc

SEQ ID NO: 134397 - DNA, 25 bp, Homo sapien
ggctggcccacaatacctgctcccc

SEQ ID NO: 134398 - DNA, 25 bp, Homo sapien
atggcaaataacctgcctatgcaac

SEQ ID NO: 134399 - DNA, 25 bp, Homo sapien
accagcccttcggtgaatgggcgga

SEQ ID NO: 134400 - DNA, 25 bp, Homo sapien
ggcggagttatgatacctacacccc

SEQ ID NO: 134401 - DNA, 25 bp, Homo sapien
gacacacatgaacagtcagccaatg

SEQ ID NO: 134402 - DNA, 25 bp, Homo sapien
acagtcagccaatgggcacctcggg

SEQ ID NO: 134403 - DNA, 25 bp, Homo sapien
gcaccacttcaacaggactcatttc

SEQ ID NO: 134404 - DNA, 25 bp, Homo sapien
ttcaacaggactcatttcccctggt

SEQ ID NO: 134405 - DNA, 25 bp, Homo sapien
atttcccctggtgtgtcagttccag

SEQ ID NO: 134406 - DNA, 25 bp, Homo sapien
ccctggtgtgtcagttccagttcaa

SEQ ID NO: 134407 - DNA, 25 bp, Homo sapien
tccagttcaagttcccggaagtgaa

SEQ ID NO: 134408 - DNA, 25 bp, Homo sapien
ggaagtgaacctgatatgtctcaat

SEQ ID NO: 134409 - DNA, 25 bp, Homo sapien
taaacactggcccttaactcacatt

SEQ ID NO: 134410 - DNA, 25 bp, Homo sapien
ggcccttaactcacattcaatgtat

SEQ ID NO: 134411 - DNA, 25 bp, Homo sapien
tttcttcccataacatttagtatag

SEQ ID NO: 134412 - DNA, 25 bp, Homo sapien
tattttcttagaatttgagcccatt

SEQ ID NO: 134413 - DNA, 25 bp, Homo sapien
tttgagcccatttaagtggattaat

SEQ ID NO: 134414 - DNA, 25 bp, Homo sapien
attctacatgtgtgcccctaaagac

SEQ ID NO: 134415 - DNA, 25 bp, Homo sapien
gacacatttcttgagatgagatgga

SEQ ID NO: 134416 - DNA, 25 bp, Homo sapien
agaatagtacacacatttagttgat

SEQ ID NO: 134417 - DNA, 25 bp, Homo sapien
gaggattgactccagcatacaagca

SEQ ID NO: 134418 - DNA, 25 bp, Homo sapien
tccagcatacaagcaggcccggtaa

SEQ ID NO: 134419 - DNA, 25 bp, Homo sapien
aagcaggcccggtaatgggcctcca

SEQ ID NO: 134420 - DNA, 25 bp, Homo sapien
gaaaggtgaaattccttggtcacaa

SEQ ID NO: 134421 - DNA, 25 bp, Homo sapien
aaggtgaaattccttggtcacaaga

SEQ ID NO: 134422 - DNA, 25 bp, Homo sapien
gtcacaagaacttcgaccagaggcc

SEQ ID NO: 134423 - DNA, 25 bp, Homo sapien
acaagaacttcgaccagaggccaag

SEQ ID NO: 134424 - DNA, 25 bp, Homo sapien
caagaacttcgaccagaggccaaga

SEQ ID NO: 134425 - DNA, 25 bp, Homo sapien
aagaacttcgaccagaggccaagaa

SEQ ID NO: 134426 - DNA, 25 bp, Homo sapien
agaacttcgaccagaggccaagaat

SEQ ID NO: 134427 - DNA, 25 bp, Homo sapien
gaacttcgaccagaggccaagaatt

SEQ ID NO: 134428 - DNA, 25 bp, Homo sapien
aacttcgaccagaggccaagaattt

SEQ ID NO: 134429 - DNA, 25 bp, Homo sapien
acgccgctgtgcagtgacgtggcct

SEQ ID NO: 134430 - DNA, 25 bp, Homo sapien
agtgacgtggcctgcggccgggctg

SEQ ID NO: 134431 - DNA, 25 bp, Homo sapien
tttaatgtgtgcaaaagcccaaagg

SEQ ID NO: 134432 - DNA, 25 bp, Homo sapien
atgtgtgcaaaagcccaaaggttcc

SEQ ID NO: 134433 - DNA, 25 bp, Homo sapien
gtgcaaaagcccaaaggttcctaag

SEQ ID NO: 134434 - DNA, 25 bp, Homo sapien
gcccaaaggttcctaagcctggctg

SEQ ID NO: 134435 - DNA, 25 bp, Homo sapien
caaaggttcctaagcctggctgcaa

SEQ ID NO: 134436 - DNA, 25 bp, Homo sapien
gcaaagaagaatcaacagggacact

SEQ ID NO: 134437 - DNA, 25 bp, Homo sapien
gaagaatcaacagggacacttttta

SEQ ID NO: 134438 - DNA, 25 bp, Homo sapien
ggtggaaactgcagagagtcatgat

SEQ ID NO: 134439 - DNA, 25 bp, Homo sapien
ggaaactgcagagagtcatgatcat

SEQ ID NO: 134440 - DNA, 25 bp, Homo sapien
gagagtcatgatcatgtccttacac

SEQ ID NO: 134441 - DNA, 25 bp, Homo sapien
gtcatgatcatgtccttacactcca

SEQ ID NO: 134442 - DNA, 25 bp, Homo sapien
tcatttctgtcaaactgtaagagta

SEQ ID NO: 134443 - DNA, 25 bp, Homo sapien
gttatttcatttagagttctctatc

SEQ ID NO: 134444 - DNA, 25 bp, Homo sapien
aaagggaatgatatgcttgtttaaa

SEQ ID NO: 134445 - DNA, 25 bp, Homo sapien
gtaaactgtgttaattggtaatgac

SEQ ID NO: 134446 - DNA, 25 bp, Homo sapien
ggtaatgactatttatcgtcgatac

SEQ ID NO: 134447 - DNA, 25 bp, Homo sapien
atcgtcgatactctgtagctgtgta

SEQ ID NO: 134448 - DNA, 25 bp, Homo sapien
ctgtagctgtgtaagttttgacaaa

SEQ ID NO: 134449 - DNA, 25 bp, Homo sapien
gacaaatagtgtatctcgtggaatc

SEQ ID NO: 134450 - DNA, 25 bp, Homo sapien
gtgtatctcgtggaatcagtggtta

SEQ ID NO: 134451 - DNA, 25 bp, Homo sapien
ggaatcagtggttagcattgccgct

SEQ ID NO: 134452 - DNA, 25 bp, Homo sapien
gcattgccgctattatatttactca

SEQ ID NO: 134453 - DNA, 25 bp, Homo sapien
gggagctactcaggactcacgtagc

SEQ ID NO: 134454 - DNA, 25 bp, Homo sapien
caggactcacgtagcattaaatcag

SEQ ID NO: 134455 - DNA, 25 bp, Homo sapien
ttaaatcagctgtgaatcgtcaggg

SEQ ID NO: 134456 - DNA, 25 bp, Homo sapien
gccgagactccgtgggagaagctca

SEQ ID NO: 134457 - DNA, 25 bp, Homo sapien
gggagaagctcattcccacatcttg

SEQ ID NO: 134458 - DNA, 25 bp, Homo sapien
acatcttgccaagacagcctttgtc

SEQ ID NO: 134459 - DNA, 25 bp, Homo sapien
tttgtccagctgtccacattgagtc

SEQ ID NO: 134460 - DNA, 25 bp, Homo sapien
gctgtccacattgagtcagactgct

SEQ ID NO: 134461 - DNA, 25 bp, Homo sapien
cataaagaactgcagccttggtact

SEQ ID NO: 134462 - DNA, 25 bp, Homo sapien
ccttggtactgcagagtctgggttg

SEQ ID NO: 134463 - DNA, 25 bp, Homo sapien
agtctgggttgtagagaactctttg

SEQ ID NO: 134464 - DNA, 25 bp, Homo sapien
ggccgcaatgaagcttggagataca

SEQ ID NO: 134465 - DNA, 25 bp, Homo sapien
ggctttgcaaagagtgtttcctttt

SEQ ID NO: 134466 - DNA, 25 bp, Homo sapien
ttttctgatgtattctttaaaggat

SEQ ID NO: 134467 - DNA, 25 bp, Homo sapien
tgctgcatttgtggtagctgtagga

SEQ ID NO: 134468 - DNA, 25 bp, Homo sapien
gaagcatcactgaagataatacctg

SEQ ID NO: 134469 - DNA, 25 bp, Homo sapien
cactgaagataatacctggaagcat

SEQ ID NO: 134470 - DNA, 25 bp, Homo sapien
ggaagcatcatagtggtttcttaac

SEQ ID NO: 134471 - DNA, 25 bp, Homo sapien
aagatttcttctctgtagcctactt

SEQ ID NO: 134472 - DNA, 25 bp, Homo sapien
tgtagcctacttgtctggtttatcc

SEQ ID NO: 134473 - DNA, 25 bp, Homo sapien
ctacttgtctggtttatcccttaca

SEQ ID NO: 134474 - DNA, 25 bp, Homo sapien
ggtttatcccttacagaatattagt

SEQ ID NO: 134475 - DNA, 25 bp, Homo sapien
agaagccgaaggatgctgacacaca

SEQ ID NO: 134476 - DNA, 25 bp, Homo sapien
gaagccgaaggatgctgacacacag

SEQ ID NO: 134477 - DNA, 25 bp, Homo sapien
tgacacacagtgatgtggagggcat

SEQ ID NO: 134478 - DNA, 25 bp, Homo sapien
tgtggagggcattccggagaaactt

SEQ ID NO: 134479 - DNA, 25 bp, Homo sapien
gagaaacttttgcaacagtgtatta

SEQ ID NO: 134480 - DNA, 25 bp, Homo sapien
gcaacagtgtattaatgtgattggt

SEQ ID NO: 134481 - DNA, 25 bp, Homo sapien
gttaacagttcatacaactcagatt

SEQ ID NO: 134482 - DNA, 25 bp, Homo sapien
acagttcatacaactcagatttagt

SEQ ID NO: 134483 - DNA, 25 bp, Homo sapien
caactcagatttagtattattgttt

SEQ ID NO: 134484 - DNA, 25 bp, Homo sapien
aaagacccaaagtatgattaatata

SEQ ID NO: 134485 - DNA, 25 bp, Homo sapien
tttgctgaataggtttaagtcagat

SEQ ID NO: 134486 - DNA, 25 bp, Homo sapien
cgttggttttgatacgaccgttgca

SEQ ID NO: 134487 - DNA, 25 bp, Homo sapien
gaccgttgcagaattatctctcaaa

SEQ ID NO: 134488 - DNA, 25 bp, Homo sapien
ttatctctcaaaacattcaacgaac

SEQ ID NO: 134489 - DNA, 25 bp, Homo sapien
gagacaactagatagcatgcttgca

SEQ ID NO: 134490 - DNA, 25 bp, Homo sapien
tataatatcggtgcacaaacagaag

SEQ ID NO: 134491 - DNA, 25 bp, Homo sapien
gaggaagagcttaaacaaacaggta

SEQ ID NO: 134492 - DNA, 25 bp, Homo sapien
tgatttttctgttgttgagagtgaa

SEQ ID NO: 134493 - DNA, 25 bp, Homo sapien
gagagtgaatctgcgttagagcgta

SEQ ID NO: 134494 - DNA, 25 bp, Homo sapien
atctgcgttagagcgtaatgtgata

SEQ ID NO: 134495 - DNA, 25 bp, Homo sapien
aatattgctaaaacttggcgtgaag

SEQ ID NO: 134496 - DNA, 25 bp, Homo sapien
gtttaacgcacagaactaatactaa

SEQ ID NO: 134497 - DNA, 25 bp, Homo sapien
atggcgaccgtgctgtgtgacatca

SEQ ID NO: 134498 - DNA, 25 bp, Homo sapien
gtgtgacatcatagtcctctactgc

SEQ ID NO: 134499 - DNA, 25 bp, Homo sapien
atcatagtcctctactgcatgaaga

SEQ ID NO: 134500 - DNA, 25 bp, Homo sapien
aaagactctactatcgggagaagaa

SEQ ID NO: 134501 - DNA, 25 bp, Homo sapien
tatgtggaagattacgagcagggtc

SEQ ID NO: 134502 - DNA, 25 bp, Homo sapien
acgagcagggtcttgctagtgagct

SEQ ID NO: 134503 - DNA, 25 bp, Homo sapien
tccacagccccatcaaagaacagag

SEQ ID NO: 134504 - DNA, 25 bp, Homo sapien
ggagggagaaatggccaccacatca

SEQ ID NO: 134505 - DNA, 25 bp, Homo sapien
ggaatctgattgagtctccactcca

SEQ ID NO: 134506 - DNA, 25 bp, Homo sapien
tgattgagtctccactccacaagca

SEQ ID NO: 134507 - DNA, 25 bp, Homo sapien
agcagctcctgtgtgttgtgtgcag

SEQ ID NO: 134508 - DNA, 25 bp, Homo sapien
gtcttgagactttatcatgtgtctt

SEQ ID NO: 134509 - DNA, 25 bp, Homo sapien
actttatcatgtgtcttctgcccta

SEQ ID NO: 134510 - DNA, 25 bp, Homo sapien
gtcttctgccctaggtgagaaccct

SEQ ID NO: 134511 - DNA, 25 bp, Homo sapien
tctgccctaggtgagaacccttgca

SEQ ID NO: 134512 - DNA, 25 bp, Homo sapien
aggtgagaacccttgcactacagga

SEQ ID NO: 134513 - DNA, 25 bp, Homo sapien
gtgagaacccttgcactacaggaac

SEQ ID NO: 134514 - DNA, 25 bp, Homo sapien
gaacccttgcactacaggaacccta

SEQ ID NO: 134515 - DNA, 25 bp, Homo sapien
aatgtagggaagaggtgccaagcca

SEQ ID NO: 134516 - DNA, 25 bp, Homo sapien
tagggaagaggtgccaagccaaccg

SEQ ID NO: 134517 - DNA, 25 bp, Homo sapien
gaagaggtgccaagccaaccgtggg

SEQ ID NO: 134518 - DNA, 25 bp, Homo sapien
caaccgtggggttagctctaattat

SEQ ID NO: 134519 - DNA, 25 bp, Homo sapien
agccagtgagagacctggcctcagc

SEQ ID NO: 134520 - DNA, 25 bp, Homo sapien
tcttcaaggccatatccacctgtgc

SEQ ID NO: 134521 - DNA, 25 bp, Homo sapien
tctttttctccgtttcattctgtgt

SEQ ID NO: 134522 - DNA, 25 bp, Homo sapien
ccgtttcattctgtgtgcgttgtgg

SEQ ID NO: 134523 - DNA, 25 bp, Homo sapien
acctgccttacctttctgagttgcc

SEQ ID NO: 134524 - DNA, 25 bp, Homo sapien
gagttgcctttagagagatgcgttt

SEQ ID NO: 134525 - DNA, 25 bp, Homo sapien
agatgcgtttttctaggactctgtg

SEQ ID NO: 134526 - DNA, 25 bp, Homo sapien
gactctgtgcaactgtcgtatatgg

SEQ ID NO: 134527 - DNA, 25 bp, Homo sapien
gcaactgtcgtatatggtcccgtgg

SEQ ID NO: 134528 - DNA, 25 bp, Homo sapien
tgtcgtatatggtcccgtgggctga

SEQ ID NO: 134529 - DNA, 25 bp, Homo sapien
gggctgaccgctttgtacatgagaa

SEQ ID NO: 134530 - DNA, 25 bp, Homo sapien
cagagtctgggtgtatttattttcc

SEQ ID NO: 134531 - DNA, 25 bp, Homo sapien
ggtttggtggcttgcaagtatgttt

SEQ ID NO: 134532 - DNA, 25 bp, Homo sapien
gtatgttttagcatgtgtttggttc

SEQ ID NO: 134533 - DNA, 25 bp, Homo sapien
agcatgtgtttggttctggggcccc

SEQ ID NO: 134534 - DNA, 25 bp, Homo sapien
cccttgagctgagatggaacccttt

SEQ ID NO: 134535 - DNA, 25 bp, Homo sapien
ctccttgcctcctgtgtaatcattt

SEQ ID NO: 134536 - DNA, 25 bp, Homo sapien
ccttgcctcctgtgtaatcatttct

SEQ ID NO: 134537 - DNA, 25 bp, Homo sapien
gtgtaatcatttcttgggccctcct

SEQ ID NO: 134538 - DNA, 25 bp, Homo sapien
taatcatttcttgggccctcctgaa

SEQ ID NO: 134539 - DNA, 25 bp, Homo sapien
ttcttgggccctcctgaaacttaca

SEQ ID NO: 134540 - DNA, 25 bp, Homo sapien
ggccctcctgaaacttacacacaaa

SEQ ID NO: 134541 - DNA, 25 bp, Homo sapien
agcccagtgggcattggaggtgcca

SEQ ID NO: 134542 - DNA, 25 bp, Homo sapien
gtcagggttgtagccaagacgcccc

SEQ ID NO: 134543 - DNA, 25 bp, Homo sapien
gggatccccagagttggtccaagga

SEQ ID NO: 134544 - DNA, 25 bp, Homo sapien
gtgggttctcaatacggtaccaaag

SEQ ID NO: 134545 - DNA, 25 bp, Homo sapien
gggttctcaatacggtaccaaagat

SEQ ID NO: 134546 - DNA, 25 bp, Homo sapien
ggtaccaaagatataatcacctagg

SEQ ID NO: 134547 - DNA, 25 bp, Homo sapien
gatataatcacctaggtttacaaat

SEQ ID NO: 134548 - DNA, 25 bp, Homo sapien
aggactcacgttaactcacatttat

SEQ ID NO: 134549 - DNA, 25 bp, Homo sapien
gttaactcacatttatacagcagaa

SEQ ID NO: 134550 - DNA, 25 bp, Homo sapien
aaatgctattttgtatgctgttaag

SEQ ID NO: 134551 - DNA, 25 bp, Homo sapien
gctattttgtatgctgttaagtttt

SEQ ID NO: 134552 - DNA, 25 bp, Homo sapien
gtgaggccttcatttgcaactgcga

SEQ ID NO: 134553 - DNA, 25 bp, Homo sapien
gaggccttcatttgcaactgcgacc

SEQ ID NO: 134554 - DNA, 25 bp, Homo sapien
ccttcatttgcaactgcgaccgcaa

SEQ ID NO: 134555 - DNA, 25 bp, Homo sapien
tgccatctgcttttcaaaagctcca

SEQ ID NO: 134556 - DNA, 25 bp, Homo sapien
aaagctccatataacaaggcacaca

SEQ ID NO: 134557 - DNA, 25 bp, Homo sapien
taacaaggcacacaagaacctggac

SEQ ID NO: 134558 - DNA, 25 bp, Homo sapien
gaacctggacaccaagaagtattgt

SEQ ID NO: 134559 - DNA, 25 bp, Homo sapien
caccaagaagtattgtcagagttga

SEQ ID NO: 134560 - DNA, 25 bp, Homo sapien
cagagttgaatatcacctctcaaaa

SEQ ID NO: 134561 - DNA, 25 bp, Homo sapien
ctctcaaaagcatcacctctatctg

SEQ ID NO: 134562 - DNA, 25 bp, Homo sapien
tcaaaagcatcacctctatctgcct

SEQ ID NO: 134563 - DNA, 25 bp, Homo sapien
gaggagggagactctgctgctataa

SEQ ID NO: 134564 - DNA, 25 bp, Homo sapien
gctgctataactgaggatgaggccg

SEQ ID NO: 134565 - DNA, 25 bp, Homo sapien
ccgtgcttgtgctgggctaggacct

SEQ ID NO: 134566 - DNA, 25 bp, Homo sapien
tgggctaggacctcaaccccaggga

SEQ ID NO: 134567 - DNA, 25 bp, Homo sapien
aaccccagggattcccaggaagcag

SEQ ID NO: 134568 - DNA, 25 bp, Homo sapien
agcagaactctccagaagaagggtt

SEQ ID NO: 134569 - DNA, 25 bp, Homo sapien
gaagggttttgatcattccagctcc

SEQ ID NO: 134570 - DNA, 25 bp, Homo sapien
tcaggcccactaatgatcctgctac

SEQ ID NO: 134571 - DNA, 25 bp, Homo sapien
cactggccaggactctgagatcaga

SEQ ID NO: 134572 - DNA, 25 bp, Homo sapien
ggaagggagccattctgaacgccac

SEQ ID NO: 134573 - DNA, 25 bp, Homo sapien
tggcccggtcagtgctgcatgcact

SEQ ID NO: 134574 - DNA, 25 bp, Homo sapien
ttcctcctatatcctcagtaacaac

SEQ ID NO: 134575 - DNA, 25 bp, Homo sapien
cagtaacaacggctactgcaccgtg

SEQ ID NO: 134576 - DNA, 25 bp, Homo sapien
gctactgcaccgtgggagtcgagcc

SEQ ID NO: 134577 - DNA, 25 bp, Homo sapien
gggatgtcttcctcaggtcctacta

SEQ ID NO: 134578 - DNA, 25 bp, Homo sapien
tcaggtcctactattccgtctacga

SEQ ID NO: 134579 - DNA, 25 bp, Homo sapien
attccgtctacgacttgggcaacaa

SEQ ID NO: 134580 - DNA, 25 bp, Homo sapien
cgtctacgacttgggcaacaacaga

SEQ ID NO: 134581 - DNA, 25 bp, Homo sapien
caacaacagagtaggctttgccact

SEQ ID NO: 134582 - DNA, 25 bp, Homo sapien
aacagagtaggctttgccactgccg

SEQ ID NO: 134583 - DNA, 25 bp, Homo sapien
gtaggctttgccactgccgcctaga

SEQ ID NO: 134584 - DNA, 25 bp, Homo sapien
tagacttgctgcctcgacacgtggg

SEQ ID NO: 134585 - DNA, 25 bp, Homo sapien
tcaggacactttacgggatcaaagt

SEQ ID NO: 134586 - DNA, 25 bp, Homo sapien
ttacgggatcaaagtgggtctacac

SEQ ID NO: 134587 - DNA, 25 bp, Homo sapien
aaagtgggtctacaccagtgctgct

SEQ ID NO: 134588 - DNA, 25 bp, Homo sapien
ccagtgctgcttcctgaatgtttgt

SEQ ID NO: 134589 - DNA, 25 bp, Homo sapien
tgtttgtgtgtgaacccttgtttcc

SEQ ID NO: 134590 - DNA, 25 bp, Homo sapien
ttcctccaaaacaaacgacagcaac

SEQ ID NO: 134591 - DNA, 25 bp, Homo sapien
acgacagcaacgaaaactccttaat

SEQ ID NO: 134592 - DNA, 25 bp, Homo sapien
gaaaactccttaatcagaacactga

SEQ ID NO: 134593 - DNA, 25 bp, Homo sapien
tcagaacactgatccaatgaggaat

SEQ ID NO: 134594 - DNA, 25 bp, Homo sapien
tgtgacccaggagaacttagtgcaa

SEQ ID NO: 134595 - DNA, 25 bp, Homo sapien
gagaacttagtgcaagactacagga

SEQ ID NO: 134596 - DNA, 25 bp, Homo sapien
gctgcagtggtggaacagattcaca

SEQ ID NO: 134597 - DNA, 25 bp, Homo sapien
gaacagattcacaagtttgcccagt

SEQ ID NO: 134598 - DNA, 25 bp, Homo sapien
ggctcaataagaaaaccacgttagg

SEQ ID NO: 134599 - DNA, 25 bp, Homo sapien
accacgttaggagcaacctttgtat

SEQ ID NO: 134600 - DNA, 25 bp, Homo sapien
gagcaacctttgtatattggagact

SEQ ID NO: 134601 - DNA, 25 bp, Homo sapien
tattggagacttcagagtaaccagc

SEQ ID NO: 134602 - DNA, 25 bp, Homo sapien
cttcaagttaccatattttccaaat

SEQ ID NO: 134603 - DNA, 25 bp, Homo sapien
ttacatggtacctgagttctgcttc

SEQ ID NO: 134604 - DNA, 25 bp, Homo sapien
acctgagttctgcttccttggatgt

SEQ ID NO: 134605 - DNA, 25 bp, Homo sapien
gcttccttggatgtcattgcttaaa

SEQ ID NO: 134606 - DNA, 25 bp, Homo sapien
tatagtcttgaagggcttgttttga

SEQ ID NO: 134607 - DNA, 25 bp, Homo sapien
gttctacgtgcgagagccgccgaat

SEQ ID NO: 134608 - DNA, 25 bp, Homo sapien
gagagccgccgaatgccaaacctga

SEQ ID NO: 134609 - DNA, 25 bp, Homo sapien
gaatgccaaacctgactggctgaaa

SEQ ID NO: 134610 - DNA, 25 bp, Homo sapien
acctgactggctgaaagttgggttc

SEQ ID NO: 134611 - DNA, 25 bp, Homo sapien
tgaaagttgggttcaccttgggcac

SEQ ID NO: 134612 - DNA, 25 bp, Homo sapien
agttgggttcaccttgggcaccact

SEQ ID NO: 134613 - DNA, 25 bp, Homo sapien
accttgggcaccactgtcttcttgt

SEQ ID NO: 134614 - DNA, 25 bp, Homo sapien
gtcttcttgtggatctatctcatca

SEQ ID NO: 134615 - DNA, 25 bp, Homo sapien
ggatctatctcatcaaacaacacaa

SEQ ID NO: 134616 - DNA, 25 bp, Homo sapien
atcaagccagcatttgtattttgca

SEQ ID NO: 134617 - DNA, 25 bp, Homo sapien
agcatttgtattttgcatcattaaa

SEQ ID NO: 134618 - DNA, 25 bp, Homo sapien
tccacctggactcaggccgggctgg

SEQ ID NO: 134619 - DNA, 25 bp, Homo sapien
tgggctgtggatccttgatcccctc

SEQ ID NO: 134620 - DNA, 25 bp, Homo sapien
ctcagccttgctaccctgtgactta

SEQ ID NO: 134621 - DNA, 25 bp, Homo sapien
agccttgctaccctgtgacttactg

SEQ ID NO: 134622 - DNA, 25 bp, Homo sapien
cttgctaccctgtgacttactggga

SEQ ID NO: 134623 - DNA, 25 bp, Homo sapien
tgctaccctgtgacttactgggagg

SEQ ID NO: 134624 - DNA, 25 bp, Homo sapien
ctaccctgtgacttactgggaggag

SEQ ID NO: 134625 - DNA, 25 bp, Homo sapien
accctgtgacttactgggaggagag

SEQ ID NO: 134626 - DNA, 25 bp, Homo sapien
cttactgggaggagagtcacctgaa

SEQ ID NO: 134627 - DNA, 25 bp, Homo sapien
gagagtcacctgaaggggaacatga

SEQ ID NO: 134628 - DNA, 25 bp, Homo sapien
cctgtatgccttgcttctaccatga

SEQ ID NO: 134629 - DNA, 25 bp, Homo sapien
cagatacttcatatagcccatttta

SEQ ID NO: 134630 - DNA, 25 bp, Homo sapien
tcatatagcccattttaacttgtat

SEQ ID NO: 134631 - DNA, 25 bp, Homo sapien
taacttgtataaactgtgtgacttg

SEQ ID NO: 134632 - DNA, 25 bp, Homo sapien
tgtgtgacttgtggcgtcttataaa

SEQ ID NO: 134633 - DNA, 25 bp, Homo sapien
gtggcgtcttataaataatgcactg

SEQ ID NO: 134634 - DNA, 25 bp, Homo sapien
aagattactgaatagttgtgtcatg

SEQ ID NO: 134635 - DNA, 25 bp, Homo sapien
gttgtgtcatgttaatgtgcctaat

SEQ ID NO: 134636 - DNA, 25 bp, Homo sapien
gtgcctaatttcatgtatcttgtaa

SEQ ID NO: 134637 - DNA, 25 bp, Homo sapien
tgtaatcatgattgagcctcagaat

SEQ ID NO: 134638 - DNA, 25 bp, Homo sapien
gaacaagacatacttcaatgtatta

SEQ ID NO: 134639 - DNA, 25 bp, Homo sapien
tgtttgattttaaaagggcggacat

SEQ ID NO: 134640 - DNA, 25 bp, Homo sapien
catcagctctgtggcggcctttact

SEQ ID NO: 134641 - DNA, 25 bp, Homo sapien
ttacttctgtgggagtgggaactgt

SEQ ID NO: 134642 - DNA, 25 bp, Homo sapien
gtgggaactgttctctgtgacatca

SEQ ID NO: 134643 - DNA, 25 bp, Homo sapien
aactgttctctgtgacatcatcctg

SEQ ID NO: 134644 - DNA, 25 bp, Homo sapien
ggaggtgaatgagactacgctgaaa

SEQ ID NO: 134645 - DNA, 25 bp, Homo sapien
gactacgctgaaaatcgcggctttg

SEQ ID NO: 134646 - DNA, 25 bp, Homo sapien
tcgcggctttgaccaacccagtgta

SEQ ID NO: 134647 - DNA, 25 bp, Homo sapien
cagcgaccagaccacagcggagaag

SEQ ID NO: 134648 - DNA, 25 bp, Homo sapien
gcggagaagcagtccaccgattcgg

SEQ ID NO: 134649 - DNA, 25 bp, Homo sapien
ggccttctccataggccactagggc

SEQ ID NO: 134650 - DNA, 25 bp, Homo sapien
ggccactagggcctctttccagggc

SEQ ID NO: 134651 - DNA, 25 bp, Homo sapien
gactcaaagcactggaactcatatt

SEQ ID NO: 134652 - DNA, 25 bp, Homo sapien
ggaactcatattgtaccacgactca

SEQ ID NO: 134653 - DNA, 25 bp, Homo sapien
atattgtaccacgactcacaccttt

SEQ ID NO: 134654 - DNA, 25 bp, Homo sapien
gactcacacctttgtcaaggcgctg

SEQ ID NO: 134655 - DNA, 25 bp, Homo sapien
tcaaggcgctgaccatggatggcaa

SEQ ID NO: 134656 - DNA, 25 bp, Homo sapien
accatggatggcaagcaggctgcct

SEQ ID NO: 134657 - DNA, 25 bp, Homo sapien
ggctgcctggcggtttatccggata

SEQ ID NO: 134658 - DNA, 25 bp, Homo sapien
gcctggcggtttatccggatagata

SEQ ID NO: 134659 - DNA, 25 bp, Homo sapien
tatccggatagatacggcctgtgtg

SEQ ID NO: 134660 - DNA, 25 bp, Homo sapien
agaagagcctgacctgccgacacgc

SEQ ID NO: 134661 - DNA, 25 bp, Homo sapien
taaggactgcatggtaatttatagt

SEQ ID NO: 134662 - DNA, 25 bp, Homo sapien
ggacacagatgacctctacgggagt

SEQ ID NO: 134663 - DNA, 25 bp, Homo sapien
aacgccaagatttagtctcaggatt

SEQ ID NO: 134664 - DNA, 25 bp, Homo sapien
gattaaccttgcttgcacagaagtt

SEQ ID NO: 134665 - DNA, 25 bp, Homo sapien
gcacagaagttagaacactctcagt

SEQ ID NO: 134666 - DNA, 25 bp, Homo sapien
gaacactctcagttttttgtcatgt

SEQ ID NO: 134667 - DNA, 25 bp, Homo sapien
gtaagatactaacctagccaccctg

SEQ ID NO: 134668 - DNA, 25 bp, Homo sapien
gagagaacagaaagctgtccctggc

SEQ ID NO: 134669 - DNA, 25 bp, Homo sapien
gcctgaacccagaacatttccctaa

SEQ ID NO: 134670 - DNA, 25 bp, Homo sapien
agcaaggcggagtgtcccctctgcc

SEQ ID NO: 134671 - DNA, 25 bp, Homo sapien
tgccgggagaagttccctccccaga

SEQ ID NO: 134672 - DNA, 25 bp, Homo sapien
agaagctcatctaccttcggcacta

SEQ ID NO: 134673 - DNA, 25 bp, Homo sapien
tgctgccagacacatgacaactgct

SEQ ID NO: 134674 - DNA, 25 bp, Homo sapien
tgccagacacatgacaactgctatg

SEQ ID NO: 134675 - DNA, 25 bp, Homo sapien
agacacatgacaactgctatgacca

SEQ ID NO: 134676 - DNA, 25 bp, Homo sapien
cacatgacaactgctatgaccaggc

SEQ ID NO: 134677 - DNA, 25 bp, Homo sapien
acacctattcatactcgtgctctgg

SEQ ID NO: 134678 - DNA, 25 bp, Homo sapien
tattcatactcgtgctctggctcgg

SEQ ID NO: 134679 - DNA, 25 bp, Homo sapien
tcatactcgtgctctggctcggcaa

SEQ ID NO: 134680 - DNA, 25 bp, Homo sapien
tactcgtgctctggctcggcaatca

SEQ ID NO: 134681 - DNA, 25 bp, Homo sapien
gctctggctcggcaatcacctgtag

SEQ ID NO: 134682 - DNA, 25 bp, Homo sapien
tggctcggcaatcacctgtagcagc

SEQ ID NO: 134683 - DNA, 25 bp, Homo sapien
ctcggcaatcacctgtagcagcaaa

SEQ ID NO: 134684 - DNA, 25 bp, Homo sapien
gctctcctgtagctctcctggggtt

SEQ ID NO: 134685 - DNA, 25 bp, Homo sapien
tcctggggttctgggagttccctga

SEQ ID NO: 134686 - DNA, 25 bp, Homo sapien
agttccctgaacatctgtgtgtgtc

SEQ ID NO: 134687 - DNA, 25 bp, Homo sapien
gttccctgaacatctgtgtgtgtcc

SEQ ID NO: 134688 - DNA, 25 bp, Homo sapien
gaacatctgtgtgtgtccccctatg

SEQ ID NO: 134689 - DNA, 25 bp, Homo sapien
tgtgtgtccccctatgctccagtat

SEQ ID NO: 134690 - DNA, 25 bp, Homo sapien
tggagggtcgccacacccggctccc

SEQ ID NO: 134691 - DNA, 25 bp, Homo sapien
tccttctggcgcaagagaacatttc

SEQ ID NO: 134692 - DNA, 25 bp, Homo sapien
ccttctggcgcaagagaacatttct

SEQ ID NO: 134693 - DNA, 25 bp, Homo sapien
ttctggcgcaagagaacatttctag

SEQ ID NO: 134694 - DNA, 25 bp, Homo sapien
ctggcgcaagagaacatttctagaa

SEQ ID NO: 134695 - DNA, 25 bp, Homo sapien
atggactttgcacactttggcccag

SEQ ID NO: 134696 - DNA, 25 bp, Homo sapien
tttgcacactttggcccagggtggc

SEQ ID NO: 134697 - DNA, 25 bp, Homo sapien
acctctatcccggctttggtgcggg

SEQ ID NO: 134698 - DNA, 25 bp, Homo sapien
tgagttgtgtgaataccccaagact

SEQ ID NO: 134699 - DNA, 25 bp, Homo sapien
tgaataccccaagactcccatgagg

SEQ ID NO: 134700 - DNA, 25 bp, Homo sapien
ataccccaagactcccatgagggag

SEQ ID NO: 134701 - DNA, 25 bp, Homo sapien
gagggagatgccatgagccgcccaa

SEQ ID NO: 134702 - DNA, 25 bp, Homo sapien
ggagatgccatgagccgcccaaggc

SEQ ID NO: 134703 - DNA, 25 bp, Homo sapien
tgcggagcacactggctcacccagt

SEQ ID NO: 134704 - DNA, 25 bp, Homo sapien
tgcccgccaccgttatcggtgtcat

SEQ ID NO: 134705 - DNA, 25 bp, Homo sapien
accgttatcggtgtcattcaccttt

SEQ ID NO: 134706 - DNA, 25 bp, Homo sapien
gatatccatttgtttgattacatgg

SEQ ID NO: 134707 - DNA, 25 bp, Homo sapien
gtgtttgaatcatgaattcccttgt

SEQ ID NO: 134708 - DNA, 25 bp, Homo sapien
attcccttgtttcaaaagacttgca

SEQ ID NO: 134709 - DNA, 25 bp, Homo sapien
gcatgtatgtatctaaacacccaca

SEQ ID NO: 134710 - DNA, 25 bp, Homo sapien
tgtatctaaacacccacatatattt

SEQ ID NO: 134711 - DNA, 25 bp, Homo sapien
gtgtgagaaatcttgctaatctata

SEQ ID NO: 134712 - DNA, 25 bp, Homo sapien
attgtatccaaatttatgccactta

SEQ ID NO: 134713 - DNA, 25 bp, Homo sapien
gccacttaaatttctttaccacgag

SEQ ID NO: 134714 - DNA, 25 bp, Homo sapien
ttaccacgagggatagagcatgcat

SEQ ID NO: 134715 - DNA, 25 bp, Homo sapien
gatagagcatgcatactggtttttt

SEQ ID NO: 134716 - DNA, 25 bp, Homo sapien
cttgatttgcccatataattggtaa

SEQ ID NO: 134717 - DNA, 25 bp, Homo sapien
tcagatcccctcttctcagacagcg

SEQ ID NO: 134718 - DNA, 25 bp, Homo sapien
atcccctcttctcagacagcgccag

SEQ ID NO: 134719 - DNA, 25 bp, Homo sapien
gacctgctccatctgagctctccag

SEQ ID NO: 134720 - DNA, 25 bp, Homo sapien
tgctccatctgagctctccagctgg

SEQ ID NO: 134721 - DNA, 25 bp, Homo sapien
agctggcccccaattgctcctctct

SEQ ID NO: 134722 - DNA, 25 bp, Homo sapien
gcctcattcttctccggtagcctct

SEQ ID NO: 134723 - DNA, 25 bp, Homo sapien
ggtagcctctcccacctaacctctg

SEQ ID NO: 134724 - DNA, 25 bp, Homo sapien
ctgcatcccccagcgtcatgtcctg

SEQ ID NO: 134725 - DNA, 25 bp, Homo sapien
ctatcctgcctgatccctggatctc

SEQ ID NO: 134726 - DNA, 25 bp, Homo sapien
gcctgatccctggatctccctcaga

SEQ ID NO: 134727 - DNA, 25 bp, Homo sapien
tgatccctggatctccctcagatcc

SEQ ID NO: 134728 - DNA, 25 bp, Homo sapien
gattccttctaactgaaggtgcagt

SEQ ID NO: 134729 - DNA, 25 bp, Homo sapien
agatgccaacatcggtgtggactac

SEQ ID NO: 134730 - DNA, 25 bp, Homo sapien
tgtggactacaggacaaggggcatt

SEQ ID NO: 134731 - DNA, 25 bp, Homo sapien
gggcattgttgcttgttgggtaaaa

SEQ ID NO: 134732 - DNA, 25 bp, Homo sapien
ggtaaaaatgaagcagaagccccaa

SEQ ID NO: 134733 - DNA, 25 bp, Homo sapien
taaaaatgaagcagaagccccaaag

SEQ ID NO: 134734 - DNA, 25 bp, Homo sapien
aagcagaagccccaaagttcacatt

SEQ ID NO: 134735 - DNA, 25 bp, Homo sapien
caaagttcacattaactcaggcatt

SEQ ID NO: 134736 - DNA, 25 bp, Homo sapien
gttcacattaactcaggcatttcat

SEQ ID NO: 134737 - DNA, 25 bp, Homo sapien
cacattaactcaggcatttcattta

SEQ ID NO: 134738 - DNA, 25 bp, Homo sapien
tttcttcttggctggttctttgttc

SEQ ID NO: 134739 - DNA, 25 bp, Homo sapien
ggagcagcgcgggatttcctttctc

SEQ ID NO: 134740 - DNA, 25 bp, Homo sapien
gagcagcgcgggatttcctttctct

SEQ ID NO: 134741 - DNA, 25 bp, Homo sapien
agcagcgcgggatttcctttctctc

SEQ ID NO: 134742 - DNA, 25 bp, Homo sapien
gcagcgcgggatttcctttctctct

SEQ ID NO: 134743 - DNA, 25 bp, Homo sapien
agcgcgggatttcctttctctctca

SEQ ID NO: 134744 - DNA, 25 bp, Homo sapien
cgggatttcctttctctctcactct

SEQ ID NO: 134745 - DNA, 25 bp, Homo sapien
tctttcctttcattctagtattctt

SEQ ID NO: 134746 - DNA, 25 bp, Homo sapien
cctttcattctagtattcttaatta

SEQ ID NO: 134747 - DNA, 25 bp, Homo sapien
tctctcgttcgctcgctctctcgta

SEQ ID NO: 134748 - DNA, 25 bp, Homo sapien
gttcgctcgctctctcgtactctct

SEQ ID NO: 134749 - DNA, 25 bp, Homo sapien
ttctttccttttcataagaggttct

SEQ ID NO: 134750 - DNA, 25 bp, Homo sapien
ctctttatgtctgcccagtgtattg

SEQ ID NO: 134751 - DNA, 25 bp, Homo sapien
tgctttgagagtgtatcctgtgccc

SEQ ID NO: 134752 - DNA, 25 bp, Homo sapien
gagagtgtatcctgtgcccgatcta

SEQ ID NO: 134753 - DNA, 25 bp, Homo sapien
tgcccgatctacttgtcattgcaga

SEQ ID NO: 134754 - DNA, 25 bp, Homo sapien
aatatgatcctttcactacgacaaa

SEQ ID NO: 134755 - DNA, 25 bp, Homo sapien
acgacaaataccgaatgcctctgca

SEQ ID NO: 134756 - DNA, 25 bp, Homo sapien
gaatgcctctgcataaaccctggct

SEQ ID NO: 134757 - DNA, 25 bp, Homo sapien
ctggctcttttccaagaagtggatt

SEQ ID NO: 134758 - DNA, 25 bp, Homo sapien
gttttttatccttctaataagacag

SEQ ID NO: 134759 - DNA, 25 bp, Homo sapien
aagatagcaaacttcaaggcttttg

SEQ ID NO: 134760 - DNA, 25 bp, Homo sapien
gttttctgcttaactctatatctta

SEQ ID NO: 134761 - DNA, 25 bp, Homo sapien
gcaacagcaagttttactcatagaa

SEQ ID NO: 134762 - DNA, 25 bp, Homo sapien
gtaggagaacgtgccctattcacac

SEQ ID NO: 134763 - DNA, 25 bp, Homo sapien
ctattcacactctgggaagacgcta

SEQ ID NO: 134764 - DNA, 25 bp, Homo sapien
gggaagacgctaatctgtgacatct

SEQ ID NO: 134765 - DNA, 25 bp, Homo sapien
tgtgacatcttttcttcaagcctgc

SEQ ID NO: 134766 - DNA, 25 bp, Homo sapien
ttcaagcctgccatcaaggacattt

SEQ ID NO: 134767 - DNA, 25 bp, Homo sapien
ggacatttcttaagacccaactggc

SEQ ID NO: 134768 - DNA, 25 bp, Homo sapien
cttggacaacttctaacttatatct

SEQ ID NO: 134769 - DNA, 25 bp, Homo sapien
atatctttatagaggattccccaaa

SEQ ID NO: 134770 - DNA, 25 bp, Homo sapien
gattccccaaaatgtgctcctcatt

SEQ ID NO: 134771 - DNA, 25 bp, Homo sapien
atttttggcctctcatgttccaaac

SEQ ID NO: 134772 - DNA, 25 bp, Homo sapien
ggaagcaacattgacctctgcgtca

SEQ ID NO: 134773 - DNA, 25 bp, Homo sapien
gacctctgcgtcatcagcaagaaca

SEQ ID NO: 134774 - DNA, 25 bp, Homo sapien
acaagctggattttctccgcccata

SEQ ID NO: 134775 - DNA, 25 bp, Homo sapien
gcccatacacagtgcccaacaagaa

SEQ ID NO: 134776 - DNA, 25 bp, Homo sapien
agggactactgcagtcctcactgag

SEQ ID NO: 134777 - DNA, 25 bp, Homo sapien
gtcctcactgagaaaatcactcctc

SEQ ID NO: 134778 - DNA, 25 bp, Homo sapien
atcactcctctggagattgaggtgc

SEQ ID NO: 134779 - DNA, 25 bp, Homo sapien
tggacacttcctgaatggcatcagt

SEQ ID NO: 134780 - DNA, 25 bp, Homo sapien
ggtgagcattgaggcccagtaagac

SEQ ID NO: 134781 - DNA, 25 bp, Homo sapien
ggcccagtaagacactcatgtggct

SEQ ID NO: 134782 - DNA, 25 bp, Homo sapien
agacactcatgtggctagtgtttgc

SEQ ID NO: 134783 - DNA, 25 bp, Homo sapien
gaattgtgaaactactcatgagtac

SEQ ID NO: 134784 - DNA, 25 bp, Homo sapien
aattgtgaaactactcatgagtact

SEQ ID NO: 134785 - DNA, 25 bp, Homo sapien
gtgaaactactcatgagtactcata

SEQ ID NO: 134786 - DNA, 25 bp, Homo sapien
gaaactactcatgagtactcatagg

SEQ ID NO: 134787 - DNA, 25 bp, Homo sapien
actactcatgagtactcataggttt

SEQ ID NO: 134788 - DNA, 25 bp, Homo sapien
actcatgagtactcataggtttatg

SEQ ID NO: 134789 - DNA, 25 bp, Homo sapien
ctgcaacaactgagacactgagaaa

SEQ ID NO: 134790 - DNA, 25 bp, Homo sapien
tatttgcttttgctgtctatctgaa

SEQ ID NO: 134791 - DNA, 25 bp, Homo sapien
gaatgccccagaattgtgaaactac

SEQ ID NO: 134792 - DNA, 25 bp, Homo sapien
aatgccccagaattgtgaaactact

SEQ ID NO: 134793 - DNA, 25 bp, Homo sapien
atgccccagaattgtgaaactactc

SEQ ID NO: 134794 - DNA, 25 bp, Homo sapien
ccatctatgtgcaattatactctaa

SEQ ID NO: 134795 - DNA, 25 bp, Homo sapien
atactctaaattccactacactaca

SEQ ID NO: 134796 - DNA, 25 bp, Homo sapien
taaattccactacactacattaaag

SEQ ID NO: 134797 - DNA, 25 bp, Homo sapien
ggacattccagaatatagatgtgat

SEQ ID NO: 134798 - DNA, 25 bp, Homo sapien
aatcagtgatgcatttgttatagag

SEQ ID NO: 134799 - DNA, 25 bp, Homo sapien
gagtataactcatcgtttacagtat

SEQ ID NO: 134800 - DNA, 25 bp, Homo sapien
gttggcagtatcatacctagatggt

SEQ ID NO: 134801 - DNA, 25 bp, Homo sapien
tattcccagtaaatttatatagcag

SEQ ID NO: 134802 - DNA, 25 bp, Homo sapien
tgaagaattacatgccttctggtgg

SEQ ID NO: 134803 - DNA, 25 bp, Homo sapien
tgccttctggtggacattttataag

SEQ ID NO: 134804 - DNA, 25 bp, Homo sapien
ggtggacattttataagtgcatttt

SEQ ID NO: 134805 - DNA, 25 bp, Homo sapien
tttactaatcctatctgccaaaatg

SEQ ID NO: 134806 - DNA, 25 bp, Homo sapien
tgccaaaatggcttagacacaaaaa

SEQ ID NO: 134807 - DNA, 25 bp, Homo sapien
tagacacaaaaacacctcagcagaa

SEQ ID NO: 134808 - DNA, 25 bp, Homo sapien
agaaatgaatatacctagcactcag

SEQ ID NO: 134809 - DNA, 25 bp, Homo sapien
tagcactcagatcttcgtgtctaat

SEQ ID NO: 134810 - DNA, 25 bp, Homo sapien
cgtgtctaatatagtttgccactaa

SEQ ID NO: 134811 - DNA, 25 bp, Homo sapien
gatgattccaaagcaagggcaaggt

SEQ ID NO: 134812 - DNA, 25 bp, Homo sapien
gagcttgaaatatcttgttatgcca

SEQ ID NO: 134813 - DNA, 25 bp, Homo sapien
tattgccaaaacatagagccagctt

SEQ ID NO: 134814 - DNA, 25 bp, Homo sapien
ctggccaaacttgagccaatctgag

SEQ ID NO: 134815 - DNA, 25 bp, Homo sapien
gagccaatctgagagcaaaataatt

SEQ ID NO: 134816 - DNA, 25 bp, Homo sapien
agccaggcaagctgcaaagacggaa

SEQ ID NO: 134817 - DNA, 25 bp, Homo sapien
gacggaaatagagaagcttcagatg

SEQ ID NO: 134818 - DNA, 25 bp, Homo sapien
aagaaatgacctgccgtgatatcgt

SEQ ID NO: 134819 - DNA, 25 bp, Homo sapien
aatgacctgccgtgatatcgttaaa

SEQ ID NO: 134820 - DNA, 25 bp, Homo sapien
gacctgccgtgatatcgttaaagaa

SEQ ID NO: 134821 - DNA, 25 bp, Homo sapien
gccgtgatatcgttaaagaagttgc

SEQ ID NO: 134822 - DNA, 25 bp, Homo sapien
gaactcagctgggttggtgaattaa

SEQ ID NO: 134823 - DNA, 25 bp, Homo sapien
cagctgggttggtgaattaactaat

SEQ ID NO: 134824 - DNA, 25 bp, Homo sapien
aatatgctaaggaatctctgaagga

SEQ ID NO: 134825 - DNA, 25 bp, Homo sapien
gtaacatttactccagcatctattg

SEQ ID NO: 134826 - DNA, 25 bp, Homo sapien
actccagcatctattgtattttaaa

SEQ ID NO: 134827 - DNA, 25 bp, Homo sapien
gaatgtggagcatgttccgctgtcc

SEQ ID NO: 134828 - DNA, 25 bp, Homo sapien
agcatgttccgctgtccttggacag

SEQ ID NO: 134829 - DNA, 25 bp, Homo sapien
agccatgcggctggtgaaagatgtc

SEQ ID NO: 134830 - DNA, 25 bp, Homo sapien
aagatgtcttcatttctgcggctga

SEQ ID NO: 134831 - DNA, 25 bp, Homo sapien
tttctgcggctgagagagatgtgta

SEQ ID NO: 134832 - DNA, 25 bp, Homo sapien
gacgcactccggatctgcatagtga

SEQ ID NO: 134833 - DNA, 25 bp, Homo sapien
gcatagtgaccaaagagggcatcag

SEQ ID NO: 134834 - DNA, 25 bp, Homo sapien
gaaggactgatctgtgtgctcttat

SEQ ID NO: 134835 - DNA, 25 bp, Homo sapien
gtgctcttatcaccaatcagttcag

SEQ ID NO: 134836 - DNA, 25 bp, Homo sapien
atcaccaatcagttcagacctggtt

SEQ ID NO: 134837 - DNA, 25 bp, Homo sapien
gacctggttgattttgtactttgga

SEQ ID NO: 134838 - DNA, 25 bp, Homo sapien
agagccctgtacatcccagactggg

SEQ ID NO: 134839 - DNA, 25 bp, Homo sapien
gggcccagggtctcccatagacagc

SEQ ID NO: 134840 - DNA, 25 bp, Homo sapien
cagggtctcccatagacagcctggg

SEQ ID NO: 134841 - DNA, 25 bp, Homo sapien
ggcaagttagcactttattcccgca

SEQ ID NO: 134842 - DNA, 25 bp, Homo sapien
ttagcactttattcccgcagcagtt

SEQ ID NO: 134843 - DNA, 25 bp, Homo sapien
ctgcttaaagaatgccctttatgat

SEQ ID NO: 134844 - DNA, 25 bp, Homo sapien
tatgatgcactgattccatcccagg

SEQ ID NO: 134845 - DNA, 25 bp, Homo sapien
gatgcactgattccatcccaggaac

SEQ ID NO: 134846 - DNA, 25 bp, Homo sapien
tgattccatcccaggaacccaacag

SEQ ID NO: 134847 - DNA, 25 bp, Homo sapien
caggaacccaacagagctcaggaca

SEQ ID NO: 134848 - DNA, 25 bp, Homo sapien
ggtggacggactgtaattgatagat

SEQ ID NO: 134849 - DNA, 25 bp, Homo sapien
gcgattgccaacaccaggacccata

SEQ ID NO: 134850 - DNA, 25 bp, Homo sapien
caggacccatacatatgaatgcagg

SEQ ID NO: 134851 - DNA, 25 bp, Homo sapien
tttggtgcgaatgccttacgcatgc

SEQ ID NO: 134852 - DNA, 25 bp, Homo sapien
gccttacgcatgcaaactattgttt

SEQ ID NO: 134853 - DNA, 25 bp, Homo sapien
attgtttcaggaacttatgtctatg

SEQ ID NO: 134854 - DNA, 25 bp, Homo sapien
tgtctatgagtattgcaccgcgaat

SEQ ID NO: 134855 - DNA, 25 bp, Homo sapien
accgcgaatgatgagtgtttagcta

SEQ ID NO: 134856 - DNA, 25 bp, Homo sapien
gtttagctattttacaggagtcaac

SEQ ID NO: 134857 - DNA, 25 bp, Homo sapien
aaatatcttggtgtcttgtttctat

SEQ ID NO: 134858 - DNA, 25 bp, Homo sapien
tggtgtcttgtttctattgtgtggc

SEQ ID NO: 134859 - DNA, 25 bp, Homo sapien
gatatgcatgcttttcttctgtaaa

SEQ ID NO: 134860 - DNA, 25 bp, Homo sapien
tttagcatgctacagttattaatct

SEQ ID NO: 134861 - DNA, 25 bp, Homo sapien
agttattaatctggacattcgagga

SEQ ID NO: 134862 - DNA, 25 bp, Homo sapien
acattcgaggaattggccgctgtca

SEQ ID NO: 134863 - DNA, 25 bp, Homo sapien
aattggccgctgtcactgcttgttg

SEQ ID NO: 134864 - DNA, 25 bp, Homo sapien
cactgcttgttgtttgcgcattttt

SEQ ID NO: 134865 - DNA, 25 bp, Homo sapien
catattggtgctagaaaaggcagct

SEQ ID NO: 134866 - DNA, 25 bp, Homo sapien
aaaggcagctaaaggaagtgaatct

SEQ ID NO: 134867 - DNA, 25 bp, Homo sapien
acaggaatgaaccttctgcaacatc

SEQ ID NO: 134868 - DNA, 25 bp, Homo sapien
ttctgcaacatcttaagatccacaa

SEQ ID NO: 134869 - DNA, 25 bp, Homo sapien
gaaacacagcaacaatgacttaacc

SEQ ID NO: 134870 - DNA, 25 bp, Homo sapien
accatataaatgtggaggctatcaa

SEQ ID NO: 134871 - DNA, 25 bp, Homo sapien
ttatcttcctggcataatttccatt

SEQ ID NO: 134872 - DNA, 25 bp, Homo sapien
cttcctggcataatttccattttat

SEQ ID NO: 134873 - DNA, 25 bp, Homo sapien
tcttctgagtgtctatgttaacttc

SEQ ID NO: 134874 - DNA, 25 bp, Homo sapien
tctgagtgtctatgttaacttccct

SEQ ID NO: 134875 - DNA, 25 bp, Homo sapien
tgttgacttgatgttttatcacttc

SEQ ID NO: 134876 - DNA, 25 bp, Homo sapien
ttatcacttctctaagtaaggttga

SEQ ID NO: 134877 - DNA, 25 bp, Homo sapien
cacttctctaagtaaggttgaaata

SEQ ID NO: 134878 - DNA, 25 bp, Homo sapien
aaagaaattcttaatcacggtgcca

SEQ ID NO: 134879 - DNA, 25 bp, Homo sapien
agaaattcttaatcacggtgccaaa

SEQ ID NO: 134880 - DNA, 25 bp, Homo sapien
aatcacggtgccaaaattcattttc

SEQ ID NO: 134881 - DNA, 25 bp, Homo sapien
aattcattttctaacaccatgtgtt

SEQ ID NO: 134882 - DNA, 25 bp, Homo sapien
attgtaacgatgatggttacccttc

SEQ ID NO: 134883 - DNA, 25 bp, Homo sapien
tgatggttacccttcatggacgtct

SEQ ID NO: 134884 - DNA, 25 bp, Homo sapien
tggttacccttcatggacgtcttaa

SEQ ID NO: 134885 - DNA, 25 bp, Homo sapien
tacccttcatggacgtcttaatctt

SEQ ID NO: 134886 - DNA, 25 bp, Homo sapien
aaagaagtggagcagttgatcaaaa

SEQ ID NO: 134887 - DNA, 25 bp, Homo sapien
gtggagcagttgatcaaaaaacatg

SEQ ID NO: 134888 - DNA, 25 bp, Homo sapien
ttacatactgaattgggtccttgtc

SEQ ID NO: 134889 - DNA, 25 bp, Homo sapien
tactgaattgggtccttgtcatttc

SEQ ID NO: 134890 - DNA, 25 bp, Homo sapien
aattgggtccttgtcatttctgtcc

SEQ ID NO: 134891 - DNA, 25 bp, Homo sapien
gtccttgtcatttctgtccaattga

SEQ ID NO: 134892 - DNA, 25 bp, Homo sapien
atttctgtccaattgaatactttat

SEQ ID NO: 134893 - DNA, 25 bp, Homo sapien
gagccgtgtgtgagttctgccagcc

SEQ ID NO: 134894 - DNA, 25 bp, Homo sapien
agccccgggagtctgagctgtatca

SEQ ID NO: 134895 - DNA, 25 bp, Homo sapien
gagctgtatcagaaggaggtatccc

SEQ ID NO: 134896 - DNA, 25 bp, Homo sapien
agaaggaggtatcccatctgaatgc

SEQ ID NO: 134897 - DNA, 25 bp, Homo sapien
gaggagcgcttctcgcgcctctgga

SEQ ID NO: 134898 - DNA, 25 bp, Homo sapien
gcttctcgcgcctctggacgcagtg

SEQ ID NO: 134899 - DNA, 25 bp, Homo sapien
tgcacgaggacgtcatctgcaccag

SEQ ID NO: 134900 - DNA, 25 bp, Homo sapien
aggacgtcatctgcaccagccggga

SEQ ID NO: 134901 - DNA, 25 bp, Homo sapien
acgtcatctgcaccagccgggactg

SEQ ID NO: 134902 - DNA, 25 bp, Homo sapien
tgccccatcttctacatgcgcaaga

SEQ ID NO: 134903 - DNA, 25 bp, Homo sapien
ttctacatgcgcaagaaggtgcgga

SEQ ID NO: 134904 - DNA, 25 bp, Homo sapien
gtatgtaaagtataacttcagccac

SEQ ID NO: 134905 - DNA, 25 bp, Homo sapien
gtaaagtataacttcagccacattt

SEQ ID NO: 134906 - DNA, 25 bp, Homo sapien
agagagctctctacatgaagatgac

SEQ ID NO: 134907 - DNA, 25 bp, Homo sapien
gctctctacatgaagatgacttgtt

SEQ ID NO: 134908 - DNA, 25 bp, Homo sapien
ttaaaagccatgtctgttaaacaag

SEQ ID NO: 134909 - DNA, 25 bp, Homo sapien
aaaagccatgtctgttaaacaagaa

SEQ ID NO: 134910 - DNA, 25 bp, Homo sapien
ggttcatcattctgtattcttactc

SEQ ID NO: 134911 - DNA, 25 bp, Homo sapien
catcattctgtattcttactcactt

SEQ ID NO: 134912 - DNA, 25 bp, Homo sapien
cattctgtattcttactcacttttt

SEQ ID NO: 134913 - DNA, 25 bp, Homo sapien
gtattcttactcactttttcaagtt

SEQ ID NO: 134914 - DNA, 25 bp, Homo sapien
ttcttactcactttttcaagttatc

SEQ ID NO: 134915 - DNA, 25 bp, Homo sapien
cacgcagtgctaaaactgaggatga

SEQ ID NO: 134916 - DNA, 25 bp, Homo sapien
aggatgatttccctaatgcttctgc

SEQ ID NO: 134917 - DNA, 25 bp, Homo sapien
aatgcttctgcttggagtctcttat

SEQ ID NO: 134918 - DNA, 25 bp, Homo sapien
gcttggagtctcttatggaggagct

SEQ ID NO: 134919 - DNA, 25 bp, Homo sapien
ggaggagctgctccttccttacagc

SEQ ID NO: 134920 - DNA, 25 bp, Homo sapien
agccctgagccctgtgagaggacga

SEQ ID NO: 134921 - DNA, 25 bp, Homo sapien
gagaggacgactgtctatgcaatga

SEQ ID NO: 134922 - DNA, 25 bp, Homo sapien
gactgtctatgcaatgaggctcggt

SEQ ID NO: 134923 - DNA, 25 bp, Homo sapien
aagtgcctgatcctgcctggctcag

SEQ ID NO: 134924 - DNA, 25 bp, Homo sapien
gggaagcaactgacagccccacagg

SEQ ID NO: 134925 - DNA, 25 bp, Homo sapien
gagggtacaagctccagaacagtaa

SEQ ID NO: 134926 - DNA, 25 bp, Homo sapien
ggaaccttgccagcgtgaaggaggc

SEQ ID NO: 134927 - DNA, 25 bp, Homo sapien
gaaggaggcttccaggtacttcacc

SEQ ID NO: 134928 - DNA, 25 bp, Homo sapien
gcttccaggtacttcaccctgtcaa

SEQ ID NO: 134929 - DNA, 25 bp, Homo sapien
gcgccttcctgggtggattcaacaa

SEQ ID NO: 134930 - DNA, 25 bp, Homo sapien
ccttcctgggtggattcaacaagat

SEQ ID NO: 134931 - DNA, 25 bp, Homo sapien
aacaagatgattttgccctttccca

SEQ ID NO: 134932 - DNA, 25 bp, Homo sapien
tctccttcactttggcatcagttgt

SEQ ID NO: 134933 - DNA, 25 bp, Homo sapien
tcactttggcatcagttgttttcta

SEQ ID NO: 134934 - DNA, 25 bp, Homo sapien
ttggcatcagttgttttctatgaaa

SEQ ID NO: 134935 - DNA, 25 bp, Homo sapien
attggttgggttttgtgcagggtct

SEQ ID NO: 134936 - DNA, 25 bp, Homo sapien
gcagggtcttgggttagagccaaaa

SEQ ID NO: 134937 - DNA, 25 bp, Homo sapien
tgcagtcattagaatttcacatgta

SEQ ID NO: 134938 - DNA, 25 bp, Homo sapien
agtcattagaatttcacatgtagta

SEQ ID NO: 134939 - DNA, 25 bp, Homo sapien
gtaacaacagagtgtcagatatgtc

SEQ ID NO: 134940 - DNA, 25 bp, Homo sapien
caacagagtgtcagatatgtcatct

SEQ ID NO: 134941 - DNA, 25 bp, Homo sapien
cagagtgtcagatatgtcatctcaa

SEQ ID NO: 134942 - DNA, 25 bp, Homo sapien
gtgtcagatatgtcatctcaacctc

SEQ ID NO: 134943 - DNA, 25 bp, Homo sapien
tgcatacagggctcccaatagaaat

SEQ ID NO: 134944 - DNA, 25 bp, Homo sapien
tacagggctcccaatagaaatgaac

SEQ ID NO: 134945 - DNA, 25 bp, Homo sapien
gggctcccaatagaaatgaacacag

SEQ ID NO: 134946 - DNA, 25 bp, Homo sapien
agaaatgaacacagagatattgcct

SEQ ID NO: 134947 - DNA, 25 bp, Homo sapien
gaacacagagatattgcctgtgtgt

SEQ ID NO: 134948 - DNA, 25 bp, Homo sapien
cacgcagtgctaaaactgaggatga

SEQ ID NO: 134949 - DNA, 25 bp, Homo sapien
acgcagtgctaaaactgaggatgat

SEQ ID NO: 134950 - DNA, 25 bp, Homo sapien
atgatttccctaatgcttctgcttg

SEQ ID NO: 134951 - DNA, 25 bp, Homo sapien
tgatttccctaatgcttctgcttgg

SEQ ID NO: 134952 - DNA, 25 bp, Homo sapien
ggaggagctgctccttccttacagc

SEQ ID NO: 134953 - DNA, 25 bp, Homo sapien
tggggggctctcaagtgcctgatcc

SEQ ID NO: 134954 - DNA, 25 bp, Homo sapien
gggctctcaagtgcctgatcctgcc

SEQ ID NO: 134955 - DNA, 25 bp, Homo sapien
gagggtacaagctccagaacagtaa

SEQ ID NO: 134956 - DNA, 25 bp, Homo sapien
agggtacaagctccagaacagtaac

SEQ ID NO: 134957 - DNA, 25 bp, Homo sapien
gggtacaagctccagaacagtaacc

SEQ ID NO: 134958 - DNA, 25 bp, Homo sapien
gtacaagctccagaacagtaaccaa

SEQ ID NO: 134959 - DNA, 25 bp, Homo sapien
tttgcctctgtctagcttaaaccta

SEQ ID NO: 134960 - DNA, 25 bp, Homo sapien
ttaaacctactacctcaagctgctt

SEQ ID NO: 134961 - DNA, 25 bp, Homo sapien
aaacctactacctcaagctgcttaa

SEQ ID NO: 134962 - DNA, 25 bp, Homo sapien
cctcaagctgcttaagttccttaag

SEQ ID NO: 134963 - DNA, 25 bp, Homo sapien
gcatttgtaattcatcagtcattat

SEQ ID NO: 134964 - DNA, 25 bp, Homo sapien
attcatcagtcattattagctttta

SEQ ID NO: 134965 - DNA, 25 bp, Homo sapien
gaagattacgttttacaatgtaact

SEQ ID NO: 134966 - DNA, 25 bp, Homo sapien
gtaactataatctcttgaatttggt

SEQ ID NO: 134967 - DNA, 25 bp, Homo sapien
cttttttaaagctccattgtcttat

SEQ ID NO: 134968 - DNA, 25 bp, Homo sapien
agctccattgtcttatgtttttaga

SEQ ID NO: 134969 - DNA, 25 bp, Homo sapien
gaggcttttccgtaaacatatatct

SEQ ID NO: 134970 - DNA, 25 bp, Homo sapien
gctggtggaacctgtggcagcacat

SEQ ID NO: 134971 - DNA, 25 bp, Homo sapien
ctgtggcagcacatggcccaaaaat

SEQ ID NO: 134972 - DNA, 25 bp, Homo sapien
gaggatctcacttgcttatctgaag

SEQ ID NO: 134973 - DNA, 25 bp, Homo sapien
gattgtccaggctcatattgggaat

SEQ ID NO: 134974 - DNA, 25 bp, Homo sapien
gaaattcatgccgagacctgctatt

SEQ ID NO: 134975 - DNA, 25 bp, Homo sapien
gccgagacctgctattcaatgcatg

SEQ ID NO: 134976 - DNA, 25 bp, Homo sapien
tcaatgcatgtatcgttgcctctgc

SEQ ID NO: 134977 - DNA, 25 bp, Homo sapien
gttgcctctgcactgacctgaagaa

SEQ ID NO: 134978 - DNA, 25 bp, Homo sapien
aaccctgtctccaagtctttggttg

SEQ ID NO: 134979 - DNA, 25 bp, Homo sapien
atgactgttgagtgtgctctttcac

SEQ ID NO: 134980 - DNA, 25 bp, Homo sapien
gtgctctttcacagaacttggtttt

SEQ ID NO: 134981 - DNA, 25 bp, Homo sapien
tagcgcccctgaacttttgatgctt

SEQ ID NO: 134982 - DNA, 25 bp, Homo sapien
agcgcccctgaacttttgatgcttt

SEQ ID NO: 134983 - DNA, 25 bp, Homo sapien
gcgcccctgaacttttgatgctttt

SEQ ID NO: 134984 - DNA, 25 bp, Homo sapien
gcccctgaacttttgatgctttttt

SEQ ID NO: 134985 - DNA, 25 bp, Homo sapien
gggctgagctggtttcccctccttc

SEQ ID NO: 134986 - DNA, 25 bp, Homo sapien
ccccaagggcttactctttctcttg

SEQ ID NO: 134987 - DNA, 25 bp, Homo sapien
tactctttctcttgctggaggtgga

SEQ ID NO: 134988 - DNA, 25 bp, Homo sapien
actctttctcttgctggaggtggag

SEQ ID NO: 134989 - DNA, 25 bp, Homo sapien
ggaagggcgtccatgccaaggcccc

SEQ ID NO: 134990 - DNA, 25 bp, Homo sapien
gaagggcgtccatgccaaggcccca

SEQ ID NO: 134991 - DNA, 25 bp, Homo sapien
cgcttcagtgggccttgccctttgt

SEQ ID NO: 134992 - DNA, 25 bp, Homo sapien
gtcttaacaccacctgatcagctgg

SEQ ID NO: 134993 - DNA, 25 bp, Homo sapien
gatcagctggttattgctaacatag

SEQ ID NO: 134994 - DNA, 25 bp, Homo sapien
ccagtctgattttgaagggttctcg

SEQ ID NO: 134995 - DNA, 25 bp, Homo sapien
tgaagggttctcgtatgtcaacccc

SEQ ID NO: 134996 - DNA, 25 bp, Homo sapien
tttgtgcaccccatcttacagagtg

SEQ ID NO: 134997 - DNA, 25 bp, Homo sapien
gtgcagtatgaaactcaccagcgag

SEQ ID NO: 134998 - DNA, 25 bp, Homo sapien
agccctccccgcagtggaagtgaat

SEQ ID NO: 134999 - DNA, 25 bp, Homo sapien
cagtggaagtgaatccttaacccta

SEQ ID NO: 135000 - DNA, 25 bp, Homo sapien
aattttaaggccacggcttgtgtct

SEQ ID NO: 135001 - DNA, 25 bp, Homo sapien
ccacggcttgtgtctgattccatat

SEQ ID NO: 135002 - DNA, 25 bp, Homo sapien
agtccaaatgtgatcaactgttcag

SEQ ID NO: 135003 - DNA, 25 bp, Homo sapien
ctctttgaggtaaaagtgcctttat

SEQ ID NO: 135004 - DNA, 25 bp, Homo sapien
tgcctttattgggagacttttgtct

SEQ ID NO: 135005 - DNA, 25 bp, Homo sapien
ttgggagacttttgtcttccagcct

SEQ ID NO: 135006 - DNA, 25 bp, Homo sapien
ttttgtcttccagcctgccaatcaa

SEQ ID NO: 135007 - DNA, 25 bp, Homo sapien
tgccaatcaaccctcctgggtgtgg

SEQ ID NO: 135008 - DNA, 25 bp, Homo sapien
gccaccatatgtgtgtgcctaggtc

SEQ ID NO: 135009 - DNA, 25 bp, Homo sapien
atatgtgtgtgcctaggtcctcctt

SEQ ID NO: 135010 - DNA, 25 bp, Homo sapien
tccttctgcacgatccaataggaga

SEQ ID NO: 135011 - DNA, 25 bp, Homo sapien
aataggagacaccagttctgactga

SEQ ID NO: 135012 - DNA, 25 bp, Homo sapien
acaccagttctgactgaaccatgcc

SEQ ID NO: 135013 - DNA, 25 bp, Homo sapien
tccaaataatctcctcggtgtgggt

SEQ ID NO: 135014 - DNA, 25 bp, Homo sapien
tagcagaactgatacctacctgtat

SEQ ID NO: 135015 - DNA, 25 bp, Homo sapien
tgttctctcctatttgagtttcact

SEQ ID NO: 135016 - DNA, 25 bp, Homo sapien
gagtttcacttccagagaacttgtt

SEQ ID NO: 135017 - DNA, 25 bp, Homo sapien
gagaacttgttcttcagcaagaatg

SEQ ID NO: 135018 - DNA, 25 bp, Homo sapien
atgtgtcactagtaaggacatctct

SEQ ID NO: 135019 - DNA, 25 bp, Homo sapien
ggacatctctagcatttctctagcc

SEQ ID NO: 135020 - DNA, 25 bp, Homo sapien
tagcatttctctagccttccttttc

SEQ ID NO: 135021 - DNA, 25 bp, Homo sapien
ccttccttttctgctgctcaaaaat

SEQ ID NO: 135022 - DNA, 25 bp, Homo sapien
ttatgcgactctcaaactttaaagg

SEQ ID NO: 135023 - DNA, 25 bp, Homo sapien
aggagttgctcctttgttccaaaat

SEQ ID NO: 135024 - DNA, 25 bp, Homo sapien
gtgattgtatgggtggcttcatgaa

SEQ ID NO: 135025 - DNA, 25 bp, Homo sapien
ggcgcagagaacctcaagaaggcat

SEQ ID NO: 135026 - DNA, 25 bp, Homo sapien
agaacctcaagaaggcatgaagcca

SEQ ID NO: 135027 - DNA, 25 bp, Homo sapien
agaaggcatgaagccagcccctgca

SEQ ID NO: 135028 - DNA, 25 bp, Homo sapien
aaggcatgaagccagcccctgcagt

SEQ ID NO: 135029 - DNA, 25 bp, Homo sapien
ctgggcctgcctgtggctctgttgc

SEQ ID NO: 135030 - DNA, 25 bp, Homo sapien
ggctctgttgccctcctctgtggcg

SEQ ID NO: 135031 - DNA, 25 bp, Homo sapien
tcctctgtggcggcaggacctttgt

SEQ ID NO: 135032 - DNA, 25 bp, Homo sapien
tctgtggcggcaggacctttgtggg

SEQ ID NO: 135033 - DNA, 25 bp, Homo sapien
caggacctttgtggggcttcgtgcc

SEQ ID NO: 135034 - DNA, 25 bp, Homo sapien
aggccccaacagcctccaaagatgg

SEQ ID NO: 135035 - DNA, 25 bp, Homo sapien
atgggtaaaggagcttgccctccct

SEQ ID NO: 135036 - DNA, 25 bp, Homo sapien
tgaggacttgggtcctcggtcttac

SEQ ID NO: 135037 - DNA, 25 bp, Homo sapien
aggaaaatcccttctaggcatctcc

SEQ ID NO: 135038 - DNA, 25 bp, Homo sapien
agaggcccagccacgtgtctggaat

SEQ ID NO: 135039 - DNA, 25 bp, Homo sapien
agctccgctgcttactgtcggtgtc

SEQ ID NO: 135040 - DNA, 25 bp, Homo sapien
ttactgtcggtgtccccttgggatg

SEQ ID NO: 135041 - DNA, 25 bp, Homo sapien
ttgggatgtacctttcttcactgca

SEQ ID NO: 135042 - DNA, 25 bp, Homo sapien
tttcttcactgcagatttctcacct

SEQ ID NO: 135043 - DNA, 25 bp, Homo sapien
gatgatacagtctccatcaggcagt

SEQ ID NO: 135044 - DNA, 25 bp, Homo sapien
ctccatcaggcagtggctgttggaa

SEQ ID NO: 135045 - DNA, 25 bp, Homo sapien
agatttcacacctatgacatacatg

SEQ ID NO: 135046 - DNA, 25 bp, Homo sapien
tgacatacatgggatagcacctggg

SEQ ID NO: 135047 - DNA, 25 bp, Homo sapien
caatcaatgagtacaccatccgtcc

SEQ ID NO: 135048 - DNA, 25 bp, Homo sapien
ccgtcccttgggagtcactggagtt

SEQ ID NO: 135049 - DNA, 25 bp, Homo sapien
tcactggagttgcaggagaacccct

SEQ ID NO: 135050 - DNA, 25 bp, Homo sapien
gaacccctgccagtggatagtgaaa

SEQ ID NO: 135051 - DNA, 25 bp, Homo sapien
catctttgattacatccagtggaaa

SEQ ID NO: 135052 - DNA, 25 bp, Homo sapien
gaccggagcgaatgaggcctgtatc

SEQ ID NO: 135053 - DNA, 25 bp, Homo sapien
aatgaggcctgtatcctccctggca

SEQ ID NO: 135054 - DNA, 25 bp, Homo sapien
acacaacccaataggagtcttaatt

SEQ ID NO: 135055 - DNA, 25 bp, Homo sapien
ttatttcttaacctttgctatgtaa

SEQ ID NO: 135056 - DNA, 25 bp, Homo sapien
gctatgtaagggtctttggtgtttt

SEQ ID NO: 135057 - DNA, 25 bp, Homo sapien
gggctcatgccctagaaaagggttt

SEQ ID NO: 135058 - DNA, 25 bp, Homo sapien
agaacctcaagaaggcatgaagcca

SEQ ID NO: 135059 - DNA, 25 bp, Homo sapien
agaaggcatgaagccagcccctgca

SEQ ID NO: 135060 - DNA, 25 bp, Homo sapien
ctcctctgtggcggcaggacctttg

SEQ ID NO: 135061 - DNA, 25 bp, Homo sapien
tcctctgtggcggcaggacctttgt

SEQ ID NO: 135062 - DNA, 25 bp, Homo sapien
cctctgtggcggcaggacctttgtg

SEQ ID NO: 135063 - DNA, 25 bp, Homo sapien
ctctgtggcggcaggacctttgtgg

SEQ ID NO: 135064 - DNA, 25 bp, Homo sapien
tctgtggcggcaggacctttgtggg

SEQ ID NO: 135065 - DNA, 25 bp, Homo sapien
ctgtggcggcaggacctttgtgggg

SEQ ID NO: 135066 - DNA, 25 bp, Homo sapien
ggacctttgtggggcttcgtgccct

SEQ ID NO: 135067 - DNA, 25 bp, Homo sapien
gatgatggattgattgtacagaaat

SEQ ID NO: 135068 - DNA, 25 bp, Homo sapien
ggaacatggagccttggtgtatttt

SEQ ID NO: 135069 - DNA, 25 bp, Homo sapien
ttaatgaatcaatagcagcgtccag

SEQ ID NO: 135070 - DNA, 25 bp, Homo sapien
aatagcagcgtccagtcccccaggg

SEQ ID NO: 135071 - DNA, 25 bp, Homo sapien
tgcacctgcggtactgtgagcagga

SEQ ID NO: 135072 - DNA, 25 bp, Homo sapien
ctgcggtactgtgagcaggatcctg

SEQ ID NO: 135073 - DNA, 25 bp, Homo sapien
cgaggctgcagctcagggcaacggc

SEQ ID NO: 135074 - DNA, 25 bp, Homo sapien
caggccaggtcgtgggtctccagcc

SEQ ID NO: 135075 - DNA, 25 bp, Homo sapien
aggtcgtgggtctccagccgtgctt

SEQ ID NO: 135076 - DNA, 25 bp, Homo sapien
ggtctccagccgtgcttggcctcag

SEQ ID NO: 135077 - DNA, 25 bp, Homo sapien
ccgtgcttggcctcaggctggcagc

SEQ ID NO: 135078 - DNA, 25 bp, Homo sapien
gaaaatggcaacagcgacaagaaga

SEQ ID NO: 135079 - DNA, 25 bp, Homo sapien
tgcccacctagactgttttctgagc

SEQ ID NO: 135080 - DNA, 25 bp, Homo sapien
ttttctgagccctccggacctgaga

SEQ ID NO: 135081 - DNA, 25 bp, Homo sapien
ctccggacctgagactgagttttgt

SEQ ID NO: 135082 - DNA, 25 bp, Homo sapien
tgagactgagttttgtctttttcct

SEQ ID NO: 135083 - DNA, 25 bp, Homo sapien
tgtctttttcctttagccttagcag

SEQ ID NO: 135084 - DNA, 25 bp, Homo sapien
tttcctttagccttagcagtgggta

SEQ ID NO: 135085 - DNA, 25 bp, Homo sapien
ctttagccttagcagtgggtatgag

SEQ ID NO: 135086 - DNA, 25 bp, Homo sapien
agctgggtggcttcactccgcccat

SEQ ID NO: 135087 - DNA, 25 bp, Homo sapien
actgcagccgggagcctctgctgtc

SEQ ID NO: 135088 - DNA, 25 bp, Homo sapien
gctcatcaccggttctgtgcctgtg

SEQ ID NO: 135089 - DNA, 25 bp, Homo sapien
gagagatgcctcaggcttcagacct

SEQ ID NO: 135090 - DNA, 25 bp, Homo sapien
cttcagaccttacctgggttttcag

SEQ ID NO: 135091 - DNA, 25 bp, Homo sapien
tacactgatttattctgttactaga

SEQ ID NO: 135092 - DNA, 25 bp, Homo sapien
ttactagatcaggttttagggtcct

SEQ ID NO: 135093 - DNA, 25 bp, Homo sapien
ttagggtcctgcaaaaggctagctc

SEQ ID NO: 135094 - DNA, 25 bp, Homo sapien
aaaaggctagctcggcactacacta

SEQ ID NO: 135095 - DNA, 25 bp, Homo sapien
agctcggcactacactagggaattt

SEQ ID NO: 135096 - DNA, 25 bp, Homo sapien
tagggaatttgctcctgttctgtca

SEQ ID NO: 135097 - DNA, 25 bp, Homo sapien
tcctgttctgtcacttgtcatggtc

SEQ ID NO: 135098 - DNA, 25 bp, Homo sapien
tcacttgtcatggtctttcttggta

SEQ ID NO: 135099 - DNA, 25 bp, Homo sapien
ggtattaaaggccaccatttgcaca

SEQ ID NO: 135100 - DNA, 25 bp, Homo sapien
ggtgggagcctttagcgctaccgac

SEQ ID NO: 135101 - DNA, 25 bp, Homo sapien
gagcctttagcgctaccgactcctt

SEQ ID NO: 135102 - DNA, 25 bp, Homo sapien
gactccttcgaccacaaaaagttct

SEQ ID NO: 135103 - DNA, 25 bp, Homo sapien
aaagttcttccaaatggtcggcctg

SEQ ID NO: 135104 - DNA, 25 bp, Homo sapien
gttcttccaaatggtcggcctgaag

SEQ ID NO: 135105 - DNA, 25 bp, Homo sapien
cggcctgaagaaaaagagtgcggat

SEQ ID NO: 135106 - DNA, 25 bp, Homo sapien
aaaagagtgcggatgatgtgaagaa

SEQ ID NO: 135107 - DNA, 25 bp, Homo sapien
agaaggtgtttcacatgctggacaa

SEQ ID NO: 135108 - DNA, 25 bp, Homo sapien
gatgagctgggattcatcctaaaag

SEQ ID NO: 135109 - DNA, 25 bp, Homo sapien
tgggattcatcctaaaaggcttctc

SEQ ID NO: 135110 - DNA, 25 bp, Homo sapien
aaggcttctccccagatgccagaga

SEQ ID NO: 135111 - DNA, 25 bp, Homo sapien
tggaaacttaagtgagaccaccaaa

SEQ ID NO: 135112 - DNA, 25 bp, Homo sapien
gagaccaccaaatacattggtcctg

SEQ ID NO: 135113 - DNA, 25 bp, Homo sapien
tggtcctgtccaattctactgaatg

SEQ ID NO: 135114 - DNA, 25 bp, Homo sapien
gtggacctggcatttatctggccaa

SEQ ID NO: 135115 - DNA, 25 bp, Homo sapien
atttatctggccaaaaacaggagcc

SEQ ID NO: 135116 - DNA, 25 bp, Homo sapien
gatactcatatgatcacttttcttt

SEQ ID NO: 135117 - DNA, 25 bp, Homo sapien
cacttttctttttagatactacatc

SEQ ID NO: 135118 - DNA, 25 bp, Homo sapien
actacatcaactagattcaggagta

SEQ ID NO: 135119 - DNA, 25 bp, Homo sapien
caggagtatatcatttgcagtgctt

SEQ ID NO: 135120 - DNA, 25 bp, Homo sapien
ttgcagtgcttgtattggtttaaaa

SEQ ID NO: 135121 - DNA, 25 bp, Homo sapien
ttaagatcctctaacactgtactaa

SEQ ID NO: 135122 - DNA, 25 bp, Homo sapien
tgccatggctgctcccaaggacgat

SEQ ID NO: 135123 - DNA, 25 bp, Homo sapien
aaggacgatgggttcctcaacggct

SEQ ID NO: 135124 - DNA, 25 bp, Homo sapien
gatgggttcctcaacggctcctgct

SEQ ID NO: 135125 - DNA, 25 bp, Homo sapien
cctgctcaggcctggacgaggaggc

SEQ ID NO: 135126 - DNA, 25 bp, Homo sapien
cacctgccctgctacaggaagagtg

SEQ ID NO: 135127 - DNA, 25 bp, Homo sapien
agagtgggagacagtcatgtgacca

SEQ ID NO: 135128 - DNA, 25 bp, Homo sapien
agacagtcatgtgaccaggcgctgg

SEQ ID NO: 135129 - DNA, 25 bp, Homo sapien
ggacctgctgacatagtggatggac

SEQ ID NO: 135130 - DNA, 25 bp, Homo sapien
cagatggaccaaaagatgggtggtt

SEQ ID NO: 135131 - DNA, 25 bp, Homo sapien
ggttgaatgatttcccactcagggc

SEQ ID NO: 135132 - DNA, 25 bp, Homo sapien
aatgatttcccactcagggcctggg

SEQ ID NO: 135133 - DNA, 25 bp, Homo sapien
ctgctgcttgtatttcggtacagaa

SEQ ID NO: 135134 - DNA, 25 bp, Homo sapien
gaagaggtttctttctgcaccagga

SEQ ID NO: 135135 - DNA, 25 bp, Homo sapien
ttctttctgcaccaggaggaggcgt

SEQ ID NO: 135136 - DNA, 25 bp, Homo sapien
gaggcgtgctcaagtatcggtacga

SEQ ID NO: 135137 - DNA, 25 bp, Homo sapien
gtatcggtacgagatctagcctgcc

SEQ ID NO: 135138 - DNA, 25 bp, Homo sapien
ggtacgagatctagcctgccctgcc

SEQ ID NO: 135139 - DNA, 25 bp, Homo sapien
tctggcccaggacgcctgctgcaag

SEQ ID NO: 135140 - DNA, 25 bp, Homo sapien
ggccagagtctgtgtggacaaccgt

SEQ ID NO: 135141 - DNA, 25 bp, Homo sapien
agtctgtgtggacaaccgtccccag

SEQ ID NO: 135142 - DNA, 25 bp, Homo sapien
tctgctcctagtggcactggcttcg

SEQ ID NO: 135143 - DNA, 25 bp, Homo sapien
tagtggcactggcttcgtcctccca

SEQ ID NO: 135144 - DNA, 25 bp, Homo sapien
attgccgagaaatctagcaccttgc

SEQ ID NO: 135145 - DNA, 25 bp, Homo sapien
aaatctagcaccttgcatgctggat

SEQ ID NO: 135146 - DNA, 25 bp, Homo sapien
accttgcatgctggatctgggctgc

SEQ ID NO: 135147 - DNA, 25 bp, Homo sapien
ccaggaggatctgcgcacggtgcac

SEQ ID NO: 135148 - DNA, 25 bp, Homo sapien
gaggatctgcgcacggtgcacagcc

SEQ ID NO: 135149 - DNA, 25 bp, Homo sapien
accagagcactacagccttttattg

SEQ ID NO: 135150 - DNA, 25 bp, Homo sapien
gtggtcgtgccctgacagcatcttc

SEQ ID NO: 135151 - DNA, 25 bp, Homo sapien
atcttccccaggcagcggctctgtg

SEQ ID NO: 135152 - DNA, 25 bp, Homo sapien
tcttccccaggcagcggctctgtgg

SEQ ID NO: 135153 - DNA, 25 bp, Homo sapien
agcggctctgtggaggaggccatac

SEQ ID NO: 135154 - DNA, 25 bp, Homo sapien
cattgttactgccttgtgagataaa

SEQ ID NO: 135155 - DNA, 25 bp, Homo sapien
atatccatggagtctcttctgagcc

SEQ ID NO: 135156 - DNA, 25 bp, Homo sapien
cttctgagccatacagggcacttga

SEQ ID NO: 135157 - DNA, 25 bp, Homo sapien
cagggcacttgagaagtccttctta

SEQ ID NO: 135158 - DNA, 25 bp, Homo sapien
gtccttcttaacttctagctaacaa

SEQ ID NO: 135159 - DNA, 25 bp, Homo sapien
ctagctaacaactacttagtgggac

SEQ ID NO: 135160 - DNA, 25 bp, Homo sapien
ctacttagtgggactattacacaca

SEQ ID NO: 135161 - DNA, 25 bp, Homo sapien
caagaattctttgacatcgcccctt

SEQ ID NO: 135162 - DNA, 25 bp, Homo sapien
ttcccaccatactgctcataataac

SEQ ID NO: 135163 - DNA, 25 bp, Homo sapien
aaagatactgctgacctgtgcttca

SEQ ID NO: 135164 - DNA, 25 bp, Homo sapien
tgctgacctgtgcttcatttctaac

SEQ ID NO: 135165 - DNA, 25 bp, Homo sapien
cttcatttctaactgtgtaaacttt

SEQ ID NO: 135166 - DNA, 25 bp, Homo sapien
ttcattgaaaaccaccacggtgcca

SEQ ID NO: 135167 - DNA, 25 bp, Homo sapien
acggtgccatctcttgtgtatgcag

SEQ ID NO: 135168 - DNA, 25 bp, Homo sapien
cttgtgtatgcagggctatgcacct

SEQ ID NO: 135169 - DNA, 25 bp, Homo sapien
tatgcacctgcaggcacgtgtgtat

SEQ ID NO: 135170 - DNA, 25 bp, Homo sapien
tgtgtatgcactccccgcttgtgtt

SEQ ID NO: 135171 - DNA, 25 bp, Homo sapien
cagcttggagagatttttgtatcac

SEQ ID NO: 135172 - DNA, 25 bp, Homo sapien
aaatcccactcgctctttttgatgg

SEQ ID NO: 135173 - DNA, 25 bp, Homo sapien
ctcgctctttttgatggccacataa

SEQ ID NO: 135174 - DNA, 25 bp, Homo sapien
ggccacataataactactgcataat

SEQ ID NO: 135175 - DNA, 25 bp, Homo sapien
atggatacgccttatttgatttaac

SEQ ID NO: 135176 - DNA, 25 bp, Homo sapien
gttccctaatgatggacttttaagt

SEQ ID NO: 135177 - DNA, 25 bp, Homo sapien
ggcccgccgccagaggtgatacaga

SEQ ID NO: 135178 - DNA, 25 bp, Homo sapien
cccgccgccagaggtgatacagatg

SEQ ID NO: 135179 - DNA, 25 bp, Homo sapien
gatacagatgtacaaggaaagccca

SEQ ID NO: 135180 - DNA, 25 bp, Homo sapien
ggaaagcccagagatcctgagtcca

SEQ ID NO: 135181 - DNA, 25 bp, Homo sapien
agcccagagatcctgagtccaccag

SEQ ID NO: 135182 - DNA, 25 bp, Homo sapien
cagctccacagggaggcgggcttag

SEQ ID NO: 135183 - DNA, 25 bp, Homo sapien
agctttgccagagtgactacctcca

SEQ ID NO: 135184 - DNA, 25 bp, Homo sapien
tttgccagagtgactacctccatga

SEQ ID NO: 135185 - DNA, 25 bp, Homo sapien
agagtgactacctccatgaccgtgg

SEQ ID NO: 135186 - DNA, 25 bp, Homo sapien
tgactacctccatgaccgtggccat

SEQ ID NO: 135187 - DNA, 25 bp, Homo sapien
gggaccaggtccagccactgggtga

SEQ ID NO: 135188 - DNA, 25 bp, Homo sapien
gaactgttagcacgactgtgtccaa

SEQ ID NO: 135189 - DNA, 25 bp, Homo sapien
ctgtgtccaaatagcactggtgctg

SEQ ID NO: 135190 - DNA, 25 bp, Homo sapien
tgctgagattagaagcgtctgcaca

SEQ ID NO: 135191 - DNA, 25 bp, Homo sapien
gcgtctgcacagaggctggtatgtt

SEQ ID NO: 135192 - DNA, 25 bp, Homo sapien
tatgtttgccatcagagcacggcga

SEQ ID NO: 135193 - DNA, 25 bp, Homo sapien
gagcacggcgaaaaattgctaccga

SEQ ID NO: 135194 - DNA, 25 bp, Homo sapien
ttgctaccgagaaggatttcttgga

SEQ ID NO: 135195 - DNA, 25 bp, Homo sapien
tatgccaaattcagtgctactcctc

SEQ ID NO: 135196 - DNA, 25 bp, Homo sapien
gctactcctcgttacatgacataca

SEQ ID NO: 135197 - DNA, 25 bp, Homo sapien
gacatacaactgaaccctgaaggct

SEQ ID NO: 135198 - DNA, 25 bp, Homo sapien
gaatcctaaccttatatagacttgt

SEQ ID NO: 135199 - DNA, 25 bp, Homo sapien
agtactgtggcccaccagtgtaatc

SEQ ID NO: 135200 - DNA, 25 bp, Homo sapien
aatctccctggattaaggcattctt

SEQ ID NO: 135201 - DNA, 25 bp, Homo sapien
gcattcttaaaaacttaggcttggc

SEQ ID NO: 135202 - DNA, 25 bp, Homo sapien
ctctttcacaaattaggccacggcc

SEQ ID NO: 135203 - DNA, 25 bp, Homo sapien
taggccacggccctaaataggaatt

SEQ ID NO: 135204 - DNA, 25 bp, Homo sapien
ggcggaagttattctggcaggtact

SEQ ID NO: 135205 - DNA, 25 bp, Homo sapien
ggaaagcatcttcccttgccctgga

SEQ ID NO: 135206 - DNA, 25 bp, Homo sapien
gggtctagggatttccaacttgtct

SEQ ID NO: 135207 - DNA, 25 bp, Homo sapien
tctctccctgaagcataaggatctg

SEQ ID NO: 135208 - DNA, 25 bp, Homo sapien
agaggcttgtaacctgaacttctgt

SEQ ID NO: 135209 - DNA, 25 bp, Homo sapien
aacttctgtgtggtggcagtactgt

SEQ ID NO: 135210 - DNA, 25 bp, Homo sapien
tggctcccacctgtttctggaagac

SEQ ID NO: 135211 - DNA, 25 bp, Homo sapien
ctcccacctgtttctggaagactgc

SEQ ID NO: 135212 - DNA, 25 bp, Homo sapien
cgcctgcccagactgatgagcacat

SEQ ID NO: 135213 - DNA, 25 bp, Homo sapien
agactgatgagcacatctctctgcc

SEQ ID NO: 135214 - DNA, 25 bp, Homo sapien
actgatgagcacatctctctgccct

SEQ ID NO: 135215 - DNA, 25 bp, Homo sapien
cacctttgtgcagcttcgaggacag

SEQ ID NO: 135216 - DNA, 25 bp, Homo sapien
ctttgtgcagcttcgaggacaggaa

SEQ ID NO: 135217 - DNA, 25 bp, Homo sapien
gcagcttcgaggacaggaaaggccc

SEQ ID NO: 135218 - DNA, 25 bp, Homo sapien
aatcttgcccactggccgctgagcg

SEQ ID NO: 135219 - DNA, 25 bp, Homo sapien
tgactcctggactccggaggactga

SEQ ID NO: 135220 - DNA, 25 bp, Homo sapien
cggaactgggctggcgcttggatct

SEQ ID NO: 135221 - DNA, 25 bp, Homo sapien
gtggtcgtgccctgacagcatcttc

SEQ ID NO: 135222 - DNA, 25 bp, Homo sapien
tggtcgtgccctgacagcatcttcc

SEQ ID NO: 135223 - DNA, 25 bp, Homo sapien
ggtcgtgccctgacagcatcttccc

SEQ ID NO: 135224 - DNA, 25 bp, Homo sapien
gtcgtgccctgacagcatcttcccc

SEQ ID NO: 135225 - DNA, 25 bp, Homo sapien
tcgtgccctgacagcatcttcccca

SEQ ID NO: 135226 - DNA, 25 bp, Homo sapien
cgtgccctgacagcatcttccccag

SEQ ID NO: 135227 - DNA, 25 bp, Homo sapien
cttccccaggcagcggctctgtgga

SEQ ID NO: 135228 - DNA, 25 bp, Homo sapien
cctagttggccactggggccaccac

SEQ ID NO: 135229 - DNA, 25 bp, Homo sapien
ctagttggccactggggccaccacc

SEQ ID NO: 135230 - DNA, 25 bp, Homo sapien
gggtttttcagctcattacactaag

SEQ ID NO: 135231 - DNA, 25 bp, Homo sapien
atgtggatttccataacccaagagg

SEQ ID NO: 135232 - DNA, 25 bp, Homo sapien
tccgactgggcagtggaatgctgat

SEQ ID NO: 135233 - DNA, 25 bp, Homo sapien
aatgctgatggaggcagacgctgcc

SEQ ID NO: 135234 - DNA, 25 bp, Homo sapien
gtctattgtttaactgtaccatcca

SEQ ID NO: 135235 - DNA, 25 bp, Homo sapien
tgtaccatccagagcccaccagaag

SEQ ID NO: 135236 - DNA, 25 bp, Homo sapien
gacaacagagtattcagatcgccac

SEQ ID NO: 135237 - DNA, 25 bp, Homo sapien
agatcgccacactctgtgaggcagc

SEQ ID NO: 135238 - DNA, 25 bp, Homo sapien
cctgggcaggtgtttggcttagtat

SEQ ID NO: 135239 - DNA, 25 bp, Homo sapien
aacagatcacgggtgtacccagggt

SEQ ID NO: 135240 - DNA, 25 bp, Homo sapien
gtacccagggtttttcagctcatta

SEQ ID NO: 135241 - DNA, 25 bp, Homo sapien
atggatttatagctacccttaccct

SEQ ID NO: 135242 - DNA, 25 bp, Homo sapien
cttaccctcacacatacacttgaaa

SEQ ID NO: 135243 - DNA, 25 bp, Homo sapien
aaaactttcagcctagccagttcta

SEQ ID NO: 135244 - DNA, 25 bp, Homo sapien
tagcccctgtcctcttagatatatc

SEQ ID NO: 135245 - DNA, 25 bp, Homo sapien
ctgggtgaactataggctctgtgcc

SEQ ID NO: 135246 - DNA, 25 bp, Homo sapien
ctctgtgcctctcagacaaattctg

SEQ ID NO: 135247 - DNA, 25 bp, Homo sapien
taagagatccccagacctcacttgc

SEQ ID NO: 135248 - DNA, 25 bp, Homo sapien
tggccctgattcaaccctaagataa

SEQ ID NO: 135249 - DNA, 25 bp, Homo sapien
agatatttttattcacctgttccgt

SEQ ID NO: 135250 - DNA, 25 bp, Homo sapien
tcacctgttccgtgctatatggagg

SEQ ID NO: 135251 - DNA, 25 bp, Homo sapien
ggaggccaagtccatttagtgacat

SEQ ID NO: 135252 - DNA, 25 bp, Homo sapien
ggcccctccagcttgtggagcccca

SEQ ID NO: 135253 - DNA, 25 bp, Homo sapien
ccctccagcttgtggagccccacac

SEQ ID NO: 135254 - DNA, 25 bp, Homo sapien
gagctttgcatgttccactaacccc

SEQ ID NO: 135255 - DNA, 25 bp, Homo sapien
agctttgcatgttccactaaccccg

SEQ ID NO: 135256 - DNA, 25 bp, Homo sapien
gctttgcatgttccactaaccccgg

SEQ ID NO: 135257 - DNA, 25 bp, Homo sapien
ctttgcatgttccactaaccccggg

SEQ ID NO: 135258 - DNA, 25 bp, Homo sapien
tttgcatgttccactaaccccgggc

SEQ ID NO: 135259 - DNA, 25 bp, Homo sapien
ttgcatgttccactaaccccgggcg

SEQ ID NO: 135260 - DNA, 25 bp, Homo sapien
tgcatgttccactaaccccgggcgg

SEQ ID NO: 135261 - DNA, 25 bp, Homo sapien
gcatgttccactaaccccgggcggg

SEQ ID NO: 135262 - DNA, 25 bp, Homo sapien
gggtggcaggtggaggtgtcaggct

SEQ ID NO: 135263 - DNA, 25 bp, Homo sapien
gacttggaatgtctgactgacttct

SEQ ID NO: 135264 - DNA, 25 bp, Homo sapien
gactgacttctatttaacagcttga

SEQ ID NO: 135265 - DNA, 25 bp, Homo sapien
aacagcttgagtattgcatttcctt

SEQ ID NO: 135266 - DNA, 25 bp, Homo sapien
cttgagtattgcatttccttggcca

SEQ ID NO: 135267 - DNA, 25 bp, Homo sapien
tactattccagtaaggcagagtcca

SEQ ID NO: 135268 - DNA, 25 bp, Homo sapien
gtaaggcagagtccaaccattgata

SEQ ID NO: 135269 - DNA, 25 bp, Homo sapien
gagtccaaccattgataatacaact

SEQ ID NO: 135270 - DNA, 25 bp, Homo sapien
aacatgtttgctataaaataccatc

SEQ ID NO: 135271 - DNA, 25 bp, Homo sapien
gagcttggtgtgaacaactcttcct

SEQ ID NO: 135272 - DNA, 25 bp, Homo sapien
aactcttcctttgtgatgccttagg

SEQ ID NO: 135273 - DNA, 25 bp, Homo sapien
cctttgtgatgccttaggacatgtt

SEQ ID NO: 135274 - DNA, 25 bp, Homo sapien
ccgcctccaaggcacagtgagctgg

SEQ ID NO: 135275 - DNA, 25 bp, Homo sapien
tccaaggcacagtgagctgggcaga

SEQ ID NO: 135276 - DNA, 25 bp, Homo sapien
agctgggctgccagaagcctttttc

SEQ ID NO: 135277 - DNA, 25 bp, Homo sapien
ctttttcactctgcagtgtgattgg

SEQ ID NO: 135278 - DNA, 25 bp, Homo sapien
tgtgattggactgccagccaggtta

SEQ ID NO: 135279 - DNA, 25 bp, Homo sapien
aaatgtgattggcttcctctcgccg

SEQ ID NO: 135280 - DNA, 25 bp, Homo sapien
ttggcttcctctcgccgtgttgtga

SEQ ID NO: 135281 - DNA, 25 bp, Homo sapien
ctctcgccgtgttgtgagggcaaag

SEQ ID NO: 135282 - DNA, 25 bp, Homo sapien
ggatggagacggaacatttgcctaa

SEQ ID NO: 135283 - DNA, 25 bp, Homo sapien
tggagacggaacatttgcctaattt

SEQ ID NO: 135284 - DNA, 25 bp, Homo sapien
tgtaataaaacactgtcttttcagg

SEQ ID NO: 135285 - DNA, 25 bp, Homo sapien
ccagagatgaattttacattggaag

SEQ ID NO: 135286 - DNA, 25 bp, Homo sapien
aataagatttgttgtccattgttca

SEQ ID NO: 135287 - DNA, 25 bp, Homo sapien
gatttgttgtccattgttcattgtt

SEQ ID NO: 135288 - DNA, 25 bp, Homo sapien
tgttgtccattgttcattgttattg

SEQ ID NO: 135289 - DNA, 25 bp, Homo sapien
gttcattgttattggtatgtacctt

SEQ ID NO: 135290 - DNA, 25 bp, Homo sapien
aacatatttatactacaaggtgact

SEQ ID NO: 135291 - DNA, 25 bp, Homo sapien
caaggtgacttaacaactataaatg

SEQ ID NO: 135292 - DNA, 25 bp, Homo sapien
gtgttataatcgaatgtcacgtttt

SEQ ID NO: 135293 - DNA, 25 bp, Homo sapien
atcgaatgtcacgtttttgagaaga

SEQ ID NO: 135294 - DNA, 25 bp, Homo sapien
gtcacgtttttgagaagatagtcat

SEQ ID NO: 135295 - DNA, 25 bp, Homo sapien
gactatttttgtaaagctctactgt

SEQ ID NO: 135296 - DNA, 25 bp, Homo sapien
tccttttttgctatgaagttgctgt

SEQ ID NO: 135297 - DNA, 25 bp, Homo sapien
tcggatgaccaaaccagccttcgga

SEQ ID NO: 135298 - DNA, 25 bp, Homo sapien
caaaccagccttcggagcgttctct

SEQ ID NO: 135299 - DNA, 25 bp, Homo sapien
agcgttctctgtcctacttctgact

SEQ ID NO: 135300 - DNA, 25 bp, Homo sapien
gttctctgtcctacttctgacttta

SEQ ID NO: 135301 - DNA, 25 bp, Homo sapien
tctgtcctacttctgactttacttg

SEQ ID NO: 135302 - DNA, 25 bp, Homo sapien
ctgtcctacttctgactttacttgt

SEQ ID NO: 135303 - DNA, 25 bp, Homo sapien
acttctgactttacttgtggtgtga

SEQ ID NO: 135304 - DNA, 25 bp, Homo sapien
acttgtggtgtgacatgttcattat

SEQ ID NO: 135305 - DNA, 25 bp, Homo sapien
caatcttattccgagcattccagta

SEQ ID NO: 135306 - DNA, 25 bp, Homo sapien
aactgttttgtgtatgtacttagct

SEQ ID NO: 135307 - DNA, 25 bp, Homo sapien
atctttttacagttgcatcaggcct

SEQ ID NO: 135308 - DNA, 25 bp, Homo sapien
acagttgcatcaggcctgaacccgt

SEQ ID NO: 135309 - DNA, 25 bp, Homo sapien
gaacccgtccattcagaaagcttca

SEQ ID NO: 135310 - DNA, 25 bp, Homo sapien
aatactgttctatacgagtgaccga

SEQ ID NO: 135311 - DNA, 25 bp, Homo sapien
acgagtgaccgattatgctttcttt

SEQ ID NO: 135312 - DNA, 25 bp, Homo sapien
gattatgctttctttggcctacatt

SEQ ID NO: 135313 - DNA, 25 bp, Homo sapien
gcctacattctttattctgcggtga

SEQ ID NO: 135314 - DNA, 25 bp, Homo sapien
ttctgcggtgaagttgaggcttata

SEQ ID NO: 135315 - DNA, 25 bp, Homo sapien
aggaactaacttactgtccaccagt

SEQ ID NO: 135316 - DNA, 25 bp, Homo sapien
tactgtccaccagtttatacagaac

SEQ ID NO: 135317 - DNA, 25 bp, Homo sapien
gaactcacagtacctatgacttttt

SEQ ID NO: 135318 - DNA, 25 bp, Homo sapien
ggaggagaagctgaatgcaacaaac

SEQ ID NO: 135319 - DNA, 25 bp, Homo sapien
gcaacaaacattgagctagccacag

SEQ ID NO: 135320 - DNA, 25 bp, Homo sapien
attgagctagccacagtgcagcctg

SEQ ID NO: 135321 - DNA, 25 bp, Homo sapien
ccacagtgcagcctggccagaattt

SEQ ID NO: 135322 - DNA, 25 bp, Homo sapien
ggacatttaaggaatcctgatcctc

SEQ ID NO: 135323 - DNA, 25 bp, Homo sapien
atcctgatcctcagaacttctctgg

SEQ ID NO: 135324 - DNA, 25 bp, Homo sapien
acttctctgggacaatttcagttct

SEQ ID NO: 135325 - DNA, 25 bp, Homo sapien
taaattttatttccagctcctgttc

SEQ ID NO: 135326 - DNA, 25 bp, Homo sapien
tcctgttccttggaaaatctccatt

SEQ ID NO: 135327 - DNA, 25 bp, Homo sapien
ggaaaatctccattgtatgtgcatt

SEQ ID NO: 135328 - DNA, 25 bp, Homo sapien
gatgtctgtacataaaggcagttct

SEQ ID NO: 135329 - DNA, 25 bp, Homo sapien
ttgtcaggacaagggctcagaggac

SEQ ID NO: 135330 - DNA, 25 bp, Homo sapien
tcagaggactggacgtgctcagaca

SEQ ID NO: 135331 - DNA, 25 bp, Homo sapien
tggacgtgctcagacatcggtgttc

SEQ ID NO: 135332 - DNA, 25 bp, Homo sapien
agacatcggtgttcttcttcccagt

SEQ ID NO: 135333 - DNA, 25 bp, Homo sapien
ggtgttcttcttcccagttcttgac

SEQ ID NO: 135334 - DNA, 25 bp, Homo sapien
ttcttcccagttcttgacccctggt

SEQ ID NO: 135335 - DNA, 25 bp, Homo sapien
agcccgtcttggcttatccactttg

SEQ ID NO: 135336 - DNA, 25 bp, Homo sapien
gcttatccactttgactcctttgag

SEQ ID NO: 135337 - DNA, 25 bp, Homo sapien
ttgactcctttgagccgtttggagg

SEQ ID NO: 135338 - DNA, 25 bp, Homo sapien
ggtttctggtagttgtggcttttat

SEQ ID NO: 135339 - DNA, 25 bp, Homo sapien
gtagttgtggcttttatgctttcaa

SEQ ID NO: 135340 - DNA, 25 bp, Homo sapien
agtgtacctggagcggaaccccttg

SEQ ID NO: 135341 - DNA, 25 bp, Homo sapien
gagcggaaccccttgcagaaggacc

SEQ ID NO: 135342 - DNA, 25 bp, Homo sapien
cagtaccggcggaaggtcatgctcg

SEQ ID NO: 135343 - DNA, 25 bp, Homo sapien
gtgcggcagatcgatgccacgttcg

SEQ ID NO: 135344 - DNA, 25 bp, Homo sapien
atgccacgttcgtcaggttctgagt

SEQ ID NO: 135345 - DNA, 25 bp, Homo sapien
aggttctgagtccttcttggctcct

SEQ ID NO: 135346 - DNA, 25 bp, Homo sapien
atgtggtccctctcctcggaagaac

SEQ ID NO: 135347 - DNA, 25 bp, Homo sapien
tttttaacccacctgttgctcctga

SEQ ID NO: 135348 - DNA, 25 bp, Homo sapien
gaggtcgtcactatatcaacagtca

SEQ ID NO: 135349 - DNA, 25 bp, Homo sapien
caatggcaataaaggcactgacgat

SEQ ID NO: 135350 - DNA, 25 bp, Homo sapien
ccaggagcctggagacagtgtacct

SEQ ID NO: 135351 - DNA, 25 bp, Homo sapien
agcgttctctgtcctacttctgact

SEQ ID NO: 135352 - DNA, 25 bp, Homo sapien
gcgttctctgtcctacttctgactt

SEQ ID NO: 135353 - DNA, 25 bp, Homo sapien
cgttctctgtcctacttctgacttt

SEQ ID NO: 135354 - DNA, 25 bp, Homo sapien
gttctctgtcctacttctgacttta

SEQ ID NO: 135355 - DNA, 25 bp, Homo sapien
ttctctgtcctacttctgactttac

SEQ ID NO: 135356 - DNA, 25 bp, Homo sapien
tctctgtcctacttctgactttact

SEQ ID NO: 135357 - DNA, 25 bp, Homo sapien
ctctgtcctacttctgactttactt

SEQ ID NO: 135358 - DNA, 25 bp, Homo sapien
tctgtcctacttctgactttacttg

SEQ ID NO: 135359 - DNA, 25 bp, Homo sapien
ctgtcctacttctgactttacttgt

SEQ ID NO: 135360 - DNA, 25 bp, Homo sapien
agcctctgctgcgagaagttctgga

SEQ ID NO: 135361 - DNA, 25 bp, Homo sapien
agcagccagtgctaagccagaccga

SEQ ID NO: 135362 - DNA, 25 bp, Homo sapien
gaggcccgcgacttagtagaacgct

SEQ ID NO: 135363 - DNA, 25 bp, Homo sapien
aacgctgcatgcgagtgctgtacta

SEQ ID NO: 135364 - DNA, 25 bp, Homo sapien
agtgctgtactaccgagatgcccgt

SEQ ID NO: 135365 - DNA, 25 bp, Homo sapien
gagatgcccgttcttacaaccggtt

SEQ ID NO: 135366 - DNA, 25 bp, Homo sapien
tcaaaccgccactgtcaccgaaaaa

SEQ ID NO: 135367 - DNA, 25 bp, Homo sapien
gaaatagagggaccattgtctacag

SEQ ID NO: 135368 - DNA, 25 bp, Homo sapien
gagaccaactgggatattgcccaca

SEQ ID NO: 135369 - DNA, 25 bp, Homo sapien
attgcccacatgatcagtggctttg

SEQ ID NO: 135370 - DNA, 25 bp, Homo sapien
cagaactgaagttgccctactttta

SEQ ID NO: 135371 - DNA, 25 bp, Homo sapien
gtatgtattggcaatgatgtcatta

SEQ ID NO: 135372 - DNA, 25 bp, Homo sapien
tttattgcagcaagttacaaaggga

SEQ ID NO: 135373 - DNA, 25 bp, Homo sapien
tgcagcaagttacaaagggaaagtg

SEQ ID NO: 135374 - DNA, 25 bp, Homo sapien
ttttcatatttgctgcgtgagcatt

SEQ ID NO: 135375 - DNA, 25 bp, Homo sapien
ttcatatttgctgcgtgagcatttt

SEQ ID NO: 135376 - DNA, 25 bp, Homo sapien
atatttgctgcgtgagcattttgta

SEQ ID NO: 135377 - DNA, 25 bp, Homo sapien
atttgctgcgtgagcattttgtaaa

SEQ ID NO: 135378 - DNA, 25 bp, Homo sapien
gaaagtggtttgagatagtggtata

SEQ ID NO: 135379 - DNA, 25 bp, Homo sapien
gatagtggtataagaaagcatttct

SEQ ID NO: 135380 - DNA, 25 bp, Homo sapien
gacttattttgtatcatttgttttc

SEQ ID NO: 135381 - DNA, 25 bp, Homo sapien
catttgttttcctcatctaaaaagt

SEQ ID NO: 135382 - DNA, 25 bp, Homo sapien
ttacttactgttgtttaaagggatg

SEQ ID NO: 135383 - DNA, 25 bp, Homo sapien
gcatataccatacacttaagaaatt

SEQ ID NO: 135384 - DNA, 25 bp, Homo sapien
caaagtatgtcactgttggaaataa

SEQ ID NO: 135385 - DNA, 25 bp, Homo sapien
atgtcactgttggaaataaactgcc

SEQ ID NO: 135386 - DNA, 25 bp, Homo sapien
gtttgctgctattagcagaaactca

SEQ ID NO: 135387 - DNA, 25 bp, Homo sapien
aactcaattgtttctctgtcttttc

SEQ ID NO: 135388 - DNA, 25 bp, Homo sapien
tttctctgtcttttctatcaaaatt

SEQ ID NO: 135389 - DNA, 25 bp, Homo sapien
attttcaacatatgcataaccttag

SEQ ID NO: 135390 - DNA, 25 bp, Homo sapien
tgcataaccttagtattttcccaac

SEQ ID NO: 135391 - DNA, 25 bp, Homo sapien
tattttcccaaccaatagaaactat

SEQ ID NO: 135392 - DNA, 25 bp, Homo sapien
atttattgtaagcttatgtcacagg

SEQ ID NO: 135393 - DNA, 25 bp, Homo sapien
atatttatagtcacaagagcccagc

SEQ ID NO: 135394 - DNA, 25 bp, Homo sapien
tggcccgtcatgttcctcaaaagca

SEQ ID NO: 135395 - DNA, 25 bp, Homo sapien
ctcaaaagcacccttgacgtcaagt

SEQ ID NO: 135396 - DNA, 25 bp, Homo sapien
ttgacgtcaagtctccttccccttt

SEQ ID NO: 135397 - DNA, 25 bp, Homo sapien
gaaggtattccttttgtgtacagtg

SEQ ID NO: 135398 - DNA, 25 bp, Homo sapien
attccttttgtgtacagtgtgtaaa

SEQ ID NO: 135399 - DNA, 25 bp, Homo sapien
gaacaactaggcttcagcatattta

SEQ ID NO: 135400 - DNA, 25 bp, Homo sapien
gcatatttatagcaatccatgttag

SEQ ID NO: 135401 - DNA, 25 bp, Homo sapien
agcaatccatgttagtttttacttt

SEQ ID NO: 135402 - DNA, 25 bp, Homo sapien
ttactttctgttgccacaaccctgt

SEQ ID NO: 135403 - DNA, 25 bp, Homo sapien
gccacaaccctgttttatactgtac

SEQ ID NO: 135404 - DNA, 25 bp, Homo sapien
ctgctgattggcacagtgtttcaca

SEQ ID NO: 135405 - DNA, 25 bp, Homo sapien
gtgtttcacaaagctctttactgtg

SEQ ID NO: 135406 - DNA, 25 bp, Homo sapien
gtgagctctaacagaccgatttgca

SEQ ID NO: 135407 - DNA, 25 bp, Homo sapien
ccgatttgcacccatgccatagaaa

SEQ ID NO: 135408 - DNA, 25 bp, Homo sapien
atgccatagaaactgaggccattat

SEQ ID NO: 135409 - DNA, 25 bp, Homo sapien
aggccattatttcaaccgcttgcca

SEQ ID NO: 135410 - DNA, 25 bp, Homo sapien
ttgccatattccgaggacccagtgt

SEQ ID NO: 135411 - DNA, 25 bp, Homo sapien
gaggacccagtgttcttagctgaac

SEQ ID NO: 135412 - DNA, 25 bp, Homo sapien
gctgaacaatgaatgctgaccctaa

SEQ ID NO: 135413 - DNA, 25 bp, Homo sapien
tgctgaccctaaatgtggacatcat

SEQ ID NO: 135414 - DNA, 25 bp, Homo sapien
gcatcaaagcactgtttaactggga

SEQ ID NO: 135415 - DNA, 25 bp, Homo sapien
agagtgtctaaggactcctgagaat

SEQ ID NO: 135416 - DNA, 25 bp, Homo sapien
ctcctgagaattcctgttacagtaa

SEQ ID NO: 135417 - DNA, 25 bp, Homo sapien
gtaatctaccatttcctacactatt

SEQ ID NO: 135418 - DNA, 25 bp, Homo sapien
catttcctacactatttgagcatgg

SEQ ID NO: 135419 - DNA, 25 bp, Homo sapien
atggaaatcatagtccccactctat

SEQ ID NO: 135420 - DNA, 25 bp, Homo sapien
catttctgtagcatgtcagtttgga

SEQ ID NO: 135421 - DNA, 25 bp, Homo sapien
ttggagaaatgatgagctacgcctt

SEQ ID NO: 135422 - DNA, 25 bp, Homo sapien
gagctacgccttgatgaaagaaccg

SEQ ID NO: 135423 - DNA, 25 bp, Homo sapien
aaccgtgttggtgctgctaagttta

SEQ ID NO: 135424 - DNA, 25 bp, Homo sapien
tagccattatggtttttcctttctc

SEQ ID NO: 135425 - DNA, 25 bp, Homo sapien
tctctctcttaagccttattcttca

SEQ ID NO: 135426 - DNA, 25 bp, Homo sapien
atgctcctgtgctgagccaggctaa

SEQ ID NO: 135427 - DNA, 25 bp, Homo sapien
gccaggctaagtgtgaagcctccta

SEQ ID NO: 135428 - DNA, 25 bp, Homo sapien
gcaaggattcatgtcagggtgattc

SEQ ID NO: 135429 - DNA, 25 bp, Homo sapien
ggattcatgtcagggtgattctggt

SEQ ID NO: 135430 - DNA, 25 bp, Homo sapien
gatggctgtgcccagaagaacaagc

SEQ ID NO: 135431 - DNA, 25 bp, Homo sapien
caaggtctacaactacgtgaaatgg

SEQ ID NO: 135432 - DNA, 25 bp, Homo sapien
aaggtctacaactacgtgaaatgga

SEQ ID NO: 135433 - DNA, 25 bp, Homo sapien
ggtctacaactacgtgaaatggatt

SEQ ID NO: 135434 - DNA, 25 bp, Homo sapien
ctacaactacgtgaaatggattaag

SEQ ID NO: 135435 - DNA, 25 bp, Homo sapien
gaaatggattaagaacaccatagct

SEQ ID NO: 135436 - DNA, 25 bp, Homo sapien
gctaaagcccccagtatctcttcag

SEQ ID NO: 135437 - DNA, 25 bp, Homo sapien
ggtcgtggcagataatcagcctctt

SEQ ID NO: 135438 - DNA, 25 bp, Homo sapien
gtggcagataatcagcctcttaaag

SEQ ID NO: 135439 - DNA, 25 bp, Homo sapien
agataatcagcctcttaaagctgcc

SEQ ID NO: 135440 - DNA, 25 bp, Homo sapien
gagaagaaggacgagggcccctaca

SEQ ID NO: 135441 - DNA, 25 bp, Homo sapien
acgagggcccctacaggatggagca

SEQ ID NO: 135442 - DNA, 25 bp, Homo sapien
agggcccctacaggatggagcactt

SEQ ID NO: 135443 - DNA, 25 bp, Homo sapien
ctacaggatggagcacttccgctgg

SEQ ID NO: 135444 - DNA, 25 bp, Homo sapien
gcccaaggacaagcgctacggcggt

SEQ ID NO: 135445 - DNA, 25 bp, Homo sapien
catcaagaacgcctacaagaagggc

SEQ ID NO: 135446 - DNA, 25 bp, Homo sapien
tacaagaagggcgagtgagggcaca

SEQ ID NO: 135447 - DNA, 25 bp, Homo sapien
gaggtcgaccccaaagccccttgct

SEQ ID NO: 135448 - DNA, 25 bp, Homo sapien
gtattattttgtggcccgtgaccct

SEQ ID NO: 135449 - DNA, 25 bp, Homo sapien
tggcccgtgaccctcgttattgtta

SEQ ID NO: 135450 - DNA, 25 bp, Homo sapien
ctcgttattgttacagctgagtgta

SEQ ID NO: 135451 - DNA, 25 bp, Homo sapien
acagctgagtgtatgtttttgttct

SEQ ID NO: 135452 - DNA, 25 bp, Homo sapien
gttctgtggagaatgctatctggca

SEQ ID NO: 135453 - DNA, 25 bp, Homo sapien
tgctatctggcattatggtaatata

SEQ ID NO: 135454 - DNA, 25 bp, Homo sapien
atatttgtactttaacatgttgcat

SEQ ID NO: 135455 - DNA, 25 bp, Homo sapien
atatgcttatgtagctttccaggac

SEQ ID NO: 135456 - DNA, 25 bp, Homo sapien
gtagctttccaggactaacagataa

SEQ ID NO: 135457 - DNA, 25 bp, Homo sapien
ggaggactcagttcacaaaatgcaa

SEQ ID NO: 135458 - DNA, 25 bp, Homo sapien
aaactcaacgatcagattcacggac

SEQ ID NO: 135459 - DNA, 25 bp, Homo sapien
taagttcttcattcactaaggaagg

SEQ ID NO: 135460 - DNA, 25 bp, Homo sapien
gttcttcattcactaaggaaggaat

SEQ ID NO: 135461 - DNA, 25 bp, Homo sapien
gaaggtgaagttcaatgatgctctt

SEQ ID NO: 135462 - DNA, 25 bp, Homo sapien
ggtgaagttcaatgatgctcttgat

SEQ ID NO: 135463 - DNA, 25 bp, Homo sapien
gtgaagttcaatgatgctcttgatt

SEQ ID NO: 135464 - DNA, 25 bp, Homo sapien
aatgatgctcttgattttaatccca

SEQ ID NO: 135465 - DNA, 25 bp, Homo sapien
gattttaatcccacatcatgtatca

SEQ ID NO: 135466 - DNA, 25 bp, Homo sapien
tgtctctgtcaccactctgggctct

SEQ ID NO: 135467 - DNA, 25 bp, Homo sapien
ctctcccttgcattcaaactgaggt

SEQ ID NO: 135468 - DNA, 25 bp, Homo sapien
gcattcaaactgaggtgcctgcctg

SEQ ID NO: 135469 - DNA, 25 bp, Homo sapien
gagtttgtgccagggtttttggatt

SEQ ID NO: 135470 - DNA, 25 bp, Homo sapien
gtgggaacattcgaggtgtcaccct

SEQ ID NO: 135471 - DNA, 25 bp, Homo sapien
ataaggcttaggtgccaggctgtaa

SEQ ID NO: 135472 - DNA, 25 bp, Homo sapien
gtgccaggctgtaagcattctgagc

SEQ ID NO: 135473 - DNA, 25 bp, Homo sapien
gcattctgagctggcttgttgtttt

SEQ ID NO: 135474 - DNA, 25 bp, Homo sapien
gttgtttttaagtcctgtatatgta

SEQ ID NO: 135475 - DNA, 25 bp, Homo sapien
tggacgtactggtttaacctcctat

SEQ ID NO: 135476 - DNA, 25 bp, Homo sapien
taacctcctatccttggagagcagc

SEQ ID NO: 135477 - DNA, 25 bp, Homo sapien
ctctccaccttgttacacattatgt

SEQ ID NO: 135478 - DNA, 25 bp, Homo sapien
tatgttagagaggtagcgagctgct

SEQ ID NO: 135479 - DNA, 25 bp, Homo sapien
ctctgctatgtccttaagccaatat

SEQ ID NO: 135480 - DNA, 25 bp, Homo sapien
gccaatatttactcatcaggtcatt

SEQ ID NO: 135481 - DNA, 25 bp, Homo sapien
taagttcttcattcactaaggaagg

SEQ ID NO: 135482 - DNA, 25 bp, Homo sapien
aagttcttcattcactaaggaagga

SEQ ID NO: 135483 - DNA, 25 bp, Homo sapien
agttcttcattcactaaggaaggaa

SEQ ID NO: 135484 - DNA, 25 bp, Homo sapien
gttcttcattcactaaggaaggaat

SEQ ID NO: 135485 - DNA, 25 bp, Homo sapien
ttcttcattcactaaggaaggaatt

SEQ ID NO: 135486 - DNA, 25 bp, Homo sapien
tcttcattcactaaggaaggaattg

SEQ ID NO: 135487 - DNA, 25 bp, Homo sapien
cttcattcactaaggaaggaattgg

SEQ ID NO: 135488 - DNA, 25 bp, Homo sapien
ttcattcactaaggaaggaattggg

SEQ ID NO: 135489 - DNA, 25 bp, Homo sapien
ttcatttgctctctagacctcatcg

SEQ ID NO: 135490 - DNA, 25 bp, Homo sapien
tgccccatggtgactgatgactttg

SEQ ID NO: 135491 - DNA, 25 bp, Homo sapien
gactttgtggtcagtggcacctgcg

SEQ ID NO: 135492 - DNA, 25 bp, Homo sapien
ggcacctgcgccgaacaaatgtacg

SEQ ID NO: 135493 - DNA, 25 bp, Homo sapien
acggaatgtgtgagtccctctggga

SEQ ID NO: 135494 - DNA, 25 bp, Homo sapien
gggagcccaacatggatccggatca

SEQ ID NO: 135495 - DNA, 25 bp, Homo sapien
tggatccggatcacctgtttgaaac

SEQ ID NO: 135496 - DNA, 25 bp, Homo sapien
tgtttgaaaccatctcccaagccat

SEQ ID NO: 135497 - DNA, 25 bp, Homo sapien
catgctgaatgctgtggaccgggat

SEQ ID NO: 135498 - DNA, 25 bp, Homo sapien
gaaggacaaaatcaccaccaggaca

SEQ ID NO: 135499 - DNA, 25 bp, Homo sapien
gaaggcccgaatggactaaccctgt

SEQ ID NO: 135500 - DNA, 25 bp, Homo sapien
ggctctttactccattcacagccat

SEQ ID NO: 135501 - DNA, 25 bp, Homo sapien
tttactccattcacagccatgcacg

SEQ ID NO: 135502 - DNA, 25 bp, Homo sapien
ttcacagccatgcacgcgctcaagt

SEQ ID NO: 135503 - DNA, 25 bp, Homo sapien
atgcacgcgctcaagtacaccaggg

SEQ ID NO: 135504 - DNA, 25 bp, Homo sapien
cgcgctcaagtacaccagggtgcga

SEQ ID NO: 135505 - DNA, 25 bp, Homo sapien
gtacaccagggtgcgagatgccagc

SEQ ID NO: 135506 - DNA, 25 bp, Homo sapien
accagggtgcgagatgccagctctg

SEQ ID NO: 135507 - DNA, 25 bp, Homo sapien
tctggagttctcggttgttgtagga

SEQ ID NO: 135508 - DNA, 25 bp, Homo sapien
gatgttttgacgaaataaatttgct

SEQ ID NO: 135509 - DNA, 25 bp, Homo sapien
aactggtgccgggtcttcacccaga

SEQ ID NO: 135510 - DNA, 25 bp, Homo sapien
accacgctgggtcccctctgttggg

SEQ ID NO: 135511 - DNA, 25 bp, Homo sapien
tgtgggtaggactggaacctttatt

SEQ ID NO: 135512 - DNA, 25 bp, Homo sapien
gaacctttattgcattggaccgaat

SEQ ID NO: 135513 - DNA, 25 bp, Homo sapien
tggaccgaatcctccagcagttaga

SEQ ID NO: 135514 - DNA, 25 bp, Homo sapien
gcagttagactccaaagactctgtg

SEQ ID NO: 135515 - DNA, 25 bp, Homo sapien
gactctgtggacatttatggagcag

SEQ ID NO: 135516 - DNA, 25 bp, Homo sapien
ggagcagtgcacgacctaagacttc

SEQ ID NO: 135517 - DNA, 25 bp, Homo sapien
acttcacagggttcacatggtccag

SEQ ID NO: 135518 - DNA, 25 bp, Homo sapien
cacatggtccagactgagtgtcagt

SEQ ID NO: 135519 - DNA, 25 bp, Homo sapien
gagtatcacagagatccagtctatt

SEQ ID NO: 135520 - DNA, 25 bp, Homo sapien
agatccagtctattcaaggcattga

SEQ ID NO: 135521 - DNA, 25 bp, Homo sapien
ttgagaatgtacctgaagagctcct

SEQ ID NO: 135522 - DNA, 25 bp, Homo sapien
ttccctagttagtactcggactcct

SEQ ID NO: 135523 - DNA, 25 bp, Homo sapien
tcggactcctgtgctaattgtcagc

SEQ ID NO: 135524 - DNA, 25 bp, Homo sapien
tagagactgtttattctgtaccaaa

SEQ ID NO: 135525 - DNA, 25 bp, Homo sapien
taaaccggtgactgtttttcttcat

SEQ ID NO: 135526 - DNA, 25 bp, Homo sapien
ttcttcataaagttctgcgtttggc

SEQ ID NO: 135527 - DNA, 25 bp, Homo sapien
aaagttctgcgtttggcatcttcac

SEQ ID NO: 135528 - DNA, 25 bp, Homo sapien
ggcatcttcactctttccaaaatgt

SEQ ID NO: 135529 - DNA, 25 bp, Homo sapien
actctttccaaaatgtatctgtaca

SEQ ID NO: 135530 - DNA, 25 bp, Homo sapien
gaaatgtcactattccaagtgtctt

SEQ ID NO: 135531 - DNA, 25 bp, Homo sapien
attccaagtgtctttttagtgtggc

SEQ ID NO: 135532 - DNA, 25 bp, Homo sapien
ctttagtatggcttccttttaatat

SEQ ID NO: 135533 - DNA, 25 bp, Homo sapien
tgtgattcagcaggacgatgagatc

SEQ ID NO: 135534 - DNA, 25 bp, Homo sapien
gatgagatccgcttaaagattgtgg

SEQ ID NO: 135535 - DNA, 25 bp, Homo sapien
tgacatttttgctattggctccctg

SEQ ID NO: 135536 - DNA, 25 bp, Homo sapien
ttggctccctgatggacgattactt

SEQ ID NO: 135537 - DNA, 25 bp, Homo sapien
tacccttggtcctactctaggaagt

SEQ ID NO: 135538 - DNA, 25 bp, Homo sapien
cctactctaggaagtgtgattgtca

SEQ ID NO: 135539 - DNA, 25 bp, Homo sapien
gattgtcacacttatcatgttgtcc

SEQ ID NO: 135540 - DNA, 25 bp, Homo sapien
atcatgttgtccagaggtccagtct

SEQ ID NO: 135541 - DNA, 25 bp, Homo sapien
ggaaggcaactcatcccagaaggca

SEQ ID NO: 135542 - DNA, 25 bp, Homo sapien
gcatctggtgcttcttgtagcttaa

SEQ ID NO: 135543 - DNA, 25 bp, Homo sapien
tagcttaactactgcctcctcattt

SEQ ID NO: 135544 - DNA, 25 bp, Homo sapien
ttgcataggacagacttaggagttt

SEQ ID NO: 135545 - DNA, 25 bp, Homo sapien
agcagttaacatctgaagtgtctaa

SEQ ID NO: 135546 - DNA, 25 bp, Homo sapien
gtctaatgcattaacttttgtaagg

SEQ ID NO: 135547 - DNA, 25 bp, Homo sapien
ttttgcgtggtccttaggcttacaa

SEQ ID NO: 135548 - DNA, 25 bp, Homo sapien
ggtccttaggcttacaatgtgcact

SEQ ID NO: 135549 - DNA, 25 bp, Homo sapien
ggcttacaatgtgcactgaatcgtt

SEQ ID NO: 135550 - DNA, 25 bp, Homo sapien
gtgcactgaatcgtttcatgtaaga

SEQ ID NO: 135551 - DNA, 25 bp, Homo sapien
gtaagaatccaaagtggacaccatt

SEQ ID NO: 135552 - DNA, 25 bp, Homo sapien
caggtctttgaaatatgcatgtact

SEQ ID NO: 135553 - DNA, 25 bp, Homo sapien
atttgtaactttgcatgttcttgtt

SEQ ID NO: 135554 - DNA, 25 bp, Homo sapien
gcatgttcttgttttgttatataaa

SEQ ID NO: 135555 - DNA, 25 bp, Homo sapien
agcccactcatccttatgtgctagg

SEQ ID NO: 135556 - DNA, 25 bp, Homo sapien
catccttatgtgctagggataaatc

SEQ ID NO: 135557 - DNA, 25 bp, Homo sapien
ggataaatcaagagtcctcagcact

SEQ ID NO: 135558 - DNA, 25 bp, Homo sapien
tcaagagtcctcagcactccacatt

SEQ ID NO: 135559 - DNA, 25 bp, Homo sapien
tccacattcccaaaaaatcccagga

SEQ ID NO: 135560 - DNA, 25 bp, Homo sapien
cagaagatgaggttggcagctgatc

SEQ ID NO: 135561 - DNA, 25 bp, Homo sapien
ggttggcagctgatcagacctcaat

SEQ ID NO: 135562 - DNA, 25 bp, Homo sapien
gcagctgatcagacctcaataattt

SEQ ID NO: 135563 - DNA, 25 bp, Homo sapien
tttatactgtaataagctctttgaa

SEQ ID NO: 135564 - DNA, 25 bp, Homo sapien
aatatcaatggactgagtctgattc

SEQ ID NO: 135565 - DNA, 25 bp, Homo sapien
gttcatattcaatatcttacagtga

SEQ ID NO: 135566 - DNA, 25 bp, Homo sapien
gggccacccgcccatggacgatgta

SEQ ID NO: 135567 - DNA, 25 bp, Homo sapien
gccacccgcccatggacgatgtata

SEQ ID NO: 135568 - DNA, 25 bp, Homo sapien
acccgcccatggacgatgtatacgc

SEQ ID NO: 135569 - DNA, 25 bp, Homo sapien
gcccatggacgatgtatacgcgcct

SEQ ID NO: 135570 - DNA, 25 bp, Homo sapien
cccatggacgatgtatacgcgcctg

SEQ ID NO: 135571 - DNA, 25 bp, Homo sapien
catggacgatgtatacgcgcctggg

SEQ ID NO: 135572 - DNA, 25 bp, Homo sapien
ggctcagtgcagtgaccccgcgggc

SEQ ID NO: 135573 - DNA, 25 bp, Homo sapien
tggactctttttgttcggttgcttt

SEQ ID NO: 135574 - DNA, 25 bp, Homo sapien
gactctttttgttcggttgctttgg

SEQ ID NO: 135575 - DNA, 25 bp, Homo sapien
tctttttgttcggttgctttggatt

SEQ ID NO: 135576 - DNA, 25 bp, Homo sapien
tgttcggttgctttggattttacaa

SEQ ID NO: 135577 - DNA, 25 bp, Homo sapien
gacatgttaatatagtaataccttt

SEQ ID NO: 135578 - DNA, 25 bp, Homo sapien
ttgtatatgtacagggcaagtaggt

SEQ ID NO: 135579 - DNA, 25 bp, Homo sapien
gtaagaaatttctgcatggtctaaa

SEQ ID NO: 135580 - DNA, 25 bp, Homo sapien
ttctgcatggtctaaatctttgtgt

SEQ ID NO: 135581 - DNA, 25 bp, Homo sapien
ggtctaaatctttgtgtactttatt

SEQ ID NO: 135582 - DNA, 25 bp, Homo sapien
tgtaaattatttgccctggagtttt

SEQ ID NO: 135583 - DNA, 25 bp, Homo sapien
tttgccctggagttttagaaaatag

SEQ ID NO: 135584 - DNA, 25 bp, Homo sapien
aattttaaacttgctggattcatgc

SEQ ID NO: 135585 - DNA, 25 bp, Homo sapien
tggattcatgcagccagctttgcag

SEQ ID NO: 135586 - DNA, 25 bp, Homo sapien
cagccagctttgcaggttatcagag

SEQ ID NO: 135587 - DNA, 25 bp, Homo sapien
cagctttgcaggttatcagagatca

SEQ ID NO: 135588 - DNA, 25 bp, Homo sapien
gaattgtgaaactactcatgagtac

SEQ ID NO: 135589 - DNA, 25 bp, Homo sapien
aattgtgaaactactcatgagtact

SEQ ID NO: 135590 - DNA, 25 bp, Homo sapien
ttgtgaaactactcatgagtactca

SEQ ID NO: 135591 - DNA, 25 bp, Homo sapien
gtgaaactactcatgagtactcata

SEQ ID NO: 135592 - DNA, 25 bp, Homo sapien
gaaactactcatgagtactcatagg

SEQ ID NO: 135593 - DNA, 25 bp, Homo sapien
actactcatgagtactcataggttt

SEQ ID NO: 135594 - DNA, 25 bp, Homo sapien
actcatgagtactcataggtttatg

SEQ ID NO: 135595 - DNA, 25 bp, Homo sapien
ctcatgagtactcataggtttatgg

SEQ ID NO: 135596 - DNA, 25 bp, Homo sapien
gaatgccccagaattgtgaaactac

SEQ ID NO: 135597 - DNA, 25 bp, Homo sapien
aatgccccagaattgtgaaactact

SEQ ID NO: 135598 - DNA, 25 bp, Homo sapien
atgccccagaattgtgaaactactc

SEQ ID NO: 135599 - DNA, 25 bp, Homo sapien
ccacacacagctcatatgctgcatt

SEQ ID NO: 135600 - DNA, 25 bp, Homo sapien
cacacagctcatatgctgcattcgt

SEQ ID NO: 135601 - DNA, 25 bp, Homo sapien
acagctcatatgctgcattcgtgca

SEQ ID NO: 135602 - DNA, 25 bp, Homo sapien
gctcatatgctgcattcgtgcaggg

SEQ ID NO: 135603 - DNA, 25 bp, Homo sapien
ccagccggtgacttactgtacagca

SEQ ID NO: 135604 - DNA, 25 bp, Homo sapien
agccggtgacttactgtacagcagg

SEQ ID NO: 135605 - DNA, 25 bp, Homo sapien
ccggtgacttactgtacagcaggca

SEQ ID NO: 135606 - DNA, 25 bp, Homo sapien
gggaaggatagttctgtgtactcct

SEQ ID NO: 135607 - DNA, 25 bp, Homo sapien
gatagttctgtgtactcctttaggg

SEQ ID NO: 135608 - DNA, 25 bp, Homo sapien
tagttctgtgtactcctttagggag

SEQ ID NO: 135609 - DNA, 25 bp, Homo sapien
tctgtgtactcctttagggagtggg

SEQ ID NO: 135610 - DNA, 25 bp, Homo sapien
ttcttcctccttgggttggaggaga

SEQ ID NO: 135611 - DNA, 25 bp, Homo sapien
cagggtgcctcttatctccttctag

SEQ ID NO: 135612 - DNA, 25 bp, Homo sapien
ttatctccttctagcggtctgcctc

SEQ ID NO: 135613 - DNA, 25 bp, Homo sapien
ggtctgcctcctggtacctcttggg

SEQ ID NO: 135614 - DNA, 25 bp, Homo sapien
gggatcggcaaacaggctacccctg

SEQ ID NO: 135615 - DNA, 25 bp, Homo sapien
aacaggctacccctgaggtcccatg

SEQ ID NO: 135616 - DNA, 25 bp, Homo sapien
tgaggtcccatgtgccatgagtgtg

SEQ ID NO: 135617 - DNA, 25 bp, Homo sapien
gtgccatgagtgtgcacaacatgca

SEQ ID NO: 135618 - DNA, 25 bp, Homo sapien
gcacaacatgcaatgtgtctgtgta

SEQ ID NO: 135619 - DNA, 25 bp, Homo sapien
gaaaaacacagccctcctttcagaa

SEQ ID NO: 135620 - DNA, 25 bp, Homo sapien
caggaaggcaggttccctctctggt

SEQ ID NO: 135621 - DNA, 25 bp, Homo sapien
tcaccgccgggatcttgggtgacct

SEQ ID NO: 135622 - DNA, 25 bp, Homo sapien
gtgtgatcacaaagactggcgccaa

SEQ ID NO: 135623 - DNA, 25 bp, Homo sapien
tgatcacaaagactggcgccaagct

SEQ ID NO: 135624 - DNA, 25 bp, Homo sapien
atcacaaagactggcgccaagctgc

SEQ ID NO: 135625 - DNA, 25 bp, Homo sapien
gcggacactgagctcacccacagag

SEQ ID NO: 135626 - DNA, 25 bp, Homo sapien
gagctcacccacagagcccgtgaag

SEQ ID NO: 135627 - DNA, 25 bp, Homo sapien
agcccgtgaagaggtctggccgcta

SEQ ID NO: 135628 - DNA, 25 bp, Homo sapien
gtgaagaggtctggccgctaccact

SEQ ID NO: 135629 - DNA, 25 bp, Homo sapien
gaggtctggccgctaccactttgtg

SEQ ID NO: 135630 - DNA, 25 bp, Homo sapien
tctggccgctaccactttgtgcctg

SEQ ID NO: 135631 - DNA, 25 bp, Homo sapien
tggagtaagctgaggcttagagctt

SEQ ID NO: 135632 - DNA, 25 bp, Homo sapien
ttgagctgtctttgtcgtggagatc

SEQ ID NO: 135633 - DNA, 25 bp, Homo sapien
tgtcgtggagatctggaactttgca

SEQ ID NO: 135634 - DNA, 25 bp, Homo sapien
ggaactttgcacatgtcactactgg

SEQ ID NO: 135635 - DNA, 25 bp, Homo sapien
tgctctagcttccacgatgaggcgc

SEQ ID NO: 135636 - DNA, 25 bp, Homo sapien
gatgaggcgccctctttacctatcc

SEQ ID NO: 135637 - DNA, 25 bp, Homo sapien
atcactactcttcttgaagcactat

SEQ ID NO: 135638 - DNA, 25 bp, Homo sapien
tttattcttccgctgtctgcctgca

SEQ ID NO: 135639 - DNA, 25 bp, Homo sapien
gcagtactactgtcaacatagtgta

SEQ ID NO: 135640 - DNA, 25 bp, Homo sapien
gttctcaaaagcttaccagtgtgga

SEQ ID NO: 135641 - DNA, 25 bp, Homo sapien
accagtgtggacttggtgttagcca

SEQ ID NO: 135642 - DNA, 25 bp, Homo sapien
gacttggtgttagccacgctgttta

SEQ ID NO: 135643 - DNA, 25 bp, Homo sapien
atgctcctagaagtcttaattgtgt

SEQ ID NO: 135644 - DNA, 25 bp, Homo sapien
caaatgttagacttgtgtgcatgga

SEQ ID NO: 135645 - DNA, 25 bp, Homo sapien
gacttgtgtgcatggaagtaattaa

SEQ ID NO: 135646 - DNA, 25 bp, Homo sapien
aggtacatcattattgtagtttgaa

SEQ ID NO: 135647 - DNA, 25 bp, Homo sapien
tttactgaatgatctattccccatc

SEQ ID NO: 135648 - DNA, 25 bp, Homo sapien
tgaatgatctattccccatcccaag

SEQ ID NO: 135649 - DNA, 25 bp, Homo sapien
cccatcccaaggcaagcatgaataa

SEQ ID NO: 135650 - DNA, 25 bp, Homo sapien
ctcttagaatttgtttcatctattt

SEQ ID NO: 135651 - DNA, 25 bp, Homo sapien
atactgtctgtatctttggttatcc

SEQ ID NO: 135652 - DNA, 25 bp, Homo sapien
ctgtctgtatctttggttatcctgt

SEQ ID NO: 135653 - DNA, 25 bp, Homo sapien
gtatctttggttatcctgtttgaag

SEQ ID NO: 135654 - DNA, 25 bp, Homo sapien
aagatctggaacttgaagatgccat

SEQ ID NO: 135655 - DNA, 25 bp, Homo sapien
atgccattcatacagccatcttaac

SEQ ID NO: 135656 - DNA, 25 bp, Homo sapien
catacagccatcttaaccctaaagg

SEQ ID NO: 135657 - DNA, 25 bp, Homo sapien
gaagggcaaatgacagaggataaca

SEQ ID NO: 135658 - DNA, 25 bp, Homo sapien
aagctggatttaggaggcttactcc

SEQ ID NO: 135659 - DNA, 25 bp, Homo sapien
ggaggcttactccaactgaagttaa

SEQ ID NO: 135660 - DNA, 25 bp, Homo sapien
gttaaggattacttggctgccatag

SEQ ID NO: 135661 - DNA, 25 bp, Homo sapien
ggctgccatagcataacaatgaagt

SEQ ID NO: 135662 - DNA, 25 bp, Homo sapien
agataatctatctacttaaacatgt

SEQ ID NO: 135663 - DNA, 25 bp, Homo sapien
gactttttgcatacttatttctaca

SEQ ID NO: 135664 - DNA, 25 bp, Homo sapien
ttctacatggtttaaatcgactgtt

SEQ ID NO: 135665 - DNA, 25 bp, Homo sapien
attgacaatgaaagtgggttctcct

SEQ ID NO: 135666 - DNA, 25 bp, Homo sapien
ccacccctttctaatttagtctctg

SEQ ID NO: 135667 - DNA, 25 bp, Homo sapien
tttctaatttagtctctgagtccca

SEQ ID NO: 135668 - DNA, 25 bp, Homo sapien
aatttagtctctgagtcccaaaaag

SEQ ID NO: 135669 - DNA, 25 bp, Homo sapien
agtcccaaaaagaagtgcaggcaga

SEQ ID NO: 135670 - DNA, 25 bp, Homo sapien
gcccaggagagctctgagctctggc

SEQ ID NO: 135671 - DNA, 25 bp, Homo sapien
agctctgagctctggccaacaactg

SEQ ID NO: 135672 - DNA, 25 bp, Homo sapien
tgagctctggccaacaactgcagcc

SEQ ID NO: 135673 - DNA, 25 bp, Homo sapien
tggccaacaactgcagccaggctgg

SEQ ID NO: 135674 - DNA, 25 bp, Homo sapien
aggctgggcagagcactccggctca

SEQ ID NO: 135675 - DNA, 25 bp, Homo sapien
tgggcagagcactccggctcacctg

SEQ ID NO: 135676 - DNA, 25 bp, Homo sapien
attattcctgcactcacaggctaca

SEQ ID NO: 135677 - DNA, 25 bp, Homo sapien
gcactcacaggctacagttgaacag

SEQ ID NO: 135678 - DNA, 25 bp, Homo sapien
agttgaacagaactgccgtgggaat

SEQ ID NO: 135679 - DNA, 25 bp, Homo sapien
gaactgccgtgggaattttatcttt

SEQ ID NO: 135680 - DNA, 25 bp, Homo sapien
ttaggcttctcctttttagcaaggc

SEQ ID NO: 135681 - DNA, 25 bp, Homo sapien
tttagcaaggccttggtgtttcttt

SEQ ID NO: 135682 - DNA, 25 bp, Homo sapien
gtgtttctttttccaccctgtctag

SEQ ID NO: 135683 - DNA, 25 bp, Homo sapien
accctgtctaggcacatgtggtttt

SEQ ID NO: 135684 - DNA, 25 bp, Homo sapien
aattaaggatcatagtcgggcatac

SEQ ID NO: 135685 - DNA, 25 bp, Homo sapien
tatccataacctctatatctttaaa

SEQ ID NO: 135686 - DNA, 25 bp, Homo sapien
actgttctcatggagaagacttctt

SEQ ID NO: 135687 - DNA, 25 bp, Homo sapien
aatgaagctggctgctcagacggtc

SEQ ID NO: 135688 - DNA, 25 bp, Homo sapien
tggctgctcagacggtcgacattga

SEQ ID NO: 135689 - DNA, 25 bp, Homo sapien
cagacggtcgacattgaatttgggt

SEQ ID NO: 135690 - DNA, 25 bp, Homo sapien
gggttgggatcctgtctgaagtaca

SEQ ID NO: 135691 - DNA, 25 bp, Homo sapien
tgaagtacagactgttcttgctcta

SEQ ID NO: 135692 - DNA, 25 bp, Homo sapien
gaggaggcttctttgtgggtctctc

SEQ ID NO: 135693 - DNA, 25 bp, Homo sapien
aggcttctttgtgggtctctcctgc

SEQ ID NO: 135694 - DNA, 25 bp, Homo sapien
atacgggagagaaagaacgtgccag

SEQ ID NO: 135695 - DNA, 25 bp, Homo sapien
ccctgaagtctgtgtactccgaggt

SEQ ID NO: 135696 - DNA, 25 bp, Homo sapien
aagtctgtgtactccgaggtggatc

SEQ ID NO: 135697 - DNA, 25 bp, Homo sapien
gtgtactccgaggtggatctccatc

SEQ ID NO: 135698 - DNA, 25 bp, Homo sapien
agaaacagcccttcttcaggactct

SEQ ID NO: 135699 - DNA, 25 bp, Homo sapien
aacagcccttcttcaggactctggg

SEQ ID NO: 135700 - DNA, 25 bp, Homo sapien
gcccttcttcaggactctgggctgg

SEQ ID NO: 135701 - DNA, 25 bp, Homo sapien
aggactctgggctgggaagccctgt

SEQ ID NO: 135702 - DNA, 25 bp, Homo sapien
accgacgtcagcaacttcgacgagg

SEQ ID NO: 135703 - DNA, 25 bp, Homo sapien
acgtcagcaacttcgacgaggagtt

SEQ ID NO: 135704 - DNA, 25 bp, Homo sapien
tcacagccgcggagcaggcagcctt

SEQ ID NO: 135705 - DNA, 25 bp, Homo sapien
agccttcctggacttcgacttcgtg

SEQ ID NO: 135706 - DNA, 25 bp, Homo sapien
tcctggacttcgacttcgtggccgg

SEQ ID NO: 135707 - DNA, 25 bp, Homo sapien
cctgcccgagagctcttagttttta

SEQ ID NO: 135708 - DNA, 25 bp, Homo sapien
tgcccgagagctcttagtttttaaa

SEQ ID NO: 135709 - DNA, 25 bp, Homo sapien
gacatgctcagatgtatgctcggaa

SEQ ID NO: 135710 - DNA, 25 bp, Homo sapien
tatgctcggaagagtctaccgaccc

SEQ ID NO: 135711 - DNA, 25 bp, Homo sapien
aagagtctaccgaccctgttggcaa

SEQ ID NO: 135712 - DNA, 25 bp, Homo sapien
taccgaccctgttggcaagtctgat

SEQ ID NO: 135713 - DNA, 25 bp, Homo sapien
accctgttggcaagtctgatacctg

SEQ ID NO: 135714 - DNA, 25 bp, Homo sapien
gcaagtctgatacctgttggtccac

SEQ ID NO: 135715 - DNA, 25 bp, Homo sapien
tgatacctgttggtccacatcatct

SEQ ID NO: 135716 - DNA, 25 bp, Homo sapien
gaggagaagcccatactgctactat

SEQ ID NO: 135717 - DNA, 25 bp, Homo sapien
gcccatactgctactataacttgtg

SEQ ID NO: 135718 - DNA, 25 bp, Homo sapien
actgctactataacttgtgtatgtt

SEQ ID NO: 135719 - DNA, 25 bp, Homo sapien
cagtaactgaaatgatatgctttct

SEQ ID NO: 135720 - DNA, 25 bp, Homo sapien
gtgacagtccaaaccactccactgg

SEQ ID NO: 135721 - DNA, 25 bp, Homo sapien
tggcctcctggcagaagccgagtgt

SEQ ID NO: 135722 - DNA, 25 bp, Homo sapien
aaaggtctgatgtctccactttcac

SEQ ID NO: 135723 - DNA, 25 bp, Homo sapien
aggccttaccgctctgtttatagtg

SEQ ID NO: 135724 - DNA, 25 bp, Homo sapien
taccgctctgtttatagtgacccac

SEQ ID NO: 135725 - DNA, 25 bp, Homo sapien
tctgtttatagtgacccaccctaga

SEQ ID NO: 135726 - DNA, 25 bp, Homo sapien
ttatagtgacccaccctagatcttc

SEQ ID NO: 135727 - DNA, 25 bp, Homo sapien
gggtccattctctgagtcagtggtt

SEQ ID NO: 135728 - DNA, 25 bp, Homo sapien
tctctgagtcagtggttatttgaaa

SEQ ID NO: 135729 - DNA, 25 bp, Homo sapien
tattttttctctgtaaacttccaag

SEQ ID NO: 135730 - DNA, 25 bp, Homo sapien
tttctctgtaaacttccaagctggc

SEQ ID NO: 135731 - DNA, 25 bp, Homo sapien
ttacgtgcaggaacgtggagaccct

SEQ ID NO: 135732 - DNA, 25 bp, Homo sapien
gtggagaccctgacgtgggctcact

SEQ ID NO: 135733 - DNA, 25 bp, Homo sapien
ctagtgttggtaggtcctagacgtg

SEQ ID NO: 135734 - DNA, 25 bp, Homo sapien
tggtaggtcctagacgtggttccct

SEQ ID NO: 135735 - DNA, 25 bp, Homo sapien
aggtcctagacgtggttccctccag

SEQ ID NO: 135736 - DNA, 25 bp, Homo sapien
ccctggtgttgagagaacgtccttc

SEQ ID NO: 135737 - DNA, 25 bp, Homo sapien
gttgagagaacgtccttctgtccat

SEQ ID NO: 135738 - DNA, 25 bp, Homo sapien
agagaacgtccttctgtccatcgtg

SEQ ID NO: 135739 - DNA, 25 bp, Homo sapien
gtccttctgtccatcgtgggtaaca

SEQ ID NO: 135740 - DNA, 25 bp, Homo sapien
gtccatcgtgggtaacagccttggg

SEQ ID NO: 135741 - DNA, 25 bp, Homo sapien
gcccattcacctttctcctagaatg

SEQ ID NO: 135742 - DNA, 25 bp, Homo sapien
acatcagaatgagtatttggtttag

SEQ ID NO: 135743 - DNA, 25 bp, Homo sapien
gtatttggtttagagtttggcaaca

SEQ ID NO: 135744 - DNA, 25 bp, Homo sapien
gtttggcaacatatgccatatgctg

SEQ ID NO: 135745 - DNA, 25 bp, Homo sapien
tatgccatatgctggctgccatgaa

SEQ ID NO: 135746 - DNA, 25 bp, Homo sapien
atgctggctgccatgaacaaaggtg

SEQ ID NO: 135747 - DNA, 25 bp, Homo sapien
aaaggtggctataaagaggtcatca

SEQ ID NO: 135748 - DNA, 25 bp, Homo sapien
aggtcatcagtatatgaaacagccc

SEQ ID NO: 135749 - DNA, 25 bp, Homo sapien
tattccatagaaaagccttgacttg

SEQ ID NO: 135750 - DNA, 25 bp, Homo sapien
aagccttgacttgaggttagatttt

SEQ ID NO: 135751 - DNA, 25 bp, Homo sapien
tttccttacatgttttactagccag

SEQ ID NO: 135752 - DNA, 25 bp, Homo sapien
ctgactactcccagtcatagctgtc

SEQ ID NO: 135753 - DNA, 25 bp, Homo sapien
agttttgaatcctttgcctgcctgg

SEQ ID NO: 135754 - DNA, 25 bp, Homo sapien
tgaatcctttgcctgcctggtgtgc

SEQ ID NO: 135755 - DNA, 25 bp, Homo sapien
ggtgtgcctcagtatatttaaactc

SEQ ID NO: 135756 - DNA, 25 bp, Homo sapien
tttaaactcaagacaatgcacctag

SEQ ID NO: 135757 - DNA, 25 bp, Homo sapien
aatgcacctagctgtgcaagaccta

SEQ ID NO: 135758 - DNA, 25 bp, Homo sapien
gcaagacctagtgctcttaagccta

SEQ ID NO: 135759 - DNA, 25 bp, Homo sapien
gtgctcttaagcctaaatgccttag

SEQ ID NO: 135760 - DNA, 25 bp, Homo sapien
tttccctctttcttataatactctg

SEQ ID NO: 135761 - DNA, 25 bp, Homo sapien
taatactctgttgtactatggaaaa

SEQ ID NO: 135762 - DNA, 25 bp, Homo sapien
actatggaaaatcagctgctcagca

SEQ ID NO: 135763 - DNA, 25 bp, Homo sapien
tcagcaacctttcacctttgtgtat

SEQ ID NO: 135764 - DNA, 25 bp, Homo sapien
gcagctgctacacaattaggactga

SEQ ID NO: 135765 - DNA, 25 bp, Homo sapien
gaaggagatgccgagccactgcttg

SEQ ID NO: 135766 - DNA, 25 bp, Homo sapien
cactgcttggtccatctacacaaga

SEQ ID NO: 135767 - DNA, 25 bp, Homo sapien
tgcattccccagtatacactaggtc

SEQ ID NO: 135768 - DNA, 25 bp, Homo sapien
gtatacactaggtcactggcaaaaa

SEQ ID NO: 135769 - DNA, 25 bp, Homo sapien
actagagtcagctaggcaattcctg

SEQ ID NO: 135770 - DNA, 25 bp, Homo sapien
aggcaattcctgactgctcacaggt

SEQ ID NO: 135771 - DNA, 25 bp, Homo sapien
gagcctcctatgagggagttgctgt

SEQ ID NO: 135772 - DNA, 25 bp, Homo sapien
atgactgtatagagagtgggcgcca

SEQ ID NO: 135773 - DNA, 25 bp, Homo sapien
gtcctgggcacagaacctaacagct

SEQ ID NO: 135774 - DNA, 25 bp, Homo sapien
agaacctaacagctgatccccaact

SEQ ID NO: 135775 - DNA, 25 bp, Homo sapien
gccagatttctagcaaataggttca

SEQ ID NO: 135776 - DNA, 25 bp, Homo sapien
gttcagtgttaccataagcctttgc

SEQ ID NO: 135777 - DNA, 25 bp, Homo sapien
accataagcctttgctgtacttctt

SEQ ID NO: 135778 - DNA, 25 bp, Homo sapien
gagagcattggaaaatccccttccc

SEQ ID NO: 135779 - DNA, 25 bp, Homo sapien
gagggagcagcttggattcttctca

SEQ ID NO: 135780 - DNA, 25 bp, Homo sapien
agcttggattcttctcagttgtccc

SEQ ID NO: 135781 - DNA, 25 bp, Homo sapien
ggagatacactaacccccagaaatg

SEQ ID NO: 135782 - DNA, 25 bp, Homo sapien
gaaatgactgctaagcctcttgcct

SEQ ID NO: 135783 - DNA, 25 bp, Homo sapien
ctcttgccttgtctttagtagctaa

SEQ ID NO: 135784 - DNA, 25 bp, Homo sapien
aactaccatggtcccaggattccat

SEQ ID NO: 135785 - DNA, 25 bp, Homo sapien
ggtcccaggattccatcctgaaatt

SEQ ID NO: 135786 - DNA, 25 bp, Homo sapien
attcttcagatatactggaaccctt

SEQ ID NO: 135787 - DNA, 25 bp, Homo sapien
cagatatactggaacccttttaaag

SEQ ID NO: 135788 - DNA, 25 bp, Homo sapien
ataagatgactgtgttgtaccaaaa

SEQ ID NO: 135789 - DNA, 25 bp, Homo sapien
gtgttgtaccaaaattcatctgtct

SEQ ID NO: 135790 - DNA, 25 bp, Homo sapien
gtaccaaaattcatctgtctatatt

SEQ ID NO: 135791 - DNA, 25 bp, Homo sapien
gggaacatggtttgactcatcttat

SEQ ID NO: 135792 - DNA, 25 bp, Homo sapien
atggtttgactcatcttatatggga

SEQ ID NO: 135793 - DNA, 25 bp, Homo sapien
gactcatcttatatgggaaaccatg

SEQ ID NO: 135794 - DNA, 25 bp, Homo sapien
ggaaaccatgtagcagtgagtcata

SEQ ID NO: 135795 - DNA, 25 bp, Homo sapien
gtagcagtgagtcatatcttaatat

SEQ ID NO: 135796 - DNA, 25 bp, Homo sapien
tgcactgtttaatcatagttactgt

SEQ ID NO: 135797 - DNA, 25 bp, Homo sapien
ggctggcaagccgaagactatcaca

SEQ ID NO: 135798 - DNA, 25 bp, Homo sapien
actatcacagggttccagacgcata

SEQ ID NO: 135799 - DNA, 25 bp, Homo sapien
agacgcatacaaccccagtgttgtt

SEQ ID NO: 135800 - DNA, 25 bp, Homo sapien
aattggccactgaggagtttcttcc

SEQ ID NO: 135801 - DNA, 25 bp, Homo sapien
cccattctggaaggttttgttatct

SEQ ID NO: 135802 - DNA, 25 bp, Homo sapien
tcttcggaagaaccccaattatgat

SEQ ID NO: 135803 - DNA, 25 bp, Homo sapien
ttatgatctctaagtgaccaccagg

SEQ ID NO: 135804 - DNA, 25 bp, Homo sapien
gggctctgaactgtagctgatgtta

SEQ ID NO: 135805 - DNA, 25 bp, Homo sapien
atgttatcagcaggccatgcatcct

SEQ ID NO: 135806 - DNA, 25 bp, Homo sapien
ccaagggtggacacggctgcagact

SEQ ID NO: 135807 - DNA, 25 bp, Homo sapien
tcctgctcttttgttactgagtgag

SEQ ID NO: 135808 - DNA, 25 bp, Homo sapien
tggcccatctattacatctacagct

SEQ ID NO: 135809 - DNA, 25 bp, Homo sapien
gcccatctattacatctacagctga

SEQ ID NO: 135810 - DNA, 25 bp, Homo sapien
tctattacatctacagctgaccctt

SEQ ID NO: 135811 - DNA, 25 bp, Homo sapien
ggagctgacaattcgtgggtccgca

SEQ ID NO: 135812 - DNA, 25 bp, Homo sapien
ctgacaattcgtgggtccgcaaaat

SEQ ID NO: 135813 - DNA, 25 bp, Homo sapien
caattcgtgggtccgcaaaatctta

SEQ ID NO: 135814 - DNA, 25 bp, Homo sapien
tcgtgggtccgcaaaatcttaacta

SEQ ID NO: 135815 - DNA, 25 bp, Homo sapien
gtccgcaaaatcttaactacctaat

SEQ ID NO: 135816 - DNA, 25 bp, Homo sapien
gcaaaatcttaactacctaatagcc

SEQ ID NO: 135817 - DNA, 25 bp, Homo sapien
tgaccataaaccttactgataacat

SEQ ID NO: 135818 - DNA, 25 bp, Homo sapien
atacactatattcctacaataaagt

SEQ ID NO: 135819 - DNA, 25 bp, Homo sapien
acctccacttgcctcttattgtctt

SEQ ID NO: 135820 - DNA, 25 bp, Homo sapien
tattttgtgacctaaggacgatggt

SEQ ID NO: 135821 - DNA, 25 bp, Homo sapien
acgatggtgaaaagatcacgttttc

SEQ ID NO: 135822 - DNA, 25 bp, Homo sapien
gttttcaaaacaatctggtgatcag

SEQ ID NO: 135823 - DNA, 25 bp, Homo sapien
cagaatgttcatataccagctggtt

SEQ ID NO: 135824 - DNA, 25 bp, Homo sapien
ctgaagaggtcagaatgatctttct

SEQ ID NO: 135825 - DNA, 25 bp, Homo sapien
gatctttctccatactgacttttaa

SEQ ID NO: 135826 - DNA, 25 bp, Homo sapien
atactgacttttaacaatgttgatc

SEQ ID NO: 135827 - DNA, 25 bp, Homo sapien
aatgttgatcattgaggctaaatta

SEQ ID NO: 135828 - DNA, 25 bp, Homo sapien
aaatattcctttttgatgacaccac

SEQ ID NO: 135829 - DNA, 25 bp, Homo sapien
gatgacaccacaaaattgttgaaca

SEQ ID NO: 135830 - DNA, 25 bp, Homo sapien
tctcccgctaggagagtcctcttct

SEQ ID NO: 135831 - DNA, 25 bp, Homo sapien
tcccgctaggagagtcctcttctaa

SEQ ID NO: 135832 - DNA, 25 bp, Homo sapien
cccgctaggagagtcctcttctaag

SEQ ID NO: 135833 - DNA, 25 bp, Homo sapien
ccgctaggagagtcctcttctaagc

SEQ ID NO: 135834 - DNA, 25 bp, Homo sapien
tctaagcaaagtgcccctgcaggcg

SEQ ID NO: 135835 - DNA, 25 bp, Homo sapien
ctaagcaaagtgcccctgcaggcgg

SEQ ID NO: 135836 - DNA, 25 bp, Homo sapien
aagcaaagtgcccctgcaggcgggt

SEQ ID NO: 135837 - DNA, 25 bp, Homo sapien
ctgcaggcgggttctgccgccagga

SEQ ID NO: 135838 - DNA, 25 bp, Homo sapien
tgcaggcgggttctgccgccaggac

SEQ ID NO: 135839 - DNA, 25 bp, Homo sapien
gcaggcgggttctgccgccaggact

SEQ ID NO: 135840 - DNA, 25 bp, Homo sapien
caggcgggttctgccgccaggactg

SEQ ID NO: 135841 - DNA, 25 bp, Homo sapien
ttccctttctaccattgatttaaat

SEQ ID NO: 135842 - DNA, 25 bp, Homo sapien
ggtaagagagactgcccatgtgttt

SEQ ID NO: 135843 - DNA, 25 bp, Homo sapien
gagagactgcccatgtgtttagaat

SEQ ID NO: 135844 - DNA, 25 bp, Homo sapien
actgcccatgtgtttagaatagaat

SEQ ID NO: 135845 - DNA, 25 bp, Homo sapien
aatgaaatgatcaacaggtggaatt

SEQ ID NO: 135846 - DNA, 25 bp, Homo sapien
ttcccttttatattttgatgattgt

SEQ ID NO: 135847 - DNA, 25 bp, Homo sapien
gattaagatatgttcttgctctttt

SEQ ID NO: 135848 - DNA, 25 bp, Homo sapien
taaattatgtttccctctgattttt

SEQ ID NO: 135849 - DNA, 25 bp, Homo sapien
ttttttcaccattgtatttactaag

SEQ ID NO: 135850 - DNA, 25 bp, Homo sapien
ttacatgaaatctggcactttaggg

SEQ ID NO: 135851 - DNA, 25 bp, Homo sapien
gcactttagggtgttctttttctca

SEQ ID NO: 135852 - DNA, 25 bp, Homo sapien
gggctgtatctctaatgaaccatgg

SEQ ID NO: 135853 - DNA, 25 bp, Homo sapien
atgaaccatggctgtcatcaggaaa

SEQ ID NO: 135854 - DNA, 25 bp, Homo sapien
ggttgggagatttctcaatccctga

SEQ ID NO: 135855 - DNA, 25 bp, Homo sapien
gagatttctcaatccctgaaaggga

SEQ ID NO: 135856 - DNA, 25 bp, Homo sapien
ggagttgcccagaggaatccctgtt

SEQ ID NO: 135857 - DNA, 25 bp, Homo sapien
aatccctgttcccactgatttttat

SEQ ID NO: 135858 - DNA, 25 bp, Homo sapien
gttcccactgatttttattagcaaa

SEQ ID NO: 135859 - DNA, 25 bp, Homo sapien
tattagcaaaacatcctgtgtcttt

SEQ ID NO: 135860 - DNA, 25 bp, Homo sapien
cctgtgtcttttggagtacgatgtg

SEQ ID NO: 135861 - DNA, 25 bp, Homo sapien
gagtacgatgtgtaagtgcccattg

SEQ ID NO: 135862 - DNA, 25 bp, Homo sapien
tgtaagtgcccattgggtggcctgt

SEQ ID NO: 135863 - DNA, 25 bp, Homo sapien
tgcaccatggccaggtacagatgct

SEQ ID NO: 135864 - DNA, 25 bp, Homo sapien
gtacagatgctgtcgcagccagagc

SEQ ID NO: 135865 - DNA, 25 bp, Homo sapien
cagccagagccggagcagatattac

SEQ ID NO: 135866 - DNA, 25 bp, Homo sapien
gatattaccgccagagacaaagaag

SEQ ID NO: 135867 - DNA, 25 bp, Homo sapien
tgccagacacggaggagagccatga

SEQ ID NO: 135868 - DNA, 25 bp, Homo sapien
cgccccaggtacagaccgagatgta

SEQ ID NO: 135869 - DNA, 25 bp, Homo sapien
aaaatagcacatccaccaaactcct

SEQ ID NO: 135870 - DNA, 25 bp, Homo sapien
ctcctgcctgagaatgttaccagac

SEQ ID NO: 135871 - DNA, 25 bp, Homo sapien
gttaccagacttcaagatcctcttg

SEQ ID NO: 135872 - DNA, 25 bp, Homo sapien
atcctcttgccacatcttgaaaatg

SEQ ID NO: 135873 - DNA, 25 bp, Homo sapien
gaaaatgccaccatccaataaaaat

SEQ ID NO: 135874 - DNA, 25 bp, Homo sapien
gtcttcgtgcactccccgtgcggta

SEQ ID NO: 135875 - DNA, 25 bp, Homo sapien
gtacaggggcacttcgtaacccagg

SEQ ID NO: 135876 - DNA, 25 bp, Homo sapien
gggcatatttgcaagcgcgctcggt

SEQ ID NO: 135877 - DNA, 25 bp, Homo sapien
gcaggctcgcattgcacccagggag

SEQ ID NO: 135878 - DNA, 25 bp, Homo sapien
actctcctgaccgtgagggcactgg

SEQ ID NO: 135879 - DNA, 25 bp, Homo sapien
gtgagggcactggtcagttccgccc

SEQ ID NO: 135880 - DNA, 25 bp, Homo sapien
gggaaattcggacccaggagcccag

SEQ ID NO: 135881 - DNA, 25 bp, Homo sapien
agccccggctgtgccatcttgtgta

SEQ ID NO: 135882 - DNA, 25 bp, Homo sapien
gtgccatcttgtgtatgggcagata

SEQ ID NO: 135883 - DNA, 25 bp, Homo sapien
tatgggcagatatgacctgacagcc

SEQ ID NO: 135884 - DNA, 25 bp, Homo sapien
tgccacagggtacgcacacgcagag

SEQ ID NO: 135885 - DNA, 25 bp, Homo sapien
gatgtgtatgagaacctgcacacta

SEQ ID NO: 135886 - DNA, 25 bp, Homo sapien
gagaacctgcacactaagaacaaga

SEQ ID NO: 135887 - DNA, 25 bp, Homo sapien
gaagaagcagcggtcagcagacaag

SEQ ID NO: 135888 - DNA, 25 bp, Homo sapien
aagagcaagggttccctcaagagga

SEQ ID NO: 135889 - DNA, 25 bp, Homo sapien
atgcctcagccctgaccctgtggaa

SEQ ID NO: 135890 - DNA, 25 bp, Homo sapien
gaccctgtggaagcatttcgcgatg

SEQ ID NO: 135891 - DNA, 25 bp, Homo sapien
gcatttcgcgatggacagactcaca

SEQ ID NO: 135892 - DNA, 25 bp, Homo sapien
gcgatggacagactcacaacctgaa

SEQ ID NO: 135893 - DNA, 25 bp, Homo sapien
aacctgaacctaggagtgccccatt

SEQ ID NO: 135894 - DNA, 25 bp, Homo sapien
aggagtgccccattcttttgtaatt

SEQ ID NO: 135895 - DNA, 25 bp, Homo sapien
tgaccctgtatatagcccagccagg

SEQ ID NO: 135896 - DNA, 25 bp, Homo sapien
ttacctttgaatgtgtttgcagagc

SEQ ID NO: 135897 - DNA, 25 bp, Homo sapien
agctagtggatgtgtttgtctacaa

SEQ ID NO: 135898 - DNA, 25 bp, Homo sapien
gtctacaagtatgattgctgttaca

SEQ ID NO: 135899 - DNA, 25 bp, Homo sapien
gattgctgttacataacaccccaaa

SEQ ID NO: 135900 - DNA, 25 bp, Homo sapien
acagttgtgctgtcaatacctcata

SEQ ID NO: 135901 - DNA, 25 bp, Homo sapien
tgctgtcaatacctcatactgcttt

SEQ ID NO: 135902 - DNA, 25 bp, Homo sapien
tacctcatactgctttacctttttt

SEQ ID NO: 135903 - DNA, 25 bp, Homo sapien
tttcctggatatctgtgtattttca

SEQ ID NO: 135904 - DNA, 25 bp, Homo sapien
atttgacatattttacagggtggag

SEQ ID NO: 135905 - DNA, 25 bp, Homo sapien
cagggtggagtgtactatatactat

SEQ ID NO: 135906 - DNA, 25 bp, Homo sapien
gtgtactatatactattacctttga

SEQ ID NO: 135907 - DNA, 25 bp, Homo sapien
tgtataatagcctttttctcccgtt

SEQ ID NO: 135908 - DNA, 25 bp, Homo sapien
taatagcctttttctcccgtttcat

SEQ ID NO: 135909 - DNA, 25 bp, Homo sapien
tctcttcctcaacaaaaacagaaat

SEQ ID NO: 135910 - DNA, 25 bp, Homo sapien
aattacttggttgacttaaaatcat

SEQ ID NO: 135911 - DNA, 25 bp, Homo sapien
caatagcttttacagaagctttact

SEQ ID NO: 135912 - DNA, 25 bp, Homo sapien
tacagaagctttacttttccacttt

SEQ ID NO: 135913 - DNA, 25 bp, Homo sapien
aaaataattattctcagaagccaca

SEQ ID NO: 135914 - DNA, 25 bp, Homo sapien
aacgggtgaaaacaagtctgaatca

SEQ ID NO: 135915 - DNA, 25 bp, Homo sapien
caagtctgaatcagagtttattttc

SEQ ID NO: 135916 - DNA, 25 bp, Homo sapien
attttctatttctaaggaacatctt

SEQ ID NO: 135917 - DNA, 25 bp, Homo sapien
aaggaacatcttgagtgcagataag

SEQ ID NO: 135918 - DNA, 25 bp, Homo sapien
cttaaagtcttagccaagagccaag

SEQ ID NO: 135919 - DNA, 25 bp, Homo sapien
gccaagagccaagacatagccctgt

SEQ ID NO: 135920 - DNA, 25 bp, Homo sapien
gagccaagacatagccctgtgacaa

SEQ ID NO: 135921 - DNA, 25 bp, Homo sapien
tagccctgtgacaaggtgaacagtt

SEQ ID NO: 135922 - DNA, 25 bp, Homo sapien
aggacttgtgcagccgggcctgcct

SEQ ID NO: 135923 - DNA, 25 bp, Homo sapien
gaagctcttgcttctcagtccatgc

SEQ ID NO: 135924 - DNA, 25 bp, Homo sapien
agtccatgctccgtgtccagaagta

SEQ ID NO: 135925 - DNA, 25 bp, Homo sapien
ctccgtgtccagaagtaagccagct

SEQ ID NO: 135926 - DNA, 25 bp, Homo sapien
gtccagaagtaagccagctgtggat

SEQ ID NO: 135927 - DNA, 25 bp, Homo sapien
gtggatcccgcccactcagaaaagg

SEQ ID NO: 135928 - DNA, 25 bp, Homo sapien
ggcgagaaggctttgtgattttcta

SEQ ID NO: 135929 - DNA, 25 bp, Homo sapien
aagaacttcagacgtggatcaacct

SEQ ID NO: 135930 - DNA, 25 bp, Homo sapien
agtttcctcctcgtgaagtacatgg

SEQ ID NO: 135931 - DNA, 25 bp, Homo sapien
aatcagcatgatgcctgggtcctca

SEQ ID NO: 135932 - DNA, 25 bp, Homo sapien
gggtcctcagaaacattaccagctg

SEQ ID NO: 135933 - DNA, 25 bp, Homo sapien
ttaaccacaacctctgggcagtcaa

SEQ ID NO: 135934 - DNA, 25 bp, Homo sapien
gatgttgcttcatcaagactgcaga

SEQ ID NO: 135935 - DNA, 25 bp, Homo sapien
aggttagacaactccactgttcgca

SEQ ID NO: 135936 - DNA, 25 bp, Homo sapien
gttcgcacatactcatgttgaccag

SEQ ID NO: 135937 - DNA, 25 bp, Homo sapien
actgacctgctatggcgtcttttca

SEQ ID NO: 135938 - DNA, 25 bp, Homo sapien
gtcttttcagtctactctacctaaa

SEQ ID NO: 135939 - DNA, 25 bp, Homo sapien
aagtgcactaccatctaagaagacg

SEQ ID NO: 135940 - DNA, 25 bp, Homo sapien
cacaagctttgcgttctgactataa

SEQ ID NO: 135941 - DNA, 25 bp, Homo sapien
caatgccagattcctgttttgcgca

SEQ ID NO: 135942 - DNA, 25 bp, Homo sapien
gttttgcgcattgtcatgggattct

SEQ ID NO: 135943 - DNA, 25 bp, Homo sapien
tgggattcttaagtgaacctttcta

SEQ ID NO: 135944 - DNA, 25 bp, Homo sapien
tggtcttgttcacatgctccacgta

SEQ ID NO: 135945 - DNA, 25 bp, Homo sapien
atgctccacgtagctgtaacttcac

SEQ ID NO: 135946 - DNA, 25 bp, Homo sapien
gtaacttcacatcatcagcttgcag

SEQ ID NO: 135947 - DNA, 25 bp, Homo sapien
cagcttgcagtttgtaattgactaa

SEQ ID NO: 135948 - DNA, 25 bp, Homo sapien
attgactaaagcattccagtgtcct

SEQ ID NO: 135949 - DNA, 25 bp, Homo sapien
cagtgtcctctttctagattgccag

SEQ ID NO: 135950 - DNA, 25 bp, Homo sapien
ttctagattgccagctcatgacatg

SEQ ID NO: 135951 - DNA, 25 bp, Homo sapien
tggccgtgcgccttgcctcctggaa

SEQ ID NO: 135952 - DNA, 25 bp, Homo sapien
tgcgccttgcctcctggaaccagat

SEQ ID NO: 135953 - DNA, 25 bp, Homo sapien
tggacccttgggtgtacatcctact

SEQ ID NO: 135954 - DNA, 25 bp, Homo sapien
gacccttgggtgtacatcctactgc

SEQ ID NO: 135955 - DNA, 25 bp, Homo sapien
ttgggtgtacatcctactgcgccag

SEQ ID NO: 135956 - DNA, 25 bp, Homo sapien
tgtacatcctactgcgccaggccgt

SEQ ID NO: 135957 - DNA, 25 bp, Homo sapien
gggctgggcctaacaccgagcgcct

SEQ ID NO: 135958 - DNA, 25 bp, Homo sapien
tcagccacttctaagcacaaccaga

SEQ ID NO: 135959 - DNA, 25 bp, Homo sapien
agccacttctaagcacaaccagagg

SEQ ID NO: 135960 - DNA, 25 bp, Homo sapien
acttctaagcacaaccagaggccca

SEQ ID NO: 135961 - DNA, 25 bp, Homo sapien
ctaagcacaaccagaggcccaacga

SEQ ID NO: 135962 - DNA, 25 bp, Homo sapien
ggatttaattgtgtatcctcattac

SEQ ID NO: 135963 - DNA, 25 bp, Homo sapien
ttaattgtgtatcctcattactgta

SEQ ID NO: 135964 - DNA, 25 bp, Homo sapien
tgtgtatcctcattactgtatcatt

SEQ ID NO: 135965 - DNA, 25 bp, Homo sapien
gtgtatcctcattactgtatcattt

SEQ ID NO: 135966 - DNA, 25 bp, Homo sapien
gtatcctcattactgtatcatttgt

SEQ ID NO: 135967 - DNA, 25 bp, Homo sapien
actgtggcttgtagcattcctcctc

SEQ ID NO: 135968 - DNA, 25 bp, Homo sapien
tgtggcttgtagcattcctcctctt

SEQ ID NO: 135969 - DNA, 25 bp, Homo sapien
tggactgctccccttcatctcttac

SEQ ID NO: 135970 - DNA, 25 bp, Homo sapien
tccacccggtcttggtggtggtata

SEQ ID NO: 135971 - DNA, 25 bp, Homo sapien
atgaaagcacacaaaatgagtcagt

SEQ ID NO: 135972 - DNA, 25 bp, Homo sapien
aaatgttttagtaacagttggctgt

SEQ ID NO: 135973 - DNA, 25 bp, Homo sapien
gataactcaggagaatcttctttac

SEQ ID NO: 135974 - DNA, 25 bp, Homo sapien
aactcaggagaatcttctttacaat

SEQ ID NO: 135975 - DNA, 25 bp, Homo sapien
caggagaatcttctttacaatttta

SEQ ID NO: 135976 - DNA, 25 bp, Homo sapien
tctttacaattttacgtttagaatg

SEQ ID NO: 135977 - DNA, 25 bp, Homo sapien
ttgttattaacattgatctgctgac

SEQ ID NO: 135978 - DNA, 25 bp, Homo sapien
attgatctgctgacaaaacctggga

SEQ ID NO: 135979 - DNA, 25 bp, Homo sapien
gaatgtttcagtgcctcagacaaat

SEQ ID NO: 135980 - DNA, 25 bp, Homo sapien
atgtttcagtgcctcagacaaatgt

SEQ ID NO: 135981 - DNA, 25 bp, Homo sapien
gtttcagtgcctcagacaaatgtgt

SEQ ID NO: 135982 - DNA, 25 bp, Homo sapien
ttcagtgcctcagacaaatgtgtat

SEQ ID NO: 135983 - DNA, 25 bp, Homo sapien
gtgcctcagacaaatgtgtatttaa

SEQ ID NO: 135984 - DNA, 25 bp, Homo sapien
ttggaataagatttgtaagctcaca

SEQ ID NO: 135985 - DNA, 25 bp, Homo sapien
ttgtaagctcacaaagccttcttcc

SEQ ID NO: 135986 - DNA, 25 bp, Homo sapien
ctcacaaagccttcttccaaagttg

SEQ ID NO: 135987 - DNA, 25 bp, Homo sapien
ccttcttccaaagttgcttgagcca

SEQ ID NO: 135988 - DNA, 25 bp, Homo sapien
aaagttgcttgagccaagtgcttaa

SEQ ID NO: 135989 - DNA, 25 bp, Homo sapien
gcttgagccaagtgcttaaaaagtt

SEQ ID NO: 135990 - DNA, 25 bp, Homo sapien
gatacctgcaattgaaaagccgaaa

SEQ ID NO: 135991 - DNA, 25 bp, Homo sapien
aaagccgaaaagattatactgtcaa

SEQ ID NO: 135992 - DNA, 25 bp, Homo sapien
atactgtcaagtccagtaaatgaca

SEQ ID NO: 135993 - DNA, 25 bp, Homo sapien
ttttagagatgcttttgtagacaag

SEQ ID NO: 135994 - DNA, 25 bp, Homo sapien
taaaactttgtgttttggcaatcgt

SEQ ID NO: 135995 - DNA, 25 bp, Homo sapien
cttcttttcctattgaccagtacag

SEQ ID NO: 135996 - DNA, 25 bp, Homo sapien
gaccagtacagatagatatgttgtg

SEQ ID NO: 135997 - DNA, 25 bp, Homo sapien
gatgacttcaagattgatgatgtga

SEQ ID NO: 135998 - DNA, 25 bp, Homo sapien
ttgatgatgtgatccaataactgtg

SEQ ID NO: 135999 - DNA, 25 bp, Homo sapien
ccaataactgtggaggtagctttaa

SEQ ID NO: 136000 - DNA, 25 bp, Homo sapien
gtggaggtagctttaacttggttct

SEQ ID NO: 136001 - DNA, 25 bp, Homo sapien
gtagctttaacttggttctgtgtaa

SEQ ID NO: 136002 - DNA, 25 bp, Homo sapien
cttggttctgtgtaaatagtatgta

SEQ ID NO: 136003 - DNA, 25 bp, Homo sapien
atttctcattttaagatgcttggtt

SEQ ID NO: 136004 - DNA, 25 bp, Homo sapien
gatgcttggtttacattaaattatg

SEQ ID NO: 136005 - DNA, 25 bp, Homo sapien
tttatgtttatactaggtagggtct

SEQ ID NO: 136006 - DNA, 25 bp, Homo sapien
agcacactgcttagtattcttgagg

SEQ ID NO: 136007 - DNA, 25 bp, Homo sapien
ctgcttagtattcttgagggacaat

SEQ ID NO: 136008 - DNA, 25 bp, Homo sapien
ggacaatgccaataggtatatcctc

SEQ ID NO: 136009 - DNA, 25 bp, Homo sapien
ggaaaaggctttcatgatttggcat

SEQ ID NO: 136010 - DNA, 25 bp, Homo sapien
atgatttggcatgggacagacggaa

SEQ ID NO: 136011 - DNA, 25 bp, Homo sapien
gtcaaaattgtttaccatagaaaga

SEQ ID NO: 136012 - DNA, 25 bp, Homo sapien
ttccacataggaaaatgccatgaaa

SEQ ID NO: 136013 - DNA, 25 bp, Homo sapien
actgcataacctttacactcctcgt

SEQ ID NO: 136014 - DNA, 25 bp, Homo sapien
tacactcctcgtccattttattagg

SEQ ID NO: 136015 - DNA, 25 bp, Homo sapien
ttaggattacccaaatataaccatt

SEQ ID NO: 136016 - DNA, 25 bp, Homo sapien
aagaatgcattccagaacaaattgt

SEQ ID NO: 136017 - DNA, 25 bp, Homo sapien
gatttttagtgtcaagtatggcggc

SEQ ID NO: 136018 - DNA, 25 bp, Homo sapien
atttttagtgtcaagtatggcggct

SEQ ID NO: 136019 - DNA, 25 bp, Homo sapien
tttttagtgtcaagtatggcggctc

SEQ ID NO: 136020 - DNA, 25 bp, Homo sapien
ttttagtgtcaagtatggcggctct

SEQ ID NO: 136021 - DNA, 25 bp, Homo sapien
tttagtgtcaagtatggcggctctt

SEQ ID NO: 136022 - DNA, 25 bp, Homo sapien
ttagtgtcaagtatggcggctcttt

SEQ ID NO: 136023 - DNA, 25 bp, Homo sapien
tagtgtcaagtatggcggctctttc

SEQ ID NO: 136024 - DNA, 25 bp, Homo sapien
agtgtcaagtatggcggctctttca

SEQ ID NO: 136025 - DNA, 25 bp, Homo sapien
caagtatggcggctctttcacccct

SEQ ID NO: 136026 - DNA, 25 bp, Homo sapien
aagtatggcggctctttcacccctc

SEQ ID NO: 136027 - DNA, 25 bp, Homo sapien
acccctccattgagagcccttgtta

SEQ ID NO: 136028 - DNA, 25 bp, Homo sapien
ttcctgagttcatgttccgcgtgcc

SEQ ID NO: 136029 - DNA, 25 bp, Homo sapien
tgagttcatgttccgcgtgcctgaa

SEQ ID NO: 136030 - DNA, 25 bp, Homo sapien
tccgcgtgcctgaactgaatatgtc

SEQ ID NO: 136031 - DNA, 25 bp, Homo sapien
gaactgaatatgtcaccttgctccc

SEQ ID NO: 136032 - DNA, 25 bp, Homo sapien
tgaatatgtcaccttgctcccaaga

SEQ ID NO: 136033 - DNA, 25 bp, Homo sapien
atgtcaccttgctcccaagacacgg

SEQ ID NO: 136034 - DNA, 25 bp, Homo sapien
gggttcgtgggcacagggcttctgg

SEQ ID NO: 136035 - DNA, 25 bp, Homo sapien
gggactccccgcgtgataaattatt

SEQ ID NO: 136036 - DNA, 25 bp, Homo sapien
actccccgcgtgataaattattaat

SEQ ID NO: 136037 - DNA, 25 bp, Homo sapien
aattattaatgttccgcagtctcac

SEQ ID NO: 136038 - DNA, 25 bp, Homo sapien
atgttccgcagtctcactctgaata

SEQ ID NO: 136039 - DNA, 25 bp, Homo sapien
gatggccttaagagaacgtagaatg

SEQ ID NO: 136040 - DNA, 25 bp, Homo sapien
atggccttaagagaacgtagaatga

SEQ ID NO: 136041 - DNA, 25 bp, Homo sapien
gccttaagagaacgtagaatgaaag

SEQ ID NO: 136042 - DNA, 25 bp, Homo sapien
ccttaagagaacgtagaatgaaagt

SEQ ID NO: 136043 - DNA, 25 bp, Homo sapien
taagagaacgtagaatgaaagtaac

SEQ ID NO: 136044 - DNA, 25 bp, Homo sapien
aagagaacgtagaatgaaagtaaca

SEQ ID NO: 136045 - DNA, 25 bp, Homo sapien
agagaacgtagaatgaaagtaacaa

SEQ ID NO: 136046 - DNA, 25 bp, Homo sapien
gagaacgtagaatgaaagtaacaaa

SEQ ID NO: 136047 - DNA, 25 bp, Homo sapien
agaacgtagaatgaaagtaacaaat

SEQ ID NO: 136048 - DNA, 25 bp, Homo sapien
gaacgtagaatgaaagtaacaaatg

SEQ ID NO: 136049 - DNA, 25 bp, Homo sapien
aacgtagaatgaaagtaacaaatga

SEQ ID NO: 136050 - DNA, 25 bp, Homo sapien
catttagttgtttcagctccaggga

SEQ ID NO: 136051 - DNA, 25 bp, Homo sapien
aacctggttagggaagctgagcgcc

SEQ ID NO: 136052 - DNA, 25 bp, Homo sapien
aagctgagcgcctgtggccctatta

SEQ ID NO: 136053 - DNA, 25 bp, Homo sapien
ccctattactatccagttggcctct

SEQ ID NO: 136054 - DNA, 25 bp, Homo sapien
ctctcccaaatcaacttcaagtctt

SEQ ID NO: 136055 - DNA, 25 bp, Homo sapien
tagagaatcgtatttttctttcaga

SEQ ID NO: 136056 - DNA, 25 bp, Homo sapien
ttctttcagaaattgctatgcctac

SEQ ID NO: 136057 - DNA, 25 bp, Homo sapien
attgctatgcctacagccattgaaa

SEQ ID NO: 136058 - DNA, 25 bp, Homo sapien
gttgttacatcttccaaggatgtca

SEQ ID NO: 136059 - DNA, 25 bp, Homo sapien
agattagaaaatagcatcccacctc

SEQ ID NO: 136060 - DNA, 25 bp, Homo sapien
gcatcccacctctgggtatctgagt

SEQ ID NO: 136061 - DNA, 25 bp, Homo sapien
ttaccagagtaagttgccaaaatgt

SEQ ID NO: 136062 - DNA, 25 bp, Homo sapien
aacaaaaggacaaccacagagggat

SEQ ID NO: 136063 - DNA, 25 bp, Homo sapien
gaatatcgtatcattgtaatcaaag

SEQ ID NO: 136064 - DNA, 25 bp, Homo sapien
taaggaggtaagattgccacgtgcc

SEQ ID NO: 136065 - DNA, 25 bp, Homo sapien
taagattgccacgtgcctgctggta

SEQ ID NO: 136066 - DNA, 25 bp, Homo sapien
acgtgcctgctggtactgtgatgca

SEQ ID NO: 136067 - DNA, 25 bp, Homo sapien
tactgtgatgcatttcaagtggcag

SEQ ID NO: 136068 - DNA, 25 bp, Homo sapien
ggcagttttatcacgtttgaatcta

SEQ ID NO: 136069 - DNA, 25 bp, Homo sapien
gaatctaccattcatagccagatgt

SEQ ID NO: 136070 - DNA, 25 bp, Homo sapien
agccagatgtgtatcagatgtttca

SEQ ID NO: 136071 - DNA, 25 bp, Homo sapien
gatgtttcactgacagtttttaaca

SEQ ID NO: 136072 - DNA, 25 bp, Homo sapien
ccaacgctgggcctgacaccaatgg

SEQ ID NO: 136073 - DNA, 25 bp, Homo sapien
agttctttatcaccttgaccaagcc

SEQ ID NO: 136074 - DNA, 25 bp, Homo sapien
caagcccacctggttggacggcaaa

SEQ ID NO: 136075 - DNA, 25 bp, Homo sapien
agtggtgcactccatagagctccaa

SEQ ID NO: 136076 - DNA, 25 bp, Homo sapien
agagctccaagcaactgatgggcat

SEQ ID NO: 136077 - DNA, 25 bp, Homo sapien
aactgatgggcatgaccgtccactc

SEQ ID NO: 136078 - DNA, 25 bp, Homo sapien
tcaccaactgctcgatcatcaacag

SEQ ID NO: 136079 - DNA, 25 bp, Homo sapien
gctcgatcatcaacagtggcaagat

SEQ ID NO: 136080 - DNA, 25 bp, Homo sapien
agatagacgtgaaaacgccttttgt

SEQ ID NO: 136081 - DNA, 25 bp, Homo sapien
acgccttttgtggttgagatcgctg

SEQ ID NO: 136082 - DNA, 25 bp, Homo sapien
gagatcgctgattggtgacacaact

SEQ ID NO: 136083 - DNA, 25 bp, Homo sapien
aaatgagatctaccctgtctggtcg

SEQ ID NO: 136084 - DNA, 25 bp, Homo sapien
aagagtctcgcctttctgcttatta

SEQ ID NO: 136085 - DNA, 25 bp, Homo sapien
tgcttattataacctgctccactgc

SEQ ID NO: 136086 - DNA, 25 bp, Homo sapien
tgcctacgcagggattcacataaaa

SEQ ID NO: 136087 - DNA, 25 bp, Homo sapien
aatcgacaattatctcaagctcctg

SEQ ID NO: 136088 - DNA, 25 bp, Homo sapien
tcaagctcctgaagtgccgaatcat

SEQ ID NO: 136089 - DNA, 25 bp, Homo sapien
taagcccacatccatttcatctatt

SEQ ID NO: 136090 - DNA, 25 bp, Homo sapien
gaaggtccttaatgatccgttccat

SEQ ID NO: 136091 - DNA, 25 bp, Homo sapien
tccgttccattgcaagcttctttta

SEQ ID NO: 136092 - DNA, 25 bp, Homo sapien
gcttcttttagttgtatctcttttg

SEQ ID NO: 136093 - DNA, 25 bp, Homo sapien
atgcttgggtgtaacaggtctcctc

SEQ ID NO: 136094 - DNA, 25 bp, Homo sapien
ctggcattcaacatgtggaaagctt

SEQ ID NO: 136095 - DNA, 25 bp, Homo sapien
caacatgtggaaagcttgtcttaga

SEQ ID NO: 136096 - DNA, 25 bp, Homo sapien
gtgtagcttgctagtttgttttcta

SEQ ID NO: 136097 - DNA, 25 bp, Homo sapien
tagcttgctagtttgttttctacat

SEQ ID NO: 136098 - DNA, 25 bp, Homo sapien
agtttagaataagcgcattatccaa

SEQ ID NO: 136099 - DNA, 25 bp, Homo sapien
gcgcattatccaattatagaggtac

SEQ ID NO: 136100 - DNA, 25 bp, Homo sapien
gaggtacaattttccaaacttccag

SEQ ID NO: 136101 - DNA, 25 bp, Homo sapien
tgtcaaaactactgtgtctgatacc

SEQ ID NO: 136102 - DNA, 25 bp, Homo sapien
gtaatttttcaagtcagaagctgat

SEQ ID NO: 136103 - DNA, 25 bp, Homo sapien
gaagctgatgttcctggtaaaagtt

SEQ ID NO: 136104 - DNA, 25 bp, Homo sapien
atatcttctttgaatgctaagcatg

SEQ ID NO: 136105 - DNA, 25 bp, Homo sapien
ggttctttaaaatgccaagcaaggg

SEQ ID NO: 136106 - DNA, 25 bp, Homo sapien
gaaagctgctttcgaataaagtgaa

SEQ ID NO: 136107 - DNA, 25 bp, Homo sapien
aagtgaatacattttgcacaaagta

SEQ ID NO: 136108 - DNA, 25 bp, Homo sapien
cacaaagtaagcctcacctttgcct

SEQ ID NO: 136109 - DNA, 25 bp, Homo sapien
tttgccttccaactgccagaacatg

SEQ ID NO: 136110 - DNA, 25 bp, Homo sapien
caactgccagaacatggattccact

SEQ ID NO: 136111 - DNA, 25 bp, Homo sapien
aatgtgagtgacctcacttctggca

SEQ ID NO: 136112 - DNA, 25 bp, Homo sapien
agtgacctcacttctggcactgtga

SEQ ID NO: 136113 - DNA, 25 bp, Homo sapien
ggcactgtgactactatggctgttt

SEQ ID NO: 136114 - DNA, 25 bp, Homo sapien
gactactatggctgtttagaactac

SEQ ID NO: 136115 - DNA, 25 bp, Homo sapien
cgtattttgatgttttgtacttaca

SEQ ID NO: 136116 - DNA, 25 bp, Homo sapien
ggatctggattcctggttccctgaa

SEQ ID NO: 136117 - DNA, 25 bp, Homo sapien
ggatgatagcttggattccctaggt

SEQ ID NO: 136118 - DNA, 25 bp, Homo sapien
gatagcttggattccctaggtcttt

SEQ ID NO: 136119 - DNA, 25 bp, Homo sapien
agcttggattccctaggtctttcca

SEQ ID NO: 136120 - DNA, 25 bp, Homo sapien
tggattccctaggtctttccaggat

SEQ ID NO: 136121 - DNA, 25 bp, Homo sapien
attccctaggtctttccaggatgca

SEQ ID NO: 136122 - DNA, 25 bp, Homo sapien
cctggattctgaggcaggaaggaat

SEQ ID NO: 136123 - DNA, 25 bp, Homo sapien
aatttgggtctggagttctggctac

SEQ ID NO: 136124 - DNA, 25 bp, Homo sapien
tgggtctggagttctggctacttga

SEQ ID NO: 136125 - DNA, 25 bp, Homo sapien
ggagttctggctacttgaggaccaa

SEQ ID NO: 136126 - DNA, 25 bp, Homo sapien
ttgaggaccaaaggcaggaaggatc

SEQ ID NO: 136127 - DNA, 25 bp, Homo sapien
acatttaacttaggaggctcctcca

SEQ ID NO: 136128 - DNA, 25 bp, Homo sapien
aatttgcctcaaacctcttacggag

SEQ ID NO: 136129 - DNA, 25 bp, Homo sapien
ggagcttctcctcagaagtggtacc

SEQ ID NO: 136130 - DNA, 25 bp, Homo sapien
aagtggtaccatcgccttccaaagt

SEQ ID NO: 136131 - DNA, 25 bp, Homo sapien
caaggatctcttggcgacagtacca

SEQ ID NO: 136132 - DNA, 25 bp, Homo sapien
tggcgacagtaccaagcacggttct

SEQ ID NO: 136133 - DNA, 25 bp, Homo sapien
gcacggttctctacacaggtgactg

SEQ ID NO: 136134 - DNA, 25 bp, Homo sapien
aggtgactgaagttgcctctgtgtt

SEQ ID NO: 136135 - DNA, 25 bp, Homo sapien
tctgtgttggctggcatccctgagt

SEQ ID NO: 136136 - DNA, 25 bp, Homo sapien
gaagaaaccttcacttgcagaaaac

SEQ ID NO: 136137 - DNA, 25 bp, Homo sapien
tagtaagggcctccagaattgactt

SEQ ID NO: 136138 - DNA, 25 bp, Homo sapien
agtgtcatctaaatattccgaatgt

SEQ ID NO: 136139 - DNA, 25 bp, Homo sapien
attccgaatgtttggccttctgaga

SEQ ID NO: 136140 - DNA, 25 bp, Homo sapien
tttggccttctgagaaaagagcttc

SEQ ID NO: 136141 - DNA, 25 bp, Homo sapien
aagagcttctagtaattgaaccatg

SEQ ID NO: 136142 - DNA, 25 bp, Homo sapien
gtaattgaaccatgggtttcccagc

SEQ ID NO: 136143 - DNA, 25 bp, Homo sapien
ctcaggattcctaacgattcaaatt

SEQ ID NO: 136144 - DNA, 25 bp, Homo sapien
acgattcaaattaccgttgagtata

SEQ ID NO: 136145 - DNA, 25 bp, Homo sapien
gaatcgagtctctgtatggaagaac

SEQ ID NO: 136146 - DNA, 25 bp, Homo sapien
aagaacaaatgtgtgcattcacccc

SEQ ID NO: 136147 - DNA, 25 bp, Homo sapien
gtcacaatggtctccattgcatttc

SEQ ID NO: 136148 - DNA, 25 bp, Homo sapien
ttcaaaggagaggatcagactatct

SEQ ID NO: 136149 - DNA, 25 bp, Homo sapien
ttgtataatagcctttttctcccgt

SEQ ID NO: 136150 - DNA, 25 bp, Homo sapien
tgtataatagcctttttctcccgtt

SEQ ID NO: 136151 - DNA, 25 bp, Homo sapien
taatagcctttttctcccgtttcat

SEQ ID NO: 136152 - DNA, 25 bp, Homo sapien
tctcttcctcaacaaaaacagaaat

SEQ ID NO: 136153 - DNA, 25 bp, Homo sapien
ttggttgacttaaaatcattttata

SEQ ID NO: 136154 - DNA, 25 bp, Homo sapien
caatagcttttacagaagctttact

SEQ ID NO: 136155 - DNA, 25 bp, Homo sapien
aaaataattattctcagaagccaca

SEQ ID NO: 136156 - DNA, 25 bp, Homo sapien
aacgggtgaaaacaagtctgaatca

SEQ ID NO: 136157 - DNA, 25 bp, Homo sapien
ggtgaaaacaagtctgaatcagagt

SEQ ID NO: 136158 - DNA, 25 bp, Homo sapien
caagtctgaatcagagtttattttc

SEQ ID NO: 136159 - DNA, 25 bp, Homo sapien
attttctatttctaaggaacatctt

SEQ ID NO: 136160 - DNA, 25 bp, Homo sapien
atgccttcctggtccctctgtgctt

SEQ ID NO: 136161 - DNA, 25 bp, Homo sapien
acgagtttctcagctctattcaggc

SEQ ID NO: 136162 - DNA, 25 bp, Homo sapien
gccaggtcttgctgttgtatcaagg

SEQ ID NO: 136163 - DNA, 25 bp, Homo sapien
ttgctgttgtatcaagggacacggt

SEQ ID NO: 136164 - DNA, 25 bp, Homo sapien
ttgtatcaagggacacggtgtggaa

SEQ ID NO: 136165 - DNA, 25 bp, Homo sapien
aaacttaactccagccctgaacagg

SEQ ID NO: 136166 - DNA, 25 bp, Homo sapien
tgaacaggcaccacttactaagaga

SEQ ID NO: 136167 - DNA, 25 bp, Homo sapien
ggcaccacttactaagagaggatga

SEQ ID NO: 136168 - DNA, 25 bp, Homo sapien
gaatgaaaagcacacctaccctttg

SEQ ID NO: 136169 - DNA, 25 bp, Homo sapien
taccctttggcgtaatcctgcctgg

SEQ ID NO: 136170 - DNA, 25 bp, Homo sapien
gagaggtttagtgccatgttcagtg

SEQ ID NO: 136171 - DNA, 25 bp, Homo sapien
gcggcgcggttttttatggtgacac

SEQ ID NO: 136172 - DNA, 25 bp, Homo sapien
tttgctaacagcaattccaggctca

SEQ ID NO: 136173 - DNA, 25 bp, Homo sapien
ccaggctcagtattgtgaccgcgga

SEQ ID NO: 136174 - DNA, 25 bp, Homo sapien
ttacccgatggcttgtgacgcggag

SEQ ID NO: 136175 - DNA, 25 bp, Homo sapien
gcttgtgacgcggagagaaccgatt

SEQ ID NO: 136176 - DNA, 25 bp, Homo sapien
tttgagaaactcctcccttgtctag

SEQ ID NO: 136177 - DNA, 25 bp, Homo sapien
tgtctagccctgtgttcgctgtgga

SEQ ID NO: 136178 - DNA, 25 bp, Homo sapien
ctgtgttcgctgtggacgctgtaga

SEQ ID NO: 136179 - DNA, 25 bp, Homo sapien
aggttggccagtctgtacctggact

SEQ ID NO: 136180 - DNA, 25 bp, Homo sapien
gtacctggacttcgaataaatcttc

SEQ ID NO: 136181 - DNA, 25 bp, Homo sapien
ataaatcttccgtatcctcgctccg

SEQ ID NO: 136182 - DNA, 25 bp, Homo sapien
ctcatctctttgttctaaagatgga

SEQ ID NO: 136183 - DNA, 25 bp, Homo sapien
gaatcaatcaattcatatctattta

SEQ ID NO: 136184 - DNA, 25 bp, Homo sapien
tctatttattaaatttctaccgctt

SEQ ID NO: 136185 - DNA, 25 bp, Homo sapien
aaatgtaagatcgttctctgcctca

SEQ ID NO: 136186 - DNA, 25 bp, Homo sapien
atgtaagatcgttctctgcctcaca

SEQ ID NO: 136187 - DNA, 25 bp, Homo sapien
taagatcgttctctgcctcacatag

SEQ ID NO: 136188 - DNA, 25 bp, Homo sapien
agatcgttctctgcctcacatagct

SEQ ID NO: 136189 - DNA, 25 bp, Homo sapien
tctctgcctcacatagcttacaagc

SEQ ID NO: 136190 - DNA, 25 bp, Homo sapien
tctgcctcacatagcttacaagcca

SEQ ID NO: 136191 - DNA, 25 bp, Homo sapien
gcctcacatagcttacaagccagct

SEQ ID NO: 136192 - DNA, 25 bp, Homo sapien
acatagcttacaagccagctggaga

SEQ ID NO: 136193 - DNA, 25 bp, Homo sapien
aatcaaggttcataggaaaagacat

SEQ ID NO: 136194 - DNA, 25 bp, Homo sapien
tgaggaaactccaaacctcctgtta

SEQ ID NO: 136195 - DNA, 25 bp, Homo sapien
tccaaacctcctgttagctgttatt

SEQ ID NO: 136196 - DNA, 25 bp, Homo sapien
aacctcctgttagctgttatttcta

SEQ ID NO: 136197 - DNA, 25 bp, Homo sapien
ctcctgttagctgttatttctattt

SEQ ID NO: 136198 - DNA, 25 bp, Homo sapien
gtggattaattaaatgcagcgaacc

SEQ ID NO: 136199 - DNA, 25 bp, Homo sapien
aatgcagcgaaccaatatttgtaga

SEQ ID NO: 136200 - DNA, 25 bp, Homo sapien
tttaagatagttttgccagaacagt

SEQ ID NO: 136201 - DNA, 25 bp, Homo sapien
gccagaacagtttgtacagacgtat

SEQ ID NO: 136202 - DNA, 25 bp, Homo sapien
gtttgtacagacgtatgcttatttt

SEQ ID NO: 136203 - DNA, 25 bp, Homo sapien
aaacaacttctttgtaatcgttatg

SEQ ID NO: 136204 - DNA, 25 bp, Homo sapien
ctattcagccatgtccctttataat

SEQ ID NO: 136205 - DNA, 25 bp, Homo sapien
gccatgtccctttataatagagtaa

SEQ ID NO: 136206 - DNA, 25 bp, Homo sapien
aaattcagcagaagacccggcttgc

SEQ ID NO: 136207 - DNA, 25 bp, Homo sapien
agaagacccggcttgctccagtgta

SEQ ID NO: 136208 - DNA, 25 bp, Homo sapien
gcttgctccagtgtagctttctaca

SEQ ID NO: 136209 - DNA, 25 bp, Homo sapien
aagacggattgagattaactgctgg

SEQ ID NO: 136210 - DNA, 25 bp, Homo sapien
aataccatacctcaggaggacaaga

SEQ ID NO: 136211 - DNA, 25 bp, Homo sapien
attgctccaaaatacaggtgattga

SEQ ID NO: 136212 - DNA, 25 bp, Homo sapien
ggtgattgacatctctatgatcctt

SEQ ID NO: 136213 - DNA, 25 bp, Homo sapien
actcacaatggagaatccgtttctt

SEQ ID NO: 136214 - DNA, 25 bp, Homo sapien
agaatccgtttcttacctattcagc

SEQ ID NO: 136215 - DNA, 25 bp, Homo sapien
tgtgataggagggatatttacatat

SEQ ID NO: 136216 - DNA, 25 bp, Homo sapien
atttacatattttagtggaccacat

SEQ ID NO: 136217 - DNA, 25 bp, Homo sapien
ttacatattttagtggaccacattt

SEQ ID NO: 136218 - DNA, 25 bp, Homo sapien
attttaagttggatggtgtgctcta

SEQ ID NO: 136219 - DNA, 25 bp, Homo sapien
ttaagttggatggtgtgctctaaaa

SEQ ID NO: 136220 - DNA, 25 bp, Homo sapien
aagttggatggtgtgctctaaaata

SEQ ID NO: 136221 - DNA, 25 bp, Homo sapien
ttggatggtgtgctctaaaatactg

SEQ ID NO: 136222 - DNA, 25 bp, Homo sapien
aatactgaaaaacaatagcccatat

SEQ ID NO: 136223 - DNA, 25 bp, Homo sapien
aaacaatagcccatatacctatgta

SEQ ID NO: 136224 - DNA, 25 bp, Homo sapien
aatagcccatatacctatgtatttg

SEQ ID NO: 136225 - DNA, 25 bp, Homo sapien
attttgtgtcatcctgtattgaaaa

SEQ ID NO: 136226 - DNA, 25 bp, Homo sapien
gagaagccaagctcttcaagcacct

SEQ ID NO: 136227 - DNA, 25 bp, Homo sapien
agccaagctcttcaagcacctctat

SEQ ID NO: 136228 - DNA, 25 bp, Homo sapien
tcttcaagcacctctatctctgtac

SEQ ID NO: 136229 - DNA, 25 bp, Homo sapien
cctctatctctgtactcctatatga

SEQ ID NO: 136230 - DNA, 25 bp, Homo sapien
ctatctctgtactcctatatgaaga

SEQ ID NO: 136231 - DNA, 25 bp, Homo sapien
ggcaacataattcactttccatctt

SEQ ID NO: 136232 - DNA, 25 bp, Homo sapien
tattttgccattaatccaatatgtt

SEQ ID NO: 136233 - DNA, 25 bp, Homo sapien
atatgtttccatcactttgccaaaa

SEQ ID NO: 136234 - DNA, 25 bp, Homo sapien
gtttccatcactttgccaaaaccta

SEQ ID NO: 136235 - DNA, 25 bp, Homo sapien
tgccaaaacctatttaaaacagtga

SEQ ID NO: 136236 - DNA, 25 bp, Homo sapien
ttttcactaggtttgaatgatcatg

SEQ ID NO: 136237 - DNA, 25 bp, Homo sapien
tccatctgtgtgcaactaactgact

SEQ ID NO: 136238 - DNA, 25 bp, Homo sapien
tctgtgtgcaactaactgactctgt

SEQ ID NO: 136239 - DNA, 25 bp, Homo sapien
gtgtgcaactaactgactctgttat

SEQ ID NO: 136240 - DNA, 25 bp, Homo sapien
actgactctgttattgatcccttct

SEQ ID NO: 136241 - DNA, 25 bp, Homo sapien
actctgttattgatcccttctcctg

SEQ ID NO: 136242 - DNA, 25 bp, Homo sapien
tcccaggtaatttaaattggtcatg

SEQ ID NO: 136243 - DNA, 25 bp, Homo sapien
taggttgttaccaagtatgaagtat

SEQ ID NO: 136244 - DNA, 25 bp, Homo sapien
aatctatattaaatgagggtttctg

SEQ ID NO: 136245 - DNA, 25 bp, Homo sapien
gggtttctgatctgtactttgtgtt

SEQ ID NO: 136246 - DNA, 25 bp, Homo sapien
gtttctgatctgtactttgtgttta

SEQ ID NO: 136247 - DNA, 25 bp, Homo sapien
tgtgtttagctacctttttatattt

SEQ ID NO: 136248 - DNA, 25 bp, Homo sapien
ttgttgtccattgcagtgctggaat

SEQ ID NO: 136249 - DNA, 25 bp, Homo sapien
cattgcagtgctggaatcggaagaa

SEQ ID NO: 136250 - DNA, 25 bp, Homo sapien
gccatgtgtctcattgaatgcaatc

SEQ ID NO: 136251 - DNA, 25 bp, Homo sapien
tgaatgcaatcagccagtttatcca

SEQ ID NO: 136252 - DNA, 25 bp, Homo sapien
aatcagccagtttatccactagata

SEQ ID NO: 136253 - DNA, 25 bp, Homo sapien
gaacaatgagagatcagcgagccat

SEQ ID NO: 136254 - DNA, 25 bp, Homo sapien
gcgagccatgatgatccaaacacct

SEQ ID NO: 136255 - DNA, 25 bp, Homo sapien
gatccaaacacctagtcaatacaga

SEQ ID NO: 136256 - DNA, 25 bp, Homo sapien
cagatttgtatgtgaagctattttg

SEQ ID NO: 136257 - DNA, 25 bp, Homo sapien
ggatatgtgttggaaaactgctttc

SEQ ID NO: 136258 - DNA, 25 bp, Homo sapien
aaactgctttcccttatgttcactg

SEQ ID NO: 136259 - DNA, 25 bp, Homo sapien
agagttctgctctagacagtgtagg

SEQ ID NO: 136260 - DNA, 25 bp, Homo sapien
tctgctctagacagtgtagggcaac

SEQ ID NO: 136261 - DNA, 25 bp, Homo sapien
acagtgtagggcaacaatacatgct

SEQ ID NO: 136262 - DNA, 25 bp, Homo sapien
tacatgctgctaattcaaagctcta

SEQ ID NO: 136263 - DNA, 25 bp, Homo sapien
attcaaagctctattaagatttcca

SEQ ID NO: 136264 - DNA, 25 bp, Homo sapien
aagatttccaagtgccaatatttct

SEQ ID NO: 136265 - DNA, 25 bp, Homo sapien
ttccaagtgccaatatttctgatat

SEQ ID NO: 136266 - DNA, 25 bp, Homo sapien
agtgccaatatttctgatataacaa

SEQ ID NO: 136267 - DNA, 25 bp, Homo sapien
aactacatgtaatccatcactagcc

SEQ ID NO: 136268 - DNA, 25 bp, Homo sapien
cactagccatgataactgcaatttt

SEQ ID NO: 136269 - DNA, 25 bp, Homo sapien
gccatgataactgcaattttaattg

SEQ ID NO: 136270 - DNA, 25 bp, Homo sapien
gttttatccctccagatttatgaat

SEQ ID NO: 136271 - DNA, 25 bp, Homo sapien
ttttatccctccagatttatgaatt

SEQ ID NO: 136272 - DNA, 25 bp, Homo sapien
ttatccctccagatttatgaatttt

SEQ ID NO: 136273 - DNA, 25 bp, Homo sapien
atccctccagatttatgaatttttt

SEQ ID NO: 136274 - DNA, 25 bp, Homo sapien
ggaaaagactatgaaaaggactctt

SEQ ID NO: 136275 - DNA, 25 bp, Homo sapien
gaaaagaactccatttcattggact

SEQ ID NO: 136276 - DNA, 25 bp, Homo sapien
aaagaactccatttcattggactaa

SEQ ID NO: 136277 - DNA, 25 bp, Homo sapien
aagaactccatttcattggactaaa

SEQ ID NO: 136278 - DNA, 25 bp, Homo sapien
ctccatttcattggactaaataaca

SEQ ID NO: 136279 - DNA, 25 bp, Homo sapien
ccatttcattggactaaataacaaa

SEQ ID NO: 136280 - DNA, 25 bp, Homo sapien
ggaaaaatgtgctgattttttgaat

SEQ ID NO: 136281 - DNA, 25 bp, Homo sapien
aacactgcagaacagcatcatgtca

SEQ ID NO: 136282 - DNA, 25 bp, Homo sapien
gaacagcatcatgtcataaacgatt

SEQ ID NO: 136283 - DNA, 25 bp, Homo sapien
gtcataaacgattctgagccattca

SEQ ID NO: 136284 - DNA, 25 bp, Homo sapien
ctgagccattcacactttttattta

SEQ ID NO: 136285 - DNA, 25 bp, Homo sapien
gagccattcacactttttatttaat

SEQ ID NO: 136286 - DNA, 25 bp, Homo sapien
tatgttttaaacacatgccttaaat

SEQ ID NO: 136287 - DNA, 25 bp, Homo sapien
aacacatgccttaaatttgtttaat

SEQ ID NO: 136288 - DNA, 25 bp, Homo sapien
ttaactctggtttctaccagctcat

SEQ ID NO: 136289 - DNA, 25 bp, Homo sapien
tctggtttctaccagctcatacaaa

SEQ ID NO: 136290 - DNA, 25 bp, Homo sapien
caaggatataggtttttctcatgta

SEQ ID NO: 136291 - DNA, 25 bp, Homo sapien
atgtatctttttgttcattggcaag

SEQ ID NO: 136292 - DNA, 25 bp, Homo sapien
tgttattcagagctccaagactaga

SEQ ID NO: 136293 - DNA, 25 bp, Homo sapien
tattcagagctccaagactagacct

SEQ ID NO: 136294 - DNA, 25 bp, Homo sapien
gctccaagactagacctggctaaca

SEQ ID NO: 136295 - DNA, 25 bp, Homo sapien
gactagacctggctaacaaacatag

SEQ ID NO: 136296 - DNA, 25 bp, Homo sapien
acctggctaacaaacataggagaca

SEQ ID NO: 136297 - DNA, 25 bp, Homo sapien
cataggagacaaagttaggaaacat

SEQ ID NO: 136298 - DNA, 25 bp, Homo sapien
ggaaacattgatacaagctttgtac

SEQ ID NO: 136299 - DNA, 25 bp, Homo sapien
gtacatttgtgtaataggccttttc

SEQ ID NO: 136300 - DNA, 25 bp, Homo sapien
atttgtgtaataggccttttcatgc

SEQ ID NO: 136301 - DNA, 25 bp, Homo sapien
ggccttttcatgctttatgtgtagc

SEQ ID NO: 136302 - DNA, 25 bp, Homo sapien
tgtgtagctttttacctgtaacctt

SEQ ID NO: 136303 - DNA, 25 bp, Homo sapien
gaagttggaataagcaatttctact

SEQ ID NO: 136304 - DNA, 25 bp, Homo sapien
ggaataagcaatttctactatatat

SEQ ID NO: 136305 - DNA, 25 bp, Homo sapien
gaaggaaaattctccttactgggat

SEQ ID NO: 136306 - DNA, 25 bp, Homo sapien
ggaaaattctccttactgggatagt

SEQ ID NO: 136307 - DNA, 25 bp, Homo sapien
aattctccttactgggatagtcagg

SEQ ID NO: 136308 - DNA, 25 bp, Homo sapien
tctccttactgggatagtcaggtaa

SEQ ID NO: 136309 - DNA, 25 bp, Homo sapien
gggatagtcaggtaaacagttggtc

SEQ ID NO: 136310 - DNA, 25 bp, Homo sapien
gtaaacagttggtcaagactttgta

SEQ ID NO: 136311 - DNA, 25 bp, Homo sapien
cagttggtcaagactttgtaaagaa

SEQ ID NO: 136312 - DNA, 25 bp, Homo sapien
gtaaatcccattattgatatgttta

SEQ ID NO: 136313 - DNA, 25 bp, Homo sapien
ttaggaagcaaaagtaagaagcagc

SEQ ID NO: 136314 - DNA, 25 bp, Homo sapien
gcctcctgcagtccgtggtcatcta

SEQ ID NO: 136315 - DNA, 25 bp, Homo sapien
tcctgcagtccgtggtcatctaggc

SEQ ID NO: 136316 - DNA, 25 bp, Homo sapien
tgcagtccgtggtcatctaggccct

SEQ ID NO: 136317 - DNA, 25 bp, Homo sapien
agtccgtggtcatctaggccctact

SEQ ID NO: 136318 - DNA, 25 bp, Homo sapien
gtccgtggtcatctaggccctactc

SEQ ID NO: 136319 - DNA, 25 bp, Homo sapien
ggatctgctctgaccgcacttgaag

SEQ ID NO: 136320 - DNA, 25 bp, Homo sapien
tgctctgaccgcacttgaaggctgg

SEQ ID NO: 136321 - DNA, 25 bp, Homo sapien
acctgtgccggccattcgttttctc

SEQ ID NO: 136322 - DNA, 25 bp, Homo sapien
acttcaaggactcagtttggttcca

SEQ ID NO: 136323 - DNA, 25 bp, Homo sapien
aaggactcagtttggttccacccag

SEQ ID NO: 136324 - DNA, 25 bp, Homo sapien
actcagtttggttccacccagttga

SEQ ID NO: 136325 - DNA, 25 bp, Homo sapien
aaaagctgccaagaccctgggcatt

SEQ ID NO: 136326 - DNA, 25 bp, Homo sapien
cctgggcattgttgtgggcatatac

SEQ ID NO: 136327 - DNA, 25 bp, Homo sapien
gggcatatacctcttgtgctggctg

SEQ ID NO: 136328 - DNA, 25 bp, Homo sapien
atagacacgatggtcgacagcctcc

SEQ ID NO: 136329 - DNA, 25 bp, Homo sapien
ctggtctttgacatctttatctggt

SEQ ID NO: 136330 - DNA, 25 bp, Homo sapien
atctggtttgcttacttcaactcag

SEQ ID NO: 136331 - DNA, 25 bp, Homo sapien
atcatctatgtcttttcctaccagt

SEQ ID NO: 136332 - DNA, 25 bp, Homo sapien
tcctaccagtggtttcggaaggcac

SEQ ID NO: 136333 - DNA, 25 bp, Homo sapien
gaaggcactgaaactcacactgagc

SEQ ID NO: 136334 - DNA, 25 bp, Homo sapien
tgagccagaaggtcttctcaccgca

SEQ ID NO: 136335 - DNA, 25 bp, Homo sapien
gacacgcactgttgatttgtaccaa

SEQ ID NO: 136336 - DNA, 25 bp, Homo sapien
ttatctcaggagagagcccgctctt

SEQ ID NO: 136337 - DNA, 25 bp, Homo sapien
agggtctgcctgttggaaagtgtac

SEQ ID NO: 136338 - DNA, 25 bp, Homo sapien
aagtgtacctggatgcttctgggct

SEQ ID NO: 136339 - DNA, 25 bp, Homo sapien
tctgggctccgtttggcaatagcaa

SEQ ID NO: 136340 - DNA, 25 bp, Homo sapien
aatagcaatcttggctgatgtgcac

SEQ ID NO: 136341 - DNA, 25 bp, Homo sapien
tggctgatgtgcacagtctggctcc

SEQ ID NO: 136342 - DNA, 25 bp, Homo sapien
gttgctaccgatagggactttgcca

SEQ ID NO: 136343 - DNA, 25 bp, Homo sapien
ttgccaagtccaattatcttctagg

SEQ ID NO: 136344 - DNA, 25 bp, Homo sapien
gattgaaaggtgcattttccccata

SEQ ID NO: 136345 - DNA, 25 bp, Homo sapien
gcgaggaaaacccatggctgctttg

SEQ ID NO: 136346 - DNA, 25 bp, Homo sapien
ggctgctttgtgtcacctcagtgac

SEQ ID NO: 136347 - DNA, 25 bp, Homo sapien
tgactctcagtatcctcgaccgata

SEQ ID NO: 136348 - DNA, 25 bp, Homo sapien
tcgaccgatactacacaccgactat

SEQ ID NO: 136349 - DNA, 25 bp, Homo sapien
acacaccgactatctcacgtgagag

SEQ ID NO: 136350 - DNA, 25 bp, Homo sapien
gagggcagtggaactccttaggaaa

SEQ ID NO: 136351 - DNA, 25 bp, Homo sapien
gagctccagaaacgcttcatcctga

SEQ ID NO: 136352 - DNA, 25 bp, Homo sapien
agaaacgcttcatcctgaatctgcc

SEQ ID NO: 136353 - DNA, 25 bp, Homo sapien
gaatctgccaaccttcagtgttcga

SEQ ID NO: 136354 - DNA, 25 bp, Homo sapien
aaccttcagtgttcgaatcattgac

SEQ ID NO: 136355 - DNA, 25 bp, Homo sapien
atccatgacctggataacatttcct

SEQ ID NO: 136356 - DNA, 25 bp, Homo sapien
aaacagggctcctaacatcatgtcc

SEQ ID NO: 136357 - DNA, 25 bp, Homo sapien
tcttttcaggcgcactcttgataaa

SEQ ID NO: 136358 - DNA, 25 bp, Homo sapien
aagggcaatgttgattaatctcagt

SEQ ID NO: 136359 - DNA, 25 bp, Homo sapien
gattaatctcagtattaaaccacat

SEQ ID NO: 136360 - DNA, 25 bp, Homo sapien
taaaccacattaatctgtatcccat

SEQ ID NO: 136361 - DNA, 25 bp, Homo sapien
attaatctgtatcccattgtctggc

SEQ ID NO: 136362 - DNA, 25 bp, Homo sapien
ttgtaaattcatccaggtcaagact

SEQ ID NO: 136363 - DNA, 25 bp, Homo sapien
atccaggtcaagactaagtatgttg

SEQ ID NO: 136364 - DNA, 25 bp, Homo sapien
agtatgttggttaataggaatcctt

SEQ ID NO: 136365 - DNA, 25 bp, Homo sapien
tattcaagcactcttaaaaccactt

SEQ ID NO: 136366 - DNA, 25 bp, Homo sapien
taaaaccacttaaacagcctccagt

SEQ ID NO: 136367 - DNA, 25 bp, Homo sapien
taaacagcctccagtcataaaaatg

SEQ ID NO: 136368 - DNA, 25 bp, Homo sapien
atatttgcttggcaacacgacttga

SEQ ID NO: 136369 - DNA, 25 bp, Homo sapien
ttgtcaccaaggtctccaggtactc

SEQ ID NO: 136370 - DNA, 25 bp, Homo sapien
caggtactcactctggtttaaacag

SEQ ID NO: 136371 - DNA, 25 bp, Homo sapien
gaaactcagctagccagaatgaaca

SEQ ID NO: 136372 - DNA, 25 bp, Homo sapien
aatgaacaacacaaccggaagcggg

SEQ ID NO: 136373 - DNA, 25 bp, Homo sapien
aagcgggattccaagctggcactgc

SEQ ID NO: 136374 - DNA, 25 bp, Homo sapien
actgccactgtggagggcgctgaaa

SEQ ID NO: 136375 - DNA, 25 bp, Homo sapien
gagggcgctgaaacttcatcacaca

SEQ ID NO: 136376 - DNA, 25 bp, Homo sapien
gaaacttcatcacacactgagaggc

SEQ ID NO: 136377 - DNA, 25 bp, Homo sapien
gagccgccgtttgctgggttgttta

SEQ ID NO: 136378 - DNA, 25 bp, Homo sapien
gttgtttaccgagcactgtgacctt

SEQ ID NO: 136379 - DNA, 25 bp, Homo sapien
tccctggaactctttatctcaatag

SEQ ID NO: 136380 - DNA, 25 bp, Homo sapien
ccataccttctggtttgaaggcgct

SEQ ID NO: 136381 - DNA, 25 bp, Homo sapien
ttctggtttgaaggcgctgacactg

SEQ ID NO: 136382 - DNA, 25 bp, Homo sapien
ttgaaggcgctgacactggcagaga

SEQ ID NO: 136383 - DNA, 25 bp, Homo sapien
gagaatggaggctcccagggtccct

SEQ ID NO: 136384 - DNA, 25 bp, Homo sapien
ctgcccacttctgttttcctaatgt

SEQ ID NO: 136385 - DNA, 25 bp, Homo sapien
ttttctctataaagggtcaggcccg

SEQ ID NO: 136386 - DNA, 25 bp, Homo sapien
ctataaagggtcaggcccgtcagca

SEQ ID NO: 136387 - DNA, 25 bp, Homo sapien
aggcccgtcagcatcactgatggga

SEQ ID NO: 136388 - DNA, 25 bp, Homo sapien
attaatgctttgtgacagcctctgc

SEQ ID NO: 136389 - DNA, 25 bp, Homo sapien
tgctttgtgacagcctctgcctgaa

SEQ ID NO: 136390 - DNA, 25 bp, Homo sapien
aggacccagaggtgttctttcattt

SEQ ID NO: 136391 - DNA, 25 bp, Homo sapien
tttactactgagtcaagttttctag

SEQ ID NO: 136392 - DNA, 25 bp, Homo sapien
agtcaagttttctagttctgtgtaa

SEQ ID NO: 136393 - DNA, 25 bp, Homo sapien
gacgtagttcattagctggtcttac

SEQ ID NO: 136394 - DNA, 25 bp, Homo sapien
gttcattagctggtcttactctacc

SEQ ID NO: 136395 - DNA, 25 bp, Homo sapien
ggtcttactctaccagttttctgac

SEQ ID NO: 136396 - DNA, 25 bp, Homo sapien
tactctaccagttttctgacattgt

SEQ ID NO: 136397 - DNA, 25 bp, Homo sapien
ctgacattgtattgtgttacctaag

SEQ ID NO: 136398 - DNA, 25 bp, Homo sapien
gtgttacctaagtcattaactttgt

SEQ ID NO: 136399 - DNA, 25 bp, Homo sapien
gtcattaactttgtttcagcatgta

SEQ ID NO: 136400 - DNA, 25 bp, Homo sapien
aatagaaataccttcattttgaaag

SEQ ID NO: 136401 - DNA, 25 bp, Homo sapien
gagaataacaccttaccaaacattg

SEQ ID NO: 136402 - DNA, 25 bp, Homo sapien
gataactcaggagaatcttctttac

SEQ ID NO: 136403 - DNA, 25 bp, Homo sapien
aactcaggagaatcttctttacaat

SEQ ID NO: 136404 - DNA, 25 bp, Homo sapien
caggagaatcttctttacaatttta

SEQ ID NO: 136405 - DNA, 25 bp, Homo sapien
tctttacaattttacgtttagaatg

SEQ ID NO: 136406 - DNA, 25 bp, Homo sapien
gaatgtttcagtgcctcagacaaat

SEQ ID NO: 136407 - DNA, 25 bp, Homo sapien
atgtttcagtgcctcagacaaatgt

SEQ ID NO: 136408 - DNA, 25 bp, Homo sapien
gtttcagtgcctcagacaaatgtgt

SEQ ID NO: 136409 - DNA, 25 bp, Homo sapien
ttcagtgcctcagacaaatgtgtat

SEQ ID NO: 136410 - DNA, 25 bp, Homo sapien
cagtgcctcagacaaatgtgtattt

SEQ ID NO: 136411 - DNA, 25 bp, Homo sapien
agtgcctcagacaaatgtgtattta

SEQ ID NO: 136412 - DNA, 25 bp, Homo sapien
tgcctcagacaaatgtgtatttaac

SEQ ID NO: 136413 - DNA, 25 bp, Homo sapien
gatgtagatacagatccgcatgtgt

SEQ ID NO: 136414 - DNA, 25 bp, Homo sapien
gatccgcatgtgtctgtattcatac

SEQ ID NO: 136415 - DNA, 25 bp, Homo sapien
tattcatacagcactacttacttag

SEQ ID NO: 136416 - DNA, 25 bp, Homo sapien
tagagatgctactctcagtgtcctc

SEQ ID NO: 136417 - DNA, 25 bp, Homo sapien
tcctcagggctctaccaagacataa

SEQ ID NO: 136418 - DNA, 25 bp, Homo sapien
gggtaccacatggtccatttcatgt

SEQ ID NO: 136419 - DNA, 25 bp, Homo sapien
ggtccatttcatgtgatctattact

SEQ ID NO: 136420 - DNA, 25 bp, Homo sapien
tattactctgacataaacccatctg

SEQ ID NO: 136421 - DNA, 25 bp, Homo sapien
aacccatctgtaatatattgccagt

SEQ ID NO: 136422 - DNA, 25 bp, Homo sapien
gagtgagctctctcagacccttgaa

SEQ ID NO: 136423 - DNA, 25 bp, Homo sapien
gacccttgaagatgtagcttccaaa

SEQ ID NO: 136424 - DNA, 25 bp, Homo sapien
tccagcttagctgtcagctgtccat

SEQ ID NO: 136425 - DNA, 25 bp, Homo sapien
ttagctgtcagctgtccatcacctc

SEQ ID NO: 136426 - DNA, 25 bp, Homo sapien
ccccactttctcatttgtgcttttt

SEQ ID NO: 136427 - DNA, 25 bp, Homo sapien
tgtgcttttttctctcgtaatagaa

SEQ ID NO: 136428 - DNA, 25 bp, Homo sapien
ggcgattcaacctgtgtgctgcgaa

SEQ ID NO: 136429 - DNA, 25 bp, Homo sapien
attcaacctgtgtgctgcgaaggac

SEQ ID NO: 136430 - DNA, 25 bp, Homo sapien
ctgtgtgctgcgaaggacgagactt

SEQ ID NO: 136431 - DNA, 25 bp, Homo sapien
tgctgcgaaggacgagacttcctct

SEQ ID NO: 136432 - DNA, 25 bp, Homo sapien
ggacgagacttcctcttgaacagtg

SEQ ID NO: 136433 - DNA, 25 bp, Homo sapien
gacttcctcttgaacagtgtgctgt

SEQ ID NO: 136434 - DNA, 25 bp, Homo sapien
cctcttgaacagtgtgctgttgtaa

SEQ ID NO: 136435 - DNA, 25 bp, Homo sapien
ggaacaggtgacaaatcagacgcta

SEQ ID NO: 136436 - DNA, 25 bp, Homo sapien
aatcagacgctaagtttttccttca

SEQ ID NO: 136437 - DNA, 25 bp, Homo sapien
tccttcatggttctgcaagacatcc

SEQ ID NO: 136438 - DNA, 25 bp, Homo sapien
catcccagtaggagacttgaagcca

SEQ ID NO: 136439 - DNA, 25 bp, Homo sapien
aagccagcaattgttaaagtctatg

SEQ ID NO: 136440 - DNA, 25 bp, Homo sapien
agatgagtctgtggttgctgagtat

SEQ ID NO: 136441 - DNA, 25 bp, Homo sapien
ctgtggttgctgagtatatcgcccc

SEQ ID NO: 136442 - DNA, 25 bp, Homo sapien
tgtttgaggaccatacaggctgtat

SEQ ID NO: 136443 - DNA, 25 bp, Homo sapien
atattttggtggattctctgtccta

SEQ ID NO: 136444 - DNA, 25 bp, Homo sapien
ggattctctgtcctatacatttact

SEQ ID NO: 136445 - DNA, 25 bp, Homo sapien
ggaatggagttatttgtctctataa

SEQ ID NO: 136446 - DNA, 25 bp, Homo sapien
gttcccagaggcttctgtacagtca

SEQ ID NO: 136447 - DNA, 25 bp, Homo sapien
gaggcttctgtacagtcaggtctgc

SEQ ID NO: 136448 - DNA, 25 bp, Homo sapien
ttctgtacagtcaggtctgctctgg

SEQ ID NO: 136449 - DNA, 25 bp, Homo sapien
tctgctctggtctgggtgctggctc

SEQ ID NO: 136450 - DNA, 25 bp, Homo sapien
tctgggtgctggctccaatctgcgt

SEQ ID NO: 136451 - DNA, 25 bp, Homo sapien
tccaatctgcgtccacttaggaggc

SEQ ID NO: 136452 - DNA, 25 bp, Homo sapien
tgcgtccacttaggaggcccaactg

SEQ ID NO: 136453 - DNA, 25 bp, Homo sapien
ttctgctccacaaaaaccacagtta

SEQ ID NO: 136454 - DNA, 25 bp, Homo sapien
gttattggaaaagctccctgccttc

SEQ ID NO: 136455 - DNA, 25 bp, Homo sapien
ctgctgcattgtgggtgatgacgta

SEQ ID NO: 136456 - DNA, 25 bp, Homo sapien
cattgtgggtgatgacgtaggacat

SEQ ID NO: 136457 - DNA, 25 bp, Homo sapien
tcagtccttattatcccagcttgct

SEQ ID NO: 136458 - DNA, 25 bp, Homo sapien
agtccttattatcccagcttgctga

SEQ ID NO: 136459 - DNA, 25 bp, Homo sapien
ccttattatcccagcttgctgaggg

SEQ ID NO: 136460 - DNA, 25 bp, Homo sapien
ctctgggcagcgctatctagatagg

SEQ ID NO: 136461 - DNA, 25 bp, Homo sapien
ggcagcgctatctagataggtaagt

SEQ ID NO: 136462 - DNA, 25 bp, Homo sapien
gtggtgccgacgtccccaaacctag

SEQ ID NO: 136463 - DNA, 25 bp, Homo sapien
gtccccaaacctagctaggctaagt

SEQ ID NO: 136464 - DNA, 25 bp, Homo sapien
gctaggctaagtcaagatcaacatt

SEQ ID NO: 136465 - DNA, 25 bp, Homo sapien
gagttcactgttgtacacagtctgt

SEQ ID NO: 136466 - DNA, 25 bp, Homo sapien
ctgttgtacacagtctgttttctat

SEQ ID NO: 136467 - DNA, 25 bp, Homo sapien
tgtacacagtctgttttctatttgt

SEQ ID NO: 136468 - DNA, 25 bp, Homo sapien
acacttgattccatttcattgtcat

SEQ ID NO: 136469 - DNA, 25 bp, Homo sapien
cattgtcattagtgtattaaccagc

SEQ ID NO: 136470 - DNA, 25 bp, Homo sapien
gtcattagtgtattaaccagcagga

SEQ ID NO: 136471 - DNA, 25 bp, Homo sapien
gtgtattaaccagcaggagaggtga

SEQ ID NO: 136472 - DNA, 25 bp, Homo sapien
gaggtgatgagccatttttcaaatg

SEQ ID NO: 136473 - DNA, 25 bp, Homo sapien
attttagagttcaatagctgtttct

SEQ ID NO: 136474 - DNA, 25 bp, Homo sapien
tagctgtttctatgattatcctcaa

SEQ ID NO: 136475 - DNA, 25 bp, Homo sapien
ttctatgattatcctcaatttccat

SEQ ID NO: 136476 - DNA, 25 bp, Homo sapien
ttttaaattgttttcagctcttgga

SEQ ID NO: 136477 - DNA, 25 bp, Homo sapien
aattgttttcagctcttggatatag

SEQ ID NO: 136478 - DNA, 25 bp, Homo sapien
ttcagctcttggatatagcagcaat

SEQ ID NO: 136479 - DNA, 25 bp, Homo sapien
ctaaaaccttagtcatcagatatgc

SEQ ID NO: 136480 - DNA, 25 bp, Homo sapien
ggaagtgtgtttgcctaaaacaatc

SEQ ID NO: 136481 - DNA, 25 bp, Homo sapien
acaattcccttctttttcatcccag

SEQ ID NO: 136482 - DNA, 25 bp, Homo sapien
tttttcatcccagaccaatggcatt

SEQ ID NO: 136483 - DNA, 25 bp, Homo sapien
ccaatggcattattaggtcttaaag

SEQ ID NO: 136484 - DNA, 25 bp, Homo sapien
taaagtagttactcccttctcgtgt

SEQ ID NO: 136485 - DNA, 25 bp, Homo sapien
agtagttactcccttctcgtgtttg

SEQ ID NO: 136486 - DNA, 25 bp, Homo sapien
ttccttgctatttcaataacagatg

SEQ ID NO: 136487 - DNA, 25 bp, Homo sapien
aacagatggtgctgctaattcccaa

SEQ ID NO: 136488 - DNA, 25 bp, Homo sapien
gctgctaattcccaacatttcttaa

SEQ ID NO: 136489 - DNA, 25 bp, Homo sapien
acagttttcattgattatatgggta

SEQ ID NO: 136490 - DNA, 25 bp, Homo sapien
gactacagccagtcagacttcaagg

SEQ ID NO: 136491 - DNA, 25 bp, Homo sapien
acttcaaggcttttgctggaaacag

SEQ ID NO: 136492 - DNA, 25 bp, Homo sapien
accccgtctggcaagaaatgcattg

SEQ ID NO: 136493 - DNA, 25 bp, Homo sapien
aacagtcggtgggaaacaaaagcat

SEQ ID NO: 136494 - DNA, 25 bp, Homo sapien
agcatgtcctttccaactggaaagt

SEQ ID NO: 136495 - DNA, 25 bp, Homo sapien
aaagtcagacagaggcttcaggtac

SEQ ID NO: 136496 - DNA, 25 bp, Homo sapien
gaggcttcaggtacaactggccaca

SEQ ID NO: 136497 - DNA, 25 bp, Homo sapien
aactggccacagagatagtcctgga

SEQ ID NO: 136498 - DNA, 25 bp, Homo sapien
tagtcctggaagacacgtggcgcct

SEQ ID NO: 136499 - DNA, 25 bp, Homo sapien
tggcgcctgtggaccggaagcacca

SEQ ID NO: 136500 - DNA, 25 bp, Homo sapien
tggaccggaagcaccaaatgctggt

SEQ ID NO: 136501 - DNA, 25 bp, Homo sapien
ggctgacggtggtgccagtgtctga

SEQ ID NO: 136502 - DNA, 25 bp, Homo sapien
aggccctggtgcgtagtggctacaa

SEQ ID NO: 136503 - DNA, 25 bp, Homo sapien
gtagtggctacaaggtccgggacct

SEQ ID NO: 136504 - DNA, 25 bp, Homo sapien
aggtccgggacctccgcacctatat

SEQ ID NO: 136505 - DNA, 25 bp, Homo sapien
tgcccaccttcagacaggcgtagat

SEQ ID NO: 136506 - DNA, 25 bp, Homo sapien
ccaccttcagacaggcgtagatgat

SEQ ID NO: 136507 - DNA, 25 bp, Homo sapien
gcgtagatgatgtcaagggcgtctt

SEQ ID NO: 136508 - DNA, 25 bp, Homo sapien
tagatgatgtcaagggcgtcttctt

SEQ ID NO: 136509 - DNA, 25 bp, Homo sapien
cgtcttcttcgcctgggctcagaag

SEQ ID NO: 136510 - DNA, 25 bp, Homo sapien
ctgggctcagaaggttgggctgtga

SEQ ID NO: 136511 - DNA, 25 bp, Homo sapien
ctgtgagggctgtacctggtgccct

SEQ ID NO: 136512 - DNA, 25 bp, Homo sapien
tttaacttctctcttcactgcatcc

SEQ ID NO: 136513 - DNA, 25 bp, Homo sapien
tgcatcccaatccatctacaggcat

SEQ ID NO: 136514 - DNA, 25 bp, Homo sapien
aatccatctacaggcatgcacactt

SEQ ID NO: 136515 - DNA, 25 bp, Homo sapien
acaggcatgcacacttattaggaaa

SEQ ID NO: 136516 - DNA, 25 bp, Homo sapien
gaggtaacaacagagactttcacta

SEQ ID NO: 136517 - DNA, 25 bp, Homo sapien
aggagtttctattaaaatctgtcac

SEQ ID NO: 136518 - DNA, 25 bp, Homo sapien
aatctgtcacttgagtgatgtcatt

SEQ ID NO: 136519 - DNA, 25 bp, Homo sapien
tgtcatttaagtcctattttaggag

SEQ ID NO: 136520 - DNA, 25 bp, Homo sapien
ttgttttaactcttaatcactttgt

SEQ ID NO: 136521 - DNA, 25 bp, Homo sapien
aatcactttgtaattttgactcaat

SEQ ID NO: 136522 - DNA, 25 bp, Homo sapien
gtaattttgactcaatccttttctg

SEQ ID NO: 136523 - DNA, 25 bp, Homo sapien
cctgtgctgagccaggctgagtgtg

SEQ ID NO: 136524 - DNA, 25 bp, Homo sapien
tgtgctgagccaggctgagtgtgaa

SEQ ID NO: 136525 - DNA, 25 bp, Homo sapien
agccaggctgagtgtgaagcctcct

SEQ ID NO: 136526 - DNA, 25 bp, Homo sapien
ggaaagattaccaacaacatgttct

SEQ ID NO: 136527 - DNA, 25 bp, Homo sapien
aacatgttctgtgtgggcttcctcg

SEQ ID NO: 136528 - DNA, 25 bp, Homo sapien
gtctccaatggagagctccaaggaa

SEQ ID NO: 136529 - DNA, 25 bp, Homo sapien
tctccaatggagagctccaaggaat

SEQ ID NO: 136530 - DNA, 25 bp, Homo sapien
ctccaatggagagctccaaggaatt

SEQ ID NO: 136531 - DNA, 25 bp, Homo sapien
tccaatggagagctccaaggaattg

SEQ ID NO: 136532 - DNA, 25 bp, Homo sapien
ccaatggagagctccaaggaattgt

SEQ ID NO: 136533 - DNA, 25 bp, Homo sapien
tatggctgtgcccagaagaacaggc

SEQ ID NO: 136534 - DNA, 25 bp, Homo sapien
tttatggaaaagactctgccaagga

SEQ ID NO: 136535 - DNA, 25 bp, Homo sapien
ttatggaaaagactctgccaaggac

SEQ ID NO: 136536 - DNA, 25 bp, Homo sapien
tatggaaaagactctgccaaggact

SEQ ID NO: 136537 - DNA, 25 bp, Homo sapien
tggaaaagactctgccaaggactct

SEQ ID NO: 136538 - DNA, 25 bp, Homo sapien
ggaaaagactctgccaaggactctt

SEQ ID NO: 136539 - DNA, 25 bp, Homo sapien
gaaaagactctgccaaggactcttg

SEQ ID NO: 136540 - DNA, 25 bp, Homo sapien
aaagactctgccaaggactcttgaa

SEQ ID NO: 136541 - DNA, 25 bp, Homo sapien
aagactctgccaaggactcttgaat

SEQ ID NO: 136542 - DNA, 25 bp, Homo sapien
agactctgccaaggactcttgaata

SEQ ID NO: 136543 - DNA, 25 bp, Homo sapien
actccatgttattggactaaataat

SEQ ID NO: 136544 - DNA, 25 bp, Homo sapien
ccatgttattggactaaataatcaa

SEQ ID NO: 136545 - DNA, 25 bp, Homo sapien
gtgccttgctgccacagtagaccta

SEQ ID NO: 136546 - DNA, 25 bp, Homo sapien
agtagacctagttccaggatccatg

SEQ ID NO: 136547 - DNA, 25 bp, Homo sapien
caggatccatgggagcattctcaaa

SEQ ID NO: 136548 - DNA, 25 bp, Homo sapien
ccatgggagcattctcaaaggcttt

SEQ ID NO: 136549 - DNA, 25 bp, Homo sapien
tcaaaggctttagccctggacccag

SEQ ID NO: 136550 - DNA, 25 bp, Homo sapien
gaggctcggcttggattattctgca

SEQ ID NO: 136551 - DNA, 25 bp, Homo sapien
tattctgcaggttcatctcagaccc

SEQ ID NO: 136552 - DNA, 25 bp, Homo sapien
tttcagccttaagcagccacctgag

SEQ ID NO: 136553 - DNA, 25 bp, Homo sapien
gagccaccaccgagccatggcagga

SEQ ID NO: 136554 - DNA, 25 bp, Homo sapien
agccatggcaggatcgggagacccc

SEQ ID NO: 136555 - DNA, 25 bp, Homo sapien
gaacaatccttttcagtattatatt

SEQ ID NO: 136556 - DNA, 25 bp, Homo sapien
acagaaaccacaagtgtccagccct

SEQ ID NO: 136557 - DNA, 25 bp, Homo sapien
ggacgttaattgtcagccaccagac

SEQ ID NO: 136558 - DNA, 25 bp, Homo sapien
gtcccggcacctacagagaatgttt

SEQ ID NO: 136559 - DNA, 25 bp, Homo sapien
acagttctggcatttaaatcctttg

SEQ ID NO: 136560 - DNA, 25 bp, Homo sapien
ttgtgctgctgttagccttagtttc

SEQ ID NO: 136561 - DNA, 25 bp, Homo sapien
gctgttagccttagtttcagtgctt

SEQ ID NO: 136562 - DNA, 25 bp, Homo sapien
ttcagtgctttacaagtctcgctta

SEQ ID NO: 136563 - DNA, 25 bp, Homo sapien
gtctcgcttattatctcattggtat

SEQ ID NO: 136564 - DNA, 25 bp, Homo sapien
gttgattattcaccacgccaatatc

SEQ ID NO: 136565 - DNA, 25 bp, Homo sapien
acgccaatatctgggtctctgtatc

SEQ ID NO: 136566 - DNA, 25 bp, Homo sapien
tatctgggtctctgtatctcatgta

SEQ ID NO: 136567 - DNA, 25 bp, Homo sapien
cagcctgacctcttcaaagatatca

SEQ ID NO: 136568 - DNA, 25 bp, Homo sapien
gtctttgcagactacgaagcctatg

SEQ ID NO: 136569 - DNA, 25 bp, Homo sapien
gaagcctatgtcaagtgtcaagata

SEQ ID NO: 136570 - DNA, 25 bp, Homo sapien
aaggcctggaacacaatggtactca

SEQ ID NO: 136571 - DNA, 25 bp, Homo sapien
aatggtactcaaaaacatagctgcc

SEQ ID NO: 136572 - DNA, 25 bp, Homo sapien
aaattctccagtgaccgaacaatta

SEQ ID NO: 136573 - DNA, 25 bp, Homo sapien
aaacatctggaacgtggaaccttca

SEQ ID NO: 136574 - DNA, 25 bp, Homo sapien
ggaacgtggaaccttcagatctaaa

SEQ ID NO: 136575 - DNA, 25 bp, Homo sapien
ggaaccttcagatctaaagatttct

SEQ ID NO: 136576 - DNA, 25 bp, Homo sapien
gatttctctatccaatgaatctaac

SEQ ID NO: 136577 - DNA, 25 bp, Homo sapien
aaattgaactctacaatgtctctag

SEQ ID NO: 136578 - DNA, 25 bp, Homo sapien
atttgtagcaactctgaagtatcaa

SEQ ID NO: 136579 - DNA, 25 bp, Homo sapien
gttttaactacttgactctcttttg

SEQ ID NO: 136580 - DNA, 25 bp, Homo sapien
gactctcttttgctaagaagggatt

SEQ ID NO: 136581 - DNA, 25 bp, Homo sapien
gaatatgctatctacctggaatctc

SEQ ID NO: 136582 - DNA, 25 bp, Homo sapien
ggaatctctctctcaacaaaaggta

SEQ ID NO: 136583 - DNA, 25 bp, Homo sapien
tcaggaatgatataatctgtcccat

SEQ ID NO: 136584 - DNA, 25 bp, Homo sapien
gtcccattttcgaggctccttataa

SEQ ID NO: 136585 - DNA, 25 bp, Homo sapien
gacatttccatgtatgtccttacat

SEQ ID NO: 136586 - DNA, 25 bp, Homo sapien
tatgtccttacatttctgaaagctt

SEQ ID NO: 136587 - DNA, 25 bp, Homo sapien
gaaagctttcaatcttcaagagcca

SEQ ID NO: 136588 - DNA, 25 bp, Homo sapien
gcaaacactagctgttctgctcata

SEQ ID NO: 136589 - DNA, 25 bp, Homo sapien
gagagggtgaatgccgtcaagacca

SEQ ID NO: 136590 - DNA, 25 bp, Homo sapien
gaatgccgtcaagaccaaagtggaa

SEQ ID NO: 136591 - DNA, 25 bp, Homo sapien
tggaagctttccagacaaccatttc

SEQ ID NO: 136592 - DNA, 25 bp, Homo sapien
gacaaccatttccaagtacttctca

SEQ ID NO: 136593 - DNA, 25 bp, Homo sapien
ggcctccaaggagactcatgtaatg

SEQ ID NO: 136594 - DNA, 25 bp, Homo sapien
atgtaatggattaccgggccttggt

SEQ ID NO: 136595 - DNA, 25 bp, Homo sapien
ttaccgggccttggtgcatgagcga

SEQ ID NO: 136596 - DNA, 25 bp, Homo sapien
gacctgagggccttctatgctgagc

SEQ ID NO: 136597 - DNA, 25 bp, Homo sapien
ggccttctatgctgagctttatcat

SEQ ID NO: 136598 - DNA, 25 bp, Homo sapien
ctttatcatatcatcagcagcaacc

SEQ ID NO: 136599 - DNA, 25 bp, Homo sapien
aaagggtgaagaaaagccatctatg

SEQ ID NO: 136600 - DNA, 25 bp, Homo sapien
aatgatcaatttacctgcatataaa

SEQ ID NO: 136601 - DNA, 25 bp, Homo sapien
atcattctatttgctttattatcgg

SEQ ID NO: 136602 - DNA, 25 bp, Homo sapien
ttattatcggtgcaggtaggtcatt

SEQ ID NO: 136603 - DNA, 25 bp, Homo sapien
ggtaggtcattaacaccacttcttt

SEQ ID NO: 136604 - DNA, 25 bp, Homo sapien
taacaccacttcttttcatctgtac

SEQ ID NO: 136605 - DNA, 25 bp, Homo sapien
tcatctgtaccacaccctggtgaaa

SEQ ID NO: 136606 - DNA, 25 bp, Homo sapien
aaacctgtctgagatgttctttcta

SEQ ID NO: 136607 - DNA, 25 bp, Homo sapien
gtctgagatgttctttctaccaatc

SEQ ID NO: 136608 - DNA, 25 bp, Homo sapien
ttctaccaatctatatgtctttcgg

SEQ ID NO: 136609 - DNA, 25 bp, Homo sapien
atgtctttcggttatcaagtgtttc

SEQ ID NO: 136610 - DNA, 25 bp, Homo sapien
tcaagtgtttctgcatggtaatgtc

SEQ ID NO: 136611 - DNA, 25 bp, Homo sapien
gtggaaggagctcacttaccaggaa

SEQ ID NO: 136612 - DNA, 25 bp, Homo sapien
aggagctcacttaccaggaagtcct

SEQ ID NO: 136613 - DNA, 25 bp, Homo sapien
cacctggcagcctggagattgagca

SEQ ID NO: 136614 - DNA, 25 bp, Homo sapien
gaaggacctgagcagcatcttccgt

SEQ ID NO: 136615 - DNA, 25 bp, Homo sapien
tgagcagcatcttccgtggagccaa

SEQ ID NO: 136616 - DNA, 25 bp, Homo sapien
cctccttggaaggatgctggtgctg

SEQ ID NO: 136617 - DNA, 25 bp, Homo sapien
acagtgaccagagggtcagtgcagc

SEQ ID NO: 136618 - DNA, 25 bp, Homo sapien
tcagtgcagctgaggcactggccca

SEQ ID NO: 136619 - DNA, 25 bp, Homo sapien
gccagtaccacgaccccgaggatga

SEQ ID NO: 136620 - DNA, 25 bp, Homo sapien
accccgaggatgagccagaggccga

SEQ ID NO: 136621 - DNA, 25 bp, Homo sapien
gagccagaggccgagccatatgatg

SEQ ID NO: 136622 - DNA, 25 bp, Homo sapien
aagtggctcagatcacattacggga

SEQ ID NO: 136623 - DNA, 25 bp, Homo sapien
attacgggagtttttcaatgccatt

SEQ ID NO: 136624 - DNA, 25 bp, Homo sapien
gtttttcaatgccattatcgcaggc

SEQ ID NO: 136625 - DNA, 25 bp, Homo sapien
gcaggcaaagatgttgatccttcct

SEQ ID NO: 136626 - DNA, 25 bp, Homo sapien
aaggccatatacaaggtcatctgca

SEQ ID NO: 136627 - DNA, 25 bp, Homo sapien
tctgcaagctggatagtgaagtccc

SEQ ID NO: 136628 - DNA, 25 bp, Homo sapien
gtgaagtccctgagtttttcaaatc

SEQ ID NO: 136629 - DNA, 25 bp, Homo sapien
tgagtttttcaaatccccgaactgc

SEQ ID NO: 136630 - DNA, 25 bp, Homo sapien
gaactgcctacaagagctgcttcat

SEQ ID NO: 136631 - DNA, 25 bp, Homo sapien
gagctgcttcatgagtagaaatttc

SEQ ID NO: 136632 - DNA, 25 bp, Homo sapien
gtagcagtcctctttggatgtccaa

SEQ ID NO: 136633 - DNA, 25 bp, Homo sapien
cttctatgaatatttccatgtattt

SEQ ID NO: 136634 - DNA, 25 bp, Homo sapien
atggagaagaaactctcattcaggg

SEQ ID NO: 136635 - DNA, 25 bp, Homo sapien
gggctccaggatccttctccttgag

SEQ ID NO: 136636 - DNA, 25 bp, Homo sapien
atccttctccttgaggcttctaaat

SEQ ID NO: 136637 - DNA, 25 bp, Homo sapien
ctccttgaggcttctaaataaatgg

SEQ ID NO: 136638 - DNA, 25 bp, Homo sapien
ataaatggcagaattcttgctgtat

SEQ ID NO: 136639 - DNA, 25 bp, Homo sapien
tgaggagatcttgcaacatggccat

SEQ ID NO: 136640 - DNA, 25 bp, Homo sapien
ggagatcttgcaacatggccatgtg

SEQ ID NO: 136641 - DNA, 25 bp, Homo sapien
gatcttgcaacatggccatgtgcaa

SEQ ID NO: 136642 - DNA, 25 bp, Homo sapien
tatgtttgggtaaccaaattggtct

SEQ ID NO: 136643 - DNA, 25 bp, Homo sapien
aaaatgatgttaacccaagaagtag

SEQ ID NO: 136644 - DNA, 25 bp, Homo sapien
atcgctgggtgcatcgagaaggcct

SEQ ID NO: 136645 - DNA, 25 bp, Homo sapien
ctgggtgcatcgagaaggcctacga

SEQ ID NO: 136646 - DNA, 25 bp, Homo sapien
gtgcatcgagaaggcctacgagaaa

SEQ ID NO: 136647 - DNA, 25 bp, Homo sapien
ggcctacgagaaaatccttttcact

SEQ ID NO: 136648 - DNA, 25 bp, Homo sapien
acgagaaaatccttttcactgaggc

SEQ ID NO: 136649 - DNA, 25 bp, Homo sapien
aacacacccaaaaagatgacagact

SEQ ID NO: 136650 - DNA, 25 bp, Homo sapien
aaagatgacagactacgccaagaag

SEQ ID NO: 136651 - DNA, 25 bp, Homo sapien
acgccaagaagcgagggtgggtcct

SEQ ID NO: 136652 - DNA, 25 bp, Homo sapien
cctccacagaactggccaaacaggt

SEQ ID NO: 136653 - DNA, 25 bp, Homo sapien
agctggagatgatcgtctgagcccc

SEQ ID NO: 136654 - DNA, 25 bp, Homo sapien
ggcagggcacgagttatttaaaaca

SEQ ID NO: 136655 - DNA, 25 bp, Homo sapien
agtgtgctttttcttgccagcttgg

SEQ ID NO: 136656 - DNA, 25 bp, Homo sapien
gggccattcttgcttagacagtcag

SEQ ID NO: 136657 - DNA, 25 bp, Homo sapien
ttgtctcctcctttaactgagtcat

SEQ ID NO: 136658 - DNA, 25 bp, Homo sapien
actgagtcatcatcttagtccaact

SEQ ID NO: 136659 - DNA, 25 bp, Homo sapien
tagtccaactaatgcagtcgataca

SEQ ID NO: 136660 - DNA, 25 bp, Homo sapien
agaagaagccccacgggagccagga

SEQ ID NO: 136661 - DNA, 25 bp, Homo sapien
gactggtcgtgtttgtgcttttctc

SEQ ID NO: 136662 - DNA, 25 bp, Homo sapien
gtcaatgcacagagaccccgggtgg

SEQ ID NO: 136663 - DNA, 25 bp, Homo sapien
gtgggtgagcgctggcttctcaaac

SEQ ID NO: 136664 - DNA, 25 bp, Homo sapien
ggccgaagttgcctcttttaggaat

SEQ ID NO: 136665 - DNA, 25 bp, Homo sapien
ctttggaattgggagcacgatgact

SEQ ID NO: 136666 - DNA, 25 bp, Homo sapien
gagggaaggtgaagttcaatgatgc

SEQ ID NO: 136667 - DNA, 25 bp, Homo sapien
agggaaggtgaagttcaatgatgct

SEQ ID NO: 136668 - DNA, 25 bp, Homo sapien
gggaaggtgaagttcaatgatgctc

SEQ ID NO: 136669 - DNA, 25 bp, Homo sapien
ggaaggtgaagttcaatgatgctct

SEQ ID NO: 136670 - DNA, 25 bp, Homo sapien
gaaggtgaagttcaatgatgctctt

SEQ ID NO: 136671 - DNA, 25 bp, Homo sapien
aaggtgaagttcaatgatgctcttg

SEQ ID NO: 136672 - DNA, 25 bp, Homo sapien
aggtgaagttcaatgatgctcttga

SEQ ID NO: 136673 - DNA, 25 bp, Homo sapien
ggtgaagttcaatgatgctcttgat

SEQ ID NO: 136674 - DNA, 25 bp, Homo sapien
gtgaagttcaatgatgctcttgatt

SEQ ID NO: 136675 - DNA, 25 bp, Homo sapien
tcagatcccctcttctcagacagcg

SEQ ID NO: 136676 - DNA, 25 bp, Homo sapien
tcttctcagacagcgccaggccggg

SEQ ID NO: 136677 - DNA, 25 bp, Homo sapien
gacctgctccatctgagctctccag

SEQ ID NO: 136678 - DNA, 25 bp, Homo sapien
tgctccatctgagctctccagctgg

SEQ ID NO: 136679 - DNA, 25 bp, Homo sapien
agctggcccccaattgctcctctct

SEQ ID NO: 136680 - DNA, 25 bp, Homo sapien
taccagcctcattcttctccggtag

SEQ ID NO: 136681 - DNA, 25 bp, Homo sapien
gcctcattcttctccggtagcctct

SEQ ID NO: 136682 - DNA, 25 bp, Homo sapien
ggtagcctctcccacctaacctctg

SEQ ID NO: 136683 - DNA, 25 bp, Homo sapien
ctgcatcccccagcgtcatgtcctg

SEQ ID NO: 136684 - DNA, 25 bp, Homo sapien
ctatcctgcctgatccctggatctc

SEQ ID NO: 136685 - DNA, 25 bp, Homo sapien
tgatccctggatctccctcagatcc

SEQ ID NO: 136686 - DNA, 25 bp, Homo sapien
gctctcctgtagctctcctggggtt

SEQ ID NO: 136687 - DNA, 25 bp, Homo sapien
tcctggggttctgggagttccctga

SEQ ID NO: 136688 - DNA, 25 bp, Homo sapien
agttccctgaacatctgtgtgtgtc

SEQ ID NO: 136689 - DNA, 25 bp, Homo sapien
gttccctgaacatctgtgtgtgtcc

SEQ ID NO: 136690 - DNA, 25 bp, Homo sapien
gaacatctgtgtgtgtccccctatg

SEQ ID NO: 136691 - DNA, 25 bp, Homo sapien
cccctatgctccagtatggaagaat

SEQ ID NO: 136692 - DNA, 25 bp, Homo sapien
tggagggtcgccacacccggctccc

SEQ ID NO: 136693 - DNA, 25 bp, Homo sapien
tctgactcacacttgggcgctctgc

SEQ ID NO: 136694 - DNA, 25 bp, Homo sapien
tccttctggcgcaagagaacatttc

SEQ ID NO: 136695 - DNA, 25 bp, Homo sapien
cttctggcgcaagagaacatttcta

SEQ ID NO: 136696 - DNA, 25 bp, Homo sapien
ctggcgcaagagaacatttctagaa

SEQ ID NO: 136697 - DNA, 25 bp, Homo sapien
ggacatgtaacaagcacaccggcct

SEQ ID NO: 136698 - DNA, 25 bp, Homo sapien
aagcacaccggcctgctgttctgtc

SEQ ID NO: 136699 - DNA, 25 bp, Homo sapien
catccctcttttgggctcttctgga

SEQ ID NO: 136700 - DNA, 25 bp, Homo sapien
ggctcttctggagggaagtaacatt

SEQ ID NO: 136701 - DNA, 25 bp, Homo sapien
tactgagcacctgttgtatgtcaca

SEQ ID NO: 136702 - DNA, 25 bp, Homo sapien
agcacctgttgtatgtcacatgcct

SEQ ID NO: 136703 - DNA, 25 bp, Homo sapien
gttgtatgtcacatgccttatgaat

SEQ ID NO: 136704 - DNA, 25 bp, Homo sapien
gtcacatgccttatgaatagaatct

SEQ ID NO: 136705 - DNA, 25 bp, Homo sapien
gaatcttaactcctagagcaactct

SEQ ID NO: 136706 - DNA, 25 bp, Homo sapien
ttaactcctagagcaactctgtggg

SEQ ID NO: 136707 - DNA, 25 bp, Homo sapien
gaggagcagatccaagttttgcggg

SEQ ID NO: 136708 - DNA, 25 bp, Homo sapien
tttgacataaatgcggtacccttta

SEQ ID NO: 136709 - DNA, 25 bp, Homo sapien
gtaccctttactacactcatgagtg

SEQ ID NO: 136710 - DNA, 25 bp, Homo sapien
gcatatttatgcttaggtcttttca

SEQ ID NO: 136711 - DNA, 25 bp, Homo sapien
gaaatcttcatattctctgtagcct

SEQ ID NO: 136712 - DNA, 25 bp, Homo sapien
ctctgtagcctttgtcaagtgagga

SEQ ID NO: 136713 - DNA, 25 bp, Homo sapien
attccactataaacttttaggcctg

SEQ ID NO: 136714 - DNA, 25 bp, Homo sapien
taaagcctcaaggacatctgcctgt

SEQ ID NO: 136715 - DNA, 25 bp, Homo sapien
ggacatctgcctgtcacaatatatt

SEQ ID NO: 136716 - DNA, 25 bp, Homo sapien
gcctgtcacaatatattctcaaagt

SEQ ID NO: 136717 - DNA, 25 bp, Homo sapien
aagtatccttgttgagtaccaagtg

SEQ ID NO: 136718 - DNA, 25 bp, Homo sapien
gagtaccaagtgctacagaaaccat

SEQ ID NO: 136719 - DNA, 25 bp, Homo sapien
accataagcttcatctgccgtgaat

SEQ ID NO: 136720 - DNA, 25 bp, Homo sapien
atctgccgtgaattggatgccattt

SEQ ID NO: 136721 - DNA, 25 bp, Homo sapien
ggatgccatttccactaatgaagag

SEQ ID NO: 136722 - DNA, 25 bp, Homo sapien
aatgaagctgaatctgatgtcaaac

SEQ ID NO: 136723 - DNA, 25 bp, Homo sapien
gatgtcaaacatagaaccagagatt

SEQ ID NO: 136724 - DNA, 25 bp, Homo sapien
gaagaccagtctagcaccttatgtg

SEQ ID NO: 136725 - DNA, 25 bp, Homo sapien
gcaccttatgtgaaagtttttgaac

SEQ ID NO: 136726 - DNA, 25 bp, Homo sapien
cagagctcctcaaaccattgtggat

SEQ ID NO: 136727 - DNA, 25 bp, Homo sapien
cattgtggatatcttctgccttcaa

SEQ ID NO: 136728 - DNA, 25 bp, Homo sapien
atatcttctgccttcaaccacagat

SEQ ID NO: 136729 - DNA, 25 bp, Homo sapien
gatcaaatacttcaagagccattta

SEQ ID NO: 136730 - DNA, 25 bp, Homo sapien
gaagagagggttgttcccactgaga

SEQ ID NO: 136731 - DNA, 25 bp, Homo sapien
ttgttcccactgagaagggccagct

SEQ ID NO: 136732 - DNA, 25 bp, Homo sapien
cagtgcaaaggagaacatcagtgta

SEQ ID NO: 136733 - DNA, 25 bp, Homo sapien
agaacatcagtgtaaggcaggcctt

SEQ ID NO: 136734 - DNA, 25 bp, Homo sapien
cagtgtaaggcaggcctttgagcgc

SEQ ID NO: 136735 - DNA, 25 bp, Homo sapien
tggtggatgccatttgtgacaagat

SEQ ID NO: 136736 - DNA, 25 bp, Homo sapien
gtgacaagatgtctgattcgctgga

SEQ ID NO: 136737 - DNA, 25 bp, Homo sapien
gattcgctggacacagacccgtcga

SEQ ID NO: 136738 - DNA, 25 bp, Homo sapien
gacacagacccgtcgatgctgggct

SEQ ID NO: 136739 - DNA, 25 bp, Homo sapien
tgggctcctccaagaacacgcgtct

SEQ ID NO: 136740 - DNA, 25 bp, Homo sapien
gctgcagcagaactgctcatgctag

SEQ ID NO: 136741 - DNA, 25 bp, Homo sapien
gttgaattcagtgggttcagaacca

SEQ ID NO: 136742 - DNA, 25 bp, Homo sapien
ttgaattcagtgggttcagaaccaa

SEQ ID NO: 136743 - DNA, 25 bp, Homo sapien
tgaattcagtgggttcagaaccaag

SEQ ID NO: 136744 - DNA, 25 bp, Homo sapien
gaattcagtgggttcagaaccaaga

SEQ ID NO: 136745 - DNA, 25 bp, Homo sapien
ttcttcttggctggttctttgttct

SEQ ID NO: 136746 - DNA, 25 bp, Homo sapien
tcttcttggctggttctttgttctg

SEQ ID NO: 136747 - DNA, 25 bp, Homo sapien
cttcttggctggttctttgttctgt

SEQ ID NO: 136748 - DNA, 25 bp, Homo sapien
ttcttggctggttctttgttctgtc

SEQ ID NO: 136749 - DNA, 25 bp, Homo sapien
tcttggctggttctttgttctgtcc

SEQ ID NO: 136750 - DNA, 25 bp, Homo sapien
cttggctggttctttgttctgtccc

SEQ ID NO: 136751 - DNA, 25 bp, Homo sapien
gaccaaagaggccatagtgcccatg

SEQ ID NO: 136752 - DNA, 25 bp, Homo sapien
agtgcccatggaggtttggacttaa

SEQ ID NO: 136753 - DNA, 25 bp, Homo sapien
attcattggcagctcaaagacttcc

SEQ ID NO: 136754 - DNA, 25 bp, Homo sapien
cctggagaccacactgcacacagtg

SEQ ID NO: 136755 - DNA, 25 bp, Homo sapien
gatgtcatagccaaagccaggcctg

SEQ ID NO: 136756 - DNA, 25 bp, Homo sapien
aggcctgacgcattctcgtatccaa

SEQ ID NO: 136757 - DNA, 25 bp, Homo sapien
tcgtatccaacccaaggaccttttg

SEQ ID NO: 136758 - DNA, 25 bp, Homo sapien
ggagggctgcagtcacattgatgta

SEQ ID NO: 136759 - DNA, 25 bp, Homo sapien
agactttataattccttctgcctaa

SEQ ID NO: 136760 - DNA, 25 bp, Homo sapien
ggctgcattcttgttggtagcatgt

SEQ ID NO: 136761 - DNA, 25 bp, Homo sapien
ggtagcatgtactctgttgagtaaa

SEQ ID NO: 136762 - DNA, 25 bp, Homo sapien
tgtggactgtgatgccacacagagt

SEQ ID NO: 136763 - DNA, 25 bp, Homo sapien
cacagagtggtctttctggagaggt

SEQ ID NO: 136764 - DNA, 25 bp, Homo sapien
ctttctggagaggttataggtcact

SEQ ID NO: 136765 - DNA, 25 bp, Homo sapien
ccccacgtgacagtgcctgggaatg

SEQ ID NO: 136766 - DNA, 25 bp, Homo sapien
tgcagcatgacctgtgaccagcact

SEQ ID NO: 136767 - DNA, 25 bp, Homo sapien
gaccagcactgtctcagtttcactt

SEQ ID NO: 136768 - DNA, 25 bp, Homo sapien
agtttcactttcacatagatgtccc

SEQ ID NO: 136769 - DNA, 25 bp, Homo sapien
tagatgtccctttcttggccagtta

SEQ ID NO: 136770 - DNA, 25 bp, Homo sapien
tcttggccagttatcccttcctttt

SEQ ID NO: 136771 - DNA, 25 bp, Homo sapien
cttccttttagcctagttcatccaa

SEQ ID NO: 136772 - DNA, 25 bp, Homo sapien
gttcatccaatcctcactgggtggg

SEQ ID NO: 136773 - DNA, 25 bp, Homo sapien
gaaatgatagtcaactcagccttca

SEQ ID NO: 136774 - DNA, 25 bp, Homo sapien
gtcaactcagccttcagattgtatg

SEQ ID NO: 136775 - DNA, 25 bp, Homo sapien
tttggtactcttcattcatttatct

SEQ ID NO: 136776 - DNA, 25 bp, Homo sapien
tctctaaaaccaggagttgaatttt

SEQ ID NO: 136777 - DNA, 25 bp, Homo sapien
gcatgaattgcattatgttctctgg

SEQ ID NO: 136778 - DNA, 25 bp, Homo sapien
gcattatgttctctggtaacacgta

SEQ ID NO: 136779 - DNA, 25 bp, Homo sapien
aacacgtagagttcagacccttctg

SEQ ID NO: 136780 - DNA, 25 bp, Homo sapien
gaactctgttgataataccacacca

SEQ ID NO: 136781 - DNA, 25 bp, Homo sapien
taccacaccatgttctggacccata

SEQ ID NO: 136782 - DNA, 25 bp, Homo sapien
atgttctggacccatagctctggca

SEQ ID NO: 136783 - DNA, 25 bp, Homo sapien
tggacccatagctctggcatcctca

SEQ ID NO: 136784 - DNA, 25 bp, Homo sapien
tgtggactacaggacaaggggcatt

SEQ ID NO: 136785 - DNA, 25 bp, Homo sapien
ggtaaaaatgaagcagaagccccaa

SEQ ID NO: 136786 - DNA, 25 bp, Homo sapien
taaaaatgaagcagaagccccaaag

SEQ ID NO: 136787 - DNA, 25 bp, Homo sapien
caaagttcacattaactcaggcatt

SEQ ID NO: 136788 - DNA, 25 bp, Homo sapien
aaagttcacattaactcaggcattt

SEQ ID NO: 136789 - DNA, 25 bp, Homo sapien
aagttcacattaactcaggcatttc

SEQ ID NO: 136790 - DNA, 25 bp, Homo sapien
agttcacattaactcaggcatttca

SEQ ID NO: 136791 - DNA, 25 bp, Homo sapien
gttcacattaactcaggcatttcat

SEQ ID NO: 136792 - DNA, 25 bp, Homo sapien
ttcacattaactcaggcatttcatt

SEQ ID NO: 136793 - DNA, 25 bp, Homo sapien
tcacattaactcaggcatttcattt

SEQ ID NO: 136794 - DNA, 25 bp, Homo sapien
cacattaactcaggcatttcattta

SEQ ID NO: 136795 - DNA, 25 bp, Homo sapien
gaatgaagtattcggctgtccactg

SEQ ID NO: 136796 - DNA, 25 bp, Homo sapien
aacatgatcgctctcaagccggtgc

SEQ ID NO: 136797 - DNA, 25 bp, Homo sapien
tcaagccggtgctccaggcctggtt

SEQ ID NO: 136798 - DNA, 25 bp, Homo sapien
cgaggccgcctaccgagagaagaac

SEQ ID NO: 136799 - DNA, 25 bp, Homo sapien
agcaagccagagctcttcaacggca

SEQ ID NO: 136800 - DNA, 25 bp, Homo sapien
agagctcttcaacggcagcgaacgg

SEQ ID NO: 136801 - DNA, 25 bp, Homo sapien
aacggaagcgcaaacgcacgtccat

SEQ ID NO: 136802 - DNA, 25 bp, Homo sapien
atcgcggcgccggagaagcgttcac

SEQ ID NO: 136803 - DNA, 25 bp, Homo sapien
agaagcgttcactcgaggcctattt

SEQ ID NO: 136804 - DNA, 25 bp, Homo sapien
actcgaggcctatttcgctatccag

SEQ ID NO: 136805 - DNA, 25 bp, Homo sapien
atctgagaagatcgcggccatcgct

SEQ ID NO: 136806 - DNA, 25 bp, Homo sapien
aataaggctgttctttcatatttta

SEQ ID NO: 136807 - DNA, 25 bp, Homo sapien
tttaatctctgtcaatggccatccc

SEQ ID NO: 136808 - DNA, 25 bp, Homo sapien
cgtgggttaagagaacttgcagact

SEQ ID NO: 136809 - DNA, 25 bp, Homo sapien
tgcagactggatatgcaagcaaacg

SEQ ID NO: 136810 - DNA, 25 bp, Homo sapien
atatgcaagcaaacgggcaactctg

SEQ ID NO: 136811 - DNA, 25 bp, Homo sapien
aagcaaacgggcaactctggagaaa

SEQ ID NO: 136812 - DNA, 25 bp, Homo sapien
aaaggaatgctgactttctctttct

SEQ ID NO: 136813 - DNA, 25 bp, Homo sapien
aatactggggccttctcaaaaggag

SEQ ID NO: 136814 - DNA, 25 bp, Homo sapien
ggagcaaattaaacaataaaccaga

SEQ ID NO: 136815 - DNA, 25 bp, Homo sapien
ataaaccagacagcaaggccctggg

SEQ ID NO: 136816 - DNA, 25 bp, Homo sapien
gggaaaggacaacatcctgaaataa

SEQ ID NO: 136817 - DNA, 25 bp, Homo sapien
cgtccactgccatgggcagctccgt

SEQ ID NO: 136818 - DNA, 25 bp, Homo sapien
tgcctccgtgactgtcgccgtgcac

SEQ ID NO: 136819 - DNA, 25 bp, Homo sapien
caggctaccctgagactgaccacgg

SEQ ID NO: 136820 - DNA, 25 bp, Homo sapien
tgagactgaccacggcctgtttgag

SEQ ID NO: 136821 - DNA, 25 bp, Homo sapien
gtgcctttccacgtccggtgtgaga

SEQ ID NO: 136822 - DNA, 25 bp, Homo sapien
tgcctttccacgtccggtgtgagag

SEQ ID NO: 136823 - DNA, 25 bp, Homo sapien
tttccacgtccggtgtgagaggagg

SEQ ID NO: 136824 - DNA, 25 bp, Homo sapien
tcgaaggtggaagtcattgagctgc

SEQ ID NO: 136825 - DNA, 25 bp, Homo sapien
aagtcattgagctgcaggacgtgga

SEQ ID NO: 136826 - DNA, 25 bp, Homo sapien
gacgtggaatgcgaggagaggcccc

SEQ ID NO: 136827 - DNA, 25 bp, Homo sapien
gccccggggaagcagctccaactga

SEQ ID NO: 136828 - DNA, 25 bp, Homo sapien
aaccctgggaggaatgctgactcga

SEQ ID NO: 136829 - DNA, 25 bp, Homo sapien
tgactcgacagccttttgccattgg

SEQ ID NO: 136830 - DNA, 25 bp, Homo sapien
tttgccattggtggctccggcagca

SEQ ID NO: 136831 - DNA, 25 bp, Homo sapien
ccggcagcacctttatctatggtta

SEQ ID NO: 136832 - DNA, 25 bp, Homo sapien
gtggatgcagcatataagccaggca

SEQ ID NO: 136833 - DNA, 25 bp, Homo sapien
aagccaggcatgtctcccgaggagt

SEQ ID NO: 136834 - DNA, 25 bp, Homo sapien
ggagtgcaggcgcttcaccacagac

SEQ ID NO: 136835 - DNA, 25 bp, Homo sapien
acagacgctattgctctggccatga

SEQ ID NO: 136836 - DNA, 25 bp, Homo sapien
tctacctggtcactattacagctgc

SEQ ID NO: 136837 - DNA, 25 bp, Homo sapien
tacagctgccggtgtggaccatcga

SEQ ID NO: 136838 - DNA, 25 bp, Homo sapien
gaccatcgagtcatcttgggcaatg

SEQ ID NO: 136839 - DNA, 25 bp, Homo sapien
tgggcttgtgcacactgacccagac

SEQ ID NO: 136840 - DNA, 25 bp, Homo sapien
ttcctcatcctaagtgcctggcaga

SEQ ID NO: 136841 - DNA, 25 bp, Homo sapien
gtgcctggcagatgaaggagttttc

SEQ ID NO: 136842 - DNA, 25 bp, Homo sapien
aggagttttcaggagcttttgacac

SEQ ID NO: 136843 - DNA, 25 bp, Homo sapien
gttttcaggagcttttgacactata

SEQ ID NO: 136844 - DNA, 25 bp, Homo sapien
tgacactatataaaccgcccttttt

SEQ ID NO: 136845 - DNA, 25 bp, Homo sapien
tataaaccgccctttttgtatgcac

SEQ ID NO: 136846 - DNA, 25 bp, Homo sapien
taaaccgccctttttgtatgcacca

SEQ ID NO: 136847 - DNA, 25 bp, Homo sapien
caccacgggcggcttttatatgtaa

SEQ ID NO: 136848 - DNA, 25 bp, Homo sapien
cttttatatgtaattgcagcgtggg

SEQ ID NO: 136849 - DNA, 25 bp, Homo sapien
gagggtgggccatccttaccccaca

SEQ ID NO: 136850 - DNA, 25 bp, Homo sapien
aagtatatttttcaattccagattt

SEQ ID NO: 136851 - DNA, 25 bp, Homo sapien
attttatcaaatcctctcttgccct

SEQ ID NO: 136852 - DNA, 25 bp, Homo sapien
tcaattcccctgtaacattcctgaa

SEQ ID NO: 136853 - DNA, 25 bp, Homo sapien
attcccctgtaacattcctgaagct

SEQ ID NO: 136854 - DNA, 25 bp, Homo sapien
ccctgtaacattcctgaagctgttc

SEQ ID NO: 136855 - DNA, 25 bp, Homo sapien
gttttatcaatagcctagaggtaaa

SEQ ID NO: 136856 - DNA, 25 bp, Homo sapien
aatagcctagaggtaaagaactgtc

SEQ ID NO: 136857 - DNA, 25 bp, Homo sapien
actgtctttttctctgattctttaa

SEQ ID NO: 136858 - DNA, 25 bp, Homo sapien
gaatatgcacaagtttttctacact

SEQ ID NO: 136859 - DNA, 25 bp, Homo sapien
gcacaagtttttctacactcagtgt

SEQ ID NO: 136860 - DNA, 25 bp, Homo sapien
gtttttctacactcagtgttaaagt

SEQ ID NO: 136861 - DNA, 25 bp, Homo sapien
aaataccttgtgacagagctcccgg

SEQ ID NO: 136862 - DNA, 25 bp, Homo sapien
agagctcccggtgaacttctggatc

SEQ ID NO: 136863 - DNA, 25 bp, Homo sapien
ttctggatcccgtttctgatgcaga

SEQ ID NO: 136864 - DNA, 25 bp, Homo sapien
ttctgatgcagattcttgtcttgtt

SEQ ID NO: 136865 - DNA, 25 bp, Homo sapien
ttgttctccacttgtgctgttagaa

SEQ ID NO: 136866 - DNA, 25 bp, Homo sapien
tgctgttagaactcactggcccagt

SEQ ID NO: 136867 - DNA, 25 bp, Homo sapien
tggcccagtggtgttctacctccta

SEQ ID NO: 136868 - DNA, 25 bp, Homo sapien
attgaagatccttccttgcctgtgg

SEQ ID NO: 136869 - DNA, 25 bp, Homo sapien
gtagttcctgctgtgagtggttaca

SEQ ID NO: 136870 - DNA, 25 bp, Homo sapien
agtggttacagctgatcctcgggaa

SEQ ID NO: 136871 - DNA, 25 bp, Homo sapien
aaagctgccttttgtctgttatttt

SEQ ID NO: 136872 - DNA, 25 bp, Homo sapien
ataagaagcgaattgctttgacaga

SEQ ID NO: 136873 - DNA, 25 bp, Homo sapien
tgctttgacagataacgctttgatt

SEQ ID NO: 136874 - DNA, 25 bp, Homo sapien
tttgacagataacgctttgattgct

SEQ ID NO: 136875 - DNA, 25 bp, Homo sapien
ttgacagataacgctttgattgctc

SEQ ID NO: 136876 - DNA, 25 bp, Homo sapien
agataacgctttgattgctcgatct

SEQ ID NO: 136877 - DNA, 25 bp, Homo sapien
tcatctgcatggaggatttgattca

SEQ ID NO: 136878 - DNA, 25 bp, Homo sapien
cccttcaaattgtcttctccacgag

SEQ ID NO: 136879 - DNA, 25 bp, Homo sapien
ccttcaaattgtcttctccacgagg

SEQ ID NO: 136880 - DNA, 25 bp, Homo sapien
cttcaaattgtcttctccacgaggt

SEQ ID NO: 136881 - DNA, 25 bp, Homo sapien
gaggaccagatcaacaggcttatta

SEQ ID NO: 136882 - DNA, 25 bp, Homo sapien
gaatgaactaaggtgtctaccatga

SEQ ID NO: 136883 - DNA, 25 bp, Homo sapien
ggaacacattgatctgggtatcgaa

SEQ ID NO: 136884 - DNA, 25 bp, Homo sapien
atgacccaagcattggtatctacgg

SEQ ID NO: 136885 - DNA, 25 bp, Homo sapien
acccaagcattggtatctacggcct

SEQ ID NO: 136886 - DNA, 25 bp, Homo sapien
cccaagcattggtatctacggcctg

SEQ ID NO: 136887 - DNA, 25 bp, Homo sapien
caagcattggtatctacggcctgga

SEQ ID NO: 136888 - DNA, 25 bp, Homo sapien
aagcattggtatctacggcctggac

SEQ ID NO: 136889 - DNA, 25 bp, Homo sapien
agcattggtatctacggcctggact

SEQ ID NO: 136890 - DNA, 25 bp, Homo sapien
gcattggtatctacggcctggactt

SEQ ID NO: 136891 - DNA, 25 bp, Homo sapien
cattggtatctacggcctggacttc

SEQ ID NO: 136892 - DNA, 25 bp, Homo sapien
gccaggtttcagcatcgcagacaag

SEQ ID NO: 136893 - DNA, 25 bp, Homo sapien
caagaagcgcaggacaggctgcatt

SEQ ID NO: 136894 - DNA, 25 bp, Homo sapien
ctggcattgttgtaaacgaacaagt

SEQ ID NO: 136895 - DNA, 25 bp, Homo sapien
gcgtattgagcacattaagcactct

SEQ ID NO: 136896 - DNA, 25 bp, Homo sapien
agagccgagataacttcctgaaacg

SEQ ID NO: 136897 - DNA, 25 bp, Homo sapien
gagccgagataacttcctgaaacgt

SEQ ID NO: 136898 - DNA, 25 bp, Homo sapien
agccgagataacttcctgaaacgtg

SEQ ID NO: 136899 - DNA, 25 bp, Homo sapien
gccgagataacttcctgaaacgtgt

SEQ ID NO: 136900 - DNA, 25 bp, Homo sapien
ccgagataacttcctgaaacgtgtg

SEQ ID NO: 136901 - DNA, 25 bp, Homo sapien
cgagataacttcctgaaacgtgtga

SEQ ID NO: 136902 - DNA, 25 bp, Homo sapien
gagataacttcctgaaacgtgtgaa

SEQ ID NO: 136903 - DNA, 25 bp, Homo sapien
gataacttcctgaaacgtgtgaagg

SEQ ID NO: 136904 - DNA, 25 bp, Homo sapien
aagaagcccaagagaaaggtacctg

SEQ ID NO: 136905 - DNA, 25 bp, Homo sapien
tagaaagctgagtgtttcacacctt

SEQ ID NO: 136906 - DNA, 25 bp, Homo sapien
aagctgagtgtttcacaccttatct

SEQ ID NO: 136907 - DNA, 25 bp, Homo sapien
gagtgtttcacaccttatctatgta

SEQ ID NO: 136908 - DNA, 25 bp, Homo sapien
gtgtttcacaccttatctatgtaga

SEQ ID NO: 136909 - DNA, 25 bp, Homo sapien
gtttcacaccttatctatgtagaat

SEQ ID NO: 136910 - DNA, 25 bp, Homo sapien
aagtttaagttctatgagggctaat

SEQ ID NO: 136911 - DNA, 25 bp, Homo sapien
gagggctaatatcttatcttcctat

SEQ ID NO: 136912 - DNA, 25 bp, Homo sapien
ggctaatatcttatcttcctataat

SEQ ID NO: 136913 - DNA, 25 bp, Homo sapien
cttactcttgattgtgggatactat

SEQ ID NO: 136914 - DNA, 25 bp, Homo sapien
actcttgattgtgggatactattta

SEQ ID NO: 136915 - DNA, 25 bp, Homo sapien
tgtgggatactatttaattatttca

SEQ ID NO: 136916 - DNA, 25 bp, Homo sapien
agttttgggacactgtgcttacctc

SEQ ID NO: 136917 - DNA, 25 bp, Homo sapien
tgtgcttacctccaaaaatctcatc

SEQ ID NO: 136918 - DNA, 25 bp, Homo sapien
aaaaatctcatctcttccctggcat

SEQ ID NO: 136919 - DNA, 25 bp, Homo sapien
tggcattctccctaggctctgtttt

SEQ ID NO: 136920 - DNA, 25 bp, Homo sapien
ggctcccgctttttcttgctctaga

SEQ ID NO: 136921 - DNA, 25 bp, Homo sapien
gagcagtattcaaccttttagctat

SEQ ID NO: 136922 - DNA, 25 bp, Homo sapien
caaccttttagctatgatgacacat

SEQ ID NO: 136923 - DNA, 25 bp, Homo sapien
gtactaatagttgaaatctgccttt

SEQ ID NO: 136924 - DNA, 25 bp, Homo sapien
gaaggcatacaaatatctgagagtg

SEQ ID NO: 136925 - DNA, 25 bp, Homo sapien
gtgactttgttgtatggctaccctt

SEQ ID NO: 136926 - DNA, 25 bp, Homo sapien
atggctacccttgtgatctacagta

SEQ ID NO: 136927 - DNA, 25 bp, Homo sapien
aagtagaagcttttaggaatgcaaa

SEQ ID NO: 136928 - DNA, 25 bp, Homo sapien
atcttgcatacagggagtggttaag

SEQ ID NO: 136929 - DNA, 25 bp, Homo sapien
ggttaagtaaggtttcatcacccat

SEQ ID NO: 136930 - DNA, 25 bp, Homo sapien
tttcatcacccatttagcactgctt

SEQ ID NO: 136931 - DNA, 25 bp, Homo sapien
acccatttagcactgcttttctgaa

SEQ ID NO: 136932 - DNA, 25 bp, Homo sapien
gaagacttcagttttgttaaggaga

SEQ ID NO: 136933 - DNA, 25 bp, Homo sapien
ggagatttagttttactgctttgac

SEQ ID NO: 136934 - DNA, 25 bp, Homo sapien
tgctttgactggtgggtcctctaga

SEQ ID NO: 136935 - DNA, 25 bp, Homo sapien
gataactcatgagaagtactgatag

SEQ ID NO: 136936 - DNA, 25 bp, Homo sapien
gtactgataggacctttatctggat

SEQ ID NO: 136937 - DNA, 25 bp, Homo sapien
acctttatctggatatggtcctata

SEQ ID NO: 136938 - DNA, 25 bp, Homo sapien
gaagaagagcgaccaggccctgaac

SEQ ID NO: 136939 - DNA, 25 bp, Homo sapien
accaggccctgaactgcggtgggac

SEQ ID NO: 136940 - DNA, 25 bp, Homo sapien
aactgcggtgggactgcctcgactg

SEQ ID NO: 136941 - DNA, 25 bp, Homo sapien
tggcagcgcgggaaacgtcaaactc

SEQ ID NO: 136942 - DNA, 25 bp, Homo sapien
gtcaaactcgaggaaagtgcagata

SEQ ID NO: 136943 - DNA, 25 bp, Homo sapien
gtgcagataacatactctccattgt

SEQ ID NO: 136944 - DNA, 25 bp, Homo sapien
gggatcgtcctgcaagacctactct

SEQ ID NO: 136945 - DNA, 25 bp, Homo sapien
gacctactcttttagaacaagtgtt

SEQ ID NO: 136946 - DNA, 25 bp, Homo sapien
gactgtcgttactaagaagtccaga

SEQ ID NO: 136947 - DNA, 25 bp, Homo sapien
gaagtccagaagtagtgcaattttt

SEQ ID NO: 136948 - DNA, 25 bp, Homo sapien
gacaacagcagtttccaggaacatc

SEQ ID NO: 136949 - DNA, 25 bp, Homo sapien
ataattttagacattgctttaactt

SEQ ID NO: 136950 - DNA, 25 bp, Homo sapien
taattttagacattgctttaacttt

SEQ ID NO: 136951 - DNA, 25 bp, Homo sapien
ggaaatgatgtttcaaaaggaatcc

SEQ ID NO: 136952 - DNA, 25 bp, Homo sapien
gaaatgatgtttcaaaaggaatcct

SEQ ID NO: 136953 - DNA, 25 bp, Homo sapien
tcaaaaggaatcctgtgatggaaat

SEQ ID NO: 136954 - DNA, 25 bp, Homo sapien
caaaaggaatcctgtgatggaaata

SEQ ID NO: 136955 - DNA, 25 bp, Homo sapien
aaaaggaatcctgtgatggaaatac

SEQ ID NO: 136956 - DNA, 25 bp, Homo sapien
aaaggaatcctgtgatggaaataca

SEQ ID NO: 136957 - DNA, 25 bp, Homo sapien
aaggaatcctgtgatggaaatacaa

SEQ ID NO: 136958 - DNA, 25 bp, Homo sapien
aggaatcctgtgatggaaatacaac

SEQ ID NO: 136959 - DNA, 25 bp, Homo sapien
gacagatgccatggtatgggccaca

SEQ ID NO: 136960 - DNA, 25 bp, Homo sapien
tggtatgggccacaggacacacttg

SEQ ID NO: 136961 - DNA, 25 bp, Homo sapien
aggacacacttgctcgagaaccaaa

SEQ ID NO: 136962 - DNA, 25 bp, Homo sapien
cttgctcgagaaccaaagtgcattt

SEQ ID NO: 136963 - DNA, 25 bp, Homo sapien
aagtgcatttgggtgacatttgaag

SEQ ID NO: 136964 - DNA, 25 bp, Homo sapien
gattgtggcaaagaatgctctggct

SEQ ID NO: 136965 - DNA, 25 bp, Homo sapien
caaagaatgctctggctggttacca

SEQ ID NO: 136966 - DNA, 25 bp, Homo sapien
tcccctgggcagaagaaacgcatgt

SEQ ID NO: 136967 - DNA, 25 bp, Homo sapien
gaagaaacgcatgtggaccagaaga

SEQ ID NO: 136968 - DNA, 25 bp, Homo sapien
gcatgtggaccagaagactttccct

SEQ ID NO: 136969 - DNA, 25 bp, Homo sapien
ttccctgctgccttaaaaccaataa

SEQ ID NO: 136970 - DNA, 25 bp, Homo sapien
ttcttcctgggtcttcagcattccc

SEQ ID NO: 136971 - DNA, 25 bp, Homo sapien
atgtccctgtgctaatcccaggatt

SEQ ID NO: 136972 - DNA, 25 bp, Homo sapien
taatcccaggattaggccataggag

SEQ ID NO: 136973 - DNA, 25 bp, Homo sapien
aggagtcctaagtgtcaccccgctg

SEQ ID NO: 136974 - DNA, 25 bp, Homo sapien
accccgctgtaagctcctttgtgga

SEQ ID NO: 136975 - DNA, 25 bp, Homo sapien
ctcctttgtggagtgctgggtaagc

SEQ ID NO: 136976 - DNA, 25 bp, Homo sapien
gctgggtaagcagtttccaataaac

SEQ ID NO: 136977 - DNA, 25 bp, Homo sapien
cagggccaagagaaaggcctgcaca

SEQ ID NO: 136978 - DNA, 25 bp, Homo sapien
acagctccctgccaaactgaagcat

SEQ ID NO: 136979 - DNA, 25 bp, Homo sapien
ctgaagcatctgtagtgacccactg

SEQ ID NO: 136980 - DNA, 25 bp, Homo sapien
ctgtagtgacccactggttccttct

SEQ ID NO: 136981 - DNA, 25 bp, Homo sapien
aaagaaacatgtcagcagggcctat

SEQ ID NO: 136982 - DNA, 25 bp, Homo sapien
aagaaacatgtcagcagggcctatg

SEQ ID NO: 136983 - DNA, 25 bp, Homo sapien
agaaacatgtcagcagggcctatgg

SEQ ID NO: 136984 - DNA, 25 bp, Homo sapien
gaaacatgtcagcagggcctatggt

SEQ ID NO: 136985 - DNA, 25 bp, Homo sapien
aaacatgtcagcagggcctatggtg

SEQ ID NO: 136986 - DNA, 25 bp, Homo sapien
aacatgtcagcagggcctatggtgg

SEQ ID NO: 136987 - DNA, 25 bp, Homo sapien
tggttccatgtgtgctaaatgtgtt

SEQ ID NO: 136988 - DNA, 25 bp, Homo sapien
gttccatgtgtgctaaatgtgttcg

SEQ ID NO: 136989 - DNA, 25 bp, Homo sapien
atgtgtgctaaatgtgttcgtgaca

SEQ ID NO: 136990 - DNA, 25 bp, Homo sapien
tgtgtgctaaatgtgttcgtgacag

SEQ ID NO: 136991 - DNA, 25 bp, Homo sapien
gtgtgctaaatgtgttcgtgacagg

SEQ ID NO: 136992 - DNA, 25 bp, Homo sapien
acagctacctcttctatggactggt

SEQ ID NO: 136993 - DNA, 25 bp, Homo sapien
cagctacctcttctatggactggtt

SEQ ID NO: 136994 - DNA, 25 bp, Homo sapien
gccacactgtgggactcttcttaac

SEQ ID NO: 136995 - DNA, 25 bp, Homo sapien
cacactgtgggactcttcttaactt

SEQ ID NO: 136996 - DNA, 25 bp, Homo sapien
cactgtgggactcttcttaacttaa

SEQ ID NO: 136997 - DNA, 25 bp, Homo sapien
ctgtgggactcttcttaacttaaat

SEQ ID NO: 136998 - DNA, 25 bp, Homo sapien
tgtgggactcttcttaacttaaatt

SEQ ID NO: 136999 - DNA, 25 bp, Homo sapien
acagtgtgtttgtgattgtttgctc

SEQ ID NO: 137000 - DNA, 25 bp, Homo sapien
gcctgtgtaggcagtcatggcacca

SEQ ID NO: 137001 - DNA, 25 bp, Homo sapien
cctgtgtaggcagtcatggcaccaa

SEQ ID NO: 137002 - DNA, 25 bp, Homo sapien
gccaccagactgacaaatgtgtatc

SEQ ID NO: 137003 - DNA, 25 bp, Homo sapien
acatgaagtgagatggctgaggttt

SEQ ID NO: 137004 - DNA, 25 bp, Homo sapien
aagtgagatggctgaggttttcagc

SEQ ID NO: 137005 - DNA, 25 bp, Homo sapien
aagttatcgtaactgttcctgtggt

SEQ ID NO: 137006 - DNA, 25 bp, Homo sapien
gttatcgtaactgttcctgtggttg

SEQ ID NO: 137007 - DNA, 25 bp, Homo sapien
tatcgtaactgttcctgtggttgct

SEQ ID NO: 137008 - DNA, 25 bp, Homo sapien
atcgtaactgttcctgtggttgctt

SEQ ID NO: 137009 - DNA, 25 bp, Homo sapien
gtaactgttcctgtggttgctttga

SEQ ID NO: 137010 - DNA, 25 bp, Homo sapien
taactgttcctgtggttgctttgaa

SEQ ID NO: 137011 - DNA, 25 bp, Homo sapien
actgttcctgtggttgctttgaaag

SEQ ID NO: 137012 - DNA, 25 bp, Homo sapien
tgttcctgtggttgctttgaaagaa

SEQ ID NO: 137013 - DNA, 25 bp, Homo sapien
tttctataaatcttcataggttatt

SEQ ID NO: 137014 - DNA, 25 bp, Homo sapien
ggcatcatcagagtactaacatgtt

SEQ ID NO: 137015 - DNA, 25 bp, Homo sapien
tttcagatatccaaagcttaccact

SEQ ID NO: 137016 - DNA, 25 bp, Homo sapien
aaagcttaccactttaggtgatgaa

SEQ ID NO: 137017 - DNA, 25 bp, Homo sapien
gatgaatctttactattttagccct

SEQ ID NO: 137018 - DNA, 25 bp, Homo sapien
attttagcccttttttgatgagact

SEQ ID NO: 137019 - DNA, 25 bp, Homo sapien
agactatttgtctaaagtgaatcat

SEQ ID NO: 137020 - DNA, 25 bp, Homo sapien
gtgaatcatttgttcttgccttatt

SEQ ID NO: 137021 - DNA, 25 bp, Homo sapien
gttcttgccttattaaacagagtag

SEQ ID NO: 137022 - DNA, 25 bp, Homo sapien
taatctattgtgaggaaactactaa

SEQ ID NO: 137023 - DNA, 25 bp, Homo sapien
tatgttggtgtgtttgtccttactt

SEQ ID NO: 137024 - DNA, 25 bp, Homo sapien
ttgtccttacttgaaatgggtctgt

SEQ ID NO: 137025 - DNA, 25 bp, Homo sapien
aacagatcttgctgacaagaggcaa

SEQ ID NO: 137026 - DNA, 25 bp, Homo sapien
tcttgctgacaagaggcaagtgtca

SEQ ID NO: 137027 - DNA, 25 bp, Homo sapien
tacaatgtaaagcagctctttcgac

SEQ ID NO: 137028 - DNA, 25 bp, Homo sapien
atgtaaagcagctctttcgacgtgt

SEQ ID NO: 137029 - DNA, 25 bp, Homo sapien
aaagcagctctttcgacgtgtagca

SEQ ID NO: 137030 - DNA, 25 bp, Homo sapien
gcagctctttcgacgtgtagcagca

SEQ ID NO: 137031 - DNA, 25 bp, Homo sapien
ctctttcgacgtgtagcagcagctt

SEQ ID NO: 137032 - DNA, 25 bp, Homo sapien
tgtagcagcagctttgccgggaatg

SEQ ID NO: 137033 - DNA, 25 bp, Homo sapien
agcagcagctttgccgggaatggaa

SEQ ID NO: 137034 - DNA, 25 bp, Homo sapien
ctttgccgggaatggaaagcacaca

SEQ ID NO: 137035 - DNA, 25 bp, Homo sapien
aaaactggaaaagcctcaggagcaa

SEQ ID NO: 137036 - DNA, 25 bp, Homo sapien
agggcaactgctacaagagcaactc

SEQ ID NO: 137037 - DNA, 25 bp, Homo sapien
tgacaaacggctccaggtaccccaa

SEQ ID NO: 137038 - DNA, 25 bp, Homo sapien
aggtaccccaactgtgcataccgga

SEQ ID NO: 137039 - DNA, 25 bp, Homo sapien
ggaccagcccgaaggagagacacat

SEQ ID NO: 137040 - DNA, 25 bp, Homo sapien
gagacacatcattgtggcctgtgaa

SEQ ID NO: 137041 - DNA, 25 bp, Homo sapien
aagggagcccatatgtgccagtcca

SEQ ID NO: 137042 - DNA, 25 bp, Homo sapien
tgccagtccactttgatgcttctgt

SEQ ID NO: 137043 - DNA, 25 bp, Homo sapien
atgcttctgtggaggactctaccta

SEQ ID NO: 137044 - DNA, 25 bp, Homo sapien
aaggtcagagcagcgagatacccca

SEQ ID NO: 137045 - DNA, 25 bp, Homo sapien
tcttccttccctgctgtgaaagaag

SEQ ID NO: 137046 - DNA, 25 bp, Homo sapien
acagttagggctcctattcaacaca

SEQ ID NO: 137047 - DNA, 25 bp, Homo sapien
aagcacctcccaaggaggatctatc

SEQ ID NO: 137048 - DNA, 25 bp, Homo sapien
aggatctatctgaggcctagaggcc

SEQ ID NO: 137049 - DNA, 25 bp, Homo sapien
tctgaggcctagaggcctggagctt

SEQ ID NO: 137050 - DNA, 25 bp, Homo sapien
gggatggacaagtctgaaaacctca

SEQ ID NO: 137051 - DNA, 25 bp, Homo sapien
tgaaaacctcacaactccttaccaa

SEQ ID NO: 137052 - DNA, 25 bp, Homo sapien
ctaaggatagtcagcgagctggact

SEQ ID NO: 137053 - DNA, 25 bp, Homo sapien
agaaaaccagatgtcctagggccta

SEQ ID NO: 137054 - DNA, 25 bp, Homo sapien
atgtcctagggcctagcccttgtag

SEQ ID NO: 137055 - DNA, 25 bp, Homo sapien
cttgtagtcagaaccaccagggaac

SEQ ID NO: 137056 - DNA, 25 bp, Homo sapien
gtagtcagaaccaccagggaacagc

SEQ ID NO: 137057 - DNA, 25 bp, Homo sapien
atgagaaggcctggaggctgattct

SEQ ID NO: 137058 - DNA, 25 bp, Homo sapien
agctgctgctcgatgcttctgccct

SEQ ID NO: 137059 - DNA, 25 bp, Homo sapien
gggcgtccagcatcaagccagaggc

SEQ ID NO: 137060 - DNA, 25 bp, Homo sapien
gtccagcatcaagccagaggccagt

SEQ ID NO: 137061 - DNA, 25 bp, Homo sapien
gcatcaagccagaggccagtcagat

SEQ ID NO: 137062 - DNA, 25 bp, Homo sapien
aagccagaggccagtcagatgcccc

SEQ ID NO: 137063 - DNA, 25 bp, Homo sapien
tgcaggcggcacgtcagatgacccg

SEQ ID NO: 137064 - DNA, 25 bp, Homo sapien
gcggcacgtcagatgacccggagcc

SEQ ID NO: 137065 - DNA, 25 bp, Homo sapien
agcgggcctcatctcccacgggtga

SEQ ID NO: 137066 - DNA, 25 bp, Homo sapien
cacgggtgatgcttccaggggttct

SEQ ID NO: 137067 - DNA, 25 bp, Homo sapien
ttctggcgggagtctcagccgaaga

SEQ ID NO: 137068 - DNA, 25 bp, Homo sapien
agtctcagccgaagagagctgggct

SEQ ID NO: 137069 - DNA, 25 bp, Homo sapien
cagttcacctggatagaatcatcta

SEQ ID NO: 137070 - DNA, 25 bp, Homo sapien
agttcacctggatagaatcatctaa

SEQ ID NO: 137071 - DNA, 25 bp, Homo sapien
tcacctggatagaatcatctaagct

SEQ ID NO: 137072 - DNA, 25 bp, Homo sapien
gatcccatctctccatatactttgg

SEQ ID NO: 137073 - DNA, 25 bp, Homo sapien
atcccatctctccatatactttggg

SEQ ID NO: 137074 - DNA, 25 bp, Homo sapien
ccatctctccatatactttgggtat

SEQ ID NO: 137075 - DNA, 25 bp, Homo sapien
atctctccatatactttgggtatca

SEQ ID NO: 137076 - DNA, 25 bp, Homo sapien
ctctccatatactttgggtatcagc

SEQ ID NO: 137077 - DNA, 25 bp, Homo sapien
ctccatatactttgggtatcagcat

SEQ ID NO: 137078 - DNA, 25 bp, Homo sapien
catatactttgggtatcagcatctg

SEQ ID NO: 137079 - DNA, 25 bp, Homo sapien
atactttgggtatcagcatctgtcc

SEQ ID NO: 137080 - DNA, 25 bp, Homo sapien
ggccgaattgacaaacccatcttga

SEQ ID NO: 137081 - DNA, 25 bp, Homo sapien
atcttgaaggctggccgggcgtacc

SEQ ID NO: 137082 - DNA, 25 bp, Homo sapien
ctggccgggcgtaccacaaatataa

SEQ ID NO: 137083 - DNA, 25 bp, Homo sapien
agaggaactgctggccacgagtacg

SEQ ID NO: 137084 - DNA, 25 bp, Homo sapien
gccatgaatcctgtggagcatcctt

SEQ ID NO: 137085 - DNA, 25 bp, Homo sapien
agcatccttttggaggtggcaacca

SEQ ID NO: 137086 - DNA, 25 bp, Homo sapien
gtggcaaccaccagcacatcggcaa

SEQ ID NO: 137087 - DNA, 25 bp, Homo sapien
agagatgcccctgctggccgcaaag

SEQ ID NO: 137088 - DNA, 25 bp, Homo sapien
tgctggccgcaaagtgggtctcatt

SEQ ID NO: 137089 - DNA, 25 bp, Homo sapien
aaagtgggtctcattgctgcccgcc

SEQ ID NO: 137090 - DNA, 25 bp, Homo sapien
gggaaccaagactgtgcaggagaaa

SEQ ID NO: 137091 - DNA, 25 bp, Homo sapien
atatgagctggcaactgctttcaca

SEQ ID NO: 137092 - DNA, 25 bp, Homo sapien
ggcaactgctttcacagagttctat

SEQ ID NO: 137093 - DNA, 25 bp, Homo sapien
agagttctatgatagctgctactgt

SEQ ID NO: 137094 - DNA, 25 bp, Homo sapien
atgatagctgctactgtgtggagaa

SEQ ID NO: 137095 - DNA, 25 bp, Homo sapien
ttgaaggtgaacatgtggcgtatct

SEQ ID NO: 137096 - DNA, 25 bp, Homo sapien
gaacatgtggcgtatcttgtgtgaa

SEQ ID NO: 137097 - DNA, 25 bp, Homo sapien
gtatcttgtgtgaaacagtagctgc

SEQ ID NO: 137098 - DNA, 25 bp, Homo sapien
tggcccaagggtgtaatccctcaca

SEQ ID NO: 137099 - DNA, 25 bp, Homo sapien
aatccctcacaggtttgaaccctgt

SEQ ID NO: 137100 - DNA, 25 bp, Homo sapien
tgaaccctgtgtgttttttcccaag

SEQ ID NO: 137101 - DNA, 25 bp, Homo sapien
tttttcccaagtggccattggccct

SEQ ID NO: 137102 - DNA, 25 bp, Homo sapien
gctgcttcctcctggaaattgacga

SEQ ID NO: 137103 - DNA, 25 bp, Homo sapien
gcttcctcctggaaattgacgaggg

SEQ ID NO: 137104 - DNA, 25 bp, Homo sapien
cagagctggctctgagcgcctccat

SEQ ID NO: 137105 - DNA, 25 bp, Homo sapien
catccaaggccaggttctccgttag

SEQ ID NO: 137106 - DNA, 25 bp, Homo sapien
aaggccaggttctccgttagctcct

SEQ ID NO: 137107 - DNA, 25 bp, Homo sapien
ggccctgggctggaatcaggaatat

SEQ ID NO: 137108 - DNA, 25 bp, Homo sapien
caaagagtgatagtcttttgctttt

SEQ ID NO: 137109 - DNA, 25 bp, Homo sapien
gcttttggcaaaactctacttaatc

SEQ ID NO: 137110 - DNA, 25 bp, Homo sapien
gcaaaactctacttaatccaatggg

SEQ ID NO: 137111 - DNA, 25 bp, Homo sapien
atccaatgggtttttccctgtacag

SEQ ID NO: 137112 - DNA, 25 bp, Homo sapien
tccaatgggtttttccctgtacagt

SEQ ID NO: 137113 - DNA, 25 bp, Homo sapien
cttcctgttgtgactgccaggataa

SEQ ID NO: 137114 - DNA, 25 bp, Homo sapien
actgccaggataaagcttccgggaa

SEQ ID NO: 137115 - DNA, 25 bp, Homo sapien
ttccgggaaaacagctattatatca

SEQ ID NO: 137116 - DNA, 25 bp, Homo sapien
ggagacaggtcagtagtcacaaact

SEQ ID NO: 137117 - DNA, 25 bp, Homo sapien
gtttattccttctgtagtgtattaa

SEQ ID NO: 137118 - DNA, 25 bp, Homo sapien
gtagtgtattaatctctgtgtgttt

SEQ ID NO: 137119 - DNA, 25 bp, Homo sapien
ggtgccttaggaatgacttgggttt

SEQ ID NO: 137120 - DNA, 25 bp, Homo sapien
gggtttaacaagctgtctactggac

SEQ ID NO: 137121 - DNA, 25 bp, Homo sapien
gtctactggacaatcttatgtttcc

SEQ ID NO: 137122 - DNA, 25 bp, Homo sapien
taaagctggagagacctgacccttc

SEQ ID NO: 137123 - DNA, 25 bp, Homo sapien
acccttctctcacttctaaattaat

SEQ ID NO: 137124 - DNA, 25 bp, Homo sapien
atgaaaggttctgccattacaggac

SEQ ID NO: 137125 - DNA, 25 bp, Homo sapien
gaaaggttctgccattacaggacca

SEQ ID NO: 137126 - DNA, 25 bp, Homo sapien
aaggttctgccattacaggaccagt

SEQ ID NO: 137127 - DNA, 25 bp, Homo sapien
aggttctgccattacaggaccagta

SEQ ID NO: 137128 - DNA, 25 bp, Homo sapien
ggttctgccattacaggaccagtag

SEQ ID NO: 137129 - DNA, 25 bp, Homo sapien
gttctgccattacaggaccagtagc

SEQ ID NO: 137130 - DNA, 25 bp, Homo sapien
tctgccattacaggaccagtagcaa

SEQ ID NO: 137131 - DNA, 25 bp, Homo sapien
tgccattacaggaccagtagcaaag

SEQ ID NO: 137132 - DNA, 25 bp, Homo sapien
cattacaggaccagtagcaaaggag

SEQ ID NO: 137133 - DNA, 25 bp, Homo sapien
gctggcagcattgcatgattctcca

SEQ ID NO: 137134 - DNA, 25 bp, Homo sapien
ggcagcattgcatgattctccagta

SEQ ID NO: 137135 - DNA, 25 bp, Homo sapien
ttccctcccaaaagcttagctatgt

SEQ ID NO: 137136 - DNA, 25 bp, Homo sapien
aagcttagctatgtataaagtgcca

SEQ ID NO: 137137 - DNA, 25 bp, Homo sapien
aaagtgccacagataggaaacagct

SEQ ID NO: 137138 - DNA, 25 bp, Homo sapien
ggaaacagctgttaattacaaagag

SEQ ID NO: 137139 - DNA, 25 bp, Homo sapien
gaaagaattgtcatagcatcttatt

SEQ ID NO: 137140 - DNA, 25 bp, Homo sapien
gcatcttattttgttcctagtttta

SEQ ID NO: 137141 - DNA, 25 bp, Homo sapien
gttttataacattaccatccttcgt

SEQ ID NO: 137142 - DNA, 25 bp, Homo sapien
taccatccttcgttttgaactacag

SEQ ID NO: 137143 - DNA, 25 bp, Homo sapien
ggagtggagtaagatgccctcccac

SEQ ID NO: 137144 - DNA, 25 bp, Homo sapien
gccctcccacttttatcagtttagt

SEQ ID NO: 137145 - DNA, 25 bp, Homo sapien
gagaaaaatcccttcagctctaaga

SEQ ID NO: 137146 - DNA, 25 bp, Homo sapien
gtgacagtcacggaggataagatca

SEQ ID NO: 137147 - DNA, 25 bp, Homo sapien
gtcacggaggataagatcaatgccc

SEQ ID NO: 137148 - DNA, 25 bp, Homo sapien
ggataagatcaatgccctcattaaa

SEQ ID NO: 137149 - DNA, 25 bp, Homo sapien
aagatcaatgccctcattaaagcag

SEQ ID NO: 137150 - DNA, 25 bp, Homo sapien
ttaaagcagccggtgtaaatgttga

SEQ ID NO: 137151 - DNA, 25 bp, Homo sapien
aagcagccggtgtaaatgttgagcc

SEQ ID NO: 137152 - DNA, 25 bp, Homo sapien
aaatgttgagcctttttggcctggc

SEQ ID NO: 137153 - DNA, 25 bp, Homo sapien
aatgttgagcctttttggcctggct

SEQ ID NO: 137154 - DNA, 25 bp, Homo sapien
tggccaacgtcaacattgggagcct

SEQ ID NO: 137155 - DNA, 25 bp, Homo sapien
gtcaacattgggagcctcatctgca

SEQ ID NO: 137156 - DNA, 25 bp, Homo sapien
aacattgggagcctcatctgcaatg

SEQ ID NO: 137157 - DNA, 25 bp, Homo sapien
ctacacgcgagctgcttccacagcg

SEQ ID NO: 137158 - DNA, 25 bp, Homo sapien
acacgcgagctgcttccacagcgcg

SEQ ID NO: 137159 - DNA, 25 bp, Homo sapien
gcgagctgcttccacagcgcggcac

SEQ ID NO: 137160 - DNA, 25 bp, Homo sapien
agctgcttccacagcgcggcacctg

SEQ ID NO: 137161 - DNA, 25 bp, Homo sapien
tccacagcgcggcacctgtacctcc

SEQ ID NO: 137162 - DNA, 25 bp, Homo sapien
gcacctgtacctccggggtggcgct

SEQ ID NO: 137163 - DNA, 25 bp, Homo sapien
gggttggctccatgaccaagatcta

SEQ ID NO: 137164 - DNA, 25 bp, Homo sapien
ggttggctccatgaccaagatctat

SEQ ID NO: 137165 - DNA, 25 bp, Homo sapien
gttggctccatgaccaagatctatg

SEQ ID NO: 137166 - DNA, 25 bp, Homo sapien
ttggctccatgaccaagatctatgg

SEQ ID NO: 137167 - DNA, 25 bp, Homo sapien
tggctccatgaccaagatctatggg

SEQ ID NO: 137168 - DNA, 25 bp, Homo sapien
aattcctacttcatggatgtgaaat

SEQ ID NO: 137169 - DNA, 25 bp, Homo sapien
atgtgaaatgcccaggatgctataa

SEQ ID NO: 137170 - DNA, 25 bp, Homo sapien
gatgctataaaatcaccacggtctt

SEQ ID NO: 137171 - DNA, 25 bp, Homo sapien
accacggtctttagccatgcacaaa

SEQ ID NO: 137172 - DNA, 25 bp, Homo sapien
ggtctttagccatgcacaaacggta

SEQ ID NO: 137173 - DNA, 25 bp, Homo sapien
ttagccatgcacaaacggtagtttt

SEQ ID NO: 137174 - DNA, 25 bp, Homo sapien
tacgcacacgagaacatgcctctcg

SEQ ID NO: 137175 - DNA, 25 bp, Homo sapien
gcctacaggaggaaaagcaaggctt

SEQ ID NO: 137176 - DNA, 25 bp, Homo sapien
ggaagcagcactaaaagcactctga

SEQ ID NO: 137177 - DNA, 25 bp, Homo sapien
atgcctctcgcaaaggatctccttc

SEQ ID NO: 137178 - DNA, 25 bp, Homo sapien
tccttcatccctctccagaagagga

SEQ ID NO: 137179 - DNA, 25 bp, Homo sapien
gaacgccatcatcaacagtggtccc

SEQ ID NO: 137180 - DNA, 25 bp, Homo sapien
catcatcaacagtggtccccgggag

SEQ ID NO: 137181 - DNA, 25 bp, Homo sapien
tcatcaacagtggtccccgggagga

SEQ ID NO: 137182 - DNA, 25 bp, Homo sapien
cgggaggactccacacgcattgggc

SEQ ID NO: 137183 - DNA, 25 bp, Homo sapien
ggaggactccacacgcattgggcgc

SEQ ID NO: 137184 - DNA, 25 bp, Homo sapien
ctgctgtgcacaggcgctcgtgagg

SEQ ID NO: 137185 - DNA, 25 bp, Homo sapien
tgtgcacaggcgctcgtgaggctgc

SEQ ID NO: 137186 - DNA, 25 bp, Homo sapien
ttccggaacattaagaccattgctg

SEQ ID NO: 137187 - DNA, 25 bp, Homo sapien
ccggaacattaagaccattgctgag

SEQ ID NO: 137188 - DNA, 25 bp, Homo sapien
aagtccaaccgctgattttccagct

SEQ ID NO: 137189 - DNA, 25 bp, Homo sapien
agtccaaccgctgattttccagctg

SEQ ID NO: 137190 - DNA, 25 bp, Homo sapien
gataaggatcagaacagcagaggtt

SEQ ID NO: 137191 - DNA, 25 bp, Homo sapien
gaacagcagaggttcttttaaaggg

SEQ ID NO: 137192 - DNA, 25 bp, Homo sapien
gagagaacaactactgtgatcaggc

SEQ ID NO: 137193 - DNA, 25 bp, Homo sapien
gaacaactactgtgatcaggctatg

SEQ ID NO: 137194 - DNA, 25 bp, Homo sapien
actgtgatcaggctatgtatggaat

SEQ ID NO: 137195 - DNA, 25 bp, Homo sapien
gtgatcaggctatgtatggaataca

SEQ ID NO: 137196 - DNA, 25 bp, Homo sapien
aaactgcattagaaattagctgtgt

SEQ ID NO: 137197 - DNA, 25 bp, Homo sapien
tagctgtgtgaaataccagtgtggt

SEQ ID NO: 137198 - DNA, 25 bp, Homo sapien
ttatttaagcttatgtcagacctat

SEQ ID NO: 137199 - DNA, 25 bp, Homo sapien
taagcttatgtcagacctatttgac

SEQ ID NO: 137200 - DNA, 25 bp, Homo sapien
gtcagacctatttgacataacacta

SEQ ID NO: 137201 - DNA, 25 bp, Homo sapien
ggcaaacttcgaggggttcgtcctg

SEQ ID NO: 137202 - DNA, 25 bp, Homo sapien
gcaaacttcgaggggttcgtcctgt

SEQ ID NO: 137203 - DNA, 25 bp, Homo sapien
tcgaggggttcgtcctgtaagacct

SEQ ID NO: 137204 - DNA, 25 bp, Homo sapien
tgtgttcgtgacaggatcaagcgtg

SEQ ID NO: 137205 - DNA, 25 bp, Homo sapien
gtgttcgtgacaggatcaagcgtgc

SEQ ID NO: 137206 - DNA, 25 bp, Homo sapien
tgttcgtgacaggatcaagcgtgct

SEQ ID NO: 137207 - DNA, 25 bp, Homo sapien
gttcgtgacaggatcaagcgtgctt

SEQ ID NO: 137208 - DNA, 25 bp, Homo sapien
ttcgtgacaggatcaagcgtgcttt

SEQ ID NO: 137209 - DNA, 25 bp, Homo sapien
tcgtgacaggatcaagcgtgctttc

SEQ ID NO: 137210 - DNA, 25 bp, Homo sapien
cgtgacaggatcaagcgtgctttcc

SEQ ID NO: 137211 - DNA, 25 bp, Homo sapien
gtgacaggatcaagcgtgctttcct

SEQ ID NO: 137212 - DNA, 25 bp, Homo sapien
tgaagttggtacctacaaagatatg

SEQ ID NO: 137213 - DNA, 25 bp, Homo sapien
agttggtacctacaaagatatgagc

SEQ ID NO: 137214 - DNA, 25 bp, Homo sapien
caaagatatgagctcactactacat

SEQ ID NO: 137215 - DNA, 25 bp, Homo sapien
atgagctcactactacatatgacta

SEQ ID NO: 137216 - DNA, 25 bp, Homo sapien
gctcactactacatatgactatctg

SEQ ID NO: 137217 - DNA, 25 bp, Homo sapien
acatatgactatctgtaatggatca

SEQ ID NO: 137218 - DNA, 25 bp, Homo sapien
tatgactatctgtaatggatcaatt

SEQ ID NO: 137219 - DNA, 25 bp, Homo sapien
ggatcaattttggatatgactttgg

SEQ ID NO: 137220 - DNA, 25 bp, Homo sapien
aattttggatatgactttgggtggg

SEQ ID NO: 137221 - DNA, 25 bp, Homo sapien
agaaccgaagacatgtaatatagat

SEQ ID NO: 137222 - DNA, 25 bp, Homo sapien
ggtgcagttgcctgcactttaggag

SEQ ID NO: 137223 - DNA, 25 bp, Homo sapien
tggtgtgtgcccaggcaaacttcga

SEQ ID NO: 137224 - DNA, 25 bp, Homo sapien
tcgaggggttcgtcctgtaagacct

SEQ ID NO: 137225 - DNA, 25 bp, Homo sapien
tcgtcctgtaagacctaaagttctt

SEQ ID NO: 137226 - DNA, 25 bp, Homo sapien
aagttcttatgagattgtccaaaac

SEQ ID NO: 137227 - DNA, 25 bp, Homo sapien
gaaacatgtcagcagggcctatggt

SEQ ID NO: 137228 - DNA, 25 bp, Homo sapien
tgtgttcgtgacaggatcaagcgtg

SEQ ID NO: 137229 - DNA, 25 bp, Homo sapien
gttcgtgacaggatcaagcgtgctt

SEQ ID NO: 137230 - DNA, 25 bp, Homo sapien
tcgtgacaggatcaagcgtgctttc

SEQ ID NO: 137231 - DNA, 25 bp, Homo sapien
gtgacaggatcaagcgtgctttcct

SEQ ID NO: 137232 - DNA, 25 bp, Homo sapien
gatcaagcgtgctttccttatcgag

SEQ ID NO: 137233 - DNA, 25 bp, Homo sapien
gttgaaggcacaagcacagagtcag

SEQ ID NO: 137234 - DNA, 25 bp, Homo sapien
gacctggaactgaactgagctgctc

SEQ ID NO: 137235 - DNA, 25 bp, Homo sapien
aggaagtcttcagggaaggtcacct

SEQ ID NO: 137236 - DNA, 25 bp, Homo sapien
ggaaggtcacctgagcccggatgct

SEQ ID NO: 137237 - DNA, 25 bp, Homo sapien
tgagcccggatgcttctccatgaga

SEQ ID NO: 137238 - DNA, 25 bp, Homo sapien
gatgcttctccatgagacacatctc

SEQ ID NO: 137239 - DNA, 25 bp, Homo sapien
atcttttttatgtgccgtgttattg

SEQ ID NO: 137240 - DNA, 25 bp, Homo sapien
gccgtgttattgtattaggtgtcat

SEQ ID NO: 137241 - DNA, 25 bp, Homo sapien
tagtttagccaaaggataagtgtcc

SEQ ID NO: 137242 - DNA, 25 bp, Homo sapien
gggatggtccactgtcactgtttct

SEQ ID NO: 137243 - DNA, 25 bp, Homo sapien
tgtcactgtttctctgctgttgcaa

SEQ ID NO: 137244 - DNA, 25 bp, Homo sapien
ctctgctgttgcaaatacatggata

SEQ ID NO: 137245 - DNA, 25 bp, Homo sapien
aacggtgctggtacaggatacagga

SEQ ID NO: 137246 - DNA, 25 bp, Homo sapien
aaattgtatcttcacctggttccta

SEQ ID NO: 137247 - DNA, 25 bp, Homo sapien
tgtatcttcacctggttcctaccct

SEQ ID NO: 137248 - DNA, 25 bp, Homo sapien
tggtcctgaagacccctcggaacac

SEQ ID NO: 137249 - DNA, 25 bp, Homo sapien
agtctccatccaccccagagaggaa

SEQ ID NO: 137250 - DNA, 25 bp, Homo sapien
gcatcaggtgtagggaccctgccaa

SEQ ID NO: 137251 - DNA, 25 bp, Homo sapien
accctgccaagtggcacctgattta

SEQ ID NO: 137252 - DNA, 25 bp, Homo sapien
gccaagtggcacctgatttactcta

SEQ ID NO: 137253 - DNA, 25 bp, Homo sapien
aagtggcacctgatttactctagaa

SEQ ID NO: 137254 - DNA, 25 bp, Homo sapien
gtggcacctgatttactctagaaaa

SEQ ID NO: 137255 - DNA, 25 bp, Homo sapien
ggcacctgatttactctagaaaata

SEQ ID NO: 137256 - DNA, 25 bp, Homo sapien
caagccttcaaatctcttaattttt

SEQ ID NO: 137257 - DNA, 25 bp, Homo sapien
aaatctgtgagtggtttaaggagcg

SEQ ID NO: 137258 - DNA, 25 bp, Homo sapien
ttaaggagcggtcagtgtgtataaa

SEQ ID NO: 137259 - DNA, 25 bp, Homo sapien
aagtgtgtttgaacattatgccaaa

SEQ ID NO: 137260 - DNA, 25 bp, Homo sapien
gactaattcaggatgcaaaaacgtt

SEQ ID NO: 137261 - DNA, 25 bp, Homo sapien
gtttaggatgcaattacgagtgtaa

SEQ ID NO: 137262 - DNA, 25 bp, Homo sapien
cgagtgtaaactgtgtgccttattt

SEQ ID NO: 137263 - DNA, 25 bp, Homo sapien
aactgtgtgccttatttacacttta

SEQ ID NO: 137264 - DNA, 25 bp, Homo sapien
atttacactttattgtctcccgctt

SEQ ID NO: 137265 - DNA, 25 bp, Homo sapien
tctcccgcttctcagatagttttga

SEQ ID NO: 137266 - DNA, 25 bp, Homo sapien
cagatagttttgatgtgttgtacag

SEQ ID NO: 137267 - DNA, 25 bp, Homo sapien
atatccttgaacctaccttaaaatg

SEQ ID NO: 137268 - DNA, 25 bp, Homo sapien
gaacctaccttaaaatgccaatgag

SEQ ID NO: 137269 - DNA, 25 bp, Homo sapien
gaggtaggcctgatctttgaatagt

SEQ ID NO: 137270 - DNA, 25 bp, Homo sapien
tagtggctaggatacaatgcatttc

SEQ ID NO: 137271 - DNA, 25 bp, Homo sapien
acaatgcatttcctcagtgatcact

SEQ ID NO: 137272 - DNA, 25 bp, Homo sapien
tgggatccttgggaagccaaacgga

SEQ ID NO: 137273 - DNA, 25 bp, Homo sapien
tcatgtcccatccagtccagtgaat

SEQ ID NO: 137274 - DNA, 25 bp, Homo sapien
cccgcaacagcttataccatggaat

SEQ ID NO: 137275 - DNA, 25 bp, Homo sapien
aaggtgatactctgagctgtggact

SEQ ID NO: 137276 - DNA, 25 bp, Homo sapien
gctgtggactgaactggcagacaca

SEQ ID NO: 137277 - DNA, 25 bp, Homo sapien
tggcagacacaacctgtacagattg

SEQ ID NO: 137278 - DNA, 25 bp, Homo sapien
gtgattggtggagccaacctcggtc

SEQ ID NO: 137279 - DNA, 25 bp, Homo sapien
aacctcggtcgtgttggtgtgatca

SEQ ID NO: 137280 - DNA, 25 bp, Homo sapien
tgtgatcaccaacagggaaagacat

SEQ ID NO: 137281 - DNA, 25 bp, Homo sapien
gacatcctggttcttttgatgtggt

SEQ ID NO: 137282 - DNA, 25 bp, Homo sapien
tgtggtgcatgtgaaggatgccaat

SEQ ID NO: 137283 - DNA, 25 bp, Homo sapien
ggcaataaaccttggatttccctgc

SEQ ID NO: 137284 - DNA, 25 bp, Homo sapien
gggaaagggcattcgacttactgtt

SEQ ID NO: 137285 - DNA, 25 bp, Homo sapien
gggcattcgacttactgttgctgaa

SEQ ID NO: 137286 - DNA, 25 bp, Homo sapien
gagataagaggctggccaccaaaca

SEQ ID NO: 137287 - DNA, 25 bp, Homo sapien
acagagcagtggctaaattgcagta

SEQ ID NO: 137288 - DNA, 25 bp, Homo sapien
attgcagtagcagcatatctttttt

SEQ ID NO: 137289 - DNA, 25 bp, Homo sapien
caaactgaaggtatgtgcactgcgc

SEQ ID NO: 137290 - DNA, 25 bp, Homo sapien
aactgaaggtatgtgcactgcgcgt

SEQ ID NO: 137291 - DNA, 25 bp, Homo sapien
ctgaaggtatgtgcactgcgcgtga

SEQ ID NO: 137292 - DNA, 25 bp, Homo sapien
tgtgcactgcgcgtgaccagccggg

SEQ ID NO: 137293 - DNA, 25 bp, Homo sapien
gggcaagatcctcactttcgaccag

SEQ ID NO: 137294 - DNA, 25 bp, Homo sapien
aagatcctcactttcgaccagctgg

SEQ ID NO: 137295 - DNA, 25 bp, Homo sapien
tggactcccctaagggctgtggcac

SEQ ID NO: 137296 - DNA, 25 bp, Homo sapien
cctaagggctgtggcactgtcctgc

SEQ ID NO: 137297 - DNA, 25 bp, Homo sapien
tccggtcctcgcaagggccgagagg

SEQ ID NO: 137298 - DNA, 25 bp, Homo sapien
gtgtaccggcatttcggcaaggccc

SEQ ID NO: 137299 - DNA, 25 bp, Homo sapien
ggcatttcggcaaggccccaggaac

SEQ ID NO: 137300 - DNA, 25 bp, Homo sapien
actgaacttaatcatgtcgtatttg

SEQ ID NO: 137301 - DNA, 25 bp, Homo sapien
ttttggtaataacttctctgtgaac

SEQ ID NO: 137302 - DNA, 25 bp, Homo sapien
ctctgtgaactattaatcatcctct

SEQ ID NO: 137303 - DNA, 25 bp, Homo sapien
tcatcctctgagttaaataattgct

SEQ ID NO: 137304 - DNA, 25 bp, Homo sapien
ataattgctcctatactattgaagt

SEQ ID NO: 137305 - DNA, 25 bp, Homo sapien
aagcattggttattcaagtattcat

SEQ ID NO: 137306 - DNA, 25 bp, Homo sapien
attcattgttgatcctcctattctc

SEQ ID NO: 137307 - DNA, 25 bp, Homo sapien
tcctattctcttccgtctaatctct

SEQ ID NO: 137308 - DNA, 25 bp, Homo sapien
gtctaatctctcacctgctaaagga

SEQ ID NO: 137309 - DNA, 25 bp, Homo sapien
cacctgctaaaggagatttacacat

SEQ ID NO: 137310 - DNA, 25 bp, Homo sapien
attttcatttatccagatgaccatt

SEQ ID NO: 137311 - DNA, 25 bp, Homo sapien
aaagaagaagattctgtgactcatg

SEQ ID NO: 137312 - DNA, 25 bp, Homo sapien
aaatgatatgagattcgaattccag

SEQ ID NO: 137313 - DNA, 25 bp, Homo sapien
aatgatatgagattcgaattccagt

SEQ ID NO: 137314 - DNA, 25 bp, Homo sapien
atgatatgagattcgaattccagtg

SEQ ID NO: 137315 - DNA, 25 bp, Homo sapien
tgatatgagattcgaattccagtgt

SEQ ID NO: 137316 - DNA, 25 bp, Homo sapien
gatatgagattcgaattccagtgtc

SEQ ID NO: 137317 - DNA, 25 bp, Homo sapien
atatgagattcgaattccagtgtct

SEQ ID NO: 137318 - DNA, 25 bp, Homo sapien
tatgagattcgaattccagtgtcta

SEQ ID NO: 137319 - DNA, 25 bp, Homo sapien
atgagattcgaattccagtgtctat

SEQ ID NO: 137320 - DNA, 25 bp, Homo sapien
tgagattcgaattccagtgtctata

SEQ ID NO: 137321 - DNA, 25 bp, Homo sapien
tccttgtcctcgtccaaaaagacgt

SEQ ID NO: 137322 - DNA, 25 bp, Homo sapien
aaagacgtcagccttacaacgcaat

SEQ ID NO: 137323 - DNA, 25 bp, Homo sapien
gccttacaacgcaatattttctcca

SEQ ID NO: 137324 - DNA, 25 bp, Homo sapien
tattttctccaaaaggcaaggagca

SEQ ID NO: 137325 - DNA, 25 bp, Homo sapien
gcaaggagcagaagacatagacgtt

SEQ ID NO: 137326 - DNA, 25 bp, Homo sapien
ttgtgatattttgcttttgcacctt

SEQ ID NO: 137327 - DNA, 25 bp, Homo sapien
gcttttgcacctttaaaacaataag

SEQ ID NO: 137328 - DNA, 25 bp, Homo sapien
aataaggcgctttcattttgcactc

SEQ ID NO: 137329 - DNA, 25 bp, Homo sapien
aaggcgctttcattttgcactctaa

SEQ ID NO: 137330 - DNA, 25 bp, Homo sapien
gctttcattttgcactctaacttaa

SEQ ID NO: 137331 - DNA, 25 bp, Homo sapien
gagtttttactttatgtagtgatac

SEQ ID NO: 137332 - DNA, 25 bp, Homo sapien
ttccctcacaccgcgtctggtgaca

SEQ ID NO: 137333 - DNA, 25 bp, Homo sapien
tccctcacaccgcgtctggtgacaa

SEQ ID NO: 137334 - DNA, 25 bp, Homo sapien
ccctcacaccgcgtctggtgacaac

SEQ ID NO: 137335 - DNA, 25 bp, Homo sapien
cctcacaccgcgtctggtgacaacc

SEQ ID NO: 137336 - DNA, 25 bp, Homo sapien
tcacaccgcgtctggtgacaaccga

SEQ ID NO: 137337 - DNA, 25 bp, Homo sapien
cacaccgcgtctggtgacaaccgag

SEQ ID NO: 137338 - DNA, 25 bp, Homo sapien
acaccgcgtctggtgacaaccgagt

SEQ ID NO: 137339 - DNA, 25 bp, Homo sapien
caccgcgtctggtgacaaccgagtg

SEQ ID NO: 137340 - DNA, 25 bp, Homo sapien
accgcgtctggtgacaaccgagtgg

SEQ ID NO: 137341 - DNA, 25 bp, Homo sapien
ccgcgtctggtgacaaccgagtggc

SEQ ID NO: 137342 - DNA, 25 bp, Homo sapien
cgcgtctggtgacaaccgagtggct

SEQ ID NO: 137343 - DNA, 25 bp, Homo sapien
ttagaaccctgctcagacaccatta

SEQ ID NO: 137344 - DNA, 25 bp, Homo sapien
attacttttgtgaacgcttctgcca

SEQ ID NO: 137345 - DNA, 25 bp, Homo sapien
gtcttccccaaaattgatcactccg

SEQ ID NO: 137346 - DNA, 25 bp, Homo sapien
tgggctcccgtagcacactataaca

SEQ ID NO: 137347 - DNA, 25 bp, Homo sapien
acatctgctggagtgttgctgttgc

SEQ ID NO: 137348 - DNA, 25 bp, Homo sapien
tgctgttgcaccatactttcttgta

SEQ ID NO: 137349 - DNA, 25 bp, Homo sapien
ttcccaactagactgtaagtgcctt

SEQ ID NO: 137350 - DNA, 25 bp, Homo sapien
aagtgccttgcggtcagggactgaa

SEQ ID NO: 137351 - DNA, 25 bp, Homo sapien
ggactgaatcttgcccgtttatgta

SEQ ID NO: 137352 - DNA, 25 bp, Homo sapien
ttatgtatgctccatgtctagccca

SEQ ID NO: 137353 - DNA, 25 bp, Homo sapien
tagcccatcatcctgcttggagcaa

SEQ ID NO: 137354 - DNA, 25 bp, Homo sapien
ttctaccaactggaagcacagaaaa

SEQ ID NO: 137355 - DNA, 25 bp, Homo sapien
tcttgtaacatccaataggaatgct

SEQ ID NO: 137356 - DNA, 25 bp, Homo sapien
ggaatgctaacagttcacttgcagt

SEQ ID NO: 137357 - DNA, 25 bp, Homo sapien
atgctaacagttcacttgcagtgga

SEQ ID NO: 137358 - DNA, 25 bp, Homo sapien
ttgcagtggaagatacttggaccga

SEQ ID NO: 137359 - DNA, 25 bp, Homo sapien
acttggaccgagtagaggcatttag

SEQ ID NO: 137360 - DNA, 25 bp, Homo sapien
ccataattccatatgctgtttcaga

SEQ ID NO: 137361 - DNA, 25 bp, Homo sapien
atgctgtttcagagtcccgcaggta

SEQ ID NO: 137362 - DNA, 25 bp, Homo sapien
gctctgcttgccgaaactggaagtt

SEQ ID NO: 137363 - DNA, 25 bp, Homo sapien
taacccttgaaagtcatgaacacat

SEQ ID NO: 137364 - DNA, 25 bp, Homo sapien
agtcatgaacacatcagctagcaaa

SEQ ID NO: 137365 - DNA, 25 bp, Homo sapien
atcacagcctgtacctgaaggtgaa

SEQ ID NO: 137366 - DNA, 25 bp, Homo sapien
aaacaagcggattctcatggaacac

SEQ ID NO: 137367 - DNA, 25 bp, Homo sapien
agctgaaggcagacaaggcccgcaa

SEQ ID NO: 137368 - DNA, 25 bp, Homo sapien
ccgcaagaagctcctggctgaccag

SEQ ID NO: 137369 - DNA, 25 bp, Homo sapien
ctgaggcccgcaggtctaagaccaa

SEQ ID NO: 137370 - DNA, 25 bp, Homo sapien
gtctaagaccaaggaagcacgcaag

SEQ ID NO: 137371 - DNA, 25 bp, Homo sapien
gcaagcgccgtgaagagcgcctcca

SEQ ID NO: 137372 - DNA, 25 bp, Homo sapien
gatcatcaagactttatccaaggag

SEQ ID NO: 137373 - DNA, 25 bp, Homo sapien
aaacctcccactttgtctgtacata

SEQ ID NO: 137374 - DNA, 25 bp, Homo sapien
actttgtctgtacatactggcctct

SEQ ID NO: 137375 - DNA, 25 bp, Homo sapien
tctgtacatactggcctctgtgatt

SEQ ID NO: 137376 - DNA, 25 bp, Homo sapien
aagcacctgaacagtttatcgacca

SEQ ID NO: 137377 - DNA, 25 bp, Homo sapien
gaacagtttatcgaccagtttgaat

SEQ ID NO: 137378 - DNA, 25 bp, Homo sapien
gtttatcgaccagtttgaatctatt

SEQ ID NO: 137379 - DNA, 25 bp, Homo sapien
cgaccagtttgaatctatttatctt

SEQ ID NO: 137380 - DNA, 25 bp, Homo sapien
tatcttcatttgaatgtcttctaga

SEQ ID NO: 137381 - DNA, 25 bp, Homo sapien
taaaatgtatcttccatgctacatg

SEQ ID NO: 137382 - DNA, 25 bp, Homo sapien
gtatcttccatgctacatgtacaat

SEQ ID NO: 137383 - DNA, 25 bp, Homo sapien
tctataattgtatatatgcctttga

SEQ ID NO: 137384 - DNA, 25 bp, Homo sapien
tgaatattcaatctggtaccagttg

SEQ ID NO: 137385 - DNA, 25 bp, Homo sapien
ttcaatctggtaccagttgaaattt

SEQ ID NO: 137386 - DNA, 25 bp, Homo sapien
aatgtaatacgaattgtttcacaaa

SEQ ID NO: 137387 - DNA, 25 bp, Homo sapien
aggtagctggttgtacatctttccc

SEQ ID NO: 137388 - DNA, 25 bp, Homo sapien
acatctttccctaaatcgatccatg

SEQ ID NO: 137389 - DNA, 25 bp, Homo sapien
atcgatccatgttaccacatagtag

SEQ ID NO: 137390 - DNA, 25 bp, Homo sapien
gaagttcttatgaccacagatcatc

SEQ ID NO: 137391 - DNA, 25 bp, Homo sapien
cagatcatcagtactgttgtctcat

SEQ ID NO: 137392 - DNA, 25 bp, Homo sapien
gtactgttgtctcatgtaatgctaa

SEQ ID NO: 137393 - DNA, 25 bp, Homo sapien
atgctaaaactgaaatggtccgtgt

SEQ ID NO: 137394 - DNA, 25 bp, Homo sapien
aatggtccgtgtttgcattgttaaa

SEQ ID NO: 137395 - DNA, 25 bp, Homo sapien
actgcagtgtccgttatgagtgcca

SEQ ID NO: 137396 - DNA, 25 bp, Homo sapien
atgagtgccaaaaatctgtcttgaa

SEQ ID NO: 137397 - DNA, 25 bp, Homo sapien
ctgtcttgaaggcagctacactttg

SEQ ID NO: 137398 - DNA, 25 bp, Homo sapien
gaagtaacttattaaaggctatgac

SEQ ID NO: 137399 - DNA, 25 bp, Homo sapien
aaggctatgacttaaatttgaagat

SEQ ID NO: 137400 - DNA, 25 bp, Homo sapien
tgaagtacagtgttctaggtttgct

SEQ ID NO: 137401 - DNA, 25 bp, Homo sapien
tacagtgttctaggtttgctgagaa

SEQ ID NO: 137402 - DNA, 25 bp, Homo sapien
ctaggtttgctgagaaggcttcatt

SEQ ID NO: 137403 - DNA, 25 bp, Homo sapien
gaaggcttcattaaattaatctcac

SEQ ID NO: 137404 - DNA, 25 bp, Homo sapien
taatctcactttgaatatctcctga

SEQ ID NO: 137405 - DNA, 25 bp, Homo sapien
tcactttgaatatctcctgagagat

SEQ ID NO: 137406 - DNA, 25 bp, Homo sapien
gacaatgaaatatcagttggtggat

SEQ ID NO: 137407 - DNA, 25 bp, Homo sapien
cagttggtggatatgtgtgatagct

SEQ ID NO: 137408 - DNA, 25 bp, Homo sapien
gatatgtgtgatagctgatttcaat

SEQ ID NO: 137409 - DNA, 25 bp, Homo sapien
ggacttttaagacttgtcttgaagg

SEQ ID NO: 137410 - DNA, 25 bp, Homo sapien
gaaggatgtgtcaaaagcatgtcca

SEQ ID NO: 137411 - DNA, 25 bp, Homo sapien
ggatgtgtcaaaagcatgtccagtg

SEQ ID NO: 137412 - DNA, 25 bp, Homo sapien
tccagtgctctcaccctgggccaaa

SEQ ID NO: 137413 - DNA, 25 bp, Homo sapien
tcatccctgggcagcacattcccat

SEQ ID NO: 137414 - DNA, 25 bp, Homo sapien
gaaaatggatgatcgaactgggaaa

SEQ ID NO: 137415 - DNA, 25 bp, Homo sapien
tttggtgtagctcagaagcttttga

SEQ ID NO: 137416 - DNA, 25 bp, Homo sapien
aagcttttgaaccagtctctaaagg

SEQ ID NO: 137417 - DNA, 25 bp, Homo sapien
tttgaaccagtctctaaagggattt

SEQ ID NO: 137418 - DNA, 25 bp, Homo sapien
aaccagtctctaaagggatttccag

SEQ ID NO: 137419 - DNA, 25 bp, Homo sapien
tctaaagggatttccagaagactgt

SEQ ID NO: 137420 - DNA, 25 bp, Homo sapien
taaagcaggccgtgataagtacaag

SEQ ID NO: 137421 - DNA, 25 bp, Homo sapien
taagtacaagactctgcgacagatt

SEQ ID NO: 137422 - DNA, 25 bp, Homo sapien
gcgacagattcgacaaggcaataca

SEQ ID NO: 137423 - DNA, 25 bp, Homo sapien
tacaaagcagcgtatcgatgagttt

SEQ ID NO: 137424 - DNA, 25 bp, Homo sapien
tgtgagagctgttattttgcatata

SEQ ID NO: 137425 - DNA, 25 bp, Homo sapien
tatgttcttcataagctgaaccacc

SEQ ID NO: 137426 - DNA, 25 bp, Homo sapien
aaagcaggcctttgcagatatgatg

SEQ ID NO: 137427 - DNA, 25 bp, Homo sapien
gatatgatggaatgcatcccacctt

SEQ ID NO: 137428 - DNA, 25 bp, Homo sapien
aaagcacttacaccagtttgactgt

SEQ ID NO: 137429 - DNA, 25 bp, Homo sapien
accagtttgactgtgctagctaaaa

SEQ ID NO: 137430 - DNA, 25 bp, Homo sapien
gggagctcttcaacattaaggcagt

SEQ ID NO: 137431 - DNA, 25 bp, Homo sapien
acctttctggtttctaccaggagat

SEQ ID NO: 137432 - DNA, 25 bp, Homo sapien
agatcgatgagaacatcctgccctc

SEQ ID NO: 137433 - DNA, 25 bp, Homo sapien
ggcacgctgcccaagtatgatggca

SEQ ID NO: 137434 - DNA, 25 bp, Homo sapien
atggcaaggccgttgctgagcagct

SEQ ID NO: 137435 - DNA, 25 bp, Homo sapien
agctgagaacacagccttctgaaaa

SEQ ID NO: 137436 - DNA, 25 bp, Homo sapien
atctcctgccagctgaactgtagtt

SEQ ID NO: 137437 - DNA, 25 bp, Homo sapien
tgtagttagaatctctgggcctctc

SEQ ID NO: 137438 - DNA, 25 bp, Homo sapien
aactgtcctggacccaaggctagga

SEQ ID NO: 137439 - DNA, 25 bp, Homo sapien
ctaggaaagggctgcttgagatgac

SEQ ID NO: 137440 - DNA, 25 bp, Homo sapien
ttagactccctaagcccgagtgagc

SEQ ID NO: 137441 - DNA, 25 bp, Homo sapien
cctaagcccgagtgagctcaggtgt

SEQ ID NO: 137442 - DNA, 25 bp, Homo sapien
aaaaatgctgtcttgctttagctat

SEQ ID NO: 137443 - DNA, 25 bp, Homo sapien
gctgtcttgctttagctattaatgg

SEQ ID NO: 137444 - DNA, 25 bp, Homo sapien
ggcattgtgaggaactgtgcaaaga

SEQ ID NO: 137445 - DNA, 25 bp, Homo sapien
ggaactgtgcaaagacatttttgtt

SEQ ID NO: 137446 - DNA, 25 bp, Homo sapien
ttttgttacaaacctgtgggcctgt

SEQ ID NO: 137447 - DNA, 25 bp, Homo sapien
gtgggcctgttgcaatactttaaaa

SEQ ID NO: 137448 - DNA, 25 bp, Homo sapien
ttgcttgttttgtatagacatttct

SEQ ID NO: 137449 - DNA, 25 bp, Homo sapien
tagacatttctattgcttctaaata

SEQ ID NO: 137450 - DNA, 25 bp, Homo sapien
gtactgtacagttaatcttatttgc

SEQ ID NO: 137451 - DNA, 25 bp, Homo sapien
aatcttatttgccatcatcttgaac

SEQ ID NO: 137452 - DNA, 25 bp, Homo sapien
tgccatcatcttgaacacaaaatgt

SEQ ID NO: 137453 - DNA, 25 bp, Homo sapien
actcttttgaggaagtctatgccaa

SEQ ID NO: 137454 - DNA, 25 bp, Homo sapien
gaggaagtctatgccaaaatccttt

SEQ ID NO: 137455 - DNA, 25 bp, Homo sapien
aatattctcgaaggcagtgcagtca

SEQ ID NO: 137456 - DNA, 25 bp, Homo sapien
gtgcagtcactaactctgatttcct

SEQ ID NO: 137457 - DNA, 25 bp, Homo sapien
gtcactaactctgatttcctaagaa

SEQ ID NO: 137458 - DNA, 25 bp, Homo sapien
ttcctaagaaaggtgggcagcatta

SEQ ID NO: 137459 - DNA, 25 bp, Homo sapien
gggcagcattagcagatggttattt

SEQ ID NO: 137460 - DNA, 25 bp, Homo sapien
taagagaactctgtaggaattattg

SEQ ID NO: 137461 - DNA, 25 bp, Homo sapien
tcagaagaccatgtagaaaactttt

SEQ ID NO: 137462 - DNA, 25 bp, Homo sapien
gtcatcttttcacaggattgtaatt

SEQ ID NO: 137463 - DNA, 25 bp, Homo sapien
caggattgtaattagtcttgtttcc

SEQ ID NO: 137464 - DNA, 25 bp, Homo sapien
gtttgtacttgactatgagccatta

SEQ ID NO: 137465 - DNA, 25 bp, Homo sapien
acttgactatgagccattaacttaa

SEQ ID NO: 137466 - DNA, 25 bp, Homo sapien
ttaaagcatatgtttcaaatagcca

SEQ ID NO: 137467 - DNA, 25 bp, Homo sapien
atatgtttcaaatagccattgctac

SEQ ID NO: 137468 - DNA, 25 bp, Homo sapien
gctactattccttgtccggtgtaat

SEQ ID NO: 137469 - DNA, 25 bp, Homo sapien
tactattccttgtccggtgtaattt

SEQ ID NO: 137470 - DNA, 25 bp, Homo sapien
tcttaaaaccagggagtcagatata

SEQ ID NO: 137471 - DNA, 25 bp, Homo sapien
gaaactggtactaaagtctatcaaa

SEQ ID NO: 137472 - DNA, 25 bp, Homo sapien
ctggtactaaagtctatcaaactga

SEQ ID NO: 137473 - DNA, 25 bp, Homo sapien
ctatcaaactgattacacagactgt

SEQ ID NO: 137474 - DNA, 25 bp, Homo sapien
tacacagactgtaagaattcaaagt

SEQ ID NO: 137475 - DNA, 25 bp, Homo sapien
gtttgtacttgactatgagccatta

SEQ ID NO: 137476 - DNA, 25 bp, Homo sapien
acttgactatgagccattaacttaa

SEQ ID NO: 137477 - DNA, 25 bp, Homo sapien
atatgtttcaaatagccattgctac

SEQ ID NO: 137478 - DNA, 25 bp, Homo sapien
gctactattccttgtccggtgtaat

SEQ ID NO: 137479 - DNA, 25 bp, Homo sapien
tactattccttgtccggtgtaattt

SEQ ID NO: 137480 - DNA, 25 bp, Homo sapien
gtgtatttaacttaagctattgctc

SEQ ID NO: 137481 - DNA, 25 bp, Homo sapien
aaccagggagtcagatatatttgta

SEQ ID NO: 137482 - DNA, 25 bp, Homo sapien
gaaactggtactaaagtctatcaaa

SEQ ID NO: 137483 - DNA, 25 bp, Homo sapien
ctatcaaactgattacacagactgt

SEQ ID NO: 137484 - DNA, 25 bp, Homo sapien
tacacagactgtaagaattcaaagt

SEQ ID NO: 137485 - DNA, 25 bp, Homo sapien
aagtcaactgacatctatgctacat

SEQ ID NO: 137486 - DNA, 25 bp, Homo sapien
gggatgctgcttagctgatcccgcc

SEQ ID NO: 137487 - DNA, 25 bp, Homo sapien
atgctgcttagctgatcccgccctg

SEQ ID NO: 137488 - DNA, 25 bp, Homo sapien
gccctgacccagaggaagcctctat

SEQ ID NO: 137489 - DNA, 25 bp, Homo sapien
gacccagaggaagcctctatttatt

SEQ ID NO: 137490 - DNA, 25 bp, Homo sapien
tattagcttttgtttacaccgtgga

SEQ ID NO: 137491 - DNA, 25 bp, Homo sapien
tagcttttgtttacaccgtggaatt

SEQ ID NO: 137492 - DNA, 25 bp, Homo sapien
tgtttacaccgtggaattgaccctt

SEQ ID NO: 137493 - DNA, 25 bp, Homo sapien
tacaccgtggaattgacccttcctc

SEQ ID NO: 137494 - DNA, 25 bp, Homo sapien
cctccaatccccagtttgtatttag

SEQ ID NO: 137495 - DNA, 25 bp, Homo sapien
tccccagtttgtatttagctgccaa

SEQ ID NO: 137496 - DNA, 25 bp, Homo sapien
agattccccattggctccctgtgtt

SEQ ID NO: 137497 - DNA, 25 bp, Homo sapien
cgccacaccaaatccctgtttttgt

SEQ ID NO: 137498 - DNA, 25 bp, Homo sapien
gccacaccaaatccctgtttttgtc

SEQ ID NO: 137499 - DNA, 25 bp, Homo sapien
cacaccaaatccctgtttttgtcca

SEQ ID NO: 137500 - DNA, 25 bp, Homo sapien
acaccaaatccctgtttttgtccat

SEQ ID NO: 137501 - DNA, 25 bp, Homo sapien
caccaaatccctgtttttgtccatg

SEQ ID NO: 137502 - DNA, 25 bp, Homo sapien
accaaatccctgtttttgtccatga

SEQ ID NO: 137503 - DNA, 25 bp, Homo sapien
ccaaatccctgtttttgtccatgaa

SEQ ID NO: 137504 - DNA, 25 bp, Homo sapien
caaatccctgtttttgtccatgaac

SEQ ID NO: 137505 - DNA, 25 bp, Homo sapien
aaatccctgtttttgtccatgaact

SEQ ID NO: 137506 - DNA, 25 bp, Homo sapien
gaagaagattctgtgactcatggaa

SEQ ID NO: 137507 - DNA, 25 bp, Homo sapien
tgagattcgaattccagtgtctata

SEQ ID NO: 137508 - DNA, 25 bp, Homo sapien
aaccacgtgaaatgcgttgaggcct

SEQ ID NO: 137509 - DNA, 25 bp, Homo sapien
acgtgaaatgcgttgaggccttgct

SEQ ID NO: 137510 - DNA, 25 bp, Homo sapien
tgccgtggccctgggataccggaaa

SEQ ID NO: 137511 - DNA, 25 bp, Homo sapien
tggccctgggataccggaaagtgca

SEQ ID NO: 137512 - DNA, 25 bp, Homo sapien
gaaagtgcaacaggtgatcgagaac

SEQ ID NO: 137513 - DNA, 25 bp, Homo sapien
tcgagaaccacatcctcaagctctt

SEQ ID NO: 137514 - DNA, 25 bp, Homo sapien
aagctcttccagagcaacctggtgc

SEQ ID NO: 137515 - DNA, 25 bp, Homo sapien
gctgaccctgagtgaaggccgcctg

SEQ ID NO: 137516 - DNA, 25 bp, Homo sapien
gggactcagacactcagggaacaaa

SEQ ID NO: 137517 - DNA, 25 bp, Homo sapien
actcagggaacaaaatggtcagcca

SEQ ID NO: 137518 - DNA, 25 bp, Homo sapien
aaggcagcttctggacaggtggtgg

SEQ ID NO: 137519 - DNA, 25 bp, Homo sapien
tgaagcaactgaaaaaccccttgga

SEQ ID NO: 137520 - DNA, 25 bp, Homo sapien
aaccccttggaaatagtcagcatac

SEQ ID NO: 137521 - DNA, 25 bp, Homo sapien
tcagcatacctgataatcatggaca

SEQ ID NO: 137522 - DNA, 25 bp, Homo sapien
tggacatattgatccctctctgaga

SEQ ID NO: 137523 - DNA, 25 bp, Homo sapien
atattgatccctctctgagactcat

SEQ ID NO: 137524 - DNA, 25 bp, Homo sapien
ctgagactcatctgggatttggctt

SEQ ID NO: 137525 - DNA, 25 bp, Homo sapien
catctgggatttggctttccttgga

SEQ ID NO: 137526 - DNA, 25 bp, Homo sapien
ctttccttggaagctcttacgtgat

SEQ ID NO: 137527 - DNA, 25 bp, Homo sapien
gaaatgacaacacaggtgtcacact

SEQ ID NO: 137528 - DNA, 25 bp, Homo sapien
aggtgtcacactactacttggcaca

SEQ ID NO: 137529 - DNA, 25 bp, Homo sapien
tacttggcacagctcactagtgtga

SEQ ID NO: 137530 - DNA, 25 bp, Homo sapien
actttggaagagatgaactgtgtat

SEQ ID NO: 137531 - DNA, 25 bp, Homo sapien
ctttggaagagatgaactgtgtatt

SEQ ID NO: 137532 - DNA, 25 bp, Homo sapien
gaagagatgaactgtgtatttaact

SEQ ID NO: 137533 - DNA, 25 bp, Homo sapien
gtgtatttaacttaagctattgctc

SEQ ID NO: 137534 - DNA, 25 bp, Homo sapien
gtatttaacttaagctattgctctt

SEQ ID NO: 137535 - DNA, 25 bp, Homo sapien
atttaacttaagctattgctcttaa

SEQ ID NO: 137536 - DNA, 25 bp, Homo sapien
taacttaagctattgctcttaaaac

SEQ ID NO: 137537 - DNA, 25 bp, Homo sapien
aaagtcaactgacatctatgctaca

SEQ ID NO: 137538 - DNA, 25 bp, Homo sapien
aagtcaactgacatctatgctacat

SEQ ID NO: 137539 - DNA, 25 bp, Homo sapien
agtcaactgacatctatgctacata

SEQ ID NO: 137540 - DNA, 25 bp, Homo sapien
gtcaactgacatctatgctacatat

SEQ ID NO: 137541 - DNA, 25 bp, Homo sapien
atcccacacggtggcatgcagggcg

SEQ ID NO: 137542 - DNA, 25 bp, Homo sapien
actcgccgctactgagtacttggaa

SEQ ID NO: 137543 - DNA, 25 bp, Homo sapien
ccgctactgagtacttggaatcctg

SEQ ID NO: 137544 - DNA, 25 bp, Homo sapien
tacttggaatcctgtgtcctgtctc

SEQ ID NO: 137545 - DNA, 25 bp, Homo sapien
aatcctgtgtcctgtctcgtggcaa

SEQ ID NO: 137546 - DNA, 25 bp, Homo sapien
gtcctgtctcgtggcaacaaggcta

SEQ ID NO: 137547 - DNA, 25 bp, Homo sapien
ggctatgttctgttaggagttacct

SEQ ID NO: 137548 - DNA, 25 bp, Homo sapien
tgttaggagttaccttaaactgtgt

SEQ ID NO: 137549 - DNA, 25 bp, Homo sapien
tttttaatctgctgccatattgtag

SEQ ID NO: 137550 - DNA, 25 bp, Homo sapien
aatctgctgccatattgtagctcaa

SEQ ID NO: 137551 - DNA, 25 bp, Homo sapien
tgctgccatattgtagctcaataca

SEQ ID NO: 137552 - DNA, 25 bp, Homo sapien
agcatggttacattggcgaatttga

SEQ ID NO: 137553 - DNA, 25 bp, Homo sapien
gcatggttacattggcgaatttgaa

SEQ ID NO: 137554 - DNA, 25 bp, Homo sapien
catggttacattggcgaatttgaaa

SEQ ID NO: 137555 - DNA, 25 bp, Homo sapien
ggttacattggcgaatttgaaatca

SEQ ID NO: 137556 - DNA, 25 bp, Homo sapien
ggtgatcagccccagatttgacgtg

SEQ ID NO: 137557 - DNA, 25 bp, Homo sapien
atttgacgtgcaactcaaagacctg

SEQ ID NO: 137558 - DNA, 25 bp, Homo sapien
ttgacgtgcaactcaaagacctgga

SEQ ID NO: 137559 - DNA, 25 bp, Homo sapien
tgacgtgcaactcaaagacctggaa

SEQ ID NO: 137560 - DNA, 25 bp, Homo sapien
gacgtgcaactcaaagacctggaaa

SEQ ID NO: 137561 - DNA, 25 bp, Homo sapien
acgtgcaactcaaagacctggaaaa

SEQ ID NO: 137562 - DNA, 25 bp, Homo sapien
cgtgcaactcaaagacctggaaaaa

SEQ ID NO: 137563 - DNA, 25 bp, Homo sapien
aagttcatggaatgtgtctctatat

SEQ ID NO: 137564 - DNA, 25 bp, Homo sapien
gaatgtgtctctatattatacaggt

SEQ ID NO: 137565 - DNA, 25 bp, Homo sapien
gaaaaagattggtgctcctgataaa

SEQ ID NO: 137566 - DNA, 25 bp, Homo sapien
gtgctcctgataaagcaaagggcta

SEQ ID NO: 137567 - DNA, 25 bp, Homo sapien
gcaaagggctaggaatacaatggaa

SEQ ID NO: 137568 - DNA, 25 bp, Homo sapien
tttgtagactctttcccggtctcca

SEQ ID NO: 137569 - DNA, 25 bp, Homo sapien
tctttcccggtctccaagaacaaag

SEQ ID NO: 137570 - DNA, 25 bp, Homo sapien
gataactaacatttttgacacttac

SEQ ID NO: 137571 - DNA, 25 bp, Homo sapien
ttgacacttactatgcgaggcacag

SEQ ID NO: 137572 - DNA, 25 bp, Homo sapien
atgcgaggcacagttctatgttttt

SEQ ID NO: 137573 - DNA, 25 bp, Homo sapien
ggcacagttctatgttttttacatg

SEQ ID NO: 137574 - DNA, 25 bp, Homo sapien
aggagagcagcatcgatgacttgat

SEQ ID NO: 137575 - DNA, 25 bp, Homo sapien
gatgacttgatgaagagcctggaca

SEQ ID NO: 137576 - DNA, 25 bp, Homo sapien
gaagagcctggacaagaacagcgac

SEQ ID NO: 137577 - DNA, 25 bp, Homo sapien
agaacagcgaccaggagatcgactt

SEQ ID NO: 137578 - DNA, 25 bp, Homo sapien
gacttcaaggagtactcggtgttcc

SEQ ID NO: 137579 - DNA, 25 bp, Homo sapien
aaggagtactcggtgttcctgacca

SEQ ID NO: 137580 - DNA, 25 bp, Homo sapien
gctgtgcatggcctacaacgacttc

SEQ ID NO: 137581 - DNA, 25 bp, Homo sapien
tggcctacaacgacttctttctaga

SEQ ID NO: 137582 - DNA, 25 bp, Homo sapien
cctacaacgacttctttctagagga

SEQ ID NO: 137583 - DNA, 25 bp, Homo sapien
gaggacaacaagtgaccagggctgc

SEQ ID NO: 137584 - DNA, 25 bp, Homo sapien
tcccagatggacccttccatgggag

SEQ ID NO: 137585 - DNA, 25 bp, Homo sapien
tgacagagatgttcatgctactaaa

SEQ ID NO: 137586 - DNA, 25 bp, Homo sapien
tcatgctactaaagaaggtgcctat

SEQ ID NO: 137587 - DNA, 25 bp, Homo sapien
gaaggtgcctattttgacaaagcta

SEQ ID NO: 137588 - DNA, 25 bp, Homo sapien
ggaaaagtcacctattcaaagccag

SEQ ID NO: 137589 - DNA, 25 bp, Homo sapien
gtcacctattcaaagccagatctaa

SEQ ID NO: 137590 - DNA, 25 bp, Homo sapien
agccagatctaataccacttaccac

SEQ ID NO: 137591 - DNA, 25 bp, Homo sapien
tctaataccacttaccacctctttt

SEQ ID NO: 137592 - DNA, 25 bp, Homo sapien
aatcagttctttacaaccgatggta

SEQ ID NO: 137593 - DNA, 25 bp, Homo sapien
accgatggtaattaagcttgtattc

SEQ ID NO: 137594 - DNA, 25 bp, Homo sapien
gtattcacaagacttcatgccaaat

SEQ ID NO: 137595 - DNA, 25 bp, Homo sapien
tgccaaattcactttttagcattat

SEQ ID NO: 137596 - DNA, 25 bp, Homo sapien
atttagttactacctcatacaaaca

SEQ ID NO: 137597 - DNA, 25 bp, Homo sapien
ataatggttactacacatcacagga

SEQ ID NO: 137598 - DNA, 25 bp, Homo sapien
ggttactacacatcacaggaactta

SEQ ID NO: 137599 - DNA, 25 bp, Homo sapien
acacatcacaggaacttagttttgg

SEQ ID NO: 137600 - DNA, 25 bp, Homo sapien
ggaatatgtatataccaggttttag

SEQ ID NO: 137601 - DNA, 25 bp, Homo sapien
caggttttagcaaaatgcacacttt

SEQ ID NO: 137602 - DNA, 25 bp, Homo sapien
aaatgcacacttttggctctttttg

SEQ ID NO: 137603 - DNA, 25 bp, Homo sapien
cacacttttggctctttttggtata

SEQ ID NO: 137604 - DNA, 25 bp, Homo sapien
ttttggctctttttggtatatgttc

SEQ ID NO: 137605 - DNA, 25 bp, Homo sapien
gtgagtatatacactaagaacaaac

SEQ ID NO: 137606 - DNA, 25 bp, Homo sapien
ttttaaaatatgttcctgattgtac

SEQ ID NO: 137607 - DNA, 25 bp, Homo sapien
ggaagtctctaggttctgagctctg

SEQ ID NO: 137608 - DNA, 25 bp, Homo sapien
taggttctgagctctggctttgcct

SEQ ID NO: 137609 - DNA, 25 bp, Homo sapien
tctggctttgccttggctttgcaag

SEQ ID NO: 137610 - DNA, 25 bp, Homo sapien
ttggctttgcaagggctctgtgaca

SEQ ID NO: 137611 - DNA, 25 bp, Homo sapien
caagggctctgtgacaaggaaggaa

SEQ ID NO: 137612 - DNA, 25 bp, Homo sapien
aggaagtcagcatgcctctagaggc

SEQ ID NO: 137613 - DNA, 25 bp, Homo sapien
gaggaacactgcactcttaagcttc

SEQ ID NO: 137614 - DNA, 25 bp, Homo sapien
tccccaactaaagcctagaagagct

SEQ ID NO: 137615 - DNA, 25 bp, Homo sapien
aagagcttctgaggcgctgctttgt

SEQ ID NO: 137616 - DNA, 25 bp, Homo sapien
ttctgaggcgctgctttgtcaaaag

SEQ ID NO: 137617 - DNA, 25 bp, Homo sapien
gctgctttgtcaaaaggaagtctct

SEQ ID NO: 137618 - DNA, 25 bp, Homo sapien
cctggaaggaaactgtctgtctaat

SEQ ID NO: 137619 - DNA, 25 bp, Homo sapien
ggaaactgtctgtctaatggtcaca

SEQ ID NO: 137620 - DNA, 25 bp, Homo sapien
tgtctaatggtcacagagcactgta

SEQ ID NO: 137621 - DNA, 25 bp, Homo sapien
cagagcactgtagcacttaacagat

SEQ ID NO: 137622 - DNA, 25 bp, Homo sapien
tagcacttaacagattgccatggac

SEQ ID NO: 137623 - DNA, 25 bp, Homo sapien
catggacaccagttgcgaagggaaa

SEQ ID NO: 137624 - DNA, 25 bp, Homo sapien
agtgccttactatatgtgggttgag

SEQ ID NO: 137625 - DNA, 25 bp, Homo sapien
atatgtgggttgagctatgcagaag

SEQ ID NO: 137626 - DNA, 25 bp, Homo sapien
gatacgtgcatgaaaaaacatcttt

SEQ ID NO: 137627 - DNA, 25 bp, Homo sapien
tctttatgtcgacctttcttttctt

SEQ ID NO: 137628 - DNA, 25 bp, Homo sapien
aaacgggtggtgtgtctcaggacaa

SEQ ID NO: 137629 - DNA, 25 bp, Homo sapien
ttccagcccttcttgatgccaaggg

SEQ ID NO: 137630 - DNA, 25 bp, Homo sapien
gatgccaagggctaattatattaca

SEQ ID NO: 137631 - DNA, 25 bp, Homo sapien
aaacaggcatagaatctgcctcctt

SEQ ID NO: 137632 - DNA, 25 bp, Homo sapien
tgcctcctttgaccttgttcaatca

SEQ ID NO: 137633 - DNA, 25 bp, Homo sapien
gaccttgttcaatcactatgaagca

SEQ ID NO: 137634 - DNA, 25 bp, Homo sapien
acaagtgtcagtttcttagttctca

SEQ ID NO: 137635 - DNA, 25 bp, Homo sapien
gttctcatttaagcactactggaat

SEQ ID NO: 137636 - DNA, 25 bp, Homo sapien
gcaagtctgtgatgtactttcactg

SEQ ID NO: 137637 - DNA, 25 bp, Homo sapien
actttcactggctctgtttgtacat

SEQ ID NO: 137638 - DNA, 25 bp, Homo sapien
aacaatgctttctatgttcatatac

SEQ ID NO: 137639 - DNA, 25 bp, Homo sapien
tactgtttacctttttccatggact

SEQ ID NO: 137640 - DNA, 25 bp, Homo sapien
ctcagaacccatcggtaggcaaagg

SEQ ID NO: 137641 - DNA, 25 bp, Homo sapien
aaatacgctcaggtggttgtggtgt

SEQ ID NO: 137642 - DNA, 25 bp, Homo sapien
tgtggtgtagactgtgtcaggccta

SEQ ID NO: 137643 - DNA, 25 bp, Homo sapien
gtcaggcctacggagtcagccagtg

SEQ ID NO: 137644 - DNA, 25 bp, Homo sapien
agccagtggctagcgcaagaccagt

SEQ ID NO: 137645 - DNA, 25 bp, Homo sapien
ttcaggcttctgtcaatttcattat

SEQ ID NO: 137646 - DNA, 25 bp, Homo sapien
agcaggaattatgtcgtaagtcact

SEQ ID NO: 137647 - DNA, 25 bp, Homo sapien
gtaagtcactgaccctaactgcaga

SEQ ID NO: 137648 - DNA, 25 bp, Homo sapien
tgaccctaactgcagaccatgaagt

SEQ ID NO: 137649 - DNA, 25 bp, Homo sapien
tatgtaactaggtttttgcttctcc

SEQ ID NO: 137650 - DNA, 25 bp, Homo sapien
tcacaacttgggttcttctcagcgg

SEQ ID NO: 137651 - DNA, 25 bp, Homo sapien
gcagacaccaacatggatctcatgg

SEQ ID NO: 137652 - DNA, 25 bp, Homo sapien
gtgatcgtcatttggcacaacatct

SEQ ID NO: 137653 - DNA, 25 bp, Homo sapien
tgaccgaaacccattatttacataa

SEQ ID NO: 137654 - DNA, 25 bp, Homo sapien
aaacctaccattcggtaaccatgtg

SEQ ID NO: 137655 - DNA, 25 bp, Homo sapien
tggaccaatatcaaggtgtcagttg

SEQ ID NO: 137656 - DNA, 25 bp, Homo sapien
gtgtcagttgacctcagtgaattct

SEQ ID NO: 137657 - DNA, 25 bp, Homo sapien
aattctgtgatgtttctgagatgca

SEQ ID NO: 137658 - DNA, 25 bp, Homo sapien
tgcagactcccgtgtagtttcagat

SEQ ID NO: 137659 - DNA, 25 bp, Homo sapien
agtttcagattcttggtccatggat

SEQ ID NO: 137660 - DNA, 25 bp, Homo sapien
atgcttccttgaattaggctttcct

SEQ ID NO: 137661 - DNA, 25 bp, Homo sapien
aggctttcctaacctgaagcgcctt

SEQ ID NO: 137662 - DNA, 25 bp, Homo sapien
caggagagtacttacatagtgctca

SEQ ID NO: 137663 - DNA, 25 bp, Homo sapien
tagccagaaacctgctggcctctgc

SEQ ID NO: 137664 - DNA, 25 bp, Homo sapien
ctgttttcatttcccactttggttg

SEQ ID NO: 137665 - DNA, 25 bp, Homo sapien
gcactttcctgcttgtcatgacttt

SEQ ID NO: 137666 - DNA, 25 bp, Homo sapien
actttcctgcttgtcatgacttttt

SEQ ID NO: 137667 - DNA, 25 bp, Homo sapien
tttcctgcttgtcatgactttttga

SEQ ID NO: 137668 - DNA, 25 bp, Homo sapien
tcatgactttttgacacacttgcca

SEQ ID NO: 137669 - DNA, 25 bp, Homo sapien
atgactttttgacacacttgccatg

SEQ ID NO: 137670 - DNA, 25 bp, Homo sapien
gactttttgacacacttgccatgac

SEQ ID NO: 137671 - DNA, 25 bp, Homo sapien
ctttttgacacacttgccatgacgt

SEQ ID NO: 137672 - DNA, 25 bp, Homo sapien
agaagaagtgttactgcattttgta

SEQ ID NO: 137673 - DNA, 25 bp, Homo sapien
ctgatcgagcaccgcgtagcccagg

SEQ ID NO: 137674 - DNA, 25 bp, Homo sapien
gtcatgggcgagttcgccaatctgg

SEQ ID NO: 137675 - DNA, 25 bp, Homo sapien
ggcgagttcgccaatctggccacct

SEQ ID NO: 137676 - DNA, 25 bp, Homo sapien
cctggaccccgacaaagacgaggag

SEQ ID NO: 137677 - DNA, 25 bp, Homo sapien
tggaccccgacaaagacgaggagga

SEQ ID NO: 137678 - DNA, 25 bp, Homo sapien
cgaggacgagctgccgcaggacatc

SEQ ID NO: 137679 - DNA, 25 bp, Homo sapien
gagctgccgcaggacatctcactgg

SEQ ID NO: 137680 - DNA, 25 bp, Homo sapien
gcaggacatctcactggcggctggc

SEQ ID NO: 137681 - DNA, 25 bp, Homo sapien
tggcggcgagtcacccgcgctgggc

SEQ ID NO: 137682 - DNA, 25 bp, Homo sapien
gacgcgcgcggcctcttcgtgcagg

SEQ ID NO: 137683 - DNA, 25 bp, Homo sapien
gtgcaggcgctgccctccagctaag

SEQ ID NO: 137684 - DNA, 25 bp, Homo sapien
cacagggcctctttgggacttcaga

SEQ ID NO: 137685 - DNA, 25 bp, Homo sapien
tctttgggacttcagaggaaatctc

SEQ ID NO: 137686 - DNA, 25 bp, Homo sapien
cagtcccactctcggagggttaaga

SEQ ID NO: 137687 - DNA, 25 bp, Homo sapien
agctgtgccgtccacacctctaggt

SEQ ID NO: 137688 - DNA, 25 bp, Homo sapien
cagcaagcctgagcccgggaagaac

SEQ ID NO: 137689 - DNA, 25 bp, Homo sapien
ggaagaaccagaggccctcccgaga

SEQ ID NO: 137690 - DNA, 25 bp, Homo sapien
gagagacccagtcacacgtctctgc

SEQ ID NO: 137691 - DNA, 25 bp, Homo sapien
acacgtctctgctttaagccttagc

SEQ ID NO: 137692 - DNA, 25 bp, Homo sapien
tgctttaagccttagccagctagtg

SEQ ID NO: 137693 - DNA, 25 bp, Homo sapien
tagccagctagtgacgagtacaacg

SEQ ID NO: 137694 - DNA, 25 bp, Homo sapien
gagtacaacgagataacgcccatgt

SEQ ID NO: 137695 - DNA, 25 bp, Homo sapien
cggcaccgtggttctggagtagcct

SEQ ID NO: 137696 - DNA, 25 bp, Homo sapien
caccgtggttctggagtagcctcca

SEQ ID NO: 137697 - DNA, 25 bp, Homo sapien
gtggttctggagtagcctccagctc

SEQ ID NO: 137698 - DNA, 25 bp, Homo sapien
gagtagcctccagctcggaggactt

SEQ ID NO: 137699 - DNA, 25 bp, Homo sapien
ccagctcggaggacttgtgttcagg

SEQ ID NO: 137700 - DNA, 25 bp, Homo sapien
ggacaggccgcacagacctactgtg

SEQ ID NO: 137701 - DNA, 25 bp, Homo sapien
ccgcacagacctactgtggcgggag

SEQ ID NO: 137702 - DNA, 25 bp, Homo sapien
tgctgcctggtgacggcacccggaa

SEQ ID NO: 137703 - DNA, 25 bp, Homo sapien
gacggcacccggaagcccaccagga

SEQ ID NO: 137704 - DNA, 25 bp, Homo sapien
accaggacgcgccaccggtcaatgt

SEQ ID NO: 137705 - DNA, 25 bp, Homo sapien
cgccaccggtcaatgtgcctctggt

SEQ ID NO: 137706 - DNA, 25 bp, Homo sapien
ggtgctgctggcctacggcaccttc

SEQ ID NO: 137707 - DNA, 25 bp, Homo sapien
tgctcttcgccgtcttctggaacgt

SEQ ID NO: 137708 - DNA, 25 bp, Homo sapien
tcttctggaacgtcttcgcctacga

SEQ ID NO: 137709 - DNA, 25 bp, Homo sapien
ctggaacgtcttcgcctacgacctg

SEQ ID NO: 137710 - DNA, 25 bp, Homo sapien
tgaccggctacctgaggctgcacag

SEQ ID NO: 137711 - DNA, 25 bp, Homo sapien
acaggccagggctcgggcatgtggt

SEQ ID NO: 137712 - DNA, 25 bp, Homo sapien
tcgggcatgtggtggccgcccacca

SEQ ID NO: 137713 - DNA, 25 bp, Homo sapien
ttcacgtctgccctttgtgaacgga

SEQ ID NO: 137714 - DNA, 25 bp, Homo sapien
tgccctttgtgaacggacgtctcag

SEQ ID NO: 137715 - DNA, 25 bp, Homo sapien
tgaacggacgtctcagggctgctgt

SEQ ID NO: 137716 - DNA, 25 bp, Homo sapien
actcccaggacttgcggtctgagcc

SEQ ID NO: 137717 - DNA, 25 bp, Homo sapien
aggtctgtttaaagtggcaatctca

SEQ ID NO: 137718 - DNA, 25 bp, Homo sapien
gtggcaatctcagatgcagtttgga

SEQ ID NO: 137719 - DNA, 25 bp, Homo sapien
gagagtcagatctttctccttgaat

SEQ ID NO: 137720 - DNA, 25 bp, Homo sapien
ctttctccttgaatatctttcgata

SEQ ID NO: 137721 - DNA, 25 bp, Homo sapien
tctttcgataaacaacaaggtggtg

SEQ ID NO: 137722 - DNA, 25 bp, Homo sapien
caaggtggtgtgatcttaatatatt

SEQ ID NO: 137723 - DNA, 25 bp, Homo sapien
aaaaaacttcattctcgtgagtcat

SEQ ID NO: 137724 - DNA, 25 bp, Homo sapien
attctcgtgagtcatttaaatgtgt

SEQ ID NO: 137725 - DNA, 25 bp, Homo sapien
gtgtacaatgtacacactggtactt

SEQ ID NO: 137726 - DNA, 25 bp, Homo sapien
tacacactggtacttagagtttctg

SEQ ID NO: 137727 - DNA, 25 bp, Homo sapien
actggtacttagagtttctgtttga

SEQ ID NO: 137728 - DNA, 25 bp, Homo sapien
gtatgcccagggaaggaggcgctat

SEQ ID NO: 137729 - DNA, 25 bp, Homo sapien
cgctatgatcggaagcagagtggct

SEQ ID NO: 137730 - DNA, 25 bp, Homo sapien
ggtgggcagacaaagccaattttcc

SEQ ID NO: 137731 - DNA, 25 bp, Homo sapien
gacaaagccaattttccggaagaag

SEQ ID NO: 137732 - DNA, 25 bp, Homo sapien
tccggaagaaggctaagaccacaaa

SEQ ID NO: 137733 - DNA, 25 bp, Homo sapien
ctggaatgtgttgagcctaactgca

SEQ ID NO: 137734 - DNA, 25 bp, Homo sapien
tgagcctaactgcagatccaagagg

SEQ ID NO: 137735 - DNA, 25 bp, Homo sapien
gatccaagaggatgctggccattaa

SEQ ID NO: 137736 - DNA, 25 bp, Homo sapien
ggatgctggccattaagagatgcaa

SEQ ID NO: 137737 - DNA, 25 bp, Homo sapien
gaagtgtggcaagcatcagcctcac

SEQ ID NO: 137738 - DNA, 25 bp, Homo sapien
gtggcaagcatcagcctcacaaagt

SEQ ID NO: 137739 - DNA, 25 bp, Homo sapien
gaagagaaaccaggccctgcgtcag

SEQ ID NO: 137740 - DNA, 25 bp, Homo sapien
ccctgcgtcaggcagtgtgagtttg

SEQ ID NO: 137741 - DNA, 25 bp, Homo sapien
tgtgagtttgccgtttgtccttaac

SEQ ID NO: 137742 - DNA, 25 bp, Homo sapien
tgagtttgccgtttgtccttaactt

SEQ ID NO: 137743 - DNA, 25 bp, Homo sapien
tatttgattggtattctgttctgaa

SEQ ID NO: 137744 - DNA, 25 bp, Homo sapien
ttgattggtattctgttctgaagtc

SEQ ID NO: 137745 - DNA, 25 bp, Homo sapien
gtattctgttctgaagtctaggata

SEQ ID NO: 137746 - DNA, 25 bp, Homo sapien
gcccttctaattctgatgtttgggt

SEQ ID NO: 137747 - DNA, 25 bp, Homo sapien
ccttctaattctgatgtttgggtat

SEQ ID NO: 137748 - DNA, 25 bp, Homo sapien
ctaattctgatgtttgggtattgtg

SEQ ID NO: 137749 - DNA, 25 bp, Homo sapien
tttgggtattgtgtgagtgcatgtg

SEQ ID NO: 137750 - DNA, 25 bp, Homo sapien
agagtggctcttttgacaaactaga

SEQ ID NO: 137751 - DNA, 25 bp, Homo sapien
caaactagaagctgtggtcaaggat

SEQ ID NO: 137752 - DNA, 25 bp, Homo sapien
atagatgagggtcatgcagcaactc

SEQ ID NO: 137753 - DNA, 25 bp, Homo sapien
tcatgcagcaactcagctcgtcaat

SEQ ID NO: 137754 - DNA, 25 bp, Homo sapien
gctcgtcaatcaactccatgatgtg

SEQ ID NO: 137755 - DNA, 25 bp, Homo sapien
ttgccgaagttgacaaatgcctagc

SEQ ID NO: 137756 - DNA, 25 bp, Homo sapien
aatgcctagcagatggtgctgatga

SEQ ID NO: 137757 - DNA, 25 bp, Homo sapien
ggtgctgatgaacatttgcaactca

SEQ ID NO: 137758 - DNA, 25 bp, Homo sapien
aacatttgcaactcatcagcctttg

SEQ ID NO: 137759 - DNA, 25 bp, Homo sapien
atcagcctttgtgcaactgtgatgc

SEQ ID NO: 137760 - DNA, 25 bp, Homo sapien
gtgatgcagcagttatctcagaatt

SEQ ID NO: 137761 - DNA, 25 bp, Homo sapien
ttcagagaggcccagtaagaggtat

SEQ ID NO: 137762 - DNA, 25 bp, Homo sapien
cagagaggcccagtaagaggtatct

SEQ ID NO: 137763 - DNA, 25 bp, Homo sapien
gagaggcccagtaagaggtatctcc

SEQ ID NO: 137764 - DNA, 25 bp, Homo sapien
agaggcccagtaagaggtatctcca

SEQ ID NO: 137765 - DNA, 25 bp, Homo sapien
gaggcccagtaagaggtatctccat

SEQ ID NO: 137766 - DNA, 25 bp, Homo sapien
aggcccagtaagaggtatctccatc

SEQ ID NO: 137767 - DNA, 25 bp, Homo sapien
ggcccagtaagaggtatctccatca

SEQ ID NO: 137768 - DNA, 25 bp, Homo sapien
gcccagtaagaggtatctccatcaa

SEQ ID NO: 137769 - DNA, 25 bp, Homo sapien
cccagtaagaggtatctccatcaag

SEQ ID NO: 137770 - DNA, 25 bp, Homo sapien
cagtaagaggtatctccatcaagct

SEQ ID NO: 137771 - DNA, 25 bp, Homo sapien
agtaagaggtatctccatcaagctg

SEQ ID NO: 137772 - DNA, 25 bp, Homo sapien
gagtgggtccaatgcactttgttct

SEQ ID NO: 137773 - DNA, 25 bp, Homo sapien
atgcactttgttctggctcttccag

SEQ ID NO: 137774 - DNA, 25 bp, Homo sapien
cttccaggctgggagagcctttcag

SEQ ID NO: 137775 - DNA, 25 bp, Homo sapien
tgcctcctttgtgaggaagccgctg

SEQ ID NO: 137776 - DNA, 25 bp, Homo sapien
ctttgttagtttctccaagcaggac

SEQ ID NO: 137777 - DNA, 25 bp, Homo sapien
agtttctccaagcaggacatggaca

SEQ ID NO: 137778 - DNA, 25 bp, Homo sapien
gcaggacatggacaaggatgatcta

SEQ ID NO: 137779 - DNA, 25 bp, Homo sapien
ggatgatctaggaagactttggaaa

SEQ ID NO: 137780 - DNA, 25 bp, Homo sapien
ggaaagacttttccaaccctcatca

SEQ ID NO: 137781 - DNA, 25 bp, Homo sapien
tcatcaccaacgtctgtgccatttt

SEQ ID NO: 137782 - DNA, 25 bp, Homo sapien
accaacgtctgtgccattttgtatt

SEQ ID NO: 137783 - DNA, 25 bp, Homo sapien
ataagagtgtattaccattaaagtc

SEQ ID NO: 137784 - DNA, 25 bp, Homo sapien
ctataatccagcatcttttattgca

SEQ ID NO: 137785 - DNA, 25 bp, Homo sapien
catcttttattgcattggaaagact

SEQ ID NO: 137786 - DNA, 25 bp, Homo sapien
actggcaaagtcttttggatgggtt

SEQ ID NO: 137787 - DNA, 25 bp, Homo sapien
agatgtggctggaaagtactttgga

SEQ ID NO: 137788 - DNA, 25 bp, Homo sapien
atacaatcaagatatctcatggcat

SEQ ID NO: 137789 - DNA, 25 bp, Homo sapien
aatcaagatatctcatggcatatta

SEQ ID NO: 137790 - DNA, 25 bp, Homo sapien
gatatctcatggcatattaaaagaa

SEQ ID NO: 137791 - DNA, 25 bp, Homo sapien
gtggaatctccttcattggcattgt

SEQ ID NO: 137792 - DNA, 25 bp, Homo sapien
tcattggcattgttatttaatcata

SEQ ID NO: 137793 - DNA, 25 bp, Homo sapien
ggcattgttatttaatcataaacgg

SEQ ID NO: 137794 - DNA, 25 bp, Homo sapien
gatttttcacaagtggagcacgtgc

SEQ ID NO: 137795 - DNA, 25 bp, Homo sapien
gtggagcacgtgcatacaatcggca

SEQ ID NO: 137796 - DNA, 25 bp, Homo sapien
cgtgcatacaatcggcaccccagaa

SEQ ID NO: 137797 - DNA, 25 bp, Homo sapien
tcagattcccttccagttaactacc

SEQ ID NO: 137798 - DNA, 25 bp, Homo sapien
tccagttaactacctctccaaggga

SEQ ID NO: 137799 - DNA, 25 bp, Homo sapien
ggaaaccactatcctgagttctaag

SEQ ID NO: 137800 - DNA, 25 bp, Homo sapien
tcctgagttctaagcgcatagatta

SEQ ID NO: 137801 - DNA, 25 bp, Homo sapien
gcgcatagattagttctgtctggtt

SEQ ID NO: 137802 - DNA, 25 bp, Homo sapien
attatgcattcttcgtatctggttt

SEQ ID NO: 137803 - DNA, 25 bp, Homo sapien
gtatctggtttcttttcaccaatat

SEQ ID NO: 137804 - DNA, 25 bp, Homo sapien
gtacatggattttcattctcatggt

SEQ ID NO: 137805 - DNA, 25 bp, Homo sapien
aaatcccaaaacatcttactgatgc

SEQ ID NO: 137806 - DNA, 25 bp, Homo sapien
aaaacatcttactgatgcttacttc

SEQ ID NO: 137807 - DNA, 25 bp, Homo sapien
gaaatatgagattacggagcagcgc

SEQ ID NO: 137808 - DNA, 25 bp, Homo sapien
gattacggagcagcgcaagattgat

SEQ ID NO: 137809 - DNA, 25 bp, Homo sapien
ggagcagcgcaagattgatcagaaa

SEQ ID NO: 137810 - DNA, 25 bp, Homo sapien
aagctgtggactcacaaattttacc

SEQ ID NO: 137811 - DNA, 25 bp, Homo sapien
agggctacctgcgatctgtgtttgc

SEQ ID NO: 137812 - DNA, 25 bp, Homo sapien
tgctctgacgaatggaatttatcct

SEQ ID NO: 137813 - DNA, 25 bp, Homo sapien
ctgacgaatggaatttatcctcaca

SEQ ID NO: 137814 - DNA, 25 bp, Homo sapien
tttatcctcacaaattggtgttcta

SEQ ID NO: 137815 - DNA, 25 bp, Homo sapien
tcctcacaaattggtgttctaaatg

SEQ ID NO: 137816 - DNA, 25 bp, Homo sapien
attttctttgtttctgactctaata

SEQ ID NO: 137817 - DNA, 25 bp, Homo sapien
ctttgtttctgactctaataattag

SEQ ID NO: 137818 - DNA, 25 bp, Homo sapien
atgagctttcctaaattaaatctat

SEQ ID NO: 137819 - DNA, 25 bp, Homo sapien
aaaagacaccttaacatatttcatc

SEQ ID NO: 137820 - DNA, 25 bp, Homo sapien
tttcatctactcagtgaagaatgac

SEQ ID NO: 137821 - DNA, 25 bp, Homo sapien
ctcaaggttgatagtggtgttcact

SEQ ID NO: 137822 - DNA, 25 bp, Homo sapien
ggtgttcactaggagacgtggaatt

SEQ ID NO: 137823 - DNA, 25 bp, Homo sapien
gacgtggaattgagactaataactt

SEQ ID NO: 137824 - DNA, 25 bp, Homo sapien
aacttggatgttaacactgtttact

SEQ ID NO: 137825 - DNA, 25 bp, Homo sapien
ttcacatgtagaaatgttctttgtg

SEQ ID NO: 137826 - DNA, 25 bp, Homo sapien
tattttttctacagaggattttctc

SEQ ID NO: 137827 - DNA, 25 bp, Homo sapien
ctgtacccctttcaatctggacttg

SEQ ID NO: 137828 - DNA, 25 bp, Homo sapien
cctttcaatctggacttgcccaggt

SEQ ID NO: 137829 - DNA, 25 bp, Homo sapien
ttgcccaggtcttctgcgatcagtt

SEQ ID NO: 137830 - DNA, 25 bp, Homo sapien
aggtcttctgcgatcagttaaccca

SEQ ID NO: 137831 - DNA, 25 bp, Homo sapien
gcgatcagttaacccattttaccta

SEQ ID NO: 137832 - DNA, 25 bp, Homo sapien
tcagttaacccattttacctaggag

SEQ ID NO: 137833 - DNA, 25 bp, Homo sapien
cattttacctaggaggcccagagat

SEQ ID NO: 137834 - DNA, 25 bp, Homo sapien
cccagagatgtgagggctccttcct

SEQ ID NO: 137835 - DNA, 25 bp, Homo sapien
cttcctcaggatgcccagcgaatga

SEQ ID NO: 137836 - DNA, 25 bp, Homo sapien
agcagagcgtgcaccaatgagacca

SEQ ID NO: 137837 - DNA, 25 bp, Homo sapien
gtgcaccaatgagaccacgatggga

SEQ ID NO: 137838 - DNA, 25 bp, Homo sapien
ctttcaggaatttgccactggcaac

SEQ ID NO: 137839 - DNA, 25 bp, Homo sapien
agacgggcatctttggcgagctgaa

SEQ ID NO: 137840 - DNA, 25 bp, Homo sapien
gcatctttggcgagctgaacgtgtg

SEQ ID NO: 137841 - DNA, 25 bp, Homo sapien
tcggacggtcagatgccggacgaca

SEQ ID NO: 137842 - DNA, 25 bp, Homo sapien
tgccggacgacatgaagggcatctc

SEQ ID NO: 137843 - DNA, 25 bp, Homo sapien
agctcctcgtccaagtcagggatgt

SEQ ID NO: 137844 - DNA, 25 bp, Homo sapien
caagtcagggatgtgtctggtttcc

SEQ ID NO: 137845 - DNA, 25 bp, Homo sapien
atgtgtctggtttcctaggtgacgc

SEQ ID NO: 137846 - DNA, 25 bp, Homo sapien
ctggtttcctaggtgacgccccaga

SEQ ID NO: 137847 - DNA, 25 bp, Homo sapien
gacgccccagagtccacgtggagga

SEQ ID NO: 137848 - DNA, 25 bp, Homo sapien
ggaaaaggacccatacggctcgatg

SEQ ID NO: 137849 - DNA, 25 bp, Homo sapien
ggcttttctgtaataagcttccttt

SEQ ID NO: 137850 - DNA, 25 bp, Homo sapien
ttctgtaataagcttccttttataa

SEQ ID NO: 137851 - DNA, 25 bp, Homo sapien
tccttttataatactggtcagctta

SEQ ID NO: 137852 - DNA, 25 bp, Homo sapien
aatactggtcagcttagtctctcag

SEQ ID NO: 137853 - DNA, 25 bp, Homo sapien
actggtcagcttagtctctcagatc

SEQ ID NO: 137854 - DNA, 25 bp, Homo sapien
gtcagcttagtctctcagatcctat

SEQ ID NO: 137855 - DNA, 25 bp, Homo sapien
agcttagtctctcagatcctatcct

SEQ ID NO: 137856 - DNA, 25 bp, Homo sapien
ttagtctctcagatcctatcctgtg

SEQ ID NO: 137857 - DNA, 25 bp, Homo sapien
gtctctcagatcctatcctgtggaa

SEQ ID NO: 137858 - DNA, 25 bp, Homo sapien
tctcagatcctatcctgtggaattt

SEQ ID NO: 137859 - DNA, 25 bp, Homo sapien
gatcctatcctgtggaatttagtta

SEQ ID NO: 137860 - DNA, 25 bp, Homo sapien
agaagaccagatccaagatgtttgg

SEQ ID NO: 137861 - DNA, 25 bp, Homo sapien
agatgtttggacaccctgtcagacg

SEQ ID NO: 137862 - DNA, 25 bp, Homo sapien
gtcagacgttggtcccaagtttaat

SEQ ID NO: 137863 - DNA, 25 bp, Homo sapien
gatttctgaatctcgttgaggccaa

SEQ ID NO: 137864 - DNA, 25 bp, Homo sapien
gaggccaaggaatgatccatactga

SEQ ID NO: 137865 - DNA, 25 bp, Homo sapien
aaatgctgagccagccatctttggc

SEQ ID NO: 137866 - DNA, 25 bp, Homo sapien
atctttggcaaaggtccctgagctc

SEQ ID NO: 137867 - DNA, 25 bp, Homo sapien
cctgagctcttgctatctctcaaga

SEQ ID NO: 137868 - DNA, 25 bp, Homo sapien
tcaagagtgctgagaaccacggtga

SEQ ID NO: 137869 - DNA, 25 bp, Homo sapien
gaaccacggtgaaagtgctgctcta

SEQ ID NO: 137870 - DNA, 25 bp, Homo sapien
tgctctaggcccacaagtgtaacta

SEQ ID NO: 137871 - DNA, 25 bp, Homo sapien
tgaggactgctccagggatgccatc

SEQ ID NO: 137872 - DNA, 25 bp, Homo sapien
gggatgccatcgtttttgtaactgt

SEQ ID NO: 137873 - DNA, 25 bp, Homo sapien
tgtaactgtgcagggcagggccatc

SEQ ID NO: 137874 - DNA, 25 bp, Homo sapien
agggccatctgttcggaccccaaca

SEQ ID NO: 137875 - DNA, 25 bp, Homo sapien
agttaaatacctgcaaagccttgag

SEQ ID NO: 137876 - DNA, 25 bp, Homo sapien
ttgagaggtcttgaagcctcctcac

SEQ ID NO: 137877 - DNA, 25 bp, Homo sapien
gactcctgactgtctcccgggacta

SEQ ID NO: 137878 - DNA, 25 bp, Homo sapien
tgtctcccgggactacctgggacct

SEQ ID NO: 137879 - DNA, 25 bp, Homo sapien
ctgggacctccaccgttggtgttca

SEQ ID NO: 137880 - DNA, 25 bp, Homo sapien
agtgagggagatcccatccccttgt

SEQ ID NO: 137881 - DNA, 25 bp, Homo sapien
catccccttgtctgaactggagcca

SEQ ID NO: 137882 - DNA, 25 bp, Homo sapien
gttggtatgaagcattaccacttaa

SEQ ID NO: 137883 - DNA, 25 bp, Homo sapien
taccacttaaagaggaaccagagct

SEQ ID NO: 137884 - DNA, 25 bp, Homo sapien
aaccagagcttctgcccaactgtca

SEQ ID NO: 137885 - DNA, 25 bp, Homo sapien
ctgcccaactgtcaaccttgacaaa

SEQ ID NO: 137886 - DNA, 25 bp, Homo sapien
caactgtcaaccttgacaaattgtg

SEQ ID NO: 137887 - DNA, 25 bp, Homo sapien
gaacagacacgggtgaatgctgcta

SEQ ID NO: 137888 - DNA, 25 bp, Homo sapien
gaatgctgctaaaaacaagactggg

SEQ ID NO: 137889 - DNA, 25 bp, Homo sapien
cattgatgtggtgcgatcgggctac

SEQ ID NO: 137890 - DNA, 25 bp, Homo sapien
gatcgggctactacaaagttctggg

SEQ ID NO: 137891 - DNA, 25 bp, Homo sapien
cccaaagcagcctgtcatcgtgaag

SEQ ID NO: 137892 - DNA, 25 bp, Homo sapien
tgtcatcgtgaaggccaaattcttc

SEQ ID NO: 137893 - DNA, 25 bp, Homo sapien
acttaccaattgatgttttacgtgc

SEQ ID NO: 137894 - DNA, 25 bp, Homo sapien
ttacgtgcaaacaacctgaatcttt

SEQ ID NO: 137895 - DNA, 25 bp, Homo sapien
agatttttgattcagctcattatga

SEQ ID NO: 137896 - DNA, 25 bp, Homo sapien
cagctcattatgaaaaacatcccaa

SEQ ID NO: 137897 - DNA, 25 bp, Homo sapien
catcccaaactttaaaatgcgaaat

SEQ ID NO: 137898 - DNA, 25 bp, Homo sapien
aaatgcgaaattattggttggtgtg

SEQ ID NO: 137899 - DNA, 25 bp, Homo sapien
tggttggtgtgaagaaagccagaca

SEQ ID NO: 137900 - DNA, 25 bp, Homo sapien
gccagacaacttctgtttcttctct

SEQ ID NO: 137901 - DNA, 25 bp, Homo sapien
caaatgaatcattgttaacacagct

SEQ ID NO: 137902 - DNA, 25 bp, Homo sapien
gttaacacagctgtggctcgtttga

SEQ ID NO: 137903 - DNA, 25 bp, Homo sapien
cacagctgtggctcgtttgagggat

SEQ ID NO: 137904 - DNA, 25 bp, Homo sapien
tcgtcgccatgcctcggaaaattga

SEQ ID NO: 137905 - DNA, 25 bp, Homo sapien
cgtcgccatgcctcggaaaattgag

SEQ ID NO: 137906 - DNA, 25 bp, Homo sapien
gtcgccatgcctcggaaaattgagg

SEQ ID NO: 137907 - DNA, 25 bp, Homo sapien
gccatgcctcggaaaattgaggaaa

SEQ ID NO: 137908 - DNA, 25 bp, Homo sapien
tgctcacagcccgacgaaaggatgc

SEQ ID NO: 137909 - DNA, 25 bp, Homo sapien
tcacagcccgacgaaaggatgccaa

SEQ ID NO: 137910 - DNA, 25 bp, Homo sapien
cacagcccgacgaaaggatgccaaa

SEQ ID NO: 137911 - DNA, 25 bp, Homo sapien
tgtctctagggtgatacgtgggtga

SEQ ID NO: 137912 - DNA, 25 bp, Homo sapien
gtgatacgtgggtgagaaaggtcct

SEQ ID NO: 137913 - DNA, 25 bp, Homo sapien
agaaaggtcctggtccgcgccagag

SEQ ID NO: 137914 - DNA, 25 bp, Homo sapien
aaaggtcctggtccgcgccagagcc

SEQ ID NO: 137915 - DNA, 25 bp, Homo sapien
tagcaatcgcatcatcggtgccaag

SEQ ID NO: 137916 - DNA, 25 bp, Homo sapien
atcatcggtgccaaggaccacgcat

SEQ ID NO: 137917 - DNA, 25 bp, Homo sapien
aggaccacgcatccatccagatgaa

SEQ ID NO: 137918 - DNA, 25 bp, Homo sapien
atccatccagatgaacgtggccgag

SEQ ID NO: 137919 - DNA, 25 bp, Homo sapien
aacgtggccgaggttgacaaggtca

SEQ ID NO: 137920 - DNA, 25 bp, Homo sapien
gtttaaaacttatgctatctgcggg

SEQ ID NO: 137921 - DNA, 25 bp, Homo sapien
gtcagatgattccattctccgattg

SEQ ID NO: 137922 - DNA, 25 bp, Homo sapien
aaatgcagaacgacgccggcgagtt

SEQ ID NO: 137923 - DNA, 25 bp, Homo sapien
acgccggcgagttcgtggacctgta

SEQ ID NO: 137924 - DNA, 25 bp, Homo sapien
tggacctgtacgtgccgcggaaatg

SEQ ID NO: 137925 - DNA, 25 bp, Homo sapien
ggaaatgctccgctagcaatcgcat

SEQ ID NO: 137926 - DNA, 25 bp, Homo sapien
acacacacacactggacagtagatg

SEQ ID NO: 137927 - DNA, 25 bp, Homo sapien
acactggacagtagatgggccgaca

SEQ ID NO: 137928 - DNA, 25 bp, Homo sapien
actggacagtagatgggccgacaca

SEQ ID NO: 137929 - DNA, 25 bp, Homo sapien
agtagatgggccgacacacacttgg

SEQ ID NO: 137930 - DNA, 25 bp, Homo sapien
ggccgacacacacttggcccgagtt

SEQ ID NO: 137931 - DNA, 25 bp, Homo sapien
ttaccccgcaggacgggcctacagg

SEQ ID NO: 137932 - DNA, 25 bp, Homo sapien
tggagcccgtgggtgcacctgttac

SEQ ID NO: 137933 - DNA, 25 bp, Homo sapien
agcccgtgggtgcacctgttactgt

SEQ ID NO: 137934 - DNA, 25 bp, Homo sapien
tgggtgcacctgttactgttgggct

SEQ ID NO: 137935 - DNA, 25 bp, Homo sapien
gtgcacctgttactgttgggctttc

SEQ ID NO: 137936 - DNA, 25 bp, Homo sapien
cacctgttactgttgggctttccac

SEQ ID NO: 137937 - DNA, 25 bp, Homo sapien
tcttttccctaattgcgggcctcac

SEQ ID NO: 137938 - DNA, 25 bp, Homo sapien
taattgcgggcctcaccattgcatg

SEQ ID NO: 137939 - DNA, 25 bp, Homo sapien
ggcagaaatgagcagttcgctcctc

SEQ ID NO: 137940 - DNA, 25 bp, Homo sapien
ttcgctcctccctgataagagttgt

SEQ ID NO: 137941 - DNA, 25 bp, Homo sapien
caaagggtcgcttaaggaatctgcc

SEQ ID NO: 137942 - DNA, 25 bp, Homo sapien
gcttaaggaatctgccccacagctt

SEQ ID NO: 137943 - DNA, 25 bp, Homo sapien
cacagcttcccccatagaaggattt

SEQ ID NO: 137944 - DNA, 25 bp, Homo sapien
ggatttcatgagcagatcaggacac

SEQ ID NO: 137945 - DNA, 25 bp, Homo sapien
atgagcagatcaggacacttagcaa

SEQ ID NO: 137946 - DNA, 25 bp, Homo sapien
gatcaggacacttagcaaatgtaaa

SEQ ID NO: 137947 - DNA, 25 bp, Homo sapien
tttttgtattgtttgcatccccttg

SEQ ID NO: 137948 - DNA, 25 bp, Homo sapien
attaccacttaaagaggaaccagag

SEQ ID NO: 137949 - DNA, 25 bp, Homo sapien
ttaccacttaaagaggaaccagagc

SEQ ID NO: 137950 - DNA, 25 bp, Homo sapien
taccacttaaagaggaaccagagct

SEQ ID NO: 137951 - DNA, 25 bp, Homo sapien
accacttaaagaggaaccagagctt

SEQ ID NO: 137952 - DNA, 25 bp, Homo sapien
accagagcttctgcccaactgtcaa

SEQ ID NO: 137953 - DNA, 25 bp, Homo sapien
ctgcccaactgtcaaccttgacaaa

SEQ ID NO: 137954 - DNA, 25 bp, Homo sapien
tgcccaactgtcaaccttgacaaat

SEQ ID NO: 137955 - DNA, 25 bp, Homo sapien
gcccaactgtcaaccttgacaaatt

SEQ ID NO: 137956 - DNA, 25 bp, Homo sapien
cccaactgtcaaccttgacaaattg

SEQ ID NO: 137957 - DNA, 25 bp, Homo sapien
ccaactgtcaaccttgacaaattgt

SEQ ID NO: 137958 - DNA, 25 bp, Homo sapien
caactgtcaaccttgacaaattgtg

SEQ ID NO: 137959 - DNA, 25 bp, Homo sapien
accgttctattgtgtggatgaccac

SEQ ID NO: 137960 - DNA, 25 bp, Homo sapien
ggatgaccacataagaaggcaattt

SEQ ID NO: 137961 - DNA, 25 bp, Homo sapien
taagggcaaggagtttattacaatg

SEQ ID NO: 137962 - DNA, 25 bp, Homo sapien
ggtgtatagtgttcacaaactgtga

SEQ ID NO: 137963 - DNA, 25 bp, Homo sapien
gtaagaactgtacattgtgagctct

SEQ ID NO: 137964 - DNA, 25 bp, Homo sapien
ctgtacattgtgagctctggttatt

SEQ ID NO: 137965 - DNA, 25 bp, Homo sapien
gttatttttctcttgtaccatagaa

SEQ ID NO: 137966 - DNA, 25 bp, Homo sapien
attatcaaaaagctaatgtgcaggg

SEQ ID NO: 137967 - DNA, 25 bp, Homo sapien
ctaatgtgcagggatattgccttat

SEQ ID NO: 137968 - DNA, 25 bp, Homo sapien
gggatattgccttatttgtctgtaa

SEQ ID NO: 137969 - DNA, 25 bp, Homo sapien
ggagctcagtaacataactgcttct

SEQ ID NO: 137970 - DNA, 25 bp, Homo sapien
tggatttatagacagacaatacact

SEQ ID NO: 137971 - DNA, 25 bp, Homo sapien
agacaatacactgtgaaccttgcta

SEQ ID NO: 137972 - DNA, 25 bp, Homo sapien
aagtggattccataactctggcaca

SEQ ID NO: 137973 - DNA, 25 bp, Homo sapien
ggattccataactctggcacaagga

SEQ ID NO: 137974 - DNA, 25 bp, Homo sapien
gtaatctagaaaagctttcacattg

SEQ ID NO: 137975 - DNA, 25 bp, Homo sapien
gctttcacattgaagatcaactctt

SEQ ID NO: 137976 - DNA, 25 bp, Homo sapien
gaagatcaactcttgtacaaaatta

SEQ ID NO: 137977 - DNA, 25 bp, Homo sapien
aacaattctgttattgcataagtaa

SEQ ID NO: 137978 - DNA, 25 bp, Homo sapien
ctaattgtcttcaataaggtcacac

SEQ ID NO: 137979 - DNA, 25 bp, Homo sapien
tctggtctctggctagagttagcaa

SEQ ID NO: 137980 - DNA, 25 bp, Homo sapien
ggtctctggctagagttagcaataa

SEQ ID NO: 137981 - DNA, 25 bp, Homo sapien
gagagacaaaagactggcggccaaa

SEQ ID NO: 137982 - DNA, 25 bp, Homo sapien
agagacaaaagactggcggccaaac

SEQ ID NO: 137983 - DNA, 25 bp, Homo sapien
gagacaaaagactggcggccaaaca

SEQ ID NO: 137984 - DNA, 25 bp, Homo sapien
agacaaaagactggcggccaaacag

SEQ ID NO: 137985 - DNA, 25 bp, Homo sapien
gacaaaagactggcggccaaacaga

SEQ ID NO: 137986 - DNA, 25 bp, Homo sapien
acaaaagactggcggccaaacagag

SEQ ID NO: 137987 - DNA, 25 bp, Homo sapien
caaaagactggcggccaaacagagc

SEQ ID NO: 137988 - DNA, 25 bp, Homo sapien
aaaagactggcggccaaacagagca

SEQ ID NO: 137989 - DNA, 25 bp, Homo sapien
aaagactggcggccaaacagagcag

SEQ ID NO: 137990 - DNA, 25 bp, Homo sapien
aagactggcggccaaacagagcagt

SEQ ID NO: 137991 - DNA, 25 bp, Homo sapien
agactggcggccaaacagagcagtg

SEQ ID NO: 137992 - DNA, 25 bp, Homo sapien
atcaataccctttgaattggacaat

SEQ ID NO: 137993 - DNA, 25 bp, Homo sapien
tggacaataatctcactaccttatt

SEQ ID NO: 137994 - DNA, 25 bp, Homo sapien
tctgtatttgccattacgctagtta

SEQ ID NO: 137995 - DNA, 25 bp, Homo sapien
attacgctagttatcatgcatgtta

SEQ ID NO: 137996 - DNA, 25 bp, Homo sapien
gcatgttatgctttactgcgaataa

SEQ ID NO: 137997 - DNA, 25 bp, Homo sapien
gcgaataagcttttaatgctccaaa

SEQ ID NO: 137998 - DNA, 25 bp, Homo sapien
ttaatgctccaaatgctgacccatg

SEQ ID NO: 137999 - DNA, 25 bp, Homo sapien
gctgacccatgcaatatttcctcat

SEQ ID NO: 138000 - DNA, 25 bp, Homo sapien
gtgatcacaatttgcagtaaacttt

SEQ ID NO: 138001 - DNA, 25 bp, Homo sapien
atgacacaacttgtcccttttttgt

SEQ ID NO: 138002 - DNA, 25 bp, Homo sapien
tgtcccttttttgtcccattagcaa

SEQ ID NO: 138003 - DNA, 25 bp, Homo sapien
caaaagaaaagaacccgccgagcag

SEQ ID NO: 138004 - DNA, 25 bp, Homo sapien
aaagaacccgccgagcagtcaaatt

SEQ ID NO: 138005 - DNA, 25 bp, Homo sapien
ccgccgagcagtcaaattccagagg

SEQ ID NO: 138006 - DNA, 25 bp, Homo sapien
agcagtcaaattccagagggccatt

SEQ ID NO: 138007 - DNA, 25 bp, Homo sapien
gtcaaattccagagggccattactg

SEQ ID NO: 138008 - DNA, 25 bp, Homo sapien
attactggtgcatctcttgctgata

SEQ ID NO: 138009 - DNA, 25 bp, Homo sapien
tgctgatataatggccaagaggaat

SEQ ID NO: 138010 - DNA, 25 bp, Homo sapien
ataatggccaagaggaatcagaaac

SEQ ID NO: 138011 - DNA, 25 bp, Homo sapien
gaaacctgaagttagaaaggctcaa

SEQ ID NO: 138012 - DNA, 25 bp, Homo sapien
acgagaacaagctatcagggctgct

SEQ ID NO: 138013 - DNA, 25 bp, Homo sapien
agctatcagggctgctaaggaagca

SEQ ID NO: 138014 - DNA, 25 bp, Homo sapien
attctatccccaatcagctcctttt

SEQ ID NO: 138015 - DNA, 25 bp, Homo sapien
agctccttttccgttctgttctgct

SEQ ID NO: 138016 - DNA, 25 bp, Homo sapien
ttctgctgggagttctagaaccact

SEQ ID NO: 138017 - DNA, 25 bp, Homo sapien
ggagttctagaaccacttcctgcta

SEQ ID NO: 138018 - DNA, 25 bp, Homo sapien
agaaccacttcctgctacaggaggg

SEQ ID NO: 138019 - DNA, 25 bp, Homo sapien
tctgccagtggatccctgcggtcag

SEQ ID NO: 138020 - DNA, 25 bp, Homo sapien
aagcactttttggctgacttcatct

SEQ ID NO: 138021 - DNA, 25 bp, Homo sapien
gggttggcaacaggacagagttcac

SEQ ID NO: 138022 - DNA, 25 bp, Homo sapien
aggacagagttcacaggaggccagt

SEQ ID NO: 138023 - DNA, 25 bp, Homo sapien
gccatgagggacagggtcttttttc

SEQ ID NO: 138024 - DNA, 25 bp, Homo sapien
tgagggacagggtcttttttcattt

SEQ ID NO: 138025 - DNA, 25 bp, Homo sapien
cccaaactccagtggctggccaggc

SEQ ID NO: 138026 - DNA, 25 bp, Homo sapien
ccaaactccagtggctggccaggcg

SEQ ID NO: 138027 - DNA, 25 bp, Homo sapien
caaactccagtggctggccaggcgc

SEQ ID NO: 138028 - DNA, 25 bp, Homo sapien
aaactccagtggctggccaggcgcg

SEQ ID NO: 138029 - DNA, 25 bp, Homo sapien
aactccagtggctggccaggcgcgg

SEQ ID NO: 138030 - DNA, 25 bp, Homo sapien
agtggctggccaggcgcggtagtca

SEQ ID NO: 138031 - DNA, 25 bp, Homo sapien
gtggctggccaggcgcggtagtcac

SEQ ID NO: 138032 - DNA, 25 bp, Homo sapien
gctgtggcaggcgaaatcgcttgaa

SEQ ID NO: 138033 - DNA, 25 bp, Homo sapien
ctgtggcaggcgaaatcgcttgaac

SEQ ID NO: 138034 - DNA, 25 bp, Homo sapien
tgtggcaggcgaaatcgcttgaacc

SEQ ID NO: 138035 - DNA, 25 bp, Homo sapien
gtggcaggcgaaatcgcttgaaccc

SEQ ID NO: 138036 - DNA, 25 bp, Homo sapien
aaacttgactccatttcatcattgt

SEQ ID NO: 138037 - DNA, 25 bp, Homo sapien
cattgtttctgcatgaatatcatac

SEQ ID NO: 138038 - DNA, 25 bp, Homo sapien
tcagttagtttttaggtcaagggct

SEQ ID NO: 138039 - DNA, 25 bp, Homo sapien
tcaagggcttactatttctgggtct

SEQ ID NO: 138040 - DNA, 25 bp, Homo sapien
ttttgctactaagttcacattagaa

SEQ ID NO: 138041 - DNA, 25 bp, Homo sapien
ttcacattagaattagtgccagaat

SEQ ID NO: 138042 - DNA, 25 bp, Homo sapien
gtgccagaattttaggaacttcaga

SEQ ID NO: 138043 - DNA, 25 bp, Homo sapien
taggaacttcagagatcgtgtattg

SEQ ID NO: 138044 - DNA, 25 bp, Homo sapien
gagatcgtgtattgagatttcttaa

SEQ ID NO: 138045 - DNA, 25 bp, Homo sapien
ataatgcttcagatattattgcttt

SEQ ID NO: 138046 - DNA, 25 bp, Homo sapien
aaattgctatgttactattttctac

SEQ ID NO: 138047 - DNA, 25 bp, Homo sapien
gatggacctgagtgtcggtcacagc

SEQ ID NO: 138048 - DNA, 25 bp, Homo sapien
tggacctgagtgtcggtcacagccc

SEQ ID NO: 138049 - DNA, 25 bp, Homo sapien
tgagtgtcggtcacagccccctaca

SEQ ID NO: 138050 - DNA, 25 bp, Homo sapien
tacactcaaggctgagaggcctcag

SEQ ID NO: 138051 - DNA, 25 bp, Homo sapien
ggcctcaggaaagtcattccttttt

SEQ ID NO: 138052 - DNA, 25 bp, Homo sapien
ttagtgtaaccatcaccctaataat

SEQ ID NO: 138053 - DNA, 25 bp, Homo sapien
gtaaccatcaccctaataatatacg

SEQ ID NO: 138054 - DNA, 25 bp, Homo sapien
ccatcaccctaataatatacgttgt

SEQ ID NO: 138055 - DNA, 25 bp, Homo sapien
ccctaataatatacgttgtacccat

SEQ ID NO: 138056 - DNA, 25 bp, Homo sapien
atatacgttgtacccattaagttat

SEQ ID NO: 138057 - DNA, 25 bp, Homo sapien
tattattccacactccatgtccacg

SEQ ID NO: 138058 - DNA, 25 bp, Homo sapien
cagcaaaaagctccgcaacaagata

SEQ ID NO: 138059 - DNA, 25 bp, Homo sapien
aaagctccgcaacaagatagcaggt

SEQ ID NO: 138060 - DNA, 25 bp, Homo sapien
aagatagcaggttacgtcacgcatc

SEQ ID NO: 138061 - DNA, 25 bp, Homo sapien
tagcaggttacgtcacgcatctgat

SEQ ID NO: 138062 - DNA, 25 bp, Homo sapien
gtcacgcatctgatgaagcgaattc

SEQ ID NO: 138063 - DNA, 25 bp, Homo sapien
acgcatctgatgaagcgaattcaga

SEQ ID NO: 138064 - DNA, 25 bp, Homo sapien
aagcgaattcagagaggcccagtaa

SEQ ID NO: 138065 - DNA, 25 bp, Homo sapien
aagaggtatctccatcaagctgcag

SEQ ID NO: 138066 - DNA, 25 bp, Homo sapien
ttatgttcctgaggtctcagccttg

SEQ ID NO: 138067 - DNA, 25 bp, Homo sapien
aagcttttggacttcggcagtctgt

SEQ ID NO: 138068 - DNA, 25 bp, Homo sapien
ggcagtctgtccaaccttcaggtca

SEQ ID NO: 138069 - DNA, 25 bp, Homo sapien
tatggactgtctgtgcaattacgtc

SEQ ID NO: 138070 - DNA, 25 bp, Homo sapien
gtctgtgcaattacgtccaccaaag

SEQ ID NO: 138071 - DNA, 25 bp, Homo sapien
ttacgtccaccaaagacccgtgttg

SEQ ID NO: 138072 - DNA, 25 bp, Homo sapien
gggaccctctgaagcatttctgcct

SEQ ID NO: 138073 - DNA, 25 bp, Homo sapien
agcatttctgcctcactttatgtca

SEQ ID NO: 138074 - DNA, 25 bp, Homo sapien
catttctgcctcactttatgtcatc

SEQ ID NO: 138075 - DNA, 25 bp, Homo sapien
actttatgtcatctgcttctcccct

SEQ ID NO: 138076 - DNA, 25 bp, Homo sapien
ggaaggagataggtggctcctaaaa

SEQ ID NO: 138077 - DNA, 25 bp, Homo sapien
tcctaaaagaggaggccatcttctc

SEQ ID NO: 138078 - DNA, 25 bp, Homo sapien
ttcctctttggcacagctactcctg

SEQ ID NO: 138079 - DNA, 25 bp, Homo sapien
tttggcacagctactcctggctggg

SEQ ID NO: 138080 - DNA, 25 bp, Homo sapien
ccagcaaaaagctccgcaacaagat

SEQ ID NO: 138081 - DNA, 25 bp, Homo sapien
cagcaaaaagctccgcaacaagata

SEQ ID NO: 138082 - DNA, 25 bp, Homo sapien
agcaaaaagctccgcaacaagatag

SEQ ID NO: 138083 - DNA, 25 bp, Homo sapien
caaaaagctccgcaacaagatagca

SEQ ID NO: 138084 - DNA, 25 bp, Homo sapien
aaaaagctccgcaacaagatagcag

SEQ ID NO: 138085 - DNA, 25 bp, Homo sapien
aaaagctccgcaacaagatagcagg

SEQ ID NO: 138086 - DNA, 25 bp, Homo sapien
aaagctccgcaacaagatagcaggt

SEQ ID NO: 138087 - DNA, 25 bp, Homo sapien
gtcacgcatctgatgaagcgaattc

SEQ ID NO: 138088 - DNA, 25 bp, Homo sapien
tcacgcatctgatgaagcgaattca

SEQ ID NO: 138089 - DNA, 25 bp, Homo sapien
cacgcatctgatgaagcgaattcag

SEQ ID NO: 138090 - DNA, 25 bp, Homo sapien
acgcatctgatgaagcgaattcaga

SEQ ID NO: 138091 - DNA, 25 bp, Homo sapien
catattctattttctaatcgtggtg

SEQ ID NO: 138092 - DNA, 25 bp, Homo sapien
ctattttctaatcgtggtgtgtcta

SEQ ID NO: 138093 - DNA, 25 bp, Homo sapien
aatcgtggtgtgtctatttgtagga

SEQ ID NO: 138094 - DNA, 25 bp, Homo sapien
tttgtaggatacactcgagtctgtt

SEQ ID NO: 138095 - DNA, 25 bp, Homo sapien
gatacactcgagtctgtttattgaa

SEQ ID NO: 138096 - DNA, 25 bp, Homo sapien
ctgtttattgaattttatggtccct

SEQ ID NO: 138097 - DNA, 25 bp, Homo sapien
gtccctttctttgatggtgcttgca

SEQ ID NO: 138098 - DNA, 25 bp, Homo sapien
ggtgcttgcaggttttctaggtaga

SEQ ID NO: 138099 - DNA, 25 bp, Homo sapien
taaattgtctgtataccagtacaag

SEQ ID NO: 138100 - DNA, 25 bp, Homo sapien
gtctgtataccagtacaagtttatt

SEQ ID NO: 138101 - DNA, 25 bp, Homo sapien
gtttattgtttcagtatactcgtac

SEQ ID NO: 138102 - DNA, 25 bp, Homo sapien
ggcggtgcctggacgtacaatacca

SEQ ID NO: 138103 - DNA, 25 bp, Homo sapien
gcggtgcctggacgtacaataccac

SEQ ID NO: 138104 - DNA, 25 bp, Homo sapien
cggtgcctggacgtacaataccact

SEQ ID NO: 138105 - DNA, 25 bp, Homo sapien
ggtgcctggacgtacaataccactt

SEQ ID NO: 138106 - DNA, 25 bp, Homo sapien
gtgcctggacgtacaataccacttc

SEQ ID NO: 138107 - DNA, 25 bp, Homo sapien
tgcctggacgtacaataccacttcc

SEQ ID NO: 138108 - DNA, 25 bp, Homo sapien
gcctggacgtacaataccacttccg

SEQ ID NO: 138109 - DNA, 25 bp, Homo sapien
ctggacgtacaataccacttccgct

SEQ ID NO: 138110 - DNA, 25 bp, Homo sapien
tggacgtacaataccacttccgctg

SEQ ID NO: 138111 - DNA, 25 bp, Homo sapien
ggacgtacaataccacttccgctgt

SEQ ID NO: 138112 - DNA, 25 bp, Homo sapien
ggacccgctatggggcctccctccg

SEQ ID NO: 138113 - DNA, 25 bp, Homo sapien
ctgcaggtatgcagacagaccagga

SEQ ID NO: 138114 - DNA, 25 bp, Homo sapien
agacagaccaggaaggaggttctat

SEQ ID NO: 138115 - DNA, 25 bp, Homo sapien
ggaaggaggttctatgtagttgcat

SEQ ID NO: 138116 - DNA, 25 bp, Homo sapien
gaggttctatgtagttgcatgtgac

SEQ ID NO: 138117 - DNA, 25 bp, Homo sapien
gtgacaacagagatccacgggattc

SEQ ID NO: 138118 - DNA, 25 bp, Homo sapien
caacagagatccacgggattctcca

SEQ ID NO: 138119 - DNA, 25 bp, Homo sapien
agagatccacgggattctccacggt

SEQ ID NO: 138120 - DNA, 25 bp, Homo sapien
agatccacgggattctccacggtat

SEQ ID NO: 138121 - DNA, 25 bp, Homo sapien
acgggattctccacggtatcctgtg

SEQ ID NO: 138122 - DNA, 25 bp, Homo sapien
ggattctccacggtatcctgtggtt

SEQ ID NO: 138123 - DNA, 25 bp, Homo sapien
tctccacggtatcctgtggttccag

SEQ ID NO: 138124 - DNA, 25 bp, Homo sapien
aattaacaatgatctgtgctctgca

SEQ ID NO: 138125 - DNA, 25 bp, Homo sapien
taacaatgatctgtgctctgcaaag

SEQ ID NO: 138126 - DNA, 25 bp, Homo sapien
acaatgatctgtgctctgcaaagtt

SEQ ID NO: 138127 - DNA, 25 bp, Homo sapien
atgatctgtgctctgcaaagttttg

SEQ ID NO: 138128 - DNA, 25 bp, Homo sapien
gttatgaggaattatacatgtatca

SEQ ID NO: 138129 - DNA, 25 bp, Homo sapien
ttttttcctgtgtgtcatgttggtt

SEQ ID NO: 138130 - DNA, 25 bp, Homo sapien
ttcctgtgtgtcatgttggtttttg

SEQ ID NO: 138131 - DNA, 25 bp, Homo sapien
gtgtgtcatgttggtttttggtact

SEQ ID NO: 138132 - DNA, 25 bp, Homo sapien
gtcatgttggtttttggtacttgta

SEQ ID NO: 138133 - DNA, 25 bp, Homo sapien
ggtttttggtacttgtattgtcatt

SEQ ID NO: 138134 - DNA, 25 bp, Homo sapien
cttgtattgtcatttggagaaacaa

SEQ ID NO: 138135 - DNA, 25 bp, Homo sapien
atccgccgtcactggggtggcaatg

SEQ ID NO: 138136 - DNA, 25 bp, Homo sapien
gccgtcactggggtggcaatgtcct

SEQ ID NO: 138137 - DNA, 25 bp, Homo sapien
ggtcctaagtctgtggctcgtatcg

SEQ ID NO: 138138 - DNA, 25 bp, Homo sapien
tcctaagtctgtggctcgtatcgcc

SEQ ID NO: 138139 - DNA, 25 bp, Homo sapien
ggctcgtatcgccaagctcgaaaag

SEQ ID NO: 138140 - DNA, 25 bp, Homo sapien
actaaactgggttaaatgtacactg

SEQ ID NO: 138141 - DNA, 25 bp, Homo sapien
ctaaactgggttaaatgtacactgt

SEQ ID NO: 138142 - DNA, 25 bp, Homo sapien
actgggttaaatgtacactgttgag

SEQ ID NO: 138143 - DNA, 25 bp, Homo sapien
ctgggttaaatgtacactgttgagt

SEQ ID NO: 138144 - DNA, 25 bp, Homo sapien
taaatgtacactgttgagttttctg

SEQ ID NO: 138145 - DNA, 25 bp, Homo sapien
atgtacactgttgagttttctgtac

SEQ ID NO: 138146 - DNA, 25 bp, Homo sapien
tggccggaaggagactgtggttttt

SEQ ID NO: 138147 - DNA, 25 bp, Homo sapien
ggctggctgcagacggtgtggttgg

SEQ ID NO: 138148 - DNA, 25 bp, Homo sapien
ttagcttttagcctggctgtcacct

SEQ ID NO: 138149 - DNA, 25 bp, Homo sapien
tttagcctggctgtcacctttttaa

SEQ ID NO: 138150 - DNA, 25 bp, Homo sapien
gtcacctttttaatttccagaactg

SEQ ID NO: 138151 - DNA, 25 bp, Homo sapien
cacctttttaatttccagaactgca

SEQ ID NO: 138152 - DNA, 25 bp, Homo sapien
agggaaggacagacatcaagtgcca

SEQ ID NO: 138153 - DNA, 25 bp, Homo sapien
gaaggacagacatcaagtgccagat

SEQ ID NO: 138154 - DNA, 25 bp, Homo sapien
tgaactaatcgagcacttctcacca

SEQ ID NO: 138155 - DNA, 25 bp, Homo sapien
aactaatcgagcacttctcaccaaa

SEQ ID NO: 138156 - DNA, 25 bp, Homo sapien
taatcgagcacttctcaccaaactt

SEQ ID NO: 138157 - DNA, 25 bp, Homo sapien
aagaagatcttggacagcgtgggta

SEQ ID NO: 138158 - DNA, 25 bp, Homo sapien
agatcttggacagcgtgggtatcga

SEQ ID NO: 138159 - DNA, 25 bp, Homo sapien
ggacagcgtgggtatcgaggcggac

SEQ ID NO: 138160 - DNA, 25 bp, Homo sapien
atcgaggcggacgacgaccggctca

SEQ ID NO: 138161 - DNA, 25 bp, Homo sapien
aggcggacgacgaccggctcaacaa

SEQ ID NO: 138162 - DNA, 25 bp, Homo sapien
gacgacgaccggctcaacaaggtta

SEQ ID NO: 138163 - DNA, 25 bp, Homo sapien
acgacgaccggctcaacaaggttat

SEQ ID NO: 138164 - DNA, 25 bp, Homo sapien
gacgaccggctcaacaaggttatca

SEQ ID NO: 138165 - DNA, 25 bp, Homo sapien
cgaccggctcaacaaggttatcagt

SEQ ID NO: 138166 - DNA, 25 bp, Homo sapien
aaacattgaagacgtcattgcccag

SEQ ID NO: 138167 - DNA, 25 bp, Homo sapien
gctgtagccgtctctgctgccccag

SEQ ID NO: 138168 - DNA, 25 bp, Homo sapien
atatttatgttttcacagtcaccaa

SEQ ID NO: 138169 - DNA, 25 bp, Homo sapien
tttatgttttcacagtcaccaagtg

SEQ ID NO: 138170 - DNA, 25 bp, Homo sapien
gttttattcagcttctataagtgtg

SEQ ID NO: 138171 - DNA, 25 bp, Homo sapien
ctataagtgtgaccagttttgatat

SEQ ID NO: 138172 - DNA, 25 bp, Homo sapien
atatgtgtatctcaaattctcccta

SEQ ID NO: 138173 - DNA, 25 bp, Homo sapien
atgtgtatctcaaattctccctaaa

SEQ ID NO: 138174 - DNA, 25 bp, Homo sapien
gtatctcaaattctccctaaagtgt

SEQ ID NO: 138175 - DNA, 25 bp, Homo sapien
aattctccctaaagtgttgtggcct

SEQ ID NO: 138176 - DNA, 25 bp, Homo sapien
tctccctaaagtgttgtggccttaa

SEQ ID NO: 138177 - DNA, 25 bp, Homo sapien
aagtgttgtggccttaactgttcag

SEQ ID NO: 138178 - DNA, 25 bp, Homo sapien
tgttgtggccttaactgttcagtat

SEQ ID NO: 138179 - DNA, 25 bp, Homo sapien
ttagcctgggcaggtcgtgtctcct

SEQ ID NO: 138180 - DNA, 25 bp, Homo sapien
tagcctgggcaggtcgtgtctcctc

SEQ ID NO: 138181 - DNA, 25 bp, Homo sapien
agtggccattagctcccgtcaccac

SEQ ID NO: 138182 - DNA, 25 bp, Homo sapien
ttccccttgggctgtgttggagtga

SEQ ID NO: 138183 - DNA, 25 bp, Homo sapien
ggctgtgttggagtgagcacctcct

SEQ ID NO: 138184 - DNA, 25 bp, Homo sapien
gtgttggagtgagcacctcctctgt

SEQ ID NO: 138185 - DNA, 25 bp, Homo sapien
tctgtaggcacctctcacactgttg

SEQ ID NO: 138186 - DNA, 25 bp, Homo sapien
taggcacctctcacactgttgtctg

SEQ ID NO: 138187 - DNA, 25 bp, Homo sapien
gcacctctcacactgttgtctgtta

SEQ ID NO: 138188 - DNA, 25 bp, Homo sapien
ctctcacactgttgtctgttactga

SEQ ID NO: 138189 - DNA, 25 bp, Homo sapien
tctcacactgttgtctgttactgat

SEQ ID NO: 138190 - DNA, 25 bp, Homo sapien
ggccagatcttgatgcccaacattg

SEQ ID NO: 138191 - DNA, 25 bp, Homo sapien
aacaaagcacatgctgcccagtggc

SEQ ID NO: 138192 - DNA, 25 bp, Homo sapien
cagtggcttccggaagttcctggtc

SEQ ID NO: 138193 - DNA, 25 bp, Homo sapien
ttcctggtccacaacgtcaaggagc

SEQ ID NO: 138194 - DNA, 25 bp, Homo sapien
gtgccgagatcgctcacaatgtttc

SEQ ID NO: 138195 - DNA, 25 bp, Homo sapien
tttcctccaagaaccgcaaagccat

SEQ ID NO: 138196 - DNA, 25 bp, Homo sapien
aagccatcgtggaaagagctgccca

SEQ ID NO: 138197 - DNA, 25 bp, Homo sapien
agagctgcccaactggccatcagag

SEQ ID NO: 138198 - DNA, 25 bp, Homo sapien
caatgccaggctgcgcagtgaagaa

SEQ ID NO: 138199 - DNA, 25 bp, Homo sapien
gagtaggcagctcatgtgcacgttt

SEQ ID NO: 138200 - DNA, 25 bp, Homo sapien
gctcatgtgcacgttttctgtttaa

SEQ ID NO: 138201 - DNA, 25 bp, Homo sapien
agtcacacaagaagtgtacagcact

SEQ ID NO: 138202 - DNA, 25 bp, Homo sapien
gtacagcactggaacttcttgagca

SEQ ID NO: 138203 - DNA, 25 bp, Homo sapien
aacttcttgagcaggagcataccca

SEQ ID NO: 138204 - DNA, 25 bp, Homo sapien
ttgagcaggagcatacccagggctt

SEQ ID NO: 138205 - DNA, 25 bp, Homo sapien
aggagcatacccagggcttcataat

SEQ ID NO: 138206 - DNA, 25 bp, Homo sapien
atacccagggcttcataatcacctt

SEQ ID NO: 138207 - DNA, 25 bp, Homo sapien
ttcataatcaccttctgttcagcac

SEQ ID NO: 138208 - DNA, 25 bp, Homo sapien
ataatcaccttctgttcagcactag

SEQ ID NO: 138209 - DNA, 25 bp, Homo sapien
atcaccttctgttcagcactagatg

SEQ ID NO: 138210 - DNA, 25 bp, Homo sapien
gttcagcactagatgatattcttgg

SEQ ID NO: 138211 - DNA, 25 bp, Homo sapien
gtggtgcaccaggtgttggaaaaac

SEQ ID NO: 138212 - DNA, 25 bp, Homo sapien
gggtatcggccgtcactcagctctc

SEQ ID NO: 138213 - DNA, 25 bp, Homo sapien
tttgttctccacaatctactgtctc

SEQ ID NO: 138214 - DNA, 25 bp, Homo sapien
aatctactgtctccgagtgtacacg

SEQ ID NO: 138215 - DNA, 25 bp, Homo sapien
ccgagtgtacacgttgcgctgtttg

SEQ ID NO: 138216 - DNA, 25 bp, Homo sapien
gttgcgctgtttgtgtttgatcccc

SEQ ID NO: 138217 - DNA, 25 bp, Homo sapien
ccctgacttgtagccagcttgtgta

SEQ ID NO: 138218 - DNA, 25 bp, Homo sapien
agccagcttgtgtaagatcccttgc

SEQ ID NO: 138219 - DNA, 25 bp, Homo sapien
gtaagatcccttgcagaacgagaaa

SEQ ID NO: 138220 - DNA, 25 bp, Homo sapien
agtactcacaccatcaagtctgtta

SEQ ID NO: 138221 - DNA, 25 bp, Homo sapien
tctgttatagagtgtacgactgtat

SEQ ID NO: 138222 - DNA, 25 bp, Homo sapien
tgtattaacacggaggcctgcctgg

SEQ ID NO: 138223 - DNA, 25 bp, Homo sapien
ggacttttaagacttgtcttgaagg

SEQ ID NO: 138224 - DNA, 25 bp, Homo sapien
gaaggatgtgtcaaaagcatgtcca

SEQ ID NO: 138225 - DNA, 25 bp, Homo sapien
ggatgtgtcaaaagcatgtccagtg

SEQ ID NO: 138226 - DNA, 25 bp, Homo sapien
gcatgtccagtgctctcaccctggg

SEQ ID NO: 138227 - DNA, 25 bp, Homo sapien
tcccatcctccaagggtgggtttga

SEQ ID NO: 138228 - DNA, 25 bp, Homo sapien
gaaaatggatgatcgaactgggaaa

SEQ ID NO: 138229 - DNA, 25 bp, Homo sapien
tttggtgtagctcagaagcttttga

SEQ ID NO: 138230 - DNA, 25 bp, Homo sapien
aagcttttgaaccagtctctaaagg

SEQ ID NO: 138231 - DNA, 25 bp, Homo sapien
aaccagtctctaaagggatttccag

SEQ ID NO: 138232 - DNA, 25 bp, Homo sapien
tctaaagggatttccagaagactgt

SEQ ID NO: 138233 - DNA, 25 bp, Homo sapien
gactgttgaacaaaggacctcttgg

SEQ ID NO: 138234 - DNA, 25 bp, Homo sapien
gaagacgaggattaaatttcattta

SEQ ID NO: 138235 - DNA, 25 bp, Homo sapien
agacgaggattaaatttcatttatc

SEQ ID NO: 138236 - DNA, 25 bp, Homo sapien
gacgaggattaaatttcatttatct

SEQ ID NO: 138237 - DNA, 25 bp, Homo sapien
gaggattaaatttcatttatctgga

SEQ ID NO: 138238 - DNA, 25 bp, Homo sapien
ggattaaatttcatttatctggaaa

SEQ ID NO: 138239 - DNA, 25 bp, Homo sapien
atctggaaaattttgtatgagttct

SEQ ID NO: 138240 - DNA, 25 bp, Homo sapien
ctggaaaattttgtatgagttcttg

SEQ ID NO: 138241 - DNA, 25 bp, Homo sapien
gaaaattttgtatgagttcttgaat

SEQ ID NO: 138242 - DNA, 25 bp, Homo sapien
aaaattttgtatgagttcttgaata

SEQ ID NO: 138243 - DNA, 25 bp, Homo sapien
aaattttgtatgagttcttgaataa

SEQ ID NO: 138244 - DNA, 25 bp, Homo sapien
aattttgtatgagttcttgaataaa

SEQ ID NO: 138245 - DNA, 25 bp, Homo sapien
gttgttccgccacaccaaatccctg

SEQ ID NO: 138246 - DNA, 25 bp, Homo sapien
ttgttccgccacaccaaatccctgt

SEQ ID NO: 138247 - DNA, 25 bp, Homo sapien
cgccacaccaaatccctgtttttgt

SEQ ID NO: 138248 - DNA, 25 bp, Homo sapien
gccacaccaaatccctgtttttgtc

SEQ ID NO: 138249 - DNA, 25 bp, Homo sapien
cacaccaaatccctgtttttgtcca

SEQ ID NO: 138250 - DNA, 25 bp, Homo sapien
acaccaaatccctgtttttgtccat

SEQ ID NO: 138251 - DNA, 25 bp, Homo sapien
caccaaatccctgtttttgtccatg

SEQ ID NO: 138252 - DNA, 25 bp, Homo sapien
accaaatccctgtttttgtccatga

SEQ ID NO: 138253 - DNA, 25 bp, Homo sapien
ccaaatccctgtttttgtccatgaa

SEQ ID NO: 138254 - DNA, 25 bp, Homo sapien
caaatccctgtttttgtccatgaac

SEQ ID NO: 138255 - DNA, 25 bp, Homo sapien
aaatccctgtttttgtccatgaact

SEQ ID NO: 138256 - DNA, 25 bp, Homo sapien
tctgacgacggctcctggtgggacc

SEQ ID NO: 138257 - DNA, 25 bp, Homo sapien
gacggctcctggtgggaccacgact

SEQ ID NO: 138258 - DNA, 25 bp, Homo sapien
tgggaccacgactgccagcggcgtc

SEQ ID NO: 138259 - DNA, 25 bp, Homo sapien
ggcgtctctactacgtctgcgagtt

SEQ ID NO: 138260 - DNA, 25 bp, Homo sapien
acgtctgcgagttccccttctagcg

SEQ ID NO: 138261 - DNA, 25 bp, Homo sapien
agtctgggcgcttctgggagggctc

SEQ ID NO: 138262 - DNA, 25 bp, Homo sapien
gggctcttgcggtgccggcactcct

SEQ ID NO: 138263 - DNA, 25 bp, Homo sapien
ggcactcctccttgttagtgtcttt

SEQ ID NO: 138264 - DNA, 25 bp, Homo sapien
ctccttgttagtgtctttccttgaa

SEQ ID NO: 138265 - DNA, 25 bp, Homo sapien
cttgttagtgtctttccttgaaggg

SEQ ID NO: 138266 - DNA, 25 bp, Homo sapien
accaggctaggtccggtgccaataa

SEQ ID NO: 138267 - DNA, 25 bp, Homo sapien
ggtttcctcccgagtaatccaatct

SEQ ID NO: 138268 - DNA, 25 bp, Homo sapien
aatctcactccccttgtaagggaat

SEQ ID NO: 138269 - DNA, 25 bp, Homo sapien
cagctatggtttgagtatgcagttt

SEQ ID NO: 138270 - DNA, 25 bp, Homo sapien
atgcagtttgcatcgtgtttctacc

SEQ ID NO: 138271 - DNA, 25 bp, Homo sapien
tgtttctacctttagtaccttgcca

SEQ ID NO: 138272 - DNA, 25 bp, Homo sapien
accttgccactcttttaaaacgctg

SEQ ID NO: 138273 - DNA, 25 bp, Homo sapien
ttaaaacgctgctgtcatttcccat

SEQ ID NO: 138274 - DNA, 25 bp, Homo sapien
gattctttgattctccctctattat

SEQ ID NO: 138275 - DNA, 25 bp, Homo sapien
gattctccctctattatgtcttaat

SEQ ID NO: 138276 - DNA, 25 bp, Homo sapien
ttgtaaacatattacctcacttggt

SEQ ID NO: 138277 - DNA, 25 bp, Homo sapien
acctcacttggtaatacaatactga

SEQ ID NO: 138278 - DNA, 25 bp, Homo sapien
tgtcttcaatcccaaaaattataaa

SEQ ID NO: 138279 - DNA, 25 bp, Homo sapien
aaactgaaacccatgaagcaagaat

SEQ ID NO: 138280 - DNA, 25 bp, Homo sapien
gatgattttaggtagtgctttttat

SEQ ID NO: 138281 - DNA, 25 bp, Homo sapien
tagtctagttagtaatgttgtatcc

SEQ ID NO: 138282 - DNA, 25 bp, Homo sapien
gtaatgttgtatccttgcatgaata

SEQ ID NO: 138283 - DNA, 25 bp, Homo sapien
gtatccttgcatgaatattattctt

SEQ ID NO: 138284 - DNA, 25 bp, Homo sapien
attattcttaattccttttgcatgt

SEQ ID NO: 138285 - DNA, 25 bp, Homo sapien
aattccttttgcatgttgactattt

SEQ ID NO: 138286 - DNA, 25 bp, Homo sapien
gttgactatttgcaacgagctcaaa

SEQ ID NO: 138287 - DNA, 25 bp, Homo sapien
gcaacgagctcaaatgctatctgat

SEQ ID NO: 138288 - DNA, 25 bp, Homo sapien
atgctatctgatcaaagtctatttt

SEQ ID NO: 138289 - DNA, 25 bp, Homo sapien
gtattgatcaatgcatgttacccat

SEQ ID NO: 138290 - DNA, 25 bp, Homo sapien
gcatgttacccattcaaccatttta

SEQ ID NO: 138291 - DNA, 25 bp, Homo sapien
attcaaccattttatagactaccaa

SEQ ID NO: 138292 - DNA, 25 bp, Homo sapien
atagactaccaatttcttttatgtt

SEQ ID NO: 138293 - DNA, 25 bp, Homo sapien
ttgttcattatttgtgctacccctt

SEQ ID NO: 138294 - DNA, 25 bp, Homo sapien
gtgctacccctttgattatgcagac

SEQ ID NO: 138295 - DNA, 25 bp, Homo sapien
cttatccatctttgaacttctgact

SEQ ID NO: 138296 - DNA, 25 bp, Homo sapien
acttctgactacttgttgtatctgc

SEQ ID NO: 138297 - DNA, 25 bp, Homo sapien
gactacttgttgtatctgctggata

SEQ ID NO: 138298 - DNA, 25 bp, Homo sapien
gtatctgctggatatttagttcaac

SEQ ID NO: 138299 - DNA, 25 bp, Homo sapien
gttttatttacttctgtatgtgtat

SEQ ID NO: 138300 - DNA, 25 bp, Homo sapien
atgacccaagcattggtatctacgg

SEQ ID NO: 138301 - DNA, 25 bp, Homo sapien
tgacccaagcattggtatctacggc

SEQ ID NO: 138302 - DNA, 25 bp, Homo sapien
acccaagcattggtatctacggcct

SEQ ID NO: 138303 - DNA, 25 bp, Homo sapien
cccaagcattggtatctacggcctg

SEQ ID NO: 138304 - DNA, 25 bp, Homo sapien
ccaagcattggtatctacggcctgg

SEQ ID NO: 138305 - DNA, 25 bp, Homo sapien
caagcattggtatctacggcctgga

SEQ ID NO: 138306 - DNA, 25 bp, Homo sapien
aagcattggtatctacggcctggac

SEQ ID NO: 138307 - DNA, 25 bp, Homo sapien
agcattggtatctacggcctggact

SEQ ID NO: 138308 - DNA, 25 bp, Homo sapien
gcattggtatctacggcctggactt

SEQ ID NO: 138309 - DNA, 25 bp, Homo sapien
cattggtatctacggcctggacttc

SEQ ID NO: 138310 - DNA, 25 bp, Homo sapien
attggtatctacggcctggacttct

SEQ ID NO: 138311 - DNA, 25 bp, Homo sapien
gatgcaagaaggaggctatgctcag

SEQ ID NO: 138312 - DNA, 25 bp, Homo sapien
agctctaccctgcatggctgagctg

SEQ ID NO: 138313 - DNA, 25 bp, Homo sapien
ccacagcaggccaggtccagagaga

SEQ ID NO: 138314 - DNA, 25 bp, Homo sapien
ggagagtctcccagggagcatgaga

SEQ ID NO: 138315 - DNA, 25 bp, Homo sapien
gaggaggcagcaggactgtcccctt

SEQ ID NO: 138316 - DNA, 25 bp, Homo sapien
gcagcaggactgtccccttgaagga

SEQ ID NO: 138317 - DNA, 25 bp, Homo sapien
caggactgtccccttgaaggagaat

SEQ ID NO: 138318 - DNA, 25 bp, Homo sapien
gaaggagaatcatcaggaccctgga

SEQ ID NO: 138319 - DNA, 25 bp, Homo sapien
aggaccctggacctgatacggctcc

SEQ ID NO: 138320 - DNA, 25 bp, Homo sapien
ctggacctgatacggctccccagta

SEQ ID NO: 138321 - DNA, 25 bp, Homo sapien
acctcttccttgtaaatatgattta

SEQ ID NO: 138322 - DNA, 25 bp, Homo sapien
acaaggccattaagaaattcgtcat

SEQ ID NO: 138323 - DNA, 25 bp, Homo sapien
ggccattaagaaattcgtcattcga

SEQ ID NO: 138324 - DNA, 25 bp, Homo sapien
tcgtcattcgaaacatagtggaggc

SEQ ID NO: 138325 - DNA, 25 bp, Homo sapien
gaaacatagtggaggccgcagcagt

SEQ ID NO: 138326 - DNA, 25 bp, Homo sapien
gggacatttctgaagcgagcgtctt

SEQ ID NO: 138327 - DNA, 25 bp, Homo sapien
aagcgagcgtcttcgatgcctatgt

SEQ ID NO: 138328 - DNA, 25 bp, Homo sapien
gagcgtcttcgatgcctatgtgctt

SEQ ID NO: 138329 - DNA, 25 bp, Homo sapien
tcgatgcctatgtgcttcccaagct

SEQ ID NO: 138330 - DNA, 25 bp, Homo sapien
accccgatttagacctgcgggtgct

SEQ ID NO: 138331 - DNA, 25 bp, Homo sapien
aaagcccatgtaaggagctgagttc

SEQ ID NO: 138332 - DNA, 25 bp, Homo sapien
gcccatgtaaggagctgagttctta

SEQ ID NO: 138333 - DNA, 25 bp, Homo sapien
gcaaaaaaggctaagcaagcatcta

SEQ ID NO: 138334 - DNA, 25 bp, Homo sapien
ggctaagcaagcatctaaaaagact

SEQ ID NO: 138335 - DNA, 25 bp, Homo sapien
gcaagcatctaaaaagactgcaatg

SEQ ID NO: 138336 - DNA, 25 bp, Homo sapien
gactgcaatggctgctgctaaggca

SEQ ID NO: 138337 - DNA, 25 bp, Homo sapien
actgcaatggctgctgctaaggcac

SEQ ID NO: 138338 - DNA, 25 bp, Homo sapien
tgcaatggctgctgctaaggcacct

SEQ ID NO: 138339 - DNA, 25 bp, Homo sapien
gcaatggctgctgctaaggcaccta

SEQ ID NO: 138340 - DNA, 25 bp, Homo sapien
aatggctgctgctaaggcacctaca

SEQ ID NO: 138341 - DNA, 25 bp, Homo sapien
atggctgctgctaaggcacctacaa

SEQ ID NO: 138342 - DNA, 25 bp, Homo sapien
ggctgctgctaaggcacctacaaag

SEQ ID NO: 138343 - DNA, 25 bp, Homo sapien
ctgctgctaaggcacctacaaaggc

SEQ ID NO: 138344 - DNA, 25 bp, Homo sapien
gaaaatagcctgcaggtaggaccat

SEQ ID NO: 138345 - DNA, 25 bp, Homo sapien
tgatgggcagatgcgtctttcacac

SEQ ID NO: 138346 - DNA, 25 bp, Homo sapien
gtctttcacacggaatcaggcacag

SEQ ID NO: 138347 - DNA, 25 bp, Homo sapien
acagtggccttctgtgacatgtgtt

SEQ ID NO: 138348 - DNA, 25 bp, Homo sapien
cagtggatgcatgttcctggtcatt

SEQ ID NO: 138349 - DNA, 25 bp, Homo sapien
ctggtcattcgggatttataggcaa

SEQ ID NO: 138350 - DNA, 25 bp, Homo sapien
aaacaatcggaagactgagccatgt

SEQ ID NO: 138351 - DNA, 25 bp, Homo sapien
actgagccatgtgactttagtcctt

SEQ ID NO: 138352 - DNA, 25 bp, Homo sapien
ttagtccttgggagaacttgagcca

SEQ ID NO: 138353 - DNA, 25 bp, Homo sapien
agaacttgagccagcggctgtcttg

SEQ ID NO: 138354 - DNA, 25 bp, Homo sapien
tgctgcctgtacttactggtgtgga

SEQ ID NO: 138355 - DNA, 25 bp, Homo sapien
atatcccaccaacaaatacagagag

SEQ ID NO: 138356 - DNA, 25 bp, Homo sapien
tatcccaccaacaaatacagagaga

SEQ ID NO: 138357 - DNA, 25 bp, Homo sapien
atcccaccaacaaatacagagagaa

SEQ ID NO: 138358 - DNA, 25 bp, Homo sapien
tcccaccaacaaatacagagagaag

SEQ ID NO: 138359 - DNA, 25 bp, Homo sapien
gagagaagatcaaaatcctgtacaa

SEQ ID NO: 138360 - DNA, 25 bp, Homo sapien
gagaagatcaaaatcctgtacaata

SEQ ID NO: 138361 - DNA, 25 bp, Homo sapien
gaagatcaaaatcctgtacaatact

SEQ ID NO: 138362 - DNA, 25 bp, Homo sapien
agatcaaaatcctgtacaatactat

SEQ ID NO: 138363 - DNA, 25 bp, Homo sapien
gtaaagtttctgatagtagtcttta

SEQ ID NO: 138364 - DNA, 25 bp, Homo sapien
agtttctgatagtagtctttaaaag

SEQ ID NO: 138365 - DNA, 25 bp, Homo sapien
gtttctgatagtagtctttaaaaga

SEQ ID NO: 138366 - DNA, 25 bp, Homo sapien
gccctcaaggaaccaccaagagaca

SEQ ID NO: 138367 - DNA, 25 bp, Homo sapien
aacacagtgggaatatcacttttga

SEQ ID NO: 138368 - DNA, 25 bp, Homo sapien
cagtgggaatatcacttttgatgag

SEQ ID NO: 138369 - DNA, 25 bp, Homo sapien
attgctcgacagatgcggcaccgat

SEQ ID NO: 138370 - DNA, 25 bp, Homo sapien
tgcggcaccgatccttagccagaga

SEQ ID NO: 138371 - DNA, 25 bp, Homo sapien
tgcccagtcagtgggctgtaatgtt

SEQ ID NO: 138372 - DNA, 25 bp, Homo sapien
gacatcaacagtggtgctgtggaat

SEQ ID NO: 138373 - DNA, 25 bp, Homo sapien
ggaatgcccagccagttaagcacaa

SEQ ID NO: 138374 - DNA, 25 bp, Homo sapien
gaatgcccagccagttaagcacaaa

SEQ ID NO: 138375 - DNA, 25 bp, Homo sapien
atgcccagccagttaagcacaaagg

SEQ ID NO: 138376 - DNA, 25 bp, Homo sapien
gcccagccagttaagcacaaaggaa

SEQ ID NO: 138377 - DNA, 25 bp, Homo sapien
ccgtttggctcgatattataagacc

SEQ ID NO: 138378 - DNA, 25 bp, Homo sapien
ggctcgatattataagaccaagcga

SEQ ID NO: 138379 - DNA, 25 bp, Homo sapien
ttataagaccaagcgagtcctccct

SEQ ID NO: 138380 - DNA, 25 bp, Homo sapien
agtcctccctcccaattggaaatat

SEQ ID NO: 138381 - DNA, 25 bp, Homo sapien
aatatgaatcatctacagcctctgc

SEQ ID NO: 138382 - DNA, 25 bp, Homo sapien
atatgaatcatctacagcctctgcc

SEQ ID NO: 138383 - DNA, 25 bp, Homo sapien
tatgaatcatctacagcctctgccc

SEQ ID NO: 138384 - DNA, 25 bp, Homo sapien
agcctctgccctggtcgcataaatt

SEQ ID NO: 138385 - DNA, 25 bp, Homo sapien
ctctgccctggtcgcataaatttgt

SEQ ID NO: 138386 - DNA, 25 bp, Homo sapien
ctgccctggtcgcataaatttgtct

SEQ ID NO: 138387 - DNA, 25 bp, Homo sapien
gccctggtcgcataaatttgtctgt

SEQ ID NO: 138388 - DNA, 25 bp, Homo sapien
ggcagagattgacgcccccggtctt

SEQ ID NO: 138389 - DNA, 25 bp, Homo sapien
tctgagcgggagagtctgtgtgtat

SEQ ID NO: 138390 - DNA, 25 bp, Homo sapien
tgtgtatgtgtcttccccggaatcc

SEQ ID NO: 138391 - DNA, 25 bp, Homo sapien
tgtcccgtggtttcatcatatctct

SEQ ID NO: 138392 - DNA, 25 bp, Homo sapien
gtggtttcatcatatctctttgcat

SEQ ID NO: 138393 - DNA, 25 bp, Homo sapien
atcatatctctttgcataccccatg

SEQ ID NO: 138394 - DNA, 25 bp, Homo sapien
tatctctttgcataccccatgtctt

SEQ ID NO: 138395 - DNA, 25 bp, Homo sapien
ggtttctgattgtggcaacgtttgc

SEQ ID NO: 138396 - DNA, 25 bp, Homo sapien
ttgtggcaacgtttgcaaccgttca

SEQ ID NO: 138397 - DNA, 25 bp, Homo sapien
acgtttgcaaccgttcacgattcaa

SEQ ID NO: 138398 - DNA, 25 bp, Homo sapien
accgttcacgattcaataaatattg

SEQ ID NO: 138399 - DNA, 25 bp, Homo sapien
agaaggaggcgccgcccatggagaa

SEQ ID NO: 138400 - DNA, 25 bp, Homo sapien
gcacctgcgggacatgatcatccta

SEQ ID NO: 138401 - DNA, 25 bp, Homo sapien
acctgcgggacatgatcatcctacc

SEQ ID NO: 138402 - DNA, 25 bp, Homo sapien
tgcgggacatgatcatcctacccga

SEQ ID NO: 138403 - DNA, 25 bp, Homo sapien
gggacatgatcatcctacccgagat

SEQ ID NO: 138404 - DNA, 25 bp, Homo sapien
acatgatcatcctacccgagatggt

SEQ ID NO: 138405 - DNA, 25 bp, Homo sapien
atgatcatcctacccgagatggtgg

SEQ ID NO: 138406 - DNA, 25 bp, Homo sapien
ctacaacggcaagaccttcaaccag

SEQ ID NO: 138407 - DNA, 25 bp, Homo sapien
aagcccgagatgatcggccactacc

SEQ ID NO: 138408 - DNA, 25 bp, Homo sapien
agcccgagatgatcggccactacct

SEQ ID NO: 138409 - DNA, 25 bp, Homo sapien
acctgggcgagttctccatcaccta

SEQ ID NO: 138410 - DNA, 25 bp, Homo sapien
ggagttgaagccaaacagccaaatt

SEQ ID NO: 138411 - DNA, 25 bp, Homo sapien
agccaaacagccaaattctgccatt

SEQ ID NO: 138412 - DNA, 25 bp, Homo sapien
cagccaaattctgccattaggaagt

SEQ ID NO: 138413 - DNA, 25 bp, Homo sapien
aagtgtgtaagggtccagctgatca

SEQ ID NO: 138414 - DNA, 25 bp, Homo sapien
tccagctgatcaagaatggcaagaa

SEQ ID NO: 138415 - DNA, 25 bp, Homo sapien
gaaaatcacagcctttgtacccaat

SEQ ID NO: 138416 - DNA, 25 bp, Homo sapien
atcacagcctttgtacccaatgacg

SEQ ID NO: 138417 - DNA, 25 bp, Homo sapien
gcctttgtacccaatgacggttgct

SEQ ID NO: 138418 - DNA, 25 bp, Homo sapien
tgtacccaatgacggttgcttgaac

SEQ ID NO: 138419 - DNA, 25 bp, Homo sapien
cccaatgacggttgcttgaacttta

SEQ ID NO: 138420 - DNA, 25 bp, Homo sapien
ttgcttgaactttattgaggaaaat

SEQ ID NO: 138421 - DNA, 25 bp, Homo sapien
aaaattaggaaatgctgatagctca

SEQ ID NO: 138422 - DNA, 25 bp, Homo sapien
gctgatagctcatattataaatttc

SEQ ID NO: 138423 - DNA, 25 bp, Homo sapien
aatcctaggaagaaacgcttggagt

SEQ ID NO: 138424 - DNA, 25 bp, Homo sapien
gaaacgcttggagtgcttctgaata

SEQ ID NO: 138425 - DNA, 25 bp, Homo sapien
acgcttggagtgcttctgaatatac

SEQ ID NO: 138426 - DNA, 25 bp, Homo sapien
atacagaagttccatttaagggcaa

SEQ ID NO: 138427 - DNA, 25 bp, Homo sapien
taagggcaagtttccccgtagatgt

SEQ ID NO: 138428 - DNA, 25 bp, Homo sapien
caagtttccccgtagatgtatcaaa

SEQ ID NO: 138429 - DNA, 25 bp, Homo sapien
gtttccccgtagatgtatcaaaata

SEQ ID NO: 138430 - DNA, 25 bp, Homo sapien
gtatcaaaatactaccaactgtaaa

SEQ ID NO: 138431 - DNA, 25 bp, Homo sapien
ctgtaaattgagatttaattcccaa

SEQ ID NO: 138432 - DNA, 25 bp, Homo sapien
gggtctattctttccagttcaacaa

SEQ ID NO: 138433 - DNA, 25 bp, Homo sapien
agaaatgaattcttggagatactca

SEQ ID NO: 138434 - DNA, 25 bp, Homo sapien
tggagatactcatgctcccagattc

SEQ ID NO: 138435 - DNA, 25 bp, Homo sapien
tactcatgctcccagattccagagg

SEQ ID NO: 138436 - DNA, 25 bp, Homo sapien
ccagattccagagggttaaccagga

SEQ ID NO: 138437 - DNA, 25 bp, Homo sapien
accaggaatggagaccatccgtcgg

SEQ ID NO: 138438 - DNA, 25 bp, Homo sapien
gaatggagaccatccgtcggccctg

SEQ ID NO: 138439 - DNA, 25 bp, Homo sapien
atccgtcggccctgctaaggactaa

SEQ ID NO: 138440 - DNA, 25 bp, Homo sapien
aacacttagccatcgtttttcacag

SEQ ID NO: 138441 - DNA, 25 bp, Homo sapien
cctttactattgctgatggagcctg

SEQ ID NO: 138442 - DNA, 25 bp, Homo sapien
ggagcctgggggaaccatcactttt

SEQ ID NO: 138443 - DNA, 25 bp, Homo sapien
tctccgcacctgtgcctaagaagct

SEQ ID NO: 138444 - DNA, 25 bp, Homo sapien
ccgcacctgtgcctaagaagctgct

SEQ ID NO: 138445 - DNA, 25 bp, Homo sapien
gcacctgtgcctaagaagctgctca

SEQ ID NO: 138446 - DNA, 25 bp, Homo sapien
cacctgtgcctaagaagctgctcat

SEQ ID NO: 138447 - DNA, 25 bp, Homo sapien
acctgtgcctaagaagctgctcatg

SEQ ID NO: 138448 - DNA, 25 bp, Homo sapien
taagaagctgctcatgatggctggt

SEQ ID NO: 138449 - DNA, 25 bp, Homo sapien
gatggctggtatcgatgactgctac

SEQ ID NO: 138450 - DNA, 25 bp, Homo sapien
gtatcgatgactgctacacctcagc

SEQ ID NO: 138451 - DNA, 25 bp, Homo sapien
gggcaacttcgccaaggccaccttt

SEQ ID NO: 138452 - DNA, 25 bp, Homo sapien
gccacctttgatgccatttctaaga

SEQ ID NO: 138453 - DNA, 25 bp, Homo sapien
aggagttcactgaccacctcgtcaa

SEQ ID NO: 138454 - DNA, 25 bp, Homo sapien
tgcagacccaggtcttcaagctggg

SEQ ID NO: 138455 - DNA, 25 bp, Homo sapien
ttcaagctgggcttggccaagtcca

SEQ ID NO: 138456 - DNA, 25 bp, Homo sapien
caagctgggcttggccaagtccatc

SEQ ID NO: 138457 - DNA, 25 bp, Homo sapien
atccaccacgctcgcgtgctgatcc

SEQ ID NO: 138458 - DNA, 25 bp, Homo sapien
gtgctgatccgccagcgccatatca

SEQ ID NO: 138459 - DNA, 25 bp, Homo sapien
gccagcgccatatcagggtccgcaa

SEQ ID NO: 138460 - DNA, 25 bp, Homo sapien
agcgccatatcagggtccgcaagca

SEQ ID NO: 138461 - DNA, 25 bp, Homo sapien
ccatatcagggtccgcaagcaggtg

SEQ ID NO: 138462 - DNA, 25 bp, Homo sapien
cattgtccgcctggattcccagaag

SEQ ID NO: 138463 - DNA, 25 bp, Homo sapien
ggattcccagaagcacattgacttc

SEQ ID NO: 138464 - DNA, 25 bp, Homo sapien
agaagcacattgacttctctctgcg

SEQ ID NO: 138465 - DNA, 25 bp, Homo sapien
taaagaacagcgtaactccagacat

SEQ ID NO: 138466 - DNA, 25 bp, Homo sapien
gaacagcgtaactccagacatgatg

SEQ ID NO: 138467 - DNA, 25 bp, Homo sapien
gatgtataagaaagctcatgctgct

SEQ ID NO: 138468 - DNA, 25 bp, Homo sapien
atgctgctatacgagagaatccagt

SEQ ID NO: 138469 - DNA, 25 bp, Homo sapien
gaagaggtggaaccgtcccaaaatg

SEQ ID NO: 138470 - DNA, 25 bp, Homo sapien
cccaaaatgtcccttgctcagaaga

SEQ ID NO: 138471 - DNA, 25 bp, Homo sapien
tcgggtagctcaaaagaaggcaagc

SEQ ID NO: 138472 - DNA, 25 bp, Homo sapien
gaaggcaagcttcctcagagctcag

SEQ ID NO: 138473 - DNA, 25 bp, Homo sapien
aagcttcctcagagctcaggagcgg

SEQ ID NO: 138474 - DNA, 25 bp, Homo sapien
ggctgctgagagctaaacccagcaa

SEQ ID NO: 138475 - DNA, 25 bp, Homo sapien
aacccagcaattttctatgattttt

SEQ ID NO: 138476 - DNA, 25 bp, Homo sapien
aagcaagtacatatagtagtgacta

SEQ ID NO: 138477 - DNA, 25 bp, Homo sapien
attatgggataatgttgcaggatta

SEQ ID NO: 138478 - DNA, 25 bp, Homo sapien
gggataatgttgcaggattatactt

SEQ ID NO: 138479 - DNA, 25 bp, Homo sapien
aatgttgcaggattatactttattg

SEQ ID NO: 138480 - DNA, 25 bp, Homo sapien
gttgcaggattatactttattgcat

SEQ ID NO: 138481 - DNA, 25 bp, Homo sapien
tgcaggattatactttattgcatct

SEQ ID NO: 138482 - DNA, 25 bp, Homo sapien
tatactttattgcatcttttttgtt

SEQ ID NO: 138483 - DNA, 25 bp, Homo sapien
ttaagcattgtgcaatcacttggga

SEQ ID NO: 138484 - DNA, 25 bp, Homo sapien
tttgttccagagattgtttaaaaat

SEQ ID NO: 138485 - DNA, 25 bp, Homo sapien
tttatatcttaattctagtatctgt

SEQ ID NO: 138486 - DNA, 25 bp, Homo sapien
tatatcttaattctagtatctgttt

SEQ ID NO: 138487 - DNA, 25 bp, Homo sapien
agaattcctgagaaccgagtggtca

SEQ ID NO: 138488 - DNA, 25 bp, Homo sapien
tgtccagcaggagcacatgcctcaa

SEQ ID NO: 138489 - DNA, 25 bp, Homo sapien
ggaggagtgatcttcaccaccaaga

SEQ ID NO: 138490 - DNA, 25 bp, Homo sapien
aagggccagcagttctgtggcgacc

SEQ ID NO: 138491 - DNA, 25 bp, Homo sapien
agttctgtggcgaccccaagcagga

SEQ ID NO: 138492 - DNA, 25 bp, Homo sapien
gtacatgaagaacctggacgccaag

SEQ ID NO: 138493 - DNA, 25 bp, Homo sapien
agaagaaggcttcccctagggccag

SEQ ID NO: 138494 - DNA, 25 bp, Homo sapien
agtggctgtcaagggccctgtccag

SEQ ID NO: 138495 - DNA, 25 bp, Homo sapien
agggccctgtccagagatatcctgg

SEQ ID NO: 138496 - DNA, 25 bp, Homo sapien
gatatcctggcaaccaaaccacctg

SEQ ID NO: 138497 - DNA, 25 bp, Homo sapien
atccctacgggctctgtggtcatac

SEQ ID NO: 138498 - DNA, 25 bp, Homo sapien
cttgttggtaaatgctcagaggtct

SEQ ID NO: 138499 - DNA, 25 bp, Homo sapien
ttggtaaatgctcagaggtctgtgc

SEQ ID NO: 138500 - DNA, 25 bp, Homo sapien
aaatgctcagaggtctgtgctacct

SEQ ID NO: 138501 - DNA, 25 bp, Homo sapien
atgctcagaggtctgtgctacctct

SEQ ID NO: 138502 - DNA, 25 bp, Homo sapien
gtaaaataaggatcgtattccctgc

SEQ ID NO: 138503 - DNA, 25 bp, Homo sapien
aaaataaggatcgtattccctgctt

SEQ ID NO: 138504 - DNA, 25 bp, Homo sapien
aataaggatcgtattccctgcttta

SEQ ID NO: 138505 - DNA, 25 bp, Homo sapien
ataaggatcgtattccctgctttaa

SEQ ID NO: 138506 - DNA, 25 bp, Homo sapien
taaggatcgtattccctgctttaag

SEQ ID NO: 138507 - DNA, 25 bp, Homo sapien
tgagacaaagttcttgagacattta

SEQ ID NO: 138508 - DNA, 25 bp, Homo sapien
tcttgagacatttaaactgtattta

SEQ ID NO: 138509 - DNA, 25 bp, Homo sapien
gcaagctcgatcgacttgcctacat

SEQ ID NO: 138510 - DNA, 25 bp, Homo sapien
cttgggaagcgtgctcgtgcccgta

SEQ ID NO: 138511 - DNA, 25 bp, Homo sapien
tgggaagcgtgctcgtgcccgtatt

SEQ ID NO: 138512 - DNA, 25 bp, Homo sapien
ggaagcgtgctcgtgcccgtattgc

SEQ ID NO: 138513 - DNA, 25 bp, Homo sapien
gaagcgtgctcgtgcccgtattgcc

SEQ ID NO: 138514 - DNA, 25 bp, Homo sapien
aagcgtgctcgtgcccgtattgcca

SEQ ID NO: 138515 - DNA, 25 bp, Homo sapien
agcgtgctcgtgcccgtattgccaa

SEQ ID NO: 138516 - DNA, 25 bp, Homo sapien
gcgtgctcgtgcccgtattgccaag

SEQ ID NO: 138517 - DNA, 25 bp, Homo sapien
cgtgctcgtgcccgtattgccaagg

SEQ ID NO: 138518 - DNA, 25 bp, Homo sapien
tgctcgtgcccgtattgccaagggg

SEQ ID NO: 138519 - DNA, 25 bp, Homo sapien
cgtgcccgtattgccaaggggctca

SEQ ID NO: 138520 - DNA, 25 bp, Homo sapien
tctccgcacctgtgcctaagaagct

SEQ ID NO: 138521 - DNA, 25 bp, Homo sapien
ctccgcacctgtgcctaagaagctg

SEQ ID NO: 138522 - DNA, 25 bp, Homo sapien
tccgcacctgtgcctaagaagctgc

SEQ ID NO: 138523 - DNA, 25 bp, Homo sapien
ccgcacctgtgcctaagaagctgct

SEQ ID NO: 138524 - DNA, 25 bp, Homo sapien
cgcacctgtgcctaagaagctgctc

SEQ ID NO: 138525 - DNA, 25 bp, Homo sapien
gcacctgtgcctaagaagctgctca

SEQ ID NO: 138526 - DNA, 25 bp, Homo sapien
cacctgtgcctaagaagctgctcat

SEQ ID NO: 138527 - DNA, 25 bp, Homo sapien
acctgtgcctaagaagctgctcatg

SEQ ID NO: 138528 - DNA, 25 bp, Homo sapien
cctgcatatcctaggtttgaagaga

SEQ ID NO: 138529 - DNA, 25 bp, Homo sapien
atcctaggtttgaagagaaacgctc

SEQ ID NO: 138530 - DNA, 25 bp, Homo sapien
gaagagaaacgctcagatccgctta

SEQ ID NO: 138531 - DNA, 25 bp, Homo sapien
agagaaacgctcagatccgcttatt

SEQ ID NO: 138532 - DNA, 25 bp, Homo sapien
gagaaacgctcagatccgcttattt

SEQ ID NO: 138533 - DNA, 25 bp, Homo sapien
gaaacgctcagatccgcttatttct

SEQ ID NO: 138534 - DNA, 25 bp, Homo sapien
aaacgctcagatccgcttatttctg

SEQ ID NO: 138535 - DNA, 25 bp, Homo sapien
tcagatccgcttatttctgccagta

SEQ ID NO: 138536 - DNA, 25 bp, Homo sapien
agatccgcttatttctgccagtata

SEQ ID NO: 138537 - DNA, 25 bp, Homo sapien
gatccgcttatttctgccagtatat

SEQ ID NO: 138538 - DNA, 25 bp, Homo sapien
tccgcttatttctgccagtatattt

SEQ ID NO: 138539 - DNA, 25 bp, Homo sapien
catgctgctatacgagagaatccag

SEQ ID NO: 138540 - DNA, 25 bp, Homo sapien
atgctgctatacgagagaatccagt

SEQ ID NO: 138541 - DNA, 25 bp, Homo sapien
tcaaaagaaggcaagcttcctcaga

SEQ ID NO: 138542 - DNA, 25 bp, Homo sapien
caaaagaaggcaagcttcctcagag

SEQ ID NO: 138543 - DNA, 25 bp, Homo sapien
aaaagaaggcaagcttcctcagagc

SEQ ID NO: 138544 - DNA, 25 bp, Homo sapien
aaagaaggcaagcttcctcagagct

SEQ ID NO: 138545 - DNA, 25 bp, Homo sapien
aagaaggcaagcttcctcagagctc

SEQ ID NO: 138546 - DNA, 25 bp, Homo sapien
agaaggcaagcttcctcagagctca

SEQ ID NO: 138547 - DNA, 25 bp, Homo sapien
gaaggcaagcttcctcagagctcag

SEQ ID NO: 138548 - DNA, 25 bp, Homo sapien
gagctcaggagcgggctgctgagag

SEQ ID NO: 138549 - DNA, 25 bp, Homo sapien
ctgctgagagctaaacccagcaatt

SEQ ID NO: 138550 - DNA, 25 bp, Homo sapien
atcctctctggcgtggtgaccaaga

SEQ ID NO: 138551 - DNA, 25 bp, Homo sapien
gaccattgtcatccgccgagactat

SEQ ID NO: 138552 - DNA, 25 bp, Homo sapien
cgagactatctgcactacatccgca

SEQ ID NO: 138553 - DNA, 25 bp, Homo sapien
agtacaaccgcttcgagaagcgcca

SEQ ID NO: 138554 - DNA, 25 bp, Homo sapien
gaagcgccacaagaacatgtctgta

SEQ ID NO: 138555 - DNA, 25 bp, Homo sapien
aagaacatgtctgtacacctgtccc

SEQ ID NO: 138556 - DNA, 25 bp, Homo sapien
ctgcttcagggacgtccagatcggt

SEQ ID NO: 138557 - DNA, 25 bp, Homo sapien
acatcgtcacagtgggcgagtgccg

SEQ ID NO: 138558 - DNA, 25 bp, Homo sapien
agtgccggcctctgagcaagacagt

SEQ ID NO: 138559 - DNA, 25 bp, Homo sapien
gagcaagacagtgcgcttcaacgtg

SEQ ID NO: 138560 - DNA, 25 bp, Homo sapien
acagtgcgcttcaacgtgctcaagg

SEQ ID NO: 138561 - DNA, 25 bp, Homo sapien
ctaaggtgtccagtgcattgggatg

SEQ ID NO: 138562 - DNA, 25 bp, Homo sapien
gtccagtgcattgggatggttttcc

SEQ ID NO: 138563 - DNA, 25 bp, Homo sapien
gatggttttccaggcaaggcactcg

SEQ ID NO: 138564 - DNA, 25 bp, Homo sapien
aggcaaggcactcggccaatccgca

SEQ ID NO: 138565 - DNA, 25 bp, Homo sapien
ggagcagtcttccatcatgctgaat

SEQ ID NO: 138566 - DNA, 25 bp, Homo sapien
gtcttccatcatgctgaattttgtc

SEQ ID NO: 138567 - DNA, 25 bp, Homo sapien
ttgtttctctagtcacatcatgtgt

SEQ ID NO: 138568 - DNA, 25 bp, Homo sapien
tgtgtatacaaggaagccaggaata

SEQ ID NO: 138569 - DNA, 25 bp, Homo sapien
attttgtttttattgcacctgacaa

SEQ ID NO: 138570 - DNA, 25 bp, Homo sapien
tattgcacctgacaaaatacagtta

SEQ ID NO: 138571 - DNA, 25 bp, Homo sapien
tacagttatctgatggtccctcaat

SEQ ID NO: 138572 - DNA, 25 bp, Homo sapien
agaaatgaattcttggagatactca

SEQ ID NO: 138573 - DNA, 25 bp, Homo sapien
ttggagatactcatgctcccagatt

SEQ ID NO: 138574 - DNA, 25 bp, Homo sapien
agatactcatgctcccagattccag

SEQ ID NO: 138575 - DNA, 25 bp, Homo sapien
tactcatgctcccagattccagagg

SEQ ID NO: 138576 - DNA, 25 bp, Homo sapien
ccagattccagagggttaaccagga

SEQ ID NO: 138577 - DNA, 25 bp, Homo sapien
ttccagagggttaaccaggaatgga

SEQ ID NO: 138578 - DNA, 25 bp, Homo sapien
aggaatggagaccatccgtcggccc

SEQ ID NO: 138579 - DNA, 25 bp, Homo sapien
gaatggagaccatccgtcggccctg

SEQ ID NO: 138580 - DNA, 25 bp, Homo sapien
atccgtcggccctgctaaggactaa

SEQ ID NO: 138581 - DNA, 25 bp, Homo sapien
cctttactattgctgatggagcctg

SEQ ID NO: 138582 - DNA, 25 bp, Homo sapien
ggagcctgggggaaccatcactttt

SEQ ID NO: 138583 - DNA, 25 bp, Homo sapien
ataaaagtcatttagaaggtcaggg

SEQ ID NO: 138584 - DNA, 25 bp, Homo sapien
atctagaggcaggattttggacatt

SEQ ID NO: 138585 - DNA, 25 bp, Homo sapien
gaggcaggattttggacattgtgaa

SEQ ID NO: 138586 - DNA, 25 bp, Homo sapien
tgaaggaaatgtgctccttctcagc

SEQ ID NO: 138587 - DNA, 25 bp, Homo sapien
tgagactgaagttttttagacaaga

SEQ ID NO: 138588 - DNA, 25 bp, Homo sapien
gctttccgtgaaatgctcagaaaat

SEQ ID NO: 138589 - DNA, 25 bp, Homo sapien
gaaatgctcagaaaatgtcaggaca

SEQ ID NO: 138590 - DNA, 25 bp, Homo sapien
ccttttccaattgtgtgtcagtgcg

SEQ ID NO: 138591 - DNA, 25 bp, Homo sapien
ttccaattgtgtgtcagtgcgtatt

SEQ ID NO: 138592 - DNA, 25 bp, Homo sapien
aattgtgtgtcagtgcgtattgtaa

SEQ ID NO: 138593 - DNA, 25 bp, Homo sapien
gtgtgtcagtgcgtattgtaataaa

SEQ ID NO: 138594 - DNA, 25 bp, Homo sapien
aagcaagtacatatagtagtgacta

SEQ ID NO: 138595 - DNA, 25 bp, Homo sapien
agcaagtacatatagtagtgactat

SEQ ID NO: 138596 - DNA, 25 bp, Homo sapien
attatgggataatgttgcaggatta

SEQ ID NO: 138597 - DNA, 25 bp, Homo sapien
gggataatgttgcaggattatactt

SEQ ID NO: 138598 - DNA, 25 bp, Homo sapien
aatgttgcaggattatactttattg

SEQ ID NO: 138599 - DNA, 25 bp, Homo sapien
atgttgcaggattatactttattgc

SEQ ID NO: 138600 - DNA, 25 bp, Homo sapien
gttgcaggattatactttattgcat

SEQ ID NO: 138601 - DNA, 25 bp, Homo sapien
tgcaggattatactttattgcatct

SEQ ID NO: 138602 - DNA, 25 bp, Homo sapien
tttgttccagagattgtttaaaaat

SEQ ID NO: 138603 - DNA, 25 bp, Homo sapien
tttatatcttaattctagtatctgt

SEQ ID NO: 138604 - DNA, 25 bp, Homo sapien
tatatcttaattctagtatctgttt

SEQ ID NO: 138605 - DNA, 25 bp, Homo sapien
aggagtctactcttcatcttgtgtt

SEQ ID NO: 138606 - DNA, 25 bp, Homo sapien
cttcatcttgtgttgagacttcgtg

SEQ ID NO: 138607 - DNA, 25 bp, Homo sapien
aagaagaagtcttacaccactccca

SEQ ID NO: 138608 - DNA, 25 bp, Homo sapien
agaagaagtcttacaccactcccaa

SEQ ID NO: 138609 - DNA, 25 bp, Homo sapien
gaaggttaagctggctgtcctgaaa

SEQ ID NO: 138610 - DNA, 25 bp, Homo sapien
atggcaaaattagtcgccttcgtcg

SEQ ID NO: 138611 - DNA, 25 bp, Homo sapien
aaaattagtcgccttcgtcgagagt

SEQ ID NO: 138612 - DNA, 25 bp, Homo sapien
attagtcgccttcgtcgagagtgcc

SEQ ID NO: 138613 - DNA, 25 bp, Homo sapien
agtgcccttctgatgaatgtggtgc

SEQ ID NO: 138614 - DNA, 25 bp, Homo sapien
tgacttactgtttcaacaaaccaga

SEQ ID NO: 138615 - DNA, 25 bp, Homo sapien
ttactgtttcaacaaaccagaagac

SEQ ID NO: 138616 - DNA, 25 bp, Homo sapien
gctaagttcagaccttctcttcctt

SEQ ID NO: 138617 - DNA, 25 bp, Homo sapien
taagttcagaccttctcttcctttc

SEQ ID NO: 138618 - DNA, 25 bp, Homo sapien
tcctgttcttctgtccttcaatact

SEQ ID NO: 138619 - DNA, 25 bp, Homo sapien
gttcttctgtccttcaatacttctg

SEQ ID NO: 138620 - DNA, 25 bp, Homo sapien
tagcttcccattcatgttctcttct

SEQ ID NO: 138621 - DNA, 25 bp, Homo sapien
cctgcggctgttggatttgggaatg

SEQ ID NO: 138622 - DNA, 25 bp, Homo sapien
ggtgagagtctcactgctccagggt

SEQ ID NO: 138623 - DNA, 25 bp, Homo sapien
cactgctccagggtctctttttggt

SEQ ID NO: 138624 - DNA, 25 bp, Homo sapien
tttttggtccaaaggctagacctat

SEQ ID NO: 138625 - DNA, 25 bp, Homo sapien
aaggctagacctatagagttggatc

SEQ ID NO: 138626 - DNA, 25 bp, Homo sapien
gacctatagagttggatcacttttt

SEQ ID NO: 138627 - DNA, 25 bp, Homo sapien
gaatgtgccataccgaatccgtgtg

SEQ ID NO: 138628 - DNA, 25 bp, Homo sapien
atgtgccataccgaatccgtgtgcg

SEQ ID NO: 138629 - DNA, 25 bp, Homo sapien
gtgccataccgaatccgtgtgcggc

SEQ ID NO: 138630 - DNA, 25 bp, Homo sapien
gccataccgaatccgtgtgcggctg

SEQ ID NO: 138631 - DNA, 25 bp, Homo sapien
ataccgaatccgtgtgcggctgtcc

SEQ ID NO: 138632 - DNA, 25 bp, Homo sapien
accgaatccgtgtgcggctgtccag

SEQ ID NO: 138633 - DNA, 25 bp, Homo sapien
atccgtgtgcggctgtccagaaaac

SEQ ID NO: 138634 - DNA, 25 bp, Homo sapien
tccgtgtgcggctgtccagaaaacg

SEQ ID NO: 138635 - DNA, 25 bp, Homo sapien
cgtgtgcggctgtccagaaaacgta

SEQ ID NO: 138636 - DNA, 25 bp, Homo sapien
tgtgcggctgtccagaaaacgtaat

SEQ ID NO: 138637 - DNA, 25 bp, Homo sapien
caaataagctatatactttggttac

SEQ ID NO: 138638 - DNA, 25 bp, Homo sapien
atccttttaaatcttgataccacct

SEQ ID NO: 138639 - DNA, 25 bp, Homo sapien
ttaaatcttgataccacctatatag

SEQ ID NO: 138640 - DNA, 25 bp, Homo sapien
accacctatatagatgcagcatttt

SEQ ID NO: 138641 - DNA, 25 bp, Homo sapien
ccacctatatagatgcagcattttg

SEQ ID NO: 138642 - DNA, 25 bp, Homo sapien
gcattttgtatttgtctaactgggg

SEQ ID NO: 138643 - DNA, 25 bp, Homo sapien
atactgactgagaatataatactgt

SEQ ID NO: 138644 - DNA, 25 bp, Homo sapien
tcagggaagaagcatacaactttgg

SEQ ID NO: 138645 - DNA, 25 bp, Homo sapien
gaagaagcatacaactttggacata

SEQ ID NO: 138646 - DNA, 25 bp, Homo sapien
caactttggacatagcgaatacaaa

SEQ ID NO: 138647 - DNA, 25 bp, Homo sapien
gcgaatacaaaattggaagctgtca

SEQ ID NO: 138648 - DNA, 25 bp, Homo sapien
agacaactcagaggccaggcgcagg

SEQ ID NO: 138649 - DNA, 25 bp, Homo sapien
ttatagttccctcaacacaattgct

SEQ ID NO: 138650 - DNA, 25 bp, Homo sapien
gttccctcaacacaattgctaatgc

SEQ ID NO: 138651 - DNA, 25 bp, Homo sapien
gcagaatagtgtaaaatgcgcttca

SEQ ID NO: 138652 - DNA, 25 bp, Homo sapien
aatgcgcttcaagaatgttgatgat

SEQ ID NO: 138653 - DNA, 25 bp, Homo sapien
gatatagaattgtggctttagtagc

SEQ ID NO: 138654 - DNA, 25 bp, Homo sapien
ttagtagcacagaggatgccccaac

SEQ ID NO: 138655 - DNA, 25 bp, Homo sapien
gatgccccaacaaactcatggcgtt

SEQ ID NO: 138656 - DNA, 25 bp, Homo sapien
catggcgttgaaaccacacagttct

SEQ ID NO: 138657 - DNA, 25 bp, Homo sapien
aaccacacagttctcattactgtta

SEQ ID NO: 138658 - DNA, 25 bp, Homo sapien
tatttattagctgtagcattctctg

SEQ ID NO: 138659 - DNA, 25 bp, Homo sapien
tacttcctcccaagagtttggactg

SEQ ID NO: 138660 - DNA, 25 bp, Homo sapien
gttttgcctttaacagttggatgga

SEQ ID NO: 138661 - DNA, 25 bp, Homo sapien
acagttggatggattttgtcaatca

SEQ ID NO: 138662 - DNA, 25 bp, Homo sapien
ggatatgctgtttagtttttacaac

SEQ ID NO: 138663 - DNA, 25 bp, Homo sapien
catgatatctttgcttttgagttcc

SEQ ID NO: 138664 - DNA, 25 bp, Homo sapien
ggacaattccatatgtagcattctg

SEQ ID NO: 138665 - DNA, 25 bp, Homo sapien
gtagcattctgcttcaatattatct

SEQ ID NO: 138666 - DNA, 25 bp, Homo sapien
gcttcaatattatctctctatgtgt

SEQ ID NO: 138667 - DNA, 25 bp, Homo sapien
tctttaaatatctgcctgtaggtaa

SEQ ID NO: 138668 - DNA, 25 bp, Homo sapien
gcctgtaggtaaaagcaagctctgc

SEQ ID NO: 138669 - DNA, 25 bp, Homo sapien
agcaagctctgcatatctgtacctc

SEQ ID NO: 138670 - DNA, 25 bp, Homo sapien
acctcttgagatagttttgttttgc

SEQ ID NO: 138671 - DNA, 25 bp, Homo sapien
acaaggtactctgtggatatcccct

SEQ ID NO: 138672 - DNA, 25 bp, Homo sapien
ggtactctgtggatatccccttgga

SEQ ID NO: 138673 - DNA, 25 bp, Homo sapien
ctctgtggatatccccttggacaaa

SEQ ID NO: 138674 - DNA, 25 bp, Homo sapien
gatatccccttggacaaaactgtcg

SEQ ID NO: 138675 - DNA, 25 bp, Homo sapien
aactgtcgtcaataaggatgtcttc

SEQ ID NO: 138676 - DNA, 25 bp, Homo sapien
gatgtcttcagagatcctgctctta

SEQ ID NO: 138677 - DNA, 25 bp, Homo sapien
tcagagatcctgctcttaaacgcaa

SEQ ID NO: 138678 - DNA, 25 bp, Homo sapien
acaagacaggcaagaacaagtggtt

SEQ ID NO: 138679 - DNA, 25 bp, Homo sapien
gaacaagtggttcttccagaaactg

SEQ ID NO: 138680 - DNA, 25 bp, Homo sapien
gtggttcttccagaaactgcggttt

SEQ ID NO: 138681 - DNA, 25 bp, Homo sapien
cttccagaaactgcggttttagatg

SEQ ID NO: 138682 - DNA, 25 bp, Homo sapien
ggaggaggccatttcactccctgaa

SEQ ID NO: 138683 - DNA, 25 bp, Homo sapien
gaacccagcctgacaaatcacagtg

SEQ ID NO: 138684 - DNA, 25 bp, Homo sapien
aatcacagtgagaatgttcacctta

SEQ ID NO: 138685 - DNA, 25 bp, Homo sapien
gttcaccttataggcttgctgtggg

SEQ ID NO: 138686 - DNA, 25 bp, Homo sapien
gggagtgacactgcctaggcatcca

SEQ ID NO: 138687 - DNA, 25 bp, Homo sapien
actgcctaggcatccagctcagtgt

SEQ ID NO: 138688 - DNA, 25 bp, Homo sapien
agctcagtgtcatccagggcctgtg

SEQ ID NO: 138689 - DNA, 25 bp, Homo sapien
ctgccacaggcactagaaggacgaa

SEQ ID NO: 138690 - DNA, 25 bp, Homo sapien
agaaggacgaatctgcctactgccc

SEQ ID NO: 138691 - DNA, 25 bp, Homo sapien
aatctgcctactgcccatgaacggg

SEQ ID NO: 138692 - DNA, 25 bp, Homo sapien
ttgcccctcaggactgctggaaaat

SEQ ID NO: 138693 - DNA, 25 bp, Homo sapien
ttcaagctgggcttggccaagtcca

SEQ ID NO: 138694 - DNA, 25 bp, Homo sapien
tcaagctgggcttggccaagtccat

SEQ ID NO: 138695 - DNA, 25 bp, Homo sapien
caagctgggcttggccaagtccatc

SEQ ID NO: 138696 - DNA, 25 bp, Homo sapien
ccatccaccacgctcgcgtgctgat

SEQ ID NO: 138697 - DNA, 25 bp, Homo sapien
accacgctcgcgtgctgatccgcca

SEQ ID NO: 138698 - DNA, 25 bp, Homo sapien
tgatccgccagcgccatatcagggt

SEQ ID NO: 138699 - DNA, 25 bp, Homo sapien
gccagcgccatatcagggtccgcaa

SEQ ID NO: 138700 - DNA, 25 bp, Homo sapien
ccagcgccatatcagggtccgcaag

SEQ ID NO: 138701 - DNA, 25 bp, Homo sapien
cagcgccatatcagggtccgcaagc

SEQ ID NO: 138702 - DNA, 25 bp, Homo sapien
agcgccatatcagggtccgcaagca

SEQ ID NO: 138703 - DNA, 25 bp, Homo sapien
tgcgctctcctacgggggttggccg

SEQ ID NO: 138704 - DNA, 25 bp, Homo sapien
ttgtcgtgtctgttcaaaccggcac

SEQ ID NO: 138705 - DNA, 25 bp, Homo sapien
aaccggcacggtctgatccggaaat

SEQ ID NO: 138706 - DNA, 25 bp, Homo sapien
tttttacctcgttgcactgctgaga

SEQ ID NO: 138707 - DNA, 25 bp, Homo sapien
aaatatggcctcaatatgtgccgcc

SEQ ID NO: 138708 - DNA, 25 bp, Homo sapien
aatatgtgccgccagtgtttccgtc

SEQ ID NO: 138709 - DNA, 25 bp, Homo sapien
cagtgtttccgtcagtacgcgaagg

SEQ ID NO: 138710 - DNA, 25 bp, Homo sapien
gtacgcgaaggatatcggtttcatt

SEQ ID NO: 138711 - DNA, 25 bp, Homo sapien
gttggactaaatgctcttccttcag

SEQ ID NO: 138712 - DNA, 25 bp, Homo sapien
gctcttccttcagaggattatccgg

SEQ ID NO: 138713 - DNA, 25 bp, Homo sapien
actgctgagagcaagatgggtcacc

SEQ ID NO: 138714 - DNA, 25 bp, Homo sapien
gaaaattcggccagggttctcgctc

SEQ ID NO: 138715 - DNA, 25 bp, Homo sapien
agagatcaacgacgagaccctccac

SEQ ID NO: 138716 - DNA, 25 bp, Homo sapien
agaccctccacagtatccggtggtt

SEQ ID NO: 138717 - DNA, 25 bp, Homo sapien
cagttcacctggatagaatcatcta

SEQ ID NO: 138718 - DNA, 25 bp, Homo sapien
agttcacctggatagaatcatctaa

SEQ ID NO: 138719 - DNA, 25 bp, Homo sapien
tcacctggatagaatcatctaagct

SEQ ID NO: 138720 - DNA, 25 bp, Homo sapien
gatcccatctctccatatactttgg

SEQ ID NO: 138721 - DNA, 25 bp, Homo sapien
atcccatctctccatatactttggg

SEQ ID NO: 138722 - DNA, 25 bp, Homo sapien
ccatctctccatatactttgggtat

SEQ ID NO: 138723 - DNA, 25 bp, Homo sapien
atctctccatatactttgggtatca

SEQ ID NO: 138724 - DNA, 25 bp, Homo sapien
ctccatatactttgggtatcagcat

SEQ ID NO: 138725 - DNA, 25 bp, Homo sapien
atactttgggtatcagcatctgtcc

SEQ ID NO: 138726 - DNA, 25 bp, Homo sapien
gggccgtgggcgtccagggcgctag

SEQ ID NO: 138727 - DNA, 25 bp, Homo sapien
gtccagggcgctaggaagccgggtg

SEQ ID NO: 138728 - DNA, 25 bp, Homo sapien
tgagggtagcccttgagccctgtcc

SEQ ID NO: 138729 - DNA, 25 bp, Homo sapien
gagggtagcccttgagccctgtccc

SEQ ID NO: 138730 - DNA, 25 bp, Homo sapien
gggtagcccttgagccctgtccctg

SEQ ID NO: 138731 - DNA, 25 bp, Homo sapien
ggtgtgagtgcgtatgaaagtgtgt

SEQ ID NO: 138732 - DNA, 25 bp, Homo sapien
cagctgtgcccctgaatcatgggca

SEQ ID NO: 138733 - DNA, 25 bp, Homo sapien
gctgtgcccctgaatcatgggcacg

SEQ ID NO: 138734 - DNA, 25 bp, Homo sapien
tgtgcccctgaatcatgggcacgga

SEQ ID NO: 138735 - DNA, 25 bp, Homo sapien
tgcccctgaatcatgggcacggagg

SEQ ID NO: 138736 - DNA, 25 bp, Homo sapien
cccctgaatcatgggcacggagggc

SEQ ID NO: 138737 - DNA, 25 bp, Homo sapien
ccttgctggtgcagacgaagcggcg

SEQ ID NO: 138738 - DNA, 25 bp, Homo sapien
cttgctggtgcagacgaagcggcgg

SEQ ID NO: 138739 - DNA, 25 bp, Homo sapien
ttgctggtgcagacgaagcggcggg

SEQ ID NO: 138740 - DNA, 25 bp, Homo sapien
tgctggtgcagacgaagcggcgggc

SEQ ID NO: 138741 - DNA, 25 bp, Homo sapien
gctggtgcagacgaagcggcgggct

SEQ ID NO: 138742 - DNA, 25 bp, Homo sapien
ctggtgcagacgaagcggcgggctc

SEQ ID NO: 138743 - DNA, 25 bp, Homo sapien
tggtgcagacgaagcggcgggctct

SEQ ID NO: 138744 - DNA, 25 bp, Homo sapien
ggtgcagacgaagcggcgggctctg

SEQ ID NO: 138745 - DNA, 25 bp, Homo sapien
tgcagacgaagcggcgggctctgga

SEQ ID NO: 138746 - DNA, 25 bp, Homo sapien
agacgaagcggcgggctctggagaa

SEQ ID NO: 138747 - DNA, 25 bp, Homo sapien
gacgaagcggcgggctctggagaag

SEQ ID NO: 138748 - DNA, 25 bp, Homo sapien
gaattagcaggtcatgctgtcaaaa

SEQ ID NO: 138749 - DNA, 25 bp, Homo sapien
attagcaggtcatgctgtcaaaatc

SEQ ID NO: 138750 - DNA, 25 bp, Homo sapien
tagcaggtcatgctgtcaaaatcat

SEQ ID NO: 138751 - DNA, 25 bp, Homo sapien
gcaggtcatgctgtcaaaatcatgg

SEQ ID NO: 138752 - DNA, 25 bp, Homo sapien
ggtcatgctgtcaaaatcatggaca

SEQ ID NO: 138753 - DNA, 25 bp, Homo sapien
tcatgctgtcaaaatcatggacaaa

SEQ ID NO: 138754 - DNA, 25 bp, Homo sapien
aatcatggacaaaggctgggtgcag

SEQ ID NO: 138755 - DNA, 25 bp, Homo sapien
aaatattagccagccatcgtggtgc

SEQ ID NO: 138756 - DNA, 25 bp, Homo sapien
atattagccagccatcgtggtgcgt

SEQ ID NO: 138757 - DNA, 25 bp, Homo sapien
tattagccagccatcgtggtgcgtg

SEQ ID NO: 138758 - DNA, 25 bp, Homo sapien
gcgggagtatcatttgagccaggag

SEQ ID NO: 138759 - DNA, 25 bp, Homo sapien
gtgttacagaaataccagctccatc

SEQ ID NO: 138760 - DNA, 25 bp, Homo sapien
cagctccatctgctccaatgagggc

SEQ ID NO: 138761 - DNA, 25 bp, Homo sapien
ggcaaagaggcctgcgccttggaca

SEQ ID NO: 138762 - DNA, 25 bp, Homo sapien
cgccttggacacagttggatgggtt

SEQ ID NO: 138763 - DNA, 25 bp, Homo sapien
acacagttggatgggttcagaggca

SEQ ID NO: 138764 - DNA, 25 bp, Homo sapien
aaatgctgaggcactgcccgtcaaa

SEQ ID NO: 138765 - DNA, 25 bp, Homo sapien
gaggcactgcccgtcaaaaagaaaa

SEQ ID NO: 138766 - DNA, 25 bp, Homo sapien
tggaaaccacatggcttcacctgtc

SEQ ID NO: 138767 - DNA, 25 bp, Homo sapien
gcttttgctaggtcacagaggatct

SEQ ID NO: 138768 - DNA, 25 bp, Homo sapien
cagaggatctgcttggtcttgataa

SEQ ID NO: 138769 - DNA, 25 bp, Homo sapien
gataagctatgttgttgcactttaa

SEQ ID NO: 138770 - DNA, 25 bp, Homo sapien
tgttcagtatctcaagcccagaaag

SEQ ID NO: 138771 - DNA, 25 bp, Homo sapien
gttcagtatctcaagcccagaaaga

SEQ ID NO: 138772 - DNA, 25 bp, Homo sapien
gtatctcaagcccagaaagatgaat

SEQ ID NO: 138773 - DNA, 25 bp, Homo sapien
ttgattcagcaagccacaacagtta

SEQ ID NO: 138774 - DNA, 25 bp, Homo sapien
gattcagcaagccacaacagttaaa

SEQ ID NO: 138775 - DNA, 25 bp, Homo sapien
ttcagcaagccacaacagttaaaaa

SEQ ID NO: 138776 - DNA, 25 bp, Homo sapien
gcaagccacaacagttaaaaacaag

SEQ ID NO: 138777 - DNA, 25 bp, Homo sapien
agaagatgccagatgacacttaaga

SEQ ID NO: 138778 - DNA, 25 bp, Homo sapien
gatgccagatgacacttaagaccta

SEQ ID NO: 138779 - DNA, 25 bp, Homo sapien
gccagatgacacttaagacctactt

SEQ ID NO: 138780 - DNA, 25 bp, Homo sapien
ccagatgacacttaagacctacttg

SEQ ID NO: 138781 - DNA, 25 bp, Homo sapien
ggagcgatttgctggtgtagacatc

SEQ ID NO: 138782 - DNA, 25 bp, Homo sapien
tggtgtagacatccgtgtccgtgta

SEQ ID NO: 138783 - DNA, 25 bp, Homo sapien
gtgtagacatccgtgtccgtgtaaa

SEQ ID NO: 138784 - DNA, 25 bp, Homo sapien
agacatccgtgtccgtgtaaagggt

SEQ ID NO: 138785 - DNA, 25 bp, Homo sapien
catccgtgtccgtgtaaagggtggt

SEQ ID NO: 138786 - DNA, 25 bp, Homo sapien
gctatccgtcagtccatctccaaag

SEQ ID NO: 138787 - DNA, 25 bp, Homo sapien
ggtggcctattaccagaaatatgtg

SEQ ID NO: 138788 - DNA, 25 bp, Homo sapien
ggcctattaccagaaatatgtggat

SEQ ID NO: 138789 - DNA, 25 bp, Homo sapien
tggatgaggcttccaagaaggagat

SEQ ID NO: 138790 - DNA, 25 bp, Homo sapien
aagcccatcgtgactcaaaactcac

SEQ ID NO: 138791 - DNA, 25 bp, Homo sapien
atcgtgactcaaaactcacttgtat

SEQ ID NO: 138792 - DNA, 25 bp, Homo sapien
gatgcaagaaggaggctatgctcag

SEQ ID NO: 138793 - DNA, 25 bp, Homo sapien
atgctggccttgccacactctttct

SEQ ID NO: 138794 - DNA, 25 bp, Homo sapien
gcaggccaggtccagagagaccgag

SEQ ID NO: 138795 - DNA, 25 bp, Homo sapien
ggagagtctcccagggagcatgaga

SEQ ID NO: 138796 - DNA, 25 bp, Homo sapien
gaggaggcagcaggactgtcccctt

SEQ ID NO: 138797 - DNA, 25 bp, Homo sapien
gcagcaggactgtccccttgaagga

SEQ ID NO: 138798 - DNA, 25 bp, Homo sapien
caggactgtccccttgaaggagaat

SEQ ID NO: 138799 - DNA, 25 bp, Homo sapien
gaaggagaatcatcaggaccctgga

SEQ ID NO: 138800 - DNA, 25 bp, Homo sapien
aggaccctggacctgatacggctcc

SEQ ID NO: 138801 - DNA, 25 bp, Homo sapien
ctggacctgatacggctccccagta

SEQ ID NO: 138802 - DNA, 25 bp, Homo sapien
acctcttccttgtaaatatgattta

SEQ ID NO: 138803 - DNA, 25 bp, Homo sapien
tctcttccttcagaagtttcgtcta

SEQ ID NO: 138804 - DNA, 25 bp, Homo sapien
tccttcagaagtttcgtctaatggg

SEQ ID NO: 138805 - DNA, 25 bp, Homo sapien
ctcagaaatctgtttgattggatat

SEQ ID NO: 138806 - DNA, 25 bp, Homo sapien
tgattggatattctcctcggactgt

SEQ ID NO: 138807 - DNA, 25 bp, Homo sapien
ggatattctcctcggactgtgtgca

SEQ ID NO: 138808 - DNA, 25 bp, Homo sapien
attctcctcggactgtgtgcaggtt

SEQ ID NO: 138809 - DNA, 25 bp, Homo sapien
cctcggactgtgtgcaggttgcaga

SEQ ID NO: 138810 - DNA, 25 bp, Homo sapien
gaagagtagatgagccgggtccggc

SEQ ID NO: 138811 - DNA, 25 bp, Homo sapien
agacggatgcccattcctgcctggt

SEQ ID NO: 138812 - DNA, 25 bp, Homo sapien
gatgcccattcctgcctggtccagt

SEQ ID NO: 138813 - DNA, 25 bp, Homo sapien
agcaggcgggctcctttgtacagtt

SEQ ID NO: 138814 - DNA, 25 bp, Homo sapien
aatcatgacccgagaggtgcagaca

SEQ ID NO: 138815 - DNA, 25 bp, Homo sapien
atgacccgagaggtgcagacaaatg

SEQ ID NO: 138816 - DNA, 25 bp, Homo sapien
cccgagaggtgcagacaaatgactt

SEQ ID NO: 138817 - DNA, 25 bp, Homo sapien
cgagaggtgcagacaaatgacttga

SEQ ID NO: 138818 - DNA, 25 bp, Homo sapien
ggtgcagacaaatgacttgaaagaa

SEQ ID NO: 138819 - DNA, 25 bp, Homo sapien
aataaattgattccagacagcattg

SEQ ID NO: 138820 - DNA, 25 bp, Homo sapien
ctccatgatgtcttcgttagaaaag

SEQ ID NO: 138821 - DNA, 25 bp, Homo sapien
ctcatggagcttcatggtgaaggca

SEQ ID NO: 138822 - DNA, 25 bp, Homo sapien
cttcatggtgaaggcagtagttctg

SEQ ID NO: 138823 - DNA, 25 bp, Homo sapien
gaaggcagtagttctggaaaagcca

SEQ ID NO: 138824 - DNA, 25 bp, Homo sapien
aaccaccagtccaagaatctgttta

SEQ ID NO: 138825 - DNA, 25 bp, Homo sapien
gttaatatggtaattatggtctggg

SEQ ID NO: 138826 - DNA, 25 bp, Homo sapien
agcttttgttttgcttacaaagtat

SEQ ID NO: 138827 - DNA, 25 bp, Homo sapien
atatttaaggattattctgctgaag

SEQ ID NO: 138828 - DNA, 25 bp, Homo sapien
ggattattctgctgaagattcagtt

SEQ ID NO: 138829 - DNA, 25 bp, Homo sapien
tcagtttaagagttttccttgggag

SEQ ID NO: 138830 - DNA, 25 bp, Homo sapien
gaaacacaatgccaacagctggcca

SEQ ID NO: 138831 - DNA, 25 bp, Homo sapien
acagctggccagtaattagtgttgt

SEQ ID NO: 138832 - DNA, 25 bp, Homo sapien
ctggccagtaattagtgttgtgcac

SEQ ID NO: 138833 - DNA, 25 bp, Homo sapien
tagtgttgtgcacttcatgtcatta

SEQ ID NO: 138834 - DNA, 25 bp, Homo sapien
tcatgtcattaatcaatttctcaat

SEQ ID NO: 138835 - DNA, 25 bp, Homo sapien
aatcaatttctcaatagttcttaaa

SEQ ID NO: 138836 - DNA, 25 bp, Homo sapien
gaaaattgaaatcagccagcacgcc

SEQ ID NO: 138837 - DNA, 25 bp, Homo sapien
ttgaaatcagccagcacgccaagta

SEQ ID NO: 138838 - DNA, 25 bp, Homo sapien
aatcagccagcacgccaagtacact

SEQ ID NO: 138839 - DNA, 25 bp, Homo sapien
agccagcacgccaagtacacttgct

SEQ ID NO: 138840 - DNA, 25 bp, Homo sapien
accaagatgaagagacgagctgtgg

SEQ ID NO: 138841 - DNA, 25 bp, Homo sapien
gatctggcactgtggttcctgcatg

SEQ ID NO: 138842 - DNA, 25 bp, Homo sapien
tggcactgtggttcctgcatgaaga

SEQ ID NO: 138843 - DNA, 25 bp, Homo sapien
gcactgtggttcctgcatgaagaca

SEQ ID NO: 138844 - DNA, 25 bp, Homo sapien
acttccgctgtcacggtaaagtccg

SEQ ID NO: 138845 - DNA, 25 bp, Homo sapien
gtcacggtaaagtccgccatcagaa

SEQ ID NO: 138846 - DNA, 25 bp, Homo sapien
gtcggtaaatacgggacccgctatg

SEQ ID NO: 138847 - DNA, 25 bp, Homo sapien
caggagagtacttacatagtgctca

SEQ ID NO: 138848 - DNA, 25 bp, Homo sapien
caggagtttctcttcttaaaatgtt

SEQ ID NO: 138849 - DNA, 25 bp, Homo sapien
tagccagaaacctgctggcctctgc

SEQ ID NO: 138850 - DNA, 25 bp, Homo sapien
ctgttttcatttcccactttggttg

SEQ ID NO: 138851 - DNA, 25 bp, Homo sapien
tttcccactttggttgtgtggcatt

SEQ ID NO: 138852 - DNA, 25 bp, Homo sapien
gcactttcctgcttgtcatgacttt

SEQ ID NO: 138853 - DNA, 25 bp, Homo sapien
tttcctgcttgtcatgactttttga

SEQ ID NO: 138854 - DNA, 25 bp, Homo sapien
tgactttttgacacacttgccatga

SEQ ID NO: 138855 - DNA, 25 bp, Homo sapien
ctttttgacacacttgccatgacgt

SEQ ID NO: 138856 - DNA, 25 bp, Homo sapien
tgaagttctgcggtagtgcctccag

SEQ ID NO: 138857 - DNA, 25 bp, Homo sapien
agaagaagtgttactgcattttgta

SEQ ID NO: 138858 - DNA, 25 bp, Homo sapien
acacattggccgcttcagacacgca

SEQ ID NO: 138859 - DNA, 25 bp, Homo sapien
acattggccgcttcagacacgcact

SEQ ID NO: 138860 - DNA, 25 bp, Homo sapien
attggccgcttcagacacgcacttc

SEQ ID NO: 138861 - DNA, 25 bp, Homo sapien
ggccgcttcagacacgcacttctgg

SEQ ID NO: 138862 - DNA, 25 bp, Homo sapien
ctctctcaccagccttgaactgtgg

SEQ ID NO: 138863 - DNA, 25 bp, Homo sapien
gccttgaactgtggccacctagaaa

SEQ ID NO: 138864 - DNA, 25 bp, Homo sapien
ttgaactgtggccacctagaaaggg

SEQ ID NO: 138865 - DNA, 25 bp, Homo sapien
attcagcctcgtctctttacagaag

SEQ ID NO: 138866 - DNA, 25 bp, Homo sapien
tcagcctcgtctctttacagaagta

SEQ ID NO: 138867 - DNA, 25 bp, Homo sapien
cagcctcgtctctttacagaagtag

SEQ ID NO: 138868 - DNA, 25 bp, Homo sapien
agcctcgtctctttacagaagtagt

SEQ ID NO: 138869 - DNA, 25 bp, Homo sapien
aaagacttgtgctatttggaagcaa

SEQ ID NO: 138870 - DNA, 25 bp, Homo sapien
tttttactattccatcatgaggaac

SEQ ID NO: 138871 - DNA, 25 bp, Homo sapien
gaggaacaacatagattccatgatc

SEQ ID NO: 138872 - DNA, 25 bp, Homo sapien
gatctttttaatgacagtacagact

SEQ ID NO: 138873 - DNA, 25 bp, Homo sapien
gaaggaaacatgcacaaatctgtaa

SEQ ID NO: 138874 - DNA, 25 bp, Homo sapien
tctgtaaaacatagaccttcgcttt

SEQ ID NO: 138875 - DNA, 25 bp, Homo sapien
tagaccttcgctttatttttgtaag

SEQ ID NO: 138876 - DNA, 25 bp, Homo sapien
tttttgtaagtatcacctgccacca

SEQ ID NO: 138877 - DNA, 25 bp, Homo sapien
cacctgccaccatgttttgtaattt

SEQ ID NO: 138878 - DNA, 25 bp, Homo sapien
tgtaatttgaggtcttgatttcacc

SEQ ID NO: 138879 - DNA, 25 bp, Homo sapien
gtcttgatttcaccattgtcggtga

SEQ ID NO: 138880 - DNA, 25 bp, Homo sapien
gaaaacgatgtcattgttcagcagc

SEQ ID NO: 138881 - DNA, 25 bp, Homo sapien
acgatgtcattgttcagcagctgag

SEQ ID NO: 138882 - DNA, 25 bp, Homo sapien
attccactgcctgttgcagagtttt

SEQ ID NO: 138883 - DNA, 25 bp, Homo sapien
actgcctgttgcagagtttttctgt

SEQ ID NO: 138884 - DNA, 25 bp, Homo sapien
gtagacgttagattgcgggcaccgc

SEQ ID NO: 138885 - DNA, 25 bp, Homo sapien
tagattgcgggcaccgccagggatt

SEQ ID NO: 138886 - DNA, 25 bp, Homo sapien
gccagggattttgcagcgcttcagt

SEQ ID NO: 138887 - DNA, 25 bp, Homo sapien
gattttgcagcgcttcagtgtacgt

SEQ ID NO: 138888 - DNA, 25 bp, Homo sapien
gcagcgcttcagtgtacgtgttaga

SEQ ID NO: 138889 - DNA, 25 bp, Homo sapien
ttggaaaagcgtctgtgagccccgt

SEQ ID NO: 138890 - DNA, 25 bp, Homo sapien
aaaagcgtctgtgagccccgtgctg

SEQ ID NO: 138891 - DNA, 25 bp, Homo sapien
tcacatggtgttgcacaagtacgtt

SEQ ID NO: 138892 - DNA, 25 bp, Homo sapien
gttgcacaagtacgttttgtgacag

SEQ ID NO: 138893 - DNA, 25 bp, Homo sapien
tcttcctgaagatctctaccattta

SEQ ID NO: 138894 - DNA, 25 bp, Homo sapien
ctgaagatctctaccatttaattaa

SEQ ID NO: 138895 - DNA, 25 bp, Homo sapien
gaaagcagttgctgttcgaaagcat

SEQ ID NO: 138896 - DNA, 25 bp, Homo sapien
ctgttcgaaagcatcttgagaggaa

SEQ ID NO: 138897 - DNA, 25 bp, Homo sapien
aaggatgctaaattccgtctgattc

SEQ ID NO: 138898 - DNA, 25 bp, Homo sapien
gctaaattccgtctgattctaatag

SEQ ID NO: 138899 - DNA, 25 bp, Homo sapien
gattctaatagagagccggattcac

SEQ ID NO: 138900 - DNA, 25 bp, Homo sapien
tagagagccggattcaccgtttggc

SEQ ID NO: 138901 - DNA, 25 bp, Homo sapien
gccggattcaccgtttggctcgata

SEQ ID NO: 138902 - DNA, 25 bp, Homo sapien
aagaagaagtcttacaccactccca

SEQ ID NO: 138903 - DNA, 25 bp, Homo sapien
agaagaagtcttacaccactcccaa

SEQ ID NO: 138904 - DNA, 25 bp, Homo sapien
acaagagaaagaaggttaagctggc

SEQ ID NO: 138905 - DNA, 25 bp, Homo sapien
atggcaaaattagtcgccttcgtcg

SEQ ID NO: 138906 - DNA, 25 bp, Homo sapien
ggcaaaattagtcgccttcgtcgag

SEQ ID NO: 138907 - DNA, 25 bp, Homo sapien
aaaattagtcgccttcgtcgagagt

SEQ ID NO: 138908 - DNA, 25 bp, Homo sapien
aaattagtcgccttcgtcgagagtg

SEQ ID NO: 138909 - DNA, 25 bp, Homo sapien
aattagtcgccttcgtcgagagtgc

SEQ ID NO: 138910 - DNA, 25 bp, Homo sapien
attagtcgccttcgtcgagagtgcc

SEQ ID NO: 138911 - DNA, 25 bp, Homo sapien
tgacttactgtttcaacaaaccaga

SEQ ID NO: 138912 - DNA, 25 bp, Homo sapien
ttactgtttcaacaaaccagaagac

SEQ ID NO: 138913 - DNA, 25 bp, Homo sapien
atgatctccctttattaccctccca

SEQ ID NO: 138914 - DNA, 25 bp, Homo sapien
tcccaaaggttaccagcgtttgaat

SEQ ID NO: 138915 - DNA, 25 bp, Homo sapien
gttaccagcgtttgaatttaataat

SEQ ID NO: 138916 - DNA, 25 bp, Homo sapien
ccagcgtttgaatttaataatgtat

SEQ ID NO: 138917 - DNA, 25 bp, Homo sapien
catgcttttttctgtgcacttacct

SEQ ID NO: 138918 - DNA, 25 bp, Homo sapien
gcttttttctgtgcacttacctaag

SEQ ID NO: 138919 - DNA, 25 bp, Homo sapien
ttttttctgtgcacttacctaagtg

SEQ ID NO: 138920 - DNA, 25 bp, Homo sapien
tttctgtgcacttacctaagtgtga

SEQ ID NO: 138921 - DNA, 25 bp, Homo sapien
ctgtgcacttacctaagtgtgaata

SEQ ID NO: 138922 - DNA, 25 bp, Homo sapien
ctaagtgtgaatatgtaaagggttt

SEQ ID NO: 138923 - DNA, 25 bp, Homo sapien
taggttaaatttgtgaatgatcatt

SEQ ID NO: 138924 - DNA, 25 bp, Homo sapien
ccccgatttatagacaactctgaca

SEQ ID NO: 138925 - DNA, 25 bp, Homo sapien
tctgacattgtcaccccactgacga

SEQ ID NO: 138926 - DNA, 25 bp, Homo sapien
tgacgaggcccgattccatagggtg

SEQ ID NO: 138927 - DNA, 25 bp, Homo sapien
aggcccgattccatagggtggatcc

SEQ ID NO: 138928 - DNA, 25 bp, Homo sapien
gattccatagggtggatccttgcca

SEQ ID NO: 138929 - DNA, 25 bp, Homo sapien
tagggtggatccttgccaggcgtcc

SEQ ID NO: 138930 - DNA, 25 bp, Homo sapien
tggatccttgccaggcgtccctgat

SEQ ID NO: 138931 - DNA, 25 bp, Homo sapien
caagtcttccttcgtgagctggcct

SEQ ID NO: 138932 - DNA, 25 bp, Homo sapien
acagctggctcctttcgggggtgca

SEQ ID NO: 138933 - DNA, 25 bp, Homo sapien
agcttcaactctctcggcggtaggg

SEQ ID NO: 138934 - DNA, 25 bp, Homo sapien
atagggctggctcacatccagtcac

SEQ ID NO: 138935 - DNA, 25 bp, Homo sapien
agactgcactaaatgttttcctctg

SEQ ID NO: 138936 - DNA, 25 bp, Homo sapien
gttttcctctgttttacaaactgct

SEQ ID NO: 138937 - DNA, 25 bp, Homo sapien
ttggcagccccaggtgaagcatcaa

SEQ ID NO: 138938 - DNA, 25 bp, Homo sapien
gtgttcacgggatgcaccaaagtgt

SEQ ID NO: 138939 - DNA, 25 bp, Homo sapien
gatgcaccaaagtgtgtaccccgta

SEQ ID NO: 138940 - DNA, 25 bp, Homo sapien
gtgtgtaccccgtaagcatgaaacc

SEQ ID NO: 138941 - DNA, 25 bp, Homo sapien
tttagttcttattccggagcctcaa

SEQ ID NO: 138942 - DNA, 25 bp, Homo sapien
ggagcctcaaacaagcattatacct

SEQ ID NO: 138943 - DNA, 25 bp, Homo sapien
taccttctgtgattatgatttcctc

SEQ ID NO: 138944 - DNA, 25 bp, Homo sapien
gatttcctctcctataattatttct

SEQ ID NO: 138945 - DNA, 25 bp, Homo sapien
attatttctgtagcactccacactg

SEQ ID NO: 138946 - DNA, 25 bp, Homo sapien
tgcctacacatgacagacaagtaac

SEQ ID NO: 138947 - DNA, 25 bp, Homo sapien
ctccaggccaagagtctcagctggc

SEQ ID NO: 138948 - DNA, 25 bp, Homo sapien
agagtctcagctggccgagagtcca

SEQ ID NO: 138949 - DNA, 25 bp, Homo sapien
acagctgctgggagcccttgtgtgt

SEQ ID NO: 138950 - DNA, 25 bp, Homo sapien
gggagcccttgtgtgtctggtcaca

SEQ ID NO: 138951 - DNA, 25 bp, Homo sapien
gtctggtcacactttttaggcgtca

SEQ ID NO: 138952 - DNA, 25 bp, Homo sapien
gtcacactttttaggcgtcacgcca

SEQ ID NO: 138953 - DNA, 25 bp, Homo sapien
taggcgtcacgccaaaggccagcct

SEQ ID NO: 138954 - DNA, 25 bp, Homo sapien
ctggccccaatacccattttggaag

SEQ ID NO: 138955 - DNA, 25 bp, Homo sapien
tggaagcccctgtggccgtgtggat

SEQ ID NO: 138956 - DNA, 25 bp, Homo sapien
ggccgtgtggatgtcggtaacagtt

SEQ ID NO: 138957 - DNA, 25 bp, Homo sapien
aggtgaattaatggacagtctggtg

SEQ ID NO: 138958 - DNA, 25 bp, Homo sapien
gaattaatggacagtctggtgaact

SEQ ID NO: 138959 - DNA, 25 bp, Homo sapien
attaatggacagtctggtgaacttc

SEQ ID NO: 138960 - DNA, 25 bp, Homo sapien
taatggacagtctggtgaacttcaa

SEQ ID NO: 138961 - DNA, 25 bp, Homo sapien
aatggacagtctggtgaacttcaaa

SEQ ID NO: 138962 - DNA, 25 bp, Homo sapien
atggacagtctggtgaacttcaaaa

SEQ ID NO: 138963 - DNA, 25 bp, Homo sapien
tggacagtctggtgaacttcaaaag

SEQ ID NO: 138964 - DNA, 25 bp, Homo sapien
ggacagtctggtgaacttcaaaagc

SEQ ID NO: 138965 - DNA, 25 bp, Homo sapien
gacagtctggtgaacttcaaaagct

SEQ ID NO: 138966 - DNA, 25 bp, Homo sapien
cagtctggtgaacttcaaaagcttt

SEQ ID NO: 138967 - DNA, 25 bp, Homo sapien
agtctggtgaacttcaaaagctttt

SEQ ID NO: 138968 - DNA, 25 bp, Homo sapien
aaaagtctgagggtcctctaggctc

SEQ ID NO: 138969 - DNA, 25 bp, Homo sapien
ctcccaggaatctgaatcttgtggt

SEQ ID NO: 138970 - DNA, 25 bp, Homo sapien
atctgaatcttgtggtctgaggaaa

SEQ ID NO: 138971 - DNA, 25 bp, Homo sapien
gaaggaaccacatgcagacaaagat

SEQ ID NO: 138972 - DNA, 25 bp, Homo sapien
aaaacaagtggcttactgcccttct

SEQ ID NO: 138973 - DNA, 25 bp, Homo sapien
aagtggcttactgcccttctggcaa

SEQ ID NO: 138974 - DNA, 25 bp, Homo sapien
gaaggcctgaactatgcctgtctca

SEQ ID NO: 138975 - DNA, 25 bp, Homo sapien
gcctgtctcactcacagtggatatg

SEQ ID NO: 138976 - DNA, 25 bp, Homo sapien
gatgggtctgattaatagcgttgtt

SEQ ID NO: 138977 - DNA, 25 bp, Homo sapien
gttgagataaacactctcattcagt

SEQ ID NO: 138978 - DNA, 25 bp, Homo sapien
aactctgctagaatgataaatgtca

SEQ ID NO: 138979 - DNA, 25 bp, Homo sapien
gtttcgtgtatatgtctcatgcaca

SEQ ID NO: 138980 - DNA, 25 bp, Homo sapien
ttttctcttagggtcgctgcataaa

SEQ ID NO: 138981 - DNA, 25 bp, Homo sapien
ataaactgttgtatgcctggtgctt

SEQ ID NO: 138982 - DNA, 25 bp, Homo sapien
atgcctggtgctttgcgacttgtca

SEQ ID NO: 138983 - DNA, 25 bp, Homo sapien
tgcgacttgtcacacgaggtcacgt

SEQ ID NO: 138984 - DNA, 25 bp, Homo sapien
gaattttccacttctggcatcacgt

SEQ ID NO: 138985 - DNA, 25 bp, Homo sapien
tggcatcacgtcagtgctcagaaat

SEQ ID NO: 138986 - DNA, 25 bp, Homo sapien
gatctcagagcatttcaattaggga

SEQ ID NO: 138987 - DNA, 25 bp, Homo sapien
gggatgctcaaacgcaactgtttct

SEQ ID NO: 138988 - DNA, 25 bp, Homo sapien
aactgtttctacttccccatttcag

SEQ ID NO: 138989 - DNA, 25 bp, Homo sapien
tgagatgtaacccaccttgaccata

SEQ ID NO: 138990 - DNA, 25 bp, Homo sapien
gatggacctgagtgtcggtcacagc

SEQ ID NO: 138991 - DNA, 25 bp, Homo sapien
atggacctgagtgtcggtcacagcc

SEQ ID NO: 138992 - DNA, 25 bp, Homo sapien
ggacctgagtgtcggtcacagcccc

SEQ ID NO: 138993 - DNA, 25 bp, Homo sapien
tgagtgtcggtcacagccccctaca

SEQ ID NO: 138994 - DNA, 25 bp, Homo sapien
tacactcaaggctgagaggcctcag

SEQ ID NO: 138995 - DNA, 25 bp, Homo sapien
gtaaccatcaccctaataatatacg

SEQ ID NO: 138996 - DNA, 25 bp, Homo sapien
accatcaccctaataatatacgttg

SEQ ID NO: 138997 - DNA, 25 bp, Homo sapien
atcaccctaataatatacgttgtac

SEQ ID NO: 138998 - DNA, 25 bp, Homo sapien
ccctaataatatacgttgtacccat

SEQ ID NO: 138999 - DNA, 25 bp, Homo sapien
ctaataatatacgttgtacccatta

SEQ ID NO: 139000 - DNA, 25 bp, Homo sapien
caccttgtcacccttctgagtctcc

SEQ ID NO: 139001 - DNA, 25 bp, Homo sapien
gattcaccgcaagactgtgggcgtg

SEQ ID NO: 139002 - DNA, 25 bp, Homo sapien
agactgtgggcgtggagccggcagc

SEQ ID NO: 139003 - DNA, 25 bp, Homo sapien
gtggagccggcagccgacggcaaag

SEQ ID NO: 139004 - DNA, 25 bp, Homo sapien
gcaaaggtgtcgtggtggtcattaa

SEQ ID NO: 139005 - DNA, 25 bp, Homo sapien
aaaggtgtcgtggtggtcattaagc

SEQ ID NO: 139006 - DNA, 25 bp, Homo sapien
cgtggtggtcattaagcggagatcc

SEQ ID NO: 139007 - DNA, 25 bp, Homo sapien
attaagcggagatccggccagcgga

SEQ ID NO: 139008 - DNA, 25 bp, Homo sapien
ggagatccggccagcggaagcctgc

SEQ ID NO: 139009 - DNA, 25 bp, Homo sapien
aagcctgccacctcctatgtgcgga

SEQ ID NO: 139010 - DNA, 25 bp, Homo sapien
ctcctatgtgcggaccaccatcaac

SEQ ID NO: 139011 - DNA, 25 bp, Homo sapien
aacaagaatgctcgcgccacgctca

SEQ ID NO: 139012 - DNA, 25 bp, Homo sapien
agacatagctatgcaagttttttat

SEQ ID NO: 139013 - DNA, 25 bp, Homo sapien
gtttgtgttccagaaggacagttcc

SEQ ID NO: 139014 - DNA, 25 bp, Homo sapien
ggacagttccattcattagttgtga

SEQ ID NO: 139015 - DNA, 25 bp, Homo sapien
cattagttgtgatcttccgtcttac

SEQ ID NO: 139016 - DNA, 25 bp, Homo sapien
gtgatcttccgtcttactttatgaa

SEQ ID NO: 139017 - DNA, 25 bp, Homo sapien
gaaactgcacttgaaggttattcat

SEQ ID NO: 139018 - DNA, 25 bp, Homo sapien
tagtaacagctgtcagtcaactgct

SEQ ID NO: 139019 - DNA, 25 bp, Homo sapien
aaaatctcaaccttatgccaaaatg

SEQ ID NO: 139020 - DNA, 25 bp, Homo sapien
gagtaatgctttatggtcccttgta

SEQ ID NO: 139021 - DNA, 25 bp, Homo sapien
cccttgtaagtagtggagctgctct

SEQ ID NO: 139022 - DNA, 25 bp, Homo sapien
agctgctctgtttaggtgaatctcc

SEQ ID NO: 139023 - DNA, 25 bp, Homo sapien
gaatgccaaaatcagcagtctcctg

SEQ ID NO: 139024 - DNA, 25 bp, Homo sapien
caaaatcagcagtctcctggaggag

SEQ ID NO: 139025 - DNA, 25 bp, Homo sapien
agcagtctcctggaggagcagttcc

SEQ ID NO: 139026 - DNA, 25 bp, Homo sapien
gtctcctggaggagcagttccagca

SEQ ID NO: 139027 - DNA, 25 bp, Homo sapien
ggagcagttccagcagggcaagctt

SEQ ID NO: 139028 - DNA, 25 bp, Homo sapien
agcagggcaagcttcttgcgtgcat

SEQ ID NO: 139029 - DNA, 25 bp, Homo sapien
agggcaagcttcttgcgtgcatcgc

SEQ ID NO: 139030 - DNA, 25 bp, Homo sapien
aagcttcttgcgtgcatcgcttcaa

SEQ ID NO: 139031 - DNA, 25 bp, Homo sapien
cttcttgcgtgcatcgcttcaaggc

SEQ ID NO: 139032 - DNA, 25 bp, Homo sapien
gagggcaaagagttggagttctatc

SEQ ID NO: 139033 - DNA, 25 bp, Homo sapien
gcaaagagttggagttctatcttag

SEQ ID NO: 139034 - DNA, 25 bp, Homo sapien
cagccacttcagccgaggctccaag

SEQ ID NO: 139035 - DNA, 25 bp, Homo sapien
agccacttcagccgaggctccaaga

SEQ ID NO: 139036 - DNA, 25 bp, Homo sapien
gccacttcagccgaggctccaagag

SEQ ID NO: 139037 - DNA, 25 bp, Homo sapien
ccacttcagccgaggctccaagagt

SEQ ID NO: 139038 - DNA, 25 bp, Homo sapien
cacttcagccgaggctccaagagtg

SEQ ID NO: 139039 - DNA, 25 bp, Homo sapien
acttcagccgaggctccaagagtgt

SEQ ID NO: 139040 - DNA, 25 bp, Homo sapien
cttcagccgaggctccaagagtgtg

SEQ ID NO: 139041 - DNA, 25 bp, Homo sapien
ttcagccgaggctccaagagtgtgg

SEQ ID NO: 139042 - DNA, 25 bp, Homo sapien
tcagccgaggctccaagagtgtggc

SEQ ID NO: 139043 - DNA, 25 bp, Homo sapien
cagccgaggctccaagagtgtggcc

SEQ ID NO: 139044 - DNA, 25 bp, Homo sapien
tcttccaccagcattctcatgagga

SEQ ID NO: 139045 - DNA, 25 bp, Homo sapien
cagcattctcatgaggaacagcggg

SEQ ID NO: 139046 - DNA, 25 bp, Homo sapien
gggcctccgctgataaccagctggt

SEQ ID NO: 139047 - DNA, 25 bp, Homo sapien
taaccagctggtctgggtgtagctc

SEQ ID NO: 139048 - DNA, 25 bp, Homo sapien
accagctggtctgggtgtagctctt

SEQ ID NO: 139049 - DNA, 25 bp, Homo sapien
gtgtagctcttagaggaaggagata

SEQ ID NO: 139050 - DNA, 25 bp, Homo sapien
aaaaggggctccttgctccacaggg

SEQ ID NO: 139051 - DNA, 25 bp, Homo sapien
cacagggccctgttgaattttgttc

SEQ ID NO: 139052 - DNA, 25 bp, Homo sapien
ggccctgttgaattttgttctctgg

SEQ ID NO: 139053 - DNA, 25 bp, Homo sapien
taaaggtatgaaagggctggtgaca

SEQ ID NO: 139054 - DNA, 25 bp, Homo sapien
ctggtgacagtcagggatgcccccg

SEQ ID NO: 139055 - DNA, 25 bp, Homo sapien
aagttgaaccattatactttatatc

SEQ ID NO: 139056 - DNA, 25 bp, Homo sapien
gatactgattatgaaatgtcccctg

SEQ ID NO: 139057 - DNA, 25 bp, Homo sapien
aaatgtcccctgaaactcattgcag

SEQ ID NO: 139058 - DNA, 25 bp, Homo sapien
gtcccctgaaactcattgcagcaga

SEQ ID NO: 139059 - DNA, 25 bp, Homo sapien
gaaactcattgcagcagataacttt

SEQ ID NO: 139060 - DNA, 25 bp, Homo sapien
gagtcattgacttcattttatattt

SEQ ID NO: 139061 - DNA, 25 bp, Homo sapien
aaattatggaatatcatctgtcatt

SEQ ID NO: 139062 - DNA, 25 bp, Homo sapien
aactgggataactgatttctatggc

SEQ ID NO: 139063 - DNA, 25 bp, Homo sapien
ggataactgatttctatggctttca

SEQ ID NO: 139064 - DNA, 25 bp, Homo sapien
accaactctaatattgcttcttgtg

SEQ ID NO: 139065 - DNA, 25 bp, Homo sapien
tcttgtgttttactgtcagattaaa

SEQ ID NO: 139066 - DNA, 25 bp, Homo sapien
aaaaccatacggatgcgctgctgtc

SEQ ID NO: 139067 - DNA, 25 bp, Homo sapien
atacggatgcgctgctgtctgagag

SEQ ID NO: 139068 - DNA, 25 bp, Homo sapien
aagggctgacacttgctggcatggc

SEQ ID NO: 139069 - DNA, 25 bp, Homo sapien
gggcttcgtcatcgcatgcactgat

SEQ ID NO: 139070 - DNA, 25 bp, Homo sapien
aggctgcccattgcaggcactgggc

SEQ ID NO: 139071 - DNA, 25 bp, Homo sapien
aggcactgggcaggcctgaccttgc

SEQ ID NO: 139072 - DNA, 25 bp, Homo sapien
ccctgtagcgcttttgttacttgaa

SEQ ID NO: 139073 - DNA, 25 bp, Homo sapien
tacttgaatgtctagctgagcctgt

SEQ ID NO: 139074 - DNA, 25 bp, Homo sapien
gagcctgtttttgatggagctacta

SEQ ID NO: 139075 - DNA, 25 bp, Homo sapien
ggagctactactgtaatgcgtgaac

SEQ ID NO: 139076 - DNA, 25 bp, Homo sapien
aatgcgtgaactaacaaacctgtga

SEQ ID NO: 139077 - DNA, 25 bp, Homo sapien
tttgttcccgattgtaatgcaaaat

SEQ ID NO: 139078 - DNA, 25 bp, Homo sapien
tgtaatgcaaaatccttgctcaata

SEQ ID NO: 139079 - DNA, 25 bp, Homo sapien
gaatcactttcctatcatctaaacc

SEQ ID NO: 139080 - DNA, 25 bp, Homo sapien
atctaaaccaagttccttcacactg

SEQ ID NO: 139081 - DNA, 25 bp, Homo sapien
accaagttccttcacactggagtat

SEQ ID NO: 139082 - DNA, 25 bp, Homo sapien
tattttgtcacttctcccctccgtg

SEQ ID NO: 139083 - DNA, 25 bp, Homo sapien
tcccctccgtggagtattttgtcac

SEQ ID NO: 139084 - DNA, 25 bp, Homo sapien
gagtattttgtcacttctcccctcc

SEQ ID NO: 139085 - DNA, 25 bp, Homo sapien
tctcccctccgtataggattttttg

SEQ ID NO: 139086 - DNA, 25 bp, Homo sapien
ttctccttttaacgtgttattgaca

SEQ ID NO: 139087 - DNA, 25 bp, Homo sapien
tgttattgacaaacctccccaaaag

SEQ ID NO: 139088 - DNA, 25 bp, Homo sapien
tgtccaattattccctcctgagtgt

SEQ ID NO: 139089 - DNA, 25 bp, Homo sapien
ttccctcctgagtgttgattatgta

SEQ ID NO: 139090 - DNA, 25 bp, Homo sapien
gtagtggacaaagcacaacttctga

SEQ ID NO: 139091 - DNA, 25 bp, Homo sapien
aaaatcacttcacagtggcccaagc

SEQ ID NO: 139092 - DNA, 25 bp, Homo sapien
gtggcccaagctgaagactttgata

SEQ ID NO: 139093 - DNA, 25 bp, Homo sapien
agatggcagatcttcctcgagagct

SEQ ID NO: 139094 - DNA, 25 bp, Homo sapien
ctcgagagctgttcccatgggaata

SEQ ID NO: 139095 - DNA, 25 bp, Homo sapien
gggaataacgtccaaaacactctgg

SEQ ID NO: 139096 - DNA, 25 bp, Homo sapien
aaacactctggatcttatatggaga

SEQ ID NO: 139097 - DNA, 25 bp, Homo sapien
tgacattgattctcctgtccttgta

SEQ ID NO: 139098 - DNA, 25 bp, Homo sapien
gtccttgtacatgtacctgactggg

SEQ ID NO: 139099 - DNA, 25 bp, Homo sapien
tcaaccttgacttctgcccaaatcc

SEQ ID NO: 139100 - DNA, 25 bp, Homo sapien
tgtgacccgttccatatccctttct

SEQ ID NO: 139101 - DNA, 25 bp, Homo sapien
ctttctctcttgtccaatggggctt

SEQ ID NO: 139102 - DNA, 25 bp, Homo sapien
aagccatcgcgctccttgcggaggt

SEQ ID NO: 139103 - DNA, 25 bp, Homo sapien
atcgcgctccttgcggaggtgaaga

SEQ ID NO: 139104 - DNA, 25 bp, Homo sapien
tccttgcggaggtgaagaggaccct

SEQ ID NO: 139105 - DNA, 25 bp, Homo sapien
tcccctgtgtagagcctgcatctgt

SEQ ID NO: 139106 - DNA, 25 bp, Homo sapien
tgtgtagagcctgcatctgtctgtc

SEQ ID NO: 139107 - DNA, 25 bp, Homo sapien
tgtagagcctgcatctgtctgtcct

SEQ ID NO: 139108 - DNA, 25 bp, Homo sapien
tcccagtgccaaacttgggccgctg

SEQ ID NO: 139109 - DNA, 25 bp, Homo sapien
cagtgccaaacttgggccgctgcac

SEQ ID NO: 139110 - DNA, 25 bp, Homo sapien
tttcagaatcaatacgcactttcag

SEQ ID NO: 139111 - DNA, 25 bp, Homo sapien
gaatcaatacgcactttcagatatt

SEQ ID NO: 139112 - DNA, 25 bp, Homo sapien
aatacgcactttcagatattcttat

SEQ ID NO: 139113 - DNA, 25 bp, Homo sapien
gcactttcagatattcttattttta

SEQ ID NO: 139114 - DNA, 25 bp, Homo sapien
ttattctcttaagtctttattaact

SEQ ID NO: 139115 - DNA, 25 bp, Homo sapien
ttggagagagaaatgatgcatcttt

SEQ ID NO: 139116 - DNA, 25 bp, Homo sapien
gaagtagatcaacatggtggaacaa

SEQ ID NO: 139117 - DNA, 25 bp, Homo sapien
gtagatcaacatggtggaacaaaat

SEQ ID NO: 139118 - DNA, 25 bp, Homo sapien
aatcctaaaattcctataacatagt

SEQ ID NO: 139119 - DNA, 25 bp, Homo sapien
gttttatgaagctttctattgtgac

SEQ ID NO: 139120 - DNA, 25 bp, Homo sapien
agctttctattgtgacttttatgga

SEQ ID NO: 139121 - DNA, 25 bp, Homo sapien
aaagagacagctcttctactacccc

SEQ ID NO: 139122 - DNA, 25 bp, Homo sapien
cacagacctgctctggacacttgct

SEQ ID NO: 139123 - DNA, 25 bp, Homo sapien
agacctgctctggacacttgctcat

SEQ ID NO: 139124 - DNA, 25 bp, Homo sapien
tgctctggacacttgctcatgccct

SEQ ID NO: 139125 - DNA, 25 bp, Homo sapien
ggacacttgctcatgccctgccaag

SEQ ID NO: 139126 - DNA, 25 bp, Homo sapien
cctactcctgggtcaggaggaaaag

SEQ ID NO: 139127 - DNA, 25 bp, Homo sapien
acagtgggtggagccaatccactcc

SEQ ID NO: 139128 - DNA, 25 bp, Homo sapien
gtgggtggagccaatccactccttc

SEQ ID NO: 139129 - DNA, 25 bp, Homo sapien
tccagcactgactggaagggaagtt

SEQ ID NO: 139130 - DNA, 25 bp, Homo sapien
gaagggaagttcaggctctgagaca

SEQ ID NO: 139131 - DNA, 25 bp, Homo sapien
aacatgcctgcacctgcagcgcgca

SEQ ID NO: 139132 - DNA, 25 bp, Homo sapien
gataaacacgaggtgtctgccagca

SEQ ID NO: 139133 - DNA, 25 bp, Homo sapien
ggtgtctgccagcacccagagcacg

SEQ ID NO: 139134 - DNA, 25 bp, Homo sapien
agcgtcgtcaccatcaccagcgagt

SEQ ID NO: 139135 - DNA, 25 bp, Homo sapien
gagaagcggttcagcctttttggca

SEQ ID NO: 139136 - DNA, 25 bp, Homo sapien
agaaatgaactcctttccttcacct

SEQ ID NO: 139137 - DNA, 25 bp, Homo sapien
tgcccttctcttaccttttcagtga

SEQ ID NO: 139138 - DNA, 25 bp, Homo sapien
tcagtgaaattccagcatgcaagct

SEQ ID NO: 139139 - DNA, 25 bp, Homo sapien
gaaattccagcatgcaagctcagaa

SEQ ID NO: 139140 - DNA, 25 bp, Homo sapien
tgcaagctcagaaccaacacattac

SEQ ID NO: 139141 - DNA, 25 bp, Homo sapien
acacattactctctgtgcctaatgt

SEQ ID NO: 139142 - DNA, 25 bp, Homo sapien
tactctctgtgcctaatgttcctca

SEQ ID NO: 139143 - DNA, 25 bp, Homo sapien
aagccaaacctgtagtgagcgattt

SEQ ID NO: 139144 - DNA, 25 bp, Homo sapien
agcaggatgaacgtgaacagtcaga

SEQ ID NO: 139145 - DNA, 25 bp, Homo sapien
gagtgatcagtatggacctttttcc

SEQ ID NO: 139146 - DNA, 25 bp, Homo sapien
tggacctttttccttggtagaactg

SEQ ID NO: 139147 - DNA, 25 bp, Homo sapien
tggtagaactgaattccttcctccc

SEQ ID NO: 139148 - DNA, 25 bp, Homo sapien
gtctcatttctacccagtgagttca

SEQ ID NO: 139149 - DNA, 25 bp, Homo sapien
ctacccagtgagttcatttgtcata

SEQ ID NO: 139150 - DNA, 25 bp, Homo sapien
gttcatttgtcatataggcactggg

SEQ ID NO: 139151 - DNA, 25 bp, Homo sapien
gtcatataggcactgggttgtttct

SEQ ID NO: 139152 - DNA, 25 bp, Homo sapien
ggttgtttctatatcatcatcgtct

SEQ ID NO: 139153 - DNA, 25 bp, Homo sapien
atcatcatcgtctataaactagctt

SEQ ID NO: 139154 - DNA, 25 bp, Homo sapien
gtatgcaactagtcactgctgaggg

SEQ ID NO: 139155 - DNA, 25 bp, Homo sapien
tgttctgttttgcacgtctttatca

SEQ ID NO: 139156 - DNA, 25 bp, Homo sapien
tttgcacgtctttatcattttcctt

SEQ ID NO: 139157 - DNA, 25 bp, Homo sapien
ttttcctttattccgattatagaat

SEQ ID NO: 139158 - DNA, 25 bp, Homo sapien
atgttgagcttctatatttctggga

SEQ ID NO: 139159 - DNA, 25 bp, Homo sapien
atttctgggaactgtactcatataa

SEQ ID NO: 139160 - DNA, 25 bp, Homo sapien
ctcatataagagtgggcagctaatt

SEQ ID NO: 139161 - DNA, 25 bp, Homo sapien
gagtgggcagctaattttactgtaa

SEQ ID NO: 139162 - DNA, 25 bp, Homo sapien
aattttactgtaaagaagggccatg

SEQ ID NO: 139163 - DNA, 25 bp, Homo sapien
gaagggccatggtatagtagataaa

SEQ ID NO: 139164 - DNA, 25 bp, Homo sapien
aaatccaaggcaattttcaaacaat

SEQ ID NO: 139165 - DNA, 25 bp, Homo sapien
ctgactcctctctttgctgaagaga

SEQ ID NO: 139166 - DNA, 25 bp, Homo sapien
aagagacccaagtctcttgacacct

SEQ ID NO: 139167 - DNA, 25 bp, Homo sapien
gtctcttgacacctcagagtgactg

SEQ ID NO: 139168 - DNA, 25 bp, Homo sapien
cagagtgactgtaagctaccagtaa

SEQ ID NO: 139169 - DNA, 25 bp, Homo sapien
acaagtgggaagaggcacgttcatc

SEQ ID NO: 139170 - DNA, 25 bp, Homo sapien
ggcacgttcatcaaacctgttacta

SEQ ID NO: 139171 - DNA, 25 bp, Homo sapien
tcatccccatgtgtaaatgtgtcca

SEQ ID NO: 139172 - DNA, 25 bp, Homo sapien
aaatgtgtccacacaaccacatctg

SEQ ID NO: 139173 - DNA, 25 bp, Homo sapien
cacatctgccttttccacaagcttt

SEQ ID NO: 139174 - DNA, 25 bp, Homo sapien
gaaaccttgggaggaggacattact

SEQ ID NO: 139175 - DNA, 25 bp, Homo sapien
tactggttgttctggctggtttgaa

SEQ ID NO: 139176 - DNA, 25 bp, Homo sapien
tttgcagcttttgcagacgggcaag

SEQ ID NO: 139177 - DNA, 25 bp, Homo sapien
ttgcagcttttgcagacgggcaaga

SEQ ID NO: 139178 - DNA, 25 bp, Homo sapien
tgcagcttttgcagacgggcaagaa

SEQ ID NO: 139179 - DNA, 25 bp, Homo sapien
gcagcttttgcagacgggcaagaag

SEQ ID NO: 139180 - DNA, 25 bp, Homo sapien
cagcttttgcagacgggcaagaagc

SEQ ID NO: 139181 - DNA, 25 bp, Homo sapien
gcttttgcagacgggcaagaagctg

SEQ ID NO: 139182 - DNA, 25 bp, Homo sapien
ttttgcagacgggcaagaagctgct

SEQ ID NO: 139183 - DNA, 25 bp, Homo sapien
tttgcagacgggcaagaagctgctt

SEQ ID NO: 139184 - DNA, 25 bp, Homo sapien
gggcccgggaactcctgccacaaca

SEQ ID NO: 139185 - DNA, 25 bp, Homo sapien
gcccgggaactcctgccacaacaga

SEQ ID NO: 139186 - DNA, 25 bp, Homo sapien
ccgggaactcctgccacaacagaat

SEQ ID NO: 139187 - DNA, 25 bp, Homo sapien
aagctgcatgtcctgaccctctttg

SEQ ID NO: 139188 - DNA, 25 bp, Homo sapien
atgtcctgaccctctttgaattaag

SEQ ID NO: 139189 - DNA, 25 bp, Homo sapien
gaccctctttgaattaagtggactg

SEQ ID NO: 139190 - DNA, 25 bp, Homo sapien
actaaatagtgcactgcaagaccag

SEQ ID NO: 139191 - DNA, 25 bp, Homo sapien
tgcactgcaagaccagaaaatttta

SEQ ID NO: 139192 - DNA, 25 bp, Homo sapien
atgttctgtagtatgtttaccctct

SEQ ID NO: 139193 - DNA, 25 bp, Homo sapien
gtatgtttaccctctttatgaagtg

SEQ ID NO: 139194 - DNA, 25 bp, Homo sapien
tgaagtgaattaccatgctttgaat

SEQ ID NO: 139195 - DNA, 25 bp, Homo sapien
aatgttcacttatacttcctgttcg

SEQ ID NO: 139196 - DNA, 25 bp, Homo sapien
gttcacttatacttcctgttcgaaa

SEQ ID NO: 139197 - DNA, 25 bp, Homo sapien
ttcctgttcgaaattacgaatttgt

SEQ ID NO: 139198 - DNA, 25 bp, Homo sapien
tcccctcatggagaaacatcctaag

SEQ ID NO: 139199 - DNA, 25 bp, Homo sapien
tcccgcgaggcctggacacttatgg

SEQ ID NO: 139200 - DNA, 25 bp, Homo sapien
gggacagcataccttggactgacta

SEQ ID NO: 139201 - DNA, 25 bp, Homo sapien
tggactgactaccagctaactccag

SEQ ID NO: 139202 - DNA, 25 bp, Homo sapien
ctaactccagtctcctgacattaag

SEQ ID NO: 139203 - DNA, 25 bp, Homo sapien
taagacacacctctggatccctgga

SEQ ID NO: 139204 - DNA, 25 bp, Homo sapien
gtgtgtcagagtaacatgccagctt

SEQ ID NO: 139205 - DNA, 25 bp, Homo sapien
aacatgccagcttcctgtgggccag

SEQ ID NO: 139206 - DNA, 25 bp, Homo sapien
gctcagccgtgcactccctaagaaa

SEQ ID NO: 139207 - DNA, 25 bp, Homo sapien
ggaaactggctgtttgatagcagaa

SEQ ID NO: 139208 - DNA, 25 bp, Homo sapien
agttgcagtctcagaaagccttcca

SEQ ID NO: 139209 - DNA, 25 bp, Homo sapien
cgcctgggtctcctaaagtactggg

SEQ ID NO: 139210 - DNA, 25 bp, Homo sapien
ccagcggcatcaggctttcttaaag

SEQ ID NO: 139211 - DNA, 25 bp, Homo sapien
tttcttaaagtgagagcacgcctgt

SEQ ID NO: 139212 - DNA, 25 bp, Homo sapien
gtgagagcacgcctgtactagagca

SEQ ID NO: 139213 - DNA, 25 bp, Homo sapien
gagcacgcctgtactagagcaagca

SEQ ID NO: 139214 - DNA, 25 bp, Homo sapien
ctagagcaagcaggaatcagagacc

SEQ ID NO: 139215 - DNA, 25 bp, Homo sapien
cagaaatactactgtgtaagggcca

SEQ ID NO: 139216 - DNA, 25 bp, Homo sapien
gtaagggccagaaatatcttcactt

SEQ ID NO: 139217 - DNA, 25 bp, Homo sapien
gaaatatcttcacttgtcattgtta

SEQ ID NO: 139218 - DNA, 25 bp, Homo sapien
tcacttgtcattgttatataatcat

SEQ ID NO: 139219 - DNA, 25 bp, Homo sapien
agatcttttattttgcaagggcata

SEQ ID NO: 139220 - DNA, 25 bp, Homo sapien
gcttcctgtcctaaaagtcattggt

SEQ ID NO: 139221 - DNA, 25 bp, Homo sapien
ggctaaaaataagtctcacccattg

SEQ ID NO: 139222 - DNA, 25 bp, Homo sapien
aaataagtctcacccattgcagtta

SEQ ID NO: 139223 - DNA, 25 bp, Homo sapien
gtctcacccattgcagttatgtcaa

SEQ ID NO: 139224 - DNA, 25 bp, Homo sapien
gcagttatgtcaacgaatggcctat

SEQ ID NO: 139225 - DNA, 25 bp, Homo sapien
acgaatggcctatattcctcagctg

SEQ ID NO: 139226 - DNA, 25 bp, Homo sapien
gcctatattcctcagctgcaatgaa

SEQ ID NO: 139227 - DNA, 25 bp, Homo sapien
atattttgtttctcgacattcctga

SEQ ID NO: 139228 - DNA, 25 bp, Homo sapien
ttgtttctcgacattcctgatgacg

SEQ ID NO: 139229 - DNA, 25 bp, Homo sapien
ttctcgacattcctgatgacgtctg

SEQ ID NO: 139230 - DNA, 25 bp, Homo sapien
ttgtattttaagcttacctgtgaat

SEQ ID NO: 139231 - DNA, 25 bp, Homo sapien
tttcatttccatttaagcaatttgt

SEQ ID NO: 139232 - DNA, 25 bp, Homo sapien
tttgtaagcaaagtccaggtccatt

SEQ ID NO: 139233 - DNA, 25 bp, Homo sapien
gcaaagtccaggtccatttagtttt

SEQ ID NO: 139234 - DNA, 25 bp, Homo sapien
gtccaggtccatttagtttttggat

SEQ ID NO: 139235 - DNA, 25 bp, Homo sapien
atatatttaatgtttgtctcctgaa

SEQ ID NO: 139236 - DNA, 25 bp, Homo sapien
atgtttgtctcctgaagtttgtctt

SEQ ID NO: 139237 - DNA, 25 bp, Homo sapien
gaagtttgtcttcatgtactgtaag

SEQ ID NO: 139238 - DNA, 25 bp, Homo sapien
gatattagttgtctttccatgtttt

SEQ ID NO: 139239 - DNA, 25 bp, Homo sapien
gttgtctttccatgttttaaatgta

SEQ ID NO: 139240 - DNA, 25 bp, Homo sapien
agaggtaatacccatctaggaaaga

SEQ ID NO: 139241 - DNA, 25 bp, Homo sapien
gtacattttcacttctgtattcgag

SEQ ID NO: 139242 - DNA, 25 bp, Homo sapien
atcgaggagcacagctgggcgcacc

SEQ ID NO: 139243 - DNA, 25 bp, Homo sapien
cggcggcggcagagtagccctaacc

SEQ ID NO: 139244 - DNA, 25 bp, Homo sapien
agagtagccctaaccgctccaggtg

SEQ ID NO: 139245 - DNA, 25 bp, Homo sapien
aggtgctgccgacgctccgggtgcg

SEQ ID NO: 139246 - DNA, 25 bp, Homo sapien
gggcatccactggtactcgcagctg

SEQ ID NO: 139247 - DNA, 25 bp, Homo sapien
tccactggtactcgcagctgctcta

SEQ ID NO: 139248 - DNA, 25 bp, Homo sapien
agctgctctaccaaataggcacctg

SEQ ID NO: 139249 - DNA, 25 bp, Homo sapien
tgctctaccaaataggcacctggct

SEQ ID NO: 139250 - DNA, 25 bp, Homo sapien
cacccgctgggcatggcggtcaagt

SEQ ID NO: 139251 - DNA, 25 bp, Homo sapien
ggcatggcggtcaagtccagctgaa

SEQ ID NO: 139252 - DNA, 25 bp, Homo sapien
atggcggtcaagtccagctgaagcc

SEQ ID NO: 139253 - DNA, 25 bp, Homo sapien
tcacagtgccgctccgcatggtggt

SEQ ID NO: 139254 - DNA, 25 bp, Homo sapien
gtgccgctccgcatggtggtgctca

SEQ ID NO: 139255 - DNA, 25 bp, Homo sapien
atggtggtgctcacccgtatcttca

SEQ ID NO: 139256 - DNA, 25 bp, Homo sapien
ttcaccgaccgagagatgaaatgtc

SEQ ID NO: 139257 - DNA, 25 bp, Homo sapien
tgaaatgtctggatgctaacgaggc

SEQ ID NO: 139258 - DNA, 25 bp, Homo sapien
taacgaggcagagccggtgtttgat

SEQ ID NO: 139259 - DNA, 25 bp, Homo sapien
ggacgagtacaatgagatgcccatg

SEQ ID NO: 139260 - DNA, 25 bp, Homo sapien
gtacaatgagatgcccatgcctgtg

SEQ ID NO: 139261 - DNA, 25 bp, Homo sapien
tgagatgcccatgcctgtgtagccg

SEQ ID NO: 139262 - DNA, 25 bp, Homo sapien
tgtgtagccgccaccgagggacagc

SEQ ID NO: 139263 - DNA, 25 bp, Homo sapien
ggacagccgagggaccgatggacga

SEQ ID NO: 139264 - DNA, 25 bp, Homo sapien
ttgaactgtcaaatccttgcatact

SEQ ID NO: 139265 - DNA, 25 bp, Homo sapien
gtcaaatccttgcatacttctgtga

SEQ ID NO: 139266 - DNA, 25 bp, Homo sapien
aatccttgcatacttctgtgacacc

SEQ ID NO: 139267 - DNA, 25 bp, Homo sapien
cttgcatacttctgtgacacccctg

SEQ ID NO: 139268 - DNA, 25 bp, Homo sapien
gtgactgtcacaactgttatgtttt

SEQ ID NO: 139269 - DNA, 25 bp, Homo sapien
tgttatgttttccagtaaactagaa

SEQ ID NO: 139270 - DNA, 25 bp, Homo sapien
gtatttcaccacctaaatgtaatgt

SEQ ID NO: 139271 - DNA, 25 bp, Homo sapien
tcaccacctaaatgtaatgttgatt

SEQ ID NO: 139272 - DNA, 25 bp, Homo sapien
atgaaggcactacattgaaatatgt

SEQ ID NO: 139273 - DNA, 25 bp, Homo sapien
gtcatgttgaacagcattttagcat

SEQ ID NO: 139274 - DNA, 25 bp, Homo sapien
acagcattttagcatggtaagttcc

SEQ ID NO: 139275 - DNA, 25 bp, Homo sapien
gcagaggccaagtacatttagtatg

SEQ ID NO: 139276 - DNA, 25 bp, Homo sapien
gtatggcattgagttgtgatatagt

SEQ ID NO: 139277 - DNA, 25 bp, Homo sapien
gatgtgcattttgaatttcagctac

SEQ ID NO: 139278 - DNA, 25 bp, Homo sapien
tttcagctacacctagatagacgta

SEQ ID NO: 139279 - DNA, 25 bp, Homo sapien
aatgctgtaaccaacttatctaata

SEQ ID NO: 139280 - DNA, 25 bp, Homo sapien
aaaattggcaaccagccactatttt

SEQ ID NO: 139281 - DNA, 25 bp, Homo sapien
accagccactattttgttgactatg

SEQ ID NO: 139282 - DNA, 25 bp, Homo sapien
gggtctgatagaatatttcatgtgt

SEQ ID NO: 139283 - DNA, 25 bp, Homo sapien
gtattacagtggtattcatatgcta

SEQ ID NO: 139284 - DNA, 25 bp, Homo sapien
gtggtattcatatgctatgtctcta

SEQ ID NO: 139285 - DNA, 25 bp, Homo sapien
gctatgtctctaaactttattttca

SEQ ID NO: 139286 - DNA, 25 bp, Homo sapien
acttcagagtgtcatgtttattgat

SEQ ID NO: 139287 - DNA, 25 bp, Homo sapien
gtttattgatgtggagctttctgaa

SEQ ID NO: 139288 - DNA, 25 bp, Homo sapien
ggagctttctgaatagggaggttaa

SEQ ID NO: 139289 - DNA, 25 bp, Homo sapien
atagggaggttaaggcacacctgct

SEQ ID NO: 139290 - DNA, 25 bp, Homo sapien
gttaaggcacacctgctgagtaaaa

SEQ ID NO: 139291 - DNA, 25 bp, Homo sapien
ggcacacctgctgagtaaaacaaat

SEQ ID NO: 139292 - DNA, 25 bp, Homo sapien
atatttcttgtgtagcgttcttagg

SEQ ID NO: 139293 - DNA, 25 bp, Homo sapien
agcgttcttaggaatctggtgtctg

SEQ ID NO: 139294 - DNA, 25 bp, Homo sapien
gaatctggtgtctgtccggccccgg

SEQ ID NO: 139295 - DNA, 25 bp, Homo sapien
tccttaccatcatctccatatgaga

SEQ ID NO: 139296 - DNA, 25 bp, Homo sapien
accatcatctccatatgagagtgtg

SEQ ID NO: 139297 - DNA, 25 bp, Homo sapien
ggaagaacactatgtggctgccgtg

SEQ ID NO: 139298 - DNA, 25 bp, Homo sapien
gctgccgtgtaagagtggaactgtc

SEQ ID NO: 139299 - DNA, 25 bp, Homo sapien
agaagtagaaatcgtggcccacctc

SEQ ID NO: 139300 - DNA, 25 bp, Homo sapien
gggtcgtcgccctcgagatgattat

SEQ ID NO: 139301 - DNA, 25 bp, Homo sapien
atgattatcgtaggaggagtcctcc

SEQ ID NO: 139302 - DNA, 25 bp, Homo sapien
gaaggagaagcttctctcgcagccg

SEQ ID NO: 139303 - DNA, 25 bp, Homo sapien
tctcgcagccggagcaggtcccttt

SEQ ID NO: 139304 - DNA, 25 bp, Homo sapien
tcgctgtctcgggagagaaatcaca

SEQ ID NO: 139305 - DNA, 25 bp, Homo sapien
gagagaaatcacaagccgtcccgat

SEQ ID NO: 139306 - DNA, 25 bp, Homo sapien
ttctctaggtctcgtagtcgatcta

SEQ ID NO: 139307 - DNA, 25 bp, Homo sapien
gtctcgtagtcgatctaggtcaaat

SEQ ID NO: 139308 - DNA, 25 bp, Homo sapien
tcccattctgtgtatgagtcccatt

SEQ ID NO: 139309 - DNA, 25 bp, Homo sapien
tgtatgagtcccatttgccttgcaa

SEQ ID NO: 139310 - DNA, 25 bp, Homo sapien
gtcccatttgccttgcaattagcat

SEQ ID NO: 139311 - DNA, 25 bp, Homo sapien
gaatgtgctatgaagctttctttcc

SEQ ID NO: 139312 - DNA, 25 bp, Homo sapien
tatgaagctttctttcctacacact

SEQ ID NO: 139313 - DNA, 25 bp, Homo sapien
ttcctacacactctgagtctctgaa

SEQ ID NO: 139314 - DNA, 25 bp, Homo sapien
gaagctgaaggtcttagtaccagag

SEQ ID NO: 139315 - DNA, 25 bp, Homo sapien
gaaggtcttagtaccagagctagtt

SEQ ID NO: 139316 - DNA, 25 bp, Homo sapien
gtaccagagctagttttcagctgct

SEQ ID NO: 139317 - DNA, 25 bp, Homo sapien
gctagttttcagctgctcagaattc

SEQ ID NO: 139318 - DNA, 25 bp, Homo sapien
tcagctgctcagaattcatctgaag

SEQ ID NO: 139319 - DNA, 25 bp, Homo sapien
atatcctggtgcgatgatgggcctg

SEQ ID NO: 139320 - DNA, 25 bp, Homo sapien
gcgatgatgggcctggcaacatttt

SEQ ID NO: 139321 - DNA, 25 bp, Homo sapien
tcctaagaaataccaccctaccact

SEQ ID NO: 139322 - DNA, 25 bp, Homo sapien
ggtataaagaatctcccagccaggc

SEQ ID NO: 139323 - DNA, 25 bp, Homo sapien
tataaagaatctcccagccaggcca

SEQ ID NO: 139324 - DNA, 25 bp, Homo sapien
taaagaatctcccagccaggccaac

SEQ ID NO: 139325 - DNA, 25 bp, Homo sapien
gccaagtgtggtaatgttcacctgc

SEQ ID NO: 139326 - DNA, 25 bp, Homo sapien
aagtgtggtaatgttcacctgcagt

SEQ ID NO: 139327 - DNA, 25 bp, Homo sapien
gtgtggtaatgttcacctgcagtcc

SEQ ID NO: 139328 - DNA, 25 bp, Homo sapien
gtggtaatgttcacctgcagtccca

SEQ ID NO: 139329 - DNA, 25 bp, Homo sapien
tggtaatgttcacctgcagtcccag

SEQ ID NO: 139330 - DNA, 25 bp, Homo sapien
cttcgctagctatgtgattggcctg

SEQ ID NO: 139331 - DNA, 25 bp, Homo sapien
gggaagctgccatactgctctggac

SEQ ID NO: 139332 - DNA, 25 bp, Homo sapien
gaagctgccatactgctctggaccc

SEQ ID NO: 139333 - DNA, 25 bp, Homo sapien
tctggacccccagtgtagggctggt

SEQ ID NO: 139334 - DNA, 25 bp, Homo sapien
tgtgggcaggtgcattctacctctt

SEQ ID NO: 139335 - DNA, 25 bp, Homo sapien
attctacctcttccacgtacaggag

SEQ ID NO: 139336 - DNA, 25 bp, Homo sapien
ctcttccacgtacaggaggtcaatg

SEQ ID NO: 139337 - DNA, 25 bp, Homo sapien
acgtacaggaggtcaatggcttata

SEQ ID NO: 139338 - DNA, 25 bp, Homo sapien
atggcttatatagggcccaggctga

SEQ ID NO: 139339 - DNA, 25 bp, Homo sapien
agctccagcatgtgctaggaagggc

SEQ ID NO: 139340 - DNA, 25 bp, Homo sapien
tccagcatgtgctaggaagggcaag

SEQ ID NO: 139341 - DNA, 25 bp, Homo sapien
accacgcctggtctatgaacttttt

SEQ ID NO: 139342 - DNA, 25 bp, Homo sapien
ccacgcctggtctatgaacttttta

SEQ ID NO: 139343 - DNA, 25 bp, Homo sapien
gtatgtgtataaacagattcaaggg

SEQ ID NO: 139344 - DNA, 25 bp, Homo sapien
acagattcaagggaaaggcactaaa

SEQ ID NO: 139345 - DNA, 25 bp, Homo sapien
aaatggttttttcctctggaagatg

SEQ ID NO: 139346 - DNA, 25 bp, Homo sapien
aatggttttttcctctggaagatga

SEQ ID NO: 139347 - DNA, 25 bp, Homo sapien
attgtaggtgatatttattttcttc

SEQ ID NO: 139348 - DNA, 25 bp, Homo sapien
cttctgaaacttttgtatagtttgc

SEQ ID NO: 139349 - DNA, 25 bp, Homo sapien
gtatagtttgcaaattttctacagt

SEQ ID NO: 139350 - DNA, 25 bp, Homo sapien
gtttgcaaattttctacagtgaaca

SEQ ID NO: 139351 - DNA, 25 bp, Homo sapien
acttttgttactagattgaatttga

SEQ ID NO: 139352 - DNA, 25 bp, Homo sapien
ttctctaagtgccaaaaacagtgtc

SEQ ID NO: 139353 - DNA, 25 bp, Homo sapien
tgtgttcctttcttgatacttagtc

SEQ ID NO: 139354 - DNA, 25 bp, Homo sapien
gttcctttcttgatacttagtcatg

SEQ ID NO: 139355 - DNA, 25 bp, Homo sapien
ttcttgatacttagtcatgggagga

SEQ ID NO: 139356 - DNA, 25 bp, Homo sapien
catagtctttcagagtagctcactt

SEQ ID NO: 139357 - DNA, 25 bp, Homo sapien
agagtagctcactttagtcctgtaa

SEQ ID NO: 139358 - DNA, 25 bp, Homo sapien
gtagctcactttagtcctgtaactt

SEQ ID NO: 139359 - DNA, 25 bp, Homo sapien
gctcactttagtcctgtaactttat

SEQ ID NO: 139360 - DNA, 25 bp, Homo sapien
ttgtgttcagtgtaattgtcttctc

SEQ ID NO: 139361 - DNA, 25 bp, Homo sapien
gtgtaattgtcttctctttgctgat

SEQ ID NO: 139362 - DNA, 25 bp, Homo sapien
tgcctcacctggttaaaaaagaaca

SEQ ID NO: 139363 - DNA, 25 bp, Homo sapien
gattcccatctatttaactttatta

SEQ ID NO: 139364 - DNA, 25 bp, Homo sapien
ttaacttctaccgtgaatgactctg

SEQ ID NO: 139365 - DNA, 25 bp, Homo sapien
gaatgactctgcaagccttgctggt

SEQ ID NO: 139366 - DNA, 25 bp, Homo sapien
gccttgctggtccaagtgcaatatg

SEQ ID NO: 139367 - DNA, 25 bp, Homo sapien
gagcctatcaatgtatcttttgtac

SEQ ID NO: 139368 - DNA, 25 bp, Homo sapien
gtagatcataggatagctgactttg

SEQ ID NO: 139369 - DNA, 25 bp, Homo sapien
gatagctgactttgacagtcacatt

SEQ ID NO: 139370 - DNA, 25 bp, Homo sapien
gagaacactttacaacgacgaggag

SEQ ID NO: 139371 - DNA, 25 bp, Homo sapien
gaggagattcgtttccaaaccagag

SEQ ID NO: 139372 - DNA, 25 bp, Homo sapien
accagaggagatcaattgtacttac

SEQ ID NO: 139373 - DNA, 25 bp, Homo sapien
ttgtacttacaaagattcccatcta

SEQ ID NO: 139374 - DNA, 25 bp, Homo sapien
cagcgtttccgtaaaattgactttg

SEQ ID NO: 139375 - DNA, 25 bp, Homo sapien
gactttgtactcgaaaacgtcaatt

SEQ ID NO: 139376 - DNA, 25 bp, Homo sapien
gtactcgaaaacgtcaatttatatt

SEQ ID NO: 139377 - DNA, 25 bp, Homo sapien
caaagtctgaaataggtcaacctgc

SEQ ID NO: 139378 - DNA, 25 bp, Homo sapien
ggtcaacctgcaggcgtaactattt

SEQ ID NO: 139379 - DNA, 25 bp, Homo sapien
acctgcaggcgtaactatttttgac

SEQ ID NO: 139380 - DNA, 25 bp, Homo sapien
gcgtaactatttttgacctagtcag

SEQ ID NO: 139381 - DNA, 25 bp, Homo sapien
gattttactcattcagtatctgagt

SEQ ID NO: 139382 - DNA, 25 bp, Homo sapien
gtatctgagtactggaagtgaaaca

SEQ ID NO: 139383 - DNA, 25 bp, Homo sapien
gaaacatgaggaatgctttagtgta

SEQ ID NO: 139384 - DNA, 25 bp, Homo sapien
aatgctttagtgtaatgtgggagaa

SEQ ID NO: 139385 - DNA, 25 bp, Homo sapien
ggccctgttgagtctatctggtaac

SEQ ID NO: 139386 - DNA, 25 bp, Homo sapien
tatctggtaacactggagctgactc

SEQ ID NO: 139387 - DNA, 25 bp, Homo sapien
gatgcaccaagatatatgaccctgt

SEQ ID NO: 139388 - DNA, 25 bp, Homo sapien
agatatatgaccctgtctgtgggac

SEQ ID NO: 139389 - DNA, 25 bp, Homo sapien
atacttatcccaatgaatgcgtgtt

SEQ ID NO: 139390 - DNA, 25 bp, Homo sapien
ccagacttctatcctcattcaaaaa

SEQ ID NO: 139391 - DNA, 25 bp, Homo sapien
cattcaaaaatctgggccttgctga

SEQ ID NO: 139392 - DNA, 25 bp, Homo sapien
gttttgaaatcccatcaggtcaccg

SEQ ID NO: 139393 - DNA, 25 bp, Homo sapien
tctggacgcagaacttcagccatga

SEQ ID NO: 139394 - DNA, 25 bp, Homo sapien
gccatgaaggtaacaggcatctttc

SEQ ID NO: 139395 - DNA, 25 bp, Homo sapien
ttctcagtgccttggccctgttgag

SEQ ID NO: 139396 - DNA, 25 bp, Homo sapien
ctcagtggtcccaggcagctcgggt

SEQ ID NO: 139397 - DNA, 25 bp, Homo sapien
tcgggtgtcggaacccccagacagt

SEQ ID NO: 139398 - DNA, 25 bp, Homo sapien
ccccagacagttcacgcgacaaaga

SEQ ID NO: 139399 - DNA, 25 bp, Homo sapien
gacagttcacgcgacaaagaatcac

SEQ ID NO: 139400 - DNA, 25 bp, Homo sapien
gacaaagaatcacgcgggtcaacct

SEQ ID NO: 139401 - DNA, 25 bp, Homo sapien
gaatcacgcgggtcaacctcaggga

SEQ ID NO: 139402 - DNA, 25 bp, Homo sapien
gggtcaacctcagggacctcatatt

SEQ ID NO: 139403 - DNA, 25 bp, Homo sapien
gaacgtgagacaagccattcactgc

SEQ ID NO: 139404 - DNA, 25 bp, Homo sapien
tgagacaagccattcactgctgctc

SEQ ID NO: 139405 - DNA, 25 bp, Homo sapien
aagccattcactgctgctctacaaa

SEQ ID NO: 139406 - DNA, 25 bp, Homo sapien
tcactgctgctctacaaagcattcc

SEQ ID NO: 139407 - DNA, 25 bp, Homo sapien
caaggtggacatcttttggatatct

SEQ ID NO: 139408 - DNA, 25 bp, Homo sapien
ggtggacatcttttggatatctttt

SEQ ID NO: 139409 - DNA, 25 bp, Homo sapien
tttctaaagctttacatatgagagg

SEQ ID NO: 139410 - DNA, 25 bp, Homo sapien
agatttgcctttcaaaccctcaggt

SEQ ID NO: 139411 - DNA, 25 bp, Homo sapien
ttgcctttcaaaccctcaggtttgc

SEQ ID NO: 139412 - DNA, 25 bp, Homo sapien
tcaggtttgcctctaaccaggtgtc

SEQ ID NO: 139413 - DNA, 25 bp, Homo sapien
aaccaggtgtccctggtcaccatca

SEQ ID NO: 139414 - DNA, 25 bp, Homo sapien
tggtcaccatcagagtactggaata

SEQ ID NO: 139415 - DNA, 25 bp, Homo sapien
agagtactggaatacgggaaccgag

SEQ ID NO: 139416 - DNA, 25 bp, Homo sapien
tgtttttgttctggactcttgggag

SEQ ID NO: 139417 - DNA, 25 bp, Homo sapien
gttctggactcttgggagtggaaat

SEQ ID NO: 139418 - DNA, 25 bp, Homo sapien
gccttcttgggcatggccgtgaaca

SEQ ID NO: 139419 - DNA, 25 bp, Homo sapien
cttcttgggcatggccgtgaacacc

SEQ ID NO: 139420 - DNA, 25 bp, Homo sapien
aacaccctgtgtggcgaggtgccgc

SEQ ID NO: 139421 - DNA, 25 bp, Homo sapien
aggacgcctccggtgagcagggtca

SEQ ID NO: 139422 - DNA, 25 bp, Homo sapien
ggacgcctccggtgagcagggtcag

SEQ ID NO: 139423 - DNA, 25 bp, Homo sapien
gacgcctccggtgagcagggtcagt

SEQ ID NO: 139424 - DNA, 25 bp, Homo sapien
acgcctccggtgagcagggtcagtg

SEQ ID NO: 139425 - DNA, 25 bp, Homo sapien
cctccggtgagcagggtcagtggaa

SEQ ID NO: 139426 - DNA, 25 bp, Homo sapien
ctccggtgagcagggtcagtggaag

SEQ ID NO: 139427 - DNA, 25 bp, Homo sapien
ccggtgagcagggtcagtggaagcc

SEQ ID NO: 139428 - DNA, 25 bp, Homo sapien
tttgcagcttttgcagacgggcaag

SEQ ID NO: 139429 - DNA, 25 bp, Homo sapien
gatgtataataataggccctcttgg

SEQ ID NO: 139430 - DNA, 25 bp, Homo sapien
ataataggccctcttggaacaagtc

SEQ ID NO: 139431 - DNA, 25 bp, Homo sapien
ggccctcttggaacaagtcttgctt

SEQ ID NO: 139432 - DNA, 25 bp, Homo sapien
ggaacaagtcttgcttttcgaacat

SEQ ID NO: 139433 - DNA, 25 bp, Homo sapien
caagtcttgcttttcgaacatggta

SEQ ID NO: 139434 - DNA, 25 bp, Homo sapien
gtcttgcttttcgaacatggtataa

SEQ ID NO: 139435 - DNA, 25 bp, Homo sapien
catggtataatagccttgtttgtgt

SEQ ID NO: 139436 - DNA, 25 bp, Homo sapien
atagccttgtttgtgttagcaaagt

SEQ ID NO: 139437 - DNA, 25 bp, Homo sapien
aaagtggaatctatcagcattgttg

SEQ ID NO: 139438 - DNA, 25 bp, Homo sapien
ggaatctatcagcattgttgaaatg

SEQ ID NO: 139439 - DNA, 25 bp, Homo sapien
gaaatctaaatgtcaattttctaca

SEQ ID NO: 139440 - DNA, 25 bp, Homo sapien
tgcataacgtataaaagcctgttta

SEQ ID NO: 139441 - DNA, 25 bp, Homo sapien
gcataacgtataaaagcctgtttaa

SEQ ID NO: 139442 - DNA, 25 bp, Homo sapien
aaaagcctgtttaagagacagccaa

SEQ ID NO: 139443 - DNA, 25 bp, Homo sapien
aagcctgtttaagagacagccaact

SEQ ID NO: 139444 - DNA, 25 bp, Homo sapien
gcctgtttaagagacagccaactat

SEQ ID NO: 139445 - DNA, 25 bp, Homo sapien
tgtttaagagacagccaactatggc

SEQ ID NO: 139446 - DNA, 25 bp, Homo sapien
ttaagagacagccaactatggcctg

SEQ ID NO: 139447 - DNA, 25 bp, Homo sapien
taagagacagccaactatggcctgt

SEQ ID NO: 139448 - DNA, 25 bp, Homo sapien
gagacagccaactatggcctgtgga

SEQ ID NO: 139449 - DNA, 25 bp, Homo sapien
tggcctgtgagctaggaattgtgtt

SEQ ID NO: 139450 - DNA, 25 bp, Homo sapien
gcctgtgagctaggaattgtgttta

SEQ ID NO: 139451 - DNA, 25 bp, Homo sapien
gaagtgcccagtgacttatggccaa

SEQ ID NO: 139452 - DNA, 25 bp, Homo sapien
gcccagtgacttatggccaatgttt

SEQ ID NO: 139453 - DNA, 25 bp, Homo sapien
aatttctgtgagatggatggccagt

SEQ ID NO: 139454 - DNA, 25 bp, Homo sapien
tggatggccagtgcaagcgtgactt

SEQ ID NO: 139455 - DNA, 25 bp, Homo sapien
caagcgtgacttgaagtgttgcatg

SEQ ID NO: 139456 - DNA, 25 bp, Homo sapien
gcatgtgtgggaaatcctgcgtttc

SEQ ID NO: 139457 - DNA, 25 bp, Homo sapien
aaatcctgcgtttcccctgtgaaag

SEQ ID NO: 139458 - DNA, 25 bp, Homo sapien
cttgattcctgccatatggaggagg

SEQ ID NO: 139459 - DNA, 25 bp, Homo sapien
tccaccactgatatcctcctttggg

SEQ ID NO: 139460 - DNA, 25 bp, Homo sapien
gcacacagcaggctttcaagaagtg

SEQ ID NO: 139461 - DNA, 25 bp, Homo sapien
ggctttcaagaagtgccagttgatc

SEQ ID NO: 139462 - DNA, 25 bp, Homo sapien
ttaaggagcctaataacgtgaaact

SEQ ID NO: 139463 - DNA, 25 bp, Homo sapien
ggagcctaataacgtgaaacttata

SEQ ID NO: 139464 - DNA, 25 bp, Homo sapien
attttatctggaagttgagacttaa

SEQ ID NO: 139465 - DNA, 25 bp, Homo sapien
tgagacttaaaaaatacttgcatga

SEQ ID NO: 139466 - DNA, 25 bp, Homo sapien
acttgcatgaatgatttgtgtttct

SEQ ID NO: 139467 - DNA, 25 bp, Homo sapien
gttaactacatattgtctggaaacc

SEQ ID NO: 139468 - DNA, 25 bp, Homo sapien
ttgtctggaaacctgtcattgtatt

SEQ ID NO: 139469 - DNA, 25 bp, Homo sapien
ggaaacctgtcattgtattcagata

SEQ ID NO: 139470 - DNA, 25 bp, Homo sapien
cctgtcattgtattcagataattag

SEQ ID NO: 139471 - DNA, 25 bp, Homo sapien
tttgtaaagttagcctttgaatgct

SEQ ID NO: 139472 - DNA, 25 bp, Homo sapien
gaatgcattattgagggtcattctt

SEQ ID NO: 139473 - DNA, 25 bp, Homo sapien
aatcttcctgttgaatgcttcatga

SEQ ID NO: 139474 - DNA, 25 bp, Homo sapien
cttcctgttgaatgcttcatgactt

SEQ ID NO: 139475 - DNA, 25 bp, Homo sapien
gaatgcttcatgacttgaattctac

SEQ ID NO: 139476 - DNA, 25 bp, Homo sapien
catgacttgaattctactttgataa

SEQ ID NO: 139477 - DNA, 25 bp, Homo sapien
gataaaaacattgccatactgcttt

SEQ ID NO: 139478 - DNA, 25 bp, Homo sapien
gatgaattcatctggcattgctttg

SEQ ID NO: 139479 - DNA, 25 bp, Homo sapien
attcatctggcattgctttgcctta

SEQ ID NO: 139480 - DNA, 25 bp, Homo sapien
attgctttgccttatcatctcatct

SEQ ID NO: 139481 - DNA, 25 bp, Homo sapien
tttgccttatcatctcatctggagt

SEQ ID NO: 139482 - DNA, 25 bp, Homo sapien
gccttatcatctcatctggagtttt

SEQ ID NO: 139483 - DNA, 25 bp, Homo sapien
atctcatctggagtttttaaatgcc

SEQ ID NO: 139484 - DNA, 25 bp, Homo sapien
tgtgaccggcgctaggaaatgaccc

SEQ ID NO: 139485 - DNA, 25 bp, Homo sapien
ggcgctaggaaatgacccgagaacc

SEQ ID NO: 139486 - DNA, 25 bp, Homo sapien
gagaaccccgttggaagcgcagcag

SEQ ID NO: 139487 - DNA, 25 bp, Homo sapien
aaccccgttggaagcgcagcagcgg

SEQ ID NO: 139488 - DNA, 25 bp, Homo sapien
gggttcacggtcaaactgaaatgga

SEQ ID NO: 139489 - DNA, 25 bp, Homo sapien
aactgaaatggatttgcacgttggg

SEQ ID NO: 139490 - DNA, 25 bp, Homo sapien
tccgccttcttttctacgtgaaatc

SEQ ID NO: 139491 - DNA, 25 bp, Homo sapien
gccttcttttctacgtgaaatcagt

SEQ ID NO: 139492 - DNA, 25 bp, Homo sapien
aaatcagtgaggtgagacttcccag

SEQ ID NO: 139493 - DNA, 25 bp, Homo sapien
cagtgaggtgagacttcccagaccc

SEQ ID NO: 139494 - DNA, 25 bp, Homo sapien
tgaggtgagacttcccagaccccgg

SEQ ID NO: 139495 - DNA, 25 bp, Homo sapien
acaatgctttctacctgaaatgtgt

SEQ ID NO: 139496 - DNA, 25 bp, Homo sapien
gctttctacctgaaatgtgtagctt

SEQ ID NO: 139497 - DNA, 25 bp, Homo sapien
tcctctcagtccttgttcttttgaa

SEQ ID NO: 139498 - DNA, 25 bp, Homo sapien
ctcagtccttgttcttttgaagctt

SEQ ID NO: 139499 - DNA, 25 bp, Homo sapien
cttgttcttttgaagcttgtgctga

SEQ ID NO: 139500 - DNA, 25 bp, Homo sapien
gcttgtgctgaggttttagcttttc

SEQ ID NO: 139501 - DNA, 25 bp, Homo sapien
gtgctgaggttttagcttttctatg

SEQ ID NO: 139502 - DNA, 25 bp, Homo sapien
gccgctgctttgaaagagaacctag

SEQ ID NO: 139503 - DNA, 25 bp, Homo sapien
gagaacctagattctatagttgtat

SEQ ID NO: 139504 - DNA, 25 bp, Homo sapien
atagttgtattattgttgtttcata

SEQ ID NO: 139505 - DNA, 25 bp, Homo sapien
ttatatggctgtggaaaaacgaatt

SEQ ID NO: 139506 - DNA, 25 bp, Homo sapien
tgaaggcggctgtgtgaccactttc

SEQ ID NO: 139507 - DNA, 25 bp, Homo sapien
tctagacaactctctcccttacctg

SEQ ID NO: 139508 - DNA, 25 bp, Homo sapien
ccttacctgtttttgctatggctgt

SEQ ID NO: 139509 - DNA, 25 bp, Homo sapien
ctgtttttgctatggctgtaaaggt

SEQ ID NO: 139510 - DNA, 25 bp, Homo sapien
gctgtaaaggtatttttcctctgcc

SEQ ID NO: 139511 - DNA, 25 bp, Homo sapien
ccatacctttatcctgggatcctat

SEQ ID NO: 139512 - DNA, 25 bp, Homo sapien
gctggtcttaggagggtgctaggct

SEQ ID NO: 139513 - DNA, 25 bp, Homo sapien
agggtgctaggctgcagactgcctt

SEQ ID NO: 139514 - DNA, 25 bp, Homo sapien
ctaggctgcagactgccttgtactc

SEQ ID NO: 139515 - DNA, 25 bp, Homo sapien
tactccctggacaccctcaaatggg

SEQ ID NO: 139516 - DNA, 25 bp, Homo sapien
cctcaaatgggggtttctgtgttat

SEQ ID NO: 139517 - DNA, 25 bp, Homo sapien
caatgccatcgtcttctctttcggg

SEQ ID NO: 139518 - DNA, 25 bp, Homo sapien
gacctcaaagtgttggatatggccc

SEQ ID NO: 139519 - DNA, 25 bp, Homo sapien
tatggcccgggcaggattcctcctc

SEQ ID NO: 139520 - DNA, 25 bp, Homo sapien
aggattcctcctcaacatcattgga

SEQ ID NO: 139521 - DNA, 25 bp, Homo sapien
gattcctcctcaacatcattggagt

SEQ ID NO: 139522 - DNA, 25 bp, Homo sapien
tcctcaacatcattggagtcctgat

SEQ ID NO: 139523 - DNA, 25 bp, Homo sapien
aacatcattggagtcctgatcatcg

SEQ ID NO: 139524 - DNA, 25 bp, Homo sapien
agtcctgatcatcgcactggccatc

SEQ ID NO: 139525 - DNA, 25 bp, Homo sapien
tgatcatcgcactggccatcaacag

SEQ ID NO: 139526 - DNA, 25 bp, Homo sapien
atcgcactggccatcaacagctggg

SEQ ID NO: 139527 - DNA, 25 bp, Homo sapien
tcctgggcacagtccaacaccacag

SEQ ID NO: 139528 - DNA, 25 bp, Homo sapien
gataaaaagcacactcttaatcttc

SEQ ID NO: 139529 - DNA, 25 bp, Homo sapien
cttccttgttgctttcaagtagtta

SEQ ID NO: 139530 - DNA, 25 bp, Homo sapien
agttagagttgagctgttaaggaca

SEQ ID NO: 139531 - DNA, 25 bp, Homo sapien
atcatagttgaggacagcaggtttt

SEQ ID NO: 139532 - DNA, 25 bp, Homo sapien
gacagcaggttttagttgaattgaa

SEQ ID NO: 139533 - DNA, 25 bp, Homo sapien
attgaaaatttgactgctctgcccc

SEQ ID NO: 139534 - DNA, 25 bp, Homo sapien
gcatatgtagctaatctcttgtgtt

SEQ ID NO: 139535 - DNA, 25 bp, Homo sapien
gctaatctcttgtgttaaactataa

SEQ ID NO: 139536 - DNA, 25 bp, Homo sapien
aagtagccaaagacaatcagcagaa

SEQ ID NO: 139537 - DNA, 25 bp, Homo sapien
atatgcaaaatgtgattcgtccagt

SEQ ID NO: 139538 - DNA, 25 bp, Homo sapien
gattcgtccagttattagtgaagcc

SEQ ID NO: 139539 - DNA, 25 bp, Homo sapien
tcccaaacctttcctcaatggacta

SEQ ID NO: 139540 - DNA, 25 bp, Homo sapien
aaacctttcctcaatggactaacag

SEQ ID NO: 139541 - DNA, 25 bp, Homo sapien
acctttcctcaatggactaacagga

SEQ ID NO: 139542 - DNA, 25 bp, Homo sapien
atggactaacaggaaagccagtgat

SEQ ID NO: 139543 - DNA, 25 bp, Homo sapien
acaagggctatctggtatctgtaga

SEQ ID NO: 139544 - DNA, 25 bp, Homo sapien
ggctacatgaacatgcagcttgcaa

SEQ ID NO: 139545 - DNA, 25 bp, Homo sapien
gaatacatagatggagctttgtctg

SEQ ID NO: 139546 - DNA, 25 bp, Homo sapien
acatagatggagctttgtctggaca

SEQ ID NO: 139547 - DNA, 25 bp, Homo sapien
ctttgtctggacatctgggtgaagt

SEQ ID NO: 139548 - DNA, 25 bp, Homo sapien
gtctggacatctgggtgaagtttta

SEQ ID NO: 139549 - DNA, 25 bp, Homo sapien
gagaatagcatcttttgtgggggat

SEQ ID NO: 139550 - DNA, 25 bp, Homo sapien
aaccaaagcatcattcatctccatt

SEQ ID NO: 139551 - DNA, 25 bp, Homo sapien
ttttgttcccgctcagtgtgaagtt

SEQ ID NO: 139552 - DNA, 25 bp, Homo sapien
gatggctgctggtttcacagaagtt

SEQ ID NO: 139553 - DNA, 25 bp, Homo sapien
gtttggatgccttactcttatctta

SEQ ID NO: 139554 - DNA, 25 bp, Homo sapien
taaagccagcatccagaatttcctc

SEQ ID NO: 139555 - DNA, 25 bp, Homo sapien
gatgccacatgcaaaaccaggtgta

SEQ ID NO: 139556 - DNA, 25 bp, Homo sapien
aaaccaggtgtacgatgtcaagatg

SEQ ID NO: 139557 - DNA, 25 bp, Homo sapien
gattctttgagagccagggtagatc

SEQ ID NO: 139558 - DNA, 25 bp, Homo sapien
gtagatcatatgactgcctttctgt

SEQ ID NO: 139559 - DNA, 25 bp, Homo sapien
ggatgcctagtacaaatgctctttg

SEQ ID NO: 139560 - DNA, 25 bp, Homo sapien
aatgctctttgcctctaattcagta

SEQ ID NO: 139561 - DNA, 25 bp, Homo sapien
tgggcctgggctgccgacacctggg

SEQ ID NO: 139562 - DNA, 25 bp, Homo sapien
cagagcccctgctgtgattggtgct

SEQ ID NO: 139563 - DNA, 25 bp, Homo sapien
agagcccctgctgtgattggtgctc

SEQ ID NO: 139564 - DNA, 25 bp, Homo sapien
gagcccctgctgtgattggtgctcc

SEQ ID NO: 139565 - DNA, 25 bp, Homo sapien
gcccctgctgtgattggtgctccct

SEQ ID NO: 139566 - DNA, 25 bp, Homo sapien
tgctgtgattggtgctccctgggcc

SEQ ID NO: 139567 - DNA, 25 bp, Homo sapien
gctgtgattggtgctccctgggcct

SEQ ID NO: 139568 - DNA, 25 bp, Homo sapien
ctgtgattggtgctccctgggcctc

SEQ ID NO: 139569 - DNA, 25 bp, Homo sapien
tgggcctcccgggtggatgaagcca

SEQ ID NO: 139570 - DNA, 25 bp, Homo sapien
tcccgggtggatgaagccaggcgtc

SEQ ID NO: 139571 - DNA, 25 bp, Homo sapien
gtggatgaagccaggcgtcgccccc

SEQ ID NO: 139572 - DNA, 25 bp, Homo sapien
aaaaggcgaaggttctgatggctgc

SEQ ID NO: 139573 - DNA, 25 bp, Homo sapien
gaaggttctgatggctgccttgctc

SEQ ID NO: 139574 - DNA, 25 bp, Homo sapien
gaggacttctctaggaagtccttcc

SEQ ID NO: 139575 - DNA, 25 bp, Homo sapien
aggaagtccttcctgactacctgtg

SEQ ID NO: 139576 - DNA, 25 bp, Homo sapien
ctgtgcccagagtgcccctacatga

SEQ ID NO: 139577 - DNA, 25 bp, Homo sapien
gagtgcccctacatgagactgtatg

SEQ ID NO: 139578 - DNA, 25 bp, Homo sapien
acatgagactgtatgccctgctatc

SEQ ID NO: 139579 - DNA, 25 bp, Homo sapien
agactgtatgccctgctatcagatg

SEQ ID NO: 139580 - DNA, 25 bp, Homo sapien
tatgccctgctatcagatgccagat

SEQ ID NO: 139581 - DNA, 25 bp, Homo sapien
gatgccagatctatgtgtctgtctg

SEQ ID NO: 139582 - DNA, 25 bp, Homo sapien
gactaacctccaggcatggactgaa

SEQ ID NO: 139583 - DNA, 25 bp, Homo sapien
attatatttctgagtgaccagacga

SEQ ID NO: 139584 - DNA, 25 bp, Homo sapien
atttctgagtgaccagacgaaagag

SEQ ID NO: 139585 - DNA, 25 bp, Homo sapien
gaaaggatgattcttctttggccat

SEQ ID NO: 139586 - DNA, 25 bp, Homo sapien
aaggatgattcttctttggccatca

SEQ ID NO: 139587 - DNA, 25 bp, Homo sapien
ggatgattcttctttggccatcatt

SEQ ID NO: 139588 - DNA, 25 bp, Homo sapien
ttcttctttggccatcatttggtac

SEQ ID NO: 139589 - DNA, 25 bp, Homo sapien
tctttggccatcatttggtacagtc

SEQ ID NO: 139590 - DNA, 25 bp, Homo sapien
ggtacagtctcatttccaagtcatg

SEQ ID NO: 139591 - DNA, 25 bp, Homo sapien
acagtctcatttccaagtcatgtat

SEQ ID NO: 139592 - DNA, 25 bp, Homo sapien
gtctcatttccaagtcatgtataat

SEQ ID NO: 139593 - DNA, 25 bp, Homo sapien
gtcatgtataatctttatggcttcc

SEQ ID NO: 139594 - DNA, 25 bp, Homo sapien
tctatccatcgtcttcattttgtgt

SEQ ID NO: 139595 - DNA, 25 bp, Homo sapien
cattttgtgtgtacagtgctgtgtg

SEQ ID NO: 139596 - DNA, 25 bp, Homo sapien
gtgtgtaagcttatcagtgtgtttt

SEQ ID NO: 139597 - DNA, 25 bp, Homo sapien
gaaagtcctgttaggtatccagagt

SEQ ID NO: 139598 - DNA, 25 bp, Homo sapien
atccagagttctatttatctagctg

SEQ ID NO: 139599 - DNA, 25 bp, Homo sapien
tatctagctgtacagactctttcag

SEQ ID NO: 139600 - DNA, 25 bp, Homo sapien
agaggtttaacgtgctgcttccgat

SEQ ID NO: 139601 - DNA, 25 bp, Homo sapien
ttccgatgtgccacctgcagtagtg

SEQ ID NO: 139602 - DNA, 25 bp, Homo sapien
cctgcagtagtggatcatgtggagt

SEQ ID NO: 139603 - DNA, 25 bp, Homo sapien
taatgtataaactctcaccacagga

SEQ ID NO: 139604 - DNA, 25 bp, Homo sapien
tcaccacaggaagcatcgctgtttc

SEQ ID NO: 139605 - DNA, 25 bp, Homo sapien
gcactcacaatatctgctatgctgt

SEQ ID NO: 139606 - DNA, 25 bp, Homo sapien
atctgctatgctgtagtgctaggat

SEQ ID NO: 139607 - DNA, 25 bp, Homo sapien
gtgctaggattgattatgtgttctc

SEQ ID NO: 139608 - DNA, 25 bp, Homo sapien
tatgtgttctccaaagatgctgctc

SEQ ID NO: 139609 - DNA, 25 bp, Homo sapien
caagggctgccaagtgtttgccagg

SEQ ID NO: 139610 - DNA, 25 bp, Homo sapien
gtttgccagggaacggtagatttat

SEQ ID NO: 139611 - DNA, 25 bp, Homo sapien
attccccaactcttaactgaaaatg

SEQ ID NO: 139612 - DNA, 25 bp, Homo sapien
aggattgttacaagcccctgatctg

SEQ ID NO: 139613 - DNA, 25 bp, Homo sapien
cggtctgcaaccaaactctaattca

SEQ ID NO: 139614 - DNA, 25 bp, Homo sapien
aactctaattcaacctgccagaagg

SEQ ID NO: 139615 - DNA, 25 bp, Homo sapien
agaggaagtctttgtcagcccttat

SEQ ID NO: 139616 - DNA, 25 bp, Homo sapien
taaaattaattgtagactccaggat

SEQ ID NO: 139617 - DNA, 25 bp, Homo sapien
ttgtagactccaggatacaaaccat

SEQ ID NO: 139618 - DNA, 25 bp, Homo sapien
ggatacaaaccatagtaggcaatac

SEQ ID NO: 139619 - DNA, 25 bp, Homo sapien
cagtggattgaatgtctttttattt

SEQ ID NO: 139620 - DNA, 25 bp, Homo sapien
tttacattcattaaggtgcctcgtt

SEQ ID NO: 139621 - DNA, 25 bp, Homo sapien
taaggtgcctcgtttttgactttgt

SEQ ID NO: 139622 - DNA, 25 bp, Homo sapien
gactttgtccattaacatttatcca

SEQ ID NO: 139623 - DNA, 25 bp, Homo sapien
acatttatccatatgcctttgcaat

SEQ ID NO: 139624 - DNA, 25 bp, Homo sapien
atgcctttgcaataactagattgtg

SEQ ID NO: 139625 - DNA, 25 bp, Homo sapien
aatccattgtttgaggtgcttgcag

SEQ ID NO: 139626 - DNA, 25 bp, Homo sapien
gaggtgcttgcagttgtcttaaaaa

SEQ ID NO: 139627 - DNA, 25 bp, Homo sapien
agcgcaaccgaccatactgatgact

SEQ ID NO: 139628 - DNA, 25 bp, Homo sapien
caaccgaccatactgatgactgttt

SEQ ID NO: 139629 - DNA, 25 bp, Homo sapien
tgaatgttcctttgtctctgacatg

SEQ ID NO: 139630 - DNA, 25 bp, Homo sapien
agtgaaattgccagagttttgcctg

SEQ ID NO: 139631 - DNA, 25 bp, Homo sapien
attgccagagttttgcctggtgctc

SEQ ID NO: 139632 - DNA, 25 bp, Homo sapien
agagttttgcctggtgctctcctcg

SEQ ID NO: 139633 - DNA, 25 bp, Homo sapien
ttttgcctggtgctctcctcgtggc

SEQ ID NO: 139634 - DNA, 25 bp, Homo sapien
ctcgtggcctcttcttgggtagtga

SEQ ID NO: 139635 - DNA, 25 bp, Homo sapien
gtggcctcttcttgggtagtgaaat

SEQ ID NO: 139636 - DNA, 25 bp, Homo sapien
gcctcttcttgggtagtgaaattaa

SEQ ID NO: 139637 - DNA, 25 bp, Homo sapien
aacccttggagctaaatgcgttgta

SEQ ID NO: 139638 - DNA, 25 bp, Homo sapien
gcccagttgacacctactggtgact

SEQ ID NO: 139639 - DNA, 25 bp, Homo sapien
gacacctactggtgacttctagggc

SEQ ID NO: 139640 - DNA, 25 bp, Homo sapien
aatagcgctgagttgggtttgtgac

SEQ ID NO: 139641 - DNA, 25 bp, Homo sapien
tgcctcacaggattgtgactcccca

SEQ ID NO: 139642 - DNA, 25 bp, Homo sapien
ttcagacccctcaggtagcagcagg

SEQ ID NO: 139643 - DNA, 25 bp, Homo sapien
tgatcttggccccttggatctgaga

SEQ ID NO: 139644 - DNA, 25 bp, Homo sapien
ggccccttggatctgagatggtttt

SEQ ID NO: 139645 - DNA, 25 bp, Homo sapien
ggtttttgcatctttccaggagagc

SEQ ID NO: 139646 - DNA, 25 bp, Homo sapien
atctttccaggagagcctcacattc

SEQ ID NO: 139647 - DNA, 25 bp, Homo sapien
gagttagcatatcccaggctcgcag

SEQ ID NO: 139648 - DNA, 25 bp, Homo sapien
ctcgcagactcaacacagcaagggt

SEQ ID NO: 139649 - DNA, 25 bp, Homo sapien
tggctatctttactttgttctggga

SEQ ID NO: 139650 - DNA, 25 bp, Homo sapien
atctttactttgttctgggagctga

SEQ ID NO: 139651 - DNA, 25 bp, Homo sapien
ttactttgttctgggagctgatcat

SEQ ID NO: 139652 - DNA, 25 bp, Homo sapien
ggagctgatcatgataacctgcaga

SEQ ID NO: 139653 - DNA, 25 bp, Homo sapien
gatcatgataacctgcagacctgat

SEQ ID NO: 139654 - DNA, 25 bp, Homo sapien
ataacctgcagacctgatcaagcct

SEQ ID NO: 139655 - DNA, 25 bp, Homo sapien
tgcagacctgatcaagcctctgtgc

SEQ ID NO: 139656 - DNA, 25 bp, Homo sapien
cagacctgatcaagcctctgtgcct

SEQ ID NO: 139657 - DNA, 25 bp, Homo sapien
cagtttctctctcaggataaagagt

SEQ ID NO: 139658 - DNA, 25 bp, Homo sapien
atagaggccgaagggtgaatttctt

SEQ ID NO: 139659 - DNA, 25 bp, Homo sapien
attatacataaaacactctgatatt

SEQ ID NO: 139660 - DNA, 25 bp, Homo sapien
tactttctaaatgcctttgacccag

SEQ ID NO: 139661 - DNA, 25 bp, Homo sapien
tttgacccaggaaccgattatctat

SEQ ID NO: 139662 - DNA, 25 bp, Homo sapien
cgattatctatatttgttcccattt

SEQ ID NO: 139663 - DNA, 25 bp, Homo sapien
ttgttcccattttccttcaccgtga

SEQ ID NO: 139664 - DNA, 25 bp, Homo sapien
cttcaccgtgacattccagcattgt

SEQ ID NO: 139665 - DNA, 25 bp, Homo sapien
attccagcattgtctgactgtgagg

SEQ ID NO: 139666 - DNA, 25 bp, Homo sapien
aggttcctcaaaacaggcctgagcg

SEQ ID NO: 139667 - DNA, 25 bp, Homo sapien
acaggcctgagcgatgggcatcaca

SEQ ID NO: 139668 - DNA, 25 bp, Homo sapien
ttacctgccagataaccaagtgaga

SEQ ID NO: 139669 - DNA, 25 bp, Homo sapien
gatgtctgcgagtggctagttttca

SEQ ID NO: 139670 - DNA, 25 bp, Homo sapien
gtggctagttttcacattcttacta

SEQ ID NO: 139671 - DNA, 25 bp, Homo sapien
atgatggtgcccactcggcccggaa

SEQ ID NO: 139672 - DNA, 25 bp, Homo sapien
ggcccggaatgactcgaccagacag

SEQ ID NO: 139673 - DNA, 25 bp, Homo sapien
ggaggccttattgtatcggttttat

SEQ ID NO: 139674 - DNA, 25 bp, Homo sapien
atcggttttatattacctgttctgc

SEQ ID NO: 139675 - DNA, 25 bp, Homo sapien
ttatattacctgttctgcttcacca

SEQ ID NO: 139676 - DNA, 25 bp, Homo sapien
tacctgttctgcttcaccaggagat

SEQ ID NO: 139677 - DNA, 25 bp, Homo sapien
tcatgctgctgtgatactgagtttt

SEQ ID NO: 139678 - DNA, 25 bp, Homo sapien
gctgctgtgatactgagttttctaa

SEQ ID NO: 139679 - DNA, 25 bp, Homo sapien
gatactgagttttctaaacagcata

SEQ ID NO: 139680 - DNA, 25 bp, Homo sapien
ataaggaagacttgctcccctgtcc

SEQ ID NO: 139681 - DNA, 25 bp, Homo sapien
ttgctcccctgtcctatgaaagaga

SEQ ID NO: 139682 - DNA, 25 bp, Homo sapien
tattttttaggttaactgagctgct

SEQ ID NO: 139683 - DNA, 25 bp, Homo sapien
ttttaggttaactgagctgctttgt

SEQ ID NO: 139684 - DNA, 25 bp, Homo sapien
tgctttgtgctcagaatctacattc

SEQ ID NO: 139685 - DNA, 25 bp, Homo sapien
gctttgtgctcagaatctacattcc

SEQ ID NO: 139686 - DNA, 25 bp, Homo sapien
tttgtgctcagaatctacattccag

SEQ ID NO: 139687 - DNA, 25 bp, Homo sapien
tgtgctcagaatctacattccagat

SEQ ID NO: 139688 - DNA, 25 bp, Homo sapien
gtgctcagaatctacattccagatt

SEQ ID NO: 139689 - DNA, 25 bp, Homo sapien
gctcagaatctacattccagattga

SEQ ID NO: 139690 - DNA, 25 bp, Homo sapien
gaatctacattccagattgaggatt

SEQ ID NO: 139691 - DNA, 25 bp, Homo sapien
ttctgtctttgtggggttcgctcta

SEQ ID NO: 139692 - DNA, 25 bp, Homo sapien
tgtggggttcgctctactatggaga

SEQ ID NO: 139693 - DNA, 25 bp, Homo sapien
acgttttggagagagcaatcttgct

SEQ ID NO: 139694 - DNA, 25 bp, Homo sapien
ataaggctgactcttactaaccacc

SEQ ID NO: 139695 - DNA, 25 bp, Homo sapien
ggctgactcttactaaccaccattt

SEQ ID NO: 139696 - DNA, 25 bp, Homo sapien
atttcccctgtggtttgttatcagt

SEQ ID NO: 139697 - DNA, 25 bp, Homo sapien
tcccctgtggtttgttatcagtaca

SEQ ID NO: 139698 - DNA, 25 bp, Homo sapien
tacaattctttgttgcttaatctag

SEQ ID NO: 139699 - DNA, 25 bp, Homo sapien
gttgcttaatctagagctatgcaca

SEQ ID NO: 139700 - DNA, 25 bp, Homo sapien
agagctatgcacaccaaattgctga

SEQ ID NO: 139701 - DNA, 25 bp, Homo sapien
gcacaccaaattgctgagatgttta

SEQ ID NO: 139702 - DNA, 25 bp, Homo sapien
gcatgtaatattaaattcctcctgt

SEQ ID NO: 139703 - DNA, 25 bp, Homo sapien
cctctgtcagtttgtgaagtgattg

SEQ ID NO: 139704 - DNA, 25 bp, Homo sapien
gtgagtgaatcaggcaaagtgctta

SEQ ID NO: 139705 - DNA, 25 bp, Homo sapien
aaagtgcttataatgtgtgttgtgt

SEQ ID NO: 139706 - DNA, 25 bp, Homo sapien
aatgtgtgttgtgtgagcgtggcct

SEQ ID NO: 139707 - DNA, 25 bp, Homo sapien
tggccttgggaggacatgcgtgtgt

SEQ ID NO: 139708 - DNA, 25 bp, Homo sapien
cagggatgagttgaggtgatatttt

SEQ ID NO: 139709 - DNA, 25 bp, Homo sapien
tatttttatgtgcagcgacccttgg

SEQ ID NO: 139710 - DNA, 25 bp, Homo sapien
tatgtgcagcgacccttggtgtttc

SEQ ID NO: 139711 - DNA, 25 bp, Homo sapien
ttggtgtttcccttcctcggtggct

SEQ ID NO: 139712 - DNA, 25 bp, Homo sapien
gtatgtcagtggtttctacttcccc

SEQ ID NO: 139713 - DNA, 25 bp, Homo sapien
gtcagtggtttctacttcccctggg

SEQ ID NO: 139714 - DNA, 25 bp, Homo sapien
gatgctgacccaggaatagtggaca

SEQ ID NO: 139715 - DNA, 25 bp, Homo sapien
agagtgtccttaccttctattcata

SEQ ID NO: 139716 - DNA, 25 bp, Homo sapien
atgttctatacagtggacagccctc

SEQ ID NO: 139717 - DNA, 25 bp, Homo sapien
tggacagccctccagaatggtactt

SEQ ID NO: 139718 - DNA, 25 bp, Homo sapien
gaatggtacttcagtgcctagtgta

SEQ ID NO: 139719 - DNA, 25 bp, Homo sapien
gcctagtgtagtaacctgaaatctt

SEQ ID NO: 139720 - DNA, 25 bp, Homo sapien
acaatggcgaatggtgacttttctt

SEQ ID NO: 139721 - DNA, 25 bp, Homo sapien
gacttttctttcacgatttcattaa

SEQ ID NO: 139722 - DNA, 25 bp, Homo sapien
agcacacaggaaagcttgctccatt

SEQ ID NO: 139723 - DNA, 25 bp, Homo sapien
agcttgctccattgataacgtgtat

SEQ ID NO: 139724 - DNA, 25 bp, Homo sapien
taacgtgtatggagacttcggtttt

SEQ ID NO: 139725 - DNA, 25 bp, Homo sapien
cttcggttttagtcaattccatatc

SEQ ID NO: 139726 - DNA, 25 bp, Homo sapien
acatggtttttgtggaaatcattat

SEQ ID NO: 139727 - DNA, 25 bp, Homo sapien
ttgtggaaatcattatatgtttgct

SEQ ID NO: 139728 - DNA, 25 bp, Homo sapien
atgtttgctttagattttgttctgt

SEQ ID NO: 139729 - DNA, 25 bp, Homo sapien
tttgttctgttttcaccatcataac

SEQ ID NO: 139730 - DNA, 25 bp, Homo sapien
gttttcaccatcataacacttaagt

SEQ ID NO: 139731 - DNA, 25 bp, Homo sapien
gtttttaattatctcgaaggccaag

SEQ ID NO: 139732 - DNA, 25 bp, Homo sapien
aattatctcgaaggccaagcattgc

SEQ ID NO: 139733 - DNA, 25 bp, Homo sapien
atctcgaaggccaagcattgcattt

SEQ ID NO: 139734 - DNA, 25 bp, Homo sapien
gaaggccaagcattgcatttgtaaa

SEQ ID NO: 139735 - DNA, 25 bp, Homo sapien
ttgcatttgtaaacagtcctggtca

SEQ ID NO: 139736 - DNA, 25 bp, Homo sapien
tcctggtcagtagttaaataatgtt

SEQ ID NO: 139737 - DNA, 25 bp, Homo sapien
ccagggatgctttacagggatttaa

SEQ ID NO: 139738 - DNA, 25 bp, Homo sapien
ggatttaagatcacaccgtcccatg

SEQ ID NO: 139739 - DNA, 25 bp, Homo sapien
acaccgtcccatgctatgaagatca

SEQ ID NO: 139740 - DNA, 25 bp, Homo sapien
atgaagatcacctatgccaagaaat

SEQ ID NO: 139741 - DNA, 25 bp, Homo sapien
taacatttgggatagtcgtctttaa

SEQ ID NO: 139742 - DNA, 25 bp, Homo sapien
agacttggtgttatttacagtgttt

SEQ ID NO: 139743 - DNA, 25 bp, Homo sapien
gttttgataacatttggctgggtca

SEQ ID NO: 139744 - DNA, 25 bp, Homo sapien
tttggctgggtcattttaatagtta

SEQ ID NO: 139745 - DNA, 25 bp, Homo sapien
attatccagtgtttctttagccttg

SEQ ID NO: 139746 - DNA, 25 bp, Homo sapien
gtttctttagccttggtgaactatg

SEQ ID NO: 139747 - DNA, 25 bp, Homo sapien
gtgaactatgaaatacgaaggcctt

SEQ ID NO: 139748 - DNA, 25 bp, Homo sapien
ctaggctccctgaggtacctttcca

SEQ ID NO: 139749 - DNA, 25 bp, Homo sapien
ataagccctgagactcccgcctttg

SEQ ID NO: 139750 - DNA, 25 bp, Homo sapien
agactcccgcctttgacctgacgat

SEQ ID NO: 139751 - DNA, 25 bp, Homo sapien
ttcaggttcctcctaggcgctcaga

SEQ ID NO: 139752 - DNA, 25 bp, Homo sapien
aggttcctcctaggcgctcagaggc

SEQ ID NO: 139753 - DNA, 25 bp, Homo sapien
tcctaggcgctcagaggccgctctg

SEQ ID NO: 139754 - DNA, 25 bp, Homo sapien
cgcggcaagccagcccgtgcaacgg

SEQ ID NO: 139755 - DNA, 25 bp, Homo sapien
gcaacggaagccaggccaactgccc

SEQ ID NO: 139756 - DNA, 25 bp, Homo sapien
aactgccccgcgtcttcagctgttt

SEQ ID NO: 139757 - DNA, 25 bp, Homo sapien
cgcgtcttcagctgtttcgcatcca

SEQ ID NO: 139758 - DNA, 25 bp, Homo sapien
gtcttcagctgtttcgcatccaccg

SEQ ID NO: 139759 - DNA, 25 bp, Homo sapien
gttaaagccacctctataattgatt

SEQ ID NO: 139760 - DNA, 25 bp, Homo sapien
aagccacctctataattgattggac

SEQ ID NO: 139761 - DNA, 25 bp, Homo sapien
tgtttttccccatgaaccacagttt

SEQ ID NO: 139762 - DNA, 25 bp, Homo sapien
ctaggggttatttctgtgccagaca

SEQ ID NO: 139763 - DNA, 25 bp, Homo sapien
agacacattccacctctccagtatt

SEQ ID NO: 139764 - DNA, 25 bp, Homo sapien
attccacctctccagtattgcagga

SEQ ID NO: 139765 - DNA, 25 bp, Homo sapien
cacctctccagtattgcaggacgga

SEQ ID NO: 139766 - DNA, 25 bp, Homo sapien
tctccagtattgcaggacggaatat

SEQ ID NO: 139767 - DNA, 25 bp, Homo sapien
gcaggacggaatatatgtgttaatg

SEQ ID NO: 139768 - DNA, 25 bp, Homo sapien
tttttctttcttcagagtactctgt

SEQ ID NO: 139769 - DNA, 25 bp, Homo sapien
agtactctgtacaataaatgcagtt

SEQ ID NO: 139770 - DNA, 25 bp, Homo sapien
ccgagaccggccaaagccaagccag

SEQ ID NO: 139771 - DNA, 25 bp, Homo sapien
cacccttaagcttcctctgacggtt

SEQ ID NO: 139772 - DNA, 25 bp, Homo sapien
ttaagcttcctctgacggttaccct

SEQ ID NO: 139773 - DNA, 25 bp, Homo sapien
ccaacgatgccaatcacgacaactt

SEQ ID NO: 139774 - DNA, 25 bp, Homo sapien
gatgccaatcacgacaactttccag

SEQ ID NO: 139775 - DNA, 25 bp, Homo sapien
tgccaatcacgacaactttccagca

SEQ ID NO: 139776 - DNA, 25 bp, Homo sapien
aatcacgacaactttccagcacact

SEQ ID NO: 139777 - DNA, 25 bp, Homo sapien
ggacacacccagatgccccagggac

SEQ ID NO: 139778 - DNA, 25 bp, Homo sapien
gggaaggcagcctggtttctcctgc

SEQ ID NO: 139779 - DNA, 25 bp, Homo sapien
gggtcctgccccctgctttgacaat

SEQ ID NO: 139780 - DNA, 25 bp, Homo sapien
acaatcagccatcctcgtctgctct

SEQ ID NO: 139781 - DNA, 25 bp, Homo sapien
ggtctggccgtacttgtgatttcga

SEQ ID NO: 139782 - DNA, 25 bp, Homo sapien
tttccgtcaacgttgtactgtatgt

SEQ ID NO: 139783 - DNA, 25 bp, Homo sapien
gtactgtatgtgatgaattgcgttg

SEQ ID NO: 139784 - DNA, 25 bp, Homo sapien
aattgcgttggtctctgcatttttc

SEQ ID NO: 139785 - DNA, 25 bp, Homo sapien
tttctgcagaagaggagtaaccgct

SEQ ID NO: 139786 - DNA, 25 bp, Homo sapien
ccaggtaccttgacctttgtacagc

SEQ ID NO: 139787 - DNA, 25 bp, Homo sapien
gtaccttgacctttgtacagcccag

SEQ ID NO: 139788 - DNA, 25 bp, Homo sapien
gcccagaggccaacactgtgggtgt

SEQ ID NO: 139789 - DNA, 25 bp, Homo sapien
actgtgggtgtgtgactctttagca

SEQ ID NO: 139790 - DNA, 25 bp, Homo sapien
tgggtgtgtgactctttagcaaaaa

SEQ ID NO: 139791 - DNA, 25 bp, Homo sapien
aaaaacccatgtggtgatgatgtgt

SEQ ID NO: 139792 - DNA, 25 bp, Homo sapien
ttgctgccactgaccaccaggtaga

SEQ ID NO: 139793 - DNA, 25 bp, Homo sapien
tgaccaccaggtagacagcgcaatc

SEQ ID NO: 139794 - DNA, 25 bp, Homo sapien
gacagcgcaatctgtggagctttta

SEQ ID NO: 139795 - DNA, 25 bp, Homo sapien
gcaatctgtggagcttttactctgt

SEQ ID NO: 139796 - DNA, 25 bp, Homo sapien
tggagcttttactctgttgtgaggg

SEQ ID NO: 139797 - DNA, 25 bp, Homo sapien
gaagagactgcattgtggccccaga

SEQ ID NO: 139798 - DNA, 25 bp, Homo sapien
gcattgtggccccagacttttaaaa

SEQ ID NO: 139799 - DNA, 25 bp, Homo sapien
ttgtggccccagacttttaaaacag

SEQ ID NO: 139800 - DNA, 25 bp, Homo sapien
ttaaaacagcactaaataacttggg

SEQ ID NO: 139801 - DNA, 25 bp, Homo sapien
gaaatgaaaaccctgttgctgcgtc

SEQ ID NO: 139802 - DNA, 25 bp, Homo sapien
aaaccctgttgctgcgtcactgtgt

SEQ ID NO: 139803 - DNA, 25 bp, Homo sapien
acttctctaagtgccaaaaacagtg

SEQ ID NO: 139804 - DNA, 25 bp, Homo sapien
tctctaagtgccaaaaacagtgtca

SEQ ID NO: 139805 - DNA, 25 bp, Homo sapien
tgtgttcctttcttgatacttagtc

SEQ ID NO: 139806 - DNA, 25 bp, Homo sapien
gttcctttcttgatacttagtcatg

SEQ ID NO: 139807 - DNA, 25 bp, Homo sapien
ttcttgatacttagtcatgggagga

SEQ ID NO: 139808 - DNA, 25 bp, Homo sapien
tttcagagtagctcactttagtcct

SEQ ID NO: 139809 - DNA, 25 bp, Homo sapien
agagtagctcactttagtcctgtaa

SEQ ID NO: 139810 - DNA, 25 bp, Homo sapien
gtagctcactttagtcctgtaactt

SEQ ID NO: 139811 - DNA, 25 bp, Homo sapien
gctcactttagtcctgtaactttat

SEQ ID NO: 139812 - DNA, 25 bp, Homo sapien
ttgtgttcagtgtaattgtcttctc

SEQ ID NO: 139813 - DNA, 25 bp, Homo sapien
tgcctcacctggttaaaaaagaaca

SEQ ID NO: 139814 - DNA, 25 bp, Homo sapien
acatcagcgaggacccgagctgggc

SEQ ID NO: 139815 - DNA, 25 bp, Homo sapien
gagctgggcccgtgtggtcaacctc

SEQ ID NO: 139816 - DNA, 25 bp, Homo sapien
gggcccgtgtggtcaacctcaatgc

SEQ ID NO: 139817 - DNA, 25 bp, Homo sapien
tcaatgccctgctcatgatggcagt

SEQ ID NO: 139818 - DNA, 25 bp, Homo sapien
catgatggcagtggccgtgttcctc

SEQ ID NO: 139819 - DNA, 25 bp, Homo sapien
gggcttctatgcctaagaccaactg

SEQ ID NO: 139820 - DNA, 25 bp, Homo sapien
tctatgcctaagaccaactgcgttg

SEQ ID NO: 139821 - DNA, 25 bp, Homo sapien
actgcgttggacaccataagccaca

SEQ ID NO: 139822 - DNA, 25 bp, Homo sapien
gggcccactgcatctgattggcagt

SEQ ID NO: 139823 - DNA, 25 bp, Homo sapien
actgcatctgattggcagtcacttc

SEQ ID NO: 139824 - DNA, 25 bp, Homo sapien
gcagtcacttcccatgagggcctgg

SEQ ID NO: 139825 - DNA, 25 bp, Homo sapien
acctgagaactcctcttgtaatttc

SEQ ID NO: 139826 - DNA, 25 bp, Homo sapien
gagaactcctcttgtaatttcaaca

SEQ ID NO: 139827 - DNA, 25 bp, Homo sapien
acacacccaaaatcaagggcctgga

SEQ ID NO: 139828 - DNA, 25 bp, Homo sapien
aagcaggtttttcctccctgttgag

SEQ ID NO: 139829 - DNA, 25 bp, Homo sapien
tttttcctccctgttgagcaagaca

SEQ ID NO: 139830 - DNA, 25 bp, Homo sapien
ggcaagataggacttggctttctta

SEQ ID NO: 139831 - DNA, 25 bp, Homo sapien
ggctttcttacatgatgcggtaact

SEQ ID NO: 139832 - DNA, 25 bp, Homo sapien
tgcggtaacttgtgacttgagtctt

SEQ ID NO: 139833 - DNA, 25 bp, Homo sapien
atagctgagctttctaaaatgatag

SEQ ID NO: 139834 - DNA, 25 bp, Homo sapien
atgtattttattgcctctgagtatc

SEQ ID NO: 139835 - DNA, 25 bp, Homo sapien
ttgcctctgagtatcatattaaatg

SEQ ID NO: 139836 - DNA, 25 bp, Homo sapien
gaatgaagccaactaaaattctgaa

SEQ ID NO: 139837 - DNA, 25 bp, Homo sapien
tgctttttgttggatttcgtagggt

SEQ ID NO: 139838 - DNA, 25 bp, Homo sapien
aggctggtcttaactgactgctttt

SEQ ID NO: 139839 - DNA, 25 bp, Homo sapien
ggtcttaactgactgctttttatta

SEQ ID NO: 139840 - DNA, 25 bp, Homo sapien
tttattattaccatgcactggcaat

SEQ ID NO: 139841 - DNA, 25 bp, Homo sapien
attaccatgcactggcaattccaaa

SEQ ID NO: 139842 - DNA, 25 bp, Homo sapien
gcactggcaattccaaacaatgtca

SEQ ID NO: 139843 - DNA, 25 bp, Homo sapien
aaatgcttctccctgaaaaagagaa

SEQ ID NO: 139844 - DNA, 25 bp, Homo sapien
ctcttattggcctaagttctaaata

SEQ ID NO: 139845 - DNA, 25 bp, Homo sapien
taaataatagctaggttaccactga

SEQ ID NO: 139846 - DNA, 25 bp, Homo sapien
ggttaccactgagttttaactatat

SEQ ID NO: 139847 - DNA, 25 bp, Homo sapien
ttgtgaacccaacggaagcgtagtt

SEQ ID NO: 139848 - DNA, 25 bp, Homo sapien
aaggccattggctaattgcacgtgt

SEQ ID NO: 139849 - DNA, 25 bp, Homo sapien
gcacgtgtgtattgcaatgggaaat

SEQ ID NO: 139850 - DNA, 25 bp, Homo sapien
atagcctggtgtgattgatgtgagc

SEQ ID NO: 139851 - DNA, 25 bp, Homo sapien
gatgtgagcttggacttgcattccc

SEQ ID NO: 139852 - DNA, 25 bp, Homo sapien
ttggacttgcattcccttatgatgg

SEQ ID NO: 139853 - DNA, 25 bp, Homo sapien
ggatgaagattgaaccctggctgaa

SEQ ID NO: 139854 - DNA, 25 bp, Homo sapien
gaaccctggctgaactttgttggct

SEQ ID NO: 139855 - DNA, 25 bp, Homo sapien
aactttgttggctgtggaagaggcc

SEQ ID NO: 139856 - DNA, 25 bp, Homo sapien
gaggccaatcctatggcagagcatt

SEQ ID NO: 139857 - DNA, 25 bp, Homo sapien
tatccaaagcataggaaggctctat

SEQ ID NO: 139858 - DNA, 25 bp, Homo sapien
atatcctggtgcgatgatgggcctg

SEQ ID NO: 139859 - DNA, 25 bp, Homo sapien
gcgatgatgggcctggcaacatttt

SEQ ID NO: 139860 - DNA, 25 bp, Homo sapien
gatgggcctggcaacattttctact

SEQ ID NO: 139861 - DNA, 25 bp, Homo sapien
tcctaagaaataccaccctaccact

SEQ ID NO: 139862 - DNA, 25 bp, Homo sapien
taccaccctaccactaacaaaatgg

SEQ ID NO: 139863 - DNA, 25 bp, Homo sapien
ggtataaagaatctcccagccaggc

SEQ ID NO: 139864 - DNA, 25 bp, Homo sapien
tataaagaatctcccagccaggcca

SEQ ID NO: 139865 - DNA, 25 bp, Homo sapien
taaagaatctcccagccaggccaac

SEQ ID NO: 139866 - DNA, 25 bp, Homo sapien
gccaagtgtggtaatgttcacctgc

SEQ ID NO: 139867 - DNA, 25 bp, Homo sapien
gtgtggtaatgttcacctgcagtcc

SEQ ID NO: 139868 - DNA, 25 bp, Homo sapien
tggtaatgttcacctgcagtcccag

SEQ ID NO: 139869 - DNA, 25 bp, Homo sapien
gtgcagcgatgggacctcttttgcc

SEQ ID NO: 139870 - DNA, 25 bp, Homo sapien
cagcgatgggacctcttttgccgag

SEQ ID NO: 139871 - DNA, 25 bp, Homo sapien
cgatgggacctcttttgccgaggag

SEQ ID NO: 139872 - DNA, 25 bp, Homo sapien
atgggacctcttttgccgaggaggt

SEQ ID NO: 139873 - DNA, 25 bp, Homo sapien
ggaggtggaaaagcccaccaagtgt

SEQ ID NO: 139874 - DNA, 25 bp, Homo sapien
atagcgctgggcgtggacaggccgg

SEQ ID NO: 139875 - DNA, 25 bp, Homo sapien
agcagcggagacagtcgccagcagc

SEQ ID NO: 139876 - DNA, 25 bp, Homo sapien
cagcggagacagtcgccagcagctg

SEQ ID NO: 139877 - DNA, 25 bp, Homo sapien
agacagtcgccagcagctgggctgg

SEQ ID NO: 139878 - DNA, 25 bp, Homo sapien
ccagagcagccttttaaaagcaaat

SEQ ID NO: 139879 - DNA, 25 bp, Homo sapien
agagcagccttttaaaagcaaattg

SEQ ID NO: 139880 - DNA, 25 bp, Homo sapien
tctgaacatgctctcctgttggtgt

SEQ ID NO: 139881 - DNA, 25 bp, Homo sapien
gaacatgctctcctgttggtgtgta

SEQ ID NO: 139882 - DNA, 25 bp, Homo sapien
acatgctctcctgttggtgtgtatg

SEQ ID NO: 139883 - DNA, 25 bp, Homo sapien
tgctctcctgttggtgtgtatgtca

SEQ ID NO: 139884 - DNA, 25 bp, Homo sapien
tctcctgttggtgtgtatgtcacta

SEQ ID NO: 139885 - DNA, 25 bp, Homo sapien
atgcaggatccaaatcctcatctta

SEQ ID NO: 139886 - DNA, 25 bp, Homo sapien
ggatccaaatcctcatcttactttc

SEQ ID NO: 139887 - DNA, 25 bp, Homo sapien
tcatcttactttcccgaccttaagg

SEQ ID NO: 139888 - DNA, 25 bp, Homo sapien
ccgaccttaaggatgtagctgctgc

SEQ ID NO: 139889 - DNA, 25 bp, Homo sapien
accttaaggatgtagctgctgcttg

SEQ ID NO: 139890 - DNA, 25 bp, Homo sapien
gtgaggccaggcctgtagctcctac

SEQ ID NO: 139891 - DNA, 25 bp, Homo sapien
tgacatcggaaaaataatcccaagc

SEQ ID NO: 139892 - DNA, 25 bp, Homo sapien
aataatcccaagctatttaaagcat

SEQ ID NO: 139893 - DNA, 25 bp, Homo sapien
caagctatttaaagcatctataagg

SEQ ID NO: 139894 - DNA, 25 bp, Homo sapien
tctctttctgtcttctacagatgag

SEQ ID NO: 139895 - DNA, 25 bp, Homo sapien
ctctttctgtcttctacagatgagt

SEQ ID NO: 139896 - DNA, 25 bp, Homo sapien
cacctttgagcttaatcttgaaggt

SEQ ID NO: 139897 - DNA, 25 bp, Homo sapien
tgagcttaatcttgaaggttagaga

SEQ ID NO: 139898 - DNA, 25 bp, Homo sapien
ttgtttcctttttcagatatcttgg

SEQ ID NO: 139899 - DNA, 25 bp, Homo sapien
gtttcctttttcagatatcttggac

SEQ ID NO: 139900 - DNA, 25 bp, Homo sapien
tcctttttcagatatcttggacaaa

SEQ ID NO: 139901 - DNA, 25 bp, Homo sapien
tttcagatatcttggacaaatcaca

SEQ ID NO: 139902 - DNA, 25 bp, Homo sapien
atatctaccccatttggtgaagtga

SEQ ID NO: 139903 - DNA, 25 bp, Homo sapien
ggagaaattcgttgttcccactgaa

SEQ ID NO: 139904 - DNA, 25 bp, Homo sapien
ttgttcccactgaaatggactgact

SEQ ID NO: 139905 - DNA, 25 bp, Homo sapien
gactgactgtaacgattgacaccaa

SEQ ID NO: 139906 - DNA, 25 bp, Homo sapien
gacaccaaaatgaaccttgctatca

SEQ ID NO: 139907 - DNA, 25 bp, Homo sapien
cttgctatcaagaaatgctcgtcat

SEQ ID NO: 139908 - DNA, 25 bp, Homo sapien
aatgctcgtcatacagtaaactctg

SEQ ID NO: 139909 - DNA, 25 bp, Homo sapien
cagtaaactctggatgattcttcca

SEQ ID NO: 139910 - DNA, 25 bp, Homo sapien
gatgattcttccagataatgtcctt

SEQ ID NO: 139911 - DNA, 25 bp, Homo sapien
gtccttgctttacaaaccaaccatt

SEQ ID NO: 139912 - DNA, 25 bp, Homo sapien
ccaaccatttctagagagtctcctt

SEQ ID NO: 139913 - DNA, 25 bp, Homo sapien
gtacatgtgtaattataggctagct

SEQ ID NO: 139914 - DNA, 25 bp, Homo sapien
tatgcatttgaagccagtgtgatac

SEQ ID NO: 139915 - DNA, 25 bp, Homo sapien
gtgtgatacagccatctgtacctac

SEQ ID NO: 139916 - DNA, 25 bp, Homo sapien
atctgtacctactggagccgcagaa

SEQ ID NO: 139917 - DNA, 25 bp, Homo sapien
ggagccgcagaagggagtccactca

SEQ ID NO: 139918 - DNA, 25 bp, Homo sapien
gagtccactcagtcacatccagaaa

SEQ ID NO: 139919 - DNA, 25 bp, Homo sapien
agaagccatgtgattgatgtctgac

SEQ ID NO: 139920 - DNA, 25 bp, Homo sapien
tgatgtctgacgtgagtctgtctca

SEQ ID NO: 139921 - DNA, 25 bp, Homo sapien
agtctgtctcaggtagattccgggt

SEQ ID NO: 139922 - DNA, 25 bp, Homo sapien
agattccgggtgtcagtgtggttta

SEQ ID NO: 139923 - DNA, 25 bp, Homo sapien
tgttttagaaactttggtctccctg

SEQ ID NO: 139924 - DNA, 25 bp, Homo sapien
caatgctttctacctgaaatgtgta

SEQ ID NO: 139925 - DNA, 25 bp, Homo sapien
catgtcttcatcaaaatcctctcag

SEQ ID NO: 139926 - DNA, 25 bp, Homo sapien
tcctctcagtccttgttcttttgaa

SEQ ID NO: 139927 - DNA, 25 bp, Homo sapien
cttgttcttttgaagcttgtgctga

SEQ ID NO: 139928 - DNA, 25 bp, Homo sapien
gcttgtgctgaggttttagcttttc

SEQ ID NO: 139929 - DNA, 25 bp, Homo sapien
gtgctgaggttttagcttttctatg

SEQ ID NO: 139930 - DNA, 25 bp, Homo sapien
ttttatatgccgctgctttgaaaga

SEQ ID NO: 139931 - DNA, 25 bp, Homo sapien
gccgctgctttgaaagagaacctag

SEQ ID NO: 139932 - DNA, 25 bp, Homo sapien
gagaacctagattctatagttgtat

SEQ ID NO: 139933 - DNA, 25 bp, Homo sapien
atagttgtattattgttgtttcata

SEQ ID NO: 139934 - DNA, 25 bp, Homo sapien
ttatatggctgtggaaaaacgaatt

SEQ ID NO: 139935 - DNA, 25 bp, Homo sapien
ggaggttgtttccactaggagattt

SEQ ID NO: 139936 - DNA, 25 bp, Homo sapien
gaggttgtttccactaggagatttt

SEQ ID NO: 139937 - DNA, 25 bp, Homo sapien
gttgtttccactaggagatttttat

SEQ ID NO: 139938 - DNA, 25 bp, Homo sapien
ttgtttccactaggagatttttata

SEQ ID NO: 139939 - DNA, 25 bp, Homo sapien
tgtttccactaggagatttttataa

SEQ ID NO: 139940 - DNA, 25 bp, Homo sapien
gagatttttataaaccctctccagc

SEQ ID NO: 139941 - DNA, 25 bp, Homo sapien
gatttttataaaccctctccagcct

SEQ ID NO: 139942 - DNA, 25 bp, Homo sapien
tttttataaaccctctccagcctct

SEQ ID NO: 139943 - DNA, 25 bp, Homo sapien
aaaggaagcgttggcagcaaaggga

SEQ ID NO: 139944 - DNA, 25 bp, Homo sapien
tgagtgaagagaggaagcagcccca

SEQ ID NO: 139945 - DNA, 25 bp, Homo sapien
gagtgaagagaggaagcagccccag

SEQ ID NO: 139946 - DNA, 25 bp, Homo sapien
ctttatattttatggcattctagta

SEQ ID NO: 139947 - DNA, 25 bp, Homo sapien
attttatggcattctagtatttttg

SEQ ID NO: 139948 - DNA, 25 bp, Homo sapien
atttttgtgtactgtattttgtgca

SEQ ID NO: 139949 - DNA, 25 bp, Homo sapien
tgcatttcatgtcttcatcaaaatc

SEQ ID NO: 139950 - DNA, 25 bp, Homo sapien
gcatttcatgtcttcatcaaaatcc

SEQ ID NO: 139951 - DNA, 25 bp, Homo sapien
catgtcttcatcaaaatcctctcag

SEQ ID NO: 139952 - DNA, 25 bp, Homo sapien
atgtcttcatcaaaatcctctcagt

SEQ ID NO: 139953 - DNA, 25 bp, Homo sapien
tgtcttcatcaaaatcctctcagtc

SEQ ID NO: 139954 - DNA, 25 bp, Homo sapien
gtcttcatcaaaatcctctcagtcc

SEQ ID NO: 139955 - DNA, 25 bp, Homo sapien
tcttcatcaaaatcctctcagtcct

SEQ ID NO: 139956 - DNA, 25 bp, Homo sapien
ttcatcaaaatcctctcagtccttg

SEQ ID NO: 139957 - DNA, 25 bp, Homo sapien
tatcagaatcatcaagtcttggccg

SEQ ID NO: 139958 - DNA, 25 bp, Homo sapien
tcttggccgggaacacagacagggt

SEQ ID NO: 139959 - DNA, 25 bp, Homo sapien
acacagacagggtgtctacccaaga

SEQ ID NO: 139960 - DNA, 25 bp, Homo sapien
cacctatccccaacttagaatttgc

SEQ ID NO: 139961 - DNA, 25 bp, Homo sapien
gtaaactctatgaaaccagaaaccg

SEQ ID NO: 139962 - DNA, 25 bp, Homo sapien
agaaaccgaatctgcctcttgctgg

SEQ ID NO: 139963 - DNA, 25 bp, Homo sapien
gcctcttgctgggatctctaaaagt

SEQ ID NO: 139964 - DNA, 25 bp, Homo sapien
gataagcatcttaaagtcactcaat

SEQ ID NO: 139965 - DNA, 25 bp, Homo sapien
gtcactcaattcctgaactaatcaa

SEQ ID NO: 139966 - DNA, 25 bp, Homo sapien
cattactcaaatacccaaatcccat

SEQ ID NO: 139967 - DNA, 25 bp, Homo sapien
atcccattccaagttttgtgaccca

SEQ ID NO: 139968 - DNA, 25 bp, Homo sapien
gcaacagcagcacagtaaagggcat

SEQ ID NO: 139969 - DNA, 25 bp, Homo sapien
aagggcatacatttcctgctttcac

SEQ ID NO: 139970 - DNA, 25 bp, Homo sapien
atttcctgctttcaccaattaacca

SEQ ID NO: 139971 - DNA, 25 bp, Homo sapien
cttttggccagatagctaggtttct

SEQ ID NO: 139972 - DNA, 25 bp, Homo sapien
cagatagctaggtttctggttcccc

SEQ ID NO: 139973 - DNA, 25 bp, Homo sapien
ccccacagtaggtgttttcacataa

SEQ ID NO: 139974 - DNA, 25 bp, Homo sapien
gttttcacataagattagggtcctt

SEQ ID NO: 139975 - DNA, 25 bp, Homo sapien
aatctagtttattttgcatttggct

SEQ ID NO: 139976 - DNA, 25 bp, Homo sapien
ttttgcatttggctaattggtctgt

SEQ ID NO: 139977 - DNA, 25 bp, Homo sapien
gcatggttatatactcctggattat

SEQ ID NO: 139978 - DNA, 25 bp, Homo sapien
agtctctgtagacatctctgtgaag

SEQ ID NO: 139979 - DNA, 25 bp, Homo sapien
aaaagcaaactgatgtactggaaac

SEQ ID NO: 139980 - DNA, 25 bp, Homo sapien
gaaaagtatttcctccatactataa

SEQ ID NO: 139981 - DNA, 25 bp, Homo sapien
atttcctccatactataagttgtag

SEQ ID NO: 139982 - DNA, 25 bp, Homo sapien
tggaaatatatcacataacctttat

SEQ ID NO: 139983 - DNA, 25 bp, Homo sapien
ataacctttatacagaatcttccca

SEQ ID NO: 139984 - DNA, 25 bp, Homo sapien
tatacagaatcttcccatctcttaa

SEQ ID NO: 139985 - DNA, 25 bp, Homo sapien
cccatctcttaatatcatgtgttaa

SEQ ID NO: 139986 - DNA, 25 bp, Homo sapien
gaccttagtagtttgcaggctggac

SEQ ID NO: 139987 - DNA, 25 bp, Homo sapien
caggctggaccttaattggacttat

SEQ ID NO: 139988 - DNA, 25 bp, Homo sapien
tggaccttaattggacttattttct

SEQ ID NO: 139989 - DNA, 25 bp, Homo sapien
agtactttgttataaattcagtcag

SEQ ID NO: 139990 - DNA, 25 bp, Homo sapien
gttttgcaattcatatactgttttc

SEQ ID NO: 139991 - DNA, 25 bp, Homo sapien
actaaggtttgttcaggttgctgca

SEQ ID NO: 139992 - DNA, 25 bp, Homo sapien
gtttgttcaggttgctgcaagctca

SEQ ID NO: 139993 - DNA, 25 bp, Homo sapien
caagctcagctgaatctgtgagcct

SEQ ID NO: 139994 - DNA, 25 bp, Homo sapien
atctgtgagcctgaggtctgtttca

SEQ ID NO: 139995 - DNA, 25 bp, Homo sapien
tgaggtctgtttcaaatttctcccc

SEQ ID NO: 139996 - DNA, 25 bp, Homo sapien
atttctgaggtggttctaattcgct

SEQ ID NO: 139997 - DNA, 25 bp, Homo sapien
gttctaattcgctaggcaggcctga

SEQ ID NO: 139998 - DNA, 25 bp, Homo sapien
gcaggcctgagcgaatacaagttta

SEQ ID NO: 139999 - DNA, 25 bp, Homo sapien
agtttagcttgtccctgttgagtaa

SEQ ID NO: 140000 - DNA, 25 bp, Homo sapien
tagggcatgctacaatggataattt

SEQ ID NO: 140001 - DNA, 25 bp, Homo sapien
ggccaagtctgtagaaagctgtcat

SEQ ID NO: 140002 - DNA, 25 bp, Homo sapien
gattatgtagttcatccagcccttg

SEQ ID NO: 140003 - DNA, 25 bp, Homo sapien
cagcccttgggcattgttatacacc

SEQ ID NO: 140004 - DNA, 25 bp, Homo sapien
gggcattgttatacaccagtaaaga

SEQ ID NO: 140005 - DNA, 25 bp, Homo sapien
acaccagtaaagaaggctgtactca

SEQ ID NO: 140006 - DNA, 25 bp, Homo sapien
gctgtactcaagaggaggagctgac

SEQ ID NO: 140007 - DNA, 25 bp, Homo sapien
gaataagagcttttttgtttcttgg

SEQ ID NO: 140008 - DNA, 25 bp, Homo sapien
ctatgaaaggctcagatttcttgca

SEQ ID NO: 140009 - DNA, 25 bp, Homo sapien
tttcttgcagtttaaaatggtgtct

SEQ ID NO: 140010 - DNA, 25 bp, Homo sapien
aaatggtgtctgaggttgtactatt

SEQ ID NO: 140011 - DNA, 25 bp, Homo sapien
ggttgtactattttggccaagtctg

SEQ ID NO: 140012 - DNA, 25 bp, Homo sapien
gtaatgtgacttggattcaatttta

SEQ ID NO: 140013 - DNA, 25 bp, Homo sapien
gaatagccctatttatccttgttaa

SEQ ID NO: 140014 - DNA, 25 bp, Homo sapien
atagccctatttatccttgttaagt

SEQ ID NO: 140015 - DNA, 25 bp, Homo sapien
agccctatttatccttgttaagtat

SEQ ID NO: 140016 - DNA, 25 bp, Homo sapien
ttatccttgttaagtatcagctaca

SEQ ID NO: 140017 - DNA, 25 bp, Homo sapien
gtatcagctacaattgtaaactagt

SEQ ID NO: 140018 - DNA, 25 bp, Homo sapien
tgtaaactagttactaaacatgtat

SEQ ID NO: 140019 - DNA, 25 bp, Homo sapien
ttttctcaatgtttagcagatttaa

SEQ ID NO: 140020 - DNA, 25 bp, Homo sapien
gcagatttaagatatgtaacaacaa

SEQ ID NO: 140021 - DNA, 25 bp, Homo sapien
gatttaattacttcttagtatgtgc

SEQ ID NO: 140022 - DNA, 25 bp, Homo sapien
ttacttcttagtatgtgcatttaat

SEQ ID NO: 140023 - DNA, 25 bp, Homo sapien
atttcttctgttacaatagtgttgc

SEQ ID NO: 140024 - DNA, 25 bp, Homo sapien
aggttagagtgcacagtgtccccaa

SEQ ID NO: 140025 - DNA, 25 bp, Homo sapien
agtgtccccaattgttcctggcact

SEQ ID NO: 140026 - DNA, 25 bp, Homo sapien
tcctggcactgcaaaaccaaattaa

SEQ ID NO: 140027 - DNA, 25 bp, Homo sapien
aacaatcccacaaagaattctgaca

SEQ ID NO: 140028 - DNA, 25 bp, Homo sapien
ttctgacatcaatgtgttttcctca

SEQ ID NO: 140029 - DNA, 25 bp, Homo sapien
gttttcctcagtcaggtctatttca

SEQ ID NO: 140030 - DNA, 25 bp, Homo sapien
agtcaggtctatttcaagattctag

SEQ ID NO: 140031 - DNA, 25 bp, Homo sapien
ttaaaactcttcctcctaatgccat

SEQ ID NO: 140032 - DNA, 25 bp, Homo sapien
atcagatctcttaacattggctcac

SEQ ID NO: 140033 - DNA, 25 bp, Homo sapien
attggctcactgtgggatctttcct

SEQ ID NO: 140034 - DNA, 25 bp, Homo sapien
attgattttcagagaaatatcacaa

SEQ ID NO: 140035 - DNA, 25 bp, Homo sapien
gattttcagagaaatatcacaaatt

SEQ ID NO: 140036 - DNA, 25 bp, Homo sapien
ttttcagagaaatatcacaaattag

SEQ ID NO: 140037 - DNA, 25 bp, Homo sapien
tttcagagaaatatcacaaattaga

SEQ ID NO: 140038 - DNA, 25 bp, Homo sapien
cagagaaatatcacaaattagaaat

SEQ ID NO: 140039 - DNA, 25 bp, Homo sapien
aatctaaggatgaaaggtatatata

SEQ ID NO: 140040 - DNA, 25 bp, Homo sapien
aaacaatttgggggccaggcacgat

SEQ ID NO: 140041 - DNA, 25 bp, Homo sapien
cgggtgtggtggcacttctctgtaa

SEQ ID NO: 140042 - DNA, 25 bp, Homo sapien
gtggtggcacttctctgtaatctca

SEQ ID NO: 140043 - DNA, 25 bp, Homo sapien
gtggcacttctctgtaatctcagct

SEQ ID NO: 140044 - DNA, 25 bp, Homo sapien
cttctctgtaatctcagcttctcag

SEQ ID NO: 140045 - DNA, 25 bp, Homo sapien
atcaacctaggtctacagccagtgg

SEQ ID NO: 140046 - DNA, 25 bp, Homo sapien
aggtctacagccagtggagtctatt

SEQ ID NO: 140047 - DNA, 25 bp, Homo sapien
gtggagtctattgtacactgtggaa

SEQ ID NO: 140048 - DNA, 25 bp, Homo sapien
aaaaatacccatgggaccagatcct

SEQ ID NO: 140049 - DNA, 25 bp, Homo sapien
tgggaccagatcctgccaaattctt

SEQ ID NO: 140050 - DNA, 25 bp, Homo sapien
gatcctgccaaattcttccagctca

SEQ ID NO: 140051 - DNA, 25 bp, Homo sapien
tccagctcactttattctcagcatt

SEQ ID NO: 140052 - DNA, 25 bp, Homo sapien
cagcattcctaggacattggacatt

SEQ ID NO: 140053 - DNA, 25 bp, Homo sapien
tgattcttttctttgcaatgctagc

SEQ ID NO: 140054 - DNA, 25 bp, Homo sapien
gcaatgctagcaaccagaatacata

SEQ ID NO: 140055 - DNA, 25 bp, Homo sapien
gggagaggagcatctattttcttaa

SEQ ID NO: 140056 - DNA, 25 bp, Homo sapien
taaactgaggacttgccttggaaat

SEQ ID NO: 140057 - DNA, 25 bp, Homo sapien
ggacttgccttggaaatggaatctg

SEQ ID NO: 140058 - DNA, 25 bp, Homo sapien
gaatggaattctacaggagactgga

SEQ ID NO: 140059 - DNA, 25 bp, Homo sapien
tacaggagactggagtcttgctttg

SEQ ID NO: 140060 - DNA, 25 bp, Homo sapien
tgctttgtggatccttttggtctcc

SEQ ID NO: 140061 - DNA, 25 bp, Homo sapien
tgtggatccttttggtctccgagtc

SEQ ID NO: 140062 - DNA, 25 bp, Homo sapien
aggtgctgcccctgggaacctgcgt

SEQ ID NO: 140063 - DNA, 25 bp, Homo sapien
ctgcctggagcacactttagaattc

SEQ ID NO: 140064 - DNA, 25 bp, Homo sapien
aagatgtgaagcctctgtctcactg

SEQ ID NO: 140065 - DNA, 25 bp, Homo sapien
tatacttttgttgttcattagcatc

SEQ ID NO: 140066 - DNA, 25 bp, Homo sapien
gttcattagcatctttgtaaactat

SEQ ID NO: 140067 - DNA, 25 bp, Homo sapien
tgattttcagagaaatatcacaaat

SEQ ID NO: 140068 - DNA, 25 bp, Homo sapien
gattttcagagaaatatcacaaatt

SEQ ID NO: 140069 - DNA, 25 bp, Homo sapien
ttttcagagaaatatcacaaattag

SEQ ID NO: 140070 - DNA, 25 bp, Homo sapien
tttcagagaaatatcacaaattaga

SEQ ID NO: 140071 - DNA, 25 bp, Homo sapien
ttcagagaaatatcacaaattagaa

SEQ ID NO: 140072 - DNA, 25 bp, Homo sapien
tcagagaaatatcacaaattagaaa

SEQ ID NO: 140073 - DNA, 25 bp, Homo sapien
cagagaaatatcacaaattagaaat

SEQ ID NO: 140074 - DNA, 25 bp, Homo sapien
tatataaaacaatttgggggccagg

SEQ ID NO: 140075 - DNA, 25 bp, Homo sapien
tgacatcggaaaaataatcccaagc

SEQ ID NO: 140076 - DNA, 25 bp, Homo sapien
aatcccaagctatttaaagcatcta

SEQ ID NO: 140077 - DNA, 25 bp, Homo sapien
aaagcatctataaggtgctctcttt

SEQ ID NO: 140078 - DNA, 25 bp, Homo sapien
tctctttctgtcttctacagatgag

SEQ ID NO: 140079 - DNA, 25 bp, Homo sapien
tctacagatgagtcacacctttgag

SEQ ID NO: 140080 - DNA, 25 bp, Homo sapien
cacctttgagcttaatcttgaaggt

SEQ ID NO: 140081 - DNA, 25 bp, Homo sapien
tactgcaaatcaggcttttgtttcc

SEQ ID NO: 140082 - DNA, 25 bp, Homo sapien
ttgtttcctttttcagatatcttgg

SEQ ID NO: 140083 - DNA, 25 bp, Homo sapien
tttcagatatcttggacaaatcaca

SEQ ID NO: 140084 - DNA, 25 bp, Homo sapien
aagaaggcatcgtcatgcacagtat

SEQ ID NO: 140085 - DNA, 25 bp, Homo sapien
gcatcgtcatgcacagtatttgtaa

SEQ ID NO: 140086 - DNA, 25 bp, Homo sapien
aaaagctgatctggtttgactccgc

SEQ ID NO: 140087 - DNA, 25 bp, Homo sapien
tgatctggtttgactccgctggagg

SEQ ID NO: 140088 - DNA, 25 bp, Homo sapien
gcaggccttgcgctgttgcgtaact

SEQ ID NO: 140089 - DNA, 25 bp, Homo sapien
tgcgctgttgcgtaactggctgtgt

SEQ ID NO: 140090 - DNA, 25 bp, Homo sapien
tgcgtaactggctgtgttctggtga

SEQ ID NO: 140091 - DNA, 25 bp, Homo sapien
aactggctgtgttctggtgaggcct

SEQ ID NO: 140092 - DNA, 25 bp, Homo sapien
ctgtgttctggtgaggccttgctcc

SEQ ID NO: 140093 - DNA, 25 bp, Homo sapien
acgctcctccctctgaggcgtgagg

SEQ ID NO: 140094 - DNA, 25 bp, Homo sapien
tctgaggcgtgaggactcgcagtca

SEQ ID NO: 140095 - DNA, 25 bp, Homo sapien
ggaagattgagagcccaaggtttaa

SEQ ID NO: 140096 - DNA, 25 bp, Homo sapien
tgagagcccaaggtttaaacttctt

SEQ ID NO: 140097 - DNA, 25 bp, Homo sapien
gtttcaatgtgattctaatgtcttc

SEQ ID NO: 140098 - DNA, 25 bp, Homo sapien
aatgtcttcatttcattgtatgatg

SEQ ID NO: 140099 - DNA, 25 bp, Homo sapien
gtatgatgtgttgtgatagctaaca

SEQ ID NO: 140100 - DNA, 25 bp, Homo sapien
aacctgtcaatgatacagtccctaa

SEQ ID NO: 140101 - DNA, 25 bp, Homo sapien
cagttgtgtcagctactgcggaaaa

SEQ ID NO: 140102 - DNA, 25 bp, Homo sapien
ggaaactcctgacagtcttgtgctt

SEQ ID NO: 140103 - DNA, 25 bp, Homo sapien
gacagtcttgtgcttttcctatttg

SEQ ID NO: 140104 - DNA, 25 bp, Homo sapien
gtactgagattttggtattacactg

SEQ ID NO: 140105 - DNA, 25 bp, Homo sapien
acactgtatttgtatctctgaagca

SEQ ID NO: 140106 - DNA, 25 bp, Homo sapien
tttgtatctctgaagcatgtttcat

SEQ ID NO: 140107 - DNA, 25 bp, Homo sapien
catgtttcatgttttgtgactatat

SEQ ID NO: 140108 - DNA, 25 bp, Homo sapien
gcaccttcactaccttgtatccagt

SEQ ID NO: 140109 - DNA, 25 bp, Homo sapien
actaccttgtatccagttcatctgg

SEQ ID NO: 140110 - DNA, 25 bp, Homo sapien
gttcatctgggaactcctttttgca

SEQ ID NO: 140111 - DNA, 25 bp, Homo sapien
gaggcaggaaattatgataaactca

SEQ ID NO: 140112 - DNA, 25 bp, Homo sapien
gagtttcactgactaaatgtatgta

SEQ ID NO: 140113 - DNA, 25 bp, Homo sapien
ttttttaaacctgctctcattccta

SEQ ID NO: 140114 - DNA, 25 bp, Homo sapien
ttaaacctgctctcattcctattaa

SEQ ID NO: 140115 - DNA, 25 bp, Homo sapien
tgctctcattcctattaacactaag

SEQ ID NO: 140116 - DNA, 25 bp, Homo sapien
aaatgggttgacatcattgtcgttt

SEQ ID NO: 140117 - DNA, 25 bp, Homo sapien
gacatcattgtcgtttgtaattgta

SEQ ID NO: 140118 - DNA, 25 bp, Homo sapien
cattgtcgtttgtaattgtaaagcc

SEQ ID NO: 140119 - DNA, 25 bp, Homo sapien
catttttgctattttcgtcatgcct

SEQ ID NO: 140120 - DNA, 25 bp, Homo sapien
tttgctattttcgtcatgcctttga

SEQ ID NO: 140121 - DNA, 25 bp, Homo sapien
tgctattttcgtcatgcctttgaga

SEQ ID NO: 140122 - DNA, 25 bp, Homo sapien
ttttcgtcatgcctttgagactgag

SEQ ID NO: 140123 - DNA, 25 bp, Homo sapien
tcgtcatgcctttgagactgagtct

SEQ ID NO: 140124 - DNA, 25 bp, Homo sapien
gccaccacgcgaactcgtattttta

SEQ ID NO: 140125 - DNA, 25 bp, Homo sapien
ccacgcgaactcgtatttttagtag

SEQ ID NO: 140126 - DNA, 25 bp, Homo sapien
caccacgccagggctttatttattt

SEQ ID NO: 140127 - DNA, 25 bp, Homo sapien
tttttaccacaatagtttgaagcag

SEQ ID NO: 140128 - DNA, 25 bp, Homo sapien
taccacaatagtttgaagcagtaag

SEQ ID NO: 140129 - DNA, 25 bp, Homo sapien
ggagggtgattatattgctttgtaa

SEQ ID NO: 140130 - DNA, 25 bp, Homo sapien
aggactccactcacaagcctcctga

SEQ ID NO: 140131 - DNA, 25 bp, Homo sapien
actcacaagcctcctgatgtcaagg

SEQ ID NO: 140132 - DNA, 25 bp, Homo sapien
ccactgtgccttgttgtctgctggg

SEQ ID NO: 140133 - DNA, 25 bp, Homo sapien
cttcttcaactgaccagtcgtggtt

SEQ ID NO: 140134 - DNA, 25 bp, Homo sapien
tcttcaactgaccagtcgtggttac

SEQ ID NO: 140135 - DNA, 25 bp, Homo sapien
ttcaactgaccagtcgtggttactc

SEQ ID NO: 140136 - DNA, 25 bp, Homo sapien
aactgaccagtcgtggttactccct

SEQ ID NO: 140137 - DNA, 25 bp, Homo sapien
actgaccagtcgtggttactccctg

SEQ ID NO: 140138 - DNA, 25 bp, Homo sapien
gaccagtcgtggttactccctgctg

SEQ ID NO: 140139 - DNA, 25 bp, Homo sapien
agtcgtggttactccctgctgccag

SEQ ID NO: 140140 - DNA, 25 bp, Homo sapien
gtcgtggttactccctgctgccagg

SEQ ID NO: 140141 - DNA, 25 bp, Homo sapien
atgtgcccgacactccaggtccgag

SEQ ID NO: 140142 - DNA, 25 bp, Homo sapien
aggtccgaggcactgatgctttcag

SEQ ID NO: 140143 - DNA, 25 bp, Homo sapien
aatccgggttctctttcttcgtgag

SEQ ID NO: 140144 - DNA, 25 bp, Homo sapien
gagacacgttatgagggaagccctg

SEQ ID NO: 140145 - DNA, 25 bp, Homo sapien
attcacagggcccaggtaaaccaag

SEQ ID NO: 140146 - DNA, 25 bp, Homo sapien
aagctgcgctcctgacataccatga

SEQ ID NO: 140147 - DNA, 25 bp, Homo sapien
gacataccatgagaatgcggcactg

SEQ ID NO: 140148 - DNA, 25 bp, Homo sapien
aatgcggcactgacgggcaagtgac

SEQ ID NO: 140149 - DNA, 25 bp, Homo sapien
cgggcaagtgacttctgcaagcctg

SEQ ID NO: 140150 - DNA, 25 bp, Homo sapien
tgcggctggtcccaatgccctgaat

SEQ ID NO: 140151 - DNA, 25 bp, Homo sapien
cctgaatcacctctctcatggaaga

SEQ ID NO: 140152 - DNA, 25 bp, Homo sapien
ccatcctgagcatcttcgtgaacgt

SEQ ID NO: 140153 - DNA, 25 bp, Homo sapien
gcatcttcgtgaacgtctatctcat

SEQ ID NO: 140154 - DNA, 25 bp, Homo sapien
gaacgtctatctcatgatgcagctg

SEQ ID NO: 140155 - DNA, 25 bp, Homo sapien
tccggtttgctgtgtggatgctgat

SEQ ID NO: 140156 - DNA, 25 bp, Homo sapien
gatgctgataggcttcatcatctac

SEQ ID NO: 140157 - DNA, 25 bp, Homo sapien
tcatcatctactttggctatggcct

SEQ ID NO: 140158 - DNA, 25 bp, Homo sapien
tctactttggctatggcctgtggca

SEQ ID NO: 140159 - DNA, 25 bp, Homo sapien
ggatgccgaccaagcaaggactcct

SEQ ID NO: 140160 - DNA, 25 bp, Homo sapien
aaggactcctgacggcaacttggac

SEQ ID NO: 140161 - DNA, 25 bp, Homo sapien
ctgacggcaacttggaccagtgcaa

SEQ ID NO: 140162 - DNA, 25 bp, Homo sapien
gaccagtgcaagtgacgcacagccc

SEQ ID NO: 140163 - DNA, 25 bp, Homo sapien
gaaccctcgggcacctgagagagat

SEQ ID NO: 140164 - DNA, 25 bp, Homo sapien
cctgagagagatgttttgcggcgat

SEQ ID NO: 140165 - DNA, 25 bp, Homo sapien
agatgttttgcggcgatgtcgtgtt

SEQ ID NO: 140166 - DNA, 25 bp, Homo sapien
gagttatcctctgcagaaattccta

SEQ ID NO: 140167 - DNA, 25 bp, Homo sapien
tctgcagaaattcctagacgccttc

SEQ ID NO: 140168 - DNA, 25 bp, Homo sapien
agaaattcctagacgccttcacttc

SEQ ID NO: 140169 - DNA, 25 bp, Homo sapien
tagacgccttcacttctctgtattc

SEQ ID NO: 140170 - DNA, 25 bp, Homo sapien
tcacttctctgtattcttcctcata

SEQ ID NO: 140171 - DNA, 25 bp, Homo sapien
ttctctgtattcttcctcatacttg

SEQ ID NO: 140172 - DNA, 25 bp, Homo sapien
tgtattcttcctcatacttgcctac

SEQ ID NO: 140173 - DNA, 25 bp, Homo sapien
catacttgcctacccccaaattaat

SEQ ID NO: 140174 - DNA, 25 bp, Homo sapien
cactggcattatcgagacctggaag

SEQ ID NO: 140175 - DNA, 25 bp, Homo sapien
aggcgcagagcccatcttcattgat

SEQ ID NO: 140176 - DNA, 25 bp, Homo sapien
ttgatgccaacttccagagcacagt

SEQ ID NO: 140177 - DNA, 25 bp, Homo sapien
ttggagggcaaaccagagttactct

SEQ ID NO: 140178 - DNA, 25 bp, Homo sapien
gttactctgaggaacgagcatctgc

SEQ ID NO: 140179 - DNA, 25 bp, Homo sapien
ctgcagtacatcgtgacctggtatg

SEQ ID NO: 140180 - DNA, 25 bp, Homo sapien
tgacctggtatggactctctgcagc

SEQ ID NO: 140181 - DNA, 25 bp, Homo sapien
cagctacatcctacctgtggtttaa

SEQ ID NO: 140182 - DNA, 25 bp, Homo sapien
gaaattcctacgtgggacacctggt

SEQ ID NO: 140183 - DNA, 25 bp, Homo sapien
acacctggtgtgtgacagatcagct

SEQ ID NO: 140184 - DNA, 25 bp, Homo sapien
aagactgcctttatgctggatcatg

SEQ ID NO: 140185 - DNA, 25 bp, Homo sapien
gaaaacctgagtcccacaacaattg

SEQ ID NO: 140186 - DNA, 25 bp, Homo sapien
tgcaatgaagtctccttattctgct

SEQ ID NO: 140187 - DNA, 25 bp, Homo sapien
ccttattctgctgaatgacaggata

SEQ ID NO: 140188 - DNA, 25 bp, Homo sapien
ggataaactctgacgcaccaagaaa

SEQ ID NO: 140189 - DNA, 25 bp, Homo sapien
aagactgttctttgcccaataacca

SEQ ID NO: 140190 - DNA, 25 bp, Homo sapien
acattttatttcttcagctttgtaa

SEQ ID NO: 140191 - DNA, 25 bp, Homo sapien
accaggttctaggaaatgtttgaca

SEQ ID NO: 140192 - DNA, 25 bp, Homo sapien
ttgacatctgaagctctcttcacac

SEQ ID NO: 140193 - DNA, 25 bp, Homo sapien
tcccgtggcactcctcaattgggag

SEQ ID NO: 140194 - DNA, 25 bp, Homo sapien
tcctcaattgggagtgttgtgactg

SEQ ID NO: 140195 - DNA, 25 bp, Homo sapien
atgcttgaaaccaaagcttcagata

SEQ ID NO: 140196 - DNA, 25 bp, Homo sapien
gagacgcatcgaatcacatgggaca

SEQ ID NO: 140197 - DNA, 25 bp, Homo sapien
aaagggtccaagttgccacattgct

SEQ ID NO: 140198 - DNA, 25 bp, Homo sapien
ccaagttgccacattgcttcattaa

SEQ ID NO: 140199 - DNA, 25 bp, Homo sapien
agagaccacttccttaacagctgta

SEQ ID NO: 140200 - DNA, 25 bp, Homo sapien
aacagctgtattatcttaaacccac

SEQ ID NO: 140201 - DNA, 25 bp, Homo sapien
taaacccacataaacacttctcctt

SEQ ID NO: 140202 - DNA, 25 bp, Homo sapien
gagtagttatgaatcgcagacgcaa

SEQ ID NO: 140203 - DNA, 25 bp, Homo sapien
gaggtttcagcattcccaattatca

SEQ ID NO: 140204 - DNA, 25 bp, Homo sapien
tgcaacttgagggacgactttcttt

SEQ ID NO: 140205 - DNA, 25 bp, Homo sapien
gggacgactttctttaacatatcat

SEQ ID NO: 140206 - DNA, 25 bp, Homo sapien
atcattcagaatgtgcaaagcagta

SEQ ID NO: 140207 - DNA, 25 bp, Homo sapien
caggacctcggaccttggagcctgc

SEQ ID NO: 140208 - DNA, 25 bp, Homo sapien
tcgcccaccaaccaagtgttacaag

SEQ ID NO: 140209 - DNA, 25 bp, Homo sapien
accaaccaagtgttacaagccccag

SEQ ID NO: 140210 - DNA, 25 bp, Homo sapien
ccaagtgttacaagccccagaatgc

SEQ ID NO: 140211 - DNA, 25 bp, Homo sapien
tgtgtgtctgtctctctggcgttcc

SEQ ID NO: 140212 - DNA, 25 bp, Homo sapien
tgaagtactacaactccgacgtgca

SEQ ID NO: 140213 - DNA, 25 bp, Homo sapien
agtactacaactccgacgtgcaccg

SEQ ID NO: 140214 - DNA, 25 bp, Homo sapien
gccgcctttgtgctgcccgagtttg

SEQ ID NO: 140215 - DNA, 25 bp, Homo sapien
ttgtgctgcccgagtttgcccgcaa

SEQ ID NO: 140216 - DNA, 25 bp, Homo sapien
agtttgcccgcaaggccctgaatga

SEQ ID NO: 140217 - DNA, 25 bp, Homo sapien
ccctgaatgatgtgagctgagccca

SEQ ID NO: 140218 - DNA, 25 bp, Homo sapien
ccatctgctgtgtttggacgcgttc

SEQ ID NO: 140219 - DNA, 25 bp, Homo sapien
atctgctgtgtttggacgcgttcct

SEQ ID NO: 140220 - DNA, 25 bp, Homo sapien
gtgtttggacgcgttcctgcccagc

SEQ ID NO: 140221 - DNA, 25 bp, Homo sapien
ccaaccttggccacttgagtttgtc

SEQ ID NO: 140222 - DNA, 25 bp, Homo sapien
ttggccacttgagtttgtcctccaa

SEQ ID NO: 140223 - DNA, 25 bp, Homo sapien
cacttgagtttgtcctccaagggta

SEQ ID NO: 140224 - DNA, 25 bp, Homo sapien
gtttgtcctccaagggtaggtgtct

SEQ ID NO: 140225 - DNA, 25 bp, Homo sapien
gtcctccaagggtaggtgtctcatt

SEQ ID NO: 140226 - DNA, 25 bp, Homo sapien
aagggtaggtgtctcatttgttctg

SEQ ID NO: 140227 - DNA, 25 bp, Homo sapien
gtaggtgtctcatttgttctggccc

SEQ ID NO: 140228 - DNA, 25 bp, Homo sapien
gtctcatttgttctggccccttgga

SEQ ID NO: 140229 - DNA, 25 bp, Homo sapien
cagtgcacgcggcttgttgacttcg

SEQ ID NO: 140230 - DNA, 25 bp, Homo sapien
tgttgacttcgcagccccgggcgga

SEQ ID NO: 140231 - DNA, 25 bp, Homo sapien
tttatgtggagactactggccccgc

SEQ ID NO: 140232 - DNA, 25 bp, Homo sapien
ttatgtggagactactggccccgcc

SEQ ID NO: 140233 - DNA, 25 bp, Homo sapien
tatgtggagactactggccccgccc

SEQ ID NO: 140234 - DNA, 25 bp, Homo sapien
tgtggagactactggccccgcccgt

SEQ ID NO: 140235 - DNA, 25 bp, Homo sapien
tcgtgctccgcagggcgcccagcgc

SEQ ID NO: 140236 - DNA, 25 bp, Homo sapien
cgcagaccagctggcgggtgtggag

SEQ ID NO: 140237 - DNA, 25 bp, Homo sapien
accagctggcgggtgtggagaccag

SEQ ID NO: 140238 - DNA, 25 bp, Homo sapien
gtggagaccaggctcctgaccccgc

SEQ ID NO: 140239 - DNA, 25 bp, Homo sapien
tgaccccgccatgcatgcagcgcca

SEQ ID NO: 140240 - DNA, 25 bp, Homo sapien
cattaaaacaagagaccacttcctt

SEQ ID NO: 140241 - DNA, 25 bp, Homo sapien
aagagaccacttccttaacagctgt

SEQ ID NO: 140242 - DNA, 25 bp, Homo sapien
gagaccacttccttaacagctgtat

SEQ ID NO: 140243 - DNA, 25 bp, Homo sapien
gaccacttccttaacagctgtatta

SEQ ID NO: 140244 - DNA, 25 bp, Homo sapien
acttccttaacagctgtattatctt

SEQ ID NO: 140245 - DNA, 25 bp, Homo sapien
aacagctgtattatcttaaacccac

SEQ ID NO: 140246 - DNA, 25 bp, Homo sapien
agctgtattatcttaaacccacata

SEQ ID NO: 140247 - DNA, 25 bp, Homo sapien
taaacccacataaacacttctcctt

SEQ ID NO: 140248 - DNA, 25 bp, Homo sapien
agaggtttcagcattcccaattatc

SEQ ID NO: 140249 - DNA, 25 bp, Homo sapien
ggtttcagcattcccaattatcaaa

SEQ ID NO: 140250 - DNA, 25 bp, Homo sapien
agcattcccaattatcaaaaaacag

SEQ ID NO: 140251 - DNA, 25 bp, Homo sapien
cgcccttgccgaaccaggagctgct

SEQ ID NO: 140252 - DNA, 25 bp, Homo sapien
gcccttgccgaaccaggagctgctc

SEQ ID NO: 140253 - DNA, 25 bp, Homo sapien
cccttgccgaaccaggagctgctca

SEQ ID NO: 140254 - DNA, 25 bp, Homo sapien
ccttgccgaaccaggagctgctcac

SEQ ID NO: 140255 - DNA, 25 bp, Homo sapien
cttgccgaaccaggagctgctcact

SEQ ID NO: 140256 - DNA, 25 bp, Homo sapien
actacctcctcagggatggccgttg

SEQ ID NO: 140257 - DNA, 25 bp, Homo sapien
ctacctcctcagggatggccgttgg

SEQ ID NO: 140258 - DNA, 25 bp, Homo sapien
tacctcctcagggatggccgttggc

SEQ ID NO: 140259 - DNA, 25 bp, Homo sapien
ctcagggatggccgttggccacgtc

SEQ ID NO: 140260 - DNA, 25 bp, Homo sapien
tcagggatggccgttggccacgtct

SEQ ID NO: 140261 - DNA, 25 bp, Homo sapien
cagggatggccgttggccacgtctt

SEQ ID NO: 140262 - DNA, 25 bp, Homo sapien
gcatgggctgatattgaacgcttca

SEQ ID NO: 140263 - DNA, 25 bp, Homo sapien
ccgagacttaaaggaggccctcata

SEQ ID NO: 140264 - DNA, 25 bp, Homo sapien
aaggaggccctcataagctatgcag

SEQ ID NO: 140265 - DNA, 25 bp, Homo sapien
ggccctcataagctatgcagtcatg

SEQ ID NO: 140266 - DNA, 25 bp, Homo sapien
tgcagtcatgcagatcagtatgtgc

SEQ ID NO: 140267 - DNA, 25 bp, Homo sapien
agggaattcaagtttggaccaatgc

SEQ ID NO: 140268 - DNA, 25 bp, Homo sapien
tggaccaatgctaaggaatgcttta

SEQ ID NO: 140269 - DNA, 25 bp, Homo sapien
aatgctttagcaagatgtaatcctg

SEQ ID NO: 140270 - DNA, 25 bp, Homo sapien
aatcctgtgaattgaatttctcttc

SEQ ID NO: 140271 - DNA, 25 bp, Homo sapien
tttctcttcaatcaaagtgccccaa

SEQ ID NO: 140272 - DNA, 25 bp, Homo sapien
gaaatttaagtcactacctagtata

SEQ ID NO: 140273 - DNA, 25 bp, Homo sapien
aagagcctattacatctactccggg

SEQ ID NO: 140274 - DNA, 25 bp, Homo sapien
agaagatccccctggtgttgagccg

SEQ ID NO: 140275 - DNA, 25 bp, Homo sapien
aacgtggccactcttcagcatctct

SEQ ID NO: 140276 - DNA, 25 bp, Homo sapien
ttcagcatctctgtcggaagaccgt

SEQ ID NO: 140277 - DNA, 25 bp, Homo sapien
atctctgtcggaagaccgtcaacgg

SEQ ID NO: 140278 - DNA, 25 bp, Homo sapien
ggaagaccgtcaacggccacctgga

SEQ ID NO: 140279 - DNA, 25 bp, Homo sapien
ggccacctggactcctatgagaaag

SEQ ID NO: 140280 - DNA, 25 bp, Homo sapien
tatgagaaagtcacccagctgccgg

SEQ ID NO: 140281 - DNA, 25 bp, Homo sapien
ggcccattcgggagttcctggacca

SEQ ID NO: 140282 - DNA, 25 bp, Homo sapien
gagttcctggaccagtacgatgccc

SEQ ID NO: 140283 - DNA, 25 bp, Homo sapien
ggaccagtacgatgccccgctttaa

SEQ ID NO: 140284 - DNA, 25 bp, Homo sapien
caccagtgccttttgcagagagata

SEQ ID NO: 140285 - DNA, 25 bp, Homo sapien
ttgcagagagatattttgtgtacac

SEQ ID NO: 140286 - DNA, 25 bp, Homo sapien
ttgtgtacacagaagccattccgag

SEQ ID NO: 140287 - DNA, 25 bp, Homo sapien
gaagccattccgagtctgggacctg

SEQ ID NO: 140288 - DNA, 25 bp, Homo sapien
agccaacagctgagctgccgggcct

SEQ ID NO: 140289 - DNA, 25 bp, Homo sapien
gtcccatctgaagctggagtaccct

SEQ ID NO: 140290 - DNA, 25 bp, Homo sapien
cccatctgaagctggagtaccctgg

SEQ ID NO: 140291 - DNA, 25 bp, Homo sapien
gagtctggtttttctcttcatcctg

SEQ ID NO: 140292 - DNA, 25 bp, Homo sapien
gtttttctcttcatcctgtctctct

SEQ ID NO: 140293 - DNA, 25 bp, Homo sapien
tctctcctccttactcttggataaa

SEQ ID NO: 140294 - DNA, 25 bp, Homo sapien
actcttggataaataaacagcctgt

SEQ ID NO: 140295 - DNA, 25 bp, Homo sapien
gttggtgaatcggttgttctttcct

SEQ ID NO: 140296 - DNA, 25 bp, Homo sapien
ggtgaatcggttgttctttcctcac

SEQ ID NO: 140297 - DNA, 25 bp, Homo sapien
gatgattgtcataaggtttttagca

SEQ ID NO: 140298 - DNA, 25 bp, Homo sapien
atgggatggtcggatctcacaggct

SEQ ID NO: 140299 - DNA, 25 bp, Homo sapien
gatggtcggatctcacaggctgaga

SEQ ID NO: 140300 - DNA, 25 bp, Homo sapien
ggtcggatctcacaggctgagaact

SEQ ID NO: 140301 - DNA, 25 bp, Homo sapien
aggctgagaactcgttcacctccaa

SEQ ID NO: 140302 - DNA, 25 bp, Homo sapien
gctgagaactcgttcacctccaagc

SEQ ID NO: 140303 - DNA, 25 bp, Homo sapien
gctgcttcttattaatcatacaaac

SEQ ID NO: 140304 - DNA, 25 bp, Homo sapien
tcatacaaactctcaccatgatgtg

SEQ ID NO: 140305 - DNA, 25 bp, Homo sapien
ctcaccatgatgtgaagagtttcac

SEQ ID NO: 140306 - DNA, 25 bp, Homo sapien
tgcatgtttatatccccaattctca

SEQ ID NO: 140307 - DNA, 25 bp, Homo sapien
tttatatccccaattctcaccacaa

SEQ ID NO: 140308 - DNA, 25 bp, Homo sapien
tcaccacaaccctgcaagtaggtgg

SEQ ID NO: 140309 - DNA, 25 bp, Homo sapien
cctgcaagtaggtggtattatccaa

SEQ ID NO: 140310 - DNA, 25 bp, Homo sapien
tattatccaagttttacccattaag

SEQ ID NO: 140311 - DNA, 25 bp, Homo sapien
ttgctcaacatcatatagtaagtag

SEQ ID NO: 140312 - DNA, 25 bp, Homo sapien
gcagagttgggattggaattccttt

SEQ ID NO: 140313 - DNA, 25 bp, Homo sapien
gcatatctgttttgtttgattctca

SEQ ID NO: 140314 - DNA, 25 bp, Homo sapien
gtttgattctcatcttcttaggtaa

SEQ ID NO: 140315 - DNA, 25 bp, Homo sapien
ttaacctttgttcatctttctagag

SEQ ID NO: 140316 - DNA, 25 bp, Homo sapien
gtgaaaacaacatggcatttggaat

SEQ ID NO: 140317 - DNA, 25 bp, Homo sapien
aagggcaattctgaaccccatcttt

SEQ ID NO: 140318 - DNA, 25 bp, Homo sapien
aaccccatctttggcaggcatacat

SEQ ID NO: 140319 - DNA, 25 bp, Homo sapien
tggcaggcatacatatttcactgtt

SEQ ID NO: 140320 - DNA, 25 bp, Homo sapien
cactgtttccaaagctatctactct

SEQ ID NO: 140321 - DNA, 25 bp, Homo sapien
aaagctatctactctgccaaacaac

SEQ ID NO: 140322 - DNA, 25 bp, Homo sapien
agtcctattccaaactctcaacgat

SEQ ID NO: 140323 - DNA, 25 bp, Homo sapien
tctcaacgattctatcttgttcctg

SEQ ID NO: 140324 - DNA, 25 bp, Homo sapien
ttctatgtatttatggttgccgttt

SEQ ID NO: 140325 - DNA, 25 bp, Homo sapien
gttgccgtttgtgtctgatttgatt

SEQ ID NO: 140326 - DNA, 25 bp, Homo sapien
agtagcattgtgacctgttttcctt

SEQ ID NO: 140327 - DNA, 25 bp, Homo sapien
tttagtaaactaaccactgtcaatg

SEQ ID NO: 140328 - DNA, 25 bp, Homo sapien
ttgagcaggctgatctactgcagga

SEQ ID NO: 140329 - DNA, 25 bp, Homo sapien
gaggaagctgaaaccccacgtagtg

SEQ ID NO: 140330 - DNA, 25 bp, Homo sapien
ccccacgtagtgttcttgaagaaat

SEQ ID NO: 140331 - DNA, 25 bp, Homo sapien
aattggactgacataactctcctcc

SEQ ID NO: 140332 - DNA, 25 bp, Homo sapien
tcctcccttgttgatgacttcttgt

SEQ ID NO: 140333 - DNA, 25 bp, Homo sapien
gatgacttcttgtggcatttcacac

SEQ ID NO: 140334 - DNA, 25 bp, Homo sapien
gtggcatttcacacactgtagatgg

SEQ ID NO: 140335 - DNA, 25 bp, Homo sapien
acactgtagatggtcactcccttca

SEQ ID NO: 140336 - DNA, 25 bp, Homo sapien
gatgatgtcttgtcagtattactgt

SEQ ID NO: 140337 - DNA, 25 bp, Homo sapien
tactgttttgctaagccgcttcatt

SEQ ID NO: 140338 - DNA, 25 bp, Homo sapien
cttcattcatgcctacacaattttt

SEQ ID NO: 140339 - DNA, 25 bp, Homo sapien
tgtttatagatcactgccctttttg

SEQ ID NO: 140340 - DNA, 25 bp, Homo sapien
actgccctttttgaaatcacctggt

SEQ ID NO: 140341 - DNA, 25 bp, Homo sapien
tgaaatcacctggtattatttttct

SEQ ID NO: 140342 - DNA, 25 bp, Homo sapien
gaactacatatttgtgcctccttgg

SEQ ID NO: 140343 - DNA, 25 bp, Homo sapien
gtgcctccttggtaaatacaacaca

SEQ ID NO: 140344 - DNA, 25 bp, Homo sapien
gatatttcaaacatcagctgaattc

SEQ ID NO: 140345 - DNA, 25 bp, Homo sapien
gctgaattcacttaagtttttccaa

SEQ ID NO: 140346 - DNA, 25 bp, Homo sapien
ttttcccctttgattcacagtggtc

SEQ ID NO: 140347 - DNA, 25 bp, Homo sapien
cctttgattcacagtggtcccattt

SEQ ID NO: 140348 - DNA, 25 bp, Homo sapien
tggtcccatttatatctgcttctag

SEQ ID NO: 140349 - DNA, 25 bp, Homo sapien
tatatctgcttctagcttagtgcta

SEQ ID NO: 140350 - DNA, 25 bp, Homo sapien
gtgtgccagcccatgcaggtgtaca

SEQ ID NO: 140351 - DNA, 25 bp, Homo sapien
ggtgtacacagacacacctgtggga

SEQ ID NO: 140352 - DNA, 25 bp, Homo sapien
tgcaggctgcaggatatctgggtat

SEQ ID NO: 140353 - DNA, 25 bp, Homo sapien
tgatttcaggtcctctgcacgtgta

SEQ ID NO: 140354 - DNA, 25 bp, Homo sapien
tgcacgtgtacacatgactaggata

SEQ ID NO: 140355 - DNA, 25 bp, Homo sapien
atgactgtgcagctgtttgtgcata

SEQ ID NO: 140356 - DNA, 25 bp, Homo sapien
catagatgttggtgcctgcgttact

SEQ ID NO: 140357 - DNA, 25 bp, Homo sapien
ttggtgcctgcgttactgaatttgc

SEQ ID NO: 140358 - DNA, 25 bp, Homo sapien
cgttactgaatttgcacacctcctt

SEQ ID NO: 140359 - DNA, 25 bp, Homo sapien
aggtcttcggccaccaccacaatta

SEQ ID NO: 140360 - DNA, 25 bp, Homo sapien
caattaattcccttcccaacacttg

SEQ ID NO: 140361 - DNA, 25 bp, Homo sapien
gaattgcagtttgcttcccgcagat

SEQ ID NO: 140362 - DNA, 25 bp, Homo sapien
ttcggtactctgcagcgaagtgcaa

SEQ ID NO: 140363 - DNA, 25 bp, Homo sapien
agggatgactgtacgaaagccacac

SEQ ID NO: 140364 - DNA, 25 bp, Homo sapien
gtacgaaagccacacactcaagaat

SEQ ID NO: 140365 - DNA, 25 bp, Homo sapien
aatggagcaccagctaggccactta

SEQ ID NO: 140366 - DNA, 25 bp, Homo sapien
gggaccgctacagccactggacaaa

SEQ ID NO: 140367 - DNA, 25 bp, Homo sapien
ggacaatcgggtaacattggctaca

SEQ ID NO: 140368 - DNA, 25 bp, Homo sapien
cattggctacaaagacctacctaga

SEQ ID NO: 140369 - DNA, 25 bp, Homo sapien
ctacctagatgctcctttttacgat

SEQ ID NO: 140370 - DNA, 25 bp, Homo sapien
ttttacgataacttacagccctcac

SEQ ID NO: 140371 - DNA, 25 bp, Homo sapien
cagccctcactttcttatgtttagt

SEQ ID NO: 140372 - DNA, 25 bp, Homo sapien
gcgggagtaatagcctcctgggcaa

SEQ ID NO: 140373 - DNA, 25 bp, Homo sapien
taatagcctcctgggcaaacgacga

SEQ ID NO: 140374 - DNA, 25 bp, Homo sapien
tcctgggcaaacgacgagctgttag

SEQ ID NO: 140375 - DNA, 25 bp, Homo sapien
acgacgagctgttagtgtatcttgt

SEQ ID NO: 140376 - DNA, 25 bp, Homo sapien
gagctgttagtgtatcttgttaaga

SEQ ID NO: 140377 - DNA, 25 bp, Homo sapien
cataaaataagtgctggagttcggg

SEQ ID NO: 140378 - DNA, 25 bp, Homo sapien
tgtccgcatcttcgtgacccgggtc

SEQ ID NO: 140379 - DNA, 25 bp, Homo sapien
gtccgagtaccccacctggaagctg

SEQ ID NO: 140380 - DNA, 25 bp, Homo sapien
ctggaagctgcgtccgtgccgagcc

SEQ ID NO: 140381 - DNA, 25 bp, Homo sapien
gtgccgagcccagcgtgtcgctgtt

SEQ ID NO: 140382 - DNA, 25 bp, Homo sapien
gagcccagcgtgtcgctgtttccca

SEQ ID NO: 140383 - DNA, 25 bp, Homo sapien
agcacacgtcgttcaaggagatgaa

SEQ ID NO: 140384 - DNA, 25 bp, Homo sapien
ggagatgaagaagaaccctatgacc

SEQ ID NO: 140385 - DNA, 25 bp, Homo sapien
gatgaagaagaaccctatgaccaac

SEQ ID NO: 140386 - DNA, 25 bp, Homo sapien
gaagaagaaccctatgaccaactac

SEQ ID NO: 140387 - DNA, 25 bp, Homo sapien
agaagaaccctatgaccaactacac

SEQ ID NO: 140388 - DNA, 25 bp, Homo sapien
aagaaccctatgaccaactacacca

SEQ ID NO: 140389 - DNA, 25 bp, Homo sapien
agcatctcccccttcatgaggaaag

SEQ ID NO: 140390 - DNA, 25 bp, Homo sapien
tctcccccttcatgaggaaaggcat

SEQ ID NO: 140391 - DNA, 25 bp, Homo sapien
ttcaccgtggcgcagaatgagcgct

SEQ ID NO: 140392 - DNA, 25 bp, Homo sapien
cgtggcgcagaatgagcgcttcgat

SEQ ID NO: 140393 - DNA, 25 bp, Homo sapien
gcagaatgagcgcttcgatgcggac

SEQ ID NO: 140394 - DNA, 25 bp, Homo sapien
acaacaacagttactatagtggtga

SEQ ID NO: 140395 - DNA, 25 bp, Homo sapien
aggaatcaaattttgccagagaaac

SEQ ID NO: 140396 - DNA, 25 bp, Homo sapien
ccatgggcatttgtttagagccaaa

SEQ ID NO: 140397 - DNA, 25 bp, Homo sapien
agagccaaattcatcctcttaccag

SEQ ID NO: 140398 - DNA, 25 bp, Homo sapien
attcatcctcttaccagatcctttt

SEQ ID NO: 140399 - DNA, 25 bp, Homo sapien
agatccttttccagaaatacctgtc

SEQ ID NO: 140400 - DNA, 25 bp, Homo sapien
cagaaatacctgtctaggaaggtgt

SEQ ID NO: 140401 - DNA, 25 bp, Homo sapien
aggaaggtgtgatgtcagaaacaat

SEQ ID NO: 140402 - DNA, 25 bp, Homo sapien
cagaaacaatgacatccagaaagct

SEQ ID NO: 140403 - DNA, 25 bp, Homo sapien
aacaggttcctgtggagacactgag

SEQ ID NO: 140404 - DNA, 25 bp, Homo sapien
gacactgagtcagaattcttcatcc

SEQ ID NO: 140405 - DNA, 25 bp, Homo sapien
gcatctctgcattatcctatatcat

SEQ ID NO: 140406 - DNA, 25 bp, Homo sapien
tcatggtgttgggtaaattagcgaa

SEQ ID NO: 140407 - DNA, 25 bp, Homo sapien
tagcgaaatcaaccgcttcctaagt

SEQ ID NO: 140408 - DNA, 25 bp, Homo sapien
tacaagagtgtatttccccttaatt

SEQ ID NO: 140409 - DNA, 25 bp, Homo sapien
ttccccttaattaggatgcatgttg

SEQ ID NO: 140410 - DNA, 25 bp, Homo sapien
ggatgcatgttgattaaactcgaga

SEQ ID NO: 140411 - DNA, 25 bp, Homo sapien
aaactcgagatacagctttttgcag

SEQ ID NO: 140412 - DNA, 25 bp, Homo sapien
acagctttttgcagtatggtgggtt

SEQ ID NO: 140413 - DNA, 25 bp, Homo sapien
ggttggttttggtgtaacatcttca

SEQ ID NO: 140414 - DNA, 25 bp, Homo sapien
catcttcaacatgtcacactggcta

SEQ ID NO: 140415 - DNA, 25 bp, Homo sapien
gtcacactggctatcaaagaataag

SEQ ID NO: 140416 - DNA, 25 bp, Homo sapien
gctcatttatgagccaccagaggct

SEQ ID NO: 140417 - DNA, 25 bp, Homo sapien
tttatgagccaccagaggctcctac

SEQ ID NO: 140418 - DNA, 25 bp, Homo sapien
gctcctaccccaaagatttcacaga

SEQ ID NO: 140419 - DNA, 25 bp, Homo sapien
ctcctaccccaaagatttcacagaa

SEQ ID NO: 140420 - DNA, 25 bp, Homo sapien
tcctaccccaaagatttcacagaaa

SEQ ID NO: 140421 - DNA, 25 bp, Homo sapien
ctaccccaaagatttcacagaaact

SEQ ID NO: 140422 - DNA, 25 bp, Homo sapien
gatttcacagaaacttgaggccagg

SEQ ID NO: 140423 - DNA, 25 bp, Homo sapien
tttcacagaaacttgaggccaggtg

SEQ ID NO: 140424 - DNA, 25 bp, Homo sapien
ttcacagaaacttgaggccaggtgc

SEQ ID NO: 140425 - DNA, 25 bp, Homo sapien
tcacagaaacttgaggccaggtgcc

SEQ ID NO: 140426 - DNA, 25 bp, Homo sapien
acagaaacttgaggccaggtgccgt

SEQ ID NO: 140427 - DNA, 25 bp, Homo sapien
tcagaacagccctccgttcgacagt

SEQ ID NO: 140428 - DNA, 25 bp, Homo sapien
gttcgacagtgtcccggaagtcatc

SEQ ID NO: 140429 - DNA, 25 bp, Homo sapien
gtgtcccggaagtcatccactacta

SEQ ID NO: 140430 - DNA, 25 bp, Homo sapien
ccaccagaaagctacccatcaaagg

SEQ ID NO: 140431 - DNA, 25 bp, Homo sapien
ctcctctatcccgtggctgtgagga

SEQ ID NO: 140432 - DNA, 25 bp, Homo sapien
tgaggaccctgtgagcggaccagac

SEQ ID NO: 140433 - DNA, 25 bp, Homo sapien
agacctgccctgctctgtgacagag

SEQ ID NO: 140434 - DNA, 25 bp, Homo sapien
ttgctggctgtgtcgtttgtgttgt

SEQ ID NO: 140435 - DNA, 25 bp, Homo sapien
ttgtgttgtgtgtatggtactagca

SEQ ID NO: 140436 - DNA, 25 bp, Homo sapien
gtatggtactagcacaccactgcat

SEQ ID NO: 140437 - DNA, 25 bp, Homo sapien
cacaccactgcatgtctctagaatg

SEQ ID NO: 140438 - DNA, 25 bp, Homo sapien
tgaaccacctttgtctctgcagagg

SEQ ID NO: 140439 - DNA, 25 bp, Homo sapien
tctgcagaggcatccggatcccagc

SEQ ID NO: 140440 - DNA, 25 bp, Homo sapien
ggatcccagcaagcgagctttagca

SEQ ID NO: 140441 - DNA, 25 bp, Homo sapien
ttagcagggaagtcacttcaccatc

SEQ ID NO: 140442 - DNA, 25 bp, Homo sapien
gccccagatggctttgtgattccct

SEQ ID NO: 140443 - DNA, 25 bp, Homo sapien
ggctttgtgattccctccagtgaag

SEQ ID NO: 140444 - DNA, 25 bp, Homo sapien
tccagtgaagcagcctccttatatt

SEQ ID NO: 140445 - DNA, 25 bp, Homo sapien
gcagcctccttatatttggcccaaa

SEQ ID NO: 140446 - DNA, 25 bp, Homo sapien
atttggcccaaactcatcttgatca

SEQ ID NO: 140447 - DNA, 25 bp, Homo sapien
atctctaggatgtcgtctttggtga

SEQ ID NO: 140448 - DNA, 25 bp, Homo sapien
tgtcgtctttggtgagatctctatt

SEQ ID NO: 140449 - DNA, 25 bp, Homo sapien
gtttgcggtgttgggcctgcttgcc

SEQ ID NO: 140450 - DNA, 25 bp, Homo sapien
tgcttgccgcgggagtgacgctact

SEQ ID NO: 140451 - DNA, 25 bp, Homo sapien
ttgccgcgggagtgacgctacttct

SEQ ID NO: 140452 - DNA, 25 bp, Homo sapien
gggagtgacgctacttcttccagag

SEQ ID NO: 140453 - DNA, 25 bp, Homo sapien
gagtgacgctacttcttccagagac

SEQ ID NO: 140454 - DNA, 25 bp, Homo sapien
gggtcgctttgccagagaccatgaa

SEQ ID NO: 140455 - DNA, 25 bp, Homo sapien
gtcgctttgccagagaccatgaagg

SEQ ID NO: 140456 - DNA, 25 bp, Homo sapien
ttgccagagaccatgaaggacgccg

SEQ ID NO: 140457 - DNA, 25 bp, Homo sapien
gagaccatgaaggacgccgagaacc

SEQ ID NO: 140458 - DNA, 25 bp, Homo sapien
atgaaggacgccgagaaccttggga

SEQ ID NO: 140459 - DNA, 25 bp, Homo sapien
gccgagaaccttgggagaaaagcaa

SEQ ID NO: 140460 - DNA, 25 bp, Homo sapien
aatattaagcctgaagacttctaaa

SEQ ID NO: 140461 - DNA, 25 bp, Homo sapien
gcctgaagacttctaaaaagacaag

SEQ ID NO: 140462 - DNA, 25 bp, Homo sapien
tggcctaaataaccaacatagattt

SEQ ID NO: 140463 - DNA, 25 bp, Homo sapien
aaccaacatagatttacatagtaag

SEQ ID NO: 140464 - DNA, 25 bp, Homo sapien
acatagtaagtttcacactacctta

SEQ ID NO: 140465 - DNA, 25 bp, Homo sapien
tttcacactaccttattaccaaaag

SEQ ID NO: 140466 - DNA, 25 bp, Homo sapien
gtatatctattgtatgctggtcttt

SEQ ID NO: 140467 - DNA, 25 bp, Homo sapien
gtatgctggtctttactttttgcca

SEQ ID NO: 140468 - DNA, 25 bp, Homo sapien
tggtctttactttttgccaaaatca

SEQ ID NO: 140469 - DNA, 25 bp, Homo sapien
catataatgaagagatgcctttgtt

SEQ ID NO: 140470 - DNA, 25 bp, Homo sapien
tcaaacttgatgctatgctttaaaa

SEQ ID NO: 140471 - DNA, 25 bp, Homo sapien
tccagcttttggattcaatgagtgg

SEQ ID NO: 140472 - DNA, 25 bp, Homo sapien
tgtgcctttctctagatgtgatacg

SEQ ID NO: 140473 - DNA, 25 bp, Homo sapien
gtgatacgttataccaaaatctttg

SEQ ID NO: 140474 - DNA, 25 bp, Homo sapien
aaatctttgtagtgtgcagagcggt

SEQ ID NO: 140475 - DNA, 25 bp, Homo sapien
gcagagcggtggtttgagactaaat

SEQ ID NO: 140476 - DNA, 25 bp, Homo sapien
atacaggcttagaacttgcagagtg

SEQ ID NO: 140477 - DNA, 25 bp, Homo sapien
gagtgtgtattcttggatggctgat

SEQ ID NO: 140478 - DNA, 25 bp, Homo sapien
gatggctgatgcatcgacttgcatt

SEQ ID NO: 140479 - DNA, 25 bp, Homo sapien
gacttgcattcccacttaacacttt

SEQ ID NO: 140480 - DNA, 25 bp, Homo sapien
cacttaacactttgattagccatga

SEQ ID NO: 140481 - DNA, 25 bp, Homo sapien
gattagccatgaacttgccaatcaa

SEQ ID NO: 140482 - DNA, 25 bp, Homo sapien
acagctgagctggcctattttggac

SEQ ID NO: 140483 - DNA, 25 bp, Homo sapien
tgaaaaccaccctatcatcagttag

SEQ ID NO: 140484 - DNA, 25 bp, Homo sapien
gaatcaagtctgtgaaagtctcctg

SEQ ID NO: 140485 - DNA, 25 bp, Homo sapien
aagtctcctgtatcatttcttggta

SEQ ID NO: 140486 - DNA, 25 bp, Homo sapien
ttcttggtatgatcattggtatctg

SEQ ID NO: 140487 - DNA, 25 bp, Homo sapien
ggtatctgatatctgtttgcttcta

SEQ ID NO: 140488 - DNA, 25 bp, Homo sapien
gcttctaaaggtttcactgttcatg

SEQ ID NO: 140489 - DNA, 25 bp, Homo sapien
aacagggatgctatctcgctagcca

SEQ ID NO: 140490 - DNA, 25 bp, Homo sapien
atctcgctagccatatattttctga

SEQ ID NO: 140491 - DNA, 25 bp, Homo sapien
ttgctggaatctactagaaccttct

SEQ ID NO: 140492 - DNA, 25 bp, Homo sapien
agaaccttctaatccatgtgctgct

SEQ ID NO: 140493 - DNA, 25 bp, Homo sapien
ctcttgcaaattccagtcaaggccc

SEQ ID NO: 140494 - DNA, 25 bp, Homo sapien
tcttgcaaattccagtcaaggccct

SEQ ID NO: 140495 - DNA, 25 bp, Homo sapien
cttgcaaattccagtcaaggcccta

SEQ ID NO: 140496 - DNA, 25 bp, Homo sapien
ttgcaaattccagtcaaggccctaa

SEQ ID NO: 140497 - DNA, 25 bp, Homo sapien
tgcaaattccagtcaaggccctaaa

SEQ ID NO: 140498 - DNA, 25 bp, Homo sapien
gcaaattccagtcaaggccctaaaa

SEQ ID NO: 140499 - DNA, 25 bp, Homo sapien
caaattccagtcaaggccctaaaat

SEQ ID NO: 140500 - DNA, 25 bp, Homo sapien
agtcctgataaacctgtgagtgtga

SEQ ID NO: 140501 - DNA, 25 bp, Homo sapien
gtcctgataaacctgtgagtgtgaa

SEQ ID NO: 140502 - DNA, 25 bp, Homo sapien
tcctgataaacctgtgagtgtgaaa

SEQ ID NO: 140503 - DNA, 25 bp, Homo sapien
agatgaaccaagaaagaaatacgtg

SEQ ID NO: 140504 - DNA, 25 bp, Homo sapien
catggagtctgagggcggcgacggc

SEQ ID NO: 140505 - DNA, 25 bp, Homo sapien
gcgacggctacctggctccggagaa

SEQ ID NO: 140506 - DNA, 25 bp, Homo sapien
tggctccggagaatgggtatttgat

SEQ ID NO: 140507 - DNA, 25 bp, Homo sapien
cgccggagtgaagaggtcgtcctct

SEQ ID NO: 140508 - DNA, 25 bp, Homo sapien
cggagtgaagaggtcgtcctctcca

SEQ ID NO: 140509 - DNA, 25 bp, Homo sapien
ggagtgaagaggtcgtcctctccat

SEQ ID NO: 140510 - DNA, 25 bp, Homo sapien
gagtgaagaggtcgtcctctccatc

SEQ ID NO: 140511 - DNA, 25 bp, Homo sapien
agtgaagaggtcgtcctctccatct

SEQ ID NO: 140512 - DNA, 25 bp, Homo sapien
gtgaagaggtcgtcctctccatctg

SEQ ID NO: 140513 - DNA, 25 bp, Homo sapien
tgaagaggtcgtcctctccatctgc

SEQ ID NO: 140514 - DNA, 25 bp, Homo sapien
gaagaggtcgtcctctccatctgct

SEQ ID NO: 140515 - DNA, 25 bp, Homo sapien
gccacgtcttccttctgcctgagct

SEQ ID NO: 140516 - DNA, 25 bp, Homo sapien
ccacgtcttccttctgcctgagctt

SEQ ID NO: 140517 - DNA, 25 bp, Homo sapien
cacgtcttccttctgcctgagcttc

SEQ ID NO: 140518 - DNA, 25 bp, Homo sapien
acgtcttccttctgcctgagcttcc

SEQ ID NO: 140519 - DNA, 25 bp, Homo sapien
cgtcttccttctgcctgagcttccc

SEQ ID NO: 140520 - DNA, 25 bp, Homo sapien
gtcttccttctgcctgagcttcccc

SEQ ID NO: 140521 - DNA, 25 bp, Homo sapien
ccttctgcctgagcttcccccccac

SEQ ID NO: 140522 - DNA, 25 bp, Homo sapien
cttctgcctgagcttcccccccacc

SEQ ID NO: 140523 - DNA, 25 bp, Homo sapien
agaagtcaagcccagccacgtggag

SEQ ID NO: 140524 - DNA, 25 bp, Homo sapien
gccacgtggagcctagagtgagggc

SEQ ID NO: 140525 - DNA, 25 bp, Homo sapien
agaagcctggcctaggcagcttcaa

SEQ ID NO: 140526 - DNA, 25 bp, Homo sapien
ggcagcttcaacctttgaacttact

SEQ ID NO: 140527 - DNA, 25 bp, Homo sapien
ttgttttgctacatactgttccaga

SEQ ID NO: 140528 - DNA, 25 bp, Homo sapien
gctacatactgttccagacttttaa

SEQ ID NO: 140529 - DNA, 25 bp, Homo sapien
catgtcaggtttgggcttggttgtt

SEQ ID NO: 140530 - DNA, 25 bp, Homo sapien
gttgttttagaagcacctgggtgtg

SEQ ID NO: 140531 - DNA, 25 bp, Homo sapien
tgggtgtgcctacctactcctcttt

SEQ ID NO: 140532 - DNA, 25 bp, Homo sapien
aaaagggcccacaatgctccaattt

SEQ ID NO: 140533 - DNA, 25 bp, Homo sapien
tccaatttcctgtctcctttagaga

SEQ ID NO: 140534 - DNA, 25 bp, Homo sapien
gagacatgaaactatcacaggtgct

SEQ ID NO: 140535 - DNA, 25 bp, Homo sapien
aactatcacaggtgctggatgacaa

SEQ ID NO: 140536 - DNA, 25 bp, Homo sapien
ctaccgcaggaatgggatggctttt

SEQ ID NO: 140537 - DNA, 25 bp, Homo sapien
aatgggatggcttttctagcctgct

SEQ ID NO: 140538 - DNA, 25 bp, Homo sapien
tttctagcctgctgatgtgacaact

SEQ ID NO: 140539 - DNA, 25 bp, Homo sapien
gtgacaactgtgatgtgcctgcaac

SEQ ID NO: 140540 - DNA, 25 bp, Homo sapien
tgcaaccttcattcagtatcacaac

SEQ ID NO: 140541 - DNA, 25 bp, Homo sapien
gtatcacaactctgctgagagcact

SEQ ID NO: 140542 - DNA, 25 bp, Homo sapien
tgagagcactgcagcctgtggtgtt

SEQ ID NO: 140543 - DNA, 25 bp, Homo sapien
gtgttgaggctcacagcgatgccat

SEQ ID NO: 140544 - DNA, 25 bp, Homo sapien
atcagagaggccattcgacgctaca

SEQ ID NO: 140545 - DNA, 25 bp, Homo sapien
cattcgacgctacagccacaggatt

SEQ ID NO: 140546 - DNA, 25 bp, Homo sapien
attcacaaatgcctaccgcaggaat

SEQ ID NO: 140547 - DNA, 25 bp, Homo sapien
cctgtggacatcacggttccaggaa

SEQ ID NO: 140548 - DNA, 25 bp, Homo sapien
tggacatcacggttccaggaacagc

SEQ ID NO: 140549 - DNA, 25 bp, Homo sapien
catcacggttccaggaacagccctt

SEQ ID NO: 140550 - DNA, 25 bp, Homo sapien
agcctggagagttcatcactacgta

SEQ ID NO: 140551 - DNA, 25 bp, Homo sapien
ggagagttcatcactacgtaaggaa

SEQ ID NO: 140552 - DNA, 25 bp, Homo sapien
tcatcactacgtaaggaaagctcct

SEQ ID NO: 140553 - DNA, 25 bp, Homo sapien
aagccctcaccatgcctaacagagg

SEQ ID NO: 140554 - DNA, 25 bp, Homo sapien
ggacttctgtttaaaagatgtttat

SEQ ID NO: 140555 - DNA, 25 bp, Homo sapien
gatgtttataatgtctgggagagag

SEQ ID NO: 140556 - DNA, 25 bp, Homo sapien
aggataggatgggaatgctgcccta

SEQ ID NO: 140557 - DNA, 25 bp, Homo sapien
tctattaaccacttctaagggtaca

SEQ ID NO: 140558 - DNA, 25 bp, Homo sapien
gttttaatagaacctgtaacttcat

SEQ ID NO: 140559 - DNA, 25 bp, Homo sapien
acttcattttggaaatgcttctcca

SEQ ID NO: 140560 - DNA, 25 bp, Homo sapien
tgcttctccaccaaataagggcttt

SEQ ID NO: 140561 - DNA, 25 bp, Homo sapien
aataggcagctgtagatcttgatct

SEQ ID NO: 140562 - DNA, 25 bp, Homo sapien
gtagatcttgatcttccaggtaccc

SEQ ID NO: 140563 - DNA, 25 bp, Homo sapien
ccaggtaccccatgtacctttattg

SEQ ID NO: 140564 - DNA, 25 bp, Homo sapien
atactgtcaaattgccacgatctca

SEQ ID NO: 140565 - DNA, 25 bp, Homo sapien
gccacgatctcactaaaggatttct

SEQ ID NO: 140566 - DNA, 25 bp, Homo sapien
aaggatttctatttgctgtcagtta

SEQ ID NO: 140567 - DNA, 25 bp, Homo sapien
tattctttctactgagggcattgtc

SEQ ID NO: 140568 - DNA, 25 bp, Homo sapien
gagggcattgtctgttttctttgta

SEQ ID NO: 140569 - DNA, 25 bp, Homo sapien
gggatgctaaccacagggcctgaga

SEQ ID NO: 140570 - DNA, 25 bp, Homo sapien
acagggcctgagaagtcttgcttta

SEQ ID NO: 140571 - DNA, 25 bp, Homo sapien
gaagtcttgctttatgggctcaaga

SEQ ID NO: 140572 - DNA, 25 bp, Homo sapien
ctcaagaatgccatgcgctggcagt

SEQ ID NO: 140573 - DNA, 25 bp, Homo sapien
tgcgctggcagtacatgtgcacaaa

SEQ ID NO: 140574 - DNA, 25 bp, Homo sapien
aaagcagaatctcagagggtctcct

SEQ ID NO: 140575 - DNA, 25 bp, Homo sapien
gctgcacagcaacaccacagaacaa

SEQ ID NO: 140576 - DNA, 25 bp, Homo sapien
tgccttccagaaatatagtccaagc

SEQ ID NO: 140577 - DNA, 25 bp, Homo sapien
tatagtccaagctttctctgtggaa

SEQ ID NO: 140578 - DNA, 25 bp, Homo sapien
gtagacatgtttccctattgctttc

SEQ ID NO: 140579 - DNA, 25 bp, Homo sapien
gtttccctattgctttcataggcac

SEQ ID NO: 140580 - DNA, 25 bp, Homo sapien
taaaaattagcaacccgaaaggatg

SEQ ID NO: 140581 - DNA, 25 bp, Homo sapien
gtgtgaaagggaagtcaaagtcagc

SEQ ID NO: 140582 - DNA, 25 bp, Homo sapien
gtcagcttgttcagacttactgggt

SEQ ID NO: 140583 - DNA, 25 bp, Homo sapien
gcttgttcagacttactgggtaatc

SEQ ID NO: 140584 - DNA, 25 bp, Homo sapien
actgggtaatcagccaagttcattt

SEQ ID NO: 140585 - DNA, 25 bp, Homo sapien
attttctggctccaacctgacattg

SEQ ID NO: 140586 - DNA, 25 bp, Homo sapien
ggctccaacctgacattgaatgatg

SEQ ID NO: 140587 - DNA, 25 bp, Homo sapien
acctgacattgaatgatgactggaa

SEQ ID NO: 140588 - DNA, 25 bp, Homo sapien
tccagtagatcctttcacgaccttg

SEQ ID NO: 140589 - DNA, 25 bp, Homo sapien
agtagatcctttcacgaccttggcc

SEQ ID NO: 140590 - DNA, 25 bp, Homo sapien
acgaccttggcctctaaggcttcac

SEQ ID NO: 140591 - DNA, 25 bp, Homo sapien
aaagctgcatctaataatgttcaat

SEQ ID NO: 140592 - DNA, 25 bp, Homo sapien
tatttattacttactgcttactcgt

SEQ ID NO: 140593 - DNA, 25 bp, Homo sapien
tgcttactcgtaatgatctagtggg

SEQ ID NO: 140594 - DNA, 25 bp, Homo sapien
taaaatactgattaagccatgggca

SEQ ID NO: 140595 - DNA, 25 bp, Homo sapien
agccatgggcaggtactgactgaag

SEQ ID NO: 140596 - DNA, 25 bp, Homo sapien
ggtactgactgaagatgcaatccaa

SEQ ID NO: 140597 - DNA, 25 bp, Homo sapien
aatccaaccaaagccattacatttt

SEQ ID NO: 140598 - DNA, 25 bp, Homo sapien
ttttgagttagatgggactctctgg

SEQ ID NO: 140599 - DNA, 25 bp, Homo sapien
ggactctctggatagttgaacctct

SEQ ID NO: 140600 - DNA, 25 bp, Homo sapien
gatagttgaacctcttcactttata

SEQ ID NO: 140601 - DNA, 25 bp, Homo sapien
gagagaaaatcactgctgtatacta

SEQ ID NO: 140602 - DNA, 25 bp, Homo sapien
ttgatcacctgaactttctctagca

SEQ ID NO: 140603 - DNA, 25 bp, Homo sapien
gagtgtggttccaagagatccatca

SEQ ID NO: 140604 - DNA, 25 bp, Homo sapien
ggcctgtgccataaaatgtgcttct

SEQ ID NO: 140605 - DNA, 25 bp, Homo sapien
tgtgcttctcttcttcgggatgttg

SEQ ID NO: 140606 - DNA, 25 bp, Homo sapien
tcgggatgttgtttgctgtctgatc

SEQ ID NO: 140607 - DNA, 25 bp, Homo sapien
gatctttgtagactgttcctgtttg

SEQ ID NO: 140608 - DNA, 25 bp, Homo sapien
tgggagcttctctgctgcttaaatt

SEQ ID NO: 140609 - DNA, 25 bp, Homo sapien
tctgctgcttaaattgttcgtcctc

SEQ ID NO: 140610 - DNA, 25 bp, Homo sapien
ccctcctatcgttggtttgtctaga

SEQ ID NO: 140611 - DNA, 25 bp, Homo sapien
gtttgtctagaacactcagctgctt

SEQ ID NO: 140612 - DNA, 25 bp, Homo sapien
tctaactttatgaactccctctgtg

SEQ ID NO: 140613 - DNA, 25 bp, Homo sapien
gccagcatccttggatcagtactga

SEQ ID NO: 140614 - DNA, 25 bp, Homo sapien
agcatccttggatcagtactgaact

SEQ ID NO: 140615 - DNA, 25 bp, Homo sapien
ggatcagtactgaactcagttccat

SEQ ID NO: 140616 - DNA, 25 bp, Homo sapien
tgaactcagttccatccgtaaaata

SEQ ID NO: 140617 - DNA, 25 bp, Homo sapien
agttccatccgtaaaatatgtaaag

SEQ ID NO: 140618 - DNA, 25 bp, Homo sapien
tgtaaaggtaagtggcagctgctct

SEQ ID NO: 140619 - DNA, 25 bp, Homo sapien
gtggcagctgctctatttaatgaaa

SEQ ID NO: 140620 - DNA, 25 bp, Homo sapien
taattctgtgattgtgtgtatgtgt

SEQ ID NO: 140621 - DNA, 25 bp, Homo sapien
gtgtgttgaaactgtaaagctttta

SEQ ID NO: 140622 - DNA, 25 bp, Homo sapien
gtaaagcttttatgactctaatatt

SEQ ID NO: 140623 - DNA, 25 bp, Homo sapien
gaacatgattgagcttaaatgatca

SEQ ID NO: 140624 - DNA, 25 bp, Homo sapien
acctcttcactctgaatcctcatga

SEQ ID NO: 140625 - DNA, 25 bp, Homo sapien
tcttcactctgaatcctcatgaggc

SEQ ID NO: 140626 - DNA, 25 bp, Homo sapien
ttcactctgaatcctcatgaggctt

SEQ ID NO: 140627 - DNA, 25 bp, Homo sapien
actctgaatcctcatgaggcttctc

SEQ ID NO: 140628 - DNA, 25 bp, Homo sapien
tgaatcctcatgaggcttctcagcc

SEQ ID NO: 140629 - DNA, 25 bp, Homo sapien
atcctcatgaggcttctcagccctg

SEQ ID NO: 140630 - DNA, 25 bp, Homo sapien
tcagccctggatttcctgctgccat

SEQ ID NO: 140631 - DNA, 25 bp, Homo sapien
ccacaactagcgcctgggcagggca

SEQ ID NO: 140632 - DNA, 25 bp, Homo sapien
ggcagggctggcacctctcaacgtc

SEQ ID NO: 140633 - DNA, 25 bp, Homo sapien
agggctggcacctctcaacgtctgt

SEQ ID NO: 140634 - DNA, 25 bp, Homo sapien
gctggcacctctcaacgtctgtgga

SEQ ID NO: 140635 - DNA, 25 bp, Homo sapien
tcccaaacctttcctcaatggacta

SEQ ID NO: 140636 - DNA, 25 bp, Homo sapien
aaacctttcctcaatggactaacag

SEQ ID NO: 140637 - DNA, 25 bp, Homo sapien
acctttcctcaatggactaacagga

SEQ ID NO: 140638 - DNA, 25 bp, Homo sapien
gaatacatagatggagctttgtctg

SEQ ID NO: 140639 - DNA, 25 bp, Homo sapien
tacatagatggagctttgtctggac

SEQ ID NO: 140640 - DNA, 25 bp, Homo sapien
acatagatggagctttgtctggaca

SEQ ID NO: 140641 - DNA, 25 bp, Homo sapien
ctttgtctggacatctgggtgaagt

SEQ ID NO: 140642 - DNA, 25 bp, Homo sapien
tttgtctggacatctgggtgaagtt

SEQ ID NO: 140643 - DNA, 25 bp, Homo sapien
tgtctggacatctgggtgaagtttt

SEQ ID NO: 140644 - DNA, 25 bp, Homo sapien
gtctggacatctgggtgaagtttta

SEQ ID NO: 140645 - DNA, 25 bp, Homo sapien
gagaatagcatcttttgtgggggat

SEQ ID NO: 140646 - DNA, 25 bp, Homo sapien
ggagatcaacagttactgtgactga

SEQ ID NO: 140647 - DNA, 25 bp, Homo sapien
acagttactgtgactgagtcggccc

SEQ ID NO: 140648 - DNA, 25 bp, Homo sapien
agttactgtgactgagtcggcccat

SEQ ID NO: 140649 - DNA, 25 bp, Homo sapien
ttactgtgactgagtcggcccattc

SEQ ID NO: 140650 - DNA, 25 bp, Homo sapien
ctgtgactgagtcggcccattctgt

SEQ ID NO: 140651 - DNA, 25 bp, Homo sapien
aactacataatttctaccagggcca

SEQ ID NO: 140652 - DNA, 25 bp, Homo sapien
tacataatttctaccagggccatat

SEQ ID NO: 140653 - DNA, 25 bp, Homo sapien
taatttctaccagggccatattagc

SEQ ID NO: 140654 - DNA, 25 bp, Homo sapien
ttctaccagggccatattagcagtg

SEQ ID NO: 140655 - DNA, 25 bp, Homo sapien
ccatattagcagtgaaacattttaa

SEQ ID NO: 140656 - DNA, 25 bp, Homo sapien
tgtatatttttcacccctgattatg

SEQ ID NO: 140657 - DNA, 25 bp, Homo sapien
tattccatgtgtggtgtcaatacat

SEQ ID NO: 140658 - DNA, 25 bp, Homo sapien
gtggtgtcaatacattttagcggac

SEQ ID NO: 140659 - DNA, 25 bp, Homo sapien
aacatttctgctactggattcttta

SEQ ID NO: 140660 - DNA, 25 bp, Homo sapien
gaacgttattttgctagttcttaag

SEQ ID NO: 140661 - DNA, 25 bp, Homo sapien
aagactcaggtacctattattgttc

SEQ ID NO: 140662 - DNA, 25 bp, Homo sapien
tattattgttccctggtgaaactga

SEQ ID NO: 140663 - DNA, 25 bp, Homo sapien
aatcaaccaggttactcccacagtt

SEQ ID NO: 140664 - DNA, 25 bp, Homo sapien
cagtttgcccgtgtgttatgtatca

SEQ ID NO: 140665 - DNA, 25 bp, Homo sapien
gcccgtgtgttatgtatcagttata

SEQ ID NO: 140666 - DNA, 25 bp, Homo sapien
ggtatcccaccaagttcaagtcaaa

SEQ ID NO: 140667 - DNA, 25 bp, Homo sapien
aattcctaactttgtatatttctgg

SEQ ID NO: 140668 - DNA, 25 bp, Homo sapien
ctgcagttagcacagaggatggctt

SEQ ID NO: 140669 - DNA, 25 bp, Homo sapien
ttctggccgctgcagtcagcacaga

SEQ ID NO: 140670 - DNA, 25 bp, Homo sapien
tttccccatcgccttctggttgttg

SEQ ID NO: 140671 - DNA, 25 bp, Homo sapien
ccttctggttgttgaagacagcaca

SEQ ID NO: 140672 - DNA, 25 bp, Homo sapien
gggctccgtgtagcaacccaggtgt

SEQ ID NO: 140673 - DNA, 25 bp, Homo sapien
aacccaggtgttgtccgtgtctgtt

SEQ ID NO: 140674 - DNA, 25 bp, Homo sapien
gtgttgtccgtgtctgttgaccaat

SEQ ID NO: 140675 - DNA, 25 bp, Homo sapien
gtgtctgttgaccaatctctattca

SEQ ID NO: 140676 - DNA, 25 bp, Homo sapien
gaccaatctctattcagcatcgtgt

SEQ ID NO: 140677 - DNA, 25 bp, Homo sapien
tattcagcatcgtgtgggtccctaa

SEQ ID NO: 140678 - DNA, 25 bp, Homo sapien
gtgtgggtccctaagcacaataaaa

SEQ ID NO: 140679 - DNA, 25 bp, Homo sapien
atggtataggtgaaggcggctgtgt

SEQ ID NO: 140680 - DNA, 25 bp, Homo sapien
aggcggctgtgtgaccactttcccc

SEQ ID NO: 140681 - DNA, 25 bp, Homo sapien
tctagacaactctctcccttacctg

SEQ ID NO: 140682 - DNA, 25 bp, Homo sapien
ccttacctgtttttgctatggctgt

SEQ ID NO: 140683 - DNA, 25 bp, Homo sapien
cttacctgtttttgctatggctgta

SEQ ID NO: 140684 - DNA, 25 bp, Homo sapien
ctgtttttgctatggctgtaaaggt

SEQ ID NO: 140685 - DNA, 25 bp, Homo sapien
tgtttttgctatggctgtaaaggta

SEQ ID NO: 140686 - DNA, 25 bp, Homo sapien
gctggtcttaggagggtgctaggct

SEQ ID NO: 140687 - DNA, 25 bp, Homo sapien
ggtcttaggagggtgctaggctgca

SEQ ID NO: 140688 - DNA, 25 bp, Homo sapien
actccctggacaccctcaaatgggg

SEQ ID NO: 140689 - DNA, 25 bp, Homo sapien
cctcaaatgggggtttctgtgttat

SEQ ID NO: 140690 - DNA, 25 bp, Homo sapien
aggagactgtggacctcatggttga

SEQ ID NO: 140691 - DNA, 25 bp, Homo sapien
ggagactgtggacctcatggttgag

SEQ ID NO: 140692 - DNA, 25 bp, Homo sapien
gagactgtggacctcatggttgagc

SEQ ID NO: 140693 - DNA, 25 bp, Homo sapien
agactgtggacctcatggttgagca

SEQ ID NO: 140694 - DNA, 25 bp, Homo sapien
gactgtggacctcatggttgagcac

SEQ ID NO: 140695 - DNA, 25 bp, Homo sapien
actgtggacctcatggttgagcaca

SEQ ID NO: 140696 - DNA, 25 bp, Homo sapien
ctgtggacctcatggttgagcacac

SEQ ID NO: 140697 - DNA, 25 bp, Homo sapien
tgtggacctcatggttgagcacacg

SEQ ID NO: 140698 - DNA, 25 bp, Homo sapien
agaagctttttgtttgcatcattta

SEQ ID NO: 140699 - DNA, 25 bp, Homo sapien
gtttgcatcatttaactgaactgtg

SEQ ID NO: 140700 - DNA, 25 bp, Homo sapien
aactgaactgtgaacccttgtgcct

SEQ ID NO: 140701 - DNA, 25 bp, Homo sapien
aactgtgaacccttgtgcctctcat

SEQ ID NO: 140702 - DNA, 25 bp, Homo sapien
gtgcctctcatctttatcatcggag

SEQ ID NO: 140703 - DNA, 25 bp, Homo sapien
tatcatcggagttgacagtgaaaca

SEQ ID NO: 140704 - DNA, 25 bp, Homo sapien
acatcagaagtttgcatctcgcgta

SEQ ID NO: 140705 - DNA, 25 bp, Homo sapien
tttgcatctcgcgtatatgccgtat

SEQ ID NO: 140706 - DNA, 25 bp, Homo sapien
atctcgcgtatatgccgtataaaag

SEQ ID NO: 140707 - DNA, 25 bp, Homo sapien
ttaaatggacaatggactgtacaat

SEQ ID NO: 140708 - DNA, 25 bp, Homo sapien
tggactgtacaataagttacttgaa

SEQ ID NO: 140709 - DNA, 25 bp, Homo sapien
tgccaattcaagtacagatttcaac

SEQ ID NO: 140710 - DNA, 25 bp, Homo sapien
gatttcaacacatcttcaacactat

SEQ ID NO: 140711 - DNA, 25 bp, Homo sapien
agggttcacatcttaacctgtgcaa

SEQ ID NO: 140712 - DNA, 25 bp, Homo sapien
acctgtgcaattcagattgatactc

SEQ ID NO: 140713 - DNA, 25 bp, Homo sapien
ggaaaatcccactcagtttttgatg

SEQ ID NO: 140714 - DNA, 25 bp, Homo sapien
gaacagtttgaacagttttctgtaa

SEQ ID NO: 140715 - DNA, 25 bp, Homo sapien
gttttctgtaatcaagcagcttgca

SEQ ID NO: 140716 - DNA, 25 bp, Homo sapien
caagcagcttgcatagaaattgtat

SEQ ID NO: 140717 - DNA, 25 bp, Homo sapien
aattttacataggttcttggtgctg

SEQ ID NO: 140718 - DNA, 25 bp, Homo sapien
ttctcatgaaggcagcctaactctg

SEQ ID NO: 140719 - DNA, 25 bp, Homo sapien
ctctgaggaaaacaatgccaattca

SEQ ID NO: 140720 - DNA, 25 bp, Homo sapien
gtcctctggcttgggttaattcttc

SEQ ID NO: 140721 - DNA, 25 bp, Homo sapien
tctggcttgggttaattcttcggtg

SEQ ID NO: 140722 - DNA, 25 bp, Homo sapien
aattcttcggtgacactggcgttgc

SEQ ID NO: 140723 - DNA, 25 bp, Homo sapien
atgcccgtcctctggcttgggttaa

SEQ ID NO: 140724 - DNA, 25 bp, Homo sapien
cctctggcttgggttaattcttgga

SEQ ID NO: 140725 - DNA, 25 bp, Homo sapien
taattcttggatgacgtcggcgttg

SEQ ID NO: 140726 - DNA, 25 bp, Homo sapien
ggagaatgtgccgttcctgccctgc

SEQ ID NO: 140727 - DNA, 25 bp, Homo sapien
cctggacacccctcgaaggagaggg

SEQ ID NO: 140728 - DNA, 25 bp, Homo sapien
cctcgaaggagagggcgcttccttg

SEQ ID NO: 140729 - DNA, 25 bp, Homo sapien
gcgcttccttgagtaggtgggctcc

SEQ ID NO: 140730 - DNA, 25 bp, Homo sapien
tccttgagtaggtgggctccccttg

SEQ ID NO: 140731 - DNA, 25 bp, Homo sapien
atgtctctagaatgctgttgccact

SEQ ID NO: 140732 - DNA, 25 bp, Homo sapien
tgtctctagaatgctgttgccactt

SEQ ID NO: 140733 - DNA, 25 bp, Homo sapien
gtctctagaatgctgttgccactta

SEQ ID NO: 140734 - DNA, 25 bp, Homo sapien
tctctagaatgctgttgccacttac

SEQ ID NO: 140735 - DNA, 25 bp, Homo sapien
ctctagaatgctgttgccacttacg

SEQ ID NO: 140736 - DNA, 25 bp, Homo sapien
tctagaatgctgttgccacttacgg

SEQ ID NO: 140737 - DNA, 25 bp, Homo sapien
ctagaatgctgttgccacttacggg

SEQ ID NO: 140738 - DNA, 25 bp, Homo sapien
tagaatgctgttgccacttacgggg

SEQ ID NO: 140739 - DNA, 25 bp, Homo sapien
gaatgctgttgccacttacgggggc

SEQ ID NO: 140740 - DNA, 25 bp, Homo sapien
aatgctgttgccacttacgggggct

SEQ ID NO: 140741 - DNA, 25 bp, Homo sapien
atgctgttgccacttacgggggctg

SEQ ID NO: 140742 - DNA, 25 bp, Homo sapien
gaaggctgtatcattggttttgatg

SEQ ID NO: 140743 - DNA, 25 bp, Homo sapien
tgaaccttgtattagatgatgcaga

SEQ ID NO: 140744 - DNA, 25 bp, Homo sapien
aaacaactgggtcggatcatgctaa

SEQ ID NO: 140745 - DNA, 25 bp, Homo sapien
aaggagataatattactctgctaca

SEQ ID NO: 140746 - DNA, 25 bp, Homo sapien
tactctgctacaaagtgtctccaac

SEQ ID NO: 140747 - DNA, 25 bp, Homo sapien
gtgtctccaactagaaatgatcaat

SEQ ID NO: 140748 - DNA, 25 bp, Homo sapien
ttgtttttagatgtcctttgtccaa

SEQ ID NO: 140749 - DNA, 25 bp, Homo sapien
catattgttttgattaccctcgtgt

SEQ ID NO: 140750 - DNA, 25 bp, Homo sapien
ttttgattaccctcgtgttactaca

SEQ ID NO: 140751 - DNA, 25 bp, Homo sapien
gattaccctcgtgttactacaagat

SEQ ID NO: 140752 - DNA, 25 bp, Homo sapien
tcgtgttactacaagatggcaataa

SEQ ID NO: 140753 - DNA, 25 bp, Homo sapien
agaaggcggcatgtcctgccctcaa

SEQ ID NO: 140754 - DNA, 25 bp, Homo sapien
gagagcaccagatggcccgcactgg

SEQ ID NO: 140755 - DNA, 25 bp, Homo sapien
ggcggcacgcagacagacctgttca

SEQ ID NO: 140756 - DNA, 25 bp, Homo sapien
gacctgttcacctgcggcaagtgca

SEQ ID NO: 140757 - DNA, 25 bp, Homo sapien
aaaagaactgcacctacacacaggt

SEQ ID NO: 140758 - DNA, 25 bp, Homo sapien
gtgcagacccgcagctctgatgagc

SEQ ID NO: 140759 - DNA, 25 bp, Homo sapien
atgaccacctttgttgtctgcaacg

SEQ ID NO: 140760 - DNA, 25 bp, Homo sapien
tggaagttctgctgacccctcgtgt

SEQ ID NO: 140761 - DNA, 25 bp, Homo sapien
tgacccctcgtgtagatgtgctgca

SEQ ID NO: 140762 - DNA, 25 bp, Homo sapien
tccgttgacacagcttctctggaga

SEQ ID NO: 140763 - DNA, 25 bp, Homo sapien
ctctggagaccctagaaggcggcat

SEQ ID NO: 140764 - DNA, 25 bp, Homo sapien
ttgccgaaccaggagctgctcacta

SEQ ID NO: 140765 - DNA, 25 bp, Homo sapien
tgccgaaccaggagctgctcactac

SEQ ID NO: 140766 - DNA, 25 bp, Homo sapien
gaaccaggagctgctcactacctcc

SEQ ID NO: 140767 - DNA, 25 bp, Homo sapien
actacctcctcagggatggccgttg

SEQ ID NO: 140768 - DNA, 25 bp, Homo sapien
tacctcctcagggatggccgttggc

SEQ ID NO: 140769 - DNA, 25 bp, Homo sapien
cctcctcagggatggccgttggcca

SEQ ID NO: 140770 - DNA, 25 bp, Homo sapien
tcagggatggccgttggccacgtct

SEQ ID NO: 140771 - DNA, 25 bp, Homo sapien
cagggatggccgttggccacgtctt

SEQ ID NO: 140772 - DNA, 25 bp, Homo sapien
tggccacgtcttccttctgcctgag

SEQ ID NO: 140773 - DNA, 25 bp, Homo sapien
agaagtcaagcccagccacgtggag

SEQ ID NO: 140774 - DNA, 25 bp, Homo sapien
aacatcacttgaatcctagggcctg

SEQ ID NO: 140775 - DNA, 25 bp, Homo sapien
agagccgggacctcaaggtgatgac

SEQ ID NO: 140776 - DNA, 25 bp, Homo sapien
gatgacagatgtagccggcaaccct

SEQ ID NO: 140777 - DNA, 25 bp, Homo sapien
atgtagccggcaaccctgaagagga

SEQ ID NO: 140778 - DNA, 25 bp, Homo sapien
caaccctgaagaggagcgccgggct

SEQ ID NO: 140779 - DNA, 25 bp, Homo sapien
agcgccgggctgagttctaccacca

SEQ ID NO: 140780 - DNA, 25 bp, Homo sapien
aggaggccgtcagtcgctacttcta

SEQ ID NO: 140781 - DNA, 25 bp, Homo sapien
gcaagatccagcagcgcaggcagga

SEQ ID NO: 140782 - DNA, 25 bp, Homo sapien
gagcagtcgctggttgtgcgcaaca

SEQ ID NO: 140783 - DNA, 25 bp, Homo sapien
gtgcgcaacacctaggagcccaaaa

SEQ ID NO: 140784 - DNA, 25 bp, Homo sapien
aacaagcagcacgacggaactttca

SEQ ID NO: 140785 - DNA, 25 bp, Homo sapien
gacggaactttcagccgtgtcccgg

SEQ ID NO: 140786 - DNA, 25 bp, Homo sapien
aggccccagtaccactcgtaggagg

SEQ ID NO: 140787 - DNA, 25 bp, Homo sapien
ccagtaccactcgtaggaggtctca

SEQ ID NO: 140788 - DNA, 25 bp, Homo sapien
gtaccactcgtaggaggtctcagct

SEQ ID NO: 140789 - DNA, 25 bp, Homo sapien
ccactcgtaggaggtctcagctctg

SEQ ID NO: 140790 - DNA, 25 bp, Homo sapien
gggtggccttgaggcagagccgtgc

SEQ ID NO: 140791 - DNA, 25 bp, Homo sapien
catggaatgggctgtatgtcctgcc

SEQ ID NO: 140792 - DNA, 25 bp, Homo sapien
gaatgggctgtatgtcctgccccaa

SEQ ID NO: 140793 - DNA, 25 bp, Homo sapien
atgggctgtatgtcctgccccaact

SEQ ID NO: 140794 - DNA, 25 bp, Homo sapien
cagagctcagtagccagcctgggtc

SEQ ID NO: 140795 - DNA, 25 bp, Homo sapien
agctcagtagccagcctgggtcctg

SEQ ID NO: 140796 - DNA, 25 bp, Homo sapien
tcctgccagggcttctcgagggctt

SEQ ID NO: 140797 - DNA, 25 bp, Homo sapien
gaaggctgtatcattggttttgatg

SEQ ID NO: 140798 - DNA, 25 bp, Homo sapien
tttgatgagtatatgaaccttgtat

SEQ ID NO: 140799 - DNA, 25 bp, Homo sapien
tgaaccttgtattagatgatgcaga

SEQ ID NO: 140800 - DNA, 25 bp, Homo sapien
gagattcattctaaaacaaagtcaa

SEQ ID NO: 140801 - DNA, 25 bp, Homo sapien
gtcaagaaaacaactgggtcggatc

SEQ ID NO: 140802 - DNA, 25 bp, Homo sapien
aaacaactgggtcggatcatgctaa

SEQ ID NO: 140803 - DNA, 25 bp, Homo sapien
actgggtcggatcatgctaaaagga

SEQ ID NO: 140804 - DNA, 25 bp, Homo sapien
aaggagataatattactctgctaca

SEQ ID NO: 140805 - DNA, 25 bp, Homo sapien
tactctgctacaaagtgtctccaac

SEQ ID NO: 140806 - DNA, 25 bp, Homo sapien
tgctacaaagtgtctccaactagaa

SEQ ID NO: 140807 - DNA, 25 bp, Homo sapien
gtgtctccaactagaaatgatcaat

SEQ ID NO: 140808 - DNA, 25 bp, Homo sapien
tgcgcccggccttgcatgctctttg

SEQ ID NO: 140809 - DNA, 25 bp, Homo sapien
ttgcatgctctttgaccctgaattt

SEQ ID NO: 140810 - DNA, 25 bp, Homo sapien
gcatgctctttgaccctgaatttga

SEQ ID NO: 140811 - DNA, 25 bp, Homo sapien
catgctctttgaccctgaatttgac

SEQ ID NO: 140812 - DNA, 25 bp, Homo sapien
cttgctggggtacagttgcttcctt

SEQ ID NO: 140813 - DNA, 25 bp, Homo sapien
tgcttccttttgaacctccaacagg

SEQ ID NO: 140814 - DNA, 25 bp, Homo sapien
tccttttgaacctccaacagggaag

SEQ ID NO: 140815 - DNA, 25 bp, Homo sapien
ttttgaacctccaacagggaaggct

SEQ ID NO: 140816 - DNA, 25 bp, Homo sapien
ttgaacctccaacagggaaggctct

SEQ ID NO: 140817 - DNA, 25 bp, Homo sapien
gaacctccaacagggaaggctctgt

SEQ ID NO: 140818 - DNA, 25 bp, Homo sapien
gtccagaaaggattgaatgtgaaac

SEQ ID NO: 140819 - DNA, 25 bp, Homo sapien
ttcttcctggagtgccttcattgag

SEQ ID NO: 140820 - DNA, 25 bp, Homo sapien
ttgggtttcctggttccactgctac

SEQ ID NO: 140821 - DNA, 25 bp, Homo sapien
gttccactgctactgacccagaggg

SEQ ID NO: 140822 - DNA, 25 bp, Homo sapien
tcatgaagacttaactggcccagaa

SEQ ID NO: 140823 - DNA, 25 bp, Homo sapien
ggcccagaagctgattttcatgaaa

SEQ ID NO: 140824 - DNA, 25 bp, Homo sapien
aaaatctgccactcagggtctggga

SEQ ID NO: 140825 - DNA, 25 bp, Homo sapien
ctgggatgaaggcttgtcagcactt

SEQ ID NO: 140826 - DNA, 25 bp, Homo sapien
gtcagcacttccagtttagaacgca

SEQ ID NO: 140827 - DNA, 25 bp, Homo sapien
gaacgcaatgtttctagagacatat

SEQ ID NO: 140828 - DNA, 25 bp, Homo sapien
gagacatattggctgtttgttttga

SEQ ID NO: 140829 - DNA, 25 bp, Homo sapien
aaaaggcatcactttcctggatcca

SEQ ID NO: 140830 - DNA, 25 bp, Homo sapien
aggactccactcacaagcctcctga

SEQ ID NO: 140831 - DNA, 25 bp, Homo sapien
cttcttcaactgaccagtcgtggtt

SEQ ID NO: 140832 - DNA, 25 bp, Homo sapien
ttcttcaactgaccagtcgtggtta

SEQ ID NO: 140833 - DNA, 25 bp, Homo sapien
cttcaactgaccagtcgtggttact

SEQ ID NO: 140834 - DNA, 25 bp, Homo sapien
tcaactgaccagtcgtggttactcc

SEQ ID NO: 140835 - DNA, 25 bp, Homo sapien
aactgaccagtcgtggttactccct

SEQ ID NO: 140836 - DNA, 25 bp, Homo sapien
actgaccagtcgtggttactccctg

SEQ ID NO: 140837 - DNA, 25 bp, Homo sapien
tgaccagtcgtggttactccctgct

SEQ ID NO: 140838 - DNA, 25 bp, Homo sapien
gaccagtcgtggttactccctgctg

SEQ ID NO: 140839 - DNA, 25 bp, Homo sapien
agtcgtggttactccctgctgccag

SEQ ID NO: 140840 - DNA, 25 bp, Homo sapien
gtcgtggttactccctgctgccagg

SEQ ID NO: 140841 - DNA, 25 bp, Homo sapien
attcccctcgtgtgactctcttgga

SEQ ID NO: 140842 - DNA, 25 bp, Homo sapien
cctcgtgtgactctcttggattatt

SEQ ID NO: 140843 - DNA, 25 bp, Homo sapien
atgtgttgtggtttggccgtggcca

SEQ ID NO: 140844 - DNA, 25 bp, Homo sapien
tggccatcagggtgggccactctcc

SEQ ID NO: 140845 - DNA, 25 bp, Homo sapien
actcagctccagaataccttcttcg

SEQ ID NO: 140846 - DNA, 25 bp, Homo sapien
gaataccttcttcgctgctagagaa

SEQ ID NO: 140847 - DNA, 25 bp, Homo sapien
ggaagacaggtctagactttctcag

SEQ ID NO: 140848 - DNA, 25 bp, Homo sapien
aggtctagactttctcagtgggaca

SEQ ID NO: 140849 - DNA, 25 bp, Homo sapien
tagactttctcagtgggacaaacca

SEQ ID NO: 140850 - DNA, 25 bp, Homo sapien
tttctcagtgggacaaaccagagca

SEQ ID NO: 140851 - DNA, 25 bp, Homo sapien
gtgggacaaaccagagcagagagca

SEQ ID NO: 140852 - DNA, 25 bp, Homo sapien
tggctaaatctagagctgctaaaag

SEQ ID NO: 140853 - DNA, 25 bp, Homo sapien
gctaaaagggctttaccctcagtga

SEQ ID NO: 140854 - DNA, 25 bp, Homo sapien
gggctttaccctcagtgaaaagtgt

SEQ ID NO: 140855 - DNA, 25 bp, Homo sapien
tttcattatctttcagaaacaggag

SEQ ID NO: 140856 - DNA, 25 bp, Homo sapien
gaaacaggagcccatttctcttctg

SEQ ID NO: 140857 - DNA, 25 bp, Homo sapien
ttctcttctgctggagttattgaca

SEQ ID NO: 140858 - DNA, 25 bp, Homo sapien
gagttattgacattctcctgacctc

SEQ ID NO: 140859 - DNA, 25 bp, Homo sapien
tgtgtgttcctaccttttctgaacc

SEQ ID NO: 140860 - DNA, 25 bp, Homo sapien
tttctgaacctcttagactcttaga

SEQ ID NO: 140861 - DNA, 25 bp, Homo sapien
taactgattagacccaagatttcat

SEQ ID NO: 140862 - DNA, 25 bp, Homo sapien
aaatccctcctgattgtagatttcc

SEQ ID NO: 140863 - DNA, 25 bp, Homo sapien
aattaaggtccaatacatgggttgt

SEQ ID NO: 140864 - DNA, 25 bp, Homo sapien
tttttctggttcacaacagcacaaa

SEQ ID NO: 140865 - DNA, 25 bp, Homo sapien
ggttcacaacagcacaaagtgtctt

SEQ ID NO: 140866 - DNA, 25 bp, Homo sapien
tgttggatttcctttaagatctttt

SEQ ID NO: 140867 - DNA, 25 bp, Homo sapien
tttaccctgaagtcggtgaacactt

SEQ ID NO: 140868 - DNA, 25 bp, Homo sapien
gtcggtgaacacttttctagttaat

SEQ ID NO: 140869 - DNA, 25 bp, Homo sapien
tagttaatttgatactctttctgtg

SEQ ID NO: 140870 - DNA, 25 bp, Homo sapien
aagcttttgctgtagattgcctagt

SEQ ID NO: 140871 - DNA, 25 bp, Homo sapien
ctgtagattgcctagtaaaattact

SEQ ID NO: 140872 - DNA, 25 bp, Homo sapien
gataggttgtttttacatatggtct

SEQ ID NO: 140873 - DNA, 25 bp, Homo sapien
atatggtctatttaagtctgatgtt

SEQ ID NO: 140874 - DNA, 25 bp, Homo sapien
gctgccacttcaccctgtgggaagt

SEQ ID NO: 140875 - DNA, 25 bp, Homo sapien
agccatctcctctagaccaaggcag

SEQ ID NO: 140876 - DNA, 25 bp, Homo sapien
tcctctatcgcccaatgcaaaatcg

SEQ ID NO: 140877 - DNA, 25 bp, Homo sapien
cgcccaatgcaaaatcgatgaaatg

SEQ ID NO: 140878 - DNA, 25 bp, Homo sapien
tctgggccaggccacattcacattc

SEQ ID NO: 140879 - DNA, 25 bp, Homo sapien
tctgtggtccagtgaagctccggac

SEQ ID NO: 140880 - DNA, 25 bp, Homo sapien
gtgaagctccggaccccaggctctg

SEQ ID NO: 140881 - DNA, 25 bp, Homo sapien
acccccctcgtcagaagtacatgag

SEQ ID NO: 140882 - DNA, 25 bp, Homo sapien
agcacacagctttgggcacggtcca

SEQ ID NO: 140883 - DNA, 25 bp, Homo sapien
tgggcacggtccagggcaaactgaa

SEQ ID NO: 140884 - DNA, 25 bp, Homo sapien
gcaaactgaaatgtacgcctgaatt

SEQ ID NO: 140885 - DNA, 25 bp, Homo sapien
tcatcgtcatcactttgcccatagg

SEQ ID NO: 140886 - DNA, 25 bp, Homo sapien
tcgtcatcactttgcccatagggag

SEQ ID NO: 140887 - DNA, 25 bp, Homo sapien
atcactttgcccatagggaggaagg

SEQ ID NO: 140888 - DNA, 25 bp, Homo sapien
ggaagtgccccagctcgctgtacat

SEQ ID NO: 140889 - DNA, 25 bp, Homo sapien
gctcgctgtacatggcctggctgga

SEQ ID NO: 140890 - DNA, 25 bp, Homo sapien
ctgtacatggcctggctggagaccc

SEQ ID NO: 140891 - DNA, 25 bp, Homo sapien
ctccagtcatcctgatccgaggaaa

SEQ ID NO: 140892 - DNA, 25 bp, Homo sapien
agtcatcctgatccgaggaaaccag

SEQ ID NO: 140893 - DNA, 25 bp, Homo sapien
aggaaaacgtgctcaccttttactg

SEQ ID NO: 140894 - DNA, 25 bp, Homo sapien
aaaacgtgctcaccttttactgcca

SEQ ID NO: 140895 - DNA, 25 bp, Homo sapien
acgtgctcaccttttactgccagta

SEQ ID NO: 140896 - DNA, 25 bp, Homo sapien
ctccccgctggccatagcattaagc

SEQ ID NO: 140897 - DNA, 25 bp, Homo sapien
tggccatagcattaagccctcgccc

SEQ ID NO: 140898 - DNA, 25 bp, Homo sapien
cggacacagggaggacgctcccggg

SEQ ID NO: 140899 - DNA, 25 bp, Homo sapien
agctgggcgtcagacccaccggcaa

SEQ ID NO: 140900 - DNA, 25 bp, Homo sapien
gacccaccggcaaccttgcagagga

SEQ ID NO: 140901 - DNA, 25 bp, Homo sapien
cttgcagaggacgacccggggtact

SEQ ID NO: 140902 - DNA, 25 bp, Homo sapien
gggagtctcaagtccgtatgtaaat

SEQ ID NO: 140903 - DNA, 25 bp, Homo sapien
agtctcaagtccgtatgtaaatcag

SEQ ID NO: 140904 - DNA, 25 bp, Homo sapien
ctcaagtccgtatgtaaatcagatc

SEQ ID NO: 140905 - DNA, 25 bp, Homo sapien
aagtccgtatgtaaatcagatctcc

SEQ ID NO: 140906 - DNA, 25 bp, Homo sapien
gtccgtatgtaaatcagatctcccc

SEQ ID NO: 140907 - DNA, 25 bp, Homo sapien
tttgtgcccctgtaggaggtaggtc

SEQ ID NO: 140908 - DNA, 25 bp, Homo sapien
tgtaggaggtaggtccttttctcct

SEQ ID NO: 140909 - DNA, 25 bp, Homo sapien
tccttttctcctccggcctagtagg

SEQ ID NO: 140910 - DNA, 25 bp, Homo sapien
ggtaacatcccatttttcggccaag

SEQ ID NO: 140911 - DNA, 25 bp, Homo sapien
tttcggccaaggtgagttgttttag

SEQ ID NO: 140912 - DNA, 25 bp, Homo sapien
aaatttccacagaaatcctgttcgt

SEQ ID NO: 140913 - DNA, 25 bp, Homo sapien
agaaatcctgttcgtatccccattt

SEQ ID NO: 140914 - DNA, 25 bp, Homo sapien
gtatccccattttgatttccctaag

SEQ ID NO: 140915 - DNA, 25 bp, Homo sapien
cttgttctccctctaaaaagagaat

SEQ ID NO: 140916 - DNA, 25 bp, Homo sapien
aaagagaatgattgcaccctgcctg

SEQ ID NO: 140917 - DNA, 25 bp, Homo sapien
caccctgcctgtttacctcaggatt

SEQ ID NO: 140918 - DNA, 25 bp, Homo sapien
gctgtttcaagctttagtcttatgt

SEQ ID NO: 140919 - DNA, 25 bp, Homo sapien
caagctttagtcttatgtgttgaaa

SEQ ID NO: 140920 - DNA, 25 bp, Homo sapien
aatgtttttgtaagccttggcatga

SEQ ID NO: 140921 - DNA, 25 bp, Homo sapien
agccttggcatgaattagtgttcta

SEQ ID NO: 140922 - DNA, 25 bp, Homo sapien
agtgttctagactctgctttgcaca

SEQ ID NO: 140923 - DNA, 25 bp, Homo sapien
acatctttgtacagagacatcttgg

SEQ ID NO: 140924 - DNA, 25 bp, Homo sapien
gagacatcttggcacctcatcccaa

SEQ ID NO: 140925 - DNA, 25 bp, Homo sapien
acctcatcccaacaaatcacatttg

SEQ ID NO: 140926 - DNA, 25 bp, Homo sapien
gtaatgcggttctgagtggcttgaa

SEQ ID NO: 140927 - DNA, 25 bp, Homo sapien
gtggcttgaaatgtacagaatgttt

SEQ ID NO: 140928 - DNA, 25 bp, Homo sapien
ttaaattcattctcttattggtgac

SEQ ID NO: 140929 - DNA, 25 bp, Homo sapien
tttcttgtgatatctgattccccag

SEQ ID NO: 140930 - DNA, 25 bp, Homo sapien
tgatatctgattccccagtgaggcc

SEQ ID NO: 140931 - DNA, 25 bp, Homo sapien
attccccagtgaggcctgggacctt

SEQ ID NO: 140932 - DNA, 25 bp, Homo sapien
tgggacctttttaagatcgctgtgt

SEQ ID NO: 140933 - DNA, 25 bp, Homo sapien
atcgctgtgtgtctgtaaaccctga

SEQ ID NO: 140934 - DNA, 25 bp, Homo sapien
gtctgtaaaccctgaatctcatctg

SEQ ID NO: 140935 - DNA, 25 bp, Homo sapien
ggagctgttatcatctcagatctct

SEQ ID NO: 140936 - DNA, 25 bp, Homo sapien
gctgttatcatctcagatctcttcg

SEQ ID NO: 140937 - DNA, 25 bp, Homo sapien
gatctcttcgcccatctatggctgt

SEQ ID NO: 140938 - DNA, 25 bp, Homo sapien
tatggctgtgttgtcacatctgtcc

SEQ ID NO: 140939 - DNA, 25 bp, Homo sapien
tttgagatcccccaattctctggaa

SEQ ID NO: 140940 - DNA, 25 bp, Homo sapien
catgttggagacttgggcaatgtga

SEQ ID NO: 140941 - DNA, 25 bp, Homo sapien
gggcaatgtgactgctgacaaagat

SEQ ID NO: 140942 - DNA, 25 bp, Homo sapien
caaagatggtgtggccgatgtgtct

SEQ ID NO: 140943 - DNA, 25 bp, Homo sapien
ccgatgtgtctattgaagattctgt

SEQ ID NO: 140944 - DNA, 25 bp, Homo sapien
aagattctgtgatctcactctcagg

SEQ ID NO: 140945 - DNA, 25 bp, Homo sapien
gtgatctcactctcaggagaccatt

SEQ ID NO: 140946 - DNA, 25 bp, Homo sapien
cactctcaggagaccattgcatcat

SEQ ID NO: 140947 - DNA, 25 bp, Homo sapien
ggagaccattgcatcattggccgca

SEQ ID NO: 140948 - DNA, 25 bp, Homo sapien
atcattggccgcacactggtggtcc

SEQ ID NO: 140949 - DNA, 25 bp, Homo sapien
gccgcacactggtggtccatgaaaa

SEQ ID NO: 140950 - DNA, 25 bp, Homo sapien
gtggtccatgaaaaagcagatgact

SEQ ID NO: 140951 - DNA, 25 bp, Homo sapien
ctcggaccaaacagtgctcatgctt

SEQ ID NO: 140952 - DNA, 25 bp, Homo sapien
aacagtgctcatgcttcaggacctt

SEQ ID NO: 140953 - DNA, 25 bp, Homo sapien
tgcttcaggaccttgtttgtcgaag

SEQ ID NO: 140954 - DNA, 25 bp, Homo sapien
ttgtcgaagatgttggtttcccttt

SEQ ID NO: 140955 - DNA, 25 bp, Homo sapien
aaagctagtctgtcttgaaacttgt

SEQ ID NO: 140956 - DNA, 25 bp, Homo sapien
gtctgtcttgaaacttgtttacctt

SEQ ID NO: 140957 - DNA, 25 bp, Homo sapien
aattatcagaatctcagtgtttgaa

SEQ ID NO: 140958 - DNA, 25 bp, Homo sapien
gaaagtactgaagcacaaacatata

SEQ ID NO: 140959 - DNA, 25 bp, Homo sapien
agcacaaacatatatcatctctgta

SEQ ID NO: 140960 - DNA, 25 bp, Homo sapien
atcatctctgtaccattctgtacta

SEQ ID NO: 140961 - DNA, 25 bp, Homo sapien
ttctgtactaaagcacttgagtcta

SEQ ID NO: 140962 - DNA, 25 bp, Homo sapien
taatttatgacggacccctcccaag

SEQ ID NO: 140963 - DNA, 25 bp, Homo sapien
cccggtgtggtcctgtgctgtattt

SEQ ID NO: 140964 - DNA, 25 bp, Homo sapien
gtgctgtatttgctacgaaacccat

SEQ ID NO: 140965 - DNA, 25 bp, Homo sapien
tgtatttgctacgaaacccattggc

SEQ ID NO: 140966 - DNA, 25 bp, Homo sapien
tttgctacgaaacccattggcacaa

SEQ ID NO: 140967 - DNA, 25 bp, Homo sapien
gcctcctccattgggtgcactttgg

SEQ ID NO: 140968 - DNA, 25 bp, Homo sapien
attgggtgcactttgggcctatagg

SEQ ID NO: 140969 - DNA, 25 bp, Homo sapien
cctcccccattaatgcactaaattt

SEQ ID NO: 140970 - DNA, 25 bp, Homo sapien
tgcactaaatttaatcgacgggccc

SEQ ID NO: 140971 - DNA, 25 bp, Homo sapien
aatatcccccattttgcgctaattt

SEQ ID NO: 140972 - DNA, 25 bp, Homo sapien
ttgcgctaatttatgacggacccct

SEQ ID NO: 140973 - DNA, 25 bp, Homo sapien
gcctttagttcctactttagccact

SEQ ID NO: 140974 - DNA, 25 bp, Homo sapien
tttagttcctactttagccactggt

SEQ ID NO: 140975 - DNA, 25 bp, Homo sapien
tagttcctactttagccactggttt

SEQ ID NO: 140976 - DNA, 25 bp, Homo sapien
gttcctactttagccactggtttct

SEQ ID NO: 140977 - DNA, 25 bp, Homo sapien
ctactttagccactggtttctcaga

SEQ ID NO: 140978 - DNA, 25 bp, Homo sapien
actttagccactggtttctcagaat

SEQ ID NO: 140979 - DNA, 25 bp, Homo sapien
ggtttctcagaatccaaagatcaca

SEQ ID NO: 140980 - DNA, 25 bp, Homo sapien
tctcagaatccaaagatcacatatt

SEQ ID NO: 140981 - DNA, 25 bp, Homo sapien
gatcacatattctagtgtaacactg

SEQ ID NO: 140982 - DNA, 25 bp, Homo sapien
tagtgtaacactgcaagaagtcttg

SEQ ID NO: 140983 - DNA, 25 bp, Homo sapien
aatgcatcatcatagaaaaactttt

SEQ ID NO: 140984 - DNA, 25 bp, Homo sapien
ctcctggaagcctgaagcaggcagg

SEQ ID NO: 140985 - DNA, 25 bp, Homo sapien
gggccggtggacttcgtcggatgaa

SEQ ID NO: 140986 - DNA, 25 bp, Homo sapien
tcggatgaagagtgatcctccttcc

SEQ ID NO: 140987 - DNA, 25 bp, Homo sapien
ctggcccttggctgtgacacaagat

SEQ ID NO: 140988 - DNA, 25 bp, Homo sapien
ttggctgtgacacaagatcctcctg

SEQ ID NO: 140989 - DNA, 25 bp, Homo sapien
tgtgacacaagatcctcctgcaggg

SEQ ID NO: 140990 - DNA, 25 bp, Homo sapien
agatcctcctgcagggctaggcgga

SEQ ID NO: 140991 - DNA, 25 bp, Homo sapien
ggctaggcggattgttctggatttc

SEQ ID NO: 140992 - DNA, 25 bp, Homo sapien
ggattgttctggatttccttttgtt

SEQ ID NO: 140993 - DNA, 25 bp, Homo sapien
ctccctggtgctcattggaatctga

SEQ ID NO: 140994 - DNA, 25 bp, Homo sapien
tgctcattggaatctgagtagagtc

SEQ ID NO: 140995 - DNA, 25 bp, Homo sapien
tcacctcctaagcagtcctggcttt

SEQ ID NO: 140996 - DNA, 25 bp, Homo sapien
aagcagtcctggcttttcctcatca

SEQ ID NO: 140997 - DNA, 25 bp, Homo sapien
actcccctctacagtgcctggtaga

SEQ ID NO: 140998 - DNA, 25 bp, Homo sapien
tcccctctacagtgcctggtagaca

SEQ ID NO: 140999 - DNA, 25 bp, Homo sapien
gctacattgaagaacacaaacctct

SEQ ID NO: 141000 - DNA, 25 bp, Homo sapien
gaagaacacaaacctcttgttaaga

SEQ ID NO: 141001 - DNA, 25 bp, Homo sapien
aacctcttgttaagacttgtcctgt

SEQ ID NO: 141002 - DNA, 25 bp, Homo sapien
gttaagacttgtcctgtagcttgat

SEQ ID NO: 141003 - DNA, 25 bp, Homo sapien
gacttgtcctgtagcttgatattac

SEQ ID NO: 141004 - DNA, 25 bp, Homo sapien
tgtgctattagtgcaataaggtgaa

SEQ ID NO: 141005 - DNA, 25 bp, Homo sapien
taaggtgaaggctgtctgcccagag

SEQ ID NO: 141006 - DNA, 25 bp, Homo sapien
agctctgtctgctcaatgccattgt

SEQ ID NO: 141007 - DNA, 25 bp, Homo sapien
gccattgtgcagagaagcaccctaa

SEQ ID NO: 141008 - DNA, 25 bp, Homo sapien
gcaccctaatgcataagctttttaa

SEQ ID NO: 141009 - DNA, 25 bp, Homo sapien
taatgctgtaaaatatagtcgctga

SEQ ID NO: 141010 - DNA, 25 bp, Homo sapien
atagtcgctgaaattaaatgccact

SEQ ID NO: 141011 - DNA, 25 bp, Homo sapien
tggaactattccatcaataggcaaa

SEQ ID NO: 141012 - DNA, 25 bp, Homo sapien
aagtgtaacaacctatctagatgga

SEQ ID NO: 141013 - DNA, 25 bp, Homo sapien
tgtaatttctgcacaggtctctgtt

SEQ ID NO: 141014 - DNA, 25 bp, Homo sapien
gcacaggtctctgtttagtaaatac

SEQ ID NO: 141015 - DNA, 25 bp, Homo sapien
atacatcactgtataccgatcagga

SEQ ID NO: 141016 - DNA, 25 bp, Homo sapien
taccgatcaggaatcttgctccaat

SEQ ID NO: 141017 - DNA, 25 bp, Homo sapien
aaacctttaagtctgagtatgcctg

SEQ ID NO: 141018 - DNA, 25 bp, Homo sapien
aagtctgagtatgcctgtaattaca

SEQ ID NO: 141019 - DNA, 25 bp, Homo sapien
agttcactgcatccaagaagaggag

SEQ ID NO: 141020 - DNA, 25 bp, Homo sapien
gaaaacactgaacaaagagcctggt

SEQ ID NO: 141021 - DNA, 25 bp, Homo sapien
ttaattttgagttttctgacagaag

SEQ ID NO: 141022 - DNA, 25 bp, Homo sapien
aagattgatattttgtgtattgaac

SEQ ID NO: 141023 - DNA, 25 bp, Homo sapien
gtattgaacaggaagactgccagta

SEQ ID NO: 141024 - DNA, 25 bp, Homo sapien
aaatccttctgggaatctgtaggtt

SEQ ID NO: 141025 - DNA, 25 bp, Homo sapien
gaatctgtaggttatttcttggaaa

SEQ ID NO: 141026 - DNA, 25 bp, Homo sapien
ggaaattgcaatacgtagttctaga

SEQ ID NO: 141027 - DNA, 25 bp, Homo sapien
tctctcagaaacaaaggcaatgtgc

SEQ ID NO: 141028 - DNA, 25 bp, Homo sapien
ctgggagtcactgatgctgcctctg

SEQ ID NO: 141029 - DNA, 25 bp, Homo sapien
gagtcactgatgctgcctctgcctt

SEQ ID NO: 141030 - DNA, 25 bp, Homo sapien
tgccttctgatgctggactggcctt

SEQ ID NO: 141031 - DNA, 25 bp, Homo sapien
tgatgctggactggccttgcttcta

SEQ ID NO: 141032 - DNA, 25 bp, Homo sapien
gactggccttgcttctacaagtatg

SEQ ID NO: 141033 - DNA, 25 bp, Homo sapien
ttgcttctacaagtatgcttctccc

SEQ ID NO: 141034 - DNA, 25 bp, Homo sapien
ttctacaagtatgcttctcccacag

SEQ ID NO: 141035 - DNA, 25 bp, Homo sapien
aagtatgcttctcccacagctgtgg

SEQ ID NO: 141036 - DNA, 25 bp, Homo sapien
gaacttaatttatagggaggagcct

SEQ ID NO: 141037 - DNA, 25 bp, Homo sapien
aatttatagggaggagcctgtggca

SEQ ID NO: 141038 - DNA, 25 bp, Homo sapien
tcgtggcttctcattttccattccc

SEQ ID NO: 141039 - DNA, 25 bp, Homo sapien
gacgctgcctttttatacactgtcc

SEQ ID NO: 141040 - DNA, 25 bp, Homo sapien
tccaccttgatggacccctagtgat

SEQ ID NO: 141041 - DNA, 25 bp, Homo sapien
caccttgatggacccctagtgatgc

SEQ ID NO: 141042 - DNA, 25 bp, Homo sapien
gatggacccctagtgatgcatcctg

SEQ ID NO: 141043 - DNA, 25 bp, Homo sapien
tagtgatgcatcctgcctaggctgg

SEQ ID NO: 141044 - DNA, 25 bp, Homo sapien
gtgatgcatcctgcctaggctggac

SEQ ID NO: 141045 - DNA, 25 bp, Homo sapien
tgtccccagttactctaaccgttat

SEQ ID NO: 141046 - DNA, 25 bp, Homo sapien
tactctaaccgttatttcatttagc

SEQ ID NO: 141047 - DNA, 25 bp, Homo sapien
ccatatatattttcttacctaagag

SEQ ID NO: 141048 - DNA, 25 bp, Homo sapien
tacctaagagaatagtttcctgctt

SEQ ID NO: 141049 - DNA, 25 bp, Homo sapien
acctacaataggtggtggaattatg

SEQ ID NO: 141050 - DNA, 25 bp, Homo sapien
tgctctccaaagaccaacggtttgg

SEQ ID NO: 141051 - DNA, 25 bp, Homo sapien
accaaggttggtgcgacgagcatca

SEQ ID NO: 141052 - DNA, 25 bp, Homo sapien
gacgagcatcagaacccggaaatag

SEQ ID NO: 141053 - DNA, 25 bp, Homo sapien
gaaaggccgccttggcaacgaaaag

SEQ ID NO: 141054 - DNA, 25 bp, Homo sapien
aaagcagacttgtggtgaatgggca

SEQ ID NO: 141055 - DNA, 25 bp, Homo sapien
gaatgggcaagcatggttgtgactt

SEQ ID NO: 141056 - DNA, 25 bp, Homo sapien
gttgtgacttgttactcaaacccaa

SEQ ID NO: 141057 - DNA, 25 bp, Homo sapien
actcaaacccaatcgaccgtggaat

SEQ ID NO: 141058 - DNA, 25 bp, Homo sapien
gtggaatccacttaaagtcctctat

SEQ ID NO: 141059 - DNA, 25 bp, Homo sapien
tccacttaaagtcctctatccagag

SEQ ID NO: 141060 - DNA, 25 bp, Homo sapien
tctatccagaggcattctttgggaa

SEQ ID NO: 141061 - DNA, 25 bp, Homo sapien
tggttccattcttaccatttttgcc

SEQ ID NO: 141062 - DNA, 25 bp, Homo sapien
aacatttacttgatggtccagttaa

SEQ ID NO: 141063 - DNA, 25 bp, Homo sapien
gacacttgggtcagattcagcattt

SEQ ID NO: 141064 - DNA, 25 bp, Homo sapien
atttggatggcaattggcttcctga

SEQ ID NO: 141065 - DNA, 25 bp, Homo sapien
ggcaattggcttcctgatttacttt

SEQ ID NO: 141066 - DNA, 25 bp, Homo sapien
attagacacagcctggagggtcatc

SEQ ID NO: 141067 - DNA, 25 bp, Homo sapien
aagatgcttatccagacaacgttca

SEQ ID NO: 141068 - DNA, 25 bp, Homo sapien
ccagacaacgttcatgcagcagcag

SEQ ID NO: 141069 - DNA, 25 bp, Homo sapien
aatctgccattcaagcaaatgacca

SEQ ID NO: 141070 - DNA, 25 bp, Homo sapien
gaccatcacccaagaaatctcagtt

SEQ ID NO: 141071 - DNA, 25 bp, Homo sapien
atctcagttcacctttcatattcca

SEQ ID NO: 141072 - DNA, 25 bp, Homo sapien
aattgatgcctttattgtcccaaat

SEQ ID NO: 141073 - DNA, 25 bp, Homo sapien
gatgcctttattgtcccaaatttac

SEQ ID NO: 141074 - DNA, 25 bp, Homo sapien
tgtcctgtttgccacttcatttcat

SEQ ID NO: 141075 - DNA, 25 bp, Homo sapien
acttcatttcatttccttgagtaaa

SEQ ID NO: 141076 - DNA, 25 bp, Homo sapien
acgcagtggcatggcctggctcctt

SEQ ID NO: 141077 - DNA, 25 bp, Homo sapien
tccctgagtggccttgttgccttgg

SEQ ID NO: 141078 - DNA, 25 bp, Homo sapien
gttgccttgggcgtgtgttcagcac

SEQ ID NO: 141079 - DNA, 25 bp, Homo sapien
acctcccatcccatggatacagtgg

SEQ ID NO: 141080 - DNA, 25 bp, Homo sapien
gtggagattccatacaggccttact

SEQ ID NO: 141081 - DNA, 25 bp, Homo sapien
ttccatacaggccttacttagctcc

SEQ ID NO: 141082 - DNA, 25 bp, Homo sapien
tacttagctccttgcgatactgtga

SEQ ID NO: 141083 - DNA, 25 bp, Homo sapien
gaaacgtaaaatggatggcgcacct

SEQ ID NO: 141084 - DNA, 25 bp, Homo sapien
aatggatggcgcacctgatggtcga

SEQ ID NO: 141085 - DNA, 25 bp, Homo sapien
gcgcacctgatggtcgaggaagaaa

SEQ ID NO: 141086 - DNA, 25 bp, Homo sapien
ataatcactaactttaaaccagtag

SEQ ID NO: 141087 - DNA, 25 bp, Homo sapien
tttaatttacgggtcttcataagat

SEQ ID NO: 141088 - DNA, 25 bp, Homo sapien
tttacgggtcttcataagatgtact

SEQ ID NO: 141089 - DNA, 25 bp, Homo sapien
agatgtactgtacaatgctcaattg

SEQ ID NO: 141090 - DNA, 25 bp, Homo sapien
atgctcaattgttatgtcatttaaa

SEQ ID NO: 141091 - DNA, 25 bp, Homo sapien
gtcatttaaagacatcaggttcatc

SEQ ID NO: 141092 - DNA, 25 bp, Homo sapien
agacatcaggttcatctgtttactg

SEQ ID NO: 141093 - DNA, 25 bp, Homo sapien
acagctgtgctgaaatttttttatc

SEQ ID NO: 141094 - DNA, 25 bp, Homo sapien
ttacgatctgtttccaaatcccttt

SEQ ID NO: 141095 - DNA, 25 bp, Homo sapien
aaatccctttcatgtctttccactt

SEQ ID NO: 141096 - DNA, 25 bp, Homo sapien
ttcatgtctttccacttctctgggt

SEQ ID NO: 141097 - DNA, 25 bp, Homo sapien
gggtgcatttgttactcatcgggcc

SEQ ID NO: 141098 - DNA, 25 bp, Homo sapien
atttgttactcatcgggcccaggga

SEQ ID NO: 141099 - DNA, 25 bp, Homo sapien
gacattgcagagtggcctagagcac

SEQ ID NO: 141100 - DNA, 25 bp, Homo sapien
ttccaaatgcccaaggatgccttag

SEQ ID NO: 141101 - DNA, 25 bp, Homo sapien
gatgccttagcatgtgactcctgaa

SEQ ID NO: 141102 - DNA, 25 bp, Homo sapien
agaggaatttggctgcttctacggc

SEQ ID NO: 141103 - DNA, 25 bp, Homo sapien
tggctgcttctacggccatgagact

SEQ ID NO: 141104 - DNA, 25 bp, Homo sapien
tgatccctggccactgaaaagcttt

SEQ ID NO: 141105 - DNA, 25 bp, Homo sapien
caagaatatcatgctatacaggtgc

SEQ ID NO: 141106 - DNA, 25 bp, Homo sapien
tatacaggtgcaactcaatccccgt

SEQ ID NO: 141107 - DNA, 25 bp, Homo sapien
gtgcaactcaatccccgttaataaa

SEQ ID NO: 141108 - DNA, 25 bp, Homo sapien
gtaggtataggcattctaccctttc

SEQ ID NO: 141109 - DNA, 25 bp, Homo sapien
ggcattctaccctttcaaatagctg

SEQ ID NO: 141110 - DNA, 25 bp, Homo sapien
tttcaaatagctgtgtcccaacctg

SEQ ID NO: 141111 - DNA, 25 bp, Homo sapien
tcccaacctgttgccattgattttt

SEQ ID NO: 141112 - DNA, 25 bp, Homo sapien
gttgtccttgaattgtctaaccatg

SEQ ID NO: 141113 - DNA, 25 bp, Homo sapien
acataaacagttgtctcccttctac

SEQ ID NO: 141114 - DNA, 25 bp, Homo sapien
tctactgtgtagaatactttgactt

SEQ ID NO: 141115 - DNA, 25 bp, Homo sapien
tttactgctgttactatttgattag

SEQ ID NO: 141116 - DNA, 25 bp, Homo sapien
cctggatacttctaatgaccctgac

SEQ ID NO: 141117 - DNA, 25 bp, Homo sapien
ggatacttctaatgaccctgacgac

SEQ ID NO: 141118 - DNA, 25 bp, Homo sapien
atgaccctgacgacctggacgtgct

SEQ ID NO: 141119 - DNA, 25 bp, Homo sapien
tgacgacctggacgtgctcagaacc

SEQ ID NO: 141120 - DNA, 25 bp, Homo sapien
tggacgtgctcagaacccggcatgc

SEQ ID NO: 141121 - DNA, 25 bp, Homo sapien
ggccaggtatctgctggccgctgac

SEQ ID NO: 141122 - DNA, 25 bp, Homo sapien
ggcctgccgactgactgtgtggcat

SEQ ID NO: 141123 - DNA, 25 bp, Homo sapien
ctgccgactgactgtgtggcatgga

SEQ ID NO: 141124 - DNA, 25 bp, Homo sapien
ggagcatggctgttccccaagtgca

SEQ ID NO: 141125 - DNA, 25 bp, Homo sapien
atggctgttccccaagtgcacacct

SEQ ID NO: 141126 - DNA, 25 bp, Homo sapien
gtgcacacctgaacacttggaggaa

SEQ ID NO: 141127 - DNA, 25 bp, Homo sapien
gccctaaaatatagtggtgatccct

SEQ ID NO: 141128 - DNA, 25 bp, Homo sapien
gtggtgatccctcaattggtaacat

SEQ ID NO: 141129 - DNA, 25 bp, Homo sapien
gtaacatatcagatgaaatggccaa

SEQ ID NO: 141130 - DNA, 25 bp, Homo sapien
aaaactgcacagtggaaggcacttt

SEQ ID NO: 141131 - DNA, 25 bp, Homo sapien
gaaggcactttccatgaatactgag

SEQ ID NO: 141132 - DNA, 25 bp, Homo sapien
gagaatgccaaagtaaccagatcta

SEQ ID NO: 141133 - DNA, 25 bp, Homo sapien
aaccagatctaacatgagtcctgat

SEQ ID NO: 141134 - DNA, 25 bp, Homo sapien
acgtggagctgaaacttcatataga

SEQ ID NO: 141135 - DNA, 25 bp, Homo sapien
gaatggaaccaagaggcatatacat

SEQ ID NO: 141136 - DNA, 25 bp, Homo sapien
acatatgtaagggtgcgatcatggc

SEQ ID NO: 141137 - DNA, 25 bp, Homo sapien
gcgatcatggcactatatatagaat

SEQ ID NO: 141138 - DNA, 25 bp, Homo sapien
ggtggcagacatgtccaaggaatat

SEQ ID NO: 141139 - DNA, 25 bp, Homo sapien
ggatttgatccctttatgaaccttg

SEQ ID NO: 141140 - DNA, 25 bp, Homo sapien
gatccctttatgaaccttgtgatag

SEQ ID NO: 141141 - DNA, 25 bp, Homo sapien
gaaccttgtgatagatgaatgtgtg

SEQ ID NO: 141142 - DNA, 25 bp, Homo sapien
agatggcgactagtggacaacagaa

SEQ ID NO: 141143 - DNA, 25 bp, Homo sapien
ggcgactagtggacaacagaacaat

SEQ ID NO: 141144 - DNA, 25 bp, Homo sapien
agtatcatcatgttagaagccttgg

SEQ ID NO: 141145 - DNA, 25 bp, Homo sapien
gttagaagccttggaacgagtataa

SEQ ID NO: 141146 - DNA, 25 bp, Homo sapien
ggctgttcagcagagaaacccatgt

SEQ ID NO: 141147 - DNA, 25 bp, Homo sapien
tcagcagagaaacccatgtcctctc

SEQ ID NO: 141148 - DNA, 25 bp, Homo sapien
tgtcctctctccatagggcctgttt

SEQ ID NO: 141149 - DNA, 25 bp, Homo sapien
aaatcagactgaaagccaggacatc

SEQ ID NO: 141150 - DNA, 25 bp, Homo sapien
aaagccaggacatctgagtacctat

SEQ ID NO: 141151 - DNA, 25 bp, Homo sapien
gccaggacatctgagtacctatctc

SEQ ID NO: 141152 - DNA, 25 bp, Homo sapien
ggacatctgagtacctatctcacac

SEQ ID NO: 141153 - DNA, 25 bp, Homo sapien
acatctgagtacctatctcacacac

SEQ ID NO: 141154 - DNA, 25 bp, Homo sapien
atctgagtacctatctcacacactg

SEQ ID NO: 141155 - DNA, 25 bp, Homo sapien
tctgagtacctatctcacacactga

SEQ ID NO: 141156 - DNA, 25 bp, Homo sapien
gagtacctatctcacacactgacca

SEQ ID NO: 141157 - DNA, 25 bp, Homo sapien
acacactgaccaccagtcacaaagt

SEQ ID NO: 141158 - DNA, 25 bp, Homo sapien
actgaccaccagtcacaaagtctgg

SEQ ID NO: 141159 - DNA, 25 bp, Homo sapien
gaccaccagtcacaaagtctggaaa

SEQ ID NO: 141160 - DNA, 25 bp, Homo sapien
cagtcttcccagcaattattacaat

SEQ ID NO: 141161 - DNA, 25 bp, Homo sapien
tttactgccctttcaaagcacttaa

SEQ ID NO: 141162 - DNA, 25 bp, Homo sapien
tgccctttcaaagcacttaagtgtt

SEQ ID NO: 141163 - DNA, 25 bp, Homo sapien
gttagatctaacgtgttccagtgtc

SEQ ID NO: 141164 - DNA, 25 bp, Homo sapien
taacgtgttccagtgtctgtctgag

SEQ ID NO: 141165 - DNA, 25 bp, Homo sapien
ccagtgtctgtctgaggtgacttaa

SEQ ID NO: 141166 - DNA, 25 bp, Homo sapien
aaacttctattatccagagtcatgg

SEQ ID NO: 141167 - DNA, 25 bp, Homo sapien
gtcatgggagagtacaccctttcca

SEQ ID NO: 141168 - DNA, 25 bp, Homo sapien
gagagtacaccctttccaggaataa

SEQ ID NO: 141169 - DNA, 25 bp, Homo sapien
aatcttcccagtattataaattgtg

SEQ ID NO: 141170 - DNA, 25 bp, Homo sapien
tacctggcggtgtataccaggcagt

SEQ ID NO: 141171 - DNA, 25 bp, Homo sapien
actgatgccacccaggacctcggac

SEQ ID NO: 141172 - DNA, 25 bp, Homo sapien
caggacctcggaccttggagcctgc

SEQ ID NO: 141173 - DNA, 25 bp, Homo sapien
tcgcccaccaaccaagtgttacaag

SEQ ID NO: 141174 - DNA, 25 bp, Homo sapien
ccaaccaagtgttacaagccccaga

SEQ ID NO: 141175 - DNA, 25 bp, Homo sapien
tgtctctctggcgttccacctccaa

SEQ ID NO: 141176 - DNA, 25 bp, Homo sapien
tgaagtactacaactccgacgtgca

SEQ ID NO: 141177 - DNA, 25 bp, Homo sapien
agtactacaactccgacgtgcaccg

SEQ ID NO: 141178 - DNA, 25 bp, Homo sapien
gccgcctttgtgctgcccgagtttg

SEQ ID NO: 141179 - DNA, 25 bp, Homo sapien
ttgtgctgcccgagtttgcccgcaa

SEQ ID NO: 141180 - DNA, 25 bp, Homo sapien
gtgctgcccgagtttgcccgcaagg

SEQ ID NO: 141181 - DNA, 25 bp, Homo sapien
agtttgcccgcaaggccctgaatga

SEQ ID NO: 141182 - DNA, 25 bp, Homo sapien
taaacatgcatgctggatgttttca

SEQ ID NO: 141183 - DNA, 25 bp, Homo sapien
gagtaaacacagttaccatactttt

SEQ ID NO: 141184 - DNA, 25 bp, Homo sapien
agttaccatacttttcaattgaaat

SEQ ID NO: 141185 - DNA, 25 bp, Homo sapien
aaatgaaggtttttcatcagcctta

SEQ ID NO: 141186 - DNA, 25 bp, Homo sapien
attaccactaatatgatgtcatcac

SEQ ID NO: 141187 - DNA, 25 bp, Homo sapien
gatgtcatcacaaaatactgccaat

SEQ ID NO: 141188 - DNA, 25 bp, Homo sapien
caaaatactgccaatgaatcatcaa

SEQ ID NO: 141189 - DNA, 25 bp, Homo sapien
gataatctgtaatctagccttgctg

SEQ ID NO: 141190 - DNA, 25 bp, Homo sapien
ctagccttgctgaatgtaacatgta

SEQ ID NO: 141191 - DNA, 25 bp, Homo sapien
gtaacatgtatacttggtcttgaat

SEQ ID NO: 141192 - DNA, 25 bp, Homo sapien
cttggtcttgaattcattgtactga

SEQ ID NO: 141193 - DNA, 25 bp, Homo sapien
aattaagtacgatcacattctttat

SEQ ID NO: 141194 - DNA, 25 bp, Homo sapien
atgatgttggtttaccttttcctag

SEQ ID NO: 141195 - DNA, 25 bp, Homo sapien
ttaccttttcctagttgaagatagt

SEQ ID NO: 141196 - DNA, 25 bp, Homo sapien
gatagtaattaggtttctaagctgt

SEQ ID NO: 141197 - DNA, 25 bp, Homo sapien
gctgtatactgtgtttattggtggc

SEQ ID NO: 141198 - DNA, 25 bp, Homo sapien
ctgtgtttattggtggcagtgacac

SEQ ID NO: 141199 - DNA, 25 bp, Homo sapien
agaaaacctgaattacactacattt

SEQ ID NO: 141200 - DNA, 25 bp, Homo sapien
tacactacattttcgaagtctcttg

SEQ ID NO: 141201 - DNA, 25 bp, Homo sapien
acattttcgaagtctcttgtaatta

SEQ ID NO: 141202 - DNA, 25 bp, Homo sapien
cttgtaattatttgggatatcaaca

SEQ ID NO: 141203 - DNA, 25 bp, Homo sapien
taatcccttgctagtattttaaata

SEQ ID NO: 141204 - DNA, 25 bp, Homo sapien
cttgtattttttctctggtggcatt

SEQ ID NO: 141205 - DNA, 25 bp, Homo sapien
gtattttttctctggtggcattcct

SEQ ID NO: 141206 - DNA, 25 bp, Homo sapien
ttttttctctggtggcattccttta

SEQ ID NO: 141207 - DNA, 25 bp, Homo sapien
tttctctggtggcattcctttagga

SEQ ID NO: 141208 - DNA, 25 bp, Homo sapien
tctctggtggcattcctttaggaat

SEQ ID NO: 141209 - DNA, 25 bp, Homo sapien
attcctttaggaatgctgtgtgtct

SEQ ID NO: 141210 - DNA, 25 bp, Homo sapien
gctgtgtgtctgtccggcaccccgg

SEQ ID NO: 141211 - DNA, 25 bp, Homo sapien
ccggcaccccggtaggcctgattgg

SEQ ID NO: 141212 - DNA, 25 bp, Homo sapien
ttctagtcctccttaaccacttatc

SEQ ID NO: 141213 - DNA, 25 bp, Homo sapien
cttaaccacttatctcccatatgag

SEQ ID NO: 141214 - DNA, 25 bp, Homo sapien
cacttatctcccatatgagagtgtg

SEQ ID NO: 141215 - DNA, 25 bp, Homo sapien
acatttttgtgccattatatttgca

SEQ ID NO: 141216 - DNA, 25 bp, Homo sapien
gtgccattatatttgcattatgtat

SEQ ID NO: 141217 - DNA, 25 bp, Homo sapien
gatatttaggtttttggctgagtac

SEQ ID NO: 141218 - DNA, 25 bp, Homo sapien
aggtttttggctgagtactggaata

SEQ ID NO: 141219 - DNA, 25 bp, Homo sapien
cagtgagcatatctggtatatgtca

SEQ ID NO: 141220 - DNA, 25 bp, Homo sapien
gagcatatctggtatatgtcattat

SEQ ID NO: 141221 - DNA, 25 bp, Homo sapien
atgaaacatatcatggtaatgacag

SEQ ID NO: 141222 - DNA, 25 bp, Homo sapien
gatgccatagcataatatgaagcct

SEQ ID NO: 141223 - DNA, 25 bp, Homo sapien
atatgaagcctttggtgaattcctt

SEQ ID NO: 141224 - DNA, 25 bp, Homo sapien
aagcctttggtgaattccttctaag

SEQ ID NO: 141225 - DNA, 25 bp, Homo sapien
ctttggtgaattccttctaagataa

SEQ ID NO: 141226 - DNA, 25 bp, Homo sapien
agcgcaaccgaccatactgatgact

SEQ ID NO: 141227 - DNA, 25 bp, Homo sapien
gcaaccgaccatactgatgactgtt

SEQ ID NO: 141228 - DNA, 25 bp, Homo sapien
caaccgaccatactgatgactgttt

SEQ ID NO: 141229 - DNA, 25 bp, Homo sapien
agtgaaattgccagagttttgcctg

SEQ ID NO: 141230 - DNA, 25 bp, Homo sapien
attgccagagttttgcctggtgctc

SEQ ID NO: 141231 - DNA, 25 bp, Homo sapien
agagttttgcctggtgctctcctcg

SEQ ID NO: 141232 - DNA, 25 bp, Homo sapien
ttttgcctggtgctctcctcgtggc

SEQ ID NO: 141233 - DNA, 25 bp, Homo sapien
tcctcgtggcctcttcttgggtagt

SEQ ID NO: 141234 - DNA, 25 bp, Homo sapien
cgtggcctcttcttgggtagtgaaa

SEQ ID NO: 141235 - DNA, 25 bp, Homo sapien
tggcctcttcttgggtagtgaaatt

SEQ ID NO: 141236 - DNA, 25 bp, Homo sapien
gcctcttcttgggtagtgaaattaa

SEQ ID NO: 141237 - DNA, 25 bp, Homo sapien
cataccaaccacaataccaacaata

SEQ ID NO: 141238 - DNA, 25 bp, Homo sapien
ggacatgattattgaggcttgattg

SEQ ID NO: 141239 - DNA, 25 bp, Homo sapien
ggcttgattggcaaatacgacttct

SEQ ID NO: 141240 - DNA, 25 bp, Homo sapien
tggcaaatacgacttctacatccat

SEQ ID NO: 141241 - DNA, 25 bp, Homo sapien
tctcatctttcataccatatcacac

SEQ ID NO: 141242 - DNA, 25 bp, Homo sapien
catatcacactactaccactttttg

SEQ ID NO: 141243 - DNA, 25 bp, Homo sapien
actgtatactctttgtttcaggata

SEQ ID NO: 141244 - DNA, 25 bp, Homo sapien
gtttcaggatacttgccttttcaat

SEQ ID NO: 141245 - DNA, 25 bp, Homo sapien
ggatacttgccttttcaattgtcac

SEQ ID NO: 141246 - DNA, 25 bp, Homo sapien
cttgccttttcaattgtcacttgat

SEQ ID NO: 141247 - DNA, 25 bp, Homo sapien
taagctgtgttcagtactgtttctg

SEQ ID NO: 141248 - DNA, 25 bp, Homo sapien
agccatcaagatggtcaaagggcct

SEQ ID NO: 141249 - DNA, 25 bp, Homo sapien
aagaacgggctggacgtgctgttca

SEQ ID NO: 141250 - DNA, 25 bp, Homo sapien
acgtgctgttcaaagttgtccgcta

SEQ ID NO: 141251 - DNA, 25 bp, Homo sapien
gttcaaagttgtccgctacgagggc

SEQ ID NO: 141252 - DNA, 25 bp, Homo sapien
acgagggcttcttcagcctgtggaa

SEQ ID NO: 141253 - DNA, 25 bp, Homo sapien
ttcagcctgtggaagggcttcacgc

SEQ ID NO: 141254 - DNA, 25 bp, Homo sapien
ggaagggcttcacgccgtactatgc

SEQ ID NO: 141255 - DNA, 25 bp, Homo sapien
tcctcaccttcatcttcttggagca

SEQ ID NO: 141256 - DNA, 25 bp, Homo sapien
aagcgtctcttcctcagtggctgaa

SEQ ID NO: 141257 - DNA, 25 bp, Homo sapien
gtttcagggcacacaggacagcaga

SEQ ID NO: 141258 - DNA, 25 bp, Homo sapien
acagcagaagatcccctttgtcagt

SEQ ID NO: 141259 - DNA, 25 bp, Homo sapien
tgcggacggtggtttgtgagcaccg

SEQ ID NO: 141260 - DNA, 25 bp, Homo sapien
tgtgagcaccgggaaggacaacctg

SEQ ID NO: 141261 - DNA, 25 bp, Homo sapien
tgagcaccgggaaggacaacctgct

SEQ ID NO: 141262 - DNA, 25 bp, Homo sapien
aaggacaacctgctcaacgcctgga

SEQ ID NO: 141263 - DNA, 25 bp, Homo sapien
ggacaacctgctcaacgcctggagg

SEQ ID NO: 141264 - DNA, 25 bp, Homo sapien
agcattttccagtccaaggagtcgt

SEQ ID NO: 141265 - DNA, 25 bp, Homo sapien
attttccagtccaaggagtcgtcct

SEQ ID NO: 141266 - DNA, 25 bp, Homo sapien
ttccagtccaaggagtcgtcctcag

SEQ ID NO: 141267 - DNA, 25 bp, Homo sapien
agtccaaggagtcgtcctcagtcct

SEQ ID NO: 141268 - DNA, 25 bp, Homo sapien
tcctgagttgtgacatctccagaaa

SEQ ID NO: 141269 - DNA, 25 bp, Homo sapien
gagttgtgacatctccagaaataac

SEQ ID NO: 141270 - DNA, 25 bp, Homo sapien
acagcaaaggaatctacagctgaaa

SEQ ID NO: 141271 - DNA, 25 bp, Homo sapien
ttatactctcaccatttggatcctg

SEQ ID NO: 141272 - DNA, 25 bp, Homo sapien
tactctcaccatttggatcctgtgt

SEQ ID NO: 141273 - DNA, 25 bp, Homo sapien
tttggatcctgtgtggagagggaat

SEQ ID NO: 141274 - DNA, 25 bp, Homo sapien
aatttacatcatttctttttgggag

SEQ ID NO: 141275 - DNA, 25 bp, Homo sapien
acatcatttctttttgggagagact

SEQ ID NO: 141276 - DNA, 25 bp, Homo sapien
gggagagacttgttttggatgcccc

SEQ ID NO: 141277 - DNA, 25 bp, Homo sapien
tgggattatgggtcacaggaaaaag

SEQ ID NO: 141278 - DNA, 25 bp, Homo sapien
attcctcatgaatgtaaatttgtac

SEQ ID NO: 141279 - DNA, 25 bp, Homo sapien
atttaactgactattcttgatgtaa

SEQ ID NO: 141280 - DNA, 25 bp, Homo sapien
aactgactattcttgatgtaaaatc

SEQ ID NO: 141281 - DNA, 25 bp, Homo sapien
ttctggacaagcttacatcttcctc

SEQ ID NO: 141282 - DNA, 25 bp, Homo sapien
ttacatcttcctcagccatctttgt

SEQ ID NO: 141283 - DNA, 25 bp, Homo sapien
tcagccatctttgtgagtccttcaa

SEQ ID NO: 141284 - DNA, 25 bp, Homo sapien
gagtccttcaagagcagttatcaat

SEQ ID NO: 141285 - DNA, 25 bp, Homo sapien
gagcagttatcaattgttagttaga

SEQ ID NO: 141286 - DNA, 25 bp, Homo sapien
gagaatgcttaagggattccaatcc

SEQ ID NO: 141287 - DNA, 25 bp, Homo sapien
gattccaatcccgatccaaatcata

SEQ ID NO: 141288 - DNA, 25 bp, Homo sapien
taatttgttcttaagtatactgggc

SEQ ID NO: 141289 - DNA, 25 bp, Homo sapien
tatactgggcaggtcccctatttta

SEQ ID NO: 141290 - DNA, 25 bp, Homo sapien
tgtatttagtgctttcctggctctc

SEQ ID NO: 141291 - DNA, 25 bp, Homo sapien
tagtgctttcctggctctcagagag

SEQ ID NO: 141292 - DNA, 25 bp, Homo sapien
ttttttcacgggactgtgtaaagca

SEQ ID NO: 141293 - DNA, 25 bp, Homo sapien
cgggactgtgtaaagcatgtaacta

SEQ ID NO: 141294 - DNA, 25 bp, Homo sapien
catgtaactaggtattgctttggta

SEQ ID NO: 141295 - DNA, 25 bp, Homo sapien
ggtattgctttggtatataactatt

SEQ ID NO: 141296 - DNA, 25 bp, Homo sapien
ataccctttaaattatgacggacat

SEQ ID NO: 141297 - DNA, 25 bp, Homo sapien
attatgacggacatccactagagat

SEQ ID NO: 141298 - DNA, 25 bp, Homo sapien
ggacatccactagagatgggtttga

SEQ ID NO: 141299 - DNA, 25 bp, Homo sapien
ttgaggattttccaagcgtgtaata

SEQ ID NO: 141300 - DNA, 25 bp, Homo sapien
aagcgtgtaataatgatgtttttcc

SEQ ID NO: 141301 - DNA, 25 bp, Homo sapien
tgatgtttttcctaacatgacagat

SEQ ID NO: 141302 - DNA, 25 bp, Homo sapien
tatcctatacatgacagtgtgagac

SEQ ID NO: 141303 - DNA, 25 bp, Homo sapien
cccctagtgccagagattgcacgga

SEQ ID NO: 141304 - DNA, 25 bp, Homo sapien
gattgcacggatctataaaacagac

SEQ ID NO: 141305 - DNA, 25 bp, Homo sapien
gactcagaagtatgccatgtgatgc

SEQ ID NO: 141306 - DNA, 25 bp, Homo sapien
gtatgccatgtgatgctaccttaaa

SEQ ID NO: 141307 - DNA, 25 bp, Homo sapien
gatgctaccttaaagtcagaataac

SEQ ID NO: 141308 - DNA, 25 bp, Homo sapien
tttttgattttcttatccggctgct

SEQ ID NO: 141309 - DNA, 25 bp, Homo sapien
ttgattttcttatccggctgctccc

SEQ ID NO: 141310 - DNA, 25 bp, Homo sapien
tttttgtttacctccctccattcat

SEQ ID NO: 141311 - DNA, 25 bp, Homo sapien
tccattcattcacatgctcatctga

SEQ ID NO: 141312 - DNA, 25 bp, Homo sapien
tgctcatctgagaagacttaagttc

SEQ ID NO: 141313 - DNA, 25 bp, Homo sapien
gaagacttaagttcttccagctttg

SEQ ID NO: 141314 - DNA, 25 bp, Homo sapien
cggcttcagctttgaagcatctggt

SEQ ID NO: 141315 - DNA, 25 bp, Homo sapien
cttcagctttgaagcatctggtcca

SEQ ID NO: 141316 - DNA, 25 bp, Homo sapien
tcagctttgaagcatctggtccagg

SEQ ID NO: 141317 - DNA, 25 bp, Homo sapien
agctttgaagcatctggtccaggga

SEQ ID NO: 141318 - DNA, 25 bp, Homo sapien
gctttgaagcatctggtccagggaa

SEQ ID NO: 141319 - DNA, 25 bp, Homo sapien
gaagcatctggtccagggaatttct

SEQ ID NO: 141320 - DNA, 25 bp, Homo sapien
gcatctggtccagggaatttctttt

SEQ ID NO: 141321 - DNA, 25 bp, Homo sapien
ttcttttttcaatttggctaatgaa

SEQ ID NO: 141322 - DNA, 25 bp, Homo sapien
tcaatttggctaatgaagggcaacc

SEQ ID NO: 141323 - DNA, 25 bp, Homo sapien
atttggctaatgaagggcaaccacc

SEQ ID NO: 141324 - DNA, 25 bp, Homo sapien
ttggctaatgaagggcaaccaccca

SEQ ID NO: 141325 - DNA, 25 bp, Homo sapien
catgtcggccgatgccatgctcaag

SEQ ID NO: 141326 - DNA, 25 bp, Homo sapien
aaggccctgctgggctcgaagcaca

SEQ ID NO: 141327 - DNA, 25 bp, Homo sapien
agcacaaggtgtgcatggacctgag

SEQ ID NO: 141328 - DNA, 25 bp, Homo sapien
gcatggacctgagggccaacctgaa

SEQ ID NO: 141329 - DNA, 25 bp, Homo sapien
gacctgagggccaacctgaagcagg

SEQ ID NO: 141330 - DNA, 25 bp, Homo sapien
cgggacctgcgagacgtgggtgact

SEQ ID NO: 141331 - DNA, 25 bp, Homo sapien
agatgtttgagtccgagtcctaggc

SEQ ID NO: 141332 - DNA, 25 bp, Homo sapien
gtttgagtccgagtcctaggccact

SEQ ID NO: 141333 - DNA, 25 bp, Homo sapien
ccggctcccagcagaacatactagg

SEQ ID NO: 141334 - DNA, 25 bp, Homo sapien
gaacatactagggagatgcacccag

SEQ ID NO: 141335 - DNA, 25 bp, Homo sapien
gatgcacccagagcctgccagggag

SEQ ID NO: 141336 - DNA, 25 bp, Homo sapien
tggtggcggcactgtatgttatgct

SEQ ID NO: 141337 - DNA, 25 bp, Homo sapien
tatgctgggcatgacggccatgact

SEQ ID NO: 141338 - DNA, 25 bp, Homo sapien
atgacttcggctatcttctgtttta

SEQ ID NO: 141339 - DNA, 25 bp, Homo sapien
gctatcttctgttttaggtccttga

SEQ ID NO: 141340 - DNA, 25 bp, Homo sapien
tccttgatttcctgatctttctgaa

SEQ ID NO: 141341 - DNA, 25 bp, Homo sapien
aggatttgtccttgggcaatctcga

SEQ ID NO: 141342 - DNA, 25 bp, Homo sapien
gcaatctcgagctgccgctttgcat

SEQ ID NO: 141343 - DNA, 25 bp, Homo sapien
tttgcatcgcccagtgcggagaaca

SEQ ID NO: 141344 - DNA, 25 bp, Homo sapien
aacaggtccagcttgattctcgtct

SEQ ID NO: 141345 - DNA, 25 bp, Homo sapien
tctcgtctctgcacttaagctgttc

SEQ ID NO: 141346 - DNA, 25 bp, Homo sapien
taagctgttctccaggtgcgtgtga

SEQ ID NO: 141347 - DNA, 25 bp, Homo sapien
tttctgtgccagacattgctctcag

SEQ ID NO: 141348 - DNA, 25 bp, Homo sapien
gacattgctctcagtgctttgcatg

SEQ ID NO: 141349 - DNA, 25 bp, Homo sapien
ttgcatgtattagctcactgaatct

SEQ ID NO: 141350 - DNA, 25 bp, Homo sapien
cactgaatcttcacgacaatgttga

SEQ ID NO: 141351 - DNA, 25 bp, Homo sapien
atgttgagaagttcccattattatt

SEQ ID NO: 141352 - DNA, 25 bp, Homo sapien
gttcccattattatttctgttctta

SEQ ID NO: 141353 - DNA, 25 bp, Homo sapien
tgtgaaacggaagctcatagaggtg

SEQ ID NO: 141354 - DNA, 25 bp, Homo sapien
gaaaactcaaccagagtcacccagt

SEQ ID NO: 141355 - DNA, 25 bp, Homo sapien
tcaaccagagtcacccagttggtga

SEQ ID NO: 141356 - DNA, 25 bp, Homo sapien
gattcagatcgaaattggactgtct

SEQ ID NO: 141357 - DNA, 25 bp, Homo sapien
ggactgtctttataacccatatttt

SEQ ID NO: 141358 - DNA, 25 bp, Homo sapien
agggccagcttttcctcaccaggag

SEQ ID NO: 141359 - DNA, 25 bp, Homo sapien
ggcttccactccccacataggaata

SEQ ID NO: 141360 - DNA, 25 bp, Homo sapien
cataggaatagtccatccccagatt

SEQ ID NO: 141361 - DNA, 25 bp, Homo sapien
aggaatagtccatccccagattcgc

SEQ ID NO: 141362 - DNA, 25 bp, Homo sapien
gtccatccccagattcgccattgtt

SEQ ID NO: 141363 - DNA, 25 bp, Homo sapien
accatccaggtggagaccctgagaa

SEQ ID NO: 141364 - DNA, 25 bp, Homo sapien
accctgagaaggaccctgggagctc

SEQ ID NO: 141365 - DNA, 25 bp, Homo sapien
gagctctgggaatttggagtgacca

SEQ ID NO: 141366 - DNA, 25 bp, Homo sapien
ggagtgaccaaaggtgtgccctgta

SEQ ID NO: 141367 - DNA, 25 bp, Homo sapien
gaccaaaggtgtgccctgtacacag

SEQ ID NO: 141368 - DNA, 25 bp, Homo sapien
aaggtgtgccctgtacacaggcgag

SEQ ID NO: 141369 - DNA, 25 bp, Homo sapien
acaacgaagcgttgggatacttcat

SEQ ID NO: 141370 - DNA, 25 bp, Homo sapien
agcgttgggatacttcattaaatgt

SEQ ID NO: 141371 - DNA, 25 bp, Homo sapien
taaatgtagcgactgtcaacagcgt

SEQ ID NO: 141372 - DNA, 25 bp, Homo sapien
actgtcaacagcgtgcaggttttct

SEQ ID NO: 141373 - DNA, 25 bp, Homo sapien
aaccgtacaatggtgtgggaatgac

SEQ ID NO: 141374 - DNA, 25 bp, Homo sapien
gatgaaacgtcatgtgttttgccaa

SEQ ID NO: 141375 - DNA, 25 bp, Homo sapien
gtgttttgccaaagactgtaaatat

SEQ ID NO: 141376 - DNA, 25 bp, Homo sapien
gtgttcacatggtcaaaatttcacc

SEQ ID NO: 141377 - DNA, 25 bp, Homo sapien
aaatttcaccactgaaaccctgcac

SEQ ID NO: 141378 - DNA, 25 bp, Homo sapien
gaaaccctgcacttagctagaacct

SEQ ID NO: 141379 - DNA, 25 bp, Homo sapien
gcacttagctagaacctcattttta

SEQ ID NO: 141380 - DNA, 25 bp, Homo sapien
gttttcttctgctgaagttttatat

SEQ ID NO: 141381 - DNA, 25 bp, Homo sapien
ttttcttctgctgaagttttatatt

SEQ ID NO: 141382 - DNA, 25 bp, Homo sapien
tcttctgctgaagttttatatttta

SEQ ID NO: 141383 - DNA, 25 bp, Homo sapien
cttctgctgaagttttatattttat

SEQ ID NO: 141384 - DNA, 25 bp, Homo sapien
ttctgctgaagttttatattttatt

SEQ ID NO: 141385 - DNA, 25 bp, Homo sapien
tctgctgaagttttatattttattt

SEQ ID NO: 141386 - DNA, 25 bp, Homo sapien
ctgctgaagttttatattttattta

SEQ ID NO: 141387 - DNA, 25 bp, Homo sapien
catgacctcagctcatttcaacctt

SEQ ID NO: 141388 - DNA, 25 bp, Homo sapien
atgacctcagctcatttcaaccttc

SEQ ID NO: 141389 - DNA, 25 bp, Homo sapien
tgacctcagctcatttcaaccttcg

SEQ ID NO: 141390 - DNA, 25 bp, Homo sapien
gacctcagctcatttcaaccttcgc

SEQ ID NO: 141391 - DNA, 25 bp, Homo sapien
ggagattgcagatctgactcagaag

SEQ ID NO: 141392 - DNA, 25 bp, Homo sapien
agaagatctttgaccttcgaggcaa

SEQ ID NO: 141393 - DNA, 25 bp, Homo sapien
gatctttgaccttcgaggcaagttt

SEQ ID NO: 141394 - DNA, 25 bp, Homo sapien
gaggcaagtttaagcggcccaccct

SEQ ID NO: 141395 - DNA, 25 bp, Homo sapien
gcccaccctgcggagagtgaggatc

SEQ ID NO: 141396 - DNA, 25 bp, Homo sapien
gagtgaggatctctgcagatgccat

SEQ ID NO: 141397 - DNA, 25 bp, Homo sapien
cagatgccatgatgcaggcgctgct

SEQ ID NO: 141398 - DNA, 25 bp, Homo sapien
cgggcccacctcaagcaggtgaaga

SEQ ID NO: 141399 - DNA, 25 bp, Homo sapien
actggcggaagaacatcgatgcact

SEQ ID NO: 141400 - DNA, 25 bp, Homo sapien
aagaacatcgatgcactgagtggaa

SEQ ID NO: 141401 - DNA, 25 bp, Homo sapien
aagtttgagagctgagccttcctgc

SEQ ID NO: 141402 - DNA, 25 bp, Homo sapien
tgatgaatgggatgactgagtggct

SEQ ID NO: 141403 - DNA, 25 bp, Homo sapien
tgactgagtggctgagttacttgct

SEQ ID NO: 141404 - DNA, 25 bp, Homo sapien
actgagtggctgagttacttgctgc

SEQ ID NO: 141405 - DNA, 25 bp, Homo sapien
ggctgagttacttgctgccctgtgc

SEQ ID NO: 141406 - DNA, 25 bp, Homo sapien
gagttacttgctgccctgtgctcct

SEQ ID NO: 141407 - DNA, 25 bp, Homo sapien
caatgctgttatccctgcctggtcc

SEQ ID NO: 141408 - DNA, 25 bp, Homo sapien
aaaattctcagttctcttcactcaa

SEQ ID NO: 141409 - DNA, 25 bp, Homo sapien
aattctcagttctcttcactcaagg

SEQ ID NO: 141410 - DNA, 25 bp, Homo sapien
ttctcagttctcttcactcaaggat

SEQ ID NO: 141411 - DNA, 25 bp, Homo sapien
tcagttctcttcactcaaggatttt

SEQ ID NO: 141412 - DNA, 25 bp, Homo sapien
gttctcttcactcaaggatttttaa

SEQ ID NO: 141413 - DNA, 25 bp, Homo sapien
gaactggccagttcagaaagaacgg

SEQ ID NO: 141414 - DNA, 25 bp, Homo sapien
gaacggataggtgcctttcgtcata

SEQ ID NO: 141415 - DNA, 25 bp, Homo sapien
ggtgcctttcgtcataaattgcaag

SEQ ID NO: 141416 - DNA, 25 bp, Homo sapien
aaattgcaagtagcacttggatcca

SEQ ID NO: 141417 - DNA, 25 bp, Homo sapien
cacttggatccaaaaactctgtaca

SEQ ID NO: 141418 - DNA, 25 bp, Homo sapien
tggcaaatttaagttttccataaag

SEQ ID NO: 141419 - DNA, 25 bp, Homo sapien
atcacaattacatctcttctaggaa

SEQ ID NO: 141420 - DNA, 25 bp, Homo sapien
aaatgtgtctccttatttcaggcct

SEQ ID NO: 141421 - DNA, 25 bp, Homo sapien
gtgtctccttatttcaggcctattt

SEQ ID NO: 141422 - DNA, 25 bp, Homo sapien
tcaggcctatttttgacaattgact

SEQ ID NO: 141423 - DNA, 25 bp, Homo sapien
ttgacaattgacttaattttaccca

SEQ ID NO: 141424 - DNA, 25 bp, Homo sapien
actgaagaaatcccctggaaatgca

SEQ ID NO: 141425 - DNA, 25 bp, Homo sapien
tttttaccaatgctcatctttttgc

SEQ ID NO: 141426 - DNA, 25 bp, Homo sapien
gctcatctttttgcacatgatatcc

SEQ ID NO: 141427 - DNA, 25 bp, Homo sapien
tcatctttttgcacatgatatcctt

SEQ ID NO: 141428 - DNA, 25 bp, Homo sapien
gatatcctttatattcgagaaaagt

SEQ ID NO: 141429 - DNA, 25 bp, Homo sapien
agaaaagtcatatctcctcacattt

SEQ ID NO: 141430 - DNA, 25 bp, Homo sapien
gtcatatctcctcacattttactaa

SEQ ID NO: 141431 - DNA, 25 bp, Homo sapien
tatctcctcacattttactaactag

SEQ ID NO: 141432 - DNA, 25 bp, Homo sapien
tcctcacattttactaactagcaat

SEQ ID NO: 141433 - DNA, 25 bp, Homo sapien
ctaactagcaatgttcatacttaat

SEQ ID NO: 141434 - DNA, 25 bp, Homo sapien
agacttcagaaaatataggccttta

SEQ ID NO: 141435 - DNA, 25 bp, Homo sapien
gtgagggcagaagagaaaccatcct

SEQ ID NO: 141436 - DNA, 25 bp, Homo sapien
agggcagaagagaaaccatcctctc

SEQ ID NO: 141437 - DNA, 25 bp, Homo sapien
ccttcttacaccgtgaggccaagat

SEQ ID NO: 141438 - DNA, 25 bp, Homo sapien
catggtgcccgtgcctctgtgctgt

SEQ ID NO: 141439 - DNA, 25 bp, Homo sapien
ctcatccaaactgtatcttccttta

SEQ ID NO: 141440 - DNA, 25 bp, Homo sapien
tccaaactgtatcttcctttactgt

SEQ ID NO: 141441 - DNA, 25 bp, Homo sapien
aactgtatcttcctttactgtttat

SEQ ID NO: 141442 - DNA, 25 bp, Homo sapien
ctgtatcttcctttactgtttatat

SEQ ID NO: 141443 - DNA, 25 bp, Homo sapien
ggttgggaccaggccaatcccttct

SEQ ID NO: 141444 - DNA, 25 bp, Homo sapien
aatcccttctccacttactataatg

SEQ ID NO: 141445 - DNA, 25 bp, Homo sapien
cttctccacttactataatggttgg

SEQ ID NO: 141446 - DNA, 25 bp, Homo sapien
actgctgctccagtgcaggagactt

SEQ ID NO: 141447 - DNA, 25 bp, Homo sapien
aaccggtcacccaggaggatggcaa

SEQ ID NO: 141448 - DNA, 25 bp, Homo sapien
accggtcacccaggaggatggcaaa

SEQ ID NO: 141449 - DNA, 25 bp, Homo sapien
cggtcacccaggaggatggcaaaga

SEQ ID NO: 141450 - DNA, 25 bp, Homo sapien
gtcacccaggaggatggcaaagaga

SEQ ID NO: 141451 - DNA, 25 bp, Homo sapien
gatggcaaagagagtcgcatctcag

SEQ ID NO: 141452 - DNA, 25 bp, Homo sapien
ggcaaagagagtcgcatctcagtgc

SEQ ID NO: 141453 - DNA, 25 bp, Homo sapien
aagagagtcgcatctcagtgcagga

SEQ ID NO: 141454 - DNA, 25 bp, Homo sapien
gagagtcgcatctcagtgcaggaga

SEQ ID NO: 141455 - DNA, 25 bp, Homo sapien
gagtcgcatctcagtgcaggagaga

SEQ ID NO: 141456 - DNA, 25 bp, Homo sapien
agacagtgaggctgcacccacccag

SEQ ID NO: 141457 - DNA, 25 bp, Homo sapien
gctgaggtggcagaatagcttatgc

SEQ ID NO: 141458 - DNA, 25 bp, Homo sapien
gaggtggcagaatagcttatgccta

SEQ ID NO: 141459 - DNA, 25 bp, Homo sapien
gcagaatagcttatgcctaggaggt

SEQ ID NO: 141460 - DNA, 25 bp, Homo sapien
aatagcttatgcctaggaggttgag

SEQ ID NO: 141461 - DNA, 25 bp, Homo sapien
taaaagctattacttggcaaaaaat

SEQ ID NO: 141462 - DNA, 25 bp, Homo sapien
acttggcaaaaaattccgcactata

SEQ ID NO: 141463 - DNA, 25 bp, Homo sapien
aaattccgcactatataattcgcac

SEQ ID NO: 141464 - DNA, 25 bp, Homo sapien
attccgcactatataattcgcacac

SEQ ID NO: 141465 - DNA, 25 bp, Homo sapien
tccgcactatataattcgcacacat

SEQ ID NO: 141466 - DNA, 25 bp, Homo sapien
gcactatataattcgcacacattaa

SEQ ID NO: 141467 - DNA, 25 bp, Homo sapien
attcgcacacattaattagggttta

SEQ ID NO: 141468 - DNA, 25 bp, Homo sapien
tggcgtcaccatagacaccacaatg

SEQ ID NO: 141469 - DNA, 25 bp, Homo sapien
cacaatgcgtggaggccgacttggc

SEQ ID NO: 141470 - DNA, 25 bp, Homo sapien
ggccgacttggcgttttctgcttct

SEQ ID NO: 141471 - DNA, 25 bp, Homo sapien
agaaaacatcatctggtccaacctc

SEQ ID NO: 141472 - DNA, 25 bp, Homo sapien
tccaacctcaagtatcgctgcaatg

SEQ ID NO: 141473 - DNA, 25 bp, Homo sapien
ggacttccaagagtttcaaacccag

SEQ ID NO: 141474 - DNA, 25 bp, Homo sapien
ttcaaacccagaatttcgaccgctt

SEQ ID NO: 141475 - DNA, 25 bp, Homo sapien
gaccgcttcgataattaaaccaagg

SEQ ID NO: 141476 - DNA, 25 bp, Homo sapien
atctgtaactgcttttcggaacact

SEQ ID NO: 141477 - DNA, 25 bp, Homo sapien
ttagcttttaccaacccaaatatat

SEQ ID NO: 141478 - DNA, 25 bp, Homo sapien
aaacgttttatgtgaatgtggcaat

SEQ ID NO: 141479 - DNA, 25 bp, Homo sapien
tatgatcagggtgaaatgtacttcc

SEQ ID NO: 141480 - DNA, 25 bp, Homo sapien
gggtgaaatgtacttcctgatgtaa

SEQ ID NO: 141481 - DNA, 25 bp, Homo sapien
gtacttcctgatgtaatgaacctaa

SEQ ID NO: 141482 - DNA, 25 bp, Homo sapien
tgtaatgaacctaatttgatttcca

SEQ ID NO: 141483 - DNA, 25 bp, Homo sapien
ttccattttaaggtggtgtctgtgc

SEQ ID NO: 141484 - DNA, 25 bp, Homo sapien
tgcagctggtgtccccgattctggc

SEQ ID NO: 141485 - DNA, 25 bp, Homo sapien
ggaagaagcccatttgttgaggctg

SEQ ID NO: 141486 - DNA, 25 bp, Homo sapien
ggctgaccttcctgatcatacacac

SEQ ID NO: 141487 - DNA, 25 bp, Homo sapien
agactgcccagacatgattgatgac

SEQ ID NO: 141488 - DNA, 25 bp, Homo sapien
gacatgattgatgacgggttcccgc

SEQ ID NO: 141489 - DNA, 25 bp, Homo sapien
gatcacacagctaacgaggctgcct

SEQ ID NO: 141490 - DNA, 25 bp, Homo sapien
agtttcacctccaggaagtgcaagg

SEQ ID NO: 141491 - DNA, 25 bp, Homo sapien
tgcaagggtgcaatcatggccccga

SEQ ID NO: 141492 - DNA, 25 bp, Homo sapien
atcatggccccgaggttgcggatgt

SEQ ID NO: 141493 - DNA, 25 bp, Homo sapien
ccgaggttgcggatgtcagcgtatt

SEQ ID NO: 141494 - DNA, 25 bp, Homo sapien
ggatgtcagcgtatttcagctcctc

SEQ ID NO: 141495 - DNA, 25 bp, Homo sapien
atttcagctcctccacagtcagggc

SEQ ID NO: 141496 - DNA, 25 bp, Homo sapien
tcctccacagtcagggccgagctgg

SEQ ID NO: 141497 - DNA, 25 bp, Homo sapien
ggcagggagcctgtggtcaccgaag

SEQ ID NO: 141498 - DNA, 25 bp, Homo sapien
gtcaccgaagggtccgggatctgcc

SEQ ID NO: 141499 - DNA, 25 bp, Homo sapien
aagggtccgggatctgcccaggcat

SEQ ID NO: 141500 - DNA, 25 bp, Homo sapien
gcccaggcatcatagcaggaggagt

SEQ ID NO: 141501 - DNA, 25 bp, Homo sapien
agacaccataaagaagttggtctgc

SEQ ID NO: 141502 - DNA, 25 bp, Homo sapien
tggtctgccctaacagtgtgtctac

SEQ ID NO: 141503 - DNA, 25 bp, Homo sapien
taacagtgtgtctacaagcttgtaa

SEQ ID NO: 141504 - DNA, 25 bp, Homo sapien
aagcttgtaaagatgttggccttga

SEQ ID NO: 141505 - DNA, 25 bp, Homo sapien
taaagccagtcttgttcacatccat

SEQ ID NO: 141506 - DNA, 25 bp, Homo sapien
gtcttgttcacatccattactatac

SEQ ID NO: 141507 - DNA, 25 bp, Homo sapien
gaattattgcttctagtccactttt

SEQ ID NO: 141508 - DNA, 25 bp, Homo sapien
gcttctagtccacttttctttacat

SEQ ID NO: 141509 - DNA, 25 bp, Homo sapien
cattttattcaatacgctgtcctga

SEQ ID NO: 141510 - DNA, 25 bp, Homo sapien
tattcaatacgctgtcctgaatcct

SEQ ID NO: 141511 - DNA, 25 bp, Homo sapien
gtcctgaatcctattcagtttcttt

SEQ ID NO: 141512 - DNA, 25 bp, Homo sapien
aattcctactgaagaaatcccctgg

SEQ ID NO: 141513 - DNA, 25 bp, Homo sapien
aaatcccctggaaatgcaaaaaatg

SEQ ID NO: 141514 - DNA, 25 bp, Homo sapien
tttttaccaatgctcatctttttgc

SEQ ID NO: 141515 - DNA, 25 bp, Homo sapien
gctcatctttttgcacatgatatcc

SEQ ID NO: 141516 - DNA, 25 bp, Homo sapien
tctttttgcacatgatatcctttat

SEQ ID NO: 141517 - DNA, 25 bp, Homo sapien
gatatcctttatattcgagaaaagt

SEQ ID NO: 141518 - DNA, 25 bp, Homo sapien
agaaaagtcatatctcctcacattt

SEQ ID NO: 141519 - DNA, 25 bp, Homo sapien
gtcatatctcctcacattttactaa

SEQ ID NO: 141520 - DNA, 25 bp, Homo sapien
atctcctcacattttactaactagc

SEQ ID NO: 141521 - DNA, 25 bp, Homo sapien
tactaactagcaatgttcatactta

SEQ ID NO: 141522 - DNA, 25 bp, Homo sapien
agacttcagaaaatataggccttta

SEQ ID NO: 141523 - DNA, 25 bp, Homo sapien
tggccaggtttctgcccacattgga

SEQ ID NO: 141524 - DNA, 25 bp, Homo sapien
cacattggacccacatgaggacatg

SEQ ID NO: 141525 - DNA, 25 bp, Homo sapien
atgatggagcgcacctgccccctgg

SEQ ID NO: 141526 - DNA, 25 bp, Homo sapien
acagtcctgggagaacctcaggctt

SEQ ID NO: 141527 - DNA, 25 bp, Homo sapien
gcttccttggcatcacagggcagag

SEQ ID NO: 141528 - DNA, 25 bp, Homo sapien
ttccttggcatcacagggcagagcc

SEQ ID NO: 141529 - DNA, 25 bp, Homo sapien
ccttggcatcacagggcagagccgg

SEQ ID NO: 141530 - DNA, 25 bp, Homo sapien
ggcagagccgggaagcgatgaattt

SEQ ID NO: 141531 - DNA, 25 bp, Homo sapien
ggccttggttcccttgtgtgtgtgt

SEQ ID NO: 141532 - DNA, 25 bp, Homo sapien
gtgttgatcccaagacaatgaaagt

SEQ ID NO: 141533 - DNA, 25 bp, Homo sapien
tttgcactgtatgctggacggcatt

SEQ ID NO: 141534 - DNA, 25 bp, Homo sapien
gtaatgactgtcatgaaagcagcat

SEQ ID NO: 141535 - DNA, 25 bp, Homo sapien
gactgtcatgaaagcagcattgaaa

SEQ ID NO: 141536 - DNA, 25 bp, Homo sapien
gaaaatttccgcttcctggtcttat

SEQ ID NO: 141537 - DNA, 25 bp, Homo sapien
aaatttccgcttcctggtcttatca

SEQ ID NO: 141538 - DNA, 25 bp, Homo sapien
ttccgcttcctggtcttatcatgga

SEQ ID NO: 141539 - DNA, 25 bp, Homo sapien
gcttcctggtcttatcatggacaat

SEQ ID NO: 141540 - DNA, 25 bp, Homo sapien
gtcttatcatggacaatttgggcta

SEQ ID NO: 141541 - DNA, 25 bp, Homo sapien
accttttcttgattccagaaacata

SEQ ID NO: 141542 - DNA, 25 bp, Homo sapien
ttgattccagaaacatatgggctga

SEQ ID NO: 141543 - DNA, 25 bp, Homo sapien
aaacatatgggctgataaacccggg

SEQ ID NO: 141544 - DNA, 25 bp, Homo sapien
gtgacctcatgaaatgagttgcagc

SEQ ID NO: 141545 - DNA, 25 bp, Homo sapien
aaatgcagattcactcagtttaatc

SEQ ID NO: 141546 - DNA, 25 bp, Homo sapien
ctcagtttaatcttgaatgtggaaa

SEQ ID NO: 141547 - DNA, 25 bp, Homo sapien
aatgtggaaacagttcacctcctcc

SEQ ID NO: 141548 - DNA, 25 bp, Homo sapien
ttcatcacgtctccgtgtgcttaga

SEQ ID NO: 141549 - DNA, 25 bp, Homo sapien
gtctccgtgtgcttagagcagtttc

SEQ ID NO: 141550 - DNA, 25 bp, Homo sapien
gagcagtttcgttttctcagttgga

SEQ ID NO: 141551 - DNA, 25 bp, Homo sapien
ttctcagttggatgccctgtgtctc

SEQ ID NO: 141552 - DNA, 25 bp, Homo sapien
gtggagcaaagggaaccaatgccga

SEQ ID NO: 141553 - DNA, 25 bp, Homo sapien
aagggaaccaatgccgaagaccgag

SEQ ID NO: 141554 - DNA, 25 bp, Homo sapien
aaccaatgccgaagaccgagggcag

SEQ ID NO: 141555 - DNA, 25 bp, Homo sapien
gacagggaggcagcttgtgaatttt

SEQ ID NO: 141556 - DNA, 25 bp, Homo sapien
gggcttagagctcaacccagacacc

SEQ ID NO: 141557 - DNA, 25 bp, Homo sapien
gcttagagctcaacccagacacctg

SEQ ID NO: 141558 - DNA, 25 bp, Homo sapien
acacctgcaggtgccggaagctgcg

SEQ ID NO: 141559 - DNA, 25 bp, Homo sapien
gccggaagctgcgaaggtgacacat

SEQ ID NO: 141560 - DNA, 25 bp, Homo sapien
gctgcgaaggtgacacatggctttt

SEQ ID NO: 141561 - DNA, 25 bp, Homo sapien
cgaaggtgacacatggcttttcaga

SEQ ID NO: 141562 - DNA, 25 bp, Homo sapien
aaggtgacacatggcttttcagact

SEQ ID NO: 141563 - DNA, 25 bp, Homo sapien
actcagcagggtgacttgcctcaga

SEQ ID NO: 141564 - DNA, 25 bp, Homo sapien
agcagggtgacttgcctcagaggct

SEQ ID NO: 141565 - DNA, 25 bp, Homo sapien
gggtgacttgcctcagaggctatat

SEQ ID NO: 141566 - DNA, 25 bp, Homo sapien
acttgcctcagaggctatatcccag

SEQ ID NO: 141567 - DNA, 25 bp, Homo sapien
atttgtctgctttgacattacagtg

SEQ ID NO: 141568 - DNA, 25 bp, Homo sapien
gctttgacattacagtggcatacca

SEQ ID NO: 141569 - DNA, 25 bp, Homo sapien
ttacagtggcataccattgtgttga

SEQ ID NO: 141570 - DNA, 25 bp, Homo sapien
ttgtgttgaaaagcccaatattact

SEQ ID NO: 141571 - DNA, 25 bp, Homo sapien
agagtaaactccacatctttgcact

SEQ ID NO: 141572 - DNA, 25 bp, Homo sapien
taaactccacatctttgcactacct

SEQ ID NO: 141573 - DNA, 25 bp, Homo sapien
tacctgtttgcctccaagagactat

SEQ ID NO: 141574 - DNA, 25 bp, Homo sapien
gcctccaagagactatcagttcctt

SEQ ID NO: 141575 - DNA, 25 bp, Homo sapien
tattcatctttgtgtctccagcatc

SEQ ID NO: 141576 - DNA, 25 bp, Homo sapien
tttgtgtctccagcatctagtacag

SEQ ID NO: 141577 - DNA, 25 bp, Homo sapien
gaaaccaactgaactgccaacaaaa

SEQ ID NO: 141578 - DNA, 25 bp, Homo sapien
tgggttaggcgtgaagactttgccc

SEQ ID NO: 141579 - DNA, 25 bp, Homo sapien
ggaaactgaacactgagatctgact

SEQ ID NO: 141580 - DNA, 25 bp, Homo sapien
aacactgagatctgactgcgtcacc

SEQ ID NO: 141581 - DNA, 25 bp, Homo sapien
acctgccccgtagagaatgtgtgta

SEQ ID NO: 141582 - DNA, 25 bp, Homo sapien
gaatgtgtgtagatacttcctgccc

SEQ ID NO: 141583 - DNA, 25 bp, Homo sapien
cctcctgtaccgtcgacaagaatgt

SEQ ID NO: 141584 - DNA, 25 bp, Homo sapien
aagaatgtccccttaggtcgcgctc

SEQ ID NO: 141585 - DNA, 25 bp, Homo sapien
ttaggtcgcgctcttgcacacacgg

SEQ ID NO: 141586 - DNA, 25 bp, Homo sapien
gcacacacggttttggcagctgact

SEQ ID NO: 141587 - DNA, 25 bp, Homo sapien
ggcagctgacttggttctgaagcca

SEQ ID NO: 141588 - DNA, 25 bp, Homo sapien
aacccaaaagtgtctaatgtattca

SEQ ID NO: 141589 - DNA, 25 bp, Homo sapien
tatttctgaggccaagcccgaagga

SEQ ID NO: 141590 - DNA, 25 bp, Homo sapien
aggccaagcccgaaggacctagagt

SEQ ID NO: 141591 - DNA, 25 bp, Homo sapien
ggacctagagtcaaggatggatctg

SEQ ID NO: 141592 - DNA, 25 bp, Homo sapien
tggatctggaacatatgagctattt

SEQ ID NO: 141593 - DNA, 25 bp, Homo sapien
gagctatttgcattcatcagtcaca

SEQ ID NO: 141594 - DNA, 25 bp, Homo sapien
ttcatcagtcacatgggaacatcca

SEQ ID NO: 141595 - DNA, 25 bp, Homo sapien
gggaacatccacaatgagtggtcat

SEQ ID NO: 141596 - DNA, 25 bp, Homo sapien
gagtggtcattacatttgccatatc

SEQ ID NO: 141597 - DNA, 25 bp, Homo sapien
ggtgatttacaatgaccacaaagtt

SEQ ID NO: 141598 - DNA, 25 bp, Homo sapien
cccctaaagacctgggctacatgta

SEQ ID NO: 141599 - DNA, 25 bp, Homo sapien
gggctacatgtacttttaccgcagg

SEQ ID NO: 141600 - DNA, 25 bp, Homo sapien
acacagtgatttgggaatgccttca

SEQ ID NO: 141601 - DNA, 25 bp, Homo sapien
gccttcatttacaatgcaatactta

SEQ ID NO: 141602 - DNA, 25 bp, Homo sapien
tacattttaatactcttgtaggaga

SEQ ID NO: 141603 - DNA, 25 bp, Homo sapien
gaatgtagagtgactttctgcaata

SEQ ID NO: 141604 - DNA, 25 bp, Homo sapien
gcaatatttgcaacctatatcagag

SEQ ID NO: 141605 - DNA, 25 bp, Homo sapien
gcaacctatatcagagaattacact

SEQ ID NO: 141606 - DNA, 25 bp, Homo sapien
tacactgtgggaaaactaccattgt

SEQ ID NO: 141607 - DNA, 25 bp, Homo sapien
aagtgtagcaaaatctccttagata

SEQ ID NO: 141608 - DNA, 25 bp, Homo sapien
aatctccttagatatctgaaaagtc

SEQ ID NO: 141609 - DNA, 25 bp, Homo sapien
aaagtcatactggatggaatctgta

SEQ ID NO: 141610 - DNA, 25 bp, Homo sapien
ggaatctgtaggaaacggttctatt

SEQ ID NO: 141611 - DNA, 25 bp, Homo sapien
gtctcttctaacatcttagaggtcc

SEQ ID NO: 141612 - DNA, 25 bp, Homo sapien
aacatcttagaggtccatggagaag

SEQ ID NO: 141613 - DNA, 25 bp, Homo sapien
gaaggcatatggagaacatgtttta

SEQ ID NO: 141614 - DNA, 25 bp, Homo sapien
ccaatcactgtgcttaatttaaata

SEQ ID NO: 141615 - DNA, 25 bp, Homo sapien
atagcattctcttatcatttatcag

SEQ ID NO: 141616 - DNA, 25 bp, Homo sapien
tctcttatcatttatcagcctttta

SEQ ID NO: 141617 - DNA, 25 bp, Homo sapien
aacatattacttcattggtcttctt

SEQ ID NO: 141618 - DNA, 25 bp, Homo sapien
ttatctggttctatatgaatgctat

SEQ ID NO: 141619 - DNA, 25 bp, Homo sapien
ttcccttctcttctaacatgaaata

SEQ ID NO: 141620 - DNA, 25 bp, Homo sapien
ctttttgatcttgtgctatgaaaca

SEQ ID NO: 141621 - DNA, 25 bp, Homo sapien
gtgctatgaaacaatcttccaaaga

SEQ ID NO: 141622 - DNA, 25 bp, Homo sapien
aggagcccagaaggaacatgtgttt

SEQ ID NO: 141623 - DNA, 25 bp, Homo sapien
catgtgtttcctgttaaaactcctc

SEQ ID NO: 141624 - DNA, 25 bp, Homo sapien
taaaactcctcttgttctcttttct

SEQ ID NO: 141625 - DNA, 25 bp, Homo sapien
gttctcttttcttacattatgacgt

SEQ ID NO: 141626 - DNA, 25 bp, Homo sapien
acattatgacgtttgttttcaagga

SEQ ID NO: 141627 - DNA, 25 bp, Homo sapien
gggatcctgtaagcagacttgggca

SEQ ID NO: 141628 - DNA, 25 bp, Homo sapien
acttgggcagtctccttttgaaata

SEQ ID NO: 141629 - DNA, 25 bp, Homo sapien
aataggttgtctgtacatgttctaa

SEQ ID NO: 141630 - DNA, 25 bp, Homo sapien
gttttgtagaacacgtgtgcctgtt

SEQ ID NO: 141631 - DNA, 25 bp, Homo sapien
acgtgtgcctgtttaagtgtattga

SEQ ID NO: 141632 - DNA, 25 bp, Homo sapien
attaccattatacatttacaaccta

SEQ ID NO: 141633 - DNA, 25 bp, Homo sapien
ttgccagcttggacagcccacagct

SEQ ID NO: 141634 - DNA, 25 bp, Homo sapien
agctctcccaggtgcacggtgtcat

SEQ ID NO: 141635 - DNA, 25 bp, Homo sapien
ccaggtgcacggtgtcatccaggtg

SEQ ID NO: 141636 - DNA, 25 bp, Homo sapien
tgcacggtgtcatccaggtggatgt

SEQ ID NO: 141637 - DNA, 25 bp, Homo sapien
tgtcatccaggtggatgtggcccca

SEQ ID NO: 141638 - DNA, 25 bp, Homo sapien
gggcttcttctcagacgctggaggt

SEQ ID NO: 141639 - DNA, 25 bp, Homo sapien
cttcttctcagacgctggaggtgac

SEQ ID NO: 141640 - DNA, 25 bp, Homo sapien
taggagagaccatccctatggcatc

SEQ ID NO: 141641 - DNA, 25 bp, Homo sapien
acactacagagcagctccccaggag

SEQ ID NO: 141642 - DNA, 25 bp, Homo sapien
tcccggagagggagtcagtcttcac

SEQ ID NO: 141643 - DNA, 25 bp, Homo sapien
ggagagggagtcagtcttcacttgc

SEQ ID NO: 141644 - DNA, 25 bp, Homo sapien
taatacgtactttagttggaattat

SEQ ID NO: 141645 - DNA, 25 bp, Homo sapien
cgtactttagttggaattattctat

SEQ ID NO: 141646 - DNA, 25 bp, Homo sapien
ggaattattctatgtcaatgatttt

SEQ ID NO: 141647 - DNA, 25 bp, Homo sapien
ttctatgtcaatgatttttaagcta

SEQ ID NO: 141648 - DNA, 25 bp, Homo sapien
acgagttactggatgcagcacgcaa

SEQ ID NO: 141649 - DNA, 25 bp, Homo sapien
agcacgcaacatggcacatgtgtat

SEQ ID NO: 141650 - DNA, 25 bp, Homo sapien
cacgcaacatggcacatgtgtatac

SEQ ID NO: 141651 - DNA, 25 bp, Homo sapien
catatgtagctaacccttcgttgtg

SEQ ID NO: 141652 - DNA, 25 bp, Homo sapien
tgtagctaacccttcgttgtgcaca

SEQ ID NO: 141653 - DNA, 25 bp, Homo sapien
gctaacccttcgttgtgcacatgta

SEQ ID NO: 141654 - DNA, 25 bp, Homo sapien
aacaacttctagtattggatctgaa

SEQ ID NO: 141655 - DNA, 25 bp, Homo sapien
ggagctgactgatgcaaaaagctga

SEQ ID NO: 141656 - DNA, 25 bp, Homo sapien
gagtggctgtttttatgccccagcc

SEQ ID NO: 141657 - DNA, 25 bp, Homo sapien
tttttatgccccagccccgcaagtt

SEQ ID NO: 141658 - DNA, 25 bp, Homo sapien
cagccaggagagaacctcccggagg

SEQ ID NO: 141659 - DNA, 25 bp, Homo sapien
tgtgtcccctgctcgggagtaaggc

SEQ ID NO: 141660 - DNA, 25 bp, Homo sapien
cctgctcgggagtaaggctggtcct

SEQ ID NO: 141661 - DNA, 25 bp, Homo sapien
actgggcctgccgagtgctgtgttc

SEQ ID NO: 141662 - DNA, 25 bp, Homo sapien
gagtgctgtgttcttcctcagtctg

SEQ ID NO: 141663 - DNA, 25 bp, Homo sapien
ttcctcagtctggctgtgggcagga

SEQ ID NO: 141664 - DNA, 25 bp, Homo sapien
gcaggagcggcctgcccagtgtcac

SEQ ID NO: 141665 - DNA, 25 bp, Homo sapien
ctgcccagtgtcacccagggtgagt

SEQ ID NO: 141666 - DNA, 25 bp, Homo sapien
tacgttttgagtaagtgagatccaa

SEQ ID NO: 141667 - DNA, 25 bp, Homo sapien
gtaagtgagatccaagcagacgtgt

SEQ ID NO: 141668 - DNA, 25 bp, Homo sapien
gtgagatccaagcagacgtgttaaa

SEQ ID NO: 141669 - DNA, 25 bp, Homo sapien
ccaagcagacgtgttaaaatcagca

SEQ ID NO: 141670 - DNA, 25 bp, Homo sapien
tcagcactcctggactggaaattaa

SEQ ID NO: 141671 - DNA, 25 bp, Homo sapien
gcactcctggactggaaattaaaga

SEQ ID NO: 141672 - DNA, 25 bp, Homo sapien
aaagtttagagaatctctgtttctt

SEQ ID NO: 141673 - DNA, 25 bp, Homo sapien
gcactgtattttctgtcaccaagac

SEQ ID NO: 141674 - DNA, 25 bp, Homo sapien
ttctgtcaccaagacaatgatttct

SEQ ID NO: 141675 - DNA, 25 bp, Homo sapien
aatgatttcttgttattgaggctgt

SEQ ID NO: 141676 - DNA, 25 bp, Homo sapien
attgaggctgttgcttttgtggatg

SEQ ID NO: 141677 - DNA, 25 bp, Homo sapien
ctccagggtagagaatgaagggtat

SEQ ID NO: 141678 - DNA, 25 bp, Homo sapien
gtatggaagtagtccggcttttgaa

SEQ ID NO: 141679 - DNA, 25 bp, Homo sapien
ggactgccttggtggctttgtttgc

SEQ ID NO: 141680 - DNA, 25 bp, Homo sapien
tgctgggacaaggcccacaacctgt

SEQ ID NO: 141681 - DNA, 25 bp, Homo sapien
aatatatgaggctttctttgattcc

SEQ ID NO: 141682 - DNA, 25 bp, Homo sapien
atgaggctttctttgattcctcctc

SEQ ID NO: 141683 - DNA, 25 bp, Homo sapien
aggctttctttgattcctcctcagt

SEQ ID NO: 141684 - DNA, 25 bp, Homo sapien
tttctttgattcctcctcagttcta

SEQ ID NO: 141685 - DNA, 25 bp, Homo sapien
tcctcagttctacctagtttcacag

SEQ ID NO: 141686 - DNA, 25 bp, Homo sapien
tcagttctacctagtttcacagagg

SEQ ID NO: 141687 - DNA, 25 bp, Homo sapien
gttctacctagtttcacagaggaaa

SEQ ID NO: 141688 - DNA, 25 bp, Homo sapien
cacagctgtggccaggtataacttt

SEQ ID NO: 141689 - DNA, 25 bp, Homo sapien
aggtataactttgccgcccgagata

SEQ ID NO: 141690 - DNA, 25 bp, Homo sapien
cccgagatatgagggagctttcgct

SEQ ID NO: 141691 - DNA, 25 bp, Homo sapien
tgacgtggtgaggatctacagccgc

SEQ ID NO: 141692 - DNA, 25 bp, Homo sapien
caacggacggattggctggtttcct

SEQ ID NO: 141693 - DNA, 25 bp, Homo sapien
gctggtttccttcaacgtacgtaga

SEQ ID NO: 141694 - DNA, 25 bp, Homo sapien
acgtacgtagaagaggagggcatcc

SEQ ID NO: 141695 - DNA, 25 bp, Homo sapien
gaacgtggacaagactcgcagattt

SEQ ID NO: 141696 - DNA, 25 bp, Homo sapien
tcgcagattttcttgggagagtcac

SEQ ID NO: 141697 - DNA, 25 bp, Homo sapien
gggagagtcactccagccctgaagt

SEQ ID NO: 141698 - DNA, 25 bp, Homo sapien
agccctgaagtctgtctctagctcc

SEQ ID NO: 141699 - DNA, 25 bp, Homo sapien
agggagggtacagagcctctgccaa

SEQ ID NO: 141700 - DNA, 25 bp, Homo sapien
gggagggtacagagcctctgccaac

SEQ ID NO: 141701 - DNA, 25 bp, Homo sapien
ggagggtacagagcctctgccaacg

SEQ ID NO: 141702 - DNA, 25 bp, Homo sapien
agggtacagagcctctgccaacgtc

SEQ ID NO: 141703 - DNA, 25 bp, Homo sapien
gggtacagagcctctgccaacgtcc

SEQ ID NO: 141704 - DNA, 25 bp, Homo sapien
ggtacagagcctctgccaacgtccc

SEQ ID NO: 141705 - DNA, 25 bp, Homo sapien
gtacagagcctctgccaacgtcccg

SEQ ID NO: 141706 - DNA, 25 bp, Homo sapien
tacagagcctctgccaacgtcccgc

SEQ ID NO: 141707 - DNA, 25 bp, Homo sapien
agagcctctgccaacgtcccgctgg

SEQ ID NO: 141708 - DNA, 25 bp, Homo sapien
agcctctgccaacgtcccgctggtg

SEQ ID NO: 141709 - DNA, 25 bp, Homo sapien
ctctgccaacgtcccgctggtgcct

SEQ ID NO: 141710 - DNA, 25 bp, Homo sapien
ggcagcgacccggaaacagcgtatc

SEQ ID NO: 141711 - DNA, 25 bp, Homo sapien
gacccggaaacagcgtatcactgag

SEQ ID NO: 141712 - DNA, 25 bp, Homo sapien
gtatcactgagaccgagtcgcctta

SEQ ID NO: 141713 - DNA, 25 bp, Homo sapien
agaccgagtcgccttatcaggagct

SEQ ID NO: 141714 - DNA, 25 bp, Homo sapien
gtcgccttatcaggagctccagggt

SEQ ID NO: 141715 - DNA, 25 bp, Homo sapien
ctccagggtcagaggtcggatgtct

SEQ ID NO: 141716 - DNA, 25 bp, Homo sapien
tcggatgtctacagcgacctcaaca

SEQ ID NO: 141717 - DNA, 25 bp, Homo sapien
gacctcaacacacagaggccgtatt

SEQ ID NO: 141718 - DNA, 25 bp, Homo sapien
gaggccgtattacaaatgagcccga

SEQ ID NO: 141719 - DNA, 25 bp, Homo sapien
gagcccgaatcatgacagtcagcaa

SEQ ID NO: 141720 - DNA, 25 bp, Homo sapien
attccaactcctaccgcgatacaga

SEQ ID NO: 141721 - DNA, 25 bp, Homo sapien
ctgcaggtggtcaccaacagagaca

SEQ ID NO: 141722 - DNA, 25 bp, Homo sapien
gagacacacaggagaccttgctgtg

SEQ ID NO: 141723 - DNA, 25 bp, Homo sapien
aggagaccttgctgtgcattgccta

SEQ ID NO: 141724 - DNA, 25 bp, Homo sapien
gctgtgcattgcctatgtctttgag

SEQ ID NO: 141725 - DNA, 25 bp, Homo sapien
gcctatgtctttgaggtgtcagcca

SEQ ID NO: 141726 - DNA, 25 bp, Homo sapien
tgtctttgaggtgtcagccagtgag

SEQ ID NO: 141727 - DNA, 25 bp, Homo sapien
caccacatctacaggctggtgaaag

SEQ ID NO: 141728 - DNA, 25 bp, Homo sapien
cccctgaagtgccaagagagctgag

SEQ ID NO: 141729 - DNA, 25 bp, Homo sapien
gaggagcagttgtgactctacccag

SEQ ID NO: 141730 - DNA, 25 bp, Homo sapien
agcagttgtgactctacccaggaac

SEQ ID NO: 141731 - DNA, 25 bp, Homo sapien
gttgtgactctacccaggaacaaac

SEQ ID NO: 141732 - DNA, 25 bp, Homo sapien
catccagagaccgtttattgcccaa

SEQ ID NO: 141733 - DNA, 25 bp, Homo sapien
attgcccaacacgttattcttgctg

SEQ ID NO: 141734 - DNA, 25 bp, Homo sapien
ctagccgaggaagacacagcgcctt

SEQ ID NO: 141735 - DNA, 25 bp, Homo sapien
aggccacgatggtctgctctggagc

SEQ ID NO: 141736 - DNA, 25 bp, Homo sapien
tgctctggagcattgggtgaacaca

SEQ ID NO: 141737 - DNA, 25 bp, Homo sapien
gggtgaacacacaggctggctgctc

SEQ ID NO: 141738 - DNA, 25 bp, Homo sapien
gaccctggagaaccatttcatttca

SEQ ID NO: 141739 - DNA, 25 bp, Homo sapien
atttcatcctggtcagtctagagtc

SEQ ID NO: 141740 - DNA, 25 bp, Homo sapien
gtctagagtctgtgcaccaggcagt

SEQ ID NO: 141741 - DNA, 25 bp, Homo sapien
agtccatccactgaaggctgtgttt

SEQ ID NO: 141742 - DNA, 25 bp, Homo sapien
cctgtgcccctcataatggaagaaa

SEQ ID NO: 141743 - DNA, 25 bp, Homo sapien
taccctggatcaaaacactataaat

SEQ ID NO: 141744 - DNA, 25 bp, Homo sapien
tacaaggaaggttttccattatact

SEQ ID NO: 141745 - DNA, 25 bp, Homo sapien
tcatttgagggctctggctctgtgg

SEQ ID NO: 141746 - DNA, 25 bp, Homo sapien
tggctctgtggctttgtgggttaaa

SEQ ID NO: 141747 - DNA, 25 bp, Homo sapien
gtgggttaaagtacttgtctggcaa

SEQ ID NO: 141748 - DNA, 25 bp, Homo sapien
aaagtacttgtctggcaaacaggag

SEQ ID NO: 141749 - DNA, 25 bp, Homo sapien
acaggagatgctggatttcaatccc

SEQ ID NO: 141750 - DNA, 25 bp, Homo sapien
cagcagggcctcactagttgaggta

SEQ ID NO: 141751 - DNA, 25 bp, Homo sapien
cactagttgaggtattgaatttgaa

SEQ ID NO: 141752 - DNA, 25 bp, Homo sapien
gaacagatgttttggctctggctgg

SEQ ID NO: 141753 - DNA, 25 bp, Homo sapien
ttgagaccagtgtgcaaaacatagc

SEQ ID NO: 141754 - DNA, 25 bp, Homo sapien
tttattggtctgttcctttggcttt

SEQ ID NO: 141755 - DNA, 25 bp, Homo sapien
tggtctgttcctttggctttctctt

SEQ ID NO: 141756 - DNA, 25 bp, Homo sapien
ttctcttggaggtgggtcgcagcac

SEQ ID NO: 141757 - DNA, 25 bp, Homo sapien
gctttatgacatgacaggcgggagt

SEQ ID NO: 141758 - DNA, 25 bp, Homo sapien
gagttttgtaccacttttagaagat

SEQ ID NO: 141759 - DNA, 25 bp, Homo sapien
ttagaagataccagatgcctctgtc

SEQ ID NO: 141760 - DNA, 25 bp, Homo sapien
tatgatcatcctctagataccagat

SEQ ID NO: 141761 - DNA, 25 bp, Homo sapien
agataccagatagaggcccattcct

SEQ ID NO: 141762 - DNA, 25 bp, Homo sapien
aggcccattcctgcatttgagatag

SEQ ID NO: 141763 - DNA, 25 bp, Homo sapien
agggttggaatatagtactctagat

SEQ ID NO: 141764 - DNA, 25 bp, Homo sapien
ctctagatgatgaatgtgtttgctt

SEQ ID NO: 141765 - DNA, 25 bp, Homo sapien
ataaagcagctgaggatacaaatgt

SEQ ID NO: 141766 - DNA, 25 bp, Homo sapien
tacaaatgtgctggtagggagcgat

SEQ ID NO: 141767 - DNA, 25 bp, Homo sapien
ctggtagggagcgatattcaagata

SEQ ID NO: 141768 - DNA, 25 bp, Homo sapien
ggttgctgaaccatgtatatagtat

SEQ ID NO: 141769 - DNA, 25 bp, Homo sapien
tatatagtatgttcccctttgtgta

SEQ ID NO: 141770 - DNA, 25 bp, Homo sapien
gtatgttcccctttgtgtacaaaag

SEQ ID NO: 141771 - DNA, 25 bp, Homo sapien
ttgtttaacctctgtctcttatctc

SEQ ID NO: 141772 - DNA, 25 bp, Homo sapien
aacctctgtctcttatctctgtatg

SEQ ID NO: 141773 - DNA, 25 bp, Homo sapien
tgtgtatgtatctttgtatgcatat

SEQ ID NO: 141774 - DNA, 25 bp, Homo sapien
gtatctgtatgtgaatagactttga

SEQ ID NO: 141775 - DNA, 25 bp, Homo sapien
aatacagaataaacttcatggtggt

SEQ ID NO: 141776 - DNA, 25 bp, Homo sapien
gcgaggacgaggcttaaaaacttct

SEQ ID NO: 141777 - DNA, 25 bp, Homo sapien
aaaacttctcagatcaatcgtgcat

SEQ ID NO: 141778 - DNA, 25 bp, Homo sapien
ttctcagatcaatcgtgcatcctta

SEQ ID NO: 141779 - DNA, 25 bp, Homo sapien
gatcaatcgtgcatccttagtgaac

SEQ ID NO: 141780 - DNA, 25 bp, Homo sapien
atcgtgcatccttagtgaacttctg

SEQ ID NO: 141781 - DNA, 25 bp, Homo sapien
catccttagtgaacttctgttgtcc

SEQ ID NO: 141782 - DNA, 25 bp, Homo sapien
gtaaactatggtgctcagttttgcc

SEQ ID NO: 141783 - DNA, 25 bp, Homo sapien
tgcctctgttagaaattcacactgt

SEQ ID NO: 141784 - DNA, 25 bp, Homo sapien
gaaattcacactgttgatgtaatga

SEQ ID NO: 141785 - DNA, 25 bp, Homo sapien
gatgtaatgatgtggaactcctcta

SEQ ID NO: 141786 - DNA, 25 bp, Homo sapien
gtggaactcctctaaaaattacagt

SEQ ID NO: 141787 - DNA, 25 bp, Homo sapien
attccacaaatcttacctctttagg

SEQ ID NO: 141788 - DNA, 25 bp, Homo sapien
tttaggtcactgatggtcactccga

SEQ ID NO: 141789 - DNA, 25 bp, Homo sapien
actgatggtcactccgattctgagt

SEQ ID NO: 141790 - DNA, 25 bp, Homo sapien
tccgattctgagtgccacattggta

SEQ ID NO: 141791 - DNA, 25 bp, Homo sapien
gtgccacattggtagactcctaaaa

SEQ ID NO: 141792 - DNA, 25 bp, Homo sapien
ggtagactcctaaaatacagttgac

SEQ ID NO: 141793 - DNA, 25 bp, Homo sapien
acagttgacaacttagccaattgca

SEQ ID NO: 141794 - DNA, 25 bp, Homo sapien
cttagccaattgcaactccagtgtt

SEQ ID NO: 141795 - DNA, 25 bp, Homo sapien
agcagcagactgtaaggtctttaga

SEQ ID NO: 141796 - DNA, 25 bp, Homo sapien
gtacttcctttcagtagggcgctaa

SEQ ID NO: 141797 - DNA, 25 bp, Homo sapien
cagtagggcgctaatgtatacacat

SEQ ID NO: 141798 - DNA, 25 bp, Homo sapien
gaggaaggcgcaaccattcttgtca

SEQ ID NO: 141799 - DNA, 25 bp, Homo sapien
aaccattcttgtcaccacgaaaacg

SEQ ID NO: 141800 - DNA, 25 bp, Homo sapien
tgactattgcaagagcctgccagct

SEQ ID NO: 141801 - DNA, 25 bp, Homo sapien
gctgctttgagtgctacggagatag

SEQ ID NO: 141802 - DNA, 25 bp, Homo sapien
ggtaattaaccatttcgactcgagc

SEQ ID NO: 141803 - DNA, 25 bp, Homo sapien
ttcgactcgagcagtgccactttaa

SEQ ID NO: 141804 - DNA, 25 bp, Homo sapien
gatgtgtcagatctctttaggatga

SEQ ID NO: 141805 - DNA, 25 bp, Homo sapien
tatttttcagttgccgatacagctt

SEQ ID NO: 141806 - DNA, 25 bp, Homo sapien
cgatacagctttttgtcctctaact

SEQ ID NO: 141807 - DNA, 25 bp, Homo sapien
gtcctctaactgtggaaactcttta

SEQ ID NO: 141808 - DNA, 25 bp, Homo sapien
atatttctctaggttactgttggga

SEQ ID NO: 141809 - DNA, 25 bp, Homo sapien
ctgctttgactccaggatccctgga

SEQ ID NO: 141810 - DNA, 25 bp, Homo sapien
tccctggagtgccttggtgtttcaa

SEQ ID NO: 141811 - DNA, 25 bp, Homo sapien
tgtttcaagcccctgactaggaaga

SEQ ID NO: 141812 - DNA, 25 bp, Homo sapien
gacagaatgcaccttctgaggcacc

SEQ ID NO: 141813 - DNA, 25 bp, Homo sapien
tgcccctgggatgcaggctgagcac

SEQ ID NO: 141814 - DNA, 25 bp, Homo sapien
ttgcccggctgtgattgctgccagg

SEQ ID NO: 141815 - DNA, 25 bp, Homo sapien
ttgctgccaggcactgttcatctca

SEQ ID NO: 141816 - DNA, 25 bp, Homo sapien
ttttctgtccctttgctcccggcaa

SEQ ID NO: 141817 - DNA, 25 bp, Homo sapien
tcccggcaagctttctgctgaaagt

SEQ ID NO: 141818 - DNA, 25 bp, Homo sapien
tttctgctgaaagttcatatctgga

SEQ ID NO: 141819 - DNA, 25 bp, Homo sapien
accagtgtgccgtgccggccaagga

SEQ ID NO: 141820 - DNA, 25 bp, Homo sapien
atgtcatgtctgtgattgccttctt

SEQ ID NO: 141821 - DNA, 25 bp, Homo sapien
gtctgtgattgccttcttacaacag

SEQ ID NO: 141822 - DNA, 25 bp, Homo sapien
gcagaagtggtaggtcagctacaaa

SEQ ID NO: 141823 - DNA, 25 bp, Homo sapien
ggacaagataccaaggcaaacccta

SEQ ID NO: 141824 - DNA, 25 bp, Homo sapien
gggttcaacaaaggctgaactggat

SEQ ID NO: 141825 - DNA, 25 bp, Homo sapien
tgaactggattcttaaccaagaaac

SEQ ID NO: 141826 - DNA, 25 bp, Homo sapien
agcaatggtggtgcaccactgtacc

SEQ ID NO: 141827 - DNA, 25 bp, Homo sapien
tgtaccccaggttctagtcatgtgt

SEQ ID NO: 141828 - DNA, 25 bp, Homo sapien
cccaggttctagtcatgtgtttttt

SEQ ID NO: 141829 - DNA, 25 bp, Homo sapien
ttaggacgatttctgtctccacgat

SEQ ID NO: 141830 - DNA, 25 bp, Homo sapien
ctgtctccacgatggtggaaacagt

SEQ ID NO: 141831 - DNA, 25 bp, Homo sapien
tgccaaggaggagaacgtcgagatt

SEQ ID NO: 141832 - DNA, 25 bp, Homo sapien
aggaggagaacgtcgagattcacca

SEQ ID NO: 141833 - DNA, 25 bp, Homo sapien
gaggagaacgtcgagattcaccaga

SEQ ID NO: 141834 - DNA, 25 bp, Homo sapien
gagaacgtcgagattcaccagacct

SEQ ID NO: 141835 - DNA, 25 bp, Homo sapien
gaacgtcgagattcaccagaccttg

SEQ ID NO: 141836 - DNA, 25 bp, Homo sapien
acgtcgagattcaccagaccttgga

SEQ ID NO: 141837 - DNA, 25 bp, Homo sapien
gtcgagattcaccagaccttggacc

SEQ ID NO: 141838 - DNA, 25 bp, Homo sapien
gagattcaccagaccttggaccaga

SEQ ID NO: 141839 - DNA, 25 bp, Homo sapien
gattcaccagaccttggaccagacc

SEQ ID NO: 141840 - DNA, 25 bp, Homo sapien
tgctggaactcaacaacctgtgagg

SEQ ID NO: 141841 - DNA, 25 bp, Homo sapien
ctggaactcaacaacctgtgagggc

SEQ ID NO: 141842 - DNA, 25 bp, Homo sapien
tgaagccccccagaaggccgatggg

SEQ ID NO: 141843 - DNA, 25 bp, Homo sapien
gaaggagtgccataccttctcccag

SEQ ID NO: 141844 - DNA, 25 bp, Homo sapien
caagagcaggaggtgcctgaaagct

SEQ ID NO: 141845 - DNA, 25 bp, Homo sapien
cctgaaagctgggagcgtgggctca

SEQ ID NO: 141846 - DNA, 25 bp, Homo sapien
aaacatggccagactcccttgcttt

SEQ ID NO: 141847 - DNA, 25 bp, Homo sapien
gccagactcccttgctttttgctgt

SEQ ID NO: 141848 - DNA, 25 bp, Homo sapien
tgctttttgctgtgtagttccctct

SEQ ID NO: 141849 - DNA, 25 bp, Homo sapien
tttgctgtgtagttccctctgcctg

SEQ ID NO: 141850 - DNA, 25 bp, Homo sapien
tctctgcctggcaacatcttacttg

SEQ ID NO: 141851 - DNA, 25 bp, Homo sapien
cctggcaacatcttacttgtccttt

SEQ ID NO: 141852 - DNA, 25 bp, Homo sapien
tttgaggccccaactcaagtgtcac

SEQ ID NO: 141853 - DNA, 25 bp, Homo sapien
ccctcttatttattctacatccttg

SEQ ID NO: 141854 - DNA, 25 bp, Homo sapien
tcttatttattctacatccttggca

SEQ ID NO: 141855 - DNA, 25 bp, Homo sapien
ttatttattctacatccttggcacc

SEQ ID NO: 141856 - DNA, 25 bp, Homo sapien
ttggcaccccacttgcactgaaaga

SEQ ID NO: 141857 - DNA, 25 bp, Homo sapien
tggcaccccacttgcactgaaagag

SEQ ID NO: 141858 - DNA, 25 bp, Homo sapien
ggtccgacaccaagggcgggccgcg

SEQ ID NO: 141859 - DNA, 25 bp, Homo sapien
agctgaagctgcgtcggcggctcac

SEQ ID NO: 141860 - DNA, 25 bp, Homo sapien
tgcgtcggcggctcacggagctcct

SEQ ID NO: 141861 - DNA, 25 bp, Homo sapien
aggcgctgcgcgtggccaggatgcc

SEQ ID NO: 141862 - DNA, 25 bp, Homo sapien
atgcccgggctggagcggagcgtcc

SEQ ID NO: 141863 - DNA, 25 bp, Homo sapien
agcggagcgtccgtgagcgcttcct

SEQ ID NO: 141864 - DNA, 25 bp, Homo sapien
tagtgtagtactgttggctcgatat

SEQ ID NO: 141865 - DNA, 25 bp, Homo sapien
gtgtagtactgttggctcgatattt

SEQ ID NO: 141866 - DNA, 25 bp, Homo sapien
gaatattcagctacgacagttttgg

SEQ ID NO: 141867 - DNA, 25 bp, Homo sapien
tattcagctacgacagttttggact

SEQ ID NO: 141868 - DNA, 25 bp, Homo sapien
cagctacgacagttttggactgttt

SEQ ID NO: 141869 - DNA, 25 bp, Homo sapien
gttttggactgtttagtagtctttg

SEQ ID NO: 141870 - DNA, 25 bp, Homo sapien
gtaccacatggtaattctaagactt

SEQ ID NO: 141871 - DNA, 25 bp, Homo sapien
ctaagacttgttctttacccatgga

SEQ ID NO: 141872 - DNA, 25 bp, Homo sapien
gacttgttctttacccatggaatgt

SEQ ID NO: 141873 - DNA, 25 bp, Homo sapien
acccatggaatgtaatatttttgca

SEQ ID NO: 141874 - DNA, 25 bp, Homo sapien
ggttataaagtcatatccacttctt

SEQ ID NO: 141875 - DNA, 25 bp, Homo sapien
gaggattaccacagcttgtatcaga

SEQ ID NO: 141876 - DNA, 25 bp, Homo sapien
agcttgtatcagagccatttataaa

SEQ ID NO: 141877 - DNA, 25 bp, Homo sapien
tagggccaaaaagcctgacctcact

SEQ ID NO: 141878 - DNA, 25 bp, Homo sapien
ctgacctcactctaactcaaagtaa

SEQ ID NO: 141879 - DNA, 25 bp, Homo sapien
aaagtaatgtccaggttcccagaga

SEQ ID NO: 141880 - DNA, 25 bp, Homo sapien
ggttcccagagaatatctgctggta

SEQ ID NO: 141881 - DNA, 25 bp, Homo sapien
aaagtgtagccttcttccaactcag

SEQ ID NO: 141882 - DNA, 25 bp, Homo sapien
tagccttcttccaactcaggtagaa

SEQ ID NO: 141883 - DNA, 25 bp, Homo sapien
gtagaacacacctgtctttgtcttg

SEQ ID NO: 141884 - DNA, 25 bp, Homo sapien
gtcttgctgttttcactcagccctt

SEQ ID NO: 141885 - DNA, 25 bp, Homo sapien
ttcccctaagcccatatgtctaagg

SEQ ID NO: 141886 - DNA, 25 bp, Homo sapien
cagattgtgtagatatgctatttaa

SEQ ID NO: 141887 - DNA, 25 bp, Homo sapien
atcaggaaatactgcctgtagagtt

SEQ ID NO: 141888 - DNA, 25 bp, Homo sapien
gcctgtagagttagtatttctattt

SEQ ID NO: 141889 - DNA, 25 bp, Homo sapien
ttttatataatgtttgcacactgaa

SEQ ID NO: 141890 - DNA, 25 bp, Homo sapien
aatgtttgcacactgaattgaagaa

SEQ ID NO: 141891 - DNA, 25 bp, Homo sapien
cacactgaattgaagaattgttggt

SEQ ID NO: 141892 - DNA, 25 bp, Homo sapien
ttgcttttgacctcccatttttact

SEQ ID NO: 141893 - DNA, 25 bp, Homo sapien
actatttgccaatacctttttctag

SEQ ID NO: 141894 - DNA, 25 bp, Homo sapien
tttgccaatacctttttctaggaat

SEQ ID NO: 141895 - DNA, 25 bp, Homo sapien
cattctaaagcagtgtaagttgtat

SEQ ID NO: 141896 - DNA, 25 bp, Homo sapien
gtgtaagttgtatattactgtttct

SEQ ID NO: 141897 - DNA, 25 bp, Homo sapien
gatgagggacgctatgcctcatgcc

SEQ ID NO: 141898 - DNA, 25 bp, Homo sapien
gctatgcctcatgcccgttttgggt

SEQ ID NO: 141899 - DNA, 25 bp, Homo sapien
tcatgcccgttttgggtgtcctcac

SEQ ID NO: 141900 - DNA, 25 bp, Homo sapien
tgtcctcaccagcaaggctgctcgg

SEQ ID NO: 141901 - DNA, 25 bp, Homo sapien
ctggttcgtccctgagcctttttca

SEQ ID NO: 141902 - DNA, 25 bp, Homo sapien
cctgagcctttttcacagtgcataa

SEQ ID NO: 141903 - DNA, 25 bp, Homo sapien
tttcacagtgcataagcagtttttt

SEQ ID NO: 141904 - DNA, 25 bp, Homo sapien
cactaatagaaacttggcactcctg

SEQ ID NO: 141905 - DNA, 25 bp, Homo sapien
agaaacttggcactcctgtgccctc

SEQ ID NO: 141906 - DNA, 25 bp, Homo sapien
gcacatagcaagctgaactgtccta

SEQ ID NO: 141907 - DNA, 25 bp, Homo sapien
atagcaagctgaactgtcctaaggc

SEQ ID NO: 141908 - DNA, 25 bp, Homo sapien
ttgggaatctcgttgagcgttcggc

SEQ ID NO: 141909 - DNA, 25 bp, Homo sapien
ctcgttgagcgttcggcgtggatcc

SEQ ID NO: 141910 - DNA, 25 bp, Homo sapien
acacgcatccacttcggattcagtg

SEQ ID NO: 141911 - DNA, 25 bp, Homo sapien
ttcagtgggtgaagacagaactctg

SEQ ID NO: 141912 - DNA, 25 bp, Homo sapien
gaactctgagagtctgcaggcggct

SEQ ID NO: 141913 - DNA, 25 bp, Homo sapien
tgctttttatttctggctcttcgga

SEQ ID NO: 141914 - DNA, 25 bp, Homo sapien
tggctcttcggatgtcttctagaca

SEQ ID NO: 141915 - DNA, 25 bp, Homo sapien
agacatttactatcactgcacctga

SEQ ID NO: 141916 - DNA, 25 bp, Homo sapien
ttactatcactgcacctgaagaaaa

SEQ ID NO: 141917 - DNA, 25 bp, Homo sapien
agaaatgtacgttccttcgctagct

SEQ ID NO: 141918 - DNA, 25 bp, Homo sapien
ccttcgctagctttagtctttctgt

SEQ ID NO: 141919 - DNA, 25 bp, Homo sapien
ccccaacacaggacgcttcatatag

SEQ ID NO: 141920 - DNA, 25 bp, Homo sapien
caggacgcttcatatagatgtgtac

SEQ ID NO: 141921 - DNA, 25 bp, Homo sapien
cgcttcatatagatgtgtacagtat

SEQ ID NO: 141922 - DNA, 25 bp, Homo sapien
cacatgcccaaaggcctcgggactt

SEQ ID NO: 141923 - DNA, 25 bp, Homo sapien
accttgctccacagatccagctagg

SEQ ID NO: 141924 - DNA, 25 bp, Homo sapien
gctccacagatccagctaggcctga

SEQ ID NO: 141925 - DNA, 25 bp, Homo sapien
agctaggcctgacctgtgcctcatc

SEQ ID NO: 141926 - DNA, 25 bp, Homo sapien
cgtgccgctcggtctctggctgatc

SEQ ID NO: 141927 - DNA, 25 bp, Homo sapien
ggtctctggctgatcccgaggcttt

SEQ ID NO: 141928 - DNA, 25 bp, Homo sapien
gaggctttgtcttcctctcgtcagt

SEQ ID NO: 141929 - DNA, 25 bp, Homo sapien
ctctcgtcagttcttttggttgtgt

SEQ ID NO: 141930 - DNA, 25 bp, Homo sapien
ctctgcggctttcactgctgagttt

SEQ ID NO: 141931 - DNA, 25 bp, Homo sapien
tctgcggctttcactgctgagtttc

SEQ ID NO: 141932 - DNA, 25 bp, Homo sapien
tctccctgggaagcctgtgccagca

SEQ ID NO: 141933 - DNA, 25 bp, Homo sapien
gtgccagcacctttgagccttggcc

SEQ ID NO: 141934 - DNA, 25 bp, Homo sapien
acctttgagccttggcccacactga

SEQ ID NO: 141935 - DNA, 25 bp, Homo sapien
ttggcccacactgaggcttaggcct

SEQ ID NO: 141936 - DNA, 25 bp, Homo sapien
gaggcttaggcctctctgcctggga

SEQ ID NO: 141937 - DNA, 25 bp, Homo sapien
cttaggcctctctgcctgggatggg

SEQ ID NO: 141938 - DNA, 25 bp, Homo sapien
tcccctgaggatggcctggattcac

SEQ ID NO: 141939 - DNA, 25 bp, Homo sapien
tatctcttcaagtgtggagagggca

SEQ ID NO: 141940 - DNA, 25 bp, Homo sapien
cttcaagtgtggagagggcagggtc

SEQ ID NO: 141941 - DNA, 25 bp, Homo sapien
cctgtctgtaaggagactttgttgc

SEQ ID NO: 141942 - DNA, 25 bp, Homo sapien
gtaaggagactttgttgcttcccct

SEQ ID NO: 141943 - DNA, 25 bp, Homo sapien
ggaatccacagtgctctgcttctct

SEQ ID NO: 141944 - DNA, 25 bp, Homo sapien
aatccacagtgctctgcttctctgt

SEQ ID NO: 141945 - DNA, 25 bp, Homo sapien
ggtctcgtttgtgcgcgtgggtgta

SEQ ID NO: 141946 - DNA, 25 bp, Homo sapien
tgcgcgtgggtgtagctttgtgcat

SEQ ID NO: 141947 - DNA, 25 bp, Homo sapien
tctcccagtggagcgatcacctgtg

SEQ ID NO: 141948 - DNA, 25 bp, Homo sapien
ccagtggagcgatcacctgtgcctc

SEQ ID NO: 141949 - DNA, 25 bp, Homo sapien
agtggagcgatcacctgtgcctccc

SEQ ID NO: 141950 - DNA, 25 bp, Homo sapien
tttgtttgcccctgtgtggttggtc

SEQ ID NO: 141951 - DNA, 25 bp, Homo sapien
tgtttgcccctgtgtggttggtcaa

SEQ ID NO: 141952 - DNA, 25 bp, Homo sapien
ttaccctccaaaagcaagtagccaa

SEQ ID NO: 141953 - DNA, 25 bp, Homo sapien
caagtagccaaagccgttgccaaac

SEQ ID NO: 141954 - DNA, 25 bp, Homo sapien
acccataaatcaatgggccctttat

SEQ ID NO: 141955 - DNA, 25 bp, Homo sapien
atgggccctttatttatgacgactt

SEQ ID NO: 141956 - DNA, 25 bp, Homo sapien
ggccctttatttatgacgactttat

SEQ ID NO: 141957 - DNA, 25 bp, Homo sapien
ttatgacgactttatttattctaat

SEQ ID NO: 141958 - DNA, 25 bp, Homo sapien
atttatatatattgggtcgtctgct

SEQ ID NO: 141959 - DNA, 25 bp, Homo sapien
atatatattgggtcgtctgcttccc

SEQ ID NO: 141960 - DNA, 25 bp, Homo sapien
tattgggtcgtctgcttcccttgta

SEQ ID NO: 141961 - DNA, 25 bp, Homo sapien
tcgtctgcttcccttgtatttttct

SEQ ID NO: 141962 - DNA, 25 bp, Homo sapien
ctgcttcccttgtatttttcttcct

SEQ ID NO: 141963 - DNA, 25 bp, Homo sapien
gatgccagtgtggtacgtgagatct

SEQ ID NO: 141964 - DNA, 25 bp, Homo sapien
acgtgagatctgctccaagtacatc

SEQ ID NO: 141965 - DNA, 25 bp, Homo sapien
aagtacatctatgaccagtgcccag

SEQ ID NO: 141966 - DNA, 25 bp, Homo sapien
agcagtggctggatatggccccatt

SEQ ID NO: 141967 - DNA, 25 bp, Homo sapien
tggatatggccccattgagcagctc

SEQ ID NO: 141968 - DNA, 25 bp, Homo sapien
ccattgagcagctcccagactacaa

SEQ ID NO: 141969 - DNA, 25 bp, Homo sapien
agactacaaccggatccgtagcggc

SEQ ID NO: 141970 - DNA, 25 bp, Homo sapien
atccgtagcggcatgttctggctgc

SEQ ID NO: 141971 - DNA, 25 bp, Homo sapien
ttctggctgcgcttctaggcgggaa

SEQ ID NO: 141972 - DNA, 25 bp, Homo sapien
gcttctaggcgggaagcctatgtaa

SEQ ID NO: 141973 - DNA, 25 bp, Homo sapien
agcacttcggctcctctaacctgtg

SEQ ID NO: 141974 - DNA, 25 bp, Homo sapien
ggtgcttctatcctaataccatcga

SEQ ID NO: 141975 - DNA, 25 bp, Homo sapien
taccatcgacgtccctccagaagag

SEQ ID NO: 141976 - DNA, 25 bp, Homo sapien
gtgaattttagacacttctgcaggg

SEQ ID NO: 141977 - DNA, 25 bp, Homo sapien
agacacttctgcagggatctgcctg

SEQ ID NO: 141978 - DNA, 25 bp, Homo sapien
ggtgccgtccccagcacggtgatta

SEQ ID NO: 141979 - DNA, 25 bp, Homo sapien
gcacggtgattagtcccagagctcg

SEQ ID NO: 141980 - DNA, 25 bp, Homo sapien
gattagtcccagagctcggctgcca

SEQ ID NO: 141981 - DNA, 25 bp, Homo sapien
acctcagacacgcttctgcagctgt

SEQ ID NO: 141982 - DNA, 25 bp, Homo sapien
tgcctcggctcacaacacagattga

SEQ ID NO: 141983 - DNA, 25 bp, Homo sapien
gattgactgctctgactttgactac

SEQ ID NO: 141984 - DNA, 25 bp, Homo sapien
gactttgactactcaaaattggcct

SEQ ID NO: 141985 - DNA, 25 bp, Homo sapien
gaggaatttaaagactcatccccag

SEQ ID NO: 141986 - DNA, 25 bp, Homo sapien
gaatttaaagactcatccccagcct

SEQ ID NO: 141987 - DNA, 25 bp, Homo sapien
aatttaaagactcatccccagcctc

SEQ ID NO: 141988 - DNA, 25 bp, Homo sapien
ctgtgtgatacttgggggctagctt

SEQ ID NO: 141989 - DNA, 25 bp, Homo sapien
gagatggtcttgttctgtcaaccag

SEQ ID NO: 141990 - DNA, 25 bp, Homo sapien
gatggtcttgttctgtcaaccaggc

SEQ ID NO: 141991 - DNA, 25 bp, Homo sapien
agcggtgcaatcatgagtcaatgca

SEQ ID NO: 141992 - DNA, 25 bp, Homo sapien
cggtgcaatcatgagtcaatgcagc

SEQ ID NO: 141993 - DNA, 25 bp, Homo sapien
ttttttgcggagacggtattgctat

SEQ ID NO: 141994 - DNA, 25 bp, Homo sapien
tttgcggagacggtattgctatgtt

SEQ ID NO: 141995 - DNA, 25 bp, Homo sapien
ttgcggagacggtattgctatgttg

SEQ ID NO: 141996 - DNA, 25 bp, Homo sapien
aactgtgccagttctttccataata

SEQ ID NO: 141997 - DNA, 25 bp, Homo sapien
aaaggctttgagttaactcactgag

SEQ ID NO: 141998 - DNA, 25 bp, Homo sapien
aactcactgagggtatctgacaatg

SEQ ID NO: 141999 - DNA, 25 bp, Homo sapien
gggtatctgacaatgctgaggttat

SEQ ID NO: 142000 - DNA, 25 bp, Homo sapien
gtgctcttagcaaaaacatgtatgt

SEQ ID NO: 142001 - DNA, 25 bp, Homo sapien
atgtatgtgcatttcaatcccacgt

SEQ ID NO: 142002 - DNA, 25 bp, Homo sapien
gcatttcaatcccacgtacttataa

SEQ ID NO: 142003 - DNA, 25 bp, Homo sapien
ggtgaatttcacaagctatttttgg

SEQ ID NO: 142004 - DNA, 25 bp, Homo sapien
tttcacaagctattccctcaaatct

SEQ ID NO: 142005 - DNA, 25 bp, Homo sapien
agggagctgagtaacaccatcgatc

SEQ ID NO: 142006 - DNA, 25 bp, Homo sapien
cgatcatgatgtagagtgtggttat

SEQ ID NO: 142007 - DNA, 25 bp, Homo sapien
ggatgcacagagttgttacattttt

SEQ ID NO: 142008 - DNA, 25 bp, Homo sapien
gatacagttactcagaattctctag

SEQ ID NO: 142009 - DNA, 25 bp, Homo sapien
ctcagaattctctagtttgattaaa

SEQ ID NO: 142010 - DNA, 25 bp, Homo sapien
ttcttgcaaagtatccctactgtaa

SEQ ID NO: 142011 - DNA, 25 bp, Homo sapien
aagtatccctactgtaatttgtgat

SEQ ID NO: 142012 - DNA, 25 bp, Homo sapien
atttgtgatacaatgctgtgcccta

SEQ ID NO: 142013 - DNA, 25 bp, Homo sapien
aatgctgtgccctaaagtgtatttt

SEQ ID NO: 142014 - DNA, 25 bp, Homo sapien
tattatgacacatcagcacgatttc

SEQ ID NO: 142015 - DNA, 25 bp, Homo sapien
acatcagcacgatttctgtttaaat

SEQ ID NO: 142016 - DNA, 25 bp, Homo sapien
ataatacaccactacattctgttaa

SEQ ID NO: 142017 - DNA, 25 bp, Homo sapien
cattctgttaatcattaggtgtgac

SEQ ID NO: 142018 - DNA, 25 bp, Homo sapien
tgaggcaggataattttgcttaaac

SEQ ID NO: 142019 - DNA, 25 bp, Homo sapien
gaggcaggataattttgcttaaacc

SEQ ID NO: 142020 - DNA, 25 bp, Homo sapien
ggcaggataattttgcttaaacccg

SEQ ID NO: 142021 - DNA, 25 bp, Homo sapien
gcaggataattttgcttaaacccgg

SEQ ID NO: 142022 - DNA, 25 bp, Homo sapien
cctgggaaacgcagtgagactgtgc

SEQ ID NO: 142023 - DNA, 25 bp, Homo sapien
ctgggaaacgcagtgagactgtgcc

SEQ ID NO: 142024 - DNA, 25 bp, Homo sapien
tgggaaacgcagtgagactgtgcct

SEQ ID NO: 142025 - DNA, 25 bp, Homo sapien
gaaaactcacgaagcagaggctggg

SEQ ID NO: 142026 - DNA, 25 bp, Homo sapien
aaaactcacgaagcagaggctgggc

SEQ ID NO: 142027 - DNA, 25 bp, Homo sapien
aactcacgaagcagaggctgggcgt

SEQ ID NO: 142028 - DNA, 25 bp, Homo sapien
actcacgaagcagaggctgggcgtg

SEQ ID NO: 142029 - DNA, 25 bp, Homo sapien
tgctgtttactcatcgggcagccac

SEQ ID NO: 142030 - DNA, 25 bp, Homo sapien
agccacgtgctctctggaggaagtg

SEQ ID NO: 142031 - DNA, 25 bp, Homo sapien
gatagtttctgaaaccgctcagatg

SEQ ID NO: 142032 - DNA, 25 bp, Homo sapien
tggccttgcgagaggtggttacacc

SEQ ID NO: 142033 - DNA, 25 bp, Homo sapien
gtggttacaccagaacctggacatt

SEQ ID NO: 142034 - DNA, 25 bp, Homo sapien
gacattggccagaagaagcttaagt

SEQ ID NO: 142035 - DNA, 25 bp, Homo sapien
gcttaagtgggcagacactgtttgc

SEQ ID NO: 142036 - DNA, 25 bp, Homo sapien
actgtttgcccagtgtttgtgcaag

SEQ ID NO: 142037 - DNA, 25 bp, Homo sapien
gatggagtgggtgtctctgcatcac

SEQ ID NO: 142038 - DNA, 25 bp, Homo sapien
gtaaggcacgctggaaggcacacgc

SEQ ID NO: 142039 - DNA, 25 bp, Homo sapien
cgcccatgatgggagggattgacat

SEQ ID NO: 142040 - DNA, 25 bp, Homo sapien
ggagctctggagtgctaacttgaac

SEQ ID NO: 142041 - DNA, 25 bp, Homo sapien
tgaacaccaagggtgctactcatcc

SEQ ID NO: 142042 - DNA, 25 bp, Homo sapien
gctactcatccctatggtatcatat

SEQ ID NO: 142043 - DNA, 25 bp, Homo sapien
gggcaatgactttcctagacaataa

SEQ ID NO: 142044 - DNA, 25 bp, Homo sapien
gacaataacccgagggactccagat

SEQ ID NO: 142045 - DNA, 25 bp, Homo sapien
ggactccagatacataccccgaagg

SEQ ID NO: 142046 - DNA, 25 bp, Homo sapien
tacataccccgaaggtctaggaaat

SEQ ID NO: 142047 - DNA, 25 bp, Homo sapien
gggcagattacagtcatttcctacc

SEQ ID NO: 142048 - DNA, 25 bp, Homo sapien
ctttacctcttcttctccaaaggat

SEQ ID NO: 142049 - DNA, 25 bp, Homo sapien
aaaggatctttgttcctctgagcca

SEQ ID NO: 142050 - DNA, 25 bp, Homo sapien
tttgttcctctgagccaagactgag

SEQ ID NO: 142051 - DNA, 25 bp, Homo sapien
ggtataggcccaaactgccttcgtt

SEQ ID NO: 142052 - DNA, 25 bp, Homo sapien
ataggcccaaactgccttcgtttgg

SEQ ID NO: 142053 - DNA, 25 bp, Homo sapien
caaactgccttcgtttggtccaggg

SEQ ID NO: 142054 - DNA, 25 bp, Homo sapien
actgccttcgtttggtccagggcca

SEQ ID NO: 142055 - DNA, 25 bp, Homo sapien
ttcgtttggtccagggccatcgtgg

SEQ ID NO: 142056 - DNA, 25 bp, Homo sapien
ttggtccagggccatcgtgggtgat

SEQ ID NO: 142057 - DNA, 25 bp, Homo sapien
cgtgggtgatgacgattgctctctt

SEQ ID NO: 142058 - DNA, 25 bp, Homo sapien
gggtgatgacgattgctctcttgca

SEQ ID NO: 142059 - DNA, 25 bp, Homo sapien
atttgatgctggtagtatggattat

SEQ ID NO: 142060 - DNA, 25 bp, Homo sapien
atgctggtagtatggattatgagat

SEQ ID NO: 142061 - DNA, 25 bp, Homo sapien
ttttttcccataccaactgcttcta

SEQ ID NO: 142062 - DNA, 25 bp, Homo sapien
cactcaggctgatgagctccaacat

SEQ ID NO: 142063 - DNA, 25 bp, Homo sapien
gagctccaacataacagaagaactt

SEQ ID NO: 142064 - DNA, 25 bp, Homo sapien
ttttttactggtctcattggcaatg

SEQ ID NO: 142065 - DNA, 25 bp, Homo sapien
cattggcaatgtttcgatagacagc

SEQ ID NO: 142066 - DNA, 25 bp, Homo sapien
cgatagacagcataatcccctacat

SEQ ID NO: 142067 - DNA, 25 bp, Homo sapien
aatcccctacatcctcaagatggag

SEQ ID NO: 142068 - DNA, 25 bp, Homo sapien
gagtataatggccagatcaccggag

SEQ ID NO: 142069 - DNA, 25 bp, Homo sapien
agtctatagcgcaaaccacacacct

SEQ ID NO: 142070 - DNA, 25 bp, Homo sapien
ttccaggaccgttcacatacaaaga

SEQ ID NO: 142071 - DNA, 25 bp, Homo sapien
tatgttagccatttcctgtctggtt

SEQ ID NO: 142072 - DNA, 25 bp, Homo sapien
gtctggtttctccttatctgttaat

SEQ ID NO: 142073 - DNA, 25 bp, Homo sapien
gtctcagcttccaccaaggttgtac

SEQ ID NO: 142074 - DNA, 25 bp, Homo sapien
aggttgtaccattgcctcccagcgc

SEQ ID NO: 142075 - DNA, 25 bp, Homo sapien
tgcaccaacctcactgggacacttt

SEQ ID NO: 142076 - DNA, 25 bp, Homo sapien
aacctcactgggacacttttgcctt

SEQ ID NO: 142077 - DNA, 25 bp, Homo sapien
ttttgccttcccgaaacactgatga

SEQ ID NO: 142078 - DNA, 25 bp, Homo sapien
cttcccgaaacactgatgagacctt

SEQ ID NO: 142079 - DNA, 25 bp, Homo sapien
agtgcagtgggtgcgcccctgacca

SEQ ID NO: 142080 - DNA, 25 bp, Homo sapien
gcccctgaccactgctgctgattag

SEQ ID NO: 142081 - DNA, 25 bp, Homo sapien
ccactgctgctgattagggtttttt

SEQ ID NO: 142082 - DNA, 25 bp, Homo sapien
actgctgctgattagggttttttaa

SEQ ID NO: 142083 - DNA, 25 bp, Homo sapien
gttcaagagaaaaagtgtacacaca

SEQ ID NO: 142084 - DNA, 25 bp, Homo sapien
aatcagattgttcctttttagtgac

SEQ ID NO: 142085 - DNA, 25 bp, Homo sapien
gattgttcctttttagtgactcatg

SEQ ID NO: 142086 - DNA, 25 bp, Homo sapien
gttcctttttagtgactcatgttta

SEQ ID NO: 142087 - DNA, 25 bp, Homo sapien
gagttgagtttaacaatcctagctt

SEQ ID NO: 142088 - DNA, 25 bp, Homo sapien
aaatattctacatgtcattcagata

SEQ ID NO: 142089 - DNA, 25 bp, Homo sapien
atattatgtatatcttctagccttt

SEQ ID NO: 142090 - DNA, 25 bp, Homo sapien
gtatatcttctagcctttattctgt

SEQ ID NO: 142091 - DNA, 25 bp, Homo sapien
atcttctagcctttattctgtactt

SEQ ID NO: 142092 - DNA, 25 bp, Homo sapien
atgtacatatttctgtcttgcgtga

SEQ ID NO: 142093 - DNA, 25 bp, Homo sapien
atatttctgtcttgcgtgatttgta

SEQ ID NO: 142094 - DNA, 25 bp, Homo sapien
gcgtgatttgtatatttcactggtt

SEQ ID NO: 142095 - DNA, 25 bp, Homo sapien
gggtcctgagcccgaactcccagag

SEQ ID NO: 142096 - DNA, 25 bp, Homo sapien
actcccagagctcacccgcgggtga

SEQ ID NO: 142097 - DNA, 25 bp, Homo sapien
ggtggtttgtgcgagttcccttgcc

SEQ ID NO: 142098 - DNA, 25 bp, Homo sapien
tggtttgtgcgagttcccttgccac

SEQ ID NO: 142099 - DNA, 25 bp, Homo sapien
tttgtgcgagttcccttgccacgcg

SEQ ID NO: 142100 - DNA, 25 bp, Homo sapien
aagtcgctgtgaatgaccccttctt

SEQ ID NO: 142101 - DNA, 25 bp, Homo sapien
cgctgtgaatgaccccttctttcct

SEQ ID NO: 142102 - DNA, 25 bp, Homo sapien
ttcctttctctgttgtaaataccct

SEQ ID NO: 142103 - DNA, 25 bp, Homo sapien
ttctctgttgtaaataccctcacgg

SEQ ID NO: 142104 - DNA, 25 bp, Homo sapien
ctgttgtaaataccctcacggagga

SEQ ID NO: 142105 - DNA, 25 bp, Homo sapien
tgtaaataccctcacggaggaaata

SEQ ID NO: 142106 - DNA, 25 bp, Homo sapien
acaagttacatatagcatcattcta

SEQ ID NO: 142107 - DNA, 25 bp, Homo sapien
ttttcttatgtctcttgttgagttt

SEQ ID NO: 142108 - DNA, 25 bp, Homo sapien
atttttgcttgtgttagatcattat

SEQ ID NO: 142109 - DNA, 25 bp, Homo sapien
aaaatatatccaatgtccctttgat

SEQ ID NO: 142110 - DNA, 25 bp, Homo sapien
aatgtccctttgatacttgtgctct

SEQ ID NO: 142111 - DNA, 25 bp, Homo sapien
cctttgatacttgtgctctgctgag

SEQ ID NO: 142112 - DNA, 25 bp, Homo sapien
gatacttgtgctctgctgagaatgt

SEQ ID NO: 142113 - DNA, 25 bp, Homo sapien
gctctgctgagaatgtacagtttgc

SEQ ID NO: 142114 - DNA, 25 bp, Homo sapien
cccaggtctcatccttcaggaattt

SEQ ID NO: 142115 - DNA, 25 bp, Homo sapien
tccttcaggaattttgcagttcaat

SEQ ID NO: 142116 - DNA, 25 bp, Homo sapien
agaagcatctctacagatgaaaatt

SEQ ID NO: 142117 - DNA, 25 bp, Homo sapien
tccttctccaggttacatgaggcag

SEQ ID NO: 142118 - DNA, 25 bp, Homo sapien
acagagacagcaagacagttaacaa

SEQ ID NO: 142119 - DNA, 25 bp, Homo sapien
agaaatagggtgtggtcactctcaa

SEQ ID NO: 142120 - DNA, 25 bp, Homo sapien
tagggtgtggtcactctcaattcac

SEQ ID NO: 142121 - DNA, 25 bp, Homo sapien
tggtcactctcaattcactggcaaa

SEQ ID NO: 142122 - DNA, 25 bp, Homo sapien
ctctcaattcactggcaaatgcctg

SEQ ID NO: 142123 - DNA, 25 bp, Homo sapien
gaatggtctgtctgaaggaagcaac

SEQ ID NO: 142124 - DNA, 25 bp, Homo sapien
tctaagttcttgtctctggccagag

SEQ ID NO: 142125 - DNA, 25 bp, Homo sapien
gccagaggtgtggtatagaaccaga

SEQ ID NO: 142126 - DNA, 25 bp, Homo sapien
gaaccagaaacccatatcaagggtg

SEQ ID NO: 142127 - DNA, 25 bp, Homo sapien
gcccggcttccggtatgagaaatta

SEQ ID NO: 142128 - DNA, 25 bp, Homo sapien
agctattcaagtattcctatgccag

SEQ ID NO: 142129 - DNA, 25 bp, Homo sapien
gtattcctatgccagagcagtgcca

SEQ ID NO: 142130 - DNA, 25 bp, Homo sapien
agtgccaactcttggaggtcccaga

SEQ ID NO: 142131 - DNA, 25 bp, Homo sapien
ggaggtcccagagtgcagccaatgc

SEQ ID NO: 142132 - DNA, 25 bp, Homo sapien
tgcctttgtgtggtagttctaaatt

SEQ ID NO: 142133 - DNA, 25 bp, Homo sapien
attttaattgcacctgaaaaacctg

SEQ ID NO: 142134 - DNA, 25 bp, Homo sapien
aaaaacctgggcacctaagcaatga

SEQ ID NO: 142135 - DNA, 25 bp, Homo sapien
gcacctaagcaatgagccacagcaa

SEQ ID NO: 142136 - DNA, 25 bp, Homo sapien
gatgtagttcttttcatgcaagtat

SEQ ID NO: 142137 - DNA, 25 bp, Homo sapien
tagttataattgttggacctccttg

SEQ ID NO: 142138 - DNA, 25 bp, Homo sapien
gacctccttgagatagtaacaacaa

SEQ ID NO: 142139 - DNA, 25 bp, Homo sapien
taaagccaggactattccctttcct

SEQ ID NO: 142140 - DNA, 25 bp, Homo sapien
ctttcctccccaggaatatgtgttt

SEQ ID NO: 142141 - DNA, 25 bp, Homo sapien
ttcctttgtcttaatcgatctggta

SEQ ID NO: 142142 - DNA, 25 bp, Homo sapien
gagaaatggcgaatgtcatacacat

SEQ ID NO: 142143 - DNA, 25 bp, Homo sapien
gagatggtatatccttgcgatgtac

SEQ ID NO: 142144 - DNA, 25 bp, Homo sapien
tatccttgcgatgtacagaatcaga

SEQ ID NO: 142145 - DNA, 25 bp, Homo sapien
cagaaggtggtttgacagcatcata

SEQ ID NO: 142146 - DNA, 25 bp, Homo sapien
agtctggccactgtcaaggcaggga

SEQ ID NO: 142147 - DNA, 25 bp, Homo sapien
aaaccccattagtctagccttgtag

SEQ ID NO: 142148 - DNA, 25 bp, Homo sapien
ttagtctagccttgtagctgttact

SEQ ID NO: 142149 - DNA, 25 bp, Homo sapien
gcttagtctgttttctaaagccagg

SEQ ID NO: 142150 - DNA, 25 bp, Homo sapien
actcactcagagacacatggtaaca

SEQ ID NO: 142151 - DNA, 25 bp, Homo sapien
gtaacacatactccagattgacctt

SEQ ID NO: 142152 - DNA, 25 bp, Homo sapien
acatactccagattgaccttataaa

SEQ ID NO: 142153 - DNA, 25 bp, Homo sapien
taaaagaatgcccaccagattgaaa

SEQ ID NO: 142154 - DNA, 25 bp, Homo sapien
gaatgcccaccagattgaaatccta

SEQ ID NO: 142155 - DNA, 25 bp, Homo sapien
gcccaccagattgaaatcctagaaa

SEQ ID NO: 142156 - DNA, 25 bp, Homo sapien
aaaggtcatgtgaaaactcccactg

SEQ ID NO: 142157 - DNA, 25 bp, Homo sapien
ggtcatgtgaaaactcccactggaa

SEQ ID NO: 142158 - DNA, 25 bp, Homo sapien
aactcccactggaaataaatcctgt

SEQ ID NO: 142159 - DNA, 25 bp, Homo sapien
gaatatattggttgctcatttttga

SEQ ID NO: 142160 - DNA, 25 bp, Homo sapien
ggttgctcatttttgaagagagtct

SEQ ID NO: 142161 - DNA, 25 bp, Homo sapien
tttgtttcaaatacagtatattgtc

SEQ ID NO: 142162 - DNA, 25 bp, Homo sapien
ttgtttcaaatacagtatattgtct

SEQ ID NO: 142163 - DNA, 25 bp, Homo sapien
tgtttcaaatacagtatattgtcta

SEQ ID NO: 142164 - DNA, 25 bp, Homo sapien
gtttcaaatacagtatattgtctat

SEQ ID NO: 142165 - DNA, 25 bp, Homo sapien
tttcaaatacagtatattgtctatt

SEQ ID NO: 142166 - DNA, 25 bp, Homo sapien
ttcaaatacagtatattgtctattt

SEQ ID NO: 142167 - DNA, 25 bp, Homo sapien
tcaaatacagtatattgtctatttt

SEQ ID NO: 142168 - DNA, 25 bp, Homo sapien
caaatacagtatattgtctattttt

SEQ ID NO: 142169 - DNA, 25 bp, Homo sapien
agagcaagtgtcctctgacagccgt

SEQ ID NO: 142170 - DNA, 25 bp, Homo sapien
gagcaagtgtcctctgacagccgtg

SEQ ID NO: 142171 - DNA, 25 bp, Homo sapien
agcaagtgtcctctgacagccgtgt

SEQ ID NO: 142172 - DNA, 25 bp, Homo sapien
gcaagtgtcctctgacagccgtgtc

SEQ ID NO: 142173 - DNA, 25 bp, Homo sapien
gccgtgtccccggacagttcagaca

SEQ ID NO: 142174 - DNA, 25 bp, Homo sapien
cccggacagttcagacacccttggg

SEQ ID NO: 142175 - DNA, 25 bp, Homo sapien
gacagttcagacacccttggggatg

SEQ ID NO: 142176 - DNA, 25 bp, Homo sapien
acacccttggggatggcactccaca

SEQ ID NO: 142177 - DNA, 25 bp, Homo sapien
acacacgacagagatgcaggggcca

SEQ ID NO: 142178 - DNA, 25 bp, Homo sapien
gctcggtgcccttcgtccagggtta

SEQ ID NO: 142179 - DNA, 25 bp, Homo sapien
gttgaccgatgtatcttttccttaa

SEQ ID NO: 142180 - DNA, 25 bp, Homo sapien
aacacccaagattgaacagctttct

SEQ ID NO: 142181 - DNA, 25 bp, Homo sapien
tatgattgtaaagtcttgcaaatgc

SEQ ID NO: 142182 - DNA, 25 bp, Homo sapien
atgacgacgacaacgatgatgcttg

SEQ ID NO: 142183 - DNA, 25 bp, Homo sapien
gacaacgatgatgcttgtaacaaga

SEQ ID NO: 142184 - DNA, 25 bp, Homo sapien
aaacataagagagccttggttcatc

SEQ ID NO: 142185 - DNA, 25 bp, Homo sapien
tgaaaaggcggtactagttcagaca

SEQ ID NO: 142186 - DNA, 25 bp, Homo sapien
actagttcagacactttggaagttt

SEQ ID NO: 142187 - DNA, 25 bp, Homo sapien
agacactttggaagtttgtgttctg

SEQ ID NO: 142188 - DNA, 25 bp, Homo sapien
gtttgtgttctgtttgttaaaactg

SEQ ID NO: 142189 - DNA, 25 bp, Homo sapien
gtttgttaaaactggcatctgacac

SEQ ID NO: 142190 - DNA, 25 bp, Homo sapien
ttctacatttcacctactttgtaag

SEQ ID NO: 142191 - DNA, 25 bp, Homo sapien
tggctcagcatgtgcgaatccacac

SEQ ID NO: 142192 - DNA, 25 bp, Homo sapien
atgtgcgaatccacacagcccaggc

SEQ ID NO: 142193 - DNA, 25 bp, Homo sapien
gtcatgttccagacagacgcggact

SEQ ID NO: 142194 - DNA, 25 bp, Homo sapien
gttccagacagacgcggacttctat

SEQ ID NO: 142195 - DNA, 25 bp, Homo sapien
agacgcggacttctatcagcagtat

SEQ ID NO: 142196 - DNA, 25 bp, Homo sapien
gacttctatcagcagtatgggccag

SEQ ID NO: 142197 - DNA, 25 bp, Homo sapien
tatcagcagtatgggccaggtggca

SEQ ID NO: 142198 - DNA, 25 bp, Homo sapien
tgccgagtgagctggcggcccttct

SEQ ID NO: 142199 - DNA, 25 bp, Homo sapien
ctggcggcccttctgactgtttatt

SEQ ID NO: 142200 - DNA, 25 bp, Homo sapien
ctgactgtttatttaaggatggatg

SEQ ID NO: 142201 - DNA, 25 bp, Homo sapien
atggatggcaccctggaaccgggaa

SEQ ID NO: 142202 - DNA, 25 bp, Homo sapien
agggccctttcctgtgtacacgtga

SEQ ID NO: 142203 - DNA, 25 bp, Homo sapien
acgtgacagagtgccttttcgagac

SEQ ID NO: 142204 - DNA, 25 bp, Homo sapien
agactggcagggacgaggacaaata

SEQ ID NO: 142205 - DNA, 25 bp, Homo sapien
gggctctggttgtaaaacacacttc

SEQ ID NO: 142206 - DNA, 25 bp, Homo sapien
aaacacacttcctgctgcgaaagac

SEQ ID NO: 142207 - DNA, 25 bp, Homo sapien
ctgcgaaagacccacatgctacaag

SEQ ID NO: 142208 - DNA, 25 bp, Homo sapien
tgagccagcacctgcggtagctgca

SEQ ID NO: 142209 - DNA, 25 bp, Homo sapien
tgcggtagctgcactacagccctgg

SEQ ID NO: 142210 - DNA, 25 bp, Homo sapien
ccgccgaccatccaagggagagtga

SEQ ID NO: 142211 - DNA, 25 bp, Homo sapien
agacctggcagccacaactgcagtc

SEQ ID NO: 142212 - DNA, 25 bp, Homo sapien
tgcagtcccatcctcttgtcagggc

SEQ ID NO: 142213 - DNA, 25 bp, Homo sapien
gggccaattcaaagccaagtcgtgg

SEQ ID NO: 142214 - DNA, 25 bp, Homo sapien
ggtgacaggcacacacatttttcta

SEQ ID NO: 142215 - DNA, 25 bp, Homo sapien
atttttctacccttcttctgagatg

SEQ ID NO: 142216 - DNA, 25 bp, Homo sapien
tacccttcttctgagatgtcctctg

SEQ ID NO: 142217 - DNA, 25 bp, Homo sapien
ctctgccttccaggtatttgtgatt

SEQ ID NO: 142218 - DNA, 25 bp, Homo sapien
gattttgtcacagcctgacatggcc

SEQ ID NO: 142219 - DNA, 25 bp, Homo sapien
tgacatggccaggttctcacactgg

SEQ ID NO: 142220 - DNA, 25 bp, Homo sapien
gcccagagaaaagagcctcagcaag

SEQ ID NO: 142221 - DNA, 25 bp, Homo sapien
agcctcagcaagagagttttgccaa

SEQ ID NO: 142222 - DNA, 25 bp, Homo sapien
gagagttttgccaacaattcccctt

SEQ ID NO: 142223 - DNA, 25 bp, Homo sapien
aggaaacagatcaactacaccgcat

SEQ ID NO: 142224 - DNA, 25 bp, Homo sapien
gagagcctttagcagtaactcccac

SEQ ID NO: 142225 - DNA, 25 bp, Homo sapien
tttagcagtaactcccacctggttc

SEQ ID NO: 142226 - DNA, 25 bp, Homo sapien
ccacctggttcgtcatcagagagtt

SEQ ID NO: 142227 - DNA, 25 bp, Homo sapien
aaagcctttagtgaaagatctacac

SEQ ID NO: 142228 - DNA, 25 bp, Homo sapien
aaagatctacacttgttcggcacca

SEQ ID NO: 142229 - DNA, 25 bp, Homo sapien
tctacacttgttcggcaccagaaag

SEQ ID NO: 142230 - DNA, 25 bp, Homo sapien
aaactcttcagccatctttgtaacc

SEQ ID NO: 142231 - DNA, 25 bp, Homo sapien
ccatctttgtaaccttgcacagcat

SEQ ID NO: 142232 - DNA, 25 bp, Homo sapien
gattcatacctgagtggagccttat

SEQ ID NO: 142233 - DNA, 25 bp, Homo sapien
ggagccttatggaagtggtctttgt

SEQ ID NO: 142234 - DNA, 25 bp, Homo sapien
gtggtctttgtgagaaaatcttcag

SEQ ID NO: 142235 - DNA, 25 bp, Homo sapien
cagccccgttctgttccgggctggg

SEQ ID NO: 142236 - DNA, 25 bp, Homo sapien
ccgttctgttccgggctgggactct

SEQ ID NO: 142237 - DNA, 25 bp, Homo sapien
cgttctgttccgggctgggactctg

SEQ ID NO: 142238 - DNA, 25 bp, Homo sapien
gttctgttccgggctgggactctgc

SEQ ID NO: 142239 - DNA, 25 bp, Homo sapien
ttctgttccgggctgggactctgcc

SEQ ID NO: 142240 - DNA, 25 bp, Homo sapien
tctgttccgggctgggactctgccc

SEQ ID NO: 142241 - DNA, 25 bp, Homo sapien
ctgttccgggctgggactctgcccc

SEQ ID NO: 142242 - DNA, 25 bp, Homo sapien
ttccgggctgggactctgcccccgg

SEQ ID NO: 142243 - DNA, 25 bp, Homo sapien
accctccccagctgacatcacccat

SEQ ID NO: 142244 - DNA, 25 bp, Homo sapien
tccccagctgacatcacccatccca

SEQ ID NO: 142245 - DNA, 25 bp, Homo sapien
ccagctgacatcacccatcccactc

SEQ ID NO: 142246 - DNA, 25 bp, Homo sapien
gacccgtgccagtgagtcccggctt

SEQ ID NO: 142247 - DNA, 25 bp, Homo sapien
tgagtcccggcttgcgggcagtctc

SEQ ID NO: 142248 - DNA, 25 bp, Homo sapien
tcttgggtacgttcaataaaaggat

SEQ ID NO: 142249 - DNA, 25 bp, Homo sapien
acctgggcgacatcgcgaacatcct

SEQ ID NO: 142250 - DNA, 25 bp, Homo sapien
tgaccttgaaccagcacgtggagca

SEQ ID NO: 142251 - DNA, 25 bp, Homo sapien
accttgaaccagcacgtggagcagc

SEQ ID NO: 142252 - DNA, 25 bp, Homo sapien
cttgaaccagcacgtggagcagctg

SEQ ID NO: 142253 - DNA, 25 bp, Homo sapien
tgcgcggcgccttcgaccagacagt

SEQ ID NO: 142254 - DNA, 25 bp, Homo sapien
gccttcgaccagacagtgtccctgg

SEQ ID NO: 142255 - DNA, 25 bp, Homo sapien
gaccagacagtgtccctggccgtgg

SEQ ID NO: 142256 - DNA, 25 bp, Homo sapien
ccgtgggcttcattctgggcagcgc

SEQ ID NO: 142257 - DNA, 25 bp, Homo sapien
tcctgtgagtcttgcgaggtggaat

SEQ ID NO: 142258 - DNA, 25 bp, Homo sapien
gtcttgcgaggtggaattaatgatt

SEQ ID NO: 142259 - DNA, 25 bp, Homo sapien
gattaaatactcatgtgttcagaaa

SEQ ID NO: 142260 - DNA, 25 bp, Homo sapien
ttatactccttaagttatcccaaag

SEQ ID NO: 142261 - DNA, 25 bp, Homo sapien
taagttatcccaaagccgtgtgttt

SEQ ID NO: 142262 - DNA, 25 bp, Homo sapien
tcccaaagccgtgtgtttgtgatgt

SEQ ID NO: 142263 - DNA, 25 bp, Homo sapien
aattattatgacacgcacttttcta

SEQ ID NO: 142264 - DNA, 25 bp, Homo sapien
gacacgcacttttctaatcattgta

SEQ ID NO: 142265 - DNA, 25 bp, Homo sapien
ttgtacatttctcagagtggataaa

SEQ ID NO: 142266 - DNA, 25 bp, Homo sapien
aaatgtttgacaaagtcctcacttt

SEQ ID NO: 142267 - DNA, 25 bp, Homo sapien
tgacaaagtcctcacttttaaggaa

SEQ ID NO: 142268 - DNA, 25 bp, Homo sapien
ggcacactgtgtttttcaaaacttg

SEQ ID NO: 142269 - DNA, 25 bp, Homo sapien
aaacttgattatgcagtcgcctggt

SEQ ID NO: 142270 - DNA, 25 bp, Homo sapien
tgattatgcagtcgcctggttcatc

SEQ ID NO: 142271 - DNA, 25 bp, Homo sapien
tggttcatccgcgaatccatgacaa

SEQ ID NO: 142272 - DNA, 25 bp, Homo sapien
atccgcgaatccatgacaatataca

SEQ ID NO: 142273 - DNA, 25 bp, Homo sapien
ttttttgtctgcattatgggaccca

SEQ ID NO: 142274 - DNA, 25 bp, Homo sapien
ttatgggacccaactataagctgga

SEQ ID NO: 142275 - DNA, 25 bp, Homo sapien
ataagctggagaactggtcgctaca

SEQ ID NO: 142276 - DNA, 25 bp, Homo sapien
gaactggtcgctacagattacgctg

SEQ ID NO: 142277 - DNA, 25 bp, Homo sapien
gggtacagcagaggaaatcctagat

SEQ ID NO: 142278 - DNA, 25 bp, Homo sapien
gatgtataactacagctttgtgact

SEQ ID NO: 142279 - DNA, 25 bp, Homo sapien
agcacccctgtgtcgaaagcatgaa

SEQ ID NO: 142280 - DNA, 25 bp, Homo sapien
gagggcgaccagaaattcccagctt

SEQ ID NO: 142281 - DNA, 25 bp, Homo sapien
agcttctggctcaaccaccagggca

SEQ ID NO: 142282 - DNA, 25 bp, Homo sapien
gcatccagatggtgtgtgagacgtt

SEQ ID NO: 142283 - DNA, 25 bp, Homo sapien
ttgactgagtgctgggaccacgacc

SEQ ID NO: 142284 - DNA, 25 bp, Homo sapien
agtgtgtggcagaacgcttcagtga

SEQ ID NO: 142285 - DNA, 25 bp, Homo sapien
aacgcttcagtgagctggagcatct

SEQ ID NO: 142286 - DNA, 25 bp, Homo sapien
gctggagcatctggacaggctctcg

SEQ ID NO: 142287 - DNA, 25 bp, Homo sapien
agctgctcggaggagaagattcctg

SEQ ID NO: 142288 - DNA, 25 bp, Homo sapien
aagattcctgaagacggctccctaa

SEQ ID NO: 142289 - DNA, 25 bp, Homo sapien
ggctccctaaacactaccaaatagc

SEQ ID NO: 142290 - DNA, 25 bp, Homo sapien
acttgccacctaggcgctctggtgg

SEQ ID NO: 142291 - DNA, 25 bp, Homo sapien
aggcgctctggtggcccttgcagaa

SEQ ID NO: 142292 - DNA, 25 bp, Homo sapien
tgcagaagccctaagtacggttact

SEQ ID NO: 142293 - DNA, 25 bp, Homo sapien
tacggttacttatgcgtgtagacat

SEQ ID NO: 142294 - DNA, 25 bp, Homo sapien
atgtcacttattaagccgctggcac

SEQ ID NO: 142295 - DNA, 25 bp, Homo sapien
taagccgctggcacggccctgcgta

SEQ ID NO: 142296 - DNA, 25 bp, Homo sapien
tatcgctccagccaaggcgaagaag

SEQ ID NO: 142297 - DNA, 25 bp, Homo sapien
aggcgaagaagcacgaacgaatgtc

SEQ ID NO: 142298 - DNA, 25 bp, Homo sapien
gaagacatttctcaacttctcggcc

SEQ ID NO: 142299 - DNA, 25 bp, Homo sapien
ttctcggccggagtttggctgagat

SEQ ID NO: 142300 - DNA, 25 bp, Homo sapien
gtttggctgagatcgcggtattaaa

SEQ ID NO: 142301 - DNA, 25 bp, Homo sapien
aggatcctccttctagctcatctgt

SEQ ID NO: 142302 - DNA, 25 bp, Homo sapien
gatcctccttctagctcatctgtag

SEQ ID NO: 142303 - DNA, 25 bp, Homo sapien
actagtagtagtcaaccaaagcctt

SEQ ID NO: 142304 - DNA, 25 bp, Homo sapien
gtagtagtcaaccaaagcctttcag

SEQ ID NO: 142305 - DNA, 25 bp, Homo sapien
agcctttcagacgagtaagacttca

SEQ ID NO: 142306 - DNA, 25 bp, Homo sapien
gacgagtaagacttcagacaacatt

SEQ ID NO: 142307 - DNA, 25 bp, Homo sapien
agtaagacttcagacaacattgaga

SEQ ID NO: 142308 - DNA, 25 bp, Homo sapien
acaaggtgtccgtggtcgtcagttt

SEQ ID NO: 142309 - DNA, 25 bp, Homo sapien
gtgtccgtggtcgtcagtttaacag

SEQ ID NO: 142310 - DNA, 25 bp, Homo sapien
gtggtcgtcagtttaacagacagag

SEQ ID NO: 142311 - DNA, 25 bp, Homo sapien
tggtctgtaaacaataacaactgtg

SEQ ID NO: 142312 - DNA, 25 bp, Homo sapien
ccttcagtgttcagcgtgtgctgag

SEQ ID NO: 142313 - DNA, 25 bp, Homo sapien
gtgttcagcgtgtgctgaggcacaa

SEQ ID NO: 142314 - DNA, 25 bp, Homo sapien
gtgctgaggcacaatggcagccctg

SEQ ID NO: 142315 - DNA, 25 bp, Homo sapien
aagagggggatgtcagcctcaccca

SEQ ID NO: 142316 - DNA, 25 bp, Homo sapien
gtgccttactcctgtctagagaccc

SEQ ID NO: 142317 - DNA, 25 bp, Homo sapien
tagagaccccacctctgtgaactta

SEQ ID NO: 142318 - DNA, 25 bp, Homo sapien
gaccccacctctgtgaacttatttt

SEQ ID NO: 142319 - DNA, 25 bp, Homo sapien
tctttcttggccgtgagcctaacca

SEQ ID NO: 142320 - DNA, 25 bp, Homo sapien
ttggccgtgagcctaaccatgatct

SEQ ID NO: 142321 - DNA, 25 bp, Homo sapien
aaccatgatcttgagggacccaaca

SEQ ID NO: 142322 - DNA, 25 bp, Homo sapien
gggcactaatccagcccttaaatcc

SEQ ID NO: 142323 - DNA, 25 bp, Homo sapien
caattcatttcccaacagattaccc

SEQ ID NO: 142324 - DNA, 25 bp, Homo sapien
attctacgatcacagtggtctccag

SEQ ID NO: 142325 - DNA, 25 bp, Homo sapien
ggtctccagcactaactatttcaaa

SEQ ID NO: 142326 - DNA, 25 bp, Homo sapien
aaagtactcttgtccatctgttctc

SEQ ID NO: 142327 - DNA, 25 bp, Homo sapien
atctgttctctgttgtgtgatccca

SEQ ID NO: 142328 - DNA, 25 bp, Homo sapien
ctgttgtgtgatcccaatccagatg

SEQ ID NO: 142329 - DNA, 25 bp, Homo sapien
aatccagatgatcctttagtgcctg

SEQ ID NO: 142330 - DNA, 25 bp, Homo sapien
atcctttagtgcctgagattgctcg

SEQ ID NO: 142331 - DNA, 25 bp, Homo sapien
gtgcctgagattgctcggatctaca

SEQ ID NO: 142332 - DNA, 25 bp, Homo sapien
gattgctcggatctacaaaacagat

SEQ ID NO: 142333 - DNA, 25 bp, Homo sapien
gactcagaagtatgcgatgtaatta

SEQ ID NO: 142334 - DNA, 25 bp, Homo sapien
gggccacactggaccatgtgaacag

SEQ ID NO: 142335 - DNA, 25 bp, Homo sapien
acactggaccatgtgaacagccatc

SEQ ID NO: 142336 - DNA, 25 bp, Homo sapien
cactggaccatgtgaacagccatcc

SEQ ID NO: 142337 - DNA, 25 bp, Homo sapien
aactgccatcagctaccacactgga

SEQ ID NO: 142338 - DNA, 25 bp, Homo sapien
atcagctaccacactggactctgca

SEQ ID NO: 142339 - DNA, 25 bp, Homo sapien
cagctaccacactggactctgcagg

SEQ ID NO: 142340 - DNA, 25 bp, Homo sapien
actctgcagggcagccatcctggat

SEQ ID NO: 142341 - DNA, 25 bp, Homo sapien
cagccatcctggatgatggaagcca

SEQ ID NO: 142342 - DNA, 25 bp, Homo sapien
atcctggatgatggaagccaccata

SEQ ID NO: 142343 - DNA, 25 bp, Homo sapien
cctggatgatggaagccaccatatt

SEQ ID NO: 142344 - DNA, 25 bp, Homo sapien
tggatgatggaagccaccatattga

SEQ ID NO: 142345 - DNA, 25 bp, Homo sapien
attatgtgctgaaggaaggactcta

SEQ ID NO: 142346 - DNA, 25 bp, Homo sapien
ggaaggactctaaacatatgactta

SEQ ID NO: 142347 - DNA, 25 bp, Homo sapien
ggtgaaaatctctacaaatagaact

SEQ ID NO: 142348 - DNA, 25 bp, Homo sapien
aggtacaaatgccttacttatgctt

SEQ ID NO: 142349 - DNA, 25 bp, Homo sapien
cttacttatgcttcacaggttagtc

SEQ ID NO: 142350 - DNA, 25 bp, Homo sapien
atgcttcacaggttagtcagtctaa

SEQ ID NO: 142351 - DNA, 25 bp, Homo sapien
gtcagtctaagaatatttatacagg

SEQ ID NO: 142352 - DNA, 25 bp, Homo sapien
gatccttatctatattcattccttc

SEQ ID NO: 142353 - DNA, 25 bp, Homo sapien
tctatattcattccttcattacttt

SEQ ID NO: 142354 - DNA, 25 bp, Homo sapien
ggaaaattcttacttgtgaatgtta

SEQ ID NO: 142355 - DNA, 25 bp, Homo sapien
catttattatattttgcctcaactt

SEQ ID NO: 142356 - DNA, 25 bp, Homo sapien
ccctaacaatacttctacagaacgt

SEQ ID NO: 142357 - DNA, 25 bp, Homo sapien
aaattcattttaaagccaatcagtc

SEQ ID NO: 142358 - DNA, 25 bp, Homo sapien
aagccaatcagtctcattcacatac

SEQ ID NO: 142359 - DNA, 25 bp, Homo sapien
aatcagtctcattcacatacaatac

SEQ ID NO: 142360 - DNA, 25 bp, Homo sapien
gtatattgatttatgctgtgtacaa

SEQ ID NO: 142361 - DNA, 25 bp, Homo sapien
gaattattacttctagttgactttt

SEQ ID NO: 142362 - DNA, 25 bp, Homo sapien
tacattttgctcagtagtgtgttct

SEQ ID NO: 142363 - DNA, 25 bp, Homo sapien
gtgttctgaattctattcagtttgt

SEQ ID NO: 142364 - DNA, 25 bp, Homo sapien
aaatagggaaaactggcaacatgct

SEQ ID NO: 142365 - DNA, 25 bp, Homo sapien
actggcaacatgctagttactttta

SEQ ID NO: 142366 - DNA, 25 bp, Homo sapien
ttttaataaagtaatccctgattct

SEQ ID NO: 142367 - DNA, 25 bp, Homo sapien
gtgactgcagtgctgtaaacttaac

SEQ ID NO: 142368 - DNA, 25 bp, Homo sapien
gtaaacttaactgttctttgccaga

SEQ ID NO: 142369 - DNA, 25 bp, Homo sapien
ttgccagaacacaagacaccaaatt

SEQ ID NO: 142370 - DNA, 25 bp, Homo sapien
accaaattgaactcactgcttttga

SEQ ID NO: 142371 - DNA, 25 bp, Homo sapien
cactgcttttgaggcatctggaaat

SEQ ID NO: 142372 - DNA, 25 bp, Homo sapien
tagcttcccttaagaatttttgaag

SEQ ID NO: 142373 - DNA, 25 bp, Homo sapien
atttttgaagtgactgggcaggcag

SEQ ID NO: 142374 - DNA, 25 bp, Homo sapien
gaaacactacaaatttattcttggt

SEQ ID NO: 142375 - DNA, 25 bp, Homo sapien
agatgatacctgaagctgtcacctc

SEQ ID NO: 142376 - DNA, 25 bp, Homo sapien
gattatctaaactaagcgctcattc

SEQ ID NO: 142377 - DNA, 25 bp, Homo sapien
taaactaagcgctcattctatttta

SEQ ID NO: 142378 - DNA, 25 bp, Homo sapien
ggacctatcccaaatgtggaattga

SEQ ID NO: 142379 - DNA, 25 bp, Homo sapien
gtggaattgactgcctatgccaagt

SEQ ID NO: 142380 - DNA, 25 bp, Homo sapien
tgcctatgccaagtccctggaaaag

SEQ ID NO: 142381 - DNA, 25 bp, Homo sapien
tgaatcaagcaatccagcctcatgg

SEQ ID NO: 142382 - DNA, 25 bp, Homo sapien
ctcatgggaagtcctggcacagttt

SEQ ID NO: 142383 - DNA, 25 bp, Homo sapien
agtttttgtaaagcccttgcacagc

SEQ ID NO: 142384 - DNA, 25 bp, Homo sapien
aaatgttctgtcaaatgtgtctcac

SEQ ID NO: 142385 - DNA, 25 bp, Homo sapien
aatgtgtctcacatctacacgtggc

SEQ ID NO: 142386 - DNA, 25 bp, Homo sapien
ctacacgtggcttggaggcttttat

SEQ ID NO: 142387 - DNA, 25 bp, Homo sapien
tggtatgtagagcttagatttccct

SEQ ID NO: 142388 - DNA, 25 bp, Homo sapien
gatttccctattgtgacagagccat

SEQ ID NO: 142389 - DNA, 25 bp, Homo sapien
aattgcggcaggatgcatgtctgtc

SEQ ID NO: 142390 - DNA, 25 bp, Homo sapien
aggatgcatgtctgtctgttctatc

SEQ ID NO: 142391 - DNA, 25 bp, Homo sapien
gtctgttctatctagagatcaccca

SEQ ID NO: 142392 - DNA, 25 bp, Homo sapien
agagatcacccatatacctatatat

SEQ ID NO: 142393 - DNA, 25 bp, Homo sapien
ctatgacttatctaatctgcctatc

SEQ ID NO: 142394 - DNA, 25 bp, Homo sapien
atctgcctatcaatctatctagtag

SEQ ID NO: 142395 - DNA, 25 bp, Homo sapien
gagtaaggccagttgagcattgctt

SEQ ID NO: 142396 - DNA, 25 bp, Homo sapien
gagcattgcttacttatggttaaag

SEQ ID NO: 142397 - DNA, 25 bp, Homo sapien
gaaaccatagtccatttacaatttt

SEQ ID NO: 142398 - DNA, 25 bp, Homo sapien
aaggctgatttgtttgctgtatata

SEQ ID NO: 142399 - DNA, 25 bp, Homo sapien
tagttccaatccataattaccgcca

SEQ ID NO: 142400 - DNA, 25 bp, Homo sapien
tcttagcatcctgccttagagccag

SEQ ID NO: 142401 - DNA, 25 bp, Homo sapien
ttagagccaggcacacactgtgctt

SEQ ID NO: 142402 - DNA, 25 bp, Homo sapien
gcacacactgtgctttctattgtac

SEQ ID NO: 142403 - DNA, 25 bp, Homo sapien
ttgtacagaagctcttcgtttcagt

SEQ ID NO: 142404 - DNA, 25 bp, Homo sapien
gaagacgagctgtacgctcagaaac

SEQ ID NO: 142405 - DNA, 25 bp, Homo sapien
acgctctcaacgatatgacttccat

SEQ ID NO: 142406 - DNA, 25 bp, Homo sapien
gacttccatataagtttctttgctt

SEQ ID NO: 142407 - DNA, 25 bp, Homo sapien
ttctttgcttcacttctcccaagac

SEQ ID NO: 142408 - DNA, 25 bp, Homo sapien
aagactccctcgtcgagctggatgt

SEQ ID NO: 142409 - DNA, 25 bp, Homo sapien
tctctgagctctgcatttgtctatt

SEQ ID NO: 142410 - DNA, 25 bp, Homo sapien
tgcatttgtctattctccagctgac

SEQ ID NO: 142411 - DNA, 25 bp, Homo sapien
tggcactgcgactgcccagtctggc

SEQ ID NO: 142412 - DNA, 25 bp, Homo sapien
tggcacagtgccttgggactggact

SEQ ID NO: 142413 - DNA, 25 bp, Homo sapien
acagtgccttgggactggactggca

SEQ ID NO: 142414 - DNA, 25 bp, Homo sapien
tgtcttgcctcttgtcattgtctgt

SEQ ID NO: 142415 - DNA, 25 bp, Homo sapien
cgtcctcaaggcatctggagggctt

SEQ ID NO: 142416 - DNA, 25 bp, Homo sapien
tcaaggcatctggagggctttcgtg

SEQ ID NO: 142417 - DNA, 25 bp, Homo sapien
tgccagggcctggtctttgttgcac

SEQ ID NO: 142418 - DNA, 25 bp, Homo sapien
tctttgttgcactaacacgtctcct

SEQ ID NO: 142419 - DNA, 25 bp, Homo sapien
cactaacacgtctcctctctgggaa

SEQ ID NO: 142420 - DNA, 25 bp, Homo sapien
ctctgggaaacgtcccttgtcagga

SEQ ID NO: 142421 - DNA, 25 bp, Homo sapien
aaacgtcccttgtcaggagacggct

SEQ ID NO: 142422 - DNA, 25 bp, Homo sapien
caactgagagctgagcgctttgctt

SEQ ID NO: 142423 - DNA, 25 bp, Homo sapien
agctgagcgctttgcttaccaaaag

SEQ ID NO: 142424 - DNA, 25 bp, Homo sapien
tgcttaccaaaagctcagggccctg

SEQ ID NO: 142425 - DNA, 25 bp, Homo sapien
agggccctgtgccaggccaaagatc

SEQ ID NO: 142426 - DNA, 25 bp, Homo sapien
attctgacatccacatgctctgcag

SEQ ID NO: 142427 - DNA, 25 bp, Homo sapien
tcgtcattttctttcccagaagcgc

SEQ ID NO: 142428 - DNA, 25 bp, Homo sapien
ccagaagcgccctgtatttattccc

SEQ ID NO: 142429 - DNA, 25 bp, Homo sapien
gagacagagagctcctccctgggtt

SEQ ID NO: 142430 - DNA, 25 bp, Homo sapien
ggagctgctaattggcagcacccac

SEQ ID NO: 142431 - DNA, 25 bp, Homo sapien
attctctacccatccttagtacatg

SEQ ID NO: 142432 - DNA, 25 bp, Homo sapien
atccttagtacatgctctgtccagc

SEQ ID NO: 142433 - DNA, 25 bp, Homo sapien
tcaggttttgtaaagatgccgggtt

SEQ ID NO: 142434 - DNA, 25 bp, Homo sapien
aaagggagcactgggttgactttca

SEQ ID NO: 142435 - DNA, 25 bp, Homo sapien
ggtactaaatacctcaacctatggt

SEQ ID NO: 142436 - DNA, 25 bp, Homo sapien
ataatggttgactgggtttctctgt

SEQ ID NO: 142437 - DNA, 25 bp, Homo sapien
gggtttctctgtatagtactggcat

SEQ ID NO: 142438 - DNA, 25 bp, Homo sapien
tactggcatggtacggagatgtttc

SEQ ID NO: 142439 - DNA, 25 bp, Homo sapien
ggtacggagatgtttcacgaagttt

SEQ ID NO: 142440 - DNA, 25 bp, Homo sapien
gtttcacgaagtttgttcatcagac

SEQ ID NO: 142441 - DNA, 25 bp, Homo sapien
tgttcatcagactcctgtgcaactt

SEQ ID NO: 142442 - DNA, 25 bp, Homo sapien
agactcctgtgcaactttcccaatg

SEQ ID NO: 142443 - DNA, 25 bp, Homo sapien
tgtggcctaaaaatgcaacttcttt

SEQ ID NO: 142444 - DNA, 25 bp, Homo sapien
gtcgaagcgaaagctgggccgccac

SEQ ID NO: 142445 - DNA, 25 bp, Homo sapien
tgagctgtgctgtaacgacgagagc

SEQ ID NO: 142446 - DNA, 25 bp, Homo sapien
gcgaggatgtcgaggttccctatgt

SEQ ID NO: 142447 - DNA, 25 bp, Homo sapien
gatgtcgaggttccctatgtccgat

SEQ ID NO: 142448 - DNA, 25 bp, Homo sapien
aggttccctatgtccgatacaccat

SEQ ID NO: 142449 - DNA, 25 bp, Homo sapien
tatgtccgatacaccatccgctgac

SEQ ID NO: 142450 - DNA, 25 bp, Homo sapien
cagggttcccatttggcttctggca

SEQ ID NO: 142451 - DNA, 25 bp, Homo sapien
ttcccatttggcttctggcagtggc

SEQ ID NO: 142452 - DNA, 25 bp, Homo sapien
ggcccaactagccaagtctggtgtt

SEQ ID NO: 142453 - DNA, 25 bp, Homo sapien
agccaagtctggtgttccctcatca

SEQ ID NO: 142454 - DNA, 25 bp, Homo sapien
cactgccttctaccttgtttgaaac

SEQ ID NO: 142455 - DNA, 25 bp, Homo sapien
acccactgaacaaggaggccgcaga

SEQ ID NO: 142456 - DNA, 25 bp, Homo sapien
gaggccgcagaggtcctgcagaaca

SEQ ID NO: 142457 - DNA, 25 bp, Homo sapien
agaggtcctgcagaacaaccggcgg

SEQ ID NO: 142458 - DNA, 25 bp, Homo sapien
acaaccggcggctgtttgagcagaa

SEQ ID NO: 142459 - DNA, 25 bp, Homo sapien
ttgagcagaacgtgcagcgctccat

SEQ ID NO: 142460 - DNA, 25 bp, Homo sapien
gcagaacgtgcagcgctccatgcgg

SEQ ID NO: 142461 - DNA, 25 bp, Homo sapien
ctacatcggctccacctactttgag

SEQ ID NO: 142462 - DNA, 25 bp, Homo sapien
ctactttgagcgctgcctgaaatag

SEQ ID NO: 142463 - DNA, 25 bp, Homo sapien
gctgcctgaaatagggttggcgcat

SEQ ID NO: 142464 - DNA, 25 bp, Homo sapien
atagggttggcgcatacccacccgc

SEQ ID NO: 142465 - DNA, 25 bp, Homo sapien
tgccacgtgcccctagttatttttt

SEQ ID NO: 142466 - DNA, 25 bp, Homo sapien
gcatcgcctacaagaactgggagac

SEQ ID NO: 142467 - DNA, 25 bp, Homo sapien
gggagactgagatcaccgcgcaacc

SEQ ID NO: 142468 - DNA, 25 bp, Homo sapien
acccgatggcggcaagaccgagaac

SEQ ID NO: 142469 - DNA, 25 bp, Homo sapien
aagaccgagaactgcgcggtcctgt

SEQ ID NO: 142470 - DNA, 25 bp, Homo sapien
agaactgcgcggtcctgtcaggcgc

SEQ ID NO: 142471 - DNA, 25 bp, Homo sapien
gcggccaacggcaagtggttcgaca

SEQ ID NO: 142472 - DNA, 25 bp, Homo sapien
aagtggttcgacaagcgctgccgcg

SEQ ID NO: 142473 - DNA, 25 bp, Homo sapien
acatctgccagttcgggatcgtgta

SEQ ID NO: 142474 - DNA, 25 bp, Homo sapien
tctccgtgcgcttggagcctctttt

SEQ ID NO: 142475 - DNA, 25 bp, Homo sapien
ttggagcctctttttgcaaataaag

SEQ ID NO: 142476 - DNA, 25 bp, Homo sapien
aataaagttggtgcacgttcgcgga

SEQ ID NO: 142477 - DNA, 25 bp, Homo sapien
gtatgaactggacttctcccatttc

SEQ ID NO: 142478 - DNA, 25 bp, Homo sapien
ctcccatttccgtctttttgaagag

SEQ ID NO: 142479 - DNA, 25 bp, Homo sapien
aatgatgctgccattctcattcttc

SEQ ID NO: 142480 - DNA, 25 bp, Homo sapien
tcattcttctggagcccattgagaa

SEQ ID NO: 142481 - DNA, 25 bp, Homo sapien
agcgcttctgcaagctgcggaagat

SEQ ID NO: 142482 - DNA, 25 bp, Homo sapien
gataatgaacaccaagacctacctg

SEQ ID NO: 142483 - DNA, 25 bp, Homo sapien
cctacctggagtggcccatggacga

SEQ ID NO: 142484 - DNA, 25 bp, Homo sapien
gcgataaagtcctaggttcccatat

SEQ ID NO: 142485 - DNA, 25 bp, Homo sapien
ggttcccatatttaagaccagtctt

SEQ ID NO: 142486 - DNA, 25 bp, Homo sapien
gaccagtctttgtctagttgggatc

SEQ ID NO: 142487 - DNA, 25 bp, Homo sapien
gttgggatctttatgtcactagtta

SEQ ID NO: 142488 - DNA, 25 bp, Homo sapien
catctcggcactagaattcgccact

SEQ ID NO: 142489 - DNA, 25 bp, Homo sapien
tctcggcactagaattcgccactct

SEQ ID NO: 142490 - DNA, 25 bp, Homo sapien
aggtctcatcttccaccccaaaaat

SEQ ID NO: 142491 - DNA, 25 bp, Homo sapien
gtctcatcttccaccccaaaaatgt

SEQ ID NO: 142492 - DNA, 25 bp, Homo sapien
catcttccaccccaaaaatgtctgt

SEQ ID NO: 142493 - DNA, 25 bp, Homo sapien
atcttccaccccaaaaatgtctgtc

SEQ ID NO: 142494 - DNA, 25 bp, Homo sapien
accccaaaaatgtctgtctctctct

SEQ ID NO: 142495 - DNA, 25 bp, Homo sapien
ttacaattttgaggtcttcgtgttc

SEQ ID NO: 142496 - DNA, 25 bp, Homo sapien
aggtcttcgtgttcaaggagaagct

SEQ ID NO: 142497 - DNA, 25 bp, Homo sapien
tcgtgttcaaggagaagctattata

SEQ ID NO: 142498 - DNA, 25 bp, Homo sapien
aaaccaagaggccaccgtgcctttg

SEQ ID NO: 142499 - DNA, 25 bp, Homo sapien
ttgcctgcctgcctgtggagacagc

SEQ ID NO: 142500 - DNA, 25 bp, Homo sapien
tgcctgtggagacagccctgcctat

SEQ ID NO: 142501 - DNA, 25 bp, Homo sapien
gtatataggccttccgccagatgaa

SEQ ID NO: 142502 - DNA, 25 bp, Homo sapien
agatgaagctttggccctcagtggg

SEQ ID NO: 142503 - DNA, 25 bp, Homo sapien
ggctcctttggctctgctactgagg

SEQ ID NO: 142504 - DNA, 25 bp, Homo sapien
ttgagaattaattctttccatgcca

SEQ ID NO: 142505 - DNA, 25 bp, Homo sapien
aattctttccatgccacgaggatca

SEQ ID NO: 142506 - DNA, 25 bp, Homo sapien
atgccacgaggatcaacacacactc

SEQ ID NO: 142507 - DNA, 25 bp, Homo sapien
agtcggtactttaccaaagcttgag

SEQ ID NO: 142508 - DNA, 25 bp, Homo sapien
caaagcttgagcaacctcttccaag

SEQ ID NO: 142509 - DNA, 25 bp, Homo sapien
tgagcaacctcttccaagcttggga

SEQ ID NO: 142510 - DNA, 25 bp, Homo sapien
gttgtttcatgtcctgtcaagaatt

SEQ ID NO: 142511 - DNA, 25 bp, Homo sapien
gtcctgtcaagaattcgtatagtac

SEQ ID NO: 142512 - DNA, 25 bp, Homo sapien
atagtacgagcctggatctgcgtgt

SEQ ID NO: 142513 - DNA, 25 bp, Homo sapien
gatctgcgtgtcaaactgttccatt

SEQ ID NO: 142514 - DNA, 25 bp, Homo sapien
agtttccatatttatccgcatgtaa

SEQ ID NO: 142515 - DNA, 25 bp, Homo sapien
tttatccgcatgtaaagggccggtt

SEQ ID NO: 142516 - DNA, 25 bp, Homo sapien
agggccggtttatccatgttacagc

SEQ ID NO: 142517 - DNA, 25 bp, Homo sapien
ggtttatccatgttacagctcttca

SEQ ID NO: 142518 - DNA, 25 bp, Homo sapien
cagctcttcaatatttatggctaga

SEQ ID NO: 142519 - DNA, 25 bp, Homo sapien
ggctagaagaactcgtatgtacact

SEQ ID NO: 142520 - DNA, 25 bp, Homo sapien
gtatgtacactttagtttccagaac

SEQ ID NO: 142521 - DNA, 25 bp, Homo sapien
caaacaagggttgcttttgttgcac

SEQ ID NO: 142522 - DNA, 25 bp, Homo sapien
ttgttgcacaacaaaaccccgtcgt

SEQ ID NO: 142523 - DNA, 25 bp, Homo sapien
ggagaacggtgtctacacgctcaat

SEQ ID NO: 142524 - DNA, 25 bp, Homo sapien
tgtctacacgctcaatttccatggt

SEQ ID NO: 142525 - DNA, 25 bp, Homo sapien
aatttccatggtcgagtcactcggg

SEQ ID NO: 142526 - DNA, 25 bp, Homo sapien
gtcactcgggcttcggtgaagaact

SEQ ID NO: 142527 - DNA, 25 bp, Homo sapien
agaacatctggtgctccagttcggc

SEQ ID NO: 142528 - DNA, 25 bp, Homo sapien
gagtgggcccagacacattcaccat

SEQ ID NO: 142529 - DNA, 25 bp, Homo sapien
tcagcatctgcttgtccagtttcaa

SEQ ID NO: 142530 - DNA, 25 bp, Homo sapien
agaagctggctgttgaataactcaa

SEQ ID NO: 142531 - DNA, 25 bp, Homo sapien
aataaaataccatacccttgccagc

SEQ ID NO: 142532 - DNA, 25 bp, Homo sapien
tactgagatgtcttcaatggaatac

SEQ ID NO: 142533 - DNA, 25 bp, Homo sapien
atacagtcattccaagaactataaa

SEQ ID NO: 142534 - DNA, 25 bp, Homo sapien
aaatgtttcttggtagattattcat

SEQ ID NO: 142535 - DNA, 25 bp, Homo sapien
attcataatgtgagatggttcccaa

SEQ ID NO: 142536 - DNA, 25 bp, Homo sapien
gatggttcccaatatcatgtgattt

SEQ ID NO: 142537 - DNA, 25 bp, Homo sapien
tattttttcagactgtgcaatactt

SEQ ID NO: 142538 - DNA, 25 bp, Homo sapien
gactgtgcaatacttagagaaccta

SEQ ID NO: 142539 - DNA, 25 bp, Homo sapien
agaacctatagcatcttctcattcc

SEQ ID NO: 142540 - DNA, 25 bp, Homo sapien
tagcatcttctcattcccatgtgga

SEQ ID NO: 142541 - DNA, 25 bp, Homo sapien
cccatgtggaacaggatgcccacat

SEQ ID NO: 142542 - DNA, 25 bp, Homo sapien
ggatgcccacatactgtctaattaa

SEQ ID NO: 142543 - DNA, 25 bp, Homo sapien
gtggagacagccctgcctatcctct

SEQ ID NO: 142544 - DNA, 25 bp, Homo sapien
tggagacagccctgcctatcctctg

SEQ ID NO: 142545 - DNA, 25 bp, Homo sapien
gccttccgccagatgaagctttggc

SEQ ID NO: 142546 - DNA, 25 bp, Homo sapien
ttccgccagatgaagctttggccct

SEQ ID NO: 142547 - DNA, 25 bp, Homo sapien
tccgccagatgaagctttggccctc

SEQ ID NO: 142548 - DNA, 25 bp, Homo sapien
cgccagatgaagctttggccctcag

SEQ ID NO: 142549 - DNA, 25 bp, Homo sapien
gccagatgaagctttggccctcagt

SEQ ID NO: 142550 - DNA, 25 bp, Homo sapien
ccagatgaagctttggccctcagtg

SEQ ID NO: 142551 - DNA, 25 bp, Homo sapien
cagatgaagctttggccctcagtgg

SEQ ID NO: 142552 - DNA, 25 bp, Homo sapien
agatgaagctttggccctcagtggg

SEQ ID NO: 142553 - DNA, 25 bp, Homo sapien
tgaagctttggccctcagtgggctc

SEQ ID NO: 142554 - DNA, 25 bp, Homo sapien
ttttcctcaccaggagcccggcttc

SEQ ID NO: 142555 - DNA, 25 bp, Homo sapien
ggcttccactccccacataggaata

SEQ ID NO: 142556 - DNA, 25 bp, Homo sapien
cataggaatagtccatccccagatt

SEQ ID NO: 142557 - DNA, 25 bp, Homo sapien
aggaatagtccatccccagattcgc

SEQ ID NO: 142558 - DNA, 25 bp, Homo sapien
gtccatccccagattcgccattgtt

SEQ ID NO: 142559 - DNA, 25 bp, Homo sapien
tggagaccctgagaaggaccctggg

SEQ ID NO: 142560 - DNA, 25 bp, Homo sapien
gagctctgggaatttggagtgacca

SEQ ID NO: 142561 - DNA, 25 bp, Homo sapien
tggagtgaccaaaggtgtgccctgt

SEQ ID NO: 142562 - DNA, 25 bp, Homo sapien
agtgaccaaaggtgtgccctgtaca

SEQ ID NO: 142563 - DNA, 25 bp, Homo sapien
gaccaaaggtgtgccctgtacacag

SEQ ID NO: 142564 - DNA, 25 bp, Homo sapien
gaggtgctgtgggagtaaaatactg

SEQ ID NO: 142565 - DNA, 25 bp, Homo sapien
gacaaggtcaagaactccagagcac

SEQ ID NO: 142566 - DNA, 25 bp, Homo sapien
gaactccagagcactgagcagagag

SEQ ID NO: 142567 - DNA, 25 bp, Homo sapien
gaaggcctgcgcactgaactgtaag

SEQ ID NO: 142568 - DNA, 25 bp, Homo sapien
ggcctcagcgctatggaagagtgtc

SEQ ID NO: 142569 - DNA, 25 bp, Homo sapien
aagagtgtccactgaggctgcacat

SEQ ID NO: 142570 - DNA, 25 bp, Homo sapien
ctgaggctgcacatggcccaggagt

SEQ ID NO: 142571 - DNA, 25 bp, Homo sapien
atggcccaggagtggcaccatgttg

SEQ ID NO: 142572 - DNA, 25 bp, Homo sapien
ggcaccatgttgcagggacaaccat

SEQ ID NO: 142573 - DNA, 25 bp, Homo sapien
agggacaaccatccccatttggctt

SEQ ID NO: 142574 - DNA, 25 bp, Homo sapien
atttggcttctccttaaaacacaat

SEQ ID NO: 142575 - DNA, 25 bp, Homo sapien
gcagctgcattctgcatcgctgaaa

SEQ ID NO: 142576 - DNA, 25 bp, Homo sapien
attataataaacctgatgctttttt

SEQ ID NO: 142577 - DNA, 25 bp, Homo sapien
ttttttagaactccttactctgatg

SEQ ID NO: 142578 - DNA, 25 bp, Homo sapien
gaactccttactctgatgtctgtat

SEQ ID NO: 142579 - DNA, 25 bp, Homo sapien
gtatatgttgcactgaaaaggttaa

SEQ ID NO: 142580 - DNA, 25 bp, Homo sapien
atgtgattagcagttattttcctta

SEQ ID NO: 142581 - DNA, 25 bp, Homo sapien
tagcagttattttccttaatatctg

SEQ ID NO: 142582 - DNA, 25 bp, Homo sapien
gtagtgagcaatataagacgcaatt

SEQ ID NO: 142583 - DNA, 25 bp, Homo sapien
aagacgcaattgtgtttttcagtaa

SEQ ID NO: 142584 - DNA, 25 bp, Homo sapien
tgtgtttttcagtaatgtgcattgt

SEQ ID NO: 142585 - DNA, 25 bp, Homo sapien
tgttattgagttgtactgtacctta

SEQ ID NO: 142586 - DNA, 25 bp, Homo sapien
agttgtactgtaccttatttggaag

SEQ ID NO: 142587 - DNA, 25 bp, Homo sapien
tgcgggccaacctcaagtctgtgaa

SEQ ID NO: 142588 - DNA, 25 bp, Homo sapien
gggccaacctcaagtctgtgaagaa

SEQ ID NO: 142589 - DNA, 25 bp, Homo sapien
gagcggcctgtggaggtgggtgact

SEQ ID NO: 142590 - DNA, 25 bp, Homo sapien
gaagaagatgtttgatgccgccaat

SEQ ID NO: 142591 - DNA, 25 bp, Homo sapien
aagatgtttgatgccgccaatgctc

SEQ ID NO: 142592 - DNA, 25 bp, Homo sapien
tttgatgccgccaatgctccgacct

SEQ ID NO: 142593 - DNA, 25 bp, Homo sapien
cgacctcacaatagaggccagcttg

SEQ ID NO: 142594 - DNA, 25 bp, Homo sapien
aatagaggccagcttgctgtgctgc

SEQ ID NO: 142595 - DNA, 25 bp, Homo sapien
agcttgctgtgctgcgctctgagct

SEQ ID NO: 142596 - DNA, 25 bp, Homo sapien
gctctgagctcctgcttcatgcttc

SEQ ID NO: 142597 - DNA, 25 bp, Homo sapien
tctgcctgtgtctggagcatccctt

SEQ ID NO: 142598 - DNA, 25 bp, Homo sapien
tattgctgtcagagaaggttttcat

SEQ ID NO: 142599 - DNA, 25 bp, Homo sapien
gtcagagaaggttttcattttcatt

SEQ ID NO: 142600 - DNA, 25 bp, Homo sapien
ggtggaaaacatatatgctaaacaa

SEQ ID NO: 142601 - DNA, 25 bp, Homo sapien
acatgatttttcttccttaaacttg

SEQ ID NO: 142602 - DNA, 25 bp, Homo sapien
cacgtggggatagctggacatgtca

SEQ ID NO: 142603 - DNA, 25 bp, Homo sapien
catgtcagcatgttaagtaaaagga

SEQ ID NO: 142604 - DNA, 25 bp, Homo sapien
atagtaatgcaattctgatatcttc

SEQ ID NO: 142605 - DNA, 25 bp, Homo sapien
aatgcaattctgatatcttctttct

SEQ ID NO: 142606 - DNA, 25 bp, Homo sapien
ttctttctaaaattcaagagtgcaa

SEQ ID NO: 142607 - DNA, 25 bp, Homo sapien
attcaagagtgcaattttgtttcaa

SEQ ID NO: 142608 - DNA, 25 bp, Homo sapien
gtttcaaatacagtatattgtctat

SEQ ID NO: 142609 - DNA, 25 bp, Homo sapien
tgggaaaaccttccgagtgagctca

SEQ ID NO: 142610 - DNA, 25 bp, Homo sapien
gaaaaccttccgagtgagctcacat

SEQ ID NO: 142611 - DNA, 25 bp, Homo sapien
aaccttccgagtgagctcacatctt

SEQ ID NO: 142612 - DNA, 25 bp, Homo sapien
ccttccgagtgagctcacatcttat

SEQ ID NO: 142613 - DNA, 25 bp, Homo sapien
acatcttattcgacactttagaatt

SEQ ID NO: 142614 - DNA, 25 bp, Homo sapien
cagtcagagctcaaaccttagtcaa

SEQ ID NO: 142615 - DNA, 25 bp, Homo sapien
gtcagagctcaaaccttagtcaaca

SEQ ID NO: 142616 - DNA, 25 bp, Homo sapien
agagctcaaaccttagtcaacacca

SEQ ID NO: 142617 - DNA, 25 bp, Homo sapien
atgagggaaaacctattaatgtaag

SEQ ID NO: 142618 - DNA, 25 bp, Homo sapien
gtaaatgctgaggaaatggcacaat

SEQ ID NO: 142619 - DNA, 25 bp, Homo sapien
gaggaaatggcacaatatgaaaaat

SEQ ID NO: 142620 - DNA, 25 bp, Homo sapien
ctgagttcccaaagggagggtggca

SEQ ID NO: 142621 - DNA, 25 bp, Homo sapien
ttcccaaagggagggtggcagagac

SEQ ID NO: 142622 - DNA, 25 bp, Homo sapien
agacagtgggcactaagggtggaga

SEQ ID NO: 142623 - DNA, 25 bp, Homo sapien
aggtactggtgagggcaagaggtgc

SEQ ID NO: 142624 - DNA, 25 bp, Homo sapien
gaggagtggccctgatccaggaaaa

SEQ ID NO: 142625 - DNA, 25 bp, Homo sapien
gaatctggaacgctctaggcagaag

SEQ ID NO: 142626 - DNA, 25 bp, Homo sapien
aatctggaacgctctaggcagaaga

SEQ ID NO: 142627 - DNA, 25 bp, Homo sapien
atctggaacgctctaggcagaagaa

SEQ ID NO: 142628 - DNA, 25 bp, Homo sapien
tctggaacgctctaggcagaagaag

SEQ ID NO: 142629 - DNA, 25 bp, Homo sapien
ctggaacgctctaggcagaagaagc

SEQ ID NO: 142630 - DNA, 25 bp, Homo sapien
tggaacgctctaggcagaagaagct

SEQ ID NO: 142631 - DNA, 25 bp, Homo sapien
tattgctgtcagagaaggttttcat

SEQ ID NO: 142632 - DNA, 25 bp, Homo sapien
attgctgtcagagaaggttttcatt

SEQ ID NO: 142633 - DNA, 25 bp, Homo sapien
ttgctgtcagagaaggttttcattt

SEQ ID NO: 142634 - DNA, 25 bp, Homo sapien
taaagatctagttaattaaggtgga

SEQ ID NO: 142635 - DNA, 25 bp, Homo sapien
ttaaggtggaaaacatatatgctaa

SEQ ID NO: 142636 - DNA, 25 bp, Homo sapien
ggtggaaaacatatatgctaaacaa

SEQ ID NO: 142637 - DNA, 25 bp, Homo sapien
cacacacgtggggatagctggacat

SEQ ID NO: 142638 - DNA, 25 bp, Homo sapien
cacgtggggatagctggacatgtca

SEQ ID NO: 142639 - DNA, 25 bp, Homo sapien
tggacatgtcagcatgttaagtaaa

SEQ ID NO: 142640 - DNA, 25 bp, Homo sapien
catgtcagcatgttaagtaaaagga

SEQ ID NO: 142641 - DNA, 25 bp, Homo sapien
gtcagcatgttaagtaaaaggagaa

SEQ ID NO: 142642 - DNA, 25 bp, Homo sapien
agccacacggacaacaacgccaaaa

SEQ ID NO: 142643 - DNA, 25 bp, Homo sapien
cacggacaacaacgccaaaagcagt

SEQ ID NO: 142644 - DNA, 25 bp, Homo sapien
ggacaacaacgccaaaagcagtgac

SEQ ID NO: 142645 - DNA, 25 bp, Homo sapien
agcagtgacaaagaggagaagcaca

SEQ ID NO: 142646 - DNA, 25 bp, Homo sapien
gcacagaaagtgaggctctcctccc

SEQ ID NO: 142647 - DNA, 25 bp, Homo sapien
accctccggcgggtgacagctccgg

SEQ ID NO: 142648 - DNA, 25 bp, Homo sapien
gacagctccgggatcagcaaccctt

SEQ ID NO: 142649 - DNA, 25 bp, Homo sapien
cgggatcagcaacccttcctgctgc

SEQ ID NO: 142650 - DNA, 25 bp, Homo sapien
gggactgccctctcgactgtcagtg

SEQ ID NO: 142651 - DNA, 25 bp, Homo sapien
gactgccctctcgactgtcagtggg

SEQ ID NO: 142652 - DNA, 25 bp, Homo sapien
agtggggcagcctctccgactctgc

SEQ ID NO: 142653 - DNA, 25 bp, Homo sapien
gaattcaaggaagggagcatagcat

SEQ ID NO: 142654 - DNA, 25 bp, Homo sapien
gggagcatagcatatctgtggcaaa

SEQ ID NO: 142655 - DNA, 25 bp, Homo sapien
tagcatatctgtggcaaactatttt

SEQ ID NO: 142656 - DNA, 25 bp, Homo sapien
aactattttccactcaaatcctgag

SEQ ID NO: 142657 - DNA, 25 bp, Homo sapien
aatcctgagttattgctgcatgctt

SEQ ID NO: 142658 - DNA, 25 bp, Homo sapien
gagaaccttaaagccaatgtctgcg

SEQ ID NO: 142659 - DNA, 25 bp, Homo sapien
aaagccaatgtctgcgatctttttt

SEQ ID NO: 142660 - DNA, 25 bp, Homo sapien
gtacctttaagtagcagtatgggac

SEQ ID NO: 142661 - DNA, 25 bp, Homo sapien
agcagtatgggacaaggcttgtaaa

SEQ ID NO: 142662 - DNA, 25 bp, Homo sapien
tattgtcaccttttatgcatttatc

SEQ ID NO: 142663 - DNA, 25 bp, Homo sapien
ttccaaatctaactttgcacaagta

SEQ ID NO: 142664 - DNA, 25 bp, Homo sapien
ttctggccaagtctggccagcctgg

SEQ ID NO: 142665 - DNA, 25 bp, Homo sapien
tggccctgcaggtctcccatgaagg

SEQ ID NO: 142666 - DNA, 25 bp, Homo sapien
tgaaggccaccccatggtctgatgg

SEQ ID NO: 142667 - DNA, 25 bp, Homo sapien
ggtctgatgggcatgaagcatctca

SEQ ID NO: 142668 - DNA, 25 bp, Homo sapien
agcatctcagactccttggcaaaaa

SEQ ID NO: 142669 - DNA, 25 bp, Homo sapien
ccttggcaaaaaacggagtccgcag

SEQ ID NO: 142670 - DNA, 25 bp, Homo sapien
aaaaaacggagtccgcaggccgcag

SEQ ID NO: 142671 - DNA, 25 bp, Homo sapien
tgtgaagaccactcgttctgtggtt

SEQ ID NO: 142672 - DNA, 25 bp, Homo sapien
gggtcctgcaagaaggcctcctcag

SEQ ID NO: 142673 - DNA, 25 bp, Homo sapien
actctgctgttagagtggcagctct

SEQ ID NO: 142674 - DNA, 25 bp, Homo sapien
agacctcagcagggctgctcagtgc

SEQ ID NO: 142675 - DNA, 25 bp, Homo sapien
atgagctgtaacttctcaagaggaa

SEQ ID NO: 142676 - DNA, 25 bp, Homo sapien
aagaacacagtagaaaactagagct

SEQ ID NO: 142677 - DNA, 25 bp, Homo sapien
agagctggaaggatctaggttgacc

SEQ ID NO: 142678 - DNA, 25 bp, Homo sapien
ggatctaggttgacctgtctgtgat

SEQ ID NO: 142679 - DNA, 25 bp, Homo sapien
ctgtctgtgattttcaaccctgtgg

SEQ ID NO: 142680 - DNA, 25 bp, Homo sapien
tgtgattttcaaccctgtggtccag

SEQ ID NO: 142681 - DNA, 25 bp, Homo sapien
cctgtggtccagagaatagggaaga

SEQ ID NO: 142682 - DNA, 25 bp, Homo sapien
atagggaagactggccagacgcact

SEQ ID NO: 142683 - DNA, 25 bp, Homo sapien
aagactggccagacgcactggctca

SEQ ID NO: 142684 - DNA, 25 bp, Homo sapien
gtttgaaaccagtctcaccaggcgc

SEQ ID NO: 142685 - DNA, 25 bp, Homo sapien
gaaaccagtctcaccaggcgcagtg

SEQ ID NO: 142686 - DNA, 25 bp, Homo sapien
agtgcttccgcatcttcgacaggaa

SEQ ID NO: 142687 - DNA, 25 bp, Homo sapien
caggaatgcagacggctacatcgac

SEQ ID NO: 142688 - DNA, 25 bp, Homo sapien
acggctacatcgacccggaggagct

SEQ ID NO: 142689 - DNA, 25 bp, Homo sapien
gtgactgacgaggagatcgaatctc

SEQ ID NO: 142690 - DNA, 25 bp, Homo sapien
aatctctgatgaaagacggcgacaa

SEQ ID NO: 142691 - DNA, 25 bp, Homo sapien
gacggccgcattgacttcgacgagt

SEQ ID NO: 142692 - DNA, 25 bp, Homo sapien
gacttcgacgagttcctgaagatga

SEQ ID NO: 142693 - DNA, 25 bp, Homo sapien
taaggagtggacagtcgcctctacc

SEQ ID NO: 142694 - DNA, 25 bp, Homo sapien
agtcgcctctaccaagatcgcgtgt

SEQ ID NO: 142695 - DNA, 25 bp, Homo sapien
caagatcgcgtgtccctagggtgtg

SEQ ID NO: 142696 - DNA, 25 bp, Homo sapien
cctagggtgtgggagactccgccct

SEQ ID NO: 142697 - DNA, 25 bp, Homo sapien
ggacaaatcagaaagcttatcggat

SEQ ID NO: 142698 - DNA, 25 bp, Homo sapien
cttatcggataatgcaacagctttt

SEQ ID NO: 142699 - DNA, 25 bp, Homo sapien
aacagcttttagcaacagatccaaa

SEQ ID NO: 142700 - DNA, 25 bp, Homo sapien
gcaacagatccaaacaacttcgaag

SEQ ID NO: 142701 - DNA, 25 bp, Homo sapien
caacttcgaaggcaaatgtggtggc

SEQ ID NO: 142702 - DNA, 25 bp, Homo sapien
aaatgtggtggcgtggatgcaaaat

SEQ ID NO: 142703 - DNA, 25 bp, Homo sapien
aagccatcatggctttggttgctgc

SEQ ID NO: 142704 - DNA, 25 bp, Homo sapien
gctttggttgctgctatccttttgc

SEQ ID NO: 142705 - DNA, 25 bp, Homo sapien
gctatccttttgctagtgattatca

SEQ ID NO: 142706 - DNA, 25 bp, Homo sapien
tagtcatgaaataccgtacttgatt

SEQ ID NO: 142707 - DNA, 25 bp, Homo sapien
taccgtacttgatttgatgacagag

SEQ ID NO: 142708 - DNA, 25 bp, Homo sapien
acacggccagactacatctcctggg

SEQ ID NO: 142709 - DNA, 25 bp, Homo sapien
aggagcagtgagtcccccaggacag

SEQ ID NO: 142710 - DNA, 25 bp, Homo sapien
caggacaggggaccctcatctgcct

SEQ ID NO: 142711 - DNA, 25 bp, Homo sapien
ccctcagagcacagatcagggacct

SEQ ID NO: 142712 - DNA, 25 bp, Homo sapien
tcacgcatctctttctcatatacat

SEQ ID NO: 142713 - DNA, 25 bp, Homo sapien
acgcatctctttctcatatacatgg

SEQ ID NO: 142714 - DNA, 25 bp, Homo sapien
gcatctctttctcatatacatggac

SEQ ID NO: 142715 - DNA, 25 bp, Homo sapien
ctctttctcatatacatggactctc

SEQ ID NO: 142716 - DNA, 25 bp, Homo sapien
tttctcatatacatggactctctgt

SEQ ID NO: 142717 - DNA, 25 bp, Homo sapien
tctcatatacatggactctctgttg

SEQ ID NO: 142718 - DNA, 25 bp, Homo sapien
catatacatggactctctgttggcc

SEQ ID NO: 142719 - DNA, 25 bp, Homo sapien
cttggactgacatttagcgtagcta

SEQ ID NO: 142720 - DNA, 25 bp, Homo sapien
ggtcatagctgagattcctggttcg

SEQ ID NO: 142721 - DNA, 25 bp, Homo sapien
gagattcctggttcgggtgttacgc

SEQ ID NO: 142722 - DNA, 25 bp, Homo sapien
tcgggtgttacgcacacgtacttaa

SEQ ID NO: 142723 - DNA, 25 bp, Homo sapien
atgtggcatgttcatcgtataacac

SEQ ID NO: 142724 - DNA, 25 bp, Homo sapien
tacagggcatgcattttgcagcagt

SEQ ID NO: 142725 - DNA, 25 bp, Homo sapien
cagtgagtctcttcagaaaaccctt

SEQ ID NO: 142726 - DNA, 25 bp, Homo sapien
gttgagttacttcctatcaagccag

SEQ ID NO: 142727 - DNA, 25 bp, Homo sapien
gtacgtgctaacaggctcaatattc

SEQ ID NO: 142728 - DNA, 25 bp, Homo sapien
actagtgacaagctcctggtcttga

SEQ ID NO: 142729 - DNA, 25 bp, Homo sapien
ctggtcttgagatgtcttctcgtta

SEQ ID NO: 142730 - DNA, 25 bp, Homo sapien
gtcaggcccttattttcaagaaact

SEQ ID NO: 142731 - DNA, 25 bp, Homo sapien
gaattttctttgtgtagctttgctc

SEQ ID NO: 142732 - DNA, 25 bp, Homo sapien
gctttgctctttggtagaaaaggct

SEQ ID NO: 142733 - DNA, 25 bp, Homo sapien
agaaaaggctaggtacacagctcta

SEQ ID NO: 142734 - DNA, 25 bp, Homo sapien
aggtacacagctctagacactgcca

SEQ ID NO: 142735 - DNA, 25 bp, Homo sapien
gacactgccacacagggtctgcaag

SEQ ID NO: 142736 - DNA, 25 bp, Homo sapien
cagggtctgcaaggtctttggttca

SEQ ID NO: 142737 - DNA, 25 bp, Homo sapien
gcaaggtctttggttcagctaagct

SEQ ID NO: 142738 - DNA, 25 bp, Homo sapien
ggaatgaaatcctgcttcagtgtat

SEQ ID NO: 142739 - DNA, 25 bp, Homo sapien
taagacaaaggttttcctcttctat

SEQ ID NO: 142740 - DNA, 25 bp, Homo sapien
tttcctcttctattttgtaaactca

SEQ ID NO: 142741 - DNA, 25 bp, Homo sapien
ggagaggtcagtaactaaattggag

SEQ ID NO: 142742 - DNA, 25 bp, Homo sapien
gagaggtcagtaactaaattggaga

SEQ ID NO: 142743 - DNA, 25 bp, Homo sapien
agaggtcagtaactaaattggagaa

SEQ ID NO: 142744 - DNA, 25 bp, Homo sapien
gaggtcagtaactaaattggagaaa

SEQ ID NO: 142745 - DNA, 25 bp, Homo sapien
ggtcagtaactaaattggagaaaag

SEQ ID NO: 142746 - DNA, 25 bp, Homo sapien
aattggagaaaagcattgatgactt

SEQ ID NO: 142747 - DNA, 25 bp, Homo sapien
attggagaaaagcattgatgactta

SEQ ID NO: 142748 - DNA, 25 bp, Homo sapien
tggagaaaagcattgatgacttaga

SEQ ID NO: 142749 - DNA, 25 bp, Homo sapien
ggagaaaagcattgatgacttagaa

SEQ ID NO: 142750 - DNA, 25 bp, Homo sapien
gagaaaagcattgatgacttagaag

SEQ ID NO: 142751 - DNA, 25 bp, Homo sapien
agaaaagcattgatgacttagaaga

SEQ ID NO: 142752 - DNA, 25 bp, Homo sapien
ggatagattatattattcgtcacaa

SEQ ID NO: 142753 - DNA, 25 bp, Homo sapien
attattcgtcacaatggagcccatc

SEQ ID NO: 142754 - DNA, 25 bp, Homo sapien
acctacgtgccgctgtccatcagat

SEQ ID NO: 142755 - DNA, 25 bp, Homo sapien
ctgtccatcagatctccttttgtca

SEQ ID NO: 142756 - DNA, 25 bp, Homo sapien
ggatattgcctttgtgcttttgctt

SEQ ID NO: 142757 - DNA, 25 bp, Homo sapien
gcttttgcttggtgctgccttgtta

SEQ ID NO: 142758 - DNA, 25 bp, Homo sapien
gctgccttgttatactttctcttgt

SEQ ID NO: 142759 - DNA, 25 bp, Homo sapien
tactttctcttgtcttgggtgacaa

SEQ ID NO: 142760 - DNA, 25 bp, Homo sapien
aagtctgtggtctagaaataagcat

SEQ ID NO: 142761 - DNA, 25 bp, Homo sapien
gcatagcacagttaatggacattac

SEQ ID NO: 142762 - DNA, 25 bp, Homo sapien
tggacattaccacaatggaatcctc

SEQ ID NO: 142763 - DNA, 25 bp, Homo sapien
gtttctaagttgtgtttattcctgg

SEQ ID NO: 142764 - DNA, 25 bp, Homo sapien
ttattcctggagtgacatgccaccc

SEQ ID NO: 142765 - DNA, 25 bp, Homo sapien
cgaatggctcactttcactgaggat

SEQ ID NO: 142766 - DNA, 25 bp, Homo sapien
tcactttcactgaggatgctgtcct

SEQ ID NO: 142767 - DNA, 25 bp, Homo sapien
atgctgtcctctgatttagctgctg

SEQ ID NO: 142768 - DNA, 25 bp, Homo sapien
cagcctctggcttgagaacttacta

SEQ ID NO: 142769 - DNA, 25 bp, Homo sapien
gagaacttactaaaggcacttcctt

SEQ ID NO: 142770 - DNA, 25 bp, Homo sapien
gtgattctctgctaggcctaagatt

SEQ ID NO: 142771 - DNA, 25 bp, Homo sapien
aacatctcttgaagccaaactccac

SEQ ID NO: 142772 - DNA, 25 bp, Homo sapien
aaactccaccttctgtgctttttgc

SEQ ID NO: 142773 - DNA, 25 bp, Homo sapien
tctgtgctttttgcttgggataatg

SEQ ID NO: 142774 - DNA, 25 bp, Homo sapien
tttgaggcccccagtgatctcgact

SEQ ID NO: 142775 - DNA, 25 bp, Homo sapien
cccagggcattgtgttcactgtact

SEQ ID NO: 142776 - DNA, 25 bp, Homo sapien
ggcattgtgttcactgtactctgtg

SEQ ID NO: 142777 - DNA, 25 bp, Homo sapien
ttgtgttcactgtactctgtgggca

SEQ ID NO: 142778 - DNA, 25 bp, Homo sapien
tgttcactgtactctgtgggcaagg

SEQ ID NO: 142779 - DNA, 25 bp, Homo sapien
aggatgggtccagaagaccccactt

SEQ ID NO: 142780 - DNA, 25 bp, Homo sapien
agactgggcctaggccaggagttcc

SEQ ID NO: 142781 - DNA, 25 bp, Homo sapien
ggcctaggccaggagttcccaaatg

SEQ ID NO: 142782 - DNA, 25 bp, Homo sapien
ctaggccaggagttcccaaatgtga

SEQ ID NO: 142783 - DNA, 25 bp, Homo sapien
aagctcctcccttgagaattccctg

SEQ ID NO: 142784 - DNA, 25 bp, Homo sapien
gctcctcccttgagaattccctgtg

SEQ ID NO: 142785 - DNA, 25 bp, Homo sapien
caacctaatcttgcggcagccaatg

SEQ ID NO: 142786 - DNA, 25 bp, Homo sapien
gcggcagccaatgatcttagagaaa

SEQ ID NO: 142787 - DNA, 25 bp, Homo sapien
tagagaaaggccagcgtttcaccct

SEQ ID NO: 142788 - DNA, 25 bp, Homo sapien
agcgtttcaccctgcgagatggcaa

SEQ ID NO: 142789 - DNA, 25 bp, Homo sapien
agatggcaaccggactattggcacc

SEQ ID NO: 142790 - DNA, 25 bp, Homo sapien
tattggcaccggtctagtcaccaac

SEQ ID NO: 142791 - DNA, 25 bp, Homo sapien
tgagtgtgcagatctctgctcagct

SEQ ID NO: 142792 - DNA, 25 bp, Homo sapien
tgctcagcttcccttgcgtttaagg

SEQ ID NO: 142793 - DNA, 25 bp, Homo sapien
ttccagtaccctctcatggcatagg

SEQ ID NO: 142794 - DNA, 25 bp, Homo sapien
atggcataggctgcaacccagcaga

SEQ ID NO: 142795 - DNA, 25 bp, Homo sapien
ggcagctagatggacatttcccctg

SEQ ID NO: 142796 - DNA, 25 bp, Homo sapien
aactatgtgtgactgttcaactatg

SEQ ID NO: 142797 - DNA, 25 bp, Homo sapien
gtgtgactgttcaactatgtgtcct

SEQ ID NO: 142798 - DNA, 25 bp, Homo sapien
gactgttcaactatgtgtcctcttc

SEQ ID NO: 142799 - DNA, 25 bp, Homo sapien
tgttcaactatgtgtcctcttccct

SEQ ID NO: 142800 - DNA, 25 bp, Homo sapien
tcaactatgtgtcctcttccctgag

SEQ ID NO: 142801 - DNA, 25 bp, Homo sapien
gggttgtatagaacactgaagcatc

SEQ ID NO: 142802 - DNA, 25 bp, Homo sapien
gaacactgaagcatctgatttcaaa

SEQ ID NO: 142803 - DNA, 25 bp, Homo sapien
ctgatttcaaactcttagctctttt

SEQ ID NO: 142804 - DNA, 25 bp, Homo sapien
tttcaaactcttagctcttttcctc

SEQ ID NO: 142805 - DNA, 25 bp, Homo sapien
aaactcttagctcttttcctctatt

SEQ ID NO: 142806 - DNA, 25 bp, Homo sapien
aactcttagctcttttcctctattt

SEQ ID NO: 142807 - DNA, 25 bp, Homo sapien
ccccatttggggcagctatttaagg

SEQ ID NO: 142808 - DNA, 25 bp, Homo sapien
aggggaggggatgtctcaccgggct

SEQ ID NO: 142809 - DNA, 25 bp, Homo sapien
ggaggggatgtctcaccgggctggg

SEQ ID NO: 142810 - DNA, 25 bp, Homo sapien
tggctccttccccttttctatgagg

SEQ ID NO: 142811 - DNA, 25 bp, Homo sapien
gctccttccccttttctatgaggaa

SEQ ID NO: 142812 - DNA, 25 bp, Homo sapien
tccttccccttttctatgaggaaat

SEQ ID NO: 142813 - DNA, 25 bp, Homo sapien
agatgctgtaactttttggaacctc

SEQ ID NO: 142814 - DNA, 25 bp, Homo sapien
gctgtaactttttggaacctcagtt

SEQ ID NO: 142815 - DNA, 25 bp, Homo sapien
caccttcacctttagcttcttgaaa

SEQ ID NO: 142816 - DNA, 25 bp, Homo sapien
tcacctttagcttcttgaaaatggg

SEQ ID NO: 142817 - DNA, 25 bp, Homo sapien
agcttcttgaaaatgggcccctgca

SEQ ID NO: 142818 - DNA, 25 bp, Homo sapien
gggccctatatcacctgtattcagg

SEQ ID NO: 142819 - DNA, 25 bp, Homo sapien
gtattcagggcctatgtgccaacaa

SEQ ID NO: 142820 - DNA, 25 bp, Homo sapien
gaacctactgggaacttctgagtgg

SEQ ID NO: 142821 - DNA, 25 bp, Homo sapien
gagctggtagttacgttgtccgcaa

SEQ ID NO: 142822 - DNA, 25 bp, Homo sapien
aaacttggaggttcgctggagcaaa

SEQ ID NO: 142823 - DNA, 25 bp, Homo sapien
taataagcccaaactttcctcagct

SEQ ID NO: 142824 - DNA, 25 bp, Homo sapien
tcctcagctgcataaaatccatttg

SEQ ID NO: 142825 - DNA, 25 bp, Homo sapien
atccatttgcagtggagttccatgt

SEQ ID NO: 142826 - DNA, 25 bp, Homo sapien
atgtttattgtccttatgccttctt

SEQ ID NO: 142827 - DNA, 25 bp, Homo sapien
tatgccttcttcttcatttatccca

SEQ ID NO: 142828 - DNA, 25 bp, Homo sapien
catttatcccagtacgagcaggaga

SEQ ID NO: 142829 - DNA, 25 bp, Homo sapien
gattgctaatcaccaaaggctctct

SEQ ID NO: 142830 - DNA, 25 bp, Homo sapien
aaggctctctcctgatagtctttca

SEQ ID NO: 142831 - DNA, 25 bp, Homo sapien
taaggagaacgacccctgcttctga

SEQ ID NO: 142832 - DNA, 25 bp, Homo sapien
ctgcttctgacactgaaacttccct

SEQ ID NO: 142833 - DNA, 25 bp, Homo sapien
aacttccctttctgcttgtgttaag

SEQ ID NO: 142834 - DNA, 25 bp, Homo sapien
gaatgaaacactcagttgttcaata

SEQ ID NO: 142835 - DNA, 25 bp, Homo sapien
aatatttttgccataatgactcaga

SEQ ID NO: 142836 - DNA, 25 bp, Homo sapien
gactcagaatattgctttggtcata

SEQ ID NO: 142837 - DNA, 25 bp, Homo sapien
tttggtcatatgagcttccttctgt

SEQ ID NO: 142838 - DNA, 25 bp, Homo sapien
gagcttccttctgtgaaatacattt

SEQ ID NO: 142839 - DNA, 25 bp, Homo sapien
aagaccttgcttatgattgcagata

SEQ ID NO: 142840 - DNA, 25 bp, Homo sapien
ttgatgagatggacacatccaggga

SEQ ID NO: 142841 - DNA, 25 bp, Homo sapien
gggagattgtgcagcagctcatcga

SEQ ID NO: 142842 - DNA, 25 bp, Homo sapien
gcagcagctcatcgatgagtaccat

SEQ ID NO: 142843 - DNA, 25 bp, Homo sapien
acacggccagactacatctcctggg

SEQ ID NO: 142844 - DNA, 25 bp, Homo sapien
aggagcagtgagtcccccaggacag

SEQ ID NO: 142845 - DNA, 25 bp, Homo sapien
ccctcagagcacagatcagggacct

SEQ ID NO: 142846 - DNA, 25 bp, Homo sapien
tcacgcatctctttctcatatacat

SEQ ID NO: 142847 - DNA, 25 bp, Homo sapien
gcatctctttctcatatacatggac

SEQ ID NO: 142848 - DNA, 25 bp, Homo sapien
catatacatggactctctgttggcc

SEQ ID NO: 142849 - DNA, 25 bp, Homo sapien
tctctgttggcctgcaaacacattt

SEQ ID NO: 142850 - DNA, 25 bp, Homo sapien
caaacacatttacttctcctcttat

SEQ ID NO: 142851 - DNA, 25 bp, Homo sapien
gaagggcaagtttccatcatctata

SEQ ID NO: 142852 - DNA, 25 bp, Homo sapien
agggcaagtttccatcatctataga

SEQ ID NO: 142853 - DNA, 25 bp, Homo sapien
aaattatacctcaatgtccccaaca

SEQ ID NO: 142854 - DNA, 25 bp, Homo sapien
atacctcaatgtccccaacaagatt

SEQ ID NO: 142855 - DNA, 25 bp, Homo sapien
aatgtccccaacaagattgcttaat

SEQ ID NO: 142856 - DNA, 25 bp, Homo sapien
gtccccaacaagattgcttaataaa

SEQ ID NO: 142857 - DNA, 25 bp, Homo sapien
attgtgtttcctccaagctattcaa

SEQ ID NO: 142858 - DNA, 25 bp, Homo sapien
gtttcctccaagctattcaattctt

SEQ ID NO: 142859 - DNA, 25 bp, Homo sapien
gctattcaattcttttaactgttgt

SEQ ID NO: 142860 - DNA, 25 bp, Homo sapien
gttgtaaaccaagtgatcaaactac

SEQ ID NO: 142861 - DNA, 25 bp, Homo sapien
actacatattgtaaagcccattttt

SEQ ID NO: 142862 - DNA, 25 bp, Homo sapien
gaaatggtgttcctcagttctgacc

SEQ ID NO: 142863 - DNA, 25 bp, Homo sapien
gtttcactgtcttgtctggtgtcta

SEQ ID NO: 142864 - DNA, 25 bp, Homo sapien
cactgtcttgtctggtgtctagtat

SEQ ID NO: 142865 - DNA, 25 bp, Homo sapien
gtcttgtctggtgtctagtattaat

SEQ ID NO: 142866 - DNA, 25 bp, Homo sapien
atgttgccagtaagcacctctctcc

SEQ ID NO: 142867 - DNA, 25 bp, Homo sapien
gagagacttccatttttagttcctt

SEQ ID NO: 142868 - DNA, 25 bp, Homo sapien
tttacactcaccaccctagcaagtg

SEQ ID NO: 142869 - DNA, 25 bp, Homo sapien
ctagcaagtgccctgcacagagtaa

SEQ ID NO: 142870 - DNA, 25 bp, Homo sapien
tgccctgcacagagtaataagtaaa

SEQ ID NO: 142871 - DNA, 25 bp, Homo sapien
gatttcctaatcacaattctatgtg

SEQ ID NO: 142872 - DNA, 25 bp, Homo sapien
caattctatgtgacttatggtcaaa

SEQ ID NO: 142873 - DNA, 25 bp, Homo sapien
agccttattccatttcctgatgttt

SEQ ID NO: 142874 - DNA, 25 bp, Homo sapien
gaaacactgccttgattatacgaat

SEQ ID NO: 142875 - DNA, 25 bp, Homo sapien
gccttgattatacgaatacactcag

SEQ ID NO: 142876 - DNA, 25 bp, Homo sapien
tagcttgtagtgttgaattctctta

SEQ ID NO: 142877 - DNA, 25 bp, Homo sapien
gaattctcttaaaggaatgcttgaa

SEQ ID NO: 142878 - DNA, 25 bp, Homo sapien
tgaatgtttagcagtatccccttcc

SEQ ID NO: 142879 - DNA, 25 bp, Homo sapien
atccccttcccacttatatattgtg

SEQ ID NO: 142880 - DNA, 25 bp, Homo sapien
ttgtgtgatatgattttgcttgcct

SEQ ID NO: 142881 - DNA, 25 bp, Homo sapien
tatgattttgcttgcctataggagt

SEQ ID NO: 142882 - DNA, 25 bp, Homo sapien
tttccatgtgaaatactctgactta

SEQ ID NO: 142883 - DNA, 25 bp, Homo sapien
aatactctgacttaaacatacatgt

SEQ ID NO: 142884 - DNA, 25 bp, Homo sapien
tgcaaggacatttctcaagggccat

SEQ ID NO: 142885 - DNA, 25 bp, Homo sapien
tgtggttttgcagacaaccctgtcc

SEQ ID NO: 142886 - DNA, 25 bp, Homo sapien
tcaggcctgaactcaccatagagac

SEQ ID NO: 142887 - DNA, 25 bp, Homo sapien
tagagacccatgtcagcaaacggtg

SEQ ID NO: 142888 - DNA, 25 bp, Homo sapien
aaacggtgaccagcaaatcctcttc

SEQ ID NO: 142889 - DNA, 25 bp, Homo sapien
aaagctgccccttgggagactccag

SEQ ID NO: 142890 - DNA, 25 bp, Homo sapien
gtgaactctttctttggtattccat

SEQ ID NO: 142891 - DNA, 25 bp, Homo sapien
ggtattccatccactatcctggcaa

SEQ ID NO: 142892 - DNA, 25 bp, Homo sapien
ggcaactcaaggctgcttctgttaa

SEQ ID NO: 142893 - DNA, 25 bp, Homo sapien
ttctgttaactgaagcctgctcctt

SEQ ID NO: 142894 - DNA, 25 bp, Homo sapien
tcttgttctgccctccagagatttg

SEQ ID NO: 142895 - DNA, 25 bp, Homo sapien
aaccttatgggcttatattgaaatt

SEQ ID NO: 142896 - DNA, 25 bp, Homo sapien
tctaatccaaaagttaccccacaca

SEQ ID NO: 142897 - DNA, 25 bp, Homo sapien
gttaccccacacaaaagttactgag

SEQ ID NO: 142898 - DNA, 25 bp, Homo sapien
acaaaagttactgagcttccttatg

SEQ ID NO: 142899 - DNA, 25 bp, Homo sapien
gagcttccttatgtttcacacattg

SEQ ID NO: 142900 - DNA, 25 bp, Homo sapien
aaaacattaacaactccactcatag

SEQ ID NO: 142901 - DNA, 25 bp, Homo sapien
aactccactcatagtatcaacattg

SEQ ID NO: 142902 - DNA, 25 bp, Homo sapien
gtatcaacattgttttgcaaatact

SEQ ID NO: 142903 - DNA, 25 bp, Homo sapien
gcaaatactcagaatattttggctt

SEQ ID NO: 142904 - DNA, 25 bp, Homo sapien
attttggcttcattttgagcagaat

SEQ ID NO: 142905 - DNA, 25 bp, Homo sapien
ggcttcattttgagcagaatttttg

SEQ ID NO: 142906 - DNA, 25 bp, Homo sapien
tgttcccacttgagcaggtacacaa

SEQ ID NO: 142907 - DNA, 25 bp, Homo sapien
gagcaggtacacaactggtcataat

SEQ ID NO: 142908 - DNA, 25 bp, Homo sapien
actggtcataattcctgtctgtgta

SEQ ID NO: 142909 - DNA, 25 bp, Homo sapien
attcctgtctgtgtaattcgatgta

SEQ ID NO: 142910 - DNA, 25 bp, Homo sapien
ttgctttgatttttgcttggcctcc

SEQ ID NO: 142911 - DNA, 25 bp, Homo sapien
gcttggcctcctttatgatgtgcat

SEQ ID NO: 142912 - DNA, 25 bp, Homo sapien
atgatgtgcatgtccttgaaggctg

SEQ ID NO: 142913 - DNA, 25 bp, Homo sapien
tttcagttcagcagatcaacaggat

SEQ ID NO: 142914 - DNA, 25 bp, Homo sapien
caacaggatggagctcttcatgact

SEQ ID NO: 142915 - DNA, 25 bp, Homo sapien
tcttcatgactgtctccagcaatag

SEQ ID NO: 142916 - DNA, 25 bp, Homo sapien
ttgtgatctctctcacctacatcaa

SEQ ID NO: 142917 - DNA, 25 bp, Homo sapien
cctaaccaggactggctggcggtcg

SEQ ID NO: 142918 - DNA, 25 bp, Homo sapien
gactggctggcggtcggaatggaga

SEQ ID NO: 142919 - DNA, 25 bp, Homo sapien
aacgtggagatcctgcacgtcggca

SEQ ID NO: 142920 - DNA, 25 bp, Homo sapien
tggagatcctgcacgtcggcaagcc

SEQ ID NO: 142921 - DNA, 25 bp, Homo sapien
agatcctgcacgtcggcaagccgga

SEQ ID NO: 142922 - DNA, 25 bp, Homo sapien
ctgcacgtcggcaagccggagaaat

SEQ ID NO: 142923 - DNA, 25 bp, Homo sapien
gtcggcaagccggagaaataccagc

SEQ ID NO: 142924 - DNA, 25 bp, Homo sapien
gcaagccggagaaataccagctgca

SEQ ID NO: 142925 - DNA, 25 bp, Homo sapien
agccggagaaataccagctgcacct

SEQ ID NO: 142926 - DNA, 25 bp, Homo sapien
cggagaaataccagctgcacctcca

SEQ ID NO: 142927 - DNA, 25 bp, Homo sapien
agaaataccagctgcacctccacga

SEQ ID NO: 142928 - DNA, 25 bp, Homo sapien
catggcagccagtcacagattggaa

SEQ ID NO: 142929 - DNA, 25 bp, Homo sapien
gtatcagtgtactataaacaggttt

SEQ ID NO: 142930 - DNA, 25 bp, Homo sapien
aggtttttagttatccctgcattat

SEQ ID NO: 142931 - DNA, 25 bp, Homo sapien
aaaagctttgtatgggaagactcaa

SEQ ID NO: 142932 - DNA, 25 bp, Homo sapien
gactcaaaatgtaaagctgcttcca

SEQ ID NO: 142933 - DNA, 25 bp, Homo sapien
aaagctgcttccatagagtctcact

SEQ ID NO: 142934 - DNA, 25 bp, Homo sapien
tagagtctcactgattctgagatgg

SEQ ID NO: 142935 - DNA, 25 bp, Homo sapien
ttctccctctacatttctctgcaga

SEQ ID NO: 142936 - DNA, 25 bp, Homo sapien
atttctctgcagaactcgcgttaga

SEQ ID NO: 142937 - DNA, 25 bp, Homo sapien
gaactcgcgttagaaacacagatat

SEQ ID NO: 142938 - DNA, 25 bp, Homo sapien
ttcctttgttaaaccatcgtcttat

SEQ ID NO: 142939 - DNA, 25 bp, Homo sapien
gtcgcagctctttggaggtgactcg

SEQ ID NO: 142940 - DNA, 25 bp, Homo sapien
gtgactcgtgttccaggtggatccc

SEQ ID NO: 142941 - DNA, 25 bp, Homo sapien
caggtggatccctctctgggagagc

SEQ ID NO: 142942 - DNA, 25 bp, Homo sapien
ggagagccgctgttcccttcctgta

SEQ ID NO: 142943 - DNA, 25 bp, Homo sapien
ctgtagcagcagcatttatgaatgg

SEQ ID NO: 142944 - DNA, 25 bp, Homo sapien
gggctattgtcgacggcacagctaa

SEQ ID NO: 142945 - DNA, 25 bp, Homo sapien
tgtcggcagagacagagccccacat

SEQ ID NO: 142946 - DNA, 25 bp, Homo sapien
gagacagagccccacattattatgt

SEQ ID NO: 142947 - DNA, 25 bp, Homo sapien
taagggtgtcaggagtttcgctttt

SEQ ID NO: 142948 - DNA, 25 bp, Homo sapien
atgtctgttcctgcagtagtaactc

SEQ ID NO: 142949 - DNA, 25 bp, Homo sapien
gtagtaactcttctttctcttgaga

SEQ ID NO: 142950 - DNA, 25 bp, Homo sapien
tgtcccatgtaaaacctgctacaaa

SEQ ID NO: 142951 - DNA, 25 bp, Homo sapien
acaaatggcagcttatacatagcaa

SEQ ID NO: 142952 - DNA, 25 bp, Homo sapien
gcaatggtaaaatcatcatctggat

SEQ ID NO: 142953 - DNA, 25 bp, Homo sapien
catcatctggatttaggaattgctc

SEQ ID NO: 142954 - DNA, 25 bp, Homo sapien
ttaggaattgctcttgtcatacccc

SEQ ID NO: 142955 - DNA, 25 bp, Homo sapien
gtttctaagatttaagattctcctt

SEQ ID NO: 142956 - DNA, 25 bp, Homo sapien
aagattctccttactactatcctac

SEQ ID NO: 142957 - DNA, 25 bp, Homo sapien
actatcctacgtttaaatatctttg

SEQ ID NO: 142958 - DNA, 25 bp, Homo sapien
gaagcagatacctggaaccacctaa

SEQ ID NO: 142959 - DNA, 25 bp, Homo sapien
acctaaagaacttccatttatggag

SEQ ID NO: 142960 - DNA, 25 bp, Homo sapien
ttttgccccttgtgtttggaattat

SEQ ID NO: 142961 - DNA, 25 bp, Homo sapien
gaaccagcacaaatgagtggcagtt

SEQ ID NO: 142962 - DNA, 25 bp, Homo sapien
gttgctggagcataactgcttcaat

SEQ ID NO: 142963 - DNA, 25 bp, Homo sapien
gtaattacaggcaagtcattttcac

SEQ ID NO: 142964 - DNA, 25 bp, Homo sapien
tcttgaggttcagagcatcagaatg

SEQ ID NO: 142965 - DNA, 25 bp, Homo sapien
gaatgaactctatgaatacatgtgt

SEQ ID NO: 142966 - DNA, 25 bp, Homo sapien
atacatgtgtaagtgccagacagct

SEQ ID NO: 142967 - DNA, 25 bp, Homo sapien
gtgccagacagctgaatctttatca

SEQ ID NO: 142968 - DNA, 25 bp, Homo sapien
gacagctgaatctttatcaggtatt

SEQ ID NO: 142969 - DNA, 25 bp, Homo sapien
aaaaccaagatcacagtacaccata

SEQ ID NO: 142970 - DNA, 25 bp, Homo sapien
gtacaccatatgcactctggtacct

SEQ ID NO: 142971 - DNA, 25 bp, Homo sapien
atatgcactctggtaccttaatttt

SEQ ID NO: 142972 - DNA, 25 bp, Homo sapien
aatggtctgtcattgtctgccttta

SEQ ID NO: 142973 - DNA, 25 bp, Homo sapien
tggtctgtcattgtctgcctttaaa

SEQ ID NO: 142974 - DNA, 25 bp, Homo sapien
ttcttcctcctctattctctaaata

SEQ ID NO: 142975 - DNA, 25 bp, Homo sapien
tcttcctcctctattctctaaataa

SEQ ID NO: 142976 - DNA, 25 bp, Homo sapien
cttcctcctctattctctaaataat

SEQ ID NO: 142977 - DNA, 25 bp, Homo sapien
ggctaagttatacccaaagctcact

SEQ ID NO: 142978 - DNA, 25 bp, Homo sapien
agttatacccaaagctcactttaca

SEQ ID NO: 142979 - DNA, 25 bp, Homo sapien
atacccaaagctcactttacaaaat

SEQ ID NO: 142980 - DNA, 25 bp, Homo sapien
aaaatatttcctcagtactttgcag

SEQ ID NO: 142981 - DNA, 25 bp, Homo sapien
aatatttcctcagtactttgcagaa

SEQ ID NO: 142982 - DNA, 25 bp, Homo sapien
tatttcctcagtactttgcagaaaa

SEQ ID NO: 142983 - DNA, 25 bp, Homo sapien
accctgtcctatgacttgatcactt

SEQ ID NO: 142984 - DNA, 25 bp, Homo sapien
tgatcacttttgcacattccctggc

SEQ ID NO: 142985 - DNA, 25 bp, Homo sapien
tttgcacattccctggccgtttctc

SEQ ID NO: 142986 - DNA, 25 bp, Homo sapien
ctcacgcccttcaatgctgcaggat

SEQ ID NO: 142987 - DNA, 25 bp, Homo sapien
caatgctgcaggatggactggcccc

SEQ ID NO: 142988 - DNA, 25 bp, Homo sapien
tgacccagggactctccaaacggga

SEQ ID NO: 142989 - DNA, 25 bp, Homo sapien
gggactctccaaacgggatacagga

SEQ ID NO: 142990 - DNA, 25 bp, Homo sapien
aggagagaagctggtctagactgtt

SEQ ID NO: 142991 - DNA, 25 bp, Homo sapien
gtctagactgtttgctgatccccaa

SEQ ID NO: 142992 - DNA, 25 bp, Homo sapien
tttgctgatccccaacctgcacggg

SEQ ID NO: 142993 - DNA, 25 bp, Homo sapien
ggatggttagtcacctgccccagca

SEQ ID NO: 142994 - DNA, 25 bp, Homo sapien
tgagccccctgagttcccaaaggga

SEQ ID NO: 142995 - DNA, 25 bp, Homo sapien
ttcccaaagggagggtggcagagac

SEQ ID NO: 142996 - DNA, 25 bp, Homo sapien
agacagtgggcactaagggtggaga

SEQ ID NO: 142997 - DNA, 25 bp, Homo sapien
ctgaggaccctcagccccaggagaa

SEQ ID NO: 142998 - DNA, 25 bp, Homo sapien
aggtactggtgagggcaagaggtgc

SEQ ID NO: 142999 - DNA, 25 bp, Homo sapien
gaggagtggccctgatccaggaaaa

SEQ ID NO: 143000 - DNA, 25 bp, Homo sapien
gaatctggaacgctctaggcagaag

SEQ ID NO: 143001 - DNA, 25 bp, Homo sapien
aatctggaacgctctaggcagaaga

SEQ ID NO: 143002 - DNA, 25 bp, Homo sapien
atctggaacgctctaggcagaagaa

SEQ ID NO: 143003 - DNA, 25 bp, Homo sapien
tctggaacgctctaggcagaagaag

SEQ ID NO: 143004 - DNA, 25 bp, Homo sapien
tggaacgctctaggcagaagaagct

SEQ ID NO: 143005 - DNA, 25 bp, Homo sapien
tttcgagccagtgggtgtctctcct

SEQ ID NO: 143006 - DNA, 25 bp, Homo sapien
tgtctctcctttgggcctgggcggc

SEQ ID NO: 143007 - DNA, 25 bp, Homo sapien
tgggcggcttgctcctgccagccat

SEQ ID NO: 143008 - DNA, 25 bp, Homo sapien
tcctgccagccatgccttcagggta

SEQ ID NO: 143009 - DNA, 25 bp, Homo sapien
tgccttcagggtaggctctgagcaa

SEQ ID NO: 143010 - DNA, 25 bp, Homo sapien
aagctggcgaacagccctggctgct

SEQ ID NO: 143011 - DNA, 25 bp, Homo sapien
tgccccaagctcactcaggaattca

SEQ ID NO: 143012 - DNA, 25 bp, Homo sapien
cacacccgcctggtttcttgaagtg

SEQ ID NO: 143013 - DNA, 25 bp, Homo sapien
tcttgaagtgtgctgggtccttccc

SEQ ID NO: 143014 - DNA, 25 bp, Homo sapien
aagtgtgctgggtccttccctctgc

SEQ ID NO: 143015 - DNA, 25 bp, Homo sapien
accacggcagagaataggctttcta

SEQ ID NO: 143016 - DNA, 25 bp, Homo sapien
aaggcagggtttgtattgtcagtcc

SEQ ID NO: 143017 - DNA, 25 bp, Homo sapien
ttgtcagtccctggagaaaatcatg

SEQ ID NO: 143018 - DNA, 25 bp, Homo sapien
cattcccttctgtatgacaggtata

SEQ ID NO: 143019 - DNA, 25 bp, Homo sapien
caggtataggtatggatctgaccca

SEQ ID NO: 143020 - DNA, 25 bp, Homo sapien
ggatctgacccatttttagccaaga

SEQ ID NO: 143021 - DNA, 25 bp, Homo sapien
agccaagagggtctgagctgtatct

SEQ ID NO: 143022 - DNA, 25 bp, Homo sapien
gagctgtatctgctggtggcttata

SEQ ID NO: 143023 - DNA, 25 bp, Homo sapien
tcttcatggatattcttggtctcac

SEQ ID NO: 143024 - DNA, 25 bp, Homo sapien
cacctggcctgggaaagtacttgcc

SEQ ID NO: 143025 - DNA, 25 bp, Homo sapien
aaagtacttgcctcatgttgctctg

SEQ ID NO: 143026 - DNA, 25 bp, Homo sapien
tgcctcatgttgctctggtttgtga

SEQ ID NO: 143027 - DNA, 25 bp, Homo sapien
tgagcttagctcagcgccggggctt

SEQ ID NO: 143028 - DNA, 25 bp, Homo sapien
gagcttagctcagcgccggggcttc

SEQ ID NO: 143029 - DNA, 25 bp, Homo sapien
gggcttcaccaagacctacactgtt

SEQ ID NO: 143030 - DNA, 25 bp, Homo sapien
ggcttcaccaagacctacactgttg

SEQ ID NO: 143031 - DNA, 25 bp, Homo sapien
gcttcaccaagacctacactgttgg

SEQ ID NO: 143032 - DNA, 25 bp, Homo sapien
cttcaccaagacctacactgttggc

SEQ ID NO: 143033 - DNA, 25 bp, Homo sapien
ttcaccaagacctacactgttggct

SEQ ID NO: 143034 - DNA, 25 bp, Homo sapien
tcaccaagacctacactgttggctg

SEQ ID NO: 143035 - DNA, 25 bp, Homo sapien
caccaagacctacactgttggctgt

SEQ ID NO: 143036 - DNA, 25 bp, Homo sapien
gtgaggaatgcacagtgtttccctg

SEQ ID NO: 143037 - DNA, 25 bp, Homo sapien
tgaggaatgcacagtgtttccctgt

SEQ ID NO: 143038 - DNA, 25 bp, Homo sapien
taacattgtttcttttagctttatt

SEQ ID NO: 143039 - DNA, 25 bp, Homo sapien
aagaagaaaaacattcacatcggaa

SEQ ID NO: 143040 - DNA, 25 bp, Homo sapien
ggtaagtggttagtatttcaccagc

SEQ ID NO: 143041 - DNA, 25 bp, Homo sapien
aagtggttagtatttcaccagcaat

SEQ ID NO: 143042 - DNA, 25 bp, Homo sapien
gtggttagtatttcaccagcaatta

SEQ ID NO: 143043 - DNA, 25 bp, Homo sapien
gttagtatttcaccagcaattatgt

SEQ ID NO: 143044 - DNA, 25 bp, Homo sapien
tagtatttcaccagcaattatgttg

SEQ ID NO: 143045 - DNA, 25 bp, Homo sapien
gtatttcaccagcaattatgttgag

SEQ ID NO: 143046 - DNA, 25 bp, Homo sapien
atttcaccagcaattatgttgagaa

SEQ ID NO: 143047 - DNA, 25 bp, Homo sapien
ttcaccagcaattatgttgagaata

SEQ ID NO: 143048 - DNA, 25 bp, Homo sapien
tatgttgagaataaggccaggcgag

SEQ ID NO: 143049 - DNA, 25 bp, Homo sapien
atatattttgtctacgatgggatta

SEQ ID NO: 143050 - DNA, 25 bp, Homo sapien
tgtctacgatgggattatgcacttc

SEQ ID NO: 143051 - DNA, 25 bp, Homo sapien
ggattatgcacttcccaattgggat

SEQ ID NO: 143052 - DNA, 25 bp, Homo sapien
ccaattgggattttacatctggatt

SEQ ID NO: 143053 - DNA, 25 bp, Homo sapien
acatctggatttttagtcattctaa

SEQ ID NO: 143054 - DNA, 25 bp, Homo sapien
gtcattctaaaaaacacctaattat

SEQ ID NO: 143055 - DNA, 25 bp, Homo sapien
tgcctactgtatgcatgagttgagt

SEQ ID NO: 143056 - DNA, 25 bp, Homo sapien
atgagttgagttgcttctgaggtac

SEQ ID NO: 143057 - DNA, 25 bp, Homo sapien
agttgagttgcttctgaggtacatt

SEQ ID NO: 143058 - DNA, 25 bp, Homo sapien
gagttgcttctgaggtacattttga

SEQ ID NO: 143059 - DNA, 25 bp, Homo sapien
ctgaggtacattttgaatgacagca

SEQ ID NO: 143060 - DNA, 25 bp, Homo sapien
gatattccatcgtgaggatgagaga

SEQ ID NO: 143061 - DNA, 25 bp, Homo sapien
atgagagaggtcctcagtgtgtttt

SEQ ID NO: 143062 - DNA, 25 bp, Homo sapien
ggttgtagggaaggactcaagtcct

SEQ ID NO: 143063 - DNA, 25 bp, Homo sapien
ggactcaagtcctggaatgtcctcc

SEQ ID NO: 143064 - DNA, 25 bp, Homo sapien
aatgtcctccactggtctactgagt

SEQ ID NO: 143065 - DNA, 25 bp, Homo sapien
actggtctactgagttgcagtcaca

SEQ ID NO: 143066 - DNA, 25 bp, Homo sapien
gagttgcagtcacactgttccaatg

SEQ ID NO: 143067 - DNA, 25 bp, Homo sapien
gcagtcacactgttccaatggatta

SEQ ID NO: 143068 - DNA, 25 bp, Homo sapien
gttccaatggattatttgctttcgg

SEQ ID NO: 143069 - DNA, 25 bp, Homo sapien
acaggtgtgaaagtcacagcttgta

SEQ ID NO: 143070 - DNA, 25 bp, Homo sapien
gtcacagcttgtaaataagtgttgt

SEQ ID NO: 143071 - DNA, 25 bp, Homo sapien
gaaaacttggaacatctccgcaaca

SEQ ID NO: 143072 - DNA, 25 bp, Homo sapien
gaacatctccgcaacaagacagagg

SEQ ID NO: 143073 - DNA, 25 bp, Homo sapien
gacagaggatctggaagccacatct

SEQ ID NO: 143074 - DNA, 25 bp, Homo sapien
ggaagccacatctgagcacttcaag

SEQ ID NO: 143075 - DNA, 25 bp, Homo sapien
gagcacttcaagacgacatcgcaga

SEQ ID NO: 143076 - DNA, 25 bp, Homo sapien
gacatcgcagaaggtggctcgaaaa

SEQ ID NO: 143077 - DNA, 25 bp, Homo sapien
gatgattgtccttatctgcgtgatt

SEQ ID NO: 143078 - DNA, 25 bp, Homo sapien
gtccttatctgcgtgattgttttta

SEQ ID NO: 143079 - DNA, 25 bp, Homo sapien
atcctcttcattgtgctctttgcca

SEQ ID NO: 143080 - DNA, 25 bp, Homo sapien
tttgccactggtgccttctcttaaa

SEQ ID NO: 143081 - DNA, 25 bp, Homo sapien
ggtgccttctcttaaagtaacaggg

SEQ ID NO: 143082 - DNA, 25 bp, Homo sapien
ccagatgcttaatgaacggcgagtg

SEQ ID NO: 143083 - DNA, 25 bp, Homo sapien
gggctaccacttcgaagacaccgcg

SEQ ID NO: 143084 - DNA, 25 bp, Homo sapien
aagacaccgcgggagcttacttgct

SEQ ID NO: 143085 - DNA, 25 bp, Homo sapien
tgctcaaccgcactctatgggatcg

SEQ ID NO: 143086 - DNA, 25 bp, Homo sapien
tggaatgtgacgctcttctcgctgc

SEQ ID NO: 143087 - DNA, 25 bp, Homo sapien
gatagtactgtgtgggatccagctg

SEQ ID NO: 143088 - DNA, 25 bp, Homo sapien
ggatccagctggtgaacgcgaccat

SEQ ID NO: 143089 - DNA, 25 bp, Homo sapien
tgaacgcgaccattggtgtcttctg

SEQ ID NO: 143090 - DNA, 25 bp, Homo sapien
attggtgtcttctgcggcgattgca

SEQ ID NO: 143091 - DNA, 25 bp, Homo sapien
aaaaacaggacacacctcactgagg

SEQ ID NO: 143092 - DNA, 25 bp, Homo sapien
tgaggctccactgaccgccgggtta

SEQ ID NO: 143093 - DNA, 25 bp, Homo sapien
taagccccggcacttctagtggtct

SEQ ID NO: 143094 - DNA, 25 bp, Homo sapien
tctagtggtctcacctggaggcaag

SEQ ID NO: 143095 - DNA, 25 bp, Homo sapien
agggagggtacagagcctctgccaa

SEQ ID NO: 143096 - DNA, 25 bp, Homo sapien
ggagggtacagagcctctgccaacg

SEQ ID NO: 143097 - DNA, 25 bp, Homo sapien
agggtacagagcctctgccaacgtc

SEQ ID NO: 143098 - DNA, 25 bp, Homo sapien
gggtacagagcctctgccaacgtcc

SEQ ID NO: 143099 - DNA, 25 bp, Homo sapien
cctgctctctggaggtactgagaca

SEQ ID NO: 143100 - DNA, 25 bp, Homo sapien
ctctctggaggtactgagacagggt

SEQ ID NO: 143101 - DNA, 25 bp, Homo sapien
ctggacctatgcagggaggccacgt

SEQ ID NO: 143102 - DNA, 25 bp, Homo sapien
acctatgcagggaggccacgtccca

SEQ ID NO: 143103 - DNA, 25 bp, Homo sapien
cacctcttgtttctgggtccctgct

SEQ ID NO: 143104 - DNA, 25 bp, Homo sapien
ttgccagcttggacagcccacagct

SEQ ID NO: 143105 - DNA, 25 bp, Homo sapien
cacagctctcccaggtgcacggtgt

SEQ ID NO: 143106 - DNA, 25 bp, Homo sapien
agctctcccaggtgcacggtgtcat

SEQ ID NO: 143107 - DNA, 25 bp, Homo sapien
ccaggtgcacggtgtcatccaggtg

SEQ ID NO: 143108 - DNA, 25 bp, Homo sapien
tgcacggtgtcatccaggtggatgt

SEQ ID NO: 143109 - DNA, 25 bp, Homo sapien
tgtcatccaggtggatgtggcccca

SEQ ID NO: 143110 - DNA, 25 bp, Homo sapien
gggcttcttctcagacgctggaggt

SEQ ID NO: 143111 - DNA, 25 bp, Homo sapien
cttcttctcagacgctggaggtgac

SEQ ID NO: 143112 - DNA, 25 bp, Homo sapien
gggcacactacagagcagctcccca

SEQ ID NO: 143113 - DNA, 25 bp, Homo sapien
tcccggagagggagtcagtcttcac

SEQ ID NO: 143114 - DNA, 25 bp, Homo sapien
ggagagggagtcagtcttcacttgc

SEQ ID NO: 143115 - DNA, 25 bp, Homo sapien
ggtgaggatcctgctgcacggctca

SEQ ID NO: 143116 - DNA, 25 bp, Homo sapien
tgaggatcctgctgcacggctcagc

SEQ ID NO: 143117 - DNA, 25 bp, Homo sapien
agccctgctctatgcggccggatgg

SEQ ID NO: 143118 - DNA, 25 bp, Homo sapien
tatgcggccggatggtcacctgaaa

SEQ ID NO: 143119 - DNA, 25 bp, Homo sapien
gcggccggatggtcacctgaaaagc

SEQ ID NO: 143120 - DNA, 25 bp, Homo sapien
ggtcacctgaaaagcaggcccagca

SEQ ID NO: 143121 - DNA, 25 bp, Homo sapien
ggcagcgggtgttggtgctagagct

SEQ ID NO: 143122 - DNA, 25 bp, Homo sapien
gtgacgacgaggacactgccttccc

SEQ ID NO: 143123 - DNA, 25 bp, Homo sapien
ctgtgacaaggcagccaccctgtca

SEQ ID NO: 143124 - DNA, 25 bp, Homo sapien
caccctgtcacctagctcaatggag

SEQ ID NO: 143125 - DNA, 25 bp, Homo sapien
cacctagctcaatggagccccggat

SEQ ID NO: 143126 - DNA, 25 bp, Homo sapien
aaaggcatgcaaacccagtgaccag

SEQ ID NO: 143127 - DNA, 25 bp, Homo sapien
gaagctgctcagtttgtggcgaata

SEQ ID NO: 143128 - DNA, 25 bp, Homo sapien
aatggcgaccaagacaccttgaagg

SEQ ID NO: 143129 - DNA, 25 bp, Homo sapien
ttgaagggcctaatgcacgcactaa

SEQ ID NO: 143130 - DNA, 25 bp, Homo sapien
agcactcaaagacgtaccactttcc

SEQ ID NO: 143131 - DNA, 25 bp, Homo sapien
ttcccaaaactgtcactcagagtct

SEQ ID NO: 143132 - DNA, 25 bp, Homo sapien
agaagaccatcaggttccttcacag

SEQ ID NO: 143133 - DNA, 25 bp, Homo sapien
ggttccttcacagcttcacaatgta

SEQ ID NO: 143134 - DNA, 25 bp, Homo sapien
gataggtaaccaggtccaatcagta

SEQ ID NO: 143135 - DNA, 25 bp, Homo sapien
aagctgcttataactggaaatggcc

SEQ ID NO: 143136 - DNA, 25 bp, Homo sapien
ctggaaatggccattgagctgtttc

SEQ ID NO: 143137 - DNA, 25 bp, Homo sapien
cggagaaggacaagcaggcgtatct

SEQ ID NO: 143138 - DNA, 25 bp, Homo sapien
gcaggcgtatctggaggcagcctat

SEQ ID NO: 143139 - DNA, 25 bp, Homo sapien
gccggcgtccgcaatatcgagatgg

SEQ ID NO: 143140 - DNA, 25 bp, Homo sapien
atggagtcctcggtgtttgccgcca

SEQ ID NO: 143141 - DNA, 25 bp, Homo sapien
tgtttgccgccatgtgcagcgcctg

SEQ ID NO: 143142 - DNA, 25 bp, Homo sapien
tccaagcggccgtggtgtgtgtcac

SEQ ID NO: 143143 - DNA, 25 bp, Homo sapien
tggtgtgtgtcaccctcctgaaccg

SEQ ID NO: 143144 - DNA, 25 bp, Homo sapien
agatcagcagccctcgcaatgtgct

SEQ ID NO: 143145 - DNA, 25 bp, Homo sapien
aatgtgctcagcgagtaccagcaga

SEQ ID NO: 143146 - DNA, 25 bp, Homo sapien
agcggctggtgagctacttcatcaa

SEQ ID NO: 143147 - DNA, 25 bp, Homo sapien
agaaactgagcaaggcctgagcgct

SEQ ID NO: 143148 - DNA, 25 bp, Homo sapien
taagccccggcacttctagtggtct

SEQ ID NO: 143149 - DNA, 25 bp, Homo sapien
aagccccggcacttctagtggtctc

SEQ ID NO: 143150 - DNA, 25 bp, Homo sapien
agccccggcacttctagtggtctca

SEQ ID NO: 143151 - DNA, 25 bp, Homo sapien
ccggcacttctagtggtctcacctg

SEQ ID NO: 143152 - DNA, 25 bp, Homo sapien
cctgctctctggaggtactgagaca

SEQ ID NO: 143153 - DNA, 25 bp, Homo sapien
ctgctctctggaggtactgagacag

SEQ ID NO: 143154 - DNA, 25 bp, Homo sapien
tgctctctggaggtactgagacagg

SEQ ID NO: 143155 - DNA, 25 bp, Homo sapien
ctctctggaggtactgagacagggt

SEQ ID NO: 143156 - DNA, 25 bp, Homo sapien
tctggaggtactgagacagggtgct

SEQ ID NO: 143157 - DNA, 25 bp, Homo sapien
ggaggtactgagacagggtgctgat

SEQ ID NO: 143158 - DNA, 25 bp, Homo sapien
ggtactgagacagggtgctgatggg

SEQ ID NO: 143159 - DNA, 25 bp, Homo sapien
gcagccacagtgttctgttggagaa

SEQ ID NO: 143160 - DNA, 25 bp, Homo sapien
gaagtgttttctgaaccagttcttt

SEQ ID NO: 143161 - DNA, 25 bp, Homo sapien
agagcgtgaaatccagacctgtttt

SEQ ID NO: 143162 - DNA, 25 bp, Homo sapien
gacctgtttttgaaaggacagcaca

SEQ ID NO: 143163 - DNA, 25 bp, Homo sapien
aagtgactgggacgatgcttcctct

SEQ ID NO: 143164 - DNA, 25 bp, Homo sapien
aacacatgcagagtcacatcctcat

SEQ ID NO: 143165 - DNA, 25 bp, Homo sapien
acatcctcatcctagtgtttggcag

SEQ ID NO: 143166 - DNA, 25 bp, Homo sapien
cctcatcctagtgtttggcagtttg

SEQ ID NO: 143167 - DNA, 25 bp, Homo sapien
tggcagtttgagaccgctaccctga

SEQ ID NO: 143168 - DNA, 25 bp, Homo sapien
gagaccgctaccctgaacttaagag

SEQ ID NO: 143169 - DNA, 25 bp, Homo sapien
taaatatgagggttgtgtttctggg

SEQ ID NO: 143170 - DNA, 25 bp, Homo sapien
caagtccaccagtctctgaaattag

SEQ ID NO: 143171 - DNA, 25 bp, Homo sapien
gaacagtaggcggtatgagataatc

SEQ ID NO: 143172 - DNA, 25 bp, Homo sapien
gataatcaggcctaatcatgttgtg

SEQ ID NO: 143173 - DNA, 25 bp, Homo sapien
ggcctaatcatgttgtgattctctt

SEQ ID NO: 143174 - DNA, 25 bp, Homo sapien
tctcttttcttagtggagtggaatg

SEQ ID NO: 143175 - DNA, 25 bp, Homo sapien
gagtggaatgttctatccccacaag

SEQ ID NO: 143176 - DNA, 25 bp, Homo sapien
gttctatccccacaagaaggattat

SEQ ID NO: 143177 - DNA, 25 bp, Homo sapien
ggattatatcttatagacttgtctt

SEQ ID NO: 143178 - DNA, 25 bp, Homo sapien
agacttgtcttgttcagattctgta

SEQ ID NO: 143179 - DNA, 25 bp, Homo sapien
gttcagattctgtatttacccattt

SEQ ID NO: 143180 - DNA, 25 bp, Homo sapien
tactaagttccatgtatttttgtta

SEQ ID NO: 143181 - DNA, 25 bp, Homo sapien
ggacgtgtgtcctttggtactatgg

SEQ ID NO: 143182 - DNA, 25 bp, Homo sapien
gtgtcctttggtactatggtgtgtt

SEQ ID NO: 143183 - DNA, 25 bp, Homo sapien
actatggtgtgttgtatctttgtaa

SEQ ID NO: 143184 - DNA, 25 bp, Homo sapien
atctttgtaagagcaaaagcctcag

SEQ ID NO: 143185 - DNA, 25 bp, Homo sapien
aagcctcagaaagggattgctttgc

SEQ ID NO: 143186 - DNA, 25 bp, Homo sapien
aagggattgctttgcattactgtcc

SEQ ID NO: 143187 - DNA, 25 bp, Homo sapien
ttgcattactgtccccttgatataa

SEQ ID NO: 143188 - DNA, 25 bp, Homo sapien
ttactgtccccttgatataaaaaat

SEQ ID NO: 143189 - DNA, 25 bp, Homo sapien
gggaatgagagttccttctcactta

SEQ ID NO: 143190 - DNA, 25 bp, Homo sapien
gagttccttctcacttagaatctga

SEQ ID NO: 143191 - DNA, 25 bp, Homo sapien
aatggtctggcaatattctgtaact

SEQ ID NO: 143192 - DNA, 25 bp, Homo sapien
gggcgatgacgccaatcgcaattac

SEQ ID NO: 143193 - DNA, 25 bp, Homo sapien
gatgacgccaatcgcaattaccgct

SEQ ID NO: 143194 - DNA, 25 bp, Homo sapien
gcaattaccgctcccacttgtgagc

SEQ ID NO: 143195 - DNA, 25 bp, Homo sapien
gtgcgcttcacacagcaccaagcag

SEQ ID NO: 143196 - DNA, 25 bp, Homo sapien
ggaactgccaaggagacctgatgtt

SEQ ID NO: 143197 - DNA, 25 bp, Homo sapien
gacctgatgttagatcaaagccaga

SEQ ID NO: 143198 - DNA, 25 bp, Homo sapien
aagccagagaggagcctatggaatg

SEQ ID NO: 143199 - DNA, 25 bp, Homo sapien
ggagcctatggaatgtggatcaaat

SEQ ID NO: 143200 - DNA, 25 bp, Homo sapien
tgtggatcaaatgccagttgtgacg

SEQ ID NO: 143201 - DNA, 25 bp, Homo sapien
atgccagttgtgacgaaatgaggaa

SEQ ID NO: 143202 - DNA, 25 bp, Homo sapien
aggaatgtatatgttggctgttttt

SEQ ID NO: 143203 - DNA, 25 bp, Homo sapien
gtgcgagctgaagcgaaaatggcga

SEQ ID NO: 143204 - DNA, 25 bp, Homo sapien
tccgcgagccgggattacagggtct

SEQ ID NO: 143205 - DNA, 25 bp, Homo sapien
gcgagccgggattacagggtctgcg

SEQ ID NO: 143206 - DNA, 25 bp, Homo sapien
caaacggagacctcggtcatctagc

SEQ ID NO: 143207 - DNA, 25 bp, Homo sapien
aaacggagacctcggtcatctagcc

SEQ ID NO: 143208 - DNA, 25 bp, Homo sapien
ggagacctcggtcatctagccccac

SEQ ID NO: 143209 - DNA, 25 bp, Homo sapien
cctgcctgtcggacgcggcgggagg

SEQ ID NO: 143210 - DNA, 25 bp, Homo sapien
gacgcggcgggaggcccacggttcg

SEQ ID NO: 143211 - DNA, 25 bp, Homo sapien
tgcggggctgagacgccggcttcct

SEQ ID NO: 143212 - DNA, 25 bp, Homo sapien
tccagatgcccgagcaccgtgtcgg

SEQ ID NO: 143213 - DNA, 25 bp, Homo sapien
ggtcagcgcggtcctgactccgtca

SEQ ID NO: 143214 - DNA, 25 bp, Homo sapien
aacccgatttatttctcctgaatct

SEQ ID NO: 143215 - DNA, 25 bp, Homo sapien
aagtttgtgtcgttccttaagcaga

SEQ ID NO: 143216 - DNA, 25 bp, Homo sapien
gcagaactaagctcagtatgtgacc

SEQ ID NO: 143217 - DNA, 25 bp, Homo sapien
agtatgtgaccttacccgctaggtg

SEQ ID NO: 143218 - DNA, 25 bp, Homo sapien
tgaccttacccgctaggtggttaat

SEQ ID NO: 143219 - DNA, 25 bp, Homo sapien
gtggttaatttatccatgctggcag

SEQ ID NO: 143220 - DNA, 25 bp, Homo sapien
gcagaggcactcaggtacttggtaa

SEQ ID NO: 143221 - DNA, 25 bp, Homo sapien
agcaaatttctaaaactccaagttg

SEQ ID NO: 143222 - DNA, 25 bp, Homo sapien
caagttgctgcagcttggcattctt

SEQ ID NO: 143223 - DNA, 25 bp, Homo sapien
ggcattcttcttattctagaggtct

SEQ ID NO: 143224 - DNA, 25 bp, Homo sapien
tcttattctagaggtctctctggaa

SEQ ID NO: 143225 - DNA, 25 bp, Homo sapien
cagagtccagctgattctaacaaaa

SEQ ID NO: 143226 - DNA, 25 bp, Homo sapien
agctgattctaacaaaaccctggag

SEQ ID NO: 143227 - DNA, 25 bp, Homo sapien
agtagggaaggaacaggactgcaaa

SEQ ID NO: 143228 - DNA, 25 bp, Homo sapien
caggactgcaaaaatccttctccac

SEQ ID NO: 143229 - DNA, 25 bp, Homo sapien
tatttaaagagccttcactggttct

SEQ ID NO: 143230 - DNA, 25 bp, Homo sapien
cctggacttcttagttgtttctcta

SEQ ID NO: 143231 - DNA, 25 bp, Homo sapien
gacttcttagttgtttctctagcgc

SEQ ID NO: 143232 - DNA, 25 bp, Homo sapien
tagttgtttctctagcgctgagcta

SEQ ID NO: 143233 - DNA, 25 bp, Homo sapien
tagcgctgagctatctcctaacttt

SEQ ID NO: 143234 - DNA, 25 bp, Homo sapien
gagctatctcctaactttggaccta

SEQ ID NO: 143235 - DNA, 25 bp, Homo sapien
cctaactttggacctattatcagaa

SEQ ID NO: 143236 - DNA, 25 bp, Homo sapien
gaagctgcaaagagcgacccttcca

SEQ ID NO: 143237 - DNA, 25 bp, Homo sapien
aaagagcgacccttccattgtatta

SEQ ID NO: 143238 - DNA, 25 bp, Homo sapien
gcgacccttccattgtattacttct

SEQ ID NO: 143239 - DNA, 25 bp, Homo sapien
gtgcgacatccagaaatgagctgat

SEQ ID NO: 143240 - DNA, 25 bp, Homo sapien
catccagaaatgagctgatgtcaat

SEQ ID NO: 143241 - DNA, 25 bp, Homo sapien
atgttccattcagtctgcagctatt

SEQ ID NO: 143242 - DNA, 25 bp, Homo sapien
cattcagtctgcagctattcacaca

SEQ ID NO: 143243 - DNA, 25 bp, Homo sapien
tcagtctgcagctattcacacacac

SEQ ID NO: 143244 - DNA, 25 bp, Homo sapien
tgtgtttgaaacactcgtgtgcatg

SEQ ID NO: 143245 - DNA, 25 bp, Homo sapien
gaaacactcgtgtgcatgagaatgt

SEQ ID NO: 143246 - DNA, 25 bp, Homo sapien
gtgcatgagaatgtcatttgctaat

SEQ ID NO: 143247 - DNA, 25 bp, Homo sapien
gtgtcatcgaaaccctcctcatgga

SEQ ID NO: 143248 - DNA, 25 bp, Homo sapien
ggacacaccctccagttatgaggct

SEQ ID NO: 143249 - DNA, 25 bp, Homo sapien
atgaggctgccatggaacttttcag

SEQ ID NO: 143250 - DNA, 25 bp, Homo sapien
tggaacttttcagccctgatcaaga

SEQ ID NO: 143251 - DNA, 25 bp, Homo sapien
aaagcccagagaaagcatcattaag

SEQ ID NO: 143252 - DNA, 25 bp, Homo sapien
gaaagcatcattaagctcatggaaa

SEQ ID NO: 143253 - DNA, 25 bp, Homo sapien
agcccaaagctcactgtgtaattag

SEQ ID NO: 143254 - DNA, 25 bp, Homo sapien
cactgtgtaattagcatttagaagc

SEQ ID NO: 143255 - DNA, 25 bp, Homo sapien
gccgctgccatgctttgagtccacg

SEQ ID NO: 143256 - DNA, 25 bp, Homo sapien
agagatctgcccgagctttcagcgt

SEQ ID NO: 143257 - DNA, 25 bp, Homo sapien
gagctttcagcgtgtcatcgaaacc

SEQ ID NO: 143258 - DNA, 25 bp, Homo sapien
agggatgcagacactgtccatggct

SEQ ID NO: 143259 - DNA, 25 bp, Homo sapien
catggctcgttctatttttgttcaa

SEQ ID NO: 143260 - DNA, 25 bp, Homo sapien
agctgtggacggtttgttgtgtcta

SEQ ID NO: 143261 - DNA, 25 bp, Homo sapien
agacttttgctacaaatcgtgtgca

SEQ ID NO: 143262 - DNA, 25 bp, Homo sapien
aatcgtgtgcatcaagtgtctcaga

SEQ ID NO: 143263 - DNA, 25 bp, Homo sapien
agataatcctcccatcagtgttctg

SEQ ID NO: 143264 - DNA, 25 bp, Homo sapien
ctcccatcagtgttctgtttctaga

SEQ ID NO: 143265 - DNA, 25 bp, Homo sapien
gaacttgtagaaccagtgttactgt

SEQ ID NO: 143266 - DNA, 25 bp, Homo sapien
ccagtgttactgtttgtatcaggga

SEQ ID NO: 143267 - DNA, 25 bp, Homo sapien
aataactaagactcctattccttgg

SEQ ID NO: 143268 - DNA, 25 bp, Homo sapien
tcctattccttggagggacccttct

SEQ ID NO: 143269 - DNA, 25 bp, Homo sapien
aaatcatgggcattgctggactgat

SEQ ID NO: 143270 - DNA, 25 bp, Homo sapien
ctggactgatggttgctttgagccc

SEQ ID NO: 143271 - DNA, 25 bp, Homo sapien
tttgagcccacaggagctccctttt

SEQ ID NO: 143272 - DNA, 25 bp, Homo sapien
caggagctccctttttgaattgtgt

SEQ ID NO: 143273 - DNA, 25 bp, Homo sapien
gaagtgtgttctgatgaggcatttt

SEQ ID NO: 143274 - DNA, 25 bp, Homo sapien
attttactatgcctgttgatctatg

SEQ ID NO: 143275 - DNA, 25 bp, Homo sapien
tgatctatgggaaatctaggcgaaa

SEQ ID NO: 143276 - DNA, 25 bp, Homo sapien
agccaaccaggctacagttgatatt

SEQ ID NO: 143277 - DNA, 25 bp, Homo sapien
gatagtgtttcgttaagcagtacat

SEQ ID NO: 143278 - DNA, 25 bp, Homo sapien
agcagtacatcttgtgcatgcaaaa

SEQ ID NO: 143279 - DNA, 25 bp, Homo sapien
atgcaaaaatgaattcacccctccc

SEQ ID NO: 143280 - DNA, 25 bp, Homo sapien
catctcggcactagaattcgccact

SEQ ID NO: 143281 - DNA, 25 bp, Homo sapien
tctcggcactagaattcgccactct

SEQ ID NO: 143282 - DNA, 25 bp, Homo sapien
ggcactagaattcgccactctccca

SEQ ID NO: 143283 - DNA, 25 bp, Homo sapien
aggtctcatcttccaccccaaaaat

SEQ ID NO: 143284 - DNA, 25 bp, Homo sapien
gtctcatcttccaccccaaaaatgt

SEQ ID NO: 143285 - DNA, 25 bp, Homo sapien
catcttccaccccaaaaatgtctgt

SEQ ID NO: 143286 - DNA, 25 bp, Homo sapien
atcttccaccccaaaaatgtctgtc

SEQ ID NO: 143287 - DNA, 25 bp, Homo sapien
accccaaaaatgtctgtctctctct

SEQ ID NO: 143288 - DNA, 25 bp, Homo sapien
tttttacaattttgaggtcttcgtg

SEQ ID NO: 143289 - DNA, 25 bp, Homo sapien
tttacaattttgaggtcttcgtgtt

SEQ ID NO: 143290 - DNA, 25 bp, Homo sapien
ttacaattttgaggtcttcgtgttc

SEQ ID NO: 143291 - DNA, 25 bp, Homo sapien
aaaagtcagactgctgggactggcc

SEQ ID NO: 143292 - DNA, 25 bp, Homo sapien
tggccaggtttctgcccacattgga

SEQ ID NO: 143293 - DNA, 25 bp, Homo sapien
cacattggacccacatgaggacatg

SEQ ID NO: 143294 - DNA, 25 bp, Homo sapien
gaggacatgatggagcgcacctgcc

SEQ ID NO: 143295 - DNA, 25 bp, Homo sapien
acagtcctgggagaacctcaggctt

SEQ ID NO: 143296 - DNA, 25 bp, Homo sapien
gcttccttggcatcacagggcagag

SEQ ID NO: 143297 - DNA, 25 bp, Homo sapien
ccttggcatcacagggcagagccgg

SEQ ID NO: 143298 - DNA, 25 bp, Homo sapien
ggcagagccgggaagcgatgaattt

SEQ ID NO: 143299 - DNA, 25 bp, Homo sapien
ggccttggttcccttgtgtgtgtgt

SEQ ID NO: 143300 - DNA, 25 bp, Homo sapien
gtgttgatcccaagacaatgaaagt

SEQ ID NO: 143301 - DNA, 25 bp, Homo sapien
tttgcactgtatgctggacggcatt

SEQ ID NO: 143302 - DNA, 25 bp, Homo sapien
gatttgcagttattcgtaatgtcag

SEQ ID NO: 143303 - DNA, 25 bp, Homo sapien
gactgttatactcttgaatccctgt

SEQ ID NO: 143304 - DNA, 25 bp, Homo sapien
aatccctgtggaaatctacatttga

SEQ ID NO: 143305 - DNA, 25 bp, Homo sapien
gaagacaacatcactctgaagtgtt

SEQ ID NO: 143306 - DNA, 25 bp, Homo sapien
aatagcaaccacttatggcactgta

SEQ ID NO: 143307 - DNA, 25 bp, Homo sapien
atggcactgtatatattgtagactt

SEQ ID NO: 143308 - DNA, 25 bp, Homo sapien
tattgtagacttgttttctctgttt

SEQ ID NO: 143309 - DNA, 25 bp, Homo sapien
gttttatgctcttgtgtaatctact

SEQ ID NO: 143310 - DNA, 25 bp, Homo sapien
gctcttgtgtaatctacttgacatc

SEQ ID NO: 143311 - DNA, 25 bp, Homo sapien
aatctacttgacatcattttactct

SEQ ID NO: 143312 - DNA, 25 bp, Homo sapien
tttactcttggaatagtgggtggat

SEQ ID NO: 143313 - DNA, 25 bp, Homo sapien
ttaaatttagtcagaaggtcagcat

SEQ ID NO: 143314 - DNA, 25 bp, Homo sapien
gaaggtcagcatttacatgacagaa

SEQ ID NO: 143315 - DNA, 25 bp, Homo sapien
ggattaagaggctagacgagacata

SEQ ID NO: 143316 - DNA, 25 bp, Homo sapien
tggtgatgtgtgcaatttcatgaat

SEQ ID NO: 143317 - DNA, 25 bp, Homo sapien
tgtttcgaagtccagttgtcattcc

SEQ ID NO: 143318 - DNA, 25 bp, Homo sapien
ttgtcattcccgcattcagatttca

SEQ ID NO: 143319 - DNA, 25 bp, Homo sapien
cagatttcatttgctgatgacttta

SEQ ID NO: 143320 - DNA, 25 bp, Homo sapien
gctgatgactttatacgttacgtac

SEQ ID NO: 143321 - DNA, 25 bp, Homo sapien
atacgttacgtacccaaggacattg

SEQ ID NO: 143322 - DNA, 25 bp, Homo sapien
aaggacattgcctcagggttgcaaa

SEQ ID NO: 143323 - DNA, 25 bp, Homo sapien
gcctcagggttgcaaactctttaaa

SEQ ID NO: 143324 - DNA, 25 bp, Homo sapien
gcttggatgccaatgagagttattt

SEQ ID NO: 143325 - DNA, 25 bp, Homo sapien
tttatggtaaccacagtgcaaggca

SEQ ID NO: 143326 - DNA, 25 bp, Homo sapien
gtgcaaggcaactgtcagcgcaatg

SEQ ID NO: 143327 - DNA, 25 bp, Homo sapien
gctcaaggtctctgggctgtcccta

SEQ ID NO: 143328 - DNA, 25 bp, Homo sapien
gccctgcagctagcaagtcttgtgt

SEQ ID NO: 143329 - DNA, 25 bp, Homo sapien
aagtcttgtgtttaggctcgtctga

SEQ ID NO: 143330 - DNA, 25 bp, Homo sapien
ttgtgtttaggctcgtctgacctat

SEQ ID NO: 143331 - DNA, 25 bp, Homo sapien
tcgtctgacctatttccttcagtta

SEQ ID NO: 143332 - DNA, 25 bp, Homo sapien
gacctatttccttcagttatacttt

SEQ ID NO: 143333 - DNA, 25 bp, Homo sapien
tatactttcaatgaccttttgtgca

SEQ ID NO: 143334 - DNA, 25 bp, Homo sapien
ccttttgtgcatctgttaaggcaaa

SEQ ID NO: 143335 - DNA, 25 bp, Homo sapien
gctcctgaaagtctggctgcctctg

SEQ ID NO: 143336 - DNA, 25 bp, Homo sapien
accttgaccctgacttttcagtgac

SEQ ID NO: 143337 - DNA, 25 bp, Homo sapien
gaccctgacttttcagtgactgaca

SEQ ID NO: 143338 - DNA, 25 bp, Homo sapien
cagtgactgacagcggaaagccctg

SEQ ID NO: 143339 - DNA, 25 bp, Homo sapien
aaagttcatgctttgttcagcctgc

SEQ ID NO: 143340 - DNA, 25 bp, Homo sapien
tcttttctcccttttaatcctggct

SEQ ID NO: 143341 - DNA, 25 bp, Homo sapien
atcctggctgtcgagaaacagcctg

SEQ ID NO: 143342 - DNA, 25 bp, Homo sapien
agaaacagcctgtgtctttaaatgc

SEQ ID NO: 143343 - DNA, 25 bp, Homo sapien
agcctgtgtctttaaatgctgcttt

SEQ ID NO: 143344 - DNA, 25 bp, Homo sapien
aaatgggacttgtgacggtgtacct

SEQ ID NO: 143345 - DNA, 25 bp, Homo sapien
acttgtgacggtgtacctgaggccc

SEQ ID NO: 143346 - DNA, 25 bp, Homo sapien
gacaggaaaatcctctggctggcta

SEQ ID NO: 143347 - DNA, 25 bp, Homo sapien
cctctggctggctaactggaagcat

SEQ ID NO: 143348 - DNA, 25 bp, Homo sapien
gtaggagaatccaagcgaggtcaac

SEQ ID NO: 143349 - DNA, 25 bp, Homo sapien
cgaggtcaacagagaaggcaggaat

SEQ ID NO: 143350 - DNA, 25 bp, Homo sapien
aaggcaggaatgtgtggcagattta

SEQ ID NO: 143351 - DNA, 25 bp, Homo sapien
atatggcagcgaaaggatgtaaaca

SEQ ID NO: 143352 - DNA, 25 bp, Homo sapien
cagtgcctgctgaatgatttccaaa

SEQ ID NO: 143353 - DNA, 25 bp, Homo sapien
aagtttgccagaagtttgtcaagtc

SEQ ID NO: 143354 - DNA, 25 bp, Homo sapien
gtttgtcaagtcaaccaatgtagaa

SEQ ID NO: 143355 - DNA, 25 bp, Homo sapien
aaatggctcatacttatatagcact

SEQ ID NO: 143356 - DNA, 25 bp, Homo sapien
tatagcacttactttgtttgcaagt

SEQ ID NO: 143357 - DNA, 25 bp, Homo sapien
cattaaacaaacatcacagccctca

SEQ ID NO: 143358 - DNA, 25 bp, Homo sapien
attaaacaaacatcacagccctcac

SEQ ID NO: 143359 - DNA, 25 bp, Homo sapien
cagctaaccaggtctttagaatatg

SEQ ID NO: 143360 - DNA, 25 bp, Homo sapien
gctaaccaggtctttagaatatgct

SEQ ID NO: 143361 - DNA, 25 bp, Homo sapien
taaccaggtctttagaatatgctct

SEQ ID NO: 143362 - DNA, 25 bp, Homo sapien
accaggtctttagaatatgctctag

SEQ ID NO: 143363 - DNA, 25 bp, Homo sapien
aggtctttagaatatgctctagcca

SEQ ID NO: 143364 - DNA, 25 bp, Homo sapien
gtctttagaatatgctctagccaag

SEQ ID NO: 143365 - DNA, 25 bp, Homo sapien
tttagaatatgctctagccaagtct

SEQ ID NO: 143366 - DNA, 25 bp, Homo sapien
tagaatatgctctagccaagtctaa

SEQ ID NO: 143367 - DNA, 25 bp, Homo sapien
agaatatgctctagccaagtctaac

SEQ ID NO: 143368 - DNA, 25 bp, Homo sapien
tttggtagggtgagtgtttccactc

SEQ ID NO: 143369 - DNA, 25 bp, Homo sapien
gagtgtttccactcaaaatatgtca

SEQ ID NO: 143370 - DNA, 25 bp, Homo sapien
aactgtagcaagatgcaaatgcatg

SEQ ID NO: 143371 - DNA, 25 bp, Homo sapien
aatgcatggcaaatctgtcggtctc

SEQ ID NO: 143372 - DNA, 25 bp, Homo sapien
aaatctgtcggtctccagttggtta

SEQ ID NO: 143373 - DNA, 25 bp, Homo sapien
gtcggtctccagttggttatctgaa

SEQ ID NO: 143374 - DNA, 25 bp, Homo sapien
ggttatctgaatagtgtcaccaatt

SEQ ID NO: 143375 - DNA, 25 bp, Homo sapien
atagtgtcaccaattccaccaagac

SEQ ID NO: 143376 - DNA, 25 bp, Homo sapien
aattccaccaagacagtgctgagat

SEQ ID NO: 143377 - DNA, 25 bp, Homo sapien
gctgagattggaaagggcactcatt

SEQ ID NO: 143378 - DNA, 25 bp, Homo sapien
aagggcttgaggtgaatttcattaa

SEQ ID NO: 143379 - DNA, 25 bp, Homo sapien
tctgcggctttcactgctgagtttc

SEQ ID NO: 143380 - DNA, 25 bp, Homo sapien
cactgctgagtttctgttctccctg

SEQ ID NO: 143381 - DNA, 25 bp, Homo sapien
ctgggaagcctgtgccagcaccttt

SEQ ID NO: 143382 - DNA, 25 bp, Homo sapien
gtgccagcacctttgagccttggcc

SEQ ID NO: 143383 - DNA, 25 bp, Homo sapien
acctttgagccttggcccacactga

SEQ ID NO: 143384 - DNA, 25 bp, Homo sapien
ttggcccacactgaggcttaggcct

SEQ ID NO: 143385 - DNA, 25 bp, Homo sapien
gaggcttaggcctctctgcctggga

SEQ ID NO: 143386 - DNA, 25 bp, Homo sapien
cttaggcctctctgcctgggatggg

SEQ ID NO: 143387 - DNA, 25 bp, Homo sapien
tcccctgaggatggcctggattcac

SEQ ID NO: 143388 - DNA, 25 bp, Homo sapien
gcaccaaccttgctgggacttggat

SEQ ID NO: 143389 - DNA, 25 bp, Homo sapien
tatctcttcaagtgtggagagggca

SEQ ID NO: 143390 - DNA, 25 bp, Homo sapien
gaggaatttaaagactcatccccag

SEQ ID NO: 143391 - DNA, 25 bp, Homo sapien
gaatttaaagactcatccccagcct

SEQ ID NO: 143392 - DNA, 25 bp, Homo sapien
ctccacctcctgtgtgatacttggg

SEQ ID NO: 143393 - DNA, 25 bp, Homo sapien
gagatggtcttgttctgtcaaccag

SEQ ID NO: 143394 - DNA, 25 bp, Homo sapien
gatggtcttgttctgtcaaccaggc

SEQ ID NO: 143395 - DNA, 25 bp, Homo sapien
tgttctgtcaaccaggctagaatgc

SEQ ID NO: 143396 - DNA, 25 bp, Homo sapien
agcggtgcaatcatgagtcaatgca

SEQ ID NO: 143397 - DNA, 25 bp, Homo sapien
atcatgagtcaatgcagcctccagc

SEQ ID NO: 143398 - DNA, 25 bp, Homo sapien
ttttttgcggagacggtattgctat

SEQ ID NO: 143399 - DNA, 25 bp, Homo sapien
ttgcggagacggtattgctatgttg

SEQ ID NO: 143400 - DNA, 25 bp, Homo sapien
ttgctatgttgccaaggttgtttac

SEQ ID NO: 143401 - DNA, 25 bp, Homo sapien
aattgtttttgcacatatctgatta

SEQ ID NO: 143402 - DNA, 25 bp, Homo sapien
ttttgcattcgagttttaaacactg

SEQ ID NO: 143403 - DNA, 25 bp, Homo sapien
taaaatgtagccaaagctcaccttt

SEQ ID NO: 143404 - DNA, 25 bp, Homo sapien
aaagctcacctttgaacagatcccg

SEQ ID NO: 143405 - DNA, 25 bp, Homo sapien
gaacagatcccggtgacattctatt

SEQ ID NO: 143406 - DNA, 25 bp, Homo sapien
atcccggtgacattctatttccagg

SEQ ID NO: 143407 - DNA, 25 bp, Homo sapien
ttccaggaaaatccggaacctgatt

SEQ ID NO: 143408 - DNA, 25 bp, Homo sapien
acactttttacatgtgagattggac

SEQ ID NO: 143409 - DNA, 25 bp, Homo sapien
gagattggacagtttcagaggcctt

SEQ ID NO: 143410 - DNA, 25 bp, Homo sapien
cagaggccttattttgtcatactaa

SEQ ID NO: 143411 - DNA, 25 bp, Homo sapien
gtcatactaagtgtctcctgtaatt

SEQ ID NO: 143412 - DNA, 25 bp, Homo sapien
tccactggcttccaggagagccgtt

SEQ ID NO: 143413 - DNA, 25 bp, Homo sapien
tggcttccaggagagccgtttccgg

SEQ ID NO: 143414 - DNA, 25 bp, Homo sapien
aggagagccgtttccggcgtcagct

SEQ ID NO: 143415 - DNA, 25 bp, Homo sapien
gtttccggcgtcagctagccctgct

SEQ ID NO: 143416 - DNA, 25 bp, Homo sapien
cctgctcacctggacgctgcaaggg

SEQ ID NO: 143417 - DNA, 25 bp, Homo sapien
caaggggcagccaatgcgcttagcg

SEQ ID NO: 143418 - DNA, 25 bp, Homo sapien
gggatgtctggaacattgataacaa

SEQ ID NO: 143419 - DNA, 25 bp, Homo sapien
tgataacaacttctgaggccctggg

SEQ ID NO: 143420 - DNA, 25 bp, Homo sapien
tctgctcctcgcttgaatgattcag

SEQ ID NO: 143421 - DNA, 25 bp, Homo sapien
gctcctcgcttgaatgattcagggt

SEQ ID NO: 143422 - DNA, 25 bp, Homo sapien
cgcttgaatgattcagggtcaggga

SEQ ID NO: 143423 - DNA, 25 bp, Homo sapien
gcccatgcgctgagtgccattggct

SEQ ID NO: 143424 - DNA, 25 bp, Homo sapien
catgcgctgagtgccattggctagg

SEQ ID NO: 143425 - DNA, 25 bp, Homo sapien
gctgagtgccattggctaggtgcac

SEQ ID NO: 143426 - DNA, 25 bp, Homo sapien
tgccattggctaggtgcacggcgtc

SEQ ID NO: 143427 - DNA, 25 bp, Homo sapien
ttggctaggtgcacggcgtccctga

SEQ ID NO: 143428 - DNA, 25 bp, Homo sapien
ggtcctgcactgtcccggagctcag

SEQ ID NO: 143429 - DNA, 25 bp, Homo sapien
gcttctcagcgcaacagctgtgtgt

SEQ ID NO: 143430 - DNA, 25 bp, Homo sapien
agcgcaacagctgtgtgtgcccgtg

SEQ ID NO: 143431 - DNA, 25 bp, Homo sapien
caacagctgtgtgtgcccgtggtga

SEQ ID NO: 143432 - DNA, 25 bp, Homo sapien
gtgcccgtggtgaggttgtgctgcc

SEQ ID NO: 143433 - DNA, 25 bp, Homo sapien
ggtgaggtcctgtcctggctcccag

SEQ ID NO: 143434 - DNA, 25 bp, Homo sapien
gagtcatgaagctaaatccttgggc

SEQ ID NO: 143435 - DNA, 25 bp, Homo sapien
tccttgggctatgtcagaggcacaa

SEQ ID NO: 143436 - DNA, 25 bp, Homo sapien
ggtgtatgtacattttgtgccttga

SEQ ID NO: 143437 - DNA, 25 bp, Homo sapien
ttgtgccttgattcacttagaagtg

SEQ ID NO: 143438 - DNA, 25 bp, Homo sapien
gaaaacctggacagttcgcttctac

SEQ ID NO: 143439 - DNA, 25 bp, Homo sapien
tggacagttcgcttctacacaagaa

SEQ ID NO: 143440 - DNA, 25 bp, Homo sapien
gaagatgattctgtaccctagtata

SEQ ID NO: 143441 - DNA, 25 bp, Homo sapien
gtatatctttttgggcatggactaa

SEQ ID NO: 143442 - DNA, 25 bp, Homo sapien
gggcatggactaatttgtatctgtt

SEQ ID NO: 143443 - DNA, 25 bp, Homo sapien
tctgtttaactcatattctgcacga

SEQ ID NO: 143444 - DNA, 25 bp, Homo sapien
attctgcacgatctgtatatagtac

SEQ ID NO: 143445 - DNA, 25 bp, Homo sapien
ggtgcaagacctagtcccctttcct

SEQ ID NO: 143446 - DNA, 25 bp, Homo sapien
ttcctctaactcactgcctaggagg

SEQ ID NO: 143447 - DNA, 25 bp, Homo sapien
cactgcctaggaggctggccaaggt

SEQ ID NO: 143448 - DNA, 25 bp, Homo sapien
ggtgtccagggtcctctagcccact

SEQ ID NO: 143449 - DNA, 25 bp, Homo sapien
acagcctatatcaaacatgcacacg

SEQ ID NO: 143450 - DNA, 25 bp, Homo sapien
tcaaacatgcacacgggcgagcttt

SEQ ID NO: 143451 - DNA, 25 bp, Homo sapien
acgggcgagctttctctccgacttc

SEQ ID NO: 143452 - DNA, 25 bp, Homo sapien
tccgacttcccctgggcaagagatg

SEQ ID NO: 143453 - DNA, 25 bp, Homo sapien
aagcagtcccttaatattgaggctg

SEQ ID NO: 143454 - DNA, 25 bp, Homo sapien
ggcacacagagattctggatctcct

SEQ ID NO: 143455 - DNA, 25 bp, Homo sapien
ctgctgccttttctggagtttgtaa

SEQ ID NO: 143456 - DNA, 25 bp, Homo sapien
tccatgctgatgatgagggtgacaa

SEQ ID NO: 143457 - DNA, 25 bp, Homo sapien
gagggtgacaaggactttccttcat

SEQ ID NO: 143458 - DNA, 25 bp, Homo sapien
gacaaggactttccttcatcagagg

SEQ ID NO: 143459 - DNA, 25 bp, Homo sapien
ggattcacacaggaaaactcgataa

SEQ ID NO: 143460 - DNA, 25 bp, Homo sapien
gttttactatctcagatgggtgctg

SEQ ID NO: 143461 - DNA, 25 bp, Homo sapien
tagagtcagtagttcagccagtgat

SEQ ID NO: 143462 - DNA, 25 bp, Homo sapien
agtgattgggagaccacacagcaga

SEQ ID NO: 143463 - DNA, 25 bp, Homo sapien
gaagcctcacaagagtggagacata

SEQ ID NO: 143464 - DNA, 25 bp, Homo sapien
gacatatggactgcattcagaacat

SEQ ID NO: 143465 - DNA, 25 bp, Homo sapien
gaacattgaccattagctgatacat

SEQ ID NO: 143466 - DNA, 25 bp, Homo sapien
gaccattagctgatacatgcagaca

SEQ ID NO: 143467 - DNA, 25 bp, Homo sapien
gtgcgattctatgagggccctgagc

SEQ ID NO: 143468 - DNA, 25 bp, Homo sapien
gcgattctatgagggccctgagctg

SEQ ID NO: 143469 - DNA, 25 bp, Homo sapien
tggtggccgacagcaacgtggtctt

SEQ ID NO: 143470 - DNA, 25 bp, Homo sapien
gacagcaacgtggtcttggacacaa

SEQ ID NO: 143471 - DNA, 25 bp, Homo sapien
gcaacgtggtcttggacacaaccat

SEQ ID NO: 143472 - DNA, 25 bp, Homo sapien
gtggtcttggacacaaccatgcggg

SEQ ID NO: 143473 - DNA, 25 bp, Homo sapien
catcatctgggccaacctgcgttac

SEQ ID NO: 143474 - DNA, 25 bp, Homo sapien
gccaacctgcgttaccgctgcaatg

SEQ ID NO: 143475 - DNA, 25 bp, Homo sapien
agaggactatgagacccatcagctg

SEQ ID NO: 143476 - DNA, 25 bp, Homo sapien
tcagctgcggcaagcctagggacca

SEQ ID NO: 143477 - DNA, 25 bp, Homo sapien
gaggacccgccggatgacagccacc

SEQ ID NO: 143478 - DNA, 25 bp, Homo sapien
aacgtttcggtagaatgcttcatac

SEQ ID NO: 143479 - DNA, 25 bp, Homo sapien
cttcatacttgagtgatgctggata

SEQ ID NO: 143480 - DNA, 25 bp, Homo sapien
gtatttcaacaatggactatgcctt

SEQ ID NO: 143481 - DNA, 25 bp, Homo sapien
ggactatgccttggtttttcactaa

SEQ ID NO: 143482 - DNA, 25 bp, Homo sapien
gaatttaccagtttagtatgctgtg

SEQ ID NO: 143483 - DNA, 25 bp, Homo sapien
aattgggaaaacatgagactggtca

SEQ ID NO: 143484 - DNA, 25 bp, Homo sapien
catgtgaattgtgatccatttctga

SEQ ID NO: 143485 - DNA, 25 bp, Homo sapien
gtgatccatttctgatatgtcttga

SEQ ID NO: 143486 - DNA, 25 bp, Homo sapien
ctgatatgtcttgaactactgtgtc

SEQ ID NO: 143487 - DNA, 25 bp, Homo sapien
actgtgtctagtaggcaaatgtcat

SEQ ID NO: 143488 - DNA, 25 bp, Homo sapien
aaatgtcattgttacctctgtgtgt

SEQ ID NO: 143489 - DNA, 25 bp, Homo sapien
cttctctgacacttgggttgggggc

SEQ ID NO: 143490 - DNA, 25 bp, Homo sapien
tggttagtggcttcaaaggcccagc

SEQ ID NO: 143491 - DNA, 25 bp, Homo sapien
ttagtggcttcaaaggcccagctga

SEQ ID NO: 143492 - DNA, 25 bp, Homo sapien
agtggcttcaaaggcccagctgaca

SEQ ID NO: 143493 - DNA, 25 bp, Homo sapien
gctgacaccctccacagcctaaggg

SEQ ID NO: 143494 - DNA, 25 bp, Homo sapien
ggtgtcctaaagtgcctccccctgt

SEQ ID NO: 143495 - DNA, 25 bp, Homo sapien
agcacaaaaccccaggaccctggct

SEQ ID NO: 143496 - DNA, 25 bp, Homo sapien
ggcagggacttttgagtttaggatc

SEQ ID NO: 143497 - DNA, 25 bp, Homo sapien
ggatctgtattttctaagtccccag

SEQ ID NO: 143498 - DNA, 25 bp, Homo sapien
tgtattttctaagtccccagttctc

SEQ ID NO: 143499 - DNA, 25 bp, Homo sapien
tattttctaagtccccagttctcct

SEQ ID NO: 143500 - DNA, 25 bp, Homo sapien
gttatcaaccagaagctaaaggatg

SEQ ID NO: 143501 - DNA, 25 bp, Homo sapien
gatgaggttgctcagctcaagaaaa

SEQ ID NO: 143502 - DNA, 25 bp, Homo sapien
gttgctcagctcaagaaaagtgcag

SEQ ID NO: 143503 - DNA, 25 bp, Homo sapien
aaagtgcagataccctgtgggacat

SEQ ID NO: 143504 - DNA, 25 bp, Homo sapien
aaggacctaaaagacctgtgactag

SEQ ID NO: 143505 - DNA, 25 bp, Homo sapien
tttagttttcatccatgtacatgga

SEQ ID NO: 143506 - DNA, 25 bp, Homo sapien
gaatcaaagcctatgcttggtagct

SEQ ID NO: 143507 - DNA, 25 bp, Homo sapien
atcaaagcctatgcttggtagctct

SEQ ID NO: 143508 - DNA, 25 bp, Homo sapien
aagtcttcctgagccttccatgtat

SEQ ID NO: 143509 - DNA, 25 bp, Homo sapien
tgagccttccatgtatcctcaatgc

SEQ ID NO: 143510 - DNA, 25 bp, Homo sapien
attaaccagcgttatcaaccagaag

SEQ ID NO: 143511 - DNA, 25 bp, Homo sapien
gaccgcctctgcctgtttgtggtga

SEQ ID NO: 143512 - DNA, 25 bp, Homo sapien
gcctgtttgtggtgacgcctgtcat

SEQ ID NO: 143513 - DNA, 25 bp, Homo sapien
gtgggcacagcctggatcttcctgc

SEQ ID NO: 143514 - DNA, 25 bp, Homo sapien
ggatcttcctgcagggcgtttacaa

SEQ ID NO: 143515 - DNA, 25 bp, Homo sapien
gcagggcgtttacaaccagccacca

SEQ ID NO: 143516 - DNA, 25 bp, Homo sapien
tactcctacaacgtgcaggacaagc

SEQ ID NO: 143517 - DNA, 25 bp, Homo sapien
caggacaagcgcttcatctagggtg

SEQ ID NO: 143518 - DNA, 25 bp, Homo sapien
aagcgcttcatctagggtgggcctg

SEQ ID NO: 143519 - DNA, 25 bp, Homo sapien
agcagggtctgagagaggagccaca

SEQ ID NO: 143520 - DNA, 25 bp, Homo sapien
ggagggagcagccactcctcaatgc

SEQ ID NO: 143521 - DNA, 25 bp, Homo sapien
gcagccactcctcaatgctcaatgg

SEQ ID NO: 143522 - DNA, 25 bp, Homo sapien
acacacagagtcaggccgttgctag

SEQ ID NO: 143523 - DNA, 25 bp, Homo sapien
gagtcaggccgttgctagtcagttc

SEQ ID NO: 143524 - DNA, 25 bp, Homo sapien
ccgttgctagtcagttctcttcttt

SEQ ID NO: 143525 - DNA, 25 bp, Homo sapien
tctaccactatagatgagggtgagg

SEQ ID NO: 143526 - DNA, 25 bp, Homo sapien
gagtagggagtgcagccctgagcct

SEQ ID NO: 143527 - DNA, 25 bp, Homo sapien
gcccactcctcattacgaaatgact

SEQ ID NO: 143528 - DNA, 25 bp, Homo sapien
aaatctattgtatctacctgcagtc

SEQ ID NO: 143529 - DNA, 25 bp, Homo sapien
tattgtatctacctgcagtctccat

SEQ ID NO: 143530 - DNA, 25 bp, Homo sapien
gcagtctccattgtttccagagtga

SEQ ID NO: 143531 - DNA, 25 bp, Homo sapien
tccattgtttccagagtgaacttgt

SEQ ID NO: 143532 - DNA, 25 bp, Homo sapien
gagtgaacttgtaattatcttgtta

SEQ ID NO: 143533 - DNA, 25 bp, Homo sapien
aatagatccattgatgccttcaagg

SEQ ID NO: 143534 - DNA, 25 bp, Homo sapien
gccttcaaggactttgtagtggcat

SEQ ID NO: 143535 - DNA, 25 bp, Homo sapien
aggactttgtagtggcatctgaaac

SEQ ID NO: 143536 - DNA, 25 bp, Homo sapien
gtgtggtttcttcaacattaagtcc

SEQ ID NO: 143537 - DNA, 25 bp, Homo sapien
gtttcttcaacattaagtcctgaga

SEQ ID NO: 143538 - DNA, 25 bp, Homo sapien
ggagactccagcctacactgggcag

SEQ ID NO: 143539 - DNA, 25 bp, Homo sapien
acactgggcagccatggcattgcca

SEQ ID NO: 143540 - DNA, 25 bp, Homo sapien
gcattgccagcattgttttctctta

SEQ ID NO: 143541 - DNA, 25 bp, Homo sapien
tgccagcattgttttctcttataat

SEQ ID NO: 143542 - DNA, 25 bp, Homo sapien
gttttctcttataattggctttgct

SEQ ID NO: 143543 - DNA, 25 bp, Homo sapien
cagccaagtcttacaagggcagttg

SEQ ID NO: 143544 - DNA, 25 bp, Homo sapien
aattggtctttcttagaatggtcta

SEQ ID NO: 143545 - DNA, 25 bp, Homo sapien
gaatggtctagttaagttccacatg

SEQ ID NO: 143546 - DNA, 25 bp, Homo sapien
agttaagttccacatgtagcataat

SEQ ID NO: 143547 - DNA, 25 bp, Homo sapien
gttccacatgtagcataattcttaa

SEQ ID NO: 143548 - DNA, 25 bp, Homo sapien
aattcttaaataggcacttttctgt

SEQ ID NO: 143549 - DNA, 25 bp, Homo sapien
ttcttactgtgggatttcatttcaa

SEQ ID NO: 143550 - DNA, 25 bp, Homo sapien
acattgtctatctgctttttcggag

SEQ ID NO: 143551 - DNA, 25 bp, Homo sapien
ctgctttttcggagattttccttct

SEQ ID NO: 143552 - DNA, 25 bp, Homo sapien
agattttccttcttacactgttaat

SEQ ID NO: 143553 - DNA, 25 bp, Homo sapien
tactttatttttgtgagttggctac

SEQ ID NO: 143554 - DNA, 25 bp, Homo sapien
tttttgtgagttggctactatttac

SEQ ID NO: 143555 - DNA, 25 bp, Homo sapien
tagtgcaaagatgcttatctggaac

SEQ ID NO: 143556 - DNA, 25 bp, Homo sapien
gatgcttatctggaactgtgttctg

SEQ ID NO: 143557 - DNA, 25 bp, Homo sapien
aactgtgttctggtgaaagaaccaa

SEQ ID NO: 143558 - DNA, 25 bp, Homo sapien
gaaccaaattactggcttgttagcc

SEQ ID NO: 143559 - DNA, 25 bp, Homo sapien
ggcttgttagccaacagcttctgat

SEQ ID NO: 143560 - DNA, 25 bp, Homo sapien
tagccaacagcttctgatagcaatt

SEQ ID NO: 143561 - DNA, 25 bp, Homo sapien
gatagcaattcatataaccctctaa

SEQ ID NO: 143562 - DNA, 25 bp, Homo sapien
tataaccctctaagaatacctgttt

SEQ ID NO: 143563 - DNA, 25 bp, Homo sapien
gaatacctgtttaagtcttgagtgt

SEQ ID NO: 143564 - DNA, 25 bp, Homo sapien
aacagttgaatgtcagactctcatt

SEQ ID NO: 143565 - DNA, 25 bp, Homo sapien
gactctcatttgtatgtgatctaaa

SEQ ID NO: 143566 - DNA, 25 bp, Homo sapien
cctggcagcaagagctctaccgcaa

SEQ ID NO: 143567 - DNA, 25 bp, Homo sapien
ctctaccgcaacttcaaaagcatct

SEQ ID NO: 143568 - DNA, 25 bp, Homo sapien
taccgcaacttcaaaagcatctcca

SEQ ID NO: 143569 - DNA, 25 bp, Homo sapien
cagcaacccacttggcttctgaata

SEQ ID NO: 143570 - DNA, 25 bp, Homo sapien
aacccacttggcttctgaatactcc

SEQ ID NO: 143571 - DNA, 25 bp, Homo sapien
ttggcttctgaatactcccggccag

SEQ ID NO: 143572 - DNA, 25 bp, Homo sapien
gcttctgaatactcccggccagggc

SEQ ID NO: 143573 - DNA, 25 bp, Homo sapien
ttccctcaagccaaagccgaagccc

SEQ ID NO: 143574 - DNA, 25 bp, Homo sapien
tagtgttcccagcactgtgcctgct

SEQ ID NO: 143575 - DNA, 25 bp, Homo sapien
agcactgtgcctgctctcaagagca

SEQ ID NO: 143576 - DNA, 25 bp, Homo sapien
gtgcctgctctcaagagcacttact

SEQ ID NO: 143577 - DNA, 25 bp, Homo sapien
ttgtatctattatgtgtcacttcca

SEQ ID NO: 143578 - DNA, 25 bp, Homo sapien
aacactctccatactcattcttgtg

SEQ ID NO: 143579 - DNA, 25 bp, Homo sapien
tactcattcttgtgattctcctcta

SEQ ID NO: 143580 - DNA, 25 bp, Homo sapien
gtgattctcctctagccatatatat

SEQ ID NO: 143581 - DNA, 25 bp, Homo sapien
atatgggccccatcactgttctgtt

SEQ ID NO: 143582 - DNA, 25 bp, Homo sapien
ttctgttccctccatctatgcacaa

SEQ ID NO: 143583 - DNA, 25 bp, Homo sapien
actctctctaaacctgtaactttct

SEQ ID NO: 143584 - DNA, 25 bp, Homo sapien
aacctgtaactttctgactgtcctg

SEQ ID NO: 143585 - DNA, 25 bp, Homo sapien
actgtgtttgggactgtatctcagc

SEQ ID NO: 143586 - DNA, 25 bp, Homo sapien
gtatctcagcaatcacttgttaatg

SEQ ID NO: 143587 - DNA, 25 bp, Homo sapien
atttgggtcaaatgagaggcctcaa

SEQ ID NO: 143588 - DNA, 25 bp, Homo sapien
aaaactcaatcattttattcagcaa

SEQ ID NO: 143589 - DNA, 25 bp, Homo sapien
caactggatgttgactgttaactag

SEQ ID NO: 143590 - DNA, 25 bp, Homo sapien
gttaactagaagctctgtcctactt

SEQ ID NO: 143591 - DNA, 25 bp, Homo sapien
aagctctgtcctacttacagcactt

SEQ ID NO: 143592 - DNA, 25 bp, Homo sapien
tacagcactttggatcatcaaaaaa

SEQ ID NO: 143593 - DNA, 25 bp, Homo sapien
gagaaaactcaatccatgaccaggg

SEQ ID NO: 143594 - DNA, 25 bp, Homo sapien
tgaccagggagaacttacaggatgt

SEQ ID NO: 143595 - DNA, 25 bp, Homo sapien
tgaaacaatcaacgcccaataaaac

SEQ ID NO: 143596 - DNA, 25 bp, Homo sapien
gaaaattctcttagttctttgataa

SEQ ID NO: 143597 - DNA, 25 bp, Homo sapien
gataacaatttgttcactcatagaa

SEQ ID NO: 143598 - DNA, 25 bp, Homo sapien
ttggtagggtaagcagacactctga

SEQ ID NO: 143599 - DNA, 25 bp, Homo sapien
gggacccacatgctccagattagag

SEQ ID NO: 143600 - DNA, 25 bp, Homo sapien
gagcctgtaaactttatcacttaaa

SEQ ID NO: 143601 - DNA, 25 bp, Homo sapien
taaacttgcatcacttaacggacca

SEQ ID NO: 143602 - DNA, 25 bp, Homo sapien
ggaccaaagcaagaccctaaacatc

SEQ ID NO: 143603 - DNA, 25 bp, Homo sapien
gaccctaaacatccataattgtgat

SEQ ID NO: 143604 - DNA, 25 bp, Homo sapien
gtgattagacagaacacctatgcaa

SEQ ID NO: 143605 - DNA, 25 bp, Homo sapien
tatgcaaagatgaacccgaggctga

SEQ ID NO: 143606 - DNA, 25 bp, Homo sapien
gactgacagtttacagacgctgctg

SEQ ID NO: 143607 - DNA, 25 bp, Homo sapien
gacgctgctgtcacaaccaagaatg

SEQ ID NO: 143608 - DNA, 25 bp, Homo sapien
gaatgttatgtgcaagtttatcagt

SEQ ID NO: 143609 - DNA, 25 bp, Homo sapien
acagatcatcttggaactgcattct

SEQ ID NO: 143610 - DNA, 25 bp, Homo sapien
tttttcaactgccaatcaaggctag

SEQ ID NO: 143611 - DNA, 25 bp, Homo sapien
aatcaaggctaggaggctcgaccac

SEQ ID NO: 143612 - DNA, 25 bp, Homo sapien
ggctcgaccacctcaacattggaga

SEQ ID NO: 143613 - DNA, 25 bp, Homo sapien
ggagacatcacttgccaatgtacat

SEQ ID NO: 143614 - DNA, 25 bp, Homo sapien
gtacataccttgttatatgcagaca

SEQ ID NO: 143615 - DNA, 25 bp, Homo sapien
agacatgtatttcttacgtacactg

SEQ ID NO: 143616 - DNA, 25 bp, Homo sapien
acgtacactgtacttctgtgtgcaa

SEQ ID NO: 143617 - DNA, 25 bp, Homo sapien
gtacttctgtgtgcaattgtaaaca

SEQ ID NO: 143618 - DNA, 25 bp, Homo sapien
ggtggtattcagtggtccaggattc

SEQ ID NO: 143619 - DNA, 25 bp, Homo sapien
gtggtccaggattctgtaatgcttt

SEQ ID NO: 143620 - DNA, 25 bp, Homo sapien
gtaatgctttacacaggcagttttg

SEQ ID NO: 143621 - DNA, 25 bp, Homo sapien
tgcctgtttttcaatctcatctgat

SEQ ID NO: 143622 - DNA, 25 bp, Homo sapien
ttttcaatctcatctgatatgcaga

SEQ ID NO: 143623 - DNA, 25 bp, Homo sapien
aaaagctgaagcctatttatttgaa

SEQ ID NO: 143624 - DNA, 25 bp, Homo sapien
gctgaagcctatttatttgaaagtc

SEQ ID NO: 143625 - DNA, 25 bp, Homo sapien
gcctatttatttgaaagtccttgtt

SEQ ID NO: 143626 - DNA, 25 bp, Homo sapien
tagtataccatacattatcattcaa

SEQ ID NO: 143627 - DNA, 25 bp, Homo sapien
atacattatcattcaaaacaaccat

SEQ ID NO: 143628 - DNA, 25 bp, Homo sapien
aaaacaaccatcctgctcataacat

SEQ ID NO: 143629 - DNA, 25 bp, Homo sapien
aaccatcctgctcataacatctttg

SEQ ID NO: 143630 - DNA, 25 bp, Homo sapien
catcctgctcataacatctttgaaa

SEQ ID NO: 143631 - DNA, 25 bp, Homo sapien
cctgctcataacatctttgaaaaga

SEQ ID NO: 143632 - DNA, 25 bp, Homo sapien
tgataaaggctttacatggttgtca

SEQ ID NO: 143633 - DNA, 25 bp, Homo sapien
gataaaggctttacatggttgtcac

SEQ ID NO: 143634 - DNA, 25 bp, Homo sapien
ataaaggctttacatggttgtcaca

SEQ ID NO: 143635 - DNA, 25 bp, Homo sapien
taaaggctttacatggttgtcacac

SEQ ID NO: 143636 - DNA, 25 bp, Homo sapien
atttacattggagtaaacttctaca

SEQ ID NO: 143637 - DNA, 25 bp, Homo sapien
tttacattggagtaaacttctacaa

SEQ ID NO: 143638 - DNA, 25 bp, Homo sapien
ttacattggagtaaacttctacaag

SEQ ID NO: 143639 - DNA, 25 bp, Homo sapien
tacattggagtaaacttctacaagt

SEQ ID NO: 143640 - DNA, 25 bp, Homo sapien
acattggagtaaacttctacaagtg

SEQ ID NO: 143641 - DNA, 25 bp, Homo sapien
ttacttggaaaaaggtatatacaca

SEQ ID NO: 143642 - DNA, 25 bp, Homo sapien
ggaaaaaggtatatacacaaagaat

SEQ ID NO: 143643 - DNA, 25 bp, Homo sapien
gattgtggccttctttgagttcggt

SEQ ID NO: 143644 - DNA, 25 bp, Homo sapien
gtcaaccgggagatgtcgcccctgg

SEQ ID NO: 143645 - DNA, 25 bp, Homo sapien
tggtggacaacatcgccctgtggat

SEQ ID NO: 143646 - DNA, 25 bp, Homo sapien
atcgccctgtggatgactgagtacc

SEQ ID NO: 143647 - DNA, 25 bp, Homo sapien
atgactgagtacctgaaccggcacc

SEQ ID NO: 143648 - DNA, 25 bp, Homo sapien
gcacctgcacacctggatccaggat

SEQ ID NO: 143649 - DNA, 25 bp, Homo sapien
gaggctgggtaggtgcatctggtga

SEQ ID NO: 143650 - DNA, 25 bp, Homo sapien
ctgaggccacaggtccgagatcggg

SEQ ID NO: 143651 - DNA, 25 bp, Homo sapien
gtggagccggcgaaataaaatcaga

SEQ ID NO: 143652 - DNA, 25 bp, Homo sapien
aaaatcagagttgttgcttcccggc

SEQ ID NO: 143653 - DNA, 25 bp, Homo sapien
agagttgttgcttcccggcgtgtcc

SEQ ID NO: 143654 - DNA, 25 bp, Homo sapien
gctccccacaggacttggacagagg

SEQ ID NO: 143655 - DNA, 25 bp, Homo sapien
acaggacttggacagagggcccaca

SEQ ID NO: 143656 - DNA, 25 bp, Homo sapien
gcatttgtcccctccatgctataat

SEQ ID NO: 143657 - DNA, 25 bp, Homo sapien
tcccctccatgctataatccagtgg

SEQ ID NO: 143658 - DNA, 25 bp, Homo sapien
catgctataatccagtggtgcctta

SEQ ID NO: 143659 - DNA, 25 bp, Homo sapien
ataatccagtggtgccttacatggt

SEQ ID NO: 143660 - DNA, 25 bp, Homo sapien
cagtggtgccttacatggtgtgtgt

SEQ ID NO: 143661 - DNA, 25 bp, Homo sapien
gaggcacaggcacaaagcattgctt

SEQ ID NO: 143662 - DNA, 25 bp, Homo sapien
caaagcattgcttgggttggtcaaa

SEQ ID NO: 143663 - DNA, 25 bp, Homo sapien
gggttggtcaaatgtcttgtgtcat

SEQ ID NO: 143664 - DNA, 25 bp, Homo sapien
ggtcaaatgtcttgtgtcataaata

SEQ ID NO: 143665 - DNA, 25 bp, Homo sapien
caagaaagcctcttcttgttgccta

SEQ ID NO: 143666 - DNA, 25 bp, Homo sapien
tcttgttgcctagctgagtgggaga

SEQ ID NO: 143667 - DNA, 25 bp, Homo sapien
ttccccagacactacatttggatac

SEQ ID NO: 143668 - DNA, 25 bp, Homo sapien
acactacatttggatacaggtgcca

SEQ ID NO: 143669 - DNA, 25 bp, Homo sapien
agtggttttcagtattgtgacaata

SEQ ID NO: 143670 - DNA, 25 bp, Homo sapien
ttacaaggttgttttctaccaccat

SEQ ID NO: 143671 - DNA, 25 bp, Homo sapien
tgttttctaccaccatattttaaag

SEQ ID NO: 143672 - DNA, 25 bp, Homo sapien
gatatttttatgaccgtgtatactc

SEQ ID NO: 143673 - DNA, 25 bp, Homo sapien
gtgtatactcacactttgcttgtat

SEQ ID NO: 143674 - DNA, 25 bp, Homo sapien
aaaggaggatatatttgcacttatg

SEQ ID NO: 143675 - DNA, 25 bp, Homo sapien
gtatacttttacagtttgccaaaat

SEQ ID NO: 143676 - DNA, 25 bp, Homo sapien
tgtggccttctttgagttcggtggg

SEQ ID NO: 143677 - DNA, 25 bp, Homo sapien
gcgtcaaccgggagatgtcgcccct

SEQ ID NO: 143678 - DNA, 25 bp, Homo sapien
caaccgggagatgtcgcccctggtg

SEQ ID NO: 143679 - DNA, 25 bp, Homo sapien
aacatcgccctgtggatgactgagt

SEQ ID NO: 143680 - DNA, 25 bp, Homo sapien
atcgccctgtggatgactgagtacc

SEQ ID NO: 143681 - DNA, 25 bp, Homo sapien
gccctgtggatgactgagtacctga

SEQ ID NO: 143682 - DNA, 25 bp, Homo sapien
tggatgactgagtacctgaaccggc

SEQ ID NO: 143683 - DNA, 25 bp, Homo sapien
gatgactgagtacctgaaccggcac

SEQ ID NO: 143684 - DNA, 25 bp, Homo sapien
tgactgagtacctgaaccggcacct

SEQ ID NO: 143685 - DNA, 25 bp, Homo sapien
gcacctgcacacctggatccaggat

SEQ ID NO: 143686 - DNA, 25 bp, Homo sapien
ctggatccaggataacggaggctgg

SEQ ID NO: 143687 - DNA, 25 bp, Homo sapien
ggcatcctgcagtgggccatccaga

SEQ ID NO: 143688 - DNA, 25 bp, Homo sapien
tcctgaccccagatggccgggacat

SEQ ID NO: 143689 - DNA, 25 bp, Homo sapien
tggccgggacatgcagctctgatga

SEQ ID NO: 143690 - DNA, 25 bp, Homo sapien
gagagtgctgagaaggacacctcct

SEQ ID NO: 143691 - DNA, 25 bp, Homo sapien
ctcagtcctggaagccggccggctg

SEQ ID NO: 143692 - DNA, 25 bp, Homo sapien
gggacagcgccacctcttgtcagtg

SEQ ID NO: 143693 - DNA, 25 bp, Homo sapien
tcttgtcagtgctcggctgtaaaca

SEQ ID NO: 143694 - DNA, 25 bp, Homo sapien
gctcggctgtaaacagctctgtgtt

SEQ ID NO: 143695 - DNA, 25 bp, Homo sapien
gacaccagccatcatgtgcctggaa

SEQ ID NO: 143696 - DNA, 25 bp, Homo sapien
tgtgcctggaaattaaaccctgccc

SEQ ID NO: 143697 - DNA, 25 bp, Homo sapien
ttctctactctggaagtccccggga

SEQ ID NO: 143698 - DNA, 25 bp, Homo sapien
gaggaatctgtttgcttcctgatta

SEQ ID NO: 143699 - DNA, 25 bp, Homo sapien
gtttgcttcctgattagatccagtc

SEQ ID NO: 143700 - DNA, 25 bp, Homo sapien
agatccagtcaatgttttaaaggta

SEQ ID NO: 143701 - DNA, 25 bp, Homo sapien
cagagggtctgtactagccatgcaa

SEQ ID NO: 143702 - DNA, 25 bp, Homo sapien
tagccatgcaaggagtcgctctagc

SEQ ID NO: 143703 - DNA, 25 bp, Homo sapien
tcgctctagctggtacccgtaaaag

SEQ ID NO: 143704 - DNA, 25 bp, Homo sapien
gggatgccaaaatttctctcattct

SEQ ID NO: 143705 - DNA, 25 bp, Homo sapien
taaacttaacattagccagggaggt

SEQ ID NO: 143706 - DNA, 25 bp, Homo sapien
ggttctggctaacgttaaatgctgc

SEQ ID NO: 143707 - DNA, 25 bp, Homo sapien
aaatgctgctatacaactgctttgc

SEQ ID NO: 143708 - DNA, 25 bp, Homo sapien
acaactgctttgcaacagttgctgg

SEQ ID NO: 143709 - DNA, 25 bp, Homo sapien
gtatgtttacatatcacctcatggc

SEQ ID NO: 143710 - DNA, 25 bp, Homo sapien
tgtttacatatcacctcatggccta

SEQ ID NO: 143711 - DNA, 25 bp, Homo sapien
ttacatatcacctcatggcctatta

SEQ ID NO: 143712 - DNA, 25 bp, Homo sapien
acatatcacctcatggcctattata

SEQ ID NO: 143713 - DNA, 25 bp, Homo sapien
atatcacctcatggcctattatatt

SEQ ID NO: 143714 - DNA, 25 bp, Homo sapien
gatgatctactcagaaatttttatt

SEQ ID NO: 143715 - DNA, 25 bp, Homo sapien
aggaaaagtacatttaatacagcag

SEQ ID NO: 143716 - DNA, 25 bp, Homo sapien
aatacagcagtgtcatcagaagata

SEQ ID NO: 143717 - DNA, 25 bp, Homo sapien
tttcactggagttacattaatgtta

SEQ ID NO: 143718 - DNA, 25 bp, Homo sapien
aattcagcactgatttcacaacaga

SEQ ID NO: 143719 - DNA, 25 bp, Homo sapien
gcactgatttcacaacagatcaatt

SEQ ID NO: 143720 - DNA, 25 bp, Homo sapien
agtcttctttccaggtcaccacttg

SEQ ID NO: 143721 - DNA, 25 bp, Homo sapien
aggtcaccacttgcaagctacatgg

SEQ ID NO: 143722 - DNA, 25 bp, Homo sapien
agaaacgttgttgttgcttgtgaaa

SEQ ID NO: 143723 - DNA, 25 bp, Homo sapien
gtgaaaatggcttacctgtccactt

SEQ ID NO: 143724 - DNA, 25 bp, Homo sapien
ttacctgtccacttggatcagtcaa

SEQ ID NO: 143725 - DNA, 25 bp, Homo sapien
tggatcagtcaattttccgtcgtcc

SEQ ID NO: 143726 - DNA, 25 bp, Homo sapien
tcaattttccgtcgtccgtaaccag

SEQ ID NO: 143727 - DNA, 25 bp, Homo sapien
ccctggtcaagtgctggctctgctg

SEQ ID NO: 143728 - DNA, 25 bp, Homo sapien
acccagaacagtggtggcaacattc

SEQ ID NO: 143729 - DNA, 25 bp, Homo sapien
aacattcattgccaagggcccaaag

SEQ ID NO: 143730 - DNA, 25 bp, Homo sapien
caaagaaagagctacctggaccttt

SEQ ID NO: 143731 - DNA, 25 bp, Homo sapien
aaaaacgaagtgctctcagtcaggt

SEQ ID NO: 143732 - DNA, 25 bp, Homo sapien
tctcagtcaggtttttccctccata

SEQ ID NO: 143733 - DNA, 25 bp, Homo sapien
tttccctccatatttttggtcactt

SEQ ID NO: 143734 - DNA, 25 bp, Homo sapien
ggtcacttttgataagtttgcatga

SEQ ID NO: 143735 - DNA, 25 bp, Homo sapien
agtttgcatgaaaccattttggtgc

SEQ ID NO: 143736 - DNA, 25 bp, Homo sapien
tttttgtaaatccacccagtgaaca

SEQ ID NO: 143737 - DNA, 25 bp, Homo sapien
atccacccagtgaacatgaaattgt

SEQ ID NO: 143738 - DNA, 25 bp, Homo sapien
gttttaatttgaattgcctgttcag

SEQ ID NO: 143739 - DNA, 25 bp, Homo sapien
gaattgcctgttcagggttccttat

SEQ ID NO: 143740 - DNA, 25 bp, Homo sapien
gcctgttcagggttccttatgcaga

SEQ ID NO: 143741 - DNA, 25 bp, Homo sapien
tcagggttccttatgcagagaaata

SEQ ID NO: 143742 - DNA, 25 bp, Homo sapien
ctggataaacttgcttcagactttt

SEQ ID NO: 143743 - DNA, 25 bp, Homo sapien
ttaaattcctgcttaatgtcagtct

SEQ ID NO: 143744 - DNA, 25 bp, Homo sapien
tgtcagtctacaggcctttcaggaa

SEQ ID NO: 143745 - DNA, 25 bp, Homo sapien
ggagggaatcgtacattttgcttgc

SEQ ID NO: 143746 - DNA, 25 bp, Homo sapien
tacattttgcttgcgtgctgggaca

SEQ ID NO: 143747 - DNA, 25 bp, Homo sapien
agctaggctgagatgcaccaagtac

SEQ ID NO: 143748 - DNA, 25 bp, Homo sapien
agccttcactggagaccggaattga

SEQ ID NO: 143749 - DNA, 25 bp, Homo sapien
cagagggtgtcgtcctgcagtatga

SEQ ID NO: 143750 - DNA, 25 bp, Homo sapien
gtcgtcctgcagtatgagatttctc

SEQ ID NO: 143751 - DNA, 25 bp, Homo sapien
atgagatttctcattgatcacagat

SEQ ID NO: 143752 - DNA, 25 bp, Homo sapien
gagtagcccaggtcactgttaacta

SEQ ID NO: 143753 - DNA, 25 bp, Homo sapien
gaagttaggtcaaacgcacctcgcc

SEQ ID NO: 143754 - DNA, 25 bp, Homo sapien
acctcgccctgatgaatttctcttg

SEQ ID NO: 143755 - DNA, 25 bp, Homo sapien
cctgatgaatttctcttgggctatg

SEQ ID NO: 143756 - DNA, 25 bp, Homo sapien
tctcttgggctatggatttagatcc

SEQ ID NO: 143757 - DNA, 25 bp, Homo sapien
gatcctaaaggagccaataaccaga

SEQ ID NO: 143758 - DNA, 25 bp, Homo sapien
gataagcgttatcttccagatgatg

SEQ ID NO: 143759 - DNA, 25 bp, Homo sapien
gatgaggagccaataacccaagaag

SEQ ID NO: 143760 - DNA, 25 bp, Homo sapien
acagatgaatcccaggagagcagca

SEQ ID NO: 143761 - DNA, 25 bp, Homo sapien
gacagatgcggatgacacacaactt

SEQ ID NO: 143762 - DNA, 25 bp, Homo sapien
ggatgacacacaacttcatgcagct

SEQ ID NO: 143763 - DNA, 25 bp, Homo sapien
ggaaatcagacttttacaactggat

SEQ ID NO: 143764 - DNA, 25 bp, Homo sapien
agcctggtgcccagtgctcaggcca

SEQ ID NO: 143765 - DNA, 25 bp, Homo sapien
tgcagcctcggcagggcaggtacag

SEQ ID NO: 143766 - DNA, 25 bp, Homo sapien
ggccacctcggatgggagcctgggt

SEQ ID NO: 143767 - DNA, 25 bp, Homo sapien
gacctgggcgtcagccgtggaaccc

SEQ ID NO: 143768 - DNA, 25 bp, Homo sapien
ctggagtctgcctgagtccctcgag

SEQ ID NO: 143769 - DNA, 25 bp, Homo sapien
ggagtctgcctgagtccctcgagcc

SEQ ID NO: 143770 - DNA, 25 bp, Homo sapien
gagccgcgagccttcgctgaagtgc

SEQ ID NO: 143771 - DNA, 25 bp, Homo sapien
gcgagccttcgctgaagtgcccttg

SEQ ID NO: 143772 - DNA, 25 bp, Homo sapien
cttcgctgaagtgcccttgctataa

SEQ ID NO: 143773 - DNA, 25 bp, Homo sapien
gctgaagtgcccttgctataacccc

SEQ ID NO: 143774 - DNA, 25 bp, Homo sapien
ctctgcttctggtgtgtgacgaggc

SEQ ID NO: 143775 - DNA, 25 bp, Homo sapien
gtgcccagcgacaatcactgaacgc

SEQ ID NO: 143776 - DNA, 25 bp, Homo sapien
cagcgacaatcactgaacgccgaag

SEQ ID NO: 143777 - DNA, 25 bp, Homo sapien
gacaatcactgaacgccgaagcctg

SEQ ID NO: 143778 - DNA, 25 bp, Homo sapien
acaatcactgaacgccgaagcctgc

SEQ ID NO: 143779 - DNA, 25 bp, Homo sapien
agcaggcccagcagatacgcctgca

SEQ ID NO: 143780 - DNA, 25 bp, Homo sapien
ttccaggcccgcctcaagagctggt

SEQ ID NO: 143781 - DNA, 25 bp, Homo sapien
aggcccgcctcaagagctggttcga

SEQ ID NO: 143782 - DNA, 25 bp, Homo sapien
gcccgcctcaagagctggttcgagc

SEQ ID NO: 143783 - DNA, 25 bp, Homo sapien
ctcaagagctggttcgagcccctgg

SEQ ID NO: 143784 - DNA, 25 bp, Homo sapien
ggaagacatgcagcgccagtgggcc

SEQ ID NO: 143785 - DNA, 25 bp, Homo sapien
gtgcaggctgccgtgggcaccagcg

SEQ ID NO: 143786 - DNA, 25 bp, Homo sapien
gatggcaaggcgtgaagccaccctg

SEQ ID NO: 143787 - DNA, 25 bp, Homo sapien
agccaccctggaaggaactggacca

SEQ ID NO: 143788 - DNA, 25 bp, Homo sapien
gaccaaggtcttcagaggtgcgaca

SEQ ID NO: 143789 - DNA, 25 bp, Homo sapien
gggtctggaatctgaccttactcta

SEQ ID NO: 143790 - DNA, 25 bp, Homo sapien
gaatctgaccttactctagcaggag

SEQ ID NO: 143791 - DNA, 25 bp, Homo sapien
gcaggagtttttgtagactctccct

SEQ ID NO: 143792 - DNA, 25 bp, Homo sapien
gactctccctgatagtttagttttt

SEQ ID NO: 143793 - DNA, 25 bp, Homo sapien
gtaaaaccactaccctcagagagag

SEQ ID NO: 143794 - DNA, 25 bp, Homo sapien
gaagaggcggagagcgcccctccaa

SEQ ID NO: 143795 - DNA, 25 bp, Homo sapien
aaccaggctgttattcccctggact

SEQ ID NO: 143796 - DNA, 25 bp, Homo sapien
cctggactccgtgacatctgtggaa

SEQ ID NO: 143797 - DNA, 25 bp, Homo sapien
aaaagaggctgtgttttgtcacaca

SEQ ID NO: 143798 - DNA, 25 bp, Homo sapien
gtcacacagggcagtcattcagcac

SEQ ID NO: 143799 - DNA, 25 bp, Homo sapien
cattcagcaccagagcacgtgatgg

SEQ ID NO: 143800 - DNA, 25 bp, Homo sapien
gagcacgtgatggtctgagactctc

SEQ ID NO: 143801 - DNA, 25 bp, Homo sapien
gagactctcttaggagcagagctct

SEQ ID NO: 143802 - DNA, 25 bp, Homo sapien
agagctctgccgcaatggccatgtg

SEQ ID NO: 143803 - DNA, 25 bp, Homo sapien
agagcggccctatgcatggtgtaga

SEQ ID NO: 143804 - DNA, 25 bp, Homo sapien
tgccctgataaagaacatctgtcct

SEQ ID NO: 143805 - DNA, 25 bp, Homo sapien
acatctgtcctgtgaaagactcaat

SEQ ID NO: 143806 - DNA, 25 bp, Homo sapien
gactcaatgagctgttatgttgtaa

SEQ ID NO: 143807 - DNA, 25 bp, Homo sapien
atgtaaacatgtgtcttttctgtag

SEQ ID NO: 143808 - DNA, 25 bp, Homo sapien
ttgaaagaacatcagttcatgcctg

SEQ ID NO: 143809 - DNA, 25 bp, Homo sapien
ctgtgcatttgagatagttttccct

SEQ ID NO: 143810 - DNA, 25 bp, Homo sapien
gatagttttccctattctgtggata

SEQ ID NO: 143811 - DNA, 25 bp, Homo sapien
tattctgtggatacagtcccagagt

SEQ ID NO: 143812 - DNA, 25 bp, Homo sapien
agagttttcagggagtacacaggta

SEQ ID NO: 143813 - DNA, 25 bp, Homo sapien
acacaggtagattagtttgaagcat

SEQ ID NO: 143814 - DNA, 25 bp, Homo sapien
gattagtttgaagcattgacctttt

SEQ ID NO: 143815 - DNA, 25 bp, Homo sapien
gaagcattgaccttttatttattcc

SEQ ID NO: 143816 - DNA, 25 bp, Homo sapien
actatctctgtattgttctgaccct

SEQ ID NO: 143817 - DNA, 25 bp, Homo sapien
ctgtattgttctgaccctggtaaat

SEQ ID NO: 143818 - DNA, 25 bp, Homo sapien
gttctgaccctggtaaatatatttc

SEQ ID NO: 143819 - DNA, 25 bp, Homo sapien
gagtcagagatctgtgcacactttt

SEQ ID NO: 143820 - DNA, 25 bp, Homo sapien
gagatctgtgcacactttttaaaca

SEQ ID NO: 143821 - DNA, 25 bp, Homo sapien
cttgtgatgcaagtgtgagcctatt

SEQ ID NO: 143822 - DNA, 25 bp, Homo sapien
gagcctattgtgttacttgacctta

SEQ ID NO: 143823 - DNA, 25 bp, Homo sapien
gtgttacttgaccttattttggaag

SEQ ID NO: 143824 - DNA, 25 bp, Homo sapien
tttggaagttttgaattggcctagg

SEQ ID NO: 143825 - DNA, 25 bp, Homo sapien
ttggcctaggaggaaacccagaaat

SEQ ID NO: 143826 - DNA, 25 bp, Homo sapien
gaaccaggggtatgtcatcactttt

SEQ ID NO: 143827 - DNA, 25 bp, Homo sapien
acttttttcatatcaagtcctcacc

SEQ ID NO: 143828 - DNA, 25 bp, Homo sapien
accctccttccacataatgctttat

SEQ ID NO: 143829 - DNA, 25 bp, Homo sapien
cataatgctttatcctttaaggttg

SEQ ID NO: 143830 - DNA, 25 bp, Homo sapien
gagtagcaaagccacgctccccaca

SEQ ID NO: 143831 - DNA, 25 bp, Homo sapien
gcatttgtcccctccatgctataat

SEQ ID NO: 143832 - DNA, 25 bp, Homo sapien
tcccctccatgctataatccagtgg

SEQ ID NO: 143833 - DNA, 25 bp, Homo sapien
catgctataatccagtggtgcctta

SEQ ID NO: 143834 - DNA, 25 bp, Homo sapien
ataatccagtggtgccttacatggt

SEQ ID NO: 143835 - DNA, 25 bp, Homo sapien
cagtggtgccttacatggtgtgtgt

SEQ ID NO: 143836 - DNA, 25 bp, Homo sapien
gaggcacaggcacaaagcattgctt

SEQ ID NO: 143837 - DNA, 25 bp, Homo sapien
caaagcattgcttgggttggtcaaa

SEQ ID NO: 143838 - DNA, 25 bp, Homo sapien
attgcttgggttggtcaaatgtctt

SEQ ID NO: 143839 - DNA, 25 bp, Homo sapien
gggttggtcaaatgtcttgtgtcat

SEQ ID NO: 143840 - DNA, 25 bp, Homo sapien
ggtcaaatgtcttgtgtcataaata

SEQ ID NO: 143841 - DNA, 25 bp, Homo sapien
gatctcactgtctacagatgaccca

SEQ ID NO: 143842 - DNA, 25 bp, Homo sapien
agatgacccaatgcaattccacttt

SEQ ID NO: 143843 - DNA, 25 bp, Homo sapien
cactttaccaaggagcccctaatgg

SEQ ID NO: 143844 - DNA, 25 bp, Homo sapien
atgctattgctgcacaagtcttcaa

SEQ ID NO: 143845 - DNA, 25 bp, Homo sapien
aagtcttcaagctgagcacctgtga

SEQ ID NO: 143846 - DNA, 25 bp, Homo sapien
gtcttgcagtgtggaatttctcatg

SEQ ID NO: 143847 - DNA, 25 bp, Homo sapien
gtttctgggcgacaattaccttgag

SEQ ID NO: 143848 - DNA, 25 bp, Homo sapien
taccttgaggaaggccctgctggaa

SEQ ID NO: 143849 - DNA, 25 bp, Homo sapien
ggccctgctggaaatgatatccgga

SEQ ID NO: 143850 - DNA, 25 bp, Homo sapien
aaatgtagcccaaatccgcatggcc

SEQ ID NO: 143851 - DNA, 25 bp, Homo sapien
atggcctatcgctatgaaacctggt

SEQ ID NO: 143852 - DNA, 25 bp, Homo sapien
cgggacttgatttccaggcttctca

SEQ ID NO: 143853 - DNA, 25 bp, Homo sapien
ttctcagataccagcccttggagag

SEQ ID NO: 143854 - DNA, 25 bp, Homo sapien
ttcaggcccactcccgaagggtgct

SEQ ID NO: 143855 - DNA, 25 bp, Homo sapien
agctgctggtgggatatccaccctt

SEQ ID NO: 143856 - DNA, 25 bp, Homo sapien
gtgggatatccaccctttgagagcg

SEQ ID NO: 143857 - DNA, 25 bp, Homo sapien
tttgagagcgcctcccacagtgaga

SEQ ID NO: 143858 - DNA, 25 bp, Homo sapien
acagtgagacttacagacgcatcct

SEQ ID NO: 143859 - DNA, 25 bp, Homo sapien
gacttacagacgcatcctcaaggta

SEQ ID NO: 143860 - DNA, 25 bp, Homo sapien
agacgcatcctcaaggtagatgtga

SEQ ID NO: 143861 - DNA, 25 bp, Homo sapien
gtagatgtgaggtttccactatcaa

SEQ ID NO: 143862 - DNA, 25 bp, Homo sapien
aggtttccactatcaatgcctctgg

SEQ ID NO: 143863 - DNA, 25 bp, Homo sapien
ctttttattttgcactctgtaattg

SEQ ID NO: 143864 - DNA, 25 bp, Homo sapien
tgcactctgtaattgcactttttaa

SEQ ID NO: 143865 - DNA, 25 bp, Homo sapien
tgaagagccattttggtaaacggtt

SEQ ID NO: 143866 - DNA, 25 bp, Homo sapien
aacggtttttattaaagatgctatg

SEQ ID NO: 143867 - DNA, 25 bp, Homo sapien
tattgcatgcaatttaaagtaactt

SEQ ID NO: 143868 - DNA, 25 bp, Homo sapien
gactatgaatattatcggattactg

SEQ ID NO: 143869 - DNA, 25 bp, Homo sapien
attatcggattactgaattgtatca

SEQ ID NO: 143870 - DNA, 25 bp, Homo sapien
gaattgtatcaatttgtttgtgttc

SEQ ID NO: 143871 - DNA, 25 bp, Homo sapien
gtttgtgttcaatatcagctttgat

SEQ ID NO: 143872 - DNA, 25 bp, Homo sapien
agctttgataattgtgtaccttaag

SEQ ID NO: 143873 - DNA, 25 bp, Homo sapien
aattgtgtaccttaagatattgaag

SEQ ID NO: 143874 - DNA, 25 bp, Homo sapien
tgtccccagagacttccctgcatga

SEQ ID NO: 143875 - DNA, 25 bp, Homo sapien
tccccagagacttccctgcatgagg

SEQ ID NO: 143876 - DNA, 25 bp, Homo sapien
ccagagacttccctgcatgaggcac

SEQ ID NO: 143877 - DNA, 25 bp, Homo sapien
cagagacttccctgcatgaggcaca

SEQ ID NO: 143878 - DNA, 25 bp, Homo sapien
agagacttccctgcatgaggcacac

SEQ ID NO: 143879 - DNA, 25 bp, Homo sapien
aaccttcattccctctttgtgacgt

SEQ ID NO: 143880 - DNA, 25 bp, Homo sapien
accttcattccctctttgtgacgtc

SEQ ID NO: 143881 - DNA, 25 bp, Homo sapien
ccttcattccctctttgtgacgtcg

SEQ ID NO: 143882 - DNA, 25 bp, Homo sapien
ttcattccctctttgtgacgtcgcg

SEQ ID NO: 143883 - DNA, 25 bp, Homo sapien
tcattccctctttgtgacgtcgcgg

SEQ ID NO: 143884 - DNA, 25 bp, Homo sapien
cattccctctttgtgacgtcgcggg

SEQ ID NO: 143885 - DNA, 25 bp, Homo sapien
ttttttacccctctagccatggcca

SEQ ID NO: 143886 - DNA, 25 bp, Homo sapien
aatggccacccttagaccctgtgat

SEQ ID NO: 143887 - DNA, 25 bp, Homo sapien
catcctctctcctagctgagtaaat

SEQ ID NO: 143888 - DNA, 25 bp, Homo sapien
ctcctagctgagtaaatccgggtct

SEQ ID NO: 143889 - DNA, 25 bp, Homo sapien
aatccgggtctctaggatgccagag

SEQ ID NO: 143890 - DNA, 25 bp, Homo sapien
gatgccagaggcagcgcacacaagc

SEQ ID NO: 143891 - DNA, 25 bp, Homo sapien
gcgcacacaagctgggaaatcctca

SEQ ID NO: 143892 - DNA, 25 bp, Homo sapien
tgggaaatcctcagggctcctacca

SEQ ID NO: 143893 - DNA, 25 bp, Homo sapien
ttccctggttgacttgactcatgct

SEQ ID NO: 143894 - DNA, 25 bp, Homo sapien
tgactcatgcttgtttcactttcac

SEQ ID NO: 143895 - DNA, 25 bp, Homo sapien
tcactttcacatggaatttcccagt

SEQ ID NO: 143896 - DNA, 25 bp, Homo sapien
ggagggttggcttcccaaaagcata

SEQ ID NO: 143897 - DNA, 25 bp, Homo sapien
agcataaccttgaccaaaccaaaca

SEQ ID NO: 143898 - DNA, 25 bp, Homo sapien
aacaataggcaccagcaatgctgtc

SEQ ID NO: 143899 - DNA, 25 bp, Homo sapien
accagcaatgctgtcattcagttat

SEQ ID NO: 143900 - DNA, 25 bp, Homo sapien
gtcattcagttatgcagaagctcat

SEQ ID NO: 143901 - DNA, 25 bp, Homo sapien
gaagctcatttgtgaaattctgttt

SEQ ID NO: 143902 - DNA, 25 bp, Homo sapien
ttctctgatttcttcgcaagtctct

SEQ ID NO: 143903 - DNA, 25 bp, Homo sapien
ttcgcaagtctcttaatggtcattt

SEQ ID NO: 143904 - DNA, 25 bp, Homo sapien
ggatagccattggtattcatctatt

SEQ ID NO: 143905 - DNA, 25 bp, Homo sapien
atttgtttatgatggccacagccta

SEQ ID NO: 143906 - DNA, 25 bp, Homo sapien
atggccacagcctaaagtacacacg

SEQ ID NO: 143907 - DNA, 25 bp, Homo sapien
tttctgtgcctagtaatttttgtca

SEQ ID NO: 143908 - DNA, 25 bp, Homo sapien
gtcagatgccagatgtaacatttac

SEQ ID NO: 143909 - DNA, 25 bp, Homo sapien
taacatttaccttgttgggtgctgg

SEQ ID NO: 143910 - DNA, 25 bp, Homo sapien
tcctgtaagtattctggagctttgt

SEQ ID NO: 143911 - DNA, 25 bp, Homo sapien
gctttgttatgagttgcaggttatt

SEQ ID NO: 143912 - DNA, 25 bp, Homo sapien
tttcctttttcaggtcttgctgtta

SEQ ID NO: 143913 - DNA, 25 bp, Homo sapien
cttgctgttaagattcgttaggtag

SEQ ID NO: 143914 - DNA, 25 bp, Homo sapien
gagcagtgctcagtcaagggctaat

SEQ ID NO: 143915 - DNA, 25 bp, Homo sapien
gtaaagagcctcattgcactctacc

SEQ ID NO: 143916 - DNA, 25 bp, Homo sapien
ttgcactctacccaattgcgttagt

SEQ ID NO: 143917 - DNA, 25 bp, Homo sapien
attgcgttagtctgttttgcaggaa

SEQ ID NO: 143918 - DNA, 25 bp, Homo sapien
gtacatcatggccattgagcagacc

SEQ ID NO: 143919 - DNA, 25 bp, Homo sapien
gcagaccatcaagtcaggctcggat

SEQ ID NO: 143920 - DNA, 25 bp, Homo sapien
atcaagtcaggctcggatgaggtgc

SEQ ID NO: 143921 - DNA, 25 bp, Homo sapien
aggttggacagcagcgcacgttcat

SEQ ID NO: 143922 - DNA, 25 bp, Homo sapien
tggacagcagcgcacgttcatcagc

SEQ ID NO: 143923 - DNA, 25 bp, Homo sapien
tcatcagccccatcaagtgcagaga

SEQ ID NO: 143924 - DNA, 25 bp, Homo sapien
acacttgggtggagcactggcctga

SEQ ID NO: 143925 - DNA, 25 bp, Homo sapien
gaatgccaagacgaagagaaccaga

SEQ ID NO: 143926 - DNA, 25 bp, Homo sapien
agaaacaatgccaggacctcggcgc

SEQ ID NO: 143927 - DNA, 25 bp, Homo sapien
ggcgccttcaccgagagcatggttg

SEQ ID NO: 143928 - DNA, 25 bp, Homo sapien
cttcaccgagagcatggttgtcttt

SEQ ID NO: 143929 - DNA, 25 bp, Homo sapien
gacagcgactcgagcctggacgagc

SEQ ID NO: 143930 - DNA, 25 bp, Homo sapien
actcgagcctggacgagccgtgccg

SEQ ID NO: 143931 - DNA, 25 bp, Homo sapien
gcttcgcctcggaatccaaggtgta

SEQ ID NO: 143932 - DNA, 25 bp, Homo sapien
ctcggaatccaaggtgtagggcccg

SEQ ID NO: 143933 - DNA, 25 bp, Homo sapien
ggaacgaggagatctgtgtttactt

SEQ ID NO: 143934 - DNA, 25 bp, Homo sapien
gtgtttacttaagaccgatagcagg

SEQ ID NO: 143935 - DNA, 25 bp, Homo sapien
tagcaggtgaactcgaagcccacaa

SEQ ID NO: 143936 - DNA, 25 bp, Homo sapien
gaagcccacaatcctcgtctgaatc

SEQ ID NO: 143937 - DNA, 25 bp, Homo sapien
tcgtctgaatcatccgaggcaaaga

SEQ ID NO: 143938 - DNA, 25 bp, Homo sapien
aagagaaaagccacggaccgttgca

SEQ ID NO: 143939 - DNA, 25 bp, Homo sapien
gccacggaccgttgcacaaaaagga

SEQ ID NO: 143940 - DNA, 25 bp, Homo sapien
gaggaagtcctaaatcacacatcga

SEQ ID NO: 143941 - DNA, 25 bp, Homo sapien
atcacacatcgacaaagcaaacttc

SEQ ID NO: 143942 - DNA, 25 bp, Homo sapien
gtcatcttgaagttggattactcag

SEQ ID NO: 143943 - DNA, 25 bp, Homo sapien
ggattactcagacttccaaattgta

SEQ ID NO: 143944 - DNA, 25 bp, Homo sapien
ataatggcctgaatttaagttttct

SEQ ID NO: 143945 - DNA, 25 bp, Homo sapien
gttttctaagataaactcagtggtt

SEQ ID NO: 143946 - DNA, 25 bp, Homo sapien
gagatagaactattgtgtgttaata

SEQ ID NO: 143947 - DNA, 25 bp, Homo sapien
gtgtgttaatattagcattagtcaa

SEQ ID NO: 143948 - DNA, 25 bp, Homo sapien
gaatgttatatatattacctgtatg

SEQ ID NO: 143949 - DNA, 25 bp, Homo sapien
ggaaggattaccactgtacacaaat

SEQ ID NO: 143950 - DNA, 25 bp, Homo sapien
ccactgtacacaaatctaatcaata

SEQ ID NO: 143951 - DNA, 25 bp, Homo sapien
cagcaataaccacctccctggaggc

SEQ ID NO: 143952 - DNA, 25 bp, Homo sapien
ccctggaggccagctgagatgcctg

SEQ ID NO: 143953 - DNA, 25 bp, Homo sapien
agctgagatgcctggctacttggca

SEQ ID NO: 143954 - DNA, 25 bp, Homo sapien
tgagatgcctggctacttggcacca

SEQ ID NO: 143955 - DNA, 25 bp, Homo sapien
atgcctggctacttggcaccaggga

SEQ ID NO: 143956 - DNA, 25 bp, Homo sapien
tacttggcaccagggacttcctgac

SEQ ID NO: 143957 - DNA, 25 bp, Homo sapien
gacttcctgacaccacagtcaatta

SEQ ID NO: 143958 - DNA, 25 bp, Homo sapien
accacagtcaattaattcctcaggg

SEQ ID NO: 143959 - DNA, 25 bp, Homo sapien
ccccaacctctctatggcagagagg

SEQ ID NO: 143960 - DNA, 25 bp, Homo sapien
agtggccctgtacatagactgctgg

SEQ ID NO: 143961 - DNA, 25 bp, Homo sapien
ggtggcacatggatgaatgagtatt

SEQ ID NO: 143962 - DNA, 25 bp, Homo sapien
aaagattgctttatccagcagtcaa

SEQ ID NO: 143963 - DNA, 25 bp, Homo sapien
cagcagtcaattaactctccagtta

SEQ ID NO: 143964 - DNA, 25 bp, Homo sapien
atcagtactcccacaattggccagg

SEQ ID NO: 143965 - DNA, 25 bp, Homo sapien
attggccagggcaacaataattgga

SEQ ID NO: 143966 - DNA, 25 bp, Homo sapien
gagttcatactgatgccctgaggca

SEQ ID NO: 143967 - DNA, 25 bp, Homo sapien
aagtgccttctgagctgtctaaaag

SEQ ID NO: 143968 - DNA, 25 bp, Homo sapien
gagctgtctaaaagttacattgtgc

SEQ ID NO: 143969 - DNA, 25 bp, Homo sapien
cattgtgcttggtagatttagtgtt

SEQ ID NO: 143970 - DNA, 25 bp, Homo sapien
ttttctcaatcttttagcacatgtg

SEQ ID NO: 143971 - DNA, 25 bp, Homo sapien
cacatgtgtaagacactgtgcaaat

SEQ ID NO: 143972 - DNA, 25 bp, Homo sapien
actttttgtggaatactagctaact

SEQ ID NO: 143973 - DNA, 25 bp, Homo sapien
gaggaagtcctaaatcacacatcga

SEQ ID NO: 143974 - DNA, 25 bp, Homo sapien
ggaagtcctaaatcacacatcgaca

SEQ ID NO: 143975 - DNA, 25 bp, Homo sapien
agtcctaaatcacacatcgacaaag

SEQ ID NO: 143976 - DNA, 25 bp, Homo sapien
aaatcacacatcgacaaagcaaact

SEQ ID NO: 143977 - DNA, 25 bp, Homo sapien
atcacacatcgacaaagcaaacttc

SEQ ID NO: 143978 - DNA, 25 bp, Homo sapien
gaaaaagtcatcttgaagttggatt

SEQ ID NO: 143979 - DNA, 25 bp, Homo sapien
gtcatcttgaagttggattactcag

SEQ ID NO: 143980 - DNA, 25 bp, Homo sapien
atcttgaagttggattactcagact

SEQ ID NO: 143981 - DNA, 25 bp, Homo sapien
gaagttggattactcagacttccaa

SEQ ID NO: 143982 - DNA, 25 bp, Homo sapien
ggattactcagacttccaaattgta

SEQ ID NO: 143983 - DNA, 25 bp, Homo sapien
attactcagacttccaaattgtaaa

SEQ ID NO: 143984 - DNA, 25 bp, Homo sapien
tttccaggcccacactgatggccag

SEQ ID NO: 143985 - DNA, 25 bp, Homo sapien
gccaggccagcaccagggagatact

SEQ ID NO: 143986 - DNA, 25 bp, Homo sapien
gaatccaagttatctgcatcacagt

SEQ ID NO: 143987 - DNA, 25 bp, Homo sapien
atcacagtcttgtgtcttccgagaa

SEQ ID NO: 143988 - DNA, 25 bp, Homo sapien
gtgtcttccgagaactattgagaaa

SEQ ID NO: 143989 - DNA, 25 bp, Homo sapien
gagaaatctgtgcactttccataga

SEQ ID NO: 143990 - DNA, 25 bp, Homo sapien
gcactttccatagaacttctggtgg

SEQ ID NO: 143991 - DNA, 25 bp, Homo sapien
ggaaactcaagccagaatactgcta

SEQ ID NO: 143992 - DNA, 25 bp, Homo sapien
gaatactgctaaacaacattgcttc

SEQ ID NO: 143993 - DNA, 25 bp, Homo sapien
aacattgcttcctaaactttcaagt

SEQ ID NO: 143994 - DNA, 25 bp, Homo sapien
tggaagttggctgcacttgatgttt

SEQ ID NO: 143995 - DNA, 25 bp, Homo sapien
agtcatagtagaacaagcctccaaa

SEQ ID NO: 143996 - DNA, 25 bp, Homo sapien
acaagcctccaaagttctcatctat

SEQ ID NO: 143997 - DNA, 25 bp, Homo sapien
agttctcatctatgggaatttgtac

SEQ ID NO: 143998 - DNA, 25 bp, Homo sapien
gaatttgtacgagacctgcttctat

SEQ ID NO: 143999 - DNA, 25 bp, Homo sapien
cgagacctgcttctatctcctgaag

SEQ ID NO: 144000 - DNA, 25 bp, Homo sapien
gaaaactgtggcattctggaatggg

SEQ ID NO: 144001 - DNA, 25 bp, Homo sapien
gtggttaaatcggaagccctggcaa

SEQ ID NO: 144002 - DNA, 25 bp, Homo sapien
atcggaagccctggcaaagatgtgg

SEQ ID NO: 144003 - DNA, 25 bp, Homo sapien
atgaaaagttgagcagagccctgag

SEQ ID NO: 144004 - DNA, 25 bp, Homo sapien
gcagagccctgagatactactataa

SEQ ID NO: 144005 - DNA, 25 bp, Homo sapien
gaaaaaatgcacacgggtggcagga

SEQ ID NO: 144006 - DNA, 25 bp, Homo sapien
gcaagagaaattccaaccgtcctga

SEQ ID NO: 144007 - DNA, 25 bp, Homo sapien
gagaaattccaaccgtcctgaccta

SEQ ID NO: 144008 - DNA, 25 bp, Homo sapien
aaccgtcctgacctataacctgtag

SEQ ID NO: 144009 - DNA, 25 bp, Homo sapien
tgacctataacctgtaggaaaccga

SEQ ID NO: 144010 - DNA, 25 bp, Homo sapien
aaagtcactcttttgggatctaact

SEQ ID NO: 144011 - DNA, 25 bp, Homo sapien
cactcttttgggatctaactgttgt

SEQ ID NO: 144012 - DNA, 25 bp, Homo sapien
ctaactgttgttactggaagacgaa

SEQ ID NO: 144013 - DNA, 25 bp, Homo sapien
aatggtattttctagactgtgaaga

SEQ ID NO: 144014 - DNA, 25 bp, Homo sapien
gttcaaatgttatccttgttcctgt

SEQ ID NO: 144015 - DNA, 25 bp, Homo sapien
atgttatccttgttcctgttacaat

SEQ ID NO: 144016 - DNA, 25 bp, Homo sapien
gttcctgttacaatatttagcatta

SEQ ID NO: 144017 - DNA, 25 bp, Homo sapien
acagaggatgtgagttatcgtctac

SEQ ID NO: 144018 - DNA, 25 bp, Homo sapien
gtgagttatcgtctacacactggca

SEQ ID NO: 144019 - DNA, 25 bp, Homo sapien
tatcgtctacacactggcaggcaaa

SEQ ID NO: 144020 - DNA, 25 bp, Homo sapien
ggcaaaagaggttacttcctcccat

SEQ ID NO: 144021 - DNA, 25 bp, Homo sapien
ttcctcccatctcaaggacttggaa

SEQ ID NO: 144022 - DNA, 25 bp, Homo sapien
ggaaataagactgtacacccaagaa

SEQ ID NO: 144023 - DNA, 25 bp, Homo sapien
gactgtacacccaagaaagcaaaat

SEQ ID NO: 144024 - DNA, 25 bp, Homo sapien
gagtagagatctgccaagttgcctt

SEQ ID NO: 144025 - DNA, 25 bp, Homo sapien
tgccaagttgccttacagagccagg

SEQ ID NO: 144026 - DNA, 25 bp, Homo sapien
ttgccttacagagccaggacagctt

SEQ ID NO: 144027 - DNA, 25 bp, Homo sapien
aggacagcttccagccagccaggct

SEQ ID NO: 144028 - DNA, 25 bp, Homo sapien
atatgaactttactctgacctgtga

SEQ ID NO: 144029 - DNA, 25 bp, Homo sapien
ctgacctgtgatcatgtttcaggaa

SEQ ID NO: 144030 - DNA, 25 bp, Homo sapien
cactcaaggactttgttcatttcca

SEQ ID NO: 144031 - DNA, 25 bp, Homo sapien
tcatttccaaagctacttgtttaca

SEQ ID NO: 144032 - DNA, 25 bp, Homo sapien
gtttacattgtacactgcgaccacc

SEQ ID NO: 144033 - DNA, 25 bp, Homo sapien
tacattgtacactgcgaccaccttg

SEQ ID NO: 144034 - DNA, 25 bp, Homo sapien
ttgccgcttttcatcacaagcttga

SEQ ID NO: 144035 - DNA, 25 bp, Homo sapien
aaattctgtacttatatctgtaaaa

SEQ ID NO: 144036 - DNA, 25 bp, Homo sapien
ctgtaaaatagccaggaatttcctg

SEQ ID NO: 144037 - DNA, 25 bp, Homo sapien
ggaatttcctgtttgtgatctatta

SEQ ID NO: 144038 - DNA, 25 bp, Homo sapien
ctgtttgtgatctattatgcctttt

SEQ ID NO: 144039 - DNA, 25 bp, Homo sapien
gtatgtaccaaaaaatattgcttca

SEQ ID NO: 144040 - DNA, 25 bp, Homo sapien
ttagcttatatattacttgttttca

SEQ ID NO: 144041 - DNA, 25 bp, Homo sapien
gagaagttacatattaggccatata

SEQ ID NO: 144042 - DNA, 25 bp, Homo sapien
atattaggccatatatatttctaga

SEQ ID NO: 144043 - DNA, 25 bp, Homo sapien
tagacatgtctagccactgatcatt

SEQ ID NO: 144044 - DNA, 25 bp, Homo sapien
atgtctagccactgatcatttttaa

SEQ ID NO: 144045 - DNA, 25 bp, Homo sapien
aaacctataaatattatcacgcaga

SEQ ID NO: 144046 - DNA, 25 bp, Homo sapien
tatcacgcagatcactaaagtatat

SEQ ID NO: 144047 - DNA, 25 bp, Homo sapien
aagtatatctttaattctgggagaa

SEQ ID NO: 144048 - DNA, 25 bp, Homo sapien
aagatgtacttgtgaccattgtaac

SEQ ID NO: 144049 - DNA, 25 bp, Homo sapien
gtacttgtgaccattgtaacaatag

SEQ ID NO: 144050 - DNA, 25 bp, Homo sapien
aaagctcatctcctattcctacatg

SEQ ID NO: 144051 - DNA, 25 bp, Homo sapien
atctcctattcctacatggttcgtg

SEQ ID NO: 144052 - DNA, 25 bp, Homo sapien
ctcctattcctacatggttcgtggg

SEQ ID NO: 144053 - DNA, 25 bp, Homo sapien
actttgcggcctttgaggagccgga

SEQ ID NO: 144054 - DNA, 25 bp, Homo sapien
tgctcgcccaggacatccgcaagtt

SEQ ID NO: 144055 - DNA, 25 bp, Homo sapien
aggacatccgcaagttcctgtcggt

SEQ ID NO: 144056 - DNA, 25 bp, Homo sapien
tccgcaagttcctgtcggtgctgga

SEQ ID NO: 144057 - DNA, 25 bp, Homo sapien
tgtcggtgctggagcggcaatgacc

SEQ ID NO: 144058 - DNA, 25 bp, Homo sapien
acaagtgccctccaggcttttcttg

SEQ ID NO: 144059 - DNA, 25 bp, Homo sapien
ataccccttttctgaggaatgagtt

SEQ ID NO: 144060 - DNA, 25 bp, Homo sapien
tgaggaatgagtttgcctccgtccc

SEQ ID NO: 144061 - DNA, 25 bp, Homo sapien
tttaccttccatggctctttttaag

SEQ ID NO: 144062 - DNA, 25 bp, Homo sapien
gatacttttaagaggtggctgatat

SEQ ID NO: 144063 - DNA, 25 bp, Homo sapien
tggctgatattctgcaacactgtac

SEQ ID NO: 144064 - DNA, 25 bp, Homo sapien
gatattctgcaacactgtacacata

SEQ ID NO: 144065 - DNA, 25 bp, Homo sapien
tacggtaaggatactttacatggtt

SEQ ID NO: 144066 - DNA, 25 bp, Homo sapien
taaagtaagtctccagttggccacc

SEQ ID NO: 144067 - DNA, 25 bp, Homo sapien
tccagttggccaccattagctataa

SEQ ID NO: 144068 - DNA, 25 bp, Homo sapien
attagctataatggcactttgtttg

SEQ ID NO: 144069 - DNA, 25 bp, Homo sapien
ggaaaaagtcacattgccattaaac

SEQ ID NO: 144070 - DNA, 25 bp, Homo sapien
tgccattaaactttccttgtctgtc

SEQ ID NO: 144071 - DNA, 25 bp, Homo sapien
actttccttgtctgtctagttaata

SEQ ID NO: 144072 - DNA, 25 bp, Homo sapien
aatgtgagctggagacaatgacagg

SEQ ID NO: 144073 - DNA, 25 bp, Homo sapien
gaaagtcaagacagtggttcagttg

SEQ ID NO: 144074 - DNA, 25 bp, Homo sapien
acagtggttcagttggaaggtgaca

SEQ ID NO: 144075 - DNA, 25 bp, Homo sapien
ggaaggtgacaataaactggtgaca

SEQ ID NO: 144076 - DNA, 25 bp, Homo sapien
aacatcaagtctgtgaccgaactca

SEQ ID NO: 144077 - DNA, 25 bp, Homo sapien
agtctgtgaccgaactcaacggcga

SEQ ID NO: 144078 - DNA, 25 bp, Homo sapien
gaactcaacggcgacataatcacca

SEQ ID NO: 144079 - DNA, 25 bp, Homo sapien
ggcgacataatcaccaataccatga

SEQ ID NO: 144080 - DNA, 25 bp, Homo sapien
atcaccaataccatgacattgggtg

SEQ ID NO: 144081 - DNA, 25 bp, Homo sapien
gggtgacattgtcttcaagagaatc

SEQ ID NO: 144082 - DNA, 25 bp, Homo sapien
agagaatttaaacaagtctgcattt

SEQ ID NO: 144083 - DNA, 25 bp, Homo sapien
gagtgagtccctccaactatgagaa

SEQ ID NO: 144084 - DNA, 25 bp, Homo sapien
actagaatacagaaaccggctggaa

SEQ ID NO: 144085 - DNA, 25 bp, Homo sapien
ctggaagagacagctagggctttat

SEQ ID NO: 144086 - DNA, 25 bp, Homo sapien
agggctttatattctctcgggtcaa

SEQ ID NO: 144087 - DNA, 25 bp, Homo sapien
ttctctcgggtcaaaagaagacact

SEQ ID NO: 144088 - DNA, 25 bp, Homo sapien
gaagacactgtaatttccctttagg

SEQ ID NO: 144089 - DNA, 25 bp, Homo sapien
tccctttagggagacgtgatgttca

SEQ ID NO: 144090 - DNA, 25 bp, Homo sapien
tttccttttctgctatttcttttca

SEQ ID NO: 144091 - DNA, 25 bp, Homo sapien
gagtcttaaccttgtactcagggaa

SEQ ID NO: 144092 - DNA, 25 bp, Homo sapien
gagataacaagtcccttgggcacct

SEQ ID NO: 144093 - DNA, 25 bp, Homo sapien
gggcaccttaagctcagttttttca

SEQ ID NO: 144094 - DNA, 25 bp, Homo sapien
atgtgatgtcttcatcatagtatga

SEQ ID NO: 144095 - DNA, 25 bp, Homo sapien
aagctgcttaaaactgtggctctaa

SEQ ID NO: 144096 - DNA, 25 bp, Homo sapien
attgcactatggaattttcattgag

SEQ ID NO: 144097 - DNA, 25 bp, Homo sapien
aattattggcttgtctactaataca

SEQ ID NO: 144098 - DNA, 25 bp, Homo sapien
ggcatcaattttaatgacgctcctg

SEQ ID NO: 144099 - DNA, 25 bp, Homo sapien
attttaatgacgctcctggtatgga

SEQ ID NO: 144100 - DNA, 25 bp, Homo sapien
gacgctcctggtatggaacctcaga

SEQ ID NO: 144101 - DNA, 25 bp, Homo sapien
ggaacctcagatataccctattgga

SEQ ID NO: 144102 - DNA, 25 bp, Homo sapien
tcagatataccctattggagacaat

SEQ ID NO: 144103 - DNA, 25 bp, Homo sapien
tggagacaatcctttgatcataaat

SEQ ID NO: 144104 - DNA, 25 bp, Homo sapien
ttgatcataaattctccccaactat

SEQ ID NO: 144105 - DNA, 25 bp, Homo sapien
atccagcatcttctctatcttagtt

SEQ ID NO: 144106 - DNA, 25 bp, Homo sapien
cagcatcttctctatcttagttgaa

SEQ ID NO: 144107 - DNA, 25 bp, Homo sapien
ctctatcttagttgaatgccttctt

SEQ ID NO: 144108 - DNA, 25 bp, Homo sapien
agttgaatgccttctttctgaacat

SEQ ID NO: 144109 - DNA, 25 bp, Homo sapien
gtcaacaatactttgcttgaattct

SEQ ID NO: 144110 - DNA, 25 bp, Homo sapien
atagtgatacaatgggacatgtgaa

SEQ ID NO: 144111 - DNA, 25 bp, Homo sapien
gtaaccactttaatgcaataactgt

SEQ ID NO: 144112 - DNA, 25 bp, Homo sapien
ataatattgtatttcgtggtagtcc

SEQ ID NO: 144113 - DNA, 25 bp, Homo sapien
catttaatgccattgtcaccttgga

SEQ ID NO: 144114 - DNA, 25 bp, Homo sapien
atgccattgtcaccttggatttatg

SEQ ID NO: 144115 - DNA, 25 bp, Homo sapien
ccattgtcaccttggatttatgagt

SEQ ID NO: 144116 - DNA, 25 bp, Homo sapien
tttgacaacacctcagacttataaa

SEQ ID NO: 144117 - DNA, 25 bp, Homo sapien
tgacaacacctcagacttataaaag

SEQ ID NO: 144118 - DNA, 25 bp, Homo sapien
ctaaaaatgtgaagactatggcaaa

SEQ ID NO: 144119 - DNA, 25 bp, Homo sapien
tggcaaagtctttggttgtcacact

SEQ ID NO: 144120 - DNA, 25 bp, Homo sapien
gcaaagtctttggttgtcacacttt

SEQ ID NO: 144121 - DNA, 25 bp, Homo sapien
gataattcatattggaacaaactac

SEQ ID NO: 144122 - DNA, 25 bp, Homo sapien
ggaacaaactacaagtgcaaacaat

SEQ ID NO: 144123 - DNA, 25 bp, Homo sapien
aaaacttaatttatgctcacacctt

SEQ ID NO: 144124 - DNA, 25 bp, Homo sapien
acttaatttatgctcacaccttact

SEQ ID NO: 144125 - DNA, 25 bp, Homo sapien
caccttactgcacagaaaagaattt

SEQ ID NO: 144126 - DNA, 25 bp, Homo sapien
tactcagcatcagaaagtacttaat

SEQ ID NO: 144127 - DNA, 25 bp, Homo sapien
gttcgtgcccttccgagacttcaag

SEQ ID NO: 144128 - DNA, 25 bp, Homo sapien
gtgcccttccgagacttcaaggatg

SEQ ID NO: 144129 - DNA, 25 bp, Homo sapien
tctgcactcgccaagtgtgtcctgg

SEQ ID NO: 144130 - DNA, 25 bp, Homo sapien
actcgccaagtgtgtcctggctgag

SEQ ID NO: 144131 - DNA, 25 bp, Homo sapien
tcctggctgaggtgccacggcaggt

SEQ ID NO: 144132 - DNA, 25 bp, Homo sapien
ggagtactacgccagccagggcatc

SEQ ID NO: 144133 - DNA, 25 bp, Homo sapien
agtactacgccagccagggcatcag

SEQ ID NO: 144134 - DNA, 25 bp, Homo sapien
accctcgtgactccagtgaccaatg

SEQ ID NO: 144135 - DNA, 25 bp, Homo sapien
gtgactccagtgaccaatgcctcca

SEQ ID NO: 144136 - DNA, 25 bp, Homo sapien
aatgcctccacctcttggaccaggt

SEQ ID NO: 144137 - DNA, 25 bp, Homo sapien
ttggaccaggtgtgccccctgggtt

SEQ ID NO: 144138 - DNA, 25 bp, Homo sapien
cttcaagcgctttaggaaatgatgc

SEQ ID NO: 144139 - DNA, 25 bp, Homo sapien
gatgcttaggcagggtacttcgttc

SEQ ID NO: 144140 - DNA, 25 bp, Homo sapien
gggtacttcgttcaagaccggcgct

SEQ ID NO: 144141 - DNA, 25 bp, Homo sapien
aagaccggcgcttggcacccttgtt

SEQ ID NO: 144142 - DNA, 25 bp, Homo sapien
tttcagcataacattttccttccac

SEQ ID NO: 144143 - DNA, 25 bp, Homo sapien
taacattttccttccacctctttga

SEQ ID NO: 144144 - DNA, 25 bp, Homo sapien
ttccctccagcgttggccaaattgt

SEQ ID NO: 144145 - DNA, 25 bp, Homo sapien
agcgttggccaaattgtgctgagga

SEQ ID NO: 144146 - DNA, 25 bp, Homo sapien
tgcatcaagggcttggctgtgcctt

SEQ ID NO: 144147 - DNA, 25 bp, Homo sapien
ggctgtgccttcataggtcatctag

SEQ ID NO: 144148 - DNA, 25 bp, Homo sapien
cataggtcatctagggttttataaa

SEQ ID NO: 144149 - DNA, 25 bp, Homo sapien
gtttcaaactttggaacaagatggt

SEQ ID NO: 144150 - DNA, 25 bp, Homo sapien
aagatggttctagcatggcatattt

SEQ ID NO: 144151 - DNA, 25 bp, Homo sapien
gcatggcatatttttcacatatcta

SEQ ID NO: 144152 - DNA, 25 bp, Homo sapien
tatatcttgtagctttatcaaaggg

SEQ ID NO: 144153 - DNA, 25 bp, Homo sapien
acatatttttgtagcactgacagat

SEQ ID NO: 144154 - DNA, 25 bp, Homo sapien
agcactgacagatttccatcctagt

SEQ ID NO: 144155 - DNA, 25 bp, Homo sapien
agatttccatcctagtcactacctt

SEQ ID NO: 144156 - DNA, 25 bp, Homo sapien
gtcactaccttcatgcataggttta

SEQ ID NO: 144157 - DNA, 25 bp, Homo sapien
ggtttagcagtatagtggcgccact

SEQ ID NO: 144158 - DNA, 25 bp, Homo sapien
gtggcgccactgttttgaatctcat

SEQ ID NO: 144159 - DNA, 25 bp, Homo sapien
gaatctcataatttatacaggtcat

SEQ ID NO: 144160 - DNA, 25 bp, Homo sapien
ctccctcagacccagcggtccaatg

SEQ ID NO: 144161 - DNA, 25 bp, Homo sapien
agacccagcggtccaatgccaccta

SEQ ID NO: 144162 - DNA, 25 bp, Homo sapien
acccagcggtccaatgccacctaga

SEQ ID NO: 144163 - DNA, 25 bp, Homo sapien
agcggtccaatgccacctagactct

SEQ ID NO: 144164 - DNA, 25 bp, Homo sapien
gcggtccaatgccacctagactctc

SEQ ID NO: 144165 - DNA, 25 bp, Homo sapien
caatgccacctagactctccctgta

SEQ ID NO: 144166 - DNA, 25 bp, Homo sapien
atgccacctagactctccctgtaca

SEQ ID NO: 144167 - DNA, 25 bp, Homo sapien
acctagactctccctgtacacagtg

SEQ ID NO: 144168 - DNA, 25 bp, Homo sapien
cctagactctccctgtacacagtgc

SEQ ID NO: 144169 - DNA, 25 bp, Homo sapien
tagactctccctgtacacagtgccc

SEQ ID NO: 144170 - DNA, 25 bp, Homo sapien
tccctgtacacagtgcccccttgtg

SEQ ID NO: 144171 - DNA, 25 bp, Homo sapien
ctggatgactttccagcctcttcaa

SEQ ID NO: 144172 - DNA, 25 bp, Homo sapien
tggatgactttccagcctcttcaac

SEQ ID NO: 144173 - DNA, 25 bp, Homo sapien
ggatgactttccagcctcttcaact

SEQ ID NO: 144174 - DNA, 25 bp, Homo sapien
gatgactttccagcctcttcaactg

SEQ ID NO: 144175 - DNA, 25 bp, Homo sapien
tttccagcctcttcaactgacttgc

SEQ ID NO: 144176 - DNA, 25 bp, Homo sapien
tcttcaactgacttgctcccctctc

SEQ ID NO: 144177 - DNA, 25 bp, Homo sapien
ccttttcttctctttagagacccag

SEQ ID NO: 144178 - DNA, 25 bp, Homo sapien
ctgtttctctttcactttcatttgc

SEQ ID NO: 144179 - DNA, 25 bp, Homo sapien
gtttctctttcactttcatttgctg

SEQ ID NO: 144180 - DNA, 25 bp, Homo sapien
ttctctttcactttcatttgctggt

SEQ ID NO: 144181 - DNA, 25 bp, Homo sapien
actttcatttgctggtgtgagccat

SEQ ID NO: 144182 - DNA, 25 bp, Homo sapien
ttggacttcatgtccccaacctagc

SEQ ID NO: 144183 - DNA, 25 bp, Homo sapien
atgtccccaacctagcttggtgagg

SEQ ID NO: 144184 - DNA, 25 bp, Homo sapien
caacctagcttggtgagggctgtaa

SEQ ID NO: 144185 - DNA, 25 bp, Homo sapien
gagggctgtaactgtttccaagtac

SEQ ID NO: 144186 - DNA, 25 bp, Homo sapien
tgtaactgtttccaagtacttgtac

SEQ ID NO: 144187 - DNA, 25 bp, Homo sapien
gtacttgtacattggaagtctgaat

SEQ ID NO: 144188 - DNA, 25 bp, Homo sapien
ggaagtctgaatgtgtaacaatatt

SEQ ID NO: 144189 - DNA, 25 bp, Homo sapien
tatttaatgtatttagagttcctca

SEQ ID NO: 144190 - DNA, 25 bp, Homo sapien
catgttgcagggtttaagaaatctg

SEQ ID NO: 144191 - DNA, 25 bp, Homo sapien
aggtcatgtgacttttctgtactgt

SEQ ID NO: 144192 - DNA, 25 bp, Homo sapien
gacttttctgtactgttaaacttca

SEQ ID NO: 144193 - DNA, 25 bp, Homo sapien
aaatagctggcatttcttgctggag

SEQ ID NO: 144194 - DNA, 25 bp, Homo sapien
atcacaagtggaaaggttaccctag

SEQ ID NO: 144195 - DNA, 25 bp, Homo sapien
gaaacaaaagatgactaccgtgagg

SEQ ID NO: 144196 - DNA, 25 bp, Homo sapien
ctaccgtgaggatggattggacatt

SEQ ID NO: 144197 - DNA, 25 bp, Homo sapien
gattggacattacaccacactggaa

SEQ ID NO: 144198 - DNA, 25 bp, Homo sapien
gaaacatctcattcagttggtgatc

SEQ ID NO: 144199 - DNA, 25 bp, Homo sapien
gttggtgatcttcctgtcatgaaag

SEQ ID NO: 144200 - DNA, 25 bp, Homo sapien
gtcatgaaagttgcttgacagctct

SEQ ID NO: 144201 - DNA, 25 bp, Homo sapien
gcttgacagctctaattacgaattg

SEQ ID NO: 144202 - DNA, 25 bp, Homo sapien
gaattgaacacattaaacacctggt

SEQ ID NO: 144203 - DNA, 25 bp, Homo sapien
aaacacctggtgaaattatcaatta

SEQ ID NO: 144204 - DNA, 25 bp, Homo sapien
agaatccctgcctgttaaggaaact

SEQ ID NO: 144205 - DNA, 25 bp, Homo sapien
tccctgcctgttaaggaaactttat

SEQ ID NO: 144206 - DNA, 25 bp, Homo sapien
ctttatttgtggtaggtacagttct

SEQ ID NO: 144207 - DNA, 25 bp, Homo sapien
gggtacatgttaagtgtccccttat

SEQ ID NO: 144208 - DNA, 25 bp, Homo sapien
taagtgtccccttatacagtggagg

SEQ ID NO: 144209 - DNA, 25 bp, Homo sapien
atacagtggagggaagtcttccttc

SEQ ID NO: 144210 - DNA, 25 bp, Homo sapien
ttgttttaaaagatcagagggtgac

SEQ ID NO: 144211 - DNA, 25 bp, Homo sapien
agagggtgactgatgatacatgcat

SEQ ID NO: 144212 - DNA, 25 bp, Homo sapien
gtgactgatgatacatgcatacata

SEQ ID NO: 144213 - DNA, 25 bp, Homo sapien
gtgataagattcatacactctgtat

SEQ ID NO: 144214 - DNA, 25 bp, Homo sapien
aagattcatacactctgtatttggg

SEQ ID NO: 144215 - DNA, 25 bp, Homo sapien
aacagactgaacagggcgccgcagc

SEQ ID NO: 144216 - DNA, 25 bp, Homo sapien
gacgagctgcccgaggtggataacc

SEQ ID NO: 144217 - DNA, 25 bp, Homo sapien
ggataacctgacactggacgggaat

SEQ ID NO: 144218 - DNA, 25 bp, Homo sapien
acactggacgggaatcccttcctgg

SEQ ID NO: 144219 - DNA, 25 bp, Homo sapien
agggctcaatgaactccggcgtggt

SEQ ID NO: 144220 - DNA, 25 bp, Homo sapien
tgtgcacgttcgaccctgtcggtgg

SEQ ID NO: 144221 - DNA, 25 bp, Homo sapien
tcgggaaccctggtgctgctccaag

SEQ ID NO: 144222 - DNA, 25 bp, Homo sapien
gggctttgcctaagatccaagacag

SEQ ID NO: 144223 - DNA, 25 bp, Homo sapien
gaatggactcaaactgccttggctt

SEQ ID NO: 144224 - DNA, 25 bp, Homo sapien
tcccgtcaggacgttgaggactttt

SEQ ID NO: 144225 - DNA, 25 bp, Homo sapien
tgaggacttttcgaccaattcaacc

SEQ ID NO: 144226 - DNA, 25 bp, Homo sapien
ttttcttgtagttgactttcatgtc

SEQ ID NO: 144227 - DNA, 25 bp, Homo sapien
gactttcatgtcactcactataaaa

SEQ ID NO: 144228 - DNA, 25 bp, Homo sapien
aataggtctcttaacctggcaccag

SEQ ID NO: 144229 - DNA, 25 bp, Homo sapien
acctggcaccagtataactataaag

SEQ ID NO: 144230 - DNA, 25 bp, Homo sapien
aagcactagctgagaaggaactgat

SEQ ID NO: 144231 - DNA, 25 bp, Homo sapien
ggaactgatacttacatttcatgga

SEQ ID NO: 144232 - DNA, 25 bp, Homo sapien
catttcatggacagcattaacaaga

SEQ ID NO: 144233 - DNA, 25 bp, Homo sapien
ggaacatagtctcagattcttctaa

SEQ ID NO: 144234 - DNA, 25 bp, Homo sapien
tgtgtatctcacaatgtcatgtaat

SEQ ID NO: 144235 - DNA, 25 bp, Homo sapien
gtcatgtaatgtaaaggaaaccctt

SEQ ID NO: 144236 - DNA, 25 bp, Homo sapien
gaattcttgttctgatgctgaacta

SEQ ID NO: 144237 - DNA, 25 bp, Homo sapien
aatgctcttaggaatgaagttctat

SEQ ID NO: 144238 - DNA, 25 bp, Homo sapien
gggacagtgcaacaagtaaccagac

SEQ ID NO: 144239 - DNA, 25 bp, Homo sapien
agtaaccagactattttgtattttg

SEQ ID NO: 144240 - DNA, 25 bp, Homo sapien
ttcatattatggagaacctaacaat

SEQ ID NO: 144241 - DNA, 25 bp, Homo sapien
aatttaaagacactgggaacacttg

SEQ ID NO: 144242 - DNA, 25 bp, Homo sapien
gaacacttgcccctcagaatagtac

SEQ ID NO: 144243 - DNA, 25 bp, Homo sapien
ttgcccctcagaatagtactgtcaa

SEQ ID NO: 144244 - DNA, 25 bp, Homo sapien
gtactgtcaagggaagccatacact

SEQ ID NO: 144245 - DNA, 25 bp, Homo sapien
ggaagccatacactttttgtagaca

SEQ ID NO: 144246 - DNA, 25 bp, Homo sapien
tacccaattctaagtggttgacaga

SEQ ID NO: 144247 - DNA, 25 bp, Homo sapien
acagatgttcactttgaagtgtgaa

SEQ ID NO: 144248 - DNA, 25 bp, Homo sapien
aaatatctccagaccttggcaaatg

SEQ ID NO: 144249 - DNA, 25 bp, Homo sapien
atctccagaccttggcaaatgttat

SEQ ID NO: 144250 - DNA, 25 bp, Homo sapien
agaccttggcaaatgttatctgtgg

SEQ ID NO: 144251 - DNA, 25 bp, Homo sapien
ctgtgggggaaaattgccctcaatt

SEQ ID NO: 144252 - DNA, 25 bp, Homo sapien
ttgccctcaattgagaaccactggt

SEQ ID NO: 144253 - DNA, 25 bp, Homo sapien
actggtctagctagacctgcactgt

SEQ ID NO: 144254 - DNA, 25 bp, Homo sapien
acatgtggctaaacttaaatttaag

SEQ ID NO: 144255 - DNA, 25 bp, Homo sapien
tcagtcacattagtcattcaagtgt

SEQ ID NO: 144256 - DNA, 25 bp, Homo sapien
ttagtcattcaagtgttcagacagc

SEQ ID NO: 144257 - DNA, 25 bp, Homo sapien
acagtgcagctacaggatatgccat

SEQ ID NO: 144258 - DNA, 25 bp, Homo sapien
ggatatgccatcatggcagaaagtt

SEQ ID NO: 144259 - DNA, 25 bp, Homo sapien
gaagtccccaaatgcttcaaggaac

SEQ ID NO: 144260 - DNA, 25 bp, Homo sapien
acacagttctctggctttttggaaa

SEQ ID NO: 144261 - DNA, 25 bp, Homo sapien
tttggaaaactgatgcatccgatgt

SEQ ID NO: 144262 - DNA, 25 bp, Homo sapien
gcatccgatgtaaagccatgctaag

SEQ ID NO: 144263 - DNA, 25 bp, Homo sapien
gctaaggtggttttcagattccaca

SEQ ID NO: 144264 - DNA, 25 bp, Homo sapien
gattccacataaaatgtcacacttg

SEQ ID NO: 144265 - DNA, 25 bp, Homo sapien
gtcacacttgtttcttgttcatcca

SEQ ID NO: 144266 - DNA, 25 bp, Homo sapien
gtttcttgttcatccaaggaaccta

SEQ ID NO: 144267 - DNA, 25 bp, Homo sapien
aagtgtagctatacagaggatgctc

SEQ ID NO: 144268 - DNA, 25 bp, Homo sapien
aggatgctcagtgtatagatggcac

SEQ ID NO: 144269 - DNA, 25 bp, Homo sapien
tagatggcactatcgaagtccccaa

SEQ ID NO: 144270 - DNA, 25 bp, Homo sapien
ttttgcccgatcatctcctagaact

SEQ ID NO: 144271 - DNA, 25 bp, Homo sapien
ccgatcatctcctagaacttcaatg

SEQ ID NO: 144272 - DNA, 25 bp, Homo sapien
gatacagcaaaaccagtctattaga

SEQ ID NO: 144273 - DNA, 25 bp, Homo sapien
cagtctattagacggccaagtcgac

SEQ ID NO: 144274 - DNA, 25 bp, Homo sapien
aagtcgacagcttgccccaaacaaa

SEQ ID NO: 144275 - DNA, 25 bp, Homo sapien
aacaaacctagctaactgccttcta

SEQ ID NO: 144276 - DNA, 25 bp, Homo sapien
aaacctagctaactgccttctatga

SEQ ID NO: 144277 - DNA, 25 bp, Homo sapien
tgccttctatgaaagcagtcattat

SEQ ID NO: 144278 - DNA, 25 bp, Homo sapien
aagcagtcattattcaaggtgatcg

SEQ ID NO: 144279 - DNA, 25 bp, Homo sapien
aaggtgatcgtattcttccagtgaa

SEQ ID NO: 144280 - DNA, 25 bp, Homo sapien
gatcgtattcttccagtgaaaacaa

SEQ ID NO: 144281 - DNA, 25 bp, Homo sapien
ataaactgtaaactaataggctggg

SEQ ID NO: 144282 - DNA, 25 bp, Homo sapien
gaagccttacaaggttatgtagaga

SEQ ID NO: 144283 - DNA, 25 bp, Homo sapien
ggttatgtagagagataccatcttc

SEQ ID NO: 144284 - DNA, 25 bp, Homo sapien
agagagataccatcttctgtaccaa

SEQ ID NO: 144285 - DNA, 25 bp, Homo sapien
gagataccatcttctgtaccaaaaa

SEQ ID NO: 144286 - DNA, 25 bp, Homo sapien
gataccatcttctgtaccaaaaata

SEQ ID NO: 144287 - DNA, 25 bp, Homo sapien
gtaatgtgaatctatgctggtgaaa

SEQ ID NO: 144288 - DNA, 25 bp, Homo sapien
gtgaatctatgctggtgaaaacaat

SEQ ID NO: 144289 - DNA, 25 bp, Homo sapien
tctatgctggtgaaaacaatttttt

SEQ ID NO: 144290 - DNA, 25 bp, Homo sapien
taaaaccttagtgtccttttctcat

SEQ ID NO: 144291 - DNA, 25 bp, Homo sapien
aaccttagtgtccttttctcatttg

SEQ ID NO: 144292 - DNA, 25 bp, Homo sapien
tctgtgacacctggtgtatcgaggc

SEQ ID NO: 144293 - DNA, 25 bp, Homo sapien
ctgtgacacctggtgtatcgaggct

SEQ ID NO: 144294 - DNA, 25 bp, Homo sapien
tgtgacacctggtgtatcgaggctg

SEQ ID NO: 144295 - DNA, 25 bp, Homo sapien
gtgacacctggtgtatcgaggctgc

SEQ ID NO: 144296 - DNA, 25 bp, Homo sapien
tgacacctggtgtatcgaggctgca

SEQ ID NO: 144297 - DNA, 25 bp, Homo sapien
ctgcagctcggatccgagagggcat

SEQ ID NO: 144298 - DNA, 25 bp, Homo sapien
tgcagctcggatccgagagggcatg

SEQ ID NO: 144299 - DNA, 25 bp, Homo sapien
agctcggatccgagagggcatggcc

SEQ ID NO: 144300 - DNA, 25 bp, Homo sapien
gctcggatccgagagggcatggccg

SEQ ID NO: 144301 - DNA, 25 bp, Homo sapien
tcggatccgagagggcatggccgcc

SEQ ID NO: 144302 - DNA, 25 bp, Homo sapien
atccgagagggcatggccgccctgc

SEQ ID NO: 144303 - DNA, 25 bp, Homo sapien
tactacacaccgcagctgctgcagt

SEQ ID NO: 144304 - DNA, 25 bp, Homo sapien
gtgccaggcccaagaactagaactt

SEQ ID NO: 144305 - DNA, 25 bp, Homo sapien
gggaatgccctacctggacatcgtg

SEQ ID NO: 144306 - DNA, 25 bp, Homo sapien
acatcgtgcgggaggtaaaggacaa

SEQ ID NO: 144307 - DNA, 25 bp, Homo sapien
gaggtaaaggacaagcaccctgacc

SEQ ID NO: 144308 - DNA, 25 bp, Homo sapien
gtgtaccacgtctctggagagtttg

SEQ ID NO: 144309 - DNA, 25 bp, Homo sapien
catgctgtggcatggagcccaggcc

SEQ ID NO: 144310 - DNA, 25 bp, Homo sapien
gcatttgatctcaaggctgccgtac

SEQ ID NO: 144311 - DNA, 25 bp, Homo sapien
aggctgccgtactggaggccatgac

SEQ ID NO: 144312 - DNA, 25 bp, Homo sapien
ggaggccatgactgccttccgcaga

SEQ ID NO: 144313 - DNA, 25 bp, Homo sapien
tgccttccgcagagcaggtgctgac

SEQ ID NO: 144314 - DNA, 25 bp, Homo sapien
tttctactttattgagacctattag

SEQ ID NO: 144315 - DNA, 25 bp, Homo sapien
gacctattagatgtaagtgctagta

SEQ ID NO: 144316 - DNA, 25 bp, Homo sapien
aaagaggctgagaattaccatacaa

SEQ ID NO: 144317 - DNA, 25 bp, Homo sapien
gaggctgagaattaccatacaaggg

SEQ ID NO: 144318 - DNA, 25 bp, Homo sapien
taccatacaagggtattacaactgt

SEQ ID NO: 144319 - DNA, 25 bp, Homo sapien
acaatttatctttgtttcattgttc

SEQ ID NO: 144320 - DNA, 25 bp, Homo sapien
aagcagaatgtatatcatcccatct

SEQ ID NO: 144321 - DNA, 25 bp, Homo sapien
gaatgtatatcatcccatctgaaaa

SEQ ID NO: 144322 - DNA, 25 bp, Homo sapien
aattattgacatgtgcatctgtaca

SEQ ID NO: 144323 - DNA, 25 bp, Homo sapien
gacatgtgcatctgtacaataaact

SEQ ID NO: 144324 - DNA, 25 bp, Homo sapien
caaatatatctactacattgtttat

SEQ ID NO: 144325 - DNA, 25 bp, Homo sapien
cctgaagatgtgacagtgattttga

SEQ ID NO: 144326 - DNA, 25 bp, Homo sapien
tgacaacacctcaaactttttcaaa

SEQ ID NO: 144327 - DNA, 25 bp, Homo sapien
gataaaggctttacatggttgtcac

SEQ ID NO: 144328 - DNA, 25 bp, Homo sapien
ataaaggctttacatggttgtcaca

SEQ ID NO: 144329 - DNA, 25 bp, Homo sapien
taaaggctttacatggttgtcacac

SEQ ID NO: 144330 - DNA, 25 bp, Homo sapien
ttacattggagtaaacttctacaag

SEQ ID NO: 144331 - DNA, 25 bp, Homo sapien
tacattggagtaaacttctacaagt

SEQ ID NO: 144332 - DNA, 25 bp, Homo sapien
acattggagtaaacttctacaagtg

SEQ ID NO: 144333 - DNA, 25 bp, Homo sapien
tttaattaatgctcataccttattg

SEQ ID NO: 144334 - DNA, 25 bp, Homo sapien
gcacaggaaagaatttttacttgga

SEQ ID NO: 144335 - DNA, 25 bp, Homo sapien
ttacttggaaaaaggtatatacaca

SEQ ID NO: 144336 - DNA, 25 bp, Homo sapien
atctttaagcccgacttgaggctga

SEQ ID NO: 144337 - DNA, 25 bp, Homo sapien
ctttaagcccgacttgaggctgaga

SEQ ID NO: 144338 - DNA, 25 bp, Homo sapien
taagcccgacttgaggctgagagca

SEQ ID NO: 144339 - DNA, 25 bp, Homo sapien
agcccgacttgaggctgagagcagc

SEQ ID NO: 144340 - DNA, 25 bp, Homo sapien
gagcagctggaagtttgggtttggt

SEQ ID NO: 144341 - DNA, 25 bp, Homo sapien
ggggccggggcaaccaagctgtatg

SEQ ID NO: 144342 - DNA, 25 bp, Homo sapien
caggacagacagactaatgtagtga

SEQ ID NO: 144343 - DNA, 25 bp, Homo sapien
atgtagtgagtgtagctgtagctga

SEQ ID NO: 144344 - DNA, 25 bp, Homo sapien
gtagctgaggcttaactgggaggga

SEQ ID NO: 144345 - DNA, 25 bp, Homo sapien
aactgggagggatgccgagcttgct

SEQ ID NO: 144346 - DNA, 25 bp, Homo sapien
gagggatgccgagcttgctggaact

SEQ ID NO: 144347 - DNA, 25 bp, Homo sapien
gctgggtgaccgatggcttcagttc

SEQ ID NO: 144348 - DNA, 25 bp, Homo sapien
gatggcttcagttccctgaaagact

SEQ ID NO: 144349 - DNA, 25 bp, Homo sapien
cctgaaagactactggagcaccgtt

SEQ ID NO: 144350 - DNA, 25 bp, Homo sapien
gactactggagcaccgttaaggaca

SEQ ID NO: 144351 - DNA, 25 bp, Homo sapien
gcaccgttaaggacaagttctctga

SEQ ID NO: 144352 - DNA, 25 bp, Homo sapien
ctgagttctgggatttggaccctga

SEQ ID NO: 144353 - DNA, 25 bp, Homo sapien
tttggaccctgaggtcagaccaact

SEQ ID NO: 144354 - DNA, 25 bp, Homo sapien
gaccctgaggtcagaccaacttcag

SEQ ID NO: 144355 - DNA, 25 bp, Homo sapien
tgcctgagacctcaataccccaagt

SEQ ID NO: 144356 - DNA, 25 bp, Homo sapien
tatccatcctgcgagctccttgggt

SEQ ID NO: 144357 - DNA, 25 bp, Homo sapien
ttgggtcctgcaatctccagggctg

SEQ ID NO: 144358 - DNA, 25 bp, Homo sapien
aacccaaatggctagaacatgttta

SEQ ID NO: 144359 - DNA, 25 bp, Homo sapien
aagttctacagttaattatgtgcat

SEQ ID NO: 144360 - DNA, 25 bp, Homo sapien
aaaacaatggcctggttcaatttct

SEQ ID NO: 144361 - DNA, 25 bp, Homo sapien
caatggcctggttcaatttctttct

SEQ ID NO: 144362 - DNA, 25 bp, Homo sapien
ttccccccaaaattatcagtgctct

SEQ ID NO: 144363 - DNA, 25 bp, Homo sapien
atcagtgctctgcttttagtcacgt

SEQ ID NO: 144364 - DNA, 25 bp, Homo sapien
tgctctgcttttagtcacgtgtatt

SEQ ID NO: 144365 - DNA, 25 bp, Homo sapien
gcttttagtcacgtgtattttcatt

SEQ ID NO: 144366 - DNA, 25 bp, Homo sapien
gtgtattttcattaccactcgtaaa

SEQ ID NO: 144367 - DNA, 25 bp, Homo sapien
tattgaaacactgtacaccatagtt

SEQ ID NO: 144368 - DNA, 25 bp, Homo sapien
gtttacaatattatgtttcctaatt

SEQ ID NO: 144369 - DNA, 25 bp, Homo sapien
gttctttttattgcagtttggaaag

SEQ ID NO: 144370 - DNA, 25 bp, Homo sapien
tgcagtttggaaagcatttgtgaaa

SEQ ID NO: 144371 - DNA, 25 bp, Homo sapien
gtgaaactttctgtttggcacagaa

SEQ ID NO: 144372 - DNA, 25 bp, Homo sapien
gtttggcacagaaacagtcaaaatt

SEQ ID NO: 144373 - DNA, 25 bp, Homo sapien
aaattttgacattcatattctccta

SEQ ID NO: 144374 - DNA, 25 bp, Homo sapien
tattctcctattttacagctacaag

SEQ ID NO: 144375 - DNA, 25 bp, Homo sapien
attctgagcccatatttcacttacc

SEQ ID NO: 144376 - DNA, 25 bp, Homo sapien
tgactgttggtctctaggtagcctt

SEQ ID NO: 144377 - DNA, 25 bp, Homo sapien
ggtctctaggtagcctttggtctat

SEQ ID NO: 144378 - DNA, 25 bp, Homo sapien
ggtagcctttggtctattgtacaca

SEQ ID NO: 144379 - DNA, 25 bp, Homo sapien
attgtacacaatctcatttcatatg

SEQ ID NO: 144380 - DNA, 25 bp, Homo sapien
caagagcaccataaccttagatggg

SEQ ID NO: 144381 - DNA, 25 bp, Homo sapien
gggtgtcctggtacatgtgcagaaa

SEQ ID NO: 144382 - DNA, 25 bp, Homo sapien
ggaaaatcaaccaccataaagagaa

SEQ ID NO: 144383 - DNA, 25 bp, Homo sapien
aaactggtggtggaatgcgtcatga

SEQ ID NO: 144384 - DNA, 25 bp, Homo sapien
atgcgtcatgaaaggcgtcacttcc

SEQ ID NO: 144385 - DNA, 25 bp, Homo sapien
ggcgtcacttccacgagagtttatg

SEQ ID NO: 144386 - DNA, 25 bp, Homo sapien
aagccaagggacgttgacctggact

SEQ ID NO: 144387 - DNA, 25 bp, Homo sapien
gacctggactgaagttcgcattgaa

SEQ ID NO: 144388 - DNA, 25 bp, Homo sapien
gcattgaactctacaacattctgtg

SEQ ID NO: 144389 - DNA, 25 bp, Homo sapien
aagatattgttgttttccctgattt

SEQ ID NO: 144390 - DNA, 25 bp, Homo sapien
gttttccctgatttagcaagcaagt

SEQ ID NO: 144391 - DNA, 25 bp, Homo sapien
cgatacgtggagctcttagacaaat

SEQ ID NO: 144392 - DNA, 25 bp, Homo sapien
aatactttggcagtgtgtgcgagct

SEQ ID NO: 144393 - DNA, 25 bp, Homo sapien
gtgcgagctggacatcatcttcaac

SEQ ID NO: 144394 - DNA, 25 bp, Homo sapien
tgagaaggcctacttcatcctggat

SEQ ID NO: 144395 - DNA, 25 bp, Homo sapien
tccaggacacctccaagaagagtgt

SEQ ID NO: 144396 - DNA, 25 bp, Homo sapien
aagagtgtgctgaaagccatcgagc

SEQ ID NO: 144397 - DNA, 25 bp, Homo sapien
atcgagcaggctgacctactgcaag

SEQ ID NO: 144398 - DNA, 25 bp, Homo sapien
ggctgacctactgcaagaggaggat

SEQ ID NO: 144399 - DNA, 25 bp, Homo sapien
ctgcaagaggaggatgagtcgccac

SEQ ID NO: 144400 - DNA, 25 bp, Homo sapien
aggagatgggtttggcatagcccct

SEQ ID NO: 144401 - DNA, 25 bp, Homo sapien
tggcgggaacggctgcttctcctct

SEQ ID NO: 144402 - DNA, 25 bp, Homo sapien
cagagaatacacactagggcccagt

SEQ ID NO: 144403 - DNA, 25 bp, Homo sapien
gaatacacactagggcccagtggtt

SEQ ID NO: 144404 - DNA, 25 bp, Homo sapien
agggcccagtggttttacgaatatg

SEQ ID NO: 144405 - DNA, 25 bp, Homo sapien
ggttttacgaatatgggaatgccct

SEQ ID NO: 144406 - DNA, 25 bp, Homo sapien
tacgaatatgggaatgccctggaag

SEQ ID NO: 144407 - DNA, 25 bp, Homo sapien
gccctggaagggtccacctttgtga

SEQ ID NO: 144408 - DNA, 25 bp, Homo sapien
gaagggtccacctttgtgagccgta

SEQ ID NO: 144409 - DNA, 25 bp, Homo sapien
gtccacctttgtgagccgtaaaaag

SEQ ID NO: 144410 - DNA, 25 bp, Homo sapien
gaaactgcatcagtgtgaagactgt

SEQ ID NO: 144411 - DNA, 25 bp, Homo sapien
gaagatatttaggtggcgttcacac

SEQ ID NO: 144412 - DNA, 25 bp, Homo sapien
atttaggtggcgttcacacctaatt

SEQ ID NO: 144413 - DNA, 25 bp, Homo sapien
gtgacaaggtaatggtcctagacaa

SEQ ID NO: 144414 - DNA, 25 bp, Homo sapien
ggtaatggtcctagacaacgggaag

SEQ ID NO: 144415 - DNA, 25 bp, Homo sapien
tggtcctagacaacgggaagattat

SEQ ID NO: 144416 - DNA, 25 bp, Homo sapien
gaagattatagagtgcggcagccct

SEQ ID NO: 144417 - DNA, 25 bp, Homo sapien
tatagagtgcggcagccctgaagaa

SEQ ID NO: 144418 - DNA, 25 bp, Homo sapien
gcagccctgaagaactgctacaaat

SEQ ID NO: 144419 - DNA, 25 bp, Homo sapien
gaagaactgctacaaatccctggac

SEQ ID NO: 144420 - DNA, 25 bp, Homo sapien
tgctacaaatccctggaccctttta

SEQ ID NO: 144421 - DNA, 25 bp, Homo sapien
tgtgaacagcacaaaattctagcag

SEQ ID NO: 144422 - DNA, 25 bp, Homo sapien
attctagcagaaggccccatgggtt

SEQ ID NO: 144423 - DNA, 25 bp, Homo sapien
aagtgaacacccatgaacctactac

SEQ ID NO: 144424 - DNA, 25 bp, Homo sapien
tacgtggagctcttagacaaatact

SEQ ID NO: 144425 - DNA, 25 bp, Homo sapien
gacaaatactttggcagtgtgtgcg

SEQ ID NO: 144426 - DNA, 25 bp, Homo sapien
aatactttggcagtgtgtgcgagct

SEQ ID NO: 144427 - DNA, 25 bp, Homo sapien
gcagtgtgtgcgagctggacatcat

SEQ ID NO: 144428 - DNA, 25 bp, Homo sapien
agtgtgtgcgagctggacatcatct

SEQ ID NO: 144429 - DNA, 25 bp, Homo sapien
tgtgtgcgagctggacatcatcttc

SEQ ID NO: 144430 - DNA, 25 bp, Homo sapien
tgtgcgagctggacatcatcttcaa

SEQ ID NO: 144431 - DNA, 25 bp, Homo sapien
tgcgagctggacatcatcttcaact

SEQ ID NO: 144432 - DNA, 25 bp, Homo sapien
tcaactttgagaaggcctacttcat

SEQ ID NO: 144433 - DNA, 25 bp, Homo sapien
ctttgagaaggcctacttcatcctg

SEQ ID NO: 144434 - DNA, 25 bp, Homo sapien
ttcatcctggatgagtttttgatgg

SEQ ID NO: 144435 - DNA, 25 bp, Homo sapien
gggctgagcgacactcagggacacc

SEQ ID NO: 144436 - DNA, 25 bp, Homo sapien
gagcgacactcagggacacctcagt

SEQ ID NO: 144437 - DNA, 25 bp, Homo sapien
gacactcagggacacctcagttgtc

SEQ ID NO: 144438 - DNA, 25 bp, Homo sapien
actcagggacacctcagttgtcctc

SEQ ID NO: 144439 - DNA, 25 bp, Homo sapien
tggtgccctggcatgaaggcccagt

SEQ ID NO: 144440 - DNA, 25 bp, Homo sapien
gcatgaaggcccagtgcgacaggcc

SEQ ID NO: 144441 - DNA, 25 bp, Homo sapien
aggcccagtgcgacaggcccttggt

SEQ ID NO: 144442 - DNA, 25 bp, Homo sapien
tccttgaggtcagaggtcaggagca

SEQ ID NO: 144443 - DNA, 25 bp, Homo sapien
ccctcagccctttgtaaagtctgat

SEQ ID NO: 144444 - DNA, 25 bp, Homo sapien
cagccctttgtaaagtctgatgaag

SEQ ID NO: 144445 - DNA, 25 bp, Homo sapien
gggtggtgattcatgctgtgtgact

SEQ ID NO: 144446 - DNA, 25 bp, Homo sapien
gccgcaccctaccttgtctaagaaa

SEQ ID NO: 144447 - DNA, 25 bp, Homo sapien
atgtgtgtctggaacacgctgctcc

SEQ ID NO: 144448 - DNA, 25 bp, Homo sapien
cctgggcagctgttgggattctgat

SEQ ID NO: 144449 - DNA, 25 bp, Homo sapien
gggaaacgatcatcctggacaggaa

SEQ ID NO: 144450 - DNA, 25 bp, Homo sapien
gtgagatggcttcagttcatgagac

SEQ ID NO: 144451 - DNA, 25 bp, Homo sapien
ggcttcagttcatgagacgggatct

SEQ ID NO: 144452 - DNA, 25 bp, Homo sapien
gacgggatctgagttagacatcacc

SEQ ID NO: 144453 - DNA, 25 bp, Homo sapien
gagttagacatcaccagtggaaatt

SEQ ID NO: 144454 - DNA, 25 bp, Homo sapien
cctaactattctcccatcaaatcat

SEQ ID NO: 144455 - DNA, 25 bp, Homo sapien
aatcatatatgttgacctgtctgaa

SEQ ID NO: 144456 - DNA, 25 bp, Homo sapien
tgaattataaaccagcctgaccttt

SEQ ID NO: 144457 - DNA, 25 bp, Homo sapien
gaatgggaagcacttcaagttcacc

SEQ ID NO: 144458 - DNA, 25 bp, Homo sapien
aatgggaagcacttcaagttcacca

SEQ ID NO: 144459 - DNA, 25 bp, Homo sapien
atgggaagcacttcaagttcaccat

SEQ ID NO: 144460 - DNA, 25 bp, Homo sapien
tgggaagcacttcaagttcaccatc

SEQ ID NO: 144461 - DNA, 25 bp, Homo sapien
gggaagcacttcaagttcaccatca

SEQ ID NO: 144462 - DNA, 25 bp, Homo sapien
ggaagcacttcaagttcaccatcac

SEQ ID NO: 144463 - DNA, 25 bp, Homo sapien
tcaagttcaccatcaccgctgggtc

SEQ ID NO: 144464 - DNA, 25 bp, Homo sapien
tcaccatcaccgctgggtccaaagt

SEQ ID NO: 144465 - DNA, 25 bp, Homo sapien
caccatcaccgctgggtccaaagtg

SEQ ID NO: 144466 - DNA, 25 bp, Homo sapien
aagtgatccaaaacgaattcacggt

SEQ ID NO: 144467 - DNA, 25 bp, Homo sapien
tgatccaaaacgaattcacggtggg

SEQ ID NO: 144468 - DNA, 25 bp, Homo sapien
aagagctctttgtctcaccagctca

SEQ ID NO: 144469 - DNA, 25 bp, Homo sapien
aactccatgaccaggccaccatctg

SEQ ID NO: 144470 - DNA, 25 bp, Homo sapien
ggccagggtgtgaggtttcacctcc

SEQ ID NO: 144471 - DNA, 25 bp, Homo sapien
gtgtgaggtttcacctccgttgcgg

SEQ ID NO: 144472 - DNA, 25 bp, Homo sapien
gtttcacctccgttgcggctgtgct

SEQ ID NO: 144473 - DNA, 25 bp, Homo sapien
gctgtgctcctgtggataacattgc

SEQ ID NO: 144474 - DNA, 25 bp, Homo sapien
gtgctcctgtggataacattgctag

SEQ ID NO: 144475 - DNA, 25 bp, Homo sapien
ggataacattgctagcgagccgcct

SEQ ID NO: 144476 - DNA, 25 bp, Homo sapien
ataacattgctagcgagccgcctct

SEQ ID NO: 144477 - DNA, 25 bp, Homo sapien
gcctctggttccactcagcttggtt

SEQ ID NO: 144478 - DNA, 25 bp, Homo sapien
tggttccactcagcttggttcctgc

SEQ ID NO: 144479 - DNA, 25 bp, Homo sapien
agcacacaacgattatagtaactat

SEQ ID NO: 144480 - DNA, 25 bp, Homo sapien
tgttttcctacaggcctatttaaca

SEQ ID NO: 144481 - DNA, 25 bp, Homo sapien
acaggcctatttaacaagatgtttc

SEQ ID NO: 144482 - DNA, 25 bp, Homo sapien
aaatgttgctctaatcagattgctt

SEQ ID NO: 144483 - DNA, 25 bp, Homo sapien
gttgctctaatcagattgcttaaaa

SEQ ID NO: 144484 - DNA, 25 bp, Homo sapien
taagtaaatgtagctcccacaaggt

SEQ ID NO: 144485 - DNA, 25 bp, Homo sapien
gtagctcccacaaggtaaacttcat

SEQ ID NO: 144486 - DNA, 25 bp, Homo sapien
tcccacaaggtaaacttcattggta

SEQ ID NO: 144487 - DNA, 25 bp, Homo sapien
cattggtaagattgcactgttctga

SEQ ID NO: 144488 - DNA, 25 bp, Homo sapien
gattgcactgttctgattatgtaag

SEQ ID NO: 144489 - DNA, 25 bp, Homo sapien
gttctgattatgtaagcatttgtac

SEQ ID NO: 144490 - DNA, 25 bp, Homo sapien
tttcacggccatagcttccaataca

SEQ ID NO: 144491 - DNA, 25 bp, Homo sapien
gggagtttatagttctgatgtcttt

SEQ ID NO: 144492 - DNA, 25 bp, Homo sapien
gatgtctttgacattttccctggaa

SEQ ID NO: 144493 - DNA, 25 bp, Homo sapien
tgtctttgacattttccctggaaca

SEQ ID NO: 144494 - DNA, 25 bp, Homo sapien
ttccctggaacataccaaaccctag

SEQ ID NO: 144495 - DNA, 25 bp, Homo sapien
ggaacataccaaaccctagaaatgt

SEQ ID NO: 144496 - DNA, 25 bp, Homo sapien
cctggaatttggttactccactgcc

SEQ ID NO: 144497 - DNA, 25 bp, Homo sapien
ggaatttggttactccactgccatg

SEQ ID NO: 144498 - DNA, 25 bp, Homo sapien
aatttggttactccactgccatgtg

SEQ ID NO: 144499 - DNA, 25 bp, Homo sapien
tttggttactccactgccatgtgac

SEQ ID NO: 144500 - DNA, 25 bp, Homo sapien
ggttactccactgccatgtgaccga

SEQ ID NO: 144501 - DNA, 25 bp, Homo sapien
agccaaattgatctcccagtcttgt

SEQ ID NO: 144502 - DNA, 25 bp, Homo sapien
tgtccttacccattccaagtgctct

SEQ ID NO: 144503 - DNA, 25 bp, Homo sapien
tcatccaagttttaagtcctccacc

SEQ ID NO: 144504 - DNA, 25 bp, Homo sapien
tccaccctgttctaagagactgttc

SEQ ID NO: 144505 - DNA, 25 bp, Homo sapien
aagagactgttccaacggctctggg

SEQ ID NO: 144506 - DNA, 25 bp, Homo sapien
ctgggcctcagtggtcacttgacca

SEQ ID NO: 144507 - DNA, 25 bp, Homo sapien
tgcctgagtcacacgtacatcttat

SEQ ID NO: 144508 - DNA, 25 bp, Homo sapien
tcctggagggcggataacatcttat

SEQ ID NO: 144509 - DNA, 25 bp, Homo sapien
ggataacatcttatactactcttgt

SEQ ID NO: 144510 - DNA, 25 bp, Homo sapien
tactcttgtattctcatggcaccta

SEQ ID NO: 144511 - DNA, 25 bp, Homo sapien
catggcacctagtgcagtgctgggc

SEQ ID NO: 144512 - DNA, 25 bp, Homo sapien
gtcgtctcctctatcagctacatcg

SEQ ID NO: 144513 - DNA, 25 bp, Homo sapien
tacatcgctcgacagctgcaggaac

SEQ ID NO: 144514 - DNA, 25 bp, Homo sapien
aggaacaggaggaccacgatgcgct

SEQ ID NO: 144515 - DNA, 25 bp, Homo sapien
accacgatgcgctgaaggaggactg

SEQ ID NO: 144516 - DNA, 25 bp, Homo sapien
ttgtggccatggtagtggaccgcct

SEQ ID NO: 144517 - DNA, 25 bp, Homo sapien
tgtggactttcatcatcttcaccag

SEQ ID NO: 144518 - DNA, 25 bp, Homo sapien
atcttcaccagcgttgggaccctag

SEQ ID NO: 144519 - DNA, 25 bp, Homo sapien
ttgggaccctagtcatcttcctgga

SEQ ID NO: 144520 - DNA, 25 bp, Homo sapien
agacccctttccttgaagactggag

SEQ ID NO: 144521 - DNA, 25 bp, Homo sapien
cccctgccagttgaagtgagagagt

SEQ ID NO: 144522 - DNA, 25 bp, Homo sapien
gtttggtgatactgtcaagccctat

SEQ ID NO: 144523 - DNA, 25 bp, Homo sapien
gaggaggcccagaaaaggccaacca

SEQ ID NO: 144524 - DNA, 25 bp, Homo sapien
agggcccaaccgtgcatgatgacag

SEQ ID NO: 144525 - DNA, 25 bp, Homo sapien
gagaacttaagtctctgcagagagc

SEQ ID NO: 144526 - DNA, 25 bp, Homo sapien
gagaatcaggacaatcctgcaggtg

SEQ ID NO: 144527 - DNA, 25 bp, Homo sapien
gcaggtggcccgcttactgttaaat

SEQ ID NO: 144528 - DNA, 25 bp, Homo sapien
ttactgttaaatcgtccctctgttg

SEQ ID NO: 144529 - DNA, 25 bp, Homo sapien
taaatcgtccctctgttgctttatc

SEQ ID NO: 144530 - DNA, 25 bp, Homo sapien
cctctgttgctttatcctctaaaat

SEQ ID NO: 144531 - DNA, 25 bp, Homo sapien
gttatgcatttgctgtcataccaga

SEQ ID NO: 144532 - DNA, 25 bp, Homo sapien
gtcataccagacaattttttatcat

SEQ ID NO: 144533 - DNA, 25 bp, Homo sapien
ttttatcatgagcacacttctttaa

SEQ ID NO: 144534 - DNA, 25 bp, Homo sapien
tctcctcatctctaacagctcagga

SEQ ID NO: 144535 - DNA, 25 bp, Homo sapien
atctctaacagctcaggatctctta

SEQ ID NO: 144536 - DNA, 25 bp, Homo sapien
aacagctcaggatctcttagcattt

SEQ ID NO: 144537 - DNA, 25 bp, Homo sapien
ctcaggatctcttagcattttaatt

SEQ ID NO: 144538 - DNA, 25 bp, Homo sapien
gtaattgtttgtctttaactgtcaa

SEQ ID NO: 144539 - DNA, 25 bp, Homo sapien
taataagacgagaggacgagcgatt

SEQ ID NO: 144540 - DNA, 25 bp, Homo sapien
agaaaacagacctaatgctccttgt

SEQ ID NO: 144541 - DNA, 25 bp, Homo sapien
agacctaatgctccttgttcctaga

SEQ ID NO: 144542 - DNA, 25 bp, Homo sapien
agggtggcctaagagttgagctctc

SEQ ID NO: 144543 - DNA, 25 bp, Homo sapien
aagagttgagctctcggaactgcat

SEQ ID NO: 144544 - DNA, 25 bp, Homo sapien
gagttgagctctcggaactgcatgc

SEQ ID NO: 144545 - DNA, 25 bp, Homo sapien
ttttcaccaaaccatggatagaatc

SEQ ID NO: 144546 - DNA, 25 bp, Homo sapien
ttcaccaaaccatggatagaatcaa

SEQ ID NO: 144547 - DNA, 25 bp, Homo sapien
accaaaccatggatagaatcaatat

SEQ ID NO: 144548 - DNA, 25 bp, Homo sapien
gaatcaatatttgtaggccaggcgt

SEQ ID NO: 144549 - DNA, 25 bp, Homo sapien
aatcaatatttgtaggccaggcgtg

SEQ ID NO: 144550 - DNA, 25 bp, Homo sapien
atcaatatttgtaggccaggcgtgg

SEQ ID NO: 144551 - DNA, 25 bp, Homo sapien
tcaatatttgtaggccaggcgtggt

SEQ ID NO: 144552 - DNA, 25 bp, Homo sapien
aaacctcatccctctaacaatataa

SEQ ID NO: 144553 - DNA, 25 bp, Homo sapien
aacctcatccctctaacaatataat

SEQ ID NO: 144554 - DNA, 25 bp, Homo sapien
acctcatccctctaacaatataata

SEQ ID NO: 144555 - DNA, 25 bp, Homo sapien
tcatccctctaacaatataataatt

SEQ ID NO: 144556 - DNA, 25 bp, Homo sapien
gactgagccaccctctccgtagggt

SEQ ID NO: 144557 - DNA, 25 bp, Homo sapien
tctccgtagggttctttctcgagga

SEQ ID NO: 144558 - DNA, 25 bp, Homo sapien
tagggttctttctcgaggactctac

SEQ ID NO: 144559 - DNA, 25 bp, Homo sapien
acctctgtccacattcttcttggat

SEQ ID NO: 144560 - DNA, 25 bp, Homo sapien
ccacattcttcttggatttgtataa

SEQ ID NO: 144561 - DNA, 25 bp, Homo sapien
aaaagttggaaacacagatctgtgc

SEQ ID NO: 144562 - DNA, 25 bp, Homo sapien
agatctgtgcagttctacattcact

SEQ ID NO: 144563 - DNA, 25 bp, Homo sapien
cagtgtgattttcatcggttttgta

SEQ ID NO: 144564 - DNA, 25 bp, Homo sapien
ttttcatcggttttgtaagtacagg

SEQ ID NO: 144565 - DNA, 25 bp, Homo sapien
agtacaggacttgccgtttcttttg

SEQ ID NO: 144566 - DNA, 25 bp, Homo sapien
gccgtttcttttgatctcttgattg

SEQ ID NO: 144567 - DNA, 25 bp, Homo sapien
gctgatttgctggtaggattttgta

SEQ ID NO: 144568 - DNA, 25 bp, Homo sapien
ttttgtacagtttagagaagcgatt

SEQ ID NO: 144569 - DNA, 25 bp, Homo sapien
gaagcgattatttattgtgaaactg

SEQ ID NO: 144570 - DNA, 25 bp, Homo sapien
tctccactccaactcctttatgtgg

SEQ ID NO: 144571 - DNA, 25 bp, Homo sapien
actcctttatgtggatctgttcaaa

SEQ ID NO: 144572 - DNA, 25 bp, Homo sapien
gatctgttcaaagtagtcactgtat

SEQ ID NO: 144573 - DNA, 25 bp, Homo sapien
aaactcatactccttagagcttgaa

SEQ ID NO: 144574 - DNA, 25 bp, Homo sapien
aaatgcatatgtgctgtttggcacc

SEQ ID NO: 144575 - DNA, 25 bp, Homo sapien
gtttggcaccgtggcaagatggtat

SEQ ID NO: 144576 - DNA, 25 bp, Homo sapien
gagaaacccatcaattgctcaaata

SEQ ID NO: 144577 - DNA, 25 bp, Homo sapien
tcaattgctcaaatactcagaaagt

SEQ ID NO: 144578 - DNA, 25 bp, Homo sapien
atggagtgtgcagacagccatgcgt

SEQ ID NO: 144579 - DNA, 25 bp, Homo sapien
gcagacagccatgcgtggccacggg

SEQ ID NO: 144580 - DNA, 25 bp, Homo sapien
ggcagtgtgaggacctccctgtctc

SEQ ID NO: 144581 - DNA, 25 bp, Homo sapien
cagctgcttgacctagctctttggg

SEQ ID NO: 144582 - DNA, 25 bp, Homo sapien
tgcttgacctagctctttgggcctc

SEQ ID NO: 144583 - DNA, 25 bp, Homo sapien
ctctgcctggagtgtcggatcctgt

SEQ ID NO: 144584 - DNA, 25 bp, Homo sapien
cctggagtgtcggatcctgtgagta

SEQ ID NO: 144585 - DNA, 25 bp, Homo sapien
ctcccctgggcagggttctccaagg

SEQ ID NO: 144586 - DNA, 25 bp, Homo sapien
ccctgacatcatcattcttgtggga

SEQ ID NO: 144587 - DNA, 25 bp, Homo sapien
cattcttgtgggagacagcagcctg

SEQ ID NO: 144588 - DNA, 25 bp, Homo sapien
tgggagacagcagcctgtatgtggt

SEQ ID NO: 144589 - DNA, 25 bp, Homo sapien
atctttaagcccgacttgaggctga

SEQ ID NO: 144590 - DNA, 25 bp, Homo sapien
taagcccgacttgaggctgagagca

SEQ ID NO: 144591 - DNA, 25 bp, Homo sapien
agcccgacttgaggctgagagcagc

SEQ ID NO: 144592 - DNA, 25 bp, Homo sapien
gagcagctggaagtttgggtttggt

SEQ ID NO: 144593 - DNA, 25 bp, Homo sapien
caggacagacagactaatgtagtga

SEQ ID NO: 144594 - DNA, 25 bp, Homo sapien
atgtagtgagtgtagctgtagctga

SEQ ID NO: 144595 - DNA, 25 bp, Homo sapien
tgtagctgtagctgaggcttaactg

SEQ ID NO: 144596 - DNA, 25 bp, Homo sapien
tagctgaggcttaactgggagggat

SEQ ID NO: 144597 - DNA, 25 bp, Homo sapien
aactgggagggatgccgagcttgct

SEQ ID NO: 144598 - DNA, 25 bp, Homo sapien
gagggatgccgagcttgctggaact

SEQ ID NO: 144599 - DNA, 25 bp, Homo sapien
agcttgctggaactactgggaccaa

SEQ ID NO: 144600 - DNA, 25 bp, Homo sapien
tgtggcggcatgtccctgtggtccc

SEQ ID NO: 144601 - DNA, 25 bp, Homo sapien
atgattcacagcactgcactgcagc

SEQ ID NO: 144602 - DNA, 25 bp, Homo sapien
aaagcaagaccctgtgtgaaattaa

SEQ ID NO: 144603 - DNA, 25 bp, Homo sapien
aaaggaggtatatcaactgttgtat

SEQ ID NO: 144604 - DNA, 25 bp, Homo sapien
tatcaactgttgtatcctcggacgg

SEQ ID NO: 144605 - DNA, 25 bp, Homo sapien
aactgttgtatcctcggacgggctc

SEQ ID NO: 144606 - DNA, 25 bp, Homo sapien
gttgtatcctcggacgggctcctga

SEQ ID NO: 144607 - DNA, 25 bp, Homo sapien
gacgggctcctgacatggctttaat

SEQ ID NO: 144608 - DNA, 25 bp, Homo sapien
gggctcctgacatggctttaatcag

SEQ ID NO: 144609 - DNA, 25 bp, Homo sapien
acatggctttaatcaggagtttcct

SEQ ID NO: 144610 - DNA, 25 bp, Homo sapien
ggagtttcctccataaactattatt

SEQ ID NO: 144611 - DNA, 25 bp, Homo sapien
aaagcaagaccctgtgtgaaattaa

SEQ ID NO: 144612 - DNA, 25 bp, Homo sapien
aaaggaggtatatcaactgttgtat

SEQ ID NO: 144613 - DNA, 25 bp, Homo sapien
tatcaactgttgtatcctcggacgg

SEQ ID NO: 144614 - DNA, 25 bp, Homo sapien
aactgttgtatcctcggacgggctc

SEQ ID NO: 144615 - DNA, 25 bp, Homo sapien
gttgtatcctcggacgggctcctga

SEQ ID NO: 144616 - DNA, 25 bp, Homo sapien
gacgggctcctgacatggctttaat

SEQ ID NO: 144617 - DNA, 25 bp, Homo sapien
gggctcctgacatggctttaatcag

SEQ ID NO: 144618 - DNA, 25 bp, Homo sapien
acatggctttaatcaggagtttcct

SEQ ID NO: 144619 - DNA, 25 bp, Homo sapien
tcaggagtttcctccataaactatt

SEQ ID NO: 144620 - DNA, 25 bp, Homo sapien
ggagtttcctccataaactattatt

SEQ ID NO: 144621 - DNA, 25 bp, Homo sapien
ttcctccataaactattattttcag

SEQ ID NO: 144622 - DNA, 25 bp, Homo sapien
ttcatgctctggaagacgtaagaca

SEQ ID NO: 144623 - DNA, 25 bp, Homo sapien
aaggcagtgtaacaatccacctcct

SEQ ID NO: 144624 - DNA, 25 bp, Homo sapien
gggtagcccctgttcaggccctgct

SEQ ID NO: 144625 - DNA, 25 bp, Homo sapien
gcttcagaaacacttgactgctcct

SEQ ID NO: 144626 - DNA, 25 bp, Homo sapien
acacttgactgctcctagcagatga

SEQ ID NO: 144627 - DNA, 25 bp, Homo sapien
agcagatgatacagcagtgggctac

SEQ ID NO: 144628 - DNA, 25 bp, Homo sapien
atgagagccctgagccctcaagaac

SEQ ID NO: 144629 - DNA, 25 bp, Homo sapien
tacaccagtttccacctggagttca

SEQ ID NO: 144630 - DNA, 25 bp, Homo sapien
ttccacctggagttcatgcaagggc

SEQ ID NO: 144631 - DNA, 25 bp, Homo sapien
aaaggcagtgccatgcaagctgttt

SEQ ID NO: 144632 - DNA, 25 bp, Homo sapien
gtgccatgcaagctgtttaaaataa

SEQ ID NO: 144633 - DNA, 25 bp, Homo sapien
ttctttttatgccacacagtgcatt

SEQ ID NO: 144634 - DNA, 25 bp, Homo sapien
tttttatgccacacagtgcattgtt

SEQ ID NO: 144635 - DNA, 25 bp, Homo sapien
ttatgccacacagtgcattgttttt

SEQ ID NO: 144636 - DNA, 25 bp, Homo sapien
tgttttttctacctgcttgtcttat

SEQ ID NO: 144637 - DNA, 25 bp, Homo sapien
tttttctacctgcttgtcttatttt

SEQ ID NO: 144638 - DNA, 25 bp, Homo sapien
ttctacctgcttgtcttatttttag

SEQ ID NO: 144639 - DNA, 25 bp, Homo sapien
catcacgaagcagctccaaaaggaa

SEQ ID NO: 144640 - DNA, 25 bp, Homo sapien
ccgtcctgctgatgtggtaggctag

SEQ ID NO: 144641 - DNA, 25 bp, Homo sapien
gtcctgctgatgtggtaggctagca

SEQ ID NO: 144642 - DNA, 25 bp, Homo sapien
cctgctgatgtggtaggctagcaat

SEQ ID NO: 144643 - DNA, 25 bp, Homo sapien
tgatgtggtaggctagcaatatttt

SEQ ID NO: 144644 - DNA, 25 bp, Homo sapien
aggacctgatcaaatttcacacagc

SEQ ID NO: 144645 - DNA, 25 bp, Homo sapien
atcaaatttcacacagcagtttcct

SEQ ID NO: 144646 - DNA, 25 bp, Homo sapien
atgctccagaatacccacccaagaa

SEQ ID NO: 144647 - DNA, 25 bp, Homo sapien
gaatacccacccaagaaaataatag

SEQ ID NO: 144648 - DNA, 25 bp, Homo sapien
aaacaatatcggctcctcatccaaa

SEQ ID NO: 144649 - DNA, 25 bp, Homo sapien
tatcggctcctcatccaaagaacaa

SEQ ID NO: 144650 - DNA, 25 bp, Homo sapien
gaacaactgctgattgaaacacctc

SEQ ID NO: 144651 - DNA, 25 bp, Homo sapien
gaaacacctcattagctgagtgtag

SEQ ID NO: 144652 - DNA, 25 bp, Homo sapien
ctgagtgtagagaagtgcatcttat

SEQ ID NO: 144653 - DNA, 25 bp, Homo sapien
gtgcatcttatgaaacagtcttagc

SEQ ID NO: 144654 - DNA, 25 bp, Homo sapien
gaaacagtcttagcagtggtaggtt

SEQ ID NO: 144655 - DNA, 25 bp, Homo sapien
ctcggagtcttcatgcttgtttgca

SEQ ID NO: 144656 - DNA, 25 bp, Homo sapien
gcttgtttgcatcatcggaacccta

SEQ ID NO: 144657 - DNA, 25 bp, Homo sapien
atcggaaccctagccgtgtttgcag

SEQ ID NO: 144658 - DNA, 25 bp, Homo sapien
gtgtttgcaggtcgactcattgaat

SEQ ID NO: 144659 - DNA, 25 bp, Homo sapien
aatgagctgagcttagctctgccct

SEQ ID NO: 144660 - DNA, 25 bp, Homo sapien
tgccctggaacctaccagagcagag

SEQ ID NO: 144661 - DNA, 25 bp, Homo sapien
ggaagatttgtctacttgctccact

SEQ ID NO: 144662 - DNA, 25 bp, Homo sapien
tccactcgcacttatcaaacgtgtt

SEQ ID NO: 144663 - DNA, 25 bp, Homo sapien
aaacgtgttatattccatacttatt

SEQ ID NO: 144664 - DNA, 25 bp, Homo sapien
gttttcatattgcttctccctttag

SEQ ID NO: 144665 - DNA, 25 bp, Homo sapien
ctttagttctgctgtctccctgaag

SEQ ID NO: 144666 - DNA, 25 bp, Homo sapien
atcctggaggctggaacagctggct

SEQ ID NO: 144667 - DNA, 25 bp, Homo sapien
acagctggctcttttagactcacaa

SEQ ID NO: 144668 - DNA, 25 bp, Homo sapien
aagtcagacgttcgattcccctctg

SEQ ID NO: 144669 - DNA, 25 bp, Homo sapien
ccctctgccaatagccagttttatt

SEQ ID NO: 144670 - DNA, 25 bp, Homo sapien
ggagtgaatcacatttcttacgcaa

SEQ ID NO: 144671 - DNA, 25 bp, Homo sapien
aatggttctgttggcaaggcttctc

SEQ ID NO: 144672 - DNA, 25 bp, Homo sapien
ttctccctgtcggtgaaggatcatg

SEQ ID NO: 144673 - DNA, 25 bp, Homo sapien
ggatcatgttcaggcactccaagtg

SEQ ID NO: 144674 - DNA, 25 bp, Homo sapien
ctcatcacagagcataaggcccatt

SEQ ID NO: 144675 - DNA, 25 bp, Homo sapien
aaggcccattttgttgttcaggtca

SEQ ID NO: 144676 - DNA, 25 bp, Homo sapien
tcaacagcaaaatgcctgcaccatg

SEQ ID NO: 144677 - DNA, 25 bp, Homo sapien
aactgcttccagtggttccaaggca

SEQ ID NO: 144678 - DNA, 25 bp, Homo sapien
gggtctgccacatgtagaaagatat

SEQ ID NO: 144679 - DNA, 25 bp, Homo sapien
aaaacgaaatcctccagcatcattg

SEQ ID NO: 144680 - DNA, 25 bp, Homo sapien
attggatccagttcagcctcacata

SEQ ID NO: 144681 - DNA, 25 bp, Homo sapien
acatacttctcaagcgacatcagga

SEQ ID NO: 144682 - DNA, 25 bp, Homo sapien
gcgacatcaggagccaatagcaaat

SEQ ID NO: 144683 - DNA, 25 bp, Homo sapien
gattatggctccaccgaagcctata

SEQ ID NO: 144684 - DNA, 25 bp, Homo sapien
gaccgtttcttaagccttcatatgc

SEQ ID NO: 144685 - DNA, 25 bp, Homo sapien
tgtacatagaccctctttcttgttt

SEQ ID NO: 144686 - DNA, 25 bp, Homo sapien
ctctttcttgtttgtcagcatctga

SEQ ID NO: 144687 - DNA, 25 bp, Homo sapien
agcatctgaccatctgtgactataa

SEQ ID NO: 144688 - DNA, 25 bp, Homo sapien
tgacccaggacccaacatggtctag

SEQ ID NO: 144689 - DNA, 25 bp, Homo sapien
aggacccaacatggtctagggatgc

SEQ ID NO: 144690 - DNA, 25 bp, Homo sapien
acccaacatggtctagggatgcagg

SEQ ID NO: 144691 - DNA, 25 bp, Homo sapien
caacatggtctagggatgcaggatc

SEQ ID NO: 144692 - DNA, 25 bp, Homo sapien
tagggatgcaggatccccgccctgg

SEQ ID NO: 144693 - DNA, 25 bp, Homo sapien
gcagggattgcccaccgtcttccag

SEQ ID NO: 144694 - DNA, 25 bp, Homo sapien
agggattgcccaccgtcttccagac

SEQ ID NO: 144695 - DNA, 25 bp, Homo sapien
tttagtgctgctgctttcactgctg

SEQ ID NO: 144696 - DNA, 25 bp, Homo sapien
agtgctgctgctttcactgctgcac

SEQ ID NO: 144697 - DNA, 25 bp, Homo sapien
ccgagcagcctttgtactctgcttg

SEQ ID NO: 144698 - DNA, 25 bp, Homo sapien
cgagcagcctttgtactctgcttgc

SEQ ID NO: 144699 - DNA, 25 bp, Homo sapien
aatctatagttcactgacacagtaa

SEQ ID NO: 144700 - DNA, 25 bp, Homo sapien
gaatcaacaagatttccacaattct

SEQ ID NO: 144701 - DNA, 25 bp, Homo sapien
acaattcttctgtcaagcttactac

SEQ ID NO: 144702 - DNA, 25 bp, Homo sapien
gggattggcaagtaacttctgactt

SEQ ID NO: 144703 - DNA, 25 bp, Homo sapien
gtaacttctgacttactgtcagttg

SEQ ID NO: 144704 - DNA, 25 bp, Homo sapien
tactgtcagttgtacttctgctcca

SEQ ID NO: 144705 - DNA, 25 bp, Homo sapien
agttgtacttctgctccatagacat

SEQ ID NO: 144706 - DNA, 25 bp, Homo sapien
gacatcagtattctgccatcatttt

SEQ ID NO: 144707 - DNA, 25 bp, Homo sapien
tcatttttgatgactacctcagaac

SEQ ID NO: 144708 - DNA, 25 bp, Homo sapien
acgtatatcacataattccagtcac

SEQ ID NO: 144709 - DNA, 25 bp, Homo sapien
cagtcacagtttttggttcctcttt

SEQ ID NO: 144710 - DNA, 25 bp, Homo sapien
tcccatttccaacccctccctagca

SEQ ID NO: 144711 - DNA, 25 bp, Homo sapien
tgacccaggacccaacatggtctag

SEQ ID NO: 144712 - DNA, 25 bp, Homo sapien
aggacccaacatggtctagggatgc

SEQ ID NO: 144713 - DNA, 25 bp, Homo sapien
ggacccaacatggtctagggatgca

SEQ ID NO: 144714 - DNA, 25 bp, Homo sapien
gacccaacatggtctagggatgcag

SEQ ID NO: 144715 - DNA, 25 bp, Homo sapien
acccaacatggtctagggatgcagg

SEQ ID NO: 144716 - DNA, 25 bp, Homo sapien
cccaacatggtctagggatgcagga

SEQ ID NO: 144717 - DNA, 25 bp, Homo sapien
ccaacatggtctagggatgcaggat

SEQ ID NO: 144718 - DNA, 25 bp, Homo sapien
caacatggtctagggatgcaggatc

SEQ ID NO: 144719 - DNA, 25 bp, Homo sapien
aacatggtctagggatgcaggatcc

SEQ ID NO: 144720 - DNA, 25 bp, Homo sapien
gcccaccgtcttccagacaccccac

SEQ ID NO: 144721 - DNA, 25 bp, Homo sapien
tcttccttgttgaattcttacagtt

SEQ ID NO: 144722 - DNA, 25 bp, Homo sapien
gaatttgctgctataagaatgtcca

SEQ ID NO: 144723 - DNA, 25 bp, Homo sapien
gaatgtccagctaccatgggaacgc

SEQ ID NO: 144724 - DNA, 25 bp, Homo sapien
gggaacgcaaggcagcaactctcta

SEQ ID NO: 144725 - DNA, 25 bp, Homo sapien
aggcagcaactctctaattaaccag

SEQ ID NO: 144726 - DNA, 25 bp, Homo sapien
ccaggtcataaaaacgattcgtctt

SEQ ID NO: 144727 - DNA, 25 bp, Homo sapien
gattcgtcttctatgtagacatcac

SEQ ID NO: 144728 - DNA, 25 bp, Homo sapien
gtagacatcactttcttactataat

SEQ ID NO: 144729 - DNA, 25 bp, Homo sapien
tctacacttcaatatgaactgcccc

SEQ ID NO: 144730 - DNA, 25 bp, Homo sapien
aatgcactgatatgaaacacggctt

SEQ ID NO: 144731 - DNA, 25 bp, Homo sapien
gaaacacggcttacactaatgacat

SEQ ID NO: 144732 - DNA, 25 bp, Homo sapien
actgaaccatagatactgtatgctt

SEQ ID NO: 144733 - DNA, 25 bp, Homo sapien
gaaccatagatactgtatgcttaag

SEQ ID NO: 144734 - DNA, 25 bp, Homo sapien
acagataagtagcagagtaggtgaa

SEQ ID NO: 144735 - DNA, 25 bp, Homo sapien
agctaagcagctgtacgtctactaa

SEQ ID NO: 144736 - DNA, 25 bp, Homo sapien
aagcagctgtacgtctactaaaatg

SEQ ID NO: 144737 - DNA, 25 bp, Homo sapien
gctgtacgtctactaaaatgtctga

SEQ ID NO: 144738 - DNA, 25 bp, Homo sapien
gtacgtctactaaaatgtctgacac

SEQ ID NO: 144739 - DNA, 25 bp, Homo sapien
tattagtgtgacttattactgctca

SEQ ID NO: 144740 - DNA, 25 bp, Homo sapien
gtgtgacttattactgctcatgact

SEQ ID NO: 144741 - DNA, 25 bp, Homo sapien
gacttattactgctcatgactttaa

SEQ ID NO: 144742 - DNA, 25 bp, Homo sapien
actgctcatgactttaatttcaatg

SEQ ID NO: 144743 - DNA, 25 bp, Homo sapien
cagcagtgtctccaggacatcttgg

SEQ ID NO: 144744 - DNA, 25 bp, Homo sapien
agcagtgtctccaggacatcttggc

SEQ ID NO: 144745 - DNA, 25 bp, Homo sapien
agagctgtgggctgcgtgtcctggg

SEQ ID NO: 144746 - DNA, 25 bp, Homo sapien
gctgcgtgtcctgggtggagatgaa

SEQ ID NO: 144747 - DNA, 25 bp, Homo sapien
aagaaagcaatttccaacctgacaa

SEQ ID NO: 144748 - DNA, 25 bp, Homo sapien
gaaagcaatttccaacctgacaaat

SEQ ID NO: 144749 - DNA, 25 bp, Homo sapien
gcaatttccaacctgacaaatccgc

SEQ ID NO: 144750 - DNA, 25 bp, Homo sapien
atttccaacctgacaaatccgccag

SEQ ID NO: 144751 - DNA, 25 bp, Homo sapien
aaagtgagccggcccagcaagatga

SEQ ID NO: 144752 - DNA, 25 bp, Homo sapien
agcaagatgaaacagggcaccccag

SEQ ID NO: 144753 - DNA, 25 bp, Homo sapien
caagatgaaacagggcaccccagct

SEQ ID NO: 144754 - DNA, 25 bp, Homo sapien
accgcgccccgtgggctgtgggtga

SEQ ID NO: 144755 - DNA, 25 bp, Homo sapien
gctccctgcactgagcgggtttagg

SEQ ID NO: 144756 - DNA, 25 bp, Homo sapien
tcgcccacatgcatgcaggccaaga

SEQ ID NO: 144757 - DNA, 25 bp, Homo sapien
cacatgcatgcaggccaagacagca

SEQ ID NO: 144758 - DNA, 25 bp, Homo sapien
caagacagcaaatgccagccgggca

SEQ ID NO: 144759 - DNA, 25 bp, Homo sapien
acagcaaatgccagccgggcacgac

SEQ ID NO: 144760 - DNA, 25 bp, Homo sapien
agtggaggcgttggtcctggaagct

SEQ ID NO: 144761 - DNA, 25 bp, Homo sapien
ctgactcatcggagagggaaatacc

SEQ ID NO: 144762 - DNA, 25 bp, Homo sapien
tcatcggagagggaaataccaaata

SEQ ID NO: 144763 - DNA, 25 bp, Homo sapien
ataccaaataaacatccgaggttgc

SEQ ID NO: 144764 - DNA, 25 bp, Homo sapien
ccaaataaacatccgaggttgcaaa

SEQ ID NO: 144765 - DNA, 25 bp, Homo sapien
agcccagagccacctggatctatcc

SEQ ID NO: 144766 - DNA, 25 bp, Homo sapien
cggcctccacacctgaacttgccta

SEQ ID NO: 144767 - DNA, 25 bp, Homo sapien
aacttgcctaactaactggcagggg

SEQ ID NO: 144768 - DNA, 25 bp, Homo sapien
gagggtggcaagaacagtgggcgtt

SEQ ID NO: 144769 - DNA, 25 bp, Homo sapien
aacagtgggcgttgggagcctagct

SEQ ID NO: 144770 - DNA, 25 bp, Homo sapien
gcgttgggagcctagctcctgccac

SEQ ID NO: 144771 - DNA, 25 bp, Homo sapien
ggagcctagctcctgccacatggag

SEQ ID NO: 144772 - DNA, 25 bp, Homo sapien
tgccggtcgggcagccagcagaggg

SEQ ID NO: 144773 - DNA, 25 bp, Homo sapien
gggagtagccaagctgcttgtcctg

SEQ ID NO: 144774 - DNA, 25 bp, Homo sapien
agtagccaagctgcttgtcctgggc

SEQ ID NO: 144775 - DNA, 25 bp, Homo sapien
agccaagctgcttgtcctgggcctg

SEQ ID NO: 144776 - DNA, 25 bp, Homo sapien
gactactagagttcattgaacacta

SEQ ID NO: 144777 - DNA, 25 bp, Homo sapien
aatccaaatgcaggatagtaatttt

SEQ ID NO: 144778 - DNA, 25 bp, Homo sapien
gaaagactattgcaggtgtttaaaa

SEQ ID NO: 144779 - DNA, 25 bp, Homo sapien
gactattgcaggtgtttaaaaagaa

SEQ ID NO: 144780 - DNA, 25 bp, Homo sapien
ctgtaagtagttgtcatattctgga

SEQ ID NO: 144781 - DNA, 25 bp, Homo sapien
agtagttgtcatattctggaaaatt

SEQ ID NO: 144782 - DNA, 25 bp, Homo sapien
ttagagttaagatatctcctctctt

SEQ ID NO: 144783 - DNA, 25 bp, Homo sapien
atatctcctctctttggttagggaa

SEQ ID NO: 144784 - DNA, 25 bp, Homo sapien
agcccttcaccattgtggaatgatg

SEQ ID NO: 144785 - DNA, 25 bp, Homo sapien
ttcaccattgtggaatgatgccctg

SEQ ID NO: 144786 - DNA, 25 bp, Homo sapien
accattgtggaatgatgccctggct

SEQ ID NO: 144787 - DNA, 25 bp, Homo sapien
agtggtggagtgtgtcatgaacaat

SEQ ID NO: 144788 - DNA, 25 bp, Homo sapien
gtgtgtcatgaacaatgtcacctgt

SEQ ID NO: 144789 - DNA, 25 bp, Homo sapien
gaacaatgtcacctgtactcggatc

SEQ ID NO: 144790 - DNA, 25 bp, Homo sapien
atgtcacctgtactcggatctatga

SEQ ID NO: 144791 - DNA, 25 bp, Homo sapien
acctgtactcggatctatgaaaaag

SEQ ID NO: 144792 - DNA, 25 bp, Homo sapien
catcactttggacaggagttaatta

SEQ ID NO: 144793 - DNA, 25 bp, Homo sapien
aagagaatgaccaagctcagttcaa

SEQ ID NO: 144794 - DNA, 25 bp, Homo sapien
gaatgaccaagctcagttcaatgag

SEQ ID NO: 144795 - DNA, 25 bp, Homo sapien
gttcaatgagcaaatctccatactg

SEQ ID NO: 144796 - DNA, 25 bp, Homo sapien
tttcattactgtgttcaattatctt

SEQ ID NO: 144797 - DNA, 25 bp, Homo sapien
gtgtgttggattaattaggatcatc

SEQ ID NO: 144798 - DNA, 25 bp, Homo sapien
gcaaaacatgggtatgctgtagcta

SEQ ID NO: 144799 - DNA, 25 bp, Homo sapien
catgggtatgctgtagctaacttta

SEQ ID NO: 144800 - DNA, 25 bp, Homo sapien
gtatgctgtagctaactttataaaa

SEQ ID NO: 144801 - DNA, 25 bp, Homo sapien
tatctgggaggattttttggttgcc

SEQ ID NO: 144802 - DNA, 25 bp, Homo sapien
gaggattttttggttgcctaaagtg

SEQ ID NO: 144803 - DNA, 25 bp, Homo sapien
ggttgcctaaagtggctatagttac

SEQ ID NO: 144804 - DNA, 25 bp, Homo sapien
gcctaaagtggctatagttactgat

SEQ ID NO: 144805 - DNA, 25 bp, Homo sapien
gtggctatagttactgattttttat

SEQ ID NO: 144806 - DNA, 25 bp, Homo sapien
ttaacaactaccttatttttcactg

SEQ ID NO: 144807 - DNA, 25 bp, Homo sapien
tttttcactgtacagacactaattc

SEQ ID NO: 144808 - DNA, 25 bp, Homo sapien
atgtgacaagtggacattatttatg

SEQ ID NO: 144809 - DNA, 25 bp, Homo sapien
agctgctggccctaaggtgcacatg

SEQ ID NO: 144810 - DNA, 25 bp, Homo sapien
ctggccctaaggtgcacatgctgag

SEQ ID NO: 144811 - DNA, 25 bp, Homo sapien
taaggtgcacatgctgaggaaggcc

SEQ ID NO: 144812 - DNA, 25 bp, Homo sapien
ggatcgtgcgcctgcccctgagagc

SEQ ID NO: 144813 - DNA, 25 bp, Homo sapien
gcccctgagagcgatcctaggtagg

SEQ ID NO: 144814 - DNA, 25 bp, Homo sapien
agcccaagggctcgagccatctctg

SEQ ID NO: 144815 - DNA, 25 bp, Homo sapien
tcccgccagccttgttttcaggtgg

SEQ ID NO: 144816 - DNA, 25 bp, Homo sapien
cagccttgttttcaggtggtctgga

SEQ ID NO: 144817 - DNA, 25 bp, Homo sapien
cttgttttcaggtggtctggaggca

SEQ ID NO: 144818 - DNA, 25 bp, Homo sapien
gaggcagctccacgtcacacagtgg

SEQ ID NO: 144819 - DNA, 25 bp, Homo sapien
ccacgtcacacagtggctgtcatat

SEQ ID NO: 144820 - DNA, 25 bp, Homo sapien
atgtgaactgctgcctaaccactca

SEQ ID NO: 144821 - DNA, 25 bp, Homo sapien
tgctgcctaaccactcaagagtaca

SEQ ID NO: 144822 - DNA, 25 bp, Homo sapien
aagagtacacagctggcaccagagc

SEQ ID NO: 144823 - DNA, 25 bp, Homo sapien
gcatcacagagagccctgtgagcca

SEQ ID NO: 144824 - DNA, 25 bp, Homo sapien
gaacttaaccttggagtgagagccc

SEQ ID NO: 144825 - DNA, 25 bp, Homo sapien
aaaaatcgcatttcaaccctttgag

SEQ ID NO: 144826 - DNA, 25 bp, Homo sapien
atttcaaccctttgagtgcctcatt

SEQ ID NO: 144827 - DNA, 25 bp, Homo sapien
tgagtgcctcattccactgaatatt

SEQ ID NO: 144828 - DNA, 25 bp, Homo sapien
ggtaaactgacttattgcaatccca

SEQ ID NO: 144829 - DNA, 25 bp, Homo sapien
aatcccaagacccatcaatatcagt

SEQ ID NO: 144830 - DNA, 25 bp, Homo sapien
ttttttcctccctatacagtgccct

SEQ ID NO: 144831 - DNA, 25 bp, Homo sapien
acctgcaccggcacgagaagatcca

SEQ ID NO: 144832 - DNA, 25 bp, Homo sapien
tgcaccggcacgagaagatccacac

SEQ ID NO: 144833 - DNA, 25 bp, Homo sapien
ggcacgagaagatccacaccaccgg

SEQ ID NO: 144834 - DNA, 25 bp, Homo sapien
caaggccctggccatgctgatgctg

SEQ ID NO: 144835 - DNA, 25 bp, Homo sapien
gctcccacctaggaggccaggaaag

SEQ ID NO: 144836 - DNA, 25 bp, Homo sapien
tggaacagccccactggagtcaagg

SEQ ID NO: 144837 - DNA, 25 bp, Homo sapien
ctggagtcaaggctccgagggagga

SEQ ID NO: 144838 - DNA, 25 bp, Homo sapien
agaaagggcaggcactctgcgaatt

SEQ ID NO: 144839 - DNA, 25 bp, Homo sapien
aaagggcaggcactctgcgaattaa

SEQ ID NO: 144840 - DNA, 25 bp, Homo sapien
agggcaggcactctgcgaattaaag

SEQ ID NO: 144841 - DNA, 25 bp, Homo sapien
gcactctgcgaattaaaggccttgg

SEQ ID NO: 144842 - DNA, 25 bp, Homo sapien
taaccagtcttcaatccttactaac

SEQ ID NO: 144843 - DNA, 25 bp, Homo sapien
accagtcttcaatccttactaacca

SEQ ID NO: 144844 - DNA, 25 bp, Homo sapien
ccagtcttcaatccttactaaccat

SEQ ID NO: 144845 - DNA, 25 bp, Homo sapien
cagtcttcaatccttactaaccata

SEQ ID NO: 144846 - DNA, 25 bp, Homo sapien
agtcttcaatccttactaaccataa

SEQ ID NO: 144847 - DNA, 25 bp, Homo sapien
gtcttcaatccttactaaccataag

SEQ ID NO: 144848 - DNA, 25 bp, Homo sapien
ttcaatccttactaaccataagaaa

SEQ ID NO: 144849 - DNA, 25 bp, Homo sapien
agaaaattcatactatcacacctgt

SEQ ID NO: 144850 - DNA, 25 bp, Homo sapien
gaaaattcatactatcacacctgta

SEQ ID NO: 144851 - DNA, 25 bp, Homo sapien
aaaattcatactatcacacctgtaa

SEQ ID NO: 144852 - DNA, 25 bp, Homo sapien
aattcatactatcacacctgtaatc

SEQ ID NO: 144853 - DNA, 25 bp, Homo sapien
cacacgggtgaacggccctacgcat

SEQ ID NO: 144854 - DNA, 25 bp, Homo sapien
tgaacggccctacgcatgccctgag

SEQ ID NO: 144855 - DNA, 25 bp, Homo sapien
cggccctacgcatgccctgagtgtg

SEQ ID NO: 144856 - DNA, 25 bp, Homo sapien
tctgcgcacccaccgacgagagaag

SEQ ID NO: 144857 - DNA, 25 bp, Homo sapien
acagcgccgagtagctccagccggg

SEQ ID NO: 144858 - DNA, 25 bp, Homo sapien
tagctccagccgggacgcactgtgt

SEQ ID NO: 144859 - DNA, 25 bp, Homo sapien
ctcccctggttattgtgaggctggc

SEQ ID NO: 144860 - DNA, 25 bp, Homo sapien
ctggttattgtgaggctggcgatta

SEQ ID NO: 144861 - DNA, 25 bp, Homo sapien
gttattgtgaggctggcgattacat

SEQ ID NO: 144862 - DNA, 25 bp, Homo sapien
gtgaggctggcgattacataagtat

SEQ ID NO: 144863 - DNA, 25 bp, Homo sapien
aggctggcgattacataagtataag

SEQ ID NO: 144864 - DNA, 25 bp, Homo sapien
gtgtttacagccctcatgaacagca

SEQ ID NO: 144865 - DNA, 25 bp, Homo sapien
catgaacagcaaaggcgtgagcctc

SEQ ID NO: 144866 - DNA, 25 bp, Homo sapien
aaggcgtgagcctcttcgacatcat

SEQ ID NO: 144867 - DNA, 25 bp, Homo sapien
tcttcgacatcatcaaccctgagat

SEQ ID NO: 144868 - DNA, 25 bp, Homo sapien
atcaaccctgagattatcactcgag

SEQ ID NO: 144869 - DNA, 25 bp, Homo sapien
gattatcactcgagatggcttcctg

SEQ ID NO: 144870 - DNA, 25 bp, Homo sapien
cactcgagatggcttcctgctgctg

SEQ ID NO: 144871 - DNA, 25 bp, Homo sapien
tgagctagaagtctccaaggaggtc

SEQ ID NO: 144872 - DNA, 25 bp, Homo sapien
gcagaaggcaagcaccaggctcaca

SEQ ID NO: 144873 - DNA, 25 bp, Homo sapien
gcaagcaccaggctcacagctggaa

SEQ ID NO: 144874 - DNA, 25 bp, Homo sapien
gagatggagattggctcccaactcc

SEQ ID NO: 144875 - DNA, 25 bp, Homo sapien
tgttgcccaatgaccagctctacca

SEQ ID NO: 144876 - DNA, 25 bp, Homo sapien
taccagcccctcaaggatcgagaag

SEQ ID NO: 144877 - DNA, 25 bp, Homo sapien
gagaagatgaccagtacagccacct

SEQ ID NO: 144878 - DNA, 25 bp, Homo sapien
gtacagccaccttcaaggaaaccag

SEQ ID NO: 144879 - DNA, 25 bp, Homo sapien
tcagagtagtccaggtgttctcctc

SEQ ID NO: 144880 - DNA, 25 bp, Homo sapien
ttctcctcctattcagttcccagaa

SEQ ID NO: 144881 - DNA, 25 bp, Homo sapien
agttcccagaatcaaagcaatgcat

SEQ ID NO: 144882 - DNA, 25 bp, Homo sapien
aatgcattttggaaagctcctagca

SEQ ID NO: 144883 - DNA, 25 bp, Homo sapien
ggaaagctcctagcagagagacttt

SEQ ID NO: 144884 - DNA, 25 bp, Homo sapien
gactttcagccctaaatctagactc

SEQ ID NO: 144885 - DNA, 25 bp, Homo sapien
tagactcaaggttcccagagatgac

SEQ ID NO: 144886 - DNA, 25 bp, Homo sapien
acatttccctgtgtctggctagagc

SEQ ID NO: 144887 - DNA, 25 bp, Homo sapien
ggctagagccaccattagactcaga

SEQ ID NO: 144888 - DNA, 25 bp, Homo sapien
ttagactcagacagaatgcttcagg

SEQ ID NO: 144889 - DNA, 25 bp, Homo sapien
aatgcttcaggaatcgttgtcaccc

SEQ ID NO: 144890 - DNA, 25 bp, Homo sapien
gttgtcaccccttcaactggagcag

SEQ ID NO: 144891 - DNA, 25 bp, Homo sapien
gcaggacggaaggttgtctgtactt

SEQ ID NO: 144892 - DNA, 25 bp, Homo sapien
gaagggagttgcttgtcacacgaat

SEQ ID NO: 144893 - DNA, 25 bp, Homo sapien
gttgcttgtcacacgaatcaggaaa

SEQ ID NO: 144894 - DNA, 25 bp, Homo sapien
gaatcaggaaactgctctccctcag

SEQ ID NO: 144895 - DNA, 25 bp, Homo sapien
gctacatgcaggttgtgagctggaa

SEQ ID NO: 144896 - DNA, 25 bp, Homo sapien
aagaaagttctagactgtggcccag

SEQ ID NO: 144897 - DNA, 25 bp, Homo sapien
aataccgagacattgagcgactttg

SEQ ID NO: 144898 - DNA, 25 bp, Homo sapien
gcgactttgaggaatccggctgagt

SEQ ID NO: 144899 - DNA, 25 bp, Homo sapien
aagctgctctctcttcccagtgcag

SEQ ID NO: 144900 - DNA, 25 bp, Homo sapien
gatccactcatcagcagagccagat

SEQ ID NO: 144901 - DNA, 25 bp, Homo sapien
gagccagattgtgccaactatccaa

SEQ ID NO: 144902 - DNA, 25 bp, Homo sapien
gtgccaactatccaaaaacttagat

SEQ ID NO: 144903 - DNA, 25 bp, Homo sapien
aggccaatgagaactcaactcctgg

SEQ ID NO: 144904 - DNA, 25 bp, Homo sapien
tgggactgcaccagactgctccaaa

SEQ ID NO: 144905 - DNA, 25 bp, Homo sapien
aaactcacctcactggcttctgtgt

SEQ ID NO: 144906 - DNA, 25 bp, Homo sapien
gcttctgtgtcccaagactaggttg

SEQ ID NO: 144907 - DNA, 25 bp, Homo sapien
caagactaggttggtacagtttaat

SEQ ID NO: 144908 - DNA, 25 bp, Homo sapien
ttaccttcactattcctcactcaag

SEQ ID NO: 144909 - DNA, 25 bp, Homo sapien
actattcctcactcaagattaagac

SEQ ID NO: 144910 - DNA, 25 bp, Homo sapien
ctcactcaagattaagacatttttt

SEQ ID NO: 144911 - DNA, 25 bp, Homo sapien
aattattcttgactataaccttgta

SEQ ID NO: 144912 - DNA, 25 bp, Homo sapien
attcttgactataaccttgtaaagg

SEQ ID NO: 144913 - DNA, 25 bp, Homo sapien
aaaattttgcaccactggtcatagc

SEQ ID NO: 144914 - DNA, 25 bp, Homo sapien
gcaccactggtcatagcatctatct

SEQ ID NO: 144915 - DNA, 25 bp, Homo sapien
actggtcatagcatctatctccttt

SEQ ID NO: 144916 - DNA, 25 bp, Homo sapien
ggtcatagcatctatctcctttgcc

SEQ ID NO: 144917 - DNA, 25 bp, Homo sapien
tctcctttgccttaatttactgaaa

SEQ ID NO: 144918 - DNA, 25 bp, Homo sapien
atgtctttactatgtattggcccta

SEQ ID NO: 144919 - DNA, 25 bp, Homo sapien
tggtggctacaaccccagagtttta

SEQ ID NO: 144920 - DNA, 25 bp, Homo sapien
tggctacaaccccagagttttaagg

SEQ ID NO: 144921 - DNA, 25 bp, Homo sapien
atggaccggcctgagcgatgtgcac

SEQ ID NO: 144922 - DNA, 25 bp, Homo sapien
tgagcgatgtgcactccacccaagc

SEQ ID NO: 144923 - DNA, 25 bp, Homo sapien
ttaaaatggttgcacggctctgccc

SEQ ID NO: 144924 - DNA, 25 bp, Homo sapien
atggttgcacggctctgccccatgg

SEQ ID NO: 144925 - DNA, 25 bp, Homo sapien
gggccttttttacacactgcgaggc

SEQ ID NO: 144926 - DNA, 25 bp, Homo sapien
ttttttacacactgcgaggcccagc

SEQ ID NO: 144927 - DNA, 25 bp, Homo sapien
cactgcgaggcccagctttctaggg

SEQ ID NO: 144928 - DNA, 25 bp, Homo sapien
gggacttttgcacatgtcatgcagc

SEQ ID NO: 144929 - DNA, 25 bp, Homo sapien
tgcacatgtcatgcagctcagctgg

SEQ ID NO: 144930 - DNA, 25 bp, Homo sapien
agagcccaccttgagggttttgcta

SEQ ID NO: 144931 - DNA, 25 bp, Homo sapien
cccaccttgagggttttgctagttg

SEQ ID NO: 144932 - DNA, 25 bp, Homo sapien
tgagggttttgctagttggttttgt

SEQ ID NO: 144933 - DNA, 25 bp, Homo sapien
ttttgttttgcgtttacagccgtgg

SEQ ID NO: 144934 - DNA, 25 bp, Homo sapien
ggaagcacataatcccgccccaggg

SEQ ID NO: 144935 - DNA, 25 bp, Homo sapien
agggcccactagcatccactgattg

SEQ ID NO: 144936 - DNA, 25 bp, Homo sapien
tagcatccactgattggaccttatg

SEQ ID NO: 144937 - DNA, 25 bp, Homo sapien
gattggaccttatggtcacccaact

SEQ ID NO: 144938 - DNA, 25 bp, Homo sapien
tatggtcacccaactcaaggacagc

SEQ ID NO: 144939 - DNA, 25 bp, Homo sapien
ccaactcaaggacagccaccaagaa

SEQ ID NO: 144940 - DNA, 25 bp, Homo sapien
agatggaggcgggaaaatcatttga

SEQ ID NO: 144941 - DNA, 25 bp, Homo sapien
gggattaccggaagattctgctgaa

SEQ ID NO: 144942 - DNA, 25 bp, Homo sapien
aagatctgtggtggcaatgactgaa

SEQ ID NO: 144943 - DNA, 25 bp, Homo sapien
aacagtgactggtggctcacttctg

SEQ ID NO: 144944 - DNA, 25 bp, Homo sapien
tgccggcaacaccagtgccaggaaa

SEQ ID NO: 144945 - DNA, 25 bp, Homo sapien
gaatgtctgtttctaacaaatccac

SEQ ID NO: 144946 - DNA, 25 bp, Homo sapien
aacaaatccacaaatagccccgaga

SEQ ID NO: 144947 - DNA, 25 bp, Homo sapien
cgagattcaccgtcctagagcttag

SEQ ID NO: 144948 - DNA, 25 bp, Homo sapien
tcctagagcttaggcctgtcttcca

SEQ ID NO: 144949 - DNA, 25 bp, Homo sapien
tgacccgtatagtgtgccacaggac

SEQ ID NO: 144950 - DNA, 25 bp, Homo sapien
acctgggtcggtctagaactctctc

SEQ ID NO: 144951 - DNA, 25 bp, Homo sapien
gaactctctcaggatgccttttcta

SEQ ID NO: 144952 - DNA, 25 bp, Homo sapien
ctcttcgagagggtgtcagtgagca

SEQ ID NO: 144953 - DNA, 25 bp, Homo sapien
gtttcccatgggattcaagagggac

SEQ ID NO: 144954 - DNA, 25 bp, Homo sapien
gattcaagagggacagccccagctt

SEQ ID NO: 144955 - DNA, 25 bp, Homo sapien
acagccccagctttgtgtgtgttta

SEQ ID NO: 144956 - DNA, 25 bp, Homo sapien
cctttatggaaagggctatgtggga

SEQ ID NO: 144957 - DNA, 25 bp, Homo sapien
ggctatgtgggagagtcagctatct

SEQ ID NO: 144958 - DNA, 25 bp, Homo sapien
tgtgggagagtcagctatcttgtct

SEQ ID NO: 144959 - DNA, 25 bp, Homo sapien
gggagagtcagctatcttgtctggt

SEQ ID NO: 144960 - DNA, 25 bp, Homo sapien
agagtcagctatcttgtctggtttt

SEQ ID NO: 144961 - DNA, 25 bp, Homo sapien
tctggttttcttgagacctcagatg

SEQ ID NO: 144962 - DNA, 25 bp, Homo sapien
tggttttcttgagacctcagatgtg

SEQ ID NO: 144963 - DNA, 25 bp, Homo sapien
aaagttccagaaatccagtgacgaa

SEQ ID NO: 144964 - DNA, 25 bp, Homo sapien
gttccagaaatccagtgacgaatgt

SEQ ID NO: 144965 - DNA, 25 bp, Homo sapien
ggtacaaataccacattccgttcta

SEQ ID NO: 144966 - DNA, 25 bp, Homo sapien
ataccacattccgttctaaaatgat

SEQ ID NO: 144967 - DNA, 25 bp, Homo sapien
tgatatcttaggatcatcaaaagaa

SEQ ID NO: 144968 - DNA, 25 bp, Homo sapien
aattatctaactgacatttttgcaa

SEQ ID NO: 144969 - DNA, 25 bp, Homo sapien
tctaccacaacttcgccttttattg

SEQ ID NO: 144970 - DNA, 25 bp, Homo sapien
ccacaacttcgccttttattgcata

SEQ ID NO: 144971 - DNA, 25 bp, Homo sapien
cttcgccttttattgcatatgctaa

SEQ ID NO: 144972 - DNA, 25 bp, Homo sapien
gcatatgctaaacaagcagatgcta

SEQ ID NO: 144973 - DNA, 25 bp, Homo sapien
agcagatgctaagtctgtaaactgt

SEQ ID NO: 144974 - DNA, 25 bp, Homo sapien
gtacattttgcctgacttaccttaa

SEQ ID NO: 144975 - DNA, 25 bp, Homo sapien
gggtacgtattgtttctggatatca

SEQ ID NO: 144976 - DNA, 25 bp, Homo sapien
tatttcttgctattgtgatatgaca

SEQ ID NO: 144977 - DNA, 25 bp, Homo sapien
gagacttaacttatcttgctctgtc

SEQ ID NO: 144978 - DNA, 25 bp, Homo sapien
tgtcttccactgtacacgctgtata

SEQ ID NO: 144979 - DNA, 25 bp, Homo sapien
ttccactgtacacgctgtatatagg

SEQ ID NO: 144980 - DNA, 25 bp, Homo sapien
tgtgatgctgctggagacgagaata

SEQ ID NO: 144981 - DNA, 25 bp, Homo sapien
gctggagacgagaataaactggact

SEQ ID NO: 144982 - DNA, 25 bp, Homo sapien
tagtgcattgtatttagtctgtatt

SEQ ID NO: 144983 - DNA, 25 bp, Homo sapien
tagtctgtattgatcatggatgccc

SEQ ID NO: 144984 - DNA, 25 bp, Homo sapien
tggatgccctccttaatagccatat

SEQ ID NO: 144985 - DNA, 25 bp, Homo sapien
tggacgtgaggaacgccattgtcct

SEQ ID NO: 144986 - DNA, 25 bp, Homo sapien
gtgaggaacgccattgtcctcttct

SEQ ID NO: 144987 - DNA, 25 bp, Homo sapien
gaggaacgccattgtcctcttctcc

SEQ ID NO: 144988 - DNA, 25 bp, Homo sapien
ctgctgccggcgtcacgcaggagct

SEQ ID NO: 144989 - DNA, 25 bp, Homo sapien
aacctgatgggctcctacaggtcgg

SEQ ID NO: 144990 - DNA, 25 bp, Homo sapien
tgatgggctcctacaggtcggtggg

SEQ ID NO: 144991 - DNA, 25 bp, Homo sapien
gggcagcccgctcaggaggccaggg

SEQ ID NO: 144992 - DNA, 25 bp, Homo sapien
ggcccatcgacgcagacaccattga

SEQ ID NO: 144993 - DNA, 25 bp, Homo sapien
catcgacgcagacaccattgacatt

SEQ ID NO: 144994 - DNA, 25 bp, Homo sapien
cattgacatttacgcccgcgctgtg

SEQ ID NO: 144995 - DNA, 25 bp, Homo sapien
cgctgtgttccctgcggcgtttgcg

SEQ ID NO: 144996 - DNA, 25 bp, Homo sapien
ttaaacatttatgcctcccttttgt

SEQ ID NO: 144997 - DNA, 25 bp, Homo sapien
cctcccttttgtgttgacactgtag

SEQ ID NO: 144998 - DNA, 25 bp, Homo sapien
gttgacactgtagctcatactggaa

SEQ ID NO: 144999 - DNA, 25 bp, Homo sapien
gtagctcatactggaaaagtcgatc

SEQ ID NO: 145000 - DNA, 25 bp, Homo sapien
aaaagtcgatcaatgttttgcagtt

SEQ ID NO: 145001 - DNA, 25 bp, Homo sapien
tgcttctaaaatgtgattatcgacc

SEQ ID NO: 145002 - DNA, 25 bp, Homo sapien
atcgaccatggtatgcatgatcgtt

SEQ ID NO: 145003 - DNA, 25 bp, Homo sapien
gatcgttgtaattgttgacattcct

SEQ ID NO: 145004 - DNA, 25 bp, Homo sapien
gttacaacttgtgcttatgtagaca

SEQ ID NO: 145005 - DNA, 25 bp, Homo sapien
ttttttgtttcagtaccagaggcac

SEQ ID NO: 145006 - DNA, 25 bp, Homo sapien
gtaccagaggcactgacttcaataa

SEQ ID NO: 145007 - DNA, 25 bp, Homo sapien
gggctgactttccattgttatcatg

SEQ ID NO: 145008 - DNA, 25 bp, Homo sapien
gtcaccattcccacaagtatacttg

SEQ ID NO: 145009 - DNA, 25 bp, Homo sapien
tacttgatgttgtcatagaacgaac

SEQ ID NO: 145010 - DNA, 25 bp, Homo sapien
gaacgaacatcctactctatgattt

SEQ ID NO: 145011 - DNA, 25 bp, Homo sapien
ttactaaccaattactttcccagat

SEQ ID NO: 145012 - DNA, 25 bp, Homo sapien
attactttcccagatcatagacctc

SEQ ID NO: 145013 - DNA, 25 bp, Homo sapien
gatcatagacctctctgcatagtag

SEQ ID NO: 145014 - DNA, 25 bp, Homo sapien
ctctgcatagtagtcataggtcttg

SEQ ID NO: 145015 - DNA, 25 bp, Homo sapien
gaagctgcaggaatatttatctcca

SEQ ID NO: 145016 - DNA, 25 bp, Homo sapien
agaactccagcaaatccaatggcta

SEQ ID NO: 145017 - DNA, 25 bp, Homo sapien
catattgctgtttcttagctgaata

SEQ ID NO: 145018 - DNA, 25 bp, Homo sapien
aggaaggtcctgtagaccctgcgga

SEQ ID NO: 145019 - DNA, 25 bp, Homo sapien
agaccctgcggagcccatcagggaa

SEQ ID NO: 145020 - DNA, 25 bp, Homo sapien
aaatgatcaagctgactgctcctct

SEQ ID NO: 145021 - DNA, 25 bp, Homo sapien
gctgactgctcctctggaaattgga

SEQ ID NO: 145022 - DNA, 25 bp, Homo sapien
atgaggatgaactccagacagctgg

SEQ ID NO: 145023 - DNA, 25 bp, Homo sapien
ggctgctgagtgagatgcttcccca

SEQ ID NO: 145024 - DNA, 25 bp, Homo sapien
gagtgagatgcttccccagcatgca

SEQ ID NO: 145025 - DNA, 25 bp, Homo sapien
ttccccagcatgcagccaagtgatg

SEQ ID NO: 145026 - DNA, 25 bp, Homo sapien
ggacagatttgggaggcccctcctg

SEQ ID NO: 145027 - DNA, 25 bp, Homo sapien
aagtgaggccctgggaatttacaga

SEQ ID NO: 145028 - DNA, 25 bp, Homo sapien
ggaatttacagagcctgccagctgg

SEQ ID NO: 145029 - DNA, 25 bp, Homo sapien
gcagtgtctccaggacatcttggct

SEQ ID NO: 145030 - DNA, 25 bp, Homo sapien
gtgaccctgaagctgtccccagaga

SEQ ID NO: 145031 - DNA, 25 bp, Homo sapien
tgtccccagagacttccctgcatga

SEQ ID NO: 145032 - DNA, 25 bp, Homo sapien
cagagacttccctgcatgaggcaca

SEQ ID NO: 145033 - DNA, 25 bp, Homo sapien
agagacttccctgcatgaggcacac

SEQ ID NO: 145034 - DNA, 25 bp, Homo sapien
gaggcacacaacctctttgagctgt

SEQ ID NO: 145035 - DNA, 25 bp, Homo sapien
acctctttgagctgttgaaccttca

SEQ ID NO: 145036 - DNA, 25 bp, Homo sapien
aaccttcattccctctttgtgacgt

SEQ ID NO: 145037 - DNA, 25 bp, Homo sapien
ttcattccctctttgtgacgtcgcg

SEQ ID NO: 145038 - DNA, 25 bp, Homo sapien
cattccctctttgtgacgtcgcggg

SEQ ID NO: 145039 - DNA, 25 bp, Homo sapien
agtgagccggcccagcaagatgaaa

SEQ ID NO: 145040 - DNA, 25 bp, Homo sapien
gtaaatctacacacggtgcctttat

SEQ ID NO: 145041 - DNA, 25 bp, Homo sapien
gtgcctttatttccactgtgcaggt

SEQ ID NO: 145042 - DNA, 25 bp, Homo sapien
tttatttccactgtgcaggttccca

SEQ ID NO: 145043 - DNA, 25 bp, Homo sapien
cactgtgcaggttcccacttaaaaa

SEQ ID NO: 145044 - DNA, 25 bp, Homo sapien
gaaagcaggtttcaaggaagtagaa

SEQ ID NO: 145045 - DNA, 25 bp, Homo sapien
gaaaatgtccatttacacgtatttg

SEQ ID NO: 145046 - DNA, 25 bp, Homo sapien
atttacacgtatttgaatggccttc

SEQ ID NO: 145047 - DNA, 25 bp, Homo sapien
tgaatggccttcatatcatccacac

SEQ ID NO: 145048 - DNA, 25 bp, Homo sapien
ggccttcatatcatccacacatgaa

SEQ ID NO: 145049 - DNA, 25 bp, Homo sapien
tccacacatgaatctgcacatctgt

SEQ ID NO: 145050 - DNA, 25 bp, Homo sapien
gcacatctgtaaatctacacacggt

SEQ ID NO: 145051 - DNA, 25 bp, Homo sapien
aggtggagcgactgatgacccctga

SEQ ID NO: 145052 - DNA, 25 bp, Homo sapien
ctgatgacccctgaaaagcagtcat

SEQ ID NO: 145053 - DNA, 25 bp, Homo sapien
aaagcagtcatcctgatggctctgg

SEQ ID NO: 145054 - DNA, 25 bp, Homo sapien
tgatggctctggctccagaggacct

SEQ ID NO: 145055 - DNA, 25 bp, Homo sapien
ggctccagaggacctgagactcaca

SEQ ID NO: 145056 - DNA, 25 bp, Homo sapien
agaggacctgagactcacactctct

SEQ ID NO: 145057 - DNA, 25 bp, Homo sapien
gacctgagactcacactctctgcag

SEQ ID NO: 145058 - DNA, 25 bp, Homo sapien
gggcagaggcttccgtgtcctctcc

SEQ ID NO: 145059 - DNA, 25 bp, Homo sapien
aagaagcgccgactccctgagtctg

SEQ ID NO: 145060 - DNA, 25 bp, Homo sapien
gaagcgccgactccctgagtctgga

SEQ ID NO: 145061 - DNA, 25 bp, Homo sapien
atgtggcagcccatgggtatgacat

SEQ ID NO: 145062 - DNA, 25 bp, Homo sapien
gaagcagagaaaatgacagtcagcc

SEQ ID NO: 145063 - DNA, 25 bp, Homo sapien
gacccattctcctgttgtcagatga

SEQ ID NO: 145064 - DNA, 25 bp, Homo sapien
gtcagatgactcctcattcagaggt

SEQ ID NO: 145065 - DNA, 25 bp, Homo sapien
agaggtgtcggctcatctgatctaa

SEQ ID NO: 145066 - DNA, 25 bp, Homo sapien
gtcggctcatctgatctaaaagcaa

SEQ ID NO: 145067 - DNA, 25 bp, Homo sapien
ttggctcacgaggtgctatggacac

SEQ ID NO: 145068 - DNA, 25 bp, Homo sapien
tatggacaccaaagggcacaagact

SEQ ID NO: 145069 - DNA, 25 bp, Homo sapien
agactgctggagatgttggttccaa

SEQ ID NO: 145070 - DNA, 25 bp, Homo sapien
ggtgtggtggcaactctaggcttca

SEQ ID NO: 145071 - DNA, 25 bp, Homo sapien
ggcaactctaggcttcatctactac

SEQ ID NO: 145072 - DNA, 25 bp, Homo sapien
cttcatctactacctgtacgagaaa

SEQ ID NO: 145073 - DNA, 25 bp, Homo sapien
gtgtgtatactgtaatcgtgctatt

SEQ ID NO: 145074 - DNA, 25 bp, Homo sapien
ctgtaatcgtgctattttttatcat

SEQ ID NO: 145075 - DNA, 25 bp, Homo sapien
aatgcccttaatgtgagggtttgta

SEQ ID NO: 145076 - DNA, 25 bp, Homo sapien
ggtgcttattaagaccaaagacttg

SEQ ID NO: 145077 - DNA, 25 bp, Homo sapien
gtgactggcccacacgtgcatagag

SEQ ID NO: 145078 - DNA, 25 bp, Homo sapien
tggcccacacgtgcatagaggtctg

SEQ ID NO: 145079 - DNA, 25 bp, Homo sapien
agtggccagaggatcaccagtgcat

SEQ ID NO: 145080 - DNA, 25 bp, Homo sapien
atcaccagtgcatccttcatcacag

SEQ ID NO: 145081 - DNA, 25 bp, Homo sapien
atcacagcatgtgcaatatgccaag

SEQ ID NO: 145082 - DNA, 25 bp, Homo sapien
atatgccaagattaccctcggtcat

SEQ ID NO: 145083 - DNA, 25 bp, Homo sapien
cctcggtcattcctgtcaacaaggg

SEQ ID NO: 145084 - DNA, 25 bp, Homo sapien
gtgattttggccacactgtcaacat

SEQ ID NO: 145085 - DNA, 25 bp, Homo sapien
gtcaacatttgttagaaccagtctt

SEQ ID NO: 145086 - DNA, 25 bp, Homo sapien
agtatttccaacttgtcacttgcca

SEQ ID NO: 145087 - DNA, 25 bp, Homo sapien
ccagtcactccgttttgcaaaaggt

SEQ ID NO: 145088 - DNA, 25 bp, Homo sapien
aaaaggtggcccttcactgtccatt

SEQ ID NO: 145089 - DNA, 25 bp, Homo sapien
gtccattccaaatagcccacacgtg

SEQ ID NO: 145090 - DNA, 25 bp, Homo sapien
acgtgctctctgctggattctaaat

SEQ ID NO: 145091 - DNA, 25 bp, Homo sapien
gttacgttcaatcagaatccccgaa

SEQ ID NO: 145092 - DNA, 25 bp, Homo sapien
tataaagcttagctgccccttctga

SEQ ID NO: 145093 - DNA, 25 bp, Homo sapien
gaggatgctgagaacggtgtctttc

SEQ ID NO: 145094 - DNA, 25 bp, Homo sapien
gaacggtgtctttctttataaatgc

SEQ ID NO: 145095 - DNA, 25 bp, Homo sapien
ttccagcttacatcttacacggtgt

SEQ ID NO: 145096 - DNA, 25 bp, Homo sapien
acacggtgtcttacaaattctgcta

SEQ ID NO: 145097 - DNA, 25 bp, Homo sapien
attctgctagtctgtaagctcctta

SEQ ID NO: 145098 - DNA, 25 bp, Homo sapien
gctccttaagagtagggttgtgcct

SEQ ID NO: 145099 - DNA, 25 bp, Homo sapien
gggttgtgccttattcaactgcata

SEQ ID NO: 145100 - DNA, 25 bp, Homo sapien
actgcatacatagctcctagcacag

SEQ ID NO: 145101 - DNA, 25 bp, Homo sapien
tagcacagtgccttattcggtaggc

SEQ ID NO: 145102 - DNA, 25 bp, Homo sapien
ttcggtaggcatctaagcaaatttc

SEQ ID NO: 145103 - DNA, 25 bp, Homo sapien
tacatgatacttgggtagctcaaca

SEQ ID NO: 145104 - DNA, 25 bp, Homo sapien
gggtagctcaacattcttaataaac

SEQ ID NO: 145105 - DNA, 25 bp, Homo sapien
taaacagcctttgtattcagaatat

SEQ ID NO: 145106 - DNA, 25 bp, Homo sapien
gagtggtggccactcaatacctttt

SEQ ID NO: 145107 - DNA, 25 bp, Homo sapien
aataccttttcctctagctttcatg

SEQ ID NO: 145108 - DNA, 25 bp, Homo sapien
ttttcctctagctttcatgtcttgt

SEQ ID NO: 145109 - DNA, 25 bp, Homo sapien
tctagctttcatgtcttgtttttgc

SEQ ID NO: 145110 - DNA, 25 bp, Homo sapien
gagtgctgtacaaagtcaaacaaac

SEQ ID NO: 145111 - DNA, 25 bp, Homo sapien
gagtcctccacatgaccttgtgatt

SEQ ID NO: 145112 - DNA, 25 bp, Homo sapien
cttgtgattgtgtgctgtccttctg

SEQ ID NO: 145113 - DNA, 25 bp, Homo sapien
ttctgtgctctgtgagaactcgtgg

SEQ ID NO: 145114 - DNA, 25 bp, Homo sapien
ctctgtgagaactcgtggtacttca

SEQ ID NO: 145115 - DNA, 25 bp, Homo sapien
ccctgtattgtgacaaggtaattct

SEQ ID NO: 145116 - DNA, 25 bp, Homo sapien
gtgacaaggtaattctgtggtatca

SEQ ID NO: 145117 - DNA, 25 bp, Homo sapien
aaatagcattgagacttgtgtagat

SEQ ID NO: 145118 - DNA, 25 bp, Homo sapien
cattgagacttgtgtagatgcttct

SEQ ID NO: 145119 - DNA, 25 bp, Homo sapien
tcaaattggaaatctgtaacgcagc

SEQ ID NO: 145120 - DNA, 25 bp, Homo sapien
ggaaatctgtaacgcagcttctgta

SEQ ID NO: 145121 - DNA, 25 bp, Homo sapien
gtaacgcagcttctgtaagcatgtg

SEQ ID NO: 145122 - DNA, 25 bp, Homo sapien
gcttctgtaagcatgtgtgggcaaa

SEQ ID NO: 145123 - DNA, 25 bp, Homo sapien
aagcaataatcctactcctcaaaat

SEQ ID NO: 145124 - DNA, 25 bp, Homo sapien
gaaaaatatgacttttctgtatgtt

SEQ ID NO: 145125 - DNA, 25 bp, Homo sapien
atgggttcaagatgaatttgtcaac

SEQ ID NO: 145126 - DNA, 25 bp, Homo sapien
gaatttgtcaacttttgtcttccat

SEQ ID NO: 145127 - DNA, 25 bp, Homo sapien
tttgtcaacttttgtcttccattgt

SEQ ID NO: 145128 - DNA, 25 bp, Homo sapien
atatcaatggaggagctgtttctct

SEQ ID NO: 145129 - DNA, 25 bp, Homo sapien
agctgtttctctgggacatccaatt

SEQ ID NO: 145130 - DNA, 25 bp, Homo sapien
atccaattgggatgtctggagccag

SEQ ID NO: 145131 - DNA, 25 bp, Homo sapien
ctggagccaggattgttggtcattt

SEQ ID NO: 145132 - DNA, 25 bp, Homo sapien
ggtcatttgactcatgccttgaagc

SEQ ID NO: 145133 - DNA, 25 bp, Homo sapien
atacggtcttgccagtatttgcaat

SEQ ID NO: 145134 - DNA, 25 bp, Homo sapien
aggtgcttctgccatgctaattcag

SEQ ID NO: 145135 - DNA, 25 bp, Homo sapien
gaagctgtagacaacctctgctatt

SEQ ID NO: 145136 - DNA, 25 bp, Homo sapien
aggagacaaccctatgtgaccagaa

SEQ ID NO: 145137 - DNA, 25 bp, Homo sapien
ccagaaggcctgctgtaatcagtgt

SEQ ID NO: 145138 - DNA, 25 bp, Homo sapien
gtgtgactactgtgggtcagcttat

SEQ ID NO: 145139 - DNA, 25 bp, Homo sapien
cttggagcccacacatgggatcaag

SEQ ID NO: 145140 - DNA, 25 bp, Homo sapien
atgggatcaagtcctgcaagcagag

SEQ ID NO: 145141 - DNA, 25 bp, Homo sapien
ctgtgggactgggacacttttatgt

SEQ ID NO: 145142 - DNA, 25 bp, Homo sapien
atgttaatgctctggacttgcctcc

SEQ ID NO: 145143 - DNA, 25 bp, Homo sapien
ctccagagactgctccagagttggt

SEQ ID NO: 145144 - DNA, 25 bp, Homo sapien
gagttggtgacacagctgtcccaag

SEQ ID NO: 145145 - DNA, 25 bp, Homo sapien
aagggcccctctgtatctagcctgg

SEQ ID NO: 145146 - DNA, 25 bp, Homo sapien
gtatctagcctggaaccaaggttat

SEQ ID NO: 145147 - DNA, 25 bp, Homo sapien
ggttatcttggaactaaatgacttt

SEQ ID NO: 145148 - DNA, 25 bp, Homo sapien
aatgacttttctcctctcagtgggt

SEQ ID NO: 145149 - DNA, 25 bp, Homo sapien
gtagcagagggatcaagcagttatt

SEQ ID NO: 145150 - DNA, 25 bp, Homo sapien
tagccagggccatgtcttaggtgca

SEQ ID NO: 145151 - DNA, 25 bp, Homo sapien
atgtcttaggtgcagctgtgccacg

SEQ ID NO: 145152 - DNA, 25 bp, Homo sapien
ctgtgccacgggtcagctgagccac

SEQ ID NO: 145153 - DNA, 25 bp, Homo sapien
agtcccagaaccaagctctcggtgt

SEQ ID NO: 145154 - DNA, 25 bp, Homo sapien
aagctctcggtgtctcgggccacca

SEQ ID NO: 145155 - DNA, 25 bp, Homo sapien
tcctgctcagtgtggcgtcagtgtc

SEQ ID NO: 145156 - DNA, 25 bp, Homo sapien
tgcttcagtgaatgtacagtgcccg

SEQ ID NO: 145157 - DNA, 25 bp, Homo sapien
agtgaatgtacagtgcccggcacga

SEQ ID NO: 145158 - DNA, 25 bp, Homo sapien
cggcacgagctgaacctcatgtgtt

SEQ ID NO: 145159 - DNA, 25 bp, Homo sapien
gaacctcatgtgttccactcccaat

SEQ ID NO: 145160 - DNA, 25 bp, Homo sapien
cactcccaataaaaggttgacaggg

SEQ ID NO: 145161 - DNA, 25 bp, Homo sapien
aaacttcggctccatgttggaactg

SEQ ID NO: 145162 - DNA, 25 bp, Homo sapien
ttcggctccatgttggaactgtcgt

SEQ ID NO: 145163 - DNA, 25 bp, Homo sapien
gctccatgttggaactgtcgtggaa

SEQ ID NO: 145164 - DNA, 25 bp, Homo sapien
tgtcgtggaagggaacgaagcccat

SEQ ID NO: 145165 - DNA, 25 bp, Homo sapien
gaagggaacgaagcccatagacctg

SEQ ID NO: 145166 - DNA, 25 bp, Homo sapien
aatggtcagaccaggaagtttctgc

SEQ ID NO: 145167 - DNA, 25 bp, Homo sapien
agaccaggaagtttctgctggacgg

SEQ ID NO: 145168 - DNA, 25 bp, Homo sapien
gaagtcatcataacagggtactgcc

SEQ ID NO: 145169 - DNA, 25 bp, Homo sapien
gtcatcataacagggtactgccagg

SEQ ID NO: 145170 - DNA, 25 bp, Homo sapien
tccctcgggctgtaggcctggtccg

SEQ ID NO: 145171 - DNA, 25 bp, Homo sapien
tgtaggcctggtccgccattcagtg

SEQ ID NO: 145172 - DNA, 25 bp, Homo sapien
atggccctcgctctgtctatgcagg

SEQ ID NO: 145173 - DNA, 25 bp, Homo sapien
aaagcccgcactttgtccgtgtgtc

SEQ ID NO: 145174 - DNA, 25 bp, Homo sapien
tttgtccgtgtgtcttagccctgtg

SEQ ID NO: 145175 - DNA, 25 bp, Homo sapien
gtcttagccctgtggttttgtctgt

SEQ ID NO: 145176 - DNA, 25 bp, Homo sapien
tgtctctgtgcctatgtggctgtgc

SEQ ID NO: 145177 - DNA, 25 bp, Homo sapien
ctatgtggctgtgctatggtttcta

SEQ ID NO: 145178 - DNA, 25 bp, Homo sapien
atggtttctatgagtctgctccatc

SEQ ID NO: 145179 - DNA, 25 bp, Homo sapien
tgctccatccatgtgtctgtttggg

SEQ ID NO: 145180 - DNA, 25 bp, Homo sapien
tctccatccctctgttggtgctgtg

SEQ ID NO: 145181 - DNA, 25 bp, Homo sapien
tgcccttggctatccctgaaagagg

SEQ ID NO: 145182 - DNA, 25 bp, Homo sapien
aagagggaggactccgctgcagctc

SEQ ID NO: 145183 - DNA, 25 bp, Homo sapien
aggacactgaattttccaccatctc

SEQ ID NO: 145184 - DNA, 25 bp, Homo sapien
caacaatcattgcttcacccaaggc

SEQ ID NO: 145185 - DNA, 25 bp, Homo sapien
tacgtgcaggacagcccgactgaga

SEQ ID NO: 145186 - DNA, 25 bp, Homo sapien
gagaccaagacctacaacagtgtca

SEQ ID NO: 145187 - DNA, 25 bp, Homo sapien
ggttgacaaaatttcccgcatcatc

SEQ ID NO: 145188 - DNA, 25 bp, Homo sapien
tcctgtgctctttgccatattcaat

SEQ ID NO: 145189 - DNA, 25 bp, Homo sapien
tattgggccacatatgtcaaccggg

SEQ ID NO: 145190 - DNA, 25 bp, Homo sapien
tgtcaaccgggagtcagctatcaag

SEQ ID NO: 145191 - DNA, 25 bp, Homo sapien
caagggcatgatccgcaaacagtag

SEQ ID NO: 145192 - DNA, 25 bp, Homo sapien
atagtggcagtgcagcaaccagagc

SEQ ID NO: 145193 - DNA, 25 bp, Homo sapien
accagagcactgtataccccgtgaa

SEQ ID NO: 145194 - DNA, 25 bp, Homo sapien
gttgtagcttccttcaagatcttgg

SEQ ID NO: 145195 - DNA, 25 bp, Homo sapien
gcttccttcaagatcttggcaggag

SEQ ID NO: 145196 - DNA, 25 bp, Homo sapien
cgagtactgcatccgccgtatggtg

SEQ ID NO: 145197 - DNA, 25 bp, Homo sapien
atccgccgtatggtgccctacaagg

SEQ ID NO: 145198 - DNA, 25 bp, Homo sapien
gtatggtgccctacaagggatccgg

SEQ ID NO: 145199 - DNA, 25 bp, Homo sapien
tttgaccccaaccactgaggttctc

SEQ ID NO: 145200 - DNA, 25 bp, Homo sapien
aaccactgaggttctctatgcaaga

SEQ ID NO: 145201 - DNA, 25 bp, Homo sapien
actgaggttctctatgcaagatgga

SEQ ID NO: 145202 - DNA, 25 bp, Homo sapien
aagatggagagaggatgcaccctgt

SEQ ID NO: 145203 - DNA, 25 bp, Homo sapien
gtccctcggagcaagggcctaagag

SEQ ID NO: 145204 - DNA, 25 bp, Homo sapien
agggcctaagagaaaagccagccaa

SEQ ID NO: 145205 - DNA, 25 bp, Homo sapien
accctttgtacgtggacttcagtga

SEQ ID NO: 145206 - DNA, 25 bp, Homo sapien
gggtatcacgccttttactgccacg

SEQ ID NO: 145207 - DNA, 25 bp, Homo sapien
ttactgccacggagaatgccctttt

SEQ ID NO: 145208 - DNA, 25 bp, Homo sapien
ggctgatcatctgaactccactaat

SEQ ID NO: 145209 - DNA, 25 bp, Homo sapien
tgaactccactaatcatgccattgt

SEQ ID NO: 145210 - DNA, 25 bp, Homo sapien
atgccattgttcagacgttggtcaa

SEQ ID NO: 145211 - DNA, 25 bp, Homo sapien
gacgttggtcaactctgttaactct

SEQ ID NO: 145212 - DNA, 25 bp, Homo sapien
agattcctaaggcatgctgtgtccc

SEQ ID NO: 145213 - DNA, 25 bp, Homo sapien
tgtgtcccgacagaactcagtgcta

SEQ ID NO: 145214 - DNA, 25 bp, Homo sapien
aactcagtgctatctcgatgctgta

SEQ ID NO: 145215 - DNA, 25 bp, Homo sapien
gatgctgtaccttgacgagaatgaa

SEQ ID NO: 145216 - DNA, 25 bp, Homo sapien
ctacttctatccgaactggacatat

SEQ ID NO: 145217 - DNA, 25 bp, Homo sapien
gaactggacatatgcctcgaaaggc

SEQ ID NO: 145218 - DNA, 25 bp, Homo sapien
aaggcttcagttggatctgcttcta

SEQ ID NO: 145219 - DNA, 25 bp, Homo sapien
atctgcttctactcgtcacgtgttt

SEQ ID NO: 145220 - DNA, 25 bp, Homo sapien
ctactcgtcacgtgtttggatcaag

SEQ ID NO: 145221 - DNA, 25 bp, Homo sapien
cacgtgtttggatcaagactgcaga

SEQ ID NO: 145222 - DNA, 25 bp, Homo sapien
ggataaagaccacagttaataccat

SEQ ID NO: 145223 - DNA, 25 bp, Homo sapien
caccttctggatctggcacaagtaa

SEQ ID NO: 145224 - DNA, 25 bp, Homo sapien
aaatatgcccgtattctctttccag

SEQ ID NO: 145225 - DNA, 25 bp, Homo sapien
gggcatttaacatggtttattgggt

SEQ ID NO: 145226 - DNA, 25 bp, Homo sapien
gttgtttatttatctaaggacacta

SEQ ID NO: 145227 - DNA, 25 bp, Homo sapien
agacaccaaatctggctgaatgaaa

SEQ ID NO: 145228 - DNA, 25 bp, Homo sapien
gacaccaaatctggctgaatgaaat

SEQ ID NO: 145229 - DNA, 25 bp, Homo sapien
caccaaatctggctgaatgaaataa

SEQ ID NO: 145230 - DNA, 25 bp, Homo sapien
accaaatctggctgaatgaaataaa

SEQ ID NO: 145231 - DNA, 25 bp, Homo sapien
ccaaatctggctgaatgaaataaat

SEQ ID NO: 145232 - DNA, 25 bp, Homo sapien
atctggctgaatgaaataaattggt

SEQ ID NO: 145233 - DNA, 25 bp, Homo sapien
ctggctgaatgaaataaattggtga

SEQ ID NO: 145234 - DNA, 25 bp, Homo sapien
gaaataaattggtgataagtggaaa

SEQ ID NO: 145235 - DNA, 25 bp, Homo sapien
gaaaaaccaatgattcataacaatg

SEQ ID NO: 145236 - DNA, 25 bp, Homo sapien
aaccaatgattcataacaatgtatg

SEQ ID NO: 145237 - DNA, 25 bp, Homo sapien
caatgattcataacaatgtatgtga

SEQ ID NO: 145238 - DNA, 25 bp, Homo sapien
atgtggacgcgctgcgcacgcatct

SEQ ID NO: 145239 - DNA, 25 bp, Homo sapien
tacagcgacgagctgcgccagcgct

SEQ ID NO: 145240 - DNA, 25 bp, Homo sapien
tggccgcgcgccttgaggctctcaa

SEQ ID NO: 145241 - DNA, 25 bp, Homo sapien
aaggccaccgagcatctgagcacgc

SEQ ID NO: 145242 - DNA, 25 bp, Homo sapien
gagcatctgagcacgctcagcgaga

SEQ ID NO: 145243 - DNA, 25 bp, Homo sapien
gagagcttcaaggtcagcttcctga

SEQ ID NO: 145244 - DNA, 25 bp, Homo sapien
aggtcagcttcctgagcgctctcga

SEQ ID NO: 145245 - DNA, 25 bp, Homo sapien
ctgagcgctctcgaggagtacacta

SEQ ID NO: 145246 - DNA, 25 bp, Homo sapien
agcgctctcgaggagtacactaaga

SEQ ID NO: 145247 - DNA, 25 bp, Homo sapien
gtacactaagaagctcaacacccag

SEQ ID NO: 145248 - DNA, 25 bp, Homo sapien
agaagctcaacacccagtgaggcgc

SEQ ID NO: 145249 - DNA, 25 bp, Homo sapien
gtaacagttgtctcatatcatcttg

SEQ ID NO: 145250 - DNA, 25 bp, Homo sapien
gttgtctcatatcatcttgatttat

SEQ ID NO: 145251 - DNA, 25 bp, Homo sapien
cttgatttattgtcactgttgctaa

SEQ ID NO: 145252 - DNA, 25 bp, Homo sapien
gtcactgttgctaactttcaggctc

SEQ ID NO: 145253 - DNA, 25 bp, Homo sapien
gttgctaactttcaggctcggagga

SEQ ID NO: 145254 - DNA, 25 bp, Homo sapien
taactttcaggctcggaggagatgc

SEQ ID NO: 145255 - DNA, 25 bp, Homo sapien
gaggagatgctcctcccaaaatgag

SEQ ID NO: 145256 - DNA, 25 bp, Homo sapien
gatgctcctcccaaaatgagttcgg

SEQ ID NO: 145257 - DNA, 25 bp, Homo sapien
atgagttcggagatgatagcagtaa

SEQ ID NO: 145258 - DNA, 25 bp, Homo sapien
ggccgacttggtgcacgtttggatt

SEQ ID NO: 145259 - DNA, 25 bp, Homo sapien
gacttggtgcacgtttggatttgga

SEQ ID NO: 145260 - DNA, 25 bp, Homo sapien
gctgttcgccactatgagaaggcat

SEQ ID NO: 145261 - DNA, 25 bp, Homo sapien
gttcgccactatgagaaggcataaa

SEQ ID NO: 145262 - DNA, 25 bp, Homo sapien
ttctgtttcctcaagtctcagtgct

SEQ ID NO: 145263 - DNA, 25 bp, Homo sapien
ctcaagtctcagtgctatcctatta

SEQ ID NO: 145264 - DNA, 25 bp, Homo sapien
gtctcagtgctatcctattacaaca

SEQ ID NO: 145265 - DNA, 25 bp, Homo sapien
gtgctatcctattacaacatggctg

SEQ ID NO: 145266 - DNA, 25 bp, Homo sapien
tcctattacaacatggctgatcatt

SEQ ID NO: 145267 - DNA, 25 bp, Homo sapien
atggctgatcattaattagaaggtt

SEQ ID NO: 145268 - DNA, 25 bp, Homo sapien
attagaaggttatccttggtgtgga

SEQ ID NO: 145269 - DNA, 25 bp, Homo sapien
ttgttactccaagcaacttgcccaa

SEQ ID NO: 145270 - DNA, 25 bp, Homo sapien
tactccaagcaacttgcccaatttt

SEQ ID NO: 145271 - DNA, 25 bp, Homo sapien
agcacaagttccctgtcttcatggg

SEQ ID NO: 145272 - DNA, 25 bp, Homo sapien
agtatatgaccccagggcctgagac

SEQ ID NO: 145273 - DNA, 25 bp, Homo sapien
ggcctgagacctgcaggatcaggtt

SEQ ID NO: 145274 - DNA, 25 bp, Homo sapien
tcaggttagggcgagcgctacctct

SEQ ID NO: 145275 - DNA, 25 bp, Homo sapien
aggtgtccgctatccaccaaaaggg

SEQ ID NO: 145276 - DNA, 25 bp, Homo sapien
tatccaccaaaagggctcctgaggg

SEQ ID NO: 145277 - DNA, 25 bp, Homo sapien
ctgggcaagggacctgcttctatta

SEQ ID NO: 145278 - DNA, 25 bp, Homo sapien
aagggacctgcttctattagccctt

SEQ ID NO: 145279 - DNA, 25 bp, Homo sapien
tgccatgctctccaaaccacttttt

SEQ ID NO: 145280 - DNA, 25 bp, Homo sapien
tccaaaccactttttgcagctttct

SEQ ID NO: 145281 - DNA, 25 bp, Homo sapien
cagctttctctagttcaagttcacc

SEQ ID NO: 145282 - DNA, 25 bp, Homo sapien
gcagaccagattgccatgttgcctc

SEQ ID NO: 145283 - DNA, 25 bp, Homo sapien
accagattgccatgttgcctcctga

SEQ ID NO: 145284 - DNA, 25 bp, Homo sapien
aaatccactggagcaccttgatagg

SEQ ID NO: 145285 - DNA, 25 bp, Homo sapien
ctggagcaccttgataggttttcaa

SEQ ID NO: 145286 - DNA, 25 bp, Homo sapien
taggttttcaaaaatacctggcaag

SEQ ID NO: 145287 - DNA, 25 bp, Homo sapien
aaaaagatgacctgcatcctaaccc

SEQ ID NO: 145288 - DNA, 25 bp, Homo sapien
gcatcctaacccttgaatgactcaa

SEQ ID NO: 145289 - DNA, 25 bp, Homo sapien
tgactcaaatcagtgccaggtggag

SEQ ID NO: 145290 - DNA, 25 bp, Homo sapien
atcagtgccaggtggaggactccca

SEQ ID NO: 145291 - DNA, 25 bp, Homo sapien
aggtggaggactcccatcaccttct

SEQ ID NO: 145292 - DNA, 25 bp, Homo sapien
ttctctcagaacaaaatcacttcat

SEQ ID NO: 145293 - DNA, 25 bp, Homo sapien
caaaaagaattccaaccgaccagct

SEQ ID NO: 145294 - DNA, 25 bp, Homo sapien
agtatacatttttgcattgccttcg

SEQ ID NO: 145295 - DNA, 25 bp, Homo sapien
atacatttttgcattgccttcggtt

SEQ ID NO: 145296 - DNA, 25 bp, Homo sapien
catttttgcattgccttcggtttgt

SEQ ID NO: 145297 - DNA, 25 bp, Homo sapien
gcattgccttcggtttgtatttagt

SEQ ID NO: 145298 - DNA, 25 bp, Homo sapien
attgccttcggtttgtatttagtgt

SEQ ID NO: 145299 - DNA, 25 bp, Homo sapien
cttgtgatttttgaacaatacgtga

SEQ ID NO: 145300 - DNA, 25 bp, Homo sapien
tgaacaatacgtgaaagatgcaagc

SEQ ID NO: 145301 - DNA, 25 bp, Homo sapien
tgaaagatgcaagcacctgaatttc

SEQ ID NO: 145302 - DNA, 25 bp, Homo sapien
ttctgtttgaatgcggaacaatagc

SEQ ID NO: 145303 - DNA, 25 bp, Homo sapien
tgcggaacaatagctggttatttct

SEQ ID NO: 145304 - DNA, 25 bp, Homo sapien
ttaatcgtagctcaaggcttaccca

SEQ ID NO: 145305 - DNA, 25 bp, Homo sapien
taatcgtagctcaaggcttacccag

SEQ ID NO: 145306 - DNA, 25 bp, Homo sapien
aatcgtagctcaaggcttacccagc

SEQ ID NO: 145307 - DNA, 25 bp, Homo sapien
atcgtagctcaaggcttacccagca

SEQ ID NO: 145308 - DNA, 25 bp, Homo sapien
cgtagctcaaggcttacccagcatc

SEQ ID NO: 145309 - DNA, 25 bp, Homo sapien
gtagctcaaggcttacccagcatca

SEQ ID NO: 145310 - DNA, 25 bp, Homo sapien
tagctcaaggcttacccagcatcaa

SEQ ID NO: 145311 - DNA, 25 bp, Homo sapien
agctcaaggcttacccagcatcaaa

SEQ ID NO: 145312 - DNA, 25 bp, Homo sapien
ttcacatgggatagaccacttacat

SEQ ID NO: 145313 - DNA, 25 bp, Homo sapien
tcacatgggatagaccacttacata

SEQ ID NO: 145314 - DNA, 25 bp, Homo sapien
cacatgggatagaccacttacatat

SEQ ID NO: 145315 - DNA, 25 bp, Homo sapien
gggatcctgtacaaccctttgtgga

SEQ ID NO: 145316 - DNA, 25 bp, Homo sapien
ttgtggacccttttggtttagctct

SEQ ID NO: 145317 - DNA, 25 bp, Homo sapien
ttctactgttgcttaattatgatgg

SEQ ID NO: 145318 - DNA, 25 bp, Homo sapien
aagataacattgtcattcctagatg

SEQ ID NO: 145319 - DNA, 25 bp, Homo sapien
gtcattcctagatgaatcctttgaa

SEQ ID NO: 145320 - DNA, 25 bp, Homo sapien
ctgacatcagctctgttcatgagtg

SEQ ID NO: 145321 - DNA, 25 bp, Homo sapien
atcagctctgttcatgagtgctcag

SEQ ID NO: 145322 - DNA, 25 bp, Homo sapien
agagtccctgctaatgtaattggaa

SEQ ID NO: 145323 - DNA, 25 bp, Homo sapien
gtaattggaagcttggtacacataa

SEQ ID NO: 145324 - DNA, 25 bp, Homo sapien
agtatctatagccatgtacatatta

SEQ ID NO: 145325 - DNA, 25 bp, Homo sapien
gtacatattacagcatgacaagctc

SEQ ID NO: 145326 - DNA, 25 bp, Homo sapien
atggctttgcacagaaccagctagt

SEQ ID NO: 145327 - DNA, 25 bp, Homo sapien
ccagctagttatttggaagtaccca

SEQ ID NO: 145328 - DNA, 25 bp, Homo sapien
gaagtacccaaccatggccaaggtg

SEQ ID NO: 145329 - DNA, 25 bp, Homo sapien
cagtggcatccgcagcagcagatga

SEQ ID NO: 145330 - DNA, 25 bp, Homo sapien
gatgagaccctgaggctatggcgct

SEQ ID NO: 145331 - DNA, 25 bp, Homo sapien
tatggcgctgttttgagttggaccc

SEQ ID NO: 145332 - DNA, 25 bp, Homo sapien
tgttttgagttggaccctgcgcggc

SEQ ID NO: 145333 - DNA, 25 bp, Homo sapien
agtgcagccaaaagcagcctcatcc

SEQ ID NO: 145334 - DNA, 25 bp, Homo sapien
catccaccaaggcatccgctgaaga

SEQ ID NO: 145335 - DNA, 25 bp, Homo sapien
aggcatccgctgaagaccaacccat

SEQ ID NO: 145336 - DNA, 25 bp, Homo sapien
acccatcacctcagttgttttttat

SEQ ID NO: 145337 - DNA, 25 bp, Homo sapien
tccctcaggctgaaggaatatcatc

SEQ ID NO: 145338 - DNA, 25 bp, Homo sapien
ggaatatcatcgtctccagagcaag

SEQ ID NO: 145339 - DNA, 25 bp, Homo sapien
gtctccagagcaaggtcactgccaa

SEQ ID NO: 145340 - DNA, 25 bp, Homo sapien
actgccaaatagacccgtgtacaat

SEQ ID NO: 145341 - DNA, 25 bp, Homo sapien
tagacccgtgtacaatgaggagctg

SEQ ID NO: 145342 - DNA, 25 bp, Homo sapien
aagtacaggcgctaattgttgtgat

SEQ ID NO: 145343 - DNA, 25 bp, Homo sapien
ttgtaattgtgacttgttctccccg

SEQ ID NO: 145344 - DNA, 25 bp, Homo sapien
gtgacttgttctccccggctggcag

SEQ ID NO: 145345 - DNA, 25 bp, Homo sapien
ccctgaagcctgcaaacgttgtcat

SEQ ID NO: 145346 - DNA, 25 bp, Homo sapien
gaagcctgcaaacgttgtcatcgaa

SEQ ID NO: 145347 - DNA, 25 bp, Homo sapien
gcaaacgttgtcatcgaagggaagg

SEQ ID NO: 145348 - DNA, 25 bp, Homo sapien
ccactgtaacgcctgttacacacaa

SEQ ID NO: 145349 - DNA, 25 bp, Homo sapien
cacaaactgttgtgggttcctgcca

SEQ ID NO: 145350 - DNA, 25 bp, Homo sapien
tgccaggcttgaagaaaatgatctg

SEQ ID NO: 145351 - DNA, 25 bp, Homo sapien
ggtattcagagtgggctgggcccct

SEQ ID NO: 145352 - DNA, 25 bp, Homo sapien
tgggcgagacacagctacctctgtt

SEQ ID NO: 145353 - DNA, 25 bp, Homo sapien
gagacacagctacctctgttggcat

SEQ ID NO: 145354 - DNA, 25 bp, Homo sapien
gctacctctgttggcatctttttaa

SEQ ID NO: 145355 - DNA, 25 bp, Homo sapien
gcatctttttaataccaggaaccca

SEQ ID NO: 145356 - DNA, 25 bp, Homo sapien
ttttaataccaggaacccagcggct

SEQ ID NO: 145357 - DNA, 25 bp, Homo sapien
ataccaggaacccagcggctctagc

SEQ ID NO: 145358 - DNA, 25 bp, Homo sapien
ggctctagccactgagcggctaaat

SEQ ID NO: 145359 - DNA, 25 bp, Homo sapien
gaatacggaacagacctatgctcta

SEQ ID NO: 145360 - DNA, 25 bp, Homo sapien
ggaacagacctatgctctaagcaaa

SEQ ID NO: 145361 - DNA, 25 bp, Homo sapien
tgagaacagtacaaagtggcagaac

SEQ ID NO: 145362 - DNA, 25 bp, Homo sapien
gtggcagaaccacattttgttccct

SEQ ID NO: 145363 - DNA, 25 bp, Homo sapien
tttgttccctcttcaagggtgtctt

SEQ ID NO: 145364 - DNA, 25 bp, Homo sapien
agggtgtcttgtatgtgccgcttga

SEQ ID NO: 145365 - DNA, 25 bp, Homo sapien
tgccgcttgaagatttgtgagtttt

SEQ ID NO: 145366 - DNA, 25 bp, Homo sapien
aactggatggcttatgattgtaaag

SEQ ID NO: 145367 - DNA, 25 bp, Homo sapien
aacaattgttcttggtttgcttatg

SEQ ID NO: 145368 - DNA, 25 bp, Homo sapien
gtttgcttatgtagagtcctgcctt

SEQ ID NO: 145369 - DNA, 25 bp, Homo sapien
gagtcctgccttattgtttgttttt

SEQ ID NO: 145370 - DNA, 25 bp, Homo sapien
attctttcttcttcatgtattcaca

SEQ ID NO: 145371 - DNA, 25 bp, Homo sapien
ctcaatgtctcctactatccaaaat

SEQ ID NO: 145372 - DNA, 25 bp, Homo sapien
atgtgcatcacaggaggctcttaac

SEQ ID NO: 145373 - DNA, 25 bp, Homo sapien
gaggctcttaactttgtgaaaatcc

SEQ ID NO: 145374 - DNA, 25 bp, Homo sapien
gtgaaaatcccatgtttgctttatt

SEQ ID NO: 145375 - DNA, 25 bp, Homo sapien
aatgtcagaaggcagtttgcgctaa

SEQ ID NO: 145376 - DNA, 25 bp, Homo sapien
ttgcgctaatgcttgaactcttttt

SEQ ID NO: 145377 - DNA, 25 bp, Homo sapien
gaactctttttctgtgaaactcatt

SEQ ID NO: 145378 - DNA, 25 bp, Homo sapien
aaggtatgaccaaatcctgcctcat

SEQ ID NO: 145379 - DNA, 25 bp, Homo sapien
ccaaatcctgcctcattaattcaag

SEQ ID NO: 145380 - DNA, 25 bp, Homo sapien
cagggaatctggcttaaacatgaaa

SEQ ID NO: 145381 - DNA, 25 bp, Homo sapien
acctgcaccggcacgagaagatcca

SEQ ID NO: 145382 - DNA, 25 bp, Homo sapien
tgcaccggcacgagaagatccacac

SEQ ID NO: 145383 - DNA, 25 bp, Homo sapien
ggcacgagaagatccacaccaccgg

SEQ ID NO: 145384 - DNA, 25 bp, Homo sapien
acccgctcccacctaggaggccagg

SEQ ID NO: 145385 - DNA, 25 bp, Homo sapien
tggaacagccccactggagtcaagg

SEQ ID NO: 145386 - DNA, 25 bp, Homo sapien
ctggagtcaaggctccgagggagga

SEQ ID NO: 145387 - DNA, 25 bp, Homo sapien
agaaagggcaggcactctgcgaatt

SEQ ID NO: 145388 - DNA, 25 bp, Homo sapien
gaaagggcaggcactctgcgaatta

SEQ ID NO: 145389 - DNA, 25 bp, Homo sapien
aagggcaggcactctgcgaattaaa

SEQ ID NO: 145390 - DNA, 25 bp, Homo sapien
gggcaggcactctgcgaattaaagg

SEQ ID NO: 145391 - DNA, 25 bp, Homo sapien
gcactctgcgaattaaaggccttgg

SEQ ID NO: 145392 - DNA, 25 bp, Homo sapien
gggatgcacctcttctttgattccc

SEQ ID NO: 145393 - DNA, 25 bp, Homo sapien
ctcttctttgattccctgggatagt

SEQ ID NO: 145394 - DNA, 25 bp, Homo sapien
gatagtggcttctgagcaaaggcca

SEQ ID NO: 145395 - DNA, 25 bp, Homo sapien
attattgtgcctgaaatttcccgag

SEQ ID NO: 145396 - DNA, 25 bp, Homo sapien
tgtgcctgaaatttcccgagagaat

SEQ ID NO: 145397 - DNA, 25 bp, Homo sapien
ttcccgagagaattaagacagactg

SEQ ID NO: 145398 - DNA, 25 bp, Homo sapien
aagacagactgaatttgcgatgaaa

SEQ ID NO: 145399 - DNA, 25 bp, Homo sapien
gggaggatgtaaatagccgcacaaa

SEQ ID NO: 145400 - DNA, 25 bp, Homo sapien
gggtccaacagctctttgagtaggc

SEQ ID NO: 145401 - DNA, 25 bp, Homo sapien
cagctctttgagtaggcatttggta

SEQ ID NO: 145402 - DNA, 25 bp, Homo sapien
ggtggaccgaatttggcaagaatga

SEQ ID NO: 145403 - DNA, 25 bp, Homo sapien
tggctacatcatccctggctgtgga

SEQ ID NO: 145404 - DNA, 25 bp, Homo sapien
tttgtgtagcaaatgctccctcctt

SEQ ID NO: 145405 - DNA, 25 bp, Homo sapien
aatgctccctccttaaggttatagg

SEQ ID NO: 145406 - DNA, 25 bp, Homo sapien
aggttatagggctccctgagtttgg

SEQ ID NO: 145407 - DNA, 25 bp, Homo sapien
tgggagtgtggaagtactacttaac

SEQ ID NO: 145408 - DNA, 25 bp, Homo sapien
acttaactgtctgtcctgcttggct

SEQ ID NO: 145409 - DNA, 25 bp, Homo sapien
tcctgcttggctgtcgttatcgttt

SEQ ID NO: 145410 - DNA, 25 bp, Homo sapien
gctgtcgttatcgttttctggtgat

SEQ ID NO: 145411 - DNA, 25 bp, Homo sapien
tcgttttctggtgatgttgtgctaa

SEQ ID NO: 145412 - DNA, 25 bp, Homo sapien
acgggtttatttctgtggcctgaga

SEQ ID NO: 145413 - DNA, 25 bp, Homo sapien
gagaaggaagggacctccacgacag

SEQ ID NO: 145414 - DNA, 25 bp, Homo sapien
gtgacgtgactcagaccatcaatac

SEQ ID NO: 145415 - DNA, 25 bp, Homo sapien
ccatcaatacagtcgcataccatgc

SEQ ID NO: 145416 - DNA, 25 bp, Homo sapien
ataccatgcgagacccgattctgat

SEQ ID NO: 145417 - DNA, 25 bp, Homo sapien
gagacccgattctgatcagcgcttc

SEQ ID NO: 145418 - DNA, 25 bp, Homo sapien
atcagcgcttctgcacacagtatat

SEQ ID NO: 145419 - DNA, 25 bp, Homo sapien
ggcaaagtctggaaggctccttcga

SEQ ID NO: 145420 - DNA, 25 bp, Homo sapien
ctccttcgagctggtttatagactg

SEQ ID NO: 145421 - DNA, 25 bp, Homo sapien
gactgtgtgatgtcctttgagttgc

SEQ ID NO: 145422 - DNA, 25 bp, Homo sapien
ctttgagttgcttcctcttgacagc

SEQ ID NO: 145423 - DNA, 25 bp, Homo sapien
aatttgcacggtttgtgagagccca

SEQ ID NO: 145424 - DNA, 25 bp, Homo sapien
gtgagagcccagtcattgtactgtt

SEQ ID NO: 145425 - DNA, 25 bp, Homo sapien
acgtcctgtctcagctgcagtcgta

SEQ ID NO: 145426 - DNA, 25 bp, Homo sapien
tcctgtctcagctgcagtcgtaagt

SEQ ID NO: 145427 - DNA, 25 bp, Homo sapien
tgtctcagctgcagtcgtaagtccg

SEQ ID NO: 145428 - DNA, 25 bp, Homo sapien
tctcagctgcagtcgtaagtccgtg

SEQ ID NO: 145429 - DNA, 25 bp, Homo sapien
tcagctgcagtcgtaagtccgtgca

SEQ ID NO: 145430 - DNA, 25 bp, Homo sapien
agctgcagtcgtaagtccgtgcacc

SEQ ID NO: 145431 - DNA, 25 bp, Homo sapien
tgcagtcgtaagtccgtgcaccatc

SEQ ID NO: 145432 - DNA, 25 bp, Homo sapien
agtcgtaagtccgtgcaccatcctt

SEQ ID NO: 145433 - DNA, 25 bp, Homo sapien
gtaagtccgtgcaccatccttgacg

SEQ ID NO: 145434 - DNA, 25 bp, Homo sapien
aagtccgtgcaccatccttgacgtt

SEQ ID NO: 145435 - DNA, 25 bp, Homo sapien
cgtgcaccatccttgacgttttgct

SEQ ID NO: 145436 - DNA, 25 bp, Homo sapien
gtctttgtaatgtcagctggcatca

SEQ ID NO: 145437 - DNA, 25 bp, Homo sapien
gtaatgtcagctggcatcatacaaa

SEQ ID NO: 145438 - DNA, 25 bp, Homo sapien
agctggcatcatacaaagagcagga

SEQ ID NO: 145439 - DNA, 25 bp, Homo sapien
agagcaggagaagcaaacacccaga

SEQ ID NO: 145440 - DNA, 25 bp, Homo sapien
ccagaactcttttgctggtcagaga

SEQ ID NO: 145441 - DNA, 25 bp, Homo sapien
tcttttgctggtcagagattccctg

SEQ ID NO: 145442 - DNA, 25 bp, Homo sapien
gtcagagattccctgagtgtctgtc

SEQ ID NO: 145443 - DNA, 25 bp, Homo sapien
tctgtgtctgtgttgtgaagcttga

SEQ ID NO: 145444 - DNA, 25 bp, Homo sapien
tgttgtgaagcttgagactctggaa

SEQ ID NO: 145445 - DNA, 25 bp, Homo sapien
ggaaatgttgccctaagaatgcttc

SEQ ID NO: 145446 - DNA, 25 bp, Homo sapien
tgttgccctaagaatgcttctcatt

SEQ ID NO: 145447 - DNA, 25 bp, Homo sapien
cagtccctcaataggcaaaggcaga

SEQ ID NO: 145448 - DNA, 25 bp, Homo sapien
gcagaagcagctactcaatgagaac

SEQ ID NO: 145449 - DNA, 25 bp, Homo sapien
caatgagaacaacaacacaggaatc

SEQ ID NO: 145450 - DNA, 25 bp, Homo sapien
cacaggaatcatcaagggtcattac

SEQ ID NO: 145451 - DNA, 25 bp, Homo sapien
gggtcattacaaccggcggactttg

SEQ ID NO: 145452 - DNA, 25 bp, Homo sapien
tacaaccggcggactttgttgtcac

SEQ ID NO: 145453 - DNA, 25 bp, Homo sapien
ggcggactttgttgtcacccagcgg

SEQ ID NO: 145454 - DNA, 25 bp, Homo sapien
tttgttgtcacccagcggcacagag

SEQ ID NO: 145455 - DNA, 25 bp, Homo sapien
gctgaaggcaccgacaaatctgatt

SEQ ID NO: 145456 - DNA, 25 bp, Homo sapien
ggcaccgacaaatctgatttgccat

SEQ ID NO: 145457 - DNA, 25 bp, Homo sapien
tgatttgccataaaagcattttctt

SEQ ID NO: 145458 - DNA, 25 bp, Homo sapien
aatgcagccctggttcaggcccgga

SEQ ID NO: 145459 - DNA, 25 bp, Homo sapien
ttcaggcccggaggagggtttgcgg

SEQ ID NO: 145460 - DNA, 25 bp, Homo sapien
gtttgcgggtagttgcacggacaat

SEQ ID NO: 145461 - DNA, 25 bp, Homo sapien
gtagttgcacggacaattcggcggg

SEQ ID NO: 145462 - DNA, 25 bp, Homo sapien
tgctgcctgttgctgccattagccc

SEQ ID NO: 145463 - DNA, 25 bp, Homo sapien
tgttgctgccattagcccaggagga

SEQ ID NO: 145464 - DNA, 25 bp, Homo sapien
tggacggcggacaggcagtccccac

SEQ ID NO: 145465 - DNA, 25 bp, Homo sapien
acaggcagtccccacgctgctgggt

SEQ ID NO: 145466 - DNA, 25 bp, Homo sapien
acgctgctgggtggcgccgggcttg

SEQ ID NO: 145467 - DNA, 25 bp, Homo sapien
atcgtcgcgcctgtggacgcctagg

SEQ ID NO: 145468 - DNA, 25 bp, Homo sapien
gacgcctaggcaagagcggccctct

SEQ ID NO: 145469 - DNA, 25 bp, Homo sapien
agctgctgagtcgcggctacggctt

SEQ ID NO: 145470 - DNA, 25 bp, Homo sapien
agcgcgccttcggcggcgtgatctt

SEQ ID NO: 145471 - DNA, 25 bp, Homo sapien
atcttccagaagaaggccgcggaca

SEQ ID NO: 145472 - DNA, 25 bp, Homo sapien
cttccagaagaaggccgcggacact

SEQ ID NO: 145473 - DNA, 25 bp, Homo sapien
ctgggcgctcggctacatgctgaac

SEQ ID NO: 145474 - DNA, 25 bp, Homo sapien
aagggcacagacttcagctcctggg

SEQ ID NO: 145475 - DNA, 25 bp, Homo sapien
gcacagacttcagctcctgggtcgt

SEQ ID NO: 145476 - DNA, 25 bp, Homo sapien
agacttcagctcctgggtcgtcctc

SEQ ID NO: 145477 - DNA, 25 bp, Homo sapien
cctggctgcgcttgtcctgctgctg

SEQ ID NO: 145478 - DNA, 25 bp, Homo sapien
ctgctgctgcgtcaggtgcactccg

SEQ ID NO: 145479 - DNA, 25 bp, Homo sapien
gcgtcaggtgcactccgccaagctg

SEQ ID NO: 145480 - DNA, 25 bp, Homo sapien
caccatttttctttgccggtttgca

SEQ ID NO: 145481 - DNA, 25 bp, Homo sapien
accatttttctttgccggtttgcat

SEQ ID NO: 145482 - DNA, 25 bp, Homo sapien
ccatttttctttgccggtttgcatg

SEQ ID NO: 145483 - DNA, 25 bp, Homo sapien
tttctttgccggtttgcatgagtgg

SEQ ID NO: 145484 - DNA, 25 bp, Homo sapien
tctttgccggtttgcatgagtggaa

SEQ ID NO: 145485 - DNA, 25 bp, Homo sapien
ccggtttgcatgagtggaaggtcta

SEQ ID NO: 145486 - DNA, 25 bp, Homo sapien
gtttgcatgagtggaaggtctaaat

SEQ ID NO: 145487 - DNA, 25 bp, Homo sapien
gagtggaaggtctaaatgtggcttt

SEQ ID NO: 145488 - DNA, 25 bp, Homo sapien
gatgggtctagggagtgggaaatgc

SEQ ID NO: 145489 - DNA, 25 bp, Homo sapien
tgccgccttctgcaatttatttatt

SEQ ID NO: 145490 - DNA, 25 bp, Homo sapien
gccgccttctgcaatttatttattt

SEQ ID NO: 145491 - DNA, 25 bp, Homo sapien
ttctggcccaactctggatgcctgt

SEQ ID NO: 145492 - DNA, 25 bp, Homo sapien
tctggatgcctgttatactgggaca

SEQ ID NO: 145493 - DNA, 25 bp, Homo sapien
gcctgttatactgggacaaacctta

SEQ ID NO: 145494 - DNA, 25 bp, Homo sapien
atatgtgtcacaactgtagatccta

SEQ ID NO: 145495 - DNA, 25 bp, Homo sapien
ttgtgaacagaacacatggtcttca

SEQ ID NO: 145496 - DNA, 25 bp, Homo sapien
gtcttcaatatgtagattctgtgtg

SEQ ID NO: 145497 - DNA, 25 bp, Homo sapien
gattctgtgtgacatagatttgaac

SEQ ID NO: 145498 - DNA, 25 bp, Homo sapien
gaacataattgctggacactgactg

SEQ ID NO: 145499 - DNA, 25 bp, Homo sapien
acactgactgatgtactgtggcaga

SEQ ID NO: 145500 - DNA, 25 bp, Homo sapien
ctgtggcagacagaactagttgctg

SEQ ID NO: 145501 - DNA, 25 bp, Homo sapien
agttgctgtctcaatatccattcct

SEQ ID NO: 145502 - DNA, 25 bp, Homo sapien
atagcgagagtcaccttcgacttgt

SEQ ID NO: 145503 - DNA, 25 bp, Homo sapien
ttcgacttgtacaggctgaacccca

SEQ ID NO: 145504 - DNA, 25 bp, Homo sapien
atcggctgccttaacgtgaaggcca

SEQ ID NO: 145505 - DNA, 25 bp, Homo sapien
atgagatgtactccgtgtcctacga

SEQ ID NO: 145506 - DNA, 25 bp, Homo sapien
tgtcctacgacatccggtgcacggg

SEQ ID NO: 145507 - DNA, 25 bp, Homo sapien
tgcacgggactcaagggcctgctga

SEQ ID NO: 145508 - DNA, 25 bp, Homo sapien
cctgctgaggagtctgctgcggttc

SEQ ID NO: 145509 - DNA, 25 bp, Homo sapien
ccaggtgacgggacagtttctcatc

SEQ ID NO: 145510 - DNA, 25 bp, Homo sapien
ggacagtttctcatctatctgggca

SEQ ID NO: 145511 - DNA, 25 bp, Homo sapien
atctgggcacatacatgctccgggt

SEQ ID NO: 145512 - DNA, 25 bp, Homo sapien
acatgctccgggtgctggatgacaa

SEQ ID NO: 145513 - DNA, 25 bp, Homo sapien
ggactctggccatcatgttgacagc

SEQ ID NO: 145514 - DNA, 25 bp, Homo sapien
atgttgacagccttgcacttccaca

SEQ ID NO: 145515 - DNA, 25 bp, Homo sapien
acttccacaggctacaagccctggg

SEQ ID NO: 145516 - DNA, 25 bp, Homo sapien
ggaccatctttctgccttaagggca

SEQ ID NO: 145517 - DNA, 25 bp, Homo sapien
aggagcccacttctgtggcaccaga

SEQ ID NO: 145518 - DNA, 25 bp, Homo sapien
gtggcaccagattccaccctgggaa

SEQ ID NO: 145519 - DNA, 25 bp, Homo sapien
agtgtcttcctcttaaacctcaatc

SEQ ID NO: 145520 - DNA, 25 bp, Homo sapien
aacctcaatcatcgagacattaggg

SEQ ID NO: 145521 - DNA, 25 bp, Homo sapien
ttatctttttcaagccacatcttcc

SEQ ID NO: 145522 - DNA, 25 bp, Homo sapien
atcttcctctaacaaatctctcagt

SEQ ID NO: 145523 - DNA, 25 bp, Homo sapien
atctctcagtatgcgattggtctca

SEQ ID NO: 145524 - DNA, 25 bp, Homo sapien
gtactgacagaaagcaaggacatgc

SEQ ID NO: 145525 - DNA, 25 bp, Homo sapien
gaaagcaaggacatgcggcctgcat

SEQ ID NO: 145526 - DNA, 25 bp, Homo sapien
aagcaaggacatgcggcctgcatgg

SEQ ID NO: 145527 - DNA, 25 bp, Homo sapien
acatgcggcctgcatggtgggagct

SEQ ID NO: 145528 - DNA, 25 bp, Homo sapien
gggagctggttgaattgtctttatt

SEQ ID NO: 145529 - DNA, 25 bp, Homo sapien
gatatccaaggccactacattgagg

SEQ ID NO: 145530 - DNA, 25 bp, Homo sapien
gagaagggttacttgctgctcacac

SEQ ID NO: 145531 - DNA, 25 bp, Homo sapien
aagggttacttgctgctcacactat

SEQ ID NO: 145532 - DNA, 25 bp, Homo sapien
ggttacttgctgctcacactatata

SEQ ID NO: 145533 - DNA, 25 bp, Homo sapien
ttacttgctgctcacactatataca

SEQ ID NO: 145534 - DNA, 25 bp, Homo sapien
cttgctgctcacactatatacagat

SEQ ID NO: 145535 - DNA, 25 bp, Homo sapien
gctgctaatatttagtattgatcgt

SEQ ID NO: 145536 - DNA, 25 bp, Homo sapien
tggggaacttgatctgtactgtaat

SEQ ID NO: 145537 - DNA, 25 bp, Homo sapien
gtaattttactaattccttgtgcag

SEQ ID NO: 145538 - DNA, 25 bp, Homo sapien
aattttactaattccttgtgcagag

SEQ ID NO: 145539 - DNA, 25 bp, Homo sapien
tttactaattccttgtgcagaggtg

SEQ ID NO: 145540 - DNA, 25 bp, Homo sapien
actaattccttgtgcagaggtgggt

SEQ ID NO: 145541 - DNA, 25 bp, Homo sapien
actctacagaagttgtgcgcgtgct

SEQ ID NO: 145542 - DNA, 25 bp, Homo sapien
ctctacagaagttgtgcgcgtgctt

SEQ ID NO: 145543 - DNA, 25 bp, Homo sapien
tctacagaagttgtgcgcgtgcttt

SEQ ID NO: 145544 - DNA, 25 bp, Homo sapien
ctacagaagttgtgcgcgtgctttc

SEQ ID NO: 145545 - DNA, 25 bp, Homo sapien
gtgcgcgtgctttctcagcagcatt

SEQ ID NO: 145546 - DNA, 25 bp, Homo sapien
gggagatgccattcactctctgcaa

SEQ ID NO: 145547 - DNA, 25 bp, Homo sapien
gccattcactctctgcaagaggagt

SEQ ID NO: 145548 - DNA, 25 bp, Homo sapien
aaactggtggactgtcagctttatt

SEQ ID NO: 145549 - DNA, 25 bp, Homo sapien
gtcagctttatttagctcacctagt

SEQ ID NO: 145550 - DNA, 25 bp, Homo sapien
atttagctcacctagtgttttcaag

SEQ ID NO: 145551 - DNA, 25 bp, Homo sapien
gaaaattgagccaccgtctaagaaa

SEQ ID NO: 145552 - DNA, 25 bp, Homo sapien
aattagaatttctggcctctctcga

SEQ ID NO: 145553 - DNA, 25 bp, Homo sapien
tggcctctctcgatcggtcagaatg

SEQ ID NO: 145554 - DNA, 25 bp, Homo sapien
cgatcggtcagaatgtgtggcaatt

SEQ ID NO: 145555 - DNA, 25 bp, Homo sapien
tgtggcaattctgatctgcattttc

SEQ ID NO: 145556 - DNA, 25 bp, Homo sapien
tttggcaagacttgtactctctcac

SEQ ID NO: 145557 - DNA, 25 bp, Homo sapien
tcaaggccacactcagatcctttct

SEQ ID NO: 145558 - DNA, 25 bp, Homo sapien
tgcctcctacccattgccaagagag

SEQ ID NO: 145559 - DNA, 25 bp, Homo sapien
cccattgccaagagaggatgcatct

SEQ ID NO: 145560 - DNA, 25 bp, Homo sapien
ggagagcaaagcactaaggaattca

SEQ ID NO: 145561 - DNA, 25 bp, Homo sapien
gattgtgcccaatctggagccagag

SEQ ID NO: 145562 - DNA, 25 bp, Homo sapien
agggcagggacctgctcatgcaact

SEQ ID NO: 145563 - DNA, 25 bp, Homo sapien
tgctcatgcaactcctgcagtatga

SEQ ID NO: 145564 - DNA, 25 bp, Homo sapien
tgcaactcctgcagtatgaccccag

SEQ ID NO: 145565 - DNA, 25 bp, Homo sapien
agccagcggatcacagccaagactg

SEQ ID NO: 145566 - DNA, 25 bp, Homo sapien
tgcccgccagtatgtgctgcagcga

SEQ ID NO: 145567 - DNA, 25 bp, Homo sapien
gctgcagcgattccgccattgagaa

SEQ ID NO: 145568 - DNA, 25 bp, Homo sapien
caaatgttgtaaattccctgagtgt

SEQ ID NO: 145569 - DNA, 25 bp, Homo sapien
gtaaattccctgagtgttattctac

SEQ ID NO: 145570 - DNA, 25 bp, Homo sapien
attccctgagtgttattctacttgt

SEQ ID NO: 145571 - DNA, 25 bp, Homo sapien
ctgagtgttattctacttgtattaa

SEQ ID NO: 145572 - DNA, 25 bp, Homo sapien
taaaatctgagggatcattgccaga

SEQ ID NO: 145573 - DNA, 25 bp, Homo sapien
atctgagggatcattgccagagatt

SEQ ID NO: 145574 - DNA, 25 bp, Homo sapien
gagggaaatgttatcaacggtttca

SEQ ID NO: 145575 - DNA, 25 bp, Homo sapien
gttatcaacggtttcattgaaatta

SEQ ID NO: 145576 - DNA, 25 bp, Homo sapien
agttatttcctcagaaaaatcaaat

SEQ ID NO: 145577 - DNA, 25 bp, Homo sapien
taaaaaccactgtagaatgatgtaa

SEQ ID NO: 145578 - DNA, 25 bp, Homo sapien
actgtgcagtatttctgacatatac

SEQ ID NO: 145579 - DNA, 25 bp, Homo sapien
ggacttccttacaatttctcctgag

SEQ ID NO: 145580 - DNA, 25 bp, Homo sapien
ttccttacaatttctcctgagttaa

SEQ ID NO: 145581 - DNA, 25 bp, Homo sapien
ttctcctgagttaacttttgtgaaa

SEQ ID NO: 145582 - DNA, 25 bp, Homo sapien
ctggcttattgaggaaatttcctaa

SEQ ID NO: 145583 - DNA, 25 bp, Homo sapien
gagaagatcattaaccactgtatac

SEQ ID NO: 145584 - DNA, 25 bp, Homo sapien
attaaccactgtatactttgtgtat

SEQ ID NO: 145585 - DNA, 25 bp, Homo sapien
atatgatttgaggtggtgcatgcaa

SEQ ID NO: 145586 - DNA, 25 bp, Homo sapien
ggtgcatgcaagtaactagggttta

SEQ ID NO: 145587 - DNA, 25 bp, Homo sapien
gtaactagggtttattctatataat

SEQ ID NO: 145588 - DNA, 25 bp, Homo sapien
atagatctgtaacatttgtttcaaa

SEQ ID NO: 145589 - DNA, 25 bp, Homo sapien
aaagtaccagtgtttagctgctttt

SEQ ID NO: 145590 - DNA, 25 bp, Homo sapien
tttggagaatattttacagctattg

SEQ ID NO: 145591 - DNA, 25 bp, Homo sapien
attgtccaaggagatactttagaag

SEQ ID NO: 145592 - DNA, 25 bp, Homo sapien
aaccaatgcaagcttgttattgaag

SEQ ID NO: 145593 - DNA, 25 bp, Homo sapien
tgttattgaagagcaatctgggcct

SEQ ID NO: 145594 - DNA, 25 bp, Homo sapien
ctttcatctggattccctcaaagga

SEQ ID NO: 145595 - DNA, 25 bp, Homo sapien
ataaattagctactgcgcctctgac

SEQ ID NO: 145596 - DNA, 25 bp, Homo sapien
tactgcgcctctgacaacgacagaa

SEQ ID NO: 145597 - DNA, 25 bp, Homo sapien
gacaacgacagaagagcatttagaa

SEQ ID NO: 145598 - DNA, 25 bp, Homo sapien
ataacatactacttggaggctttta

SEQ ID NO: 145599 - DNA, 25 bp, Homo sapien
gcagtcaatgtgaattcttacgaat

SEQ ID NO: 145600 - DNA, 25 bp, Homo sapien
gaattcttacgaatgtacaacacaa

SEQ ID NO: 145601 - DNA, 25 bp, Homo sapien
tgcctggccattgcgagcggcatct

SEQ ID NO: 145602 - DNA, 25 bp, Homo sapien
tggccattgcgagcggcatctacct

SEQ ID NO: 145603 - DNA, 25 bp, Homo sapien
attgcgagcggcatctacctactgg

SEQ ID NO: 145604 - DNA, 25 bp, Homo sapien
ttgcgagcggcatctacctactggc

SEQ ID NO: 145605 - DNA, 25 bp, Homo sapien
gcgagcggcatctacctactggcgg

SEQ ID NO: 145606 - DNA, 25 bp, Homo sapien
gagcggcatctacctactggcggct

SEQ ID NO: 145607 - DNA, 25 bp, Homo sapien
gcggcatctacctactggcggctgt

SEQ ID NO: 145608 - DNA, 25 bp, Homo sapien
ggcatctacctactggcggctgtgc

SEQ ID NO: 145609 - DNA, 25 bp, Homo sapien
catctacctactggcggctgtgcgt

SEQ ID NO: 145610 - DNA, 25 bp, Homo sapien
agcggccgcagatcggaggcaccat

SEQ ID NO: 145611 - DNA, 25 bp, Homo sapien
gacgaggtcgtgtgacctcgccccg

SEQ ID NO: 145612 - DNA, 25 bp, Homo sapien
gcagtgagcctgtcatcgctccact

SEQ ID NO: 145613 - DNA, 25 bp, Homo sapien
gtgagcctgtcatcgctccactgag

SEQ ID NO: 145614 - DNA, 25 bp, Homo sapien
tgtcatcgctccactgagccaagat

SEQ ID NO: 145615 - DNA, 25 bp, Homo sapien
gtcatcgctccactgagccaagatc

SEQ ID NO: 145616 - DNA, 25 bp, Homo sapien
atatgagataatgcagtcgggagaa

SEQ ID NO: 145617 - DNA, 25 bp, Homo sapien
tttattaaatgtgacgaactgcccc

SEQ ID NO: 145618 - DNA, 25 bp, Homo sapien
tattaaatgtgacgaactgcccccc

SEQ ID NO: 145619 - DNA, 25 bp, Homo sapien
caggagagcagcaaaatttatgtaa

SEQ ID NO: 145620 - DNA, 25 bp, Homo sapien
gctcctgccaggattaaaagtccat

SEQ ID NO: 145621 - DNA, 25 bp, Homo sapien
tcctgccaggattaaaagtccatga

SEQ ID NO: 145622 - DNA, 25 bp, Homo sapien
ggattaaaagtccatgagtttcttg

SEQ ID NO: 145623 - DNA, 25 bp, Homo sapien
gtactgacagaaagcaaggacatgc

SEQ ID NO: 145624 - DNA, 25 bp, Homo sapien
gaaagcaaggacatgcggcctgcat

SEQ ID NO: 145625 - DNA, 25 bp, Homo sapien
aagcaaggacatgcggcctgcatgg

SEQ ID NO: 145626 - DNA, 25 bp, Homo sapien
acatgcggcctgcatggtgggagct

SEQ ID NO: 145627 - DNA, 25 bp, Homo sapien
ggagaagggttacttgctgctcaca

SEQ ID NO: 145628 - DNA, 25 bp, Homo sapien
agaagggttacttgctgctcacact

SEQ ID NO: 145629 - DNA, 25 bp, Homo sapien
aagggttacttgctgctcacactat

SEQ ID NO: 145630 - DNA, 25 bp, Homo sapien
agggttacttgctgctcacactata

SEQ ID NO: 145631 - DNA, 25 bp, Homo sapien
ggttacttgctgctcacactatata

SEQ ID NO: 145632 - DNA, 25 bp, Homo sapien
ttacttgctgctcacactatataca

SEQ ID NO: 145633 - DNA, 25 bp, Homo sapien
cttgctgctcacactatatacagat

SEQ ID NO: 145634 - DNA, 25 bp, Homo sapien
cctcttcaactgacttgctcccctc

SEQ ID NO: 145635 - DNA, 25 bp, Homo sapien
ctcttcaactgacttgctcccctct

SEQ ID NO: 145636 - DNA, 25 bp, Homo sapien
tcttcaactgacttgctcccctctc

SEQ ID NO: 145637 - DNA, 25 bp, Homo sapien
cttcaactgacttgctcccctctcc

SEQ ID NO: 145638 - DNA, 25 bp, Homo sapien
actgacttgctcccctctccttttc

SEQ ID NO: 145639 - DNA, 25 bp, Homo sapien
ctgacttgctcccctctccttttct

SEQ ID NO: 145640 - DNA, 25 bp, Homo sapien
ccttttcttctctttagagacccag

SEQ ID NO: 145641 - DNA, 25 bp, Homo sapien
ggtgtgagccatggggtgtgtattt

SEQ ID NO: 145642 - DNA, 25 bp, Homo sapien
gtgtgagccatggggtgtgtatttg

SEQ ID NO: 145643 - DNA, 25 bp, Homo sapien
tattggctggagtgaatggattatc

SEQ ID NO: 145644 - DNA, 25 bp, Homo sapien
tgaatggattatctcccccaagtcc

SEQ ID NO: 145645 - DNA, 25 bp, Homo sapien
ccccaagtcctttgatgcctattat

SEQ ID NO: 145646 - DNA, 25 bp, Homo sapien
ttgatgcctattattgctctggagc

SEQ ID NO: 145647 - DNA, 25 bp, Homo sapien
tattgctctggagcatgccagttcc

SEQ ID NO: 145648 - DNA, 25 bp, Homo sapien
gccagttccccatgccaaagtcttt

SEQ ID NO: 145649 - DNA, 25 bp, Homo sapien
gaatgtagtgcttaaagtataccct

SEQ ID NO: 145650 - DNA, 25 bp, Homo sapien
gtgcttaaagtataccctaacatga

SEQ ID NO: 145651 - DNA, 25 bp, Homo sapien
tataccctaacatgacagtagagtc

SEQ ID NO: 145652 - DNA, 25 bp, Homo sapien
gacagtagagtcttgcgcttgcaga

SEQ ID NO: 145653 - DNA, 25 bp, Homo sapien
gagtcttgcgcttgcagataacctg

SEQ ID NO: 145654 - DNA, 25 bp, Homo sapien
aaggtattggaggactccctcccag

SEQ ID NO: 145655 - DNA, 25 bp, Homo sapien
gtattggaggactccctcccagctt

SEQ ID NO: 145656 - DNA, 25 bp, Homo sapien
ggaggactccctcccagctttggaa

SEQ ID NO: 145657 - DNA, 25 bp, Homo sapien
gtgtgtatgtgtagacaagctctcg

SEQ ID NO: 145658 - DNA, 25 bp, Homo sapien
gtgtatgtgtagacaagctctcgct

SEQ ID NO: 145659 - DNA, 25 bp, Homo sapien
gtatgtgtagacaagctctcgctct

SEQ ID NO: 145660 - DNA, 25 bp, Homo sapien
atgtgtagacaagctctcgctctgt

SEQ ID NO: 145661 - DNA, 25 bp, Homo sapien
gtgtagacaagctctcgctctgtca

SEQ ID NO: 145662 - DNA, 25 bp, Homo sapien
tgggaccataggctcacaacaccac

SEQ ID NO: 145663 - DNA, 25 bp, Homo sapien
gggaccataggctcacaacaccaca

SEQ ID NO: 145664 - DNA, 25 bp, Homo sapien
tcgcaacattgcccagacttccttt

SEQ ID NO: 145665 - DNA, 25 bp, Homo sapien
ggctatagatcaaattatctgtatg

SEQ ID NO: 145666 - DNA, 25 bp, Homo sapien
ttgactggcaaattcgctttggact

SEQ ID NO: 145667 - DNA, 25 bp, Homo sapien
gactggcaaattcgctttggactcg

SEQ ID NO: 145668 - DNA, 25 bp, Homo sapien
ggcaaattcgctttggactcgtgta

SEQ ID NO: 145669 - DNA, 25 bp, Homo sapien
caaattcgctttggactcgtgtatt

SEQ ID NO: 145670 - DNA, 25 bp, Homo sapien
aattcgctttggactcgtgtattct

SEQ ID NO: 145671 - DNA, 25 bp, Homo sapien
ttcgctttggactcgtgtattctca

SEQ ID NO: 145672 - DNA, 25 bp, Homo sapien
gctttggactcgtgtattctcattt

SEQ ID NO: 145673 - DNA, 25 bp, Homo sapien
tttggactcgtgtattctcatttgt

SEQ ID NO: 145674 - DNA, 25 bp, Homo sapien
tcatttgtcataccgcatcacacta

SEQ ID NO: 145675 - DNA, 25 bp, Homo sapien
ggatacttcccttcctaattatcat

SEQ ID NO: 145676 - DNA, 25 bp, Homo sapien
gacaattgtgtctactacatgttta

SEQ ID NO: 145677 - DNA, 25 bp, Homo sapien
tgtgtctactacatgtttaaaaaca

SEQ ID NO: 145678 - DNA, 25 bp, Homo sapien
ttagttgtaactgcttgaggtatgt

SEQ ID NO: 145679 - DNA, 25 bp, Homo sapien
agttgtaactgcttgaggtatgttt

SEQ ID NO: 145680 - DNA, 25 bp, Homo sapien
aagtgacagatttgttatcctttat

SEQ ID NO: 145681 - DNA, 25 bp, Homo sapien
tatcctttattaacgtactttgttg

SEQ ID NO: 145682 - DNA, 25 bp, Homo sapien
attaacgtactttgttggtcagcac

SEQ ID NO: 145683 - DNA, 25 bp, Homo sapien
acgtactttgttggtcagcactggg

SEQ ID NO: 145684 - DNA, 25 bp, Homo sapien
tactttgttggtcagcactgggctg

SEQ ID NO: 145685 - DNA, 25 bp, Homo sapien
agcactgggctgacaaaaatttttt

SEQ ID NO: 145686 - DNA, 25 bp, Homo sapien
ggctgacaaaaattttttcttgcta

SEQ ID NO: 145687 - DNA, 25 bp, Homo sapien
gcctttacctacataggcaaattgg

SEQ ID NO: 145688 - DNA, 25 bp, Homo sapien
gattaaacagactttagcttacagt

SEQ ID NO: 145689 - DNA, 25 bp, Homo sapien
actttagcttacagtcaattttaca

SEQ ID NO: 145690 - DNA, 25 bp, Homo sapien
gaaatatagttctgatgggtcccaa

SEQ ID NO: 145691 - DNA, 25 bp, Homo sapien
tgatgggtcccaaaagcttagcagg

SEQ ID NO: 145692 - DNA, 25 bp, Homo sapien
tagcagggtgctaacgtatctctag

SEQ ID NO: 145693 - DNA, 25 bp, Homo sapien
aacgtatctctaggctgttttctcc

SEQ ID NO: 145694 - DNA, 25 bp, Homo sapien
taggctgttttctccaccaactgga

SEQ ID NO: 145695 - DNA, 25 bp, Homo sapien
tccaccaactggagcactgatcaat

SEQ ID NO: 145696 - DNA, 25 bp, Homo sapien
gagcactgatcaatccttcttatgt

SEQ ID NO: 145697 - DNA, 25 bp, Homo sapien
tgttttctaaagttgttcacatata

SEQ ID NO: 145698 - DNA, 25 bp, Homo sapien
aaacatggagcccttgtcagatgtg

SEQ ID NO: 145699 - DNA, 25 bp, Homo sapien
catggagcccttgtcagatgtgaca

SEQ ID NO: 145700 - DNA, 25 bp, Homo sapien
atgtgacagccaccctcctctttga

SEQ ID NO: 145701 - DNA, 25 bp, Homo sapien
gtgggaatgccctcatgaagcaata

SEQ ID NO: 145702 - DNA, 25 bp, Homo sapien
gaatgccctcatgaagcaataccag

SEQ ID NO: 145703 - DNA, 25 bp, Homo sapien
tgccctcatgaagcaataccaggtt

SEQ ID NO: 145704 - DNA, 25 bp, Homo sapien
tgaagcaataccaggttcagttctg

SEQ ID NO: 145705 - DNA, 25 bp, Homo sapien
gcaataccaggttcagttctggaag

SEQ ID NO: 145706 - DNA, 25 bp, Homo sapien
ggttcagttctggaagatgctaatt

SEQ ID NO: 145707 - DNA, 25 bp, Homo sapien
gaagatgctaattctcatcaaagag

SEQ ID NO: 145708 - DNA, 25 bp, Homo sapien
gctaattctcatcaaagaggactac

SEQ ID NO: 145709 - DNA, 25 bp, Homo sapien
gaaagttctatctgttctattatag

SEQ ID NO: 145710 - DNA, 25 bp, Homo sapien
aaggtaaacatctgaaagcacattt

SEQ ID NO: 145711 - DNA, 25 bp, Homo sapien
tgaaagcacatttcagcctatttgc

SEQ ID NO: 145712 - DNA, 25 bp, Homo sapien
agcctatttgcttagtgaaacatta

SEQ ID NO: 145713 - DNA, 25 bp, Homo sapien
gctgtagactgtaaactcctcgtga

SEQ ID NO: 145714 - DNA, 25 bp, Homo sapien
aactcctcgtgagtaggaaccctgt

SEQ ID NO: 145715 - DNA, 25 bp, Homo sapien
gagtaggaaccctgtctcagtgcat

SEQ ID NO: 145716 - DNA, 25 bp, Homo sapien
aaccctgtctcagtgcattttgttt

SEQ ID NO: 145717 - DNA, 25 bp, Homo sapien
ttgttttcctgcttcctacctcaag

SEQ ID NO: 145718 - DNA, 25 bp, Homo sapien
gcttcctacctcaagatcttggcaa

SEQ ID NO: 145719 - DNA, 25 bp, Homo sapien
gatcttggcaatggtacactacaaa

SEQ ID NO: 145720 - DNA, 25 bp, Homo sapien
ggagcatgtgcttcaaagttcctta

SEQ ID NO: 145721 - DNA, 25 bp, Homo sapien
tgtgcttcaaagttccttatcccag

SEQ ID NO: 145722 - DNA, 25 bp, Homo sapien
gttccttatcccaggagcataaaga

SEQ ID NO: 145723 - DNA, 25 bp, Homo sapien
aacacccccatgatacaggtctgtg

SEQ ID NO: 145724 - DNA, 25 bp, Homo sapien
gaagagtgtttatatccctacgtta

SEQ ID NO: 145725 - DNA, 25 bp, Homo sapien
atatccctacgttaactttgcctag

SEQ ID NO: 145726 - DNA, 25 bp, Homo sapien
aactttgcctagtagaggcccttct

SEQ ID NO: 145727 - DNA, 25 bp, Homo sapien
tagaggcccttctttgcacttgctt

SEQ ID NO: 145728 - DNA, 25 bp, Homo sapien
ctaaggaagtccattctcctctgta

SEQ ID NO: 145729 - DNA, 25 bp, Homo sapien
attctcctctgtacagacagctgag

SEQ ID NO: 145730 - DNA, 25 bp, Homo sapien
ttgataccctgggcctttagtgtaa

SEQ ID NO: 145731 - DNA, 25 bp, Homo sapien
ttcagagtagcctcaccattagtgg

SEQ ID NO: 145732 - DNA, 25 bp, Homo sapien
cctcaccattagtggcagcatcatg

SEQ ID NO: 145733 - DNA, 25 bp, Homo sapien
gcagcatcatgtaactgagtggact

SEQ ID NO: 145734 - DNA, 25 bp, Homo sapien
aactgagtggactgtgcttgtcaac

SEQ ID NO: 145735 - DNA, 25 bp, Homo sapien
gactgtgcttgtcaacggatgtgta

SEQ ID NO: 145736 - DNA, 25 bp, Homo sapien
aacggatgtgtagcttttcagaaac

SEQ ID NO: 145737 - DNA, 25 bp, Homo sapien
gaaaacctgtaagctttgatgttct

SEQ ID NO: 145738 - DNA, 25 bp, Homo sapien
agctttgatgttctggttacttcta

SEQ ID NO: 145739 - DNA, 25 bp, Homo sapien
ttacttctagtaaattcctgtcaaa

SEQ ID NO: 145740 - DNA, 25 bp, Homo sapien
ggagaatttaacattttactcttgt

SEQ ID NO: 145741 - DNA, 25 bp, Homo sapien
gtacattttcgatgcttttatgggt

SEQ ID NO: 145742 - DNA, 25 bp, Homo sapien
gaaactgaggtatggccatgcccta

SEQ ID NO: 145743 - DNA, 25 bp, Homo sapien
aaggatgaccacacccgaagtcctg

SEQ ID NO: 145744 - DNA, 25 bp, Homo sapien
acacccgaagtcctgtcactgagca

SEQ ID NO: 145745 - DNA, 25 bp, Homo sapien
ttagccccgctgagcttggaggaag

SEQ ID NO: 145746 - DNA, 25 bp, Homo sapien
gtgctgattcaaaccaaagctgcct

SEQ ID NO: 145747 - DNA, 25 bp, Homo sapien
gtgccatgcccaaggcctaggttat

SEQ ID NO: 145748 - DNA, 25 bp, Homo sapien
ttatgggtacggcaaccacatgtcc

SEQ ID NO: 145749 - DNA, 25 bp, Homo sapien
tcccagatcgtctccaattcgaaaa

SEQ ID NO: 145750 - DNA, 25 bp, Homo sapien
aattcgaaaacaaccgtcctgctgt

SEQ ID NO: 145751 - DNA, 25 bp, Homo sapien
tgctgtccctgtcaggacacatgga

SEQ ID NO: 145752 - DNA, 25 bp, Homo sapien
caggacacatggattttggcagggc

SEQ ID NO: 145753 - DNA, 25 bp, Homo sapien
ttcaaacggaagagagtggcagcat

SEQ ID NO: 145754 - DNA, 25 bp, Homo sapien
aacggaagagagtggcagcatttag

SEQ ID NO: 145755 - DNA, 25 bp, Homo sapien
gaatctaattgaaatgtctgaactg

SEQ ID NO: 145756 - DNA, 25 bp, Homo sapien
acatgccaggaacaatgtctccctt

SEQ ID NO: 145757 - DNA, 25 bp, Homo sapien
ggaacaatgtctcccttttgcagag

SEQ ID NO: 145758 - DNA, 25 bp, Homo sapien
gcagagctgtattgacttgttcaag

SEQ ID NO: 145759 - DNA, 25 bp, Homo sapien
gagctgtattgacttgttcaagaat

SEQ ID NO: 145760 - DNA, 25 bp, Homo sapien
agaataactgatatgccttcactca

SEQ ID NO: 145761 - DNA, 25 bp, Homo sapien
aactgatatgccttcactcagaaga

SEQ ID NO: 145762 - DNA, 25 bp, Homo sapien
gaatgtgaaagaaagccaagcatca

SEQ ID NO: 145763 - DNA, 25 bp, Homo sapien
ttgcacttaaatcattaccacggaa

SEQ ID NO: 145764 - DNA, 25 bp, Homo sapien
gatgggcagactcccgatgaagcct

SEQ ID NO: 145765 - DNA, 25 bp, Homo sapien
gaagcctgcttattggatcctgaca

SEQ ID NO: 145766 - DNA, 25 bp, Homo sapien
ggaatagctggcaacaagcccctgt

SEQ ID NO: 145767 - DNA, 25 bp, Homo sapien
gtgcccgtttgggactgaactgact

SEQ ID NO: 145768 - DNA, 25 bp, Homo sapien
gggactgaactgacttggcatatgt

SEQ ID NO: 145769 - DNA, 25 bp, Homo sapien
tggcatatgtgctctggctttccat

SEQ ID NO: 145770 - DNA, 25 bp, Homo sapien
aaccctgcttggctttggatgcctt

SEQ ID NO: 145771 - DNA, 25 bp, Homo sapien
ttggatgccttcagggttcccgaga

SEQ ID NO: 145772 - DNA, 25 bp, Homo sapien
cagggttcccgagacagacctcttt

SEQ ID NO: 145773 - DNA, 25 bp, Homo sapien
caccctgcacgatcttgactataat

SEQ ID NO: 145774 - DNA, 25 bp, Homo sapien
tgactataataaagcttccctactg

SEQ ID NO: 145775 - DNA, 25 bp, Homo sapien
taaacactgcttcttacaggaaaca

SEQ ID NO: 145776 - DNA, 25 bp, Homo sapien
ggaaacaaacctcttctgggatctc

SEQ ID NO: 145777 - DNA, 25 bp, Homo sapien
gggatctccttttgtgaaaaccagt

SEQ ID NO: 145778 - DNA, 25 bp, Homo sapien
gtgtggtcttgttcagaagcagcca

SEQ ID NO: 145779 - DNA, 25 bp, Homo sapien
agcagccagatttccaatgttgttt

SEQ ID NO: 145780 - DNA, 25 bp, Homo sapien
gccctttcccttcagaaaacgatgg

SEQ ID NO: 145781 - DNA, 25 bp, Homo sapien
aaaacgatggcaggcattcctctga

SEQ ID NO: 145782 - DNA, 25 bp, Homo sapien
ggcattcctctgagtttacaagcag

SEQ ID NO: 145783 - DNA, 25 bp, Homo sapien
ttacaagcagagactcactccaacc

SEQ ID NO: 145784 - DNA, 25 bp, Homo sapien
aaactagctgggagttcagaaccat

SEQ ID NO: 145785 - DNA, 25 bp, Homo sapien
aaagaaatgtgcatctggtccaaaa

SEQ ID NO: 145786 - DNA, 25 bp, Homo sapien
gctcagcaacccctgaatttgacag

SEQ ID NO: 145787 - DNA, 25 bp, Homo sapien
aacccctgaatttgacagtctcacc

SEQ ID NO: 145788 - DNA, 25 bp, Homo sapien
atttgacagtctcaccaatttcaga

SEQ ID NO: 145789 - DNA, 25 bp, Homo sapien
gacagtctcaccaatttcagaaaat

SEQ ID NO: 145790 - DNA, 25 bp, Homo sapien
attttatactactttggcatggact

SEQ ID NO: 145791 - DNA, 25 bp, Homo sapien
tactactttggcatggactgtattt

SEQ ID NO: 145792 - DNA, 25 bp, Homo sapien
tactttggcatggactgtatttatt

SEQ ID NO: 145793 - DNA, 25 bp, Homo sapien
tctgggcaagttttattgtgagatt

SEQ ID NO: 145794 - DNA, 25 bp, Homo sapien
gtgagattttctaattatgaagcaa

SEQ ID NO: 145795 - DNA, 25 bp, Homo sapien
tttctccaccatgctttatgtgata

SEQ ID NO: 145796 - DNA, 25 bp, Homo sapien
ccatgctttatgtgatagtatttaa

SEQ ID NO: 145797 - DNA, 25 bp, Homo sapien
ggccgggaccgcagagccccgggag

SEQ ID NO: 145798 - DNA, 25 bp, Homo sapien
gagcggcagacgcagcgctctaaac

SEQ ID NO: 145799 - DNA, 25 bp, Homo sapien
agcgctctaaaccgcagccggcggt

SEQ ID NO: 145800 - DNA, 25 bp, Homo sapien
atcctgaaccgctgcagcgagagca

SEQ ID NO: 145801 - DNA, 25 bp, Homo sapien
aagctggcgtctgccgtctgaggct

SEQ ID NO: 145802 - DNA, 25 bp, Homo sapien
gtctgaggctggagcgcagtcccca

SEQ ID NO: 145803 - DNA, 25 bp, Homo sapien
aggctggagcgcagtccccagctag

SEQ ID NO: 145804 - DNA, 25 bp, Homo sapien
gtgcctgtacatacgtgttctatag

SEQ ID NO: 145805 - DNA, 25 bp, Homo sapien
tctatagagcctggcgtctggacgc

SEQ ID NO: 145806 - DNA, 25 bp, Homo sapien
atagagcctggcgtctggacgccga

SEQ ID NO: 145807 - DNA, 25 bp, Homo sapien
gtctggacgccgagggcagccccga

SEQ ID NO: 145808 - DNA, 25 bp, Homo sapien
ttgaccccaccatcagtactccatt

SEQ ID NO: 145809 - DNA, 25 bp, Homo sapien
tgaccccaccatcagtactccattc

SEQ ID NO: 145810 - DNA, 25 bp, Homo sapien
gaccccaccatcagtactccattct

SEQ ID NO: 145811 - DNA, 25 bp, Homo sapien
accccaccatcagtactccattctt

SEQ ID NO: 145812 - DNA, 25 bp, Homo sapien
ccccaccatcagtactccattcttc

SEQ ID NO: 145813 - DNA, 25 bp, Homo sapien
caccatcagtactccattcttcatt

SEQ ID NO: 145814 - DNA, 25 bp, Homo sapien
accatcagtactccattcttcattt

SEQ ID NO: 145815 - DNA, 25 bp, Homo sapien
ccatcagtactccattcttcatttt

SEQ ID NO: 145816 - DNA, 25 bp, Homo sapien
catcagtactccattcttcatttta

SEQ ID NO: 145817 - DNA, 25 bp, Homo sapien
atcagtactccattcttcattttaa

SEQ ID NO: 145818 - DNA, 25 bp, Homo sapien
tcagtactccattcttcattttaaa

SEQ ID NO: 145819 - DNA, 25 bp, Homo sapien
ttgccatactttgtctgaaaaattc

SEQ ID NO: 145820 - DNA, 25 bp, Homo sapien
ctgaaaaattcctttgtgtttctat

SEQ ID NO: 145821 - DNA, 25 bp, Homo sapien
tttgtgtttctattgacttcaatga

SEQ ID NO: 145822 - DNA, 25 bp, Homo sapien
aaagtggttgttagttatagatgtc

SEQ ID NO: 145823 - DNA, 25 bp, Homo sapien
ttatagatgtctaggtacttcaggg

SEQ ID NO: 145824 - DNA, 25 bp, Homo sapien
tattcccaagcccatgagtccttga

SEQ ID NO: 145825 - DNA, 25 bp, Homo sapien
agcccatgagtccttgaaaatattt

SEQ ID NO: 145826 - DNA, 25 bp, Homo sapien
gtgtaaatacataagcggcgtaagt

SEQ ID NO: 145827 - DNA, 25 bp, Homo sapien
agcggcgtaagtttaaaggatgttg

SEQ ID NO: 145828 - DNA, 25 bp, Homo sapien
aaggatgttggtgttccacgtgttt

SEQ ID NO: 145829 - DNA, 25 bp, Homo sapien
gttccacgtgttttattcctgtatg

SEQ ID NO: 145830 - DNA, 25 bp, Homo sapien
cagcgacgccgccaggcgcggccgg

SEQ ID NO: 145831 - DNA, 25 bp, Homo sapien
cgccaggcgcggccgggaccgcaga

SEQ ID NO: 145832 - DNA, 25 bp, Homo sapien
gccaggcgcggccgggaccgcagag

SEQ ID NO: 145833 - DNA, 25 bp, Homo sapien
aggcgcggccgggaccgcagagccc

SEQ ID NO: 145834 - DNA, 25 bp, Homo sapien
ggcgcggccgggaccgcagagcccc

SEQ ID NO: 145835 - DNA, 25 bp, Homo sapien
gcgcggccgggaccgcagagccccg

SEQ ID NO: 145836 - DNA, 25 bp, Homo sapien
gcggccgggaccgcagagccccggg

SEQ ID NO: 145837 - DNA, 25 bp, Homo sapien
tctatagagcctggcgtctggacgc

SEQ ID NO: 145838 - DNA, 25 bp, Homo sapien
ctatagagcctggcgtctggacgcc

SEQ ID NO: 145839 - DNA, 25 bp, Homo sapien
atagagcctggcgtctggacgccga

SEQ ID NO: 145840 - DNA, 25 bp, Homo sapien
agcctggcgtctggacgccgagggc

SEQ ID NO: 145841 - DNA, 25 bp, Homo sapien
tctgaatggttgtcctgaccagtaa

SEQ ID NO: 145842 - DNA, 25 bp, Homo sapien
tggttgtcctgaccagtaacccaag

SEQ ID NO: 145843 - DNA, 25 bp, Homo sapien
gtaacccaagcctatttcacagcaa

SEQ ID NO: 145844 - DNA, 25 bp, Homo sapien
atttcacagcaaggaaattcacctt

SEQ ID NO: 145845 - DNA, 25 bp, Homo sapien
aaattcaccttcaaaagcactgatt

SEQ ID NO: 145846 - DNA, 25 bp, Homo sapien
aaagcactgattacccaatgcacct

SEQ ID NO: 145847 - DNA, 25 bp, Homo sapien
cccagctcgagatcattcttcaatt

SEQ ID NO: 145848 - DNA, 25 bp, Homo sapien
ctcgagatcattcttcaattaggac

SEQ ID NO: 145849 - DNA, 25 bp, Homo sapien
accagacaggtttaatagcgaatct

SEQ ID NO: 145850 - DNA, 25 bp, Homo sapien
tgaattctgaccatggatacccatc

SEQ ID NO: 145851 - DNA, 25 bp, Homo sapien
attcagtgctacatgtgtattttat

SEQ ID NO: 145852 - DNA, 25 bp, Homo sapien
gggacagcgccaggcccaggagtat

SEQ ID NO: 145853 - DNA, 25 bp, Homo sapien
tttaatcttggtgatgccttggaca

SEQ ID NO: 145854 - DNA, 25 bp, Homo sapien
gccttggacagcagcaactccatgc

SEQ ID NO: 145855 - DNA, 25 bp, Homo sapien
caactccatgcaaaccatccaaaag

SEQ ID NO: 145856 - DNA, 25 bp, Homo sapien
caccaaagttctgaggcattaagcc

SEQ ID NO: 145857 - DNA, 25 bp, Homo sapien
accaaagttctgaggcattaagcca

SEQ ID NO: 145858 - DNA, 25 bp, Homo sapien
ccaaagttctgaggcattaagccag

SEQ ID NO: 145859 - DNA, 25 bp, Homo sapien
aaagttctgaggcattaagccagca

SEQ ID NO: 145860 - DNA, 25 bp, Homo sapien
aagttctgaggcattaagccagcag

SEQ ID NO: 145861 - DNA, 25 bp, Homo sapien
agttctgaggcattaagccagcaga

SEQ ID NO: 145862 - DNA, 25 bp, Homo sapien
gttctgaggcattaagccagcagaa

SEQ ID NO: 145863 - DNA, 25 bp, Homo sapien
gctctgccactgtccggaaattcat

SEQ ID NO: 145864 - DNA, 25 bp, Homo sapien
gtccggaaattcatggttggctacg

SEQ ID NO: 145865 - DNA, 25 bp, Homo sapien
ggttggctacgaaatgcttgctcag

SEQ ID NO: 145866 - DNA, 25 bp, Homo sapien
tacgaaatgcttgctcaggctcaga

SEQ ID NO: 145867 - DNA, 25 bp, Homo sapien
aggctcagagggacctcacccctga

SEQ ID NO: 145868 - DNA, 25 bp, Homo sapien
gactaagggcacttcctgaggttca

SEQ ID NO: 145869 - DNA, 25 bp, Homo sapien
ttcctgaggttcattaccacctggg

SEQ ID NO: 145870 - DNA, 25 bp, Homo sapien
agggagacagcaaccatcgcctgac

SEQ ID NO: 145871 - DNA, 25 bp, Homo sapien
agcagaaagggccttgaatcctggc

SEQ ID NO: 145872 - DNA, 25 bp, Homo sapien
ggaaccattggcagctgcacgctca

SEQ ID NO: 145873 - DNA, 25 bp, Homo sapien
attggcagctgcacgctcattacta

SEQ ID NO: 145874 - DNA, 25 bp, Homo sapien
atgggtaaagcatctgccaatgaaa

SEQ ID NO: 145875 - DNA, 25 bp, Homo sapien
taattgctgggcgaaagctgacagc

SEQ ID NO: 145876 - DNA, 25 bp, Homo sapien
gaggcatgcgccaaaggcctggtct

SEQ ID NO: 145877 - DNA, 25 bp, Homo sapien
gcctggtctctcaggtatttttgac

SEQ ID NO: 145878 - DNA, 25 bp, Homo sapien
tatttttgactggaactttcaccca

SEQ ID NO: 145879 - DNA, 25 bp, Homo sapien
gactggaactttcacccaagaggtt

SEQ ID NO: 145880 - DNA, 25 bp, Homo sapien
cacccaagaggttatgattcaaatt

SEQ ID NO: 145881 - DNA, 25 bp, Homo sapien
actggaagaatgtaaggccctcgtt

SEQ ID NO: 145882 - DNA, 25 bp, Homo sapien
ggccctcgttcgctgtaatattaag

SEQ ID NO: 145883 - DNA, 25 bp, Homo sapien
attaagttggagttggaacaggcca

SEQ ID NO: 145884 - DNA, 25 bp, Homo sapien
agctcagcccaagggatagaatcca

SEQ ID NO: 145885 - DNA, 25 bp, Homo sapien
aagcaagatgtgttccttattgtga

SEQ ID NO: 145886 - DNA, 25 bp, Homo sapien
gtgaagagcgacacaactgcctgct

SEQ ID NO: 145887 - DNA, 25 bp, Homo sapien
tgcctttccacagctataatggaca

SEQ ID NO: 145888 - DNA, 25 bp, Homo sapien
ataatggacatcaggttgactctaa

SEQ ID NO: 145889 - DNA, 25 bp, Homo sapien
aaatcaaggatcatgtgtgcacaat

SEQ ID NO: 145890 - DNA, 25 bp, Homo sapien
gtgtgcacaatacttgtggcccaca

SEQ ID NO: 145891 - DNA, 25 bp, Homo sapien
tgctgaggaatcattctttttgcct

SEQ ID NO: 145892 - DNA, 25 bp, Homo sapien
aagggcatcattaagtagaccaggt

SEQ ID NO: 145893 - DNA, 25 bp, Homo sapien
aggtaattactgcttgtctctcaag

SEQ ID NO: 145894 - DNA, 25 bp, Homo sapien
tcaaggctgctgtctttatcagcac

SEQ ID NO: 145895 - DNA, 25 bp, Homo sapien
ggttcagttgtacttgtcctgcaaa

SEQ ID NO: 145896 - DNA, 25 bp, Homo sapien
tgaccgggtcacacaaaggcatgct

SEQ ID NO: 145897 - DNA, 25 bp, Homo sapien
gtcacacaaaggcatgctggagtac

SEQ ID NO: 145898 - DNA, 25 bp, Homo sapien
ctggagtacccagcctatcaggtgc

SEQ ID NO: 145899 - DNA, 25 bp, Homo sapien
tcaggtgcccctcttccaaaggcag

SEQ ID NO: 145900 - DNA, 25 bp, Homo sapien
caaaggcagcgtgccgagccagcaa

SEQ ID NO: 145901 - DNA, 25 bp, Homo sapien
aggagttcaggaacccttctccata

SEQ ID NO: 145902 - DNA, 25 bp, Homo sapien
ccacaatctgagcacgctaccaaat

SEQ ID NO: 145903 - DNA, 25 bp, Homo sapien
agcacgctaccaaatctcaaaatat

SEQ ID NO: 145904 - DNA, 25 bp, Homo sapien
gactaacaaaggcagctgtgtctga

SEQ ID NO: 145905 - DNA, 25 bp, Homo sapien
tgagcccaacccttctaaacggtga

SEQ ID NO: 145906 - DNA, 25 bp, Homo sapien
tctaaacggtgacctttagtgccaa

SEQ ID NO: 145907 - DNA, 25 bp, Homo sapien
gatgaataacaagctaaatctgcag

SEQ ID NO: 145908 - DNA, 25 bp, Homo sapien
acaagctaaatctgcagaacaagca

SEQ ID NO: 145909 - DNA, 25 bp, Homo sapien
caagcagagtttgaccatggatcca

SEQ ID NO: 145910 - DNA, 25 bp, Homo sapien
gcagagtttgaccatggatccagtt

SEQ ID NO: 145911 - DNA, 25 bp, Homo sapien
gagtttgaccatggatccagttgtc

SEQ ID NO: 145912 - DNA, 25 bp, Homo sapien
accatggatccagttgtcaagtcaa

SEQ ID NO: 145913 - DNA, 25 bp, Homo sapien
ggatccagttgtcaagtcaaaagag

SEQ ID NO: 145914 - DNA, 25 bp, Homo sapien
attaaggagctgacaagtacttgta

SEQ ID NO: 145915 - DNA, 25 bp, Homo sapien
gacaagtacttgtagccctataatt

SEQ ID NO: 145916 - DNA, 25 bp, Homo sapien
gtacttgtagccctataatttcaaa

SEQ ID NO: 145917 - DNA, 25 bp, Homo sapien
tgtagccctataatttcaaagccca

SEQ ID NO: 145918 - DNA, 25 bp, Homo sapien
ggaggccctctacgtcctcatggta

SEQ ID NO: 145919 - DNA, 25 bp, Homo sapien
catggtactgggattcttcggcttc

SEQ ID NO: 145920 - DNA, 25 bp, Homo sapien
tgggcatcatgctgagctacatccg

SEQ ID NO: 145921 - DNA, 25 bp, Homo sapien
gctacatccgctccaagaagctgga

SEQ ID NO: 145922 - DNA, 25 bp, Homo sapien
gaagctggagcactcgaacgaccca

SEQ ID NO: 145923 - DNA, 25 bp, Homo sapien
attcaacgtctacatcgagtccgat

SEQ ID NO: 145924 - DNA, 25 bp, Homo sapien
acatcgagtccgatgcctggcaaga

SEQ ID NO: 145925 - DNA, 25 bp, Homo sapien
gaaggacaaggcctatgtccaggcc

SEQ ID NO: 145926 - DNA, 25 bp, Homo sapien
caggtcgtgctatgtcgttgaaaac

SEQ ID NO: 145927 - DNA, 25 bp, Homo sapien
aaaccatctggccatagaacaaccc

SEQ ID NO: 145928 - DNA, 25 bp, Homo sapien
ttcctgagacgaagccttccccatg

SEQ ID NO: 145929 - DNA, 25 bp, Homo sapien
agatcttctctccaaaccagttagt

SEQ ID NO: 145930 - DNA, 25 bp, Homo sapien
tagttagagccagtgacgcctctgt

SEQ ID NO: 145931 - DNA, 25 bp, Homo sapien
ggcggaatctgtgctgtctaggttt

SEQ ID NO: 145932 - DNA, 25 bp, Homo sapien
tgtgctgtctaggtttgtgcttcta

SEQ ID NO: 145933 - DNA, 25 bp, Homo sapien
aggtttgtgcttctagccatgccca

SEQ ID NO: 145934 - DNA, 25 bp, Homo sapien
accatgcctctttgcattgcccatt

SEQ ID NO: 145935 - DNA, 25 bp, Homo sapien
tgtattctgttgaggacccaggccc

SEQ ID NO: 145936 - DNA, 25 bp, Homo sapien
gggatttcatctctaagcctggcag

SEQ ID NO: 145937 - DNA, 25 bp, Homo sapien
gtgtatatagctcctcttgtccact

SEQ ID NO: 145938 - DNA, 25 bp, Homo sapien
tcttgtccactctgctttcggaagt

SEQ ID NO: 145939 - DNA, 25 bp, Homo sapien
actctgctttcggaagtgctgtggt

SEQ ID NO: 145940 - DNA, 25 bp, Homo sapien
caagagagagatgaagagtacggct

SEQ ID NO: 145941 - DNA, 25 bp, Homo sapien
aagagagagatgaagagtacggcta

SEQ ID NO: 145942 - DNA, 25 bp, Homo sapien
agagagagatgaagagtacggctat

SEQ ID NO: 145943 - DNA, 25 bp, Homo sapien
agagagatgaagagtacggctatga

SEQ ID NO: 145944 - DNA, 25 bp, Homo sapien
agagatgaagagtacggctatgagt

SEQ ID NO: 145945 - DNA, 25 bp, Homo sapien
agatgaagagtacggctatgagtgt

SEQ ID NO: 145946 - DNA, 25 bp, Homo sapien
gatgaagagtacggctatgagtgtc

SEQ ID NO: 145947 - DNA, 25 bp, Homo sapien
aagagtacggctatgagtgtctgga

SEQ ID NO: 145948 - DNA, 25 bp, Homo sapien
agagtacggctatgagtgtctggac

SEQ ID NO: 145949 - DNA, 25 bp, Homo sapien
gagtacggctatgagtgtctggacg

SEQ ID NO: 145950 - DNA, 25 bp, Homo sapien
gacggcaaggactgtgccagttttt

SEQ ID NO: 145951 - DNA, 25 bp, Homo sapien
gattcactaaagcagcacatagcac

SEQ ID NO: 145952 - DNA, 25 bp, Homo sapien
gcacatagcactgggaactctggct

SEQ ID NO: 145953 - DNA, 25 bp, Homo sapien
atatcaaggatgttctggctttaca

SEQ ID NO: 145954 - DNA, 25 bp, Homo sapien
aatggagcttgtacatattggaaag

SEQ ID NO: 145955 - DNA, 25 bp, Homo sapien
gaaaggtcattgtggctatctgcat

SEQ ID NO: 145956 - DNA, 25 bp, Homo sapien
cattgtggctatctgcatttataaa

SEQ ID NO: 145957 - DNA, 25 bp, Homo sapien
gtgtggtgctaactgtatgtgtctt

SEQ ID NO: 145958 - DNA, 25 bp, Homo sapien
gtgtctttatcagtgatggtctcac

SEQ ID NO: 145959 - DNA, 25 bp, Homo sapien
gtgatggtctcacagagccaactca

SEQ ID NO: 145960 - DNA, 25 bp, Homo sapien
agagccaactcactcttatgaaatg

SEQ ID NO: 145961 - DNA, 25 bp, Homo sapien
gaaacgtacttaactgtgtgaagaa

SEQ ID NO: 145962 - DNA, 25 bp, Homo sapien
aacatgttctgtcacaaatagcagc

SEQ ID NO: 145963 - DNA, 25 bp, Homo sapien
aaatagcagcaccactttggattga

SEQ ID NO: 145964 - DNA, 25 bp, Homo sapien
ccactttggattgattttgctctcc

SEQ ID NO: 145965 - DNA, 25 bp, Homo sapien
ttgattttgctctccaggacatcag

SEQ ID NO: 145966 - DNA, 25 bp, Homo sapien
tgatcagcactaccacatccaaaca

SEQ ID NO: 145967 - DNA, 25 bp, Homo sapien
taccacatccaaacataagtcactg

SEQ ID NO: 145968 - DNA, 25 bp, Homo sapien
gtactatttgctagattcatgcctc

SEQ ID NO: 145969 - DNA, 25 bp, Homo sapien
gattcatgcctcaaaagttattata

SEQ ID NO: 145970 - DNA, 25 bp, Homo sapien
acagacctttattaaacacatcttg

SEQ ID NO: 145971 - DNA, 25 bp, Homo sapien
tcttgaaagatgtagaagtccctct

SEQ ID NO: 145972 - DNA, 25 bp, Homo sapien
agaagtccctctatagtctagtata

SEQ ID NO: 145973 - DNA, 25 bp, Homo sapien
atcatcgggcgggtgaacgcagacc

SEQ ID NO: 145974 - DNA, 25 bp, Homo sapien
tttggcctcaacgtgcgaggattcc

SEQ ID NO: 145975 - DNA, 25 bp, Homo sapien
acgtgcgaggattcctggaccgcta

SEQ ID NO: 145976 - DNA, 25 bp, Homo sapien
gaggattcctggaccgctactgccc

SEQ ID NO: 145977 - DNA, 25 bp, Homo sapien
atcaccgtgcgctgttgcgatctgg

SEQ ID NO: 145978 - DNA, 25 bp, Homo sapien
gctgttgcgatctggaccccgagaa

SEQ ID NO: 145979 - DNA, 25 bp, Homo sapien
tggaccccgagaagaggccatcctt

SEQ ID NO: 145980 - DNA, 25 bp, Homo sapien
gaagaggccatcctttgtgaagctg

SEQ ID NO: 145981 - DNA, 25 bp, Homo sapien
ggccatcctttgtgaagctggaaca

SEQ ID NO: 145982 - DNA, 25 bp, Homo sapien
agctggaacactggctggagaccct

SEQ ID NO: 145983 - DNA, 25 bp, Homo sapien
gacagaggtttctgggagacctacc

SEQ ID NO: 145984 - DNA, 25 bp, Homo sapien
atcttaaagcactcataatatggca

SEQ ID NO: 145985 - DNA, 25 bp, Homo sapien
aatatggcatccttcaatttctgta

SEQ ID NO: 145986 - DNA, 25 bp, Homo sapien
tggcatccttcaatttctgtataaa

SEQ ID NO: 145987 - DNA, 25 bp, Homo sapien
ctgtaacttaagaaacctggcattt

SEQ ID NO: 145988 - DNA, 25 bp, Homo sapien
taagaaacctggcatttaaatcata

SEQ ID NO: 145989 - DNA, 25 bp, Homo sapien
taaaagctttggtttgtgttcgtgt

SEQ ID NO: 145990 - DNA, 25 bp, Homo sapien
agctttggtttgtgttcgtgttttg

SEQ ID NO: 145991 - DNA, 25 bp, Homo sapien
tcgtgttttgtttgtttcacttgtt

SEQ ID NO: 145992 - DNA, 25 bp, Homo sapien
tttgtttcacttgtttccctcccag

SEQ ID NO: 145993 - DNA, 25 bp, Homo sapien
tttgttctctccgtgaaacttacct

SEQ ID NO: 145994 - DNA, 25 bp, Homo sapien
tgttctctccgtgaaacttaccttt

SEQ ID NO: 145995 - DNA, 25 bp, Homo sapien
agactttgttccctgactcatagct

SEQ ID NO: 145996 - DNA, 25 bp, Homo sapien
gactttgttccctgactcatagctg

SEQ ID NO: 145997 - DNA, 25 bp, Homo sapien
actttgttccctgactcatagctgc

SEQ ID NO: 145998 - DNA, 25 bp, Homo sapien
tttgttccctgactcatagctgccg

SEQ ID NO: 145999 - DNA, 25 bp, Homo sapien
tgttccctgactcatagctgccgct

SEQ ID NO: 146000 - DNA, 25 bp, Homo sapien
cctgactcatagctgccgcttgtta

SEQ ID NO: 146001 - DNA, 25 bp, Homo sapien
tgactcatagctgccgcttgttagg

SEQ ID NO: 146002 - DNA, 25 bp, Homo sapien
tcatagctgccgcttgttaggttag

SEQ ID NO: 146003 - DNA, 25 bp, Homo sapien
catagctgccgcttgttaggttagg

SEQ ID NO: 146004 - DNA, 25 bp, Homo sapien
atagctgccgcttgttaggttaggg

SEQ ID NO: 146005 - DNA, 25 bp, Homo sapien
tagctgccgcttgttaggttagggt

SEQ ID NO: 146006 - DNA, 25 bp, Homo sapien
ctttgaagctgttgggaaaatattc

SEQ ID NO: 146007 - DNA, 25 bp, Homo sapien
gaaaatattcagcaatgtccgcatc

SEQ ID NO: 146008 - DNA, 25 bp, Homo sapien
attcagcaatgtccgcatcaacttg

SEQ ID NO: 146009 - DNA, 25 bp, Homo sapien
atgtccgcatcaacttgcagaaaga

SEQ ID NO: 146010 - DNA, 25 bp, Homo sapien
tccttttaattttcctggtgccaat

SEQ ID NO: 146011 - DNA, 25 bp, Homo sapien
aattttcctggtgccaatttcaagt

SEQ ID NO: 146012 - DNA, 25 bp, Homo sapien
gccaatttcaagttccaagttgcta

SEQ ID NO: 146013 - DNA, 25 bp, Homo sapien
tcaagttccaagttgctaatacagc

SEQ ID NO: 146014 - DNA, 25 bp, Homo sapien
atgaattgaattatcttggttgaaa

SEQ ID NO: 146015 - DNA, 25 bp, Homo sapien
ctcttctgagctatttcatctattt

SEQ ID NO: 146016 - DNA, 25 bp, Homo sapien
ctatttcatctatttttggcagtct

SEQ ID NO: 146017 - DNA, 25 bp, Homo sapien
gaaggttctcttgtatacctgctca

SEQ ID NO: 146018 - DNA, 25 bp, Homo sapien
gtatacctgctcagtcagttccttt

SEQ ID NO: 146019 - DNA, 25 bp, Homo sapien
agttcctttcactcccaattgttgg

SEQ ID NO: 146020 - DNA, 25 bp, Homo sapien
gttggcagccattgataggaattct

SEQ ID NO: 146021 - DNA, 25 bp, Homo sapien
ggaattctatcactataggttagtt

SEQ ID NO: 146022 - DNA, 25 bp, Homo sapien
gaaagcggcgtcatgtactgtgtat

SEQ ID NO: 146023 - DNA, 25 bp, Homo sapien
ggcgtcatgtactgtgtattcttat

SEQ ID NO: 146024 - DNA, 25 bp, Homo sapien
atgaatggtttctttccatcagcat

SEQ ID NO: 146025 - DNA, 25 bp, Homo sapien
agcataatgatttgagattggtcca

SEQ ID NO: 146026 - DNA, 25 bp, Homo sapien
gattggtccatgttgtgtgattcag

SEQ ID NO: 146027 - DNA, 25 bp, Homo sapien
tctgaagagttttccattgtatgaa

SEQ ID NO: 146028 - DNA, 25 bp, Homo sapien
ttatatactatttcccttgaaattt

SEQ ID NO: 146029 - DNA, 25 bp, Homo sapien
ctatattttctttacaggtatttat

SEQ ID NO: 146030 - DNA, 25 bp, Homo sapien
atataccaatgcttttatcaaacag

SEQ ID NO: 146031 - DNA, 25 bp, Homo sapien
gagaataagaaagtttcacccaata

SEQ ID NO: 146032 - DNA, 25 bp, Homo sapien
gaaaggcatgttcctctgtcaatga

SEQ ID NO: 146033 - DNA, 25 bp, Homo sapien
gtacatgtatgtgttgtgatattaa

SEQ ID NO: 146034 - DNA, 25 bp, Homo sapien
agtgacatttgtctaatagcctaat

SEQ ID NO: 146035 - DNA, 25 bp, Homo sapien
gacatttgtctaatagcctaataca

SEQ ID NO: 146036 - DNA, 25 bp, Homo sapien
gcctaatacaacatgtagctgagtt

SEQ ID NO: 146037 - DNA, 25 bp, Homo sapien
agctgagtttaacatgtgtggtctt

SEQ ID NO: 146038 - DNA, 25 bp, Homo sapien
tggtcttggtattcttaagggaact

SEQ ID NO: 146039 - DNA, 25 bp, Homo sapien
cttaaatctcattgcttacaagcct

SEQ ID NO: 146040 - DNA, 25 bp, Homo sapien
gcttacaagcctaagaatctttaga

SEQ ID NO: 146041 - DNA, 25 bp, Homo sapien
cttttcttttctctggtaatattga

SEQ ID NO: 146042 - DNA, 25 bp, Homo sapien
ttctctggtaatattgacttgtata

SEQ ID NO: 146043 - DNA, 25 bp, Homo sapien
cctgggtgacatttgggagacatgt

SEQ ID NO: 146044 - DNA, 25 bp, Homo sapien
catttgggagacatgtgacatttat

SEQ ID NO: 146045 - DNA, 25 bp, Homo sapien
taatatccctacatgtattgcacat

SEQ ID NO: 146046 - DNA, 25 bp, Homo sapien
tgagttgtgagtttaccttgtatac

SEQ ID NO: 146047 - DNA, 25 bp, Homo sapien
ttaccttgtatactgtaggcacact

SEQ ID NO: 146048 - DNA, 25 bp, Homo sapien
tactgtaggcacactttgcactgat

SEQ ID NO: 146049 - DNA, 25 bp, Homo sapien
ggcacactttgcactgatatatcat

SEQ ID NO: 146050 - DNA, 25 bp, Homo sapien
aaagctgctgacagtgttgtatgag

SEQ ID NO: 146051 - DNA, 25 bp, Homo sapien
ggattttgatccaagctggtccact

SEQ ID NO: 146052 - DNA, 25 bp, Homo sapien
ggtccactcagtccatagcagagaa

SEQ ID NO: 146053 - DNA, 25 bp, Homo sapien
gaagtcacacagtgagtcgaggaca

SEQ ID NO: 146054 - DNA, 25 bp, Homo sapien
ggatgttctgggacacagttcaatt

SEQ ID NO: 146055 - DNA, 25 bp, Homo sapien
acagttcaattctcatttgtcacac

SEQ ID NO: 146056 - DNA, 25 bp, Homo sapien
atttgtcacacactttggctattag

SEQ ID NO: 146057 - DNA, 25 bp, Homo sapien
tggctattagagatcaaccccttcg

SEQ ID NO: 146058 - DNA, 25 bp, Homo sapien
ttcgctcctgtgtcttgcaatggca

SEQ ID NO: 146059 - DNA, 25 bp, Homo sapien
gcagccttggcaaacgctaaatgaa

SEQ ID NO: 146060 - DNA, 25 bp, Homo sapien
atgaaaatcgtgacaacacttgtgt

SEQ ID NO: 146061 - DNA, 25 bp, Homo sapien
ctgcatcaactatgaagcatttgtg

SEQ ID NO: 146062 - DNA, 25 bp, Homo sapien
tttgtgaagcacatcatgtccagct

SEQ ID NO: 146063 - DNA, 25 bp, Homo sapien
atgtccagctaaacctcgtgcccag

SEQ ID NO: 146064 - DNA, 25 bp, Homo sapien
aaacctcgtgcccagaagccaggaa

SEQ ID NO: 146065 - DNA, 25 bp, Homo sapien
aaggctgtgcaggacgtctcatctc

SEQ ID NO: 146066 - DNA, 25 bp, Homo sapien
tcatctcccatgtgtgatgctgaca

SEQ ID NO: 146067 - DNA, 25 bp, Homo sapien
gatgctgacaccaagcggcctggag

SEQ ID NO: 146068 - DNA, 25 bp, Homo sapien
gagccttaccaagactcctgcaaaa

SEQ ID NO: 146069 - DNA, 25 bp, Homo sapien
ttggacctctccacgtggttgccgt

SEQ ID NO: 146070 - DNA, 25 bp, Homo sapien
tctcaggctgtgcttacctgtgaca

SEQ ID NO: 146071 - DNA, 25 bp, Homo sapien
tgtgcttacctgtgacagcagctct

SEQ ID NO: 146072 - DNA, 25 bp, Homo sapien
ctcaagaagctcaaccggtattccg

SEQ ID NO: 146073 - DNA, 25 bp, Homo sapien
caagaagctcaaccggtattccgac

SEQ ID NO: 146074 - DNA, 25 bp, Homo sapien
gaagctcaaccggtattccgacggg

SEQ ID NO: 146075 - DNA, 25 bp, Homo sapien
aaccggtattccgacgggctgctga

SEQ ID NO: 146076 - DNA, 25 bp, Homo sapien
atgggcagcgtcagtagcctcatct

SEQ ID NO: 146077 - DNA, 25 bp, Homo sapien
tctcccaggactccggtcacggcaa

SEQ ID NO: 146078 - DNA, 25 bp, Homo sapien
ggcagcgtcagtagcctcatctccg

SEQ ID NO: 146079 - DNA, 25 bp, Homo sapien
ttccacagcaagcactgccgggctt

SEQ ID NO: 146080 - DNA, 25 bp, Homo sapien
gcactgccgggcttcgcagtacaag

SEQ ID NO: 146081 - DNA, 25 bp, Homo sapien
tgccgggcttcgcagtacaagctgc

SEQ ID NO: 146082 - DNA, 25 bp, Homo sapien
gggcttcgcagtacaagctgcgcaa

SEQ ID NO: 146083 - DNA, 25 bp, Homo sapien
ggctgtcccggaggcggtgggcctg

SEQ ID NO: 146084 - DNA, 25 bp, Homo sapien
gaggcggtgggcctggttaaataag

SEQ ID NO: 146085 - DNA, 25 bp, Homo sapien
tttatatgcactttcttccgatctg

SEQ ID NO: 146086 - DNA, 25 bp, Homo sapien
ttatatgcactttcttccgatctgt

SEQ ID NO: 146087 - DNA, 25 bp, Homo sapien
tatatgcactttcttccgatctgta

SEQ ID NO: 146088 - DNA, 25 bp, Homo sapien
atatgcactttcttccgatctgtac

SEQ ID NO: 146089 - DNA, 25 bp, Homo sapien
tatgcactttcttccgatctgtacc

SEQ ID NO: 146090 - DNA, 25 bp, Homo sapien
atgcactttcttccgatctgtacct

SEQ ID NO: 146091 - DNA, 25 bp, Homo sapien
gcactttcttccgatctgtacctga

SEQ ID NO: 146092 - DNA, 25 bp, Homo sapien
actttcttccgatctgtacctgaga

SEQ ID NO: 146093 - DNA, 25 bp, Homo sapien
tttcttccgatctgtacctgagagg

SEQ ID NO: 146094 - DNA, 25 bp, Homo sapien
taacaattgccctgcccgtacctgt

SEQ ID NO: 146095 - DNA, 25 bp, Homo sapien
tttcaactatttctaccaccgagaa

SEQ ID NO: 146096 - DNA, 25 bp, Homo sapien
aggctcagttgctccacgtcagttc

SEQ ID NO: 146097 - DNA, 25 bp, Homo sapien
agttcccctaacttagcctctgaca

SEQ ID NO: 146098 - DNA, 25 bp, Homo sapien
tgacagtgacctcagtcgccgcagt

SEQ ID NO: 146099 - DNA, 25 bp, Homo sapien
ccgcagttcctctactatgagcaag

SEQ ID NO: 146100 - DNA, 25 bp, Homo sapien
gcatagcccattatagacaggtcaa

SEQ ID NO: 146101 - DNA, 25 bp, Homo sapien
gacaggtcaatatcagaactgccaa

SEQ ID NO: 146102 - DNA, 25 bp, Homo sapien
tatcagaactgccaattgcaccaca

SEQ ID NO: 146103 - DNA, 25 bp, Homo sapien
ttgcaccacagctaaccaaaactgc

SEQ ID NO: 146104 - DNA, 25 bp, Homo sapien
gagcaagctactgaccgatgtttaa

SEQ ID NO: 146105 - DNA, 25 bp, Homo sapien
attatatcatatagccagtgtcagt

SEQ ID NO: 146106 - DNA, 25 bp, Homo sapien
atcatatagccagtgtcagttaacc

SEQ ID NO: 146107 - DNA, 25 bp, Homo sapien
atatagccagtgtcagttaaccaag

SEQ ID NO: 146108 - DNA, 25 bp, Homo sapien
tatagccagtgtcagttaaccaagg

SEQ ID NO: 146109 - DNA, 25 bp, Homo sapien
tcagttaaccaaggatttagttaca

SEQ ID NO: 146110 - DNA, 25 bp, Homo sapien
ggatttagttacaccaaacactcta

SEQ ID NO: 146111 - DNA, 25 bp, Homo sapien
tagttacaccaaacactctatgatg

SEQ ID NO: 146112 - DNA, 25 bp, Homo sapien
gatgaattacatctctcaaattcta

SEQ ID NO: 146113 - DNA, 25 bp, Homo sapien
attacatctctcaaattctaatgat

SEQ ID NO: 146114 - DNA, 25 bp, Homo sapien
ttctaatgattagatccttgtaaaa

SEQ ID NO: 146115 - DNA, 25 bp, Homo sapien
aaattttacctgtgcctaaacagag

SEQ ID NO: 146116 - DNA, 25 bp, Homo sapien
gtcatgttagcaaacgcagctccaa

SEQ ID NO: 146117 - DNA, 25 bp, Homo sapien
gcaaacgcagctccaacttatataa

SEQ ID NO: 146118 - DNA, 25 bp, Homo sapien
aaatagacttactgcagttactttt

SEQ ID NO: 146119 - DNA, 25 bp, Homo sapien
gcagttacttttgacccatgtgcaa

SEQ ID NO: 146120 - DNA, 25 bp, Homo sapien
tttgacccatgtgcaaggattgtac

SEQ ID NO: 146121 - DNA, 25 bp, Homo sapien
caaggattgtacacgctgatgagaa

SEQ ID NO: 146122 - DNA, 25 bp, Homo sapien
gagaatcatgcactttttctcctct

SEQ ID NO: 146123 - DNA, 25 bp, Homo sapien
tggttagaatttggctttgggagaa

SEQ ID NO: 146124 - DNA, 25 bp, Homo sapien
aagagatgctgccatttaacccctt

SEQ ID NO: 146125 - DNA, 25 bp, Homo sapien
gagaaaatccccaactatgcatgcc

SEQ ID NO: 146126 - DNA, 25 bp, Homo sapien
agctgttgacgtttgctcatttaag

SEQ ID NO: 146127 - DNA, 25 bp, Homo sapien
acattaagcactgtggatcacgaca

SEQ ID NO: 146128 - DNA, 25 bp, Homo sapien
ttaagcactgtggatcacgacagga

SEQ ID NO: 146129 - DNA, 25 bp, Homo sapien
aagcactgtggatcacgacaggaaa

SEQ ID NO: 146130 - DNA, 25 bp, Homo sapien
gcactgtggatcacgacaggaaaaa

SEQ ID NO: 146131 - DNA, 25 bp, Homo sapien
tgcttttcactactttgtatcaatc

SEQ ID NO: 146132 - DNA, 25 bp, Homo sapien
cttttcactactttgtatcaatcca

SEQ ID NO: 146133 - DNA, 25 bp, Homo sapien
gatttatgacattacaatcctgcat

SEQ ID NO: 146134 - DNA, 25 bp, Homo sapien
tttatgacattacaatcctgcattg

SEQ ID NO: 146135 - DNA, 25 bp, Homo sapien
gacattacaatcctgcattgtttca

SEQ ID NO: 146136 - DNA, 25 bp, Homo sapien
acaatcctgcattgtttcaagactg

SEQ ID NO: 146137 - DNA, 25 bp, Homo sapien
cctaaggaaggaaataatcatctaa

SEQ ID NO: 146138 - DNA, 25 bp, Homo sapien
aacaatttatgcatgctgtgactta

SEQ ID NO: 146139 - DNA, 25 bp, Homo sapien
ttatgcatgctgtgacttagtctat

SEQ ID NO: 146140 - DNA, 25 bp, Homo sapien
gtgacttagtctatggatttattcc

SEQ ID NO: 146141 - DNA, 25 bp, Homo sapien
ggatttattccaaaattgcttagtc

SEQ ID NO: 146142 - DNA, 25 bp, Homo sapien
attgcttagtcaccatgcagtgtct

SEQ ID NO: 146143 - DNA, 25 bp, Homo sapien
gtcaccatgcagtgtctgtattttt

SEQ ID NO: 146144 - DNA, 25 bp, Homo sapien
tgaggtggtattacattattcctaa

SEQ ID NO: 146145 - DNA, 25 bp, Homo sapien
cctaataatagggataatgctgttt

SEQ ID NO: 146146 - DNA, 25 bp, Homo sapien
aaaatcgttctcttcaattaatggc

SEQ ID NO: 146147 - DNA, 25 bp, Homo sapien
gttctcttcaattaatggccctttt

SEQ ID NO: 146148 - DNA, 25 bp, Homo sapien
tcttcaattaatggcccttttattt

SEQ ID NO: 146149 - DNA, 25 bp, Homo sapien
caccatccagaacgcggatatcatt

SEQ ID NO: 146150 - DNA, 25 bp, Homo sapien
gaacgcggatatcattgctgtcatg

SEQ ID NO: 146151 - DNA, 25 bp, Homo sapien
gcggatatcattgctgtcatggcac

SEQ ID NO: 146152 - DNA, 25 bp, Homo sapien
atatcattgctgtcatggcacaggg

SEQ ID NO: 146153 - DNA, 25 bp, Homo sapien
gacccatgaagaactgatggcccaa

SEQ ID NO: 146154 - DNA, 25 bp, Homo sapien
tggcccaaaaaggagcctactacaa

SEQ ID NO: 146155 - DNA, 25 bp, Homo sapien
gcctactacaaactagtcaccactg

SEQ ID NO: 146156 - DNA, 25 bp, Homo sapien
ccccatcagttgacccaatgcaaga

SEQ ID NO: 146157 - DNA, 25 bp, Homo sapien
atcagttgacccaatgcaagaatct

SEQ ID NO: 146158 - DNA, 25 bp, Homo sapien
agaatctcagacacacatgacgcac

SEQ ID NO: 146159 - DNA, 25 bp, Homo sapien
acacacatgacgcaccagttacagg

SEQ ID NO: 146160 - DNA, 25 bp, Homo sapien
gaaagtgaaaacaagatacctgcca

SEQ ID NO: 146161 - DNA, 25 bp, Homo sapien
gaaaacaagatacctgccacgcaaa

SEQ ID NO: 146162 - DNA, 25 bp, Homo sapien
agatacctgccacgcaaaagagttg

SEQ ID NO: 146163 - DNA, 25 bp, Homo sapien
ctgccacgcaaaagagttgaaggtt

SEQ ID NO: 146164 - DNA, 25 bp, Homo sapien
gttgaaggttgctaataatttatac

SEQ ID NO: 146165 - DNA, 25 bp, Homo sapien
ataatttatactggaatctggcatt

SEQ ID NO: 146166 - DNA, 25 bp, Homo sapien
gcatttttccaagccaagagaagat

SEQ ID NO: 146167 - DNA, 25 bp, Homo sapien
tttccaagccaagagaagatcgaat

SEQ ID NO: 146168 - DNA, 25 bp, Homo sapien
tagttagtttgtagagtgatttccc

SEQ ID NO: 146169 - DNA, 25 bp, Homo sapien
ttgtagagtgatttccccccagttt

SEQ ID NO: 146170 - DNA, 25 bp, Homo sapien
tcagttgtgctattcattattaaac

SEQ ID NO: 146171 - DNA, 25 bp, Homo sapien
ggagcacaaagaccctggctttcat

SEQ ID NO: 146172 - DNA, 25 bp, Homo sapien
ggcaacaaaagaagcccggctcctg

SEQ ID NO: 146173 - DNA, 25 bp, Homo sapien
aagaagcccggctcctggtcaccta

SEQ ID NO: 146174 - DNA, 25 bp, Homo sapien
tggtcacctaggaagcctcagattc

SEQ ID NO: 146175 - DNA, 25 bp, Homo sapien
ctcagattccttcccatggagggag

SEQ ID NO: 146176 - DNA, 25 bp, Homo sapien
agtggtttgcaggtggccaagttcc

SEQ ID NO: 146177 - DNA, 25 bp, Homo sapien
aagttcctctaacttggctcacact

SEQ ID NO: 146178 - DNA, 25 bp, Homo sapien
taacttggctcacactcgacatgaa

SEQ ID NO: 146179 - DNA, 25 bp, Homo sapien
ggctcacactcgacatgaaaattca

SEQ ID NO: 146180 - DNA, 25 bp, Homo sapien
tatactttccctaccctctagagaa

SEQ ID NO: 146181 - DNA, 25 bp, Homo sapien
gttaatagttcctgctaaaacaatg

SEQ ID NO: 146182 - DNA, 25 bp, Homo sapien
tgggcacttgccgacctgagtctgg

SEQ ID NO: 146183 - DNA, 25 bp, Homo sapien
agccaggtgctttcatcacagctaa

SEQ ID NO: 146184 - DNA, 25 bp, Homo sapien
ggtgctttcatcacagctaaacctg

SEQ ID NO: 146185 - DNA, 25 bp, Homo sapien
tcatcacagctaaacctggttccct

SEQ ID NO: 146186 - DNA, 25 bp, Homo sapien
gccactcgggcttgtaactgtctga

SEQ ID NO: 146187 - DNA, 25 bp, Homo sapien
ttgtaactgtctgagccccggatcc

SEQ ID NO: 146188 - DNA, 25 bp, Homo sapien
aaagcagccagctcatcccagtgac

SEQ ID NO: 146189 - DNA, 25 bp, Homo sapien
tgactcacaggacacagccatccag

SEQ ID NO: 146190 - DNA, 25 bp, Homo sapien
agcggcatctttccttgtcgaatga

SEQ ID NO: 146191 - DNA, 25 bp, Homo sapien
atctttccttgtcgaatgatactgt

SEQ ID NO: 146192 - DNA, 25 bp, Homo sapien
atgatactgtaatgaccttccaaag

SEQ ID NO: 146193 - DNA, 25 bp, Homo sapien
aataaaatcctgctcctgactcggt

SEQ ID NO: 146194 - DNA, 25 bp, Homo sapien
gctcctgactcggtcaaaatatttt

SEQ ID NO: 146195 - DNA, 25 bp, Homo sapien
ctattgtttgttgtgcttgctggta

SEQ ID NO: 146196 - DNA, 25 bp, Homo sapien
gtgcttgctggtactaagaggctat

SEQ ID NO: 146197 - DNA, 25 bp, Homo sapien
aactgctttgtatccatgagggttt

SEQ ID NO: 146198 - DNA, 25 bp, Homo sapien
atccatgagggtttcattgtgtgtt

SEQ ID NO: 146199 - DNA, 25 bp, Homo sapien
gtgttagcagcagtgagcttctatt

SEQ ID NO: 146200 - DNA, 25 bp, Homo sapien
attttgtttaagtggctttcagcaa

SEQ ID NO: 146201 - DNA, 25 bp, Homo sapien
ggctttcagcaaacctcagtcatat

SEQ ID NO: 146202 - DNA, 25 bp, Homo sapien
cagtcatattcttatgcagggtatt

SEQ ID NO: 146203 - DNA, 25 bp, Homo sapien
gggtattgcgaaacaacttgtgttc

SEQ ID NO: 146204 - DNA, 25 bp, Homo sapien
cagaggtctatataaagttactttt

SEQ ID NO: 146205 - DNA, 25 bp, Homo sapien
tcccctttacttaattatattgtag

SEQ ID NO: 146206 - DNA, 25 bp, Homo sapien
gataacaaaactgctaccttctcat

SEQ ID NO: 146207 - DNA, 25 bp, Homo sapien
taccttctcatccaagtggtctgta

SEQ ID NO: 146208 - DNA, 25 bp, Homo sapien
gtggtctgtagaattcatgtccctt

SEQ ID NO: 146209 - DNA, 25 bp, Homo sapien
gtctgtagaattcatgtcccttaca

SEQ ID NO: 146210 - DNA, 25 bp, Homo sapien
gtcccttacagtggtcatttaaagt

SEQ ID NO: 146211 - DNA, 25 bp, Homo sapien
gtgtatgtctgtcacattatttaga

SEQ ID NO: 146212 - DNA, 25 bp, Homo sapien
gtcttgatattctgtgactcattat

SEQ ID NO: 146213 - DNA, 25 bp, Homo sapien
tattctgtgactcattattttcatg

SEQ ID NO: 146214 - DNA, 25 bp, Homo sapien
tttcatgttagagtttgtacatact

SEQ ID NO: 146215 - DNA, 25 bp, Homo sapien
cacacatgcccgtaacaggatttat

SEQ ID NO: 146216 - DNA, 25 bp, Homo sapien
ggatttatcaccaagacacgcctgc

SEQ ID NO: 146217 - DNA, 25 bp, Homo sapien
gactgtagtattccagatgagctgc

SEQ ID NO: 146218 - DNA, 25 bp, Homo sapien
gagctgcagatgcttacctaccacg

SEQ ID NO: 146219 - DNA, 25 bp, Homo sapien
gaaaaccatcgccaactcctgcgat

SEQ ID NO: 146220 - DNA, 25 bp, Homo sapien
tcctgcgatcagcttgtgacttaca

SEQ ID NO: 146221 - DNA, 25 bp, Homo sapien
cagcttgtgacttacaaaccttgtt

SEQ ID NO: 146222 - DNA, 25 bp, Homo sapien
cttacatggacttctgtcctttaaa

SEQ ID NO: 146223 - DNA, 25 bp, Homo sapien
ttggctgtggccctctgtgtatgcc

SEQ ID NO: 146224 - DNA, 25 bp, Homo sapien
tgtatgcctgggatccttccaagca

SEQ ID NO: 146225 - DNA, 25 bp, Homo sapien
ttccaagcactcatagcccagatag

SEQ ID NO: 146226 - DNA, 25 bp, Homo sapien
gcacctacatctacgaccacggctt

SEQ ID NO: 146227 - DNA, 25 bp, Homo sapien
acacggaccctgtgggtgtgctcta

SEQ ID NO: 146228 - DNA, 25 bp, Homo sapien
ccctgtgggtgtgctctatgaggat

SEQ ID NO: 146229 - DNA, 25 bp, Homo sapien
tgatgacacggtggcgacccgcagc

SEQ ID NO: 146230 - DNA, 25 bp, Homo sapien
tgctgcccctgcacgggatacagca

SEQ ID NO: 146231 - DNA, 25 bp, Homo sapien
tgcacgggatacagcatctcaacat

SEQ ID NO: 146232 - DNA, 25 bp, Homo sapien
gggatacagcatctcaacatggtct

SEQ ID NO: 146233 - DNA, 25 bp, Homo sapien
gatacagcatctcaacatggtcttc

SEQ ID NO: 146234 - DNA, 25 bp, Homo sapien
tcaacatggtcttcagcaacctgac

SEQ ID NO: 146235 - DNA, 25 bp, Homo sapien
ggtcttcagcaacctgaccctggag

SEQ ID NO: 146236 - DNA, 25 bp, Homo sapien
tgctgggtgcctaccgccagggtcc

SEQ ID NO: 146237 - DNA, 25 bp, Homo sapien
acaagcaggagggtcgacatggact

SEQ ID NO: 146238 - DNA, 25 bp, Homo sapien
gacatggactgaaatcaccctctgc

SEQ ID NO: 146239 - DNA, 25 bp, Homo sapien
gcagctgagaggactttcacaccat

SEQ ID NO: 146240 - DNA, 25 bp, Homo sapien
ggactttcacaccataaggagattt

SEQ ID NO: 146241 - DNA, 25 bp, Homo sapien
tttggctgttaatgcttgtctataa

SEQ ID NO: 146242 - DNA, 25 bp, Homo sapien
ttgtctataacattggagccatcac

SEQ ID NO: 146243 - DNA, 25 bp, Homo sapien
ggagccatcacaagaatgttcattt

SEQ ID NO: 146244 - DNA, 25 bp, Homo sapien
caggcactggttgcagacgtcttta

SEQ ID NO: 146245 - DNA, 25 bp, Homo sapien
gacgtctttataggcagtcaccatg

SEQ ID NO: 146246 - DNA, 25 bp, Homo sapien
ggcagtcaccatgttgtcaaacctt

SEQ ID NO: 146247 - DNA, 25 bp, Homo sapien
gtcaaaccttaataatgcacctcat

SEQ ID NO: 146248 - DNA, 25 bp, Homo sapien
ggccagcttcatcgaacaagtagca

SEQ ID NO: 146249 - DNA, 25 bp, Homo sapien
gaacaagtagcagtgtccatgacat

SEQ ID NO: 146250 - DNA, 25 bp, Homo sapien
agcagtgtccatgacatagaccctg

SEQ ID NO: 146251 - DNA, 25 bp, Homo sapien
tgtccatgacatagaccctgccctt

SEQ ID NO: 146252 - DNA, 25 bp, Homo sapien
cgccgccgttgagggctgagtcctt

SEQ ID NO: 146253 - DNA, 25 bp, Homo sapien
ccgttgagggctgagtccttgctgt

SEQ ID NO: 146254 - DNA, 25 bp, Homo sapien
tgagtccttgctgtgggatgtgcca

SEQ ID NO: 146255 - DNA, 25 bp, Homo sapien
agtgtccccaccaacaccaggaatt

SEQ ID NO: 146256 - DNA, 25 bp, Homo sapien
gaatttagaccttttccctgcacca

SEQ ID NO: 146257 - DNA, 25 bp, Homo sapien
atcctgggggctctgttacactaat

SEQ ID NO: 146258 - DNA, 25 bp, Homo sapien
cactaatttgaataaactctcccct

SEQ ID NO: 146259 - DNA, 25 bp, Homo sapien
aaatgcagaaatttacccaggcacg

SEQ ID NO: 146260 - DNA, 25 bp, Homo sapien
aatgcagaaatttacccaggcacgg

SEQ ID NO: 146261 - DNA, 25 bp, Homo sapien
atgcagaaatttacccaggcacggc

SEQ ID NO: 146262 - DNA, 25 bp, Homo sapien
tgcagaaatttacccaggcacggcg

SEQ ID NO: 146263 - DNA, 25 bp, Homo sapien
cagaaatttacccaggcacggcggc

SEQ ID NO: 146264 - DNA, 25 bp, Homo sapien
agaaatttacccaggcacggcggcg

SEQ ID NO: 146265 - DNA, 25 bp, Homo sapien
gaaatttacccaggcacggcggcgg

SEQ ID NO: 146266 - DNA, 25 bp, Homo sapien
atttacccaggcacggcggcggacg

SEQ ID NO: 146267 - DNA, 25 bp, Homo sapien
ggcggacgcccatcatcccagctac

SEQ ID NO: 146268 - DNA, 25 bp, Homo sapien
caccattgcacaccaacctgcgtga

SEQ ID NO: 146269 - DNA, 25 bp, Homo sapien
ttgcacaccaacctgcgtgacagag

SEQ ID NO: 146270 - DNA, 25 bp, Homo sapien
tccctgggttagactgccagctctt

SEQ ID NO: 146271 - DNA, 25 bp, Homo sapien
gttagactgccagctcttcctagct

SEQ ID NO: 146272 - DNA, 25 bp, Homo sapien
gccagctgctgagccgcagagaagt

SEQ ID NO: 146273 - DNA, 25 bp, Homo sapien
gagccgcagagaagtgacggttcct

SEQ ID NO: 146274 - DNA, 25 bp, Homo sapien
agaagtgacggttcctacacaggac

SEQ ID NO: 146275 - DNA, 25 bp, Homo sapien
gtgacggttcctacacaggacaggg

SEQ ID NO: 146276 - DNA, 25 bp, Homo sapien
ttccttctgggcattacatcgcata

SEQ ID NO: 146277 - DNA, 25 bp, Homo sapien
ctgggcattacatcgcatagaaatc

SEQ ID NO: 146278 - DNA, 25 bp, Homo sapien
aataatttgtggtgatttggatctg

SEQ ID NO: 146279 - DNA, 25 bp, Homo sapien
tggtgatttggatctgtgttttaat

SEQ ID NO: 146280 - DNA, 25 bp, Homo sapien
gagtttcacagtgtgattttgatta

SEQ ID NO: 146281 - DNA, 25 bp, Homo sapien
cggcaaggccatgaccagatgtcct

SEQ ID NO: 146282 - DNA, 25 bp, Homo sapien
ggcaaggccatgaccagatgtcctc

SEQ ID NO: 146283 - DNA, 25 bp, Homo sapien
gcaaggccatgaccagatgtcctcg

SEQ ID NO: 146284 - DNA, 25 bp, Homo sapien
caaggccatgaccagatgtcctcgg

SEQ ID NO: 146285 - DNA, 25 bp, Homo sapien
aaggccatgaccagatgtcctcggg

SEQ ID NO: 146286 - DNA, 25 bp, Homo sapien
aggccatgaccagatgtcctcgggc

SEQ ID NO: 146287 - DNA, 25 bp, Homo sapien
gccatgaccagatgtcctcgggctt

SEQ ID NO: 146288 - DNA, 25 bp, Homo sapien
atgaccagatgtcctcgggcttcca

SEQ ID NO: 146289 - DNA, 25 bp, Homo sapien
tgaccagatgtcctcgggcttccag

SEQ ID NO: 146290 - DNA, 25 bp, Homo sapien
gaccagatgtcctcgggcttccagc

SEQ ID NO: 146291 - DNA, 25 bp, Homo sapien
cagatgtcctcgggcttccagcatg

SEQ ID NO: 146292 - DNA, 25 bp, Homo sapien
aagtattgttacacagggttatgca

SEQ ID NO: 146293 - DNA, 25 bp, Homo sapien
agggttatgcaattcccggcctgga

SEQ ID NO: 146294 - DNA, 25 bp, Homo sapien
aattcccggcctggagcatttttga

SEQ ID NO: 146295 - DNA, 25 bp, Homo sapien
attcaaattgtctgtcctgtggagc

SEQ ID NO: 146296 - DNA, 25 bp, Homo sapien
ggagcaggcagtgattttgttccaa

SEQ ID NO: 146297 - DNA, 25 bp, Homo sapien
gtctgattttaatgtccgttcttag

SEQ ID NO: 146298 - DNA, 25 bp, Homo sapien
taatgtccgttcttagccaagctgc

SEQ ID NO: 146299 - DNA, 25 bp, Homo sapien
ttagccaagctgctagcaggtgtta

SEQ ID NO: 146300 - DNA, 25 bp, Homo sapien
gcaggtgttaattggatccctttcc

SEQ ID NO: 146301 - DNA, 25 bp, Homo sapien
gatccctttccttcactgaaatgga

SEQ ID NO: 146302 - DNA, 25 bp, Homo sapien
gagtttataagcttacgttagtatt

SEQ ID NO: 146303 - DNA, 25 bp, Homo sapien
gggtgcaactacatccaagtcctgc

SEQ ID NO: 146304 - DNA, 25 bp, Homo sapien
gcaactacatccaagtcctgctgca

SEQ ID NO: 146305 - DNA, 25 bp, Homo sapien
gatgtgctggctggacggcaccacc

SEQ ID NO: 146306 - DNA, 25 bp, Homo sapien
cctttcctgggaagagatgactcaa

SEQ ID NO: 146307 - DNA, 25 bp, Homo sapien
gatgactcaagccagtggaagacca

SEQ ID NO: 146308 - DNA, 25 bp, Homo sapien
gtggaagaccacacaccttgagaag

SEQ ID NO: 146309 - DNA, 25 bp, Homo sapien
gaccacacaccttgagaagtagaag

SEQ ID NO: 146310 - DNA, 25 bp, Homo sapien
gagtcataggatttgaaagctgtta

SEQ ID NO: 146311 - DNA, 25 bp, Homo sapien
agagaatttagcttccaggactgtt

SEQ ID NO: 146312 - DNA, 25 bp, Homo sapien
ttagcttccaggactgttcaatctt

SEQ ID NO: 146313 - DNA, 25 bp, Homo sapien
gcttccaggactgttcaatcttttg

SEQ ID NO: 146314 - DNA, 25 bp, Homo sapien
aggtgttgcaccagggacttctgct

SEQ ID NO: 146315 - DNA, 25 bp, Homo sapien
gggtaaagacacctggatcagactc

SEQ ID NO: 146316 - DNA, 25 bp, Homo sapien
ggatcagactccaagggctgccctg

SEQ ID NO: 146317 - DNA, 25 bp, Homo sapien
aagggctgccctgagtctgggactt

SEQ ID NO: 146318 - DNA, 25 bp, Homo sapien
ctccatggctggtcatgagagcaaa

SEQ ID NO: 146319 - DNA, 25 bp, Homo sapien
tgagagcaaaccgtagtcccctgga

SEQ ID NO: 146320 - DNA, 25 bp, Homo sapien
agccactccagagaacctcttggga

SEQ ID NO: 146321 - DNA, 25 bp, Homo sapien
atctgtgcacagctcgatcttctac

SEQ ID NO: 146322 - DNA, 25 bp, Homo sapien
agctcgatcttctacttgcctgtgg

SEQ ID NO: 146323 - DNA, 25 bp, Homo sapien
gggagtgacaggtccacacaccaca

SEQ ID NO: 146324 - DNA, 25 bp, Homo sapien
agagagggacagaccgtcagaaact

SEQ ID NO: 146325 - DNA, 25 bp, Homo sapien
gacattggcacgaagggcttgaatg

SEQ ID NO: 146326 - DNA, 25 bp, Homo sapien
cattggcacgaagggcttgaatgag

SEQ ID NO: 146327 - DNA, 25 bp, Homo sapien
gaatgaggagtagctttgccacatc

SEQ ID NO: 146328 - DNA, 25 bp, Homo sapien
tgaggagtagctttgccacatcttg

SEQ ID NO: 146329 - DNA, 25 bp, Homo sapien
aggagtagctttgccacatcttgat

SEQ ID NO: 146330 - DNA, 25 bp, Homo sapien
gagtagctttgccacatcttgatct

SEQ ID NO: 146331 - DNA, 25 bp, Homo sapien
tggaggtgccagcaaagccccatgc

SEQ ID NO: 146332 - DNA, 25 bp, Homo sapien
agcaaagccccatgctggagcctgt

SEQ ID NO: 146333 - DNA, 25 bp, Homo sapien
gctggagcctgtgtaacagctcctt

SEQ ID NO: 146334 - DNA, 25 bp, Homo sapien
gagcctgtgtaacagctccttggga

SEQ ID NO: 146335 - DNA, 25 bp, Homo sapien
cctgtgtaacagctccttgggagga

SEQ ID NO: 146336 - DNA, 25 bp, Homo sapien
ttattgcagctgttatagcaccttg

SEQ ID NO: 146337 - DNA, 25 bp, Homo sapien
agctgttatagcaccttgagttgta

SEQ ID NO: 146338 - DNA, 25 bp, Homo sapien
gctgatgtaaaagacactgatgctg

SEQ ID NO: 146339 - DNA, 25 bp, Homo sapien
taaaagacactgatgctgttgatgt

SEQ ID NO: 146340 - DNA, 25 bp, Homo sapien
gtgtattgctgatggtgtctgtata

SEQ ID NO: 146341 - DNA, 25 bp, Homo sapien
gtgtctgtatagatgcttttctaaa

SEQ ID NO: 146342 - DNA, 25 bp, Homo sapien
agatgcttttctaaaacctcccatg

SEQ ID NO: 146343 - DNA, 25 bp, Homo sapien
gcttttctaaaacctcccatggaga

SEQ ID NO: 146344 - DNA, 25 bp, Homo sapien
cagaagaacctcaaattttctacaa

SEQ ID NO: 146345 - DNA, 25 bp, Homo sapien
aaattttctacaatgcttcaccctc

SEQ ID NO: 146346 - DNA, 25 bp, Homo sapien
cacactatctgccacaatgttcatt

SEQ ID NO: 146347 - DNA, 25 bp, Homo sapien
atgaaaggattgctactgtatcaga

SEQ ID NO: 146348 - DNA, 25 bp, Homo sapien
attgtttcaatttagtctatcctgg

SEQ ID NO: 146349 - DNA, 25 bp, Homo sapien
tctatcctggatatgtactaacgaa

SEQ ID NO: 146350 - DNA, 25 bp, Homo sapien
gtactaacgaatattaccaccagag

SEQ ID NO: 146351 - DNA, 25 bp, Homo sapien
gagctttctacaaaagtcactacag

SEQ ID NO: 146352 - DNA, 25 bp, Homo sapien
gtcactacagattttgctatattgc

SEQ ID NO: 146353 - DNA, 25 bp, Homo sapien
aaaagcatttatccttcataccaat

SEQ ID NO: 146354 - DNA, 25 bp, Homo sapien
gtaacatctgacaccatgtagaagc

SEQ ID NO: 146355 - DNA, 25 bp, Homo sapien
ggagtgagcgttttctcaagacctt

SEQ ID NO: 146356 - DNA, 25 bp, Homo sapien
aagaccttcctcaagcattttatct

SEQ ID NO: 146357 - DNA, 25 bp, Homo sapien
aaactgatgggcacctgatactctg

SEQ ID NO: 146358 - DNA, 25 bp, Homo sapien
ggctatagatcaaattatctgtatg

SEQ ID NO: 146359 - DNA, 25 bp, Homo sapien
ttgactggcaaattcgctttggact

SEQ ID NO: 146360 - DNA, 25 bp, Homo sapien
gactggcaaattcgctttggactcg

SEQ ID NO: 146361 - DNA, 25 bp, Homo sapien
ctggcaaattcgctttggactcgtg

SEQ ID NO: 146362 - DNA, 25 bp, Homo sapien
ggcaaattcgctttggactcgtgta

SEQ ID NO: 146363 - DNA, 25 bp, Homo sapien
caaattcgctttggactcgtgtatt

SEQ ID NO: 146364 - DNA, 25 bp, Homo sapien
aattcgctttggactcgtgtattct

SEQ ID NO: 146365 - DNA, 25 bp, Homo sapien
ttcgctttggactcgtgtattctca

SEQ ID NO: 146366 - DNA, 25 bp, Homo sapien
tcgctttggactcgtgtattctcat

SEQ ID NO: 146367 - DNA, 25 bp, Homo sapien
gctttggactcgtgtattctcattt

SEQ ID NO: 146368 - DNA, 25 bp, Homo sapien
tttggactcgtgtattctcatttgt

SEQ ID NO: 146369 - DNA, 25 bp, Homo sapien
ttaggagagcggaaaggacctcctg

SEQ ID NO: 146370 - DNA, 25 bp, Homo sapien
aagtcagatagtcttctgctgctgg

SEQ ID NO: 146371 - DNA, 25 bp, Homo sapien
agtcttctgctgctggtacctgggt

SEQ ID NO: 146372 - DNA, 25 bp, Homo sapien
tcttctgctgctggtacctgggtgg

SEQ ID NO: 146373 - DNA, 25 bp, Homo sapien
gctggtacctgggtgggcaatggcc

SEQ ID NO: 146374 - DNA, 25 bp, Homo sapien
tcatatgcaatggaaaacagccaca

SEQ ID NO: 146375 - DNA, 25 bp, Homo sapien
acctaccttatatggaagttgtagc

SEQ ID NO: 146376 - DNA, 25 bp, Homo sapien
gaagttgtagccctctgcagctcag

SEQ ID NO: 146377 - DNA, 25 bp, Homo sapien
gctcagccctgtacatatacctgtc

SEQ ID NO: 146378 - DNA, 25 bp, Homo sapien
ctgtacatatacctgtccctctctg

SEQ ID NO: 146379 - DNA, 25 bp, Homo sapien
cttcctccctactttctgtaaatat

SEQ ID NO: 146380 - DNA, 25 bp, Homo sapien
actctcgcatcttcccaacccctta

SEQ ID NO: 146381 - DNA, 25 bp, Homo sapien
ctctcgcatcttcccaaccccttaa

SEQ ID NO: 146382 - DNA, 25 bp, Homo sapien
ctcgcatcttcccaaccccttaagc

SEQ ID NO: 146383 - DNA, 25 bp, Homo sapien
tcgcatcttcccaaccccttaagcc

SEQ ID NO: 146384 - DNA, 25 bp, Homo sapien
gcatcttcccaaccccttaagccct

SEQ ID NO: 146385 - DNA, 25 bp, Homo sapien
catcttcccaaccccttaagccctg

SEQ ID NO: 146386 - DNA, 25 bp, Homo sapien
gacagagcctcgctcgttacccagg

SEQ ID NO: 146387 - DNA, 25 bp, Homo sapien
acagagcctcgctcgttacccaggg

SEQ ID NO: 146388 - DNA, 25 bp, Homo sapien
cagagcctcgctcgttacccagggt

SEQ ID NO: 146389 - DNA, 25 bp, Homo sapien
agagcctcgctcgttacccagggtg

SEQ ID NO: 146390 - DNA, 25 bp, Homo sapien
gagcctcgctcgttacccagggtgg

SEQ ID NO: 146391 - DNA, 25 bp, Homo sapien
ggaacacattgtctataaagccttg

SEQ ID NO: 146392 - DNA, 25 bp, Homo sapien
taaagccttgcgctcacacattctg

SEQ ID NO: 146393 - DNA, 25 bp, Homo sapien
acattctgcctcctaaacatttcac

SEQ ID NO: 146394 - DNA, 25 bp, Homo sapien
gaaatatcctgcagcttgctaacct

SEQ ID NO: 146395 - DNA, 25 bp, Homo sapien
tgctaacctgcctgatctatacaaa

SEQ ID NO: 146396 - DNA, 25 bp, Homo sapien
aatatggttatttatgcactgtggg

SEQ ID NO: 146397 - DNA, 25 bp, Homo sapien
ggatgtgttcttctttctctgtatt

SEQ ID NO: 146398 - DNA, 25 bp, Homo sapien
gttggtagcacttaagacttatact

SEQ ID NO: 146399 - DNA, 25 bp, Homo sapien
aagacttatacttgccttctgatag

SEQ ID NO: 146400 - DNA, 25 bp, Homo sapien
acttgccttctgatagtattccttt

SEQ ID NO: 146401 - DNA, 25 bp, Homo sapien
tagtattcctttatacacagtggat

SEQ ID NO: 146402 - DNA, 25 bp, Homo sapien
agcaggccaccaccagtgctcaggt

SEQ ID NO: 146403 - DNA, 25 bp, Homo sapien
ggtggcctgtttgtaccggaagcaa

SEQ ID NO: 146404 - DNA, 25 bp, Homo sapien
gtcagattcagaaccaacaaggcga

SEQ ID NO: 146405 - DNA, 25 bp, Homo sapien
ccaacaaggcgaggactcaggctct

SEQ ID NO: 146406 - DNA, 25 bp, Homo sapien
aggctctgaccctgaagatacctac

SEQ ID NO: 146407 - DNA, 25 bp, Homo sapien
tgaagatacctactaagccctcgcc

SEQ ID NO: 146408 - DNA, 25 bp, Homo sapien
ctcctagggcctgggtacagggcat

SEQ ID NO: 146409 - DNA, 25 bp, Homo sapien
cagggcatgagttggacggacccca

SEQ ID NO: 146410 - DNA, 25 bp, Homo sapien
gaccccagggttattattgcctttg

SEQ ID NO: 146411 - DNA, 25 bp, Homo sapien
tctgctgtggcaggctgtggatttt

SEQ ID NO: 146412 - DNA, 25 bp, Homo sapien
ttactccggagtctgggattcatcc

SEQ ID NO: 146413 - DNA, 25 bp, Homo sapien
ggactactttcccaggtatcaggct

SEQ ID NO: 146414 - DNA, 25 bp, Homo sapien
actttcccaggtatcaggcttgttg

SEQ ID NO: 146415 - DNA, 25 bp, Homo sapien
tatcaggcttgttgagcagacagca

SEQ ID NO: 146416 - DNA, 25 bp, Homo sapien
taagtaactcataaccaggcctcag

SEQ ID NO: 146417 - DNA, 25 bp, Homo sapien
taaccaggcctcagatacccaaggg

SEQ ID NO: 146418 - DNA, 25 bp, Homo sapien
atacccaagggtgctattacctgct

SEQ ID NO: 146419 - DNA, 25 bp, Homo sapien
aagggtgctattacctgctggtttt

SEQ ID NO: 146420 - DNA, 25 bp, Homo sapien
acctgctggttttgattcaagttaa

SEQ ID NO: 146421 - DNA, 25 bp, Homo sapien
taaaaacacctgtactaagtatgac

SEQ ID NO: 146422 - DNA, 25 bp, Homo sapien
aagtatgacatctttcctactccag

SEQ ID NO: 146423 - DNA, 25 bp, Homo sapien
tccagtccctctcgttgatatttga

SEQ ID NO: 146424 - DNA, 25 bp, Homo sapien
tgttcataggttaaagtctgcactg

SEQ ID NO: 146425 - DNA, 25 bp, Homo sapien
tgcactgacattttctcatcaatca

SEQ ID NO: 146426 - DNA, 25 bp, Homo sapien
tctcatcaatcactggtatgtaagt

SEQ ID NO: 146427 - DNA, 25 bp, Homo sapien
gtatgtaagttatcagtgactgaca

SEQ ID NO: 146428 - DNA, 25 bp, Homo sapien
tgactgacagctaggtggactgccc

SEQ ID NO: 146429 - DNA, 25 bp, Homo sapien
tggactgcccctaggacttctgttt

SEQ ID NO: 146430 - DNA, 25 bp, Homo sapien
ggacttctgtttcaccagagcagga

SEQ ID NO: 146431 - DNA, 25 bp, Homo sapien
gaggcactgaatcgctgtacaggct

SEQ ID NO: 146432 - DNA, 25 bp, Homo sapien
tgtacaggctgaagacctccttatt

SEQ ID NO: 146433 - DNA, 25 bp, Homo sapien
gacctccttattagagttgaacttc

SEQ ID NO: 146434 - DNA, 25 bp, Homo sapien
gattcatgtgttttccaggtggata

SEQ ID NO: 146435 - DNA, 25 bp, Homo sapien
cccatattcctcagactcaacaatt

SEQ ID NO: 146436 - DNA, 25 bp, Homo sapien
tagaactgtgttctcaccttcccaa

SEQ ID NO: 146437 - DNA, 25 bp, Homo sapien
ccaacactgcactgccgaagtgtag

SEQ ID NO: 146438 - DNA, 25 bp, Homo sapien
ttgctctcatcaccagctagagctt

SEQ ID NO: 146439 - DNA, 25 bp, Homo sapien
gagcttcttcccgaagggcctttag

SEQ ID NO: 146440 - DNA, 25 bp, Homo sapien
ggagaaagggttcatgcacacacgt

SEQ ID NO: 146441 - DNA, 25 bp, Homo sapien
acacgtgtgagaatggaagagcccc

SEQ ID NO: 146442 - DNA, 25 bp, Homo sapien
tctacagctgctctagccttagttg

SEQ ID NO: 146443 - DNA, 25 bp, Homo sapien
gccttagttgccactaggaagtttt

SEQ ID NO: 146444 - DNA, 25 bp, Homo sapien
ggaagttttctgaggctggctgtaa

SEQ ID NO: 146445 - DNA, 25 bp, Homo sapien
aagtaagtgtaaggtccacatcctt

SEQ ID NO: 146446 - DNA, 25 bp, Homo sapien
gctggtcagcactccagtagcgaga

SEQ ID NO: 146447 - DNA, 25 bp, Homo sapien
agtagcgagagacggcacccagaat

SEQ ID NO: 146448 - DNA, 25 bp, Homo sapien
agagacggcacccagaatcagatcc

SEQ ID NO: 146449 - DNA, 25 bp, Homo sapien
agaatcagatcccagcttcggcatt

SEQ ID NO: 146450 - DNA, 25 bp, Homo sapien
cagcttcggcatttgatcagaccaa

SEQ ID NO: 146451 - DNA, 25 bp, Homo sapien
ttgatcagaccaaacagtgctgttt

SEQ ID NO: 146452 - DNA, 25 bp, Homo sapien
ttaattacccttttgcaggcaccac

SEQ ID NO: 146453 - DNA, 25 bp, Homo sapien
aatctgttttataccttgcttatta

SEQ ID NO: 146454 - DNA, 25 bp, Homo sapien
aatgctgtcctttagtagcaagtaa

SEQ ID NO: 146455 - DNA, 25 bp, Homo sapien
attccttttcccaggaaagaagcat

SEQ ID NO: 146456 - DNA, 25 bp, Homo sapien
gaagcatttctgatactttctgtca

SEQ ID NO: 146457 - DNA, 25 bp, Homo sapien
ccccagtctcagaaattaacatggt

SEQ ID NO: 146458 - DNA, 25 bp, Homo sapien
catggtatgaaagtgtttccaggcc

SEQ ID NO: 146459 - DNA, 25 bp, Homo sapien
atggtatgaaagtgtttccaggcca

SEQ ID NO: 146460 - DNA, 25 bp, Homo sapien
tggtatgaaagtgtttccaggccag

SEQ ID NO: 146461 - DNA, 25 bp, Homo sapien
ggtatgaaagtgtttccaggccagg

SEQ ID NO: 146462 - DNA, 25 bp, Homo sapien
atgaaagtgtttccaggccaggcgc

SEQ ID NO: 146463 - DNA, 25 bp, Homo sapien
agcctggccaacactatctgtacta

SEQ ID NO: 146464 - DNA, 25 bp, Homo sapien
gcctggccaacactatctgtactaa

SEQ ID NO: 146465 - DNA, 25 bp, Homo sapien
cctggccaacactatctgtactaaa

SEQ ID NO: 146466 - DNA, 25 bp, Homo sapien
ctggccaacactatctgtactaaaa

SEQ ID NO: 146467 - DNA, 25 bp, Homo sapien
ggccaacactatctgtactaaaaac

SEQ ID NO: 146468 - DNA, 25 bp, Homo sapien
gtgtcagcaaaattgaccgactgtc

SEQ ID NO: 146469 - DNA, 25 bp, Homo sapien
gaccgactgtcaagaatagccttcc

SEQ ID NO: 146470 - DNA, 25 bp, Homo sapien
tagccttcccgctgctatttggaat

SEQ ID NO: 146471 - DNA, 25 bp, Homo sapien
taacttagtctactgggctacgtat

SEQ ID NO: 146472 - DNA, 25 bp, Homo sapien
acgtatttaaacagagagcctcagc

SEQ ID NO: 146473 - DNA, 25 bp, Homo sapien
acagagagcctcagctaaaagcccc

SEQ ID NO: 146474 - DNA, 25 bp, Homo sapien
caatagatcttttactcacattctg

SEQ ID NO: 146475 - DNA, 25 bp, Homo sapien
acattctgttgttcagttcctctgc

SEQ ID NO: 146476 - DNA, 25 bp, Homo sapien
gaatttatttatgttctcaacgcag

SEQ ID NO: 146477 - DNA, 25 bp, Homo sapien
ttctcaacgcagtaattcccatctg

SEQ ID NO: 146478 - DNA, 25 bp, Homo sapien
atctgcctttattgcctctgtctta

SEQ ID NO: 146479 - DNA, 25 bp, Homo sapien
catgcctggccatgattcttaagag

SEQ ID NO: 146480 - DNA, 25 bp, Homo sapien
atgcctggccatgattcttaagaga

SEQ ID NO: 146481 - DNA, 25 bp, Homo sapien
tgcctggccatgattcttaagagaa

SEQ ID NO: 146482 - DNA, 25 bp, Homo sapien
gcctggccatgattcttaagagaat

SEQ ID NO: 146483 - DNA, 25 bp, Homo sapien
cctggccatgattcttaagagaatt

SEQ ID NO: 146484 - DNA, 25 bp, Homo sapien
ctggccatgattcttaagagaattg

SEQ ID NO: 146485 - DNA, 25 bp, Homo sapien
ggccatgattcttaagagaattgac

SEQ ID NO: 146486 - DNA, 25 bp, Homo sapien
attcttaagagaattgactgggcct

SEQ ID NO: 146487 - DNA, 25 bp, Homo sapien
ttcttaagagaattgactgggcctc

SEQ ID NO: 146488 - DNA, 25 bp, Homo sapien
tcttaagagaattgactgggcctca

SEQ ID NO: 146489 - DNA, 25 bp, Homo sapien
cttaagagaattgactgggcctcat

SEQ ID NO: 146490 - DNA, 25 bp, Homo sapien
aagtcaaaatttcaggtgcacccac

SEQ ID NO: 146491 - DNA, 25 bp, Homo sapien
aagtcttctcggcttactgctgcct

SEQ ID NO: 146492 - DNA, 25 bp, Homo sapien
tttggcatccttgtctacttggaat

SEQ ID NO: 146493 - DNA, 25 bp, Homo sapien
ttctgaatgtgttgtgacagctgct

SEQ ID NO: 146494 - DNA, 25 bp, Homo sapien
agaagacacccttcaaccctgggat

SEQ ID NO: 146495 - DNA, 25 bp, Homo sapien
aaccctgggatgaccacaattcctt

SEQ ID NO: 146496 - DNA, 25 bp, Homo sapien
acaattccttccaatttctgcggct

SEQ ID NO: 146497 - DNA, 25 bp, Homo sapien
tgcggctccatcctaagccaaataa

SEQ ID NO: 146498 - DNA, 25 bp, Homo sapien
attcaactgatttacaacacacatg

SEQ ID NO: 146499 - DNA, 25 bp, Homo sapien
aacacacatgatgactgaggcattc

SEQ ID NO: 146500 - DNA, 25 bp, Homo sapien
tgaggcattcaggaaccccttcatc

SEQ ID NO: 146501 - DNA, 25 bp, Homo sapien
tgtacaatacttgcattccagagtt

SEQ ID NO: 146502 - DNA, 25 bp, Homo sapien
tcttttaaagactacctgggacctg

SEQ ID NO: 146503 - DNA, 25 bp, Homo sapien
tacctgggacctgatttattgaaat

SEQ ID NO: 146504 - DNA, 25 bp, Homo sapien
gtcatttcctttgttgtctacatta

SEQ ID NO: 146505 - DNA, 25 bp, Homo sapien
gtctacattaaatcacttgaatcca

SEQ ID NO: 146506 - DNA, 25 bp, Homo sapien
gtgcttcaagggtaatcttgggttt

SEQ ID NO: 146507 - DNA, 25 bp, Homo sapien
tcttgggtttctagcaccttatcta

SEQ ID NO: 146508 - DNA, 25 bp, Homo sapien
ggtttctagcaccttatctatgatg

SEQ ID NO: 146509 - DNA, 25 bp, Homo sapien
cttatctatgatgtttcttttgcaa

SEQ ID NO: 146510 - DNA, 25 bp, Homo sapien
tgcaattggaataatcacttggtca

SEQ ID NO: 146511 - DNA, 25 bp, Homo sapien
ccaagctttcccctctgaataaata

SEQ ID NO: 146512 - DNA, 25 bp, Homo sapien
atatttgaaaaagttatctctgggt

SEQ ID NO: 146513 - DNA, 25 bp, Homo sapien
ttgcataaaaggcttcatcttataa

SEQ ID NO: 146514 - DNA, 25 bp, Homo sapien
aggcttcatcttataaagtgaaatc

SEQ ID NO: 146515 - DNA, 25 bp, Homo sapien
agtaaacttcatattggccaacacc

SEQ ID NO: 146516 - DNA, 25 bp, Homo sapien
cttcatattggccaacaccagggtt

SEQ ID NO: 146517 - DNA, 25 bp, Homo sapien
ttggccaacaccagggttgtattct

SEQ ID NO: 146518 - DNA, 25 bp, Homo sapien
aacaccagggttgtattctatggat

SEQ ID NO: 146519 - DNA, 25 bp, Homo sapien
cagggttgtattctatggatgtcat

SEQ ID NO: 146520 - DNA, 25 bp, Homo sapien
ggttgtattctatggatgtcattat

SEQ ID NO: 146521 - DNA, 25 bp, Homo sapien
aaattgttttgagtgcttgattata

SEQ ID NO: 146522 - DNA, 25 bp, Homo sapien
gagtgcttgattataatttgtaaaa

SEQ ID NO: 146523 - DNA, 25 bp, Homo sapien
aaccaggtggtgctgagcttccgct

SEQ ID NO: 146524 - DNA, 25 bp, Homo sapien
tggtgctgagcttccgctgagcgct

SEQ ID NO: 146525 - DNA, 25 bp, Homo sapien
cgctgagcgctcttttgttttgtgg

SEQ ID NO: 146526 - DNA, 25 bp, Homo sapien
ctgagcgctcttttgttttgtggtt

SEQ ID NO: 146527 - DNA, 25 bp, Homo sapien
gtggtttgacacttttgttgacagc

SEQ ID NO: 146528 - DNA, 25 bp, Homo sapien
gacacttttgttgacagcatgttgc

SEQ ID NO: 146529 - DNA, 25 bp, Homo sapien
acagcatgttgcagtttcttttcgg

SEQ ID NO: 146530 - DNA, 25 bp, Homo sapien
atgttgcagtttcttttcggttttg

SEQ ID NO: 146531 - DNA, 25 bp, Homo sapien
tgtttacaaagtcctgtagccccct

SEQ ID NO: 146532 - DNA, 25 bp, Homo sapien
tcacttttgccaatgtacatcgggt

SEQ ID NO: 146533 - DNA, 25 bp, Homo sapien
tcttgtattatttaaacggttgtgg

SEQ ID NO: 146534 - DNA, 25 bp, Homo sapien
attgtggttttaacctgtcaacctg

SEQ ID NO: 146535 - DNA, 25 bp, Homo sapien
gtggttttaacctgtcaacctgaga

SEQ ID NO: 146536 - DNA, 25 bp, Homo sapien
ggttttaacctgtcaacctgagact

SEQ ID NO: 146537 - DNA, 25 bp, Homo sapien
tttaacctgtcaacctgagactcag

SEQ ID NO: 146538 - DNA, 25 bp, Homo sapien
tgctgctctccactgacaacaggac

SEQ ID NO: 146539 - DNA, 25 bp, Homo sapien
tcgttctactcagcgccacaaagaa

SEQ ID NO: 146540 - DNA, 25 bp, Homo sapien
tactcagcgccacaaagaatgacat

SEQ ID NO: 146541 - DNA, 25 bp, Homo sapien
gccacaaagaatgacataggaccct

SEQ ID NO: 146542 - DNA, 25 bp, Homo sapien
tcaccctgaatgtccgctatgagtc

SEQ ID NO: 146543 - DNA, 25 bp, Homo sapien
caccctgaatgtccgctatgagtca

SEQ ID NO: 146544 - DNA, 25 bp, Homo sapien
tgaatgtccgctatgagtcagtaca

SEQ ID NO: 146545 - DNA, 25 bp, Homo sapien
gaagtttcacccctccaaggagtct

SEQ ID NO: 146546 - DNA, 25 bp, Homo sapien
cccctccaaggagtctcggaataat

SEQ ID NO: 146547 - DNA, 25 bp, Homo sapien
caaggagtctcggaataattcaagt

SEQ ID NO: 146548 - DNA, 25 bp, Homo sapien
tttggttgagaggaacatccccatc

SEQ ID NO: 146549 - DNA, 25 bp, Homo sapien
catctcaaggccgaacctgtgtgaa

SEQ ID NO: 146550 - DNA, 25 bp, Homo sapien
caaggccgaacctgtgtgaacctca

SEQ ID NO: 146551 - DNA, 25 bp, Homo sapien
gtgtgaacctcatgccaagcacaga

SEQ ID NO: 146552 - DNA, 25 bp, Homo sapien
tcatgccaagcacagatatagggct

SEQ ID NO: 146553 - DNA, 25 bp, Homo sapien
ttgggactttttacttcactaggag

SEQ ID NO: 146554 - DNA, 25 bp, Homo sapien
cactaggagaacttgtaacaccatg

SEQ ID NO: 146555 - DNA, 25 bp, Homo sapien
ggaagtcagctgaaacttgtcttgt

SEQ ID NO: 146556 - DNA, 25 bp, Homo sapien
aaatacggatcctgcactgactctg

SEQ ID NO: 146557 - DNA, 25 bp, Homo sapien
cactgactctggaaaaggcatatat

SEQ ID NO: 146558 - DNA, 25 bp, Homo sapien
ggagaatgcaccatactcatgcatg

SEQ ID NO: 146559 - DNA, 25 bp, Homo sapien
atgaatctatttgtgggtgtgctat

SEQ ID NO: 146560 - DNA, 25 bp, Homo sapien
gtgtgctatagctttagcgtgtcac

SEQ ID NO: 146561 - DNA, 25 bp, Homo sapien
gtgtcacgggcatcattctctaata

SEQ ID NO: 146562 - DNA, 25 bp, Homo sapien
ggcatcattctctaatatccacttg

SEQ ID NO: 146563 - DNA, 25 bp, Homo sapien
tatccacttgtccatgtgaaacatg

SEQ ID NO: 146564 - DNA, 25 bp, Homo sapien
tggcttgtcttctgaacgtttggtt

SEQ ID NO: 146565 - DNA, 25 bp, Homo sapien
aaatgtgttttggtcctggaggctc

SEQ ID NO: 146566 - DNA, 25 bp, Homo sapien
ttgagttattcccacgttttgaaat

SEQ ID NO: 146567 - DNA, 25 bp, Homo sapien
aaggaaagatgcgaacatactggct

SEQ ID NO: 146568 - DNA, 25 bp, Homo sapien
aggaaagatgcgaacatactggctc

SEQ ID NO: 146569 - DNA, 25 bp, Homo sapien
ggaaagatgcgaacatactggctct

SEQ ID NO: 146570 - DNA, 25 bp, Homo sapien
gaaagatgcgaacatactggctctt

SEQ ID NO: 146571 - DNA, 25 bp, Homo sapien
aaagatgcgaacatactggctctta

SEQ ID NO: 146572 - DNA, 25 bp, Homo sapien
aagatgcgaacatactggctcttag

SEQ ID NO: 146573 - DNA, 25 bp, Homo sapien
agatgcgaacatactggctcttagg

SEQ ID NO: 146574 - DNA, 25 bp, Homo sapien
gatgcgaacatactggctcttagga

SEQ ID NO: 146575 - DNA, 25 bp, Homo sapien
atgcgaacatactggctcttaggag

SEQ ID NO: 146576 - DNA, 25 bp, Homo sapien
tgcgaacatactggctcttaggaga

SEQ ID NO: 146577 - DNA, 25 bp, Homo sapien
aggccttatctcaacaacaaccaca

SEQ ID NO: 146578 - DNA, 25 bp, Homo sapien
ggccttatctcaacaacaaccacaa

SEQ ID NO: 146579 - DNA, 25 bp, Homo sapien
gccttatctcaacaacaaccacaaa

SEQ ID NO: 146580 - DNA, 25 bp, Homo sapien
ccttatctcaacaacaaccacaaaa

SEQ ID NO: 146581 - DNA, 25 bp, Homo sapien
cttatctcaacaacaaccacaaaat

SEQ ID NO: 146582 - DNA, 25 bp, Homo sapien
ttatctcaacaacaaccacaaaatc

SEQ ID NO: 146583 - DNA, 25 bp, Homo sapien
tatctcaacaacaaccacaaaatct

SEQ ID NO: 146584 - DNA, 25 bp, Homo sapien
atctcaacaacaaccacaaaatcta

SEQ ID NO: 146585 - DNA, 25 bp, Homo sapien
tctcaacaacaaccacaaaatctaa

SEQ ID NO: 146586 - DNA, 25 bp, Homo sapien
ctcaacaacaaccacaaaatctaaa

SEQ ID NO: 146587 - DNA, 25 bp, Homo sapien
taacatggtatgaaagtgtttccag

SEQ ID NO: 146588 - DNA, 25 bp, Homo sapien
aacatggtatgaaagtgtttccagg

SEQ ID NO: 146589 - DNA, 25 bp, Homo sapien
acatggtatgaaagtgtttccaggc

SEQ ID NO: 146590 - DNA, 25 bp, Homo sapien
catggtatgaaagtgtttccaggcc

SEQ ID NO: 146591 - DNA, 25 bp, Homo sapien
atggtatgaaagtgtttccaggcca

SEQ ID NO: 146592 - DNA, 25 bp, Homo sapien
tggtatgaaagtgtttccaggccag

SEQ ID NO: 146593 - DNA, 25 bp, Homo sapien
ggtatgaaagtgtttccaggccagg

SEQ ID NO: 146594 - DNA, 25 bp, Homo sapien
agcctggccaacactatctgtacta

SEQ ID NO: 146595 - DNA, 25 bp, Homo sapien
gcctggccaacactatctgtactaa

SEQ ID NO: 146596 - DNA, 25 bp, Homo sapien
cctggccaacactatctgtactaaa

SEQ ID NO: 146597 - DNA, 25 bp, Homo sapien
ctggccaacactatctgtactaaaa

SEQ ID NO: 146598 - DNA, 25 bp, Homo sapien
agctggagacacagttggagaaggg

SEQ ID NO: 146599 - DNA, 25 bp, Homo sapien
ttatacaggaacacccctgtgcagc

SEQ ID NO: 146600 - DNA, 25 bp, Homo sapien
tatacaggaacacccctgtgcagct

SEQ ID NO: 146601 - DNA, 25 bp, Homo sapien
aggaacacccctgtgcagctacgtt

SEQ ID NO: 146602 - DNA, 25 bp, Homo sapien
gaacacccctgtgcagctacgttta

SEQ ID NO: 146603 - DNA, 25 bp, Homo sapien
acacccctgtgcagctacgtttacg

SEQ ID NO: 146604 - DNA, 25 bp, Homo sapien
acccctgtgcagctacgtttacgtc

SEQ ID NO: 146605 - DNA, 25 bp, Homo sapien
acttgtactatagatgtacttctgc

SEQ ID NO: 146606 - DNA, 25 bp, Homo sapien
gtactatagatgtacttctgctgtg

SEQ ID NO: 146607 - DNA, 25 bp, Homo sapien
gtacttctgctgtgagattccctag

SEQ ID NO: 146608 - DNA, 25 bp, Homo sapien
tacttctgctgtgagattccctagt

SEQ ID NO: 146609 - DNA, 25 bp, Homo sapien
ggaattaagggcgtgcctcagccac

SEQ ID NO: 146610 - DNA, 25 bp, Homo sapien
gggcgtgcctcagccacaaatgtga

SEQ ID NO: 146611 - DNA, 25 bp, Homo sapien
gccacaaatgtgacccaggatacag

SEQ ID NO: 146612 - DNA, 25 bp, Homo sapien
aggatacagagtgttgctgtcctca

SEQ ID NO: 146613 - DNA, 25 bp, Homo sapien
gttgctgtcctcagggaggtccgat

SEQ ID NO: 146614 - DNA, 25 bp, Homo sapien
aaagggctttagagtgagacagacc

SEQ ID NO: 146615 - DNA, 25 bp, Homo sapien
tctgccatttaattagctgcatatc

SEQ ID NO: 146616 - DNA, 25 bp, Homo sapien
tagctgcatatcaccttagggtaca

SEQ ID NO: 146617 - DNA, 25 bp, Homo sapien
ttagggtacagcacttaacgcaatc

SEQ ID NO: 146618 - DNA, 25 bp, Homo sapien
aacgcaatctgcctcaatttcttca

SEQ ID NO: 146619 - DNA, 25 bp, Homo sapien
ggaaccaattctgcttggctacaga

SEQ ID NO: 146620 - DNA, 25 bp, Homo sapien
tctggatggagccaggcatcggcaa

SEQ ID NO: 146621 - DNA, 25 bp, Homo sapien
atcggcaagggctctcgggagctgc

SEQ ID NO: 146622 - DNA, 25 bp, Homo sapien
ctcgggagctgctgccgtcagactc

SEQ ID NO: 146623 - DNA, 25 bp, Homo sapien
tgcctcaagcctgagtggaagcacc

SEQ ID NO: 146624 - DNA, 25 bp, Homo sapien
gtgcacgtgactgccctctgtggaa

SEQ ID NO: 146625 - DNA, 25 bp, Homo sapien
ctctgtggaagccagcttaaaccct

SEQ ID NO: 146626 - DNA, 25 bp, Homo sapien
gtggaagccagcttaaaccctagcc

SEQ ID NO: 146627 - DNA, 25 bp, Homo sapien
agcttaaaccctagccctgtgagag

SEQ ID NO: 146628 - DNA, 25 bp, Homo sapien
taaaccctagccctgtgagagcttc

SEQ ID NO: 146629 - DNA, 25 bp, Homo sapien
gccctgtgagagcttcctgtgccca

SEQ ID NO: 146630 - DNA, 25 bp, Homo sapien
atcaggaaggctctccagccccatg

SEQ ID NO: 146631 - DNA, 25 bp, Homo sapien
ccaagtaagacatctcaaatacagt

SEQ ID NO: 146632 - DNA, 25 bp, Homo sapien
aagtaagacatctcaaatacagtag

SEQ ID NO: 146633 - DNA, 25 bp, Homo sapien
gtaagacatctcaaatacagtagta

SEQ ID NO: 146634 - DNA, 25 bp, Homo sapien
aagacatctcaaatacagtagtata

SEQ ID NO: 146635 - DNA, 25 bp, Homo sapien
agacatctcaaatacagtagtataa

SEQ ID NO: 146636 - DNA, 25 bp, Homo sapien
ctcttactttttgtaaatgctgtaa

SEQ ID NO: 146637 - DNA, 25 bp, Homo sapien
ataaattaacaaagtgtcactccat

SEQ ID NO: 146638 - DNA, 25 bp, Homo sapien
aattaacaaagtgtcactccataaa

SEQ ID NO: 146639 - DNA, 25 bp, Homo sapien
acaaagtgtcactccataaaaagaa

SEQ ID NO: 146640 - DNA, 25 bp, Homo sapien
aaagtgtcactccataaaaagaaag

SEQ ID NO: 146641 - DNA, 25 bp, Homo sapien
actaatagcctaaaagattttgtga

SEQ ID NO: 146642 - DNA, 25 bp, Homo sapien
attattcctttcagagtaacatgct

SEQ ID NO: 146643 - DNA, 25 bp, Homo sapien
gtattacttcaatccctatttttgt

SEQ ID NO: 146644 - DNA, 25 bp, Homo sapien
tacttcaatccctatttttgtctgt

SEQ ID NO: 146645 - DNA, 25 bp, Homo sapien
ttccattttctttggattccctatt

SEQ ID NO: 146646 - DNA, 25 bp, Homo sapien
tctttggattccctattcacattga

SEQ ID NO: 146647 - DNA, 25 bp, Homo sapien
ttcacattgaatcctttttgccctt

SEQ ID NO: 146648 - DNA, 25 bp, Homo sapien
tggtcatgttggtctttgtaacaaa

SEQ ID NO: 146649 - DNA, 25 bp, Homo sapien
ttatatccttctggacaactggagt

SEQ ID NO: 146650 - DNA, 25 bp, Homo sapien
gacaactggagtagtcttttaacga

SEQ ID NO: 146651 - DNA, 25 bp, Homo sapien
tttcttaatcatagagctttactca

SEQ ID NO: 146652 - DNA, 25 bp, Homo sapien
gagctttactcaagtagtattgttt

SEQ ID NO: 146653 - DNA, 25 bp, Homo sapien
ttatatactatttcccttgaaattt

SEQ ID NO: 146654 - DNA, 25 bp, Homo sapien
ctatattttctttacaggtatttat

SEQ ID NO: 146655 - DNA, 25 bp, Homo sapien
atataccaatgcttttatcaaacag

SEQ ID NO: 146656 - DNA, 25 bp, Homo sapien
caatgcttttatcaaacagaatttt

SEQ ID NO: 146657 - DNA, 25 bp, Homo sapien
gtacatgtatgtgttgtgatattaa

SEQ ID NO: 146658 - DNA, 25 bp, Homo sapien
agtgacatttgtctaatagcctaat

SEQ ID NO: 146659 - DNA, 25 bp, Homo sapien
gacatttgtctaatagcctaataca

SEQ ID NO: 146660 - DNA, 25 bp, Homo sapien
gtctaatagcctaatacaacatgta

SEQ ID NO: 146661 - DNA, 25 bp, Homo sapien
gcctaatacaacatgtagctgagtt

SEQ ID NO: 146662 - DNA, 25 bp, Homo sapien
agctgagtttaacatgtgtggtctt

SEQ ID NO: 146663 - DNA, 25 bp, Homo sapien
ctgagtttaacatgtgtggtcttgg

SEQ ID NO: 146664 - DNA, 25 bp, Homo sapien
tggacgtgaggaacgccattgtcct

SEQ ID NO: 146665 - DNA, 25 bp, Homo sapien
tgaggaacgccattgtcctcttctc

SEQ ID NO: 146666 - DNA, 25 bp, Homo sapien
ctgctgccggcgtcacgcaggagct

SEQ ID NO: 146667 - DNA, 25 bp, Homo sapien
ggcgtcacgcaggagctggccatct

SEQ ID NO: 146668 - DNA, 25 bp, Homo sapien
aacctgatgggctcctacaggtcgg

SEQ ID NO: 146669 - DNA, 25 bp, Homo sapien
gggcagcccgctcaggaggccaggg

SEQ ID NO: 146670 - DNA, 25 bp, Homo sapien
catcgacgcagacaccattgacatt

SEQ ID NO: 146671 - DNA, 25 bp, Homo sapien
cattgacatttacgcccgcgctgtg

SEQ ID NO: 146672 - DNA, 25 bp, Homo sapien
cgctgtgttccctgcggcgtttgcg

SEQ ID NO: 146673 - DNA, 25 bp, Homo sapien
cctgcggcgtttgcggccgtcaatg

SEQ ID NO: 146674 - DNA, 25 bp, Homo sapien
gtcaatgtcatctactgggcggcat

SEQ ID NO: 146675 - DNA, 25 bp, Homo sapien
gactaggttcagagaaccagggttc

SEQ ID NO: 146676 - DNA, 25 bp, Homo sapien
gaaccagggttcaaagcccagggat

SEQ ID NO: 146677 - DNA, 25 bp, Homo sapien
ccagggttcaaagcccagggatgca

SEQ ID NO: 146678 - DNA, 25 bp, Homo sapien
cagtgagttgagtcatgggatccca

SEQ ID NO: 146679 - DNA, 25 bp, Homo sapien
gagtcatgggatcccagactttttt

SEQ ID NO: 146680 - DNA, 25 bp, Homo sapien
atgtttgcaatgtttcccgtttaca

SEQ ID NO: 146681 - DNA, 25 bp, Homo sapien
gcaatgtttcccgtttacagaatgc

SEQ ID NO: 146682 - DNA, 25 bp, Homo sapien
gtttcccgtttacagaatgctacaa

SEQ ID NO: 146683 - DNA, 25 bp, Homo sapien
acaagaataatgtacgtactaccta

SEQ ID NO: 146684 - DNA, 25 bp, Homo sapien
gtacgtactacctaaaaggatgtct

SEQ ID NO: 146685 - DNA, 25 bp, Homo sapien
taagaaatagctacagtgacagatt

SEQ ID NO: 146686 - DNA, 25 bp, Homo sapien
gggatcacaaggtcactagatggcg

SEQ ID NO: 146687 - DNA, 25 bp, Homo sapien
ggatcacaaggtcactagatggcga

SEQ ID NO: 146688 - DNA, 25 bp, Homo sapien
gatcacaaggtcactagatggcgag

SEQ ID NO: 146689 - DNA, 25 bp, Homo sapien
tcacaaggtcactagatggcgagca

SEQ ID NO: 146690 - DNA, 25 bp, Homo sapien
cacaaggtcactagatggcgagcat

SEQ ID NO: 146691 - DNA, 25 bp, Homo sapien
acaaggtcactagatggcgagcatc

SEQ ID NO: 146692 - DNA, 25 bp, Homo sapien
aaggtcactagatggcgagcatcct

SEQ ID NO: 146693 - DNA, 25 bp, Homo sapien
aggtcactagatggcgagcatcctg

SEQ ID NO: 146694 - DNA, 25 bp, Homo sapien
tcactagatggcgagcatcctggcc

SEQ ID NO: 146695 - DNA, 25 bp, Homo sapien
cactagatggcgagcatcctggcca

SEQ ID NO: 146696 - DNA, 25 bp, Homo sapien
actagatggcgagcatcctggccaa

SEQ ID NO: 146697 - DNA, 25 bp, Homo sapien
gtaatctacataaatatacctcaga

SEQ ID NO: 146698 - DNA, 25 bp, Homo sapien
atacctcagaaatcatttttggtga

SEQ ID NO: 146699 - DNA, 25 bp, Homo sapien
gttttgtagaattgcacttcagttt

SEQ ID NO: 146700 - DNA, 25 bp, Homo sapien
tgtttaatggcttccaagagccttt

SEQ ID NO: 146701 - DNA, 25 bp, Homo sapien
ttaatggcttccaagagcctttttt

SEQ ID NO: 146702 - DNA, 25 bp, Homo sapien
atttcagagaaaattcaggtaccag

SEQ ID NO: 146703 - DNA, 25 bp, Homo sapien
tttcagagaaaattcaggtaccagg

SEQ ID NO: 146704 - DNA, 25 bp, Homo sapien
aaattcaggtaccaggatgcaatgg

SEQ ID NO: 146705 - DNA, 25 bp, Homo sapien
gggacctgtatttccatgtcaaatg

SEQ ID NO: 146706 - DNA, 25 bp, Homo sapien
tgtatttccatgtcaaatgttttca

SEQ ID NO: 146707 - DNA, 25 bp, Homo sapien
tattatggttattgtccgccatttt

SEQ ID NO: 146708 - DNA, 25 bp, Homo sapien
agatgacctcaagcagtttggccta

SEQ ID NO: 146709 - DNA, 25 bp, Homo sapien
gacctcaagcagtttggcctaacaa

SEQ ID NO: 146710 - DNA, 25 bp, Homo sapien
gcagtttggcctaacaaccagtatt

SEQ ID NO: 146711 - DNA, 25 bp, Homo sapien
taacaaccagtattccgttccgagg

SEQ ID NO: 146712 - DNA, 25 bp, Homo sapien
cagtattccgttccgaggttgcatc

SEQ ID NO: 146713 - DNA, 25 bp, Homo sapien
attccgttccgaggttgcatcagat

SEQ ID NO: 146714 - DNA, 25 bp, Homo sapien
gttgcatcagatccctgaagctcac

SEQ ID NO: 146715 - DNA, 25 bp, Homo sapien
gcatcagatccctgaagctcaccaa

SEQ ID NO: 146716 - DNA, 25 bp, Homo sapien
caagccactggaggttaattttgcc

SEQ ID NO: 146717 - DNA, 25 bp, Homo sapien
tgtatcatgcccagccaactaataa

SEQ ID NO: 146718 - DNA, 25 bp, Homo sapien
gagtctgtcaaaacaagtatatcaa

SEQ ID NO: 146719 - DNA, 25 bp, Homo sapien
ctttatatactattcccaccatggg

SEQ ID NO: 146720 - DNA, 25 bp, Homo sapien
tttcaaaggtggagcgtgataccag

SEQ ID NO: 146721 - DNA, 25 bp, Homo sapien
gtggagcgtgataccagaaggatcc

SEQ ID NO: 146722 - DNA, 25 bp, Homo sapien
agaaggatccagtattcagtcactt

SEQ ID NO: 146723 - DNA, 25 bp, Homo sapien
ggatccagtattcagtcacttaaat

SEQ ID NO: 146724 - DNA, 25 bp, Homo sapien
atatctatttgagtgaaaccttgtg

SEQ ID NO: 146725 - DNA, 25 bp, Homo sapien
tttgagtgaaaccttgtgaaccttt

SEQ ID NO: 146726 - DNA, 25 bp, Homo sapien
gagtgaaaccttgtgaacctttaat

SEQ ID NO: 146727 - DNA, 25 bp, Homo sapien
tgaaaccttgtgaacctttaattag

SEQ ID NO: 146728 - DNA, 25 bp, Homo sapien
ccttgtgaacctttaattagagtct

SEQ ID NO: 146729 - DNA, 25 bp, Homo sapien
gaacctttaattagagtcttcttgt

SEQ ID NO: 146730 - DNA, 25 bp, Homo sapien
tgagcaggaagacatttctctttcc

SEQ ID NO: 146731 - DNA, 25 bp, Homo sapien
gagcaggaagacatttctctttcct

SEQ ID NO: 146732 - DNA, 25 bp, Homo sapien
agcaggaagacatttctctttcctt

SEQ ID NO: 146733 - DNA, 25 bp, Homo sapien
gcaggaagacatttctctttccttt

SEQ ID NO: 146734 - DNA, 25 bp, Homo sapien
caggaagacatttctctttccttta

SEQ ID NO: 146735 - DNA, 25 bp, Homo sapien
ttctctttcctttatgccatttttt

SEQ ID NO: 146736 - DNA, 25 bp, Homo sapien
atttgcaaaagatcttgtattcctt

SEQ ID NO: 146737 - DNA, 25 bp, Homo sapien
gcaaaagatcttgtattcctttttt

SEQ ID NO: 146738 - DNA, 25 bp, Homo sapien
aaatgctaggtttgtagaggcttac

SEQ ID NO: 146739 - DNA, 25 bp, Homo sapien
atgctaggtttgtagaggcttactt

SEQ ID NO: 146740 - DNA, 25 bp, Homo sapien
tgctaggtttgtagaggcttactta

SEQ ID NO: 146741 - DNA, 25 bp, Homo sapien
ttggccatctccctttgggaactag

SEQ ID NO: 146742 - DNA, 25 bp, Homo sapien
gccagggcagatgtatgcattcctt

SEQ ID NO: 146743 - DNA, 25 bp, Homo sapien
tccctgtaaatgtgggactacaaga

SEQ ID NO: 146744 - DNA, 25 bp, Homo sapien
gaggagctgcctgagtggtactttc

SEQ ID NO: 146745 - DNA, 25 bp, Homo sapien
agtggtactttctcttcctggtaat

SEQ ID NO: 146746 - DNA, 25 bp, Homo sapien
gcagaatagaggtatttttaggcta

SEQ ID NO: 146747 - DNA, 25 bp, Homo sapien
ggctatttttgtaatatggcttctg

SEQ ID NO: 146748 - DNA, 25 bp, Homo sapien
atggcttctggtcaaaatccctgtg

SEQ ID NO: 146749 - DNA, 25 bp, Homo sapien
gcttctggtcaaaatccctgtgtag

SEQ ID NO: 146750 - DNA, 25 bp, Homo sapien
atccctgtgtagctgaattcccaag

SEQ ID NO: 146751 - DNA, 25 bp, Homo sapien
tgtagctgaattcccaagccctgca

SEQ ID NO: 146752 - DNA, 25 bp, Homo sapien
caccatcagtactccattcttcatt

SEQ ID NO: 146753 - DNA, 25 bp, Homo sapien
accatcagtactccattcttcattt

SEQ ID NO: 146754 - DNA, 25 bp, Homo sapien
ccatcagtactccattcttcatttt

SEQ ID NO: 146755 - DNA, 25 bp, Homo sapien
catcagtactccattcttcatttta

SEQ ID NO: 146756 - DNA, 25 bp, Homo sapien
atcagtactccattcttcattttaa

SEQ ID NO: 146757 - DNA, 25 bp, Homo sapien
tcagtactccattcttcattttaaa

SEQ ID NO: 146758 - DNA, 25 bp, Homo sapien
cagtactccattcttcattttaaaa

SEQ ID NO: 146759 - DNA, 25 bp, Homo sapien
ttaaaaaataagatgggctgggcac

SEQ ID NO: 146760 - DNA, 25 bp, Homo sapien
agtggcttacgcctttaatatcagt

SEQ ID NO: 146761 - DNA, 25 bp, Homo sapien
ggcttacgcctttaatatcagtact

SEQ ID NO: 146762 - DNA, 25 bp, Homo sapien
cttacgcctttaatatcagtacttt

SEQ ID NO: 146763 - DNA, 25 bp, Homo sapien
gagatccagttctctcaggacggta

SEQ ID NO: 146764 - DNA, 25 bp, Homo sapien
tcaggacggtaaggcgtacaccccg

SEQ ID NO: 146765 - DNA, 25 bp, Homo sapien
gtacaccccggtcagcaggaagcca

SEQ ID NO: 146766 - DNA, 25 bp, Homo sapien
cagcaggaagccatcgaccttcaac

SEQ ID NO: 146767 - DNA, 25 bp, Homo sapien
gaccttcaacctctttgtgttcagc

SEQ ID NO: 146768 - DNA, 25 bp, Homo sapien
cagacacaggtgctgtctctggctc

SEQ ID NO: 146769 - DNA, 25 bp, Homo sapien
gtctctggctcctaccgagttcgag

SEQ ID NO: 146770 - DNA, 25 bp, Homo sapien
gagttcgagccctggactactgggc

SEQ ID NO: 146771 - DNA, 25 bp, Homo sapien
tctcggaccctgtgccgtacctgga

SEQ ID NO: 146772 - DNA, 25 bp, Homo sapien
ccgggcaatccatgagcctgtgctg

SEQ ID NO: 146773 - DNA, 25 bp, Homo sapien
agtgggttgcacctccaccggcagt

SEQ ID NO: 146774 - DNA, 25 bp, Homo sapien
gacagttgaggttgtagatacactt

SEQ ID NO: 146775 - DNA, 25 bp, Homo sapien
acagcaagtgatttcagaatgttgt

SEQ ID NO: 146776 - DNA, 25 bp, Homo sapien
aatgttgtaggcctcattagagctt

SEQ ID NO: 146777 - DNA, 25 bp, Homo sapien
ggcctcattagagcttggtctccaa

SEQ ID NO: 146778 - DNA, 25 bp, Homo sapien
gcttggtctccaaaaatctgtttga

SEQ ID NO: 146779 - DNA, 25 bp, Homo sapien
gaaaaaagcaacatgttcttcacag

SEQ ID NO: 146780 - DNA, 25 bp, Homo sapien
tcttcacagtgttcccctagaaagg

SEQ ID NO: 146781 - DNA, 25 bp, Homo sapien
gaagagatttaattgccagttagat

SEQ ID NO: 146782 - DNA, 25 bp, Homo sapien
gggacaaagaaagcatctcgtaggt

SEQ ID NO: 146783 - DNA, 25 bp, Homo sapien
gcatctcgtaggtgtgtctactggg

SEQ ID NO: 146784 - DNA, 25 bp, Homo sapien
taggtgtgtctactgggttttaact

SEQ ID NO: 146785 - DNA, 25 bp, Homo sapien
ggactccatgttaaagtacttgcag

SEQ ID NO: 146786 - DNA, 25 bp, Homo sapien
cttgcagaggaagatcgatgagttc

SEQ ID NO: 146787 - DNA, 25 bp, Homo sapien
atgagttctgagtgtcgggctgccc

SEQ ID NO: 146788 - DNA, 25 bp, Homo sapien
tgcccactggtgacaccgggatcgg

SEQ ID NO: 146789 - DNA, 25 bp, Homo sapien
aggagaacatcaccggctccagttc

SEQ ID NO: 146790 - DNA, 25 bp, Homo sapien
tgatccattctcacagcctgaaaca

SEQ ID NO: 146791 - DNA, 25 bp, Homo sapien
cagcctgaaacaagctcacccgtag

SEQ ID NO: 146792 - DNA, 25 bp, Homo sapien
tcacccgtagcttacgcttggaagc

SEQ ID NO: 146793 - DNA, 25 bp, Homo sapien
aagcaggactgggaacatccacgct

SEQ ID NO: 146794 - DNA, 25 bp, Homo sapien
tgggaacatccacgctatttattat

SEQ ID NO: 146795 - DNA, 25 bp, Homo sapien
ccacgctatttattatcgaggagtt

SEQ ID NO: 146796 - DNA, 25 bp, Homo sapien
agggacaatttgctgccaaacaccc

SEQ ID NO: 146797 - DNA, 25 bp, Homo sapien
gggctcctcgtatgcatggaacccc

SEQ ID NO: 146798 - DNA, 25 bp, Homo sapien
gaataaatatgctcagccaccctgt

SEQ ID NO: 146799 - DNA, 25 bp, Homo sapien
tgtgggccgggcaatccagacagca

SEQ ID NO: 146800 - DNA, 25 bp, Homo sapien
gacagcaggcataaggcaccagtta

SEQ ID NO: 146801 - DNA, 25 bp, Homo sapien
aaggcaccagttaccctgcatgttg

SEQ ID NO: 146802 - DNA, 25 bp, Homo sapien
tgcatgttggcccagacctcaggtg

SEQ ID NO: 146803 - DNA, 25 bp, Homo sapien
ggcccagacctcaggtgctagggaa

SEQ ID NO: 146804 - DNA, 25 bp, Homo sapien
ggaaccttgggttgagtaatgctcg

SEQ ID NO: 146805 - DNA, 25 bp, Homo sapien
gagtaatgctcgtctgtgtgtttta

SEQ ID NO: 146806 - DNA, 25 bp, Homo sapien
tgtgtgttttagtttcatcacctgt

SEQ ID NO: 146807 - DNA, 25 bp, Homo sapien
gaaggagagcataggaaaccacaca

SEQ ID NO: 146808 - DNA, 25 bp, Homo sapien
gaaaccacacagacttgggcagggt

SEQ ID NO: 146809 - DNA, 25 bp, Homo sapien
gacttgggcagggtacagacactcc

SEQ ID NO: 146810 - DNA, 25 bp, Homo sapien
tacagacactcccacttggcatcat

SEQ ID NO: 146811 - DNA, 25 bp, Homo sapien
tcccacttggcatcattcacagcaa

SEQ ID NO: 146812 - DNA, 25 bp, Homo sapien
tcactggccagtggctggatctgtg

SEQ ID NO: 146813 - DNA, 25 bp, Homo sapien
gggctctctcatgatagaaggctat

SEQ ID NO: 146814 - DNA, 25 bp, Homo sapien
tgtggacacattggacctttcctga

SEQ ID NO: 146815 - DNA, 25 bp, Homo sapien
agagggactgttcttttgtcccaga

SEQ ID NO: 146816 - DNA, 25 bp, Homo sapien
gtcccagaaaagcagtggctccatt

SEQ ID NO: 146817 - DNA, 25 bp, Homo sapien
gacatacatccaacattaaaagcca

SEQ ID NO: 146818 - DNA, 25 bp, Homo sapien
aggcctggtgtcatgctataagtat

SEQ ID NO: 146819 - DNA, 25 bp, Homo sapien
ggtgtcatgctataagtatgtacat

SEQ ID NO: 146820 - DNA, 25 bp, Homo sapien
gtatgtacatacagtttcacttcaa

SEQ ID NO: 146821 - DNA, 25 bp, Homo sapien
gtacatacagtttcacttcaaaaat

SEQ ID NO: 146822 - DNA, 25 bp, Homo sapien
aatccctaaaaactctctatactct

SEQ ID NO: 146823 - DNA, 25 bp, Homo sapien
actctctatactctctataacaata

SEQ ID NO: 146824 - DNA, 25 bp, Homo sapien
aatactttatcaagaactctggaca

SEQ ID NO: 146825 - DNA, 25 bp, Homo sapien
gaactctggacaatggtattatttt

SEQ ID NO: 146826 - DNA, 25 bp, Homo sapien
ctaaaaaaactctgactattcccat

SEQ ID NO: 146827 - DNA, 25 bp, Homo sapien
agtttagcattacattgtcttgagc

SEQ ID NO: 146828 - DNA, 25 bp, Homo sapien
gcattacattgtcttgagcaccaga

SEQ ID NO: 146829 - DNA, 25 bp, Homo sapien
gcagtttcaaacgtaatagcattaa

SEQ ID NO: 146830 - DNA, 25 bp, Homo sapien
gatcgtgtgaagcttgcttgctttc

SEQ ID NO: 146831 - DNA, 25 bp, Homo sapien
taaaatcaacttaacatgggctctt

SEQ ID NO: 146832 - DNA, 25 bp, Homo sapien
taacatgggctcttcactagtgacc

SEQ ID NO: 146833 - DNA, 25 bp, Homo sapien
ctgcacttcctgttttataatgaac

SEQ ID NO: 146834 - DNA, 25 bp, Homo sapien
ataatgaacccatccggtttgccat

SEQ ID NO: 146835 - DNA, 25 bp, Homo sapien
ttgccatgttgccagatgatcaact

SEQ ID NO: 146836 - DNA, 25 bp, Homo sapien
gatgatcaactcttcgaagccttgc

SEQ ID NO: 146837 - DNA, 25 bp, Homo sapien
caactcttcgaagccttgcctaaat

SEQ ID NO: 146838 - DNA, 25 bp, Homo sapien
gccttgcctaaatttaatgctgcct

SEQ ID NO: 146839 - DNA, 25 bp, Homo sapien
ttttcttctacttttggcgtgtatc

SEQ ID NO: 146840 - DNA, 25 bp, Homo sapien
tcctgtaccgtaagttcaccaccga

SEQ ID NO: 146841 - DNA, 25 bp, Homo sapien
agctctccaacacggaggcaatcga

SEQ ID NO: 146842 - DNA, 25 bp, Homo sapien
ccaacacggaggcaatcgactgcat

SEQ ID NO: 146843 - DNA, 25 bp, Homo sapien
acacggaggcaatcgactgcatcac

SEQ ID NO: 146844 - DNA, 25 bp, Homo sapien
ggaggcaatcgactgcatcacgcag

SEQ ID NO: 146845 - DNA, 25 bp, Homo sapien
ggcaatcgactgcatcacgcaggga

SEQ ID NO: 146846 - DNA, 25 bp, Homo sapien
atcgactgcatcacgcagggacgtg

SEQ ID NO: 146847 - DNA, 25 bp, Homo sapien
actgcatcacgcagggacgtgagtt

SEQ ID NO: 146848 - DNA, 25 bp, Homo sapien
cagggacgtgagttggagcggccac

SEQ ID NO: 146849 - DNA, 25 bp, Homo sapien
accagaggtctacgccatcatgcgg

SEQ ID NO: 146850 - DNA, 25 bp, Homo sapien
ccagcaacgccacagcatcaaggat

SEQ ID NO: 146851 - DNA, 25 bp, Homo sapien
agtgctcttgctgggccaggtcaga

SEQ ID NO: 146852 - DNA, 25 bp, Homo sapien
gccaggtcagaagcgcactgcggac

SEQ ID NO: 146853 - DNA, 25 bp, Homo sapien
tcgagatcctagagcctgacgttca

SEQ ID NO: 146854 - DNA, 25 bp, Homo sapien
gcctgacgttcagtgaacccatgtt

SEQ ID NO: 146855 - DNA, 25 bp, Homo sapien
acccatgtttctgggtgggtgaaag

SEQ ID NO: 146856 - DNA, 25 bp, Homo sapien
gggacttgtgccagcagaacatgtg

SEQ ID NO: 146857 - DNA, 25 bp, Homo sapien
catccgcagcccagggtagggagaa

SEQ ID NO: 146858 - DNA, 25 bp, Homo sapien
gggagagttcttgctctcgacctag

SEQ ID NO: 146859 - DNA, 25 bp, Homo sapien
ttgctctcgacctagtggtttctac

SEQ ID NO: 146860 - DNA, 25 bp, Homo sapien
tagtggtttctactctcaccgactt

SEQ ID NO: 146861 - DNA, 25 bp, Homo sapien
ctctcaccgacttattctgatttca

SEQ ID NO: 146862 - DNA, 25 bp, Homo sapien
aaacagaggcccgacgaatggtgat

SEQ ID NO: 146863 - DNA, 25 bp, Homo sapien
gaaaggcaggctctgttacctctct

SEQ ID NO: 146864 - DNA, 25 bp, Homo sapien
aggctctgttacctctctaaggaga

SEQ ID NO: 146865 - DNA, 25 bp, Homo sapien
aggagagctaccaggttgtcaccgc

SEQ ID NO: 146866 - DNA, 25 bp, Homo sapien
ttgtcaccgcagtctgctaaccaat

SEQ ID NO: 146867 - DNA, 25 bp, Homo sapien
tgctaaccaattccagtctggtcca

SEQ ID NO: 146868 - DNA, 25 bp, Homo sapien
aaggtagatctgagctcatctcgct

SEQ ID NO: 146869 - DNA, 25 bp, Homo sapien
agctcatctcgctgatggacattca

SEQ ID NO: 146870 - DNA, 25 bp, Homo sapien
aagcactgtgcaactgtactgtaac

SEQ ID NO: 146871 - DNA, 25 bp, Homo sapien
ctgtactgtaacaccatctcttttg

SEQ ID NO: 146872 - DNA, 25 bp, Homo sapien
aaatgacctggtatcttgccagagg

SEQ ID NO: 146873 - DNA, 25 bp, Homo sapien
aaaagcatataccaccttagttcat

SEQ ID NO: 146874 - DNA, 25 bp, Homo sapien
gcatataccaccttagttcattcat

SEQ ID NO: 146875 - DNA, 25 bp, Homo sapien
agttcattcatgtatcctggtaaag

SEQ ID NO: 146876 - DNA, 25 bp, Homo sapien
gtatcctggtaaagcatcttaatca

SEQ ID NO: 146877 - DNA, 25 bp, Homo sapien
atatttcttagacgttttgggacag

SEQ ID NO: 146878 - DNA, 25 bp, Homo sapien
aatgcattagtatgtttgccttaaa

SEQ ID NO: 146879 - DNA, 25 bp, Homo sapien
tgccttaaacttgtagactaaacca

SEQ ID NO: 146880 - DNA, 25 bp, Homo sapien
aataaacagcgataacagtgatagt

SEQ ID NO: 146881 - DNA, 25 bp, Homo sapien
agtgatagtttttaactctatggtc

SEQ ID NO: 146882 - DNA, 25 bp, Homo sapien
ctatggtcattgtatcactctggaa

SEQ ID NO: 146883 - DNA, 25 bp, Homo sapien
tggtcattgtatcactctggaaaat

SEQ ID NO: 146884 - DNA, 25 bp, Homo sapien
tttcaaaggtggagcgtgataccag

SEQ ID NO: 146885 - DNA, 25 bp, Homo sapien
gtggagcgtgataccagaaggatcc

SEQ ID NO: 146886 - DNA, 25 bp, Homo sapien
atatctatttgagtgaaaccttgtg

SEQ ID NO: 146887 - DNA, 25 bp, Homo sapien
ctatttgagtgaaaccttgtgaacc

SEQ ID NO: 146888 - DNA, 25 bp, Homo sapien
atttgagtgaaaccttgtgaacctt

SEQ ID NO: 146889 - DNA, 25 bp, Homo sapien
ttgagtgaaaccttgtgaaccttta

SEQ ID NO: 146890 - DNA, 25 bp, Homo sapien
gagtgaaaccttgtgaacctttaat

SEQ ID NO: 146891 - DNA, 25 bp, Homo sapien
tgaaaccttgtgaacctttaattag

SEQ ID NO: 146892 - DNA, 25 bp, Homo sapien
ccttgtgaacctttaattagagtct

SEQ ID NO: 146893 - DNA, 25 bp, Homo sapien
gtgaacctttaattagagtcttctt

SEQ ID NO: 146894 - DNA, 25 bp, Homo sapien
gaacctttaattagagtcttcttgt

SEQ ID NO: 146895 - DNA, 25 bp, Homo sapien
actgtactaggcgtgagaagcatat

SEQ ID NO: 146896 - DNA, 25 bp, Homo sapien
caagaaagagataccaagatgccat

SEQ ID NO: 146897 - DNA, 25 bp, Homo sapien
tgccatctgtgtcctggttagcaga

SEQ ID NO: 146898 - DNA, 25 bp, Homo sapien
tgtcctggttagcagagctggacca

SEQ ID NO: 146899 - DNA, 25 bp, Homo sapien
gctgtgtggttgacttatgggccca

SEQ ID NO: 146900 - DNA, 25 bp, Homo sapien
tggttgacttatgggcccagccagc

SEQ ID NO: 146901 - DNA, 25 bp, Homo sapien
ttcctcaccctgatttcttgcttat

SEQ ID NO: 146902 - DNA, 25 bp, Homo sapien
gatttcttgcttattcactgaagtt

SEQ ID NO: 146903 - DNA, 25 bp, Homo sapien
cactgaagttctcctgaagaggaac

SEQ ID NO: 146904 - DNA, 25 bp, Homo sapien
aactgggcctgttgccctttctgta

SEQ ID NO: 146905 - DNA, 25 bp, Homo sapien
taccatttatttgctcccaatgttt

SEQ ID NO: 146906 - DNA, 25 bp, Homo sapien
tgtacaaatacaagctcctgccacg

SEQ ID NO: 146907 - DNA, 25 bp, Homo sapien
aagctcctgccacggtcttgaagtt

SEQ ID NO: 146908 - DNA, 25 bp, Homo sapien
gccacggtcttgaagttctgttctt

SEQ ID NO: 146909 - DNA, 25 bp, Homo sapien
gaagttctgttcttatgctctctgc

SEQ ID NO: 146910 - DNA, 25 bp, Homo sapien
gctctctgctcactggttttcaata

SEQ ID NO: 146911 - DNA, 25 bp, Homo sapien
tggttttcaataccaccaagaggaa

SEQ ID NO: 146912 - DNA, 25 bp, Homo sapien
ttggcttaattccaatcattgttaa

SEQ ID NO: 146913 - DNA, 25 bp, Homo sapien
attaatttcagtaagatcaagctcc

SEQ ID NO: 146914 - DNA, 25 bp, Homo sapien
cttatttgtcagtgtagatcaactc

SEQ ID NO: 146915 - DNA, 25 bp, Homo sapien
gtcagtgtagatcaactcatgttaa

SEQ ID NO: 146916 - DNA, 25 bp, Homo sapien
tagaataaagccttgtgatcacttt

SEQ ID NO: 146917 - DNA, 25 bp, Homo sapien
gtctgtgctgtgagagtcgccgctc

SEQ ID NO: 146918 - DNA, 25 bp, Homo sapien
tgtgctgtgagagtcgccgctcgct

SEQ ID NO: 146919 - DNA, 25 bp, Homo sapien
gggacacagctacacgcccattaaa

SEQ ID NO: 146920 - DNA, 25 bp, Homo sapien
ggacacagctacacgcccattaaag

SEQ ID NO: 146921 - DNA, 25 bp, Homo sapien
cagctacacgcccattaaagcacag

SEQ ID NO: 146922 - DNA, 25 bp, Homo sapien
tacacgcccattaaagcacagcacg

SEQ ID NO: 146923 - DNA, 25 bp, Homo sapien
gcccattaaagcacagcacgtcctg

SEQ ID NO: 146924 - DNA, 25 bp, Homo sapien
ccattaaagcacagcacgtcctggg

SEQ ID NO: 146925 - DNA, 25 bp, Homo sapien
tttctctgtaattccgtgttttcgc

SEQ ID NO: 146926 - DNA, 25 bp, Homo sapien
ctctgtaattccgtgttttcgcttt

SEQ ID NO: 146927 - DNA, 25 bp, Homo sapien
tctgtaattccgtgttttcgctttt

SEQ ID NO: 146928 - DNA, 25 bp, Homo sapien
ggctgacatcccctacgaggacatc

SEQ ID NO: 146929 - DNA, 25 bp, Homo sapien
tgacatcccctacgaggacatcata

SEQ ID NO: 146930 - DNA, 25 bp, Homo sapien
gacatcccctacgaggacatcatag

SEQ ID NO: 146931 - DNA, 25 bp, Homo sapien
acatcccctacgaggacatcatagc

SEQ ID NO: 146932 - DNA, 25 bp, Homo sapien
ccctacgaggacatcatagccactg

SEQ ID NO: 146933 - DNA, 25 bp, Homo sapien
cctacgaggacatcatagccactga

SEQ ID NO: 146934 - DNA, 25 bp, Homo sapien
tacgaggacatcatagccactgaga

SEQ ID NO: 146935 - DNA, 25 bp, Homo sapien
acgaggacatcatagccactgagat

SEQ ID NO: 146936 - DNA, 25 bp, Homo sapien
cgaggacatcatagccactgagatc

SEQ ID NO: 146937 - DNA, 25 bp, Homo sapien
gaggacatcatagccactgagatct

SEQ ID NO: 146938 - DNA, 25 bp, Homo sapien
ggacatcatagccactgagatctga

SEQ ID NO: 146939 - DNA, 25 bp, Homo sapien
gagaaacactagtgatgtgcatggt

SEQ ID NO: 146940 - DNA, 25 bp, Homo sapien
tatcccatttattatttgtggcacc

SEQ ID NO: 146941 - DNA, 25 bp, Homo sapien
tttgtggcacctatatcaatgtggg

SEQ ID NO: 146942 - DNA, 25 bp, Homo sapien
aggtgagaaatatttgcttggagaa

SEQ ID NO: 146943 - DNA, 25 bp, Homo sapien
ggagaagctcttgtgcaattagcct

SEQ ID NO: 146944 - DNA, 25 bp, Homo sapien
gctcttgtgcaattagcctggcaat

SEQ ID NO: 146945 - DNA, 25 bp, Homo sapien
ttagcctggcaatgattggccggcc

SEQ ID NO: 146946 - DNA, 25 bp, Homo sapien
gattggccggccatgtttgaatgcc

SEQ ID NO: 146947 - DNA, 25 bp, Homo sapien
gccatgtttgaatgccagtttctct

SEQ ID NO: 146948 - DNA, 25 bp, Homo sapien
atgccagtttctcttctttgctgaa

SEQ ID NO: 146949 - DNA, 25 bp, Homo sapien
aaagtaagcctagacataaaatctg

SEQ ID NO: 146950 - DNA, 25 bp, Homo sapien
gaattggtccatttcttacaagtca

SEQ ID NO: 146951 - DNA, 25 bp, Homo sapien
acaagtcatgtatcccaaactgtgt

SEQ ID NO: 146952 - DNA, 25 bp, Homo sapien
ccaaactgtgtcagcactggcaagt

SEQ ID NO: 146953 - DNA, 25 bp, Homo sapien
gcaagtgatctggatgatggctgca

SEQ ID NO: 146954 - DNA, 25 bp, Homo sapien
tgatgctggtcttgactgttgtgct

SEQ ID NO: 146955 - DNA, 25 bp, Homo sapien
gggctctacaattcctataactctt

SEQ ID NO: 146956 - DNA, 25 bp, Homo sapien
ctataactcttgtgcagagcaggct

SEQ ID NO: 146957 - DNA, 25 bp, Homo sapien
tgatgggccccttggaagatccact

SEQ ID NO: 146958 - DNA, 25 bp, Homo sapien
agatccacttgctcggcagcccaga

SEQ ID NO: 146959 - DNA, 25 bp, Homo sapien
actcctggtggagctcaggactcca

SEQ ID NO: 146960 - DNA, 25 bp, Homo sapien
agcatgagcagcctacagagcagta

SEQ ID NO: 146961 - DNA, 25 bp, Homo sapien
acacactgagtgttgagttgccgtg

SEQ ID NO: 146962 - DNA, 25 bp, Homo sapien
taatgtatgacgctccactgtggat

SEQ ID NO: 146963 - DNA, 25 bp, Homo sapien
ctgtggatatctaatgccctgttga

SEQ ID NO: 146964 - DNA, 25 bp, Homo sapien
tgccctgttgagagtagccttgctc

SEQ ID NO: 146965 - DNA, 25 bp, Homo sapien
ccttgctcagtactaaaatgcccca

SEQ ID NO: 146966 - DNA, 25 bp, Homo sapien
tgccccaaagttctatacagcattt

SEQ ID NO: 146967 - DNA, 25 bp, Homo sapien
tacagcatttcctttatagcattca

SEQ ID NO: 146968 - DNA, 25 bp, Homo sapien
ttatagcattcaaacctcacatcct

SEQ ID NO: 146969 - DNA, 25 bp, Homo sapien
cacatcctcccttcagtttaatgca

SEQ ID NO: 146970 - DNA, 25 bp, Homo sapien
atgcaagtaagtcaggtttcacaag

SEQ ID NO: 146971 - DNA, 25 bp, Homo sapien
gaatttgaggttgatctggttttca

SEQ ID NO: 146972 - DNA, 25 bp, Homo sapien
aagtgtgccaaatcagtttgactac

SEQ ID NO: 146973 - DNA, 25 bp, Homo sapien
cagtttgactactctctgttttagt

SEQ ID NO: 146974 - DNA, 25 bp, Homo sapien
gactactctctgttttagtgtttat

SEQ ID NO: 146975 - DNA, 25 bp, Homo sapien
tatttttgtatttctctattttcat

SEQ ID NO: 146976 - DNA, 25 bp, Homo sapien
aaactcatttatctcctcttcatgg

SEQ ID NO: 146977 - DNA, 25 bp, Homo sapien
atttatctcctcttcatggcatctt

SEQ ID NO: 146978 - DNA, 25 bp, Homo sapien
ttatctcctcttcatggcatcttca

SEQ ID NO: 146979 - DNA, 25 bp, Homo sapien
catggcatcttcaatatgaatctat

SEQ ID NO: 146980 - DNA, 25 bp, Homo sapien
gtaacaatctatggcttatttctat

SEQ ID NO: 146981 - DNA, 25 bp, Homo sapien
ggcttatttctatgacaaattcaag

SEQ ID NO: 146982 - DNA, 25 bp, Homo sapien
atttgccacaaaacctgtattactg

SEQ ID NO: 146983 - DNA, 25 bp, Homo sapien
taaacccttgtgtatgtatcaccca

SEQ ID NO: 146984 - DNA, 25 bp, Homo sapien
gtatgtatcacccaactcactaatt

SEQ ID NO: 146985 - DNA, 25 bp, Homo sapien
atcacccaactcactaattatcaac

SEQ ID NO: 146986 - DNA, 25 bp, Homo sapien
aattatcaacttatgtgctatcaga

SEQ ID NO: 146987 - DNA, 25 bp, Homo sapien
tgtgctatcagatatcctctctacc

SEQ ID NO: 146988 - DNA, 25 bp, Homo sapien
ctctctaccctcacgttattttgaa

SEQ ID NO: 146989 - DNA, 25 bp, Homo sapien
ctttcatccataaaaatgtcagcat

SEQ ID NO: 146990 - DNA, 25 bp, Homo sapien
ggatggcctgtgattatcttgggaa

SEQ ID NO: 146991 - DNA, 25 bp, Homo sapien
ttatcttgggaagcagagtgattca

SEQ ID NO: 146992 - DNA, 25 bp, Homo sapien
caaacctggtgatggatcccttact

SEQ ID NO: 146993 - DNA, 25 bp, Homo sapien
ctggtgatggatcccttactattta

SEQ ID NO: 146994 - DNA, 25 bp, Homo sapien
gaaataaatcagtgtccgtttgcca

SEQ ID NO: 146995 - DNA, 25 bp, Homo sapien
aatcagtgtccgtttgccagtaata

SEQ ID NO: 146996 - DNA, 25 bp, Homo sapien
gtgtccgtttgccagtaataaattt

SEQ ID NO: 146997 - DNA, 25 bp, Homo sapien
tttgttttttaaggcaggtctgtca

SEQ ID NO: 146998 - DNA, 25 bp, Homo sapien
ggcaggtctgtcatttttgaatact

SEQ ID NO: 146999 - DNA, 25 bp, Homo sapien
gaatactgtaaaactgtgataaact

SEQ ID NO: 147000 - DNA, 25 bp, Homo sapien
agctgtattttaatatgaccgcttt

SEQ ID NO: 147001 - DNA, 25 bp, Homo sapien
aatatgaccgctttgaatccttaca

SEQ ID NO: 147002 - DNA, 25 bp, Homo sapien
gaccgctttgaatccttacatgaaa

SEQ ID NO: 147003 - DNA, 25 bp, Homo sapien
catgaaatgttctgggagttgttat

SEQ ID NO: 147004 - DNA, 25 bp, Homo sapien
gagttgttataaacacaccccaagg

SEQ ID NO: 147005 - DNA, 25 bp, Homo sapien
tatgggaaccgacagaacatgggct

SEQ ID NO: 147006 - DNA, 25 bp, Homo sapien
agaacatgggctgatcttcccacaa

SEQ ID NO: 147007 - DNA, 25 bp, Homo sapien
accacaggactgcagggtgcacaac

SEQ ID NO: 147008 - DNA, 25 bp, Homo sapien
gggtgcacaactccctgccaaggaa

SEQ ID NO: 147009 - DNA, 25 bp, Homo sapien
gcttcagctctgtacaacgagggca

SEQ ID NO: 147010 - DNA, 25 bp, Homo sapien
gatgctaaatcttgctttgcattca

SEQ ID NO: 147011 - DNA, 25 bp, Homo sapien
gtgtgtatttgtaccctagatgata

SEQ ID NO: 147012 - DNA, 25 bp, Homo sapien
gatgatatgaaccagcagtcttgtt

SEQ ID NO: 147013 - DNA, 25 bp, Homo sapien
agcagtcttgttttggcatcatcct

SEQ ID NO: 147014 - DNA, 25 bp, Homo sapien
gcatcatcctcatcatgttgtattc

SEQ ID NO: 147015 - DNA, 25 bp, Homo sapien
atgttgtattccagcttcttaagtg

SEQ ID NO: 147016 - DNA, 25 bp, Homo sapien
agcagatcttctttcgaagctatgc

SEQ ID NO: 147017 - DNA, 25 bp, Homo sapien
ttctttcgaagctatgcccaggtga

SEQ ID NO: 147018 - DNA, 25 bp, Homo sapien
cgaagctatgcccaggtgatgtgta

SEQ ID NO: 147019 - DNA, 25 bp, Homo sapien
ggtgatgtgtaggaagcccagcccc

SEQ ID NO: 147020 - DNA, 25 bp, Homo sapien
agcctttgccaggtatttccgctgt

SEQ ID NO: 147021 - DNA, 25 bp, Homo sapien
aggtatttccgctgtgcacgtggtg

SEQ ID NO: 147022 - DNA, 25 bp, Homo sapien
gtggtgctctcttgaacccctccag

SEQ ID NO: 147023 - DNA, 25 bp, Homo sapien
ctgccagctctggtaacttggttac

SEQ ID NO: 147024 - DNA, 25 bp, Homo sapien
ggttaccaaagatgccacagcacag

SEQ ID NO: 147025 - DNA, 25 bp, Homo sapien
agaaatatcgaccaacacctccctg

SEQ ID NO: 147026 - DNA, 25 bp, Homo sapien
acctccctggtcacatccatggaat

SEQ ID NO: 147027 - DNA, 25 bp, Homo sapien
acttatgaacctttacatccagata

SEQ ID NO: 147028 - DNA, 25 bp, Homo sapien
ctttacatccagataggttaccagt

SEQ ID NO: 147029 - DNA, 25 bp, Homo sapien
catccagataggttaccagtaacgg

SEQ ID NO: 147030 - DNA, 25 bp, Homo sapien
tatccagtactcctggttcctaggt

SEQ ID NO: 147031 - DNA, 25 bp, Homo sapien
gtactcctggttcctaggtgagcag

SEQ ID NO: 147032 - DNA, 25 bp, Homo sapien
tcctaggtgagcaggtgatgcccca

SEQ ID NO: 147033 - DNA, 25 bp, Homo sapien
gatgccccagggacctttgtagcca

SEQ ID NO: 147034 - DNA, 25 bp, Homo sapien
cagggacctttgtagccacttcact

SEQ ID NO: 147035 - DNA, 25 bp, Homo sapien
ttttctctgccttggtatagcatat

SEQ ID NO: 147036 - DNA, 25 bp, Homo sapien
gtaagtttatgcatacagtaatttt

SEQ ID NO: 147037 - DNA, 25 bp, Homo sapien
ttggacttaaaatctaattcaaact

SEQ ID NO: 147038 - DNA, 25 bp, Homo sapien
ggaactcgaaagcacagctcctccc

SEQ ID NO: 147039 - DNA, 25 bp, Homo sapien
cttgggaccatcttctcctgcagtc

SEQ ID NO: 147040 - DNA, 25 bp, Homo sapien
gccctgagggcattagctggtctaa

SEQ ID NO: 147041 - DNA, 25 bp, Homo sapien
gcattagctggtctaactgcccgga

SEQ ID NO: 147042 - DNA, 25 bp, Homo sapien
tagctggtctaactgcccggaggca

SEQ ID NO: 147043 - DNA, 25 bp, Homo sapien
tgggccttaggcacctcaaggactt

SEQ ID NO: 147044 - DNA, 25 bp, Homo sapien
ttaggcacctcaaggacttttctgc

SEQ ID NO: 147045 - DNA, 25 bp, Homo sapien
gcacctcaaggacttttctgctatt

SEQ ID NO: 147046 - DNA, 25 bp, Homo sapien
ggacttttctgctatttactgctct

SEQ ID NO: 147047 - DNA, 25 bp, Homo sapien
tttctgctatttactgctcttattg

SEQ ID NO: 147048 - DNA, 25 bp, Homo sapien
gctatttactgctcttattgttaag

SEQ ID NO: 147049 - DNA, 25 bp, Homo sapien
tcagtggcaaattccgggagcagtt

SEQ ID NO: 147050 - DNA, 25 bp, Homo sapien
gggagcagtttaaggctgccttctc

SEQ ID NO: 147051 - DNA, 25 bp, Homo sapien
gtttaaggctgccttctcctgctgc

SEQ ID NO: 147052 - DNA, 25 bp, Homo sapien
tgcggctctctgaaggcccctagtc

SEQ ID NO: 147053 - DNA, 25 bp, Homo sapien
agccacaagtccttgtccttgcaga

SEQ ID NO: 147054 - DNA, 25 bp, Homo sapien
aagtccttgtccttgcagagccgat

SEQ ID NO: 147055 - DNA, 25 bp, Homo sapien
ttgtccttgcagagccgatgctcca

SEQ ID NO: 147056 - DNA, 25 bp, Homo sapien
agagccgatgctccatctccaaaat

SEQ ID NO: 147057 - DNA, 25 bp, Homo sapien
catctccaaaatctctgagcatgtg

SEQ ID NO: 147058 - DNA, 25 bp, Homo sapien
ctacccctcatggaaagacagctgg

SEQ ID NO: 147059 - DNA, 25 bp, Homo sapien
ccctcatggaaagacagctggatgt

SEQ ID NO: 147060 - DNA, 25 bp, Homo sapien
tcgcatcttcccaaccccttaagcc

SEQ ID NO: 147061 - DNA, 25 bp, Homo sapien
ctgagtttccttttctcgtctctct

SEQ ID NO: 147062 - DNA, 25 bp, Homo sapien
ccttttctcgtctctctctttttat

SEQ ID NO: 147063 - DNA, 25 bp, Homo sapien
gacagagcctcgctcgttacccagg

SEQ ID NO: 147064 - DNA, 25 bp, Homo sapien
acagagcctcgctcgttacccaggg

SEQ ID NO: 147065 - DNA, 25 bp, Homo sapien
cagagcctcgctcgttacccagggt

SEQ ID NO: 147066 - DNA, 25 bp, Homo sapien
agagcctcgctcgttacccagggtg

SEQ ID NO: 147067 - DNA, 25 bp, Homo sapien
gagcctcgctcgttacccagggtgg

SEQ ID NO: 147068 - DNA, 25 bp, Homo sapien
agcctcgctcgttacccagggtgga

SEQ ID NO: 147069 - DNA, 25 bp, Homo sapien
gcctcgctcgttacccagggtggag

SEQ ID NO: 147070 - DNA, 25 bp, Homo sapien
cctcgctcgttacccagggtggagt

SEQ ID NO: 147071 - DNA, 25 bp, Homo sapien
gcattgaacttctttagtattatat

SEQ ID NO: 147072 - DNA, 25 bp, Homo sapien
ttgtaatcataaatactgctgtata

SEQ ID NO: 147073 - DNA, 25 bp, Homo sapien
gtaataaaactctgcacctaatccc

SEQ ID NO: 147074 - DNA, 25 bp, Homo sapien
acctaatccccataacttccagtat

SEQ ID NO: 147075 - DNA, 25 bp, Homo sapien
aacttccagtatcattttccaatta

SEQ ID NO: 147076 - DNA, 25 bp, Homo sapien
ttccaattaattatcaagtctgttt

SEQ ID NO: 147077 - DNA, 25 bp, Homo sapien
gaggacatttatgatgcagcagatg

SEQ ID NO: 147078 - DNA, 25 bp, Homo sapien
tatgatgcagcagatgttgactaaa

SEQ ID NO: 147079 - DNA, 25 bp, Homo sapien
gcagatgttgactaaaggcttggtt

SEQ ID NO: 147080 - DNA, 25 bp, Homo sapien
ggcttggttggtagatattcaggaa

SEQ ID NO: 147081 - DNA, 25 bp, Homo sapien
ggtagatattcaggaaatgttcact

SEQ ID NO: 147082 - DNA, 25 bp, Homo sapien
gaacagtccacaggaagaggttgaa

SEQ ID NO: 147083 - DNA, 25 bp, Homo sapien
aagatagctgaccagctggaagagt

SEQ ID NO: 147084 - DNA, 25 bp, Homo sapien
ataaagagcttactggaatccagca

SEQ ID NO: 147085 - DNA, 25 bp, Homo sapien
gaatccagcagggttttctgcccaa

SEQ ID NO: 147086 - DNA, 25 bp, Homo sapien
ccaaggatttgcaagctgaagctct

SEQ ID NO: 147087 - DNA, 25 bp, Homo sapien
agctgaagctctctgcaaacttgat

SEQ ID NO: 147088 - DNA, 25 bp, Homo sapien
gaagctctctgcaaacttgatagga

SEQ ID NO: 147089 - DNA, 25 bp, Homo sapien
aaagccacaatagagcagtttatga

SEQ ID NO: 147090 - DNA, 25 bp, Homo sapien
tcttggaggagattgacacactgat

SEQ ID NO: 147091 - DNA, 25 bp, Homo sapien
attgacacactgatcctgccagaaa

SEQ ID NO: 147092 - DNA, 25 bp, Homo sapien
aattttcctactctcacactggttc

SEQ ID NO: 147093 - DNA, 25 bp, Homo sapien
tcctggaagcctgcactttccgtag

SEQ ID NO: 147094 - DNA, 25 bp, Homo sapien
aagcctgcactttccgtagacctta

SEQ ID NO: 147095 - DNA, 25 bp, Homo sapien
ctgcactttccgtagaccttaaaat

SEQ ID NO: 147096 - DNA, 25 bp, Homo sapien
gcactttccgtagaccttaaaatct

SEQ ID NO: 147097 - DNA, 25 bp, Homo sapien
ttccgtagaccttaaaatctcagag

SEQ ID NO: 147098 - DNA, 25 bp, Homo sapien
aaatctcagaggtagggctgccacc

SEQ ID NO: 147099 - DNA, 25 bp, Homo sapien
atctcagaggtagggctgccaccaa

SEQ ID NO: 147100 - DNA, 25 bp, Homo sapien
aggtagggctgccaccaaggtgaag

SEQ ID NO: 147101 - DNA, 25 bp, Homo sapien
ccaaggtgaagatgggaacgcagat

SEQ ID NO: 147102 - DNA, 25 bp, Homo sapien
gggaacgcagatgatccatgagttt

SEQ ID NO: 147103 - DNA, 25 bp, Homo sapien
cagatgatccatgagtttgccctgg

SEQ ID NO: 147104 - DNA, 25 bp, Homo sapien
ttggaaatcctagtttcctctcctt

SEQ ID NO: 147105 - DNA, 25 bp, Homo sapien
aatcctagtttcctctccttcgtat

SEQ ID NO: 147106 - DNA, 25 bp, Homo sapien
tctccttcgtatcccgagtctggga

SEQ ID NO: 147107 - DNA, 25 bp, Homo sapien
ttcgtatcccgagtctgggacacaa

SEQ ID NO: 147108 - DNA, 25 bp, Homo sapien
gagtctgggacacaaaactccgccc

SEQ ID NO: 147109 - DNA, 25 bp, Homo sapien
tcttcctgacgaaactggccccgga

SEQ ID NO: 147110 - DNA, 25 bp, Homo sapien
aaactggccccggatcagagcagga

SEQ ID NO: 147111 - DNA, 25 bp, Homo sapien
gatcagagcaggacctcccttccga

SEQ ID NO: 147112 - DNA, 25 bp, Homo sapien
catctcggagcatcccggaggaaat

SEQ ID NO: 147113 - DNA, 25 bp, Homo sapien
agcatcccggaggaaatctgcagag

SEQ ID NO: 147114 - DNA, 25 bp, Homo sapien
gtgggtgacaagagcctgatctctt

SEQ ID NO: 147115 - DNA, 25 bp, Homo sapien
cagagttgagcctggacttgaccaa

SEQ ID NO: 147116 - DNA, 25 bp, Homo sapien
tggacttgaccaattaattccctta

SEQ ID NO: 147117 - DNA, 25 bp, Homo sapien
tacctttcagcccaagatagctaca

SEQ ID NO: 147118 - DNA, 25 bp, Homo sapien
gatagctacatgtctttacttgctg

SEQ ID NO: 147119 - DNA, 25 bp, Homo sapien
gtgcctgattgatcctatctcttca

SEQ ID NO: 147120 - DNA, 25 bp, Homo sapien
atctcttcacccttcattctttcaa

SEQ ID NO: 147121 - DNA, 25 bp, Homo sapien
atgccatctatctcccaggacattt

SEQ ID NO: 147122 - DNA, 25 bp, Homo sapien
tcccaggacatttattcccttctat

SEQ ID NO: 147123 - DNA, 25 bp, Homo sapien
attcccttctattcaaggccagtta

SEQ ID NO: 147124 - DNA, 25 bp, Homo sapien
gacttgtttggacgcaaggtaccct

SEQ ID NO: 147125 - DNA, 25 bp, Homo sapien
tggacgcaaggtaccctttctcttt

SEQ ID NO: 147126 - DNA, 25 bp, Homo sapien
ttgagctggtaggatcacaataggc

SEQ ID NO: 147127 - DNA, 25 bp, Homo sapien
gagctggtaggatcacaataggcca

SEQ ID NO: 147128 - DNA, 25 bp, Homo sapien
ggtaggatcacaataggccacgaat

SEQ ID NO: 147129 - DNA, 25 bp, Homo sapien
taggatcacaataggccacgaattt

SEQ ID NO: 147130 - DNA, 25 bp, Homo sapien
atcacaataggccacgaatttgaga

SEQ ID NO: 147131 - DNA, 25 bp, Homo sapien
caataggccacgaatttgagaccag

SEQ ID NO: 147132 - DNA, 25 bp, Homo sapien
gcctggtaaaatagtgagacctcat

SEQ ID NO: 147133 - DNA, 25 bp, Homo sapien
aattagccacatgtgctggcactta

SEQ ID NO: 147134 - DNA, 25 bp, Homo sapien
attagccacatgtgctggcacttac

SEQ ID NO: 147135 - DNA, 25 bp, Homo sapien
tagccacatgtgctggcacttacct

SEQ ID NO: 147136 - DNA, 25 bp, Homo sapien
gccacatgtgctggcacttacctgt

SEQ ID NO: 147137 - DNA, 25 bp, Homo sapien
gcgcgggcaatcacgcggccggcat

SEQ ID NO: 147138 - DNA, 25 bp, Homo sapien
ggccggcatcctcacgctgggcaag

SEQ ID NO: 147139 - DNA, 25 bp, Homo sapien
tcacgctgggcaagcggaggtccgg

SEQ ID NO: 147140 - DNA, 25 bp, Homo sapien
gggcctccagggtcggctgcagcgc

SEQ ID NO: 147141 - DNA, 25 bp, Homo sapien
acgccgcgggcatcctgaccatggg

SEQ ID NO: 147142 - DNA, 25 bp, Homo sapien
aggacagtccgggatctgagtcgtt

SEQ ID NO: 147143 - DNA, 25 bp, Homo sapien
gacagtccgggatctgagtcgttct

SEQ ID NO: 147144 - DNA, 25 bp, Homo sapien
agtccgggatctgagtcgttcttcg

SEQ ID NO: 147145 - DNA, 25 bp, Homo sapien
gggatctgagtcgttcttcgggccc

SEQ ID NO: 147146 - DNA, 25 bp, Homo sapien
atctgagtcgttcttcgggccctgt

SEQ ID NO: 147147 - DNA, 25 bp, Homo sapien
ctgagtcgttcttcgggccctgtcc

SEQ ID NO: 147148 - DNA, 25 bp, Homo sapien
gagggcatgtgtagcagagaactta

SEQ ID NO: 147149 - DNA, 25 bp, Homo sapien
ttctcattcttttgccctgcatcct

SEQ ID NO: 147150 - DNA, 25 bp, Homo sapien
ctgcatcctgtcatttctgttcttg

SEQ ID NO: 147151 - DNA, 25 bp, Homo sapien
atcctgtcatttctgttcttgtccc

SEQ ID NO: 147152 - DNA, 25 bp, Homo sapien
ttcttgtccctcatacatctttgga

SEQ ID NO: 147153 - DNA, 25 bp, Homo sapien
tcatacatctttggagaaccgggct

SEQ ID NO: 147154 - DNA, 25 bp, Homo sapien
gagaaccgggctccagactttgttc

SEQ ID NO: 147155 - DNA, 25 bp, Homo sapien
ggctactcttgccttatggctctag

SEQ ID NO: 147156 - DNA, 25 bp, Homo sapien
ttgccttatggctctagtgtgtgac

SEQ ID NO: 147157 - DNA, 25 bp, Homo sapien
atggctctagtgtgtgacctacaga

SEQ ID NO: 147158 - DNA, 25 bp, Homo sapien
agtgtgtgacctacagagcatgctc

SEQ ID NO: 147159 - DNA, 25 bp, Homo sapien
acaattattgaagaggtggcgcccg

SEQ ID NO: 147160 - DNA, 25 bp, Homo sapien
ggcgcccgacggtagagttctttca

SEQ ID NO: 147161 - DNA, 25 bp, Homo sapien
cccgacggtagagttctttcatcta

SEQ ID NO: 147162 - DNA, 25 bp, Homo sapien
gatgcatggaaaacaaagtctccaa

SEQ ID NO: 147163 - DNA, 25 bp, Homo sapien
aagtctccaagaaaacacttctgtc

SEQ ID NO: 147164 - DNA, 25 bp, Homo sapien
aacacttctgtcttgatggtctatg

SEQ ID NO: 147165 - DNA, 25 bp, Homo sapien
acacttctgtcttgatggtctatgg

SEQ ID NO: 147166 - DNA, 25 bp, Homo sapien
tgtcttgatggtctatggaaataga

SEQ ID NO: 147167 - DNA, 25 bp, Homo sapien
gaccttgaaaataaggtgtctacaa

SEQ ID NO: 147168 - DNA, 25 bp, Homo sapien
tgtctacaaggtgttttgtggtttc

SEQ ID NO: 147169 - DNA, 25 bp, Homo sapien
aactttctgttctcatttactaatg

SEQ ID NO: 147170 - DNA, 25 bp, Homo sapien
atgacctatggctcttaccgctatc

SEQ ID NO: 147171 - DNA, 25 bp, Homo sapien
tatcctaactggtccatggtgctcg

SEQ ID NO: 147172 - DNA, 25 bp, Homo sapien
catggtgctcggatggctaatgctc

SEQ ID NO: 147173 - DNA, 25 bp, Homo sapien
gatggctaatgctcgcctgttccgt

SEQ ID NO: 147174 - DNA, 25 bp, Homo sapien
tgttccgtcatctggatcccaatta

SEQ ID NO: 147175 - DNA, 25 bp, Homo sapien
aaaaatgcatctggcccctggaaga

SEQ ID NO: 147176 - DNA, 25 bp, Homo sapien
ctggcccctggaagatttattgaga

SEQ ID NO: 147177 - DNA, 25 bp, Homo sapien
aagaacatgatcgaccccttgggaa

SEQ ID NO: 147178 - DNA, 25 bp, Homo sapien
tgggaacctcttccttgggactcaa

SEQ ID NO: 147179 - DNA, 25 bp, Homo sapien
cttgggactcaaactgccagtgaag

SEQ ID NO: 147180 - DNA, 25 bp, Homo sapien
gaaggatttggaactgggcactcag

SEQ ID NO: 147181 - DNA, 25 bp, Homo sapien
gaggacgcgcatgagacgaacaggg

SEQ ID NO: 147182 - DNA, 25 bp, Homo sapien
gggagaggaacattagtgcaaatcc

SEQ ID NO: 147183 - DNA, 25 bp, Homo sapien
ttagtgcaaatcctagcgccggccc

SEQ ID NO: 147184 - DNA, 25 bp, Homo sapien
attggccagctaaatggaggcaccg

SEQ ID NO: 147185 - DNA, 25 bp, Homo sapien
ccagctaaatggaggcaccggagtg

SEQ ID NO: 147186 - DNA, 25 bp, Homo sapien
tgaccggccgactcactgaggccta

SEQ ID NO: 147187 - DNA, 25 bp, Homo sapien
agccagtacattccaggtcctgtca

SEQ ID NO: 147188 - DNA, 25 bp, Homo sapien
attccaggtcctgtcattgggcgac

SEQ ID NO: 147189 - DNA, 25 bp, Homo sapien
ggtcctgtcattgggcgacgcgtaa

SEQ ID NO: 147190 - DNA, 25 bp, Homo sapien
ttgggcgacgcgtaaaatagactcc

SEQ ID NO: 147191 - DNA, 25 bp, Homo sapien
gtaaaatagactccgccctcagcca

SEQ ID NO: 147192 - DNA, 25 bp, Homo sapien
cacccagttgggacgagtgaccaca

SEQ ID NO: 147193 - DNA, 25 bp, Homo sapien
gacgagtgaccacagggatgccaca

SEQ ID NO: 147194 - DNA, 25 bp, Homo sapien
gtgaccacagggatgccacacagct

SEQ ID NO: 147195 - DNA, 25 bp, Homo sapien
cacacagctcggatttcagcctctg

SEQ ID NO: 147196 - DNA, 25 bp, Homo sapien
tctgatgtcagatcttgggtccact

SEQ ID NO: 147197 - DNA, 25 bp, Homo sapien
atgtcagatcttgggtccactggct

SEQ ID NO: 147198 - DNA, 25 bp, Homo sapien
agatcttgggtccactggctccact

SEQ ID NO: 147199 - DNA, 25 bp, Homo sapien
actctacagccaggcagctgggatt

SEQ ID NO: 147200 - DNA, 25 bp, Homo sapien
aggcagctgggattcaattccctgc

SEQ ID NO: 147201 - DNA, 25 bp, Homo sapien
agctgggattcaattccctgcctgg

SEQ ID NO: 147202 - DNA, 25 bp, Homo sapien
atctcacgagcactttccctcttgg

SEQ ID NO: 147203 - DNA, 25 bp, Homo sapien
tatcccccccctgtatagttaggat

SEQ ID NO: 147204 - DNA, 25 bp, Homo sapien
tttgatttatgcatggaaacctgaa

SEQ ID NO: 147205 - DNA, 25 bp, Homo sapien
gtgccttttatagctattactgtct

SEQ ID NO: 147206 - DNA, 25 bp, Homo sapien
tactgtctggttttaacaatttcct

SEQ ID NO: 147207 - DNA, 25 bp, Homo sapien
atttagtgaactacgcttgctcatt

SEQ ID NO: 147208 - DNA, 25 bp, Homo sapien
tgaactacgcttgctcattttttct

SEQ ID NO: 147209 - DNA, 25 bp, Homo sapien
ttcaagttattgtacagctgtttaa

SEQ ID NO: 147210 - DNA, 25 bp, Homo sapien
ttaagatgggcagctagttcgtagc

SEQ ID NO: 147211 - DNA, 25 bp, Homo sapien
gctagttcgtagctttcccaaataa

SEQ ID NO: 147212 - DNA, 25 bp, Homo sapien
aaacattaatcaatcatctgtgtga

SEQ ID NO: 147213 - DNA, 25 bp, Homo sapien
tgaaaatgggttggtgcttctaacc

SEQ ID NO: 147214 - DNA, 25 bp, Homo sapien
acagacgttcagctggtcacgcagc

SEQ ID NO: 147215 - DNA, 25 bp, Homo sapien
ggtcacgcagcaggtcatccagtgt

SEQ ID NO: 147216 - DNA, 25 bp, Homo sapien
gcagcaggtcatccagtgtgcgtac

SEQ ID NO: 147217 - DNA, 25 bp, Homo sapien
aggtcatccagtgtgcgtacgacat

SEQ ID NO: 147218 - DNA, 25 bp, Homo sapien
tccagtgtgcgtacgacatcgccaa

SEQ ID NO: 147219 - DNA, 25 bp, Homo sapien
gctgccaagcagctggttaccatca

SEQ ID NO: 147220 - DNA, 25 bp, Homo sapien
cctctgttttctaggctttataaag

SEQ ID NO: 147221 - DNA, 25 bp, Homo sapien
agtccaatttcaaattcagacgcag

SEQ ID NO: 147222 - DNA, 25 bp, Homo sapien
aattcagacgcagaactcttcagat

SEQ ID NO: 147223 - DNA, 25 bp, Homo sapien
gacgcagaactcttcagatttctac

SEQ ID NO: 147224 - DNA, 25 bp, Homo sapien
gaactcttcagatttctacaaaaag

SEQ ID NO: 147225 - DNA, 25 bp, Homo sapien
tttttatgagtaacacacaccatat

SEQ ID NO: 147226 - DNA, 25 bp, Homo sapien
caccatatataaaacagcctttctg

SEQ ID NO: 147227 - DNA, 25 bp, Homo sapien
aaaacagcctttctggctgaccaca

SEQ ID NO: 147228 - DNA, 25 bp, Homo sapien
cctttctggctgaccacatggttaa

SEQ ID NO: 147229 - DNA, 25 bp, Homo sapien
atggttaaatgcataccttcccagt

SEQ ID NO: 147230 - DNA, 25 bp, Homo sapien
aaatgcataccttcccagtactggg

SEQ ID NO: 147231 - DNA, 25 bp, Homo sapien
aaatgacccttcttagaatgtgcaa

SEQ ID NO: 147232 - DNA, 25 bp, Homo sapien
gaatgtgcaagttccatagagtaat

SEQ ID NO: 147233 - DNA, 25 bp, Homo sapien
gttgatagttacatcttcaaactta

SEQ ID NO: 147234 - DNA, 25 bp, Homo sapien
aaacttatcattccagtatgcatct

SEQ ID NO: 147235 - DNA, 25 bp, Homo sapien
taaagagtgctatacatgttaagaa

SEQ ID NO: 147236 - DNA, 25 bp, Homo sapien
acagacgttcagctggtcacgcagc

SEQ ID NO: 147237 - DNA, 25 bp, Homo sapien
gttcagctggtcacgcagcaggtca

SEQ ID NO: 147238 - DNA, 25 bp, Homo sapien
ggtcacgcagcaggtcatccagtgt

SEQ ID NO: 147239 - DNA, 25 bp, Homo sapien
gcagcaggtcatccagtgtgcgtac

SEQ ID NO: 147240 - DNA, 25 bp, Homo sapien
aggtcatccagtgtgcgtacgacat

SEQ ID NO: 147241 - DNA, 25 bp, Homo sapien
gtcatccagtgtgcgtacgacatcg

SEQ ID NO: 147242 - DNA, 25 bp, Homo sapien
tccagtgtgcgtacgacatcgccaa

SEQ ID NO: 147243 - DNA, 25 bp, Homo sapien
agtccaatttcaaattcagacgcag

SEQ ID NO: 147244 - DNA, 25 bp, Homo sapien
aattcagacgcagaactcttcagat

SEQ ID NO: 147245 - DNA, 25 bp, Homo sapien
gacgcagaactcttcagatttctac

SEQ ID NO: 147246 - DNA, 25 bp, Homo sapien
gaactcttcagatttctacaaaaag

SEQ ID NO: 147247 - DNA, 25 bp, Homo sapien
ttagcctaattcattatctgtatga

SEQ ID NO: 147248 - DNA, 25 bp, Homo sapien
gatggctaggaattatgtcatttgt

SEQ ID NO: 147249 - DNA, 25 bp, Homo sapien
gtcatttgtattaaacccagatcta

SEQ ID NO: 147250 - DNA, 25 bp, Homo sapien
agatctatttctgagtatgtggttc

SEQ ID NO: 147251 - DNA, 25 bp, Homo sapien
gtatgtggttcatgctgttgtgaaa

SEQ ID NO: 147252 - DNA, 25 bp, Homo sapien
tttccttttaccctttgtagctcag

SEQ ID NO: 147253 - DNA, 25 bp, Homo sapien
ttttaccctttgtagctcagagagc

SEQ ID NO: 147254 - DNA, 25 bp, Homo sapien
aaacgcctacttgcaagtcttgctt

SEQ ID NO: 147255 - DNA, 25 bp, Homo sapien
gatgtactaaggatactggtcctga

SEQ ID NO: 147256 - DNA, 25 bp, Homo sapien
ggtcctgaagtctaccaaatattat

SEQ ID NO: 147257 - DNA, 25 bp, Homo sapien
attatagtgcattttagcctaattc

SEQ ID NO: 147258 - DNA, 25 bp, Homo sapien
gcaccgatgggcttagagctctcat

SEQ ID NO: 147259 - DNA, 25 bp, Homo sapien
ttagagctctcatgatgctacccga

SEQ ID NO: 147260 - DNA, 25 bp, Homo sapien
tgctacccgaggtttgcaaatcctt

SEQ ID NO: 147261 - DNA, 25 bp, Homo sapien
gcaaatccttcatgtcttaacctac

SEQ ID NO: 147262 - DNA, 25 bp, Homo sapien
gtcttaacctacctggaagaagcca

SEQ ID NO: 147263 - DNA, 25 bp, Homo sapien
ggaagaagccattgagctctccggc

SEQ ID NO: 147264 - DNA, 25 bp, Homo sapien
tgagctctccggctgcatctagttc

SEQ ID NO: 147265 - DNA, 25 bp, Homo sapien
tgcatctagttctgctgtttagcct

SEQ ID NO: 147266 - DNA, 25 bp, Homo sapien
tgctgtttagcctctttggtttctg

SEQ ID NO: 147267 - DNA, 25 bp, Homo sapien
ttggtttctgtacaactacctccca

SEQ ID NO: 147268 - DNA, 25 bp, Homo sapien
agtggcaagggcgtcccgatctgcc

SEQ ID NO: 147269 - DNA, 25 bp, Homo sapien
caccaaagttctgaggcattaagcc

SEQ ID NO: 147270 - DNA, 25 bp, Homo sapien
accaaagttctgaggcattaagcca

SEQ ID NO: 147271 - DNA, 25 bp, Homo sapien
ccaaagttctgaggcattaagccag

SEQ ID NO: 147272 - DNA, 25 bp, Homo sapien
caaagttctgaggcattaagccagc

SEQ ID NO: 147273 - DNA, 25 bp, Homo sapien
aaagttctgaggcattaagccagca

SEQ ID NO: 147274 - DNA, 25 bp, Homo sapien
aagttctgaggcattaagccagcag

SEQ ID NO: 147275 - DNA, 25 bp, Homo sapien
agttctgaggcattaagccagcaga

SEQ ID NO: 147276 - DNA, 25 bp, Homo sapien
gttctgaggcattaagccagcagaa

SEQ ID NO: 147277 - DNA, 25 bp, Homo sapien
tttcatgctttatcaatagcccagg

SEQ ID NO: 147278 - DNA, 25 bp, Homo sapien
gaattttgtgaaacagacttgtata

SEQ ID NO: 147279 - DNA, 25 bp, Homo sapien
tattttacaactacaaatgcctcca

SEQ ID NO: 147280 - DNA, 25 bp, Homo sapien
acaaatgcctccaaagtattgtaca

SEQ ID NO: 147281 - DNA, 25 bp, Homo sapien
agtgtgcagtatctgtgaactgaat

SEQ ID NO: 147282 - DNA, 25 bp, Homo sapien
gtgaactgaattcaccacagacttt

SEQ ID NO: 147283 - DNA, 25 bp, Homo sapien
acagactttagctttctgagcaaga

SEQ ID NO: 147284 - DNA, 25 bp, Homo sapien
caagaggattttgcgtcagagaaat

SEQ ID NO: 147285 - DNA, 25 bp, Homo sapien
gagaaatgtctgtccatttttattc

SEQ ID NO: 147286 - DNA, 25 bp, Homo sapien
agatttttatgcctgtgacttcctt

SEQ ID NO: 147287 - DNA, 25 bp, Homo sapien
tatgcctgtgacttccttggaaatc

SEQ ID NO: 147288 - DNA, 25 bp, Homo sapien
tttgccaacacgacaagcactggag

SEQ ID NO: 147289 - DNA, 25 bp, Homo sapien
tttcaggaacactcatattaccaca

SEQ ID NO: 147290 - DNA, 25 bp, Homo sapien
cactcatattaccacaacaaccttt

SEQ ID NO: 147291 - DNA, 25 bp, Homo sapien
gcagatccagactcttagccgcaca

SEQ ID NO: 147292 - DNA, 25 bp, Homo sapien
agccgcacactgtcagctaaagctg

SEQ ID NO: 147293 - DNA, 25 bp, Homo sapien
tctggtttcacttttggcaacgtgc

SEQ ID NO: 147294 - DNA, 25 bp, Homo sapien
ttttggcaacgtgcctgagcaccga

SEQ ID NO: 147295 - DNA, 25 bp, Homo sapien
tgagcaccgaactggcccttttagg

SEQ ID NO: 147296 - DNA, 25 bp, Homo sapien
cttttaggcacagggcacctaatgg

SEQ ID NO: 147297 - DNA, 25 bp, Homo sapien
tgtcatctattccttatcaaccaac

SEQ ID NO: 147298 - DNA, 25 bp, Homo sapien
gtaatgatccagaccgaggcacctc

SEQ ID NO: 147299 - DNA, 25 bp, Homo sapien
taaacacaaggatccccagctggac

SEQ ID NO: 147300 - DNA, 25 bp, Homo sapien
ccacctctccaggtgtcaaaggtga

SEQ ID NO: 147301 - DNA, 25 bp, Homo sapien
ggtgaaccgagtccagtattagctg

SEQ ID NO: 147302 - DNA, 25 bp, Homo sapien
gaatgtcatttcgtacaccacagct

SEQ ID NO: 147303 - DNA, 25 bp, Homo sapien
atttcgtacaccacagctcagtcag

SEQ ID NO: 147304 - DNA, 25 bp, Homo sapien
agcccatggccttcgtgaactttgc

SEQ ID NO: 147305 - DNA, 25 bp, Homo sapien
tgaactttgctccaacacactgatg

SEQ ID NO: 147306 - DNA, 25 bp, Homo sapien
aacacactgatgtgtgggcttccca

SEQ ID NO: 147307 - DNA, 25 bp, Homo sapien
ggcttcccacagcaggactgacttc

SEQ ID NO: 147308 - DNA, 25 bp, Homo sapien
ccctttctgttgtttgcacatgccc

SEQ ID NO: 147309 - DNA, 25 bp, Homo sapien
gcacatgcccctcttactgtactgt

SEQ ID NO: 147310 - DNA, 25 bp, Homo sapien
tagcatgagctgtctaccaagaaga

SEQ ID NO: 147311 - DNA, 25 bp, Homo sapien
gaaacctgctgctctcttaatttta

SEQ ID NO: 147312 - DNA, 25 bp, Homo sapien
atttcctaatttgttgatggccttt

SEQ ID NO: 147313 - DNA, 25 bp, Homo sapien
tggccttttgtgttgtgaaccacaa

SEQ ID NO: 147314 - DNA, 25 bp, Homo sapien
gagaggcctcttttgtggctggtta

SEQ ID NO: 147315 - DNA, 25 bp, Homo sapien
ggctggttattccagttccctggga

SEQ ID NO: 147316 - DNA, 25 bp, Homo sapien
ggtctattaagtatccttgtattgg

SEQ ID NO: 147317 - DNA, 25 bp, Homo sapien
gatacgtaataccttagtgctgtca

SEQ ID NO: 147318 - DNA, 25 bp, Homo sapien
tagtgctgtcataatgttgtacaag

SEQ ID NO: 147319 - DNA, 25 bp, Homo sapien
aagatcatgatcagcttctcccttt

SEQ ID NO: 147320 - DNA, 25 bp, Homo sapien
atttaaccatgttctttcctgtctc

SEQ ID NO: 147321 - DNA, 25 bp, Homo sapien
atctcggagacaggcggaggaactc

SEQ ID NO: 147322 - DNA, 25 bp, Homo sapien
aggaactcccgagctgagatgcgga

SEQ ID NO: 147323 - DNA, 25 bp, Homo sapien
gctgagatgcggaaagcaccaggcc

SEQ ID NO: 147324 - DNA, 25 bp, Homo sapien
gcagaacagcttcatgttcccaaaa

SEQ ID NO: 147325 - DNA, 25 bp, Homo sapien
atgttcccaaaatcaccgtacgact

SEQ ID NO: 147326 - DNA, 25 bp, Homo sapien
ccgtacgactcttttccaaacacag

SEQ ID NO: 147327 - DNA, 25 bp, Homo sapien
caggcaaatcggaaatcagcaggac

SEQ ID NO: 147328 - DNA, 25 bp, Homo sapien
atcagcaggacgactgttttcccaa

SEQ ID NO: 147329 - DNA, 25 bp, Homo sapien
caggacgactgttttcccaacacgg

SEQ ID NO: 147330 - DNA, 25 bp, Homo sapien
ccaacacgggtaaatctagtaccat

SEQ ID NO: 147331 - DNA, 25 bp, Homo sapien
tctagtaccatgtcgtagttactct

SEQ ID NO: 147332 - DNA, 25 bp, Homo sapien
agttggcaggaacattatacatggc

SEQ ID NO: 147333 - DNA, 25 bp, Homo sapien
aggagatcggcttgtggtttcaccc

SEQ ID NO: 147334 - DNA, 25 bp, Homo sapien
gtggtttcaccctgaggaactggta

SEQ ID NO: 147335 - DNA, 25 bp, Homo sapien
ggtagattacacgagctgtgctcag

SEQ ID NO: 147336 - DNA, 25 bp, Homo sapien
gctcagaactggatctatgaatgac

SEQ ID NO: 147337 - DNA, 25 bp, Homo sapien
cccatgggcagaggaccaggctgta

SEQ ID NO: 147338 - DNA, 25 bp, Homo sapien
ggaccaggctgtaggaaatctagtt

SEQ ID NO: 147339 - DNA, 25 bp, Homo sapien
ggaacttcatcataatttggaggga

SEQ ID NO: 147340 - DNA, 25 bp, Homo sapien
aagctcttggagctgtgagttctcc

SEQ ID NO: 147341 - DNA, 25 bp, Homo sapien
ggagctgtgagttctccctgtacag

SEQ ID NO: 147342 - DNA, 25 bp, Homo sapien
agttctccctgtacagtgttaccat

SEQ ID NO: 147343 - DNA, 25 bp, Homo sapien
gcccatggagattgcctcttctagg

SEQ ID NO: 147344 - DNA, 25 bp, Homo sapien
tatccttttctggagagtagtctag

SEQ ID NO: 147345 - DNA, 25 bp, Homo sapien
agtagtctagaccaagccaattgca

SEQ ID NO: 147346 - DNA, 25 bp, Homo sapien
ccaagccaattgcagaaccacattc

SEQ ID NO: 147347 - DNA, 25 bp, Homo sapien
accacattctttggttcccaggaga

SEQ ID NO: 147348 - DNA, 25 bp, Homo sapien
gtgccgcagttctatattctgcttc

SEQ ID NO: 147349 - DNA, 25 bp, Homo sapien
attctgcttcaaatcagccttcagg

SEQ ID NO: 147350 - DNA, 25 bp, Homo sapien
agccttcaggtttcccacagcatgg

SEQ ID NO: 147351 - DNA, 25 bp, Homo sapien
agcatggcccctgctgacacgagaa

SEQ ID NO: 147352 - DNA, 25 bp, Homo sapien
tgctgacacgagaacccaaagtttt

SEQ ID NO: 147353 - DNA, 25 bp, Homo sapien
aagttttcccaaatctaaatcatca

SEQ ID NO: 147354 - DNA, 25 bp, Homo sapien
ttcagacgatggagctgcggaacta

SEQ ID NO: 147355 - DNA, 25 bp, Homo sapien
gatggagctgcggaactacttctcc

SEQ ID NO: 147356 - DNA, 25 bp, Homo sapien
tgcggaactacttctccctgtactg

SEQ ID NO: 147357 - DNA, 25 bp, Homo sapien
tgcaccaggagacgcagctcatcca

SEQ ID NO: 147358 - DNA, 25 bp, Homo sapien
aggagacgcagctcatccacgtcta

SEQ ID NO: 147359 - DNA, 25 bp, Homo sapien
cttcgtcaactctcagatccaaggg

SEQ ID NO: 147360 - DNA, 25 bp, Homo sapien
aactctcagatccaagggcacaagg

SEQ ID NO: 147361 - DNA, 25 bp, Homo sapien
aaggtgtggaacgacctgaggccca

SEQ ID NO: 147362 - DNA, 25 bp, Homo sapien
tggaacgacctgaggcccaagctca

SEQ ID NO: 147363 - DNA, 25 bp, Homo sapien
tcagctgcctctttgcgggaccaca

SEQ ID NO: 147364 - DNA, 25 bp, Homo sapien
gtggtgctccctgcggtcgcaagct

SEQ ID NO: 147365 - DNA, 25 bp, Homo sapien
gtgaacgtgatgttttcggatgcaa

SEQ ID NO: 147366 - DNA, 25 bp, Homo sapien
tttcggatgcaaactcagctcaggg

SEQ ID NO: 147367 - DNA, 25 bp, Homo sapien
tcagctcagggattcattttgtgtc

SEQ ID NO: 147368 - DNA, 25 bp, Homo sapien
gtcttagttttatatgcatccttat

SEQ ID NO: 147369 - DNA, 25 bp, Homo sapien
ccttatttttaatacacctgcttca

SEQ ID NO: 147370 - DNA, 25 bp, Homo sapien
gcttcacgtccctatgttgggaagt

SEQ ID NO: 147371 - DNA, 25 bp, Homo sapien
ttgggaagtccatatttgtctgctt

SEQ ID NO: 147372 - DNA, 25 bp, Homo sapien
tcttgcagcatcatttccttacaat

SEQ ID NO: 147373 - DNA, 25 bp, Homo sapien
tccttacaatactgtccggtggaca

SEQ ID NO: 147374 - DNA, 25 bp, Homo sapien
gatataattactttagctgcactaa

SEQ ID NO: 147375 - DNA, 25 bp, Homo sapien
gctgcactaacagtacaatgcttgt

SEQ ID NO: 147376 - DNA, 25 bp, Homo sapien
gatatcggcgagctgatcatgatca

SEQ ID NO: 147377 - DNA, 25 bp, Homo sapien
ctgatcatgatcaagttcaagtggg

SEQ ID NO: 147378 - DNA, 25 bp, Homo sapien
aaacagtgcagtgtgggccaatgtc

SEQ ID NO: 147379 - DNA, 25 bp, Homo sapien
gggccaatgtctgggacacggtcca

SEQ ID NO: 147380 - DNA, 25 bp, Homo sapien
tgggacacggtccagaccatcatcc

SEQ ID NO: 147381 - DNA, 25 bp, Homo sapien
atcatcccatggagcacagggccgc

SEQ ID NO: 147382 - DNA, 25 bp, Homo sapien
actcaggcctcgttctgaagacgat

SEQ ID NO: 147383 - DNA, 25 bp, Homo sapien
gcctcgttctgaagacgatcagagt

SEQ ID NO: 147384 - DNA, 25 bp, Homo sapien
gaatgacattttgttcagaaaacac

SEQ ID NO: 147385 - DNA, 25 bp, Homo sapien
aaacacagatgacctactacttcgc

SEQ ID NO: 147386 - DNA, 25 bp, Homo sapien
acagatgacctactacttcgcccaa

SEQ ID NO: 147387 - DNA, 25 bp, Homo sapien
gagcaatgtagcaggcgtcttctac

SEQ ID NO: 147388 - DNA, 25 bp, Homo sapien
ctacattctggttggcggcttgggc

SEQ ID NO: 147389 - DNA, 25 bp, Homo sapien
caagtccagggcagaagcgaagaga

SEQ ID NO: 147390 - DNA, 25 bp, Homo sapien
aagaaacaaagccagattatccatc

SEQ ID NO: 147391 - DNA, 25 bp, Homo sapien
cagattatccatcactgggagtgtg

SEQ ID NO: 147392 - DNA, 25 bp, Homo sapien
agaatggccgcgtcttgacgcctga

SEQ ID NO: 147393 - DNA, 25 bp, Homo sapien
tgacgcctgactgcccaaaggctgt

SEQ ID NO: 147394 - DNA, 25 bp, Homo sapien
aggctgtacacactggaactgcaat

SEQ ID NO: 147395 - DNA, 25 bp, Homo sapien
actgcaatcagacaaagttcaggat

SEQ ID NO: 147396 - DNA, 25 bp, Homo sapien
gttcaggattggctgtcattgcatc

SEQ ID NO: 147397 - DNA, 25 bp, Homo sapien
ctgtcattgcatcggacctaccata

SEQ ID NO: 147398 - DNA, 25 bp, Homo sapien
taccattaaaaagctcaccttgcag

SEQ ID NO: 147399 - DNA, 25 bp, Homo sapien
agctgagtgaagagcccagcccctc

SEQ ID NO: 147400 - DNA, 25 bp, Homo sapien
agcccctcttatgtgcaattgcctt

SEQ ID NO: 147401 - DNA, 25 bp, Homo sapien
ccctcttatgtgcaattgccttgaa

SEQ ID NO: 147402 - DNA, 25 bp, Homo sapien
gtgcaattgccttgaactacgaccc

SEQ ID NO: 147403 - DNA, 25 bp, Homo sapien
aattgccttgaactacgaccctgta

SEQ ID NO: 147404 - DNA, 25 bp, Homo sapien
gccttgaactacgaccctgtagaga

SEQ ID NO: 147405 - DNA, 25 bp, Homo sapien
gaactacgaccctgtagagatttct

SEQ ID NO: 147406 - DNA, 25 bp, Homo sapien
agagatttctctcatggcgttctag

SEQ ID NO: 147407 - DNA, 25 bp, Homo sapien
gatttctctcatggcgttctagttc

SEQ ID NO: 147408 - DNA, 25 bp, Homo sapien
tctcatggcgttctagttctctgac

SEQ ID NO: 147409 - DNA, 25 bp, Homo sapien
gaaatgaacttggtacctgcagagt

SEQ ID NO: 147410 - DNA, 25 bp, Homo sapien
gaacttggtacctgcagagtggctg

SEQ ID NO: 147411 - DNA, 25 bp, Homo sapien
gcagagtggctgcagttaaatagat

SEQ ID NO: 147412 - DNA, 25 bp, Homo sapien
acattctatgtgtttggaagacaac

SEQ ID NO: 147413 - DNA, 25 bp, Homo sapien
tggaagacaactctgcttgctcatc

SEQ ID NO: 147414 - DNA, 25 bp, Homo sapien
ctctgcttgctcatccaaggattaa

SEQ ID NO: 147415 - DNA, 25 bp, Homo sapien
tctggtcagcaggtggaatgtgtat

SEQ ID NO: 147416 - DNA, 25 bp, Homo sapien
aaacattaaatggtgcctccaagga

SEQ ID NO: 147417 - DNA, 25 bp, Homo sapien
tggtgcctccaaggaaactttgcca

SEQ ID NO: 147418 - DNA, 25 bp, Homo sapien
aaatataatctcacctgcttccttc

SEQ ID NO: 147419 - DNA, 25 bp, Homo sapien
cttccttccagacagtgtcgctaag

SEQ ID NO: 147420 - DNA, 25 bp, Homo sapien
gaacaccatgacctcctctgtgtgt

SEQ ID NO: 147421 - DNA, 25 bp, Homo sapien
ttctccccaaggacaaaatgtagaa

SEQ ID NO: 147422 - DNA, 25 bp, Homo sapien
gataacttactcaagattcccctcc

SEQ ID NO: 147423 - DNA, 25 bp, Homo sapien
aaaacccttcctgctatacatagga

SEQ ID NO: 147424 - DNA, 25 bp, Homo sapien
cacacatccacctaaaattgactgt

SEQ ID NO: 147425 - DNA, 25 bp, Homo sapien
aaaattgactgtactgtttaactgt

SEQ ID NO: 147426 - DNA, 25 bp, Homo sapien
ttaactgtcaattctcctgaggcta

SEQ ID NO: 147427 - DNA, 25 bp, Homo sapien
tcctgaggctaaacacagtttgttt

SEQ ID NO: 147428 - DNA, 25 bp, Homo sapien
gtttttcttgtaatcacttttcatg

SEQ ID NO: 147429 - DNA, 25 bp, Homo sapien
gctttctgaatatagactttctggg

SEQ ID NO: 147430 - DNA, 25 bp, Homo sapien
tctgggaaaaggtttactgctcgta

SEQ ID NO: 147431 - DNA, 25 bp, Homo sapien
tttgcacatgttcaccatctggctg

SEQ ID NO: 147432 - DNA, 25 bp, Homo sapien
tgggctacatcaactccacactgaa

SEQ ID NO: 147433 - DNA, 25 bp, Homo sapien
catctaccccttgtgcaatgagaac

SEQ ID NO: 147434 - DNA, 25 bp, Homo sapien
accccttgtgcaatgagaacttcaa

SEQ ID NO: 147435 - DNA, 25 bp, Homo sapien
gagaattctgcatattcgctcctaa

SEQ ID NO: 147436 - DNA, 25 bp, Homo sapien
tctgcatattcgctcctaagggagg

SEQ ID NO: 147437 - DNA, 25 bp, Homo sapien
aatgatccttatgatgtccaacaag

SEQ ID NO: 147438 - DNA, 25 bp, Homo sapien
tgttgccaggcaggcacctgggctt

SEQ ID NO: 147439 - DNA, 25 bp, Homo sapien
gcacctgggctttctggaatccaaa

SEQ ID NO: 147440 - DNA, 25 bp, Homo sapien
tggaatccaaaccacagtcttaggg

SEQ ID NO: 147441 - DNA, 25 bp, Homo sapien
agtttggaaagttcttaggcaccat

SEQ ID NO: 147442 - DNA, 25 bp, Homo sapien
gaatctaccctgaccaatgggctca

SEQ ID NO: 147443 - DNA, 25 bp, Homo sapien
taccctgaccaatgggctcaagaat

SEQ ID NO: 147444 - DNA, 25 bp, Homo sapien
gaccaatgggctcaagaataaagta

SEQ ID NO: 147445 - DNA, 25 bp, Homo sapien
atgatttttgagtcaggcacagtgg

SEQ ID NO: 147446 - DNA, 25 bp, Homo sapien
tgagctggtaggatcacaataggcc

SEQ ID NO: 147447 - DNA, 25 bp, Homo sapien
gtaggatcacaataggccacgaatt

SEQ ID NO: 147448 - DNA, 25 bp, Homo sapien
caataggccacgaatttgagaccag

SEQ ID NO: 147449 - DNA, 25 bp, Homo sapien
gcctggtaaaatagtgagacctcat

SEQ ID NO: 147450 - DNA, 25 bp, Homo sapien
aattagccacatgtgctggcactta

SEQ ID NO: 147451 - DNA, 25 bp, Homo sapien
gccacatgtgctggcacttacctgt

SEQ ID NO: 147452 - DNA, 25 bp, Homo sapien
gtgtgcgaatctaccctgaccaatg

SEQ ID NO: 147453 - DNA, 25 bp, Homo sapien
gagttcagagatcgttcctatacat

SEQ ID NO: 147454 - DNA, 25 bp, Homo sapien
gatcgttcctatacatttctgttca

SEQ ID NO: 147455 - DNA, 25 bp, Homo sapien
tttctgttcatcttaaggtggactc

SEQ ID NO: 147456 - DNA, 25 bp, Homo sapien
catcttaaggtggactcgtttggtt

SEQ ID NO: 147457 - DNA, 25 bp, Homo sapien
ggttaccaatttaactagtcctgca

SEQ ID NO: 147458 - DNA, 25 bp, Homo sapien
ccaatttaactagtcctgcagagga

SEQ ID NO: 147459 - DNA, 25 bp, Homo sapien
taactagtcctgcagaggatttaac

SEQ ID NO: 147460 - DNA, 25 bp, Homo sapien
gatttaactgtgaacctggagggca

SEQ ID NO: 147461 - DNA, 25 bp, Homo sapien
ggcaacgacggtttcaaaccaggat

SEQ ID NO: 147462 - DNA, 25 bp, Homo sapien
gacggtttcaaaccaggattttgtg

SEQ ID NO: 147463 - DNA, 25 bp, Homo sapien
tgctggtgtctgagcttcagtataa

SEQ ID NO: 147464 - DNA, 25 bp, Homo sapien
taaacctgacgtccaagcctatcat

SEQ ID NO: 147465 - DNA, 25 bp, Homo sapien
aagcctatcatcttgcgtttcaacc

SEQ ID NO: 147466 - DNA, 25 bp, Homo sapien
agcccttcatcatcatgatcttcga

SEQ ID NO: 147467 - DNA, 25 bp, Homo sapien
tgatcttcgaccacttcacctggag

SEQ ID NO: 147468 - DNA, 25 bp, Homo sapien
agcagccttttcctggcgagggtta

SEQ ID NO: 147469 - DNA, 25 bp, Homo sapien
gttatgaacccagtgtaagagacca

SEQ ID NO: 147470 - DNA, 25 bp, Homo sapien
agtgtaagagaccacccacccagag

SEQ ID NO: 147471 - DNA, 25 bp, Homo sapien
agagcctcagcactgtctgactttg

SEQ ID NO: 147472 - DNA, 25 bp, Homo sapien
agcactgtctgactttgggaaccag

SEQ ID NO: 147473 - DNA, 25 bp, Homo sapien
ggaaccagggatcccacagaaatgt

SEQ ID NO: 147474 - DNA, 25 bp, Homo sapien
tccctccaaccagagttgtgtctaa

SEQ ID NO: 147475 - DNA, 25 bp, Homo sapien
gaatctaccctgaccaatgggctca

SEQ ID NO: 147476 - DNA, 25 bp, Homo sapien
aatctaccctgaccaatgggctcaa

SEQ ID NO: 147477 - DNA, 25 bp, Homo sapien
atctaccctgaccaatgggctcaag

SEQ ID NO: 147478 - DNA, 25 bp, Homo sapien
ctaccctgaccaatgggctcaagaa

SEQ ID NO: 147479 - DNA, 25 bp, Homo sapien
taccctgaccaatgggctcaagaat

SEQ ID NO: 147480 - DNA, 25 bp, Homo sapien
gaccaatgggctcaagaataaagta

SEQ ID NO: 147481 - DNA, 25 bp, Homo sapien
ccaatgggctcaagaataaagtatg

SEQ ID NO: 147482 - DNA, 25 bp, Homo sapien
gtgtgcgaatctaccctgaccaatg

SEQ ID NO: 147483 - DNA, 25 bp, Homo sapien
tgtgcgaatctaccctgaccaatgg

SEQ ID NO: 147484 - DNA, 25 bp, Homo sapien
tgcgaatctaccctgaccaatgggc

SEQ ID NO: 147485 - DNA, 25 bp, Homo sapien
gcgaatctaccctgaccaatgggct

SEQ ID NO: 147486 - DNA, 25 bp, Homo sapien
acgggacgcggcaggcttctcagtc

SEQ ID NO: 147487 - DNA, 25 bp, Homo sapien
acgcggcaggcttctcagtctctgt

SEQ ID NO: 147488 - DNA, 25 bp, Homo sapien
cagtctctgtccgagacagccggga

SEQ ID NO: 147489 - DNA, 25 bp, Homo sapien
tctctgtccgagacagccgggagga

SEQ ID NO: 147490 - DNA, 25 bp, Homo sapien
agagctgggctttcctctgtgacca

SEQ ID NO: 147491 - DNA, 25 bp, Homo sapien
agctgggctttcctctgtgaccatc

SEQ ID NO: 147492 - DNA, 25 bp, Homo sapien
atcccggcctgtaacatatctgtaa

SEQ ID NO: 147493 - DNA, 25 bp, Homo sapien
tcccggcctgtaacatatctgtaaa

SEQ ID NO: 147494 - DNA, 25 bp, Homo sapien
tctgtaaatagtgagatggacttgg

SEQ ID NO: 147495 - DNA, 25 bp, Homo sapien
cagagcgggctcgaagaaaataatt

SEQ ID NO: 147496 - DNA, 25 bp, Homo sapien
gggctcgaagaaaataattctctat

SEQ ID NO: 147497 - DNA, 25 bp, Homo sapien
aggccttatctcaacaacaaccaca

SEQ ID NO: 147498 - DNA, 25 bp, Homo sapien
ggccttatctcaacaacaaccacaa

SEQ ID NO: 147499 - DNA, 25 bp, Homo sapien
gccttatctcaacaacaaccacaaa

SEQ ID NO: 147500 - DNA, 25 bp, Homo sapien
ccttatctcaacaacaaccacaaaa

SEQ ID NO: 147501 - DNA, 25 bp, Homo sapien
tatctcaacaacaaccacaaaatct

SEQ ID NO: 147502 - DNA, 25 bp, Homo sapien
tctcaacaacaaccacaaaatctaa

SEQ ID NO: 147503 - DNA, 25 bp, Homo sapien
ctcaacaacaaccacaaaatctaaa

SEQ ID NO: 147504 - DNA, 25 bp, Homo sapien
gcctgtgatcctggctacttcagag

SEQ ID NO: 147505 - DNA, 25 bp, Homo sapien
ctgtgatcctggctacttcagaggc

SEQ ID NO: 147506 - DNA, 25 bp, Homo sapien
tgtgatcctggctacttcagaggct

SEQ ID NO: 147507 - DNA, 25 bp, Homo sapien
agaccctgtctgaaagaaagagaga

SEQ ID NO: 147508 - DNA, 25 bp, Homo sapien
aacgcatcctatgcctcagctggat

SEQ ID NO: 147509 - DNA, 25 bp, Homo sapien
tcagctggatggacaacgccgcgga

SEQ ID NO: 147510 - DNA, 25 bp, Homo sapien
aggagccggttgactattacgccac

SEQ ID NO: 147511 - DNA, 25 bp, Homo sapien
caagagccgtgcctacagtgtggaa

SEQ ID NO: 147512 - DNA, 25 bp, Homo sapien
aacctgagaacctggagtccggcgg

SEQ ID NO: 147513 - DNA, 25 bp, Homo sapien
ggcgtcttccgtaatggcacctgca

SEQ ID NO: 147514 - DNA, 25 bp, Homo sapien
tgtttgctgagcaggacgacgccac

SEQ ID NO: 147515 - DNA, 25 bp, Homo sapien
cacggtgagtcagctgtcggtcatc

SEQ ID NO: 147516 - DNA, 25 bp, Homo sapien
tgtcggtcatcctcggctatgccaa

SEQ ID NO: 147517 - DNA, 25 bp, Homo sapien
atggctttctctcagacaacttcaa

SEQ ID NO: 147518 - DNA, 25 bp, Homo sapien
agacaacttcaagcgctctttccaa

SEQ ID NO: 147519 - DNA, 25 bp, Homo sapien
aggtctgggccatagcatggctgcc

SEQ ID NO: 147520 - DNA, 25 bp, Homo sapien
tgggccatagcatggctgccctgtg

SEQ ID NO: 147521 - DNA, 25 bp, Homo sapien
gaggtggatggcactttccagagcc

SEQ ID NO: 147522 - DNA, 25 bp, Homo sapien
ggtggatggcactttccagagccca

SEQ ID NO: 147523 - DNA, 25 bp, Homo sapien
agagcccaggttcttatggcatttc

SEQ ID NO: 147524 - DNA, 25 bp, Homo sapien
aggttcttatggcatttcccagggt

SEQ ID NO: 147525 - DNA, 25 bp, Homo sapien
cttatggcatttcccagggttctgt

SEQ ID NO: 147526 - DNA, 25 bp, Homo sapien
tgtgatttccccatgctctgcattt

SEQ ID NO: 147527 - DNA, 25 bp, Homo sapien
catgctctgcatttctaggatattt

SEQ ID NO: 147528 - DNA, 25 bp, Homo sapien
taggatatttctaggacacctggat

SEQ ID NO: 147529 - DNA, 25 bp, Homo sapien
atttctaggacacctggattggctc

SEQ ID NO: 147530 - DNA, 25 bp, Homo sapien
tggacgagcagcaggtaaacgtgct

SEQ ID NO: 147531 - DNA, 25 bp, Homo sapien
gtgctgctctacgacatgaacggct

SEQ ID NO: 147532 - DNA, 25 bp, Homo sapien
tgctctacgacatgaacggctgtta

SEQ ID NO: 147533 - DNA, 25 bp, Homo sapien
gacatgaacggctgttactcacgcc

SEQ ID NO: 147534 - DNA, 25 bp, Homo sapien
ccagaaccgcaaggtgagcaaggtg

SEQ ID NO: 147535 - DNA, 25 bp, Homo sapien
tggagattctccagcacgtcatcga

SEQ ID NO: 147536 - DNA, 25 bp, Homo sapien
tcatcgactacatcagggaccttca

SEQ ID NO: 147537 - DNA, 25 bp, Homo sapien
catcagggaccttcagttggagctg

SEQ ID NO: 147538 - DNA, 25 bp, Homo sapien
gttggagctgaactcggaatccgaa

SEQ ID NO: 147539 - DNA, 25 bp, Homo sapien
tgaactcggaatccgaagttggaac

SEQ ID NO: 147540 - DNA, 25 bp, Homo sapien
aacggcgagatcagcgccctgacgg

SEQ ID NO: 147541 - DNA, 25 bp, Homo sapien
ttcgacgactacatcgcctgctgcg

SEQ ID NO: 147542 - DNA, 25 bp, Homo sapien
tgctgcgtcaaactgagggctctta

SEQ ID NO: 147543 - DNA, 25 bp, Homo sapien
tgagggctcttacagacagctttcg

SEQ ID NO: 147544 - DNA, 25 bp, Homo sapien
ttcgaagacgggatactgctcagca

SEQ ID NO: 147545 - DNA, 25 bp, Homo sapien
agcaaggtgttgtgaatttcccata

SEQ ID NO: 147546 - DNA, 25 bp, Homo sapien
gaggaagctgcatgaatgtaatcaa

SEQ ID NO: 147547 - DNA, 25 bp, Homo sapien
atgtaatcaacattccaactggagc

SEQ ID NO: 147548 - DNA, 25 bp, Homo sapien
actggagctctcctttgcttgtcct

SEQ ID NO: 147549 - DNA, 25 bp, Homo sapien
gtcctctttgccttcggtaatatgt

SEQ ID NO: 147550 - DNA, 25 bp, Homo sapien
gtataaacttacatcacgactttct

SEQ ID NO: 147551 - DNA, 25 bp, Homo sapien
cacgactttctcttaacagctgttg

SEQ ID NO: 147552 - DNA, 25 bp, Homo sapien
actacgtggtagaatctcctgtctg

SEQ ID NO: 147553 - DNA, 25 bp, Homo sapien
tctcctgtctgggtatcagctcata

SEQ ID NO: 147554 - DNA, 25 bp, Homo sapien
tatcagctcataccactcagtttac

SEQ ID NO: 147555 - DNA, 25 bp, Homo sapien
ctcagtttactcaacctggctggta

SEQ ID NO: 147556 - DNA, 25 bp, Homo sapien
aacctggctggtattacctgaagac

SEQ ID NO: 147557 - DNA, 25 bp, Homo sapien
acctgaagacagttggccatttaga

SEQ ID NO: 147558 - DNA, 25 bp, Homo sapien
gctacgtagctctgactgatggctt

SEQ ID NO: 147559 - DNA, 25 bp, Homo sapien
actgatggcttagggaacctcacca

SEQ ID NO: 147560 - DNA, 25 bp, Homo sapien
acctcaccatcatcattgaaaccat

SEQ ID NO: 147561 - DNA, 25 bp, Homo sapien
gctagttactatgaacagttgcctt

SEQ ID NO: 147562 - DNA, 25 bp, Homo sapien
gatgacggcccaagagccatggagt

SEQ ID NO: 147563 - DNA, 25 bp, Homo sapien
cccttgctgggagtaagtggtagaa

SEQ ID NO: 147564 - DNA, 25 bp, Homo sapien
gtggtagaatcctgtactctctctt

SEQ ID NO: 147565 - DNA, 25 bp, Homo sapien
gtagaatcctgtactctctcttctc

SEQ ID NO: 147566 - DNA, 25 bp, Homo sapien
aatcctgtactctctcttctccgtg

SEQ ID NO: 147567 - DNA, 25 bp, Homo sapien
ttctccgtgcactcagtcatgtgtg

SEQ ID NO: 147568 - DNA, 25 bp, Homo sapien
gtgcactcagtcatgtgtgccggag

SEQ ID NO: 147569 - DNA, 25 bp, Homo sapien
actcagtcatgtgtgccggaggcct

SEQ ID NO: 147570 - DNA, 25 bp, Homo sapien
tcagtcatgtgtgccggaggccttc

SEQ ID NO: 147571 - DNA, 25 bp, Homo sapien
catgtgtgccggaggccttcccact

SEQ ID NO: 147572 - DNA, 25 bp, Homo sapien
ttcccactcctactgcgagtgcaca

SEQ ID NO: 147573 - DNA, 25 bp, Homo sapien
tccgctacgcacaggagttttggga

SEQ ID NO: 147574 - DNA, 25 bp, Homo sapien
aaggctagcgagatcctgggtctca

SEQ ID NO: 147575 - DNA, 25 bp, Homo sapien
gcgagatcctgggtctcaaggcaca

SEQ ID NO: 147576 - DNA, 25 bp, Homo sapien
ggtctcaaggcacagctgaaggaca

SEQ ID NO: 147577 - DNA, 25 bp, Homo sapien
tcaaggcacagctgaaggacacgcg

SEQ ID NO: 147578 - DNA, 25 bp, Homo sapien
gagctgaggacccaggacctggagg

SEQ ID NO: 147579 - DNA, 25 bp, Homo sapien
agctacgtggccatgtaccagcgga

SEQ ID NO: 147580 - DNA, 25 bp, Homo sapien
atgtaccagcggaaccagcgcctgg

SEQ ID NO: 147581 - DNA, 25 bp, Homo sapien
ccagcggaaccagcgcctggagaag

SEQ ID NO: 147582 - DNA, 25 bp, Homo sapien
tgacatcccctacgaggacatcata

SEQ ID NO: 147583 - DNA, 25 bp, Homo sapien
tacgaggacatcatagccactgaga

SEQ ID NO: 147584 - DNA, 25 bp, Homo sapien
ggacatcatagccactgagatctga

SEQ ID NO: 147585 - DNA, 25 bp, Homo sapien
taattgctacatgatctagagccag

SEQ ID NO: 147586 - DNA, 25 bp, Homo sapien
atgatctagagccagttactttgtg

SEQ ID NO: 147587 - DNA, 25 bp, Homo sapien
gccagttactttgtgtttcagccat

SEQ ID NO: 147588 - DNA, 25 bp, Homo sapien
tgtgtttcagccatgtatttgcagc

SEQ ID NO: 147589 - DNA, 25 bp, Homo sapien
gccatgtatttgcagctgagagaaa

SEQ ID NO: 147590 - DNA, 25 bp, Homo sapien
gtatcaggatactatattttaggtc

SEQ ID NO: 147591 - DNA, 25 bp, Homo sapien
attttaggtcttaatacacacagtt

SEQ ID NO: 147592 - DNA, 25 bp, Homo sapien
aatacacacagttatgccgctagat

SEQ ID NO: 147593 - DNA, 25 bp, Homo sapien
tgccgctagatacatgctttttaat

SEQ ID NO: 147594 - DNA, 25 bp, Homo sapien
taaatcaaccttgctttgatggaat

SEQ ID NO: 147595 - DNA, 25 bp, Homo sapien
ggaataaactccatttagtcacaaa

SEQ ID NO: 147596 - DNA, 25 bp, Homo sapien
acaaagatgttatggtgtttagact

SEQ ID NO: 147597 - DNA, 25 bp, Homo sapien
atggtgtttagacttatggttgtta

SEQ ID NO: 147598 - DNA, 25 bp, Homo sapien
aaatgtcatctcaagtcaagtcact

SEQ ID NO: 147599 - DNA, 25 bp, Homo sapien
gtcaagtcactggtctgtttgcatt

SEQ ID NO: 147600 - DNA, 25 bp, Homo sapien
cactggtctgtttgcatttgataca

SEQ ID NO: 147601 - DNA, 25 bp, Homo sapien
gatacatttttgtactaactagcat

SEQ ID NO: 147602 - DNA, 25 bp, Homo sapien
tcatgattagaaattacctgtggat

SEQ ID NO: 147603 - DNA, 25 bp, Homo sapien
aattacctgtggatatttgtataaa

SEQ ID NO: 147604 - DNA, 25 bp, Homo sapien
gttcattgtttcgtaacacagcatt

SEQ ID NO: 147605 - DNA, 25 bp, Homo sapien
gtttcgtaacacagcattgtatatg

SEQ ID NO: 147606 - DNA, 25 bp, Homo sapien
gtatatgtgaagcaaactctaaaat

SEQ ID NO: 147607 - DNA, 25 bp, Homo sapien
ccagaagccattaactacgggacat

SEQ ID NO: 147608 - DNA, 25 bp, Homo sapien
aactacgggacattcaccatcaagt

SEQ ID NO: 147609 - DNA, 25 bp, Homo sapien
ttgggatcctgctgacggaaattgt

SEQ ID NO: 147610 - DNA, 25 bp, Homo sapien
tgacggaaattgtcacccacggccg

SEQ ID NO: 147611 - DNA, 25 bp, Homo sapien
agaacctggagcgaggctaccgcat

SEQ ID NO: 147612 - DNA, 25 bp, Homo sapien
gaggctaccgcatggtgcgccctga

SEQ ID NO: 147613 - DNA, 25 bp, Homo sapien
tgcgccctgacaactgtccagagga

SEQ ID NO: 147614 - DNA, 25 bp, Homo sapien
gtccagaggagctgtaccaactcat

SEQ ID NO: 147615 - DNA, 25 bp, Homo sapien
aactcatgaggctgtgctggaagga

SEQ ID NO: 147616 - DNA, 25 bp, Homo sapien
actacctgcgcagtgtgctggagga

SEQ ID NO: 147617 - DNA, 25 bp, Homo sapien
gaggacttcttcacggccacagagg

SEQ ID NO: 147618 - DNA, 25 bp, Homo sapien
gctggctgttgctgtcgagactgct

SEQ ID NO: 147619 - DNA, 25 bp, Homo sapien
tggctgttgctgtcgagactgctgc

SEQ ID NO: 147620 - DNA, 25 bp, Homo sapien
ctgttgctgtcgagactgctgcgtg

SEQ ID NO: 147621 - DNA, 25 bp, Homo sapien
tgtcgagactgctgcgtggagccgg

SEQ ID NO: 147622 - DNA, 25 bp, Homo sapien
gtggagccgggcacagaactgtccc

SEQ ID NO: 147623 - DNA, 25 bp, Homo sapien
tggacctcgggtcatgatcctctgc

SEQ ID NO: 147624 - DNA, 25 bp, Homo sapien
ctcgggtcatgatcctctgcgtggg

SEQ ID NO: 147625 - DNA, 25 bp, Homo sapien
tcatgatcctctgcgtgggagggct

SEQ ID NO: 147626 - DNA, 25 bp, Homo sapien
tgaaccgggagtttctctgccctgt

SEQ ID NO: 147627 - DNA, 25 bp, Homo sapien
gaaccgggagtttctctgccctgtc

SEQ ID NO: 147628 - DNA, 25 bp, Homo sapien
ttattgttccttcttgtaataaagg

SEQ ID NO: 147629 - DNA, 25 bp, Homo sapien
ggcacagatcttttcattgctattc

SEQ ID NO: 147630 - DNA, 25 bp, Homo sapien
ttcaggctgttgataaggtcgatct

SEQ ID NO: 147631 - DNA, 25 bp, Homo sapien
cagaaatatccaacattgcacgagt

SEQ ID NO: 147632 - DNA, 25 bp, Homo sapien
cattgcacgagtatctttgtttatt

SEQ ID NO: 147633 - DNA, 25 bp, Homo sapien
atctttgtttattcctccacagact

SEQ ID NO: 147634 - DNA, 25 bp, Homo sapien
gccagagacacctagtcctgatgaa

SEQ ID NO: 147635 - DNA, 25 bp, Homo sapien
tagtcctgatgaaacgtctgctcct

SEQ ID NO: 147636 - DNA, 25 bp, Homo sapien
gtctgctccttgtcctaatattcat

SEQ ID NO: 147637 - DNA, 25 bp, Homo sapien
ttcatatcaacagcaccattcctgg

SEQ ID NO: 147638 - DNA, 25 bp, Homo sapien
aactgcagctgtcaatagcctaggg

SEQ ID NO: 147639 - DNA, 25 bp, Homo sapien
atagcctagggctgaatttttgtca

SEQ ID NO: 147640 - DNA, 25 bp, Homo sapien
tctgctgttttgaagattgtcgaac

SEQ ID NO: 147641 - DNA, 25 bp, Homo sapien
gattgtcgaacaggagcttggagac

SEQ ID NO: 147642 - DNA, 25 bp, Homo sapien
gggaggatacatatccgcattgcca

SEQ ID NO: 147643 - DNA, 25 bp, Homo sapien
atccgcattgccaaaatggactcct

SEQ ID NO: 147644 - DNA, 25 bp, Homo sapien
aaatggactcctatgctcggatctt

SEQ ID NO: 147645 - DNA, 25 bp, Homo sapien
tatgctcggatcttcttccccactg

SEQ ID NO: 147646 - DNA, 25 bp, Homo sapien
atctggtctattgggtctcctacct

SEQ ID NO: 147647 - DNA, 25 bp, Homo sapien
gtctcctacctctacctgtgaggag

SEQ ID NO: 147648 - DNA, 25 bp, Homo sapien
gggttttactgatatggttcttatt

SEQ ID NO: 147649 - DNA, 25 bp, Homo sapien
tcttattcactgagtctcatggaga

SEQ ID NO: 147650 - DNA, 25 bp, Homo sapien
gagatgtctgttctaagtccactta

SEQ ID NO: 147651 - DNA, 25 bp, Homo sapien
tgaaccccaatcctctgacagaaga

SEQ ID NO: 147652 - DNA, 25 bp, Homo sapien
aatcctctgacagaagaaccccagg

SEQ ID NO: 147653 - DNA, 25 bp, Homo sapien
cagggtcctgtagccctaagtggta

SEQ ID NO: 147654 - DNA, 25 bp, Homo sapien
ggtcctgtagccctaagtggtacta

SEQ ID NO: 147655 - DNA, 25 bp, Homo sapien
cctgtagccctaagtggtactaact

SEQ ID NO: 147656 - DNA, 25 bp, Homo sapien
tggtactaactttccttcattcaac

SEQ ID NO: 147657 - DNA, 25 bp, Homo sapien
tactaactttccttcattcaaccca

SEQ ID NO: 147658 - DNA, 25 bp, Homo sapien
tggctgatttggaattttgtgcccc

SEQ ID NO: 147659 - DNA, 25 bp, Homo sapien
atgtaagcaccccttcatttggcat

SEQ ID NO: 147660 - DNA, 25 bp, Homo sapien
cttcatttggcattccccacttgag

SEQ ID NO: 147661 - DNA, 25 bp, Homo sapien
gaattacccttttgccccgaacatg

SEQ ID NO: 147662 - DNA, 25 bp, Homo sapien
tcagaggagaggtagtaaaggcttt

SEQ ID NO: 147663 - DNA, 25 bp, Homo sapien
aaggcttttgtcgttctaaatcctg

SEQ ID NO: 147664 - DNA, 25 bp, Homo sapien
ggcttttgtcgttctaaatcctgat

SEQ ID NO: 147665 - DNA, 25 bp, Homo sapien
ttttgtcgttctaaatcctgattac

SEQ ID NO: 147666 - DNA, 25 bp, Homo sapien
ctaaatcctgattacaagtcacatg

SEQ ID NO: 147667 - DNA, 25 bp, Homo sapien
ataaaggagattcaggagcatgtta

SEQ ID NO: 147668 - DNA, 25 bp, Homo sapien
acaaatatcccagaaaggtagaatt

SEQ ID NO: 147669 - DNA, 25 bp, Homo sapien
aatttattcaagagctgccaaagac

SEQ ID NO: 147670 - DNA, 25 bp, Homo sapien
gagctgccaaagactgtcagtggga

SEQ ID NO: 147671 - DNA, 25 bp, Homo sapien
gccaaagactgtcagtgggaagaca

SEQ ID NO: 147672 - DNA, 25 bp, Homo sapien
gtttcattaattaccatatctataa

SEQ ID NO: 147673 - DNA, 25 bp, Homo sapien
gtttaatcttaatgtgttgtttcca

SEQ ID NO: 147674 - DNA, 25 bp, Homo sapien
gtgttgtttccataagtgacatgaa

SEQ ID NO: 147675 - DNA, 25 bp, Homo sapien
gattctcaattgttatgtccactta

SEQ ID NO: 147676 - DNA, 25 bp, Homo sapien
gtccacttattcactaggtaaattt

SEQ ID NO: 147677 - DNA, 25 bp, Homo sapien
ttaccccttcctttgatcatttcat

SEQ ID NO: 147678 - DNA, 25 bp, Homo sapien
ccttcctttgatcatttcatgtgaa

SEQ ID NO: 147679 - DNA, 25 bp, Homo sapien
ataaattccttgttgatgtaccctt

SEQ ID NO: 147680 - DNA, 25 bp, Homo sapien
ccttgttgatgtacccttaaattga

SEQ ID NO: 147681 - DNA, 25 bp, Homo sapien
ttttgaagtatcttgtatcgactac

SEQ ID NO: 147682 - DNA, 25 bp, Homo sapien
gtatcttgtatcgactacatatgta

SEQ ID NO: 147683 - DNA, 25 bp, Homo sapien
catatgtatttgaccctgtgggagg

SEQ ID NO: 147684 - DNA, 25 bp, Homo sapien
tgagtttgcaaactcttgtgaaggg

SEQ ID NO: 147685 - DNA, 25 bp, Homo sapien
gagtgctgagatatggactctctaa

SEQ ID NO: 147686 - DNA, 25 bp, Homo sapien
gggccgaacgcttgtaattggaata

SEQ ID NO: 147687 - DNA, 25 bp, Homo sapien
gaaatatttgtcttctcaggcctat

SEQ ID NO: 147688 - DNA, 25 bp, Homo sapien
tcttctcaggcctatgtttgcggaa

SEQ ID NO: 147689 - DNA, 25 bp, Homo sapien
ctatgtttgcggaatgcattgtcaa

SEQ ID NO: 147690 - DNA, 25 bp, Homo sapien
gcattgtcaatatttagcaaactgt

SEQ ID NO: 147691 - DNA, 25 bp, Homo sapien
gttttgacaaatgagcaccagtggt

SEQ ID NO: 147692 - DNA, 25 bp, Homo sapien
ggtactaagcacagaaactcactat

SEQ ID NO: 147693 - DNA, 25 bp, Homo sapien
gaaactcactatataagtcacatag

SEQ ID NO: 147694 - DNA, 25 bp, Homo sapien
gaaacttgaaaggtctgaggatgat

SEQ ID NO: 147695 - DNA, 25 bp, Homo sapien
cgttccttggaagatcatgtttaag

SEQ ID NO: 147696 - DNA, 25 bp, Homo sapien
tgtttaagtgactcctgttgcctga

SEQ ID NO: 147697 - DNA, 25 bp, Homo sapien
ctgagcacaaaaatgggcaccaatg

SEQ ID NO: 147698 - DNA, 25 bp, Homo sapien
atggaggaaaatgacccttgggctg

SEQ ID NO: 147699 - DNA, 25 bp, Homo sapien
ccttccagggtaccactgagggaag

SEQ ID NO: 147700 - DNA, 25 bp, Homo sapien
tttggctaaccgagcccctgaaatg

SEQ ID NO: 147701 - DNA, 25 bp, Homo sapien
gcccagtactgccatttgacatgag

SEQ ID NO: 147702 - DNA, 25 bp, Homo sapien
gccatttgacatgagggtaccttcg

SEQ ID NO: 147703 - DNA, 25 bp, Homo sapien
gtaccttcgccctcaggagatgtga

SEQ ID NO: 147704 - DNA, 25 bp, Homo sapien
gaacaaggtctaatttgtgcgtgtg

SEQ ID NO: 147705 - DNA, 25 bp, Homo sapien
gtgcgtgtgtggactcactatggaa

SEQ ID NO: 147706 - DNA, 25 bp, Homo sapien
ggagcagaccagcacttcaacctag

SEQ ID NO: 147707 - DNA, 25 bp, Homo sapien
caacctagtccgctgaagatggagg

SEQ ID NO: 147708 - DNA, 25 bp, Homo sapien
tgccttgcccatgaaatcttggcgg

SEQ ID NO: 147709 - DNA, 25 bp, Homo sapien
atcttggcgggctttctgagcctga

SEQ ID NO: 147710 - DNA, 25 bp, Homo sapien
tttctgagcctgatcccggcctggg

SEQ ID NO: 147711 - DNA, 25 bp, Homo sapien
cttctacagcggtgccttccaaagg

SEQ ID NO: 147712 - DNA, 25 bp, Homo sapien
ggtgccttccaaaggctgctcctga

SEQ ID NO: 147713 - DNA, 25 bp, Homo sapien
tgctcctgacacactatgtggcata

SEQ ID NO: 147714 - DNA, 25 bp, Homo sapien
actatgtggcatacctgaagctcaa

SEQ ID NO: 147715 - DNA, 25 bp, Homo sapien
tgaagctcaacaccaaggtcaggta

SEQ ID NO: 147716 - DNA, 25 bp, Homo sapien
caccaaggtcaggtagccaggcggt

SEQ ID NO: 147717 - DNA, 25 bp, Homo sapien
aaatctgtgcactgtcaagctggag

SEQ ID NO: 147718 - DNA, 25 bp, Homo sapien
gtgcactgtcaagctggagacacag

SEQ ID NO: 147719 - DNA, 25 bp, Homo sapien
gtcaagctggagacacagttggaga

SEQ ID NO: 147720 - DNA, 25 bp, Homo sapien
ttataacctttcagtcatcacccaa

SEQ ID NO: 147721 - DNA, 25 bp, Homo sapien
ttatacaggaacacccctgtgcagc

SEQ ID NO: 147722 - DNA, 25 bp, Homo sapien
gaacacccctgtgcagctacgttta

SEQ ID NO: 147723 - DNA, 25 bp, Homo sapien
acccctgtgcagctacgtttacgtc

SEQ ID NO: 147724 - DNA, 25 bp, Homo sapien
gtttacgtcgtcatttattccacag

SEQ ID NO: 147725 - DNA, 25 bp, Homo sapien
gtactatagatgtacttctgctgtg

SEQ ID NO: 147726 - DNA, 25 bp, Homo sapien
gtacttctgctgtgagattccctag

SEQ ID NO: 147727 - DNA, 25 bp, Homo sapien
tacttctgctgtgagattccctagt

SEQ ID NO: 147728 - DNA, 25 bp, Homo sapien
gtagtctaagcatacgtatacaata

SEQ ID NO: 147729 - DNA, 25 bp, Homo sapien
aattgagcatagtaattacccacag

SEQ ID NO: 147730 - DNA, 25 bp, Homo sapien
atagtaattacccacagaaggagga

SEQ ID NO: 147731 - DNA, 25 bp, Homo sapien
agcacataggtagatgccaagttat

SEQ ID NO: 147732 - DNA, 25 bp, Homo sapien
gccaagttatgcagctgttctggtt

SEQ ID NO: 147733 - DNA, 25 bp, Homo sapien
caagttatgcagctgttctggttcc

SEQ ID NO: 147734 - DNA, 25 bp, Homo sapien
tctggttcctcctggtaggcttaca

SEQ ID NO: 147735 - DNA, 25 bp, Homo sapien
ggttcctcctggtaggcttacaagt

SEQ ID NO: 147736 - DNA, 25 bp, Homo sapien
cctggtaggcttacaagtgtttact

SEQ ID NO: 147737 - DNA, 25 bp, Homo sapien
ggcttacaagtgtttactatatgct

SEQ ID NO: 147738 - DNA, 25 bp, Homo sapien
caagtgtttactatatgctattaat

SEQ ID NO: 147739 - DNA, 25 bp, Homo sapien
gactctgaaaaacattccaggaaac

SEQ ID NO: 147740 - DNA, 25 bp, Homo sapien
tggagagcctcttagtgattgtgtc

SEQ ID NO: 147741 - DNA, 25 bp, Homo sapien
agagcctcttagtgattgtgtctgc

SEQ ID NO: 147742 - DNA, 25 bp, Homo sapien
attgtgtctgcattgttattgtgga

SEQ ID NO: 147743 - DNA, 25 bp, Homo sapien
gaagatttaccttttctgttgtacg

SEQ ID NO: 147744 - DNA, 25 bp, Homo sapien
tttctgttgtacgtaaagcttaaat

SEQ ID NO: 147745 - DNA, 25 bp, Homo sapien
cttttgttgtgactttttagccagt

SEQ ID NO: 147746 - DNA, 25 bp, Homo sapien
cagtgactttttctgagcttttcat

SEQ ID NO: 147747 - DNA, 25 bp, Homo sapien
gactttttctgagcttttcatggaa

SEQ ID NO: 147748 - DNA, 25 bp, Homo sapien
gagcttttcatggaagtggcagtga

SEQ ID NO: 147749 - DNA, 25 bp, Homo sapien
atcttgctggattaatgttttgtac

SEQ ID NO: 147750 - DNA, 25 bp, Homo sapien
tgggaggccccggttcctgcatatc

SEQ ID NO: 147751 - DNA, 25 bp, Homo sapien
gggaggccccggttcctgcatatcc

SEQ ID NO: 147752 - DNA, 25 bp, Homo sapien
ggaggccccggttcctgcatatccg

SEQ ID NO: 147753 - DNA, 25 bp, Homo sapien
gaggccccggttcctgcatatccgg

SEQ ID NO: 147754 - DNA, 25 bp, Homo sapien
aggccccggttcctgcatatccgga

SEQ ID NO: 147755 - DNA, 25 bp, Homo sapien
ggccccggttcctgcatatccggag

SEQ ID NO: 147756 - DNA, 25 bp, Homo sapien
ccccggttcctgcatatccggaggt

SEQ ID NO: 147757 - DNA, 25 bp, Homo sapien
cggttcctgcatatccggaggtctg

SEQ ID NO: 147758 - DNA, 25 bp, Homo sapien
ggttcctgcatatccggaggtctgg

SEQ ID NO: 147759 - DNA, 25 bp, Homo sapien
cctgcatatccggaggtctgggcca

SEQ ID NO: 147760 - DNA, 25 bp, Homo sapien
atgccttgtcagtgccgccagcctg

SEQ ID NO: 147761 - DNA, 25 bp, Homo sapien
tctgatatcttttggtctaaattat

SEQ ID NO: 147762 - DNA, 25 bp, Homo sapien
gtctaaattatgaggtaccaagatt

SEQ ID NO: 147763 - DNA, 25 bp, Homo sapien
gtaccaagattgtttctttgtttct

SEQ ID NO: 147764 - DNA, 25 bp, Homo sapien
aagccattacgtatgaactcatccg

SEQ ID NO: 147765 - DNA, 25 bp, Homo sapien
acgtatgaactcatccgtgtctcat

SEQ ID NO: 147766 - DNA, 25 bp, Homo sapien
aactcatccgtgtctcattttgtgt

SEQ ID NO: 147767 - DNA, 25 bp, Homo sapien
attttgtgatctcttgtccactaag

SEQ ID NO: 147768 - DNA, 25 bp, Homo sapien
ttgtgatctcttgtccactaagtat

SEQ ID NO: 147769 - DNA, 25 bp, Homo sapien
taaatgccagtatctcagtctttct

SEQ ID NO: 147770 - DNA, 25 bp, Homo sapien
gccagtatctcagtctttctgaagc

SEQ ID NO: 147771 - DNA, 25 bp, Homo sapien
ctcagtctttctgaagccctgaaat

SEQ ID NO: 147772 - DNA, 25 bp, Homo sapien
aagctggcgtctgccgtctgaggct

SEQ ID NO: 147773 - DNA, 25 bp, Homo sapien
agctggcgtctgccgtctgaggctg

SEQ ID NO: 147774 - DNA, 25 bp, Homo sapien
gctggcgtctgccgtctgaggctgg

SEQ ID NO: 147775 - DNA, 25 bp, Homo sapien
ctggcgtctgccgtctgaggctgga

SEQ ID NO: 147776 - DNA, 25 bp, Homo sapien
tggcgtctgccgtctgaggctggag

SEQ ID NO: 147777 - DNA, 25 bp, Homo sapien
ggcgtctgccgtctgaggctggagc

SEQ ID NO: 147778 - DNA, 25 bp, Homo sapien
gcgtctgccgtctgaggctggagcg

SEQ ID NO: 147779 - DNA, 25 bp, Homo sapien
cgtctgccgtctgaggctggagcgc

SEQ ID NO: 147780 - DNA, 25 bp, Homo sapien
gtctgccgtctgaggctggagcgca

SEQ ID NO: 147781 - DNA, 25 bp, Homo sapien
tctgccgtctgaggctggagcgcag

SEQ ID NO: 147782 - DNA, 25 bp, Homo sapien
ctgccgtctgaggctggagcgcagt

SEQ ID NO: 147783 - DNA, 25 bp, Homo sapien
agtcagcccttcacagaactactac

SEQ ID NO: 147784 - DNA, 25 bp, Homo sapien
agcccttcacagaactactacggaa

SEQ ID NO: 147785 - DNA, 25 bp, Homo sapien
attatatcatatagccagtgtcagt

SEQ ID NO: 147786 - DNA, 25 bp, Homo sapien
atatagccagtgtcagttaaccaag

SEQ ID NO: 147787 - DNA, 25 bp, Homo sapien
gccagtgtcagttaaccaaggattt

SEQ ID NO: 147788 - DNA, 25 bp, Homo sapien
ggatttagttacaccaaacactcta

SEQ ID NO: 147789 - DNA, 25 bp, Homo sapien
tagttacaccaaacactctatgatg

SEQ ID NO: 147790 - DNA, 25 bp, Homo sapien
gatgaattacatctctcaaattcta

SEQ ID NO: 147791 - DNA, 25 bp, Homo sapien
attacatctctcaaattctaatgat

SEQ ID NO: 147792 - DNA, 25 bp, Homo sapien
ttctaatgattagatccttgtaaaa

SEQ ID NO: 147793 - DNA, 25 bp, Homo sapien
aaattttacctgtgcctaaacagag

SEQ ID NO: 147794 - DNA, 25 bp, Homo sapien
actttcttctaccagacccttctgg

SEQ ID NO: 147795 - DNA, 25 bp, Homo sapien
ttctggtgccagatcctcttctcaa

SEQ ID NO: 147796 - DNA, 25 bp, Homo sapien
ccagatcctcttctcaaagctggga

SEQ ID NO: 147797 - DNA, 25 bp, Homo sapien
tacaggtgtgagcatagtgagacct

SEQ ID NO: 147798 - DNA, 25 bp, Homo sapien
gagaccttggcgctacaaaataaag

SEQ ID NO: 147799 - DNA, 25 bp, Homo sapien
attcctgttctttcttacacaagag

SEQ ID NO: 147800 - DNA, 25 bp, Homo sapien
ttcttacacaagagctggagcccgt

SEQ ID NO: 147801 - DNA, 25 bp, Homo sapien
tgactcgggccttagaactttgcat

SEQ ID NO: 147802 - DNA, 25 bp, Homo sapien
tagaactttgcatagcagctgctac

SEQ ID NO: 147803 - DNA, 25 bp, Homo sapien
gcagctgctactagctctttgagat

SEQ ID NO: 147804 - DNA, 25 bp, Homo sapien
cagttctgccttatctaaatcacca

SEQ ID NO: 147805 - DNA, 25 bp, Homo sapien
ggatttttatctctctcaacttcct

SEQ ID NO: 147806 - DNA, 25 bp, Homo sapien
tttttatctctctcaacttcctgca

SEQ ID NO: 147807 - DNA, 25 bp, Homo sapien
tttatctctctcaacttcctgcact

SEQ ID NO: 147808 - DNA, 25 bp, Homo sapien
aatagaaacttttgtctttactgag

SEQ ID NO: 147809 - DNA, 25 bp, Homo sapien
gaaacttttgtctttactgagatga

SEQ ID NO: 147810 - DNA, 25 bp, Homo sapien
gatgaggatatgtttgagatgcaca

SEQ ID NO: 147811 - DNA, 25 bp, Homo sapien
gtttgagatgcacagttgggataat

SEQ ID NO: 147812 - DNA, 25 bp, Homo sapien
gggaaaatgacatctaagctttacc

SEQ ID NO: 147813 - DNA, 25 bp, Homo sapien
ttaacacttttcacttggttcttat

SEQ ID NO: 147814 - DNA, 25 bp, Homo sapien
cacttttcacttggttcttatactg

SEQ ID NO: 147815 - DNA, 25 bp, Homo sapien
ttttcacttggttcttatactgaat

SEQ ID NO: 147816 - DNA, 25 bp, Homo sapien
agtcagcccttcacagaactactac

SEQ ID NO: 147817 - DNA, 25 bp, Homo sapien
gtcagcccttcacagaactactacg

SEQ ID NO: 147818 - DNA, 25 bp, Homo sapien
tcagcccttcacagaactactacgg

SEQ ID NO: 147819 - DNA, 25 bp, Homo sapien
cagcccttcacagaactactacgga

SEQ ID NO: 147820 - DNA, 25 bp, Homo sapien
agcccttcacagaactactacggaa

SEQ ID NO: 147821 - DNA, 25 bp, Homo sapien
gcccttcacagaactactacggaag

SEQ ID NO: 147822 - DNA, 25 bp, Homo sapien
cccttcacagaactactacggaaga

SEQ ID NO: 147823 - DNA, 25 bp, Homo sapien
ccttcacagaactactacggaagaa

SEQ ID NO: 147824 - DNA, 25 bp, Homo sapien
tgaaccaacacctgtgcggctcaca

SEQ ID NO: 147825 - DNA, 25 bp, Homo sapien
tgtgcggctcacacctggtggaagc

SEQ ID NO: 147826 - DNA, 25 bp, Homo sapien
tggtggaagctctctacctagtgtg

SEQ ID NO: 147827 - DNA, 25 bp, Homo sapien
tggaagctctctacctagtgtgcgg

SEQ ID NO: 147828 - DNA, 25 bp, Homo sapien
cggggaacgaggcttcttctacaca

SEQ ID NO: 147829 - DNA, 25 bp, Homo sapien
ggtccctgcagaagcgtggcattgt

SEQ ID NO: 147830 - DNA, 25 bp, Homo sapien
cctgcagaagcgtggcattgtggaa

SEQ ID NO: 147831 - DNA, 25 bp, Homo sapien
attgtggaacaatgctgtaccagca

SEQ ID NO: 147832 - DNA, 25 bp, Homo sapien
gaacaatgctgtaccagcatctgct

SEQ ID NO: 147833 - DNA, 25 bp, Homo sapien
gagaactactgcaactagacgcagc

SEQ ID NO: 147834 - DNA, 25 bp, Homo sapien
gcaactagacgcagcccgcaggcag

SEQ ID NO: 147835 - DNA, 25 bp, Homo sapien
tttaacgccaaagaaagactctcag

SEQ ID NO: 147836 - DNA, 25 bp, Homo sapien
caaagtcatggttctctggtggttt

SEQ ID NO: 147837 - DNA, 25 bp, Homo sapien
ttctctggtggtttgtcttgacatt

SEQ ID NO: 147838 - DNA, 25 bp, Homo sapien
agaaagcccacagtcttctgagttg

SEQ ID NO: 147839 - DNA, 25 bp, Homo sapien
gcccacagtcttctgagttgtgcta

SEQ ID NO: 147840 - DNA, 25 bp, Homo sapien
gttgtgctacaccaatatttctatg

SEQ ID NO: 147841 - DNA, 25 bp, Homo sapien
gaacagatcttacaactgagagtga

SEQ ID NO: 147842 - DNA, 25 bp, Homo sapien
ctgagagtgatctgcagatttttca

SEQ ID NO: 147843 - DNA, 25 bp, Homo sapien
cagatttttcagagtcatgttctcc

SEQ ID NO: 147844 - DNA, 25 bp, Homo sapien
gtttgtaaaattccctagctctctg

SEQ ID NO: 147845 - DNA, 25 bp, Homo sapien
tccctagctctctgcactgagctga

SEQ ID NO: 147846 - DNA, 25 bp, Homo sapien
tgtttttcatctgtgtacactccag

SEQ ID NO: 147847 - DNA, 25 bp, Homo sapien
gtttttcatctgtgtacactccagc

SEQ ID NO: 147848 - DNA, 25 bp, Homo sapien
attatttcctctgcataattgaaat

SEQ ID NO: 147849 - DNA, 25 bp, Homo sapien
ttatttcctctgcataattgaaata

SEQ ID NO: 147850 - DNA, 25 bp, Homo sapien
tatttcctctgcataattgaaatag

SEQ ID NO: 147851 - DNA, 25 bp, Homo sapien
atttcctctgcataattgaaatagt

SEQ ID NO: 147852 - DNA, 25 bp, Homo sapien
tttcctctgcataattgaaatagta

SEQ ID NO: 147853 - DNA, 25 bp, Homo sapien
ttcctctgcataattgaaatagtat

SEQ ID NO: 147854 - DNA, 25 bp, Homo sapien
tcctctgcataattgaaatagtatt

SEQ ID NO: 147855 - DNA, 25 bp, Homo sapien
cctctgcataattgaaatagtatta

SEQ ID NO: 147856 - DNA, 25 bp, Homo sapien
tagtattaaatgtctaaagcacatg

SEQ ID NO: 147857 - DNA, 25 bp, Homo sapien
gaggtggccttctggaagtatcagc

SEQ ID NO: 147858 - DNA, 25 bp, Homo sapien
tatcagcggcctgaaggcctctgag

SEQ ID NO: 147859 - DNA, 25 bp, Homo sapien
tttggacagagtaatgactccccag

SEQ ID NO: 147860 - DNA, 25 bp, Homo sapien
gactccccagaaaacgtcatataag

SEQ ID NO: 147861 - DNA, 25 bp, Homo sapien
gaccaggaggagcatccttgacctt

SEQ ID NO: 147862 - DNA, 25 bp, Homo sapien
gaccttcatttaacttggctcactt

SEQ ID NO: 147863 - DNA, 25 bp, Homo sapien
gctcacttctcttcagacttgggta

SEQ ID NO: 147864 - DNA, 25 bp, Homo sapien
acttgggtagaagtgcagagccaca

SEQ ID NO: 147865 - DNA, 25 bp, Homo sapien
agagccacagaattgctttccttcc

SEQ ID NO: 147866 - DNA, 25 bp, Homo sapien
cgcctttgacatgaggccttcagta

SEQ ID NO: 147867 - DNA, 25 bp, Homo sapien
gaggccttcagtaaagagctacaga

SEQ ID NO: 147868 - DNA, 25 bp, Homo sapien
tcagtaggttttaaggagtccccag

SEQ ID NO: 147869 - DNA, 25 bp, Homo sapien
ttctgggcccgaccagcttatactg

SEQ ID NO: 147870 - DNA, 25 bp, Homo sapien
ctgggcccgaccagcttatactgct

SEQ ID NO: 147871 - DNA, 25 bp, Homo sapien
cgaccagcttatactgctccatctt

SEQ ID NO: 147872 - DNA, 25 bp, Homo sapien
gaccagcttatactgctccatcttc

SEQ ID NO: 147873 - DNA, 25 bp, Homo sapien
tgccccgccaagtactgcacaggga

SEQ ID NO: 147874 - DNA, 25 bp, Homo sapien
gggccctgctccgtgagataatgtg

SEQ ID NO: 147875 - DNA, 25 bp, Homo sapien
ggccctgctccgtgagataatgtga

SEQ ID NO: 147876 - DNA, 25 bp, Homo sapien
gccctgctccgtgagataatgtgaa

SEQ ID NO: 147877 - DNA, 25 bp, Homo sapien
ctgctccgtgagataatgtgaaata

SEQ ID NO: 147878 - DNA, 25 bp, Homo sapien
agataatgtgaaatacgactgtgga

SEQ ID NO: 147879 - DNA, 25 bp, Homo sapien
taatgaataacacaggagaatggat

SEQ ID NO: 147880 - DNA, 25 bp, Homo sapien
aggagaatggataaggcaaaacgga

SEQ ID NO: 147881 - DNA, 25 bp, Homo sapien
tctgtgaaatgctatctctcctgaa

SEQ ID NO: 147882 - DNA, 25 bp, Homo sapien
tgtgaaatgctatctctcctgaagc

SEQ ID NO: 147883 - DNA, 25 bp, Homo sapien
gtgaaatgctatctctcctgaagca

SEQ ID NO: 147884 - DNA, 25 bp, Homo sapien
tgaaatgctatctctcctgaagcaa

SEQ ID NO: 147885 - DNA, 25 bp, Homo sapien
aaatgctatctctcctgaagcaata

SEQ ID NO: 147886 - DNA, 25 bp, Homo sapien
atgctatctctcctgaagcaatact

SEQ ID NO: 147887 - DNA, 25 bp, Homo sapien
ctaatttttctgactgatatggaaa

SEQ ID NO: 147888 - DNA, 25 bp, Homo sapien
tctgactgatatggaaacgattgcc

SEQ ID NO: 147889 - DNA, 25 bp, Homo sapien
tgactgatatggaaacgattgccaa

SEQ ID NO: 147890 - DNA, 25 bp, Homo sapien
aacagtgttcagttcatagcagaaa

SEQ ID NO: 147891 - DNA, 25 bp, Homo sapien
gagccacaatgaaaccaaggaggta

SEQ ID NO: 147892 - DNA, 25 bp, Homo sapien
aagatgactggaaatacgtggccat

SEQ ID NO: 147893 - DNA, 25 bp, Homo sapien
ggacagagtatttctttgggtattt

SEQ ID NO: 147894 - DNA, 25 bp, Homo sapien
gtgtatttggaactgcagggctatt

SEQ ID NO: 147895 - DNA, 25 bp, Homo sapien
gaactgcagggctatttctacagcc

SEQ ID NO: 147896 - DNA, 25 bp, Homo sapien
ttctacagccactacttgggaacac

SEQ ID NO: 147897 - DNA, 25 bp, Homo sapien
gccactacttgggaacacaggaaaa

SEQ ID NO: 147898 - DNA, 25 bp, Homo sapien
gttcagaaatttacagacaccatat

SEQ ID NO: 147899 - DNA, 25 bp, Homo sapien
ttacagacaccatatttgttctgca

SEQ ID NO: 147900 - DNA, 25 bp, Homo sapien
tgcattccctgccacaaggaaagga

SEQ ID NO: 147901 - DNA, 25 bp, Homo sapien
gcttgggatcatggaattggccgtt

SEQ ID NO: 147902 - DNA, 25 bp, Homo sapien
cttgggatcatggaattggccgttg

SEQ ID NO: 147903 - DNA, 25 bp, Homo sapien
gatcatggaattggccgttgggctt

SEQ ID NO: 147904 - DNA, 25 bp, Homo sapien
catggaattggccgttgggcttacc

SEQ ID NO: 147905 - DNA, 25 bp, Homo sapien
tgccagcgggctggatcctgtcaca

SEQ ID NO: 147906 - DNA, 25 bp, Homo sapien
gagacctacaggaggccagagtgaa

SEQ ID NO: 147907 - DNA, 25 bp, Homo sapien
agacctacaggaggccagagtgaag

SEQ ID NO: 147908 - DNA, 25 bp, Homo sapien
cagagtgaaggggtccgttctgtcc

SEQ ID NO: 147909 - DNA, 25 bp, Homo sapien
ggtccgttctgtccctcacactgtg

SEQ ID NO: 147910 - DNA, 25 bp, Homo sapien
gcctcccctggatcatgtcattcaa

SEQ ID NO: 147911 - DNA, 25 bp, Homo sapien
ctcccctggatcatgtcattcaatt

SEQ ID NO: 147912 - DNA, 25 bp, Homo sapien
gcaatgtagtggatggccagccttt

SEQ ID NO: 147913 - DNA, 25 bp, Homo sapien
tagtggatggccagccttttacaaa

SEQ ID NO: 147914 - DNA, 25 bp, Homo sapien
tgataatgggagcaaccaagtggct

SEQ ID NO: 147915 - DNA, 25 bp, Homo sapien
caaccaagtggcttttgggagagga

SEQ ID NO: 147916 - DNA, 25 bp, Homo sapien
ttaactttgcaaactggtcttcctg

SEQ ID NO: 147917 - DNA, 25 bp, Homo sapien
aactttgcaaactggtcttcctgct

SEQ ID NO: 147918 - DNA, 25 bp, Homo sapien
gtgatgtcatttctggagataaaat

SEQ ID NO: 147919 - DNA, 25 bp, Homo sapien
tacgtttctgatgatggcaaagctc

SEQ ID NO: 147920 - DNA, 25 bp, Homo sapien
gctgaagatccatttattgcaattc

SEQ ID NO: 147921 - DNA, 25 bp, Homo sapien
agatccatttattgcaattcatgct

SEQ ID NO: 147922 - DNA, 25 bp, Homo sapien
gcaattcatgctgaatctaaattgt

SEQ ID NO: 147923 - DNA, 25 bp, Homo sapien
tcttcctaccgggattacctatgtt

SEQ ID NO: 147924 - DNA, 25 bp, Homo sapien
tacctatgtttttccttgcttgcaa

SEQ ID NO: 147925 - DNA, 25 bp, Homo sapien
tttccttgcttgcaatctcatctga

SEQ ID NO: 147926 - DNA, 25 bp, Homo sapien
gcaatctcatctgattttgctagaa

SEQ ID NO: 147927 - DNA, 25 bp, Homo sapien
gcatattgcatgagtattaccaaga

SEQ ID NO: 147928 - DNA, 25 bp, Homo sapien
aaatgtctttccatgtacctctggt

SEQ ID NO: 147929 - DNA, 25 bp, Homo sapien
catgtacctctggtgtgtcagggat

SEQ ID NO: 147930 - DNA, 25 bp, Homo sapien
gtgtgtcagggattttgtgcctcaa

SEQ ID NO: 147931 - DNA, 25 bp, Homo sapien
tttgtgcctcaaaaaatgtttccaa

SEQ ID NO: 147932 - DNA, 25 bp, Homo sapien
caaggttgtgtgtttatactgtgta

SEQ ID NO: 147933 - DNA, 25 bp, Homo sapien
aattcacggtgaacagcacttttat

SEQ ID NO: 147934 - DNA, 25 bp, Homo sapien
aaagtgctcacacctgctggagagg

SEQ ID NO: 147935 - DNA, 25 bp, Homo sapien
ggagaggatctaccacacttgcaag

SEQ ID NO: 147936 - DNA, 25 bp, Homo sapien
tctggtaattgaaagcctcctggat

SEQ ID NO: 147937 - DNA, 25 bp, Homo sapien
atgaagacaggcgaggtcctctgct

SEQ ID NO: 147938 - DNA, 25 bp, Homo sapien
tctactctctgaacatgcttgtgca

SEQ ID NO: 147939 - DNA, 25 bp, Homo sapien
acatgcttgtgcagacggaagggca

SEQ ID NO: 147940 - DNA, 25 bp, Homo sapien
tcctctcttctgctggcttcagaga

SEQ ID NO: 147941 - DNA, 25 bp, Homo sapien
aaacaggagccatttatgatgccat

SEQ ID NO: 147942 - DNA, 25 bp, Homo sapien
ttatgatgccattttagccaggaaa

SEQ ID NO: 147943 - DNA, 25 bp, Homo sapien
gtttcttgtgacctggaactaacgt

SEQ ID NO: 147944 - DNA, 25 bp, Homo sapien
acctggaactaacgtcaaagcacac

SEQ ID NO: 147945 - DNA, 25 bp, Homo sapien
gggctgagcaggacgccgctggtgc

SEQ ID NO: 147946 - DNA, 25 bp, Homo sapien
agcaggacgccgctggtgctggccg

SEQ ID NO: 147947 - DNA, 25 bp, Homo sapien
aagactgggcccatgaacacagaga

SEQ ID NO: 147948 - DNA, 25 bp, Homo sapien
gactgggcccatgaacacagagagg

SEQ ID NO: 147949 - DNA, 25 bp, Homo sapien
catgaacacagagagggcctaaccg

SEQ ID NO: 147950 - DNA, 25 bp, Homo sapien
cagagagggcctaaccgagatcagt

SEQ ID NO: 147951 - DNA, 25 bp, Homo sapien
gagggcctaaccgagatcagtattt

SEQ ID NO: 147952 - DNA, 25 bp, Homo sapien
gggcctaaccgagatcagtatttaa

SEQ ID NO: 147953 - DNA, 25 bp, Homo sapien
gcctaaccgagatcagtatttaact

SEQ ID NO: 147954 - DNA, 25 bp, Homo sapien
ttccctccccgataaagaatgttct

SEQ ID NO: 147955 - DNA, 25 bp, Homo sapien
ccctccccgataaagaatgttctat

SEQ ID NO: 147956 - DNA, 25 bp, Homo sapien
tgacccgctcggacttactgcctga

SEQ ID NO: 147957 - DNA, 25 bp, Homo sapien
ggacttactgcctgaccttggaatc

SEQ ID NO: 147958 - DNA, 25 bp, Homo sapien
ttactgcctgaccttggaatcgtcc

SEQ ID NO: 147959 - DNA, 25 bp, Homo sapien
gaccttggaatcgtccctatatcag

SEQ ID NO: 147960 - DNA, 25 bp, Homo sapien
tggaatcgtccctatatcagggcct

SEQ ID NO: 147961 - DNA, 25 bp, Homo sapien
agtgacctccttctgcaaagtggca

SEQ ID NO: 147962 - DNA, 25 bp, Homo sapien
tctacaggcctgcagcccctaagtg

SEQ ID NO: 147963 - DNA, 25 bp, Homo sapien
agcccctaagtgcaaacacagcatg

SEQ ID NO: 147964 - DNA, 25 bp, Homo sapien
gcatgggtccagaagacgtggtcta

SEQ ID NO: 147965 - DNA, 25 bp, Homo sapien
agacgtggtctagaccagggctgct

SEQ ID NO: 147966 - DNA, 25 bp, Homo sapien
agaccagggctgctctttccacttg

SEQ ID NO: 147967 - DNA, 25 bp, Homo sapien
acagcaggatcaagacaacccgttg

SEQ ID NO: 147968 - DNA, 25 bp, Homo sapien
gcaggatcaagacaacccgttggag

SEQ ID NO: 147969 - DNA, 25 bp, Homo sapien
ggatcaagacaacccgttggagccc

SEQ ID NO: 147970 - DNA, 25 bp, Homo sapien
gagcccctgtgttccagaggacctg

SEQ ID NO: 147971 - DNA, 25 bp, Homo sapien
tgtgttccagaggacctgatgccaa

SEQ ID NO: 147972 - DNA, 25 bp, Homo sapien
tgttccagaggacctgatgccaagg

SEQ ID NO: 147973 - DNA, 25 bp, Homo sapien
aggcccctttatctgtacatagtga

SEQ ID NO: 147974 - DNA, 25 bp, Homo sapien
gcccctttatctgtacatagtgact

SEQ ID NO: 147975 - DNA, 25 bp, Homo sapien
tatctgtacatagtgactgagtggg

SEQ ID NO: 147976 - DNA, 25 bp, Homo sapien
tgggctgagcacagcttgacccctc

SEQ ID NO: 147977 - DNA, 25 bp, Homo sapien
gctgagcacagcttgacccctctag

SEQ ID NO: 147978 - DNA, 25 bp, Homo sapien
gcaaagtaatggttctcatagtggt

SEQ ID NO: 147979 - DNA, 25 bp, Homo sapien
agtggtataaagttcacacagtatt

SEQ ID NO: 147980 - DNA, 25 bp, Homo sapien
cacagtattatgacactcccagcgt

SEQ ID NO: 147981 - DNA, 25 bp, Homo sapien
gacactcccagcgtatcatagaaaa

SEQ ID NO: 147982 - DNA, 25 bp, Homo sapien
gggaacagcaaaccaatgctattgt

SEQ ID NO: 147983 - DNA, 25 bp, Homo sapien
gattattggattcacacccagctga

SEQ ID NO: 147984 - DNA, 25 bp, Homo sapien
tgacgcgactatcattctctcacaa

SEQ ID NO: 147985 - DNA, 25 bp, Homo sapien
ttgtcatatacccagcttcagatac

SEQ ID NO: 147986 - DNA, 25 bp, Homo sapien
acccagcttcagataccatgcaatg

SEQ ID NO: 147987 - DNA, 25 bp, Homo sapien
gatacaactatcatacctggaccca

SEQ ID NO: 147988 - DNA, 25 bp, Homo sapien
attcttatggccacaagcaaagtaa

SEQ ID NO: 147989 - DNA, 25 bp, Homo sapien
aggaggagttccaccatgagctcac

SEQ ID NO: 147990 - DNA, 25 bp, Homo sapien
agctcacccgtgtctatgacgcaaa

SEQ ID NO: 147991 - DNA, 25 bp, Homo sapien
atgacgcaaagatcaccagccatgt

SEQ ID NO: 147992 - DNA, 25 bp, Homo sapien
aagatcaccagccatgtgccttagt

SEQ ID NO: 147993 - DNA, 25 bp, Homo sapien
gtgccttagtgtccttcttaacaga

SEQ ID NO: 147994 - DNA, 25 bp, Homo sapien
ttaacagactcaaaccacatggacc

SEQ ID NO: 147995 - DNA, 25 bp, Homo sapien
catggaccacgaatattctttctgt

SEQ ID NO: 147996 - DNA, 25 bp, Homo sapien
tttctgtccagaagggctactttcc

SEQ ID NO: 147997 - DNA, 25 bp, Homo sapien
gtccagaagggctactttccacata

SEQ ID NO: 147998 - DNA, 25 bp, Homo sapien
actttccacatatagagctccaggg

SEQ ID NO: 147999 - DNA, 25 bp, Homo sapien
tatagagctccagggactgtctttt

SEQ ID NO: 148000 - DNA, 25 bp, Homo sapien
aaggccctctaacctatgcaggttt

SEQ ID NO: 148001 - DNA, 25 bp, Homo sapien
gcaggtttccccattatgcatatag

SEQ ID NO: 148002 - DNA, 25 bp, Homo sapien
gttttgctcacttcatatgtaacag

SEQ ID NO: 148003 - DNA, 25 bp, Homo sapien
gtaacaggtgcccttatgttgtgct

SEQ ID NO: 148004 - DNA, 25 bp, Homo sapien
tatgttgtgctgtatcctgtgcttt

SEQ ID NO: 148005 - DNA, 25 bp, Homo sapien
ctgtgctttttctgtgggaccattc

SEQ ID NO: 148006 - DNA, 25 bp, Homo sapien
gggaccattccattcaggagcaaag

SEQ ID NO: 148007 - DNA, 25 bp, Homo sapien
gagcaaagagcaccatgattccaat

SEQ ID NO: 148008 - DNA, 25 bp, Homo sapien
ccatgattccaatcttgtgtgtgtt

SEQ ID NO: 148009 - DNA, 25 bp, Homo sapien
tgtgtgtgtttactaacccttccct

SEQ ID NO: 148010 - DNA, 25 bp, Homo sapien
aacccttccctgaggcttgtgtatg

SEQ ID NO: 148011 - DNA, 25 bp, Homo sapien
tcacaacaacccaatgtggtaggtt

SEQ ID NO: 148012 - DNA, 25 bp, Homo sapien
aggttattgatatcctcttcttaaa

SEQ ID NO: 148013 - DNA, 25 bp, Homo sapien
ggcccagagaaatgtaatttgcctg

SEQ ID NO: 148014 - DNA, 25 bp, Homo sapien
aaggttgcttaagatcaaactgcta

SEQ ID NO: 148015 - DNA, 25 bp, Homo sapien
cagtttgagtctgagctagtgctcc

SEQ ID NO: 148016 - DNA, 25 bp, Homo sapien
gagctagtgctcctaaacactggac

SEQ ID NO: 148017 - DNA, 25 bp, Homo sapien
aaacactggacatttttgctgtgaa

SEQ ID NO: 148018 - DNA, 25 bp, Homo sapien
ttttgctgtgaaccacagtcgggaa

SEQ ID NO: 148019 - DNA, 25 bp, Homo sapien
ttaatgtttagactctttcctcaga

SEQ ID NO: 148020 - DNA, 25 bp, Homo sapien
tagactctttcctcagaggctttta

SEQ ID NO: 148021 - DNA, 25 bp, Homo sapien
gaggcttttaactacacacaatttt

SEQ ID NO: 148022 - DNA, 25 bp, Homo sapien
taaagctttaactggctctataaat

SEQ ID NO: 148023 - DNA, 25 bp, Homo sapien
gctttaactggctctataaattaag

SEQ ID NO: 148024 - DNA, 25 bp, Homo sapien
gctttccttgaaatgcacttattct

SEQ ID NO: 148025 - DNA, 25 bp, Homo sapien
cttgaaatgcacttattcttattac

SEQ ID NO: 148026 - DNA, 25 bp, Homo sapien
aatgcacttattcttattacaagca

SEQ ID NO: 148027 - DNA, 25 bp, Homo sapien
tttgctttcagtaaaatgctttcca

SEQ ID NO: 148028 - DNA, 25 bp, Homo sapien
tttcagtaaaatgctttccaactct

SEQ ID NO: 148029 - DNA, 25 bp, Homo sapien
ctgtttagtgtattaattaccagtg

SEQ ID NO: 148030 - DNA, 25 bp, Homo sapien
agtgtattaattaccagtggattgg

SEQ ID NO: 148031 - DNA, 25 bp, Homo sapien
ccagtggattggtagaactgctttt

SEQ ID NO: 148032 - DNA, 25 bp, Homo sapien
ttaccttaggcttacagaattaaat

SEQ ID NO: 148033 - DNA, 25 bp, Homo sapien
tggtgaatggcaagtattctctcca

SEQ ID NO: 148034 - DNA, 25 bp, Homo sapien
attctctccatggagtgaccagctt

SEQ ID NO: 148035 - DNA, 25 bp, Homo sapien
agtgaccagctttgtgtccagccgg

SEQ ID NO: 148036 - DNA, 25 bp, Homo sapien
gctgtaatgtctccaggaagcctac

SEQ ID NO: 148037 - DNA, 25 bp, Homo sapien
ggaagcctacagtcttcacccaggt

SEQ ID NO: 148038 - DNA, 25 bp, Homo sapien
tctctgcttacatctcctggataaa

SEQ ID NO: 148039 - DNA, 25 bp, Homo sapien
taaataatgtcatcgcctccaactg

SEQ ID NO: 148040 - DNA, 25 bp, Homo sapien
tgaacattttcctgagtccaacgac

SEQ ID NO: 148041 - DNA, 25 bp, Homo sapien
gagtccaacgaccttcccaaaatgg

SEQ ID NO: 148042 - DNA, 25 bp, Homo sapien
ggttcttagatctgcaataggactt

SEQ ID NO: 148043 - DNA, 25 bp, Homo sapien
cattctgaaagactattgagccatt

SEQ ID NO: 148044 - DNA, 25 bp, Homo sapien
ggctctggtcttttctaaagtgggc

SEQ ID NO: 148045 - DNA, 25 bp, Homo sapien
tctggtcttttctaaagtgggcggt

SEQ ID NO: 148046 - DNA, 25 bp, Homo sapien
aagtgggcggtttgtcttttgatct

SEQ ID NO: 148047 - DNA, 25 bp, Homo sapien
ctttcccttttggatgtgcgtgtgt

SEQ ID NO: 148048 - DNA, 25 bp, Homo sapien
tgtgccatgtgcgtggcacgcatat

SEQ ID NO: 148049 - DNA, 25 bp, Homo sapien
cgtgtgaacggctttgggtcctgct

SEQ ID NO: 148050 - DNA, 25 bp, Homo sapien
gaacggctttgggtcctgctggttt

SEQ ID NO: 148051 - DNA, 25 bp, Homo sapien
ggctttgggtcctgctggttttgct

SEQ ID NO: 148052 - DNA, 25 bp, Homo sapien
ctgtgggtctgtggtatctgacact

SEQ ID NO: 148053 - DNA, 25 bp, Homo sapien
ctgtggtatctgacactgtggacat

SEQ ID NO: 148054 - DNA, 25 bp, Homo sapien
gacactgtggacattaatgtacttc

SEQ ID NO: 148055 - DNA, 25 bp, Homo sapien
tgggcattgggctcggctcggagaa

SEQ ID NO: 148056 - DNA, 25 bp, Homo sapien
gggcattgggctcggctcggagaat

SEQ ID NO: 148057 - DNA, 25 bp, Homo sapien
cattgggctcggctcggagaatgct

SEQ ID NO: 148058 - DNA, 25 bp, Homo sapien
attgggctcggctcggagaatgctg

SEQ ID NO: 148059 - DNA, 25 bp, Homo sapien
ttgggctcggctcggagaatgctgc

SEQ ID NO: 148060 - DNA, 25 bp, Homo sapien
gggctcggctcggagaatgctgccg

SEQ ID NO: 148061 - DNA, 25 bp, Homo sapien
ggctcggctcggagaatgctgccgg

SEQ ID NO: 148062 - DNA, 25 bp, Homo sapien
ctcggagaatgctgccgggccctgc

SEQ ID NO: 148063 - DNA, 25 bp, Homo sapien
actgggacgaagctgatatcggacc

SEQ ID NO: 148064 - DNA, 25 bp, Homo sapien
ctgggacgaagctgatatcggaccc

SEQ ID NO: 148065 - DNA, 25 bp, Homo sapien
tgggacgaagctgatatcggaccct

SEQ ID NO: 148066 - DNA, 25 bp, Homo sapien
agagtctcccgctgcaatctgggtg

SEQ ID NO: 148067 - DNA, 25 bp, Homo sapien
gctgcaatctgggtggtaactgcca

SEQ ID NO: 148068 - DNA, 25 bp, Homo sapien
gtaactgccagccttggaggatcgt

SEQ ID NO: 148069 - DNA, 25 bp, Homo sapien
aggatcgtggccaacgtggacctgc

SEQ ID NO: 148070 - DNA, 25 bp, Homo sapien
caacgtggacctgcctacggagggt

SEQ ID NO: 148071 - DNA, 25 bp, Homo sapien
aggtctcactgctttgcaccgtggt

SEQ ID NO: 148072 - DNA, 25 bp, Homo sapien
tttgcaccgtggtcagagggactgt

SEQ ID NO: 148073 - DNA, 25 bp, Homo sapien
cacccagacctgaatgcttctgaga

SEQ ID NO: 148074 - DNA, 25 bp, Homo sapien
gaaggactgacgagagatgtatatt

SEQ ID NO: 148075 - DNA, 25 bp, Homo sapien
ttaattttttaactgctgcaaacat

SEQ ID NO: 148076 - DNA, 25 bp, Homo sapien
aactgctgcaaacattgtacatcca

SEQ ID NO: 148077 - DNA, 25 bp, Homo sapien
agggaggtaggcactgcctcagtct

SEQ ID NO: 148078 - DNA, 25 bp, Homo sapien
aggcactgcctcagtcttcatccaa

SEQ ID NO: 148079 - DNA, 25 bp, Homo sapien
tcagaatcttccctttaacccaaga

SEQ ID NO: 148080 - DNA, 25 bp, Homo sapien
tccagggacccttagatcacatcac

SEQ ID NO: 148081 - DNA, 25 bp, Homo sapien
gggacccttagatcacatcactcca

SEQ ID NO: 148082 - DNA, 25 bp, Homo sapien
tgccaggccccaggttaggaatagt

SEQ ID NO: 148083 - DNA, 25 bp, Homo sapien
caggccccaggttaggaatagtggt

SEQ ID NO: 148084 - DNA, 25 bp, Homo sapien
tcaccgctcccagcaactgaaagga

SEQ ID NO: 148085 - DNA, 25 bp, Homo sapien
aaggacaacactatctggagccacc

SEQ ID NO: 148086 - DNA, 25 bp, Homo sapien
ggagccacccactgaaagggctgca

SEQ ID NO: 148087 - DNA, 25 bp, Homo sapien
ggctgcaggcatgggctgtacccaa

SEQ ID NO: 148088 - DNA, 25 bp, Homo sapien
ctcttctcatccctttatcagaata

SEQ ID NO: 148089 - DNA, 25 bp, Homo sapien
tttatcagaatatagggctcctctc

SEQ ID NO: 148090 - DNA, 25 bp, Homo sapien
gaatatagggctcctctcattcctg

SEQ ID NO: 148091 - DNA, 25 bp, Homo sapien
ggtggtgagctgctgcatatttttt

SEQ ID NO: 148092 - DNA, 25 bp, Homo sapien
tggtgagctgctgcatattttttat

SEQ ID NO: 148093 - DNA, 25 bp, Homo sapien
attgtgtttctctagtgttatggca

SEQ ID NO: 148094 - DNA, 25 bp, Homo sapien
gtttctctagtgttatggcagtgga

SEQ ID NO: 148095 - DNA, 25 bp, Homo sapien
tctctagtgttatggcagtggaggt

SEQ ID NO: 148096 - DNA, 25 bp, Homo sapien
gaatttagtccccaggtgggacaag

SEQ ID NO: 148097 - DNA, 25 bp, Homo sapien
ttttcattttggagctagttactgg

SEQ ID NO: 148098 - DNA, 25 bp, Homo sapien
ttttggagctagttactgggagtaa

SEQ ID NO: 148099 - DNA, 25 bp, Homo sapien
tcaatgacagactagccaaggaggg

SEQ ID NO: 148100 - DNA, 25 bp, Homo sapien
ccgagctgccatgtttaggaaacac

SEQ ID NO: 148101 - DNA, 25 bp, Homo sapien
gctgccatgtttaggaaacacactg

SEQ ID NO: 148102 - DNA, 25 bp, Homo sapien
tgctcccagcatcacaaggcacttg

SEQ ID NO: 148103 - DNA, 25 bp, Homo sapien
gcatcacaaggcacttgtctacaag

SEQ ID NO: 148104 - DNA, 25 bp, Homo sapien
acttgtctacaagtgtgtcccaaca

SEQ ID NO: 148105 - DNA, 25 bp, Homo sapien
aagtgtgtcccaacacagtcctggg

SEQ ID NO: 148106 - DNA, 25 bp, Homo sapien
tgtgtcccaacacagtcctgggcca

SEQ ID NO: 148107 - DNA, 25 bp, Homo sapien
gggagcacataaagaagcttgccaa

SEQ ID NO: 148108 - DNA, 25 bp, Homo sapien
tccccagttgtcctgtttctgtaac

SEQ ID NO: 148109 - DNA, 25 bp, Homo sapien
ctgtaacttatgatgtcttttccct

SEQ ID NO: 148110 - DNA, 25 bp, Homo sapien
taacaatttaacagagaatctctag

SEQ ID NO: 148111 - DNA, 25 bp, Homo sapien
gtgttagatgtgcacaaggaaagtt

SEQ ID NO: 148112 - DNA, 25 bp, Homo sapien
tcagacatatttgaatgactgctgt

SEQ ID NO: 148113 - DNA, 25 bp, Homo sapien
catatttgaatgactgctgtactgc

SEQ ID NO: 148114 - DNA, 25 bp, Homo sapien
actgctgtactgcaatatttggatt

SEQ ID NO: 148115 - DNA, 25 bp, Homo sapien
gcaatatttggattgtcattcttac

SEQ ID NO: 148116 - DNA, 25 bp, Homo sapien
ggattgtcattcttacaaaacattt

SEQ ID NO: 148117 - DNA, 25 bp, Homo sapien
ctttccaatatgctgtatagccttt

SEQ ID NO: 148118 - DNA, 25 bp, Homo sapien
caatatgctgtatagcctttgtcat

SEQ ID NO: 148119 - DNA, 25 bp, Homo sapien
tgctgtatagcctttgtcattttat

SEQ ID NO: 148120 - DNA, 25 bp, Homo sapien
atagcctttgtcattttataatttt

SEQ ID NO: 148121 - DNA, 25 bp, Homo sapien
ttcatttggtgtactaacatcaaaa

SEQ ID NO: 148122 - DNA, 25 bp, Homo sapien
aacatcaaaatgtatccaagccatt

SEQ ID NO: 148123 - DNA, 25 bp, Homo sapien
ttatttgtatcgcattttttattac

SEQ ID NO: 148124 - DNA, 25 bp, Homo sapien
ttcatgtttatataagctgtaatca

SEQ ID NO: 148125 - DNA, 25 bp, Homo sapien
gctgtaatcaaaaaggactagtagt

SEQ ID NO: 148126 - DNA, 25 bp, Homo sapien
gtgattttagccctaggcccgaaat

SEQ ID NO: 148127 - DNA, 25 bp, Homo sapien
gattttagccctaggcccgaaatga

SEQ ID NO: 148128 - DNA, 25 bp, Homo sapien
agccctaggcccgaaatgactagca

SEQ ID NO: 148129 - DNA, 25 bp, Homo sapien
cctaggcccgaaatgactagcaaat

SEQ ID NO: 148130 - DNA, 25 bp, Homo sapien
gactagcaaatatcattttctgtat

SEQ ID NO: 148131 - DNA, 25 bp, Homo sapien
ttttctgtatgaattgtggaacatc

SEQ ID NO: 148132 - DNA, 25 bp, Homo sapien
agggagagacaaggctgctgctatt

SEQ ID NO: 148133 - DNA, 25 bp, Homo sapien
gagacaaggctgctgctattagagc

SEQ ID NO: 148134 - DNA, 25 bp, Homo sapien
tgctgctattagagcccatcctgga

SEQ ID NO: 148135 - DNA, 25 bp, Homo sapien
tattagagcccatcctggagcccca

SEQ ID NO: 148136 - DNA, 25 bp, Homo sapien
aaacaggtgtttgatttgtcaccgt

SEQ ID NO: 148137 - DNA, 25 bp, Homo sapien
gtttgatttgtcaccgttggagctt

SEQ ID NO: 148138 - DNA, 25 bp, Homo sapien
atttgtcaccgttggagcttggata

SEQ ID NO: 148139 - DNA, 25 bp, Homo sapien
accgttggagcttggatatgtgcgt

SEQ ID NO: 148140 - DNA, 25 bp, Homo sapien
gaatgcacaggtgggtatttaatct

SEQ ID NO: 148141 - DNA, 25 bp, Homo sapien
atctgtattattccccgttcttgga

SEQ ID NO: 148142 - DNA, 25 bp, Homo sapien
gctggggtactttacattcaataaa

SEQ ID NO: 148143 - DNA, 25 bp, Homo sapien
caagctgcacatcgtcgacacggtg

SEQ ID NO: 148144 - DNA, 25 bp, Homo sapien
agctgcacatcgtcgacacggtgtg

SEQ ID NO: 148145 - DNA, 25 bp, Homo sapien
acatcgtcgacacggtgtgcgcgca

SEQ ID NO: 148146 - DNA, 25 bp, Homo sapien
atcgtcgacacggtgtgcgcgcact

SEQ ID NO: 148147 - DNA, 25 bp, Homo sapien
gtcgacacggtgtgcgcgcacttcc

SEQ ID NO: 148148 - DNA, 25 bp, Homo sapien
ggtgtgcgcgcacttccgccaggcg

SEQ ID NO: 148149 - DNA, 25 bp, Homo sapien
gtacgccgctacctggacagcgcga

SEQ ID NO: 148150 - DNA, 25 bp, Homo sapien
tggacagcgcgatgcaggagaaaga

SEQ ID NO: 148151 - DNA, 25 bp, Homo sapien
tctgtcgcccaataaaggcatcttt

SEQ ID NO: 148152 - DNA, 25 bp, Homo sapien
gtcgcccaataaaggcatctttgtc

SEQ ID NO: 148153 - DNA, 25 bp, Homo sapien
cccaataaaggcatctttgtcggga

SEQ ID NO: 148154 - DNA, 25 bp, Homo sapien
acgtcacccacgtttctggagggca

SEQ ID NO: 148155 - DNA, 25 bp, Homo sapien
tcacccacgtttctggagggcaaca

SEQ ID NO: 148156 - DNA, 25 bp, Homo sapien
acccacgtttctggagggcaacacg

SEQ ID NO: 148157 - DNA, 25 bp, Homo sapien
cacgtttctggagggcaacacggtg

SEQ ID NO: 148158 - DNA, 25 bp, Homo sapien
gatcctctacaaagcccactacttt

SEQ ID NO: 148159 - DNA, 25 bp, Homo sapien
tacaaagcccactactttttcgccg

SEQ ID NO: 148160 - DNA, 25 bp, Homo sapien
tttttcgccgtctccaccctgaatt

SEQ ID NO: 148161 - DNA, 25 bp, Homo sapien
gtcatctacacgtggcgcagccggg

SEQ ID NO: 148162 - DNA, 25 bp, Homo sapien
tacacgtggcgcagccgggacctgc

SEQ ID NO: 148163 - DNA, 25 bp, Homo sapien
cgggaggtgcttcggccgctgcagt

SEQ ID NO: 148164 - DNA, 25 bp, Homo sapien
tgcaaggacggaggcgggtcgggac

SEQ ID NO: 148165 - DNA, 25 bp, Homo sapien
tgcaaacgagccgttcaccaccatc

SEQ ID NO: 148166 - DNA, 25 bp, Homo sapien
accagcaaagcaatgtgctcctgat

SEQ ID NO: 148167 - DNA, 25 bp, Homo sapien
agcaaagcaatgtgctcctgatcaa

SEQ ID NO: 148168 - DNA, 25 bp, Homo sapien
aagcaatgtgctcctgatcaagtag

SEQ ID NO: 148169 - DNA, 25 bp, Homo sapien
gcaatgtgctcctgatcaagtagat

SEQ ID NO: 148170 - DNA, 25 bp, Homo sapien
atgtgctcctgatcaagtagatttt

SEQ ID NO: 148171 - DNA, 25 bp, Homo sapien
cttatgttccaagtgtacaagagta

SEQ ID NO: 148172 - DNA, 25 bp, Homo sapien
gtgtacaagagtaagattatgctca

SEQ ID NO: 148173 - DNA, 25 bp, Homo sapien
gaagtgattaattggctccatattt

SEQ ID NO: 148174 - DNA, 25 bp, Homo sapien
taattggctccatatttagactaat

SEQ ID NO: 148175 - DNA, 25 bp, Homo sapien
ttggctccatatttagactaataaa

SEQ ID NO: 148176 - DNA, 25 bp, Homo sapien
ggcagttttactgttgtcgctacag

SEQ ID NO: 148177 - DNA, 25 bp, Homo sapien
gtcgctacagcaagaggtgcccata

SEQ ID NO: 148178 - DNA, 25 bp, Homo sapien
aggtgcccatattcctgctggctaa

SEQ ID NO: 148179 - DNA, 25 bp, Homo sapien
acaacagaatatccaggtcactatg

SEQ ID NO: 148180 - DNA, 25 bp, Homo sapien
atggacatgatttcctacaattatg

SEQ ID NO: 148181 - DNA, 25 bp, Homo sapien
tatgattactatatccgaggagcaa

SEQ ID NO: 148182 - DNA, 25 bp, Homo sapien
gagcaacaaccactttctctgcagt

SEQ ID NO: 148183 - DNA, 25 bp, Homo sapien
ttctctgcagtggaaagggatcgcc

SEQ ID NO: 148184 - DNA, 25 bp, Homo sapien
gtggaagttcataatgtgccggatg

SEQ ID NO: 148185 - DNA, 25 bp, Homo sapien
gtgccggatgactgaatacgactgt

SEQ ID NO: 148186 - DNA, 25 bp, Homo sapien
aaatgtttagatttgccacatacca

SEQ ID NO: 148187 - DNA, 25 bp, Homo sapien
gttctctgttcaaaagtaattggca

SEQ ID NO: 148188 - DNA, 25 bp, Homo sapien
ttctctgttcaaaagtaattggcag

SEQ ID NO: 148189 - DNA, 25 bp, Homo sapien
tctctgttcaaaagtaattggcagt

SEQ ID NO: 148190 - DNA, 25 bp, Homo sapien
ctctgttcaaaagtaattggcagtg

SEQ ID NO: 148191 - DNA, 25 bp, Homo sapien
tctgttcaaaagtaattggcagtga

SEQ ID NO: 148192 - DNA, 25 bp, Homo sapien
ctgttcaaaagtaattggcagtgat

SEQ ID NO: 148193 - DNA, 25 bp, Homo sapien
tgttcaaaagtaattggcagtgatt

SEQ ID NO: 148194 - DNA, 25 bp, Homo sapien
gttcaaaagtaattggcagtgattg

SEQ ID NO: 148195 - DNA, 25 bp, Homo sapien
gttggtataaactgagggtggcttt

SEQ ID NO: 148196 - DNA, 25 bp, Homo sapien
taaactgagggtggcttttagagac

SEQ ID NO: 148197 - DNA, 25 bp, Homo sapien
ggcttttagagacccagacttggtt

SEQ ID NO: 148198 - DNA, 25 bp, Homo sapien
gagacccagacttggttggcagcgc

SEQ ID NO: 148199 - DNA, 25 bp, Homo sapien
ccagacttggttggcagcgctgcca

SEQ ID NO: 148200 - DNA, 25 bp, Homo sapien
gcatccttaatgcttctcagtcttc

SEQ ID NO: 148201 - DNA, 25 bp, Homo sapien
ttctcagtcttcagccagagggagg

SEQ ID NO: 148202 - DNA, 25 bp, Homo sapien
agggctgttatttccagaggtgcgc

SEQ ID NO: 148203 - DNA, 25 bp, Homo sapien
atttccagaggtgcgctttttatgt

SEQ ID NO: 148204 - DNA, 25 bp, Homo sapien
cagaggtgcgctttttatgtacttt

SEQ ID NO: 148205 - DNA, 25 bp, Homo sapien
ggcatgcatctgtgagctttagatc

SEQ ID NO: 148206 - DNA, 25 bp, Homo sapien
tatcacatttgtgtccgatgagaat

SEQ ID NO: 148207 - DNA, 25 bp, Homo sapien
gatgccaagatcctcaatgatgtgc

SEQ ID NO: 148208 - DNA, 25 bp, Homo sapien
ctcaatgatgtgcaggatcgctttg

SEQ ID NO: 148209 - DNA, 25 bp, Homo sapien
gtgcaggatcgctttgaggtcaata

SEQ ID NO: 148210 - DNA, 25 bp, Homo sapien
ggtcaatattagtgagctgcctgat

SEQ ID NO: 148211 - DNA, 25 bp, Homo sapien
agtgagctgcctgatgagatagaca

SEQ ID NO: 148212 - DNA, 25 bp, Homo sapien
gagatagacatctcctcctacattg

SEQ ID NO: 148213 - DNA, 25 bp, Homo sapien
tcctcctacattgaacagacacggt

SEQ ID NO: 148214 - DNA, 25 bp, Homo sapien
gacacggtagaagactcgcccattt

SEQ ID NO: 148215 - DNA, 25 bp, Homo sapien
aagactcgcccattttggaatgtga

SEQ ID NO: 148216 - DNA, 25 bp, Homo sapien
aatgtgaccgtctgtccttcaggag

SEQ ID NO: 148217 - DNA, 25 bp, Homo sapien
tagttcttcaaggaatggggggcca

SEQ ID NO: 148218 - DNA, 25 bp, Homo sapien
gagcctttgttgctaatcaaatccg

SEQ ID NO: 148219 - DNA, 25 bp, Homo sapien
agcctttgttgctaatcaaatccgg

SEQ ID NO: 148220 - DNA, 25 bp, Homo sapien
gcctttgttgctaatcaaatccggg

SEQ ID NO: 148221 - DNA, 25 bp, Homo sapien
ctttgttgctaatcaaatccgggac

SEQ ID NO: 148222 - DNA, 25 bp, Homo sapien
ttgttgctaatcaaatccgggactt

SEQ ID NO: 148223 - DNA, 25 bp, Homo sapien
tgttgctaatcaaatccgggacttg

SEQ ID NO: 148224 - DNA, 25 bp, Homo sapien
gttgctaatcaaatccgggacttgt

SEQ ID NO: 148225 - DNA, 25 bp, Homo sapien
tgctaatcaaatccgggacttgttt

SEQ ID NO: 148226 - DNA, 25 bp, Homo sapien
atcaaatccgggacttgtttgtacg

SEQ ID NO: 148227 - DNA, 25 bp, Homo sapien
tcaaatccgggacttgtttgtacgt

SEQ ID NO: 148228 - DNA, 25 bp, Homo sapien
ggtaaaataccaactcatttcttat

SEQ ID NO: 148229 - DNA, 25 bp, Homo sapien
taccaactcatttcttatatcatat

SEQ ID NO: 148230 - DNA, 25 bp, Homo sapien
gggtggtccttcttgaattcatgta

SEQ ID NO: 148231 - DNA, 25 bp, Homo sapien
ggtccttcttgaattcatgtacatg

SEQ ID NO: 148232 - DNA, 25 bp, Homo sapien
gtacatggtattaacacttagtgtt

SEQ ID NO: 148233 - DNA, 25 bp, Homo sapien
atgctgttttcaacattgtatttgg

SEQ ID NO: 148234 - DNA, 25 bp, Homo sapien
tgtatttggactatgcatgtgtttt

SEQ ID NO: 148235 - DNA, 25 bp, Homo sapien
catgtgttttttccccattgtatat

SEQ ID NO: 148236 - DNA, 25 bp, Homo sapien
ccccattgtatataaagtaccgctt

SEQ ID NO: 148237 - DNA, 25 bp, Homo sapien
attctgttctttaagatcccctgta

SEQ ID NO: 148238 - DNA, 25 bp, Homo sapien
aagatcccctgtaagaatgtttaag

SEQ ID NO: 148239 - DNA, 25 bp, Homo sapien
gagttgtagccccatgaactagttt

SEQ ID NO: 148240 - DNA, 25 bp, Homo sapien
gtagccccatgaactagtttcttgt

SEQ ID NO: 148241 - DNA, 25 bp, Homo sapien
aactagtttcttgtctgggtcagga

SEQ ID NO: 148242 - DNA, 25 bp, Homo sapien
agtttcttgtctgggtcaggaacaa

SEQ ID NO: 148243 - DNA, 25 bp, Homo sapien
tctgggtcaggaacaagggccggct

SEQ ID NO: 148244 - DNA, 25 bp, Homo sapien
ctggtgtcagggtatgctgtttgct

SEQ ID NO: 148245 - DNA, 25 bp, Homo sapien
atgctgtttgctgatgggcagggac

SEQ ID NO: 148246 - DNA, 25 bp, Homo sapien
tgaacattccgggaccctgggcatc

SEQ ID NO: 148247 - DNA, 25 bp, Homo sapien
gggaccctgggcatcttatctaggt

SEQ ID NO: 148248 - DNA, 25 bp, Homo sapien
gggcatcttatctaggtccgtgcag

SEQ ID NO: 148249 - DNA, 25 bp, Homo sapien
ttatctaggtccgtgcagcccaagg

SEQ ID NO: 148250 - DNA, 25 bp, Homo sapien
tgtccattccatgtaccagcttagt

SEQ ID NO: 148251 - DNA, 25 bp, Homo sapien
gtccattccatgtaccagcttagtt

SEQ ID NO: 148252 - DNA, 25 bp, Homo sapien
ccattccatgtaccagcttagttat

SEQ ID NO: 148253 - DNA, 25 bp, Homo sapien
atctttgataaaggtagaggcacaa

SEQ ID NO: 148254 - DNA, 25 bp, Homo sapien
aggtagaggcacaaagaggcaaact

SEQ ID NO: 148255 - DNA, 25 bp, Homo sapien
attctaatgtgtgtacttcataata

SEQ ID NO: 148256 - DNA, 25 bp, Homo sapien
gtacttcataataattttttatcca

SEQ ID NO: 148257 - DNA, 25 bp, Homo sapien
gtaacatgaaacttacctaatcttc

SEQ ID NO: 148258 - DNA, 25 bp, Homo sapien
gaaacttacctaatcttcaaatgtt

SEQ ID NO: 148259 - DNA, 25 bp, Homo sapien
cctaatcttcaaatgttagcttcat

SEQ ID NO: 148260 - DNA, 25 bp, Homo sapien
acctttgaaatacttaatctttctg

SEQ ID NO: 148261 - DNA, 25 bp, Homo sapien
ctgggccttgacaaagtgtaaaccg

SEQ ID NO: 148262 - DNA, 25 bp, Homo sapien
ggccttgacaaagtgtaaaccgcat

SEQ ID NO: 148263 - DNA, 25 bp, Homo sapien
gtgtaaaccgcatggatgggcttcc

SEQ ID NO: 148264 - DNA, 25 bp, Homo sapien
taaaccgcatggatgggcttcccca

SEQ ID NO: 148265 - DNA, 25 bp, Homo sapien
aaccgcatggatgggcttccccaag

SEQ ID NO: 148266 - DNA, 25 bp, Homo sapien
ggcttccccaaggatttattgacat

SEQ ID NO: 148267 - DNA, 25 bp, Homo sapien
ttgctacttgagtgtgaacagttac

SEQ ID NO: 148268 - DNA, 25 bp, Homo sapien
gtgaacagttacctggaaatactga

SEQ ID NO: 148269 - DNA, 25 bp, Homo sapien
cctttattgagtaccaagccatgta

SEQ ID NO: 148270 - DNA, 25 bp, Homo sapien
ttattgagtaccaagccatgtaatg

SEQ ID NO: 148271 - DNA, 25 bp, Homo sapien
gtaccaagccatgtaatggtaactt

SEQ ID NO: 148272 - DNA, 25 bp, Homo sapien
gtgggaaggcaatttctctgcacac

SEQ ID NO: 148273 - DNA, 25 bp, Homo sapien
tctgcacacaagaggctacgttttg

SEQ ID NO: 148274 - DNA, 25 bp, Homo sapien
aaatgaactgtaaatgctcctagag

SEQ ID NO: 148275 - DNA, 25 bp, Homo sapien
gctcctagagtatattcctctgctg

SEQ ID NO: 148276 - DNA, 25 bp, Homo sapien
gagtatattcctctgctgaacaaaa

SEQ ID NO: 148277 - DNA, 25 bp, Homo sapien
taacagtaacacacccctgcttggg

SEQ ID NO: 148278 - DNA, 25 bp, Homo sapien
cttgggaccctagctatatgcattt

SEQ ID NO: 148279 - DNA, 25 bp, Homo sapien
atgcattttatgtgaccttgccatg

SEQ ID NO: 148280 - DNA, 25 bp, Homo sapien
gcttcagtgaacatactaattctat

SEQ ID NO: 148281 - DNA, 25 bp, Homo sapien
gtctagcacatgttgatttcctatg

SEQ ID NO: 148282 - DNA, 25 bp, Homo sapien
gatttcctatgtattctgggtattc

SEQ ID NO: 148283 - DNA, 25 bp, Homo sapien
gagagaccttgagagtcatgatgga

SEQ ID NO: 148284 - DNA, 25 bp, Homo sapien
aacgtcaacggcttgaaacagctga

SEQ ID NO: 148285 - DNA, 25 bp, Homo sapien
cagctgagagatttcaaaagcacct

SEQ ID NO: 148286 - DNA, 25 bp, Homo sapien
aaagcacctggaacgagtaattgaa

SEQ ID NO: 148287 - DNA, 25 bp, Homo sapien
gaaatgattcagaattgcttggctt

SEQ ID NO: 148288 - DNA, 25 bp, Homo sapien
cttggcttctttgcctgatgatttg

SEQ ID NO: 148289 - DNA, 25 bp, Homo sapien
tttgcctgatgatttgcctcattca

SEQ ID NO: 148290 - DNA, 25 bp, Homo sapien
aactgaaccaatggatgctgatgat

SEQ ID NO: 148291 - DNA, 25 bp, Homo sapien
tgatagcaacaattgtactggacag

SEQ ID NO: 148292 - DNA, 25 bp, Homo sapien
ttcaggtcataggagagatcagatt

SEQ ID NO: 148293 - DNA, 25 bp, Homo sapien
agatgctgccttgtgtgtcctaatt

SEQ ID NO: 148294 - DNA, 25 bp, Homo sapien
ggacttcagtcctagtggcattttc

SEQ ID NO: 148295 - DNA, 25 bp, Homo sapien
acttcagtcctagtggcattttcgg

SEQ ID NO: 148296 - DNA, 25 bp, Homo sapien
agtcctagtggcattttcggagcgt

SEQ ID NO: 148297 - DNA, 25 bp, Homo sapien
ctagtggcattttcggagcgtttca

SEQ ID NO: 148298 - DNA, 25 bp, Homo sapien
gtggcattttcggagcgtttcaaag

SEQ ID NO: 148299 - DNA, 25 bp, Homo sapien
ttcggagcgtttcaaagaggttact

SEQ ID NO: 148300 - DNA, 25 bp, Homo sapien
gagcgtttcaaagaggttactaccg

SEQ ID NO: 148301 - DNA, 25 bp, Homo sapien
ctccttttcctacaagcatctcaag

SEQ ID NO: 148302 - DNA, 25 bp, Homo sapien
tttcctacaagcatctcaagcacga

SEQ ID NO: 148303 - DNA, 25 bp, Homo sapien
acaagcatctcaagcacgagcggct

SEQ ID NO: 148304 - DNA, 25 bp, Homo sapien
aagcatctcaagcacgagcggctcc

SEQ ID NO: 148305 - DNA, 25 bp, Homo sapien
cttcatgttccctgcaatttattta

SEQ ID NO: 148306 - DNA, 25 bp, Homo sapien
ctttgtatttcactacataatctga

SEQ ID NO: 148307 - DNA, 25 bp, Homo sapien
taatctgaaatctttctccctagcc

SEQ ID NO: 148308 - DNA, 25 bp, Homo sapien
tctggaatccttctgcctactgaaa

SEQ ID NO: 148309 - DNA, 25 bp, Homo sapien
atccttctgcctactgaaatctgat

SEQ ID NO: 148310 - DNA, 25 bp, Homo sapien
tgaaatctgatatattacacacccc

SEQ ID NO: 148311 - DNA, 25 bp, Homo sapien
gaaggtagttttaatttggcaagtg

SEQ ID NO: 148312 - DNA, 25 bp, Homo sapien
atttggcaagtgttgctcttcttaa

SEQ ID NO: 148313 - DNA, 25 bp, Homo sapien
tgctcttcttaaaacactgctcaaa

SEQ ID NO: 148314 - DNA, 25 bp, Homo sapien
agatacttagtatcctcggctgctt

SEQ ID NO: 148315 - DNA, 25 bp, Homo sapien
tatcctcggctgcttgttagcagag

SEQ ID NO: 148316 - DNA, 25 bp, Homo sapien
gccataaagtgccagtttgcttagt

SEQ ID NO: 148317 - DNA, 25 bp, Homo sapien
aagtgccagtttgcttagttctcac

SEQ ID NO: 148318 - DNA, 25 bp, Homo sapien
cagtttgcttagttctcactgtctc

SEQ ID NO: 148319 - DNA, 25 bp, Homo sapien
tctcactgtctcctggtctgtgctg

SEQ ID NO: 148320 - DNA, 25 bp, Homo sapien
ctcgcaggtctcagcccgggacagg

SEQ ID NO: 148321 - DNA, 25 bp, Homo sapien
tcagcccgggacagggtcttgcaag

SEQ ID NO: 148322 - DNA, 25 bp, Homo sapien
gggacagggtcttgcaagcagcctc

SEQ ID NO: 148323 - DNA, 25 bp, Homo sapien
agggtcttgcaagcagcctcctggg

SEQ ID NO: 148324 - DNA, 25 bp, Homo sapien
aagcagcctcctgggcagtcgtaag

SEQ ID NO: 148325 - DNA, 25 bp, Homo sapien
agcctcctgggcagtcgtaagggtt

SEQ ID NO: 148326 - DNA, 25 bp, Homo sapien
cagtcgtaagggttgcggcgtgatg

SEQ ID NO: 148327 - DNA, 25 bp, Homo sapien
taatctgctatgcttgaatgccacg

SEQ ID NO: 148328 - DNA, 25 bp, Homo sapien
gcttgaatgccacgcggtacaaagg

SEQ ID NO: 148329 - DNA, 25 bp, Homo sapien
gaatgccacgcggtacaaaggaaaa

SEQ ID NO: 148330 - DNA, 25 bp, Homo sapien
gaaatattatgcaaattcccagatt

SEQ ID NO: 148331 - DNA, 25 bp, Homo sapien
gcaaattcccagatttgaagacaaa

SEQ ID NO: 148332 - DNA, 25 bp, Homo sapien
taattctaaccagagcaagcttttt

SEQ ID NO: 148333 - DNA, 25 bp, Homo sapien
agattccttttcttgtttatcagca

SEQ ID NO: 148334 - DNA, 25 bp, Homo sapien
attccttttcttgtttatcagcagt

SEQ ID NO: 148335 - DNA, 25 bp, Homo sapien
ccttttcttgtttatcagcagttgt

SEQ ID NO: 148336 - DNA, 25 bp, Homo sapien
ttcttgtttatcagcagttgttatt

SEQ ID NO: 148337 - DNA, 25 bp, Homo sapien
attacatccttgtggcacatttttt

SEQ ID NO: 148338 - DNA, 25 bp, Homo sapien
tcctggacggcgacaggctcacgct

SEQ ID NO: 148339 - DNA, 25 bp, Homo sapien
ggcgacaggctcacgctggccgact

SEQ ID NO: 148340 - DNA, 25 bp, Homo sapien
aagctgcacatcgtcgacacggtgt

SEQ ID NO: 148341 - DNA, 25 bp, Homo sapien
agctgcgcggcgtacgccgctacct

SEQ ID NO: 148342 - DNA, 25 bp, Homo sapien
gctacctggacagcgcgatgcagga

SEQ ID NO: 148343 - DNA, 25 bp, Homo sapien
gagttcaaatacacgtgtccgcaca

SEQ ID NO: 148344 - DNA, 25 bp, Homo sapien
gtgtccgcacagcgccgagatcctg

SEQ ID NO: 148345 - DNA, 25 bp, Homo sapien
acagcgccgagatcctggcggccta

SEQ ID NO: 148346 - DNA, 25 bp, Homo sapien
cgccgagatcctggcggcctaccgg

SEQ ID NO: 148347 - DNA, 25 bp, Homo sapien
gcgtctgtcgcccaataaaggcatc

SEQ ID NO: 148348 - DNA, 25 bp, Homo sapien
caataaaggcatctttgtcgggaaa

SEQ ID NO: 148349 - DNA, 25 bp, Homo sapien
gtctgtcctggcctaatgccaggct

SEQ ID NO: 148350 - DNA, 25 bp, Homo sapien
ctggcctaatgccaggctctgagtt

SEQ ID NO: 148351 - DNA, 25 bp, Homo sapien
tggcctaatgccaggctctgagttc

SEQ ID NO: 148352 - DNA, 25 bp, Homo sapien
ctgagttctgtgaccaaagccaggt

SEQ ID NO: 148353 - DNA, 25 bp, Homo sapien
gggatagtgtgagcttcattttgta

SEQ ID NO: 148354 - DNA, 25 bp, Homo sapien
gcttcattttgtacacgtgttgctt

SEQ ID NO: 148355 - DNA, 25 bp, Homo sapien
cttcattttgtacacgtgttgcttc

SEQ ID NO: 148356 - DNA, 25 bp, Homo sapien
ttcattttgtacacgtgttgcttcg

SEQ ID NO: 148357 - DNA, 25 bp, Homo sapien
cattttgtacacgtgttgcttcgtc

SEQ ID NO: 148358 - DNA, 25 bp, Homo sapien
attttgtacacgtgttgcttcgtcc

SEQ ID NO: 148359 - DNA, 25 bp, Homo sapien
ttttgtacacgtgttgcttcgtcca

SEQ ID NO: 148360 - DNA, 25 bp, Homo sapien
tcaccacattcgtcaggttggtttc

SEQ ID NO: 148361 - DNA, 25 bp, Homo sapien
ccacattcgtcaggttggtttcaaa

SEQ ID NO: 148362 - DNA, 25 bp, Homo sapien
catcacacctggtcaactttctttt

SEQ ID NO: 148363 - DNA, 25 bp, Homo sapien
tcaactttcttttgattagtgtttt

SEQ ID NO: 148364 - DNA, 25 bp, Homo sapien
atatctttttccatcatgttacttt

SEQ ID NO: 148365 - DNA, 25 bp, Homo sapien
ttttccatcatgttactttaaatat

SEQ ID NO: 148366 - DNA, 25 bp, Homo sapien
aaatgtgtttcttacagactgcatg

SEQ ID NO: 148367 - DNA, 25 bp, Homo sapien
gtgtttcttacagactgcatgtagt

SEQ ID NO: 148368 - DNA, 25 bp, Homo sapien
acagactgcatgtagttgggtataa

SEQ ID NO: 148369 - DNA, 25 bp, Homo sapien
actgcatgtagttgggtataatttt

SEQ ID NO: 148370 - DNA, 25 bp, Homo sapien
tttatccagtctaaaaatatctgtc

SEQ ID NO: 148371 - DNA, 25 bp, Homo sapien
acttgggatgttcctcttggtgtca

SEQ ID NO: 148372 - DNA, 25 bp, Homo sapien
ggtgtcatattccaactcagattga

SEQ ID NO: 148373 - DNA, 25 bp, Homo sapien
gattgagccctacattgtgctgcac

SEQ ID NO: 148374 - DNA, 25 bp, Homo sapien
gctgcacctggtcatacggagttga

SEQ ID NO: 148375 - DNA, 25 bp, Homo sapien
tacggagttgaatcagacctggttc

SEQ ID NO: 148376 - DNA, 25 bp, Homo sapien
cccaaggctcatggtccttggagga

SEQ ID NO: 148377 - DNA, 25 bp, Homo sapien
ttctgacctggatggcccatagacc

SEQ ID NO: 148378 - DNA, 25 bp, Homo sapien
atagacctgacgtcccagaatccat

SEQ ID NO: 148379 - DNA, 25 bp, Homo sapien
acgtcccagaatccatgcttctcat

SEQ ID NO: 148380 - DNA, 25 bp, Homo sapien
gtcaatacttacttcttagcactgt

SEQ ID NO: 148381 - DNA, 25 bp, Homo sapien
acttcttagcactgttgagagggtt

SEQ ID NO: 148382 - DNA, 25 bp, Homo sapien
acaatgtaactttatgcttccaaat

SEQ ID NO: 148383 - DNA, 25 bp, Homo sapien
atgtgaaccttgttgcagtgtataa

SEQ ID NO: 148384 - DNA, 25 bp, Homo sapien
gttgcagtgtataaggtggaagcct

SEQ ID NO: 148385 - DNA, 25 bp, Homo sapien
ggaagcctaaagaaatctcaccgaa

SEQ ID NO: 148386 - DNA, 25 bp, Homo sapien
gaaatctcaccgaaacttactgctg

SEQ ID NO: 148387 - DNA, 25 bp, Homo sapien
caccgaaacttactgctgaatgatt

SEQ ID NO: 148388 - DNA, 25 bp, Homo sapien
aatgattacattctcccttaagcag

SEQ ID NO: 148389 - DNA, 25 bp, Homo sapien
cattctcccttaagcagaaaacttt

SEQ ID NO: 148390 - DNA, 25 bp, Homo sapien
gaaaactttggatgtgccatgcaat

SEQ ID NO: 148391 - DNA, 25 bp, Homo sapien
gccatgcaatggtgtctgtgtaatt

SEQ ID NO: 148392 - DNA, 25 bp, Homo sapien
gtgtctgtgtaattattttgctctt

SEQ ID NO: 148393 - DNA, 25 bp, Homo sapien
cacggctgggccaagagagagatcc

SEQ ID NO: 148394 - DNA, 25 bp, Homo sapien
atcccgggggcataactgctggcag

SEQ ID NO: 148395 - DNA, 25 bp, Homo sapien
ataactgctggcagcaccgacgaac

SEQ ID NO: 148396 - DNA, 25 bp, Homo sapien
ccccaatgctgaccaaggaggagcc

SEQ ID NO: 148397 - DNA, 25 bp, Homo sapien
aggaggagcctgttccagaactgct

SEQ ID NO: 148398 - DNA, 25 bp, Homo sapien
aggagcctgttccagaactgctgga

SEQ ID NO: 148399 - DNA, 25 bp, Homo sapien
gcctgttccagaactgctggaagct

SEQ ID NO: 148400 - DNA, 25 bp, Homo sapien
cgaagcttaccctgtctttgagcca

SEQ ID NO: 148401 - DNA, 25 bp, Homo sapien
tgtctttgagccagtgccacctgtc

SEQ ID NO: 148402 - DNA, 25 bp, Homo sapien
cactcaagcgcatctgcccaaatgc

SEQ ID NO: 148403 - DNA, 25 bp, Homo sapien
tgagaagccggcctgcctgtcctgt

SEQ ID NO: 148404 - DNA, 25 bp, Homo sapien
aagagaccaactttttcattccctg

SEQ ID NO: 148405 - DNA, 25 bp, Homo sapien
ccccaatttcccagactagatttca

SEQ ID NO: 148406 - DNA, 25 bp, Homo sapien
ttcccagactagatttcaagctaat

SEQ ID NO: 148407 - DNA, 25 bp, Homo sapien
ttctgaagcctctaacaaatgatct

SEQ ID NO: 148408 - DNA, 25 bp, Homo sapien
aatgatctagttcagaaggaagcaa

SEQ ID NO: 148409 - DNA, 25 bp, Homo sapien
aaatcccttaatctatgtgcaccgt

SEQ ID NO: 148410 - DNA, 25 bp, Homo sapien
aatctatgtgcaccgttgggaccaa

SEQ ID NO: 148411 - DNA, 25 bp, Homo sapien
gcaccgttgggaccaatgccttaat

SEQ ID NO: 148412 - DNA, 25 bp, Homo sapien
gttgggaccaatgccttaattaaag

SEQ ID NO: 148413 - DNA, 25 bp, Homo sapien
agagaatatttttggcattcctctc

SEQ ID NO: 148414 - DNA, 25 bp, Homo sapien
tttggcattcctctcaatgttgtgt

SEQ ID NO: 148415 - DNA, 25 bp, Homo sapien
acattccagactctagccatctcgg

SEQ ID NO: 148416 - DNA, 25 bp, Homo sapien
tagccatctcggcaggatctcctgg

SEQ ID NO: 148417 - DNA, 25 bp, Homo sapien
atctcctggctccttgagtgcccag

SEQ ID NO: 148418 - DNA, 25 bp, Homo sapien
ttgagtgcccaggtgccaccaagag

SEQ ID NO: 148419 - DNA, 25 bp, Homo sapien
tgcccaggtgccaccaagaggaagg

SEQ ID NO: 148420 - DNA, 25 bp, Homo sapien
ggccttgtgggatacaccttgcaga

SEQ ID NO: 148421 - DNA, 25 bp, Homo sapien
aatagggatcggtgtgccccgctgc

SEQ ID NO: 148422 - DNA, 25 bp, Homo sapien
aggacatcccaacccctggctggga

SEQ ID NO: 148423 - DNA, 25 bp, Homo sapien
tgggactgaaccacccagagcggag

SEQ ID NO: 148424 - DNA, 25 bp, Homo sapien
cttttcagccttgtgagtcacctgg

SEQ ID NO: 148425 - DNA, 25 bp, Homo sapien
ttgtgagtcacctggcaggccccag

SEQ ID NO: 148426 - DNA, 25 bp, Homo sapien
tcttggcagcttaagtggcgcagcc

SEQ ID NO: 148427 - DNA, 25 bp, Homo sapien
gccaggccaagctgtgtaagttaag

SEQ ID NO: 148428 - DNA, 25 bp, Homo sapien
gcagtaacgttaagatgcgtgggca

SEQ ID NO: 148429 - DNA, 25 bp, Homo sapien
cgtgggcagggcaccttgaactctg

SEQ ID NO: 148430 - DNA, 25 bp, Homo sapien
ggcaccttgaactctggcttagcaa

SEQ ID NO: 148431 - DNA, 25 bp, Homo sapien
ttagcaagcatctaggctgcctctt

SEQ ID NO: 148432 - DNA, 25 bp, Homo sapien
gcctcttcactttcttttagcatgg

SEQ ID NO: 148433 - DNA, 25 bp, Homo sapien
cactttcttttagcatggtaactgg

SEQ ID NO: 148434 - DNA, 25 bp, Homo sapien
catggtaactggatgttttctaaac

SEQ ID NO: 148435 - DNA, 25 bp, Homo sapien
aactatgcatttgtaatggcacatt

SEQ ID NO: 148436 - DNA, 25 bp, Homo sapien
ggatatgcatcacacaagtaaggta

SEQ ID NO: 148437 - DNA, 25 bp, Homo sapien
atgttaggaaggtactgtcatgggc

SEQ ID NO: 148438 - DNA, 25 bp, Homo sapien
tgttaggaaggtactgtcatgggct

SEQ ID NO: 148439 - DNA, 25 bp, Homo sapien
ttaggaaggtactgtcatgggctag

SEQ ID NO: 148440 - DNA, 25 bp, Homo sapien
taggaaggtactgtcatgggctagg

SEQ ID NO: 148441 - DNA, 25 bp, Homo sapien
aggaaggtactgtcatgggctaggc

SEQ ID NO: 148442 - DNA, 25 bp, Homo sapien
ggaaggtactgtcatgggctaggca

SEQ ID NO: 148443 - DNA, 25 bp, Homo sapien
gaaggtactgtcatgggctaggcat

SEQ ID NO: 148444 - DNA, 25 bp, Homo sapien
aaggtactgtcatgggctaggcatg

SEQ ID NO: 148445 - DNA, 25 bp, Homo sapien
aggtactgtcatgggctaggcatgg

SEQ ID NO: 148446 - DNA, 25 bp, Homo sapien
ggtactgtcatgggctaggcatggt

SEQ ID NO: 148447 - DNA, 25 bp, Homo sapien
gtactgtcatgggctaggcatggtg

SEQ ID NO: 148448 - DNA, 25 bp, Homo sapien
cagccaacccatttcaacaaaattg

SEQ ID NO: 148449 - DNA, 25 bp, Homo sapien
aattgaacacaggactcttctgctc

SEQ ID NO: 148450 - DNA, 25 bp, Homo sapien
cacaggactcttctgctcagcagca

SEQ ID NO: 148451 - DNA, 25 bp, Homo sapien
atgtggccatgttacagtagagggt

SEQ ID NO: 148452 - DNA, 25 bp, Homo sapien
gtagagggtattccataagcacata

SEQ ID NO: 148453 - DNA, 25 bp, Homo sapien
atattccataaagtgctcagagtca

SEQ ID NO: 148454 - DNA, 25 bp, Homo sapien
tgctcagagtcacaggttttataat

SEQ ID NO: 148455 - DNA, 25 bp, Homo sapien
tatgtaaacgaattgcatgcatgtt

SEQ ID NO: 148456 - DNA, 25 bp, Homo sapien
attttttagcagtactttagcttga

SEQ ID NO: 148457 - DNA, 25 bp, Homo sapien
tttagcttgaaagtactcgtacaaa

SEQ ID NO: 148458 - DNA, 25 bp, Homo sapien
gtactcgtacaaatactgttagatt

SEQ ID NO: 148459 - DNA, 25 bp, Homo sapien
ctctgcagtctggtctttgctgctg

SEQ ID NO: 148460 - DNA, 25 bp, Homo sapien
gatggtccaggcctcctttgatgca

SEQ ID NO: 148461 - DNA, 25 bp, Homo sapien
aggcctcctttgatgcatgagacac

SEQ ID NO: 148462 - DNA, 25 bp, Homo sapien
atgagacacgggacagcctcgcctg

SEQ ID NO: 148463 - DNA, 25 bp, Homo sapien
cctgaggatgttggccatgtgtgct

SEQ ID NO: 148464 - DNA, 25 bp, Homo sapien
ggccatgtgtgcttcagtgtaacca

SEQ ID NO: 148465 - DNA, 25 bp, Homo sapien
cagtgtaaccaagattcctgtcaat

SEQ ID NO: 148466 - DNA, 25 bp, Homo sapien
tcctgtcaatcccatctgcagggaa

SEQ ID NO: 148467 - DNA, 25 bp, Homo sapien
gggaactctgggaccttctctggta

SEQ ID NO: 148468 - DNA, 25 bp, Homo sapien
gggaccttctctggtagctgccaga

SEQ ID NO: 148469 - DNA, 25 bp, Homo sapien
ggactgaaccttacccagggctgta

SEQ ID NO: 148470 - DNA, 25 bp, Homo sapien
tgagctggccaacgatgaacttatc

SEQ ID NO: 148471 - DNA, 25 bp, Homo sapien
tgaacttatcctgacgtttggcgcc

SEQ ID NO: 148472 - DNA, 25 bp, Homo sapien
ttggcgccgatgacgtggtctgcac

SEQ ID NO: 148473 - DNA, 25 bp, Homo sapien
tctgcaccagaatttatgtccggga

SEQ ID NO: 148474 - DNA, 25 bp, Homo sapien
aatgaaggcagctggcttgctccta

SEQ ID NO: 148475 - DNA, 25 bp, Homo sapien
gcttgctcctactttcaggaaggga

SEQ ID NO: 148476 - DNA, 25 bp, Homo sapien
ggtccccgaggaatatgtcatagtt

SEQ ID NO: 148477 - DNA, 25 bp, Homo sapien
catagttctgagctgccagtggacc

SEQ ID NO: 148478 - DNA, 25 bp, Homo sapien
tcccgttttccccatgacaatgttg

SEQ ID NO: 148479 - DNA, 25 bp, Homo sapien
tcttgtatccctagtgctgcatagc

SEQ ID NO: 148480 - DNA, 25 bp, Homo sapien
tagcccggcatttgcacggtttcga

SEQ ID NO: 148481 - DNA, 25 bp, Homo sapien
catttgaggctcgtttgaggtgaca

SEQ ID NO: 148482 - DNA, 25 bp, Homo sapien
gtacagagcgattcagcgttttcat

SEQ ID NO: 148483 - DNA, 25 bp, Homo sapien
tttcatgaatgggttggctgtgctg

SEQ ID NO: 148484 - DNA, 25 bp, Homo sapien
gttactgatgaatatgggcccctta

SEQ ID NO: 148485 - DNA, 25 bp, Homo sapien
aagcatcataaaggcacaagtgcac

SEQ ID NO: 148486 - DNA, 25 bp, Homo sapien
acaagtgcacacacatctatgcaga

SEQ ID NO: 148487 - DNA, 25 bp, Homo sapien
atctatgcagacaagcttcctcgct

SEQ ID NO: 148488 - DNA, 25 bp, Homo sapien
agacaagcttcctcgctgcttatgc

SEQ ID NO: 148489 - DNA, 25 bp, Homo sapien
atgcccacagggtttttctgtatga

SEQ ID NO: 148490 - DNA, 25 bp, Homo sapien
gtatgacacacctcagaggagcctg

SEQ ID NO: 148491 - DNA, 25 bp, Homo sapien
aggagcctgtgcttaacatttgtag

SEQ ID NO: 148492 - DNA, 25 bp, Homo sapien
aagatctggatttggtggaagacca

SEQ ID NO: 148493 - DNA, 25 bp, Homo sapien
gtaattgctggaagactggatttgc

SEQ ID NO: 148494 - DNA, 25 bp, Homo sapien
gactggatttgctggaagacttgat

SEQ ID NO: 148495 - DNA, 25 bp, Homo sapien
gaagacttggagcttcttggaagac

SEQ ID NO: 148496 - DNA, 25 bp, Homo sapien
gcttcttggaagacatggattgtcc

SEQ ID NO: 148497 - DNA, 25 bp, Homo sapien
gattgtccggaagacatggattgtc

SEQ ID NO: 148498 - DNA, 25 bp, Homo sapien
aagatctagatttttctggaagaac

SEQ ID NO: 148499 - DNA, 25 bp, Homo sapien
ctagatttactggaagacttggatt

SEQ ID NO: 148500 - DNA, 25 bp, Homo sapien
catggattagctggaagatctgtat

SEQ ID NO: 148501 - DNA, 25 bp, Homo sapien
ctgtatttgatggaagaccttgaaa

SEQ ID NO: 148502 - DNA, 25 bp, Homo sapien
gaagaccttgaaattattggaagac

SEQ ID NO: 148503 - DNA, 25 bp, Homo sapien
agaggaacctgctggcgacaccaag

SEQ ID NO: 148504 - DNA, 25 bp, Homo sapien
gaggaacctgctggcgacaccaaga

SEQ ID NO: 148505 - DNA, 25 bp, Homo sapien
aggaacctgctggcgacaccaagaa

SEQ ID NO: 148506 - DNA, 25 bp, Homo sapien
ggaacctgctggcgacaccaagaaa

SEQ ID NO: 148507 - DNA, 25 bp, Homo sapien
gaacctgctggcgacaccaagaaaa

SEQ ID NO: 148508 - DNA, 25 bp, Homo sapien
aacctgctggcgacaccaagaaaaa

SEQ ID NO: 148509 - DNA, 25 bp, Homo sapien
acctgctggcgacaccaagaaaaaa

SEQ ID NO: 148510 - DNA, 25 bp, Homo sapien
cctgctggcgacaccaagaaaaaaa

SEQ ID NO: 148511 - DNA, 25 bp, Homo sapien
atgaaaacaaagaagtgggcagtag

SEQ ID NO: 148512 - DNA, 25 bp, Homo sapien
tgaaaacaaagaagtgggcagtaga

SEQ ID NO: 148513 - DNA, 25 bp, Homo sapien
gggtccccagattctgctctaaggg

SEQ ID NO: 148514 - DNA, 25 bp, Homo sapien
ccagattctgctctaagggggccag

SEQ ID NO: 148515 - DNA, 25 bp, Homo sapien
attctgctctaagggggccagaccc

SEQ ID NO: 148516 - DNA, 25 bp, Homo sapien
cctctgccaggctggattgtacggg

SEQ ID NO: 148517 - DNA, 25 bp, Homo sapien
tctgccaggctggattgtacgggcc

SEQ ID NO: 148518 - DNA, 25 bp, Homo sapien
ctgccaggctggattgtacgggccc

SEQ ID NO: 148519 - DNA, 25 bp, Homo sapien
tgccaggctggattgtacgggcccc

SEQ ID NO: 148520 - DNA, 25 bp, Homo sapien
gccaggctggattgtacgggcccca

SEQ ID NO: 148521 - DNA, 25 bp, Homo sapien
aggctggattgtacgggccccacct

SEQ ID NO: 148522 - DNA, 25 bp, Homo sapien
ttgtacgggccccaccttcgctgtg

SEQ ID NO: 148523 - DNA, 25 bp, Homo sapien
gggccccaccttcgctgtgttcttg

SEQ ID NO: 148524 - DNA, 25 bp, Homo sapien
gctcctgcaggacccattacggcta

SEQ ID NO: 148525 - DNA, 25 bp, Homo sapien
tgcaggacccattacggctactcct

SEQ ID NO: 148526 - DNA, 25 bp, Homo sapien
gacccattacggctactcctctggg

SEQ ID NO: 148527 - DNA, 25 bp, Homo sapien
tgggagaccagagtcccctttaggg

SEQ ID NO: 148528 - DNA, 25 bp, Homo sapien
ggagctccgggaagacccgcccatc

SEQ ID NO: 148529 - DNA, 25 bp, Homo sapien
atcccaggactccagatgccaggag

SEQ ID NO: 148530 - DNA, 25 bp, Homo sapien
gactccagatgccaggagccctgct

SEQ ID NO: 148531 - DNA, 25 bp, Homo sapien
gctgcccacatgcaaggaccagcat

SEQ ID NO: 148532 - DNA, 25 bp, Homo sapien
atgcaaggaccagcatctcctgaga

SEQ ID NO: 148533 - DNA, 25 bp, Homo sapien
ggaccagcatctcctgagaggacgc

SEQ ID NO: 148534 - DNA, 25 bp, Homo sapien
gagaggacgcctgggcttacctggg

SEQ ID NO: 148535 - DNA, 25 bp, Homo sapien
tatggctcaaaatccactgacgatc

SEQ ID NO: 148536 - DNA, 25 bp, Homo sapien
cactgacgatcattctcctaaactg

SEQ ID NO: 148537 - DNA, 25 bp, Homo sapien
gatcattctcctaaactgaacacat

SEQ ID NO: 148538 - DNA, 25 bp, Homo sapien
aactgaacacatgactagaattggt

SEQ ID NO: 148539 - DNA, 25 bp, Homo sapien
ctagaattggtggtgagatatcgct

SEQ ID NO: 148540 - DNA, 25 bp, Homo sapien
gtgagatatcgcttgattttctttt

SEQ ID NO: 148541 - DNA, 25 bp, Homo sapien
ataaatgtctagttcttacccagtt

SEQ ID NO: 148542 - DNA, 25 bp, Homo sapien
gtaaaacttgtaacaccacattagt

SEQ ID NO: 148543 - DNA, 25 bp, Homo sapien
ggaaatatccaggttctaatgtgtg

SEQ ID NO: 148544 - DNA, 25 bp, Homo sapien
ggaatgtgcagatttaggttacttt

SEQ ID NO: 148545 - DNA, 25 bp, Homo sapien
aggttactttagtgtatgttctagt

SEQ ID NO: 148546 - DNA, 25 bp, Homo sapien
agccccatctgccacgtgtatttaa

SEQ ID NO: 148547 - DNA, 25 bp, Homo sapien
aaccttgaagggttcaccaggtcag

SEQ ID NO: 148548 - DNA, 25 bp, Homo sapien
gtttgggaactgcaataacctggga

SEQ ID NO: 148549 - DNA, 25 bp, Homo sapien
gcaataacctgggagttttggtgga

SEQ ID NO: 148550 - DNA, 25 bp, Homo sapien
gttttggtggagtccgatgattctc

SEQ ID NO: 148551 - DNA, 25 bp, Homo sapien
tggagtccgatgattctcttttgca

SEQ ID NO: 148552 - DNA, 25 bp, Homo sapien
acagtttatctatggcacccatgca

SEQ ID NO: 148553 - DNA, 25 bp, Homo sapien
gcacccatgcaccttacatttgaaa

SEQ ID NO: 148554 - DNA, 25 bp, Homo sapien
gaaatatcatgctccattgttcaga

SEQ ID NO: 148555 - DNA, 25 bp, Homo sapien
gctccattgttcagatgcttcttag

SEQ ID NO: 148556 - DNA, 25 bp, Homo sapien
tgttcagatgcttcttaggccacat

SEQ ID NO: 148557 - DNA, 25 bp, Homo sapien
agggaaagtctgtcctgggatgctt

SEQ ID NO: 148558 - DNA, 25 bp, Homo sapien
aaagtctgtcctgggatgcttctct

SEQ ID NO: 148559 - DNA, 25 bp, Homo sapien
gtctgtcctgggatgcttctctgtc

SEQ ID NO: 148560 - DNA, 25 bp, Homo sapien
aatgtgggagtggaacagatgctaa

SEQ ID NO: 148561 - DNA, 25 bp, Homo sapien
gatgctaaaagctatccaggatttt

SEQ ID NO: 148562 - DNA, 25 bp, Homo sapien
ctcccatgcgtaagacgttctgtgt

SEQ ID NO: 148563 - DNA, 25 bp, Homo sapien
gtaagacgttctgtgtaacctccat

SEQ ID NO: 148564 - DNA, 25 bp, Homo sapien
gacgttctgtgtaacctccattaaa

SEQ ID NO: 148565 - DNA, 25 bp, Homo sapien
tgtgtaacctccattaaatttggta

SEQ ID NO: 148566 - DNA, 25 bp, Homo sapien
aatttggtacaaaaccactcgccag

SEQ ID NO: 148567 - DNA, 25 bp, Homo sapien
tacaaaaccactcgccagagctgtg

SEQ ID NO: 148568 - DNA, 25 bp, Homo sapien
tggaaactgtgttgctctaaccctc

SEQ ID NO: 148569 - DNA, 25 bp, Homo sapien
tccccttgcagtcatcattcgtgtt

SEQ ID NO: 148570 - DNA, 25 bp, Homo sapien
agtcatcattcgtgttctgtgtata

SEQ ID NO: 148571 - DNA, 25 bp, Homo sapien
attcgtgttctgtgtataccaaatg

SEQ ID NO: 148572 - DNA, 25 bp, Homo sapien
ctgtgtataccaaatgattctgtta

SEQ ID NO: 148573 - DNA, 25 bp, Homo sapien
ttttgctgggaaaacgatgtcctga

SEQ ID NO: 148574 - DNA, 25 bp, Homo sapien
aaacgatgtcctgaaaatggtattt

SEQ ID NO: 148575 - DNA, 25 bp, Homo sapien
ggtatttcaatgaggcatatgttca

SEQ ID NO: 148576 - DNA, 25 bp, Homo sapien
gaggcatatgttcaggatttcagaa

SEQ ID NO: 148577 - DNA, 25 bp, Homo sapien
gaagttagttctatttagcaggtta

SEQ ID NO: 148578 - DNA, 25 bp, Homo sapien
acacaaagcattgggagtcagactg

SEQ ID NO: 148579 - DNA, 25 bp, Homo sapien
ggcttctcctgcctttttcagggaa

SEQ ID NO: 148580 - DNA, 25 bp, Homo sapien
agagcctgcacccaggtactgagtg

SEQ ID NO: 148581 - DNA, 25 bp, Homo sapien
gggagtgtacagaccctgccttggg

SEQ ID NO: 148582 - DNA, 25 bp, Homo sapien
gatgcaactggttttactagtgtgc

SEQ ID NO: 148583 - DNA, 25 bp, Homo sapien
tagtgtgcaagtgtgttcatcccca

SEQ ID NO: 148584 - DNA, 25 bp, Homo sapien
aagtgtgttcatccccaagttctct

SEQ ID NO: 148585 - DNA, 25 bp, Homo sapien
aagttctcttttgtcctcacatgca

SEQ ID NO: 148586 - DNA, 25 bp, Homo sapien
cttttgtcctcacatgcagagttgt

SEQ ID NO: 148587 - DNA, 25 bp, Homo sapien
gcagagttgtgcatgcccctgagtg

SEQ ID NO: 148588 - DNA, 25 bp, Homo sapien
gaacaggtttgcctacgttggtgca

SEQ ID NO: 148589 - DNA, 25 bp, Homo sapien
tgcctacgttggtgcaagtgtgcat

SEQ ID NO: 148590 - DNA, 25 bp, Homo sapien
tcaaggagagggttttggccgctcc

SEQ ID NO: 148591 - DNA, 25 bp, Homo sapien
tttggccgctccctccccactaagg

SEQ ID NO: 148592 - DNA, 25 bp, Homo sapien
ttggccgctccctccccactaagga

SEQ ID NO: 148593 - DNA, 25 bp, Homo sapien
tccccactaaggactggacccttgg

SEQ ID NO: 148594 - DNA, 25 bp, Homo sapien
gtaccaaagacagtggtggtccggt

SEQ ID NO: 148595 - DNA, 25 bp, Homo sapien
taccaaagacagtggtggtccggtg

SEQ ID NO: 148596 - DNA, 25 bp, Homo sapien
accaaagacagtggtggtccggtgg

SEQ ID NO: 148597 - DNA, 25 bp, Homo sapien
ccaaagacagtggtggtccggtgga

SEQ ID NO: 148598 - DNA, 25 bp, Homo sapien
caaagacagtggtggtccggtggag

SEQ ID NO: 148599 - DNA, 25 bp, Homo sapien
acagtggtggtccggtggagggaag

SEQ ID NO: 148600 - DNA, 25 bp, Homo sapien
cagtggtggtccggtggagggaaga

SEQ ID NO: 148601 - DNA, 25 bp, Homo sapien
ttgctgctttctgaccaaatgtttt

SEQ ID NO: 148602 - DNA, 25 bp, Homo sapien
gctgctttctgaccaaatgtttttc

SEQ ID NO: 148603 - DNA, 25 bp, Homo sapien
ctccagctgtttgaagagagggaac

SEQ ID NO: 148604 - DNA, 25 bp, Homo sapien
tgaagagagggaacaacacggttta

SEQ ID NO: 148605 - DNA, 25 bp, Homo sapien
ggtttagaaagaatccccattccag

SEQ ID NO: 148606 - DNA, 25 bp, Homo sapien
gaaagaatccccattccagcagtag

SEQ ID NO: 148607 - DNA, 25 bp, Homo sapien
agaatccccattccagcagtagatt

SEQ ID NO: 148608 - DNA, 25 bp, Homo sapien
tccagcagtagatttaactgatctc

SEQ ID NO: 148609 - DNA, 25 bp, Homo sapien
aactgatctctgaggttcagtatca

SEQ ID NO: 148610 - DNA, 25 bp, Homo sapien
gatctctgaggttcagtatcatttt

SEQ ID NO: 148611 - DNA, 25 bp, Homo sapien
aaatgagcaagagattgcattgcag

SEQ ID NO: 148612 - DNA, 25 bp, Homo sapien
caaggctgcgttaaagttgtactag

SEQ ID NO: 148613 - DNA, 25 bp, Homo sapien
gttgtactaggcaaacacactgatg

SEQ ID NO: 148614 - DNA, 25 bp, Homo sapien
atatagtgttactgtgagcctgtca

SEQ ID NO: 148615 - DNA, 25 bp, Homo sapien
gagcctgtcagtagtgggtaccaat

SEQ ID NO: 148616 - DNA, 25 bp, Homo sapien
gtgggtaccaatcttttgtgacata

SEQ ID NO: 148617 - DNA, 25 bp, Homo sapien
ttgtcatgctgaggtgtgacacctg

SEQ ID NO: 148618 - DNA, 25 bp, Homo sapien
acctgctgcactcatctgatgtaaa

SEQ ID NO: 148619 - DNA, 25 bp, Homo sapien
atgtaaaaccatcccagagctggcg

SEQ ID NO: 148620 - DNA, 25 bp, Homo sapien
gagctgggtggaaactgctttgcac

SEQ ID NO: 148621 - DNA, 25 bp, Homo sapien
tgctttgcactatcgtttgcttggt

SEQ ID NO: 148622 - DNA, 25 bp, Homo sapien
gtttttaacgcacaacttgcttgta

SEQ ID NO: 148623 - DNA, 25 bp, Homo sapien
aaagcatctgtaaatttggactgtt

SEQ ID NO: 148624 - DNA, 25 bp, Homo sapien
ttggactgttttccttcaaccacca

SEQ ID NO: 148625 - DNA, 25 bp, Homo sapien
tggttattatttttgtcacggaaag

SEQ ID NO: 148626 - DNA, 25 bp, Homo sapien
ttttgtcacggaaagcatcctctcc

SEQ ID NO: 148627 - DNA, 25 bp, Homo sapien
ggaaagcatcctctccaaagttgga

SEQ ID NO: 148628 - DNA, 25 bp, Homo sapien
aaagttggagcttctattgccatga

SEQ ID NO: 148629 - DNA, 25 bp, Homo sapien
ttggagcttctattgccatgaacca

SEQ ID NO: 148630 - DNA, 25 bp, Homo sapien
ccatgaaccatgcttacaaagaaag

SEQ ID NO: 148631 - DNA, 25 bp, Homo sapien
ttcctgcatttgatagcaatgtaag

SEQ ID NO: 148632 - DNA, 25 bp, Homo sapien
tgtaagtgcctataaccatgttcta

SEQ ID NO: 148633 - DNA, 25 bp, Homo sapien
gtgcctataaccatgttctatattc

SEQ ID NO: 148634 - DNA, 25 bp, Homo sapien
gccaaggactccatcctgcgcaggg

SEQ ID NO: 148635 - DNA, 25 bp, Homo sapien
aggactccatcctgcgcagggccag

SEQ ID NO: 148636 - DNA, 25 bp, Homo sapien
gggcatgttcactgccgaagacctg

SEQ ID NO: 148637 - DNA, 25 bp, Homo sapien
gagcctctgatttccaattccctgc

SEQ ID NO: 148638 - DNA, 25 bp, Homo sapien
tgctccttcccactccattaagagg

SEQ ID NO: 148639 - DNA, 25 bp, Homo sapien
ttcccactccattaagaggctaggt

SEQ ID NO: 148640 - DNA, 25 bp, Homo sapien
ggaacaggaagcctgaccatctccc

SEQ ID NO: 148641 - DNA, 25 bp, Homo sapien
acctcttccctgtgctgttacacag

SEQ ID NO: 148642 - DNA, 25 bp, Homo sapien
ttccctgtgctgttacacagtgtca

SEQ ID NO: 148643 - DNA, 25 bp, Homo sapien
tgtgctgttacacagtgtcattgtt

SEQ ID NO: 148644 - DNA, 25 bp, Homo sapien
gctgttacacagtgtcattgttgat

SEQ ID NO: 148645 - DNA, 25 bp, Homo sapien
tcttctctgtctaaccttctttttc

SEQ ID NO: 148646 - DNA, 25 bp, Homo sapien
tgttctgtttacttttgctcatatc

SEQ ID NO: 148647 - DNA, 25 bp, Homo sapien
acttttgctcatatcatcattcccg

SEQ ID NO: 148648 - DNA, 25 bp, Homo sapien
atcattcccgctatctttctattaa

SEQ ID NO: 148649 - DNA, 25 bp, Homo sapien
attcccgctatctttctattaactg

SEQ ID NO: 148650 - DNA, 25 bp, Homo sapien
gctatctttctattaactgaccata

SEQ ID NO: 148651 - DNA, 25 bp, Homo sapien
tgaccataacacagaactagttgac

SEQ ID NO: 148652 - DNA, 25 bp, Homo sapien
actagttgactatatattatgttga

SEQ ID NO: 148653 - DNA, 25 bp, Homo sapien
atgttgaaattttatggcagctatt

SEQ ID NO: 148654 - DNA, 25 bp, Homo sapien
aaatccatgctttttgtagctggtt

SEQ ID NO: 148655 - DNA, 25 bp, Homo sapien
ccatgctttttgtagctggttgaaa

SEQ ID NO: 148656 - DNA, 25 bp, Homo sapien
gttctctgttcaaaagtaattggca

SEQ ID NO: 148657 - DNA, 25 bp, Homo sapien
ttctctgttcaaaagtaattggcag

SEQ ID NO: 148658 - DNA, 25 bp, Homo sapien
tctctgttcaaaagtaattggcagt

SEQ ID NO: 148659 - DNA, 25 bp, Homo sapien
ctctgttcaaaagtaattggcagtg

SEQ ID NO: 148660 - DNA, 25 bp, Homo sapien
tctgttcaaaagtaattggcagtga

SEQ ID NO: 148661 - DNA, 25 bp, Homo sapien
ctgttcaaaagtaattggcagtgat

SEQ ID NO: 148662 - DNA, 25 bp, Homo sapien
tgttcaaaagtaattggcagtgatt

SEQ ID NO: 148663 - DNA, 25 bp, Homo sapien
gttcaaaagtaattggcagtgattg

SEQ ID NO: 148664 - DNA, 25 bp, Homo sapien
agtaattggcagtgattggccaggc

SEQ ID NO: 148665 - DNA, 25 bp, Homo sapien
taattggcagtgattggccaggcgc

SEQ ID NO: 148666 - DNA, 25 bp, Homo sapien
aattggcagtgattggccaggcgca

SEQ ID NO: 148667 - DNA, 25 bp, Homo sapien
cctattgctggtgactctgtgtgaa

SEQ ID NO: 148668 - DNA, 25 bp, Homo sapien
gctggtgactctgtgtgaactggcc

SEQ ID NO: 148669 - DNA, 25 bp, Homo sapien
ggagatgctgtgctgcctacagcct

SEQ ID NO: 148670 - DNA, 25 bp, Homo sapien
gtgctgcctacagcctggacagggt

SEQ ID NO: 148671 - DNA, 25 bp, Homo sapien
ctggacagggtctctgctgtactgc

SEQ ID NO: 148672 - DNA, 25 bp, Homo sapien
gctctgcatagccaggatgacgcct

SEQ ID NO: 148673 - DNA, 25 bp, Homo sapien
gatgacgcctttcatgtcccagaga

SEQ ID NO: 148674 - DNA, 25 bp, Homo sapien
cagagacctgttgtgctgtgtattt

SEQ ID NO: 148675 - DNA, 25 bp, Homo sapien
gtgtattttgatttcctgtgtatgc

SEQ ID NO: 148676 - DNA, 25 bp, Homo sapien
atgtgtgtatttaccattgtgtagg

SEQ ID NO: 148677 - DNA, 25 bp, Homo sapien
ggctgtgtctgatcttggtgttcaa

SEQ ID NO: 148678 - DNA, 25 bp, Homo sapien
agcacgctttacttagtagccggtt

SEQ ID NO: 148679 - DNA, 25 bp, Homo sapien
tagtagccggttcccatttgccata

SEQ ID NO: 148680 - DNA, 25 bp, Homo sapien
cggttcccatttgccatacaatgta

SEQ ID NO: 148681 - DNA, 25 bp, Homo sapien
gccatacaatgtaggttctgcttaa

SEQ ID NO: 148682 - DNA, 25 bp, Homo sapien
ttttgcttaagcatttgcatgacta

SEQ ID NO: 148683 - DNA, 25 bp, Homo sapien
tgcatgactattagtgcttcaaagt

SEQ ID NO: 148684 - DNA, 25 bp, Homo sapien
gaagaaagagcaacccaccaaacct

SEQ ID NO: 148685 - DNA, 25 bp, Homo sapien
gaacactttcatactaagactgtaa

SEQ ID NO: 148686 - DNA, 25 bp, Homo sapien
gtaagtagatctcagttctgcgttt

SEQ ID NO: 148687 - DNA, 25 bp, Homo sapien
ctcagttctgcgtttattgtaagtt

SEQ ID NO: 148688 - DNA, 25 bp, Homo sapien
aaaactgtttgcatctttgtatgta

SEQ ID NO: 148689 - DNA, 25 bp, Homo sapien
cctattgctggtgactctgtgtgaa

SEQ ID NO: 148690 - DNA, 25 bp, Homo sapien
tattgctggtgactctgtgtgaact

SEQ ID NO: 148691 - DNA, 25 bp, Homo sapien
tgctggtgactctgtgtgaactggc

SEQ ID NO: 148692 - DNA, 25 bp, Homo sapien
gctggtgactctgtgtgaactggcc

SEQ ID NO: 148693 - DNA, 25 bp, Homo sapien
cacaggacagtaaaggagatgctgt

SEQ ID NO: 148694 - DNA, 25 bp, Homo sapien
ctggacagggtctctgctgtactgc

SEQ ID NO: 148695 - DNA, 25 bp, Homo sapien
gtgtattttgatttcctgtgtatgc

SEQ ID NO: 148696 - DNA, 25 bp, Homo sapien
atgtgtgtatttaccattgtgtagg

SEQ ID NO: 148697 - DNA, 25 bp, Homo sapien
ctgtgtctgatcttggtgttcaaaa

SEQ ID NO: 148698 - DNA, 25 bp, Homo sapien
tgtctgatcttggtgttcaaaacag

SEQ ID NO: 148699 - DNA, 25 bp, Homo sapien
gtgttcaaaacagaactgtattttt

SEQ ID NO: 148700 - DNA, 25 bp, Homo sapien
cacggctgggccaagagagagatcc

SEQ ID NO: 148701 - DNA, 25 bp, Homo sapien
atcccgggggcataactgctggcag

SEQ ID NO: 148702 - DNA, 25 bp, Homo sapien
gaacccccaatgctgaccaaggagg

SEQ ID NO: 148703 - DNA, 25 bp, Homo sapien
ccccaatgctgaccaaggaggagcc

SEQ ID NO: 148704 - DNA, 25 bp, Homo sapien
aggaggagcctgttccagaactgct

SEQ ID NO: 148705 - DNA, 25 bp, Homo sapien
aggagcctgttccagaactgctgga

SEQ ID NO: 148706 - DNA, 25 bp, Homo sapien
gagcctgttccagaactgctggaag

SEQ ID NO: 148707 - DNA, 25 bp, Homo sapien
ctgttccagaactgctggaagctga

SEQ ID NO: 148708 - DNA, 25 bp, Homo sapien
tggaagctgaggcccccgaagctta

SEQ ID NO: 148709 - DNA, 25 bp, Homo sapien
cgaagcttaccctgtctttgagcca

SEQ ID NO: 148710 - DNA, 25 bp, Homo sapien
cactcaagcgcatctgcccaaatgc

SEQ ID NO: 148711 - DNA, 25 bp, Homo sapien
tccgctacagcgacgtgaagaagct

SEQ ID NO: 148712 - DNA, 25 bp, Homo sapien
aatgaagccaaagtacccgcactgc

SEQ ID NO: 148713 - DNA, 25 bp, Homo sapien
ggagaagatggttatcatcaccacc

SEQ ID NO: 148714 - DNA, 25 bp, Homo sapien
atcaccaccaagagcgtgtccaggt

SEQ ID NO: 148715 - DNA, 25 bp, Homo sapien
agagcgtgtccaggtaccgaggtca

SEQ ID NO: 148716 - DNA, 25 bp, Homo sapien
agctgcagagcaccaagcgcttcat

SEQ ID NO: 148717 - DNA, 25 bp, Homo sapien
caagcgcttcatcaagtggtacaac

SEQ ID NO: 148718 - DNA, 25 bp, Homo sapien
caagtggtacaacgcctggaacgag

SEQ ID NO: 148719 - DNA, 25 bp, Homo sapien
aacgagaagcgcagggtctacgaag

SEQ ID NO: 148720 - DNA, 25 bp, Homo sapien
aaatgcaagtgctcccggaagggac

SEQ ID NO: 148721 - DNA, 25 bp, Homo sapien
ggaagggacccaagatccgctacag

SEQ ID NO: 148722 - DNA, 25 bp, Homo sapien
ttgatttggatctctttttatttaa

SEQ ID NO: 148723 - DNA, 25 bp, Homo sapien
gacttttgttgaaatagctttactg

SEQ ID NO: 148724 - DNA, 25 bp, Homo sapien
agctttactgtttctcaagtgtttt

SEQ ID NO: 148725 - DNA, 25 bp, Homo sapien
aatcaaccctgcaatcactttttgg

SEQ ID NO: 148726 - DNA, 25 bp, Homo sapien
aaccctgcaatcactttttggaatt

SEQ ID NO: 148727 - DNA, 25 bp, Homo sapien
attgtcttgatttttcggcagttca

SEQ ID NO: 148728 - DNA, 25 bp, Homo sapien
cggcagttcaagctatatcgaatat

SEQ ID NO: 148729 - DNA, 25 bp, Homo sapien
tatcgaatatagttctgtgtagaga

SEQ ID NO: 148730 - DNA, 25 bp, Homo sapien
tgtagagaatgtcactgtagttttg

SEQ ID NO: 148731 - DNA, 25 bp, Homo sapien
gtcactgtagttttgagtgtataca

SEQ ID NO: 148732 - DNA, 25 bp, Homo sapien
gtgtgggtgctgataattgtgtatt

SEQ ID NO: 148733 - DNA, 25 bp, Homo sapien
atgggccccttatagagctgcaaaa

SEQ ID NO: 148734 - DNA, 25 bp, Homo sapien
tgggccccttatagagctgcaaaac

SEQ ID NO: 148735 - DNA, 25 bp, Homo sapien
gggccccttatagagctgcaaaaca

SEQ ID NO: 148736 - DNA, 25 bp, Homo sapien
ggccccttatagagctgcaaaacac

SEQ ID NO: 148737 - DNA, 25 bp, Homo sapien
gccccttatagagctgcaaaacaca

SEQ ID NO: 148738 - DNA, 25 bp, Homo sapien
ccttatagagctgcaaaacacacac

SEQ ID NO: 148739 - DNA, 25 bp, Homo sapien
acacacacatgcgtatagacataca

SEQ ID NO: 148740 - DNA, 25 bp, Homo sapien
cacacacatgcgtatagacatacat

SEQ ID NO: 148741 - DNA, 25 bp, Homo sapien
gtacaccatacatagacaagcatca

SEQ ID NO: 148742 - DNA, 25 bp, Homo sapien
acaccatacatagacaagcatcata

SEQ ID NO: 148743 - DNA, 25 bp, Homo sapien
ccatacatagacaagcatcataaag

SEQ ID NO: 148744 - DNA, 25 bp, Homo sapien
gagtggcaaaacatcctacagtgga

SEQ ID NO: 148745 - DNA, 25 bp, Homo sapien
tacagtggatagtcatacacaacaa

SEQ ID NO: 148746 - DNA, 25 bp, Homo sapien
gataatcctgctcaaaatgccaaca

SEQ ID NO: 148747 - DNA, 25 bp, Homo sapien
tgctcaaaatgccaacagtgttccc

SEQ ID NO: 148748 - DNA, 25 bp, Homo sapien
tgccaacagtgttcccattgagaaa

SEQ ID NO: 148749 - DNA, 25 bp, Homo sapien
tgttcccattgagaaacactgaatt

SEQ ID NO: 148750 - DNA, 25 bp, Homo sapien
agaaacactgaattactgatccttc

SEQ ID NO: 148751 - DNA, 25 bp, Homo sapien
tgaattactgatccttcacaggtca

SEQ ID NO: 148752 - DNA, 25 bp, Homo sapien
atccttcacaggtcagttcaaatca

SEQ ID NO: 148753 - DNA, 25 bp, Homo sapien
ggtcagttcaaatcatacttgtctt

SEQ ID NO: 148754 - DNA, 25 bp, Homo sapien
agttcaaatcatacttgtctttaga

SEQ ID NO: 148755 - DNA, 25 bp, Homo sapien
agacaaccccaaatctgccacagag

SEQ ID NO: 148756 - DNA, 25 bp, Homo sapien
ccaaatctgccacagagcagtcagg

SEQ ID NO: 148757 - DNA, 25 bp, Homo sapien
agtcaggaactggtatccgatcaga

SEQ ID NO: 148758 - DNA, 25 bp, Homo sapien
gtatccgatcagagagtgagacaga

SEQ ID NO: 148759 - DNA, 25 bp, Homo sapien
gagacagagtccgaggcctcagaaa

SEQ ID NO: 148760 - DNA, 25 bp, Homo sapien
gtccgaggcctcagaaattactatt

SEQ ID NO: 148761 - DNA, 25 bp, Homo sapien
cagaaattactattcctcccagcac

SEQ ID NO: 148762 - DNA, 25 bp, Homo sapien
actacggcaaaggtgtcatcttcta

SEQ ID NO: 148763 - DNA, 25 bp, Homo sapien
gggattgtgctatggaacatcttta

SEQ ID NO: 148764 - DNA, 25 bp, Homo sapien
gaacatctttaaccgaatgccaata

SEQ ID NO: 148765 - DNA, 25 bp, Homo sapien
gaagatctcaatgaagtagccaaac

SEQ ID NO: 148766 - DNA, 25 bp, Homo sapien
gctcctgcaggacccattacggcta

SEQ ID NO: 148767 - DNA, 25 bp, Homo sapien
gacccattacggctactcctctggg

SEQ ID NO: 148768 - DNA, 25 bp, Homo sapien
tgtctgtctctcctgtgaaacctgg

SEQ ID NO: 148769 - DNA, 25 bp, Homo sapien
gaaacctgggagaccagagtcccct

SEQ ID NO: 148770 - DNA, 25 bp, Homo sapien
tgggagaccagagtcccctttaggg

SEQ ID NO: 148771 - DNA, 25 bp, Homo sapien
atcccaggactccagatgccaggag

SEQ ID NO: 148772 - DNA, 25 bp, Homo sapien
gactccagatgccaggagccctgct

SEQ ID NO: 148773 - DNA, 25 bp, Homo sapien
gctgcccacatgcaaggaccagcat

SEQ ID NO: 148774 - DNA, 25 bp, Homo sapien
atgcaaggaccagcatctcctgaga

SEQ ID NO: 148775 - DNA, 25 bp, Homo sapien
ggaccagcatctcctgagaggacgc

SEQ ID NO: 148776 - DNA, 25 bp, Homo sapien
tctcctgagaggacgcctgggctta

SEQ ID NO: 148777 - DNA, 25 bp, Homo sapien
gttactgtgtgaagaataatgcctg

SEQ ID NO: 148778 - DNA, 25 bp, Homo sapien
gaataatgcctgtatggtgttgata

SEQ ID NO: 148779 - DNA, 25 bp, Homo sapien
tatggtgttgatacgtgtgtgaagt

SEQ ID NO: 148780 - DNA, 25 bp, Homo sapien
gaagtatctatttattgtctgacaa

SEQ ID NO: 148781 - DNA, 25 bp, Homo sapien
gtctgacaaactcttgtgtaccttt

SEQ ID NO: 148782 - DNA, 25 bp, Homo sapien
gaagggaagctttgtttgaaaattg

SEQ ID NO: 148783 - DNA, 25 bp, Homo sapien
tatttttgtatgtggcatggcagaa

SEQ ID NO: 148784 - DNA, 25 bp, Homo sapien
aattagatctagctaatctcggtag

SEQ ID NO: 148785 - DNA, 25 bp, Homo sapien
atctcggtagatgtcattacaacct

SEQ ID NO: 148786 - DNA, 25 bp, Homo sapien
gatgtcattacaacctggaaaataa

SEQ ID NO: 148787 - DNA, 25 bp, Homo sapien
aaatcaccctaagtgacacaaattg

SEQ ID NO: 148788 - DNA, 25 bp, Homo sapien
caaaggccagggtcactgaaggcct

SEQ ID NO: 148789 - DNA, 25 bp, Homo sapien
ggaacagtgaggtgcccagctagct

SEQ ID NO: 148790 - DNA, 25 bp, Homo sapien
tagctgcagagccaccctgtgttga

SEQ ID NO: 148791 - DNA, 25 bp, Homo sapien
agagccaccctgtgttgacacctcg

SEQ ID NO: 148792 - DNA, 25 bp, Homo sapien
ggacacgtggtgcattttgcttgtt

SEQ ID NO: 148793 - DNA, 25 bp, Homo sapien
ttttctctccatcagaatgaaagct

SEQ ID NO: 148794 - DNA, 25 bp, Homo sapien
tcagaatgaaagctcctcgagggca

SEQ ID NO: 148795 - DNA, 25 bp, Homo sapien
cagggactttggtctattgtctgta

SEQ ID NO: 148796 - DNA, 25 bp, Homo sapien
tattgtctgtatttgccggtgccta

SEQ ID NO: 148797 - DNA, 25 bp, Homo sapien
atttgccggtgcctaggattgtgcc

SEQ ID NO: 148798 - DNA, 25 bp, Homo sapien
gcctaggattgtgcctgtatgcaac

SEQ ID NO: 148799 - DNA, 25 bp, Homo sapien
gggcaggcatgcacccggtgccagc

SEQ ID NO: 148800 - DNA, 25 bp, Homo sapien
gggtccccagattctgctctaaggg

SEQ ID NO: 148801 - DNA, 25 bp, Homo sapien
gattctgctctaagggggccagacc

SEQ ID NO: 148802 - DNA, 25 bp, Homo sapien
cctctgccaggctggattgtacggg

SEQ ID NO: 148803 - DNA, 25 bp, Homo sapien
tctgccaggctggattgtacgggcc

SEQ ID NO: 148804 - DNA, 25 bp, Homo sapien
tgccaggctggattgtacgggcccc

SEQ ID NO: 148805 - DNA, 25 bp, Homo sapien
gccaggctggattgtacgggcccca

SEQ ID NO: 148806 - DNA, 25 bp, Homo sapien
aggctggattgtacgggccccacct

SEQ ID NO: 148807 - DNA, 25 bp, Homo sapien
ttgtacgggccccaccttcgctgtg

SEQ ID NO: 148808 - DNA, 25 bp, Homo sapien
gggccccaccttcgctgtgttcttg

SEQ ID NO: 148809 - DNA, 25 bp, Homo sapien
gtgttcttgctgcaaagtctggtca

SEQ ID NO: 148810 - DNA, 25 bp, Homo sapien
taggagaaaattaccctcccagcac

SEQ ID NO: 148811 - DNA, 25 bp, Homo sapien
caagcattttggaatgagtctcctt

SEQ ID NO: 148812 - DNA, 25 bp, Homo sapien
ggaatgagtctcctttagtttcaga

SEQ ID NO: 148813 - DNA, 25 bp, Homo sapien
gtctcctttagtttcagagtgtgga

SEQ ID NO: 148814 - DNA, 25 bp, Homo sapien
gattgtataacccatatactcttcg

SEQ ID NO: 148815 - DNA, 25 bp, Homo sapien
taacccatatactcttcgatgtact

SEQ ID NO: 148816 - DNA, 25 bp, Homo sapien
actcttcgatgtacttgtttggttt

SEQ ID NO: 148817 - DNA, 25 bp, Homo sapien
cgatgtacttgtttggtttggtatt

SEQ ID NO: 148818 - DNA, 25 bp, Homo sapien
aatttgactgtgcatgacagcggca

SEQ ID NO: 148819 - DNA, 25 bp, Homo sapien
gcatgacagcggcaatcttttcttt

SEQ ID NO: 148820 - DNA, 25 bp, Homo sapien
agcggcaatcttttctttggtcaaa

SEQ ID NO: 148821 - DNA, 25 bp, Homo sapien
ttggtacacaactagttttgtttat

SEQ ID NO: 148822 - DNA, 25 bp, Homo sapien
aaactaaatacttgctccatttaca

SEQ ID NO: 148823 - DNA, 25 bp, Homo sapien
acttgctccatttacaaactacttg

SEQ ID NO: 148824 - DNA, 25 bp, Homo sapien
caaactacttgattttattgtacaa

SEQ ID NO: 148825 - DNA, 25 bp, Homo sapien
gtacaagttgaaatatgctcttttg

SEQ ID NO: 148826 - DNA, 25 bp, Homo sapien
atatgctcttttgtttgggttacag

SEQ ID NO: 148827 - DNA, 25 bp, Homo sapien
tgggttacagtatgcttgctctaag

SEQ ID NO: 148828 - DNA, 25 bp, Homo sapien
gtatgcttgctctaagtcaaattcc

SEQ ID NO: 148829 - DNA, 25 bp, Homo sapien
tgctctaagtcaaattccaaggaac

SEQ ID NO: 148830 - DNA, 25 bp, Homo sapien
aatttcttctcctggagttgcattg

SEQ ID NO: 148831 - DNA, 25 bp, Homo sapien
cttctcctggagttgcattgattca

SEQ ID NO: 148832 - DNA, 25 bp, Homo sapien
aagtccggcggaattcaccagtgtt

SEQ ID NO: 148833 - DNA, 25 bp, Homo sapien
aattcaccagtgttcctgaagctgc

SEQ ID NO: 148834 - DNA, 25 bp, Homo sapien
tgctgtgtcctctagttgagtttct

SEQ ID NO: 148835 - DNA, 25 bp, Homo sapien
agttgagtttctggcgcccctgcct

SEQ ID NO: 148836 - DNA, 25 bp, Homo sapien
tgcccgcatgtgtgcctggccgcag

SEQ ID NO: 148837 - DNA, 25 bp, Homo sapien
tgccgagccaccatacttaactgaa

SEQ ID NO: 148838 - DNA, 25 bp, Homo sapien
gagccaccatacttaactgaagctt

SEQ ID NO: 148839 - DNA, 25 bp, Homo sapien
ccatacttaactgaagcttcggccg

SEQ ID NO: 148840 - DNA, 25 bp, Homo sapien
aagggtcctcttttcctggcagctg

SEQ ID NO: 148841 - DNA, 25 bp, Homo sapien
ctgccccgcagacggtctgtgtgct

SEQ ID NO: 148842 - DNA, 25 bp, Homo sapien
gcagacggtctgtgtgctgtttgaa

SEQ ID NO: 148843 - DNA, 25 bp, Homo sapien
tagcaactccaccattgggcactgc

SEQ ID NO: 148844 - DNA, 25 bp, Homo sapien
attgggcactgccatgcagagacgt

SEQ ID NO: 148845 - DNA, 25 bp, Homo sapien
atgcagagacgtggctggcccagaa

SEQ ID NO: 148846 - DNA, 25 bp, Homo sapien
gtgaacagaataacaacagcaacaa

SEQ ID NO: 148847 - DNA, 25 bp, Homo sapien
tgatggccgttggactctgtgagat

SEQ ID NO: 148848 - DNA, 25 bp, Homo sapien
gactctgtgagatggagagccaatc

SEQ ID NO: 148849 - DNA, 25 bp, Homo sapien
gagagccaatctcacattcaagtgt

SEQ ID NO: 148850 - DNA, 25 bp, Homo sapien
ctcacattcaagtgttcaccaacca

SEQ ID NO: 148851 - DNA, 25 bp, Homo sapien
gtgttcaccaaccactgatgtgttt

SEQ ID NO: 148852 - DNA, 25 bp, Homo sapien
accactgatgtgtttttatttcctt

SEQ ID NO: 148853 - DNA, 25 bp, Homo sapien
gtgtttttatttccttctatatgat

SEQ ID NO: 148854 - DNA, 25 bp, Homo sapien
ccagcagccacctgtgggtatttat

SEQ ID NO: 148855 - DNA, 25 bp, Homo sapien
cacctgtgggtatttatgagtttca

SEQ ID NO: 148856 - DNA, 25 bp, Homo sapien
gtttcatatgaagtactgtgcccct

SEQ ID NO: 148857 - DNA, 25 bp, Homo sapien
tcatatgaagtactgtgccccttcc

SEQ ID NO: 148858 - DNA, 25 bp, Homo sapien
tgaaggtcctcactgtttgcatatc

SEQ ID NO: 148859 - DNA, 25 bp, Homo sapien
aggtcctcactgtttgcatatcgct

SEQ ID NO: 148860 - DNA, 25 bp, Homo sapien
actgtttgcatatcgctcaggccac

SEQ ID NO: 148861 - DNA, 25 bp, Homo sapien
cccacctaggttttataatgtatat

SEQ ID NO: 148862 - DNA, 25 bp, Homo sapien
gtatttttaaaatccagctgtgatg

SEQ ID NO: 148863 - DNA, 25 bp, Homo sapien
atccagctgtgatgggttatatcat

SEQ ID NO: 148864 - DNA, 25 bp, Homo sapien
ggttatatcataaatgcagcttggg

SEQ ID NO: 148865 - DNA, 25 bp, Homo sapien
ttgacattttgctaaaggctgtggg

SEQ ID NO: 148866 - DNA, 25 bp, Homo sapien
gctaaaggctgtgggagacactcct

SEQ ID NO: 148867 - DNA, 25 bp, Homo sapien
gctgtgggagacactcctattatga

SEQ ID NO: 148868 - DNA, 25 bp, Homo sapien
gggcagtagagcgaacacgaaccat

SEQ ID NO: 148869 - DNA, 25 bp, Homo sapien
agagcgaacacgaaccatccaagga

SEQ ID NO: 148870 - DNA, 25 bp, Homo sapien
gaaccatccaaggactcattgactt

SEQ ID NO: 148871 - DNA, 25 bp, Homo sapien
tccaaggactcattgacttcatcaa

SEQ ID NO: 148872 - DNA, 25 bp, Homo sapien
aggactcattgacttcatcaaaaag

SEQ ID NO: 148873 - DNA, 25 bp, Homo sapien
taaacttgtggcctcagaacagttg

SEQ ID NO: 148874 - DNA, 25 bp, Homo sapien
ttgtggcctcagaacagttgtttat

SEQ ID NO: 148875 - DNA, 25 bp, Homo sapien
ggcctcagaacagttgtttatttat

SEQ ID NO: 148876 - DNA, 25 bp, Homo sapien
gcacacgcagtatgagcgcttcatc

SEQ ID NO: 148877 - DNA, 25 bp, Homo sapien
agtatgagcgcttcatcccctcggc

SEQ ID NO: 148878 - DNA, 25 bp, Homo sapien
gatgctggggctcttcatcttcagc

SEQ ID NO: 148879 - DNA, 25 bp, Homo sapien
gcatcgtcttcttgcacatgaagga

SEQ ID NO: 148880 - DNA, 25 bp, Homo sapien
tcgtcttcttgcacatgaaggagaa

SEQ ID NO: 148881 - DNA, 25 bp, Homo sapien
gagccctctccgcacagcgtggaga

SEQ ID NO: 148882 - DNA, 25 bp, Homo sapien
tgtttaaagccgtgggaaaatggca

SEQ ID NO: 148883 - DNA, 25 bp, Homo sapien
gaaaatggcacaactttacctctgt

SEQ ID NO: 148884 - DNA, 25 bp, Homo sapien
ggcacaactttacctctgtgggaga

SEQ ID NO: 148885 - DNA, 25 bp, Homo sapien
ttacctctgtgggagatgcaacact

SEQ ID NO: 148886 - DNA, 25 bp, Homo sapien
gagatgcaacactgagagccaaggg

SEQ ID NO: 148887 - DNA, 25 bp, Homo sapien
taagcaggacagtgtgcgtgcacga

SEQ ID NO: 148888 - DNA, 25 bp, Homo sapien
gacagtgtgcgtgcacgagctccga

SEQ ID NO: 148889 - DNA, 25 bp, Homo sapien
gagctccgagcccagcacagacatg

SEQ ID NO: 148890 - DNA, 25 bp, Homo sapien
gagcccagcacagacatgcctggaa

SEQ ID NO: 148891 - DNA, 25 bp, Homo sapien
gaacgccgtgactgtcgggcagcct

SEQ ID NO: 148892 - DNA, 25 bp, Homo sapien
tcctacgcagggtcacgccacgtgg

SEQ ID NO: 148893 - DNA, 25 bp, Homo sapien
gcgttgcttttcctgggcggccttt

SEQ ID NO: 148894 - DNA, 25 bp, Homo sapien
tcctgggcggccttttatgtcttgg

SEQ ID NO: 148895 - DNA, 25 bp, Homo sapien
tgtcttggagacacctgatgtaaag

SEQ ID NO: 148896 - DNA, 25 bp, Homo sapien
gacacctgatgtaaagtttctgtaa

SEQ ID NO: 148897 - DNA, 25 bp, Homo sapien
gtaaatctatttcatatctgaccca

SEQ ID NO: 148898 - DNA, 25 bp, Homo sapien
ggctccgaatgcacctgggcttggt

SEQ ID NO: 148899 - DNA, 25 bp, Homo sapien
aaggctgcaagattcgatgtgccaa

SEQ ID NO: 148900 - DNA, 25 bp, Homo sapien
gatgtgccaacgagaccaagacctg

SEQ ID NO: 148901 - DNA, 25 bp, Homo sapien
gcaaggtgctcatctttgatgactc

SEQ ID NO: 148902 - DNA, 25 bp, Homo sapien
ttgatgactcctttgagcacgaggt

SEQ ID NO: 148903 - DNA, 25 bp, Homo sapien
aggtatggcaggatgcctcatcttt

SEQ ID NO: 148904 - DNA, 25 bp, Homo sapien
atctttccggctgatattcatcgtg

SEQ ID NO: 148905 - DNA, 25 bp, Homo sapien
gatgtgtggcatccggaactgacac

SEQ ID NO: 148906 - DNA, 25 bp, Homo sapien
agcagagacgcagccttccagcaat

SEQ ID NO: 148907 - DNA, 25 bp, Homo sapien
atgcaagcttgggaaactctggaga

SEQ ID NO: 148908 - DNA, 25 bp, Homo sapien
agagaggctgcctttctggttccat

SEQ ID NO: 148909 - DNA, 25 bp, Homo sapien
agtttgctagtgactaagccccgca

SEQ ID NO: 148910 - DNA, 25 bp, Homo sapien
ctaagccccgcatatgtgagtgaaa

SEQ ID NO: 148911 - DNA, 25 bp, Homo sapien
gtgaaagtacttcaggcacgctgcc

SEQ ID NO: 148912 - DNA, 25 bp, Homo sapien
caggcacgctgcctcctggtaacag

SEQ ID NO: 148913 - DNA, 25 bp, Homo sapien
cctcctggtaacagctatgcaggga

SEQ ID NO: 148914 - DNA, 25 bp, Homo sapien
tatgcagggagggaggacccacact

SEQ ID NO: 148915 - DNA, 25 bp, Homo sapien
agggaggacccacactgctacactt

SEQ ID NO: 148916 - DNA, 25 bp, Homo sapien
tacacttctgatcccctttggtttt

SEQ ID NO: 148917 - DNA, 25 bp, Homo sapien
gataactgctcttttactaagacat

SEQ ID NO: 148918 - DNA, 25 bp, Homo sapien
taagacatagtctctacctatagaa

SEQ ID NO: 148919 - DNA, 25 bp, Homo sapien
acacttattttacacagcaattttg

SEQ ID NO: 148920 - DNA, 25 bp, Homo sapien
ttctggccaggcgtctgcgaaatca

SEQ ID NO: 148921 - DNA, 25 bp, Homo sapien
ggcgtctgcgaaatcatatggctgt

SEQ ID NO: 148922 - DNA, 25 bp, Homo sapien
atcatatggctgtagcattcgtgct

SEQ ID NO: 148923 - DNA, 25 bp, Homo sapien
ctgtagcattcgtgctatccctggg

SEQ ID NO: 148924 - DNA, 25 bp, Homo sapien
cagctttgtataagtttcgtgtggc

SEQ ID NO: 148925 - DNA, 25 bp, Homo sapien
ataagtttcgtgtggctgatcaaag

SEQ ID NO: 148926 - DNA, 25 bp, Homo sapien
ttctacagaaactacgatgtcatga

SEQ ID NO: 148927 - DNA, 25 bp, Homo sapien
gaatttcttcaggttgaattaccta

SEQ ID NO: 148928 - DNA, 25 bp, Homo sapien
gtttgtcactgacttgtgttcctga

SEQ ID NO: 148929 - DNA, 25 bp, Homo sapien
gtcactgacttgtgttcctgaacta

SEQ ID NO: 148930 - DNA, 25 bp, Homo sapien
gtgttcctgaactatgccacatgaa

SEQ ID NO: 148931 - DNA, 25 bp, Homo sapien
gcttgttttgcagtattagtgaatc

SEQ ID NO: 148932 - DNA, 25 bp, Homo sapien
gtgaatcactgaatagcttaagtat

SEQ ID NO: 148933 - DNA, 25 bp, Homo sapien
taaatagtttttctgacccttctga

SEQ ID NO: 148934 - DNA, 25 bp, Homo sapien
aactacataagtgcttcttgttgct

SEQ ID NO: 148935 - DNA, 25 bp, Homo sapien
acataagtgcttcttgttgctgggt

SEQ ID NO: 148936 - DNA, 25 bp, Homo sapien
aagtgcttcttgttgctgggtgaga

SEQ ID NO: 148937 - DNA, 25 bp, Homo sapien
gttgctgggtgagaaatactacttt

SEQ ID NO: 148938 - DNA, 25 bp, Homo sapien
ggttttctgtttgcagatatgattg

SEQ ID NO: 148939 - DNA, 25 bp, Homo sapien
atgattgatgtatttcaccaaaata

SEQ ID NO: 148940 - DNA, 25 bp, Homo sapien
tgtaatttttaggttcacttagaat

SEQ ID NO: 148941 - DNA, 25 bp, Homo sapien
agttaaaattcttttggcacactat

SEQ ID NO: 148942 - DNA, 25 bp, Homo sapien
aattgctttatctgtatatctgaac

SEQ ID NO: 148943 - DNA, 25 bp, Homo sapien
gtatatctgaactcttgaaacttat

SEQ ID NO: 148944 - DNA, 25 bp, Homo sapien
taaaacactaggatttatctgcagt

SEQ ID NO: 148945 - DNA, 25 bp, Homo sapien
aaaaccagccaacctatgttacacg

SEQ ID NO: 148946 - DNA, 25 bp, Homo sapien
gccaacctatgttacacgtgagatt

SEQ ID NO: 148947 - DNA, 25 bp, Homo sapien
tacacgtgagattaaaaccaatttt

SEQ ID NO: 148948 - DNA, 25 bp, Homo sapien
ttttctcttgctgcccacattgtgc

SEQ ID NO: 148949 - DNA, 25 bp, Homo sapien
ttgctgcccacattgtgcctttatt

SEQ ID NO: 148950 - DNA, 25 bp, Homo sapien
gtgcctttattttatgagccccagt

SEQ ID NO: 148951 - DNA, 25 bp, Homo sapien
gagccccagttttctgggcttagtt

SEQ ID NO: 148952 - DNA, 25 bp, Homo sapien
aaatcaagtctaaacattgcattta

SEQ ID NO: 148953 - DNA, 25 bp, Homo sapien
ttatgggatgcctggatcattcaga

SEQ ID NO: 148954 - DNA, 25 bp, Homo sapien
gcctggatcattcagaaggatgctt

SEQ ID NO: 148955 - DNA, 25 bp, Homo sapien
agaaggatgcttcaactattatttg

SEQ ID NO: 148956 - DNA, 25 bp, Homo sapien
ttatttgtcaggtccaaaggtcgta

SEQ ID NO: 148957 - DNA, 25 bp, Homo sapien
gtcgtacttgataaccccattttct

SEQ ID NO: 148958 - DNA, 25 bp, Homo sapien
gaaagtccttagtgcaaaccaccat

SEQ ID NO: 148959 - DNA, 25 bp, Homo sapien
aaccaccattggaatctagtcagaa

SEQ ID NO: 148960 - DNA, 25 bp, Homo sapien
ttgtaacatctaaacctgccacgga

SEQ ID NO: 148961 - DNA, 25 bp, Homo sapien
acctgccacggatcgaatggtactt

SEQ ID NO: 148962 - DNA, 25 bp, Homo sapien
gtacttacaggtacctctcttaggg

SEQ ID NO: 148963 - DNA, 25 bp, Homo sapien
gtacctctcttagggactctgtgat

SEQ ID NO: 148964 - DNA, 25 bp, Homo sapien
caatcatatggtattttcaagggaa

SEQ ID NO: 148965 - DNA, 25 bp, Homo sapien
aagattcatcttttcagtttgatag

SEQ ID NO: 148966 - DNA, 25 bp, Homo sapien
aactctttcattacttgcatcgtgt

SEQ ID NO: 148967 - DNA, 25 bp, Homo sapien
tgcatcgtgtaaatcatctctgtag

SEQ ID NO: 148968 - DNA, 25 bp, Homo sapien
atcatctctgtagacatgtgttcat

SEQ ID NO: 148969 - DNA, 25 bp, Homo sapien
gaacacattttttctcaacattgta

SEQ ID NO: 148970 - DNA, 25 bp, Homo sapien
gaaatcattttattcgtcatgatca

SEQ ID NO: 148971 - DNA, 25 bp, Homo sapien
gaatatgtgatttgctccagatcgt

SEQ ID NO: 148972 - DNA, 25 bp, Homo sapien
gtgatttgctccagatcgttagaag

SEQ ID NO: 148973 - DNA, 25 bp, Homo sapien
aatgtttttaccgtagccctcatct

SEQ ID NO: 148974 - DNA, 25 bp, Homo sapien
cctcatctaacttacacgtggtgca

SEQ ID NO: 148975 - DNA, 25 bp, Homo sapien
gctgtacataggctagctatttcta

SEQ ID NO: 148976 - DNA, 25 bp, Homo sapien
gtacataggctagctatttctaaat

SEQ ID NO: 148977 - DNA, 25 bp, Homo sapien
cataggctagctatttctaaatatt

SEQ ID NO: 148978 - DNA, 25 bp, Homo sapien
aaatccagcctcataaagtagatta

SEQ ID NO: 148979 - DNA, 25 bp, Homo sapien
tccagcctcataaagtagattagaa

SEQ ID NO: 148980 - DNA, 25 bp, Homo sapien
agtttattttgttatcagatatgtg

SEQ ID NO: 148981 - DNA, 25 bp, Homo sapien
gttatcagatatgtgaatctcttct

SEQ ID NO: 148982 - DNA, 25 bp, Homo sapien
attgttacggtatgaagtcttctgt

SEQ ID NO: 148983 - DNA, 25 bp, Homo sapien
tgaagtcttctgtatagtttgtttt

SEQ ID NO: 148984 - DNA, 25 bp, Homo sapien
ctgaaaagaaaacaccactaattgt

SEQ ID NO: 148985 - DNA, 25 bp, Homo sapien
aacaccactaattgtgtacatatgt

SEQ ID NO: 148986 - DNA, 25 bp, Homo sapien
gggaagaatcactaaatacttgtct

SEQ ID NO: 148987 - DNA, 25 bp, Homo sapien
atacttgtctagttatagcatgatg

SEQ ID NO: 148988 - DNA, 25 bp, Homo sapien
tagcatgatgtgagcatctcctcct

SEQ ID NO: 148989 - DNA, 25 bp, Homo sapien
ttatccctcgatgcctggcttggtg

SEQ ID NO: 148990 - DNA, 25 bp, Homo sapien
cctggcttggtgtctggcaaacagt

SEQ ID NO: 148991 - DNA, 25 bp, Homo sapien
tagcagatgttgaaagaccgtttac

SEQ ID NO: 148992 - DNA, 25 bp, Homo sapien
gaaagaccgtttacaaagcagaatt

SEQ ID NO: 148993 - DNA, 25 bp, Homo sapien
attacagcttccagtgttttgacta

SEQ ID NO: 148994 - DNA, 25 bp, Homo sapien
tccagtgttttgactatgtgaacca

SEQ ID NO: 148995 - DNA, 25 bp, Homo sapien
atgtgaaccatatccaactactttt

SEQ ID NO: 148996 - DNA, 25 bp, Homo sapien
gtaatatatttctgtggcatcaaat

SEQ ID NO: 148997 - DNA, 25 bp, Homo sapien
aggctcttctccatcaatgagtgca

SEQ ID NO: 148998 - DNA, 25 bp, Homo sapien
gagtgcaagatcttctaaaccccaa

SEQ ID NO: 148999 - DNA, 25 bp, Homo sapien
agacttcacacaacacttatgtatg

SEQ ID NO: 149000 - DNA, 25 bp, Homo sapien
cttatgtatgcaccccaaagactaa

SEQ ID NO: 149001 - DNA, 25 bp, Homo sapien
gttttctctgggtacaccccaagca

SEQ ID NO: 149002 - DNA, 25 bp, Homo sapien
agcagcgtctccgttttggatacag

SEQ ID NO: 149003 - DNA, 25 bp, Homo sapien
acagttattgatgaggcttggccac

SEQ ID NO: 149004 - DNA, 25 bp, Homo sapien
ttggccactggatgttttcactaac

SEQ ID NO: 149005 - DNA, 25 bp, Homo sapien
gttttcactaactacactctacaag

SEQ ID NO: 149006 - DNA, 25 bp, Homo sapien
tctacaagtgaactccttgcccagg

SEQ ID NO: 149007 - DNA, 25 bp, Homo sapien
ccttgcccaggccagttagaaaatc

SEQ ID NO: 149008 - DNA, 25 bp, Homo sapien
ggccaacaagggaggactcattgca

SEQ ID NO: 149009 - DNA, 25 bp, Homo sapien
gactcattgcatacagatccaggaa

SEQ ID NO: 149010 - DNA, 25 bp, Homo sapien
tggagacattcctgagcctcctggt

SEQ ID NO: 149011 - DNA, 25 bp, Homo sapien
gagcctcctggtccaaaacctggca

SEQ ID NO: 149012 - DNA, 25 bp, Homo sapien
tggcacctgcagagacgcataccta

SEQ ID NO: 149013 - DNA, 25 bp, Homo sapien
gagacgcatacctagaggaactcta

SEQ ID NO: 149014 - DNA, 25 bp, Homo sapien
ggtgtacctgtataaactgaactgt

SEQ ID NO: 149015 - DNA, 25 bp, Homo sapien
gtttcggttatctctgtcttttgag

SEQ ID NO: 149016 - DNA, 25 bp, Homo sapien
ttgaggatggctttgtcctgttgct

SEQ ID NO: 149017 - DNA, 25 bp, Homo sapien
gtcctgttgctggttaacattcacc

SEQ ID NO: 149018 - DNA, 25 bp, Homo sapien
tcctcttttgaggagtatttttcca

SEQ ID NO: 149019 - DNA, 25 bp, Homo sapien
tgctccttccccagaccaagaagtt

SEQ ID NO: 149020 - DNA, 25 bp, Homo sapien
gctccttccccagaccaagaagttg

SEQ ID NO: 149021 - DNA, 25 bp, Homo sapien
ctccttccccagaccaagaagttgg

SEQ ID NO: 149022 - DNA, 25 bp, Homo sapien
tccttccccagaccaagaagttgga

SEQ ID NO: 149023 - DNA, 25 bp, Homo sapien
ttccccagaccaagaagttggaact

SEQ ID NO: 149024 - DNA, 25 bp, Homo sapien
tccccagaccaagaagttggaactc

SEQ ID NO: 149025 - DNA, 25 bp, Homo sapien
agaagttggaactctctatgagtgt

SEQ ID NO: 149026 - DNA, 25 bp, Homo sapien
gaagttggaactctctatgagtgtt

SEQ ID NO: 149027 - DNA, 25 bp, Homo sapien
gattcttactgttcttcgcagctca

SEQ ID NO: 149028 - DNA, 25 bp, Homo sapien
tgttcttcgcagctcatcttttcct

SEQ ID NO: 149029 - DNA, 25 bp, Homo sapien
atcttttcctgcttagaattaacca

SEQ ID NO: 149030 - DNA, 25 bp, Homo sapien
ggagcagctagctgcttttctgtca

SEQ ID NO: 149031 - DNA, 25 bp, Homo sapien
gcttttctgtcagtctgaagcgtag

SEQ ID NO: 149032 - DNA, 25 bp, Homo sapien
gtaagcaccagctgcctctttgctg

SEQ ID NO: 149033 - DNA, 25 bp, Homo sapien
cctcctgattctcttaaatttgggt

SEQ ID NO: 149034 - DNA, 25 bp, Homo sapien
cctgccccatgaaacttgagcattc

SEQ ID NO: 149035 - DNA, 25 bp, Homo sapien
aagattcagcagtgtctgttcttca

SEQ ID NO: 149036 - DNA, 25 bp, Homo sapien
gtctgttcttcatttctatagccaa

SEQ ID NO: 149037 - DNA, 25 bp, Homo sapien
gccaaagctgttagttaaaatccca

SEQ ID NO: 149038 - DNA, 25 bp, Homo sapien
gcagatgctctgaaccctgagcagg

SEQ ID NO: 149039 - DNA, 25 bp, Homo sapien
atgctctgaaccctgagcaggcacc

SEQ ID NO: 149040 - DNA, 25 bp, Homo sapien
acttccctgcaggacagtattcctg

SEQ ID NO: 149041 - DNA, 25 bp, Homo sapien
aggacagtattcctgccgaggctga

SEQ ID NO: 149042 - DNA, 25 bp, Homo sapien
tgccgaggctgacttcctacttggt

SEQ ID NO: 149043 - DNA, 25 bp, Homo sapien
cttcctacttggtctggccactgtc

SEQ ID NO: 149044 - DNA, 25 bp, Homo sapien
tggccactgtcccaggctatgtatc

SEQ ID NO: 149045 - DNA, 25 bp, Homo sapien
caggctatgtatcctttcggcatgt

SEQ ID NO: 149046 - DNA, 25 bp, Homo sapien
tatgtatcctttcggcatgtggagg

SEQ ID NO: 149047 - DNA, 25 bp, Homo sapien
gctggtatattcagtctctgtgtaa

SEQ ID NO: 149048 - DNA, 25 bp, Homo sapien
cagtctctgtgtaatcatctgaaga

SEQ ID NO: 149049 - DNA, 25 bp, Homo sapien
aagaaatactacaaggccattttga

SEQ ID NO: 149050 - DNA, 25 bp, Homo sapien
agaaatactacaaggccattttgat

SEQ ID NO: 149051 - DNA, 25 bp, Homo sapien
gaaatactacaaggccattttgatg

SEQ ID NO: 149052 - DNA, 25 bp, Homo sapien
aaatactacaaggccattttgatga

SEQ ID NO: 149053 - DNA, 25 bp, Homo sapien
aatactacaaggccattttgatgaa

SEQ ID NO: 149054 - DNA, 25 bp, Homo sapien
acaaggccattttgatgaaagacct

SEQ ID NO: 149055 - DNA, 25 bp, Homo sapien
caaggccattttgatgaaagaccta

SEQ ID NO: 149056 - DNA, 25 bp, Homo sapien
aaggccattttgatgaaagacctag

SEQ ID NO: 149057 - DNA, 25 bp, Homo sapien
aggccattttgatgaaagacctaga

SEQ ID NO: 149058 - DNA, 25 bp, Homo sapien
ctccctgccacgtggagacgcagag

SEQ ID NO: 149059 - DNA, 25 bp, Homo sapien
gtggagacgcagaggccgaacccaa

SEQ ID NO: 149060 - DNA, 25 bp, Homo sapien
gacgcagaggccgaacccaaactgg

SEQ ID NO: 149061 - DNA, 25 bp, Homo sapien
gtaccctcacttcagggcacctgag

SEQ ID NO: 149062 - DNA, 25 bp, Homo sapien
ctgagccaccctcagcaggagctgg

SEQ ID NO: 149063 - DNA, 25 bp, Homo sapien
tccaacggccataacagctctgact

SEQ ID NO: 149064 - DNA, 25 bp, Homo sapien
acgtgaggccacctttgggtgcacc

SEQ ID NO: 149065 - DNA, 25 bp, Homo sapien
acctttgggtgcaccccagtgggtg

SEQ ID NO: 149066 - DNA, 25 bp, Homo sapien
gttggttgagttgcctagaacccct

SEQ ID NO: 149067 - DNA, 25 bp, Homo sapien
gagttgcctagaacccctgccaggg

SEQ ID NO: 149068 - DNA, 25 bp, Homo sapien
ggagtcattactccccattacctag

SEQ ID NO: 149069 - DNA, 25 bp, Homo sapien
acctgtttcctggaccagtgaccaa

SEQ ID NO: 149070 - DNA, 25 bp, Homo sapien
ggaccagtgaccaaacctcatatgt

SEQ ID NO: 149071 - DNA, 25 bp, Homo sapien
ggccaaagcacatgcaggctcctgg

SEQ ID NO: 149072 - DNA, 25 bp, Homo sapien
aggctcctggttgttcctctcaaac

SEQ ID NO: 149073 - DNA, 25 bp, Homo sapien
gttgttcctctcaaacctgtgctga

SEQ ID NO: 149074 - DNA, 25 bp, Homo sapien
aacctgtgctgaccaaagattagta

SEQ ID NO: 149075 - DNA, 25 bp, Homo sapien
tagttatacaccatatgcctcattt

SEQ ID NO: 149076 - DNA, 25 bp, Homo sapien
atatgcctcattttatcatagccta

SEQ ID NO: 149077 - DNA, 25 bp, Homo sapien
gatgtttagtttgctttagtcattt

SEQ ID NO: 149078 - DNA, 25 bp, Homo sapien
agcacgtatccattattcttctcaa

SEQ ID NO: 149079 - DNA, 25 bp, Homo sapien
atccattattcttctcaacccaaga

SEQ ID NO: 149080 - DNA, 25 bp, Homo sapien
gctggaagagtgattaatacatctt

SEQ ID NO: 149081 - DNA, 25 bp, Homo sapien
aacaatgtagacctttaaacttcag

SEQ ID NO: 149082 - DNA, 25 bp, Homo sapien
gacctttaaacttcagtcttattgg

SEQ ID NO: 149083 - DNA, 25 bp, Homo sapien
ggaacttaattcatacaggtacttg

SEQ ID NO: 149084 - DNA, 25 bp, Homo sapien
tacaggtacttgatacagttataca

SEQ ID NO: 149085 - DNA, 25 bp, Homo sapien
cagttatacattttccacttacaaa

SEQ ID NO: 149086 - DNA, 25 bp, Homo sapien
tattaccctgtgtaccttgtccctc

SEQ ID NO: 149087 - DNA, 25 bp, Homo sapien
ctcattttgctgtgacaccctgaaa

SEQ ID NO: 149088 - DNA, 25 bp, Homo sapien
ttttgctgtgacaccctgaaaaagc

SEQ ID NO: 149089 - DNA, 25 bp, Homo sapien
tgtgacaccctgaaaaagctgacca

SEQ ID NO: 149090 - DNA, 25 bp, Homo sapien
gacaccctgaaaaagctgaccacaa

SEQ ID NO: 149091 - DNA, 25 bp, Homo sapien
gccctcgatggacaggcctgaccca

SEQ ID NO: 149092 - DNA, 25 bp, Homo sapien
ccctcgatggacaggcctgacccac

SEQ ID NO: 149093 - DNA, 25 bp, Homo sapien
cctcgatggacaggcctgacccacc

SEQ ID NO: 149094 - DNA, 25 bp, Homo sapien
cgatggacaggcctgacccacccca

SEQ ID NO: 149095 - DNA, 25 bp, Homo sapien
gatggacaggcctgacccaccccac

SEQ ID NO: 149096 - DNA, 25 bp, Homo sapien
ggacaggcctgacccaccccacctg

SEQ ID NO: 149097 - DNA, 25 bp, Homo sapien
gggccactggctggcgcctcttccc

SEQ ID NO: 149098 - DNA, 25 bp, Homo sapien
tgagagccgtctcctataggtcccc

SEQ ID NO: 149099 - DNA, 25 bp, Homo sapien
gagagccgtctcctataggtccccc

SEQ ID NO: 149100 - DNA, 25 bp, Homo sapien
agagccgtctcctataggtcccccg

SEQ ID NO: 149101 - DNA, 25 bp, Homo sapien
gtctcctataggtcccccgccccat

SEQ ID NO: 149102 - DNA, 25 bp, Homo sapien
gaggattcagtagtacacatacaac

SEQ ID NO: 149103 - DNA, 25 bp, Homo sapien
gaagacatctaccagtttctccaaa

SEQ ID NO: 149104 - DNA, 25 bp, Homo sapien
gccttttttaaaactcatcacagaa

SEQ ID NO: 149105 - DNA, 25 bp, Homo sapien
atgctgagtatgacacttttcttct

SEQ ID NO: 149106 - DNA, 25 bp, Homo sapien
tgacacttttcttcttgcatgcatg

SEQ ID NO: 149107 - DNA, 25 bp, Homo sapien
ttcttgcatgcatgtcagctacata

SEQ ID NO: 149108 - DNA, 25 bp, Homo sapien
tactaatttgtttgacattccatgt

SEQ ID NO: 149109 - DNA, 25 bp, Homo sapien
acattccatgttaaactacggtcat

SEQ ID NO: 149110 - DNA, 25 bp, Homo sapien
acggtcatgttcagcttcattgcat

SEQ ID NO: 149111 - DNA, 25 bp, Homo sapien
tgtaatgtagacctagtccatcaga

SEQ ID NO: 149112 - DNA, 25 bp, Homo sapien
tccatcagatcatgtgttctggaga

SEQ ID NO: 149113 - DNA, 25 bp, Homo sapien
agtgcccagtagcacagctgccagc

SEQ ID NO: 149114 - DNA, 25 bp, Homo sapien
gggcagagtttgcacaaagtccccc

SEQ ID NO: 149115 - DNA, 25 bp, Homo sapien
tttgcacaaagtcccccccataata

SEQ ID NO: 149116 - DNA, 25 bp, Homo sapien
gggagctgtagttgccccctacctc

SEQ ID NO: 149117 - DNA, 25 bp, Homo sapien
ttccacatcgtgaagctgccgctgt

SEQ ID NO: 149118 - DNA, 25 bp, Homo sapien
acatcgtgaagctgccgctgttacc

SEQ ID NO: 149119 - DNA, 25 bp, Homo sapien
tgaagctgccgctgttaccccatga

SEQ ID NO: 149120 - DNA, 25 bp, Homo sapien
aagctgccgctgttaccccatgagg

SEQ ID NO: 149121 - DNA, 25 bp, Homo sapien
ctgccgctgttaccccatgaggtgc

SEQ ID NO: 149122 - DNA, 25 bp, Homo sapien
gggcagacaaggtcaacaccttctc

SEQ ID NO: 149123 - DNA, 25 bp, Homo sapien
agacaaggtcaacaccttctcggcc

SEQ ID NO: 149124 - DNA, 25 bp, Homo sapien
gggcggatcccttatgtatgacttt

SEQ ID NO: 149125 - DNA, 25 bp, Homo sapien
gatcccttatgtatgactttgtgcc

SEQ ID NO: 149126 - DNA, 25 bp, Homo sapien
ttatgtatgactttgtgccatcccc

SEQ ID NO: 149127 - DNA, 25 bp, Homo sapien
atgactttgtgccatccccatagta

SEQ ID NO: 149128 - DNA, 25 bp, Homo sapien
tgtgccatccccatagtaatgagtg

SEQ ID NO: 149129 - DNA, 25 bp, Homo sapien
tctcactctggttgtttatgcaaga

SEQ ID NO: 149130 - DNA, 25 bp, Homo sapien
atgattgtaagcttcgtgaggccct

SEQ ID NO: 149131 - DNA, 25 bp, Homo sapien
gattgtaagcttcgtgaggccctca

SEQ ID NO: 149132 - DNA, 25 bp, Homo sapien
gatgcccagcgccatgcttcctata

SEQ ID NO: 149133 - DNA, 25 bp, Homo sapien
gcttcctatacagttctatgcagaa

SEQ ID NO: 149134 - DNA, 25 bp, Homo sapien
atacagttctatgcagaacagtgag

SEQ ID NO: 149135 - DNA, 25 bp, Homo sapien
tagcatcatggagcccacagcatcc

SEQ ID NO: 149136 - DNA, 25 bp, Homo sapien
atccctggtccccttggaggctact

SEQ ID NO: 149137 - DNA, 25 bp, Homo sapien
tggaggctactgacagcctgctgga

SEQ ID NO: 149138 - DNA, 25 bp, Homo sapien
acccactcctgcagcagactgagga

SEQ ID NO: 149139 - DNA, 25 bp, Homo sapien
agactgaggaccagttcctgtcccc

SEQ ID NO: 149140 - DNA, 25 bp, Homo sapien
actgaggaccagttcctgtccccga

SEQ ID NO: 149141 - DNA, 25 bp, Homo sapien
tggcgtgcagctcccctctgatcag

SEQ ID NO: 149142 - DNA, 25 bp, Homo sapien
atccttggaccaggacgactacctg

SEQ ID NO: 149143 - DNA, 25 bp, Homo sapien
ttggaccaggacgactacctgtggg

SEQ ID NO: 149144 - DNA, 25 bp, Homo sapien
gtgagggcatcagcgatctcttcga

SEQ ID NO: 149145 - DNA, 25 bp, Homo sapien
atctcttcgactcctacgaccttgg

SEQ ID NO: 149146 - DNA, 25 bp, Homo sapien
gatagtggacgtcccattctatgag

SEQ ID NO: 149147 - DNA, 25 bp, Homo sapien
tagtggacgtcccattctatgagtg

SEQ ID NO: 149148 - DNA, 25 bp, Homo sapien
ctggaactcaagtctgaatggcaga

SEQ ID NO: 149149 - DNA, 25 bp, Homo sapien
gaatggcagaaaggcgcctacctca

SEQ ID NO: 149150 - DNA, 25 bp, Homo sapien
gccaagtgacttgtgccagcagcat

SEQ ID NO: 149151 - DNA, 25 bp, Homo sapien
ctctccgccggaggtctagctgtgg

SEQ ID NO: 149152 - DNA, 25 bp, Homo sapien
cggaggtctagctgtgggcggccaa

SEQ ID NO: 149153 - DNA, 25 bp, Homo sapien
tgggcggccaagaagggtcaccctt

SEQ ID NO: 149154 - DNA, 25 bp, Homo sapien
ggcggccaagaagggtcacccttga

SEQ ID NO: 149155 - DNA, 25 bp, Homo sapien
tgagggacagaacgtcctcttgtgt

SEQ ID NO: 149156 - DNA, 25 bp, Homo sapien
agggacagaacgtcctcttgtgtat

SEQ ID NO: 149157 - DNA, 25 bp, Homo sapien
tcactgatattttagtcattctgct

SEQ ID NO: 149158 - DNA, 25 bp, Homo sapien
ctgatattttagtcattctgcttct

SEQ ID NO: 149159 - DNA, 25 bp, Homo sapien
tattttagtcattctgcttctcatc

SEQ ID NO: 149160 - DNA, 25 bp, Homo sapien
ttttagtcattctgcttctcatcta

SEQ ID NO: 149161 - DNA, 25 bp, Homo sapien
tagtcattctgcttctcatctaaat

SEQ ID NO: 149162 - DNA, 25 bp, Homo sapien
gtcattctgcttctcatctaaatat

SEQ ID NO: 149163 - DNA, 25 bp, Homo sapien
ttctgcttctcatctaaatatttcc

SEQ ID NO: 149164 - DNA, 25 bp, Homo sapien
ctgcttctcatctaaatatttccat

SEQ ID NO: 149165 - DNA, 25 bp, Homo sapien
gcttctcatctaaatatttccatat

SEQ ID NO: 149166 - DNA, 25 bp, Homo sapien
aatatttccatattctgtattagga

SEQ ID NO: 149167 - DNA, 25 bp, Homo sapien
tatttccatattctgtattaggaga

SEQ ID NO: 149168 - DNA, 25 bp, Homo sapien
atggatcattctgagctcagggtcc

SEQ ID NO: 149169 - DNA, 25 bp, Homo sapien
gagctcagggtccagactttattct

SEQ ID NO: 149170 - DNA, 25 bp, Homo sapien
gtccagactttattcttattcccag

SEQ ID NO: 149171 - DNA, 25 bp, Homo sapien
tattcccagaattttgtgttacgtt

SEQ ID NO: 149172 - DNA, 25 bp, Homo sapien
ttacgtttttacctcctaacatatg

SEQ ID NO: 149173 - DNA, 25 bp, Homo sapien
tacctcctaacatatgacacttcat

SEQ ID NO: 149174 - DNA, 25 bp, Homo sapien
ttcatttgttactaagccttctcag

SEQ ID NO: 149175 - DNA, 25 bp, Homo sapien
gccttctcaggcaagctgtatacta

SEQ ID NO: 149176 - DNA, 25 bp, Homo sapien
gtatactagttactggtctccactg

SEQ ID NO: 149177 - DNA, 25 bp, Homo sapien
ccactgccatgccttttcaaggttc

SEQ ID NO: 149178 - DNA, 25 bp, Homo sapien
ttcaaggttcccatggtccagaatg

SEQ ID NO: 149179 - DNA, 25 bp, Homo sapien
agctttaccctatctccatttttat

SEQ ID NO: 149180 - DNA, 25 bp, Homo sapien
tattaaacccaaatccatggaaaat

SEQ ID NO: 149181 - DNA, 25 bp, Homo sapien
aactggaacaggagtttactgaaca

SEQ ID NO: 149182 - DNA, 25 bp, Homo sapien
gagtttactgaacatttcacagcta

SEQ ID NO: 149183 - DNA, 25 bp, Homo sapien
ggatacgctggaagacatttacaac

SEQ ID NO: 149184 - DNA, 25 bp, Homo sapien
gctggaagacatttacaaccaagtg

SEQ ID NO: 149185 - DNA, 25 bp, Homo sapien
aacaatctggttcttacatctgggt

SEQ ID NO: 149186 - DNA, 25 bp, Homo sapien
aatctggttcttacatctgggttcc

SEQ ID NO: 149187 - DNA, 25 bp, Homo sapien
gttcttacatctgggttccggcaaa

SEQ ID NO: 149188 - DNA, 25 bp, Homo sapien
ttacatctgggttccggcaaaagaa

SEQ ID NO: 149189 - DNA, 25 bp, Homo sapien
tctgggttccggcaaaagaaaagct

SEQ ID NO: 149190 - DNA, 25 bp, Homo sapien
atgggcaatcccagcgagttctttg

SEQ ID NO: 149191 - DNA, 25 bp, Homo sapien
gcaatcccagcgagttctttgtgga

SEQ ID NO: 149192 - DNA, 25 bp, Homo sapien
tgggccgggcgctcctggtgtgtga

SEQ ID NO: 149193 - DNA, 25 bp, Homo sapien
ctcctggtgtgtgactgggtgtcct

SEQ ID NO: 149194 - DNA, 25 bp, Homo sapien
ggccgtcatgtgcttgctcttacag

SEQ ID NO: 149195 - DNA, 25 bp, Homo sapien
gtcatgtgcttgctcttacagtgcc

SEQ ID NO: 149196 - DNA, 25 bp, Homo sapien
atgtgcttgctcttacagtgcctgg

SEQ ID NO: 149197 - DNA, 25 bp, Homo sapien
gcttgctcttacagtgcctgggctc

SEQ ID NO: 149198 - DNA, 25 bp, Homo sapien
ctaccagctgctgccatacaggaga

SEQ ID NO: 149199 - DNA, 25 bp, Homo sapien
cagctgctgccatacaggagattgt

SEQ ID NO: 149200 - DNA, 25 bp, Homo sapien
ctgccatacaggagattgtggccac

SEQ ID NO: 149201 - DNA, 25 bp, Homo sapien
gataggagacttgtacagttgactg

SEQ ID NO: 149202 - DNA, 25 bp, Homo sapien
cagttgactggctttcctctcgttg

SEQ ID NO: 149203 - DNA, 25 bp, Homo sapien
tggctttcctctcgttggtagttga

SEQ ID NO: 149204 - DNA, 25 bp, Homo sapien
tcctctcgttggtagttgagacgct

SEQ ID NO: 149205 - DNA, 25 bp, Homo sapien
tgagacgctgttgcaaattccaccc

SEQ ID NO: 149206 - DNA, 25 bp, Homo sapien
tccctggtccagattgtagctctta

SEQ ID NO: 149207 - DNA, 25 bp, Homo sapien
agattgtagctcttagtcctccctg

SEQ ID NO: 149208 - DNA, 25 bp, Homo sapien
gtttcttgggaaaatatcactttgt

SEQ ID NO: 149209 - DNA, 25 bp, Homo sapien
tatcactttgtattctctgtccagg

SEQ ID NO: 149210 - DNA, 25 bp, Homo sapien
tattctctgtccagggcttcagata

SEQ ID NO: 149211 - DNA, 25 bp, Homo sapien
ccagggcttcagatattttgcacga

SEQ ID NO: 149212 - DNA, 25 bp, Homo sapien
gatgattgactgtaatgctttccat

SEQ ID NO: 149213 - DNA, 25 bp, Homo sapien
aatgctttccatttacctgactaaa

SEQ ID NO: 149214 - DNA, 25 bp, Homo sapien
tttacctgactaaacagatcattat

SEQ ID NO: 149215 - DNA, 25 bp, Homo sapien
aggtattgattgctaccctgaccac

SEQ ID NO: 149216 - DNA, 25 bp, Homo sapien
ttgctaccctgaccacagtgctttg

SEQ ID NO: 149217 - DNA, 25 bp, Homo sapien
gtgctttggactatgagaaacttct

SEQ ID NO: 149218 - DNA, 25 bp, Homo sapien
ttttatatgtaaatgctgtggacca

SEQ ID NO: 149219 - DNA, 25 bp, Homo sapien
actgggagcacaatgcccacatcat

SEQ ID NO: 149220 - DNA, 25 bp, Homo sapien
aatgcccacatcatcttaagaagag

SEQ ID NO: 149221 - DNA, 25 bp, Homo sapien
agagtttatgtgcagcatttaaatc

SEQ ID NO: 149222 - DNA, 25 bp, Homo sapien
gttaactaaaacagacatgggcttt

SEQ ID NO: 149223 - DNA, 25 bp, Homo sapien
acttttcaatagttgtttgtgagct

SEQ ID NO: 149224 - DNA, 25 bp, Homo sapien
gcttacttttcaacataattcccag

SEQ ID NO: 149225 - DNA, 25 bp, Homo sapien
aagatttccacctgtcacgtatctg

SEQ ID NO: 149226 - DNA, 25 bp, Homo sapien
gtatctgcctcttttacctgagcaa

SEQ ID NO: 149227 - DNA, 25 bp, Homo sapien
gcctcttttacctgagcaatggtgt

SEQ ID NO: 149228 - DNA, 25 bp, Homo sapien
gcaatggtgtagttcttagacctaa

SEQ ID NO: 149229 - DNA, 25 bp, Homo sapien
gacctaaggtctgtaattgcaatac

SEQ ID NO: 149230 - DNA, 25 bp, Homo sapien
atgttgctctaagtgctgtttgtta

SEQ ID NO: 149231 - DNA, 25 bp, Homo sapien
agtgctgtttgttagttatgaaatc

SEQ ID NO: 149232 - DNA, 25 bp, Homo sapien
agatttttctgcttgttcttaatgc

SEQ ID NO: 149233 - DNA, 25 bp, Homo sapien
ttcttaatgctgtggtcaaaccata

SEQ ID NO: 149234 - DNA, 25 bp, Homo sapien
gtgcaatgtgaatgtaccgtctctg

SEQ ID NO: 149235 - DNA, 25 bp, Homo sapien
tgaatgtaccgtctctgctaaacca

SEQ ID NO: 149236 - DNA, 25 bp, Homo sapien
gtctctgctaaaccaccattttatt

SEQ ID NO: 149237 - DNA, 25 bp, Homo sapien
tgtttggttttctcggatacttgcc

SEQ ID NO: 149238 - DNA, 25 bp, Homo sapien
ggttttctcggatacttgccaaaat

SEQ ID NO: 149239 - DNA, 25 bp, Homo sapien
tacttgccaaaatgagactctccgt

SEQ ID NO: 149240 - DNA, 25 bp, Homo sapien
aaaatgagactctccgtcggcagct

SEQ ID NO: 149241 - DNA, 25 bp, Homo sapien
atgagactctccgtcggcagctggg

SEQ ID NO: 149242 - DNA, 25 bp, Homo sapien
ctgagactctctttccttttggttt

SEQ ID NO: 149243 - DNA, 25 bp, Homo sapien
ggttttgggattacttttgatcctg

SEQ ID NO: 149244 - DNA, 25 bp, Homo sapien
tcctggtcgggaagggaggtgcctc

SEQ ID NO: 149245 - DNA, 25 bp, Homo sapien
ggcgacaggctcacgctggccgact

SEQ ID NO: 149246 - DNA, 25 bp, Homo sapien
gagctgcgcggcgtacgccgctacc

SEQ ID NO: 149247 - DNA, 25 bp, Homo sapien
gctgcgcggcgtacgccgctacctg

SEQ ID NO: 149248 - DNA, 25 bp, Homo sapien
acgtgtccgcacagcgccgagatcc

SEQ ID NO: 149249 - DNA, 25 bp, Homo sapien
gtgtccgcacagcgccgagatcctg

SEQ ID NO: 149250 - DNA, 25 bp, Homo sapien
acagcgccgagatcctggcggccta

SEQ ID NO: 149251 - DNA, 25 bp, Homo sapien
cagcgccgagatcctggcggcctac

SEQ ID NO: 149252 - DNA, 25 bp, Homo sapien
agcgccgagatcctggcggcctacc

SEQ ID NO: 149253 - DNA, 25 bp, Homo sapien
gcgccgagatcctggcggcctaccg

SEQ ID NO: 149254 - DNA, 25 bp, Homo sapien
cgccgagatcctggcggcctaccgg

SEQ ID NO: 149255 - DNA, 25 bp, Homo sapien
gagatcctggcggcctaccggcccg

SEQ ID NO: 149256 - DNA, 25 bp, Homo sapien
acagtaattcagtccattcttctcc

SEQ ID NO: 149257 - DNA, 25 bp, Homo sapien
ttctcccctgaaatgaagactacat

SEQ ID NO: 149258 - DNA, 25 bp, Homo sapien
ctctctccctttggaaacagtcaag

SEQ ID NO: 149259 - DNA, 25 bp, Homo sapien
ggaaacagtcaagtgtacttcacac

SEQ ID NO: 149260 - DNA, 25 bp, Homo sapien
gtgtacttcacactactagatgtta

SEQ ID NO: 149261 - DNA, 25 bp, Homo sapien
gattattggcatatactgactgact

SEQ ID NO: 149262 - DNA, 25 bp, Homo sapien
tggcatatactgactgactgcaata

SEQ ID NO: 149263 - DNA, 25 bp, Homo sapien
gactgactgcaatatttgtagtaaa

SEQ ID NO: 149264 - DNA, 25 bp, Homo sapien
gggataatttgatcgaatcacctga

SEQ ID NO: 149265 - DNA, 25 bp, Homo sapien
attcttttcttgctttcttgtgtta

SEQ ID NO: 149266 - DNA, 25 bp, Homo sapien
tcttgctttcttgtgttaaggtata

SEQ ID NO: 149267 - DNA, 25 bp, Homo sapien
tagtgtgctgcatggaacgtattta

SEQ ID NO: 149268 - DNA, 25 bp, Homo sapien
gctgcatggaacgtatttatttgaa

SEQ ID NO: 149269 - DNA, 25 bp, Homo sapien
aaatgatcctagagcatgtgcataa

SEQ ID NO: 149270 - DNA, 25 bp, Homo sapien
agaggactgtattctctctgctgct

SEQ ID NO: 149271 - DNA, 25 bp, Homo sapien
tctctctgctgctgttgaggttata

SEQ ID NO: 149272 - DNA, 25 bp, Homo sapien
gaggttatattaagttccacatagc

SEQ ID NO: 149273 - DNA, 25 bp, Homo sapien
aagttccacatagcaattacagtat

SEQ ID NO: 149274 - DNA, 25 bp, Homo sapien
attacagtatgccagttccactgaa

SEQ ID NO: 149275 - DNA, 25 bp, Homo sapien
aaatctttagaggtttcttgcagtg

SEQ ID NO: 149276 - DNA, 25 bp, Homo sapien
ttagaggtttcttgcagtgaacgaa

SEQ ID NO: 149277 - DNA, 25 bp, Homo sapien
accactaatacttctcactgaagct

SEQ ID NO: 149278 - DNA, 25 bp, Homo sapien
gcatttattgctgagttatatgttc

SEQ ID NO: 149279 - DNA, 25 bp, Homo sapien
gctgagttatatgttcactgtcccc

SEQ ID NO: 149280 - DNA, 25 bp, Homo sapien
ttcactgtccccctaatattaggga

SEQ ID NO: 149281 - DNA, 25 bp, Homo sapien
ggagtaaaacggataccaagttgat

SEQ ID NO: 149282 - DNA, 25 bp, Homo sapien
taaaacggataccaagttgatttag

SEQ ID NO: 149283 - DNA, 25 bp, Homo sapien
tgtgaagaagggtgtttttctgttt

SEQ ID NO: 149284 - DNA, 25 bp, Homo sapien
ttttctgttttatattcaactcata

SEQ ID NO: 149285 - DNA, 25 bp, Homo sapien
atattcaactcataagactttggga

SEQ ID NO: 149286 - DNA, 25 bp, Homo sapien
caactcataagactttgggatagga

SEQ ID NO: 149287 - DNA, 25 bp, Homo sapien
gaacccccatgatgtaagtttacct

SEQ ID NO: 149288 - DNA, 25 bp, Homo sapien
gcacttatacccatgaacttaaaat

SEQ ID NO: 149289 - DNA, 25 bp, Homo sapien
tagcctgtccacttagctgaatacc

SEQ ID NO: 149290 - DNA, 25 bp, Homo sapien
cagggtggccacttacaaacttacg

SEQ ID NO: 149291 - DNA, 25 bp, Homo sapien
tacggagctcaggacagatattctt

SEQ ID NO: 149292 - DNA, 25 bp, Homo sapien
aatagacttgcttgggtggtagtac

SEQ ID NO: 149293 - DNA, 25 bp, Homo sapien
gggtggtagtacgttgtgcaatttt

SEQ ID NO: 149294 - DNA, 25 bp, Homo sapien
ttgatctggaggcaggacagcttct

SEQ ID NO: 149295 - DNA, 25 bp, Homo sapien
aatgtggttccctttgtcacttctt

SEQ ID NO: 149296 - DNA, 25 bp, Homo sapien
ggtggtcttaaattatcttgcttca

SEQ ID NO: 149297 - DNA, 25 bp, Homo sapien
tcttgcttcatatatcattccttaa

SEQ ID NO: 149298 - DNA, 25 bp, Homo sapien
aaattccagtcattgttccagcata

SEQ ID NO: 149299 - DNA, 25 bp, Homo sapien
tgccagtagatttgcctagcctgtc

SEQ ID NO: 149300 - DNA, 25 bp, Homo sapien
agagaattctcttatccaacatcaa

SEQ ID NO: 149301 - DNA, 25 bp, Homo sapien
gaattctcttatccaacatcaacat

SEQ ID NO: 149302 - DNA, 25 bp, Homo sapien
atccaacatcaacatcttggtcaga

SEQ ID NO: 149303 - DNA, 25 bp, Homo sapien
catcttggtcagatttgaactcttc

SEQ ID NO: 149304 - DNA, 25 bp, Homo sapien
tgaactcttcaatctcttgcactca

SEQ ID NO: 149305 - DNA, 25 bp, Homo sapien
aatctcttgcactcaaagcttgtta

SEQ ID NO: 149306 - DNA, 25 bp, Homo sapien
gttaacttccaatttacatactctg

SEQ ID NO: 149307 - DNA, 25 bp, Homo sapien
tccaatttacatactctgcttagaa

SEQ ID NO: 149308 - DNA, 25 bp, Homo sapien
gattcatatttacttcttatacatt

SEQ ID NO: 149309 - DNA, 25 bp, Homo sapien
aagtaaggcatggttgtggttaatc

SEQ ID NO: 149310 - DNA, 25 bp, Homo sapien
gcatggttgtggttaatctggttta

SEQ ID NO: 149311 - DNA, 25 bp, Homo sapien
atctaaaaatgtccctaagcaattc

SEQ ID NO: 149312 - DNA, 25 bp, Homo sapien
aagcaattcttaatttcagctgaaa

SEQ ID NO: 149313 - DNA, 25 bp, Homo sapien
gggtttttgctaatgataatggttt

SEQ ID NO: 149314 - DNA, 25 bp, Homo sapien
ggttttgaggatagaacttcagaac

SEQ ID NO: 149315 - DNA, 25 bp, Homo sapien
tatgaaacactcttaattgaaacag

SEQ ID NO: 149316 - DNA, 25 bp, Homo sapien
acagcctcttctctagtcaagaatg

SEQ ID NO: 149317 - DNA, 25 bp, Homo sapien
gcctcttctctagtcaagaatgcta

SEQ ID NO: 149318 - DNA, 25 bp, Homo sapien
aagaatgctattcagttgtcaatag

SEQ ID NO: 149319 - DNA, 25 bp, Homo sapien
ttcagttgtcaatagaacagctggt

SEQ ID NO: 149320 - DNA, 25 bp, Homo sapien
tagaacagctggttaatgaaatggc

SEQ ID NO: 149321 - DNA, 25 bp, Homo sapien
aacaatcttctacagtgacttactc

SEQ ID NO: 149322 - DNA, 25 bp, Homo sapien
aatggtggcttcagctccagcccct

SEQ ID NO: 149323 - DNA, 25 bp, Homo sapien
tagtagttctcttggtgttaaaaca

SEQ ID NO: 149324 - DNA, 25 bp, Homo sapien
gtgttaaaacacttctgtcctgtga

SEQ ID NO: 149325 - DNA, 25 bp, Homo sapien
tgtcctgtgaggtttcccaatggtg

SEQ ID NO: 149326 - DNA, 25 bp, Homo sapien
tcccaatggtgtttttcttgtaaat

SEQ ID NO: 149327 - DNA, 25 bp, Homo sapien
gtgaagatgcattgtagtttaacca

SEQ ID NO: 149328 - DNA, 25 bp, Homo sapien
gtagtttaaccatatgcccacattt

SEQ ID NO: 149329 - DNA, 25 bp, Homo sapien
gcccacatttagtctctttattcct

SEQ ID NO: 149330 - DNA, 25 bp, Homo sapien
tttattcctagttggtgagaaacct

SEQ ID NO: 149331 - DNA, 25 bp, Homo sapien
aacctgtatctttctatgctgcttt

SEQ ID NO: 149332 - DNA, 25 bp, Homo sapien
ctatgctgcttttatatctgtatgt

SEQ ID NO: 149333 - DNA, 25 bp, Homo sapien
atttcaatgaccctggttcaccatg

SEQ ID NO: 149334 - DNA, 25 bp, Homo sapien
atgaccctggttcaccatgttttaa

SEQ ID NO: 149335 - DNA, 25 bp, Homo sapien
gttcaccatgttttaaccggctgtt

SEQ ID NO: 149336 - DNA, 25 bp, Homo sapien
taaccggctgttttatgctgtggat

SEQ ID NO: 149337 - DNA, 25 bp, Homo sapien
tatgctgtggatgttgacgacgata

SEQ ID NO: 149338 - DNA, 25 bp, Homo sapien
tgttgacgacgatatttgggaagat

SEQ ID NO: 149339 - DNA, 25 bp, Homo sapien
caaagtaactttgcgggatatttag

SEQ ID NO: 149340 - DNA, 25 bp, Homo sapien
gcgggatatttagggtactattcat

SEQ ID NO: 149341 - DNA, 25 bp, Homo sapien
aacgaggtttatattttcatgtggt

SEQ ID NO: 149342 - DNA, 25 bp, Homo sapien
gtggtactactgaagaaggtgcatt

SEQ ID NO: 149343 - DNA, 25 bp, Homo sapien
agaaggtgcattgatacatttttaa

SEQ ID NO: 149344 - DNA, 25 bp, Homo sapien
gaaggagtacgtgggctactgctca

SEQ ID NO: 149345 - DNA, 25 bp, Homo sapien
gtgggctactgctcacactggcagc

SEQ ID NO: 149346 - DNA, 25 bp, Homo sapien
actggcagctgacccagatgttcca

SEQ ID NO: 149347 - DNA, 25 bp, Homo sapien
agggcaggcaccttccttagctgag

SEQ ID NO: 149348 - DNA, 25 bp, Homo sapien
gcaccttccttagctgagaactttg

SEQ ID NO: 149349 - DNA, 25 bp, Homo sapien
tccttagctgagaactttgcagaac

SEQ ID NO: 149350 - DNA, 25 bp, Homo sapien
ttgcagaacatgtccttcgagctac

SEQ ID NO: 149351 - DNA, 25 bp, Homo sapien
gtccttcgagctacaaaccagatca

SEQ ID NO: 149352 - DNA, 25 bp, Homo sapien
atgctgtataaaaatgaccctgtag

SEQ ID NO: 149353 - DNA, 25 bp, Homo sapien
caatgctgagtctctgaggaggtga

SEQ ID NO: 149354 - DNA, 25 bp, Homo sapien
agctctcctcctctagctcaataaa

SEQ ID NO: 149355 - DNA, 25 bp, Homo sapien
aggtgagctctgacccttgggcctg

SEQ ID NO: 149356 - DNA, 25 bp, Homo sapien
acccgaaatgccacgtggtcactgt

SEQ ID NO: 149357 - DNA, 25 bp, Homo sapien
cgaaatgccacgtggtcactgtgca

SEQ ID NO: 149358 - DNA, 25 bp, Homo sapien
gaaatgccacgtggtcactgtgcac

SEQ ID NO: 149359 - DNA, 25 bp, Homo sapien
aaatgccacgtggtcactgtgcact

SEQ ID NO: 149360 - DNA, 25 bp, Homo sapien
aatgccacgtggtcactgtgcactg

SEQ ID NO: 149361 - DNA, 25 bp, Homo sapien
atgccacgtggtcactgtgcactgc

SEQ ID NO: 149362 - DNA, 25 bp, Homo sapien
tgccacgtggtcactgtgcactgcc

SEQ ID NO: 149363 - DNA, 25 bp, Homo sapien
cactgctgtacccagatgcctacaa

SEQ ID NO: 149364 - DNA, 25 bp, Homo sapien
actgctgtacccagatgcctacaac

SEQ ID NO: 149365 - DNA, 25 bp, Homo sapien
gctgtacccagatgcctacaaccat

SEQ ID NO: 149366 - DNA, 25 bp, Homo sapien
gagctttaatggctgaagacccaga

SEQ ID NO: 149367 - DNA, 25 bp, Homo sapien
aagacccagatcagggcagtgacca

SEQ ID NO: 149368 - DNA, 25 bp, Homo sapien
ggcagtgaccagatcacagggacat

SEQ ID NO: 149369 - DNA, 25 bp, Homo sapien
tgtggctcccagtccaggacaggaa

SEQ ID NO: 149370 - DNA, 25 bp, Homo sapien
attctaggcccttatccctgtttag

SEQ ID NO: 149371 - DNA, 25 bp, Homo sapien
atccctgtttagttctgagagccaa

SEQ ID NO: 149372 - DNA, 25 bp, Homo sapien
gagagccaacttgagataccatatg

SEQ ID NO: 149373 - DNA, 25 bp, Homo sapien
gataccatatgctagcattcccagt

SEQ ID NO: 149374 - DNA, 25 bp, Homo sapien
ttctatggctattgtgtcaggtcac

SEQ ID NO: 149375 - DNA, 25 bp, Homo sapien
caagaccccgttggtgactgaagat

SEQ ID NO: 149376 - DNA, 25 bp, Homo sapien
gactgaagatgacactgagctttaa

SEQ ID NO: 149377 - DNA, 25 bp, Homo sapien
tggattttggccgtcgcagtgccga

SEQ ID NO: 149378 - DNA, 25 bp, Homo sapien
cagtgccgaggagtatgagtacccc

SEQ ID NO: 149379 - DNA, 25 bp, Homo sapien
gtatgagtacccctcctagaggacc

SEQ ID NO: 149380 - DNA, 25 bp, Homo sapien
gaagcaacctcccaacccagaggag

SEQ ID NO: 149381 - DNA, 25 bp, Homo sapien
gacaacaatcacactcataactcat

SEQ ID NO: 149382 - DNA, 25 bp, Homo sapien
cactcataactcattgtctgtggag

SEQ ID NO: 149383 - DNA, 25 bp, Homo sapien
gtctgtggagtttgacattgaatgt

SEQ ID NO: 149384 - DNA, 25 bp, Homo sapien
gtatctatttattaagttctcaatg

SEQ ID NO: 149385 - DNA, 25 bp, Homo sapien
aaaattgtgtctgtaagattgtcca

SEQ ID NO: 149386 - DNA, 25 bp, Homo sapien
aagattgtccagtgcaaccacacac

SEQ ID NO: 149387 - DNA, 25 bp, Homo sapien
accacacacgctcaccagaagttgt

SEQ ID NO: 149388 - DNA, 25 bp, Homo sapien
tgggacaagtacacgatccgctgag

SEQ ID NO: 149389 - DNA, 25 bp, Homo sapien
gggacaagtacacgatccgctgagc

SEQ ID NO: 149390 - DNA, 25 bp, Homo sapien
ggacaagtacacgatccgctgagca

SEQ ID NO: 149391 - DNA, 25 bp, Homo sapien
gacaagtacacgatccgctgagcat

SEQ ID NO: 149392 - DNA, 25 bp, Homo sapien
acaagtacacgatccgctgagcatc

SEQ ID NO: 149393 - DNA, 25 bp, Homo sapien
caagtacacgatccgctgagcatcc

SEQ ID NO: 149394 - DNA, 25 bp, Homo sapien
gtacacgatccgctgagcatccagg

SEQ ID NO: 149395 - DNA, 25 bp, Homo sapien
tacacgatccgctgagcatccagga

SEQ ID NO: 149396 - DNA, 25 bp, Homo sapien
accatgccaggcacgctgggaggag

SEQ ID NO: 149397 - DNA, 25 bp, Homo sapien
caggcacgctgggaggaggacggca

SEQ ID NO: 149398 - DNA, 25 bp, Homo sapien
gcaggcaaggtggtgctgaggagct

SEQ ID NO: 149399 - DNA, 25 bp, Homo sapien
gtttccaaaagatttcgtttcgatg

SEQ ID NO: 149400 - DNA, 25 bp, Homo sapien
cgtttcgatgactcattacccaatc

SEQ ID NO: 149401 - DNA, 25 bp, Homo sapien
ttacccaatccccatgaacttgttt

SEQ ID NO: 149402 - DNA, 25 bp, Homo sapien
acttgtttcagatttgctctgttag

SEQ ID NO: 149403 - DNA, 25 bp, Homo sapien
gctctgttagcacttttttctttga

SEQ ID NO: 149404 - DNA, 25 bp, Homo sapien
ttttctttgactcatttggactgaa

SEQ ID NO: 149405 - DNA, 25 bp, Homo sapien
gaaattttatatccactccagtgag

SEQ ID NO: 149406 - DNA, 25 bp, Homo sapien
cactccagtgagattatgatttgta

SEQ ID NO: 149407 - DNA, 25 bp, Homo sapien
ttgtaaatgcacttttccatggaat

SEQ ID NO: 149408 - DNA, 25 bp, Homo sapien
agttgctagcatgttatgatttcat

SEQ ID NO: 149409 - DNA, 25 bp, Homo sapien
catatcctgagatagctctgcagat

SEQ ID NO: 149410 - DNA, 25 bp, Homo sapien
atcagtttttgtatggaagccaccg

SEQ ID NO: 149411 - DNA, 25 bp, Homo sapien
ggaagccaccgggagatttctggat

SEQ ID NO: 149412 - DNA, 25 bp, Homo sapien
tgcatccgtgaatgcgctgatcgtt

SEQ ID NO: 149413 - DNA, 25 bp, Homo sapien
gatcgtttcttccagttagagtctt

SEQ ID NO: 149414 - DNA, 25 bp, Homo sapien
tagagtcttcatctgtccgacaagt

SEQ ID NO: 149415 - DNA, 25 bp, Homo sapien
gacaagttcactcgcctcggttgcg

SEQ ID NO: 149416 - DNA, 25 bp, Homo sapien
tcggttgcggacctaggaccatttc

SEQ ID NO: 149417 - DNA, 25 bp, Homo sapien
taggaccatttctctgcaggccact

SEQ ID NO: 149418 - DNA, 25 bp, Homo sapien
gagtcaggcttactaatgctgccct

SEQ ID NO: 149419 - DNA, 25 bp, Homo sapien
agtacaggtcatctgctgggatcta

SEQ ID NO: 149420 - DNA, 25 bp, Homo sapien
gctgggatctagttttccaagtaac

SEQ ID NO: 149421 - DNA, 25 bp, Homo sapien
ttctcccaattaatttaccaattca

SEQ ID NO: 149422 - DNA, 25 bp, Homo sapien
gtagaactcccataaacatcacctt

SEQ ID NO: 149423 - DNA, 25 bp, Homo sapien
aaacatcaccttactaatcactggt

SEQ ID NO: 149424 - DNA, 25 bp, Homo sapien
caccttactaatcactggtgatgat

SEQ ID NO: 149425 - DNA, 25 bp, Homo sapien
tgggagaaagaaattcctctttacg

SEQ ID NO: 149426 - DNA, 25 bp, Homo sapien
gaaattcctctttacgtagatactt

SEQ ID NO: 149427 - DNA, 25 bp, Homo sapien
tacgtagatactttttagctttatt

SEQ ID NO: 149428 - DNA, 25 bp, Homo sapien
ttctaaaatcagtttgcgtgcaatg

SEQ ID NO: 149429 - DNA, 25 bp, Homo sapien
atcagtttgcgtgcaatgctagaaa

SEQ ID NO: 149430 - DNA, 25 bp, Homo sapien
ctgtatgtaagattcaattgatttt

SEQ ID NO: 149431 - DNA, 25 bp, Homo sapien
ataccatttgaaatattacctcaac

SEQ ID NO: 149432 - DNA, 25 bp, Homo sapien
gaaagtgttgtatatgacccacatt

SEQ ID NO: 149433 - DNA, 25 bp, Homo sapien
tatgacccacatttacctagtttgt

SEQ ID NO: 149434 - DNA, 25 bp, Homo sapien
agttacagtgagttgtttgcttaaa

SEQ ID NO: 149435 - DNA, 25 bp, Homo sapien
gtttgcttaaattatagattccttt

SEQ ID NO: 149436 - DNA, 25 bp, Homo sapien
gattcctttaaggacatgccttgtt

SEQ ID NO: 149437 - DNA, 25 bp, Homo sapien
tgccttgttcataaaatcactggat

SEQ ID NO: 149438 - DNA, 25 bp, Homo sapien
atcactggattatattgcagcatat

SEQ ID NO: 149439 - DNA, 25 bp, Homo sapien
ttttatagttgctttatgccagagt

SEQ ID NO: 149440 - DNA, 25 bp, Homo sapien
tttatgccagagtggtttaccccat

SEQ ID NO: 149441 - DNA, 25 bp, Homo sapien
cagagtggtttaccccattcacaaa

SEQ ID NO: 149442 - DNA, 25 bp, Homo sapien
atttcttatgcatacattgctattg

SEQ ID NO: 149443 - DNA, 25 bp, Homo sapien
attctcgcctctattgagctgctgg

SEQ ID NO: 149444 - DNA, 25 bp, Homo sapien
tgctggcccgctcattgccaaaaat

SEQ ID NO: 149445 - DNA, 25 bp, Homo sapien
ttgccaaaaattcaccgcagtgcat

SEQ ID NO: 149446 - DNA, 25 bp, Homo sapien
aaaattcaccgcagtgcatcagaac

SEQ ID NO: 149447 - DNA, 25 bp, Homo sapien
agtgcatcagaaccctccttgaatc

SEQ ID NO: 149448 - DNA, 25 bp, Homo sapien
agaaccctccttgaatcgggctggt

SEQ ID NO: 149449 - DNA, 25 bp, Homo sapien
cttgaatcgggctggtttccaaaca

SEQ ID NO: 149450 - DNA, 25 bp, Homo sapien
aatcgggctggtttccaaacagagg

SEQ ID NO: 149451 - DNA, 25 bp, Homo sapien
ttccaaacagaggattttagtctat

SEQ ID NO: 149452 - DNA, 25 bp, Homo sapien
agtctatatgcttgtgcttctccaa

SEQ ID NO: 149453 - DNA, 25 bp, Homo sapien
tgcttgtgcttctccaaaaacaccc

SEQ ID NO: 149454 - DNA, 25 bp, Homo sapien
gggagccactcgcccagagactcag

SEQ ID NO: 149455 - DNA, 25 bp, Homo sapien
tgtgggctgcacagctcaccttgtt

SEQ ID NO: 149456 - DNA, 25 bp, Homo sapien
tgccccggttcgagagccgagtctg

SEQ ID NO: 149457 - DNA, 25 bp, Homo sapien
tgccttcatgcacctgtcctttcta

SEQ ID NO: 149458 - DNA, 25 bp, Homo sapien
atgcacctgtcctttctaacacgtc

SEQ ID NO: 149459 - DNA, 25 bp, Homo sapien
tttctaacacgtcgccttcaactgt

SEQ ID NO: 149460 - DNA, 25 bp, Homo sapien
taacacgtcgccttcaactgtaatc

SEQ ID NO: 149461 - DNA, 25 bp, Homo sapien
acgtcgccttcaactgtaatcacaa

SEQ ID NO: 149462 - DNA, 25 bp, Homo sapien
tgtaatcacaacatcctgactccgt

SEQ ID NO: 149463 - DNA, 25 bp, Homo sapien
cacaacatcctgactccgtcattta

SEQ ID NO: 149464 - DNA, 25 bp, Homo sapien
gactccgtcatttaataaagaagga

SEQ ID NO: 149465 - DNA, 25 bp, Homo sapien
tactgggatttttatcgagaagtaa

SEQ ID NO: 149466 - DNA, 25 bp, Homo sapien
aagctgttcattctggcaatgattt

SEQ ID NO: 149467 - DNA, 25 bp, Homo sapien
atttggcaacagtgcgggtggtcct

SEQ ID NO: 149468 - DNA, 25 bp, Homo sapien
aacagtgcgggtggtcctcgagctc

SEQ ID NO: 149469 - DNA, 25 bp, Homo sapien
tggtcctcgagctctatttttactg

SEQ ID NO: 149470 - DNA, 25 bp, Homo sapien
tcgagctctatttttactgtctggt

SEQ ID NO: 149471 - DNA, 25 bp, Homo sapien
gaaacatacgtttctaagcaatacg

SEQ ID NO: 149472 - DNA, 25 bp, Homo sapien
taagcaatacgaggccaccttcagt

SEQ ID NO: 149473 - DNA, 25 bp, Homo sapien
ggccaccttcagtcgcaagctgggt

SEQ ID NO: 149474 - DNA, 25 bp, Homo sapien
ggaaacactgctgacctttgcaaag

SEQ ID NO: 149475 - DNA, 25 bp, Homo sapien
gctgacctttgcaaaggctgccgag

SEQ ID NO: 149476 - DNA, 25 bp, Homo sapien
gaatgagaggacttctatgaatgag

SEQ ID NO: 149477 - DNA, 25 bp, Homo sapien
aatgagagggagaccggcatgcttt

SEQ ID NO: 149478 - DNA, 25 bp, Homo sapien
agggagaccggcatgctttgatcct

SEQ ID NO: 149479 - DNA, 25 bp, Homo sapien
atgctttgatcctcactgtggaacc

SEQ ID NO: 149480 - DNA, 25 bp, Homo sapien
tgtggaacccctcaatggactctct

SEQ ID NO: 149481 - DNA, 25 bp, Homo sapien
gggacacccaaggatatgtcttctg

SEQ ID NO: 149482 - DNA, 25 bp, Homo sapien
aggcaagaacctctttagcatccac

SEQ ID NO: 149483 - DNA, 25 bp, Homo sapien
tagcatccaccaattttcactgcat

SEQ ID NO: 149484 - DNA, 25 bp, Homo sapien
tttcactgcattttgcatgggatga

SEQ ID NO: 149485 - DNA, 25 bp, Homo sapien
gaacagtgttttatgctgggaatct

SEQ ID NO: 149486 - DNA, 25 bp, Homo sapien
ttatgctgggaatctagggcctgga

SEQ ID NO: 149487 - DNA, 25 bp, Homo sapien
tgtcggtgacactggagcagtgcct

SEQ ID NO: 149488 - DNA, 25 bp, Homo sapien
tggagcagtgcctgatcctgcaaca

SEQ ID NO: 149489 - DNA, 25 bp, Homo sapien
tgatcctgcaacacgagcatggcat

SEQ ID NO: 149490 - DNA, 25 bp, Homo sapien
acgagcatggcatggccccgcaggt

SEQ ID NO: 149491 - DNA, 25 bp, Homo sapien
cccaggccctggagtgcatgcgcag

SEQ ID NO: 149492 - DNA, 25 bp, Homo sapien
gtcgcaaatatgcatttaattccct

SEQ ID NO: 149493 - DNA, 25 bp, Homo sapien
tgcagctgaaggctttccccaagca

SEQ ID NO: 149494 - DNA, 25 bp, Homo sapien
gaaggctttccccaagcattacagg

SEQ ID NO: 149495 - DNA, 25 bp, Homo sapien
gtgaacacacggtttcctctaatta

SEQ ID NO: 149496 - DNA, 25 bp, Homo sapien
ggtttcctctaattagctgttacat

SEQ ID NO: 149497 - DNA, 25 bp, Homo sapien
tgtgggtacctctagtgtcatatat

SEQ ID NO: 149498 - DNA, 25 bp, Homo sapien
tcttgtagcagtggttacccagact

SEQ ID NO: 149499 - DNA, 25 bp, Homo sapien
tagcagtggttacccagacttacag

SEQ ID NO: 149500 - DNA, 25 bp, Homo sapien
cagacttacagaattatgtcctcca

SEQ ID NO: 149501 - DNA, 25 bp, Homo sapien
tatgtcctccagaaaccagcaagaa

SEQ ID NO: 149502 - DNA, 25 bp, Homo sapien
agaacacttggaatgaacgaatgaa

SEQ ID NO: 149503 - DNA, 25 bp, Homo sapien
gcaagagtgattttctgttacattc

SEQ ID NO: 149504 - DNA, 25 bp, Homo sapien
caaactctctaattgtgggttttct

SEQ ID NO: 149505 - DNA, 25 bp, Homo sapien
ttttcacatactttccaaaagacca

SEQ ID NO: 149506 - DNA, 25 bp, Homo sapien
ggatgttgacaacaacccaatgaaa

SEQ ID NO: 149507 - DNA, 25 bp, Homo sapien
gaaataacattttgcatatctgaaa

SEQ ID NO: 149508 - DNA, 25 bp, Homo sapien
gaagcattgaatataagccaaaagc

SEQ ID NO: 149509 - DNA, 25 bp, Homo sapien
agcctctagcttcaggctgggcacg

SEQ ID NO: 149510 - DNA, 25 bp, Homo sapien
gcctctagcttcaggctgggcacgg

SEQ ID NO: 149511 - DNA, 25 bp, Homo sapien
cctctagcttcaggctgggcacggt

SEQ ID NO: 149512 - DNA, 25 bp, Homo sapien
caatatagggagactccggctctac

SEQ ID NO: 149513 - DNA, 25 bp, Homo sapien
tatagggagactccggctctacaaa

SEQ ID NO: 149514 - DNA, 25 bp, Homo sapien
gactccggctctacaaaaaagagtt

SEQ ID NO: 149515 - DNA, 25 bp, Homo sapien
aggcgaagtggcacacatctgtggt

SEQ ID NO: 149516 - DNA, 25 bp, Homo sapien
gcgaagtggcacacatctgtggtcc

SEQ ID NO: 149517 - DNA, 25 bp, Homo sapien
cgaagtggcacacatctgtggtccc

SEQ ID NO: 149518 - DNA, 25 bp, Homo sapien
acacatctgtggtcccaggtgctca

SEQ ID NO: 149519 - DNA, 25 bp, Homo sapien
atcacttgagcccaattcaaagctg

SEQ ID NO: 149520 - DNA, 25 bp, Homo sapien
gagaaagaaagtacccagcaaatgg

SEQ ID NO: 149521 - DNA, 25 bp, Homo sapien
cagcaaatgggcattttacaagaag

SEQ ID NO: 149522 - DNA, 25 bp, Homo sapien
gaagtacgaatcttatttttcctgt

SEQ ID NO: 149523 - DNA, 25 bp, Homo sapien
acgaatcttatttttcctgtcctgc

SEQ ID NO: 149524 - DNA, 25 bp, Homo sapien
tcttatttttcctgtcctgcccgtg

SEQ ID NO: 149525 - DNA, 25 bp, Homo sapien
tcggtcgccccgtgtttgcgcttga

SEQ ID NO: 149526 - DNA, 25 bp, Homo sapien
gtgtttgcgcttgaccatgttgcac

SEQ ID NO: 149527 - DNA, 25 bp, Homo sapien
gcttgaccatgttgcactgtttgca

SEQ ID NO: 149528 - DNA, 25 bp, Homo sapien
atgttgcactgtttgcatgcgcccg

SEQ ID NO: 149529 - DNA, 25 bp, Homo sapien
cactgtttgcatgcgcccgaggcag

SEQ ID NO: 149530 - DNA, 25 bp, Homo sapien
ggcttggatttcgtgtgccgctgcc

SEQ ID NO: 149531 - DNA, 25 bp, Homo sapien
actatgtgttctggtgtgtcttaaa

SEQ ID NO: 149532 - DNA, 25 bp, Homo sapien
ctggtgtgtcttaaaattccaaaca

SEQ ID NO: 149533 - DNA, 25 bp, Homo sapien
aaaatgatccctgcatttcctgaag

SEQ ID NO: 149534 - DNA, 25 bp, Homo sapien
tgatccctgcatttcctgaagatgt

SEQ ID NO: 149535 - DNA, 25 bp, Homo sapien
gatgtttaaacgtgagagtctggta

SEQ ID NO: 149536 - DNA, 25 bp, Homo sapien
gagagtctggtaggcaaagcagtct

SEQ ID NO: 149537 - DNA, 25 bp, Homo sapien
ggttgcatataatctttgctctttt

SEQ ID NO: 149538 - DNA, 25 bp, Homo sapien
aagctctgtgagctctgaaatatat

SEQ ID NO: 149539 - DNA, 25 bp, Homo sapien
atatttttgggttacttcagtgtgt

SEQ ID NO: 149540 - DNA, 25 bp, Homo sapien
ttcagtgtgtttgacaagacagctt

SEQ ID NO: 149541 - DNA, 25 bp, Homo sapien
aatgactttcatattgcaacaatct

SEQ ID NO: 149542 - DNA, 25 bp, Homo sapien
tgcgcagtgagggttgtcgaagaga

SEQ ID NO: 149543 - DNA, 25 bp, Homo sapien
gaatgttggaagtcgcaaatatgca

SEQ ID NO: 149544 - DNA, 25 bp, Homo sapien
ttggaagtcgcaaatatgcatttaa

SEQ ID NO: 149545 - DNA, 25 bp, Homo sapien
tgcagctgaaggctttccccaagca

SEQ ID NO: 149546 - DNA, 25 bp, Homo sapien
gaaggctttccccaagcattacagg

SEQ ID NO: 149547 - DNA, 25 bp, Homo sapien
aggctttccccaagcattacaggcc

SEQ ID NO: 149548 - DNA, 25 bp, Homo sapien
gaaacgtgaacacacggtttcctct

SEQ ID NO: 149549 - DNA, 25 bp, Homo sapien
gtgaacacacggtttcctctaatta

SEQ ID NO: 149550 - DNA, 25 bp, Homo sapien
cacacggtttcctctaattagctgt

SEQ ID NO: 149551 - DNA, 25 bp, Homo sapien
ggtttcctctaattagctgttacat

SEQ ID NO: 149552 - DNA, 25 bp, Homo sapien
cctctagtgtcatatatgaattctt

SEQ ID NO: 149553 - DNA, 25 bp, Homo sapien
aaggttcgacttacattcttcacac

SEQ ID NO: 149554 - DNA, 25 bp, Homo sapien
acattcttcacactgtcaaaaaatg

SEQ ID NO: 149555 - DNA, 25 bp, Homo sapien
aaactacagctgacatctggagttc

SEQ ID NO: 149556 - DNA, 25 bp, Homo sapien
gacatctggagttcatagcaccata

SEQ ID NO: 149557 - DNA, 25 bp, Homo sapien
gcaccataaaggttattaaggccaa

SEQ ID NO: 149558 - DNA, 25 bp, Homo sapien
aaaaaggaccaattcaagccaactg

SEQ ID NO: 149559 - DNA, 25 bp, Homo sapien
tcaagccaactggtctaagcagcat

SEQ ID NO: 149560 - DNA, 25 bp, Homo sapien
gaatatgtgatacagcctcttcaat

SEQ ID NO: 149561 - DNA, 25 bp, Homo sapien
gtgatacagcctcttcaatcagatt

SEQ ID NO: 149562 - DNA, 25 bp, Homo sapien
tgaaagctgcagttcacaggctcct

SEQ ID NO: 149563 - DNA, 25 bp, Homo sapien
ctcctctctccaccaaattaggata

SEQ ID NO: 149564 - DNA, 25 bp, Homo sapien
ccaggacatcttggccaggggctgc

SEQ ID NO: 149565 - DNA, 25 bp, Homo sapien
aggggctgccccacggaaccagtga

SEQ ID NO: 149566 - DNA, 25 bp, Homo sapien
gtgaccctgacgctattctcagaga

SEQ ID NO: 149567 - DNA, 25 bp, Homo sapien
tgaccctgacgctattctcagagac

SEQ ID NO: 149568 - DNA, 25 bp, Homo sapien
accctgacgctattctcagagacca

SEQ ID NO: 149569 - DNA, 25 bp, Homo sapien
ttctcagagaccaccttgcaccagg

SEQ ID NO: 149570 - DNA, 25 bp, Homo sapien
gagaccaccttgcaccaggcacaaa

SEQ ID NO: 149571 - DNA, 25 bp, Homo sapien
ttgcaccaggcacaaaacctcttta

SEQ ID NO: 149572 - DNA, 25 bp, Homo sapien
tgcaccaggcacaaaacctctttaa

SEQ ID NO: 149573 - DNA, 25 bp, Homo sapien
aaccttcagtccctcttcgtgacat

SEQ ID NO: 149574 - DNA, 25 bp, Homo sapien
tcagtccctcttcgtgacatcgcgg

SEQ ID NO: 149575 - DNA, 25 bp, Homo sapien
tttaaaaacctgcacaaacactgga

SEQ ID NO: 149576 - DNA, 25 bp, Homo sapien
cactggacagtctaaataggcttct

SEQ ID NO: 149577 - DNA, 25 bp, Homo sapien
gtctaaataggcttctgcattcagt

SEQ ID NO: 149578 - DNA, 25 bp, Homo sapien
tctgcattcagtcctgctgtttaca

SEQ ID NO: 149579 - DNA, 25 bp, Homo sapien
caatgtgaaatggagctgatatcat

SEQ ID NO: 149580 - DNA, 25 bp, Homo sapien
ggagctgatatcatattaatttcat

SEQ ID NO: 149581 - DNA, 25 bp, Homo sapien
gtaatcatttgggatattatctgta

SEQ ID NO: 149582 - DNA, 25 bp, Homo sapien
gaaaaacctgtctttgtgaattgga

SEQ ID NO: 149583 - DNA, 25 bp, Homo sapien
ttaagttaaaccattttagtcactg

SEQ ID NO: 149584 - DNA, 25 bp, Homo sapien
tttagtcactggaaggaactgcctc

SEQ ID NO: 149585 - DNA, 25 bp, Homo sapien
cactggaaggaactgcctccatttt

SEQ ID NO: 149586 - DNA, 25 bp, Homo sapien
cattacaagtgggaccggtggagca

SEQ ID NO: 149587 - DNA, 25 bp, Homo sapien
gtctgtcctggcctaatgccaggct

SEQ ID NO: 149588 - DNA, 25 bp, Homo sapien
tggcctaatgccaggctctgagttc

SEQ ID NO: 149589 - DNA, 25 bp, Homo sapien
taatgccaggctctgagttctgtga

SEQ ID NO: 149590 - DNA, 25 bp, Homo sapien
ctgagttctgtgaccaaagccaggt

SEQ ID NO: 149591 - DNA, 25 bp, Homo sapien
tgaccaaagccaggtgggttccctt

SEQ ID NO: 149592 - DNA, 25 bp, Homo sapien
agtccctactctgctttgggatagt

SEQ ID NO: 149593 - DNA, 25 bp, Homo sapien
gggatagtgtgagcttcattttgta

SEQ ID NO: 149594 - DNA, 25 bp, Homo sapien
gcttcattttgtacacgtgttgctt

SEQ ID NO: 149595 - DNA, 25 bp, Homo sapien
cattttgtacacgtgttgcttcgtc

SEQ ID NO: 149596 - DNA, 25 bp, Homo sapien
ttttgtacacgtgttgcttcgtcca

SEQ ID NO: 149597 - DNA, 25 bp, Homo sapien
tggagaccacctgactgaggctagt

SEQ ID NO: 149598 - DNA, 25 bp, Homo sapien
aggctagtgggaagcttcacctgct

SEQ ID NO: 149599 - DNA, 25 bp, Homo sapien
ttcacctgctggataagctactagc

SEQ ID NO: 149600 - DNA, 25 bp, Homo sapien
gctactagcattcctgtattctggg

SEQ ID NO: 149601 - DNA, 25 bp, Homo sapien
ttacttttctcccaaatgacccaga

SEQ ID NO: 149602 - DNA, 25 bp, Homo sapien
ttttctcccaaatgacccagatgtt

SEQ ID NO: 149603 - DNA, 25 bp, Homo sapien
tacagaacattttgtcccagcttcg

SEQ ID NO: 149604 - DNA, 25 bp, Homo sapien
ttttgtcccagcttcgaaagtgtgt

SEQ ID NO: 149605 - DNA, 25 bp, Homo sapien
cgaaagtgtgtggatcacccatatt

SEQ ID NO: 149606 - DNA, 25 bp, Homo sapien
tgtggagccggagccttttgaagtt

SEQ ID NO: 149607 - DNA, 25 bp, Homo sapien
ggagccttttgaagttggagaccac

SEQ ID NO: 149608 - DNA, 25 bp, Homo sapien
tacccaaggtctagctaggcccaag

SEQ ID NO: 149609 - DNA, 25 bp, Homo sapien
aagacctagttacccagacagtgag

SEQ ID NO: 149610 - DNA, 25 bp, Homo sapien
catgtatcacatgtcttcagaagca

SEQ ID NO: 149611 - DNA, 25 bp, Homo sapien
ggtttcatgtaaccgagtgtcctct

SEQ ID NO: 149612 - DNA, 25 bp, Homo sapien
gagtgtcctcttgcgtgtccaaaag

SEQ ID NO: 149613 - DNA, 25 bp, Homo sapien
cgtgtccaaaagtagcccagggctg

SEQ ID NO: 149614 - DNA, 25 bp, Homo sapien
tgtagcacaggcttcacagtgattt

SEQ ID NO: 149615 - DNA, 25 bp, Homo sapien
acagtgattttgtgttcagccgtga

SEQ ID NO: 149616 - DNA, 25 bp, Homo sapien
gttcagccgtgagtcacactacatg

SEQ ID NO: 149617 - DNA, 25 bp, Homo sapien
tgaagctgggcattggtgacgtcca

SEQ ID NO: 149618 - DNA, 25 bp, Homo sapien
gacgtccaggttgtccttgagtaat

SEQ ID NO: 149619 - DNA, 25 bp, Homo sapien
tcgggtcctcaataagcttggagga

SEQ ID NO: 149620 - DNA, 25 bp, Homo sapien
ctgcccaacaagaaggtctgcattg

SEQ ID NO: 149621 - DNA, 25 bp, Homo sapien
gtctgcattgaatctgagcacagca

SEQ ID NO: 149622 - DNA, 25 bp, Homo sapien
actctgcttgcaaccctgaagaaaa

SEQ ID NO: 149623 - DNA, 25 bp, Homo sapien
agactgtttcctaccttggccttga

SEQ ID NO: 149624 - DNA, 25 bp, Homo sapien
cctaccttggccttgagtagcaggg

SEQ ID NO: 149625 - DNA, 25 bp, Homo sapien
cacagcccacaggatggaccaaagg

SEQ ID NO: 149626 - DNA, 25 bp, Homo sapien
gggcaggatgctgatcctcccgctg

SEQ ID NO: 149627 - DNA, 25 bp, Homo sapien
acttggcagtcatgccgggtgatcg

SEQ ID NO: 149628 - DNA, 25 bp, Homo sapien
catgccgggtgatcgtgttcctgcg

SEQ ID NO: 149629 - DNA, 25 bp, Homo sapien
tgcggagaccctcagttgtcctatt

SEQ ID NO: 149630 - DNA, 25 bp, Homo sapien
agaaatctagaggatctctcctttt

SEQ ID NO: 149631 - DNA, 25 bp, Homo sapien
atctagaggatctctcctttttata

SEQ ID NO: 149632 - DNA, 25 bp, Homo sapien
gaaatatgaagcactttctcttaac

SEQ ID NO: 149633 - DNA, 25 bp, Homo sapien
gaagcactttctcttaacttaattt

SEQ ID NO: 149634 - DNA, 25 bp, Homo sapien
ttttcctgctgtatccagaagaaat

SEQ ID NO: 149635 - DNA, 25 bp, Homo sapien
gtatccagaagaaataattgtgtca

SEQ ID NO: 149636 - DNA, 25 bp, Homo sapien
aggatatattcggatggcaagaaat

SEQ ID NO: 149637 - DNA, 25 bp, Homo sapien
atcattgtgggattgctagctttcc

SEQ ID NO: 149638 - DNA, 25 bp, Homo sapien
attgtgggattgctagctttccctc

SEQ ID NO: 149639 - DNA, 25 bp, Homo sapien
tgggattgctagctttccctcttac

SEQ ID NO: 149640 - DNA, 25 bp, Homo sapien
ctttccctcttacccagaaatctag

SEQ ID NO: 149641 - DNA, 25 bp, Homo sapien
gccaaggactccatcctgcgcaggg

SEQ ID NO: 149642 - DNA, 25 bp, Homo sapien
aggactccatcctgcgcagggccag

SEQ ID NO: 149643 - DNA, 25 bp, Homo sapien
gggcatgttcactgccgaagacctg

SEQ ID NO: 149644 - DNA, 25 bp, Homo sapien
atcagccttctttactttttgagcc

SEQ ID NO: 149645 - DNA, 25 bp, Homo sapien
gagcctctgatttccaattccctgc

SEQ ID NO: 149646 - DNA, 25 bp, Homo sapien
tgctccttcccactccattaagagg

SEQ ID NO: 149647 - DNA, 25 bp, Homo sapien
ttcccactccattaagaggctaggt

SEQ ID NO: 149648 - DNA, 25 bp, Homo sapien
ggaacaggaagcctgaccatctccc

SEQ ID NO: 149649 - DNA, 25 bp, Homo sapien
acctcttccctgtgctgttacacag

SEQ ID NO: 149650 - DNA, 25 bp, Homo sapien
ttccctgtgctgttacacagtgtca

SEQ ID NO: 149651 - DNA, 25 bp, Homo sapien
gctgttacacagtgtcattgttgat

SEQ ID NO: 149652 - DNA, 25 bp, Homo sapien
caggtccctgtgtagagcagtgaaa

SEQ ID NO: 149653 - DNA, 25 bp, Homo sapien
gtccctgtgtagagcagtgaaaata

SEQ ID NO: 149654 - DNA, 25 bp, Homo sapien
gtgaaaataagatgtgcgtatgtgt

SEQ ID NO: 149655 - DNA, 25 bp, Homo sapien
tggtgtttcacttcagtgagaggat

SEQ ID NO: 149656 - DNA, 25 bp, Homo sapien
gaggattggctgtgagcttcagacc

SEQ ID NO: 149657 - DNA, 25 bp, Homo sapien
ggattggctgtgagcttcagaccag

SEQ ID NO: 149658 - DNA, 25 bp, Homo sapien
tgtgctggagtgaggatcttgaaca

SEQ ID NO: 149659 - DNA, 25 bp, Homo sapien
ggatcttgaacagaaacttcctttt

SEQ ID NO: 149660 - DNA, 25 bp, Homo sapien
ttctgttattattcactacgaagct

SEQ ID NO: 149661 - DNA, 25 bp, Homo sapien
attcactacgaagctaaaatggcca

SEQ ID NO: 149662 - DNA, 25 bp, Homo sapien
taacaaaagatcagatccctccttc

SEQ ID NO: 149663 - DNA, 25 bp, Homo sapien
gctgagaacggcatgtacatccgca

SEQ ID NO: 149664 - DNA, 25 bp, Homo sapien
atgtacatccgcatggctctgttag

SEQ ID NO: 149665 - DNA, 25 bp, Homo sapien
atggctctgttagccaccgtgctgg

SEQ ID NO: 149666 - DNA, 25 bp, Homo sapien
cagctgctgggcaaggaattccagt

SEQ ID NO: 149667 - DNA, 25 bp, Homo sapien
aaggaattccagtgcctcctacggg

SEQ ID NO: 149668 - DNA, 25 bp, Homo sapien
gggcagcacacttagatattcctgg

SEQ ID NO: 149669 - DNA, 25 bp, Homo sapien
gatattcctggacatccagattgct

SEQ ID NO: 149670 - DNA, 25 bp, Homo sapien
atccagattgctcacatgtgctgac

SEQ ID NO: 149671 - DNA, 25 bp, Homo sapien
catgtgctgaccacacttcaggctc

SEQ ID NO: 149672 - DNA, 25 bp, Homo sapien
ttcattcctgcaccttaaacctgta

SEQ ID NO: 149673 - DNA, 25 bp, Homo sapien
gcaccttaaacctgtacagtcattt

SEQ ID NO: 149674 - DNA, 25 bp, Homo sapien
ataggactctagacggcatccagcc

SEQ ID NO: 149675 - DNA, 25 bp, Homo sapien
gcatccagccggaggccagagctga

SEQ ID NO: 149676 - DNA, 25 bp, Homo sapien
agctgagcactcagcccgggaggca

SEQ ID NO: 149677 - DNA, 25 bp, Homo sapien
agcaggtgcggagccgtcactgcac

SEQ ID NO: 149678 - DNA, 25 bp, Homo sapien
gtcactgcaccaagtctcactggct

SEQ ID NO: 149679 - DNA, 25 bp, Homo sapien
aagtctcactggctgtcagtatgac

SEQ ID NO: 149680 - DNA, 25 bp, Homo sapien
gtcagtatgacatttcacgggagat

SEQ ID NO: 149681 - DNA, 25 bp, Homo sapien
cacgggagatttcttgttgctcaaa

SEQ ID NO: 149682 - DNA, 25 bp, Homo sapien
aaatgagctcgcatttgtcaatgac

SEQ ID NO: 149683 - DNA, 25 bp, Homo sapien
ttcttactagacctgtaacttttgt

SEQ ID NO: 149684 - DNA, 25 bp, Homo sapien
cacacagcatgtaatggtatcttaa

SEQ ID NO: 149685 - DNA, 25 bp, Homo sapien
gcagaaataattaggctagggctct

SEQ ID NO: 149686 - DNA, 25 bp, Homo sapien
aggctagggctcttagttttcattc

SEQ ID NO: 149687 - DNA, 25 bp, Homo sapien
tagggctcttagttttcattcctat

SEQ ID NO: 149688 - DNA, 25 bp, Homo sapien
ttcctattgccccaagtattgtcaa

SEQ ID NO: 149689 - DNA, 25 bp, Homo sapien
gccccaagtattgtcaaactatggt

SEQ ID NO: 149690 - DNA, 25 bp, Homo sapien
atccataatctgctagttttgcatg

SEQ ID NO: 149691 - DNA, 25 bp, Homo sapien
gcagtaagttgaaaactcagtatct

SEQ ID NO: 149692 - DNA, 25 bp, Homo sapien
aactcagtatctatggaattgataa

SEQ ID NO: 149693 - DNA, 25 bp, Homo sapien
gataaatgttgatctggtgtagtat

SEQ ID NO: 149694 - DNA, 25 bp, Homo sapien
ggtgtagtatattttatccgcattt

SEQ ID NO: 149695 - DNA, 25 bp, Homo sapien
attttatccgcattttcttatatta

SEQ ID NO: 149696 - DNA, 25 bp, Homo sapien
ggaagccgcctggaatgtcttcacg

SEQ ID NO: 149697 - DNA, 25 bp, Homo sapien
ggaatgtcttcacggcagcgttttg

SEQ ID NO: 149698 - DNA, 25 bp, Homo sapien
agcgttttgctcacacagcagcttt

SEQ ID NO: 149699 - DNA, 25 bp, Homo sapien
cccgactgctgaaatccaacttgag

SEQ ID NO: 149700 - DNA, 25 bp, Homo sapien
atccaacttgagctggctggtggtc

SEQ ID NO: 149701 - DNA, 25 bp, Homo sapien
tggtggtccctggatcctagagccc

SEQ ID NO: 149702 - DNA, 25 bp, Homo sapien
tagagcccttcacttcgggttactc

SEQ ID NO: 149703 - DNA, 25 bp, Homo sapien
ttcttgcctctatttcttagttgga

SEQ ID NO: 149704 - DNA, 25 bp, Homo sapien
agtaaagcctcaggaatgcccacgc

SEQ ID NO: 149705 - DNA, 25 bp, Homo sapien
aagcctttgtctctgagacctctta

SEQ ID NO: 149706 - DNA, 25 bp, Homo sapien
gtctctgagacctcttaagttctaa

SEQ ID NO: 149707 - DNA, 25 bp, Homo sapien
gggacttctgagatcagcgtcctac

SEQ ID NO: 149708 - DNA, 25 bp, Homo sapien
tgagatcagcgtcctaccaagaccc

SEQ ID NO: 149709 - DNA, 25 bp, Homo sapien
aagcctgctgaccacagtcacatca

SEQ ID NO: 149710 - DNA, 25 bp, Homo sapien
agtcacatcacccatcagcacatgg

SEQ ID NO: 149711 - DNA, 25 bp, Homo sapien
atcagcacatggaaggcccctggta

SEQ ID NO: 149712 - DNA, 25 bp, Homo sapien
aggcccctggtatggacactgaaag

SEQ ID NO: 149713 - DNA, 25 bp, Homo sapien
tgcaaacatgactgggacctaagag

SEQ ID NO: 149714 - DNA, 25 bp, Homo sapien
ctgggacctaagagccagaggctgt

SEQ ID NO: 149715 - DNA, 25 bp, Homo sapien
gaggctgtgtagaggctcctgctcc

SEQ ID NO: 149716 - DNA, 25 bp, Homo sapien
tccacctgccagtctcgtaagagat

SEQ ID NO: 149717 - DNA, 25 bp, Homo sapien
gagggagccaaggtcactccaataa

SEQ ID NO: 149718 - DNA, 25 bp, Homo sapien
ccagaccagttgtcaaaggatgaac

SEQ ID NO: 149719 - DNA, 25 bp, Homo sapien
gaagctattgattcaggctgaattc

SEQ ID NO: 149720 - DNA, 25 bp, Homo sapien
gctgaattccccagtttactcaaag

SEQ ID NO: 149721 - DNA, 25 bp, Homo sapien
ttactcaaaggtccaaacaccctag

SEQ ID NO: 149722 - DNA, 25 bp, Homo sapien
acaccctagatgatctctttcaaga

SEQ ID NO: 149723 - DNA, 25 bp, Homo sapien
gatgatctctttcaagaactggaca

SEQ ID NO: 149724 - DNA, 25 bp, Homo sapien
aatagaaccctgagcactggaggaa

SEQ ID NO: 149725 - DNA, 25 bp, Homo sapien
gaagagcgcctgtgctgtggtctta

SEQ ID NO: 149726 - DNA, 25 bp, Homo sapien
gtgctgtggtcttatcctatgtgga

SEQ ID NO: 149727 - DNA, 25 bp, Homo sapien
tggtcttatcctatgtggaatcccc

SEQ ID NO: 149728 - DNA, 25 bp, Homo sapien
aagtctctggtttaattctttgcaa

SEQ ID NO: 149729 - DNA, 25 bp, Homo sapien
gggctccatcttcattacggaactc

SEQ ID NO: 149730 - DNA, 25 bp, Homo sapien
ccatcttcattacggaactcatcac

SEQ ID NO: 149731 - DNA, 25 bp, Homo sapien
attcttgctgctgccacctaatgga

SEQ ID NO: 149732 - DNA, 25 bp, Homo sapien
gctgctgccacctaatggaaatatt

SEQ ID NO: 149733 - DNA, 25 bp, Homo sapien
ggtacagaaatcatttgaagttcca

SEQ ID NO: 149734 - DNA, 25 bp, Homo sapien
ttgaagttccacaggctaaagccca

SEQ ID NO: 149735 - DNA, 25 bp, Homo sapien
accatagaacgagcaaccttgacaa

SEQ ID NO: 149736 - DNA, 25 bp, Homo sapien
aaccttgacaagagatttctacctc

SEQ ID NO: 149737 - DNA, 25 bp, Homo sapien
tcctctgtcaacatcaaagagcaca

SEQ ID NO: 149738 - DNA, 25 bp, Homo sapien
gagcacatttaccagtatagcttgc

SEQ ID NO: 149739 - DNA, 25 bp, Homo sapien
accagtatagcttgcatagtcaata

SEQ ID NO: 149740 - DNA, 25 bp, Homo sapien
ttctgggcccgaccagcttatactg

SEQ ID NO: 149741 - DNA, 25 bp, Homo sapien
ctgggcccgaccagcttatactgct

SEQ ID NO: 149742 - DNA, 25 bp, Homo sapien
cgaccagcttatactgctccatctt

SEQ ID NO: 149743 - DNA, 25 bp, Homo sapien
gaccagcttatactgctccatcttc

SEQ ID NO: 149744 - DNA, 25 bp, Homo sapien
gggccctgctccgtgagataatgtg

SEQ ID NO: 149745 - DNA, 25 bp, Homo sapien
ggccctgctccgtgagataatgtga

SEQ ID NO: 149746 - DNA, 25 bp, Homo sapien
gccctgctccgtgagataatgtgaa

SEQ ID NO: 149747 - DNA, 25 bp, Homo sapien
ccctgctccgtgagataatgtgaaa

SEQ ID NO: 149748 - DNA, 25 bp, Homo sapien
ctgctccgtgagataatgtgaaata

SEQ ID NO: 149749 - DNA, 25 bp, Homo sapien
tgctccgtgagataatgtgaaatac

SEQ ID NO: 149750 - DNA, 25 bp, Homo sapien
agataatgtgaaatacgactgtgga

SEQ ID NO: 149751 - DNA, 25 bp, Homo sapien
gacatactgcttgattttaatacat

SEQ ID NO: 149752 - DNA, 25 bp, Homo sapien
aatacattgatcaggccatccagga

SEQ ID NO: 149753 - DNA, 25 bp, Homo sapien
aggccatccaggacaccacgattct

SEQ ID NO: 149754 - DNA, 25 bp, Homo sapien
tgcagcctggcaagcagaagaagtt

SEQ ID NO: 149755 - DNA, 25 bp, Homo sapien
gagacagcagaaactagcagacaga

SEQ ID NO: 149756 - DNA, 25 bp, Homo sapien
gaaaagagagcagccgaacaacaaa

SEQ ID NO: 149757 - DNA, 25 bp, Homo sapien
aaggaagcacaacggctaatgaaga

SEQ ID NO: 149758 - DNA, 25 bp, Homo sapien
gtgaaactttcataacacatgttca

SEQ ID NO: 149759 - DNA, 25 bp, Homo sapien
gttcaaattttatcatgccagtagg

SEQ ID NO: 149760 - DNA, 25 bp, Homo sapien
ttatcatgccagtaggagaaatctc

SEQ ID NO: 149761 - DNA, 25 bp, Homo sapien
gctccacaacccaagcaacatttgt

SEQ ID NO: 149762 - DNA, 25 bp, Homo sapien
gaaaaatacacacgaatgtcctcag

SEQ ID NO: 149763 - DNA, 25 bp, Homo sapien
tacacacgaatgtcctcagtatcca

SEQ ID NO: 149764 - DNA, 25 bp, Homo sapien
gaagcaagtcaacttacctattaaa

SEQ ID NO: 149765 - DNA, 25 bp, Homo sapien
tacctattaaatattcctctattag

SEQ ID NO: 149766 - DNA, 25 bp, Homo sapien
ttcctctattagatgtttcaacact

SEQ ID NO: 149767 - DNA, 25 bp, Homo sapien
gatgtttcaacactataatttaatt

SEQ ID NO: 149768 - DNA, 25 bp, Homo sapien
ttattatgccatatttcccttcatt

SEQ ID NO: 149769 - DNA, 25 bp, Homo sapien
gccatatttcccttcattatagtaa

SEQ ID NO: 149770 - DNA, 25 bp, Homo sapien
atatgctcacgaatcaatgctgatt

SEQ ID NO: 149771 - DNA, 25 bp, Homo sapien
ataatctgaagtggaaattgtttgc

SEQ ID NO: 149772 - DNA, 25 bp, Homo sapien
agcagtttgtgctatacttttcccc

SEQ ID NO: 149773 - DNA, 25 bp, Homo sapien
tttgaggactttgcccggcttcggc

SEQ ID NO: 149774 - DNA, 25 bp, Homo sapien
actttgcccggcttcggctgaaggg

SEQ ID NO: 149775 - DNA, 25 bp, Homo sapien
aaggatgacgactatgatgatcaac

SEQ ID NO: 149776 - DNA, 25 bp, Homo sapien
atgatgatcaactctgctaggaagc

SEQ ID NO: 149777 - DNA, 25 bp, Homo sapien
atgatcaactctgctaggaagcggg

SEQ ID NO: 149778 - DNA, 25 bp, Homo sapien
agggcaggattaagatccccactgt

SEQ ID NO: 149779 - DNA, 25 bp, Homo sapien
gcaggattaagatccccactgtcaa

SEQ ID NO: 149780 - DNA, 25 bp, Homo sapien
gattaagatccccactgtcaatggg

SEQ ID NO: 149781 - DNA, 25 bp, Homo sapien
tcacctggaagcttcttcaaccaat

SEQ ID NO: 149782 - DNA, 25 bp, Homo sapien
tggaagcttcttcaaccaatccctt

SEQ ID NO: 149783 - DNA, 25 bp, Homo sapien
gaagcttcttcaaccaatcccttca

SEQ ID NO: 149784 - DNA, 25 bp, Homo sapien
ttgcctctgaaacttaattacatcc

SEQ ID NO: 149785 - DNA, 25 bp, Homo sapien
gaaggacacttgtatgctagtctat

SEQ ID NO: 149786 - DNA, 25 bp, Homo sapien
acacttgtatgctagtctatggtca

SEQ ID NO: 149787 - DNA, 25 bp, Homo sapien
tgctagtctatggtcagttgaggaa

SEQ ID NO: 149788 - DNA, 25 bp, Homo sapien
agttgaggaatatgactgtttttat

SEQ ID NO: 149789 - DNA, 25 bp, Homo sapien
gtttttatatgcacatgtaacccaa

SEQ ID NO: 149790 - DNA, 25 bp, Homo sapien
gtaacccaaatgtccaatataaatt

SEQ ID NO: 149791 - DNA, 25 bp, Homo sapien
aagtgttattatttggcatgcttaa

SEQ ID NO: 149792 - DNA, 25 bp, Homo sapien
gaataagtattcttcatcagcattt

SEQ ID NO: 149793 - DNA, 25 bp, Homo sapien
agtattcttcatcagcatttaataa

SEQ ID NO: 149794 - DNA, 25 bp, Homo sapien
gtataggcagatgtaaggtaatttc

SEQ ID NO: 149795 - DNA, 25 bp, Homo sapien
ttggctggtatctggcagcacacac

SEQ ID NO: 149796 - DNA, 25 bp, Homo sapien
acaccggctgttatgaccttctaaa

SEQ ID NO: 149797 - DNA, 25 bp, Homo sapien
atagttaaactccagaccctgccaa

SEQ ID NO: 149798 - DNA, 25 bp, Homo sapien
agaccctgccaaaacatgagccctg

SEQ ID NO: 149799 - DNA, 25 bp, Homo sapien
ccctgccctcaattacagtaacgta

SEQ ID NO: 149800 - DNA, 25 bp, Homo sapien
gggcctgttccatggcataacacta

SEQ ID NO: 149801 - DNA, 25 bp, Homo sapien
actaaggcgcagactcctaaggcac

SEQ ID NO: 149802 - DNA, 25 bp, Homo sapien
cactggctgcatgtcagggtgtcag

SEQ ID NO: 149803 - DNA, 25 bp, Homo sapien
gggtgtcagatccttaaacgtgtgt

SEQ ID NO: 149804 - DNA, 25 bp, Homo sapien
gtgaatgctgcatcatctatgtgta

SEQ ID NO: 149805 - DNA, 25 bp, Homo sapien
aaatcctatacgtgtcctctattgg

SEQ ID NO: 149806 - DNA, 25 bp, Homo sapien
tagcatcatggagcccacagcatcc

SEQ ID NO: 149807 - DNA, 25 bp, Homo sapien
ccctggtccccttggaggctactga

SEQ ID NO: 149808 - DNA, 25 bp, Homo sapien
acccactcctgcagcagactgagga

SEQ ID NO: 149809 - DNA, 25 bp, Homo sapien
agactgaggaccagttcctgtcccc

SEQ ID NO: 149810 - DNA, 25 bp, Homo sapien
actgaggaccagttcctgtccccga

SEQ ID NO: 149811 - DNA, 25 bp, Homo sapien
tggcgtgcagctcccctctgatcag

SEQ ID NO: 149812 - DNA, 25 bp, Homo sapien
atccttggaccaggacgactacctg

SEQ ID NO: 149813 - DNA, 25 bp, Homo sapien
ttggaccaggacgactacctgtggg

SEQ ID NO: 149814 - DNA, 25 bp, Homo sapien
aggcgggtgagggcatcagcgatct

SEQ ID NO: 149815 - DNA, 25 bp, Homo sapien
gatctcttcgactcctacgaccttg

SEQ ID NO: 149816 - DNA, 25 bp, Homo sapien
tctcttcgactcctacgaccttggg

SEQ ID NO: 149817 - DNA, 25 bp, Homo sapien
aaggtgacttccatcaagctataca

SEQ ID NO: 149818 - DNA, 25 bp, Homo sapien
atcaagctatacatacccttcttct

SEQ ID NO: 149819 - DNA, 25 bp, Homo sapien
agtcgctgcctttgcataccagata

SEQ ID NO: 149820 - DNA, 25 bp, Homo sapien
gagttaatgatactcctggaataca

SEQ ID NO: 149821 - DNA, 25 bp, Homo sapien
gatgggatgcctattaatgttggag

SEQ ID NO: 149822 - DNA, 25 bp, Homo sapien
atgttggagatggtggtctctttga

SEQ ID NO: 149823 - DNA, 25 bp, Homo sapien
tgcaggagctttcacagtggacagt

SEQ ID NO: 149824 - DNA, 25 bp, Homo sapien
ggacagtaaggtccatccatgacct

SEQ ID NO: 149825 - DNA, 25 bp, Homo sapien
atgaccttcgtttcatttcttctca

SEQ ID NO: 149826 - DNA, 25 bp, Homo sapien
catttcttctcatcagactgggatc

SEQ ID NO: 149827 - DNA, 25 bp, Homo sapien
gcacgtgggagccattatattgcta

SEQ ID NO: 149828 - DNA, 25 bp, Homo sapien
tgttaatgcagctgtgccacaaatt

SEQ ID NO: 149829 - DNA, 25 bp, Homo sapien
gtgccacaaattctcctttatcttt

SEQ ID NO: 149830 - DNA, 25 bp, Homo sapien
aggagtttgagttagtcacctcggg

SEQ ID NO: 149831 - DNA, 25 bp, Homo sapien
tgttaaattaatgtagcctgcctct

SEQ ID NO: 149832 - DNA, 25 bp, Homo sapien
ttaatgtagcctgcctctatttgtt

SEQ ID NO: 149833 - DNA, 25 bp, Homo sapien
aaagggttatttgcctcatctccta

SEQ ID NO: 149834 - DNA, 25 bp, Homo sapien
tgcctcatctcctatctttagtgaa

SEQ ID NO: 149835 - DNA, 25 bp, Homo sapien
tgtgtgtatttattccaccgtggga

SEQ ID NO: 149836 - DNA, 25 bp, Homo sapien
tccaccgtgggaacagagaatacct

SEQ ID NO: 149837 - DNA, 25 bp, Homo sapien
gagaatacctgtttagtgttgcact

SEQ ID NO: 149838 - DNA, 25 bp, Homo sapien
gtgttgcactttagactggtgtctg

SEQ ID NO: 149839 - DNA, 25 bp, Homo sapien
tctaggcaggccagagatttgagtt

SEQ ID NO: 149840 - DNA, 25 bp, Homo sapien
tcttgagaataaagccactgggcca

SEQ ID NO: 149841 - DNA, 25 bp, Homo sapien
actgggccaggaactcacctttcaa

SEQ ID NO: 149842 - DNA, 25 bp, Homo sapien
gaactcacctttcaaaccctggtag

SEQ ID NO: 149843 - DNA, 25 bp, Homo sapien
caaaccctggtagagcattaaaatt

SEQ ID NO: 149844 - DNA, 25 bp, Homo sapien
ttaaaatttccttgcaagaccagcc

SEQ ID NO: 149845 - DNA, 25 bp, Homo sapien
tgcaagaccagccaatgaataatgg

SEQ ID NO: 149846 - DNA, 25 bp, Homo sapien
ataactttcaaatagcattgtgctt

SEQ ID NO: 149847 - DNA, 25 bp, Homo sapien
agcattgtgctttatagcacacaaa

SEQ ID NO: 149848 - DNA, 25 bp, Homo sapien
ctgaggagtgggttttcaaaattat

SEQ ID NO: 149849 - DNA, 25 bp, Homo sapien
attagtatccctattatacaggtga

SEQ ID NO: 149850 - DNA, 25 bp, Homo sapien
gagccagcgtggtggccatagacaa

SEQ ID NO: 149851 - DNA, 25 bp, Homo sapien
tcgaacaggccatggatctggtgaa

SEQ ID NO: 149852 - DNA, 25 bp, Homo sapien
gatctggtgaagaatcatctgatgt

SEQ ID NO: 149853 - DNA, 25 bp, Homo sapien
gaatcatctgatgtatgctgtgaga

SEQ ID NO: 149854 - DNA, 25 bp, Homo sapien
agaagaactcccagctagagcgtga

SEQ ID NO: 149855 - DNA, 25 bp, Homo sapien
gctagagcgtgagaacaccctgttg

SEQ ID NO: 149856 - DNA, 25 bp, Homo sapien
gagaacaccctgttgaagaccctgg

SEQ ID NO: 149857 - DNA, 25 bp, Homo sapien
ctgttgaagaccctggcaagcccag

SEQ ID NO: 149858 - DNA, 25 bp, Homo sapien
tccagtcctgtctgagccctgaaga

SEQ ID NO: 149859 - DNA, 25 bp, Homo sapien
ctgtctgagccctgaagagccagct

SEQ ID NO: 149860 - DNA, 25 bp, Homo sapien
acaagtgcccgaggcccctggtggt

SEQ ID NO: 149861 - DNA, 25 bp, Homo sapien
tttccccattccttgataactctct

SEQ ID NO: 149862 - DNA, 25 bp, Homo sapien
taactctcttgtctttactgggaag

SEQ ID NO: 149863 - DNA, 25 bp, Homo sapien
gctggagagtcacagtctagtagaa

SEQ ID NO: 149864 - DNA, 25 bp, Homo sapien
ttcaactgtaggtgcctttgcaacc

SEQ ID NO: 149865 - DNA, 25 bp, Homo sapien
tgcctttgcaacctatcctgggaga

SEQ ID NO: 149866 - DNA, 25 bp, Homo sapien
tatcctgggagaccctaaaacatat

SEQ ID NO: 149867 - DNA, 25 bp, Homo sapien
agagattttcactcctctaacatct

SEQ ID NO: 149868 - DNA, 25 bp, Homo sapien
atctctggatacagtgtccctggtc

SEQ ID NO: 149869 - DNA, 25 bp, Homo sapien
acagtgtccctggtcaacatgaaga

SEQ ID NO: 149870 - DNA, 25 bp, Homo sapien
agaagaacgctttctgatcctggcc

SEQ ID NO: 149871 - DNA, 25 bp, Homo sapien
gatcctggcccctaaagaatttact

SEQ ID NO: 149872 - DNA, 25 bp, Homo sapien
gcatttattgctgagttatatgttc

SEQ ID NO: 149873 - DNA, 25 bp, Homo sapien
gctgagttatatgttcactgtcccc

SEQ ID NO: 149874 - DNA, 25 bp, Homo sapien
ttcactgtccccctaatattaggga

SEQ ID NO: 149875 - DNA, 25 bp, Homo sapien
gagtaaaacggataccaagttgatt

SEQ ID NO: 149876 - DNA, 25 bp, Homo sapien
ttagtgtttttacctctgtcttggc

SEQ ID NO: 149877 - DNA, 25 bp, Homo sapien
tacctctgtcttggctttcatgtta

SEQ ID NO: 149878 - DNA, 25 bp, Homo sapien
tgtgaagaagggtgtttttctgttt

SEQ ID NO: 149879 - DNA, 25 bp, Homo sapien
ttttctgttttatattcaactcata

SEQ ID NO: 149880 - DNA, 25 bp, Homo sapien
tcaactcataagactttgggatagg

SEQ ID NO: 149881 - DNA, 25 bp, Homo sapien
gaacccccatgatgtaagtttacct

SEQ ID NO: 149882 - DNA, 25 bp, Homo sapien
gcacttatacccatgaacttaaaat

SEQ ID NO: 149883 - DNA, 25 bp, Homo sapien
tggtgtcctacaaagtcagagtcaa

SEQ ID NO: 149884 - DNA, 25 bp, Homo sapien
cagagtcaacctgatggtgtcctgt

SEQ ID NO: 149885 - DNA, 25 bp, Homo sapien
atggtgtcctgtggtggcatcctag

SEQ ID NO: 149886 - DNA, 25 bp, Homo sapien
gcatcctaggagacctgacagccag

SEQ ID NO: 149887 - DNA, 25 bp, Homo sapien
gcgatgttggtgtggagctaccctt

SEQ ID NO: 149888 - DNA, 25 bp, Homo sapien
tgtggagctacccttggtcctgatc

SEQ ID NO: 149889 - DNA, 25 bp, Homo sapien
ttggtcctgatccatccgaagccat

SEQ ID NO: 149890 - DNA, 25 bp, Homo sapien
aagccatctcatgaggccgctagct

SEQ ID NO: 149891 - DNA, 25 bp, Homo sapien
gaggccgctagctctgaggacatag

SEQ ID NO: 149892 - DNA, 25 bp, Homo sapien
gaggacatagtcatcgaggagttta

SEQ ID NO: 149893 - DNA, 25 bp, Homo sapien
gtcatcgaggagtttacgcggaaag

SEQ ID NO: 149894 - DNA, 25 bp, Homo sapien
gcttgaatgccacgcggtacaaagg

SEQ ID NO: 149895 - DNA, 25 bp, Homo sapien
gaatgccacgcggtacaaaggaaaa

SEQ ID NO: 149896 - DNA, 25 bp, Homo sapien
gaaatattatgcaaattcccagatt

SEQ ID NO: 149897 - DNA, 25 bp, Homo sapien
gcaaattcccagatttgaagacaaa

SEQ ID NO: 149898 - DNA, 25 bp, Homo sapien
aagattccttttcttgtttatcagc

SEQ ID NO: 149899 - DNA, 25 bp, Homo sapien
gattccttttcttgtttatcagcag

SEQ ID NO: 149900 - DNA, 25 bp, Homo sapien
ttccttttcttgtttatcagcagtt

SEQ ID NO: 149901 - DNA, 25 bp, Homo sapien
ccttttcttgtttatcagcagttgt

SEQ ID NO: 149902 - DNA, 25 bp, Homo sapien
ttcttgtttatcagcagttgttatt

SEQ ID NO: 149903 - DNA, 25 bp, Homo sapien
tattacatccttgtggcacattttt

SEQ ID NO: 149904 - DNA, 25 bp, Homo sapien
attacatccttgtggcacatttttt

SEQ ID NO: 149905 - DNA, 25 bp, Homo sapien
gatatttactcatgcatttactcta

SEQ ID NO: 149906 - DNA, 25 bp, Homo sapien
gttagtaaccttggcatctttattt

SEQ ID NO: 149907 - DNA, 25 bp, Homo sapien
gcatctttatttaccaactttgcaa

SEQ ID NO: 149908 - DNA, 25 bp, Homo sapien
caataacagaaagtccttccgcctt

SEQ ID NO: 149909 - DNA, 25 bp, Homo sapien
gcagagacctcttgctgggtttcaa

SEQ ID NO: 149910 - DNA, 25 bp, Homo sapien
gctgggtttcaacaaacgtgccatt

SEQ ID NO: 149911 - DNA, 25 bp, Homo sapien
aacgtgccattgataaatgctggaa

SEQ ID NO: 149912 - DNA, 25 bp, Homo sapien
aagattagacacttccccaacgaat

SEQ ID NO: 149913 - DNA, 25 bp, Homo sapien
gacacttccccaacgaatttattgt

SEQ ID NO: 149914 - DNA, 25 bp, Homo sapien
tattgttgagaccaagatctgtcaa

SEQ ID NO: 149915 - DNA, 25 bp, Homo sapien
gcaacagatagagtgtccttggtaa

SEQ ID NO: 149916 - DNA, 25 bp, Homo sapien
gcctgaggcctgtgcctgtcaggct

SEQ ID NO: 149917 - DNA, 25 bp, Homo sapien
aggctctggcccttgcctttgtggc

SEQ ID NO: 149918 - DNA, 25 bp, Homo sapien
cagggaatcagggaccagctttact

SEQ ID NO: 149919 - DNA, 25 bp, Homo sapien
atcagggaccagctttactggagtt

SEQ ID NO: 149920 - DNA, 25 bp, Homo sapien
ggcggcttgtcttcgctggctccta

SEQ ID NO: 149921 - DNA, 25 bp, Homo sapien
taccccatctccaagataagcctga

SEQ ID NO: 149922 - DNA, 25 bp, Homo sapien
agataagcctgagccttagctccca

SEQ ID NO: 149923 - DNA, 25 bp, Homo sapien
cctgagccttagctcccagctaggg

SEQ ID NO: 149924 - DNA, 25 bp, Homo sapien
ggcgttatttatggaccacttttat

SEQ ID NO: 149925 - DNA, 25 bp, Homo sapien
atttatggaccacttttatttattg

SEQ ID NO: 149926 - DNA, 25 bp, Homo sapien
tattgtcagacacttatttattggg

SEQ ID NO: 149927 - DNA, 25 bp, Homo sapien
caaaaatgagcacgctttcctaccg

SEQ ID NO: 149928 - DNA, 25 bp, Homo sapien
taccgcccctcagataatgtaagct

SEQ ID NO: 149929 - DNA, 25 bp, Homo sapien
tgtaagctcatccaccaagaagcct

SEQ ID NO: 149930 - DNA, 25 bp, Homo sapien
gaagcctgcaccatgttttgaggtt

SEQ ID NO: 149931 - DNA, 25 bp, Homo sapien
gttgagtgacatgttcgaaacctgt

SEQ ID NO: 149932 - DNA, 25 bp, Homo sapien
gttcgaaacctgtccataaagtaat

SEQ ID NO: 149933 - DNA, 25 bp, Homo sapien
ctgcagcacttcactaccaaatgag

SEQ ID NO: 149934 - DNA, 25 bp, Homo sapien
tgcattatgtggactgaaccgactt

SEQ ID NO: 149935 - DNA, 25 bp, Homo sapien
tgaaccgacttttctaaagctctga

SEQ ID NO: 149936 - DNA, 25 bp, Homo sapien
tctttccttttgcaacaagacaaag

SEQ ID NO: 149937 - DNA, 25 bp, Homo sapien
acaagacaaagcaaagccacatttt

SEQ ID NO: 149938 - DNA, 25 bp, Homo sapien
tagtagttgggcatcagtcaggttt

SEQ ID NO: 149939 - DNA, 25 bp, Homo sapien
ttgggcatcagtcaggttttaagca

SEQ ID NO: 149940 - DNA, 25 bp, Homo sapien
tcaggttttaagcaagttgttttgt

SEQ ID NO: 149941 - DNA, 25 bp, Homo sapien
gttttgtccatactaaatgtagtct

SEQ ID NO: 149942 - DNA, 25 bp, Homo sapien
aaaaacacatgagagctttgtgctc

SEQ ID NO: 149943 - DNA, 25 bp, Homo sapien
agctttgtgctctagtagttttgaa

SEQ ID NO: 149944 - DNA, 25 bp, Homo sapien
gtgctctagtagttttgaagtgatg

SEQ ID NO: 149945 - DNA, 25 bp, Homo sapien
tgacttgaagtgttgagattttctt

SEQ ID NO: 149946 - DNA, 25 bp, Homo sapien
tttcttgcagcatgagcaccagttc

SEQ ID NO: 149947 - DNA, 25 bp, Homo sapien
gcaccagttccacttacgctaatta

SEQ ID NO: 149948 - DNA, 25 bp, Homo sapien
gttccacttacgctaattaaattat

SEQ ID NO: 149949 - DNA, 25 bp, Homo sapien
ttcacccactggaccatgtcaagga

SEQ ID NO: 149950 - DNA, 25 bp, Homo sapien
agaaggacccggatcaaccagcaga

SEQ ID NO: 149951 - DNA, 25 bp, Homo sapien
acagcgtgcccctgaaggcgactgt

SEQ ID NO: 149952 - DNA, 25 bp, Homo sapien
aggcgactgtctgaatggcccaggc

SEQ ID NO: 149953 - DNA, 25 bp, Homo sapien
ccaggcagctctagctgggagcttg

SEQ ID NO: 149954 - DNA, 25 bp, Homo sapien
agcttggcctctggctccatctgag

SEQ ID NO: 149955 - DNA, 25 bp, Homo sapien
catctgagtcccctgggagagagcc

SEQ ID NO: 149956 - DNA, 25 bp, Homo sapien
gagagagcccagcacccaagatcca

SEQ ID NO: 149957 - DNA, 25 bp, Homo sapien
accatcaccaggcatgtctgcagag

SEQ ID NO: 149958 - DNA, 25 bp, Homo sapien
ggacaccaactttatggactgccca

SEQ ID NO: 149959 - DNA, 25 bp, Homo sapien
tggactgcccatgggagtgctccaa

SEQ ID NO: 149960 - DNA, 25 bp, Homo sapien
ttctttgccttctcttgtcctcttt

SEQ ID NO: 149961 - DNA, 25 bp, Homo sapien
tctttctcctatttcttaccctgtc

SEQ ID NO: 149962 - DNA, 25 bp, Homo sapien
cctgccttccattttgaagtgggat

SEQ ID NO: 149963 - DNA, 25 bp, Homo sapien
gggatgttaatgaaatcaagttcca

SEQ ID NO: 149964 - DNA, 25 bp, Homo sapien
atcaagttccagtaacccaaatctt

SEQ ID NO: 149965 - DNA, 25 bp, Homo sapien
tccagtaacccaaatcttgtttaca

SEQ ID NO: 149966 - DNA, 25 bp, Homo sapien
aaatattcgtggtatctgtgaacat

SEQ ID NO: 149967 - DNA, 25 bp, Homo sapien
cgtggtatctgtgaacatgttaaga

SEQ ID NO: 149968 - DNA, 25 bp, Homo sapien
gccccattgggcatgataagccgag

SEQ ID NO: 149969 - DNA, 25 bp, Homo sapien
tgataagccgaggaggcattcttcc

SEQ ID NO: 149970 - DNA, 25 bp, Homo sapien
aggcattcttcctaaaagtagactt

SEQ ID NO: 149971 - DNA, 25 bp, Homo sapien
aaccctgctccgttggtcagcgtta

SEQ ID NO: 149972 - DNA, 25 bp, Homo sapien
ctccgttggtcagcgttactatcat

SEQ ID NO: 149973 - DNA, 25 bp, Homo sapien
ggtcagcgttactatcatctcggat

SEQ ID NO: 149974 - DNA, 25 bp, Homo sapien
gcgttactatcatctcggatcatat

SEQ ID NO: 149975 - DNA, 25 bp, Homo sapien
tctcggatcatatggagctcatgtc

SEQ ID NO: 149976 - DNA, 25 bp, Homo sapien
tatggagctcatgtcagccgtgtgg

SEQ ID NO: 149977 - DNA, 25 bp, Homo sapien
tgcacagagacggtctggaaggaaa

SEQ ID NO: 149978 - DNA, 25 bp, Homo sapien
tggaaggaaacacgcggatctgaac

SEQ ID NO: 149979 - DNA, 25 bp, Homo sapien
gttgggctagattacagagggctca

SEQ ID NO: 149980 - DNA, 25 bp, Homo sapien
tacagagggctcattttctacgtca

SEQ ID NO: 149981 - DNA, 25 bp, Homo sapien
tttacatttgttgtacaatcaggaa

SEQ ID NO: 149982 - DNA, 25 bp, Homo sapien
gggttacccagatttcaacctcatc

SEQ ID NO: 149983 - DNA, 25 bp, Homo sapien
agatttcaacctcatcgtgaaccct

SEQ ID NO: 149984 - DNA, 25 bp, Homo sapien
catcgtgaacccttatgagcccata

SEQ ID NO: 149985 - DNA, 25 bp, Homo sapien
tatgagcccataaggaaggttaaag

SEQ ID NO: 149986 - DNA, 25 bp, Homo sapien
actctggcctgcagcgtctgtcctt

SEQ ID NO: 149987 - DNA, 25 bp, Homo sapien
tgcagcgtctgtccttccaggttcc

SEQ ID NO: 149988 - DNA, 25 bp, Homo sapien
ttccaggttcctggcagtgagaggc

SEQ ID NO: 149989 - DNA, 25 bp, Homo sapien
gcagcaggtgctccttagccaaata

SEQ ID NO: 149990 - DNA, 25 bp, Homo sapien
ccctccgagatccaggtcttcgtga

SEQ ID NO: 149991 - DNA, 25 bp, Homo sapien
aatcctgatggtgggagctacgcct

SEQ ID NO: 149992 - DNA, 25 bp, Homo sapien
tgggagctacgcctatgccatcaac

SEQ ID NO: 149993 - DNA, 25 bp, Homo sapien
agcctgtttctgctgagtttcttat

SEQ ID NO: 149994 - DNA, 25 bp, Homo sapien
gagtttcttatcagccctcaagcta

SEQ ID NO: 149995 - DNA, 25 bp, Homo sapien
agccctcaagctatgctaggaaaag

SEQ ID NO: 149996 - DNA, 25 bp, Homo sapien
tacattggatactctgtaagtagga

SEQ ID NO: 149997 - DNA, 25 bp, Homo sapien
tgtaagtaggaggtactttgtccca

SEQ ID NO: 149998 - DNA, 25 bp, Homo sapien
acagttcagttgtatctatgcccca

SEQ ID NO: 149999 - DNA, 25 bp, Homo sapien
cagttgtatctatgccccacagtga

SEQ ID NO: 150000 - DNA, 25 bp, Homo sapien
tatgccccacagtgaccagtaaagt

SEQ ID NO: 150001 - DNA, 25 bp, Homo sapien
cacagtgaccagtaaagtccaatta

SEQ ID NO: 150002 - DNA, 25 bp, Homo sapien
tgccgaataccttaaagtaactaat

SEQ ID NO: 150003 - DNA, 25 bp, Homo sapien
agtaactaattatccttacacacaa

SEQ ID NO: 150004 - DNA, 25 bp, Homo sapien
tgcattcactcctgcggagacctag

SEQ ID NO: 150005 - DNA, 25 bp, Homo sapien
actcctgcggagacctaggaacttt

SEQ ID NO: 150006 - DNA, 25 bp, Homo sapien
tttttctgtcccacgcgcgtttgtt

SEQ ID NO: 150007 - DNA, 25 bp, Homo sapien
cgcgtttgttcttgcgcacgggaga

SEQ ID NO: 150008 - DNA, 25 bp, Homo sapien
ttgttcttgcgcacgggagagtttg

SEQ ID NO: 150009 - DNA, 25 bp, Homo sapien
tggcggcgattatgcagcgtgcaat

SEQ ID NO: 150010 - DNA, 25 bp, Homo sapien
gtgcaatgagtgatcctgcagcctg

SEQ ID NO: 150011 - DNA, 25 bp, Homo sapien
tgcagcctggtgtcttagctgtccc

SEQ ID NO: 150012 - DNA, 25 bp, Homo sapien
caggagtgccctccgagagtccatg

SEQ ID NO: 150013 - DNA, 25 bp, Homo sapien
aactgggactgagctcgggcacgca

SEQ ID NO: 150014 - DNA, 25 bp, Homo sapien
ctcgggcacgcagggcctgagatct

SEQ ID NO: 150015 - DNA, 25 bp, Homo sapien
tctacctgctcatgccaggagaatc

SEQ ID NO: 150016 - DNA, 25 bp, Homo sapien
ctgctcatgccaggagaatccataa

SEQ ID NO: 150017 - DNA, 25 bp, Homo sapien
gagaatccataactgcctagagcct

SEQ ID NO: 150018 - DNA, 25 bp, Homo sapien
gaatccataactgcctagagcctgg

SEQ ID NO: 150019 - DNA, 25 bp, Homo sapien
gggccctaccggtcgtgaggtgagt

SEQ ID NO: 150020 - DNA, 25 bp, Homo sapien
ctcccctgctgttgtaaatactgta

SEQ ID NO: 150021 - DNA, 25 bp, Homo sapien
tcatttgtaactgcgtttccgggtc

SEQ ID NO: 150022 - DNA, 25 bp, Homo sapien
gtaactgcgtttccgggtcgcgcca

SEQ ID NO: 150023 - DNA, 25 bp, Homo sapien
gtcgcgccagagtcatttggtacta

SEQ ID NO: 150024 - DNA, 25 bp, Homo sapien
tagattcccccacctttcaaactgg

SEQ ID NO: 150025 - DNA, 25 bp, Homo sapien
ttcaaactggtttgtatttatttca

SEQ ID NO: 150026 - DNA, 25 bp, Homo sapien
aagccagagtagttttatacagaca

SEQ ID NO: 150027 - DNA, 25 bp, Homo sapien
aaaaccagtgtcaggcctttgcagt

SEQ ID NO: 150028 - DNA, 25 bp, Homo sapien
tgtcaggcctttgcagtaggcttga

SEQ ID NO: 150029 - DNA, 25 bp, Homo sapien
gtaggcttgagtgaacttctgatct

SEQ ID NO: 150030 - DNA, 25 bp, Homo sapien
agacattgcccatttttacttcctc

SEQ ID NO: 150031 - DNA, 25 bp, Homo sapien
acttcctcattcattattgtaccag

SEQ ID NO: 150032 - DNA, 25 bp, Homo sapien
tattgtaccagcatcatagctttat

SEQ ID NO: 150033 - DNA, 25 bp, Homo sapien
tagctttattactctaatcccaggt

SEQ ID NO: 150034 - DNA, 25 bp, Homo sapien
taatcccaggtaagtcaagcctaca

SEQ ID NO: 150035 - DNA, 25 bp, Homo sapien
aagtcaagcctacaatgccctagag

SEQ ID NO: 150036 - DNA, 25 bp, Homo sapien
cagaaattcatgctggcttaaataa

SEQ ID NO: 150037 - DNA, 25 bp, Homo sapien
aggcactgaatgtctaggacatgct

SEQ ID NO: 150038 - DNA, 25 bp, Homo sapien
tgtctaggacatgctgtggatgaag

SEQ ID NO: 150039 - DNA, 25 bp, Homo sapien
ctaggacatgctgtggatgaagata

SEQ ID NO: 150040 - DNA, 25 bp, Homo sapien
acatctcttatttctcttttcccct

SEQ ID NO: 150041 - DNA, 25 bp, Homo sapien
ttactctctaccatttcctttatgt

SEQ ID NO: 150042 - DNA, 25 bp, Homo sapien
gtaataaataggttacttaccatca

SEQ ID NO: 150043 - DNA, 25 bp, Homo sapien
ggttacttaccatcatatgttcata

SEQ ID NO: 150044 - DNA, 25 bp, Homo sapien
aactggcccccaattgaagtcatat

SEQ ID NO: 150045 - DNA, 25 bp, Homo sapien
gggaaatggcatacgcaatattata

SEQ ID NO: 150046 - DNA, 25 bp, Homo sapien
tggatatttatgttcacacaggaat

SEQ ID NO: 150047 - DNA, 25 bp, Homo sapien
tatttatgttcacacaggaatttgg

SEQ ID NO: 150048 - DNA, 25 bp, Homo sapien
atgcatgtgacaagtccactgggcc

SEQ ID NO: 150049 - DNA, 25 bp, Homo sapien
ggccctgtatctctaatccctgtgg

SEQ ID NO: 150050 - DNA, 25 bp, Homo sapien
gccctgtatctctaatccctgtggc

SEQ ID NO: 150051 - DNA, 25 bp, Homo sapien
cctgtatctctaatccctgtggcct

SEQ ID NO: 150052 - DNA, 25 bp, Homo sapien
ctgtatctctaatccctgtggccta

SEQ ID NO: 150053 - DNA, 25 bp, Homo sapien
tgtatctctaatccctgtggcctac

SEQ ID NO: 150054 - DNA, 25 bp, Homo sapien
tatctctaatccctgtggcctacgt

SEQ ID NO: 150055 - DNA, 25 bp, Homo sapien
atctctaatccctgtggcctacgtg

SEQ ID NO: 150056 - DNA, 25 bp, Homo sapien
tctctaatccctgtggcctacgtgc

SEQ ID NO: 150057 - DNA, 25 bp, Homo sapien
cctacgtgctcggtgtgggccttgc

SEQ ID NO: 150058 - DNA, 25 bp, Homo sapien
ctacgtgctcggtgtgggccttgca

SEQ ID NO: 150059 - DNA, 25 bp, Homo sapien
tttgtgccaaacatcctggcgcggg

SEQ ID NO: 150060 - DNA, 25 bp, Homo sapien
aaggccatcacggcgggcagtaagt

SEQ ID NO: 150061 - DNA, 25 bp, Homo sapien
gtaccaggtcatcggcaagaaccac

SEQ ID NO: 150062 - DNA, 25 bp, Homo sapien
tcatcggcaagaaccacgtggcagt

SEQ ID NO: 150063 - DNA, 25 bp, Homo sapien
cttcaaggtgctgatcctggaggca

SEQ ID NO: 150064 - DNA, 25 bp, Homo sapien
gtgggcaaattgagctccgcaccta

SEQ ID NO: 150065 - DNA, 25 bp, Homo sapien
aattgagctccgcacctacgtgatg

SEQ ID NO: 150066 - DNA, 25 bp, Homo sapien
tacgtgatgcccaacgcacctgtgg

SEQ ID NO: 150067 - DNA, 25 bp, Homo sapien
gatgcccaacgcacctgtggatgag

SEQ ID NO: 150068 - DNA, 25 bp, Homo sapien
tggtgcccatcgagagcattgagcg

SEQ ID NO: 150069 - DNA, 25 bp, Homo sapien
catcgagagcattgagcgggcttcg

SEQ ID NO: 150070 - DNA, 25 bp, Homo sapien
ttagaggtccccagtaggttcccag

SEQ ID NO: 150071 - DNA, 25 bp, Homo sapien
agacacacggacacaatcagccgag

SEQ ID NO: 150072 - DNA, 25 bp, Homo sapien
caatcagccgagaagttcctggtct

SEQ ID NO: 150073 - DNA, 25 bp, Homo sapien
gaagttcctggtctgaatcacgaga

SEQ ID NO: 150074 - DNA, 25 bp, Homo sapien
gttgctggtgaaactgggccaatct

SEQ ID NO: 150075 - DNA, 25 bp, Homo sapien
aacatccttgccagggagtttctga

SEQ ID NO: 150076 - DNA, 25 bp, Homo sapien
tttctgagggtctgctttgtttacc

SEQ ID NO: 150077 - DNA, 25 bp, Homo sapien
tttgtttacctttcgtgcggtggat

SEQ ID NO: 150078 - DNA, 25 bp, Homo sapien
tcgtgcggtggattctttttaactc

SEQ ID NO: 150079 - DNA, 25 bp, Homo sapien
gattctttttaactccgtctacctg

SEQ ID NO: 150080 - DNA, 25 bp, Homo sapien
gtctacctggcgttttgttagaaat

SEQ ID NO: 150081 - DNA, 25 bp, Homo sapien
tgcagtctaacccactaatcagttc

SEQ ID NO: 150082 - DNA, 25 bp, Homo sapien
agtctaacccactaatcagttctta

SEQ ID NO: 150083 - DNA, 25 bp, Homo sapien
taacccactaatcagttcttagatt

SEQ ID NO: 150084 - DNA, 25 bp, Homo sapien
cactaatcagttcttagattcaggg

SEQ ID NO: 150085 - DNA, 25 bp, Homo sapien
gggcaggcaccaacaactcagaatg

SEQ ID NO: 150086 - DNA, 25 bp, Homo sapien
gcaggcaccaacaactcagaatggg

SEQ ID NO: 150087 - DNA, 25 bp, Homo sapien
aacaactcagaatgggggctttcgg

SEQ ID NO: 150088 - DNA, 25 bp, Homo sapien
gaacccatagggagctgatcgtaat

SEQ ID NO: 150089 - DNA, 25 bp, Homo sapien
cccatagggagctgatcgtaatgtt

SEQ ID NO: 150090 - DNA, 25 bp, Homo sapien
tagggagctgatcgtaatgtttatc

SEQ ID NO: 150091 - DNA, 25 bp, Homo sapien
gctgatcgtaatgtttatcatgtta

SEQ ID NO: 150092 - DNA, 25 bp, Homo sapien
tggtggcttcccagtcatggtatca

SEQ ID NO: 150093 - DNA, 25 bp, Homo sapien
cagtcatggtatcactggcatggac

SEQ ID NO: 150094 - DNA, 25 bp, Homo sapien
ctggcatggacctctgtccggcaga

SEQ ID NO: 150095 - DNA, 25 bp, Homo sapien
gtgtggactggagaccaggattcat

SEQ ID NO: 150096 - DNA, 25 bp, Homo sapien
caggattcatgctggtctggaacaa

SEQ ID NO: 150097 - DNA, 25 bp, Homo sapien
tgacattgccaacttaagacacaca

SEQ ID NO: 150098 - DNA, 25 bp, Homo sapien
caagataacatgctggccaaccaca

SEQ ID NO: 150099 - DNA, 25 bp, Homo sapien
ggccaaccacaattcctagagttaa

SEQ ID NO: 150100 - DNA, 25 bp, Homo sapien
gaaccttaaaagattaccgctcatg

SEQ ID NO: 150101 - DNA, 25 bp, Homo sapien
gattaccgctcatgctaaaagtatg

SEQ ID NO: 150102 - DNA, 25 bp, Homo sapien
gtaaagatcccatgtacagtatgat

SEQ ID NO: 150103 - DNA, 25 bp, Homo sapien
agctgccttagcttcaggaacctcg

SEQ ID NO: 150104 - DNA, 25 bp, Homo sapien
tagcttcaggaacctcgagtactgt

SEQ ID NO: 150105 - DNA, 25 bp, Homo sapien
tcaggaacctcgagtactgtgggca

SEQ ID NO: 150106 - DNA, 25 bp, Homo sapien
agtactgtgggcaatttagaaaaag

SEQ ID NO: 150107 - DNA, 25 bp, Homo sapien
catgcagtttgaaattctgaatttg

SEQ ID NO: 150108 - DNA, 25 bp, Homo sapien
actttttattgccttctcaccagct

SEQ ID NO: 150109 - DNA, 25 bp, Homo sapien
tgccttctcaccagctgcaaagtgt

SEQ ID NO: 150110 - DNA, 25 bp, Homo sapien
accagctgcaaagtgttttgtacca

SEQ ID NO: 150111 - DNA, 25 bp, Homo sapien
caaagtgttttgtaccagtgaattt

SEQ ID NO: 150112 - DNA, 25 bp, Homo sapien
gtaccagtgaatttttgcaataatg

SEQ ID NO: 150113 - DNA, 25 bp, Homo sapien
atgcagtatggtacatttttcaact

SEQ ID NO: 150114 - DNA, 25 bp, Homo sapien
tgagaactaccgtgttagtggtttt

SEQ ID NO: 150115 - DNA, 25 bp, Homo sapien
gtggtttttcacttactgtatatta

SEQ ID NO: 150116 - DNA, 25 bp, Homo sapien
tactgtatattacccttgtaggaat

SEQ ID NO: 150117 - DNA, 25 bp, Homo sapien
caaactttagttattacaggcagca

SEQ ID NO: 150118 - DNA, 25 bp, Homo sapien
caggcagcaaaaaccactgtctgaa

SEQ ID NO: 150119 - DNA, 25 bp, Homo sapien
aaccactgtctgaaactaaatctgt

SEQ ID NO: 150120 - DNA, 25 bp, Homo sapien
gtgttcaaagatgaagacccctcat

SEQ ID NO: 150121 - DNA, 25 bp, Homo sapien
gaagacccctcattaaaagccaagg

SEQ ID NO: 150122 - DNA, 25 bp, Homo sapien
aaagccaaggacgttcttaagattg

SEQ ID NO: 150123 - DNA, 25 bp, Homo sapien
ggaactgacataattagtcttgact

SEQ ID NO: 150124 - DNA, 25 bp, Homo sapien
agtcttgacttacttcattaaagca

SEQ ID NO: 150125 - DNA, 25 bp, Homo sapien
gagcgggccggctcttgacgacctc

SEQ ID NO: 150126 - DNA, 25 bp, Homo sapien
ggctcttgacgacctccagggtctc

SEQ ID NO: 150127 - DNA, 25 bp, Homo sapien
agcacgcgaaacctggccctcggaa

SEQ ID NO: 150128 - DNA, 25 bp, Homo sapien
gaaacctggccctcggaagctggcg

SEQ ID NO: 150129 - DNA, 25 bp, Homo sapien
ccgggccgcgcaagagccctcagga

SEQ ID NO: 150130 - DNA, 25 bp, Homo sapien
agccggccccgagtgaggacagaaa

SEQ ID NO: 150131 - DNA, 25 bp, Homo sapien
gccggccccgagtgaggacagaaac

SEQ ID NO: 150132 - DNA, 25 bp, Homo sapien
ctccctctcgctcaaatacagggat

SEQ ID NO: 150133 - DNA, 25 bp, Homo sapien
cctctcgctcaaatacagggatggc

SEQ ID NO: 150134 - DNA, 25 bp, Homo sapien
cgctcaaatacagggatggcgcctc

SEQ ID NO: 150135 - DNA, 25 bp, Homo sapien
agggatggcgcctctcaggaggtga

SEQ ID NO: 150136 - DNA, 25 bp, Homo sapien
ggaagttctgtttggagcccatttc

SEQ ID NO: 150137 - DNA, 25 bp, Homo sapien
agcccatttctgtgagaccctgtat

SEQ ID NO: 150138 - DNA, 25 bp, Homo sapien
gagaccctgtatttcaaatttgcag

SEQ ID NO: 150139 - DNA, 25 bp, Homo sapien
gaaaggtgcttctacctctgatttc

SEQ ID NO: 150140 - DNA, 25 bp, Homo sapien
gatttcaccccagagttggagttct

SEQ ID NO: 150141 - DNA, 25 bp, Homo sapien
gagttctgctcaaggaacgtgtgta

SEQ ID NO: 150142 - DNA, 25 bp, Homo sapien
gtacatctgtgtccatgtgtgacca

SEQ ID NO: 150143 - DNA, 25 bp, Homo sapien
accatgtgtctgtgaggcagggaac

SEQ ID NO: 150144 - DNA, 25 bp, Homo sapien
gggaacatgtattctctgcatgcat

SEQ ID NO: 150145 - DNA, 25 bp, Homo sapien
tctgcatgcatgtatgtaggtgcct

SEQ ID NO: 150146 - DNA, 25 bp, Homo sapien
tgtgtgggtccttggctcttggcct

SEQ ID NO: 150147 - DNA, 25 bp, Homo sapien
ctgctgtgcagacacctctgtggcc

SEQ ID NO: 150148 - DNA, 25 bp, Homo sapien
tgctgtgcagacacctctgtggccc

SEQ ID NO: 150149 - DNA, 25 bp, Homo sapien
gggccgtggcactgaggccgaaagt

SEQ ID NO: 150150 - DNA, 25 bp, Homo sapien
gcactgaggccgaaagtgcctgcca

SEQ ID NO: 150151 - DNA, 25 bp, Homo sapien
actgaggccgaaagtgcctgccaga

SEQ ID NO: 150152 - DNA, 25 bp, Homo sapien
tgaggccgaaagtgcctgccagacg

SEQ ID NO: 150153 - DNA, 25 bp, Homo sapien
ggccgaaagtgcctgccagacggca

SEQ ID NO: 150154 - DNA, 25 bp, Homo sapien
tgccagacggcacggtctgggtgcg

SEQ ID NO: 150155 - DNA, 25 bp, Homo sapien
cacggtctgggtgcgggtgttccct

SEQ ID NO: 150156 - DNA, 25 bp, Homo sapien
ctgggtgcgggtgttccctgtgagc

SEQ ID NO: 150157 - DNA, 25 bp, Homo sapien
ggatgacgcgctgtgggtgggagga

SEQ ID NO: 150158 - DNA, 25 bp, Homo sapien
atggtatgccgcatctggagggcca

SEQ ID NO: 150159 - DNA, 25 bp, Homo sapien
atgccgcatctggagggccatcttg

SEQ ID NO: 150160 - DNA, 25 bp, Homo sapien
catctggagggccatcttggcacag

SEQ ID NO: 150161 - DNA, 25 bp, Homo sapien
gagggccatcttggcacagcgagca

SEQ ID NO: 150162 - DNA, 25 bp, Homo sapien
ggccatcttggcacagcgagcagga

SEQ ID NO: 150163 - DNA, 25 bp, Homo sapien
catcttggcacagcgagcaggatcc

SEQ ID NO: 150164 - DNA, 25 bp, Homo sapien
acagcgagcaggatccacaccagtc

SEQ ID NO: 150165 - DNA, 25 bp, Homo sapien
agcgagcaggatccacaccagtcac

SEQ ID NO: 150166 - DNA, 25 bp, Homo sapien
tctggaccctgagagctgaatgagg

SEQ ID NO: 150167 - DNA, 25 bp, Homo sapien
gaatgagggcatcataggccagaca

SEQ ID NO: 150168 - DNA, 25 bp, Homo sapien
gagggcatcataggccagacaggcc

SEQ ID NO: 150169 - DNA, 25 bp, Homo sapien
ggagatttaaaggaccagggacatg

SEQ ID NO: 150170 - DNA, 25 bp, Homo sapien
taaaggaccagggacatgggaacca

SEQ ID NO: 150171 - DNA, 25 bp, Homo sapien
tgggaaccaagccatagggatcaga

SEQ ID NO: 150172 - DNA, 25 bp, Homo sapien
ccaagccatagggatcagagggcct

SEQ ID NO: 150173 - DNA, 25 bp, Homo sapien
gtccttgaacactactggggtatat

SEQ ID NO: 150174 - DNA, 25 bp, Homo sapien
ggtatattcaggctcatccacgcag

SEQ ID NO: 150175 - DNA, 25 bp, Homo sapien
tatattcaggctcatccacgcagct

SEQ ID NO: 150176 - DNA, 25 bp, Homo sapien
cctgcaacatccgtcttggaggaga

SEQ ID NO: 150177 - DNA, 25 bp, Homo sapien
gcaacatccgtcttggaggagaggc

SEQ ID NO: 150178 - DNA, 25 bp, Homo sapien
acagcaccctactgccctttaaata

SEQ ID NO: 150179 - DNA, 25 bp, Homo sapien
tgtgggcagggccatgtccctttct

SEQ ID NO: 150180 - DNA, 25 bp, Homo sapien
taagccattcttgattggacctcat

SEQ ID NO: 150181 - DNA, 25 bp, Homo sapien
ttgattggacctcatagcttatttt

SEQ ID NO: 150182 - DNA, 25 bp, Homo sapien
gtggtgcaagtgaattcgttttcat

SEQ ID NO: 150183 - DNA, 25 bp, Homo sapien
tcgttttcatttagaagcccctctg

SEQ ID NO: 150184 - DNA, 25 bp, Homo sapien
gaagcccctctgtacagataatcaa

SEQ ID NO: 150185 - DNA, 25 bp, Homo sapien
aaagcagccacagttatgtaggtct

SEQ ID NO: 150186 - DNA, 25 bp, Homo sapien
gtaggtctgatttgaatgtcataat

SEQ ID NO: 150187 - DNA, 25 bp, Homo sapien
attgcagtgacaggacattgccacc

SEQ ID NO: 150188 - DNA, 25 bp, Homo sapien
tgacaggacattgccaccaactcta

SEQ ID NO: 150189 - DNA, 25 bp, Homo sapien
aactctatcctactaccatcaatgt

SEQ ID NO: 150190 - DNA, 25 bp, Homo sapien
tcctactaccatcaatgttgtgttt

SEQ ID NO: 150191 - DNA, 25 bp, Homo sapien
tggtcctcatgaattgcattaagac

SEQ ID NO: 150192 - DNA, 25 bp, Homo sapien
attgcattaagactctgtactgctc

SEQ ID NO: 150193 - DNA, 25 bp, Homo sapien
catcctctctgtagtttgctgggta

SEQ ID NO: 150194 - DNA, 25 bp, Homo sapien
cctctctgtagtttgctgggtagtg

SEQ ID NO: 150195 - DNA, 25 bp, Homo sapien
gggtaagctaaatcatagtttctga

SEQ ID NO: 150196 - DNA, 25 bp, Homo sapien
catagtttctgacaataactgggaa

SEQ ID NO: 150197 - DNA, 25 bp, Homo sapien
gagtgtatgtagaagggctgttaaa

SEQ ID NO: 150198 - DNA, 25 bp, Homo sapien
ttgcattatttgtggaggctcaaac

SEQ ID NO: 150199 - DNA, 25 bp, Homo sapien
atttgtggaggctcaaacttgtgaa

SEQ ID NO: 150200 - DNA, 25 bp, Homo sapien
ggaggctcaaacttgtgaaggttaa

SEQ ID NO: 150201 - DNA, 25 bp, Homo sapien
tcaaacttgtgaaggttaataccat

SEQ ID NO: 150202 - DNA, 25 bp, Homo sapien
gactggttttccctcaacaacatat

SEQ ID NO: 150203 - DNA, 25 bp, Homo sapien
ggttttccctcaacaacatatatta

SEQ ID NO: 150204 - DNA, 25 bp, Homo sapien
acatatattatacttgctactggaa

SEQ ID NO: 150205 - DNA, 25 bp, Homo sapien
gtttaagacttagctaggtttccat

SEQ ID NO: 150206 - DNA, 25 bp, Homo sapien
gctaggtttccatttagatcttcat

SEQ ID NO: 150207 - DNA, 25 bp, Homo sapien
agatcttcatatctgttgcatggaa

SEQ ID NO: 150208 - DNA, 25 bp, Homo sapien
agttgggttcttggcatagagttgc

SEQ ID NO: 150209 - DNA, 25 bp, Homo sapien
gattttgtgcattcataattgttaa

SEQ ID NO: 150210 - DNA, 25 bp, Homo sapien
aatctgtgttccaaaagtggacata

SEQ ID NO: 150211 - DNA, 25 bp, Homo sapien
gtatgtacaggcagttttctgtcct

SEQ ID NO: 150212 - DNA, 25 bp, Homo sapien
ttgttgttgtatacccaaatacgca

SEQ ID NO: 150213 - DNA, 25 bp, Homo sapien
atcaacctgaggaagcggcgggact

SEQ ID NO: 150214 - DNA, 25 bp, Homo sapien
aagcggcgggactcgctcatcctag

SEQ ID NO: 150215 - DNA, 25 bp, Homo sapien
attgggatctgtaccatcctgttgc

SEQ ID NO: 150216 - DNA, 25 bp, Homo sapien
gttgctgctgtatgcgttccattga

SEQ ID NO: 150217 - DNA, 25 bp, Homo sapien
atgcgttccattgatgggacatctt

SEQ ID NO: 150218 - DNA, 25 bp, Homo sapien
gggacatcttcagggactcttgaca

SEQ ID NO: 150219 - DNA, 25 bp, Homo sapien
agggactcttgacagccaccgcttt

SEQ ID NO: 150220 - DNA, 25 bp, Homo sapien
tcttgataattagcctgaccagcag

SEQ ID NO: 150221 - DNA, 25 bp, Homo sapien
cagtgatggactctgtgacatggtc

SEQ ID NO: 150222 - DNA, 25 bp, Homo sapien
tgagctgaagccacagtttctctgt

SEQ ID NO: 150223 - DNA, 25 bp, Homo sapien
aagccacagtttctctgtgctgtgt

SEQ ID NO: 150224 - DNA, 25 bp, Homo sapien
tctgtctcccaacaccagctggtgt

SEQ ID NO: 150225 - DNA, 25 bp, Homo sapien
gaggtcaacgtgagtttggatctct

SEQ ID NO: 150226 - DNA, 25 bp, Homo sapien
tttggatctcttgtacgcagatgta

SEQ ID NO: 150227 - DNA, 25 bp, Homo sapien
gtacgcagatgtaatcattcacatg

SEQ ID NO: 150228 - DNA, 25 bp, Homo sapien
ccaccccaaaaagggcaagagctgt

SEQ ID NO: 150229 - DNA, 25 bp, Homo sapien
gattgccaaatgagatggctggtta

SEQ ID NO: 150230 - DNA, 25 bp, Homo sapien
ggctggttagagcatgattttttct

SEQ ID NO: 150231 - DNA, 25 bp, Homo sapien
agcatacttcatatattttcttaag

SEQ ID NO: 150232 - DNA, 25 bp, Homo sapien
gattacatcaagctaattgtgcgag

SEQ ID NO: 150233 - DNA, 25 bp, Homo sapien
attgtgcgagctcaattcactttgt

SEQ ID NO: 150234 - DNA, 25 bp, Homo sapien
gcgagctcaattcactttgtaagaa

SEQ ID NO: 150235 - DNA, 25 bp, Homo sapien
acaaaatcaacgaccgggagcagaa

SEQ ID NO: 150236 - DNA, 25 bp, Homo sapien
gagcagaagttgcatgcccttaagg

SEQ ID NO: 150237 - DNA, 25 bp, Homo sapien
gaagtcttcaagtatgtcatctctc

SEQ ID NO: 150238 - DNA, 25 bp, Homo sapien
gtatgtcatctctcacctaaacaag

SEQ ID NO: 150239 - DNA, 25 bp, Homo sapien
acaaggtcagccacaacaacaaggt

SEQ ID NO: 150240 - DNA, 25 bp, Homo sapien
acaaggtgaatctcatgaccagcga

SEQ ID NO: 150241 - DNA, 25 bp, Homo sapien
tgaccagcgagaacctctccatctg

SEQ ID NO: 150242 - DNA, 25 bp, Homo sapien
ttctggcccaccttgatgagacctg

SEQ ID NO: 150243 - DNA, 25 bp, Homo sapien
ctgatttcagcactatggacgccct

SEQ ID NO: 150244 - DNA, 25 bp, Homo sapien
aatcattgaactctttatccagcag

SEQ ID NO: 150245 - DNA, 25 bp, Homo sapien
ttcttcttctacaatcggcccatca

SEQ ID NO: 150246 - DNA, 25 bp, Homo sapien
ggacccctgcaaaactgggactttg

SEQ ID NO: 150247 - DNA, 25 bp, Homo sapien
agaatcactctctccttctgctggt

SEQ ID NO: 150248 - DNA, 25 bp, Homo sapien
agagccctgctatcatcgattcgga

SEQ ID NO: 150249 - DNA, 25 bp, Homo sapien
ctatcatcgattcggacccagtgga

SEQ ID NO: 150250 - DNA, 25 bp, Homo sapien
gggttggaccgagccaatgagcttc

SEQ ID NO: 150251 - DNA, 25 bp, Homo sapien
gagccaatgagcttccggagctgtg

SEQ ID NO: 150252 - DNA, 25 bp, Homo sapien
atgagtttgacttcactgcggactt

SEQ ID NO: 150253 - DNA, 25 bp, Homo sapien
tgcggactttccatctagctgctaa

SEQ ID NO: 150254 - DNA, 25 bp, Homo sapien
catctagctgctaatgccaagtgtc

SEQ ID NO: 150255 - DNA, 25 bp, Homo sapien
gccaagtgtccctaaagatggagga

SEQ ID NO: 150256 - DNA, 25 bp, Homo sapien
gaggaataaagccaccaattctgtt

SEQ ID NO: 150257 - DNA, 25 bp, Homo sapien
gcaataaaacccagcgcccaggtag

SEQ ID NO: 150258 - DNA, 25 bp, Homo sapien
caggtagcctccagcagtgcggctt

SEQ ID NO: 150259 - DNA, 25 bp, Homo sapien
agtgcggcttcctggcaacaaggta

SEQ ID NO: 150260 - DNA, 25 bp, Homo sapien
tggcaacaaggtaggccctggtgca

SEQ ID NO: 150261 - DNA, 25 bp, Homo sapien
aagccgcagcgaccatttcagatac

SEQ ID NO: 150262 - DNA, 25 bp, Homo sapien
tttcagataccgtccacagccagga

SEQ ID NO: 150263 - DNA, 25 bp, Homo sapien
ggaccgctgagaactgggacagttt

SEQ ID NO: 150264 - DNA, 25 bp, Homo sapien
agtttcctgggatgagtgccagcct

SEQ ID NO: 150265 - DNA, 25 bp, Homo sapien
agggagccaggcttcgcttcaaggc

SEQ ID NO: 150266 - DNA, 25 bp, Homo sapien
ggcctctaccttttctcagaatggt

SEQ ID NO: 150267 - DNA, 25 bp, Homo sapien
atggtttcctgattgtgtcaatgtg

SEQ ID NO: 150268 - DNA, 25 bp, Homo sapien
aaaaaggcagctgtgttatttcata

SEQ ID NO: 150269 - DNA, 25 bp, Homo sapien
acttgggagaaactgcatcctaagt

SEQ ID NO: 150270 - DNA, 25 bp, Homo sapien
gcatcctaagtggaagaactagttt

SEQ ID NO: 150271 - DNA, 25 bp, Homo sapien
gataaaaccaacatgctttttaagg

SEQ ID NO: 150272 - DNA, 25 bp, Homo sapien
aaaggagactttcttaagcaccata

SEQ ID NO: 150273 - DNA, 25 bp, Homo sapien
gagactttcttaagcaccatataga

SEQ ID NO: 150274 - DNA, 25 bp, Homo sapien
aagcatatgtgctactcatctttgc

SEQ ID NO: 150275 - DNA, 25 bp, Homo sapien
atgtgctactcatctttgctcacta

SEQ ID NO: 150276 - DNA, 25 bp, Homo sapien
tcatctttgctcactatgcagtctt

SEQ ID NO: 150277 - DNA, 25 bp, Homo sapien
tttgctcactatgcagtctttttta

SEQ ID NO: 150278 - DNA, 25 bp, Homo sapien
acattacttgagcatgacacttctt

SEQ ID NO: 150279 - DNA, 25 bp, Homo sapien
ggaccgcaggatatacgccaacatg

SEQ ID NO: 150280 - DNA, 25 bp, Homo sapien
tacgccaacatgttcaagaagtttg

SEQ ID NO: 150281 - DNA, 25 bp, Homo sapien
aagaggccaataaagcaatgggcaa

SEQ ID NO: 150282 - DNA, 25 bp, Homo sapien
agcaatgggcaagaagacttcagaa

SEQ ID NO: 150283 - DNA, 25 bp, Homo sapien
gaacagacagtcaagcaatggaaga

SEQ ID NO: 150284 - DNA, 25 bp, Homo sapien
agagaaacctgagggccacgtatga

SEQ ID NO: 150285 - DNA, 25 bp, Homo sapien
ctgagggccacgtatgacgccacgc

SEQ ID NO: 150286 - DNA, 25 bp, Homo sapien
gccacgccaaggagggaagagtccc

SEQ ID NO: 150287 - DNA, 25 bp, Homo sapien
ggaagagtcccagtgaactcggccc

SEQ ID NO: 150288 - DNA, 25 bp, Homo sapien
ccaactcaggacagaacagtgttta

SEQ ID NO: 150289 - DNA, 25 bp, Homo sapien
atagtctatgtgattctggaagcaa

SEQ ID NO: 150290 - DNA, 25 bp, Homo sapien
tgagccaggctaacgggaccccaag

SEQ ID NO: 150291 - DNA, 25 bp, Homo sapien
aacgggaccccaagcatcctgctgg

SEQ ID NO: 150292 - DNA, 25 bp, Homo sapien
gagccttgatggaagccctgatcca

SEQ ID NO: 150293 - DNA, 25 bp, Homo sapien
acagcatgggacctgacaccccgga

SEQ ID NO: 150294 - DNA, 25 bp, Homo sapien
atgtccatcgactcagccaccagtg

SEQ ID NO: 150295 - DNA, 25 bp, Homo sapien
tgacaccacgctggacacgacaggg

SEQ ID NO: 150296 - DNA, 25 bp, Homo sapien
atgtgaaggatttcctgggctcctc

SEQ ID NO: 150297 - DNA, 25 bp, Homo sapien
gaagaacctgaggaacctggcagaa

SEQ ID NO: 150298 - DNA, 25 bp, Homo sapien
tggcagaagacgaggcccacgcctg

SEQ ID NO: 150299 - DNA, 25 bp, Homo sapien
cacgcctgttgcatctgatcaatga

SEQ ID NO: 150300 - DNA, 25 bp, Homo sapien
gcctgttgcatctgatcaatgagga

SEQ ID NO: 150301 - DNA, 25 bp, Homo sapien
aggatgctgtggagttgcaccttct

SEQ ID NO: 150302 - DNA, 25 bp, Homo sapien
ggaagccaacagtgccatcatgtat

SEQ ID NO: 150303 - DNA, 25 bp, Homo sapien
cagatgcagcctcaggaccagctga

SEQ ID NO: 150304 - DNA, 25 bp, Homo sapien
ggaccagctgaatgtgagttcctcc

SEQ ID NO: 150305 - DNA, 25 bp, Homo sapien
gttcctcctcttgaaggcctactgt

SEQ ID NO: 150306 - DNA, 25 bp, Homo sapien
ttgaaggcctactgtcatccacaaa

SEQ ID NO: 150307 - DNA, 25 bp, Homo sapien
tactgtcatccacaaagctcctttt

SEQ ID NO: 150308 - DNA, 25 bp, Homo sapien
cacaaagctccttttttacgggcat

SEQ ID NO: 150309 - DNA, 25 bp, Homo sapien
acgggcatcccatttaatattcgag

SEQ ID NO: 150310 - DNA, 25 bp, Homo sapien
gagattacggtgagcctttcaggaa

SEQ ID NO: 150311 - DNA, 25 bp, Homo sapien
gaagcaatgtggttggacctggtta

SEQ ID NO: 150312 - DNA, 25 bp, Homo sapien
cttcagtgatgtggctcagctcagc

SEQ ID NO: 150313 - DNA, 25 bp, Homo sapien
tcagtgatgtggctcagctcagcct

SEQ ID NO: 150314 - DNA, 25 bp, Homo sapien
cagtgatgtggctcagctcagccta

SEQ ID NO: 150315 - DNA, 25 bp, Homo sapien
agtgatgtggctcagctcagcctag

SEQ ID NO: 150316 - DNA, 25 bp, Homo sapien
tgatgtggctcagctcagcctagaa

SEQ ID NO: 150317 - DNA, 25 bp, Homo sapien
gatgtggctcagctcagcctagaag

SEQ ID NO: 150318 - DNA, 25 bp, Homo sapien
atgtggctcagctcagcctagaaga

SEQ ID NO: 150319 - DNA, 25 bp, Homo sapien
tgtggctcagctcagcctagaagac

SEQ ID NO: 150320 - DNA, 25 bp, Homo sapien
tggctcagctcagcctagaagacct

SEQ ID NO: 150321 - DNA, 25 bp, Homo sapien
gctcagctcagcctagaagacctgc

SEQ ID NO: 150322 - DNA, 25 bp, Homo sapien
agctcagcctagaagacctgcctgc

SEQ ID NO: 150323 - DNA, 25 bp, Homo sapien
aatccgtgaagatcccaagttcctg

SEQ ID NO: 150324 - DNA, 25 bp, Homo sapien
gatcccaagttcctgataaccaatt

SEQ ID NO: 150325 - DNA, 25 bp, Homo sapien
tgataaccaattaccaaggagtcct

SEQ ID NO: 150326 - DNA, 25 bp, Homo sapien
aaggagtcctgacgctgaacatccg

SEQ ID NO: 150327 - DNA, 25 bp, Homo sapien
ttcgacgctgggacttacacctgcc

SEQ ID NO: 150328 - DNA, 25 bp, Homo sapien
gggacttacacctgccgggccgtca

SEQ ID NO: 150329 - DNA, 25 bp, Homo sapien
agtgcaagctggaggtccgagtgcc

SEQ ID NO: 150330 - DNA, 25 bp, Homo sapien
tccgagtgccgcagtgagacctgtc

SEQ ID NO: 150331 - DNA, 25 bp, Homo sapien
cctacctgccaagacaattggtggt

SEQ ID NO: 150332 - DNA, 25 bp, Homo sapien
aattggtggtggagtcctgacccca

SEQ ID NO: 150333 - DNA, 25 bp, Homo sapien
ggtggtggagtcctgaccccaatcc

SEQ ID NO: 150334 - DNA, 25 bp, Homo sapien
ttggcctggattgttggacgagttc

SEQ ID NO: 150335 - DNA, 25 bp, Homo sapien
ttgttggacgagttctttatgctta

SEQ ID NO: 150336 - DNA, 25 bp, Homo sapien
gctattacacgggagaacccagcaa

SEQ ID NO: 150337 - DNA, 25 bp, Homo sapien
agaacccagcaagcgtagtcgagga

SEQ ID NO: 150338 - DNA, 25 bp, Homo sapien
cagcaagcgtagtcgaggagccctg

SEQ ID NO: 150339 - DNA, 25 bp, Homo sapien
tgggcacaactgtgtgctctgcttt

SEQ ID NO: 150340 - DNA, 25 bp, Homo sapien
aactgtgtgctctgctttccagcat

SEQ ID NO: 150341 - DNA, 25 bp, Homo sapien
gctttccagcatcttggttgggtta

SEQ ID NO: 150342 - DNA, 25 bp, Homo sapien
ttaaaagtggcttgggcagtggacc

SEQ ID NO: 150343 - DNA, 25 bp, Homo sapien
cagtggacccaaatgctgccattaa

SEQ ID NO: 150344 - DNA, 25 bp, Homo sapien
aaaaacttacctggcatcagcctca

SEQ ID NO: 150345 - DNA, 25 bp, Homo sapien
tgagccaggctaacgggaccccaag

SEQ ID NO: 150346 - DNA, 25 bp, Homo sapien
aggctaacgggaccccaagcatcct

SEQ ID NO: 150347 - DNA, 25 bp, Homo sapien
aacgggaccccaagcatcctgctgg

SEQ ID NO: 150348 - DNA, 25 bp, Homo sapien
gaagccctgatccagcccacagcat

SEQ ID NO: 150349 - DNA, 25 bp, Homo sapien
agcatgggacctgacaccccggagc

SEQ ID NO: 150350 - DNA, 25 bp, Homo sapien
ggagccacccgaggctgcactctca

SEQ ID NO: 150351 - DNA, 25 bp, Homo sapien
atgtccatcgactcagccaccagtg

SEQ ID NO: 150352 - DNA, 25 bp, Homo sapien
atcgactcagccaccagtgctgaca

SEQ ID NO: 150353 - DNA, 25 bp, Homo sapien
agatgtgaaggatttcctgggctcc

SEQ ID NO: 150354 - DNA, 25 bp, Homo sapien
ggctcctctgaggagtcagagaaga

SEQ ID NO: 150355 - DNA, 25 bp, Homo sapien
tggcagaagacgaggcccacgcctg

SEQ ID NO: 150356 - DNA, 25 bp, Homo sapien
cgtgagatcaccacgctggtgagcc

SEQ ID NO: 150357 - DNA, 25 bp, Homo sapien
atgagcccaagaagtggcccatctc

SEQ ID NO: 150358 - DNA, 25 bp, Homo sapien
agaagtggcccatctcgggtgtcct

SEQ ID NO: 150359 - DNA, 25 bp, Homo sapien
actccggccagctggtgtggtacat

SEQ ID NO: 150360 - DNA, 25 bp, Homo sapien
tgtggtacatggactacgacgcctt

SEQ ID NO: 150361 - DNA, 25 bp, Homo sapien
actacgacgccttcctgggatgagg

SEQ ID NO: 150362 - DNA, 25 bp, Homo sapien
gatgagggcgcctgtgccccttgcc

SEQ ID NO: 150363 - DNA, 25 bp, Homo sapien
tgtgctttccttcgcccgtgtcttc

SEQ ID NO: 150364 - DNA, 25 bp, Homo sapien
tatcccacagtcaggccccagagag

SEQ ID NO: 150365 - DNA, 25 bp, Homo sapien
agggcaggacaagccttgtcccgat

SEQ ID NO: 150366 - DNA, 25 bp, Homo sapien
ttgtcccgatgcctttgaccggcag

SEQ ID NO: 150367 - DNA, 25 bp, Homo sapien
gttcctcctcttgaaggcctactgt

SEQ ID NO: 150368 - DNA, 25 bp, Homo sapien
tcttgaaggcctactgtcatccaca

SEQ ID NO: 150369 - DNA, 25 bp, Homo sapien
ttgaaggcctactgtcatccacaaa

SEQ ID NO: 150370 - DNA, 25 bp, Homo sapien
gaaggcctactgtcatccacaaagc

SEQ ID NO: 150371 - DNA, 25 bp, Homo sapien
tactgtcatccacaaagctcctttt

SEQ ID NO: 150372 - DNA, 25 bp, Homo sapien
gtcatccacaaagctccttttttac

SEQ ID NO: 150373 - DNA, 25 bp, Homo sapien
catccacaaagctccttttttacgg

SEQ ID NO: 150374 - DNA, 25 bp, Homo sapien
cacaaagctccttttttacgggcat

SEQ ID NO: 150375 - DNA, 25 bp, Homo sapien
acgggcatcccatttaatattcgag

SEQ ID NO: 150376 - DNA, 25 bp, Homo sapien
gggcatcccatttaatattcgagat

SEQ ID NO: 150377 - DNA, 25 bp, Homo sapien
cccatttaatattcgagattacggt

SEQ ID NO: 150378 - DNA, 25 bp, Homo sapien
acgcctccttttctgaccttcaaag

SEQ ID NO: 150379 - DNA, 25 bp, Homo sapien
tgaccttcaaagtcccctgtagaga

SEQ ID NO: 150380 - DNA, 25 bp, Homo sapien
aagtcccctgtagagaccatgcatg

SEQ ID NO: 150381 - DNA, 25 bp, Homo sapien
gagaccatgcatgctctaagcctta

SEQ ID NO: 150382 - DNA, 25 bp, Homo sapien
ccatgcatgctctaagccttaggga

SEQ ID NO: 150383 - DNA, 25 bp, Homo sapien
agccttagggagtgagaccaacacc

SEQ ID NO: 150384 - DNA, 25 bp, Homo sapien
gggcttgtcttatgtttccatctgt

SEQ ID NO: 150385 - DNA, 25 bp, Homo sapien
catctgttttcttcgtggcattcaa

SEQ ID NO: 150386 - DNA, 25 bp, Homo sapien
cttcgtggcattcaatttcattttt

SEQ ID NO: 150387 - DNA, 25 bp, Homo sapien
tagccaaataacaaatgtgccatgt

SEQ ID NO: 150388 - DNA, 25 bp, Homo sapien
aaatgtgccatgtaaaagtaagtct

SEQ ID NO: 150389 - DNA, 25 bp, Homo sapien
tggtgtgcacattgagccccggtat

SEQ ID NO: 150390 - DNA, 25 bp, Homo sapien
attgagccccggtatagacagttcc

SEQ ID NO: 150391 - DNA, 25 bp, Homo sapien
agatcccaggtgttccagagcgagt

SEQ ID NO: 150392 - DNA, 25 bp, Homo sapien
aggtgttccagagcgagttcttcag

SEQ ID NO: 150393 - DNA, 25 bp, Homo sapien
tccagagcgagttcttcagcggact

SEQ ID NO: 150394 - DNA, 25 bp, Homo sapien
agcggactcatgtggttctggattc

SEQ ID NO: 150395 - DNA, 25 bp, Homo sapien
catgtggttctggattctctggcgc

SEQ ID NO: 150396 - DNA, 25 bp, Homo sapien
ttctggattctctggcgcttttggc

SEQ ID NO: 150397 - DNA, 25 bp, Homo sapien
ggcgcttttggcatgactcagaaga

SEQ ID NO: 150398 - DNA, 25 bp, Homo sapien
agaagaggtgctgggtcactttccg

SEQ ID NO: 150399 - DNA, 25 bp, Homo sapien
tgaagaattaggtatccctcctgat

SEQ ID NO: 150400 - DNA, 25 bp, Homo sapien
tacctgtttatctgttaactattat

SEQ ID NO: 150401 - DNA, 25 bp, Homo sapien
gtttatctgttaactattatccaaa

SEQ ID NO: 150402 - DNA, 25 bp, Homo sapien
aattaaatactgtggttgcctctat

SEQ ID NO: 150403 - DNA, 25 bp, Homo sapien
aaatactgtggttgcctctatgtgc

SEQ ID NO: 150404 - DNA, 25 bp, Homo sapien
aatactgtggttgcctctatgtgct

SEQ ID NO: 150405 - DNA, 25 bp, Homo sapien
actgtggttgcctctatgtgctgtt

SEQ ID NO: 150406 - DNA, 25 bp, Homo sapien
tggttgcctctatgtgctgtttttc

SEQ ID NO: 150407 - DNA, 25 bp, Homo sapien
gttgcctctatgtgctgtttttcct

SEQ ID NO: 150408 - DNA, 25 bp, Homo sapien
tgtgctgtttttcctcatacaagta

SEQ ID NO: 150409 - DNA, 25 bp, Homo sapien
gtgctgtttttcctcatacaagtaa

SEQ ID NO: 150410 - DNA, 25 bp, Homo sapien
gctgtttttcctcatacaagtaaac

SEQ ID NO: 150411 - DNA, 25 bp, Homo sapien
gttccccacaaagcaccagaggtag

SEQ ID NO: 150412 - DNA, 25 bp, Homo sapien
aagcaccagaggtaggagacctgga

SEQ ID NO: 150413 - DNA, 25 bp, Homo sapien
gagacctggattcaagtgccagctc

SEQ ID NO: 150414 - DNA, 25 bp, Homo sapien
agccaggtcttcacacgtacaactc

SEQ ID NO: 150415 - DNA, 25 bp, Homo sapien
gtacaactccacgtgggtgcaacta

SEQ ID NO: 150416 - DNA, 25 bp, Homo sapien
actccacgtgggtgcaactagacct

SEQ ID NO: 150417 - DNA, 25 bp, Homo sapien
gccccaaggctacccagtattttat

SEQ ID NO: 150418 - DNA, 25 bp, Homo sapien
gctacccagtattttatcgtccaga

SEQ ID NO: 150419 - DNA, 25 bp, Homo sapien
agtattttatcgtccagacccatgg

SEQ ID NO: 150420 - DNA, 25 bp, Homo sapien
attttatcgtccagacccatggcag

SEQ ID NO: 150421 - DNA, 25 bp, Homo sapien
ggaggacaatggatactcagttttt

SEQ ID NO: 150422 - DNA, 25 bp, Homo sapien
tgatgtcggtcaaccacgaggagct

SEQ ID NO: 150423 - DNA, 25 bp, Homo sapien
ggagaggtctccaagtggcttcagc

SEQ ID NO: 150424 - DNA, 25 bp, Homo sapien
gagatgattatgtgttcggccccaa

SEQ ID NO: 150425 - DNA, 25 bp, Homo sapien
tgattatgtgttcggccccaatggg

SEQ ID NO: 150426 - DNA, 25 bp, Homo sapien
acctcgccgagggtgagacggacac

SEQ ID NO: 150427 - DNA, 25 bp, Homo sapien
agacggacacagacacggacccctt

SEQ ID NO: 150428 - DNA, 25 bp, Homo sapien
tttctgattcagtatggaccccttc

SEQ ID NO: 150429 - DNA, 25 bp, Homo sapien
attcagtatggaccccttccaataa

SEQ ID NO: 150430 - DNA, 25 bp, Homo sapien
ttccaataagcccatttaaaagagg

SEQ ID NO: 150431 - DNA, 25 bp, Homo sapien
ttaaaagaggtcactggctgacccc

SEQ ID NO: 150432 - DNA, 25 bp, Homo sapien
tgacccctccttgtaatgtagacag

SEQ ID NO: 150433 - DNA, 25 bp, Homo sapien
cattgagcccctacttcaagtactc

SEQ ID NO: 150434 - DNA, 25 bp, Homo sapien
ctacttcaagtactccgtcatgatc

SEQ ID NO: 150435 - DNA, 25 bp, Homo sapien
gtactccgtcatgatcaacaaggcc

SEQ ID NO: 150436 - DNA, 25 bp, Homo sapien
tcatgatcaacaaggccacgcccta

SEQ ID NO: 150437 - DNA, 25 bp, Homo sapien
cagtgcccgtccgtgatgatgggaa

SEQ ID NO: 150438 - DNA, 25 bp, Homo sapien
atgatgggaacatgcccgacgtgcc

SEQ ID NO: 150439 - DNA, 25 bp, Homo sapien
gtggctgaagaaactgtgagcacct

SEQ ID NO: 150440 - DNA, 25 bp, Homo sapien
gagcacctccactgacagaggcggc

SEQ ID NO: 150441 - DNA, 25 bp, Homo sapien
ttcctcaagaatgcctgggacaagg

SEQ ID NO: 150442 - DNA, 25 bp, Homo sapien
caaggagccagtgctggtcgtgtcc

SEQ ID NO: 150443 - DNA, 25 bp, Homo sapien
agtgctggtcgtgtccttcgtcgtc

SEQ ID NO: 150444 - DNA, 25 bp, Homo sapien
tgtgacccacagaacattgtaaatg

SEQ ID NO: 150445 - DNA, 25 bp, Homo sapien
aaagaattcttaacttcacaagtgt

SEQ ID NO: 150446 - DNA, 25 bp, Homo sapien
acttcacaagtgttttacttcgacg

SEQ ID NO: 150447 - DNA, 25 bp, Homo sapien
ttacttcgacgatgtgcctttgatt

SEQ ID NO: 150448 - DNA, 25 bp, Homo sapien
cgacgatgtgcctttgatttaattt

SEQ ID NO: 150449 - DNA, 25 bp, Homo sapien
aggatacattattcgtgtttgcaac

SEQ ID NO: 150450 - DNA, 25 bp, Homo sapien
tattcgtgtttgcaacggtctttga

SEQ ID NO: 150451 - DNA, 25 bp, Homo sapien
aggctgccccatcgtgtatataaat

SEQ ID NO: 150452 - DNA, 25 bp, Homo sapien
gtattcttacgtttactctgctttg

SEQ ID NO: 150453 - DNA, 25 bp, Homo sapien
ctctgctttgtagttgtggctgtac

SEQ ID NO: 150454 - DNA, 25 bp, Homo sapien
ttgtggctgtacttaaagcaataca

SEQ ID NO: 150455 - DNA, 25 bp, Homo sapien
gacagagtttgacagcagcctgccc

SEQ ID NO: 150456 - DNA, 25 bp, Homo sapien
ttggcacaggccaggtcatcaaggg

SEQ ID NO: 150457 - DNA, 25 bp, Homo sapien
gcacaggccaggtcatcaagggctg

SEQ ID NO: 150458 - DNA, 25 bp, Homo sapien
aaagcgcaagctggtgatcccatcc

SEQ ID NO: 150459 - DNA, 25 bp, Homo sapien
agcgcaagctggtgatcccatccga

SEQ ID NO: 150460 - DNA, 25 bp, Homo sapien
cgcaagctggtgatcccatccgagc

SEQ ID NO: 150461 - DNA, 25 bp, Homo sapien
ccccaaagattccaggcggtgcaac

SEQ ID NO: 150462 - DNA, 25 bp, Homo sapien
gtggagctgctcaaaatagagcgac

SEQ ID NO: 150463 - DNA, 25 bp, Homo sapien
gagctgctcaaaatagagcgacgaa

SEQ ID NO: 150464 - DNA, 25 bp, Homo sapien
aactgagctgtaaccagactgggag

SEQ ID NO: 150465 - DNA, 25 bp, Homo sapien
ccatcaggaccagactgttccaaaa

SEQ ID NO: 150466 - DNA, 25 bp, Homo sapien
gattctgtcctgcaggagtttatga

SEQ ID NO: 150467 - DNA, 25 bp, Homo sapien
ttctgtcctgcaggagtttatgaat

SEQ ID NO: 150468 - DNA, 25 bp, Homo sapien
acctgcttacaatggaatgtaaact

SEQ ID NO: 150469 - DNA, 25 bp, Homo sapien
gtaaactgcagctagccagtttctt

SEQ ID NO: 150470 - DNA, 25 bp, Homo sapien
aaactgcagctagccagtttctttc

SEQ ID NO: 150471 - DNA, 25 bp, Homo sapien
agtttctttcaagtatggcaagcta

SEQ ID NO: 150472 - DNA, 25 bp, Homo sapien
tctttcaagtatggcaagctaacgt

SEQ ID NO: 150473 - DNA, 25 bp, Homo sapien
gtatggcaagctaacgttaaaatgt

SEQ ID NO: 150474 - DNA, 25 bp, Homo sapien
agagattaacagatttcagaatgtc

SEQ ID NO: 150475 - DNA, 25 bp, Homo sapien
atgtctttctgcatattactgaaca

SEQ ID NO: 150476 - DNA, 25 bp, Homo sapien
tactgaacagaatagtcacaaaatg

SEQ ID NO: 150477 - DNA, 25 bp, Homo sapien
cagttgctagaggttttcattaaaa

SEQ ID NO: 150478 - DNA, 25 bp, Homo sapien
aagcagcaattctgttatatggaca

SEQ ID NO: 150479 - DNA, 25 bp, Homo sapien
acagtgttctgctttttaatcctat

SEQ ID NO: 150480 - DNA, 25 bp, Homo sapien
aatcctatttagcttgtttcagaaa

SEQ ID NO: 150481 - DNA, 25 bp, Homo sapien
gaaattctcacttttgttgactgcc

SEQ ID NO: 150482 - DNA, 25 bp, Homo sapien
gttgactgccaacatacaaagtaag

SEQ ID NO: 150483 - DNA, 25 bp, Homo sapien
taaaatctgcagagcctggttcaaa

SEQ ID NO: 150484 - DNA, 25 bp, Homo sapien
gcagagcctggttcaaaatcagtca

SEQ ID NO: 150485 - DNA, 25 bp, Homo sapien
aaatcagtcactcccttcagaagca

SEQ ID NO: 150486 - DNA, 25 bp, Homo sapien
aagcagacatggcatctgttccttg

SEQ ID NO: 150487 - DNA, 25 bp, Homo sapien
atctgttccttgcttgcttgttggt

SEQ ID NO: 150488 - DNA, 25 bp, Homo sapien
atcgggggccagggcacaacatctg

SEQ ID NO: 150489 - DNA, 25 bp, Homo sapien
acatccgcgtcatcaacggccgggc

SEQ ID NO: 150490 - DNA, 25 bp, Homo sapien
gaggcctaggctggccctaggacct

SEQ ID NO: 150491 - DNA, 25 bp, Homo sapien
taggctggccctaggaccttcttgg

SEQ ID NO: 150492 - DNA, 25 bp, Homo sapien
aggctggccctaggaccttcttggt

SEQ ID NO: 150493 - DNA, 25 bp, Homo sapien
ttggtttgctccttggattcccctt

SEQ ID NO: 150494 - DNA, 25 bp, Homo sapien
tggtttgctccttggattccccttc

SEQ ID NO: 150495 - DNA, 25 bp, Homo sapien
agccagcctggtacgcagatcccag

SEQ ID NO: 150496 - DNA, 25 bp, Homo sapien
cagcctggtacgcagatcccagaat

SEQ ID NO: 150497 - DNA, 25 bp, Homo sapien
gcctggtacgcagatcccagaataa

SEQ ID NO: 150498 - DNA, 25 bp, Homo sapien
tggtacgcagatcccagaataaagc

SEQ ID NO: 150499 - DNA, 25 bp, Homo sapien
tattatgaaactttcctttgtcatt

SEQ ID NO: 150500 - DNA, 25 bp, Homo sapien
attagtcttcaaaagcatgattttt

SEQ ID NO: 150501 - DNA, 25 bp, Homo sapien
taatagttgttgagtattccaccac

SEQ ID NO: 150502 - DNA, 25 bp, Homo sapien
agttgttgagtattccaccacagga

SEQ ID NO: 150503 - DNA, 25 bp, Homo sapien
tccaccacaggaatgtatcacaact

SEQ ID NO: 150504 - DNA, 25 bp, Homo sapien
atgtatcacaacttaaccgttcccg

SEQ ID NO: 150505 - DNA, 25 bp, Homo sapien
gttagactagtttcttattaatgtt

SEQ ID NO: 150506 - DNA, 25 bp, Homo sapien
taattttgttgctacatttacttta

SEQ ID NO: 150507 - DNA, 25 bp, Homo sapien
tttaatttccttgactgtaaagaga

SEQ ID NO: 150508 - DNA, 25 bp, Homo sapien
gaagtaattttgctccttgataaag

SEQ ID NO: 150509 - DNA, 25 bp, Homo sapien
attttgctccttgataaagtattat

SEQ ID NO: 150510 - DNA, 25 bp, Homo sapien
gcatttagaacctgttaaactagct

SEQ ID NO: 150511 - DNA, 25 bp, Homo sapien
gattgttttatctccaacgtgtgta

SEQ ID NO: 150512 - DNA, 25 bp, Homo sapien
atctccaacgtgtgtatctacagct

SEQ ID NO: 150513 - DNA, 25 bp, Homo sapien
aacgtgtgtatctacagcttttcaa

SEQ ID NO: 150514 - DNA, 25 bp, Homo sapien
atctctagcaatggtaaagttcagt

SEQ ID NO: 150515 - DNA, 25 bp, Homo sapien
gattcaatattagcttttcataaca

SEQ ID NO: 150516 - DNA, 25 bp, Homo sapien
tgatagtttcctaaccttttcataa

SEQ ID NO: 150517 - DNA, 25 bp, Homo sapien
tcataaccttttcataacatgatag

SEQ ID NO: 150518 - DNA, 25 bp, Homo sapien
agtttccataacagagacagcctaa

SEQ ID NO: 150519 - DNA, 25 bp, Homo sapien
cagcctaacaatgatgagttgtatt

SEQ ID NO: 150520 - DNA, 25 bp, Homo sapien
atggattaccattgtactaaataca

SEQ ID NO: 150521 - DNA, 25 bp, Homo sapien
ttttggtggatgtgttaccccgcac

SEQ ID NO: 150522 - DNA, 25 bp, Homo sapien
ccgcacacttcaatctcaactttgt

SEQ ID NO: 150523 - DNA, 25 bp, Homo sapien
atctcaactttgtgcaccgtccatt

SEQ ID NO: 150524 - DNA, 25 bp, Homo sapien
gtgcaccgtccattttctagggata

SEQ ID NO: 150525 - DNA, 25 bp, Homo sapien
attttctagggatagacgcccaggg

SEQ ID NO: 150526 - DNA, 25 bp, Homo sapien
gacgcccagggaatgaactctagtt

SEQ ID NO: 150527 - DNA, 25 bp, Homo sapien
gaactctagttttctaacagattag

SEQ ID NO: 150528 - DNA, 25 bp, Homo sapien
tattaacttactcacacggacaggt

SEQ ID NO: 150529 - DNA, 25 bp, Homo sapien
ggacaggttgatgccagagccgtaa

SEQ ID NO: 150530 - DNA, 25 bp, Homo sapien
gccagagccgtaagaatgcgccagt

SEQ ID NO: 150531 - DNA, 25 bp, Homo sapien
taagaatgcgccagtgcgggtttgc

SEQ ID NO: 150532 - DNA, 25 bp, Homo sapien
gcaggccaggcttgcaccagcatgt

SEQ ID NO: 150533 - DNA, 25 bp, Homo sapien
ccaggcttgcaccagcatgtcttga

SEQ ID NO: 150534 - DNA, 25 bp, Homo sapien
gcatgtcttgagttagaggacttaa

SEQ ID NO: 150535 - DNA, 25 bp, Homo sapien
agtttcttctgtgtttctacttgaa

SEQ ID NO: 150536 - DNA, 25 bp, Homo sapien
ttctacttgaattgtggaaaagctc

SEQ ID NO: 150537 - DNA, 25 bp, Homo sapien
gaaaagctctattatccaattaact

SEQ ID NO: 150538 - DNA, 25 bp, Homo sapien
ctattatccaattaacttctccata

SEQ ID NO: 150539 - DNA, 25 bp, Homo sapien
aacatggttcacataactagcttgt

SEQ ID NO: 150540 - DNA, 25 bp, Homo sapien
actagcttgtggaaaccagcaggta

SEQ ID NO: 150541 - DNA, 25 bp, Homo sapien
gaattcttaagttgacgcttttggt

SEQ ID NO: 150542 - DNA, 25 bp, Homo sapien
ttaagttgacgcttttggttctgtt

SEQ ID NO: 150543 - DNA, 25 bp, Homo sapien
taattgcatcagttcattgacctca

SEQ ID NO: 150544 - DNA, 25 bp, Homo sapien
gcatcagttcattgacctcatcatt

SEQ ID NO: 150545 - DNA, 25 bp, Homo sapien
gttcattgacctcatcattaataag

SEQ ID NO: 150546 - DNA, 25 bp, Homo sapien
aataaaatattcactctccattaga

SEQ ID NO: 150547 - DNA, 25 bp, Homo sapien
ttcactctccattagaaaattttgt

SEQ ID NO: 150548 - DNA, 25 bp, Homo sapien
atgccatgaacaaattctttagtac

SEQ ID NO: 150549 - DNA, 25 bp, Homo sapien
tctttagtactcaatgtttctggac

SEQ ID NO: 150550 - DNA, 25 bp, Homo sapien
actcaatgtttctggacattctctt

SEQ ID NO: 150551 - DNA, 25 bp, Homo sapien
gatatgttgatcagccttatgtgga

SEQ ID NO: 150552 - DNA, 25 bp, Homo sapien
gttgatcagccttatgtggaagaac

SEQ ID NO: 150553 - DNA, 25 bp, Homo sapien
agccttatgtggaagaactgtgata

SEQ ID NO: 150554 - DNA, 25 bp, Homo sapien
gtacaagaagactcacggcggcttt

SEQ ID NO: 150555 - DNA, 25 bp, Homo sapien
ctcacggcggctttggtttattgtg

SEQ ID NO: 150556 - DNA, 25 bp, Homo sapien
atcagtgtggcctgccggataagcc

SEQ ID NO: 150557 - DNA, 25 bp, Homo sapien
gccggataagccaggagtgtatact

SEQ ID NO: 150558 - DNA, 25 bp, Homo sapien
tgtatactcgagtgacagcctacct

SEQ ID NO: 150559 - DNA, 25 bp, Homo sapien
gtgacagcctaccttgactggatta

SEQ ID NO: 150560 - DNA, 25 bp, Homo sapien
aactgggatctagtgcaacaagtgc

SEQ ID NO: 150561 - DNA, 25 bp, Homo sapien
agtgcatccctgttgcaaagtctgt

SEQ ID NO: 150562 - DNA, 25 bp, Homo sapien
aaagtctgtatgcaggtgtgcctgt

SEQ ID NO: 150563 - DNA, 25 bp, Homo sapien
aggtgtgcctgtcttaaattccaaa

SEQ ID NO: 150564 - DNA, 25 bp, Homo sapien
attccaaagctttacatttcaactg

SEQ ID NO: 150565 - DNA, 25 bp, Homo sapien
tgaccttaggcaggacttctcttct

SEQ ID NO: 150566 - DNA, 25 bp, Homo sapien
ggacttctcttctgagctggtagaa

SEQ ID NO: 150567 - DNA, 25 bp, Homo sapien
gtagaagcagtgtgatccagggatt

SEQ ID NO: 150568 - DNA, 25 bp, Homo sapien
gatccagggattactggcctccaga

SEQ ID NO: 150569 - DNA, 25 bp, Homo sapien
tactggcctccagagtcttcaagat

SEQ ID NO: 150570 - DNA, 25 bp, Homo sapien
gaattccttgtaactggagctcgga

SEQ ID NO: 150571 - DNA, 25 bp, Homo sapien
gagctgcaccgagggcaaccaggac

SEQ ID NO: 150572 - DNA, 25 bp, Homo sapien
gacagctgtgtgtgcagacctcatg

SEQ ID NO: 150573 - DNA, 25 bp, Homo sapien
agacctcatgtgttgggttctctcc

SEQ ID NO: 150574 - DNA, 25 bp, Homo sapien
cttcctgttcctcttatataccagt

SEQ ID NO: 150575 - DNA, 25 bp, Homo sapien
gctgcaatgcagctggtgctgttca

SEQ ID NO: 150576 - DNA, 25 bp, Homo sapien
tacacaagaaagaccatattagaat

SEQ ID NO: 150577 - DNA, 25 bp, Homo sapien
ggaaaacatgcatattcacattaat

SEQ ID NO: 150578 - DNA, 25 bp, Homo sapien
atcgatcagatttttccagaattcc

SEQ ID NO: 150579 - DNA, 25 bp, Homo sapien
gatttttccagaattccgtatcagt

SEQ ID NO: 150580 - DNA, 25 bp, Homo sapien
ttccagaattccgtatcagtcacca

SEQ ID NO: 150581 - DNA, 25 bp, Homo sapien
gaattccgtatcagtcaccatttta

SEQ ID NO: 150582 - DNA, 25 bp, Homo sapien
gggacaatgaagacaagcacacagg

SEQ ID NO: 150583 - DNA, 25 bp, Homo sapien
agcacacaggaggtagaatatcaga

SEQ ID NO: 150584 - DNA, 25 bp, Homo sapien
taagtcatctgacattaaatcattt

SEQ ID NO: 150585 - DNA, 25 bp, Homo sapien
cattaaatcatttagccactaagtt

SEQ ID NO: 150586 - DNA, 25 bp, Homo sapien
tactctcactttaaactcaccaaag

SEQ ID NO: 150587 - DNA, 25 bp, Homo sapien
gacccttgggacaccaacgagtgcc

SEQ ID NO: 150588 - DNA, 25 bp, Homo sapien
accgagtttgcggtgcgctctggac

SEQ ID NO: 150589 - DNA, 25 bp, Homo sapien
gctctggactgctcacggtcatggt

SEQ ID NO: 150590 - DNA, 25 bp, Homo sapien
ggtgtgggtgtccagcatcttcttc

SEQ ID NO: 150591 - DNA, 25 bp, Homo sapien
gcatcttcttcttccttcctgtctt

SEQ ID NO: 150592 - DNA, 25 bp, Homo sapien
tctgtctcacggtcctctacagtct

SEQ ID NO: 150593 - DNA, 25 bp, Homo sapien
tctacagtctcatcggcaggaagct

SEQ ID NO: 150594 - DNA, 25 bp, Homo sapien
agtctcatcggcaggaagctgtggc

SEQ ID NO: 150595 - DNA, 25 bp, Homo sapien
atgctgtcgtgggtgcctcgctcag

SEQ ID NO: 150596 - DNA, 25 bp, Homo sapien
tgggtgcctcgctcagggaccagaa

SEQ ID NO: 150597 - DNA, 25 bp, Homo sapien
gggaccagaaccacaagcaaaccgt

SEQ ID NO: 150598 - DNA, 25 bp, Homo sapien
atgggtgatggaacttggaagatat

SEQ ID NO: 150599 - DNA, 25 bp, Homo sapien
ttaaaagtccttacatcccaaattg

SEQ ID NO: 150600 - DNA, 25 bp, Homo sapien
gtccttacatcccaaattgtgttta

SEQ ID NO: 150601 - DNA, 25 bp, Homo sapien
ttggctataagattttgtgtaattt

SEQ ID NO: 150602 - DNA, 25 bp, Homo sapien
tctagaatttttaaaagccactttg

SEQ ID NO: 150603 - DNA, 25 bp, Homo sapien
aattatgtaagcaaggagcctgtta

SEQ ID NO: 150604 - DNA, 25 bp, Homo sapien
gagcctgttagtttatagatcatgc

SEQ ID NO: 150605 - DNA, 25 bp, Homo sapien
gttagtttatagatcatgccttcaa

SEQ ID NO: 150606 - DNA, 25 bp, Homo sapien
agatcatgccttcaaacctctagag

SEQ ID NO: 150607 - DNA, 25 bp, Homo sapien
catgccttcaaacctctagagttaa

SEQ ID NO: 150608 - DNA, 25 bp, Homo sapien
cctctagagttaatttgggtgactt

SEQ ID NO: 150609 - DNA, 25 bp, Homo sapien
aggtctctttctttactctgggtca

SEQ ID NO: 150610 - DNA, 25 bp, Homo sapien
gagccatgctcagaatgtctggtcc

SEQ ID NO: 150611 - DNA, 25 bp, Homo sapien
aatgtctggtcctggcttgggcctg

SEQ ID NO: 150612 - DNA, 25 bp, Homo sapien
agagagggcctttcatggctgatca

SEQ ID NO: 150613 - DNA, 25 bp, Homo sapien
ttcatggctgatcagagcttaccag

SEQ ID NO: 150614 - DNA, 25 bp, Homo sapien
accatggtagccttagggtgctgag

SEQ ID NO: 150615 - DNA, 25 bp, Homo sapien
agggtgctgagtgcctgatactgcc

SEQ ID NO: 150616 - DNA, 25 bp, Homo sapien
tgatactgcctgacaagtgcctgac

SEQ ID NO: 150617 - DNA, 25 bp, Homo sapien
aagtgcctgacacgcagcctagttc

SEQ ID NO: 150618 - DNA, 25 bp, Homo sapien
gggaaaccctagaccatgtcagata

SEQ ID NO: 150619 - DNA, 25 bp, Homo sapien
aggacaacactgctgggttttacat

SEQ ID NO: 150620 - DNA, 25 bp, Homo sapien
tcggacatataatttcacccaggat

SEQ ID NO: 150621 - DNA, 25 bp, Homo sapien
cacccaggatagagtcagtgaccac

SEQ ID NO: 150622 - DNA, 25 bp, Homo sapien
gtcagtgaccacaggatagcatatg

SEQ ID NO: 150623 - DNA, 25 bp, Homo sapien
caggatagcatatgaagttcgtgat

SEQ ID NO: 150624 - DNA, 25 bp, Homo sapien
ggaagggcctggatcagctaattca

SEQ ID NO: 150625 - DNA, 25 bp, Homo sapien
ggatcagctaattcagagactgctt

SEQ ID NO: 150626 - DNA, 25 bp, Homo sapien
cagagactgcttcaatcagcagatg

SEQ ID NO: 150627 - DNA, 25 bp, Homo sapien
attgctgaacttttggatgaacacc

SEQ ID NO: 150628 - DNA, 25 bp, Homo sapien
ggatgaacaccttaaatcagcaaaa

SEQ ID NO: 150629 - DNA, 25 bp, Homo sapien
atggacctatatcaagaggcagact

SEQ ID NO: 150630 - DNA, 25 bp, Homo sapien
ggcagactgaagcttggaaatcatt

SEQ ID NO: 150631 - DNA, 25 bp, Homo sapien
aaacctgttttactactatggcact

SEQ ID NO: 150632 - DNA, 25 bp, Homo sapien
ggtcaggaaccaactttactggcaa

SEQ ID NO: 150633 - DNA, 25 bp, Homo sapien
ggcaaaagggtccatgtaccaccat

SEQ ID NO: 150634 - DNA, 25 bp, Homo sapien
atgtaccaccatgtgctggagcatc

SEQ ID NO: 150635 - DNA, 25 bp, Homo sapien
gtgctggagcatctgttctacatgt

SEQ ID NO: 150636 - DNA, 25 bp, Homo sapien
gcatctgttctacatgtggatatct

SEQ ID NO: 150637 - DNA, 25 bp, Homo sapien
aatgttttccttcatgtaagtgcct

SEQ ID NO: 150638 - DNA, 25 bp, Homo sapien
catgtaagtgcctattcagagtttc

SEQ ID NO: 150639 - DNA, 25 bp, Homo sapien
atggtcatttgcatgtagtaagcca

SEQ ID NO: 150640 - DNA, 25 bp, Homo sapien
aaccaattgtatttaaccagcctca

SEQ ID NO: 150641 - DNA, 25 bp, Homo sapien
accagcctcaaattgtgcaaccatg

SEQ ID NO: 150642 - DNA, 25 bp, Homo sapien
catgcccagctactaaaaatacttg

SEQ ID NO: 150643 - DNA, 25 bp, Homo sapien
gcccagctactaaaaatacttgtat

SEQ ID NO: 150644 - DNA, 25 bp, Homo sapien
ggagaaaagatatcacaactctatg

SEQ ID NO: 150645 - DNA, 25 bp, Homo sapien
aaaagatatcacaactctatggaaa

SEQ ID NO: 150646 - DNA, 25 bp, Homo sapien
ggaaaatgacatttccatttgcctt

SEQ ID NO: 150647 - DNA, 25 bp, Homo sapien
atgacatttccatttgccttattgc

SEQ ID NO: 150648 - DNA, 25 bp, Homo sapien
tgacatttccatttgccttattgct

SEQ ID NO: 150649 - DNA, 25 bp, Homo sapien
gacatttccatttgccttattgcta

SEQ ID NO: 150650 - DNA, 25 bp, Homo sapien
acatttccatttgccttattgctac

SEQ ID NO: 150651 - DNA, 25 bp, Homo sapien
atttccatttgccttattgctactt

SEQ ID NO: 150652 - DNA, 25 bp, Homo sapien
ttccatttgccttattgctacttca

SEQ ID NO: 150653 - DNA, 25 bp, Homo sapien
agtgaaaattgtagcctgtgatggt

SEQ ID NO: 150654 - DNA, 25 bp, Homo sapien
atggtaaaaatactggctccaatac

SEQ ID NO: 150655 - DNA, 25 bp, Homo sapien
tggctccaatactacagaatgaata

SEQ ID NO: 150656 - DNA, 25 bp, Homo sapien
atgacttttttacaccatcttctgt

SEQ ID NO: 150657 - DNA, 25 bp, Homo sapien
caccatcttctgttattcattgctt

SEQ ID NO: 150658 - DNA, 25 bp, Homo sapien
ctgttattcattgcttttgaagaga

SEQ ID NO: 150659 - DNA, 25 bp, Homo sapien
tgtgctataccagagaattccagta

SEQ ID NO: 150660 - DNA, 25 bp, Homo sapien
gaaacttgtaactctgtagcctctt

SEQ ID NO: 150661 - DNA, 25 bp, Homo sapien
gtagcctcttacatcacctttatta

SEQ ID NO: 150662 - DNA, 25 bp, Homo sapien
gcctcttacatcacctttattatac

SEQ ID NO: 150663 - DNA, 25 bp, Homo sapien
atcacctttattatacagcatgaaa

SEQ ID NO: 150664 - DNA, 25 bp, Homo sapien
tcttggttattctgccataacagat

SEQ ID NO: 150665 - DNA, 25 bp, Homo sapien
ttgtagattcagtggttcaatacct

SEQ ID NO: 150666 - DNA, 25 bp, Homo sapien
gttcaatacctgtttagttgcttgc

SEQ ID NO: 150667 - DNA, 25 bp, Homo sapien
ttagttgcttgctaatatttccaga

SEQ ID NO: 150668 - DNA, 25 bp, Homo sapien
cagaaggatttcttgtattggtgaa

SEQ ID NO: 150669 - DNA, 25 bp, Homo sapien
tgttcttgttgtacccttgttttga

SEQ ID NO: 150670 - DNA, 25 bp, Homo sapien
tgttgtacccttgttttgaaactag

SEQ ID NO: 150671 - DNA, 25 bp, Homo sapien
gaaactagaaatctgtcctgtggca

SEQ ID NO: 150672 - DNA, 25 bp, Homo sapien
aaatctgtcctgtggcatgcaaaag

SEQ ID NO: 150673 - DNA, 25 bp, Homo sapien
gtacttttggtgtcattattccatc

SEQ ID NO: 150674 - DNA, 25 bp, Homo sapien
attattccatcttctccataagtgg

SEQ ID NO: 150675 - DNA, 25 bp, Homo sapien
gggcccgggcgctgtatgactttga

SEQ ID NO: 150676 - DNA, 25 bp, Homo sapien
gtggaggtcctggatagctccaacc

SEQ ID NO: 150677 - DNA, 25 bp, Homo sapien
atagctccaacccatcctggtggac

SEQ ID NO: 150678 - DNA, 25 bp, Homo sapien
gtggaccggccgcctgcacaacaag

SEQ ID NO: 150679 - DNA, 25 bp, Homo sapien
tacgtggcacccatgacccgataaa

SEQ ID NO: 150680 - DNA, 25 bp, Homo sapien
cccatgacccgataaactcttcagg

SEQ ID NO: 150681 - DNA, 25 bp, Homo sapien
accggcttgggcagtgaaatgaatg

SEQ ID NO: 150682 - DNA, 25 bp, Homo sapien
atgaatgcggccctcatgcatcgga

SEQ ID NO: 150683 - DNA, 25 bp, Homo sapien
atgcggccctcatgcatcggagaca

SEQ ID NO: 150684 - DNA, 25 bp, Homo sapien
ctcatgcatcggagacacacagacc

SEQ ID NO: 150685 - DNA, 25 bp, Homo sapien
agtgcagctccaggcggcagggcga

SEQ ID NO: 150686 - DNA, 25 bp, Homo sapien
aactatgcacacagcactcgctctt

SEQ ID NO: 150687 - DNA, 25 bp, Homo sapien
ctctgtccgggctactaggagtgag

SEQ ID NO: 150688 - DNA, 25 bp, Homo sapien
tgtccgggctactaggagtgagacc

SEQ ID NO: 150689 - DNA, 25 bp, Homo sapien
cgggctactaggagtgagaccagct

SEQ ID NO: 150690 - DNA, 25 bp, Homo sapien
gtgagaccagcttctggcaactgcc

SEQ ID NO: 150691 - DNA, 25 bp, Homo sapien
acccatctgtagctccctcaaagtc

SEQ ID NO: 150692 - DNA, 25 bp, Homo sapien
atggtcctgcttcatgctttgggtc

SEQ ID NO: 150693 - DNA, 25 bp, Homo sapien
ggtcctgcttcatgctttgggtcag

SEQ ID NO: 150694 - DNA, 25 bp, Homo sapien
gcttcatgctttgggtcaggaggcc

SEQ ID NO: 150695 - DNA, 25 bp, Homo sapien
gtcaggaggccaaagctgatgttca

SEQ ID NO: 150696 - DNA, 25 bp, Homo sapien
ggaggccaaagctgatgttcaggcc

SEQ ID NO: 150697 - DNA, 25 bp, Homo sapien
atttttctttttgtcgctgcacttc

SEQ ID NO: 150698 - DNA, 25 bp, Homo sapien
ctgcacttcctgtttagttccaagg

SEQ ID NO: 150699 - DNA, 25 bp, Homo sapien
tagttccaagggaaacactttctct

SEQ ID NO: 150700 - DNA, 25 bp, Homo sapien
cctgtgttggaaagtttttatgtat

SEQ ID NO: 150701 - DNA, 25 bp, Homo sapien
atttaaactacctaccatgcctgtt

SEQ ID NO: 150702 - DNA, 25 bp, Homo sapien
aactacctaccatgcctgttgtgct

SEQ ID NO: 150703 - DNA, 25 bp, Homo sapien
ctgttgtgctcaggtgtttgttcat

SEQ ID NO: 150704 - DNA, 25 bp, Homo sapien
tacctcaagtctgtgtgaccactca

SEQ ID NO: 150705 - DNA, 25 bp, Homo sapien
aagtctgtgtgaccactcacagccc

SEQ ID NO: 150706 - DNA, 25 bp, Homo sapien
tcccttcgccaaagcagtgtctatg

SEQ ID NO: 150707 - DNA, 25 bp, Homo sapien
cgccaaagcagtgtctatgctcttg

SEQ ID NO: 150708 - DNA, 25 bp, Homo sapien
gccattttaatcattgccatcgtgt

SEQ ID NO: 150709 - DNA, 25 bp, Homo sapien
taatcattgccatcgtgtgcttgtt

SEQ ID NO: 150710 - DNA, 25 bp, Homo sapien
cgtgtgcttgtttcatccagtgtta

SEQ ID NO: 150711 - DNA, 25 bp, Homo sapien
tcatccagtgttatgcactttccac

SEQ ID NO: 150712 - DNA, 25 bp, Homo sapien
ccacagttggtgttagtatagccag

SEQ ID NO: 150713 - DNA, 25 bp, Homo sapien
agccagagggtttcattattatttc

SEQ ID NO: 150714 - DNA, 25 bp, Homo sapien
tctttgctttctcaatgttaattta

SEQ ID NO: 150715 - DNA, 25 bp, Homo sapien
ttttctttacagctgaaattgcttt

SEQ ID NO: 150716 - DNA, 25 bp, Homo sapien
ataataccagattttaagccgcgga

SEQ ID NO: 150717 - DNA, 25 bp, Homo sapien
ttaagccgcggaaaatgttcttgat

SEQ ID NO: 150718 - DNA, 25 bp, Homo sapien
atgttcttgatcatttgcagttaag

SEQ ID NO: 150719 - DNA, 25 bp, Homo sapien
gagatcattaacatgccagggcagt

SEQ ID NO: 150720 - DNA, 25 bp, Homo sapien
cagggcagttcccactgatttagat

SEQ ID NO: 150721 - DNA, 25 bp, Homo sapien
gttcccactgatttagatggtccaa

SEQ ID NO: 150722 - DNA, 25 bp, Homo sapien
gatggtccaagataatctcattcag

SEQ ID NO: 150723 - DNA, 25 bp, Homo sapien
tctcattcaggaggcttgaaacatt

SEQ ID NO: 150724 - DNA, 25 bp, Homo sapien
aacagttctctgtcatcgtttaaca

SEQ ID NO: 150725 - DNA, 25 bp, Homo sapien
acaactgacacaactccttaagctg

SEQ ID NO: 150726 - DNA, 25 bp, Homo sapien
agctgtggtttcagtctctgctagt

SEQ ID NO: 150727 - DNA, 25 bp, Homo sapien
gtctctgctagttcatattgcatgt

SEQ ID NO: 150728 - DNA, 25 bp, Homo sapien
ttgcatgtttattttggacagtctt

SEQ ID NO: 150729 - DNA, 25 bp, Homo sapien
ttggacagtcttttgttaagcatgg

SEQ ID NO: 150730 - DNA, 25 bp, Homo sapien
atttcgtagagtgtttgcttcggca

SEQ ID NO: 150731 - DNA, 25 bp, Homo sapien
gtttgcttcggcagaaaacgatgag

SEQ ID NO: 150732 - DNA, 25 bp, Homo sapien
aaacgatgagacgtgcaggtaccat

SEQ ID NO: 150733 - DNA, 25 bp, Homo sapien
agacgtgcaggtaccatcaggaagc

SEQ ID NO: 150734 - DNA, 25 bp, Homo sapien
tcggccctgaacagagcagctgctg

SEQ ID NO: 150735 - DNA, 25 bp, Homo sapien
gctgctgatgtctggaggctgattt

SEQ ID NO: 150736 - DNA, 25 bp, Homo sapien
tgattttcctgttctctgttctcca

SEQ ID NO: 150737 - DNA, 25 bp, Homo sapien
tgttctctgttctccactggaaagg

SEQ ID NO: 150738 - DNA, 25 bp, Homo sapien
ttgtttacgacaaacctccttgtca

SEQ ID NO: 150739 - DNA, 25 bp, Homo sapien
caaacctccttgtcaaagtgtgtaa

SEQ ID NO: 150740 - DNA, 25 bp, Homo sapien
gtgtaaaaataaaggattgctccat

SEQ ID NO: 150741 - DNA, 25 bp, Homo sapien
acaagtttattgtcgaaagtctcac

SEQ ID NO: 150742 - DNA, 25 bp, Homo sapien
gaaagtctcacaccttcatcactat

SEQ ID NO: 150743 - DNA, 25 bp, Homo sapien
atcactatccttgatgcattcacct

SEQ ID NO: 150744 - DNA, 25 bp, Homo sapien
acctcccggcactcagaatataagt

SEQ ID NO: 150745 - DNA, 25 bp, Homo sapien
gtgagatcaacttgagtccaatgga

SEQ ID NO: 150746 - DNA, 25 bp, Homo sapien
gagtccaatggaaatcagcacattc

SEQ ID NO: 150747 - DNA, 25 bp, Homo sapien
agcacattccgaatccagttgaggt

SEQ ID NO: 150748 - DNA, 25 bp, Homo sapien
ccagttgaggtgaacctgactttca

SEQ ID NO: 150749 - DNA, 25 bp, Homo sapien
gaatcattggcttttatacctttct

SEQ ID NO: 150750 - DNA, 25 bp, Homo sapien
atacctttcttggtttgacgtgcaa

SEQ ID NO: 150751 - DNA, 25 bp, Homo sapien
tattttagcttctggctactgtgag

SEQ ID NO: 150752 - DNA, 25 bp, Homo sapien
tctggacagtcagctcttcatctgc

SEQ ID NO: 150753 - DNA, 25 bp, Homo sapien
ttcatctgcccaactgtgtagcatc

SEQ ID NO: 150754 - DNA, 25 bp, Homo sapien
aaggctgatgcaggatttgttctct

SEQ ID NO: 150755 - DNA, 25 bp, Homo sapien
agtcacttcggccagagctgaagag

SEQ ID NO: 150756 - DNA, 25 bp, Homo sapien
agagctgaagagttgccccgtctct

SEQ ID NO: 150757 - DNA, 25 bp, Homo sapien
ctcctttaagagctctggtgataag

SEQ ID NO: 150758 - DNA, 25 bp, Homo sapien
agagctctggtgataaggacatgat

SEQ ID NO: 150759 - DNA, 25 bp, Homo sapien
aggacatgatgcttttactgaactt

SEQ ID NO: 150760 - DNA, 25 bp, Homo sapien
gaactttcttatcctagcacatgct

SEQ ID NO: 150761 - DNA, 25 bp, Homo sapien
agcacatgcttcaatagttcaagga

SEQ ID NO: 150762 - DNA, 25 bp, Homo sapien
tctttactcctcacacttactgtaa

SEQ ID NO: 150763 - DNA, 25 bp, Homo sapien
gggcgattggctccaggccattaaa

SEQ ID NO: 150764 - DNA, 25 bp, Homo sapien
ggaccggtataaggataacttcaca

SEQ ID NO: 150765 - DNA, 25 bp, Homo sapien
ctggttataccacactagaggctgt

SEQ ID NO: 150766 - DNA, 25 bp, Homo sapien
tagaggctgtggtgcacgtgaacca

SEQ ID NO: 150767 - DNA, 25 bp, Homo sapien
gaattggtatcacagccatcacgca

SEQ ID NO: 150768 - DNA, 25 bp, Homo sapien
acagccatcacgcaccagaataaga

SEQ ID NO: 150769 - DNA, 25 bp, Homo sapien
gaataagattttgagcagtgtccag

SEQ ID NO: 150770 - DNA, 25 bp, Homo sapien
gtgtccaggcaatgcgaacccaaat

SEQ ID NO: 150771 - DNA, 25 bp, Homo sapien
atgcacggcagaatggttcccgtct

SEQ ID NO: 150772 - DNA, 25 bp, Homo sapien
gttcccgtctgagccagtactgaat

SEQ ID NO: 150773 - DNA, 25 bp, Homo sapien
aattagtttacctcatccatgcact

SEQ ID NO: 150774 - DNA, 25 bp, Homo sapien
gagtgaactcagctgtcatctgcag

SEQ ID NO: 150775 - DNA, 25 bp, Homo sapien
gaggcatccgtgtgccggccctgca

SEQ ID NO: 150776 - DNA, 25 bp, Homo sapien
cctgcccacggtcaggcattgaaaa

SEQ ID NO: 150777 - DNA, 25 bp, Homo sapien
ggcattgaaaactaagcccaaccac

SEQ ID NO: 150778 - DNA, 25 bp, Homo sapien
aagcccaaccactctgcactttgtt

SEQ ID NO: 150779 - DNA, 25 bp, Homo sapien
tgcactttgtttcccactcccatta

SEQ ID NO: 150780 - DNA, 25 bp, Homo sapien
cctcttttactaattagttggtcag

SEQ ID NO: 150781 - DNA, 25 bp, Homo sapien
ctaattagttggtcagtttggagag

SEQ ID NO: 150782 - DNA, 25 bp, Homo sapien
cagtttggagagttgactggcacca

SEQ ID NO: 150783 - DNA, 25 bp, Homo sapien
tgactggcaccatggagggtaggca

SEQ ID NO: 150784 - DNA, 25 bp, Homo sapien
atggaaaaacagaacaacagtggac

SEQ ID NO: 150785 - DNA, 25 bp, Homo sapien
gcccatctggctggtttggacaaga

SEQ ID NO: 150786 - DNA, 25 bp, Homo sapien
tgtctaagggacacatgttggcaga

SEQ ID NO: 150787 - DNA, 25 bp, Homo sapien
gacacatgttggcagatgtcgttgc

SEQ ID NO: 150788 - DNA, 25 bp, Homo sapien
atgtcgttgccatcataggtaccca

SEQ ID NO: 150789 - DNA, 25 bp, Homo sapien
gccatcataggtacccaagatattg

SEQ ID NO: 150790 - DNA, 25 bp, Homo sapien
tgcctatcagcttcttctgtggagc

SEQ ID NO: 150791 - DNA, 25 bp, Homo sapien
tgtggagcctgttcctcactggaaa

SEQ ID NO: 150792 - DNA, 25 bp, Homo sapien
tcactggaaattggcctctgtgtgt

SEQ ID NO: 150793 - DNA, 25 bp, Homo sapien
atgtacacttggctgtcaggctttc

SEQ ID NO: 150794 - DNA, 25 bp, Homo sapien
tcaggctttctgtgcatgtactaaa

SEQ ID NO: 150795 - DNA, 25 bp, Homo sapien
tataataaattagccgtcttgcgcc

SEQ ID NO: 150796 - DNA, 25 bp, Homo sapien
accagacttttctctagaagccgtc

SEQ ID NO: 150797 - DNA, 25 bp, Homo sapien
tagaagccgtctgcgtttactcttg

SEQ ID NO: 150798 - DNA, 25 bp, Homo sapien
gtctgcgtttactcttgttttcaaa

SEQ ID NO: 150799 - DNA, 25 bp, Homo sapien
gtaaaatcaaatcatcctgtcacaa

SEQ ID NO: 150800 - DNA, 25 bp, Homo sapien
aatcatcctgtcacaaggcaggagg

SEQ ID NO: 150801 - DNA, 25 bp, Homo sapien
ggagctgataatgaactttattgga

SEQ ID NO: 150802 - DNA, 25 bp, Homo sapien
ggagcattgatctgcatccaaggcc

SEQ ID NO: 150803 - DNA, 25 bp, Homo sapien
ttgatctgcatccaaggccttctca

SEQ ID NO: 150804 - DNA, 25 bp, Homo sapien
aaggccttctcaggccggcttgagt

SEQ ID NO: 150805 - DNA, 25 bp, Homo sapien
gccggcttgagtgaattgtgtacct

SEQ ID NO: 150806 - DNA, 25 bp, Homo sapien
gaattgtgtacctgaagtacagtat

SEQ ID NO: 150807 - DNA, 25 bp, Homo sapien
tgggcgaggcgcacctgagcatcat

SEQ ID NO: 150808 - DNA, 25 bp, Homo sapien
aacgccgtcaatgagggcacctaca

SEQ ID NO: 150809 - DNA, 25 bp, Homo sapien
caatgagggcacctacacctgcgtg

SEQ ID NO: 150810 - DNA, 25 bp, Homo sapien
cacctgcgtggtgcgccgccagcag

SEQ ID NO: 150811 - DNA, 25 bp, Homo sapien
gccagcagcgcgtgctgaccaccta

SEQ ID NO: 150812 - DNA, 25 bp, Homo sapien
agcagcgcgtgctgaccacctactc

SEQ ID NO: 150813 - DNA, 25 bp, Homo sapien
agcgcgtgctgaccacctactcctg

SEQ ID NO: 150814 - DNA, 25 bp, Homo sapien
tgctgaccacctactcctggcgagt

SEQ ID NO: 150815 - DNA, 25 bp, Homo sapien
ctactcctggcgagtccgtgtgcgg

SEQ ID NO: 150816 - DNA, 25 bp, Homo sapien
gtgaccttccgttgcggccagaaga

SEQ ID NO: 150817 - DNA, 25 bp, Homo sapien
ttgcggccagaagatcctccacaag

SEQ ID NO: 150818 - DNA, 25 bp, Homo sapien
acgtcagcctgtttgagctgagtga

SEQ ID NO: 150819 - DNA, 25 bp, Homo sapien
gggctggttttctatgaacgattcc

SEQ ID NO: 150820 - DNA, 25 bp, Homo sapien
ggttttctatgaacgattccggcct

SEQ ID NO: 150821 - DNA, 25 bp, Homo sapien
tctatgaacgattccggcctgggat

SEQ ID NO: 150822 - DNA, 25 bp, Homo sapien
tgcaggcggcatagttgggcccatt

SEQ ID NO: 150823 - DNA, 25 bp, Homo sapien
tagttgggcccattcgtcctggaaa

SEQ ID NO: 150824 - DNA, 25 bp, Homo sapien
ggcccattcgtcctggaaagggact

SEQ ID NO: 150825 - DNA, 25 bp, Homo sapien
cagtcggctctggttgttggcagct

SEQ ID NO: 150826 - DNA, 25 bp, Homo sapien
gggctgtttttgagcttctcattgt

SEQ ID NO: 150827 - DNA, 25 bp, Homo sapien
gagcttctcattgtgtagaatttct

SEQ ID NO: 150828 - DNA, 25 bp, Homo sapien
tgtagaatttctagatcccccgatt

SEQ ID NO: 150829 - DNA, 25 bp, Homo sapien
aaagtgtgcaacttcttggccagcc

SEQ ID NO: 150830 - DNA, 25 bp, Homo sapien
tgtgcaacttcttggccagccaagt

SEQ ID NO: 150831 - DNA, 25 bp, Homo sapien
gtgaccctgctgagtatgctcacct

SEQ ID NO: 150832 - DNA, 25 bp, Homo sapien
gagtatgctcacctcgtacaggcca

SEQ ID NO: 150833 - DNA, 25 bp, Homo sapien
tcgtacaggccatcatcgagaaccc

SEQ ID NO: 150834 - DNA, 25 bp, Homo sapien
tcatcgagaacccattcctcaatgg

SEQ ID NO: 150835 - DNA, 25 bp, Homo sapien
aacccattcctcaatggagaggtca

SEQ ID NO: 150836 - DNA, 25 bp, Homo sapien
gggccattcgtatgcagccttgaag

SEQ ID NO: 150837 - DNA, 25 bp, Homo sapien
aaggcagagaaaacacacgctcctc

SEQ ID NO: 150838 - DNA, 25 bp, Homo sapien
gaggaagcccagtagccattttgta

SEQ ID NO: 150839 - DNA, 25 bp, Homo sapien
taccagtcgccctctgtgcctaata

SEQ ID NO: 150840 - DNA, 25 bp, Homo sapien
tctataggtgtcttcagagttctga

SEQ ID NO: 150841 - DNA, 25 bp, Homo sapien
aaattactggacacagcttcagcta

SEQ ID NO: 150842 - DNA, 25 bp, Homo sapien
agcttcagctatacttacactgtat

SEQ ID NO: 150843 - DNA, 25 bp, Homo sapien
tacactgtattgaagtcacgtcatt

SEQ ID NO: 150844 - DNA, 25 bp, Homo sapien
gccagaactttctttcacggttact

SEQ ID NO: 150845 - DNA, 25 bp, Homo sapien
tcacggttactgttcctgaaaagaa

SEQ ID NO: 150846 - DNA, 25 bp, Homo sapien
ttctgcacctcggaaaaataccaac

SEQ ID NO: 150847 - DNA, 25 bp, Homo sapien
tacagactcaagtttcgctttggat

SEQ ID NO: 150848 - DNA, 25 bp, Homo sapien
tcttggccttgtgagaaaccattct

SEQ ID NO: 150849 - DNA, 25 bp, Homo sapien
gaaaccattctttcccctcaggagt

SEQ ID NO: 150850 - DNA, 25 bp, Homo sapien
ctttcccctcaggagtttctatagg

SEQ ID NO: 150851 - DNA, 25 bp, Homo sapien
gattatggcttcgagggacatcctt

SEQ ID NO: 150852 - DNA, 25 bp, Homo sapien
tcgagggacatcctttccggaaaga

SEQ ID NO: 150853 - DNA, 25 bp, Homo sapien
ggaaagactttcctctatctggcta

SEQ ID NO: 150854 - DNA, 25 bp, Homo sapien
actttcctctatctggctatgttga

SEQ ID NO: 150855 - DNA, 25 bp, Homo sapien
atctggctatgttgagttacgttat

SEQ ID NO: 150856 - DNA, 25 bp, Homo sapien
ggcagagccggtggagttggcccaa

SEQ ID NO: 150857 - DNA, 25 bp, Homo sapien
ggcccaagagttccgcaaatttgac

SEQ ID NO: 150858 - DNA, 25 bp, Homo sapien
gttccgcaaatttgacctgaacagc

SEQ ID NO: 150859 - DNA, 25 bp, Homo sapien
ggagagtctcaagcttgaagccgga

SEQ ID NO: 150860 - DNA, 25 bp, Homo sapien
tgaagccggagacaagaagcctgat

SEQ ID NO: 150861 - DNA, 25 bp, Homo sapien
gaagcctgatgccaagtagctccag

SEQ ID NO: 150862 - DNA, 25 bp, Homo sapien
caacctgggtcgtgttccttgtggg

SEQ ID NO: 150863 - DNA, 25 bp, Homo sapien
ggacatctgatgagtacaggtttgc

SEQ ID NO: 150864 - DNA, 25 bp, Homo sapien
caggtttgcagggaggacactgact

SEQ ID NO: 150865 - DNA, 25 bp, Homo sapien
gacactgactggtggaagcctcgtt

SEQ ID NO: 150866 - DNA, 25 bp, Homo sapien
tggtggaagcctcgttctgctgacc

SEQ ID NO: 150867 - DNA, 25 bp, Homo sapien
cagctgactgtcaacagcgagaaaa

SEQ ID NO: 150868 - DNA, 25 bp, Homo sapien
acagcgagaaaatggtgattggcac

SEQ ID NO: 150869 - DNA, 25 bp, Homo sapien
gattggcaccatgctggtaaaggat

SEQ ID NO: 150870 - DNA, 25 bp, Homo sapien
acttccaaatgctgtgacctgtttg

SEQ ID NO: 150871 - DNA, 25 bp, Homo sapien
acctgtttggctcccatctatacct

SEQ ID NO: 150872 - DNA, 25 bp, Homo sapien
atgacacctaggctgtcagtctctc

SEQ ID NO: 150873 - DNA, 25 bp, Homo sapien
actctctcccagcattttgtctggg

SEQ ID NO: 150874 - DNA, 25 bp, Homo sapien
ttacccaccccctagaaatgagctg

SEQ ID NO: 150875 - DNA, 25 bp, Homo sapien
aatgagctgcaataacaggaacatg

SEQ ID NO: 150876 - DNA, 25 bp, Homo sapien
caggaacatgagacttcgcaaatct

SEQ ID NO: 150877 - DNA, 25 bp, Homo sapien
agacttcgcaaatctctggaaaata

SEQ ID NO: 150878 - DNA, 25 bp, Homo sapien
aagtctcactgaacatttcaatcaa

SEQ ID NO: 150879 - DNA, 25 bp, Homo sapien
tttcaatcaagaatggcagggatct

SEQ ID NO: 150880 - DNA, 25 bp, Homo sapien
gaatggcagggatctattttattga

SEQ ID NO: 150881 - DNA, 25 bp, Homo sapien
gaatattctagctactgtaacattg

SEQ ID NO: 150882 - DNA, 25 bp, Homo sapien
tttgtactgcaaagagtgaactata

SEQ ID NO: 150883 - DNA, 25 bp, Homo sapien
gagagacaataatttcttgcaaaaa

SEQ ID NO: 150884 - DNA, 25 bp, Homo sapien
acatgtctttttctcgcctcaactt

SEQ ID NO: 150885 - DNA, 25 bp, Homo sapien
atgtctttttctcgcctcaacttta

SEQ ID NO: 150886 - DNA, 25 bp, Homo sapien
tctttttctcgcctcaactttatcc

SEQ ID NO: 150887 - DNA, 25 bp, Homo sapien
tttttctcgcctcaactttatccac

SEQ ID NO: 150888 - DNA, 25 bp, Homo sapien
tttctcgcctcaactttatccacat

SEQ ID NO: 150889 - DNA, 25 bp, Homo sapien
tctcgcctcaactttatccacatga

SEQ ID NO: 150890 - DNA, 25 bp, Homo sapien
tcgcctcaactttatccacatgaaa

SEQ ID NO: 150891 - DNA, 25 bp, Homo sapien
gcctcaactttatccacatgaaatg

SEQ ID NO: 150892 - DNA, 25 bp, Homo sapien
tatccacatgaaatgtgtgcccatg

SEQ ID NO: 150893 - DNA, 25 bp, Homo sapien
ccacatgaaatgtgtgcccatggct

SEQ ID NO: 150894 - DNA, 25 bp, Homo sapien
catgaaatgtgtgcccatggctggg

SEQ ID NO: 150895 - DNA, 25 bp, Homo sapien
caggatgtatgtggccttgaggata

SEQ ID NO: 150896 - DNA, 25 bp, Homo sapien
gtggccttgaggataacctgcactg

SEQ ID NO: 150897 - DNA, 25 bp, Homo sapien
gtctaccttctgcttccctggaaag

SEQ ID NO: 150898 - DNA, 25 bp, Homo sapien
gcttccctggaaaggatgaatttac

SEQ ID NO: 150899 - DNA, 25 bp, Homo sapien
gaatttacatcatttgacaagccta

SEQ ID NO: 150900 - DNA, 25 bp, Homo sapien
acatcatttgacaagcctattttca

SEQ ID NO: 150901 - DNA, 25 bp, Homo sapien
ttgacaagcctattttcaagttatt

SEQ ID NO: 150902 - DNA, 25 bp, Homo sapien
caaatacaattttagttcttacaag

SEQ ID NO: 150903 - DNA, 25 bp, Homo sapien
aattttgtaccaattcaggtagaag

SEQ ID NO: 150904 - DNA, 25 bp, Homo sapien
agtagaggcctaccttgaattaagg

SEQ ID NO: 150905 - DNA, 25 bp, Homo sapien
acacattgttgaagaaaaggtacca

SEQ ID NO: 150906 - DNA, 25 bp, Homo sapien
gtcctattataattacatctcattg

SEQ ID NO: 150907 - DNA, 25 bp, Homo sapien
attataattacatctcattgtcctg

SEQ ID NO: 150908 - DNA, 25 bp, Homo sapien
ttataattacatctcattgtcctgt

SEQ ID NO: 150909 - DNA, 25 bp, Homo sapien
tataattacatctcattgtcctgtg

SEQ ID NO: 150910 - DNA, 25 bp, Homo sapien
ataattacatctcattgtcctgtgg

SEQ ID NO: 150911 - DNA, 25 bp, Homo sapien
taattacatctcattgtcctgtgga

SEQ ID NO: 150912 - DNA, 25 bp, Homo sapien
aattacatctcattgtcctgtggag

SEQ ID NO: 150913 - DNA, 25 bp, Homo sapien
attacatctcattgtcctgtggagg

SEQ ID NO: 150914 - DNA, 25 bp, Homo sapien
ttacatctcattgtcctgtggaggt

SEQ ID NO: 150915 - DNA, 25 bp, Homo sapien
tacatctcattgtcctgtggaggtg

SEQ ID NO: 150916 - DNA, 25 bp, Homo sapien
acatctcattgtcctgtggaggtgg

SEQ ID NO: 150917 - DNA, 25 bp, Homo sapien
gtgatcctaagtaagaacataatgt

SEQ ID NO: 150918 - DNA, 25 bp, Homo sapien
gaagagtcaactcacttgaagaaga

SEQ ID NO: 150919 - DNA, 25 bp, Homo sapien
gggtcttgagaaatccttagcataa

SEQ ID NO: 150920 - DNA, 25 bp, Homo sapien
aatccttagcataaagggctactgg

SEQ ID NO: 150921 - DNA, 25 bp, Homo sapien
agggctactggtgagattgagatct

SEQ ID NO: 150922 - DNA, 25 bp, Homo sapien
gagatctgagcaggcaaagctcaaa

SEQ ID NO: 150923 - DNA, 25 bp, Homo sapien
aatttatttttgcagtagtgtgctt

SEQ ID NO: 150924 - DNA, 25 bp, Homo sapien
gcagtagtgtgctttgaaatgtgta

SEQ ID NO: 150925 - DNA, 25 bp, Homo sapien
gtgtgctttgaaatgtgtaaatctt

SEQ ID NO: 150926 - DNA, 25 bp, Homo sapien
atcttatttctaatgtatacaacca

SEQ ID NO: 150927 - DNA, 25 bp, Homo sapien
gtatacaaccacatttcacataaaa

SEQ ID NO: 150928 - DNA, 25 bp, Homo sapien
gacagagggtgtcaaacattcgtga

SEQ ID NO: 150929 - DNA, 25 bp, Homo sapien
agggtgtcaaacattcgtgagctgg

SEQ ID NO: 150930 - DNA, 25 bp, Homo sapien
actcagggaccggtgctgcaggagt

SEQ ID NO: 150931 - DNA, 25 bp, Homo sapien
ggtgctgcaggagtgtcctgcccat

SEQ ID NO: 150932 - DNA, 25 bp, Homo sapien
gctgcaggagtgtcctgcccatgcc

SEQ ID NO: 150933 - DNA, 25 bp, Homo sapien
cccatctctcatccttttggataag

SEQ ID NO: 150934 - DNA, 25 bp, Homo sapien
atctctcatccttttggataagttt

SEQ ID NO: 150935 - DNA, 25 bp, Homo sapien
ggataagtttctattctgtcagtgt

SEQ ID NO: 150936 - DNA, 25 bp, Homo sapien
ataagtttctattctgtcagtgtta

SEQ ID NO: 150937 - DNA, 25 bp, Homo sapien
gtttctattctgtcagtgttaaaga

SEQ ID NO: 150938 - DNA, 25 bp, Homo sapien
ttggacatttttttcgaatcttaat

SEQ ID NO: 150939 - DNA, 25 bp, Homo sapien
gaaagagggacactggcattccatt

SEQ ID NO: 150940 - DNA, 25 bp, Homo sapien
gggacactggcattccatttgtcag

SEQ ID NO: 150941 - DNA, 25 bp, Homo sapien
attccatttgtcagagcatcccgga

SEQ ID NO: 150942 - DNA, 25 bp, Homo sapien
atttgtcagagcatcccggacgatg

SEQ ID NO: 150943 - DNA, 25 bp, Homo sapien
cagagggtgggagaactacatgcta

SEQ ID NO: 150944 - DNA, 25 bp, Homo sapien
ggagaactacatgctaaatttcttt

SEQ ID NO: 150945 - DNA, 25 bp, Homo sapien
aaccacataggctcagtcttttcag

SEQ ID NO: 150946 - DNA, 25 bp, Homo sapien
ccacataggctcagtcttttcagta

SEQ ID NO: 150947 - DNA, 25 bp, Homo sapien
tttcagtatctgctttactggttca

SEQ ID NO: 150948 - DNA, 25 bp, Homo sapien
aagccaggaaacacaactttgtggt

SEQ ID NO: 150949 - DNA, 25 bp, Homo sapien
cacaactttgtggtaatctgaatgt

SEQ ID NO: 150950 - DNA, 25 bp, Homo sapien
cctgccagttctgcggcaagcgttt

SEQ ID NO: 150951 - DNA, 25 bp, Homo sapien
tgcggcaagcgtttccaccagaagt

SEQ ID NO: 150952 - DNA, 25 bp, Homo sapien
gcaagcgtttccaccagaagtccga

SEQ ID NO: 150953 - DNA, 25 bp, Homo sapien
cgtttccaccagaagtccgacatga

SEQ ID NO: 150954 - DNA, 25 bp, Homo sapien
catgaagaagcacacctacatccac

SEQ ID NO: 150955 - DNA, 25 bp, Homo sapien
cacaggtgagaagccgcacaagtgc

SEQ ID NO: 150956 - DNA, 25 bp, Homo sapien
aggcttcaagcccttcagctgtgag

SEQ ID NO: 150957 - DNA, 25 bp, Homo sapien
cagctgtgagctgtgcaccaaaggc

SEQ ID NO: 150958 - DNA, 25 bp, Homo sapien
tgagctgtgcaccaaaggcttccag

SEQ ID NO: 150959 - DNA, 25 bp, Homo sapien
ggcttccagcgcaaggtggacctgc

SEQ ID NO: 150960 - DNA, 25 bp, Homo sapien
gcgagagccagcacaatctcaagtg

SEQ ID NO: 150961 - DNA, 25 bp, Homo sapien
agagccagttcacatcccactctga

SEQ ID NO: 150962 - DNA, 25 bp, Homo sapien
tgagctcccacgagaaacactgctt

SEQ ID NO: 150963 - DNA, 25 bp, Homo sapien
cacgagaaacactgcttctccaggc

SEQ ID NO: 150964 - DNA, 25 bp, Homo sapien
agaggcagctggagcgccgttctct

SEQ ID NO: 150965 - DNA, 25 bp, Homo sapien
agcgccgttctctcctgctgggaca

SEQ ID NO: 150966 - DNA, 25 bp, Homo sapien
ggtattgactgagtggctgacagtt

SEQ ID NO: 150967 - DNA, 25 bp, Homo sapien
gagtggctgacagttatcttccaac

SEQ ID NO: 150968 - DNA, 25 bp, Homo sapien
tggctgacagttatcttccaacccc

SEQ ID NO: 150969 - DNA, 25 bp, Homo sapien
gctaggcttgatggtggccaggctt

SEQ ID NO: 150970 - DNA, 25 bp, Homo sapien
tctggacctctcatttctcttcatt

SEQ ID NO: 150971 - DNA, 25 bp, Homo sapien
ctctcatttctcttcattggtttat

SEQ ID NO: 150972 - DNA, 25 bp, Homo sapien
gataaagaagctaacctgccatagt

SEQ ID NO: 150973 - DNA, 25 bp, Homo sapien
gctaacctgccatagtcagacttca

SEQ ID NO: 150974 - DNA, 25 bp, Homo sapien
gtcagacttcagactttcaagatta

SEQ ID NO: 150975 - DNA, 25 bp, Homo sapien
tcaagattattctaaatcaccagaa

SEQ ID NO: 150976 - DNA, 25 bp, Homo sapien
aattaatttcagtttctattgggag

SEQ ID NO: 150977 - DNA, 25 bp, Homo sapien
tcagtttctattgggagtttatacc

SEQ ID NO: 150978 - DNA, 25 bp, Homo sapien
gggagtttataccaagagattcttc

SEQ ID NO: 150979 - DNA, 25 bp, Homo sapien
gattcttctagatctcattgatcct

SEQ ID NO: 150980 - DNA, 25 bp, Homo sapien
cattgatccttttgaagagcttttt

SEQ ID NO: 150981 - DNA, 25 bp, Homo sapien
ggatatcagaattgttcaacttttc

SEQ ID NO: 150982 - DNA, 25 bp, Homo sapien
tcaacttttcactctatagactgtt

SEQ ID NO: 150983 - DNA, 25 bp, Homo sapien
caaccctgtacagaatcgagtgctg

SEQ ID NO: 150984 - DNA, 25 bp, Homo sapien
aatcgagtgctgtagcctggccaga

SEQ ID NO: 150985 - DNA, 25 bp, Homo sapien
gagtgctgtagcctggccagacccc

SEQ ID NO: 150986 - DNA, 25 bp, Homo sapien
ccagagcccttgtgccatctttctt

SEQ ID NO: 150987 - DNA, 25 bp, Homo sapien
gggaagcaacccaatcctctgtctc

SEQ ID NO: 150988 - DNA, 25 bp, Homo sapien
tgtctccttgctccaatggaggcag

SEQ ID NO: 150989 - DNA, 25 bp, Homo sapien
gagcccaggacccaagcgtcttggc

SEQ ID NO: 150990 - DNA, 25 bp, Homo sapien
agcctgtgtagctcttcctgcatgt

SEQ ID NO: 150991 - DNA, 25 bp, Homo sapien
catgtggatgctgcatgtctggtct

SEQ ID NO: 150992 - DNA, 25 bp, Homo sapien
gggcttggatgttgcactgccccac

SEQ ID NO: 150993 - DNA, 25 bp, Homo sapien
tggatgttgcactgccccactgcct

SEQ ID NO: 150994 - DNA, 25 bp, Homo sapien
atgcagactgtcatatccagcgagt

SEQ ID NO: 150995 - DNA, 25 bp, Homo sapien
ctgaccctttctgcgaatgtaacga

SEQ ID NO: 150996 - DNA, 25 bp, Homo sapien
aacgagcaagcagtcagcacagcct

SEQ ID NO: 150997 - DNA, 25 bp, Homo sapien
gatgtagccccggtaggtttgcctc

SEQ ID NO: 150998 - DNA, 25 bp, Homo sapien
ggtaggtttgcctctgcagaactaa

SEQ ID NO: 150999 - DNA, 25 bp, Homo sapien
tgcagaactaatggctgtgacttca

SEQ ID NO: 151000 - DNA, 25 bp, Homo sapien
aagtttaacctacgtgtcatctgcc

SEQ ID NO: 151001 - DNA, 25 bp, Homo sapien
tgcctggtcatctcagacccatgaa

SEQ ID NO: 151002 - DNA, 25 bp, Homo sapien
gacccatgaaattaggcgccttgtt

SEQ ID NO: 151003 - DNA, 25 bp, Homo sapien
gccttgtttgagctgcgtttcacac

SEQ ID NO: 151004 - DNA, 25 bp, Homo sapien
gtttcacacttctttagacgctagc

SEQ ID NO: 151005 - DNA, 25 bp, Homo sapien
aacagtcttcccatttacaggtctt

SEQ ID NO: 151006 - DNA, 25 bp, Homo sapien
catttacaggtcttctctccaactc

SEQ ID NO: 151007 - DNA, 25 bp, Homo sapien
aactcttcacggaaagtgcctgcaa

SEQ ID NO: 151008 - DNA, 25 bp, Homo sapien
tggcgagtctgctttcttctactgc

SEQ ID NO: 151009 - DNA, 25 bp, Homo sapien
cctgaacgcttctgcttaatctgag

SEQ ID NO: 151010 - DNA, 25 bp, Homo sapien
tcacatttggtttgttgagcctaat

SEQ ID NO: 151011 - DNA, 25 bp, Homo sapien
tgttgagattttgcaggaccctgat

SEQ ID NO: 151012 - DNA, 25 bp, Homo sapien
ccctgatcttttgtggtcctgtaaa

SEQ ID NO: 151013 - DNA, 25 bp, Homo sapien
gaggaatgtctttcagccaagccaa

SEQ ID NO: 151014 - DNA, 25 bp, Homo sapien
gccaagccaagaggatggtttcaat

SEQ ID NO: 151015 - DNA, 25 bp, Homo sapien
attccagtggaacagtcttcccatt

SEQ ID NO: 151016 - DNA, 25 bp, Homo sapien
taagttcagtagttgcttccctaac

SEQ ID NO: 151017 - DNA, 25 bp, Homo sapien
gtagttgcttccctaactgcaaagg

SEQ ID NO: 151018 - DNA, 25 bp, Homo sapien
actgcaaaggcaatctcatttagtt

SEQ ID NO: 151019 - DNA, 25 bp, Homo sapien
gagtagctcttgaaagcagctttga

SEQ ID NO: 151020 - DNA, 25 bp, Homo sapien
gaaagcagctttgagttagaagtat

SEQ ID NO: 151021 - DNA, 25 bp, Homo sapien
ttagaagtatgtgtgttacaccctc

SEQ ID NO: 151022 - DNA, 25 bp, Homo sapien
ttttgtgaatgagagttggcatgtc

SEQ ID NO: 151023 - DNA, 25 bp, Homo sapien
gttggcatgtcaaatgcatcctcta

SEQ ID NO: 151024 - DNA, 25 bp, Homo sapien
gtcaaatgcatcctctagaaaaata

SEQ ID NO: 151025 - DNA, 25 bp, Homo sapien
atttttgtgaacagcctgatgtttg

SEQ ID NO: 151026 - DNA, 25 bp, Homo sapien
acagcctgatgtttgggaccttttt

SEQ ID NO: 151027 - DNA, 25 bp, Homo sapien
aaagaccacatttgattcaactgag

SEQ ID NO: 151028 - DNA, 25 bp, Homo sapien
gattcaactgagaccttgtgtatgt

SEQ ID NO: 151029 - DNA, 25 bp, Homo sapien
ctgagaccttgtgtatgtgacatat

SEQ ID NO: 151030 - DNA, 25 bp, Homo sapien
tgtatgtgacatatagtggcctata

SEQ ID NO: 151031 - DNA, 25 bp, Homo sapien
gtggcctataaatttaatcataatg

SEQ ID NO: 151032 - DNA, 25 bp, Homo sapien
gatgttattgtttaccactgaggtg

SEQ ID NO: 151033 - DNA, 25 bp, Homo sapien
taccgtgttttctttgtattgtgtt

SEQ ID NO: 151034 - DNA, 25 bp, Homo sapien
tttgtattgtgttctaccttccctt

SEQ ID NO: 151035 - DNA, 25 bp, Homo sapien
tgtgttctaccttccctttcactga

SEQ ID NO: 151036 - DNA, 25 bp, Homo sapien
tccctttcactgaaaatgatcactt

SEQ ID NO: 151037 - DNA, 25 bp, Homo sapien
tttcatgttcttgtattgcaaccta

SEQ ID NO: 151038 - DNA, 25 bp, Homo sapien
ctgataatttgcttcttcctattaa

SEQ ID NO: 151039 - DNA, 25 bp, Homo sapien
tgcttcttcctattaaaaccttaca

SEQ ID NO: 151040 - DNA, 25 bp, Homo sapien
aaccttacacccattattgatttat

SEQ ID NO: 151041 - DNA, 25 bp, Homo sapien
taaaatatcttcctgcactggctaa

SEQ ID NO: 151042 - DNA, 25 bp, Homo sapien
tgcactggctaaaacctccactata

SEQ ID NO: 151043 - DNA, 25 bp, Homo sapien
aaacctccactataatgttgagcag

SEQ ID NO: 151044 - DNA, 25 bp, Homo sapien
agcagaacagtgaggcatccttaga

SEQ ID NO: 151045 - DNA, 25 bp, Homo sapien
gtgaggcatccttagaactatcttg

SEQ ID NO: 151046 - DNA, 25 bp, Homo sapien
tcttggttgcaaagggtaggtctct

SEQ ID NO: 151047 - DNA, 25 bp, Homo sapien
gggtaggtctctaatgtttcatcaa

SEQ ID NO: 151048 - DNA, 25 bp, Homo sapien
gtgatgtttctagtctgagtttgct

SEQ ID NO: 151049 - DNA, 25 bp, Homo sapien
aggctgcgtgacatgggccactcta

SEQ ID NO: 151050 - DNA, 25 bp, Homo sapien
atgggccactctaggacaggtcatc

SEQ ID NO: 151051 - DNA, 25 bp, Homo sapien
taggacaggtcatcctccccgagtc

SEQ ID NO: 151052 - DNA, 25 bp, Homo sapien
gctcctttgcatccctggccagtga

SEQ ID NO: 151053 - DNA, 25 bp, Homo sapien
cctggccagtgaccttgtatttatg

SEQ ID NO: 151054 - DNA, 25 bp, Homo sapien
gaccttgtatttatgaggctctgtg

SEQ ID NO: 151055 - DNA, 25 bp, Homo sapien
tatgaggctctgtgaggccagcccc

SEQ ID NO: 151056 - DNA, 25 bp, Homo sapien
ccaggaccagaatcccagggacaga

SEQ ID NO: 151057 - DNA, 25 bp, Homo sapien
gaggactgggtagcaggttccttct

SEQ ID NO: 151058 - DNA, 25 bp, Homo sapien
aggttccttctgttgtcctgtgtgg

SEQ ID NO: 151059 - DNA, 25 bp, Homo sapien
tcctgtgtggtgtgtctactgtgag

SEQ ID NO: 151060 - DNA, 25 bp, Homo sapien
tatgtaatctactcatccatgttgt

SEQ ID NO: 151061 - DNA, 25 bp, Homo sapien
ctactcatccatgttgtacagacaa

SEQ ID NO: 151062 - DNA, 25 bp, Homo sapien
agacaacaggaatctggtagagcct

SEQ ID NO: 151063 - DNA, 25 bp, Homo sapien
ctggtagagcctggtttttgggatt

SEQ ID NO: 151064 - DNA, 25 bp, Homo sapien
gaaaaccaaaccagcagctcatttt

SEQ ID NO: 151065 - DNA, 25 bp, Homo sapien
agctcattttctacccaagccattg

SEQ ID NO: 151066 - DNA, 25 bp, Homo sapien
tacccaagccattggaagttgccat

SEQ ID NO: 151067 - DNA, 25 bp, Homo sapien
gaagttgccatgtaccgagaaccat

SEQ ID NO: 151068 - DNA, 25 bp, Homo sapien
gtaccgagaaccatctttgcatgat

SEQ ID NO: 151069 - DNA, 25 bp, Homo sapien
aagcacaagtgcgtctgcaataatg

SEQ ID NO: 151070 - DNA, 25 bp, Homo sapien
gaggcaaaccagtcaacaagagtaa

SEQ ID NO: 151071 - DNA, 25 bp, Homo sapien
ctgctactggctttacatggtgaca

SEQ ID NO: 151072 - DNA, 25 bp, Homo sapien
gacagacattccgtggataggaaga

SEQ ID NO: 151073 - DNA, 25 bp, Homo sapien
acattccgtggataggaagatagca

SEQ ID NO: 151074 - DNA, 25 bp, Homo sapien
gatagcaggagaaagtaactccata

SEQ ID NO: 151075 - DNA, 25 bp, Homo sapien
aagtaactccatagagtgtcattcc

SEQ ID NO: 151076 - DNA, 25 bp, Homo sapien
tagagtgtcattccactggttgata

SEQ ID NO: 151077 - DNA, 25 bp, Homo sapien
attccactggttgatattggcttag

SEQ ID NO: 151078 - DNA, 25 bp, Homo sapien
gccagtctcccatttgtgacctatg

SEQ ID NO: 151079 - DNA, 25 bp, Homo sapien
atttgtgacctatgccatccatcta

SEQ ID NO: 151080 - DNA, 25 bp, Homo sapien
ggataccaacatttcttcctaatat

SEQ ID NO: 151081 - DNA, 25 bp, Homo sapien
atattctataatctccaactcctga

SEQ ID NO: 151082 - DNA, 25 bp, Homo sapien
gcattgggcattagtgtcccccctt

SEQ ID NO: 151083 - DNA, 25 bp, Homo sapien
tgggcattagtgtccccccttgaag

SEQ ID NO: 151084 - DNA, 25 bp, Homo sapien
ccccttgaagcaataactccaagca

SEQ ID NO: 151085 - DNA, 25 bp, Homo sapien
ggtggccagggcttccccatcagct

SEQ ID NO: 151086 - DNA, 25 bp, Homo sapien
caacgagcctcctcagggggtagga

SEQ ID NO: 151087 - DNA, 25 bp, Homo sapien
tgccctgcagagcaataacactata

SEQ ID NO: 151088 - DNA, 25 bp, Homo sapien
tgcagagcaataacactatatttat

SEQ ID NO: 151089 - DNA, 25 bp, Homo sapien
tttggccagggaggcgcagggacat

SEQ ID NO: 151090 - DNA, 25 bp, Homo sapien
gcccagagcccttggctgtacagag

SEQ ID NO: 151091 - DNA, 25 bp, Homo sapien
gtacagagactctattttaatgtat

SEQ ID NO: 151092 - DNA, 25 bp, Homo sapien
ctgcaaagagaaaccgcttttggtt

SEQ ID NO: 151093 - DNA, 25 bp, Homo sapien
gcacctatgagatggccatgctcaa

SEQ ID NO: 151094 - DNA, 25 bp, Homo sapien
cacctatgagatggccatgctcaac

SEQ ID NO: 151095 - DNA, 25 bp, Homo sapien
ctatgagatggccatgctcaacccc

SEQ ID NO: 151096 - DNA, 25 bp, Homo sapien
agggctggagacttcctctggtaaa

SEQ ID NO: 151097 - DNA, 25 bp, Homo sapien
gggctggagacttcctctggtaaac

SEQ ID NO: 151098 - DNA, 25 bp, Homo sapien
ggctggagacttcctctggtaaaca

SEQ ID NO: 151099 - DNA, 25 bp, Homo sapien
gctggagacttcctctggtaaacat

SEQ ID NO: 151100 - DNA, 25 bp, Homo sapien
ctggagacttcctctggtaaacatt

SEQ ID NO: 151101 - DNA, 25 bp, Homo sapien
tggagacttcctctggtaaacattc

SEQ ID NO: 151102 - DNA, 25 bp, Homo sapien
acgccaaggaggtgggccacaccca

SEQ ID NO: 151103 - DNA, 25 bp, Homo sapien
aaggaggtgggccacacccaggaag

SEQ ID NO: 151104 - DNA, 25 bp, Homo sapien
aagagagcaagtgagtgtgtgtccc

SEQ ID NO: 151105 - DNA, 25 bp, Homo sapien
ggttgggcgccctctggtgttacca

SEQ ID NO: 151106 - DNA, 25 bp, Homo sapien
tggtgttaccacctcgagacttgtc

SEQ ID NO: 151107 - DNA, 25 bp, Homo sapien
ttaccacctcgagacttgtctcatg

SEQ ID NO: 151108 - DNA, 25 bp, Homo sapien
tcatgcctccatgcttgccgatgga

SEQ ID NO: 151109 - DNA, 25 bp, Homo sapien
tgcttgccgatggaggacagactgc

SEQ ID NO: 151110 - DNA, 25 bp, Homo sapien
gacagactgcaggaacttggcccat

SEQ ID NO: 151111 - DNA, 25 bp, Homo sapien
gactgcaggaacttggcccatgtgg

SEQ ID NO: 151112 - DNA, 25 bp, Homo sapien
gcccatgtgggaacctagcctgttt

SEQ ID NO: 151113 - DNA, 25 bp, Homo sapien
atgtgggaacctagcctgttttggg

SEQ ID NO: 151114 - DNA, 25 bp, Homo sapien
gtaggacccacagatgtcttggaca

SEQ ID NO: 151115 - DNA, 25 bp, Homo sapien
catgtctagtttgtaaagtgtgtcc

SEQ ID NO: 151116 - DNA, 25 bp, Homo sapien
aagtgtgtcctgtgtactgcagatg

SEQ ID NO: 151117 - DNA, 25 bp, Homo sapien
actgcagatgtgtgttctctgggct

SEQ ID NO: 151118 - DNA, 25 bp, Homo sapien
ttctctgggctttatgtatctgtac

SEQ ID NO: 151119 - DNA, 25 bp, Homo sapien
gtatctgtacagtagctttcacatt

SEQ ID NO: 151120 - DNA, 25 bp, Homo sapien
aacgatgctgtactatagtccatgt

SEQ ID NO: 151121 - DNA, 25 bp, Homo sapien
aaaagatctggaagtcaccctcctc

SEQ ID NO: 151122 - DNA, 25 bp, Homo sapien
tcctctggcccacggaaaattttgg

SEQ ID NO: 151123 - DNA, 25 bp, Homo sapien
ttggtaatcttctaggttctaaaat

SEQ ID NO: 151124 - DNA, 25 bp, Homo sapien
agatgtatgggtactctggcagact

SEQ ID NO: 151125 - DNA, 25 bp, Homo sapien
tctggcagactgcatgttgtataat

SEQ ID NO: 151126 - DNA, 25 bp, Homo sapien
aaaggaccgccacccacacttgtga

SEQ ID NO: 151127 - DNA, 25 bp, Homo sapien
acacttgtgattacgcgggctgcgg

SEQ ID NO: 151128 - DNA, 25 bp, Homo sapien
aaagagttcccatctcaaggcacac

SEQ ID NO: 151129 - DNA, 25 bp, Homo sapien
gaaaccttaccactgtgactgggac

SEQ ID NO: 151130 - DNA, 25 bp, Homo sapien
gctgtggatggaaattcgcccgctc

SEQ ID NO: 151131 - DNA, 25 bp, Homo sapien
aaattcgcccgctcagatgaactga

SEQ ID NO: 151132 - DNA, 25 bp, Homo sapien
gatgaactgaccaggcactaccgta

SEQ ID NO: 151133 - DNA, 25 bp, Homo sapien
gaccaggcactaccgtaaacacacg

SEQ ID NO: 151134 - DNA, 25 bp, Homo sapien
ttccagtgccaaaaatgcgaccgag

SEQ ID NO: 151135 - DNA, 25 bp, Homo sapien
aatgcgaccgagcattttccaggtc

SEQ ID NO: 151136 - DNA, 25 bp, Homo sapien
ctcgccttacacatgaagaggcatt

SEQ ID NO: 151137 - DNA, 25 bp, Homo sapien
agctagaggaggttctgactaataa

SEQ ID NO: 151138 - DNA, 25 bp, Homo sapien
tctgactaataagaagacgaccttc

SEQ ID NO: 151139 - DNA, 25 bp, Homo sapien
accttctttggtggcaattctatct

SEQ ID NO: 151140 - DNA, 25 bp, Homo sapien
tggtggcaattctatctctatgatt

SEQ ID NO: 151141 - DNA, 25 bp, Homo sapien
ggcaattctatctctatgattgatt

SEQ ID NO: 151142 - DNA, 25 bp, Homo sapien
ccctggtttgaacggctggaagcaa

SEQ ID NO: 151143 - DNA, 25 bp, Homo sapien
ttgaacggctggaagcaatgaagtt

SEQ ID NO: 151144 - DNA, 25 bp, Homo sapien
gtgtagaccacactccaaaactgaa

SEQ ID NO: 151145 - DNA, 25 bp, Homo sapien
tagaccacactccaaaactgaaact

SEQ ID NO: 151146 - DNA, 25 bp, Homo sapien
ggcagccatgaaggaagatcccaca

SEQ ID NO: 151147 - DNA, 25 bp, Homo sapien
catgaaggaagatcccacagtctca

SEQ ID NO: 151148 - DNA, 25 bp, Homo sapien
ttttacctgtcaccgaagccaggaa

SEQ ID NO: 151149 - DNA, 25 bp, Homo sapien
agccaggaagccccgtttgtaagcg

SEQ ID NO: 151150 - DNA, 25 bp, Homo sapien
gtgctttattgtacatcctccagtg

SEQ ID NO: 151151 - DNA, 25 bp, Homo sapien
ttattgtacatcctccagtggcgtt

SEQ ID NO: 151152 - DNA, 25 bp, Homo sapien
tccagtggcgttctttttactctaa

SEQ ID NO: 151153 - DNA, 25 bp, Homo sapien
tttcccccctcagaagaatcatgaa

SEQ ID NO: 151154 - DNA, 25 bp, Homo sapien
gaatcatgaatttgcaacagaccta

SEQ ID NO: 151155 - DNA, 25 bp, Homo sapien
tttgcaacagacctaatttttggtt

SEQ ID NO: 151156 - DNA, 25 bp, Homo sapien
tttttgtcttattgatggatttgaa

SEQ ID NO: 151157 - DNA, 25 bp, Homo sapien
ggcaaagcagaatctgttgtcctta

SEQ ID NO: 151158 - DNA, 25 bp, Homo sapien
gcagaatctgttgtccttaattata

SEQ ID NO: 151159 - DNA, 25 bp, Homo sapien
gccagtctcccatttgtgacctatg

SEQ ID NO: 151160 - DNA, 25 bp, Homo sapien
ccagtctcccatttgtgacctatgc

SEQ ID NO: 151161 - DNA, 25 bp, Homo sapien
cagtctcccatttgtgacctatgcc

SEQ ID NO: 151162 - DNA, 25 bp, Homo sapien
agtctcccatttgtgacctatgcca

SEQ ID NO: 151163 - DNA, 25 bp, Homo sapien
gtctcccatttgtgacctatgccat

SEQ ID NO: 151164 - DNA, 25 bp, Homo sapien
tctcccatttgtgacctatgccatc

SEQ ID NO: 151165 - DNA, 25 bp, Homo sapien
tcccatttgtgacctatgccatcca

SEQ ID NO: 151166 - DNA, 25 bp, Homo sapien
cccatttgtgacctatgccatccat

SEQ ID NO: 151167 - DNA, 25 bp, Homo sapien
ccatttgtgacctatgccatccatc

SEQ ID NO: 151168 - DNA, 25 bp, Homo sapien
catttgtgacctatgccatccatct

SEQ ID NO: 151169 - DNA, 25 bp, Homo sapien
atttgtgacctatgccatccatcta

SEQ ID NO: 151170 - DNA, 25 bp, Homo sapien
agattctcaggtccaggcgttaaaa

SEQ ID NO: 151171 - DNA, 25 bp, Homo sapien
tcaggtccaggcgttaaaaaataat

SEQ ID NO: 151172 - DNA, 25 bp, Homo sapien
gaatgccagcgaagcaattcttttt

SEQ ID NO: 151173 - DNA, 25 bp, Homo sapien
gaggacacttgtctggtgtactttt

SEQ ID NO: 151174 - DNA, 25 bp, Homo sapien
cacttgtctggtgtactttttcatg

SEQ ID NO: 151175 - DNA, 25 bp, Homo sapien
aatggttaacatgtttacacaagaa

SEQ ID NO: 151176 - DNA, 25 bp, Homo sapien
ttatcatttatttcaacctgtgttt

SEQ ID NO: 151177 - DNA, 25 bp, Homo sapien
acctgtgttttgtatcataacagac

SEQ ID NO: 151178 - DNA, 25 bp, Homo sapien
gtatcataacagacgtgtggatttt

SEQ ID NO: 151179 - DNA, 25 bp, Homo sapien
gtacttactgcgtattctttacaag

SEQ ID NO: 151180 - DNA, 25 bp, Homo sapien
ctgcgtattctttacaaggagtatt

SEQ ID NO: 151181 - DNA, 25 bp, Homo sapien
gggcggccgcagctctcacccactt

SEQ ID NO: 151182 - DNA, 25 bp, Homo sapien
cactttctcctgcagacggcgaggg

SEQ ID NO: 151183 - DNA, 25 bp, Homo sapien
tttctcctgcagacggcgaggggac

SEQ ID NO: 151184 - DNA, 25 bp, Homo sapien
ggagagggacctgccgcgaaaccat

SEQ ID NO: 151185 - DNA, 25 bp, Homo sapien
gggacctgccgcgaaaccatcattg

SEQ ID NO: 151186 - DNA, 25 bp, Homo sapien
ggacctgccgcgaaaccatcattgc

SEQ ID NO: 151187 - DNA, 25 bp, Homo sapien
tgccgcgaaaccatcattgccccat

SEQ ID NO: 151188 - DNA, 25 bp, Homo sapien
aaaccatcattgccccatccagtgt

SEQ ID NO: 151189 - DNA, 25 bp, Homo sapien
atcattgccccatccagtgtcctct

SEQ ID NO: 151190 - DNA, 25 bp, Homo sapien
cagtgtcctctgcagcaaggccagg

SEQ ID NO: 151191 - DNA, 25 bp, Homo sapien
agtgtcctctgcagcaaggccaggg

SEQ ID NO: 151192 - DNA, 25 bp, Homo sapien
agacatctaaaattccactcctcat

SEQ ID NO: 151193 - DNA, 25 bp, Homo sapien
attccactcctcatagagcttttaa

SEQ ID NO: 151194 - DNA, 25 bp, Homo sapien
ggtttcattggatataggccttaag

SEQ ID NO: 151195 - DNA, 25 bp, Homo sapien
ggagcagtatgttccctctgagaag

SEQ ID NO: 151196 - DNA, 25 bp, Homo sapien
gtatgttccctctgagaagctgagt

SEQ ID NO: 151197 - DNA, 25 bp, Homo sapien
gaagctgagtatctatggtgacttg

SEQ ID NO: 151198 - DNA, 25 bp, Homo sapien
aacagatatccagcttcttctcttg

SEQ ID NO: 151199 - DNA, 25 bp, Homo sapien
agcttcttctcttgtggttgttaga

SEQ ID NO: 151200 - DNA, 25 bp, Homo sapien
gatcatgaagaagcagggcctctac

SEQ ID NO: 151201 - DNA, 25 bp, Homo sapien
gggcctctacctacaaaagtgaatc

SEQ ID NO: 151202 - DNA, 25 bp, Homo sapien
aagtgaatcttgctcattctgaaat

SEQ ID NO: 151203 - DNA, 25 bp, Homo sapien
gcatgcttgggctgacccagcatct

SEQ ID NO: 151204 - DNA, 25 bp, Homo sapien
ctcatctgtggagctgccacagaga

SEQ ID NO: 151205 - DNA, 25 bp, Homo sapien
gccacagagaagtttgtagccaggt

SEQ ID NO: 151206 - DNA, 25 bp, Homo sapien
gaagtttgtagccaggtactgcatt

SEQ ID NO: 151207 - DNA, 25 bp, Homo sapien
actccccagagctgtgccagcaggg

SEQ ID NO: 151208 - DNA, 25 bp, Homo sapien
agtgtagctgtaagggcagtgccca

SEQ ID NO: 151209 - DNA, 25 bp, Homo sapien
agggcagtgcccatgtgtacattct

SEQ ID NO: 151210 - DNA, 25 bp, Homo sapien
tgcccatgtgtacattctgcctaga

SEQ ID NO: 151211 - DNA, 25 bp, Homo sapien
acattctgcctagagtgtagcctaa

SEQ ID NO: 151212 - DNA, 25 bp, Homo sapien
gtgtagcctaaagggcagggcccac

SEQ ID NO: 151213 - DNA, 25 bp, Homo sapien
agggcccacgtgtatagtatctgta

SEQ ID NO: 151214 - DNA, 25 bp, Homo sapien
atggcattttacaaactgtgaccgt

SEQ ID NO: 151215 - DNA, 25 bp, Homo sapien
aactgtgaccgtttctgtgtgaaga

SEQ ID NO: 151216 - DNA, 25 bp, Homo sapien
gaccgtttctgtgtgaagattttta

SEQ ID NO: 151217 - DNA, 25 bp, Homo sapien
tctgtgtgaagatttttagctgtat

SEQ ID NO: 151218 - DNA, 25 bp, Homo sapien
ttagctgtatttgtggtctctgtat

SEQ ID NO: 151219 - DNA, 25 bp, Homo sapien
gctgtatttgtggtctctgtattta

SEQ ID NO: 151220 - DNA, 25 bp, Homo sapien
gtatttgtggtctctgtatttatat

SEQ ID NO: 151221 - DNA, 25 bp, Homo sapien
ttatatttatgtttagcaccgtcag

SEQ ID NO: 151222 - DNA, 25 bp, Homo sapien
atgtttagcaccgtcagtgttccta

SEQ ID NO: 151223 - DNA, 25 bp, Homo sapien
gtcagtgttcctatccaatttcaaa

SEQ ID NO: 151224 - DNA, 25 bp, Homo sapien
gtgttcctatccaatttcaaaaaag

SEQ ID NO: 151225 - DNA, 25 bp, Homo sapien
gaaaaattacattccttgtcattgt

SEQ ID NO: 151226 - DNA, 25 bp, Homo sapien
gtaaattacctttgtgtgtacattt

SEQ ID NO: 151227 - DNA, 25 bp, Homo sapien
gtgtgtgactagttaattttgcagg

SEQ ID NO: 151228 - DNA, 25 bp, Homo sapien
aattttgcaggatgtgccatatcat

SEQ ID NO: 151229 - DNA, 25 bp, Homo sapien
ggatgtgccatatcattgaacggaa

SEQ ID NO: 151230 - DNA, 25 bp, Homo sapien
gtgccatatcattgaacggaactaa

SEQ ID NO: 151231 - DNA, 25 bp, Homo sapien
gaacggaactaaagtctgtgacagt

SEQ ID NO: 151232 - DNA, 25 bp, Homo sapien
gtctgtgacagtggatatagctgct

SEQ ID NO: 151233 - DNA, 25 bp, Homo sapien
ggatatagctgctggaccattccat

SEQ ID NO: 151234 - DNA, 25 bp, Homo sapien
gctgctggaccattccatcttatat

SEQ ID NO: 151235 - DNA, 25 bp, Homo sapien
ggaccattccatcttatatgtaaag

SEQ ID NO: 151236 - DNA, 25 bp, Homo sapien
gtgaggtgcccaggtgtctatttac

SEQ ID NO: 151237 - DNA, 25 bp, Homo sapien
aggtgtctatttaccctgcagagct

SEQ ID NO: 151238 - DNA, 25 bp, Homo sapien
gtctatttaccctgcagagctggga

SEQ ID NO: 151239 - DNA, 25 bp, Homo sapien
tgcagagctgggagtttcaccccac

SEQ ID NO: 151240 - DNA, 25 bp, Homo sapien
tctccttacctttggcatcctttgg

SEQ ID NO: 151241 - DNA, 25 bp, Homo sapien
ctttggcatcctttggcctggtggg

SEQ ID NO: 151242 - DNA, 25 bp, Homo sapien
gtggagacctaagcgggtataagac

SEQ ID NO: 151243 - DNA, 25 bp, Homo sapien
aagcgggtataagaccaggtggcct

SEQ ID NO: 151244 - DNA, 25 bp, Homo sapien
ttttctgggccctagcacaggtggg

SEQ ID NO: 151245 - DNA, 25 bp, Homo sapien
ctgggccctagcacaggtgggtaac

SEQ ID NO: 151246 - DNA, 25 bp, Homo sapien
tgctgctgtcccagtcttgggctgg

SEQ ID NO: 151247 - DNA, 25 bp, Homo sapien
cctgcgccacaaccaatgcatgtga

SEQ ID NO: 151248 - DNA, 25 bp, Homo sapien
atgcatgtgacaagtccactgggcc

SEQ ID NO: 151249 - DNA, 25 bp, Homo sapien
catgtgacaagtccactgggccctg

SEQ ID NO: 151250 - DNA, 25 bp, Homo sapien
tccactgggccctgtatctctaatc

SEQ ID NO: 151251 - DNA, 25 bp, Homo sapien
ggccctgtatctctaatccctgtgg

SEQ ID NO: 151252 - DNA, 25 bp, Homo sapien
gccctgtatctctaatccctgtggc

SEQ ID NO: 151253 - DNA, 25 bp, Homo sapien
ctgtatctctaatccctgtggccta

SEQ ID NO: 151254 - DNA, 25 bp, Homo sapien
tgtatctctaatccctgtggcctac

SEQ ID NO: 151255 - DNA, 25 bp, Homo sapien
tatctctaatccctgtggcctacgt

SEQ ID NO: 151256 - DNA, 25 bp, Homo sapien
atctctaatccctgtggcctacgtg

SEQ ID NO: 151257 - DNA, 25 bp, Homo sapien
ctacgtgctcggtgtgggccttgca

SEQ ID NO: 151258 - DNA, 25 bp, Homo sapien
ccgtcaatgacttcgcagagcagca

SEQ ID NO: 151259 - DNA, 25 bp, Homo sapien
ttcgcagagcagcacgtccatgagc

SEQ ID NO: 151260 - DNA, 25 bp, Homo sapien
agcagcacgtccatgagcgccaggg

SEQ ID NO: 151261 - DNA, 25 bp, Homo sapien
ccctgccctgtgagtctttaagacc

SEQ ID NO: 151262 - DNA, 25 bp, Homo sapien
tctttaagaccctctttgccaagtt

SEQ ID NO: 151263 - DNA, 25 bp, Homo sapien
ttgccaagttttacgacgggactgt

SEQ ID NO: 151264 - DNA, 25 bp, Homo sapien
gggactgtctgattatttcacacat

SEQ ID NO: 151265 - DNA, 25 bp, Homo sapien
gtcttcttccaaccctttaatacat

SEQ ID NO: 151266 - DNA, 25 bp, Homo sapien
ctttaatacattaacatccctggga

SEQ ID NO: 151267 - DNA, 25 bp, Homo sapien
gggaccagactgtaagtgaacgttt

SEQ ID NO: 151268 - DNA, 25 bp, Homo sapien
gaacgttttacacacatttgcattg

SEQ ID NO: 151269 - DNA, 25 bp, Homo sapien
tcacagagccagttcacatcccact

SEQ ID NO: 151270 - DNA, 25 bp, Homo sapien
actctgagctcccacgagaaacact

SEQ ID NO: 151271 - DNA, 25 bp, Homo sapien
tgagctcccacgagaaacactgctt

SEQ ID NO: 151272 - DNA, 25 bp, Homo sapien
cacgagaaacactgcttctccaggc

SEQ ID NO: 151273 - DNA, 25 bp, Homo sapien
ggtattgactgagtggctgacagtt

SEQ ID NO: 151274 - DNA, 25 bp, Homo sapien
gagtggctgacagttatcttccaac

SEQ ID NO: 151275 - DNA, 25 bp, Homo sapien
tggctgacagttatcttccaacccc

SEQ ID NO: 151276 - DNA, 25 bp, Homo sapien
gctaggcttgatggtggccaggctt

SEQ ID NO: 151277 - DNA, 25 bp, Homo sapien
tctggacctctcatttctcttcatt

SEQ ID NO: 151278 - DNA, 25 bp, Homo sapien
cctctcatttctcttcattggttta

SEQ ID NO: 151279 - DNA, 25 bp, Homo sapien
ctcatttctcttcattggtttattt

SEQ ID NO: 151280 - DNA, 25 bp, Homo sapien
tcttgcttgaggaaacttcggttgc

SEQ ID NO: 151281 - DNA, 25 bp, Homo sapien
catttcaggttgtgcattttgtgtg

SEQ ID NO: 151282 - DNA, 25 bp, Homo sapien
gatgcatgtagtagcctttcctgat

SEQ ID NO: 151283 - DNA, 25 bp, Homo sapien
aacacagatctcttgttcgcacaat

SEQ ID NO: 151284 - DNA, 25 bp, Homo sapien
tgttcgcacaatctacactgcctta

SEQ ID NO: 151285 - DNA, 25 bp, Homo sapien
tacactgccttaccttcacttaaac

SEQ ID NO: 151286 - DNA, 25 bp, Homo sapien
cttcacttaaaccacacacacaagg

SEQ ID NO: 151287 - DNA, 25 bp, Homo sapien
acacacaaggtgctcagacatgaaa

SEQ ID NO: 151288 - DNA, 25 bp, Homo sapien
tggcgtaccgtacacagagggactt

SEQ ID NO: 151289 - DNA, 25 bp, Homo sapien
tataaattctgttagctgctcactt

SEQ ID NO: 151290 - DNA, 25 bp, Homo sapien
gctgctcacttaaacaatgtcctct

SEQ ID NO: 151291 - DNA, 25 bp, Homo sapien
cctgccagttctgcggcaagcgttt

SEQ ID NO: 151292 - DNA, 25 bp, Homo sapien
agttctgcggcaagcgtttccacca

SEQ ID NO: 151293 - DNA, 25 bp, Homo sapien
tgcggcaagcgtttccaccagaagt

SEQ ID NO: 151294 - DNA, 25 bp, Homo sapien
gcaagcgtttccaccagaagtccga

SEQ ID NO: 151295 - DNA, 25 bp, Homo sapien
cgtttccaccagaagtccgacatga

SEQ ID NO: 151296 - DNA, 25 bp, Homo sapien
ttcagctgtgagctgtgcaccaaag

SEQ ID NO: 151297 - DNA, 25 bp, Homo sapien
gctgtgagctgtgcaccaaaggctt

SEQ ID NO: 151298 - DNA, 25 bp, Homo sapien
tgagctgtgcaccaaaggcttccag

SEQ ID NO: 151299 - DNA, 25 bp, Homo sapien
ggcttccagcgcaaggtggacctgc

SEQ ID NO: 151300 - DNA, 25 bp, Homo sapien
ttccagcgcaaggtggacctgcggc

SEQ ID NO: 151301 - DNA, 25 bp, Homo sapien
gcgagagccagcacaatctcaagtg

SEQ ID NO: 151302 - DNA, 25 bp, Homo sapien
gaattcaaggaccaattacctgctg

SEQ ID NO: 151303 - DNA, 25 bp, Homo sapien
ggaccaattacctgctgatgagtgc

SEQ ID NO: 151304 - DNA, 25 bp, Homo sapien
aattacctgctgatgagtgcaacaa

SEQ ID NO: 151305 - DNA, 25 bp, Homo sapien
cctgctgatgagtgcaacaagctga

SEQ ID NO: 151306 - DNA, 25 bp, Homo sapien
gatgagtgcaacaagctgaaagaag

SEQ ID NO: 151307 - DNA, 25 bp, Homo sapien
gatttccaaaatgagggagctcctg

SEQ ID NO: 151308 - DNA, 25 bp, Homo sapien
gaaaatattagacaggcagcatcct

SEQ ID NO: 151309 - DNA, 25 bp, Homo sapien
tattagacaggcagcatcctctctt

SEQ ID NO: 151310 - DNA, 25 bp, Homo sapien
ttagacaggcagcatcctctcttca

SEQ ID NO: 151311 - DNA, 25 bp, Homo sapien
gatggcatctgagcgagaaggctct

SEQ ID NO: 151312 - DNA, 25 bp, Homo sapien
cagaaattttgaagccagaaggaca

SEQ ID NO: 151313 - DNA, 25 bp, Homo sapien
aacttacttcagattgtgcgggacc

SEQ ID NO: 151314 - DNA, 25 bp, Homo sapien
gtgcgggaccactgggttcatgttc

SEQ ID NO: 151315 - DNA, 25 bp, Homo sapien
tgggttcatgttcttgtccctatgg

SEQ ID NO: 151316 - DNA, 25 bp, Homo sapien
tgtccctatgggatttgtcattgga

SEQ ID NO: 151317 - DNA, 25 bp, Homo sapien
aagagtgatgaacggctaactgcct

SEQ ID NO: 151318 - DNA, 25 bp, Homo sapien
ggctaactgccttccggaacaagag

SEQ ID NO: 151319 - DNA, 25 bp, Homo sapien
actgccttccggaacaagagtatgt

SEQ ID NO: 151320 - DNA, 25 bp, Homo sapien
aaaagggaattgcaacccagtgaag

SEQ ID NO: 151321 - DNA, 25 bp, Homo sapien
ttgcaacccagtgaagaagttacct

SEQ ID NO: 151322 - DNA, 25 bp, Homo sapien
gtaaagactggctagattatcgaat

SEQ ID NO: 151323 - DNA, 25 bp, Homo sapien
ggctagattatcgaatgttcacatt

SEQ ID NO: 151324 - DNA, 25 bp, Homo sapien
gaggccgcaggctactaagacactg

SEQ ID NO: 151325 - DNA, 25 bp, Homo sapien
ctactaagacactgctctgcccaga

SEQ ID NO: 151326 - DNA, 25 bp, Homo sapien
agagctgaagtctggccccaccatg

SEQ ID NO: 151327 - DNA, 25 bp, Homo sapien
aagtctggccccaccatgagtcctg

SEQ ID NO: 151328 - DNA, 25 bp, Homo sapien
atgagtcctgtgtccaggccggaca

SEQ ID NO: 151329 - DNA, 25 bp, Homo sapien
agtcctgtgtccaggccggacatgg

SEQ ID NO: 151330 - DNA, 25 bp, Homo sapien
gggaccaactactctggcaggatct

SEQ ID NO: 151331 - DNA, 25 bp, Homo sapien
aactactctggcaggatctggaccc

SEQ ID NO: 151332 - DNA, 25 bp, Homo sapien
ctggcaggatctggacccctggcag

SEQ ID NO: 151333 - DNA, 25 bp, Homo sapien
ctgggcagatgagaggctgagcctc

SEQ ID NO: 151334 - DNA, 25 bp, Homo sapien
tggtggtcctgaaccggcccctcta

SEQ ID NO: 151335 - DNA, 25 bp, Homo sapien
aactgtgtagcatctcgattgccag

SEQ ID NO: 151336 - DNA, 25 bp, Homo sapien
ctgtgtagcatctcgattgccagtc

SEQ ID NO: 151337 - DNA, 25 bp, Homo sapien
tgtgtagcatctcgattgccagtct

SEQ ID NO: 151338 - DNA, 25 bp, Homo sapien
gtgtagcatctcgattgccagtctt

SEQ ID NO: 151339 - DNA, 25 bp, Homo sapien
gtagcatctcgattgccagtcttca

SEQ ID NO: 151340 - DNA, 25 bp, Homo sapien
tagcatctcgattgccagtcttcat

SEQ ID NO: 151341 - DNA, 25 bp, Homo sapien
agcatctcgattgccagtcttcatg

SEQ ID NO: 151342 - DNA, 25 bp, Homo sapien
atctcgattgccagtcttcatgtgt

SEQ ID NO: 151343 - DNA, 25 bp, Homo sapien
tctcgattgccagtcttcatgtgtg

SEQ ID NO: 151344 - DNA, 25 bp, Homo sapien
ctcgattgccagtcttcatgtgtgc

SEQ ID NO: 151345 - DNA, 25 bp, Homo sapien
cgattgccagtcttcatgtgtgcca

SEQ ID NO: 151346 - DNA, 25 bp, Homo sapien
gtttgttctttgaatggttgcaaaa

SEQ ID NO: 151347 - DNA, 25 bp, Homo sapien
ctgtagataatcttactgaggactg

SEQ ID NO: 151348 - DNA, 25 bp, Homo sapien
ctgaggactgtacaaacatgaaggt

SEQ ID NO: 151349 - DNA, 25 bp, Homo sapien
aggtgtggtatcaaacttcaggttg

SEQ ID NO: 151350 - DNA, 25 bp, Homo sapien
ttcaggttgaaactgtttgaagcat

SEQ ID NO: 151351 - DNA, 25 bp, Homo sapien
aaacattcatttcacaactagattg

SEQ ID NO: 151352 - DNA, 25 bp, Homo sapien
aggatattagctgtgatgagactca

SEQ ID NO: 151353 - DNA, 25 bp, Homo sapien
gctgtgatgagactcactgcattat

SEQ ID NO: 151354 - DNA, 25 bp, Homo sapien
gaattttatgaaatccccgttccat

SEQ ID NO: 151355 - DNA, 25 bp, Homo sapien
ccgttccattcaacaggcacatgtt

SEQ ID NO: 151356 - DNA, 25 bp, Homo sapien
aaagagctttgtcgttggtgttaat

SEQ ID NO: 151357 - DNA, 25 bp, Homo sapien
ttcggaggcctctgctgccaatggg

SEQ ID NO: 151358 - DNA, 25 bp, Homo sapien
tctgctgccaatgggtcggacaaca

SEQ ID NO: 151359 - DNA, 25 bp, Homo sapien
ggacaacaagctcaagaccgaggtg

SEQ ID NO: 151360 - DNA, 25 bp, Homo sapien
aagctcaagaccgaggtgtcctctt

SEQ ID NO: 151361 - DNA, 25 bp, Homo sapien
aagaccgaggtgtcctcttccatct

SEQ ID NO: 151362 - DNA, 25 bp, Homo sapien
aggtgtcctcttccatctacttcca

SEQ ID NO: 151363 - DNA, 25 bp, Homo sapien
atctacttccacaagcccagggagt

SEQ ID NO: 151364 - DNA, 25 bp, Homo sapien
ggtgtctgctgttctttccccatag

SEQ ID NO: 151365 - DNA, 25 bp, Homo sapien
tgttctttccccataggtcttgctt

SEQ ID NO: 151366 - DNA, 25 bp, Homo sapien
ctttccccataggtcttgctttgtt

SEQ ID NO: 151367 - DNA, 25 bp, Homo sapien
ctgtcttgctgtctagggatggact

SEQ ID NO: 151368 - DNA, 25 bp, Homo sapien
gaggggaccgacctgtttgccgtgg

SEQ ID NO: 151369 - DNA, 25 bp, Homo sapien
ccaactccattatgaggcccttcta

SEQ ID NO: 151370 - DNA, 25 bp, Homo sapien
aactccattatgaggcccttctacc

SEQ ID NO: 151371 - DNA, 25 bp, Homo sapien
attatgaggcccttctaccagggtc

SEQ ID NO: 151372 - DNA, 25 bp, Homo sapien
tatgaggcccttctaccagggtccg

SEQ ID NO: 151373 - DNA, 25 bp, Homo sapien
tgaggcccttctaccagggtccggt

SEQ ID NO: 151374 - DNA, 25 bp, Homo sapien
gtccggtgggcgaccctgacaagta

SEQ ID NO: 151375 - DNA, 25 bp, Homo sapien
ggtgggcgaccctgacaagtaccgc

SEQ ID NO: 151376 - DNA, 25 bp, Homo sapien
aggatgaccgcgatggcctgcagca

SEQ ID NO: 151377 - DNA, 25 bp, Homo sapien
gatgaccgcgatggcctgcagcaac

SEQ ID NO: 151378 - DNA, 25 bp, Homo sapien
accgcgatggcctgcagcaactcta

SEQ ID NO: 151379 - DNA, 25 bp, Homo sapien
ggacaatgatcttaacaccggaaat

SEQ ID NO: 151380 - DNA, 25 bp, Homo sapien
caccggaaattgtgctgtgatgttt

SEQ ID NO: 151381 - DNA, 25 bp, Homo sapien
atgtttcagggagcttggtggtaca

SEQ ID NO: 151382 - DNA, 25 bp, Homo sapien
ggtggtacaaaaactgccatgtgtc

SEQ ID NO: 151383 - DNA, 25 bp, Homo sapien
aaactgccatgtgtcaaacctgaat

SEQ ID NO: 151384 - DNA, 25 bp, Homo sapien
gtcaaacctgaatggtcgctacctc

SEQ ID NO: 151385 - DNA, 25 bp, Homo sapien
gcaaatggcatcaactggaagtcgg

SEQ ID NO: 151386 - DNA, 25 bp, Homo sapien
aggatacaattatagctacaaggtg

SEQ ID NO: 151387 - DNA, 25 bp, Homo sapien
agatgaaggtgcgacctgcctagcc

SEQ ID NO: 151388 - DNA, 25 bp, Homo sapien
tcagggtcaggacgcctccacacat

SEQ ID NO: 151389 - DNA, 25 bp, Homo sapien
gacgcctccacacatagttggttgg

SEQ ID NO: 151390 - DNA, 25 bp, Homo sapien
tttgaaacgtagaggccgcagcagt

SEQ ID NO: 151391 - DNA, 25 bp, Homo sapien
gccgcagcagtcagcgatgtttctg

SEQ ID NO: 151392 - DNA, 25 bp, Homo sapien
agcagtcagcgatgtttctgaaatg

SEQ ID NO: 151393 - DNA, 25 bp, Homo sapien
ttgacgcctgtgtacttcccaggct

SEQ ID NO: 151394 - DNA, 25 bp, Homo sapien
gtgtacttcccaggctggatgtgaa

SEQ ID NO: 151395 - DNA, 25 bp, Homo sapien
gagttgtgccattcacagcacagtg

SEQ ID NO: 151396 - DNA, 25 bp, Homo sapien
gccattcacagcacagtggtgagga

SEQ ID NO: 151397 - DNA, 25 bp, Homo sapien
tcatgaagcaggcaaggaccgaaca

SEQ ID NO: 151398 - DNA, 25 bp, Homo sapien
accccaacgtagacctgcaggtgct

SEQ ID NO: 151399 - DNA, 25 bp, Homo sapien
gcccatataaggagcggagttgtta

SEQ ID NO: 151400 - DNA, 25 bp, Homo sapien
agcggagttgttaaggactgaagaa

SEQ ID NO: 151401 - DNA, 25 bp, Homo sapien
gcgccgtgcaagtgccgctgttcga

SEQ ID NO: 151402 - DNA, 25 bp, Homo sapien
aagtgccgctgttcgaccccgacat

SEQ ID NO: 151403 - DNA, 25 bp, Homo sapien
acagccctgtggaccacgaggacat

SEQ ID NO: 151404 - DNA, 25 bp, Homo sapien
gtggaccacgaggacatctccgtct

SEQ ID NO: 151405 - DNA, 25 bp, Homo sapien
gctcggtcagcaccaacatggactg

SEQ ID NO: 151406 - DNA, 25 bp, Homo sapien
accaacatggactgagggacttctc

SEQ ID NO: 151407 - DNA, 25 bp, Homo sapien
agggacttctcagaggcagggcagc

SEQ ID NO: 151408 - DNA, 25 bp, Homo sapien
ggactcctctcgtacttgaactcac

SEQ ID NO: 151409 - DNA, 25 bp, Homo sapien
gtacttgaactcactccctcacggg

SEQ ID NO: 151410 - DNA, 25 bp, Homo sapien
ggagagagaccacacgcagtattga

SEQ ID NO: 151411 - DNA, 25 bp, Homo sapien
agagagaccacacgcagtattgagc

SEQ ID NO: 151412 - DNA, 25 bp, Homo sapien
agaaggcagctcttggcctcccact

SEQ ID NO: 151413 - DNA, 25 bp, Homo sapien
tcccacacttctttgcctataaatc

SEQ ID NO: 151414 - DNA, 25 bp, Homo sapien
gcctataaatcttcctagcagcaat

SEQ ID NO: 151415 - DNA, 25 bp, Homo sapien
agcagcaatttgagctacctgagga

SEQ ID NO: 151416 - DNA, 25 bp, Homo sapien
aagggcaagggcctgcctctgacct

SEQ ID NO: 151417 - DNA, 25 bp, Homo sapien
gacctgccgtgtcctttgcaggaag

SEQ ID NO: 151418 - DNA, 25 bp, Homo sapien
ctttgcaggaaggaggtaggcacct

SEQ ID NO: 151419 - DNA, 25 bp, Homo sapien
aggtaggcacctttctgagcttatt

SEQ ID NO: 151420 - DNA, 25 bp, Homo sapien
aggcacctttctgagcttattctat

SEQ ID NO: 151421 - DNA, 25 bp, Homo sapien
tttctgagcttattctattccccac

SEQ ID NO: 151422 - DNA, 25 bp, Homo sapien
gcagggttggaaatgaaggactttt

SEQ ID NO: 151423 - DNA, 25 bp, Homo sapien
agatgaaggcaactgaatcccaaga

SEQ ID NO: 151424 - DNA, 25 bp, Homo sapien
aactgaatcccaagaggcacctgca

SEQ ID NO: 151425 - DNA, 25 bp, Homo sapien
gcagccaggaaggaaagccccgtgt

SEQ ID NO: 151426 - DNA, 25 bp, Homo sapien
agccccgtgtggaatgtggtgacct

SEQ ID NO: 151427 - DNA, 25 bp, Homo sapien
gtggtgacctagtcacctggaacca

SEQ ID NO: 151428 - DNA, 25 bp, Homo sapien
gacagaccccggcaacttctagatg

SEQ ID NO: 151429 - DNA, 25 bp, Homo sapien
cttctagatgaacccaagtgaactt

SEQ ID NO: 151430 - DNA, 25 bp, Homo sapien
tttcctcattaccatcctgaagtca

SEQ ID NO: 151431 - DNA, 25 bp, Homo sapien
ggagctatagcttcatgaccgtaac

SEQ ID NO: 151432 - DNA, 25 bp, Homo sapien
agctatagcttcatgaccgtaacat

SEQ ID NO: 151433 - DNA, 25 bp, Homo sapien
gctggcaggacgactcactgcggct

SEQ ID NO: 151434 - DNA, 25 bp, Homo sapien
tggggcttgatgactttctttttgt

SEQ ID NO: 151435 - DNA, 25 bp, Homo sapien
gagagaaataagtgccctctcccac

SEQ ID NO: 151436 - DNA, 25 bp, Homo sapien
tcttcctactggtctctctatgcct

SEQ ID NO: 151437 - DNA, 25 bp, Homo sapien
ctgatgaaaaattgctgactgtagc

SEQ ID NO: 151438 - DNA, 25 bp, Homo sapien
atgaaaaattgctgactgtagcttt

SEQ ID NO: 151439 - DNA, 25 bp, Homo sapien
gactgtagctttggaagtttagctc

SEQ ID NO: 151440 - DNA, 25 bp, Homo sapien
ctgtagctttggaagtttagctctg

SEQ ID NO: 151441 - DNA, 25 bp, Homo sapien
gtttagctctgagaaccgtagatga

SEQ ID NO: 151442 - DNA, 25 bp, Homo sapien
ttagctctgagaaccgtagatgatt

SEQ ID NO: 151443 - DNA, 25 bp, Homo sapien
tagctctgagaaccgtagatgattt

SEQ ID NO: 151444 - DNA, 25 bp, Homo sapien
gctctgagaaccgtagatgatttca

SEQ ID NO: 151445 - DNA, 25 bp, Homo sapien
aaatttgacatgattgtgcctatcc

SEQ ID NO: 151446 - DNA, 25 bp, Homo sapien
ttgacatgattgtgcctatccttga

SEQ ID NO: 151447 - DNA, 25 bp, Homo sapien
acatgattgtgcctatccttgagaa

SEQ ID NO: 151448 - DNA, 25 bp, Homo sapien
gattgtgcctatccttgagaagatg

SEQ ID NO: 151449 - DNA, 25 bp, Homo sapien
gtgcctatccttgagaagatgcagg

SEQ ID NO: 151450 - DNA, 25 bp, Homo sapien
caagtaggactggaaggtccttgcc

SEQ ID NO: 151451 - DNA, 25 bp, Homo sapien
aaggtccttgcctgaactccagagg

SEQ ID NO: 151452 - DNA, 25 bp, Homo sapien
actccagaggtgtcgggacatggtt

SEQ ID NO: 151453 - DNA, 25 bp, Homo sapien
gggaatgcacctccccaaagcagca

SEQ ID NO: 151454 - DNA, 25 bp, Homo sapien
gggcgggctcagagctttgtcactt

SEQ ID NO: 151455 - DNA, 25 bp, Homo sapien
ggctcagagctttgtcacttgccac

SEQ ID NO: 151456 - DNA, 25 bp, Homo sapien
gaacaacgtggccaagcttcgacaa

SEQ ID NO: 151457 - DNA, 25 bp, Homo sapien
acaacgtggccaagcttcgacaatg

SEQ ID NO: 151458 - DNA, 25 bp, Homo sapien
aacgtggccaagcttcgacaatgct

SEQ ID NO: 151459 - DNA, 25 bp, Homo sapien
tggccaagcttcgacaatgctcaca

SEQ ID NO: 151460 - DNA, 25 bp, Homo sapien
aagcttcgacaatgctcacacccta

SEQ ID NO: 151461 - DNA, 25 bp, Homo sapien
tcgacaatgctcacaccctattgca

SEQ ID NO: 151462 - DNA, 25 bp, Homo sapien
gaaatgtacaaatattggcaaagta

SEQ ID NO: 151463 - DNA, 25 bp, Homo sapien
aaaaatccattaacacctgctcaca

SEQ ID NO: 151464 - DNA, 25 bp, Homo sapien
tccattaacacctgctcacatctta

SEQ ID NO: 151465 - DNA, 25 bp, Homo sapien
tcacatcttactcaaaattgtagag

SEQ ID NO: 151466 - DNA, 25 bp, Homo sapien
gtagagttcatagtaaataaaagca

SEQ ID NO: 151467 - DNA, 25 bp, Homo sapien
aataatcctctgtagcttgagctac

SEQ ID NO: 151468 - DNA, 25 bp, Homo sapien
gctgtaacttacgtgacctgtgctg

SEQ ID NO: 151469 - DNA, 25 bp, Homo sapien
gtcactgggcataggacagcggcat

SEQ ID NO: 151470 - DNA, 25 bp, Homo sapien
taggacagcggcatcacggttgcat

SEQ ID NO: 151471 - DNA, 25 bp, Homo sapien
atcacggttgcattcccattggact

SEQ ID NO: 151472 - DNA, 25 bp, Homo sapien
attggactcatgcacctcccggatg

SEQ ID NO: 151473 - DNA, 25 bp, Homo sapien
gaaaggcttgaacctgccagctgat

SEQ ID NO: 151474 - DNA, 25 bp, Homo sapien
aacctgccagctgatttgaaatact

SEQ ID NO: 151475 - DNA, 25 bp, Homo sapien
tgaaatactttcaccctgcgcaggg

SEQ ID NO: 151476 - DNA, 25 bp, Homo sapien
agggccgtatgcatcctgccaagct

SEQ ID NO: 151477 - DNA, 25 bp, Homo sapien
gccaagctgcgttatattctgtact

SEQ ID NO: 151478 - DNA, 25 bp, Homo sapien
caggcccttggaacaggaggtctct

SEQ ID NO: 151479 - DNA, 25 bp, Homo sapien
tttcttgtcctagtacatccagctc

SEQ ID NO: 151480 - DNA, 25 bp, Homo sapien
ctagtacatccagctctcagtggat

SEQ ID NO: 151481 - DNA, 25 bp, Homo sapien
ctcagtggatgctcctgctagagta

SEQ ID NO: 151482 - DNA, 25 bp, Homo sapien
gatgctcctgctagagtagccacat

SEQ ID NO: 151483 - DNA, 25 bp, Homo sapien
tcagccagctgaggtaactccagga

SEQ ID NO: 151484 - DNA, 25 bp, Homo sapien
aggacatgcacctgggaactcgctg

SEQ ID NO: 151485 - DNA, 25 bp, Homo sapien
ctgggaactcgctggctcagaaaag

SEQ ID NO: 151486 - DNA, 25 bp, Homo sapien
ctcagaaaagagttgggtcctatac

SEQ ID NO: 151487 - DNA, 25 bp, Homo sapien
gagttgggtcctatacccacccttg

SEQ ID NO: 151488 - DNA, 25 bp, Homo sapien
tatacccacccttgcctgttgtttc

SEQ ID NO: 151489 - DNA, 25 bp, Homo sapien
ggtaagtagatcttttgccttgcaa

SEQ ID NO: 151490 - DNA, 25 bp, Homo sapien
ttttgccttgcaaattgctgcctgg

SEQ ID NO: 151491 - DNA, 25 bp, Homo sapien
gcaaattgctgcctgggtgaatgct

SEQ ID NO: 151492 - DNA, 25 bp, Homo sapien
gggtgaatgctgcttgttctctcac

SEQ ID NO: 151493 - DNA, 25 bp, Homo sapien
tagtagttcctccactaactttctc

SEQ ID NO: 151494 - DNA, 25 bp, Homo sapien
gtggtagagcacttgatttcagttg

SEQ ID NO: 151495 - DNA, 25 bp, Homo sapien
gatttcagttgaatgcctgctggta

SEQ ID NO: 151496 - DNA, 25 bp, Homo sapien
gttgaatgcctgctggtagcttttc

SEQ ID NO: 151497 - DNA, 25 bp, Homo sapien
gcttttccattctgtggagctgccg

SEQ ID NO: 151498 - DNA, 25 bp, Homo sapien
gagctgccgttcctaataattccag

SEQ ID NO: 151499 - DNA, 25 bp, Homo sapien
taattccaggtttggtaacgtggag

SEQ ID NO: 151500 - DNA, 25 bp, Homo sapien
ggcagcaacccactaaagtccagat

SEQ ID NO: 151501 - DNA, 25 bp, Homo sapien
taaagtccagatccctcaaagtgaa

SEQ ID NO: 151502 - DNA, 25 bp, Homo sapien
aatagaggcagtgcaccacagaccc

SEQ ID NO: 151503 - DNA, 25 bp, Homo sapien
agtcaccacagctgacttttcgctc

SEQ ID NO: 151504 - DNA, 25 bp, Homo sapien
agcacatcagtaccatcctcttaga

SEQ ID NO: 151505 - DNA, 25 bp, Homo sapien
atcagtaccatcctcttagaagaaa

SEQ ID NO: 151506 - DNA, 25 bp, Homo sapien
tgggcactgaggtttcagcgccttg

SEQ ID NO: 151507 - DNA, 25 bp, Homo sapien
aggtttcagcgccttgtcagggacc

SEQ ID NO: 151508 - DNA, 25 bp, Homo sapien
gtcagggaccttccaaagggctgtc

SEQ ID NO: 151509 - DNA, 25 bp, Homo sapien
aagcagaaactgttccctttctctt

SEQ ID NO: 151510 - DNA, 25 bp, Homo sapien
actgttccctttctcttcaagagag

SEQ ID NO: 151511 - DNA, 25 bp, Homo sapien
agcttgcacctccagtttgcacagg

SEQ ID NO: 151512 - DNA, 25 bp, Homo sapien
gcttgcacctccagtttgcacaggg

SEQ ID NO: 151513 - DNA, 25 bp, Homo sapien
agtttgcacagggatttgtcctggg

SEQ ID NO: 151514 - DNA, 25 bp, Homo sapien
ccgcccttggtgctgtcataaaagg

SEQ ID NO: 151515 - DNA, 25 bp, Homo sapien
tggtgctgtcataaaagggcaggca

SEQ ID NO: 151516 - DNA, 25 bp, Homo sapien
cccagagactgactctcagagccag

SEQ ID NO: 151517 - DNA, 25 bp, Homo sapien
tggcctgcacagagagcatgggtga

SEQ ID NO: 151518 - DNA, 25 bp, Homo sapien
cacagagagcatgggtgagcgtgta

SEQ ID NO: 151519 - DNA, 25 bp, Homo sapien
tgagcgtgtaaaagcttggccctgt

SEQ ID NO: 151520 - DNA, 25 bp, Homo sapien
gcgtgtaaaagcttggccctgtgcc

SEQ ID NO: 151521 - DNA, 25 bp, Homo sapien
cgtgtaaaagcttggccctgtgccc

SEQ ID NO: 151522 - DNA, 25 bp, Homo sapien
taagatttttactcattcaaggcaa

SEQ ID NO: 151523 - DNA, 25 bp, Homo sapien
gatttttactcattcaaggcaagta

SEQ ID NO: 151524 - DNA, 25 bp, Homo sapien
aattatctgagctctatggcactgg

SEQ ID NO: 151525 - DNA, 25 bp, Homo sapien
atctgagctctatggcactggttgt

SEQ ID NO: 151526 - DNA, 25 bp, Homo sapien
gagctctatggcactggttgtttag

SEQ ID NO: 151527 - DNA, 25 bp, Homo sapien
gcactggttgtttagagtgactgat

SEQ ID NO: 151528 - DNA, 25 bp, Homo sapien
atcaccagcctactgcagaagtgca

SEQ ID NO: 151529 - DNA, 25 bp, Homo sapien
agcctactgcagaagtgcagggcac

SEQ ID NO: 151530 - DNA, 25 bp, Homo sapien
gtaaacaccatgtattattgaagat

SEQ ID NO: 151531 - DNA, 25 bp, Homo sapien
ctgttttgtatgtatccttgtcaaa

SEQ ID NO: 151532 - DNA, 25 bp, Homo sapien
gtatccttgtcaaatatattctata

SEQ ID NO: 151533 - DNA, 25 bp, Homo sapien
caggatggtgagcagcgtccctctc

SEQ ID NO: 151534 - DNA, 25 bp, Homo sapien
aggatggtgagcagcgtccctctca

SEQ ID NO: 151535 - DNA, 25 bp, Homo sapien
ggatggtgagcagcgtccctctcat

SEQ ID NO: 151536 - DNA, 25 bp, Homo sapien
atggtgagcagcgtccctctcatgt

SEQ ID NO: 151537 - DNA, 25 bp, Homo sapien
tggtgagcagcgtccctctcatgtg

SEQ ID NO: 151538 - DNA, 25 bp, Homo sapien
ggtgagcagcgtccctctcatgtga

SEQ ID NO: 151539 - DNA, 25 bp, Homo sapien
tgagcagcgtccctctcatgtgaca

SEQ ID NO: 151540 - DNA, 25 bp, Homo sapien
gagcagcgtccctctcatgtgacac

SEQ ID NO: 151541 - DNA, 25 bp, Homo sapien
gcgtccctctcatgtgacacccaca

SEQ ID NO: 151542 - DNA, 25 bp, Homo sapien
tcaacccccaactgaggaccactgt

SEQ ID NO: 151543 - DNA, 25 bp, Homo sapien
agtcaggaaatattgtagggagaaa

SEQ ID NO: 151544 - DNA, 25 bp, Homo sapien
catccatgggagctaaaagcctttg

SEQ ID NO: 151545 - DNA, 25 bp, Homo sapien
taaaagcctttgcatccccttcaaa

SEQ ID NO: 151546 - DNA, 25 bp, Homo sapien
cagcctggagccaaatgtgtctgtg

SEQ ID NO: 151547 - DNA, 25 bp, Homo sapien
aatgtgtctgtggcaagaaccctgc

SEQ ID NO: 151548 - DNA, 25 bp, Homo sapien
aagaaccctgccaagtactacacct

SEQ ID NO: 151549 - DNA, 25 bp, Homo sapien
agtactacaccttatttggtcgcag

SEQ ID NO: 151550 - DNA, 25 bp, Homo sapien
acaccttatttggtcgcagctactg

SEQ ID NO: 151551 - DNA, 25 bp, Homo sapien
tatttggtcgcagctactgagggat

SEQ ID NO: 151552 - DNA, 25 bp, Homo sapien
cgcagctactgagggatgaacgaaa

SEQ ID NO: 151553 - DNA, 25 bp, Homo sapien
ggatgaacgaaagccccctcttcaa

SEQ ID NO: 151554 - DNA, 25 bp, Homo sapien
gacaattattcttatgcctaagtta

SEQ ID NO: 151555 - DNA, 25 bp, Homo sapien
gagattgcagaaaaggcttcccttg

SEQ ID NO: 151556 - DNA, 25 bp, Homo sapien
gaaaaggcttcccttggctcccaag

SEQ ID NO: 151557 - DNA, 25 bp, Homo sapien
cttggctcccaaggaggtgtagcag

SEQ ID NO: 151558 - DNA, 25 bp, Homo sapien
ggtgtagcaggtgtgagcaatatta

SEQ ID NO: 151559 - DNA, 25 bp, Homo sapien
caatattagtgccatgtgcctttca

SEQ ID NO: 151560 - DNA, 25 bp, Homo sapien
gccatgtgcctttcacacagggttt

SEQ ID NO: 151561 - DNA, 25 bp, Homo sapien
cacacagggtttgcatttatcagtc

SEQ ID NO: 151562 - DNA, 25 bp, Homo sapien
gcatttatcagtctgttttccgatg

SEQ ID NO: 151563 - DNA, 25 bp, Homo sapien
gtctgttttccgatgatgtgtacat

SEQ ID NO: 151564 - DNA, 25 bp, Homo sapien
atagaactcttcttgcagtgggttg

SEQ ID NO: 151565 - DNA, 25 bp, Homo sapien
gcagtgggttgctattttctagatt

SEQ ID NO: 151566 - DNA, 25 bp, Homo sapien
tttgtttttctaccgtccttgtcat

SEQ ID NO: 151567 - DNA, 25 bp, Homo sapien
ctaccgtccttgtcataactttgtg

SEQ ID NO: 151568 - DNA, 25 bp, Homo sapien
gtccttgtcataactttgtgttgga

SEQ ID NO: 151569 - DNA, 25 bp, Homo sapien
ttgtgttggagggaacctgtttcac

SEQ ID NO: 151570 - DNA, 25 bp, Homo sapien
gagggaacctgtttcactatggcct

SEQ ID NO: 151571 - DNA, 25 bp, Homo sapien
aacctgtttcactatggcctccttt

SEQ ID NO: 151572 - DNA, 25 bp, Homo sapien
cccatcatcatgtctgtttccagaa

SEQ ID NO: 151573 - DNA, 25 bp, Homo sapien
gtttccagaacagtgccttggtcat

SEQ ID NO: 151574 - DNA, 25 bp, Homo sapien
gggacccccaagatgtgtcctatga

SEQ ID NO: 151575 - DNA, 25 bp, Homo sapien
tggtggaacccagaaacggacgccg

SEQ ID NO: 151576 - DNA, 25 bp, Homo sapien
acccagaaacggacgccggtgcttg

SEQ ID NO: 151577 - DNA, 25 bp, Homo sapien
tctcctggacgccatatagctttaa

SEQ ID NO: 151578 - DNA, 25 bp, Homo sapien
gggtctcacaaaaagcaatccatcc

SEQ ID NO: 151579 - DNA, 25 bp, Homo sapien
gcaatccatcctgtagtataggtaa

SEQ ID NO: 151580 - DNA, 25 bp, Homo sapien
agcagcttccattctggatgtttgg

SEQ ID NO: 151581 - DNA, 25 bp, Homo sapien
cattctggatgtttggaacccttta

SEQ ID NO: 151582 - DNA, 25 bp, Homo sapien
ttggaatggcccaccattctcactg

SEQ ID NO: 151583 - DNA, 25 bp, Homo sapien
aaacagtggtctgctgtgaaaggcc

SEQ ID NO: 151584 - DNA, 25 bp, Homo sapien
tgtgaaaggccagctctcggcagcc

SEQ ID NO: 151585 - DNA, 25 bp, Homo sapien
tgtggtttcagcgtgccgctctgtg

SEQ ID NO: 151586 - DNA, 25 bp, Homo sapien
cgctctgtgtcattcaggttgtgca

SEQ ID NO: 151587 - DNA, 25 bp, Homo sapien
caggttgtgcacattgtttttcttc

SEQ ID NO: 151588 - DNA, 25 bp, Homo sapien
tgaatgtaccaattgcagtgtggaa

SEQ ID NO: 151589 - DNA, 25 bp, Homo sapien
aagatgttggccttttgcttccaaa

SEQ ID NO: 151590 - DNA, 25 bp, Homo sapien
actccccaatcttatttaccacaag

SEQ ID NO: 151591 - DNA, 25 bp, Homo sapien
cttatttaccacaaggagattcctt

SEQ ID NO: 151592 - DNA, 25 bp, Homo sapien
agattcctttttacaatcacttgga

SEQ ID NO: 151593 - DNA, 25 bp, Homo sapien
tacaatcacttggactttatctggg

SEQ ID NO: 151594 - DNA, 25 bp, Homo sapien
caatggatgcccctcaagaagttta

SEQ ID NO: 151595 - DNA, 25 bp, Homo sapien
gatgcccctcaagaagtttacaatg

SEQ ID NO: 151596 - DNA, 25 bp, Homo sapien
aatgacattgtttctatgatatcag

SEQ ID NO: 151597 - DNA, 25 bp, Homo sapien
aaatactttattctctcatacatag

SEQ ID NO: 151598 - DNA, 25 bp, Homo sapien
taatgtttgacatgcagtgcttctt

SEQ ID NO: 151599 - DNA, 25 bp, Homo sapien
catgcccagctactaaaaatacttg

SEQ ID NO: 151600 - DNA, 25 bp, Homo sapien
gcccagctactaaaaatacttgtat

SEQ ID NO: 151601 - DNA, 25 bp, Homo sapien
gagccagccagcattagtaattttt

SEQ ID NO: 151602 - DNA, 25 bp, Homo sapien
gccagccagcattagtaatttttaa

SEQ ID NO: 151603 - DNA, 25 bp, Homo sapien
ggagaaaagatatcacaactctatg

SEQ ID NO: 151604 - DNA, 25 bp, Homo sapien
aaaagatatcacaactctatggaaa

SEQ ID NO: 151605 - DNA, 25 bp, Homo sapien
ggaaaatgacatttccatttgcctt

SEQ ID NO: 151606 - DNA, 25 bp, Homo sapien
atgacatttccatttgccttattgc

SEQ ID NO: 151607 - DNA, 25 bp, Homo sapien
gacatttccatttgccttattgcta

SEQ ID NO: 151608 - DNA, 25 bp, Homo sapien
atttccatttgccttattgctactt

SEQ ID NO: 151609 - DNA, 25 bp, Homo sapien
ttccatttgccttattgctacttca

SEQ ID NO: 151610 - DNA, 25 bp, Homo sapien
gacccatgtaatccttttgtttagt

SEQ ID NO: 151611 - DNA, 25 bp, Homo sapien
catggaatggcaggtgtcatatgac

SEQ ID NO: 151612 - DNA, 25 bp, Homo sapien
ggtgtcatatgactgattactcaga

SEQ ID NO: 151613 - DNA, 25 bp, Homo sapien
aactgtagtctctgagtcctttgct

SEQ ID NO: 151614 - DNA, 25 bp, Homo sapien
gagtcctttgctaatcgcaactctt

SEQ ID NO: 151615 - DNA, 25 bp, Homo sapien
tcgcaactcttgtgaattattctga

SEQ ID NO: 151616 - DNA, 25 bp, Homo sapien
gcagaatttgattcgtatgatcagt

SEQ ID NO: 151617 - DNA, 25 bp, Homo sapien
cgtatgatcagtactgactttctga

SEQ ID NO: 151618 - DNA, 25 bp, Homo sapien
gactttctgattactgtccagctta

SEQ ID NO: 151619 - DNA, 25 bp, Homo sapien
gtccagcttatagtcttccagttta

SEQ ID NO: 151620 - DNA, 25 bp, Homo sapien
gtttaatgaactaccatctgatgtt

SEQ ID NO: 151621 - DNA, 25 bp, Homo sapien
cagcaacccctgcattccttttttt

SEQ ID NO: 151622 - DNA, 25 bp, Homo sapien
tttttaccgggctgacgagaatgat

SEQ ID NO: 151623 - DNA, 25 bp, Homo sapien
ttttaccgggctgacgagaatgatg

SEQ ID NO: 151624 - DNA, 25 bp, Homo sapien
tttaccgggctgacgagaatgatga

SEQ ID NO: 151625 - DNA, 25 bp, Homo sapien
ctgacgagaatgatgaggtgaagat

SEQ ID NO: 151626 - DNA, 25 bp, Homo sapien
catatccctaccatcccttctcagt

SEQ ID NO: 151627 - DNA, 25 bp, Homo sapien
ttacccttacagtagcaagcataga

SEQ ID NO: 151628 - DNA, 25 bp, Homo sapien
tacccttacagtagcaagcatagac

SEQ ID NO: 151629 - DNA, 25 bp, Homo sapien
acccttacagtagcaagcatagacc

SEQ ID NO: 151630 - DNA, 25 bp, Homo sapien
ccttacagtagcaagcatagacccc

SEQ ID NO: 151631 - DNA, 25 bp, Homo sapien
aagcatagacccctgtctaacgggg

SEQ ID NO: 151632 - DNA, 25 bp, Homo sapien
tgccctcttggcgtgagttgcgtat

SEQ ID NO: 151633 - DNA, 25 bp, Homo sapien
gtgagttgcgtattcaggctgcttt

SEQ ID NO: 151634 - DNA, 25 bp, Homo sapien
ccagagagctggttgaagatgtttg

SEQ ID NO: 151635 - DNA, 25 bp, Homo sapien
gtttctgtgcccctgtggtggaaga

SEQ ID NO: 151636 - DNA, 25 bp, Homo sapien
acgacagtgccagcgcagcgttctg

SEQ ID NO: 151637 - DNA, 25 bp, Homo sapien
agcgttctgggctcctcagtcgcag

SEQ ID NO: 151638 - DNA, 25 bp, Homo sapien
gtgagtcatgcggattatccactcg

SEQ ID NO: 151639 - DNA, 25 bp, Homo sapien
ggattatccactcgccacagttatc

SEQ ID NO: 151640 - DNA, 25 bp, Homo sapien
gccacagttatcagctgccattgct

SEQ ID NO: 151641 - DNA, 25 bp, Homo sapien
tttccccactctcttatttgtgcat

SEQ ID NO: 151642 - DNA, 25 bp, Homo sapien
ctcttatttgtgcattcggtttggt

SEQ ID NO: 151643 - DNA, 25 bp, Homo sapien
gcccagcagtggaggccggcgacga

SEQ ID NO: 151644 - DNA, 25 bp, Homo sapien
gggccagcgccacaaggtgaagtcc

SEQ ID NO: 151645 - DNA, 25 bp, Homo sapien
ggcctgtgtgactcctgccagcggc

SEQ ID NO: 151646 - DNA, 25 bp, Homo sapien
cctgtgtgactcctgccagcggctg

SEQ ID NO: 151647 - DNA, 25 bp, Homo sapien
ctgccagcggctgctgaaccttccc

SEQ ID NO: 151648 - DNA, 25 bp, Homo sapien
aaggggtcatcatctctggccacca

SEQ ID NO: 151649 - DNA, 25 bp, Homo sapien
tgggcagagcagctatgaccgccac

SEQ ID NO: 151650 - DNA, 25 bp, Homo sapien
gggcagagcagctatgaccgccacc

SEQ ID NO: 151651 - DNA, 25 bp, Homo sapien
agagcagctatgaccgccacccagc

SEQ ID NO: 151652 - DNA, 25 bp, Homo sapien
gggttgtaatttataagctgacgaa

SEQ ID NO: 151653 - DNA, 25 bp, Homo sapien
atttataagctgacgaaggtagcca

SEQ ID NO: 151654 - DNA, 25 bp, Homo sapien
gaggaaagatatctgtggtagacat

SEQ ID NO: 151655 - DNA, 25 bp, Homo sapien
gacatgtccttccatgactaatttc

SEQ ID NO: 151656 - DNA, 25 bp, Homo sapien
gactaatttctaattgtaactcaac

SEQ ID NO: 151657 - DNA, 25 bp, Homo sapien
gtaactcaacacacattgaggtatg

SEQ ID NO: 151658 - DNA, 25 bp, Homo sapien
gaggtatgggccctcctcagtgact

SEQ ID NO: 151659 - DNA, 25 bp, Homo sapien
ggccctcctcagtgactttaactag

SEQ ID NO: 151660 - DNA, 25 bp, Homo sapien
tcctcagtgactttaactagctcag

SEQ ID NO: 151661 - DNA, 25 bp, Homo sapien
taactagctcagaaacgtactcccc

SEQ ID NO: 151662 - DNA, 25 bp, Homo sapien
gttctgggagagcattgttattaag

SEQ ID NO: 151663 - DNA, 25 bp, Homo sapien
aaaaagcattatcagacagtcttga

SEQ ID NO: 151664 - DNA, 25 bp, Homo sapien
gacagtcttgatattatacattttc

SEQ ID NO: 151665 - DNA, 25 bp, Homo sapien
agcgtccaggctgcgcgatgagcac

SEQ ID NO: 151666 - DNA, 25 bp, Homo sapien
aggctgcgcgatgagcacacactac

SEQ ID NO: 151667 - DNA, 25 bp, Homo sapien
gagcacacactactactgatggcct

SEQ ID NO: 151668 - DNA, 25 bp, Homo sapien
acactactactgatggcctttcggg

SEQ ID NO: 151669 - DNA, 25 bp, Homo sapien
gggcatcccggcttccacaatgcag

SEQ ID NO: 151670 - DNA, 25 bp, Homo sapien
gcttccacaatgcagctgctctggg

SEQ ID NO: 151671 - DNA, 25 bp, Homo sapien
gggcctcgtctgtctgggtcctttg

SEQ ID NO: 151672 - DNA, 25 bp, Homo sapien
tcgtctgtctgggtcctttggtcaa

SEQ ID NO: 151673 - DNA, 25 bp, Homo sapien
gtctgggtcctttggtcaatgttgc

SEQ ID NO: 151674 - DNA, 25 bp, Homo sapien
gttgcacagtttttattgctcccat

SEQ ID NO: 151675 - DNA, 25 bp, Homo sapien
cagtttttattgctcccatcccttt

SEQ ID NO: 151676 - DNA, 25 bp, Homo sapien
gaccttttaaagtgtttcagctaag

SEQ ID NO: 151677 - DNA, 25 bp, Homo sapien
tgtttcagctaagggaagacatttc

SEQ ID NO: 151678 - DNA, 25 bp, Homo sapien
ttttctttttacataactgccttga

SEQ ID NO: 151679 - DNA, 25 bp, Homo sapien
taactgccttgaacctgtgagtaaa

SEQ ID NO: 151680 - DNA, 25 bp, Homo sapien
ctgtgagtaaatattgaggctttgt

SEQ ID NO: 151681 - DNA, 25 bp, Homo sapien
gaggctttgtgttgtaattcttcag

SEQ ID NO: 151682 - DNA, 25 bp, Homo sapien
gtaattcttcagttggttgtgtctt

SEQ ID NO: 151683 - DNA, 25 bp, Homo sapien
ttcttcagttggttgtgtctttttt

SEQ ID NO: 151684 - DNA, 25 bp, Homo sapien
tttcctttttctgattagctttgtg

SEQ ID NO: 151685 - DNA, 25 bp, Homo sapien
gtttggtttacatttaaagcattgc

SEQ ID NO: 151686 - DNA, 25 bp, Homo sapien
aagcattgctgttatgtctgtttaa

SEQ ID NO: 151687 - DNA, 25 bp, Homo sapien
tttgttatactctagccaagattga

SEQ ID NO: 151688 - DNA, 25 bp, Homo sapien
tagccaagattgactgtattagatg

SEQ ID NO: 151689 - DNA, 25 bp, Homo sapien
gaggatcttgttcaatcggaaaccc

SEQ ID NO: 151690 - DNA, 25 bp, Homo sapien
gatggaagttgttcttcgtcactta

SEQ ID NO: 151691 - DNA, 25 bp, Homo sapien
gttcttcgtcacttaatgttggttc

SEQ ID NO: 151692 - DNA, 25 bp, Homo sapien
aatgttggttccagtccttcaactg

SEQ ID NO: 151693 - DNA, 25 bp, Homo sapien
gtccttcaactgttcatatctactt

SEQ ID NO: 151694 - DNA, 25 bp, Homo sapien
aacattcacatactaacccttcttc

SEQ ID NO: 151695 - DNA, 25 bp, Homo sapien
acatactaacccttcttcaagatgg

SEQ ID NO: 151696 - DNA, 25 bp, Homo sapien
atgcagtttagccatgtcctcaaga

SEQ ID NO: 151697 - DNA, 25 bp, Homo sapien
tagccatgtcctcaagataaagtct

SEQ ID NO: 151698 - DNA, 25 bp, Homo sapien
gatttgatagcagagcagcccgtga

SEQ ID NO: 151699 - DNA, 25 bp, Homo sapien
tgatagcagagcagcccgtgagcga

SEQ ID NO: 151700 - DNA, 25 bp, Homo sapien
gggagctcttggccacccaaaagtg

SEQ ID NO: 151701 - DNA, 25 bp, Homo sapien
aaaccggcacatgcggttactgtgg

SEQ ID NO: 151702 - DNA, 25 bp, Homo sapien
ttactgtgggctccagttcagacag

SEQ ID NO: 151703 - DNA, 25 bp, Homo sapien
agttcagacagcaccaccactagag

SEQ ID NO: 151704 - DNA, 25 bp, Homo sapien
agcatcctgtgagcatttccgcggg

SEQ ID NO: 151705 - DNA, 25 bp, Homo sapien
agcacgtgaagctcgctggttctgt

SEQ ID NO: 151706 - DNA, 25 bp, Homo sapien
ctggttctgtgcgaagggtattcct

SEQ ID NO: 151707 - DNA, 25 bp, Homo sapien
gaagggtattcctggtgctgaataa

SEQ ID NO: 151708 - DNA, 25 bp, Homo sapien
gtgctgaataaagggtgttgctgtc

SEQ ID NO: 151709 - DNA, 25 bp, Homo sapien
tcccccagaagcaggtgagaggctc

SEQ ID NO: 151710 - DNA, 25 bp, Homo sapien
cctgtggaccctggttgtaaagagt

SEQ ID NO: 151711 - DNA, 25 bp, Homo sapien
gagtaaattgtatcttaggaaacca

SEQ ID NO: 151712 - DNA, 25 bp, Homo sapien
tcttaggaaaccagtgtcacctttt

SEQ ID NO: 151713 - DNA, 25 bp, Homo sapien
attatttgcgtcatacatttcctgt

SEQ ID NO: 151714 - DNA, 25 bp, Homo sapien
tgcgtcatacatttcctgtaacgga

SEQ ID NO: 151715 - DNA, 25 bp, Homo sapien
catttcctgtaacggaagtgttaat

SEQ ID NO: 151716 - DNA, 25 bp, Homo sapien
tggtaccccttttgggaatctaatg

SEQ ID NO: 151717 - DNA, 25 bp, Homo sapien
tgtcctgattttgccacaacctgga

SEQ ID NO: 151718 - DNA, 25 bp, Homo sapien
gattttgccacaacctggatattga

SEQ ID NO: 151719 - DNA, 25 bp, Homo sapien
gccacaacctggatattgaagctat

SEQ ID NO: 151720 - DNA, 25 bp, Homo sapien
gacagacattccgtggataggaaga

SEQ ID NO: 151721 - DNA, 25 bp, Homo sapien
acagacattccgtggataggaagat

SEQ ID NO: 151722 - DNA, 25 bp, Homo sapien
cagacattccgtggataggaagata

SEQ ID NO: 151723 - DNA, 25 bp, Homo sapien
gacattccgtggataggaagatagc

SEQ ID NO: 151724 - DNA, 25 bp, Homo sapien
cattccgtggataggaagatagcag

SEQ ID NO: 151725 - DNA, 25 bp, Homo sapien
taggaagatagcaggagaaagtaac

SEQ ID NO: 151726 - DNA, 25 bp, Homo sapien
gatagcaggagaaagtaactccata

SEQ ID NO: 151727 - DNA, 25 bp, Homo sapien
gagaaagtaactccatagagtgtca

SEQ ID NO: 151728 - DNA, 25 bp, Homo sapien
gaaagtaactccatagagtgtcatt

SEQ ID NO: 151729 - DNA, 25 bp, Homo sapien
aaagtaactccatagagtgtcattc

SEQ ID NO: 151730 - DNA, 25 bp, Homo sapien
aagtaactccatagagtgtcattcc

SEQ ID NO: 151731 - DNA, 25 bp, Homo sapien
gaaaataccctccaatggattctga

SEQ ID NO: 151732 - DNA, 25 bp, Homo sapien
ggattctgatagcaggacatttctg

SEQ ID NO: 151733 - DNA, 25 bp, Homo sapien
gacatttctgtcaagctactatcga

SEQ ID NO: 151734 - DNA, 25 bp, Homo sapien
gctactatcgagatcacaacgtgga

SEQ ID NO: 151735 - DNA, 25 bp, Homo sapien
cacaacgtggaactctcaaagctgc

SEQ ID NO: 151736 - DNA, 25 bp, Homo sapien
gatagcactgagagaaaacttgaga

SEQ ID NO: 151737 - DNA, 25 bp, Homo sapien
gaaaacttgagacttcatcgtccat

SEQ ID NO: 151738 - DNA, 25 bp, Homo sapien
gagacttcatcgtccatgtagaaca

SEQ ID NO: 151739 - DNA, 25 bp, Homo sapien
gtccatgtagaacacaccttttcca

SEQ ID NO: 151740 - DNA, 25 bp, Homo sapien
aacacaccttttccaaagcttccag

SEQ ID NO: 151741 - DNA, 25 bp, Homo sapien
tccagaagctaccaaaaggcagttg

SEQ ID NO: 151742 - DNA, 25 bp, Homo sapien
gacatttgggctggataaaacccct

SEQ ID NO: 151743 - DNA, 25 bp, Homo sapien
atttgggctggataaaacccctgtg

SEQ ID NO: 151744 - DNA, 25 bp, Homo sapien
ttgggctggataaaacccctgtggt

SEQ ID NO: 151745 - DNA, 25 bp, Homo sapien
tctgtgctgtgcattgcaggatggt

SEQ ID NO: 151746 - DNA, 25 bp, Homo sapien
aggatggtgagcagcgtccctctca

SEQ ID NO: 151747 - DNA, 25 bp, Homo sapien
ggatgttgccagatgcccctaggga

SEQ ID NO: 151748 - DNA, 25 bp, Homo sapien
gatgcccctagggacagagtcaacc

SEQ ID NO: 151749 - DNA, 25 bp, Homo sapien
ccaactgaggaccactgtctacaga

SEQ ID NO: 151750 - DNA, 25 bp, Homo sapien
ggaccactgtctacagagtcaggaa

SEQ ID NO: 151751 - DNA, 25 bp, Homo sapien
attattccttattcaatgtattttt

SEQ ID NO: 151752 - DNA, 25 bp, Homo sapien
attcaatgtatttttatcaaatcga

SEQ ID NO: 151753 - DNA, 25 bp, Homo sapien
gtgtggaccgaggaacaacttggaa

SEQ ID NO: 151754 - DNA, 25 bp, Homo sapien
acaacttggaagatctacctgcaac

SEQ ID NO: 151755 - DNA, 25 bp, Homo sapien
gatctacctgcaacacaacatttgt

SEQ ID NO: 151756 - DNA, 25 bp, Homo sapien
acaacatttgtgtcactgtacagtt

SEQ ID NO: 151757 - DNA, 25 bp, Homo sapien
ctgtacagttttgtggactgagcga

SEQ ID NO: 151758 - DNA, 25 bp, Homo sapien
gttggctagagcttctgtattttca

SEQ ID NO: 151759 - DNA, 25 bp, Homo sapien
gtattttcaaagactgccacgtgcc

SEQ ID NO: 151760 - DNA, 25 bp, Homo sapien
aagactgccacgtgccttaggaata

SEQ ID NO: 151761 - DNA, 25 bp, Homo sapien
acgtgccttaggaatactgttttat

SEQ ID NO: 151762 - DNA, 25 bp, Homo sapien
atactgttttatctccatactttgg

SEQ ID NO: 151763 - DNA, 25 bp, Homo sapien
atctccatactttggatgacttgtt

SEQ ID NO: 151764 - DNA, 25 bp, Homo sapien
atgacgatggccgagtgtcctaccc

SEQ ID NO: 151765 - DNA, 25 bp, Homo sapien
tgtcctaccctttgtgtttcatctt

SEQ ID NO: 151766 - DNA, 25 bp, Homo sapien
cctgtgggctgcaagccggaacaac

SEQ ID NO: 151767 - DNA, 25 bp, Homo sapien
ctggtgcagacagcagagctcacaa

SEQ ID NO: 151768 - DNA, 25 bp, Homo sapien
gagctcacaaaggtgttcgaaatcc

SEQ ID NO: 151769 - DNA, 25 bp, Homo sapien
gttcgaaatccgcaccactgatgac

SEQ ID NO: 151770 - DNA, 25 bp, Homo sapien
agttgtctttctttcgttgatctct

SEQ ID NO: 151771 - DNA, 25 bp, Homo sapien
gggactgaattcctgatgtctgagt

SEQ ID NO: 151772 - DNA, 25 bp, Homo sapien
atgtctgagtcctcaggtgactggg

SEQ ID NO: 151773 - DNA, 25 bp, Homo sapien
gacttggaaccctaggacctgaaca

SEQ ID NO: 151774 - DNA, 25 bp, Homo sapien
taggacctgaacaaccaagacttta

SEQ ID NO: 151775 - DNA, 25 bp, Homo sapien
tgctgctgacaaccctgagctctct

SEQ ID NO: 151776 - DNA, 25 bp, Homo sapien
gcccaccctgtgtctgacgacagtg

SEQ ID NO: 151777 - DNA, 25 bp, Homo sapien
gtctgacgacagtgacctccctgag

SEQ ID NO: 151778 - DNA, 25 bp, Homo sapien
gtgacctccctgagtcggcctctag

SEQ ID NO: 151779 - DNA, 25 bp, Homo sapien
agctggagtctgacaccatcgctga

SEQ ID NO: 151780 - DNA, 25 bp, Homo sapien
ggagtctgacaccatcgctgacctt

SEQ ID NO: 151781 - DNA, 25 bp, Homo sapien
ttcctgaccctactgtagtcactac

SEQ ID NO: 151782 - DNA, 25 bp, Homo sapien
gtagtcactaccagtaccaatgatt

SEQ ID NO: 151783 - DNA, 25 bp, Homo sapien
gtaccaatgattaccatgatgtcgt

SEQ ID NO: 151784 - DNA, 25 bp, Homo sapien
ccatgatgtcgtggttgttgatgtt

SEQ ID NO: 151785 - DNA, 25 bp, Homo sapien
gaagatgatcctgatgaaatggctg

SEQ ID NO: 151786 - DNA, 25 bp, Homo sapien
tgtttcctacctactcttcttgtaa

SEQ ID NO: 151787 - DNA, 25 bp, Homo sapien
actcttcttgtaaactctgctgctt

SEQ ID NO: 151788 - DNA, 25 bp, Homo sapien
actagagtgcaattttggcatctta

SEQ ID NO: 151789 - DNA, 25 bp, Homo sapien
cagtttacaactgtggccctattta

SEQ ID NO: 151790 - DNA, 25 bp, Homo sapien
acaactgtggccctatttattacac

SEQ ID NO: 151791 - DNA, 25 bp, Homo sapien
cacagtttgtctatcgtgtcttaaa

SEQ ID NO: 151792 - DNA, 25 bp, Homo sapien
gtctatcgtgtcttaaatttagtct

SEQ ID NO: 151793 - DNA, 25 bp, Homo sapien
aaatttagtctttactgtgccaagc

SEQ ID NO: 151794 - DNA, 25 bp, Homo sapien
tagtctttactgtgccaagctaact

SEQ ID NO: 151795 - DNA, 25 bp, Homo sapien
taccttataggactgtactttttgt

SEQ ID NO: 151796 - DNA, 25 bp, Homo sapien
taatctcagtttaaattacctagct

SEQ ID NO: 151797 - DNA, 25 bp, Homo sapien
tgacatttgggctggataaaacccc

SEQ ID NO: 151798 - DNA, 25 bp, Homo sapien
gacatttgggctggataaaacccct

SEQ ID NO: 151799 - DNA, 25 bp, Homo sapien
acatttgggctggataaaacccctg

SEQ ID NO: 151800 - DNA, 25 bp, Homo sapien
catttgggctggataaaacccctgt

SEQ ID NO: 151801 - DNA, 25 bp, Homo sapien
atttgggctggataaaacccctgtg

SEQ ID NO: 151802 - DNA, 25 bp, Homo sapien
tttgggctggataaaacccctgtgg

SEQ ID NO: 151803 - DNA, 25 bp, Homo sapien
ttgggctggataaaacccctgtggt

SEQ ID NO: 151804 - DNA, 25 bp, Homo sapien
aaacccctgtggtggggtctgtgct

SEQ ID NO: 151805 - DNA, 25 bp, Homo sapien
aacccctgtggtggggtctgtgctg

SEQ ID NO: 151806 - DNA, 25 bp, Homo sapien
acccctgtggtggggtctgtgctgt

SEQ ID NO: 151807 - DNA, 25 bp, Homo sapien
gaacatggctcgtgagcatttcaaa

SEQ ID NO: 151808 - DNA, 25 bp, Homo sapien
gggctgaacactactgggaccttgc

SEQ ID NO: 151809 - DNA, 25 bp, Homo sapien
tactgggaccttgcgctgagtgaat

SEQ ID NO: 151810 - DNA, 25 bp, Homo sapien
gaccttgcgctgagtgaatctgtgt

SEQ ID NO: 151811 - DNA, 25 bp, Homo sapien
gaatctgtgttagagtccactgatt

SEQ ID NO: 151812 - DNA, 25 bp, Homo sapien
gtccactgattgagactactgcaag

SEQ ID NO: 151813 - DNA, 25 bp, Homo sapien
gagactactgcaagcccttgcctct

SEQ ID NO: 151814 - DNA, 25 bp, Homo sapien
ttcagtcctctcacttattctattt

SEQ ID NO: 151815 - DNA, 25 bp, Homo sapien
gtttgtgtgatctcagaactgtgcc

SEQ ID NO: 151816 - DNA, 25 bp, Homo sapien
gaactgtgccaagcagacactggga

SEQ ID NO: 151817 - DNA, 25 bp, Homo sapien
cactgggacaaagggagaatatctt

SEQ ID NO: 151818 - DNA, 25 bp, Homo sapien
ctgggtaggaaatcttttgacatct

SEQ ID NO: 151819 - DNA, 25 bp, Homo sapien
ttttgacatcttaactcatgttgag

SEQ ID NO: 151820 - DNA, 25 bp, Homo sapien
actcatgttgagtttgtgctgtggt

SEQ ID NO: 151821 - DNA, 25 bp, Homo sapien
agataaacacacagcctttcccata

SEQ ID NO: 151822 - DNA, 25 bp, Homo sapien
ataagatccattgatgtccaaataa

SEQ ID NO: 151823 - DNA, 25 bp, Homo sapien
gtccaaataataccaccgagcatct

SEQ ID NO: 151824 - DNA, 25 bp, Homo sapien
ttggtccacttgctaatgcccagtt

SEQ ID NO: 151825 - DNA, 25 bp, Homo sapien
taatgcccagttttcttctccattt

SEQ ID NO: 151826 - DNA, 25 bp, Homo sapien
ttccactttttcttaggctccctat

SEQ ID NO: 151827 - DNA, 25 bp, Homo sapien
cttaggctccctatttactattcat

SEQ ID NO: 151828 - DNA, 25 bp, Homo sapien
attcattttgacttccttctgtttt

SEQ ID NO: 151829 - DNA, 25 bp, Homo sapien
gttaggtcattttaactgacttgat

SEQ ID NO: 151830 - DNA, 25 bp, Homo sapien
ctgacttgattatccaactggtctt

SEQ ID NO: 151831 - DNA, 25 bp, Homo sapien
ggtctttgacagatttgactgtcca

SEQ ID NO: 151832 - DNA, 25 bp, Homo sapien
atgtttgtctgatcatccagtttgc

SEQ ID NO: 151833 - DNA, 25 bp, Homo sapien
tttggctgtgtttaatttggtggtt

SEQ ID NO: 151834 - DNA, 25 bp, Homo sapien
ggtaccagtgtactaaaactagtca

SEQ ID NO: 151835 - DNA, 25 bp, Homo sapien
gtttgtgcaaagtgtacaaccttag

SEQ ID NO: 151836 - DNA, 25 bp, Homo sapien
gtacaaccttagtaaagtgtccatg

SEQ ID NO: 151837 - DNA, 25 bp, Homo sapien
aaagtgtccatgaagcaatagccat

SEQ ID NO: 151838 - DNA, 25 bp, Homo sapien
gccatgaatgctaattatttctaaa

SEQ ID NO: 151839 - DNA, 25 bp, Homo sapien
tatttctaaatagggccacatggtt

SEQ ID NO: 151840 - DNA, 25 bp, Homo sapien
cctactgcagtatttgagcagggac

SEQ ID NO: 151841 - DNA, 25 bp, Homo sapien
ctactgcagtatttgagcagggaca

SEQ ID NO: 151842 - DNA, 25 bp, Homo sapien
tactgcagtatttgagcagggacag

SEQ ID NO: 151843 - DNA, 25 bp, Homo sapien
actgcagtatttgagcagggacagt

SEQ ID NO: 151844 - DNA, 25 bp, Homo sapien
ctgcagtatttgagcagggacagtc

SEQ ID NO: 151845 - DNA, 25 bp, Homo sapien
tgcagtatttgagcagggacagtca

SEQ ID NO: 151846 - DNA, 25 bp, Homo sapien
gcagtatttgagcagggacagtcat

SEQ ID NO: 151847 - DNA, 25 bp, Homo sapien
cagtatttgagcagggacagtcatt

SEQ ID NO: 151848 - DNA, 25 bp, Homo sapien
agtatttgagcagggacagtcattt

SEQ ID NO: 151849 - DNA, 25 bp, Homo sapien
gtatttgagcagggacagtcatttt

SEQ ID NO: 151850 - DNA, 25 bp, Homo sapien
aggaaaatgtcccaagaagctctcg

SEQ ID NO: 151851 - DNA, 25 bp, Homo sapien
atgtcccaagaagctctcggaagga

SEQ ID NO: 151852 - DNA, 25 bp, Homo sapien
atggcgctgagaagcttcggaagct

SEQ ID NO: 151853 - DNA, 25 bp, Homo sapien
tgagaagcttcggaagctgcagccc

SEQ ID NO: 151854 - DNA, 25 bp, Homo sapien
tgcagccctcacttaacagtgggcg

SEQ ID NO: 151855 - DNA, 25 bp, Homo sapien
aacagtgggcggctcctacatctag

SEQ ID NO: 151856 - DNA, 25 bp, Homo sapien
ctacatctagccatgcgaggtcttg

SEQ ID NO: 151857 - DNA, 25 bp, Homo sapien
acatctagccatgcgaggtcttggg

SEQ ID NO: 151858 - DNA, 25 bp, Homo sapien
gcagcagcctgtccgagtgcagtga

SEQ ID NO: 151859 - DNA, 25 bp, Homo sapien
gggatgtcaccatggccaacaccat

SEQ ID NO: 151860 - DNA, 25 bp, Homo sapien
gtcaccatggccaacaccatggagg

SEQ ID NO: 151861 - DNA, 25 bp, Homo sapien
agccccttggatctcccttcgtgga

SEQ ID NO: 151862 - DNA, 25 bp, Homo sapien
tggatctcccttcgtggagacgaca

SEQ ID NO: 151863 - DNA, 25 bp, Homo sapien
ctcccttcgtggagacgacaccggg

SEQ ID NO: 151864 - DNA, 25 bp, Homo sapien
ggcccaggatgctgatttgaaggat

SEQ ID NO: 151865 - DNA, 25 bp, Homo sapien
caggatgctgatttgaaggatgtaa

SEQ ID NO: 151866 - DNA, 25 bp, Homo sapien
aatgtgattccagccaccgcctgac

SEQ ID NO: 151867 - DNA, 25 bp, Homo sapien
cgccattccgactgctaaaagcgaa

SEQ ID NO: 151868 - DNA, 25 bp, Homo sapien
tgctaaaagcgaatgtagtcaggcc

SEQ ID NO: 151869 - DNA, 25 bp, Homo sapien
ctggaacactggcatctctgagcct

SEQ ID NO: 151870 - DNA, 25 bp, Homo sapien
cagtttcccctcctaatacatatgg

SEQ ID NO: 151871 - DNA, 25 bp, Homo sapien
ttcccctcctaatacatatggctgt

SEQ ID NO: 151872 - DNA, 25 bp, Homo sapien
tggactctgggacttaggccccctt

SEQ ID NO: 151873 - DNA, 25 bp, Homo sapien
taggcccccttaaatctagacttct

SEQ ID NO: 151874 - DNA, 25 bp, Homo sapien
ctctttataggtttcaggtctccta

SEQ ID NO: 151875 - DNA, 25 bp, Homo sapien
aggtttcaggtctcctatgggtgcc

SEQ ID NO: 151876 - DNA, 25 bp, Homo sapien
gtctcctatgggtgcctgggaagtc

SEQ ID NO: 151877 - DNA, 25 bp, Homo sapien
tccttgaaagtggactgttctcagg

SEQ ID NO: 151878 - DNA, 25 bp, Homo sapien
ggactgttctcaggcttgacctgcc

SEQ ID NO: 151879 - DNA, 25 bp, Homo sapien
ctagggtacagggtgctgcccagca

SEQ ID NO: 151880 - DNA, 25 bp, Homo sapien
tgcccagcaggtcgccaccgagtgt

SEQ ID NO: 151881 - DNA, 25 bp, Homo sapien
gtcgccaccgagtgtcttctcattt

SEQ ID NO: 151882 - DNA, 25 bp, Homo sapien
ttctcattttatttcagctccattt

SEQ ID NO: 151883 - DNA, 25 bp, Homo sapien
gctaacattgatagtttataaatcc

SEQ ID NO: 151884 - DNA, 25 bp, Homo sapien
aaatccttttcatcctttgtgcctc

SEQ ID NO: 151885 - DNA, 25 bp, Homo sapien
ttttcatcctttgtgcctcggttat

SEQ ID NO: 151886 - DNA, 25 bp, Homo sapien
catcctttgtgcctcggttattaag

SEQ ID NO: 151887 - DNA, 25 bp, Homo sapien
gtccaacatacagtttttaaagtgt

SEQ ID NO: 151888 - DNA, 25 bp, Homo sapien
aagtgtggcagttttgagtagtaac

SEQ ID NO: 151889 - DNA, 25 bp, Homo sapien
aaccgaacaataagtggcaaccaat

SEQ ID NO: 151890 - DNA, 25 bp, Homo sapien
agtggcaaccaattatcttaacatt

SEQ ID NO: 151891 - DNA, 25 bp, Homo sapien
ttatcttaacattggaaatactggg

SEQ ID NO: 151892 - DNA, 25 bp, Homo sapien
aaaagttattcattgtaatccactg

SEQ ID NO: 151893 - DNA, 25 bp, Homo sapien
ttgtaatccactgttttggctttca

SEQ ID NO: 151894 - DNA, 25 bp, Homo sapien
aatgcagtccaaacatgaaaggaaa

SEQ ID NO: 151895 - DNA, 25 bp, Homo sapien
tataactctgaagcatgataaaggg

SEQ ID NO: 151896 - DNA, 25 bp, Homo sapien
aggggcagttcacaattttcaccat

SEQ ID NO: 151897 - DNA, 25 bp, Homo sapien
atttaaacacaaatttgctgcacag

SEQ ID NO: 151898 - DNA, 25 bp, Homo sapien
tttgctgcacagaatatcaccattg

SEQ ID NO: 151899 - DNA, 25 bp, Homo sapien
gaatatcaccattgcagttcaaaac

SEQ ID NO: 151900 - DNA, 25 bp, Homo sapien
tgtgaacactgatgcaagaaacttg

SEQ ID NO: 151901 - DNA, 25 bp, Homo sapien
tgaaaggactctttaccctagaagg

SEQ ID NO: 151902 - DNA, 25 bp, Homo sapien
tctttaccctagaaggaagaggtga

SEQ ID NO: 151903 - DNA, 25 bp, Homo sapien
aagaggtgaaggatctggcttgttt

SEQ ID NO: 151904 - DNA, 25 bp, Homo sapien
aaaccatattatttgattactgtgt

SEQ ID NO: 151905 - DNA, 25 bp, Homo sapien
agcttgcacctccagtttgcacagg

SEQ ID NO: 151906 - DNA, 25 bp, Homo sapien
agtttgcacagggatttgtcctggg

SEQ ID NO: 151907 - DNA, 25 bp, Homo sapien
ccgcccttggtgctgtcataaaagg

SEQ ID NO: 151908 - DNA, 25 bp, Homo sapien
tggtgctgtcataaaagggcaggca

SEQ ID NO: 151909 - DNA, 25 bp, Homo sapien
caggctgaggagttgcccgttgccc

SEQ ID NO: 151910 - DNA, 25 bp, Homo sapien
cccagagactgactctcagagccag

SEQ ID NO: 151911 - DNA, 25 bp, Homo sapien
tgtgtgtgcacgcactggcctgcac

SEQ ID NO: 151912 - DNA, 25 bp, Homo sapien
gcactggcctgcacagagagcatgg

SEQ ID NO: 151913 - DNA, 25 bp, Homo sapien
cacagagagcatgggtgagcgtgta

SEQ ID NO: 151914 - DNA, 25 bp, Homo sapien
tgagcgtgtaaaagcttggccctgt

SEQ ID NO: 151915 - DNA, 25 bp, Homo sapien
cgtgtaaaagcttggccctgtgccc

SEQ ID NO: 151916 - DNA, 25 bp, Homo sapien
aaaatattcatgtagcaaatctgag

SEQ ID NO: 151917 - DNA, 25 bp, Homo sapien
aatattcatgtagcaaatctgagaa

SEQ ID NO: 151918 - DNA, 25 bp, Homo sapien
ttcatgtagcaaatctgagaattga

SEQ ID NO: 151919 - DNA, 25 bp, Homo sapien
gtagcaaatctgagaattgaaaact

SEQ ID NO: 151920 - DNA, 25 bp, Homo sapien
aaactgcagataaccggccgggtat

SEQ ID NO: 151921 - DNA, 25 bp, Homo sapien
aactgcagataaccggccgggtatg

SEQ ID NO: 151922 - DNA, 25 bp, Homo sapien
ataaccggccgggtatggtgactca

SEQ ID NO: 151923 - DNA, 25 bp, Homo sapien
gtctgtactaaaagtgcaaaggttt

SEQ ID NO: 151924 - DNA, 25 bp, Homo sapien
gtactaaaagtgcaaaggtttgcct

SEQ ID NO: 151925 - DNA, 25 bp, Homo sapien
aaaagtgcaaaggtttgcctggtgt

SEQ ID NO: 151926 - DNA, 25 bp, Homo sapien
agtgcaaaggtttgcctggtgtggt

SEQ ID NO: 151927 - DNA, 25 bp, Homo sapien
gagtactggctatacccattcccag

SEQ ID NO: 151928 - DNA, 25 bp, Homo sapien
agcacccgtctgttacacatgtgaa

SEQ ID NO: 151929 - DNA, 25 bp, Homo sapien
acatgtgaaaccaaagcctgctctc

SEQ ID NO: 151930 - DNA, 25 bp, Homo sapien
aaccaaagcctgctctctcctaagg

SEQ ID NO: 151931 - DNA, 25 bp, Homo sapien
taaggctctcattcagcctatcttg

SEQ ID NO: 151932 - DNA, 25 bp, Homo sapien
agcctatcttgcgaggcccgggcag

SEQ ID NO: 151933 - DNA, 25 bp, Homo sapien
gggcagctggaaagtcctcctccag

SEQ ID NO: 151934 - DNA, 25 bp, Homo sapien
ggagtctctcaatgccaggttgtca

SEQ ID NO: 151935 - DNA, 25 bp, Homo sapien
cacccacctgtctcatagtgtttat

SEQ ID NO: 151936 - DNA, 25 bp, Homo sapien
agtgtttataagtggcctgctggga

SEQ ID NO: 151937 - DNA, 25 bp, Homo sapien
ctgctgggagtgagtgctccctctg

SEQ ID NO: 151938 - DNA, 25 bp, Homo sapien
acacattccgggagagatgcctggc

SEQ ID NO: 151939 - DNA, 25 bp, Homo sapien
cagagggtctccctttctgcctttc

SEQ ID NO: 151940 - DNA, 25 bp, Homo sapien
aacgttgagaccctgcttgtccaat

SEQ ID NO: 151941 - DNA, 25 bp, Homo sapien
gagaccctgcttgtccaatattata

SEQ ID NO: 151942 - DNA, 25 bp, Homo sapien
aagacatctattatctgctttgtgc

SEQ ID NO: 151943 - DNA, 25 bp, Homo sapien
atctattatctgctttgtgcttaaa

SEQ ID NO: 151944 - DNA, 25 bp, Homo sapien
tctccaaggaagttcgtttcctctg

SEQ ID NO: 151945 - DNA, 25 bp, Homo sapien
gaagttcgtttcctctgaagcctaa

SEQ ID NO: 151946 - DNA, 25 bp, Homo sapien
gaagcctaaaccagtgtctacgcag

SEQ ID NO: 151947 - DNA, 25 bp, Homo sapien
taaaccagtgtctacgcaggcggag

SEQ ID NO: 151948 - DNA, 25 bp, Homo sapien
agtgtctacgcaggcggagctgaac

SEQ ID NO: 151949 - DNA, 25 bp, Homo sapien
gatgatggccacacaagatttacag

SEQ ID NO: 151950 - DNA, 25 bp, Homo sapien
gatctaatacagctggtggagttct

SEQ ID NO: 151951 - DNA, 25 bp, Homo sapien
agttctatcaactcaataagggcgt

SEQ ID NO: 151952 - DNA, 25 bp, Homo sapien
aataagggcgttcttccttgcaagt

SEQ ID NO: 151953 - DNA, 25 bp, Homo sapien
gggcgttcttccttgcaagttgaaa

SEQ ID NO: 151954 - DNA, 25 bp, Homo sapien
gttcttccttgcaagttgaaacatt

SEQ ID NO: 151955 - DNA, 25 bp, Homo sapien
attattgtgctaggattgctctcta

SEQ ID NO: 151956 - DNA, 25 bp, Homo sapien
gattgctctctagacaagccagaag

SEQ ID NO: 151957 - DNA, 25 bp, Homo sapien
ataagggcgaaaacattatcatgtg

SEQ ID NO: 151958 - DNA, 25 bp, Homo sapien
gtatttcacctgcaagttacaaaaa

SEQ ID NO: 151959 - DNA, 25 bp, Homo sapien
gacttggattgactttacattcatc

SEQ ID NO: 151960 - DNA, 25 bp, Homo sapien
gtttgaatctgactttagcctacct

SEQ ID NO: 151961 - DNA, 25 bp, Homo sapien
tagcctacctaacccagaaaatctg

SEQ ID NO: 151962 - DNA, 25 bp, Homo sapien
gaattggaatgcactcagactgtat

SEQ ID NO: 151963 - DNA, 25 bp, Homo sapien
aaggacagtcctatttagacatgta

SEQ ID NO: 151964 - DNA, 25 bp, Homo sapien
gactttattagcagctgactttcaa

SEQ ID NO: 151965 - DNA, 25 bp, Homo sapien
gactttcaaagtggatgcaattttt

SEQ ID NO: 151966 - DNA, 25 bp, Homo sapien
ggaatataatattgtctctttttta

SEQ ID NO: 151967 - DNA, 25 bp, Homo sapien
gtttggcaaacagaatgttcatact

SEQ ID NO: 151968 - DNA, 25 bp, Homo sapien
gttcatactgatgtgttgtgcctta

SEQ ID NO: 151969 - DNA, 25 bp, Homo sapien
actgatgtgttgtgccttaaagaca

SEQ ID NO: 151970 - DNA, 25 bp, Homo sapien
gacaagacagcatttgtgtgttaca

SEQ ID NO: 151971 - DNA, 25 bp, Homo sapien
aaatattacttttgggccctagcat

SEQ ID NO: 151972 - DNA, 25 bp, Homo sapien
aatattacttttgggccctagcatg

SEQ ID NO: 151973 - DNA, 25 bp, Homo sapien
acttttgggccctagcatggcgggt

SEQ ID NO: 151974 - DNA, 25 bp, Homo sapien
ttttgggccctagcatggcgggtca

SEQ ID NO: 151975 - DNA, 25 bp, Homo sapien
ttgggccctagcatggcgggtcaac

SEQ ID NO: 151976 - DNA, 25 bp, Homo sapien
tagcatggcgggtcaaccctgtaat

SEQ ID NO: 151977 - DNA, 25 bp, Homo sapien
gcatggcgggtcaaccctgtaattc

SEQ ID NO: 151978 - DNA, 25 bp, Homo sapien
cagggcgggatcaactgaagtcaga

SEQ ID NO: 151979 - DNA, 25 bp, Homo sapien
ggcgggatcaactgaagtcagagtt

SEQ ID NO: 151980 - DNA, 25 bp, Homo sapien
gggatcaactgaagtcagagttcaa

SEQ ID NO: 151981 - DNA, 25 bp, Homo sapien
ggggggcgcctattcatcctagcta

SEQ ID NO: 151982 - DNA, 25 bp, Homo sapien
ttcctgtcgctcaccagctgggctg

SEQ ID NO: 151983 - DNA, 25 bp, Homo sapien
gtggcccagcttgctattgcgtggt

SEQ ID NO: 151984 - DNA, 25 bp, Homo sapien
ttgctattgcgtggtgtctccgcag

SEQ ID NO: 151985 - DNA, 25 bp, Homo sapien
gtctccgcagtgagggtgtcagctc

SEQ ID NO: 151986 - DNA, 25 bp, Homo sapien
gtgcggagcagttgatagaacacct

SEQ ID NO: 151987 - DNA, 25 bp, Homo sapien
tgatagaacacctgggcgcgctaca

SEQ ID NO: 151988 - DNA, 25 bp, Homo sapien
tgagccagctgaccccgcagacagt

SEQ ID NO: 151989 - DNA, 25 bp, Homo sapien
atagacgggctcctgggaaacaagc

SEQ ID NO: 151990 - DNA, 25 bp, Homo sapien
gaaacaagccgcattccaagaagta

SEQ ID NO: 151991 - DNA, 25 bp, Homo sapien
gcaacaagccaaagtcatggacctt

SEQ ID NO: 151992 - DNA, 25 bp, Homo sapien
aaagtcatggaccttcttcctgtcg

SEQ ID NO: 151993 - DNA, 25 bp, Homo sapien
cagatacgcagtaacatgtgttggc

SEQ ID NO: 151994 - DNA, 25 bp, Homo sapien
acatgtgttggcttcgtgattaaaa

SEQ ID NO: 151995 - DNA, 25 bp, Homo sapien
ggcttcgtgattaaaatgctcctaa

SEQ ID NO: 151996 - DNA, 25 bp, Homo sapien
aatgctcctaatcaagattgtttga

SEQ ID NO: 151997 - DNA, 25 bp, Homo sapien
gattgtttgaacacatgtatttata

SEQ ID NO: 151998 - DNA, 25 bp, Homo sapien
aatactgtatcatactttcaaagga

SEQ ID NO: 151999 - DNA, 25 bp, Homo sapien
ggataaaaagactacccctctgaag

SEQ ID NO: 152000 - DNA, 25 bp, Homo sapien
gactacccctctgaaggttgttttg

SEQ ID NO: 152001 - DNA, 25 bp, Homo sapien
gtattaatggtcagtctttgttctc

SEQ ID NO: 152002 - DNA, 25 bp, Homo sapien
atgttggaagcagcatactttcaaa

SEQ ID NO: 152003 - DNA, 25 bp, Homo sapien
gcagcatactttcaaattattacca

SEQ ID NO: 152004 - DNA, 25 bp, Homo sapien
gccatgccccgcagtcagtgttggg

SEQ ID NO: 152005 - DNA, 25 bp, Homo sapien
ggctcctgcctacagggagagggat

SEQ ID NO: 152006 - DNA, 25 bp, Homo sapien
agggcagcacagggaatatttttgt

SEQ ID NO: 152007 - DNA, 25 bp, Homo sapien
gtaactaactaactgctgtggttgg

SEQ ID NO: 152008 - DNA, 25 bp, Homo sapien
actaactgctgtggttggagcgaat

SEQ ID NO: 152009 - DNA, 25 bp, Homo sapien
agcgaatggaagttgggtgatttta

SEQ ID NO: 152010 - DNA, 25 bp, Homo sapien
ggtgattttaagttattgttgccaa

SEQ ID NO: 152011 - DNA, 25 bp, Homo sapien
gttgccaaagagatgtaaagtttat

SEQ ID NO: 152012 - DNA, 25 bp, Homo sapien
taaagtttattgttgcttcgcaggg

SEQ ID NO: 152013 - DNA, 25 bp, Homo sapien
gtttgaggcttagaacgctggtgca

SEQ ID NO: 152014 - DNA, 25 bp, Homo sapien
gaacgctggtgcaatgttttcttgt

SEQ ID NO: 152015 - DNA, 25 bp, Homo sapien
gctggagctggccagtcaagctaat

SEQ ID NO: 152016 - DNA, 25 bp, Homo sapien
aagaaccccagcgatgaagatttgc

SEQ ID NO: 152017 - DNA, 25 bp, Homo sapien
tttgctgcgggacttgctgattcaa

SEQ ID NO: 152018 - DNA, 25 bp, Homo sapien
tgattcaagagctgttggcctgctt

SEQ ID NO: 152019 - DNA, 25 bp, Homo sapien
ttggcctgcttgctggatcagacaa

SEQ ID NO: 152020 - DNA, 25 bp, Homo sapien
gatcagacaaacctctgcaggctca

SEQ ID NO: 152021 - DNA, 25 bp, Homo sapien
aggctcaggtctcggtgactctgac

SEQ ID NO: 152022 - DNA, 25 bp, Homo sapien
aggactcgattctgcccttcactta

SEQ ID NO: 152023 - DNA, 25 bp, Homo sapien
gccccactccagaatagccaagaga

SEQ ID NO: 152024 - DNA, 25 bp, Homo sapien
atagccaagagaacccaaaccaata

SEQ ID NO: 152025 - DNA, 25 bp, Homo sapien
gtttatgctaagtcgagcccattgt

SEQ ID NO: 152026 - DNA, 25 bp, Homo sapien
gagaaaccaccacagtagctttaga

SEQ ID NO: 152027 - DNA, 25 bp, Homo sapien
gatgcggtcatattcttctttggct

SEQ ID NO: 152028 - DNA, 25 bp, Homo sapien
cttctttggcttctggttcttccag

SEQ ID NO: 152029 - DNA, 25 bp, Homo sapien
gccctcatggttggcatcacatatg

SEQ ID NO: 152030 - DNA, 25 bp, Homo sapien
atatgcctgcatgccattaacacca

SEQ ID NO: 152031 - DNA, 25 bp, Homo sapien
tacccctataatgatcctgtgtcct

SEQ ID NO: 152032 - DNA, 25 bp, Homo sapien
atgatcctgtgtcctaaattaatat

SEQ ID NO: 152033 - DNA, 25 bp, Homo sapien
ctcctccctgttaaagactaatgct

SEQ ID NO: 152034 - DNA, 25 bp, Homo sapien
gctcagatgctgtttacggatattt

SEQ ID NO: 152035 - DNA, 25 bp, Homo sapien
tatattctagtctcactctcttgtc

SEQ ID NO: 152036 - DNA, 25 bp, Homo sapien
ccattcccaactccagctaaaatat

SEQ ID NO: 152037 - DNA, 25 bp, Homo sapien
atttaattgctgctgttgggcttcg

SEQ ID NO: 152038 - DNA, 25 bp, Homo sapien
ttgggcttcgtttctgcaattcagc

SEQ ID NO: 152039 - DNA, 25 bp, Homo sapien
cattctgaacatatccatgcgcaat

SEQ ID NO: 152040 - DNA, 25 bp, Homo sapien
atgcgcaatcatgataactgttgtg

SEQ ID NO: 152041 - DNA, 25 bp, Homo sapien
ctgttgtgagtagtgcttttcattc

SEQ ID NO: 152042 - DNA, 25 bp, Homo sapien
ttttcattcttctcacttgcctttg

SEQ ID NO: 152043 - DNA, 25 bp, Homo sapien
ttctcacttgcctttgttacttaat

SEQ ID NO: 152044 - DNA, 25 bp, Homo sapien
gcctttgttacttaatgtgctttca

SEQ ID NO: 152045 - DNA, 25 bp, Homo sapien
tgtgctttcagtacagcagatatgc

SEQ ID NO: 152046 - DNA, 25 bp, Homo sapien
ggtggtattctctgaaatctgtggt

SEQ ID NO: 152047 - DNA, 25 bp, Homo sapien
aatctgtggttatgaaaattaggcc

SEQ ID NO: 152048 - DNA, 25 bp, Homo sapien
agacaaaccagatgtaatatatttt

SEQ ID NO: 152049 - DNA, 25 bp, Homo sapien
ttgtggatgtttttatttcttggat

SEQ ID NO: 152050 - DNA, 25 bp, Homo sapien
tatttcttggatttatagtacctta

SEQ ID NO: 152051 - DNA, 25 bp, Homo sapien
ggatttatagtaccttatactaagg

SEQ ID NO: 152052 - DNA, 25 bp, Homo sapien
gaaattcttcaccaacatttcattt

SEQ ID NO: 152053 - DNA, 25 bp, Homo sapien
ttcaccaacatttcatttgctcctt

SEQ ID NO: 152054 - DNA, 25 bp, Homo sapien
ttcatttgctcctttgtcatattgt

SEQ ID NO: 152055 - DNA, 25 bp, Homo sapien
ggtgtaatgttgtaccatttgcact

SEQ ID NO: 152056 - DNA, 25 bp, Homo sapien
atgttgtaccatttgcactgtgagc

SEQ ID NO: 152057 - DNA, 25 bp, Homo sapien
gttgtaccatttgcactgtgagcaa

SEQ ID NO: 152058 - DNA, 25 bp, Homo sapien
tgtaccatttgcactgtgagcaaat

SEQ ID NO: 152059 - DNA, 25 bp, Homo sapien
agctccttcagcaacacctgaggca

SEQ ID NO: 152060 - DNA, 25 bp, Homo sapien
tccttcagcaacacctgaggcagca

SEQ ID NO: 152061 - DNA, 25 bp, Homo sapien
gaggtctgagaatgacgatacccgt

SEQ ID NO: 152062 - DNA, 25 bp, Homo sapien
gagaatgacgatacccgtgactcag

SEQ ID NO: 152063 - DNA, 25 bp, Homo sapien
acgatacccgtgactcagccctgga

SEQ ID NO: 152064 - DNA, 25 bp, Homo sapien
agccctggacactggtccgagaagg

SEQ ID NO: 152065 - DNA, 25 bp, Homo sapien
gacactggtccgagaagggacatgt

SEQ ID NO: 152066 - DNA, 25 bp, Homo sapien
gacatgtgggacgtgagccgggctc

SEQ ID NO: 152067 - DNA, 25 bp, Homo sapien
tgagccgggctccaacagcctctgt

SEQ ID NO: 152068 - DNA, 25 bp, Homo sapien
agcctctgtgagagatgccccacac

SEQ ID NO: 152069 - DNA, 25 bp, Homo sapien
gatggctgcattccctggtcctccg

SEQ ID NO: 152070 - DNA, 25 bp, Homo sapien
agctgcatctcgtgggacctccaag

SEQ ID NO: 152071 - DNA, 25 bp, Homo sapien
aagctcctctgactgaacctacgtg

SEQ ID NO: 152072 - DNA, 25 bp, Homo sapien
gagaggctctacaaagaagcgcccc

SEQ ID NO: 152073 - DNA, 25 bp, Homo sapien
ccccaaagagtgcagctgctaattt

SEQ ID NO: 152074 - DNA, 25 bp, Homo sapien
gctgctaattttagtcccaggacca

SEQ ID NO: 152075 - DNA, 25 bp, Homo sapien
atccccagactccacagatgtaatg

SEQ ID NO: 152076 - DNA, 25 bp, Homo sapien
atgaagtccccgaatgtatctgttt

SEQ ID NO: 152077 - DNA, 25 bp, Homo sapien
gtatctgtttctaaggagcctcttg

SEQ ID NO: 152078 - DNA, 25 bp, Homo sapien
tcttggcagtccttaagcagtcttg

SEQ ID NO: 152079 - DNA, 25 bp, Homo sapien
ttaagcagtcttgagggtccatcct

SEQ ID NO: 152080 - DNA, 25 bp, Homo sapien
caactttttaggagtgcttcctcac

SEQ ID NO: 152081 - DNA, 25 bp, Homo sapien
tctgtcttgttcaagttcagacgaa

SEQ ID NO: 152082 - DNA, 25 bp, Homo sapien
agacgaagctactctggcatctgca

SEQ ID NO: 152083 - DNA, 25 bp, Homo sapien
ggcatctgcacatttccgtgttaca

SEQ ID NO: 152084 - DNA, 25 bp, Homo sapien
atttccgtgttacagcagctgcctg

SEQ ID NO: 152085 - DNA, 25 bp, Homo sapien
tcagcatgtggctcgcgtggacagg

SEQ ID NO: 152086 - DNA, 25 bp, Homo sapien
acgctgtggccgcatggaaccttga

SEQ ID NO: 152087 - DNA, 25 bp, Homo sapien
gtggccgcatggaaccttgagaacc

SEQ ID NO: 152088 - DNA, 25 bp, Homo sapien
cttgagaacccagggacgagccagt

SEQ ID NO: 152089 - DNA, 25 bp, Homo sapien
aggaactgccgggactcaccgagct

SEQ ID NO: 152090 - DNA, 25 bp, Homo sapien
tcaccgagctgcacttaactgttct

SEQ ID NO: 152091 - DNA, 25 bp, Homo sapien
ctgcacttaactgttctctttctgg

SEQ ID NO: 152092 - DNA, 25 bp, Homo sapien
agatcagaacatgaaatgccctcct

SEQ ID NO: 152093 - DNA, 25 bp, Homo sapien
atgccctcctaaatgtcagctgttg

SEQ ID NO: 152094 - DNA, 25 bp, Homo sapien
agctgttgtcacacagtagctccaa

SEQ ID NO: 152095 - DNA, 25 bp, Homo sapien
gtagctccaacactttgagcatttt

SEQ ID NO: 152096 - DNA, 25 bp, Homo sapien
taagggagtggcctcatttcactag

SEQ ID NO: 152097 - DNA, 25 bp, Homo sapien
aaaattgggcttgtgatttccattt

SEQ ID NO: 152098 - DNA, 25 bp, Homo sapien
gtgatttccatttctgatgtctcca

SEQ ID NO: 152099 - DNA, 25 bp, Homo sapien
ttctgatgtctccagattggcaccc

SEQ ID NO: 152100 - DNA, 25 bp, Homo sapien
gattggcacccctttctagttcaat

SEQ ID NO: 152101 - DNA, 25 bp, Homo sapien
caatgcctcacgagatttgccaggg

SEQ ID NO: 152102 - DNA, 25 bp, Homo sapien
aaggcaaacaatcccaatctttcta

SEQ ID NO: 152103 - DNA, 25 bp, Homo sapien
accactagaggtcagcgtcgcgccg

SEQ ID NO: 152104 - DNA, 25 bp, Homo sapien
tagaggtcagcgtcgcgccgcactc

SEQ ID NO: 152105 - DNA, 25 bp, Homo sapien
aaatctgaagaacagccccatctct

SEQ ID NO: 152106 - DNA, 25 bp, Homo sapien
tttcgcctgcacacttggaactcag

SEQ ID NO: 152107 - DNA, 25 bp, Homo sapien
tgcacacttggaactcagcaagaag

SEQ ID NO: 152108 - DNA, 25 bp, Homo sapien
cagcaagaagggactgtttctaggt

SEQ ID NO: 152109 - DNA, 25 bp, Homo sapien
gactgtttctaggtgggctgggcgc

SEQ ID NO: 152110 - DNA, 25 bp, Homo sapien
ggctgggcgcgagcagggactgtcc

SEQ ID NO: 152111 - DNA, 25 bp, Homo sapien
ggactgtcccgagctggtataggtg

SEQ ID NO: 152112 - DNA, 25 bp, Homo sapien
gggttcacccacctggagctggaat

SEQ ID NO: 152113 - DNA, 25 bp, Homo sapien
gagctggaattatcacttccgaaat

SEQ ID NO: 152114 - DNA, 25 bp, Homo sapien
tcctccacgtcgccggcaggccccc

SEQ ID NO: 152115 - DNA, 25 bp, Homo sapien
ctccacgtcgccggcaggcccccct

SEQ ID NO: 152116 - DNA, 25 bp, Homo sapien
tccacgtcgccggcaggcccccctc

SEQ ID NO: 152117 - DNA, 25 bp, Homo sapien
ccacgtcgccggcaggcccccctcg

SEQ ID NO: 152118 - DNA, 25 bp, Homo sapien
cacgtcgccggcaggcccccctcga

SEQ ID NO: 152119 - DNA, 25 bp, Homo sapien
gccggcaggcccccctcgacccctg

SEQ ID NO: 152120 - DNA, 25 bp, Homo sapien
gcaggcccccctcgacccctgccct

SEQ ID NO: 152121 - DNA, 25 bp, Homo sapien
caggcccccctcgacccctgccctg

SEQ ID NO: 152122 - DNA, 25 bp, Homo sapien
ggcccccctcgacccctgccctgtg

SEQ ID NO: 152123 - DNA, 25 bp, Homo sapien
gcccccctcgacccctgccctgtga

SEQ ID NO: 152124 - DNA, 25 bp, Homo sapien
cccccctcgacccctgccctgtgag

SEQ ID NO: 152125 - DNA, 25 bp, Homo sapien
atcaagattagatcctgtgctgaaa

SEQ ID NO: 152126 - DNA, 25 bp, Homo sapien
aaaagatgacattccagaagaagac

SEQ ID NO: 152127 - DNA, 25 bp, Homo sapien
gaaatttcagagcttccaagaccac

SEQ ID NO: 152128 - DNA, 25 bp, Homo sapien
gagcttccaagaccacaaacttaaa

SEQ ID NO: 152129 - DNA, 25 bp, Homo sapien
aaggctcggaaagatggatttttgc

SEQ ID NO: 152130 - DNA, 25 bp, Homo sapien
ggatttttgcatgagacgcttctgg

SEQ ID NO: 152131 - DNA, 25 bp, Homo sapien
gatttttgcatgagacgcttctgga

SEQ ID NO: 152132 - DNA, 25 bp, Homo sapien
atttttgcatgagacgcttctggac

SEQ ID NO: 152133 - DNA, 25 bp, Homo sapien
ttgcatgagacgcttctggacagga

SEQ ID NO: 152134 - DNA, 25 bp, Homo sapien
tgagacgcttctggacaggagagcc

SEQ ID NO: 152135 - DNA, 25 bp, Homo sapien
gacaggagagccaaattgaaagccg

SEQ ID NO: 152136 - DNA, 25 bp, Homo sapien
gccatgttatttatagtgttgcttt

SEQ ID NO: 152137 - DNA, 25 bp, Homo sapien
tccttgtgctttccttgtggttttc

SEQ ID NO: 152138 - DNA, 25 bp, Homo sapien
gtggttttcttggttggttattcag

SEQ ID NO: 152139 - DNA, 25 bp, Homo sapien
gtgcagatatcacagaggcctatag

SEQ ID NO: 152140 - DNA, 25 bp, Homo sapien
aggcctatagccttttggtatctac

SEQ ID NO: 152141 - DNA, 25 bp, Homo sapien
ggtatctacttctacatccaatgta

SEQ ID NO: 152142 - DNA, 25 bp, Homo sapien
aatgttgctttcttatcccagtgat

SEQ ID NO: 152143 - DNA, 25 bp, Homo sapien
tcccagtgatcacctgccaaatgaa

SEQ ID NO: 152144 - DNA, 25 bp, Homo sapien
gacatatatctattacacttgggat

SEQ ID NO: 152145 - DNA, 25 bp, Homo sapien
acttgggattgtgcttactgttgca

SEQ ID NO: 152146 - DNA, 25 bp, Homo sapien
gtgcttactgttgcataactatttt

SEQ ID NO: 152147 - DNA, 25 bp, Homo sapien
gtttgcatcgccagcttctatatat

SEQ ID NO: 152148 - DNA, 25 bp, Homo sapien
gcttctatatattacggcctttttt

SEQ ID NO: 152149 - DNA, 25 bp, Homo sapien
aaaacgtgaagactacctgtatgct

SEQ ID NO: 152150 - DNA, 25 bp, Homo sapien
acctgtatgctgtgagggaccgtga

SEQ ID NO: 152151 - DNA, 25 bp, Homo sapien
ttacatccagaggattttcctgaag

SEQ ID NO: 152152 - DNA, 25 bp, Homo sapien
attccatccaatacgttgaagtctt

SEQ ID NO: 152153 - DNA, 25 bp, Homo sapien
gaagtcttcaaaatgcttgctccag

SEQ ID NO: 152154 - DNA, 25 bp, Homo sapien
aaaatgcttgctccagtttcactga

SEQ ID NO: 152155 - DNA, 25 bp, Homo sapien
gtttcactgatacctgctgtttctg

SEQ ID NO: 152156 - DNA, 25 bp, Homo sapien
ggaacatgtttcttatgacagttga

SEQ ID NO: 152157 - DNA, 25 bp, Homo sapien
gacagttgaagcttatgctaatctg

SEQ ID NO: 152158 - DNA, 25 bp, Homo sapien
gctcaggagcctggatacccaaaaa

SEQ ID NO: 152159 - DNA, 25 bp, Homo sapien
tggatacccaaaaagccacctgcca

SEQ ID NO: 152160 - DNA, 25 bp, Homo sapien
ttcaacaggtcacggaccttccctg

SEQ ID NO: 152161 - DNA, 25 bp, Homo sapien
gagagaaatattatatcacactgtt

SEQ ID NO: 152162 - DNA, 25 bp, Homo sapien
atatcacactgttgcaaggactaag

SEQ ID NO: 152163 - DNA, 25 bp, Homo sapien
gttgcaaggactaagataagcgatg

SEQ ID NO: 152164 - DNA, 25 bp, Homo sapien
gcctgtgttctgtggactcctcgta

SEQ ID NO: 152165 - DNA, 25 bp, Homo sapien
ttctgtggactcctcgtagccaaga

SEQ ID NO: 152166 - DNA, 25 bp, Homo sapien
ggactcctcgtagccaagagcctgg

SEQ ID NO: 152167 - DNA, 25 bp, Homo sapien
ctcgtagccaagagcctggtgctgt

SEQ ID NO: 152168 - DNA, 25 bp, Homo sapien
gctgtcagccctgctcgtctggtgg

SEQ ID NO: 152169 - DNA, 25 bp, Homo sapien
gagagtaattgcttgacaacaacct

SEQ ID NO: 152170 - DNA, 25 bp, Homo sapien
gacaacaacctatgcaccaggtatt

SEQ ID NO: 152171 - DNA, 25 bp, Homo sapien
tgcaccaggtatttaacattaactt

SEQ ID NO: 152172 - DNA, 25 bp, Homo sapien
catagtaatttcactctctgcattg

SEQ ID NO: 152173 - DNA, 25 bp, Homo sapien
atttcactctctgcattgacttatg

SEQ ID NO: 152174 - DNA, 25 bp, Homo sapien
ctctgcattgacttatgagataatt

SEQ ID NO: 152175 - DNA, 25 bp, Homo sapien
gttcataatatcatgtgcacttcaa

SEQ ID NO: 152176 - DNA, 25 bp, Homo sapien
gtgcacttcaagaaaatggaatgct

SEQ ID NO: 152177 - DNA, 25 bp, Homo sapien
aatggaatgctactcttttgtggtt

SEQ ID NO: 152178 - DNA, 25 bp, Homo sapien
tgctactcttttgtggtttacgtgt

SEQ ID NO: 152179 - DNA, 25 bp, Homo sapien
gtggtttacgtgtattattttcaat

SEQ ID NO: 152180 - DNA, 25 bp, Homo sapien
atggttttcttgtgtgtttattgtc

SEQ ID NO: 152181 - DNA, 25 bp, Homo sapien
ggtgagaggcatccagtatcttgaa

SEQ ID NO: 152182 - DNA, 25 bp, Homo sapien
ttgaagacttttctttcagccaaga

SEQ ID NO: 152183 - DNA, 25 bp, Homo sapien
aacacaacatctttttctactcgag

SEQ ID NO: 152184 - DNA, 25 bp, Homo sapien
atctttttctactcgagttacagac

SEQ ID NO: 152185 - DNA, 25 bp, Homo sapien
gttacagacaaagcgtggtggacat

SEQ ID NO: 152186 - DNA, 25 bp, Homo sapien
tggtggacatgcacagctaacatgg

SEQ ID NO: 152187 - DNA, 25 bp, Homo sapien
tgcacagctaacatggaagtactat

SEQ ID NO: 152188 - DNA, 25 bp, Homo sapien
gtttctgcagccactattgttagtc

SEQ ID NO: 152189 - DNA, 25 bp, Homo sapien
actattgttagtctcttgattcata

SEQ ID NO: 152190 - DNA, 25 bp, Homo sapien
gattcataatgacttaagcacactt

SEQ ID NO: 152191 - DNA, 25 bp, Homo sapien
aaatgcttccactaccaaaagacat

SEQ ID NO: 152192 - DNA, 25 bp, Homo sapien
atgtgtgctagttcaccagagaaaa

SEQ ID NO: 152193 - DNA, 25 bp, Homo sapien
gaaaattgaaatcttggctcctcca

SEQ ID NO: 152194 - DNA, 25 bp, Homo sapien
aaatcttggctcctccaaatgggtc

SEQ ID NO: 152195 - DNA, 25 bp, Homo sapien
caaatgggtctgttcctggagacag

SEQ ID NO: 152196 - DNA, 25 bp, Homo sapien
atgctttcccaggagagcctgacaa

SEQ ID NO: 152197 - DNA, 25 bp, Homo sapien
ggagagcctgacaaggagctgaatc

SEQ ID NO: 152198 - DNA, 25 bp, Homo sapien
cagcctgatcttcacactaatgatg

SEQ ID NO: 152199 - DNA, 25 bp, Homo sapien
atgagtgtgtggctacatacaaagg

SEQ ID NO: 152200 - DNA, 25 bp, Homo sapien
gtggctacatacaaaggagttccct

SEQ ID NO: 152201 - DNA, 25 bp, Homo sapien
agggagtatgtagggctcaaaccat

SEQ ID NO: 152202 - DNA, 25 bp, Homo sapien
tttatgtgtttatctgtgtcaagta

SEQ ID NO: 152203 - DNA, 25 bp, Homo sapien
atctgtgtcaagtatttctggtaat

SEQ ID NO: 152204 - DNA, 25 bp, Homo sapien
agaagcacttaatttacacatattt

SEQ ID NO: 152205 - DNA, 25 bp, Homo sapien
tacacatattttaatcctgtgaaag

SEQ ID NO: 152206 - DNA, 25 bp, Homo sapien
aatcctgtgaaagattccacataga

SEQ ID NO: 152207 - DNA, 25 bp, Homo sapien
gaaagatacctaaccttcaacaaat

SEQ ID NO: 152208 - DNA, 25 bp, Homo sapien
gatacctaaccttcaacaaatgtta

SEQ ID NO: 152209 - DNA, 25 bp, Homo sapien
gattcattaattttcatagtgcctt

SEQ ID NO: 152210 - DNA, 25 bp, Homo sapien
atagtgcctttttcacatgagtcag

SEQ ID NO: 152211 - DNA, 25 bp, Homo sapien
tgcctttttcacatgagtcagctgg

SEQ ID NO: 152212 - DNA, 25 bp, Homo sapien
ctttttcacatgagtcagctggaaa

SEQ ID NO: 152213 - DNA, 25 bp, Homo sapien
gaatatgttactgagcttgcttgtg

SEQ ID NO: 152214 - DNA, 25 bp, Homo sapien
ctgagcttgcttgtggtaaccattt

SEQ ID NO: 152215 - DNA, 25 bp, Homo sapien
gtacaccaaaacatgttgaacatcc

SEQ ID NO: 152216 - DNA, 25 bp, Homo sapien
gaacatccatgttgtacaactgaaa

SEQ ID NO: 152217 - DNA, 25 bp, Homo sapien
aaatgttaatagtgcgtacctctag

SEQ ID NO: 152218 - DNA, 25 bp, Homo sapien
gtgcgtacctctaggaagtgggcct

SEQ ID NO: 152219 - DNA, 25 bp, Homo sapien
aagtgggcctggaagccattcttac

SEQ ID NO: 152220 - DNA, 25 bp, Homo sapien
gcctggaagccattcttacttttca

SEQ ID NO: 152221 - DNA, 25 bp, Homo sapien
attcttacttttcagtctctcccat

SEQ ID NO: 152222 - DNA, 25 bp, Homo sapien
ttttgttttactttcgtgcctgcat

SEQ ID NO: 152223 - DNA, 25 bp, Homo sapien
tactttcgtgcctgcattatttttc

SEQ ID NO: 152224 - DNA, 25 bp, Homo sapien
ttgtgatccagctcacagctccacg

SEQ ID NO: 152225 - DNA, 25 bp, Homo sapien
gtgatccagctcacagctccacgaa

SEQ ID NO: 152226 - DNA, 25 bp, Homo sapien
gatccagctcacagctccacgaaga

SEQ ID NO: 152227 - DNA, 25 bp, Homo sapien
agctcacagctccacgaagactcaa

SEQ ID NO: 152228 - DNA, 25 bp, Homo sapien
tcacagctccacgaagactcaaaag

SEQ ID NO: 152229 - DNA, 25 bp, Homo sapien
cacagctccacgaagactcaaaagg

SEQ ID NO: 152230 - DNA, 25 bp, Homo sapien
cagctccacgaagactcaaaaggaa

SEQ ID NO: 152231 - DNA, 25 bp, Homo sapien
aggaaaagccatttttgcctcaggg

SEQ ID NO: 152232 - DNA, 25 bp, Homo sapien
ggaaaagccatttttgcctcagggt

SEQ ID NO: 152233 - DNA, 25 bp, Homo sapien
gaaaagccatttttgcctcagggtt

SEQ ID NO: 152234 - DNA, 25 bp, Homo sapien
aaacaaaatgcaggccgagcgcggt

SEQ ID NO: 152235 - DNA, 25 bp, Homo sapien
ggctgaaggtcagaagtaatcctga

SEQ ID NO: 152236 - DNA, 25 bp, Homo sapien
ggtcagaagtaatcctgagaaatgt

SEQ ID NO: 152237 - DNA, 25 bp, Homo sapien
cgacgcctctgcaataactggacca

SEQ ID NO: 152238 - DNA, 25 bp, Homo sapien
cgcctctgcaataactggaccaggg

SEQ ID NO: 152239 - DNA, 25 bp, Homo sapien
gcagcccagtccctagtgcccaagg

SEQ ID NO: 152240 - DNA, 25 bp, Homo sapien
ggcctgggccatccattccattttg

SEQ ID NO: 152241 - DNA, 25 bp, Homo sapien
cattttgttccacatttcctttcta

SEQ ID NO: 152242 - DNA, 25 bp, Homo sapien
ttctactctttctgccaagagcctg

SEQ ID NO: 152243 - DNA, 25 bp, Homo sapien
agagcctgcccctgcatttgtcctg

SEQ ID NO: 152244 - DNA, 25 bp, Homo sapien
gaaacacggtatttaagagagaact

SEQ ID NO: 152245 - DNA, 25 bp, Homo sapien
cacggtatttaagagagaactatat

SEQ ID NO: 152246 - DNA, 25 bp, Homo sapien
aaacagtgcagcctgactgggaaca

SEQ ID NO: 152247 - DNA, 25 bp, Homo sapien
gtgcagcctgactgggaacaggatc

SEQ ID NO: 152248 - DNA, 25 bp, Homo sapien
agcctgactgggaacaggatcctgt

SEQ ID NO: 152249 - DNA, 25 bp, Homo sapien
acaggatcctgtgaaagctgatgcc

SEQ ID NO: 152250 - DNA, 25 bp, Homo sapien
tgtcccaagccacagctatggcgtt

SEQ ID NO: 152251 - DNA, 25 bp, Homo sapien
tcccaagccacagctatggcgttaa

SEQ ID NO: 152252 - DNA, 25 bp, Homo sapien
agccacagctatggcgttaatgtca

SEQ ID NO: 152253 - DNA, 25 bp, Homo sapien
tggaggtgcctccacagccgaccag

SEQ ID NO: 152254 - DNA, 25 bp, Homo sapien
gagggtccggtgaggctgcagcagt

SEQ ID NO: 152255 - DNA, 25 bp, Homo sapien
gctgcagcagtggttaaggagtaac

SEQ ID NO: 152256 - DNA, 25 bp, Homo sapien
gttaaggagtaacaccttcttgtat

SEQ ID NO: 152257 - DNA, 25 bp, Homo sapien
atctgaggcagttttttcctgggaa

SEQ ID NO: 152258 - DNA, 25 bp, Homo sapien
cacacgttccatgctttttcagaaa

SEQ ID NO: 152259 - DNA, 25 bp, Homo sapien
gttaggcctgaagtgcctgtggcat

SEQ ID NO: 152260 - DNA, 25 bp, Homo sapien
tgaagtgcctgtggcatgttgcagc

SEQ ID NO: 152261 - DNA, 25 bp, Homo sapien
gttgcagcagctattttgccagtta

SEQ ID NO: 152262 - DNA, 25 bp, Homo sapien
gccagttagtatacctctttgttgt

SEQ ID NO: 152263 - DNA, 25 bp, Homo sapien
tttgttgtactttcttgggcttttg

SEQ ID NO: 152264 - DNA, 25 bp, Homo sapien
tgggcttttgctctggtgtatttta

SEQ ID NO: 152265 - DNA, 25 bp, Homo sapien
ttattgtcagaaagtccagactcaa

SEQ ID NO: 152266 - DNA, 25 bp, Homo sapien
taatggattttccttaaaacttcag

SEQ ID NO: 152267 - DNA, 25 bp, Homo sapien
aacttcagtctttttgtagtattat

SEQ ID NO: 152268 - DNA, 25 bp, Homo sapien
ttactcctggttagtacattctcag

SEQ ID NO: 152269 - DNA, 25 bp, Homo sapien
tggttagtacattctcagaggattc

SEQ ID NO: 152270 - DNA, 25 bp, Homo sapien
cagaggattctgaaccactagagtt

SEQ ID NO: 152271 - DNA, 25 bp, Homo sapien
accactagagtttccttgattcaga

SEQ ID NO: 152272 - DNA, 25 bp, Homo sapien
gagtttccttgattcagactttgaa

SEQ ID NO: 152273 - DNA, 25 bp, Homo sapien
gaatgtactgttctatagtttttca

SEQ ID NO: 152274 - DNA, 25 bp, Homo sapien
gaggaacataattcatgcaattgta

SEQ ID NO: 152275 - DNA, 25 bp, Homo sapien
gtatactattattgttctttcactt

SEQ ID NO: 152276 - DNA, 25 bp, Homo sapien
tattcagaacattacatgccttcaa

SEQ ID NO: 152277 - DNA, 25 bp, Homo sapien
gggattgtactataccagtaagtgc

SEQ ID NO: 152278 - DNA, 25 bp, Homo sapien
accagtaagtgccacttctgtgtct

SEQ ID NO: 152279 - DNA, 25 bp, Homo sapien
agtttagctcgagcgccatccagaa

SEQ ID NO: 152280 - DNA, 25 bp, Homo sapien
gaagatgggcgaagtgccccacacc

SEQ ID NO: 152281 - DNA, 25 bp, Homo sapien
tgggctaccagaacggcgccttcgg

SEQ ID NO: 152282 - DNA, 25 bp, Homo sapien
agaacggcgccttcggcagcctcag

SEQ ID NO: 152283 - DNA, 25 bp, Homo sapien
aaccctggctacgtggtgccctgta

SEQ ID NO: 152284 - DNA, 25 bp, Homo sapien
tacgtggtgccctgtaactgtaccg

SEQ ID NO: 152285 - DNA, 25 bp, Homo sapien
cctgtaactgtaccgcctggtctgc

SEQ ID NO: 152286 - DNA, 25 bp, Homo sapien
tcttcccaggcatgaccaagactgg

SEQ ID NO: 152287 - DNA, 25 bp, Homo sapien
gaccaagactggcatagacccttat

SEQ ID NO: 152288 - DNA, 25 bp, Homo sapien
tggcatagacccttattcgtcagcc

SEQ ID NO: 152289 - DNA, 25 bp, Homo sapien
gtcagcccacgctacggccatgtaa

SEQ ID NO: 152290 - DNA, 25 bp, Homo sapien
tggcccctgtgtggtagctagtgac

SEQ ID NO: 152291 - DNA, 25 bp, Homo sapien
tggagtctgctgctcgagttcctac

SEQ ID NO: 152292 - DNA, 25 bp, Homo sapien
gctgctcgagttcctacagagtttt

SEQ ID NO: 152293 - DNA, 25 bp, Homo sapien
acagagttttctaggcagccacaca

SEQ ID NO: 152294 - DNA, 25 bp, Homo sapien
tgtttgggaacagacatgatgcggt

SEQ ID NO: 152295 - DNA, 25 bp, Homo sapien
atgatgcggtctacggcccagcaga

SEQ ID NO: 152296 - DNA, 25 bp, Homo sapien
ggcccagcagataccatggtccagt

SEQ ID NO: 152297 - DNA, 25 bp, Homo sapien
atggtccagtacatggaactcttca

SEQ ID NO: 152298 - DNA, 25 bp, Homo sapien
ggaactcttcaacaagatccgcaag

SEQ ID NO: 152299 - DNA, 25 bp, Homo sapien
caacaagatccgcaagcagcagcag

SEQ ID NO: 152300 - DNA, 25 bp, Homo sapien
ggattcgttagtgatgagcagctgc

SEQ ID NO: 152301 - DNA, 25 bp, Homo sapien
ccttgtatgttcctatcaggctgat

SEQ ID NO: 152302 - DNA, 25 bp, Homo sapien
ctatcaggctgatttttggagaaat

SEQ ID NO: 152303 - DNA, 25 bp, Homo sapien
agagggagaccatactagggcgact

SEQ ID NO: 152304 - DNA, 25 bp, Homo sapien
atactagggcgactcctgtgtgact

SEQ ID NO: 152305 - DNA, 25 bp, Homo sapien
tgtgtgactgaagtcccagcccttc

SEQ ID NO: 152306 - DNA, 25 bp, Homo sapien
tggccccaaggctaggatcaaagtg

SEQ ID NO: 152307 - DNA, 25 bp, Homo sapien
agcagagttagctgtctagcgccta

SEQ ID NO: 152308 - DNA, 25 bp, Homo sapien
tagcgcctagcaaggtgcctttgta

SEQ ID NO: 152309 - DNA, 25 bp, Homo sapien
gtgcctttgtacctcaggtgtttta

SEQ ID NO: 152310 - DNA, 25 bp, Homo sapien
gaaccaaagttctgataccttgttt

SEQ ID NO: 152311 - DNA, 25 bp, Homo sapien
ggcatttctatctattgtggcttta

SEQ ID NO: 152312 - DNA, 25 bp, Homo sapien
tagaatattccttatgttgacatgg

SEQ ID NO: 152313 - DNA, 25 bp, Homo sapien
gttcaatcaaactttcagctttttt

SEQ ID NO: 152314 - DNA, 25 bp, Homo sapien
agattaacaacactgcatgcggcaa

SEQ ID NO: 152315 - DNA, 25 bp, Homo sapien
tcttacccacactacgcagaagaga

SEQ ID NO: 152316 - DNA, 25 bp, Homo sapien
accactatcttttgttctacctgta

SEQ ID NO: 152317 - DNA, 25 bp, Homo sapien
gttctacctgtattgtctgacttct

SEQ ID NO: 152318 - DNA, 25 bp, Homo sapien
gtctgacttctcaggaagatcgtga

SEQ ID NO: 152319 - DNA, 25 bp, Homo sapien
agatcgtgaacataactgagggcat

SEQ ID NO: 152320 - DNA, 25 bp, Homo sapien
gagggcatgagtctcactagcacat

SEQ ID NO: 152321 - DNA, 25 bp, Homo sapien
tcactagcacatggaggcccttttg

SEQ ID NO: 152322 - DNA, 25 bp, Homo sapien
gcccttttggatttagagactgtaa

SEQ ID NO: 152323 - DNA, 25 bp, Homo sapien
gtcatctggacagctgttttcctgt

SEQ ID NO: 152324 - DNA, 25 bp, Homo sapien
atctggacagctgttttcctgtttg

SEQ ID NO: 152325 - DNA, 25 bp, Homo sapien
gttgagagtctttagacctgtgcac

SEQ ID NO: 152326 - DNA, 25 bp, Homo sapien
gagtctttagacctgtgcacagccc

SEQ ID NO: 152327 - DNA, 25 bp, Homo sapien
gggtgctgtatgctctaggcatccc

SEQ ID NO: 152328 - DNA, 25 bp, Homo sapien
tgctgtatgctctaggcatcccctc

SEQ ID NO: 152329 - DNA, 25 bp, Homo sapien
acacggtgaactggctgtgtccatc

SEQ ID NO: 152330 - DNA, 25 bp, Homo sapien
gaactggctgtgtccatctttgtca

SEQ ID NO: 152331 - DNA, 25 bp, Homo sapien
ggctgtgtccatctttgtcactgag

SEQ ID NO: 152332 - DNA, 25 bp, Homo sapien
tgtccatctttgtcactgagtgaaa

SEQ ID NO: 152333 - DNA, 25 bp, Homo sapien
gataagtttgtatgttctgagaata

SEQ ID NO: 152334 - DNA, 25 bp, Homo sapien
tggttctagggtgggtttacagctt

SEQ ID NO: 152335 - DNA, 25 bp, Homo sapien
tctagggtgggtttacagctttttg

SEQ ID NO: 152336 - DNA, 25 bp, Homo sapien
aagccgtagtaagaaatggatcata

SEQ ID NO: 152337 - DNA, 25 bp, Homo sapien
ggatcatatatattacaactaactt

SEQ ID NO: 152338 - DNA, 25 bp, Homo sapien
aactaacttcttcaactatggactt

SEQ ID NO: 152339 - DNA, 25 bp, Homo sapien
aactatggactttttaagcctaatg

SEQ ID NO: 152340 - DNA, 25 bp, Homo sapien
gcctaatgaaatcttaagtgtctta

SEQ ID NO: 152341 - DNA, 25 bp, Homo sapien
agtgtcttatatgtaatcctgtagg

SEQ ID NO: 152342 - DNA, 25 bp, Homo sapien
tgtaatcctgtaggttggtacttcc

SEQ ID NO: 152343 - DNA, 25 bp, Homo sapien
ggtaacagtttaatcatctcacttg

SEQ ID NO: 152344 - DNA, 25 bp, Homo sapien
atcatctcacttgctaacatgtttt

SEQ ID NO: 152345 - DNA, 25 bp, Homo sapien
ttattattttgatagcagatgtgct

SEQ ID NO: 152346 - DNA, 25 bp, Homo sapien
ggagcctcctatgtgtgacttatga

SEQ ID NO: 152347 - DNA, 25 bp, Homo sapien
agcctcctatgtgtgacttatgact

SEQ ID NO: 152348 - DNA, 25 bp, Homo sapien
tctctgtgttctgtgtatttgtctg

SEQ ID NO: 152349 - DNA, 25 bp, Homo sapien
atttgtctgaattaatgacctggga

SEQ ID NO: 152350 - DNA, 25 bp, Homo sapien
tgacctgggatataaagctatgcta

SEQ ID NO: 152351 - DNA, 25 bp, Homo sapien
gctatgctagctttcaaacaggaga

SEQ ID NO: 152352 - DNA, 25 bp, Homo sapien
atgctagctttcaaacaggagatgc

SEQ ID NO: 152353 - DNA, 25 bp, Homo sapien
gtatattttgcagttgccagaccaa

SEQ ID NO: 152354 - DNA, 25 bp, Homo sapien
tttgcagttgccagaccaataaaat

SEQ ID NO: 152355 - DNA, 25 bp, Homo sapien
gccagaccaataaaatacctggttg

SEQ ID NO: 152356 - DNA, 25 bp, Homo sapien
ctgccatgggccaggctaggccttg

SEQ ID NO: 152357 - DNA, 25 bp, Homo sapien
atgggccaggctaggccttggtccc

SEQ ID NO: 152358 - DNA, 25 bp, Homo sapien
gctaggccttggtcccttttaatat

SEQ ID NO: 152359 - DNA, 25 bp, Homo sapien
aggtggccttcccaatgcgcgttat

SEQ ID NO: 152360 - DNA, 25 bp, Homo sapien
gtggccttcccaatgcgcgttattc

SEQ ID NO: 152361 - DNA, 25 bp, Homo sapien
ggccttcccaatgcgcgttattcgg

SEQ ID NO: 152362 - DNA, 25 bp, Homo sapien
aatgcgcgttattcggggttattga

SEQ ID NO: 152363 - DNA, 25 bp, Homo sapien
agccagaagtagactttctgtcctc

SEQ ID NO: 152364 - DNA, 25 bp, Homo sapien
ccagaagtagactttctgtcctcac

SEQ ID NO: 152365 - DNA, 25 bp, Homo sapien
gtcctcacaccgaagaacccgagtg

SEQ ID NO: 152366 - DNA, 25 bp, Homo sapien
cacaccgaagaacccgagtgagcag

SEQ ID NO: 152367 - DNA, 25 bp, Homo sapien
ttctgcacaggagagcaaggcactt

SEQ ID NO: 152368 - DNA, 25 bp, Homo sapien
gcaaggcacttgcagtagtgatcta

SEQ ID NO: 152369 - DNA, 25 bp, Homo sapien
tgcagtagtgatctatgccagcaaa

SEQ ID NO: 152370 - DNA, 25 bp, Homo sapien
gtgatctatgccagcaaaacatcat

SEQ ID NO: 152371 - DNA, 25 bp, Homo sapien
ttttgtggcagatgtttttcctaaa

SEQ ID NO: 152372 - DNA, 25 bp, Homo sapien
aaaagtactatatcatccaagaaat

SEQ ID NO: 152373 - DNA, 25 bp, Homo sapien
atcccttgttcttttgggtgacatt

SEQ ID NO: 152374 - DNA, 25 bp, Homo sapien
gggtgacattaactgacatttgctt

SEQ ID NO: 152375 - DNA, 25 bp, Homo sapien
aagcccataatgtatttagaaacag

SEQ ID NO: 152376 - DNA, 25 bp, Homo sapien
acaggaatcctcagagcaattctct

SEQ ID NO: 152377 - DNA, 25 bp, Homo sapien
ttctctgtattctcatataatttca

SEQ ID NO: 152378 - DNA, 25 bp, Homo sapien
ggtttatttccatacctgactctgg

SEQ ID NO: 152379 - DNA, 25 bp, Homo sapien
cctgactctgggtgtggtggttaaa

SEQ ID NO: 152380 - DNA, 25 bp, Homo sapien
aagtcttccagtgactttcggtctt

SEQ ID NO: 152381 - DNA, 25 bp, Homo sapien
cttggttatatggagaattctgaat

SEQ ID NO: 152382 - DNA, 25 bp, Homo sapien
agaattctgaatcccaaacccctgg

SEQ ID NO: 152383 - DNA, 25 bp, Homo sapien
gaaggaggatgcctaatcctacaaa

SEQ ID NO: 152384 - DNA, 25 bp, Homo sapien
atcctacaaagtgaccctttataca

SEQ ID NO: 152385 - DNA, 25 bp, Homo sapien
gttgagagacaattaattatcccct

SEQ ID NO: 152386 - DNA, 25 bp, Homo sapien
gacaattaattatcccctcttacac

SEQ ID NO: 152387 - DNA, 25 bp, Homo sapien
aattatcccctcttacacacaaaca

SEQ ID NO: 152388 - DNA, 25 bp, Homo sapien
catacttacccacatgtacacagag

SEQ ID NO: 152389 - DNA, 25 bp, Homo sapien
gaattcttatatttcgctgatgtga

SEQ ID NO: 152390 - DNA, 25 bp, Homo sapien
tttgggtaacaagactgacagtgaa

SEQ ID NO: 152391 - DNA, 25 bp, Homo sapien
tgacagtgaacagcaggtgtctgca

SEQ ID NO: 152392 - DNA, 25 bp, Homo sapien
acggcagcgactatccttaatttga

SEQ ID NO: 152393 - DNA, 25 bp, Homo sapien
aagatcgtcaaatgtggcagtagca

SEQ ID NO: 152394 - DNA, 25 bp, Homo sapien
gggttccaagagttcttactaccag

SEQ ID NO: 152395 - DNA, 25 bp, Homo sapien
gagttcttactaccagggataggtc

SEQ ID NO: 152396 - DNA, 25 bp, Homo sapien
gggataggtcagatcacttgactca

SEQ ID NO: 152397 - DNA, 25 bp, Homo sapien
gagagtgatggtctgacttcatcga

SEQ ID NO: 152398 - DNA, 25 bp, Homo sapien
gtctgacttcatcgaaaccattggt

SEQ ID NO: 152399 - DNA, 25 bp, Homo sapien
gaaaccattggtcaatcttcattga

SEQ ID NO: 152400 - DNA, 25 bp, Homo sapien
tttggcctgtgcttctgcttattca

SEQ ID NO: 152401 - DNA, 25 bp, Homo sapien
ttattcagtccttcagctcacggaa

SEQ ID NO: 152402 - DNA, 25 bp, Homo sapien
atgctagtccgtgaaggtgacctca

SEQ ID NO: 152403 - DNA, 25 bp, Homo sapien
ggtgacctcacagtactggttaatt

SEQ ID NO: 152404 - DNA, 25 bp, Homo sapien
tggaaactcaccatcggcaggcagt

SEQ ID NO: 152405 - DNA, 25 bp, Homo sapien
gcattagagggagcccagtctggat

SEQ ID NO: 152406 - DNA, 25 bp, Homo sapien
gtctggatgtggacttggatgccct

SEQ ID NO: 152407 - DNA, 25 bp, Homo sapien
gatgccctgtgggtatcagttctgc

SEQ ID NO: 152408 - DNA, 25 bp, Homo sapien
ctgctgacactttggcccgaaatag

SEQ ID NO: 152409 - DNA, 25 bp, Homo sapien
ggcccgaaatagatccagtgctgag

SEQ ID NO: 152410 - DNA, 25 bp, Homo sapien
tcagtgagcccatctgcacagtggg

SEQ ID NO: 152411 - DNA, 25 bp, Homo sapien
ttgggctgtaacttcttcgttgaca

SEQ ID NO: 152412 - DNA, 25 bp, Homo sapien
ttcgttgacacagtggtcccagata

SEQ ID NO: 152413 - DNA, 25 bp, Homo sapien
agatacttcacgcatctatgtggcc

SEQ ID NO: 152414 - DNA, 25 bp, Homo sapien
tgtggccctgggatatggttttttc

SEQ ID NO: 152415 - DNA, 25 bp, Homo sapien
tgacactggcagaagctctcaagtt

SEQ ID NO: 152416 - DNA, 25 bp, Homo sapien
gttcattgatcgtaagagctctctc

SEQ ID NO: 152417 - DNA, 25 bp, Homo sapien
agcctcaccaaggactccatgaata

SEQ ID NO: 152418 - DNA, 25 bp, Homo sapien
aaagcccatatccacatgttgctag

SEQ ID NO: 152419 - DNA, 25 bp, Homo sapien
gggcttagagaactacaaggcctgc

SEQ ID NO: 152420 - DNA, 25 bp, Homo sapien
acaaggcctgcagaatttcccagag

SEQ ID NO: 152421 - DNA, 25 bp, Homo sapien
tttcccagagaagcctcaccattga

SEQ ID NO: 152422 - DNA, 25 bp, Homo sapien
ttcagctggctctcatcaggctgca

SEQ ID NO: 152423 - DNA, 25 bp, Homo sapien
cagctggctctcatcaggctgcagc

SEQ ID NO: 152424 - DNA, 25 bp, Homo sapien
aaccacagcattatcacagcattat

SEQ ID NO: 152425 - DNA, 25 bp, Homo sapien
acagcattattgtgacagccacgaa

SEQ ID NO: 152426 - DNA, 25 bp, Homo sapien
attattgtgacagccacgaacccat

SEQ ID NO: 152427 - DNA, 25 bp, Homo sapien
tattgtgacagccacgaacccattg

SEQ ID NO: 152428 - DNA, 25 bp, Homo sapien
gctctgagccctgttctgaccaaat

SEQ ID NO: 152429 - DNA, 25 bp, Homo sapien
tgagccctgttctgaccaaatcatg

SEQ ID NO: 152430 - DNA, 25 bp, Homo sapien
gagccctgttctgaccaaatcatga

SEQ ID NO: 152431 - DNA, 25 bp, Homo sapien
gccctgttctgaccaaatcatgatg

SEQ ID NO: 152432 - DNA, 25 bp, Homo sapien
tgttctgaccaaatcatgatgatga

SEQ ID NO: 152433 - DNA, 25 bp, Homo sapien
gttgctgaagatgccttgaggtgaa

SEQ ID NO: 152434 - DNA, 25 bp, Homo sapien
cacatcttgctctgcatttataaag

SEQ ID NO: 152435 - DNA, 25 bp, Homo sapien
gctctgcatttataaagaccgtaca

SEQ ID NO: 152436 - DNA, 25 bp, Homo sapien
aaaagattgccaattttcttcatct

SEQ ID NO: 152437 - DNA, 25 bp, Homo sapien
attttcttcatctttgccatatgga

SEQ ID NO: 152438 - DNA, 25 bp, Homo sapien
tttgccatatggaggactgtgacag

SEQ ID NO: 152439 - DNA, 25 bp, Homo sapien
actgtgacagactttggacagtggc

SEQ ID NO: 152440 - DNA, 25 bp, Homo sapien
gagttcctctgcagttttgacattt

SEQ ID NO: 152441 - DNA, 25 bp, Homo sapien
ctctgcagttttgacatttaggatt

SEQ ID NO: 152442 - DNA, 25 bp, Homo sapien
ttgtctgcagctgtttgttgcccca

SEQ ID NO: 152443 - DNA, 25 bp, Homo sapien
ttgttgccccattcctaagaggagt

SEQ ID NO: 152444 - DNA, 25 bp, Homo sapien
aggagttgagcaggtgcttctcacc

SEQ ID NO: 152445 - DNA, 25 bp, Homo sapien
ggtgcttctcacctggtgttattga

SEQ ID NO: 152446 - DNA, 25 bp, Homo sapien
tctcacctggtgttattgaggtgca

SEQ ID NO: 152447 - DNA, 25 bp, Homo sapien
taaaaaggtggccagagttgccaac

SEQ ID NO: 152448 - DNA, 25 bp, Homo sapien
cccggctggataccttcagcagaga

SEQ ID NO: 152449 - DNA, 25 bp, Homo sapien
accttcagcagagaaatcttccgga

SEQ ID NO: 152450 - DNA, 25 bp, Homo sapien
gcagagaaatcttccggaatgagaa

SEQ ID NO: 152451 - DNA, 25 bp, Homo sapien
taaagaaggttgtgaggcttgcccg

SEQ ID NO: 152452 - DNA, 25 bp, Homo sapien
aggcttgcccgggttcgagatcatt

SEQ ID NO: 152453 - DNA, 25 bp, Homo sapien
cttgcccgggttcgagatcattata

SEQ ID NO: 152454 - DNA, 25 bp, Homo sapien
gcccgggttcgagatcattatatct

SEQ ID NO: 152455 - DNA, 25 bp, Homo sapien
tataagcagggcacgagccgcatcc

SEQ ID NO: 152456 - DNA, 25 bp, Homo sapien
cgcggtgaccagagcctgtggatcc

SEQ ID NO: 152457 - DNA, 25 bp, Homo sapien
ctgtggatccgctcgcgggacatcg

SEQ ID NO: 152458 - DNA, 25 bp, Homo sapien
acatcgcctgcaagtgtcccaaaat

SEQ ID NO: 152459 - DNA, 25 bp, Homo sapien
gcaagtgtcccaaaatcaagcccct

SEQ ID NO: 152460 - DNA, 25 bp, Homo sapien
tcaagcccctcaagaagtacctgct

SEQ ID NO: 152461 - DNA, 25 bp, Homo sapien
gaggactctccggaccagagcggca

SEQ ID NO: 152462 - DNA, 25 bp, Homo sapien
gaccagagcggcatcgtggccgata

SEQ ID NO: 152463 - DNA, 25 bp, Homo sapien
gcatcgtggccgataaaagcagcct

SEQ ID NO: 152464 - DNA, 25 bp, Homo sapien
aaagcagcctggtgatccagtggcg

SEQ ID NO: 152465 - DNA, 25 bp, Homo sapien
gcggctgcgcaagttccagcagcgt

SEQ ID NO: 152466 - DNA, 25 bp, Homo sapien
aaacagtgcagcctgactgggaaca

SEQ ID NO: 152467 - DNA, 25 bp, Homo sapien
agcctgactgggaacaggatcctgt

SEQ ID NO: 152468 - DNA, 25 bp, Homo sapien
acaggatcctgtgaaagctgatgcc

SEQ ID NO: 152469 - DNA, 25 bp, Homo sapien
tgatgcccatgtgccctgagagctg

SEQ ID NO: 152470 - DNA, 25 bp, Homo sapien
tgtcccaagccacagctatggcgtt

SEQ ID NO: 152471 - DNA, 25 bp, Homo sapien
aagccacagctatggcgttaatgtc

SEQ ID NO: 152472 - DNA, 25 bp, Homo sapien
tggcgttaatgtcaccagtgttctc

SEQ ID NO: 152473 - DNA, 25 bp, Homo sapien
tggaggtgcctccacagccgaccag

SEQ ID NO: 152474 - DNA, 25 bp, Homo sapien
gagggtccggtgaggctgcagcagt

SEQ ID NO: 152475 - DNA, 25 bp, Homo sapien
gctgcagcagtggttaaggagtaac

SEQ ID NO: 152476 - DNA, 25 bp, Homo sapien
gttaaggagtaacaccttcttgtat

SEQ ID NO: 152477 - DNA, 25 bp, Homo sapien
atgttgtccatttttttcggctact

SEQ ID NO: 152478 - DNA, 25 bp, Homo sapien
tttcggctactctgaaatgttgcag

SEQ ID NO: 152479 - DNA, 25 bp, Homo sapien
ctctgaaatgttgcagtgtggaaca

SEQ ID NO: 152480 - DNA, 25 bp, Homo sapien
ctgggtgtttgggtcagataaatga

SEQ ID NO: 152481 - DNA, 25 bp, Homo sapien
atgaagatcaaactccagctccagc

SEQ ID NO: 152482 - DNA, 25 bp, Homo sapien
ccagcctcattttgcttgagacttt

SEQ ID NO: 152483 - DNA, 25 bp, Homo sapien
gtgaggagtttcagggccattgaaa

SEQ ID NO: 152484 - DNA, 25 bp, Homo sapien
gccattgaaacatagctgtgccctt

SEQ ID NO: 152485 - DNA, 25 bp, Homo sapien
attgaaacatagctgtgcccttgaa

SEQ ID NO: 152486 - DNA, 25 bp, Homo sapien
gctgtgcccttgaagagaatagtaa

SEQ ID NO: 152487 - DNA, 25 bp, Homo sapien
ggtttatgactgaattccctttgac

SEQ ID NO: 152488 - DNA, 25 bp, Homo sapien
catttattctgtcaggttaaaatat

SEQ ID NO: 152489 - DNA, 25 bp, Homo sapien
aacatatcagttgcaaagttcctaa

SEQ ID NO: 152490 - DNA, 25 bp, Homo sapien
atatcagttgcaaagttcctaatgt

SEQ ID NO: 152491 - DNA, 25 bp, Homo sapien
atcagttgcaaagttcctaatgtgt

SEQ ID NO: 152492 - DNA, 25 bp, Homo sapien
cagttgcaaagttcctaatgtgtat

SEQ ID NO: 152493 - DNA, 25 bp, Homo sapien
ttgcaaagttcctaatgtgtatttt

SEQ ID NO: 152494 - DNA, 25 bp, Homo sapien
gtgtatttttaaagcacatatctga

SEQ ID NO: 152495 - DNA, 25 bp, Homo sapien
gcacatatctgaataaattgcctag

SEQ ID NO: 152496 - DNA, 25 bp, Homo sapien
acactcttcacctattgtatgacca

SEQ ID NO: 152497 - DNA, 25 bp, Homo sapien
actcttcacctattgtatgaccaaa

SEQ ID NO: 152498 - DNA, 25 bp, Homo sapien
ctcttcacctattgtatgaccaaat

SEQ ID NO: 152499 - DNA, 25 bp, Homo sapien
aatgataaccagttacttacttctt

SEQ ID NO: 152500 - DNA, 25 bp, Homo sapien
tctttgttgtttgcaggccacctag

SEQ ID NO: 152501 - DNA, 25 bp, Homo sapien
tgcaggccacctagaaatacaaatg

SEQ ID NO: 152502 - DNA, 25 bp, Homo sapien
tacaaatgccaattcacctaatttt

SEQ ID NO: 152503 - DNA, 25 bp, Homo sapien
ttttatactgaaatgtagatgcccc

SEQ ID NO: 152504 - DNA, 25 bp, Homo sapien
ttttttccattatgtactcatgttt

SEQ ID NO: 152505 - DNA, 25 bp, Homo sapien
aataccatattttagggccagggat

SEQ ID NO: 152506 - DNA, 25 bp, Homo sapien
aattttgcatgcgtcattgtagccc

SEQ ID NO: 152507 - DNA, 25 bp, Homo sapien
atgcgtcattgtagccctcaatatt

SEQ ID NO: 152508 - DNA, 25 bp, Homo sapien
agccctcaatatttggtaatgctat

SEQ ID NO: 152509 - DNA, 25 bp, Homo sapien
gtaatgctatttaaagtgactcaag

SEQ ID NO: 152510 - DNA, 25 bp, Homo sapien
cagagccttcttagtgtgacaccaa

SEQ ID NO: 152511 - DNA, 25 bp, Homo sapien
gtgtgacaccaaaaccttctggtca

SEQ ID NO: 152512 - DNA, 25 bp, Homo sapien
aaaaccttctggtcagccacagaac

SEQ ID NO: 152513 - DNA, 25 bp, Homo sapien
aacagacatgacagaactgttcctg

SEQ ID NO: 152514 - DNA, 25 bp, Homo sapien
gctgccattgctgtggttatgggca

SEQ ID NO: 152515 - DNA, 25 bp, Homo sapien
gatgggcagaggttcaacccacacc

SEQ ID NO: 152516 - DNA, 25 bp, Homo sapien
acacctccactttgcttctgaaggc

SEQ ID NO: 152517 - DNA, 25 bp, Homo sapien
gaaggcccattcattagaccacttg

SEQ ID NO: 152518 - DNA, 25 bp, Homo sapien
tgtaaagattactccaacccagttt

SEQ ID NO: 152519 - DNA, 25 bp, Homo sapien
ggttcaaaacggcatgtctctccaa

SEQ ID NO: 152520 - DNA, 25 bp, Homo sapien
tctccaacaatttaagtgcctgata

SEQ ID NO: 152521 - DNA, 25 bp, Homo sapien
gttgtgtcaactgcagtgatactat

SEQ ID NO: 152522 - DNA, 25 bp, Homo sapien
tattcaggatggtgggaaatcccca

SEQ ID NO: 152523 - DNA, 25 bp, Homo sapien
ggcttgcttagattactatatttca

SEQ ID NO: 152524 - DNA, 25 bp, Homo sapien
taatcttttgtctcttgcggtgctc

SEQ ID NO: 152525 - DNA, 25 bp, Homo sapien
cttttgtctcttgcggtgctcatga

SEQ ID NO: 152526 - DNA, 25 bp, Homo sapien
gcacacggaaggcattgctgtagtc

SEQ ID NO: 152527 - DNA, 25 bp, Homo sapien
aaggcattgctgtagtcagtcattt

SEQ ID NO: 152528 - DNA, 25 bp, Homo sapien
tttggttttcttctatagccatttt

SEQ ID NO: 152529 - DNA, 25 bp, Homo sapien
tatctatttgtaaattgctactttg

SEQ ID NO: 152530 - DNA, 25 bp, Homo sapien
ctttgtattttatgcatgctctgta

SEQ ID NO: 152531 - DNA, 25 bp, Homo sapien
tatgcatgctctgtaatttgatttt

SEQ ID NO: 152532 - DNA, 25 bp, Homo sapien
tggctgttccctttcgtgtaaaatg

SEQ ID NO: 152533 - DNA, 25 bp, Homo sapien
ggctgttccctttcgtgtaaaatgg

SEQ ID NO: 152534 - DNA, 25 bp, Homo sapien
gctgttccctttcgtgtaaaatggt

SEQ ID NO: 152535 - DNA, 25 bp, Homo sapien
ctgttccctttcgtgtaaaatggtg

SEQ ID NO: 152536 - DNA, 25 bp, Homo sapien
gttccctttcgtgtaaaatggtgct

SEQ ID NO: 152537 - DNA, 25 bp, Homo sapien
ttccctttcgtgtaaaatggtgctg

SEQ ID NO: 152538 - DNA, 25 bp, Homo sapien
tccctttcgtgtaaaatggtgctgt

SEQ ID NO: 152539 - DNA, 25 bp, Homo sapien
cctttcgtgtaaaatggtgctgtta

SEQ ID NO: 152540 - DNA, 25 bp, Homo sapien
tttcgtgtaaaatggtgctgttatt

SEQ ID NO: 152541 - DNA, 25 bp, Homo sapien
gctgttattactctgtcttgaaata

SEQ ID NO: 152542 - DNA, 25 bp, Homo sapien
gttattactctgtcttgaaatagga

SEQ ID NO: 152543 - DNA, 25 bp, Homo sapien
cagggatgccctggacctaagtgac

SEQ ID NO: 152544 - DNA, 25 bp, Homo sapien
gggatgccctggacctaagtgacat

SEQ ID NO: 152545 - DNA, 25 bp, Homo sapien
tgccctggacctaagtgacatcaac

SEQ ID NO: 152546 - DNA, 25 bp, Homo sapien
tggacctaagtgacatcaactcaga

SEQ ID NO: 152547 - DNA, 25 bp, Homo sapien
ctgtttgaggacaccctagacccaa

SEQ ID NO: 152548 - DNA, 25 bp, Homo sapien
ccagactctgcctctgcacttttaa

SEQ ID NO: 152549 - DNA, 25 bp, Homo sapien
tgcctctgcacttttaaccttttat

SEQ ID NO: 152550 - DNA, 25 bp, Homo sapien
ttaaccttttatcctgtgtctctcc

SEQ ID NO: 152551 - DNA, 25 bp, Homo sapien
gtgtctctcccgtcgcccttgaaag

SEQ ID NO: 152552 - DNA, 25 bp, Homo sapien
tcgggaactcccatggtcttctctg

SEQ ID NO: 152553 - DNA, 25 bp, Homo sapien
ctctgcctggccgtgtctaataaaa

SEQ ID NO: 152554 - DNA, 25 bp, Homo sapien
tgcacagccagaactgcctttggcc

SEQ ID NO: 152555 - DNA, 25 bp, Homo sapien
agaactgcctttggccctacggatg

SEQ ID NO: 152556 - DNA, 25 bp, Homo sapien
atggccactggctctggtctaaagt

SEQ ID NO: 152557 - DNA, 25 bp, Homo sapien
gctctggtctaaagtgcctgggctt

SEQ ID NO: 152558 - DNA, 25 bp, Homo sapien
tctaaagtgcctgggcttggtggcc

SEQ ID NO: 152559 - DNA, 25 bp, Homo sapien
catcaagagggagccagtcaggcct

SEQ ID NO: 152560 - DNA, 25 bp, Homo sapien
tcaggcctgtgagggccgtagacct

SEQ ID NO: 152561 - DNA, 25 bp, Homo sapien
gggccgtagaccttgtatataccct

SEQ ID NO: 152562 - DNA, 25 bp, Homo sapien
cttgtatataccctgcaccagcagt

SEQ ID NO: 152563 - DNA, 25 bp, Homo sapien
gcaccagcagtgaccgggcagagcc

SEQ ID NO: 152564 - DNA, 25 bp, Homo sapien
cagcacccacttttctaatcatgaa

SEQ ID NO: 152565 - DNA, 25 bp, Homo sapien
caaagcacggagcatcagcctgaag

SEQ ID NO: 152566 - DNA, 25 bp, Homo sapien
aaagcacggagcatcagcctgaagc

SEQ ID NO: 152567 - DNA, 25 bp, Homo sapien
gcctggacctgggttatttattgac

SEQ ID NO: 152568 - DNA, 25 bp, Homo sapien
ctggacctgggttatttattgacac

SEQ ID NO: 152569 - DNA, 25 bp, Homo sapien
ggacctgggttatttattgacacac

SEQ ID NO: 152570 - DNA, 25 bp, Homo sapien
gacctgggttatttattgacacacc

SEQ ID NO: 152571 - DNA, 25 bp, Homo sapien
ggttatttattgacacacccaaggg

SEQ ID NO: 152572 - DNA, 25 bp, Homo sapien
gggacccagacttttggccccagcg

SEQ ID NO: 152573 - DNA, 25 bp, Homo sapien
ggcgcagaggcttttccagtgtgta

SEQ ID NO: 152574 - DNA, 25 bp, Homo sapien
cgcagaggcttttccagtgtgtata

SEQ ID NO: 152575 - DNA, 25 bp, Homo sapien
gcagaggcttttccagtgtgtataa

SEQ ID NO: 152576 - DNA, 25 bp, Homo sapien
tgtccccagcgaagaatccggctgc

SEQ ID NO: 152577 - DNA, 25 bp, Homo sapien
tgcacaggactgatgggtgtaactg

SEQ ID NO: 152578 - DNA, 25 bp, Homo sapien
aggactgatgggtgtaactgacccc

SEQ ID NO: 152579 - DNA, 25 bp, Homo sapien
tgggtgtaactgacccccacaggga

SEQ ID NO: 152580 - DNA, 25 bp, Homo sapien
agccagaagccaccttgacactttt

SEQ ID NO: 152581 - DNA, 25 bp, Homo sapien
attgcttctcaagtctaaccagcct

SEQ ID NO: 152582 - DNA, 25 bp, Homo sapien
tctcaagtctaaccagcctcagcag

SEQ ID NO: 152583 - DNA, 25 bp, Homo sapien
cagcctcagcagtgtgcatagacca

SEQ ID NO: 152584 - DNA, 25 bp, Homo sapien
gcctcagcagtgtgcatagaccatt

SEQ ID NO: 152585 - DNA, 25 bp, Homo sapien
cagcagtgtgcatagaccatttcca

SEQ ID NO: 152586 - DNA, 25 bp, Homo sapien
gagggtctgtccccagatgctctgc

SEQ ID NO: 152587 - DNA, 25 bp, Homo sapien
tggactgttcaagcaaaaaaggtaa

SEQ ID NO: 152588 - DNA, 25 bp, Homo sapien
cttcatctccttttgcgcttatttg

SEQ ID NO: 152589 - DNA, 25 bp, Homo sapien
ctccttttgcgcttatttggaaatt

SEQ ID NO: 152590 - DNA, 25 bp, Homo sapien
atagtgtttaactggcatggattaa

SEQ ID NO: 152591 - DNA, 25 bp, Homo sapien
gcatggattaatagagttggagttt

SEQ ID NO: 152592 - DNA, 25 bp, Homo sapien
gaaaaattcacaagctaacttccac

SEQ ID NO: 152593 - DNA, 25 bp, Homo sapien
acaagctaacttccactaatccatt

SEQ ID NO: 152594 - DNA, 25 bp, Homo sapien
ctaacttccactaatccattatcct

SEQ ID NO: 152595 - DNA, 25 bp, Homo sapien
gaaaaggttcttcttgggagtatgt

SEQ ID NO: 152596 - DNA, 25 bp, Homo sapien
tcttcttgggagtatgttgtcataa

SEQ ID NO: 152597 - DNA, 25 bp, Homo sapien
gttgatctgcatatttctgtatatt

SEQ ID NO: 152598 - DNA, 25 bp, Homo sapien
cccctagagtcttcagaaacagagg

SEQ ID NO: 152599 - DNA, 25 bp, Homo sapien
agaaacagaggaggcctcacagctg

SEQ ID NO: 152600 - DNA, 25 bp, Homo sapien
agaagaagttaacaagtgacctggg

SEQ ID NO: 152601 - DNA, 25 bp, Homo sapien
cgccacgagactgcaggagcttctg

SEQ ID NO: 152602 - DNA, 25 bp, Homo sapien
agaaggacacggtgaagaagctgca

SEQ ID NO: 152603 - DNA, 25 bp, Homo sapien
gaaaaggcagaggacggcagcagct

SEQ ID NO: 152604 - DNA, 25 bp, Homo sapien
ggcagcagctcaaaggagggcacct

SEQ ID NO: 152605 - DNA, 25 bp, Homo sapien
aggagggcacctctgtctgagtttc

SEQ ID NO: 152606 - DNA, 25 bp, Homo sapien
cacctctgtctgagtttcctctttg

SEQ ID NO: 152607 - DNA, 25 bp, Homo sapien
tcaacttaccaaaatgccttacaca

SEQ ID NO: 152608 - DNA, 25 bp, Homo sapien
tgccttacacattccttacaaataa

SEQ ID NO: 152609 - DNA, 25 bp, Homo sapien
ggatgcttcgccagccaggtcctca

SEQ ID NO: 152610 - DNA, 25 bp, Homo sapien
ctcacctgtgtgtacaccagcagga

SEQ ID NO: 152611 - DNA, 25 bp, Homo sapien
tacaccagcaggacactgatccagt

SEQ ID NO: 152612 - DNA, 25 bp, Homo sapien
tgatccagtcacagccatacagctg

SEQ ID NO: 152613 - DNA, 25 bp, Homo sapien
tgtcctacaacagcctgaatcaaat

SEQ ID NO: 152614 - DNA, 25 bp, Homo sapien
agataaaaatcccagactacttcag

SEQ ID NO: 152615 - DNA, 25 bp, Homo sapien
gactacttcagcctttaatgccttt

SEQ ID NO: 152616 - DNA, 25 bp, Homo sapien
gtgaaagctagactgaaccattgga

SEQ ID NO: 152617 - DNA, 25 bp, Homo sapien
gaaacatttaactcagactctggat

SEQ ID NO: 152618 - DNA, 25 bp, Homo sapien
ttcagagtcgggaacccttagttct

SEQ ID NO: 152619 - DNA, 25 bp, Homo sapien
gggaacccttagttctatctgaatc

SEQ ID NO: 152620 - DNA, 25 bp, Homo sapien
agaacaaactcttgcacatctccag

SEQ ID NO: 152621 - DNA, 25 bp, Homo sapien
ttcctgtccaggcagtaatcattga

SEQ ID NO: 152622 - DNA, 25 bp, Homo sapien
ggcagtaatcattgaccatatagtc

SEQ ID NO: 152623 - DNA, 25 bp, Homo sapien
tcatagtaagacacacgagaccagg

SEQ ID NO: 152624 - DNA, 25 bp, Homo sapien
cacgagaccaggctttaccatgaaa

SEQ ID NO: 152625 - DNA, 25 bp, Homo sapien
tttaccatgaaagcgacctgtcacg

SEQ ID NO: 152626 - DNA, 25 bp, Homo sapien
atgaaagcgacctgtcacggactcc

SEQ ID NO: 152627 - DNA, 25 bp, Homo sapien
gtcacggactccacttttaatttgc

SEQ ID NO: 152628 - DNA, 25 bp, Homo sapien
ggactccacttttaatttgctctta

SEQ ID NO: 152629 - DNA, 25 bp, Homo sapien
tttgctcttaggttctatctctgta

SEQ ID NO: 152630 - DNA, 25 bp, Homo sapien
ctatctctgtagaatgtctccaaga

SEQ ID NO: 152631 - DNA, 25 bp, Homo sapien
agctgcagcctggacagtagagcga

SEQ ID NO: 152632 - DNA, 25 bp, Homo sapien
cctggacagtagagcgagaccccat

SEQ ID NO: 152633 - DNA, 25 bp, Homo sapien
ctggacagtagagcgagaccccatc

SEQ ID NO: 152634 - DNA, 25 bp, Homo sapien
tggacagtagagcgagaccccatct

SEQ ID NO: 152635 - DNA, 25 bp, Homo sapien
acagtagagcgagaccccatcttaa

SEQ ID NO: 152636 - DNA, 25 bp, Homo sapien
tcttaaaaataaagaaggctgggcg

SEQ ID NO: 152637 - DNA, 25 bp, Homo sapien
ttaaaaataaagaaggctgggcgtg

SEQ ID NO: 152638 - DNA, 25 bp, Homo sapien
cctggcgtaatggcaggcgcctata

SEQ ID NO: 152639 - DNA, 25 bp, Homo sapien
ctggcgtaatggcaggcgcctataa

SEQ ID NO: 152640 - DNA, 25 bp, Homo sapien
tggcgtaatggcaggcgcctataat

SEQ ID NO: 152641 - DNA, 25 bp, Homo sapien
ggcgtaatggcaggcgcctataatc

SEQ ID NO: 152642 - DNA, 25 bp, Homo sapien
caggaaaatggttttagtagccact

SEQ ID NO: 152643 - DNA, 25 bp, Homo sapien
ggttttagtagccactttgtctcag

SEQ ID NO: 152644 - DNA, 25 bp, Homo sapien
ttttagtagccactttgtctcagcc

SEQ ID NO: 152645 - DNA, 25 bp, Homo sapien
ttagtagccactttgtctcagccaa

SEQ ID NO: 152646 - DNA, 25 bp, Homo sapien
agtagccactttgtctcagccaaga

SEQ ID NO: 152647 - DNA, 25 bp, Homo sapien
agccactttgtctcagccaagacag

SEQ ID NO: 152648 - DNA, 25 bp, Homo sapien
cactttgtctcagccaagacaggag

SEQ ID NO: 152649 - DNA, 25 bp, Homo sapien
caggagactctgtcttcctgtgctt

SEQ ID NO: 152650 - DNA, 25 bp, Homo sapien
gtacagtagtgcagagggtggtgaa

SEQ ID NO: 152651 - DNA, 25 bp, Homo sapien
gtaaactacaaccaggaacctatgt

SEQ ID NO: 152652 - DNA, 25 bp, Homo sapien
tgtcaaggactgttaaccctcctag

SEQ ID NO: 152653 - DNA, 25 bp, Homo sapien
gttgtcttcatcaagaacagactat

SEQ ID NO: 152654 - DNA, 25 bp, Homo sapien
aacagactatatactaattcccact

SEQ ID NO: 152655 - DNA, 25 bp, Homo sapien
taattcccactagaagctgtccatg

SEQ ID NO: 152656 - DNA, 25 bp, Homo sapien
gaagctgtccatgccatacagaaga

SEQ ID NO: 152657 - DNA, 25 bp, Homo sapien
gaaaatgtactctagaccacaggac

SEQ ID NO: 152658 - DNA, 25 bp, Homo sapien
gtactctagaccacaggactaatgt

SEQ ID NO: 152659 - DNA, 25 bp, Homo sapien
agtgtaaacttgtgtctgaatgttt

SEQ ID NO: 152660 - DNA, 25 bp, Homo sapien
aatgttttatttgttctttagctga

SEQ ID NO: 152661 - DNA, 25 bp, Homo sapien
tagctgaagttttgcaatttttatg

SEQ ID NO: 152662 - DNA, 25 bp, Homo sapien
acaagttgagatccagttataaatt

SEQ ID NO: 152663 - DNA, 25 bp, Homo sapien
ttaaccttgtttttagtagatgaca

SEQ ID NO: 152664 - DNA, 25 bp, Homo sapien
ggcttctcatgggaaatgtgccccc

SEQ ID NO: 152665 - DNA, 25 bp, Homo sapien
aggaccctctcccttgtggacaggc

SEQ ID NO: 152666 - DNA, 25 bp, Homo sapien
ctctcccttgtggacaggcagggag

SEQ ID NO: 152667 - DNA, 25 bp, Homo sapien
tactcctgcccagtgactgtgacca

SEQ ID NO: 152668 - DNA, 25 bp, Homo sapien
tgactgtgaccactgtccgtgttgc

SEQ ID NO: 152669 - DNA, 25 bp, Homo sapien
ccgtgttgccttcttgaacagcgat

SEQ ID NO: 152670 - DNA, 25 bp, Homo sapien
gttgccttcttgaacagcgattccc

SEQ ID NO: 152671 - DNA, 25 bp, Homo sapien
aaaggtcttggtacaaccagctgcc

SEQ ID NO: 152672 - DNA, 25 bp, Homo sapien
ttggtacaaccagctgcccattttg

SEQ ID NO: 152673 - DNA, 25 bp, Homo sapien
caaccagctgcccattttgtgaaat

SEQ ID NO: 152674 - DNA, 25 bp, Homo sapien
accagctgcccattttgtgaaattt

SEQ ID NO: 152675 - DNA, 25 bp, Homo sapien
taagctccgcttctgtcagtatttg

SEQ ID NO: 152676 - DNA, 25 bp, Homo sapien
cgcttctgtcagtatttgcaaccaa

SEQ ID NO: 152677 - DNA, 25 bp, Homo sapien
gtcagtatttgcaaccaaggtggtc

SEQ ID NO: 152678 - DNA, 25 bp, Homo sapien
caaccaaggtggtcgggcaaagtat

SEQ ID NO: 152679 - DNA, 25 bp, Homo sapien
gcaaagtattgccaggagatactga

SEQ ID NO: 152680 - DNA, 25 bp, Homo sapien
gatattgtgtaagcatctggagaaa

SEQ ID NO: 152681 - DNA, 25 bp, Homo sapien
aagcagctgaggaattactatcact

SEQ ID NO: 152682 - DNA, 25 bp, Homo sapien
ggaattactatcactcatggagaag

SEQ ID NO: 152683 - DNA, 25 bp, Homo sapien
tcaataagtgagtatgcaatatcca

SEQ ID NO: 152684 - DNA, 25 bp, Homo sapien
gcaatatccatatatactttcacag

SEQ ID NO: 152685 - DNA, 25 bp, Homo sapien
aagaggctgagtgtgactttataaa

SEQ ID NO: 152686 - DNA, 25 bp, Homo sapien
aggagtgggacccaccatttgtggg

SEQ ID NO: 152687 - DNA, 25 bp, Homo sapien
agtagcattcctccacctcaggcct

SEQ ID NO: 152688 - DNA, 25 bp, Homo sapien
aggccttgggtagatttggcaaaag

SEQ ID NO: 152689 - DNA, 25 bp, Homo sapien
gagcagcataggctgtttgagcttt

SEQ ID NO: 152690 - DNA, 25 bp, Homo sapien
cagcataggctgtttgagctttggg

SEQ ID NO: 152691 - DNA, 25 bp, Homo sapien
tggggaaatgaactttgctttttat

SEQ ID NO: 152692 - DNA, 25 bp, Homo sapien
gctttttatatttaactaggatact

SEQ ID NO: 152693 - DNA, 25 bp, Homo sapien
agcaggctctcttgtttccgaggtg

SEQ ID NO: 152694 - DNA, 25 bp, Homo sapien
aggctctcttgtttccgaggtgctg

SEQ ID NO: 152695 - DNA, 25 bp, Homo sapien
gctctcttgtttccgaggtgctgct

SEQ ID NO: 152696 - DNA, 25 bp, Homo sapien
gtactgctttatggtcatttgaagg

SEQ ID NO: 152697 - DNA, 25 bp, Homo sapien
ttatacagtgtttcgttctaaatct

SEQ ID NO: 152698 - DNA, 25 bp, Homo sapien
gtttcgttctaaatctatgaggttt

SEQ ID NO: 152699 - DNA, 25 bp, Homo sapien
gggttcaaaatgatggaaggccgaa

SEQ ID NO: 152700 - DNA, 25 bp, Homo sapien
gaaggccgaagagcaaggcttatat

SEQ ID NO: 152701 - DNA, 25 bp, Homo sapien
tatggtggtagggagcttatagctt

SEQ ID NO: 152702 - DNA, 25 bp, Homo sapien
gggagcttatagcttgtgctaatac

SEQ ID NO: 152703 - DNA, 25 bp, Homo sapien
taatactgtagcatcaagcccaagc

SEQ ID NO: 152704 - DNA, 25 bp, Homo sapien
ctgtagcatcaagcccaagcaaatt

SEQ ID NO: 152705 - DNA, 25 bp, Homo sapien
agcaaattagtcagagcccgccttt

SEQ ID NO: 152706 - DNA, 25 bp, Homo sapien
tcagagcccgcctttagagttaaat

SEQ ID NO: 152707 - DNA, 25 bp, Homo sapien
ggtttaaatagggttcagagatcat

SEQ ID NO: 152708 - DNA, 25 bp, Homo sapien
tcacaccttgatttcactcccaccc

SEQ ID NO: 152709 - DNA, 25 bp, Homo sapien
cctctggcttcaaagcctaaccaag

SEQ ID NO: 152710 - DNA, 25 bp, Homo sapien
tctggcttcaaagcctaaccaaggc

SEQ ID NO: 152711 - DNA, 25 bp, Homo sapien
tggcttcaaagcctaaccaaggctg

SEQ ID NO: 152712 - DNA, 25 bp, Homo sapien
ggcttcaaagcctaaccaaggctgc

SEQ ID NO: 152713 - DNA, 25 bp, Homo sapien
gcttcaaagcctaaccaaggctgct

SEQ ID NO: 152714 - DNA, 25 bp, Homo sapien
ttcaaagcctaaccaaggctgctgg

SEQ ID NO: 152715 - DNA, 25 bp, Homo sapien
tcaaagcctaaccaaggctgctggg

SEQ ID NO: 152716 - DNA, 25 bp, Homo sapien
caaagcctaaccaaggctgctggga

SEQ ID NO: 152717 - DNA, 25 bp, Homo sapien
caggcctccccatgggctctggagg

SEQ ID NO: 152718 - DNA, 25 bp, Homo sapien
aaaagccatccatgctcaggaaaca

SEQ ID NO: 152719 - DNA, 25 bp, Homo sapien
tactcctgggacaacgcccaggtca

SEQ ID NO: 152720 - DNA, 25 bp, Homo sapien
acctggaggacgaacgtgttgtgcc

SEQ ID NO: 152721 - DNA, 25 bp, Homo sapien
gaggacgaacgtgttgtgcctgctg

SEQ ID NO: 152722 - DNA, 25 bp, Homo sapien
atggccggaggctcgccgacgacct

SEQ ID NO: 152723 - DNA, 25 bp, Homo sapien
ggaggctcgccgacgaccttggttt

SEQ ID NO: 152724 - DNA, 25 bp, Homo sapien
tcgccgacgaccttggtttcgagtt

SEQ ID NO: 152725 - DNA, 25 bp, Homo sapien
gaccttggtttcgagttctttgaag

SEQ ID NO: 152726 - DNA, 25 bp, Homo sapien
tggtttcgagttctttgaagccagt

SEQ ID NO: 152727 - DNA, 25 bp, Homo sapien
gaacatcaatgtgaagcaggtcttc

SEQ ID NO: 152728 - DNA, 25 bp, Homo sapien
gaagatgaacgagtccctggaaccc

SEQ ID NO: 152729 - DNA, 25 bp, Homo sapien
gctcaggcagcaacgggaaaggccc

SEQ ID NO: 152730 - DNA, 25 bp, Homo sapien
aatatcatctttacgggatctaccg

SEQ ID NO: 152731 - DNA, 25 bp, Homo sapien
ctgcctgagaccctgaacagccctt

SEQ ID NO: 152732 - DNA, 25 bp, Homo sapien
agcccttgccagagacgatcgaaga

SEQ ID NO: 152733 - DNA, 25 bp, Homo sapien
ccttgccagagacgatcgaagacct

SEQ ID NO: 152734 - DNA, 25 bp, Homo sapien
gagacgatcgaagacctggaaaact

SEQ ID NO: 152735 - DNA, 25 bp, Homo sapien
gacctggaaaactggtcagtcactg

SEQ ID NO: 152736 - DNA, 25 bp, Homo sapien
gaaaactggtcagtcactgcctctg

SEQ ID NO: 152737 - DNA, 25 bp, Homo sapien
tgggcccagggcttttccttagctc

SEQ ID NO: 152738 - DNA, 25 bp, Homo sapien
agggcttttccttagctctctgtcc

SEQ ID NO: 152739 - DNA, 25 bp, Homo sapien
tctgtccctaggtctgcgggcaaag

SEQ ID NO: 152740 - DNA, 25 bp, Homo sapien
gtctgcgggcaaagaagccaaagca

SEQ ID NO: 152741 - DNA, 25 bp, Homo sapien
caatgttgtgggtgactcttttggg

SEQ ID NO: 152742 - DNA, 25 bp, Homo sapien
gggctgggatagtctatcacctctc

SEQ ID NO: 152743 - DNA, 25 bp, Homo sapien
tatcacctctccaagtctgagctgg

SEQ ID NO: 152744 - DNA, 25 bp, Homo sapien
tgactcccagcatcgagtgcatgaa

SEQ ID NO: 152745 - DNA, 25 bp, Homo sapien
gaccaagactcaatccatttatgat

SEQ ID NO: 152746 - DNA, 25 bp, Homo sapien
gaaccacagggaaagcaactctaat

SEQ ID NO: 152747 - DNA, 25 bp, Homo sapien
ctctaatcaatgtgtctatgctgca

SEQ ID NO: 152748 - DNA, 25 bp, Homo sapien
atgctgcacacaactctgtcatagt

SEQ ID NO: 152749 - DNA, 25 bp, Homo sapien
atgcaaggtaactctggcagccaat

SEQ ID NO: 152750 - DNA, 25 bp, Homo sapien
aagtcagccgactgcagtgttgagg

SEQ ID NO: 152751 - DNA, 25 bp, Homo sapien
gaagaaccttggaaacgtgagaaat

SEQ ID NO: 152752 - DNA, 25 bp, Homo sapien
acttggctcctctcacttcccaggg

SEQ ID NO: 152753 - DNA, 25 bp, Homo sapien
ctgcctgtgggtttccatggcttcc

SEQ ID NO: 152754 - DNA, 25 bp, Homo sapien
tgtgggtttccatggcttcccagag

SEQ ID NO: 152755 - DNA, 25 bp, Homo sapien
agcagaggggactccccatcccggg

SEQ ID NO: 152756 - DNA, 25 bp, Homo sapien
ttccagccctttcagctgcaggtgg

SEQ ID NO: 152757 - DNA, 25 bp, Homo sapien
agccctttcagctgcaggtgggagc

SEQ ID NO: 152758 - DNA, 25 bp, Homo sapien
gccctttcagctgcaggtgggagct

SEQ ID NO: 152759 - DNA, 25 bp, Homo sapien
gagctggcccgtcaagtgctgcccc

SEQ ID NO: 152760 - DNA, 25 bp, Homo sapien
cttttcttggagtggtgatttttct

SEQ ID NO: 152761 - DNA, 25 bp, Homo sapien
tcttggagtggtgatttttctctaa

SEQ ID NO: 152762 - DNA, 25 bp, Homo sapien
tggagtggtgatttttctctaaata

SEQ ID NO: 152763 - DNA, 25 bp, Homo sapien
cgccacctgtgaccagcagctgatg

SEQ ID NO: 152764 - DNA, 25 bp, Homo sapien
acctgtgaccagcagctgatgcctc

SEQ ID NO: 152765 - DNA, 25 bp, Homo sapien
agctgatgcctccttggccaccaga

SEQ ID NO: 152766 - DNA, 25 bp, Homo sapien
ttggccaccagaccatgggccaaga

SEQ ID NO: 152767 - DNA, 25 bp, Homo sapien
agaccatgggccaagagccgccgtg

SEQ ID NO: 152768 - DNA, 25 bp, Homo sapien
aagagccgccgtggctatacctggg

SEQ ID NO: 152769 - DNA, 25 bp, Homo sapien
atacctggggacttgatgttccttc

SEQ ID NO: 152770 - DNA, 25 bp, Homo sapien
tgctgcgcgtgtgggtctctgggca

SEQ ID NO: 152771 - DNA, 25 bp, Homo sapien
tctctgggcacagtgggcctgtgtg

SEQ ID NO: 152772 - DNA, 25 bp, Homo sapien
ttttctcctagacccgtgacctgag

SEQ ID NO: 152773 - DNA, 25 bp, Homo sapien
ctcctagacccgtgacctgagatgt

SEQ ID NO: 152774 - DNA, 25 bp, Homo sapien
aagccagccccagggacattcggga

SEQ ID NO: 152775 - DNA, 25 bp, Homo sapien
agccccagggacattcgggaacagt

SEQ ID NO: 152776 - DNA, 25 bp, Homo sapien
acattcgggaacagtctgagacaac

SEQ ID NO: 152777 - DNA, 25 bp, Homo sapien
gaggagtagcttgaagtggccagaa

SEQ ID NO: 152778 - DNA, 25 bp, Homo sapien
accctgagcctgctgagaaatcctt

SEQ ID NO: 152779 - DNA, 25 bp, Homo sapien
gagaaatccttttagcgccagcaag

SEQ ID NO: 152780 - DNA, 25 bp, Homo sapien
gaaatccttttagcgccagcaagcc

SEQ ID NO: 152781 - DNA, 25 bp, Homo sapien
tgtctgccaccacctttgtctgata

SEQ ID NO: 152782 - DNA, 25 bp, Homo sapien
caccacctttgtctgatacttgttt

SEQ ID NO: 152783 - DNA, 25 bp, Homo sapien
gtctgatacttgtttccagggaagc

SEQ ID NO: 152784 - DNA, 25 bp, Homo sapien
gggaactgccacatctgaggaactg

SEQ ID NO: 152785 - DNA, 25 bp, Homo sapien
gccagaacgtggagtcgattttcat

SEQ ID NO: 152786 - DNA, 25 bp, Homo sapien
gattttcatgtgcttggcttgccga

SEQ ID NO: 152787 - DNA, 25 bp, Homo sapien
tggcttgccgattgaaggcccagaa

SEQ ID NO: 152788 - DNA, 25 bp, Homo sapien
aaatccctgctgtatcgtgatgctg

SEQ ID NO: 152789 - DNA, 25 bp, Homo sapien
gaaactggagttcccacaggaagct

SEQ ID NO: 152790 - DNA, 25 bp, Homo sapien
tcctgtccttgttgaaaccaaacga

SEQ ID NO: 152791 - DNA, 25 bp, Homo sapien
tgtgcctgcataatgctgacacctg

SEQ ID NO: 152792 - DNA, 25 bp, Homo sapien
tgacacctgcttgtttccatacaaa

SEQ ID NO: 152793 - DNA, 25 bp, Homo sapien
acatgctcttgtttgagacatcggc

SEQ ID NO: 152794 - DNA, 25 bp, Homo sapien
tgagacatcggccaaggaccccaaa

SEQ ID NO: 152795 - DNA, 25 bp, Homo sapien
ggaccccaaagagagccagaacgtg

SEQ ID NO: 152796 - DNA, 25 bp, Homo sapien
gtataaccctgttacaaagctgtgt

SEQ ID NO: 152797 - DNA, 25 bp, Homo sapien
aaagctgtgttgttgcttcttgtga

SEQ ID NO: 152798 - DNA, 25 bp, Homo sapien
gttgttgcttcttgtgaaggccatg

SEQ ID NO: 152799 - DNA, 25 bp, Homo sapien
tttccccaattaattgctattgtgt

SEQ ID NO: 152800 - DNA, 25 bp, Homo sapien
gtgttattttactaacttctctctg

SEQ ID NO: 152801 - DNA, 25 bp, Homo sapien
attttttcttgcattgacattatag

SEQ ID NO: 152802 - DNA, 25 bp, Homo sapien
gacattatagacattgaggacctca

SEQ ID NO: 152803 - DNA, 25 bp, Homo sapien
aaataatgcctctgtctagcatgcc

SEQ ID NO: 152804 - DNA, 25 bp, Homo sapien
ataatgcctctgtctagcatgccaa

SEQ ID NO: 152805 - DNA, 25 bp, Homo sapien
gcctctgtctagcatgccaacaaga

SEQ ID NO: 152806 - DNA, 25 bp, Homo sapien
tctgtctagcatgccaacaagaatg

SEQ ID NO: 152807 - DNA, 25 bp, Homo sapien
gtggacagggcttcttggaagaccc

SEQ ID NO: 152808 - DNA, 25 bp, Homo sapien
gtatcctgggtgaagcctgtttgcc

SEQ ID NO: 152809 - DNA, 25 bp, Homo sapien
aagcctgtttgcctctcttgaaaat

SEQ ID NO: 152810 - DNA, 25 bp, Homo sapien
ctctcttgaaaatggcaggtgctct

SEQ ID NO: 152811 - DNA, 25 bp, Homo sapien
aggtgctcttgttttacccatgttg

SEQ ID NO: 152812 - DNA, 25 bp, Homo sapien
acccatgttgggtcagcctgaaact

SEQ ID NO: 152813 - DNA, 25 bp, Homo sapien
gtcagcctgaaactgccaaccagta

SEQ ID NO: 152814 - DNA, 25 bp, Homo sapien
cagtaggaagcatggactctcctga

SEQ ID NO: 152815 - DNA, 25 bp, Homo sapien
agaaccctgagaggtgtccatcttc

SEQ ID NO: 152816 - DNA, 25 bp, Homo sapien
gtgtccatcttcttgctgttgagga

SEQ ID NO: 152817 - DNA, 25 bp, Homo sapien
tgaggaccctgaaacaccgttgttt

SEQ ID NO: 152818 - DNA, 25 bp, Homo sapien
cgattaatgttctaggagcagccgt

SEQ ID NO: 152819 - DNA, 25 bp, Homo sapien
aggagcagccgttgtgaaccagcca

SEQ ID NO: 152820 - DNA, 25 bp, Homo sapien
gccactctccatacaggtgatattt

SEQ ID NO: 152821 - DNA, 25 bp, Homo sapien
caggtgatattttcaaaccccctct

SEQ ID NO: 152822 - DNA, 25 bp, Homo sapien
cccctctcggagcaggttgaggact

SEQ ID NO: 152823 - DNA, 25 bp, Homo sapien
gaaagtcttccttggagtcctcaaa

SEQ ID NO: 152824 - DNA, 25 bp, Homo sapien
aagcaagcatcattctggagaccgt

SEQ ID NO: 152825 - DNA, 25 bp, Homo sapien
ggagaccgtccccttcaagagtgga

SEQ ID NO: 152826 - DNA, 25 bp, Homo sapien
cttcaagagtggacaaaggcagatc

SEQ ID NO: 152827 - DNA, 25 bp, Homo sapien
aaggcagatccaagctaatatgaga

SEQ ID NO: 152828 - DNA, 25 bp, Homo sapien
caggaatgtttatgtagactttgca

SEQ ID NO: 152829 - DNA, 25 bp, Homo sapien
cccatccctaggcaaagagccatga

SEQ ID NO: 152830 - DNA, 25 bp, Homo sapien
cctaggcaaagagccatgagtcctg

SEQ ID NO: 152831 - DNA, 25 bp, Homo sapien
gcccaactgtgttgctccacccgga

SEQ ID NO: 152832 - DNA, 25 bp, Homo sapien
atctctcccttctagacctgagctt

SEQ ID NO: 152833 - DNA, 25 bp, Homo sapien
ctagcactaagcaacatctcgctgt

SEQ ID NO: 152834 - DNA, 25 bp, Homo sapien
gcaacatctcgctgtaagcgcctgt

SEQ ID NO: 152835 - DNA, 25 bp, Homo sapien
catctcgctgtaagcgcctgtaaat

SEQ ID NO: 152836 - DNA, 25 bp, Homo sapien
gtaagcgcctgtaaattactgtgaa

SEQ ID NO: 152837 - DNA, 25 bp, Homo sapien
aaatgtgaaacgtgcaatcttgaaa

SEQ ID NO: 152838 - DNA, 25 bp, Homo sapien
cgtgcaatcttgaaactgaggtgtt

SEQ ID NO: 152839 - DNA, 25 bp, Homo sapien
gcaatcttgaaactgaggtgttaga

SEQ ID NO: 152840 - DNA, 25 bp, Homo sapien
aaaggctctccataaaagaccgccg

SEQ ID NO: 152841 - DNA, 25 bp, Homo sapien
atggagtgggccaacactatccagc

SEQ ID NO: 152842 - DNA, 25 bp, Homo sapien
aaatgagccatagcgggaccacaag

SEQ ID NO: 152843 - DNA, 25 bp, Homo sapien
catagcgggaccacaagggcaagga

SEQ ID NO: 152844 - DNA, 25 bp, Homo sapien
aggagaccaccactttctccagtct

SEQ ID NO: 152845 - DNA, 25 bp, Homo sapien
tccagtctcttttcggacagccagt

SEQ ID NO: 152846 - DNA, 25 bp, Homo sapien
tttcggacagccagtaattcccggg

SEQ ID NO: 152847 - DNA, 25 bp, Homo sapien
taattcccgggcaaggccagagact

SEQ ID NO: 152848 - DNA, 25 bp, Homo sapien
gggcaaggccagagacttcaagtct

SEQ ID NO: 152849 - DNA, 25 bp, Homo sapien
gtctatctgaaaagtctccagaggt

SEQ ID NO: 152850 - DNA, 25 bp, Homo sapien
accccaaagggtatgccccatgtga

SEQ ID NO: 152851 - DNA, 25 bp, Homo sapien
tgcggcgactggaagaaccacttca

SEQ ID NO: 152852 - DNA, 25 bp, Homo sapien
gaagaaccacttcacggtggcccag

SEQ ID NO: 152853 - DNA, 25 bp, Homo sapien
ttcacggtggcccagagcgaagcct

SEQ ID NO: 152854 - DNA, 25 bp, Homo sapien
agagcgaagccttcgatcgtgccta

SEQ ID NO: 152855 - DNA, 25 bp, Homo sapien
agccttcgatcgtgcctaccgcaag

SEQ ID NO: 152856 - DNA, 25 bp, Homo sapien
gatgccgaccttcccctgggatgaa

SEQ ID NO: 152857 - DNA, 25 bp, Homo sapien
ttcccctgggatgaagacccggagg

SEQ ID NO: 152858 - DNA, 25 bp, Homo sapien
aggaggatggcagcccagatcctga

SEQ ID NO: 152859 - DNA, 25 bp, Homo sapien
atggcagcccagatcctgagcccag

SEQ ID NO: 152860 - DNA, 25 bp, Homo sapien
acaccagcctggagcgtgagcccag

SEQ ID NO: 152861 - DNA, 25 bp, Homo sapien
gaccctcataataaacacgtcgatt

SEQ ID NO: 152862 - DNA, 25 bp, Homo sapien
gggcctgaacataatttcaagagga

SEQ ID NO: 152863 - DNA, 25 bp, Homo sapien
ggcctgaacataatttcaagaggag

SEQ ID NO: 152864 - DNA, 25 bp, Homo sapien
gcctgaacataatttcaagaggagg

SEQ ID NO: 152865 - DNA, 25 bp, Homo sapien
cctgaacataatttcaagaggagga

SEQ ID NO: 152866 - DNA, 25 bp, Homo sapien
ctgaacataatttcaagaggaggat

SEQ ID NO: 152867 - DNA, 25 bp, Homo sapien
gaacataatttcaagaggaggattt

SEQ ID NO: 152868 - DNA, 25 bp, Homo sapien
aacataatttcaagaggaggattta

SEQ ID NO: 152869 - DNA, 25 bp, Homo sapien
acataatttcaagaggaggatttat

SEQ ID NO: 152870 - DNA, 25 bp, Homo sapien
cataatttcaagaggaggatttata

SEQ ID NO: 152871 - DNA, 25 bp, Homo sapien
taatttcaagaggaggatttataaa

SEQ ID NO: 152872 - DNA, 25 bp, Homo sapien
ttcaagaggaggatttataaaacca

SEQ ID NO: 152873 - DNA, 25 bp, Homo sapien
ttggactggcagttattgagatact

SEQ ID NO: 152874 - DNA, 25 bp, Homo sapien
tattgagatactgggtttggtgttt

SEQ ID NO: 152875 - DNA, 25 bp, Homo sapien
gtttggtgttttctatggtcctgta

SEQ ID NO: 152876 - DNA, 25 bp, Homo sapien
atggtcctgtattgccagatcggga

SEQ ID NO: 152877 - DNA, 25 bp, Homo sapien
ttgccagatcgggaacaaatgaatc

SEQ ID NO: 152878 - DNA, 25 bp, Homo sapien
gaatctgtggatgcatcaacctatc

SEQ ID NO: 152879 - DNA, 25 bp, Homo sapien
gatgcatcaacctatcgtcagtcaa

SEQ ID NO: 152880 - DNA, 25 bp, Homo sapien
tcgtcagtcaaacccctttaaaatg

SEQ ID NO: 152881 - DNA, 25 bp, Homo sapien
ctttttaaaatgtctcggctagcta

SEQ ID NO: 152882 - DNA, 25 bp, Homo sapien
tctcggctagctagaccacagatat

SEQ ID NO: 152883 - DNA, 25 bp, Homo sapien
gaccacagatatcttctagacatat

SEQ ID NO: 152884 - DNA, 25 bp, Homo sapien
aaaaacaaccaagcactcttccata

SEQ ID NO: 152885 - DNA, 25 bp, Homo sapien
acaaccaagcactcttccatatata

SEQ ID NO: 152886 - DNA, 25 bp, Homo sapien
cttccatatataaatctggctgtat

SEQ ID NO: 152887 - DNA, 25 bp, Homo sapien
taaatctggctgtattcagtagcaa

SEQ ID NO: 152888 - DNA, 25 bp, Homo sapien
atgtagaaagactctttggttcaca

SEQ ID NO: 152889 - DNA, 25 bp, Homo sapien
tctttggttcacattccgatattaa

SEQ ID NO: 152890 - DNA, 25 bp, Homo sapien
ttaaaagctttcacgtgggataaat

SEQ ID NO: 152891 - DNA, 25 bp, Homo sapien
ttcacgtgggataaatgattttctt

SEQ ID NO: 152892 - DNA, 25 bp, Homo sapien
cttttctttcttcctatggtcttgt

SEQ ID NO: 152893 - DNA, 25 bp, Homo sapien
tcttcctatggtcttgtctgaataa

SEQ ID NO: 152894 - DNA, 25 bp, Homo sapien
ctgaataaactactctcctgaataa

SEQ ID NO: 152895 - DNA, 25 bp, Homo sapien
tagctacactgctagcttctcaagt

SEQ ID NO: 152896 - DNA, 25 bp, Homo sapien
ctgctagcttctcaagttcttgtga

SEQ ID NO: 152897 - DNA, 25 bp, Homo sapien
cagtagatgtggaacacctagccca

SEQ ID NO: 152898 - DNA, 25 bp, Homo sapien
atagacaaaggagtgcagaggacct

SEQ ID NO: 152899 - DNA, 25 bp, Homo sapien
acctggcctggcactggcttattta

SEQ ID NO: 152900 - DNA, 25 bp, Homo sapien
cctggcactggcttatttacctgag

SEQ ID NO: 152901 - DNA, 25 bp, Homo sapien
actggcttatttacctgagctcaag

SEQ ID NO: 152902 - DNA, 25 bp, Homo sapien
tgagctcaaggagatccccgctgga

SEQ ID NO: 152903 - DNA, 25 bp, Homo sapien
aggagatccccgctggagcagcctc

SEQ ID NO: 152904 - DNA, 25 bp, Homo sapien
gcctctgcaaaagggagcccatgta

SEQ ID NO: 152905 - DNA, 25 bp, Homo sapien
aaccaccccaaggataataatagct

SEQ ID NO: 152906 - DNA, 25 bp, Homo sapien
tcagagcaggctcagactctgggtc

SEQ ID NO: 152907 - DNA, 25 bp, Homo sapien
tggacagatagacagtgctgccctg

SEQ ID NO: 152908 - DNA, 25 bp, Homo sapien
tgctgccctgcgaagtggctctcag

SEQ ID NO: 152909 - DNA, 25 bp, Homo sapien
tgggcccacagagatgcatgcgcag

SEQ ID NO: 152910 - DNA, 25 bp, Homo sapien
acagagatgcatgcgcaggctcata

SEQ ID NO: 152911 - DNA, 25 bp, Homo sapien
atgcgcaggctcatatgcgtcccaa

SEQ ID NO: 152912 - DNA, 25 bp, Homo sapien
atatgcgtcccaagcagccgcagcg

SEQ ID NO: 152913 - DNA, 25 bp, Homo sapien
gggagaggactctgccttttttcac

SEQ ID NO: 152914 - DNA, 25 bp, Homo sapien
tgccttttttcacagcccgggtgtg

SEQ ID NO: 152915 - DNA, 25 bp, Homo sapien
ggagggaggctcttcagtgcggtag

SEQ ID NO: 152916 - DNA, 25 bp, Homo sapien
tcagtgcggtagctacttgtttaca

SEQ ID NO: 152917 - DNA, 25 bp, Homo sapien
ttcccttcccagagtgatgtgcatc

SEQ ID NO: 152918 - DNA, 25 bp, Homo sapien
cagagtgatgtgcatcccctacctg

SEQ ID NO: 152919 - DNA, 25 bp, Homo sapien
tcccctacctgctgagggatacaat

SEQ ID NO: 152920 - DNA, 25 bp, Homo sapien
gatacaataaggtagggccaggcta

SEQ ID NO: 152921 - DNA, 25 bp, Homo sapien
taaggtagggccaggctatggccct

SEQ ID NO: 152922 - DNA, 25 bp, Homo sapien
ctacagcagcggctttcgagacagt

SEQ ID NO: 152923 - DNA, 25 bp, Homo sapien
agcagcggctttcgagacagtgtcc

SEQ ID NO: 152924 - DNA, 25 bp, Homo sapien
agcggctttcgagacagtgtcccta

SEQ ID NO: 152925 - DNA, 25 bp, Homo sapien
tttcgagacagtgtccctatccagg

SEQ ID NO: 152926 - DNA, 25 bp, Homo sapien
gacagtgtccctatccagggtatca

SEQ ID NO: 152927 - DNA, 25 bp, Homo sapien
tatccagggtatcacgctggaggaa

SEQ ID NO: 152928 - DNA, 25 bp, Homo sapien
caggaaaatggttttagtagccact

SEQ ID NO: 152929 - DNA, 25 bp, Homo sapien
atggttttagtagccactttgtctc

SEQ ID NO: 152930 - DNA, 25 bp, Homo sapien
ggttttagtagccactttgtctcag

SEQ ID NO: 152931 - DNA, 25 bp, Homo sapien
gttttagtagccactttgtctcagc

SEQ ID NO: 152932 - DNA, 25 bp, Homo sapien
tttagtagccactttgtctcagcca

SEQ ID NO: 152933 - DNA, 25 bp, Homo sapien
ttagtagccactttgtctcagccaa

SEQ ID NO: 152934 - DNA, 25 bp, Homo sapien
agtagccactttgtctcagccaaga

SEQ ID NO: 152935 - DNA, 25 bp, Homo sapien
tagccactttgtctcagccaagaca

SEQ ID NO: 152936 - DNA, 25 bp, Homo sapien
gccactttgtctcagccaagacagg

SEQ ID NO: 152937 - DNA, 25 bp, Homo sapien
cactttgtctcagccaagacaggag

SEQ ID NO: 152938 - DNA, 25 bp, Homo sapien
gtacagtagtgcagagggtggtgaa

SEQ ID NO: 152939 - DNA, 25 bp, Homo sapien
agaacaacactaattgacattgcgt

SEQ ID NO: 152940 - DNA, 25 bp, Homo sapien
attgacattgcgtgggctttttctc

SEQ ID NO: 152941 - DNA, 25 bp, Homo sapien
aaatgtcatttgttgagcaagagtt

SEQ ID NO: 152942 - DNA, 25 bp, Homo sapien
gtattatctacttacttgaaggctg

SEQ ID NO: 152943 - DNA, 25 bp, Homo sapien
gaaggctgttaatttttcattacag

SEQ ID NO: 152944 - DNA, 25 bp, Homo sapien
gttttgtaaatgtatccacgagacc

SEQ ID NO: 152945 - DNA, 25 bp, Homo sapien
gtatccacgagaccatgatgtcatt

SEQ ID NO: 152946 - DNA, 25 bp, Homo sapien
gtcattgttttgtgctcaacttgtg

SEQ ID NO: 152947 - DNA, 25 bp, Homo sapien
gtgctcaacttgtgttttgtattta

SEQ ID NO: 152948 - DNA, 25 bp, Homo sapien
tatgctctttagaatggaacacaga

SEQ ID NO: 152949 - DNA, 25 bp, Homo sapien
caaaccttataagcctgattaaatt

SEQ ID NO: 152950 - DNA, 25 bp, Homo sapien
gaagatgacgattattgaactacaa

SEQ ID NO: 152951 - DNA, 25 bp, Homo sapien
gattattgaactacaagtgctcaca

SEQ ID NO: 152952 - DNA, 25 bp, Homo sapien
tattgaactacaagtgctcacagac

SEQ ID NO: 152953 - DNA, 25 bp, Homo sapien
gaactacaagtgctcacagactaga

SEQ ID NO: 152954 - DNA, 25 bp, Homo sapien
tacaagtgctcacagactagaactt

SEQ ID NO: 152955 - DNA, 25 bp, Homo sapien
gtgctcacagactagaacttaacgg

SEQ ID NO: 152956 - DNA, 25 bp, Homo sapien
gctcacagactagaacttaacggaa

SEQ ID NO: 152957 - DNA, 25 bp, Homo sapien
cacagactagaacttaacggaacaa

SEQ ID NO: 152958 - DNA, 25 bp, Homo sapien
cttaacggaacaagtctaggacaga

SEQ ID NO: 152959 - DNA, 25 bp, Homo sapien
aagtctaggacagaagttaagatct

SEQ ID NO: 152960 - DNA, 25 bp, Homo sapien
gttaagatctgattatttactttgt

SEQ ID NO: 152961 - DNA, 25 bp, Homo sapien
gcgcccagccaatgtcctagagagt

SEQ ID NO: 152962 - DNA, 25 bp, Homo sapien
gcccagccaatgtcctagagagttt

SEQ ID NO: 152963 - DNA, 25 bp, Homo sapien
ccagccaatgtcctagagagttttg

SEQ ID NO: 152964 - DNA, 25 bp, Homo sapien
aatgtcctagagagttttgtgatct

SEQ ID NO: 152965 - DNA, 25 bp, Homo sapien
cacctttactcttagaaatacggat

SEQ ID NO: 152966 - DNA, 25 bp, Homo sapien
ttactcttagaaatacggattcggc

SEQ ID NO: 152967 - DNA, 25 bp, Homo sapien
tagaaatacggattcggcagccttc

SEQ ID NO: 152968 - DNA, 25 bp, Homo sapien
ggattcggcagccttcagtgaatat

SEQ ID NO: 152969 - DNA, 25 bp, Homo sapien
atattggtttctctttggtatgtca

SEQ ID NO: 152970 - DNA, 25 bp, Homo sapien
aaagtttatccgtatgtcagaacgg

SEQ ID NO: 152971 - DNA, 25 bp, Homo sapien
gtttatccgtatgtcagaacggatt

SEQ ID NO: 152972 - DNA, 25 bp, Homo sapien
cagtgccggggatctctgtggaggt

SEQ ID NO: 152973 - DNA, 25 bp, Homo sapien
agtgccggggatctctgtggaggtg

SEQ ID NO: 152974 - DNA, 25 bp, Homo sapien
gctgagctctgtcacaagggtactc

SEQ ID NO: 152975 - DNA, 25 bp, Homo sapien
ctgagctctgtcacaagggtactcc

SEQ ID NO: 152976 - DNA, 25 bp, Homo sapien
tgagctctgtcacaagggtactcca

SEQ ID NO: 152977 - DNA, 25 bp, Homo sapien
agctctgtcacaagggtactccaca

SEQ ID NO: 152978 - DNA, 25 bp, Homo sapien
gctctgtcacaagggtactccacag

SEQ ID NO: 152979 - DNA, 25 bp, Homo sapien
ctctgtcacaagggtactccacagg

SEQ ID NO: 152980 - DNA, 25 bp, Homo sapien
ctgtcacaagggtactccacaggag

SEQ ID NO: 152981 - DNA, 25 bp, Homo sapien
tgtcacaagggtactccacaggagg

SEQ ID NO: 152982 - DNA, 25 bp, Homo sapien
gtcacaagggtactccacaggagga

SEQ ID NO: 152983 - DNA, 25 bp, Homo sapien
gcaccaatgtgaggaaaacctaaag

SEQ ID NO: 152984 - DNA, 25 bp, Homo sapien
aaacactgtgcttcatatttgtaca

SEQ ID NO: 152985 - DNA, 25 bp, Homo sapien
gcttcatatttgtacactgtgttgt

SEQ ID NO: 152986 - DNA, 25 bp, Homo sapien
gttgtactacagtgaggaatttcct

SEQ ID NO: 152987 - DNA, 25 bp, Homo sapien
aatttcctcctgtagtcatatatta

SEQ ID NO: 152988 - DNA, 25 bp, Homo sapien
atcatacctatgacttgtttggaaa

SEQ ID NO: 152989 - DNA, 25 bp, Homo sapien
gttgaattttaaatccagaaagcat

SEQ ID NO: 152990 - DNA, 25 bp, Homo sapien
tataaacttatgcagagcactttta

SEQ ID NO: 152991 - DNA, 25 bp, Homo sapien
atgcagagcacttttattgctcaaa

SEQ ID NO: 152992 - DNA, 25 bp, Homo sapien
tttattgctcaaaagttctgaattc

SEQ ID NO: 152993 - DNA, 25 bp, Homo sapien
catttcattgaaagattgcggcatt

SEQ ID NO: 152994 - DNA, 25 bp, Homo sapien
gaacattgtgatcatcctttgtgga

SEQ ID NO: 152995 - DNA, 25 bp, Homo sapien
gtgatcatcctttgtggaaacaaga

SEQ ID NO: 152996 - DNA, 25 bp, Homo sapien
gacctggatgcagatcgtgaagtta

SEQ ID NO: 152997 - DNA, 25 bp, Homo sapien
gcagatcgtgaagttaccttcttag

SEQ ID NO: 152998 - DNA, 25 bp, Homo sapien
accttcttagaagcctccagatttg

SEQ ID NO: 152999 - DNA, 25 bp, Homo sapien
gtttttggaaacaagtgcgctcaca

SEQ ID NO: 153000 - DNA, 25 bp, Homo sapien
gaagaggcttttgtacagtgtgcaa

SEQ ID NO: 153001 - DNA, 25 bp, Homo sapien
taacaaaatcgaatcaggtgagctg

SEQ ID NO: 153002 - DNA, 25 bp, Homo sapien
aatgggctcaggtattcagtacgga

SEQ ID NO: 153003 - DNA, 25 bp, Homo sapien
tattcagtacggagatgctgccttg

SEQ ID NO: 153004 - DNA, 25 bp, Homo sapien
aggccccgaacgctcaggagtgtgg

SEQ ID NO: 153005 - DNA, 25 bp, Homo sapien
cagggatttttttctcatagagtaa

SEQ ID NO: 153006 - DNA, 25 bp, Homo sapien
atatgaacagtttttatgacctcct

SEQ ID NO: 153007 - DNA, 25 bp, Homo sapien
atgaacagtttttatgacctccttt

SEQ ID NO: 153008 - DNA, 25 bp, Homo sapien
gaacagtttttatgacctccttttg

SEQ ID NO: 153009 - DNA, 25 bp, Homo sapien
ttttatgacctccttttggtctgaa

SEQ ID NO: 153010 - DNA, 25 bp, Homo sapien
tttatgacctccttttggtctgaaa

SEQ ID NO: 153011 - DNA, 25 bp, Homo sapien
gacctccttttggtctgaaatactt

SEQ ID NO: 153012 - DNA, 25 bp, Homo sapien
ataagctaccatgctgggcctgaac

SEQ ID NO: 153013 - DNA, 25 bp, Homo sapien
agctaccatgctgggcctgaacata

SEQ ID NO: 153014 - DNA, 25 bp, Homo sapien
gggcctgaacataatttcaagagga

SEQ ID NO: 153015 - DNA, 25 bp, Homo sapien
attggtgtcattttcccatttgcca

SEQ ID NO: 153016 - DNA, 25 bp, Homo sapien
ggacaggagaatggcacactttcaa

SEQ ID NO: 153017 - DNA, 25 bp, Homo sapien
aatggcacactttcaacgactccag

SEQ ID NO: 153018 - DNA, 25 bp, Homo sapien
acatttgtgaacttccccctaagag

SEQ ID NO: 153019 - DNA, 25 bp, Homo sapien
gacctggacttaagagaatttgcct

SEQ ID NO: 153020 - DNA, 25 bp, Homo sapien
ctcagaaaacaccaaccatgctgtt

SEQ ID NO: 153021 - DNA, 25 bp, Homo sapien
ccaaccatgctgtttacaacctgta

SEQ ID NO: 153022 - DNA, 25 bp, Homo sapien
tttacaacctgtacgctgtgtccaa

SEQ ID NO: 153023 - DNA, 25 bp, Homo sapien
tacgctgtgtccaatcactccggaa

SEQ ID NO: 153024 - DNA, 25 bp, Homo sapien
atcactccggaaccaccatgggtgg

SEQ ID NO: 153025 - DNA, 25 bp, Homo sapien
atgggtggccactatacagcctact

SEQ ID NO: 153026 - DNA, 25 bp, Homo sapien
acagcctactgtcgcagtccaggga

SEQ ID NO: 153027 - DNA, 25 bp, Homo sapien
catgttgccaagctagtctacaaag

SEQ ID NO: 153028 - DNA, 25 bp, Homo sapien
gttgccaagctagtctacaaagcat

SEQ ID NO: 153029 - DNA, 25 bp, Homo sapien
gccaagctagtctacaaagcatctg

SEQ ID NO: 153030 - DNA, 25 bp, Homo sapien
aagctagtctacaaagcatctgatt

SEQ ID NO: 153031 - DNA, 25 bp, Homo sapien
gctagtctacaaagcatctgatttt

SEQ ID NO: 153032 - DNA, 25 bp, Homo sapien
gtctacaaagcatctgattttggaa

SEQ ID NO: 153033 - DNA, 25 bp, Homo sapien
atctgattttggaagtacatggaat

SEQ ID NO: 153034 - DNA, 25 bp, Homo sapien
gaagtacatggaattgttgtaacaa

SEQ ID NO: 153035 - DNA, 25 bp, Homo sapien
gtatattgaatggaaatggctctca

SEQ ID NO: 153036 - DNA, 25 bp, Homo sapien
attgaatggaaatggctctcatgta

SEQ ID NO: 153037 - DNA, 25 bp, Homo sapien
aatggaaatggctctcatgtatttt

SEQ ID NO: 153038 - DNA, 25 bp, Homo sapien
tccgtttttggaaaccagtgctaag

SEQ ID NO: 153039 - DNA, 25 bp, Homo sapien
gaaaccagtgctaagaatgcaacga

SEQ ID NO: 153040 - DNA, 25 bp, Homo sapien
agaacagtctttcatgacgatggca

SEQ ID NO: 153041 - DNA, 25 bp, Homo sapien
ctttcatgacgatggcagctgagat

SEQ ID NO: 153042 - DNA, 25 bp, Homo sapien
tgagattaaaaagcgaatgggtccc

SEQ ID NO: 153043 - DNA, 25 bp, Homo sapien
aaagcgaatgggtcccggagcaaca

SEQ ID NO: 153044 - DNA, 25 bp, Homo sapien
aatgggtcccggagcaacagctggt

SEQ ID NO: 153045 - DNA, 25 bp, Homo sapien
gctgagaagtccaatgttaaaattc

SEQ ID NO: 153046 - DNA, 25 bp, Homo sapien
atgttaaaattcagagcactccagt

SEQ ID NO: 153047 - DNA, 25 bp, Homo sapien
gagcactccagtcaagcagtcaggt

SEQ ID NO: 153048 - DNA, 25 bp, Homo sapien
cagtcaggtggaggttgctgctaaa

SEQ ID NO: 153049 - DNA, 25 bp, Homo sapien
cagggatttttttctcatagagtaa

SEQ ID NO: 153050 - DNA, 25 bp, Homo sapien
agggatttttttctcatagagtaat

SEQ ID NO: 153051 - DNA, 25 bp, Homo sapien
gggatttttttctcatagagtaatt

SEQ ID NO: 153052 - DNA, 25 bp, Homo sapien
ggatttttttctcatagagtaatta

SEQ ID NO: 153053 - DNA, 25 bp, Homo sapien
gatttttttctcatagagtaattat

SEQ ID NO: 153054 - DNA, 25 bp, Homo sapien
tagagtaattatatgaacagttttt

SEQ ID NO: 153055 - DNA, 25 bp, Homo sapien
agagtaattatatgaacagttttta

SEQ ID NO: 153056 - DNA, 25 bp, Homo sapien
gagtaattatatgaacagtttttat

SEQ ID NO: 153057 - DNA, 25 bp, Homo sapien
aattatatgaacagtttttatgacc

SEQ ID NO: 153058 - DNA, 25 bp, Homo sapien
ttttatgacctccttttggtctgaa

SEQ ID NO: 153059 - DNA, 25 bp, Homo sapien
tttatgacctccttttggtctgaaa

SEQ ID NO: 153060 - DNA, 25 bp, Homo sapien
agttttggccggtgctcattagaca

SEQ ID NO: 153061 - DNA, 25 bp, Homo sapien
tagacatgagtcctcactctgtgtc

SEQ ID NO: 153062 - DNA, 25 bp, Homo sapien
tctgtgtcctgagcccgtgtcattc

SEQ ID NO: 153063 - DNA, 25 bp, Homo sapien
acttatcccagacacaacaccatgt

SEQ ID NO: 153064 - DNA, 25 bp, Homo sapien
aacaccatgtggtctggaggtccca

SEQ ID NO: 153065 - DNA, 25 bp, Homo sapien
aaggttatccctgagaactccacca

SEQ ID NO: 153066 - DNA, 25 bp, Homo sapien
gagaactccaccagacttgggagcc

SEQ ID NO: 153067 - DNA, 25 bp, Homo sapien
cttgggagcccaagtgcagtgcctg

SEQ ID NO: 153068 - DNA, 25 bp, Homo sapien
tctctcctgcaattggtttgtactc

SEQ ID NO: 153069 - DNA, 25 bp, Homo sapien
gtttgtactcactgggctgtgctct

SEQ ID NO: 153070 - DNA, 25 bp, Homo sapien
ctcccctgtttacccgatgtatgga

SEQ ID NO: 153071 - DNA, 25 bp, Homo sapien
agagacgtgcctagtcctgtgtgcc

SEQ ID NO: 153072 - DNA, 25 bp, Homo sapien
gccttgagtccagaactcagggcat

SEQ ID NO: 153073 - DNA, 25 bp, Homo sapien
tgcactgagtgaaacttgccctctg

SEQ ID NO: 153074 - DNA, 25 bp, Homo sapien
gccctctggcttgattcagactgga

SEQ ID NO: 153075 - DNA, 25 bp, Homo sapien
ggaacctgacttatttgactgagac

SEQ ID NO: 153076 - DNA, 25 bp, Homo sapien
gggtctctacttcaccaaactggcc

SEQ ID NO: 153077 - DNA, 25 bp, Homo sapien
actggcctctatccataccaaggag

SEQ ID NO: 153078 - DNA, 25 bp, Homo sapien
tggccctgagctgctggatacagct

SEQ ID NO: 153079 - DNA, 25 bp, Homo sapien
ggatacagctggacctgaattcctg

SEQ ID NO: 153080 - DNA, 25 bp, Homo sapien
tgatgcccatgtgatgttgttgccc

SEQ ID NO: 153081 - DNA, 25 bp, Homo sapien
gttgttgccccagatgggcactaaa

SEQ ID NO: 153082 - DNA, 25 bp, Homo sapien
gggacggccactccctggctgaggg

SEQ ID NO: 153083 - DNA, 25 bp, Homo sapien
tgcctgtccggaacgggaggctgaa

SEQ ID NO: 153084 - DNA, 25 bp, Homo sapien
aaatggaaaagctgccttggccctg

SEQ ID NO: 153085 - DNA, 25 bp, Homo sapien
tggaaaagctgccttggccctgctt

SEQ ID NO: 153086 - DNA, 25 bp, Homo sapien
ttggccctgcttggctgagtcacaa

SEQ ID NO: 153087 - DNA, 25 bp, Homo sapien
gccctgcttggctgagtcacaaggg

SEQ ID NO: 153088 - DNA, 25 bp, Homo sapien
cagtgggctcttgggtgctgttcca

SEQ ID NO: 153089 - DNA, 25 bp, Homo sapien
gggcaggcagttcctaccatgtacc

SEQ ID NO: 153090 - DNA, 25 bp, Homo sapien
ctgcctgacaaggtcagcatcattt

SEQ ID NO: 153091 - DNA, 25 bp, Homo sapien
aggtcagcatcatttgctctcctga

SEQ ID NO: 153092 - DNA, 25 bp, Homo sapien
ctcctgaatttatgaggtttattta

SEQ ID NO: 153093 - DNA, 25 bp, Homo sapien
ttacacagtgtatgccttaaaaggc

SEQ ID NO: 153094 - DNA, 25 bp, Homo sapien
ggctgtttcttaaaggtgttacaag

SEQ ID NO: 153095 - DNA, 25 bp, Homo sapien
ggtatttcaactagttatcagcaag

SEQ ID NO: 153096 - DNA, 25 bp, Homo sapien
acaatacattccaccacaaatacac

SEQ ID NO: 153097 - DNA, 25 bp, Homo sapien
atacactcttgttcttctagctttt

SEQ ID NO: 153098 - DNA, 25 bp, Homo sapien
aaaccgggtgcttcaaagtacatga

SEQ ID NO: 153099 - DNA, 25 bp, Homo sapien
ggaacactatacctgtcatggatga

SEQ ID NO: 153100 - DNA, 25 bp, Homo sapien
ggatgaactgaagactttgcctgtt

SEQ ID NO: 153101 - DNA, 25 bp, Homo sapien
tattttcaggtcctttgcttaccaa

SEQ ID NO: 153102 - DNA, 25 bp, Homo sapien
tgcttaccaaaggaggcccaatttc

SEQ ID NO: 153103 - DNA, 25 bp, Homo sapien
ggaggcccaatttcactcaaatgtt

SEQ ID NO: 153104 - DNA, 25 bp, Homo sapien
catgcttttggtttgttaccaaaat

SEQ ID NO: 153105 - DNA, 25 bp, Homo sapien
atatacagtgtggtgaaggttgact

SEQ ID NO: 153106 - DNA, 25 bp, Homo sapien
ctgaagaagtccagtgtgtccagtt

SEQ ID NO: 153107 - DNA, 25 bp, Homo sapien
taaactcttcatcaacaaagacctg

SEQ ID NO: 153108 - DNA, 25 bp, Homo sapien
aagacctgtttttgtgactgccttg

SEQ ID NO: 153109 - DNA, 25 bp, Homo sapien
gtgactgccttgagttttatcagaa

SEQ ID NO: 153110 - DNA, 25 bp, Homo sapien
ttattggcctagtaatccttcagaa

SEQ ID NO: 153111 - DNA, 25 bp, Homo sapien
gtaatccttcagaaacaccgtaatt

SEQ ID NO: 153112 - DNA, 25 bp, Homo sapien
taaataaacctcttcccatacacct

SEQ ID NO: 153113 - DNA, 25 bp, Homo sapien
tttcccccataagatctgtcttcaa

SEQ ID NO: 153114 - DNA, 25 bp, Homo sapien
gatctgtcttcaacactataaagca

SEQ ID NO: 153115 - DNA, 25 bp, Homo sapien
ttcatttccctcagcacttggcatc

SEQ ID NO: 153116 - DNA, 25 bp, Homo sapien
tttccctcagcacttggcatcttgt

SEQ ID NO: 153117 - DNA, 25 bp, Homo sapien
cttggcatcttgtcatctacacaat

SEQ ID NO: 153118 - DNA, 25 bp, Homo sapien
ggcatcttgtcatctacacaatgga

SEQ ID NO: 153119 - DNA, 25 bp, Homo sapien
ttgtcatctacacaatggaccctca

SEQ ID NO: 153120 - DNA, 25 bp, Homo sapien
gtcatctacacaatggaccctcaat

SEQ ID NO: 153121 - DNA, 25 bp, Homo sapien
atctacacaatggaccctcaataaa

SEQ ID NO: 153122 - DNA, 25 bp, Homo sapien
gtgagctgggaagtgtttccaaata

SEQ ID NO: 153123 - DNA, 25 bp, Homo sapien
ctgggaagtgtttccaaatacagtt

SEQ ID NO: 153124 - DNA, 25 bp, Homo sapien
gtgcctaaaatagtgtcctttgaaa

SEQ ID NO: 153125 - DNA, 25 bp, Homo sapien
ggcatagtgggttatccctgtaatt

SEQ ID NO: 153126 - DNA, 25 bp, Homo sapien
aaggacattctatttattttcgcag

SEQ ID NO: 153127 - DNA, 25 bp, Homo sapien
attttcgcagtaattctcatgtccc

SEQ ID NO: 153128 - DNA, 25 bp, Homo sapien
gtaattctcatgtccccataagcag

SEQ ID NO: 153129 - DNA, 25 bp, Homo sapien
atgtccccataagcagagctgtcac

SEQ ID NO: 153130 - DNA, 25 bp, Homo sapien
gtcacagtgtgcactaccttagatt

SEQ ID NO: 153131 - DNA, 25 bp, Homo sapien
gtgtgcactaccttagattgtttta

SEQ ID NO: 153132 - DNA, 25 bp, Homo sapien
gattgttttattgtcgtcattgtta

SEQ ID NO: 153133 - DNA, 25 bp, Homo sapien
ttttgtatgctgaatatgggcacca

SEQ ID NO: 153134 - DNA, 25 bp, Homo sapien
atatgggcaccaaagaacctgtaaa

SEQ ID NO: 153135 - DNA, 25 bp, Homo sapien
tatctttttcaattgaatgtgcaca

SEQ ID NO: 153136 - DNA, 25 bp, Homo sapien
gatattgctgcttttacaaaaggac

SEQ ID NO: 153137 - DNA, 25 bp, Homo sapien
cacccggcagcggtatgggaaaaga

SEQ ID NO: 153138 - DNA, 25 bp, Homo sapien
agagacggcccggacaggcttcttt

SEQ ID NO: 153139 - DNA, 25 bp, Homo sapien
gacaggcttctttccaaaacgttct

SEQ ID NO: 153140 - DNA, 25 bp, Homo sapien
gtcaggtcgcggtcggagggcccag

SEQ ID NO: 153141 - DNA, 25 bp, Homo sapien
cagacctgtggtgaggacccctgag

SEQ ID NO: 153142 - DNA, 25 bp, Homo sapien
tgaggacccctgaggcctcctggga

SEQ ID NO: 153143 - DNA, 25 bp, Homo sapien
tcctgggagatctgccaaccacgcc

SEQ ID NO: 153144 - DNA, 25 bp, Homo sapien
caaccacgcccacgtcatttgcata

SEQ ID NO: 153145 - DNA, 25 bp, Homo sapien
acgtcatttgcatacgcactcccga

SEQ ID NO: 153146 - DNA, 25 bp, Homo sapien
cagaaacccggattctgcctcccga

SEQ ID NO: 153147 - DNA, 25 bp, Homo sapien
ggcagggttcgggtgcggccctccg

SEQ ID NO: 153148 - DNA, 25 bp, Homo sapien
gaaatcggaatgtaccataataaat

SEQ ID NO: 153149 - DNA, 25 bp, Homo sapien
caaactctcaattacgccatggtaa

SEQ ID NO: 153150 - DNA, 25 bp, Homo sapien
tacgccatggtaattcagtcactaa

SEQ ID NO: 153151 - DNA, 25 bp, Homo sapien
gccatggtaattcagtcactaaaat

SEQ ID NO: 153152 - DNA, 25 bp, Homo sapien
gaagtgtgaaacatagccattgatt

SEQ ID NO: 153153 - DNA, 25 bp, Homo sapien
gaaacatagccattgattgatcaga

SEQ ID NO: 153154 - DNA, 25 bp, Homo sapien
gccattgattgatcagaattctgga

SEQ ID NO: 153155 - DNA, 25 bp, Homo sapien
gattgatcagaattctggaatctga

SEQ ID NO: 153156 - DNA, 25 bp, Homo sapien
atattaaaaccttacttagtgactg

SEQ ID NO: 153157 - DNA, 25 bp, Homo sapien
aaaaccttacttagtgactggaatg

SEQ ID NO: 153158 - DNA, 25 bp, Homo sapien
gactggaatggtatatgctccctcc

SEQ ID NO: 153159 - DNA, 25 bp, Homo sapien
actcccaagcggctctgtgcagaag

SEQ ID NO: 153160 - DNA, 25 bp, Homo sapien
gctgccaggcagtgtcttagatgtg

SEQ ID NO: 153161 - DNA, 25 bp, Homo sapien
tcttagatgtgagacggaggccatg

SEQ ID NO: 153162 - DNA, 25 bp, Homo sapien
ggaggccatggcgagaatccagctt

SEQ ID NO: 153163 - DNA, 25 bp, Homo sapien
gaatccagctttgacctttattcaa

SEQ ID NO: 153164 - DNA, 25 bp, Homo sapien
caagagaccagatgggttgccccag

SEQ ID NO: 153165 - DNA, 25 bp, Homo sapien
atgggttgccccaggatccggctgc

SEQ ID NO: 153166 - DNA, 25 bp, Homo sapien
ctgaggccaagcacggctggagacc

SEQ ID NO: 153167 - DNA, 25 bp, Homo sapien
ggctggagacccacgacctggcctg

SEQ ID NO: 153168 - DNA, 25 bp, Homo sapien
tgagctgcagcctcggccccaggat

SEQ ID NO: 153169 - DNA, 25 bp, Homo sapien
acagtcaccgcaggtgcaggcagga

SEQ ID NO: 153170 - DNA, 25 bp, Homo sapien
ccacccttgaattatgcacatctca

SEQ ID NO: 153171 - DNA, 25 bp, Homo sapien
acccttgaattatgcacatctcatg

SEQ ID NO: 153172 - DNA, 25 bp, Homo sapien
cttgaattatgcacatctcatggtt

SEQ ID NO: 153173 - DNA, 25 bp, Homo sapien
gaattatgcacatctcatggttttt

SEQ ID NO: 153174 - DNA, 25 bp, Homo sapien
aattatgcacatctcatggtttttt

SEQ ID NO: 153175 - DNA, 25 bp, Homo sapien
gtatacaattcaatgactttgagta

SEQ ID NO: 153176 - DNA, 25 bp, Homo sapien
gactttgagtaaatgtacagcgttg

SEQ ID NO: 153177 - DNA, 25 bp, Homo sapien
gagtaaatgtacagcgttgtgtgac

SEQ ID NO: 153178 - DNA, 25 bp, Homo sapien
agcgttgtgtgaccatcgccacaat

SEQ ID NO: 153179 - DNA, 25 bp, Homo sapien
ttgtgtgaccatcgccacaatctaa

SEQ ID NO: 153180 - DNA, 25 bp, Homo sapien
tgtgaccatcgccacaatctaattt

SEQ ID NO: 153181 - DNA, 25 bp, Homo sapien
aactgtttcgcttctgactgttaaa

SEQ ID NO: 153182 - DNA, 25 bp, Homo sapien
taaacaccgatgacgcatgcactgc

SEQ ID NO: 153183 - DNA, 25 bp, Homo sapien
atgcactgcacttcttcgttttctt

SEQ ID NO: 153184 - DNA, 25 bp, Homo sapien
ccattggcctgagtttcttgtgcat

SEQ ID NO: 153185 - DNA, 25 bp, Homo sapien
gagtttcttgtgcattactcctctc

SEQ ID NO: 153186 - DNA, 25 bp, Homo sapien
ctctccctccttcgttagaataggt

SEQ ID NO: 153187 - DNA, 25 bp, Homo sapien
gaaaacagtattctgcatctgtggc

SEQ ID NO: 153188 - DNA, 25 bp, Homo sapien
aaatgcaggcttttgtaacagtgtg

SEQ ID NO: 153189 - DNA, 25 bp, Homo sapien
gtgtgatctttactgatgcactcat

SEQ ID NO: 153190 - DNA, 25 bp, Homo sapien
gatgcactcatgacaagtacccaat

SEQ ID NO: 153191 - DNA, 25 bp, Homo sapien
gtacccaatgtattttagctatttt

SEQ ID NO: 153192 - DNA, 25 bp, Homo sapien
ggattcaagttcttttgcatagttt

SEQ ID NO: 153193 - DNA, 25 bp, Homo sapien
ttctaacccctgttggagtccaggg

SEQ ID NO: 153194 - DNA, 25 bp, Homo sapien
aaggacagatttatgcagctatttt

SEQ ID NO: 153195 - DNA, 25 bp, Homo sapien
atgcagctattttcatacattccct

SEQ ID NO: 153196 - DNA, 25 bp, Homo sapien
gctattttcatacattccctgttca

SEQ ID NO: 153197 - DNA, 25 bp, Homo sapien
attttcatacattccctgttcagag

SEQ ID NO: 153198 - DNA, 25 bp, Homo sapien
tcatacattccctgttcagagtggg

SEQ ID NO: 153199 - DNA, 25 bp, Homo sapien
gtttcctttgctgtggtgggagata

SEQ ID NO: 153200 - DNA, 25 bp, Homo sapien
gtgggagatagtttgactgaacccc

SEQ ID NO: 153201 - DNA, 25 bp, Homo sapien
ggagatagtttgactgaacccccac

SEQ ID NO: 153202 - DNA, 25 bp, Homo sapien
cccaccttgaccttggtctccaggg

SEQ ID NO: 153203 - DNA, 25 bp, Homo sapien
tggtcacccggcagcggtatgggaa

SEQ ID NO: 153204 - DNA, 25 bp, Homo sapien
cacccggcagcggtatgggaaaaga

SEQ ID NO: 153205 - DNA, 25 bp, Homo sapien
cagcggtatgggaaaagagacggcc

SEQ ID NO: 153206 - DNA, 25 bp, Homo sapien
ccgacggcgaggaccgccccgtcag

SEQ ID NO: 153207 - DNA, 25 bp, Homo sapien
cctcctgggagatctgccaaccacg

SEQ ID NO: 153208 - DNA, 25 bp, Homo sapien
tgggagatctgccaaccacgcccac

SEQ ID NO: 153209 - DNA, 25 bp, Homo sapien
caaccacgcccacgtcatttgcata

SEQ ID NO: 153210 - DNA, 25 bp, Homo sapien
acgtcatttgcatacgcactcccga

SEQ ID NO: 153211 - DNA, 25 bp, Homo sapien
tgcatacgcactcccgaccccagaa

SEQ ID NO: 153212 - DNA, 25 bp, Homo sapien
ccagaaacccggattctgcctcccg

SEQ ID NO: 153213 - DNA, 25 bp, Homo sapien
attctgcctcccgacggcggcgtct

SEQ ID NO: 153214 - DNA, 25 bp, Homo sapien
gatctgtgagatgcactgctacctg

SEQ ID NO: 153215 - DNA, 25 bp, Homo sapien
tgagatgcactgctacctggtactg

SEQ ID NO: 153216 - DNA, 25 bp, Homo sapien
ctacctggtactgctttcagtgtgt

SEQ ID NO: 153217 - DNA, 25 bp, Homo sapien
cggcgtgtcaggcatactctgagta

SEQ ID NO: 153218 - DNA, 25 bp, Homo sapien
gtagataatttgtcatgcagcgcat

SEQ ID NO: 153219 - DNA, 25 bp, Homo sapien
catgcagcgcatgcaatcagaatct

SEQ ID NO: 153220 - DNA, 25 bp, Homo sapien
atcagaatctcactgagccacccat

SEQ ID NO: 153221 - DNA, 25 bp, Homo sapien
tacctcagttgtacaggacttggtg

SEQ ID NO: 153222 - DNA, 25 bp, Homo sapien
gacttggtgatcaggatccaggcac

SEQ ID NO: 153223 - DNA, 25 bp, Homo sapien
gatccaggcactcacttgtattcta

SEQ ID NO: 153224 - DNA, 25 bp, Homo sapien
acttgtattctactgctcaataaac

SEQ ID NO: 153225 - DNA, 25 bp, Homo sapien
ttcaaggagaacaaacgcccgtcaa

SEQ ID NO: 153226 - DNA, 25 bp, Homo sapien
acaaacgcccgtcaaaggagatgca

SEQ ID NO: 153227 - DNA, 25 bp, Homo sapien
acgcccgtcaaaggagatgcagatc

SEQ ID NO: 153228 - DNA, 25 bp, Homo sapien
aggagatgcagatcaccatttccca

SEQ ID NO: 153229 - DNA, 25 bp, Homo sapien
gcctggagctcacaaccgtcagcaa

SEQ ID NO: 153230 - DNA, 25 bp, Homo sapien
gagaagtggcaagacgatctgagca

SEQ ID NO: 153231 - DNA, 25 bp, Homo sapien
ctccagcacgtgtaccaaagcatga

SEQ ID NO: 153232 - DNA, 25 bp, Homo sapien
tgtaccaaagcatgatggaaggact

SEQ ID NO: 153233 - DNA, 25 bp, Homo sapien
acttgggcacaagtcacctccaaat

SEQ ID NO: 153234 - DNA, 25 bp, Homo sapien
gggcacaagtcacctccaaatgagg

SEQ ID NO: 153235 - DNA, 25 bp, Homo sapien
aatgaggacaacagataccaaaaga

SEQ ID NO: 153236 - DNA, 25 bp, Homo sapien
gagtgaggcagtgaccacgcattgt

SEQ ID NO: 153237 - DNA, 25 bp, Homo sapien
cacgcattgtcacagctaccaaagt

SEQ ID NO: 153238 - DNA, 25 bp, Homo sapien
ttgtcacagctaccaaagtgtggtt

SEQ ID NO: 153239 - DNA, 25 bp, Homo sapien
aaagtgtggtttgcagatgatctgg

SEQ ID NO: 153240 - DNA, 25 bp, Homo sapien
atgatctgggcttgtttctggcaga

SEQ ID NO: 153241 - DNA, 25 bp, Homo sapien
ttctggcagagattctggtacagag

SEQ ID NO: 153242 - DNA, 25 bp, Homo sapien
gtggaaccacgatgggctgaggcca

SEQ ID NO: 153243 - DNA, 25 bp, Homo sapien
tcacaacctccaacaacactttttt

SEQ ID NO: 153244 - DNA, 25 bp, Homo sapien
tggcctccaattctgaccttacaaa

SEQ ID NO: 153245 - DNA, 25 bp, Homo sapien
tgaccttacaaaagtgtcccttgag

SEQ ID NO: 153246 - DNA, 25 bp, Homo sapien
acaaaagtgtcccttgagtgaggca

SEQ ID NO: 153247 - DNA, 25 bp, Homo sapien
tgcttcacctacactacctacaaga

SEQ ID NO: 153248 - DNA, 25 bp, Homo sapien
tacctacaagatcccgcgtcagcgg

SEQ ID NO: 153249 - DNA, 25 bp, Homo sapien
ccgcgtcagcggattatggattact

SEQ ID NO: 153250 - DNA, 25 bp, Homo sapien
agcggattatggattactatgagac

SEQ ID NO: 153251 - DNA, 25 bp, Homo sapien
gctccaagcccggaattgtcttcat

SEQ ID NO: 153252 - DNA, 25 bp, Homo sapien
gcccggaattgtcttcatcaccaaa

SEQ ID NO: 153253 - DNA, 25 bp, Homo sapien
ctgtaccaaccccagtgacaagtgg

SEQ ID NO: 153254 - DNA, 25 bp, Homo sapien
aaccccagtgacaagtgggtccagg

SEQ ID NO: 153255 - DNA, 25 bp, Homo sapien
gtgggtccaggactatatcaaggac

SEQ ID NO: 153256 - DNA, 25 bp, Homo sapien
gtggcgaaggcacagctcagagaca

SEQ ID NO: 153257 - DNA, 25 bp, Homo sapien
aagagaagatgccaaggccccctcc

SEQ ID NO: 153258 - DNA, 25 bp, Homo sapien
ctgtgcccactgctgtatgatctgg

SEQ ID NO: 153259 - DNA, 25 bp, Homo sapien
tgtgcccactgctgtatgatctggg

SEQ ID NO: 153260 - DNA, 25 bp, Homo sapien
gctgcctcccgtggtgtgagggcgg

SEQ ID NO: 153261 - DNA, 25 bp, Homo sapien
gctggtgctcatggcacttcctcct

SEQ ID NO: 153262 - DNA, 25 bp, Homo sapien
ggctttgcctgacaacacccagctt

SEQ ID NO: 153263 - DNA, 25 bp, Homo sapien
ttgcctgacaacacccagctttatg

SEQ ID NO: 153264 - DNA, 25 bp, Homo sapien
cctgacaacacccagctttatgtaa

SEQ ID NO: 153265 - DNA, 25 bp, Homo sapien
gacaacacccagctttatgtaaata

SEQ ID NO: 153266 - DNA, 25 bp, Homo sapien
tattctgcagttgttacttaggaag

SEQ ID NO: 153267 - DNA, 25 bp, Homo sapien
tctgcagttgttacttaggaagcct

SEQ ID NO: 153268 - DNA, 25 bp, Homo sapien
tcccagactctgtctgtgccgagtg

SEQ ID NO: 153269 - DNA, 25 bp, Homo sapien
ctcaaggacctggaaacccatgctt

SEQ ID NO: 153270 - DNA, 25 bp, Homo sapien
ggaaacccatgcttcgagacaacgt

SEQ ID NO: 153271 - DNA, 25 bp, Homo sapien
gaaacccatgcttcgagacaacgtg

SEQ ID NO: 153272 - DNA, 25 bp, Homo sapien
aaacccatgcttcgagacaacgtga

SEQ ID NO: 153273 - DNA, 25 bp, Homo sapien
acccatgcttcgagacaacgtgact

SEQ ID NO: 153274 - DNA, 25 bp, Homo sapien
ccatgcttcgagacaacgtgacttt

SEQ ID NO: 153275 - DNA, 25 bp, Homo sapien
atgcttcgagacaacgtgactttaa

SEQ ID NO: 153276 - DNA, 25 bp, Homo sapien
gcttcgagacaacgtgactttaatg

SEQ ID NO: 153277 - DNA, 25 bp, Homo sapien
tcgagacaacgtgactttaatggga

SEQ ID NO: 153278 - DNA, 25 bp, Homo sapien
acaacgtgactttaatgggagggtg

SEQ ID NO: 153279 - DNA, 25 bp, Homo sapien
gtgggtgggccgcagacaggctggc

SEQ ID NO: 153280 - DNA, 25 bp, Homo sapien
tggggggaccgatgttccataattc

SEQ ID NO: 153281 - DNA, 25 bp, Homo sapien
attctaagtcttctatgcattgtcc

SEQ ID NO: 153282 - DNA, 25 bp, Homo sapien
taagtcttctatgcattgtccacca

SEQ ID NO: 153283 - DNA, 25 bp, Homo sapien
gtcttctatgcattgtccaccaaga

SEQ ID NO: 153284 - DNA, 25 bp, Homo sapien
tgggcagcttctgttcctgcacaac

SEQ ID NO: 153285 - DNA, 25 bp, Homo sapien
agcttctgttcctgcacaacagtta

SEQ ID NO: 153286 - DNA, 25 bp, Homo sapien
tgttcctgcacaacagttatgctat

SEQ ID NO: 153287 - DNA, 25 bp, Homo sapien
aacagttatgctatccttgcagcta

SEQ ID NO: 153288 - DNA, 25 bp, Homo sapien
ttatgctatccttgcagctaatccc

SEQ ID NO: 153289 - DNA, 25 bp, Homo sapien
agctaatccccttctgttactgttt

SEQ ID NO: 153290 - DNA, 25 bp, Homo sapien
atccccttctgttactgtttagaca

SEQ ID NO: 153291 - DNA, 25 bp, Homo sapien
atagggacaaacaaatcttgaggaa

SEQ ID NO: 153292 - DNA, 25 bp, Homo sapien
gaggaagcccaagtgcgtaccttta

SEQ ID NO: 153293 - DNA, 25 bp, Homo sapien
gcccaagtgcgtacctttatttttg

SEQ ID NO: 153294 - DNA, 25 bp, Homo sapien
caccctctttctgtacttcaatttt

SEQ ID NO: 153295 - DNA, 25 bp, Homo sapien
cctctttctgtacttcaatttttgt

SEQ ID NO: 153296 - DNA, 25 bp, Homo sapien
tttggtgcttcaaaacttgtacctt

SEQ ID NO: 153297 - DNA, 25 bp, Homo sapien
gtgcttcaaaacttgtaccttcatt

SEQ ID NO: 153298 - DNA, 25 bp, Homo sapien
gacaatgtacgttgtaattaccaaa

SEQ ID NO: 153299 - DNA, 25 bp, Homo sapien
aagaatttcatgactctacctgtgg

SEQ ID NO: 153300 - DNA, 25 bp, Homo sapien
atttcatgactctacctgtggtcta

SEQ ID NO: 153301 - DNA, 25 bp, Homo sapien
gactctacctgtggtctatctttaa

SEQ ID NO: 153302 - DNA, 25 bp, Homo sapien
cactcaggatctcatggccaaagtc

SEQ ID NO: 153303 - DNA, 25 bp, Homo sapien
tcaggatctcatggccaaagtcaga

SEQ ID NO: 153304 - DNA, 25 bp, Homo sapien
tggccaaagtcagagcgatgcttgc

SEQ ID NO: 153305 - DNA, 25 bp, Homo sapien
aagtcagagcgatgcttgcagcttc

SEQ ID NO: 153306 - DNA, 25 bp, Homo sapien
atgcttgcagcttccaaaaacctgc

SEQ ID NO: 153307 - DNA, 25 bp, Homo sapien
tccaaaaacctgcaaaccagcgctt

SEQ ID NO: 153308 - DNA, 25 bp, Homo sapien
gcaaaccagcgcttcctgagacggg

SEQ ID NO: 153309 - DNA, 25 bp, Homo sapien
ttctgggcaggctcacgcagacgcc

SEQ ID NO: 153310 - DNA, 25 bp, Homo sapien
tggccgcctccatggacccttggtg

SEQ ID NO: 153311 - DNA, 25 bp, Homo sapien
tggacccttggtggcttttgtaaat

SEQ ID NO: 153312 - DNA, 25 bp, Homo sapien
gtaaatatatcatgtttctgtgaaa

SEQ ID NO: 153313 - DNA, 25 bp, Homo sapien
gagataattgacgaccttgccaacc

SEQ ID NO: 153314 - DNA, 25 bp, Homo sapien
acgaccttgccaacctagtggagaa

SEQ ID NO: 153315 - DNA, 25 bp, Homo sapien
aacttcgcaatgaaaccaggcgggt

SEQ ID NO: 153316 - DNA, 25 bp, Homo sapien
ggtggacagaaagtcagcctcttgt

SEQ ID NO: 153317 - DNA, 25 bp, Homo sapien
gtcagcctcttgtgggatgatcatg

SEQ ID NO: 153318 - DNA, 25 bp, Homo sapien
gtgattttactgctgcttgtggcta

SEQ ID NO: 153319 - DNA, 25 bp, Homo sapien
gctatcgtggttgttgcagtctggc

SEQ ID NO: 153320 - DNA, 25 bp, Homo sapien
agtctggccgaccaactgatggcag

SEQ ID NO: 153321 - DNA, 25 bp, Homo sapien
ggcagtaaagagaccaccagcagtg

SEQ ID NO: 153322 - DNA, 25 bp, Homo sapien
gcagtgacacctggcaatgacagat

SEQ ID NO: 153323 - DNA, 25 bp, Homo sapien
atgcaagcccaacacccttttggta

SEQ ID NO: 153324 - DNA, 25 bp, Homo sapien
tgcctgacatgctgaagaacgcacc

SEQ ID NO: 153325 - DNA, 25 bp, Homo sapien
gctgaagaacgcacccatgttaaag

SEQ ID NO: 153326 - DNA, 25 bp, Homo sapien
aagaacgcacccatgttaaagagca

SEQ ID NO: 153327 - DNA, 25 bp, Homo sapien
aaaagctgccattctcaaggcccaa

SEQ ID NO: 153328 - DNA, 25 bp, Homo sapien
gctgccattctcaaggcccaagtgg

SEQ ID NO: 153329 - DNA, 25 bp, Homo sapien
caaggcccaagtggccgcaagagga

SEQ ID NO: 153330 - DNA, 25 bp, Homo sapien
atctgagttcattggagtgggtgct

SEQ ID NO: 153331 - DNA, 25 bp, Homo sapien
gagtgggtgcttgtgcatatatcta

SEQ ID NO: 153332 - DNA, 25 bp, Homo sapien
gcttgtgcatatatctaggtatctt

SEQ ID NO: 153333 - DNA, 25 bp, Homo sapien
ctaggtatcttttgccatctttctc

SEQ ID NO: 153334 - DNA, 25 bp, Homo sapien
tgccatctttctctttagatcaggg

SEQ ID NO: 153335 - DNA, 25 bp, Homo sapien
gtagcttcattattgtaaaacatat

SEQ ID NO: 153336 - DNA, 25 bp, Homo sapien
aacatattcaagatcctacagtaag

SEQ ID NO: 153337 - DNA, 25 bp, Homo sapien
gatcctacagtaagagtgaaacatt

SEQ ID NO: 153338 - DNA, 25 bp, Homo sapien
gtgaaacattcacaaagatttgcgt

SEQ ID NO: 153339 - DNA, 25 bp, Homo sapien
gatttgcgttaatgaagactacaca

SEQ ID NO: 153340 - DNA, 25 bp, Homo sapien
gactacacagaaaacctttctaggg

SEQ ID NO: 153341 - DNA, 25 bp, Homo sapien
aacctttctagggatttgtgtggat

SEQ ID NO: 153342 - DNA, 25 bp, Homo sapien
gtggatcagatacatacttggcaaa

SEQ ID NO: 153343 - DNA, 25 bp, Homo sapien
cattcttacagaaaagtccatttaa

SEQ ID NO: 153344 - DNA, 25 bp, Homo sapien
tcaacagattgcctgctcctcagag

SEQ ID NO: 153345 - DNA, 25 bp, Homo sapien
tgctcctcagagtctctcctatttt

SEQ ID NO: 153346 - DNA, 25 bp, Homo sapien
aggctcccacagctcctgtgtgcgg

SEQ ID NO: 153347 - DNA, 25 bp, Homo sapien
cagctcctgtgtgcggctttggcag

SEQ ID NO: 153348 - DNA, 25 bp, Homo sapien
gaaggcttccggcagcttgaccttc

SEQ ID NO: 153349 - DNA, 25 bp, Homo sapien
ggcagcttgaccttctctgtgacat

SEQ ID NO: 153350 - DNA, 25 bp, Homo sapien
cctggtgggttttatcaacagcctc

SEQ ID NO: 153351 - DNA, 25 bp, Homo sapien
gtgggttttatcaacagcctcaagt

SEQ ID NO: 153352 - DNA, 25 bp, Homo sapien
caggagcacaggcttggccgatggt

SEQ ID NO: 153353 - DNA, 25 bp, Homo sapien
cgatggtggagaatcaaagaggctc

SEQ ID NO: 153354 - DNA, 25 bp, Homo sapien
aagaggctcggaattctgtctgcat

SEQ ID NO: 153355 - DNA, 25 bp, Homo sapien
gctgctggttcctgacactcttatc

SEQ ID NO: 153356 - DNA, 25 bp, Homo sapien
tgctggttcctgacactcttatcct

SEQ ID NO: 153357 - DNA, 25 bp, Homo sapien
aatatcatctttacgggatctaccg

SEQ ID NO: 153358 - DNA, 25 bp, Homo sapien
ctgcctgagaccctgaacagccctt

SEQ ID NO: 153359 - DNA, 25 bp, Homo sapien
agcccttgccagagacgatcgaaga

SEQ ID NO: 153360 - DNA, 25 bp, Homo sapien
ccttgccagagacgatcgaagacct

SEQ ID NO: 153361 - DNA, 25 bp, Homo sapien
gagacgatcgaagacctggaaaact

SEQ ID NO: 153362 - DNA, 25 bp, Homo sapien
gacgatcgaagacctggaaaactgg

SEQ ID NO: 153363 - DNA, 25 bp, Homo sapien
gacctggaaaactggtcagtcactg

SEQ ID NO: 153364 - DNA, 25 bp, Homo sapien
agtcactgcctctggccccatcagt

SEQ ID NO: 153365 - DNA, 25 bp, Homo sapien
tgggcccagggcttttccttagctc

SEQ ID NO: 153366 - DNA, 25 bp, Homo sapien
ccagggcttttccttagctctctgt

SEQ ID NO: 153367 - DNA, 25 bp, Homo sapien
agggcttttccttagctctctgtcc

SEQ ID NO: 153368 - DNA, 25 bp, Homo sapien
tactggcaggaaggatcaggatggg

SEQ ID NO: 153369 - DNA, 25 bp, Homo sapien
gggtctcttcccgtaactgtctgac

SEQ ID NO: 153370 - DNA, 25 bp, Homo sapien
gtctcttcccgtaactgtctgacgt

SEQ ID NO: 153371 - DNA, 25 bp, Homo sapien
ttcccgtaactgtctgacgtcctgt

SEQ ID NO: 153372 - DNA, 25 bp, Homo sapien
tcccgtaactgtctgacgtcctgtg

SEQ ID NO: 153373 - DNA, 25 bp, Homo sapien
gtaactgtctgacgtcctgtgccgt

SEQ ID NO: 153374 - DNA, 25 bp, Homo sapien
aactgtctgacgtcctgtgccgtct

SEQ ID NO: 153375 - DNA, 25 bp, Homo sapien
tgtctgacgtcctgtgccgtcttgt

SEQ ID NO: 153376 - DNA, 25 bp, Homo sapien
tctgacgtcctgtgccgtcttgtcc

SEQ ID NO: 153377 - DNA, 25 bp, Homo sapien
ggcagtcgtgggagcccctctcagc

SEQ ID NO: 153378 - DNA, 25 bp, Homo sapien
cgtgggagcccctctcagctgtggg

SEQ ID NO: 153379 - DNA, 25 bp, Homo sapien
ggccgatggagacaccaaccgacag

SEQ ID NO: 153380 - DNA, 25 bp, Homo sapien
tggagacaccaaccgacaggccctg

SEQ ID NO: 153381 - DNA, 25 bp, Homo sapien
agctgcgcgggcttatttattaaca

SEQ ID NO: 153382 - DNA, 25 bp, Homo sapien
ttattaacaggataacccttgaatg

SEQ ID NO: 153383 - DNA, 25 bp, Homo sapien
gataacccttgaatgtagcagcccc

SEQ ID NO: 153384 - DNA, 25 bp, Homo sapien
taacccttgaatgtagcagccccgg

SEQ ID NO: 153385 - DNA, 25 bp, Homo sapien
cccttgaatgtagcagccccgggag

SEQ ID NO: 153386 - DNA, 25 bp, Homo sapien
aggtcgggcgcaggattcagccgga

SEQ ID NO: 153387 - DNA, 25 bp, Homo sapien
aggaggtgcctggagtgcccaccct

SEQ ID NO: 153388 - DNA, 25 bp, Homo sapien
ccacctccttgggtagtgagcagtg

SEQ ID NO: 153389 - DNA, 25 bp, Homo sapien
cctccttgggtagtgagcagtgagc

SEQ ID NO: 153390 - DNA, 25 bp, Homo sapien
ctgggatctgctgctctgggtctaa

SEQ ID NO: 153391 - DNA, 25 bp, Homo sapien
atctgctgctctgggtctaagtcta

SEQ ID NO: 153392 - DNA, 25 bp, Homo sapien
acctttctgatccttgggtctgggt

SEQ ID NO: 153393 - DNA, 25 bp, Homo sapien
gatccttgggtctgggttttttgag

SEQ ID NO: 153394 - DNA, 25 bp, Homo sapien
tggcaggtgactttctagggatcag

SEQ ID NO: 153395 - DNA, 25 bp, Homo sapien
gcaggtgactttctagggatcagca

SEQ ID NO: 153396 - DNA, 25 bp, Homo sapien
tagggatcagcacctgccctgtgtt

SEQ ID NO: 153397 - DNA, 25 bp, Homo sapien
ctgccctgtgttttgtaccttgaac

SEQ ID NO: 153398 - DNA, 25 bp, Homo sapien
gccctgtgttttgtaccttgaacct

SEQ ID NO: 153399 - DNA, 25 bp, Homo sapien
gtgttttgtaccttgaacctaagat

SEQ ID NO: 153400 - DNA, 25 bp, Homo sapien
gtaccttgaacctaagatatattaa

SEQ ID NO: 153401 - DNA, 25 bp, Homo sapien
gactcttactgctaacttttgtgta

SEQ ID NO: 153402 - DNA, 25 bp, Homo sapien
gctaacttttgtgtatcgtaaccag

SEQ ID NO: 153403 - DNA, 25 bp, Homo sapien
tgtgtatcgtaaccagccagatcct

SEQ ID NO: 153404 - DNA, 25 bp, Homo sapien
accagccagatcctcttggttattt

SEQ ID NO: 153405 - DNA, 25 bp, Homo sapien
cagatcctcttggttatttgtttac

SEQ ID NO: 153406 - DNA, 25 bp, Homo sapien
gtttaccacttgtattattaatgcc

SEQ ID NO: 153407 - DNA, 25 bp, Homo sapien
aggcctccatctcatgtatcatctg

SEQ ID NO: 153408 - DNA, 25 bp, Homo sapien
gtatcatctggataggagcctgctg

SEQ ID NO: 153409 - DNA, 25 bp, Homo sapien
ggataggagcctgctggtcacagcc

SEQ ID NO: 153410 - DNA, 25 bp, Homo sapien
tctgccagaagatcccctcaggact

SEQ ID NO: 153411 - DNA, 25 bp, Homo sapien
aagatcccctcaggactgcaacagg

SEQ ID NO: 153412 - DNA, 25 bp, Homo sapien
gaagcagtattgtacagaacacggt

SEQ ID NO: 153413 - DNA, 25 bp, Homo sapien
gcagtattgtacagaacacggtatt

SEQ ID NO: 153414 - DNA, 25 bp, Homo sapien
agaatcatgtacagagcttaaatgt

SEQ ID NO: 153415 - DNA, 25 bp, Homo sapien
agttggtcttggtttgcttctctct

SEQ ID NO: 153416 - DNA, 25 bp, Homo sapien
ggtcttggtttgcttctctctgtac

SEQ ID NO: 153417 - DNA, 25 bp, Homo sapien
ggtttgcttctctctgtaccacgtg

SEQ ID NO: 153418 - DNA, 25 bp, Homo sapien
ttctctctgtaccacgtgcacatga

SEQ ID NO: 153419 - DNA, 25 bp, Homo sapien
tctctgtaccacgtgcacatgaggt

SEQ ID NO: 153420 - DNA, 25 bp, Homo sapien
acacagacccacaggcagccgtctg

SEQ ID NO: 153421 - DNA, 25 bp, Homo sapien
gtctgtgcccgcacacattgttggt

SEQ ID NO: 153422 - DNA, 25 bp, Homo sapien
tgcccgcacacattgttggtcctat

SEQ ID NO: 153423 - DNA, 25 bp, Homo sapien
attggcacctagtggctgggagctt

SEQ ID NO: 153424 - DNA, 25 bp, Homo sapien
cacctagtggctgggagcttgccag

SEQ ID NO: 153425 - DNA, 25 bp, Homo sapien
tggctgggagcttgccaggaaccca

SEQ ID NO: 153426 - DNA, 25 bp, Homo sapien
tggccagggagcgtggcacttacct

SEQ ID NO: 153427 - DNA, 25 bp, Homo sapien
cagggagcgtggcacttacctttgt

SEQ ID NO: 153428 - DNA, 25 bp, Homo sapien
agggagcgtggcacttacctttgtc

SEQ ID NO: 153429 - DNA, 25 bp, Homo sapien
gggagcgtggcacttacctttgtcc

SEQ ID NO: 153430 - DNA, 25 bp, Homo sapien
gagcgtggcacttacctttgtccct

SEQ ID NO: 153431 - DNA, 25 bp, Homo sapien
gcgtggcacttacctttgtcccttg

SEQ ID NO: 153432 - DNA, 25 bp, Homo sapien
gtggcacttacctttgtcccttgct

SEQ ID NO: 153433 - DNA, 25 bp, Homo sapien
cacttacctttgtcccttgcttcat

SEQ ID NO: 153434 - DNA, 25 bp, Homo sapien
agcaccagggagcagttgccctcag

SEQ ID NO: 153435 - DNA, 25 bp, Homo sapien
acgaatgttttctaccagtgtgctt

SEQ ID NO: 153436 - DNA, 25 bp, Homo sapien
tctaccagtgtgcttgggtttgcca

SEQ ID NO: 153437 - DNA, 25 bp, Homo sapien
cttgggtttgccatgatgcgaggct

SEQ ID NO: 153438 - DNA, 25 bp, Homo sapien
gtttgccatgatgcgaggctgagtt

SEQ ID NO: 153439 - DNA, 25 bp, Homo sapien
aggctgagttgctgtagcgtcttga

SEQ ID NO: 153440 - DNA, 25 bp, Homo sapien
tgagttgctgtagcgtcttgattct

SEQ ID NO: 153441 - DNA, 25 bp, Homo sapien
ttttccctttattacacaggacagc

SEQ ID NO: 153442 - DNA, 25 bp, Homo sapien
cctttattacacaggacagccaggg

SEQ ID NO: 153443 - DNA, 25 bp, Homo sapien
ggcaggcctgcggatgcatgaaata

SEQ ID NO: 153444 - DNA, 25 bp, Homo sapien
gcctgcggatgcatgaaataatgtt

SEQ ID NO: 153445 - DNA, 25 bp, Homo sapien
cgaggccgcgctgttggactctagt

SEQ ID NO: 153446 - DNA, 25 bp, Homo sapien
aggccgcgctgttggactctagtct

SEQ ID NO: 153447 - DNA, 25 bp, Homo sapien
cgcgctgttggactctagtctcgag

SEQ ID NO: 153448 - DNA, 25 bp, Homo sapien
gcgctgttggactctagtctcgagg

SEQ ID NO: 153449 - DNA, 25 bp, Homo sapien
gctgttggactctagtctcgagggc

SEQ ID NO: 153450 - DNA, 25 bp, Homo sapien
agaccctcgcacctgttggagaaga

SEQ ID NO: 153451 - DNA, 25 bp, Homo sapien
gaccctcgcacctgttggagaagat

SEQ ID NO: 153452 - DNA, 25 bp, Homo sapien
ccctcgcacctgttggagaagatgc

SEQ ID NO: 153453 - DNA, 25 bp, Homo sapien
gaagatgctatgaagactcccagcc

SEQ ID NO: 153454 - DNA, 25 bp, Homo sapien
agatgctatgaagactcccagcccg

SEQ ID NO: 153455 - DNA, 25 bp, Homo sapien
gatgctatgaagactcccagcccgg

SEQ ID NO: 153456 - DNA, 25 bp, Homo sapien
aaagcaatccgaggaccacagcagc

SEQ ID NO: 153457 - DNA, 25 bp, Homo sapien
gaagccctttcctaatcaagacagt

SEQ ID NO: 153458 - DNA, 25 bp, Homo sapien
caagacagtgactcggtggtactaa

SEQ ID NO: 153459 - DNA, 25 bp, Homo sapien
ggtggtactaagtggcacagactca

SEQ ID NO: 153460 - DNA, 25 bp, Homo sapien
tcagaactgcatatacctcgagtat

SEQ ID NO: 153461 - DNA, 25 bp, Homo sapien
atacctcgagtatgtgaattctgtc

SEQ ID NO: 153462 - DNA, 25 bp, Homo sapien
gtgaattctgtcaagcagttttccc

SEQ ID NO: 153463 - DNA, 25 bp, Homo sapien
gcagttttcccaccatccattacat

SEQ ID NO: 153464 - DNA, 25 bp, Homo sapien
gatttccttcggcatcttaattcac

SEQ ID NO: 153465 - DNA, 25 bp, Homo sapien
cttcggcatcttaattcacacttca

SEQ ID NO: 153466 - DNA, 25 bp, Homo sapien
attcacacttcaatggagagactta

SEQ ID NO: 153467 - DNA, 25 bp, Homo sapien
cacactggcccctatgcagaagggc

SEQ ID NO: 153468 - DNA, 25 bp, Homo sapien
agacagttcttctggggttggcagc

SEQ ID NO: 153469 - DNA, 25 bp, Homo sapien
gcagctgctcattcatgatggcctc

SEQ ID NO: 153470 - DNA, 25 bp, Homo sapien
cctgcactgtcctgattggccggga

SEQ ID NO: 153471 - DNA, 25 bp, Homo sapien
tgattggccgggacacacggttttg

SEQ ID NO: 153472 - DNA, 25 bp, Homo sapien
ctagcagtcatcattggcgtcacag

SEQ ID NO: 153473 - DNA, 25 bp, Homo sapien
gcagtcatcattggcgtcacagtgg

SEQ ID NO: 153474 - DNA, 25 bp, Homo sapien
tcatcattggcgtcacagtggttgg

SEQ ID NO: 153475 - DNA, 25 bp, Homo sapien
cattggcgtcacagtggttggataa

SEQ ID NO: 153476 - DNA, 25 bp, Homo sapien
cacagtggttggataatgtcgcaca

SEQ ID NO: 153477 - DNA, 25 bp, Homo sapien
ggttggataatgtcgcacattgttg

SEQ ID NO: 153478 - DNA, 25 bp, Homo sapien
tgcggtgaagccaagccgcaaggtt

SEQ ID NO: 153479 - DNA, 25 bp, Homo sapien
cggtgaagccaagccgcaaggttac

SEQ ID NO: 153480 - DNA, 25 bp, Homo sapien
gaagccaagccgcaaggttacaagg

SEQ ID NO: 153481 - DNA, 25 bp, Homo sapien
aagccaagccgcaaggttacaaggc

SEQ ID NO: 153482 - DNA, 25 bp, Homo sapien
gccaagccgcaaggttacaaggcat

SEQ ID NO: 153483 - DNA, 25 bp, Homo sapien
caagccgcaaggttacaaggcatcc

SEQ ID NO: 153484 - DNA, 25 bp, Homo sapien
aagccgcaaggttacaaggcatcct

SEQ ID NO: 153485 - DNA, 25 bp, Homo sapien
agccgcaaggttacaaggcatcctc

SEQ ID NO: 153486 - DNA, 25 bp, Homo sapien
gccgcaaggttacaaggcatcctca

SEQ ID NO: 153487 - DNA, 25 bp, Homo sapien
ccgcaaggttacaaggcatcctcac

SEQ ID NO: 153488 - DNA, 25 bp, Homo sapien
cgcaaggttacaaggcatcctcacc

SEQ ID NO: 153489 - DNA, 25 bp, Homo sapien
ttttattggtactccagtccaggca

SEQ ID NO: 153490 - DNA, 25 bp, Homo sapien
atgacttcaaacgagtagttggcaa

SEQ ID NO: 153491 - DNA, 25 bp, Homo sapien
gacactggacaaccatattgcaatc

SEQ ID NO: 153492 - DNA, 25 bp, Homo sapien
tattgcaatcagatctacagctcct

SEQ ID NO: 153493 - DNA, 25 bp, Homo sapien
gatctacagctcctggataattgct

SEQ ID NO: 153494 - DNA, 25 bp, Homo sapien
gataattgcttgattctcgccagag

SEQ ID NO: 153495 - DNA, 25 bp, Homo sapien
ttctcgccagagactgtcaatgttt

SEQ ID NO: 153496 - DNA, 25 bp, Homo sapien
atgtttcattcattgccattaccaa

SEQ ID NO: 153497 - DNA, 25 bp, Homo sapien
attgcttttgttcagatggtatcac

SEQ ID NO: 153498 - DNA, 25 bp, Homo sapien
gatggtatcactagtgtttccattg

SEQ ID NO: 153499 - DNA, 25 bp, Homo sapien
gtttccattgtaatcttgacacatg

SEQ ID NO: 153500 - DNA, 25 bp, Homo sapien
gagtagtcagtcttctagattgttc

SEQ ID NO: 153501 - DNA, 25 bp, Homo sapien
agattgttcttataccacctctcaa

SEQ ID NO: 153502 - DNA, 25 bp, Homo sapien
gggacctagcctggagtcaggacaa

SEQ ID NO: 153503 - DNA, 25 bp, Homo sapien
gtcaggacaaatggatcgggctgca

SEQ ID NO: 153504 - DNA, 25 bp, Homo sapien
gagagaaactcttcagcgaatcctt

SEQ ID NO: 153505 - DNA, 25 bp, Homo sapien
cagcgaatccttctagtactagttg

SEQ ID NO: 153506 - DNA, 25 bp, Homo sapien
actagttgagagtttgactgtgaat

SEQ ID NO: 153507 - DNA, 25 bp, Homo sapien
gactgtgaattaattttatgccata

SEQ ID NO: 153508 - DNA, 25 bp, Homo sapien
tttatgccataaaagaccaacccag

SEQ ID NO: 153509 - DNA, 25 bp, Homo sapien
acccagttctgtttgactatgtagc

SEQ ID NO: 153510 - DNA, 25 bp, Homo sapien
ctgtttgactatgtagcatcttgaa

SEQ ID NO: 153511 - DNA, 25 bp, Homo sapien
aagccagccccagggacattcggga

SEQ ID NO: 153512 - DNA, 25 bp, Homo sapien
agccccagggacattcgggaacagt

SEQ ID NO: 153513 - DNA, 25 bp, Homo sapien
acattcgggaacagtctgagacaac

SEQ ID NO: 153514 - DNA, 25 bp, Homo sapien
gaggagtagcttgaagtggccagaa

SEQ ID NO: 153515 - DNA, 25 bp, Homo sapien
gagaaatccttttagcgccagcaag

SEQ ID NO: 153516 - DNA, 25 bp, Homo sapien
gaaatccttttagcgccagcaagcc

SEQ ID NO: 153517 - DNA, 25 bp, Homo sapien
tgtctgccaccacctttgtctgata

SEQ ID NO: 153518 - DNA, 25 bp, Homo sapien
caccacctttgtctgatacttgttt

SEQ ID NO: 153519 - DNA, 25 bp, Homo sapien
cacctttgtctgatacttgtttcca

SEQ ID NO: 153520 - DNA, 25 bp, Homo sapien
gtctgatacttgtttccagggaagc

SEQ ID NO: 153521 - DNA, 25 bp, Homo sapien
aagctgggggaactgccacatctga

SEQ ID NO: 153522 - DNA, 25 bp, Homo sapien
actctggccctcttgtcctttcaga

SEQ ID NO: 153523 - DNA, 25 bp, Homo sapien
gcaaataccaagatccatacaaaac

SEQ ID NO: 153524 - DNA, 25 bp, Homo sapien
ttattccactgatcaaccaagactg

SEQ ID NO: 153525 - DNA, 25 bp, Homo sapien
ccaagactggttctggttggacagc

SEQ ID NO: 153526 - DNA, 25 bp, Homo sapien
ggttggacagctaatctgatttggg

SEQ ID NO: 153527 - DNA, 25 bp, Homo sapien
gggattcactgtttcagaggacaca

SEQ ID NO: 153528 - DNA, 25 bp, Homo sapien
agctgttgcatcaaaactggacttt

SEQ ID NO: 153529 - DNA, 25 bp, Homo sapien
agtaatttctattgaactcctgtca

SEQ ID NO: 153530 - DNA, 25 bp, Homo sapien
gaactcctgtcaatatgtttatttc

SEQ ID NO: 153531 - DNA, 25 bp, Homo sapien
gtttatttcctctgtctacagcaga

SEQ ID NO: 153532 - DNA, 25 bp, Homo sapien
tctacagcagatgggagtcttctct

SEQ ID NO: 153533 - DNA, 25 bp, Homo sapien
ggaagaagaccccaggagccaagcc

SEQ ID NO: 153534 - DNA, 25 bp, Homo sapien
caagcccaccccttctttgtgtagg

SEQ ID NO: 153535 - DNA, 25 bp, Homo sapien
gggaccatggcctgttccgggacac

SEQ ID NO: 153536 - DNA, 25 bp, Homo sapien
ggcctgttccgggacactctgggca

SEQ ID NO: 153537 - DNA, 25 bp, Homo sapien
tgggcagggccctcgggacatctcc

SEQ ID NO: 153538 - DNA, 25 bp, Homo sapien
tccacccgatcctggagagctgtga

SEQ ID NO: 153539 - DNA, 25 bp, Homo sapien
agagctgtgaggatccattcagcct

SEQ ID NO: 153540 - DNA, 25 bp, Homo sapien
tgaggatccattcagcctgccagct

SEQ ID NO: 153541 - DNA, 25 bp, Homo sapien
tgccagctctggctggtcagagaca

SEQ ID NO: 153542 - DNA, 25 bp, Homo sapien
tggtcagagacaaggcagaactttt

SEQ ID NO: 153543 - DNA, 25 bp, Homo sapien
tgtgtgtatctgtgcgtgagtgtga

SEQ ID NO: 153544 - DNA, 25 bp, Homo sapien
aggcctgagctgcttcactagggaa

SEQ ID NO: 153545 - DNA, 25 bp, Homo sapien
gagctgcttcactagggaatcctgc

SEQ ID NO: 153546 - DNA, 25 bp, Homo sapien
ttcactagggaatcctgcggcagga

SEQ ID NO: 153547 - DNA, 25 bp, Homo sapien
atcctgcggcaggactgcagagcag

SEQ ID NO: 153548 - DNA, 25 bp, Homo sapien
gcagatggcagatgcacatgttgga

SEQ ID NO: 153549 - DNA, 25 bp, Homo sapien
gtcttcctctgcaagtgctcaggga

SEQ ID NO: 153550 - DNA, 25 bp, Homo sapien
gtgctcagggaaatggccttcccgc

SEQ ID NO: 153551 - DNA, 25 bp, Homo sapien
ggaggccagctatctgcctgacagg

SEQ ID NO: 153552 - DNA, 25 bp, Homo sapien
tatctgcctgacaggctgtgactct

SEQ ID NO: 153553 - DNA, 25 bp, Homo sapien
gcctgacaggctgtgactcttctct

SEQ ID NO: 153554 - DNA, 25 bp, Homo sapien
ctcttctgagctagttggttgaatt

SEQ ID NO: 153555 - DNA, 25 bp, Homo sapien
gggccttcttggagccgtgtgtgag

SEQ ID NO: 153556 - DNA, 25 bp, Homo sapien
tgagtgagtggtcgccacacagcat

SEQ ID NO: 153557 - DNA, 25 bp, Homo sapien
gagtggtcgccacacagcattgtac

SEQ ID NO: 153558 - DNA, 25 bp, Homo sapien
tcgccacacagcattgtacccagag

SEQ ID NO: 153559 - DNA, 25 bp, Homo sapien
cacagcattgtacccagagtctgtc

SEQ ID NO: 153560 - DNA, 25 bp, Homo sapien
gtctgtccccagacattgcacctgg

SEQ ID NO: 153561 - DNA, 25 bp, Homo sapien
cgcgatgccctgcagggctttaaga

SEQ ID NO: 153562 - DNA, 25 bp, Homo sapien
gccctgcagggctttaagatcacgc

SEQ ID NO: 153563 - DNA, 25 bp, Homo sapien
cagggctttaagatcacgcagaaca

SEQ ID NO: 153564 - DNA, 25 bp, Homo sapien
gatcacgcagaacaacgccatgaag

SEQ ID NO: 153565 - DNA, 25 bp, Homo sapien
ttgccaagaagtagcaccttttccc

SEQ ID NO: 153566 - DNA, 25 bp, Homo sapien
tacgctccctttaaacggtggattg

SEQ ID NO: 153567 - DNA, 25 bp, Homo sapien
gattcagaaatcctgtagcgtgtaa

SEQ ID NO: 153568 - DNA, 25 bp, Homo sapien
aatcctgtagcgtgtaataaaagaa

SEQ ID NO: 153569 - DNA, 25 bp, Homo sapien
aatggcatggaatcactgcctcctg

SEQ ID NO: 153570 - DNA, 25 bp, Homo sapien
gaatcactgcctcctgtgatttgaa

SEQ ID NO: 153571 - DNA, 25 bp, Homo sapien
actgcctcctgtgatttgaaggcca

SEQ ID NO: 153572 - DNA, 25 bp, Homo sapien
cctcctgtgatttgaaggccattgt

SEQ ID NO: 153573 - DNA, 25 bp, Homo sapien
gaaagttcttcatattaggacagat

SEQ ID NO: 153574 - DNA, 25 bp, Homo sapien
aggacagatatcattgcatcacatt

SEQ ID NO: 153575 - DNA, 25 bp, Homo sapien
cattgcatcacatttatttatcttt

SEQ ID NO: 153576 - DNA, 25 bp, Homo sapien
tatctttctgggtatttttatagcc

SEQ ID NO: 153577 - DNA, 25 bp, Homo sapien
tgacttctcaggcttaggtgacccc

SEQ ID NO: 153578 - DNA, 25 bp, Homo sapien
atcctcccaggtggctgaaactaca

SEQ ID NO: 153579 - DNA, 25 bp, Homo sapien
catgttgccaagctagtctacaaag

SEQ ID NO: 153580 - DNA, 25 bp, Homo sapien
gttgccaagctagtctacaaagcat

SEQ ID NO: 153581 - DNA, 25 bp, Homo sapien
gccaagctagtctacaaagcatctg

SEQ ID NO: 153582 - DNA, 25 bp, Homo sapien
gctagtctacaaagcatctgatttt

SEQ ID NO: 153583 - DNA, 25 bp, Homo sapien
gtctacaaagcatctgattttggaa

SEQ ID NO: 153584 - DNA, 25 bp, Homo sapien
atctgattttggaagtacatggaat

SEQ ID NO: 153585 - DNA, 25 bp, Homo sapien
gaagtacatggaattgttgtaacaa

SEQ ID NO: 153586 - DNA, 25 bp, Homo sapien
gtatattgaatggaaatggctctca

SEQ ID NO: 153587 - DNA, 25 bp, Homo sapien
aatggaaatggctctcatgtatttt

SEQ ID NO: 153588 - DNA, 25 bp, Homo sapien
gctgatattttgataacaatctcta

SEQ ID NO: 153589 - DNA, 25 bp, Homo sapien
aacaatctctaatttgcatgggcac

SEQ ID NO: 153590 - DNA, 25 bp, Homo sapien
atctctaatttgcatgggcaccaca

SEQ ID NO: 153591 - DNA, 25 bp, Homo sapien
tctaatttgcatgggcaccacattt

SEQ ID NO: 153592 - DNA, 25 bp, Homo sapien
atttgcatgggcaccacatttctta

SEQ ID NO: 153593 - DNA, 25 bp, Homo sapien
gcatgggcaccacatttcttatatt

SEQ ID NO: 153594 - DNA, 25 bp, Homo sapien
tgggcaccacatttcttatattaaa

SEQ ID NO: 153595 - DNA, 25 bp, Homo sapien
agaattagtgttttggcttctgtac

SEQ ID NO: 153596 - DNA, 25 bp, Homo sapien
ctgtactgcttatggttgtaggatt

SEQ ID NO: 153597 - DNA, 25 bp, Homo sapien
actgcttatggttgtaggattcagg

SEQ ID NO: 153598 - DNA, 25 bp, Homo sapien
tatgcagtacattatccaaaagaga

SEQ ID NO: 153599 - DNA, 25 bp, Homo sapien
aagatcgacagcaacctagatgagc

SEQ ID NO: 153600 - DNA, 25 bp, Homo sapien
tgtccatgggactgggtcgtctgaa

SEQ ID NO: 153601 - DNA, 25 bp, Homo sapien
gggtcgtctgaaggacatagccctg

SEQ ID NO: 153602 - DNA, 25 bp, Homo sapien
agatgacattcttgaccggctgaca

SEQ ID NO: 153603 - DNA, 25 bp, Homo sapien
attcttgaccggctgacaaccaaag

SEQ ID NO: 153604 - DNA, 25 bp, Homo sapien
tgaccggctgacaaccaaagtggac

SEQ ID NO: 153605 - DNA, 25 bp, Homo sapien
aagttcgacaactctgaagacagac

SEQ ID NO: 153606 - DNA, 25 bp, Homo sapien
gaagacagacggatttccactctat

SEQ ID NO: 153607 - DNA, 25 bp, Homo sapien
acggatttccactctattgtgatga

SEQ ID NO: 153608 - DNA, 25 bp, Homo sapien
tgaacttccaagaaatttcatttac

SEQ ID NO: 153609 - DNA, 25 bp, Homo sapien
taatgtgtgtttgcaaatgttataa

SEQ ID NO: 153610 - DNA, 25 bp, Homo sapien
tttctgtagccggaagatctccgtt

SEQ ID NO: 153611 - DNA, 25 bp, Homo sapien
ttctgtagccggaagatctccgttc

SEQ ID NO: 153612 - DNA, 25 bp, Homo sapien
tctgtagccggaagatctccgttcc

SEQ ID NO: 153613 - DNA, 25 bp, Homo sapien
tgtagccggaagatctccgttccgc

SEQ ID NO: 153614 - DNA, 25 bp, Homo sapien
gtagccggaagatctccgttccgct

SEQ ID NO: 153615 - DNA, 25 bp, Homo sapien
tagccggaagatctccgttccgctc

SEQ ID NO: 153616 - DNA, 25 bp, Homo sapien
gctcccagcggctccagtgtaaatt

SEQ ID NO: 153617 - DNA, 25 bp, Homo sapien
tcccagcggctccagtgtaaattcc

SEQ ID NO: 153618 - DNA, 25 bp, Homo sapien
gggaaatgcactaccttgttttggg

SEQ ID NO: 153619 - DNA, 25 bp, Homo sapien
gaaatgcactaccttgttttggggg

SEQ ID NO: 153620 - DNA, 25 bp, Homo sapien
ttttttagctcatttccaggggtgg

SEQ ID NO: 153621 - DNA, 25 bp, Homo sapien
gggtggtgctcgcctacctgcctct

SEQ ID NO: 153622 - DNA, 25 bp, Homo sapien
ctcccctctgtgcaagtggaatgtc

SEQ ID NO: 153623 - DNA, 25 bp, Homo sapien
cccctctgtgcaagtggaatgtctg

SEQ ID NO: 153624 - DNA, 25 bp, Homo sapien
tctgtgcaagtggaatgtctgccct

SEQ ID NO: 153625 - DNA, 25 bp, Homo sapien
tgtgcaagtggaatgtctgccctgt

SEQ ID NO: 153626 - DNA, 25 bp, Homo sapien
tctctgtcccttggcaaatggacac

SEQ ID NO: 153627 - DNA, 25 bp, Homo sapien
tgtcccttggcaaatggacaccagg

SEQ ID NO: 153628 - DNA, 25 bp, Homo sapien
ctcaaagccatacgcctctgggcgg

SEQ ID NO: 153629 - DNA, 25 bp, Homo sapien
aaagccatacgcctctgggcgggca

SEQ ID NO: 153630 - DNA, 25 bp, Homo sapien
aagccatacgcctctgggcgggcat

SEQ ID NO: 153631 - DNA, 25 bp, Homo sapien
cagccaggggcatggacagagcctt

SEQ ID NO: 153632 - DNA, 25 bp, Homo sapien
tgagtgagatcattggccgagacct

SEQ ID NO: 153633 - DNA, 25 bp, Homo sapien
gagtgagatcattggccgagacctg

SEQ ID NO: 153634 - DNA, 25 bp, Homo sapien
agatcattggccgagacctgagtgg

SEQ ID NO: 153635 - DNA, 25 bp, Homo sapien
atcattggccgagacctgagtggct

SEQ ID NO: 153636 - DNA, 25 bp, Homo sapien
tcattggccgagacctgagtggctt

SEQ ID NO: 153637 - DNA, 25 bp, Homo sapien
cattggccgagacctgagtggcttc

SEQ ID NO: 153638 - DNA, 25 bp, Homo sapien
attggccgagacctgagtggcttcc

SEQ ID NO: 153639 - DNA, 25 bp, Homo sapien
ttggccgagacctgagtggcttccc

SEQ ID NO: 153640 - DNA, 25 bp, Homo sapien
ggccgagacctgagtggcttccctg

SEQ ID NO: 153641 - DNA, 25 bp, Homo sapien
ccgagacctgagtggcttccctgca

SEQ ID NO: 153642 - DNA, 25 bp, Homo sapien
ctcctggagaagagcctcctgcctg

SEQ ID NO: 153643 - DNA, 25 bp, Homo sapien
actatgctgcccttttgacatcaaa

SEQ ID NO: 153644 - DNA, 25 bp, Homo sapien
aaagacctgctgacaatggaggcca

SEQ ID NO: 153645 - DNA, 25 bp, Homo sapien
tgctgacaatggaggccacgcctgc

SEQ ID NO: 153646 - DNA, 25 bp, Homo sapien
aacgcaagagaagaatccattgtct

SEQ ID NO: 153647 - DNA, 25 bp, Homo sapien
cattgtcttccaaagaaactatcga

SEQ ID NO: 153648 - DNA, 25 bp, Homo sapien
aaactatcgaacaggagaggcaagc

SEQ ID NO: 153649 - DNA, 25 bp, Homo sapien
gagaggcaagcaggcgaatcttaaa

SEQ ID NO: 153650 - DNA, 25 bp, Homo sapien
gcgaatcttaaacaggcatgtgcca

SEQ ID NO: 153651 - DNA, 25 bp, Homo sapien
gcatgtgccaccaatatctactgta

SEQ ID NO: 153652 - DNA, 25 bp, Homo sapien
tactgtacattctacaagcattgct

SEQ ID NO: 153653 - DNA, 25 bp, Homo sapien
cttggttagatgcaaacacgttgga

SEQ ID NO: 153654 - DNA, 25 bp, Homo sapien
ggaccaggccaaggttctggccaat

SEQ ID NO: 153655 - DNA, 25 bp, Homo sapien
aggccaaggttctggccaatctggc

SEQ ID NO: 153656 - DNA, 25 bp, Homo sapien
aaggttctggccaatctggcccacc

SEQ ID NO: 153657 - DNA, 25 bp, Homo sapien
cacccacctgcagagtgacggaggg

SEQ ID NO: 153658 - DNA, 25 bp, Homo sapien
tcccctgccttgctgttggtcatgt

SEQ ID NO: 153659 - DNA, 25 bp, Homo sapien
cctgccttgctgttggtcatgtggg

SEQ ID NO: 153660 - DNA, 25 bp, Homo sapien
gccttgctgttggtcatgtgggtct

SEQ ID NO: 153661 - DNA, 25 bp, Homo sapien
ggtcatgtgggtcttccagggagaa

SEQ ID NO: 153662 - DNA, 25 bp, Homo sapien
gtgggtcttccagggagaaggccaa

SEQ ID NO: 153663 - DNA, 25 bp, Homo sapien
ctctgggctatggacacagggtgac

SEQ ID NO: 153664 - DNA, 25 bp, Homo sapien
tgacggtgacaaagatggctcagag

SEQ ID NO: 153665 - DNA, 25 bp, Homo sapien
gggctgaaggtcagaagtaatcctg

SEQ ID NO: 153666 - DNA, 25 bp, Homo sapien
gctgaaggtcagaagtaatcctgag

SEQ ID NO: 153667 - DNA, 25 bp, Homo sapien
gaaggtcagaagtaatcctgagaaa

SEQ ID NO: 153668 - DNA, 25 bp, Homo sapien
gtcagaagtaatcctgagaaatgtt

SEQ ID NO: 153669 - DNA, 25 bp, Homo sapien
cgacgcctctgcaataactggacca

SEQ ID NO: 153670 - DNA, 25 bp, Homo sapien
ttctactctttctgccaagagcctg

SEQ ID NO: 153671 - DNA, 25 bp, Homo sapien
tctactctttctgccaagagcctgc

SEQ ID NO: 153672 - DNA, 25 bp, Homo sapien
agagcctgcccctgcatttgtcctg

SEQ ID NO: 153673 - DNA, 25 bp, Homo sapien
gaaacacggtatttaagagagaact

SEQ ID NO: 153674 - DNA, 25 bp, Homo sapien
aacacggtatttaagagagaactat

SEQ ID NO: 153675 - DNA, 25 bp, Homo sapien
cacggtatttaagagagaactatat

SEQ ID NO: 153676 - DNA, 25 bp, Homo sapien
attaacattcactttcaacgggcaa

SEQ ID NO: 153677 - DNA, 25 bp, Homo sapien
tttcaacgggcaaagaatggaggtg

SEQ ID NO: 153678 - DNA, 25 bp, Homo sapien
gtggtcaagtgttctctaggtcaac

SEQ ID NO: 153679 - DNA, 25 bp, Homo sapien
gtcaagtgttctctaggtcaacctc

SEQ ID NO: 153680 - DNA, 25 bp, Homo sapien
tgttctctaggtcaacctcacatag

SEQ ID NO: 153681 - DNA, 25 bp, Homo sapien
ggtcaacctcacatagcatactttg

SEQ ID NO: 153682 - DNA, 25 bp, Homo sapien
gcatactttgaagaatagacttaac

SEQ ID NO: 153683 - DNA, 25 bp, Homo sapien
acagaatcatgaaaactatagcttt

SEQ ID NO: 153684 - DNA, 25 bp, Homo sapien
tatagctttttaacccggattactg

SEQ ID NO: 153685 - DNA, 25 bp, Homo sapien
atttttaccatccatttatgtttag

SEQ ID NO: 153686 - DNA, 25 bp, Homo sapien
ttccatgtttctgaatcttctttgt

SEQ ID NO: 153687 - DNA, 25 bp, Homo sapien
tcaccttgggaaggcttgggagcca

SEQ ID NO: 153688 - DNA, 25 bp, Homo sapien
agtgtcgggctctcgtgtgtgcaaa

SEQ ID NO: 153689 - DNA, 25 bp, Homo sapien
gggctctcgtgtgtgcaaaaggtca

SEQ ID NO: 153690 - DNA, 25 bp, Homo sapien
ctcgtgtgtgcaaaaggtcagatgt

SEQ ID NO: 153691 - DNA, 25 bp, Homo sapien
ctgctgtttgcctggtttctgaccc

SEQ ID NO: 153692 - DNA, 25 bp, Homo sapien
gggtttgagcaatgcttctctgccc

SEQ ID NO: 153693 - DNA, 25 bp, Homo sapien
gcccttccatggaaagtggaaccag

SEQ ID NO: 153694 - DNA, 25 bp, Homo sapien
tggaaccagaaatggtgccaaggct

SEQ ID NO: 153695 - DNA, 25 bp, Homo sapien
ggagggcagggttcttttctctacg

SEQ ID NO: 153696 - DNA, 25 bp, Homo sapien
gcagggttcttttctctacgtgtca

SEQ ID NO: 153697 - DNA, 25 bp, Homo sapien
gttcttttctctacgtgtcatgtta

SEQ ID NO: 153698 - DNA, 25 bp, Homo sapien
caagatgtttaacagtaagtaacag

SEQ ID NO: 153699 - DNA, 25 bp, Homo sapien
aagatgtttaacagtaagtaacagt

SEQ ID NO: 153700 - DNA, 25 bp, Homo sapien
agatgtttaacagtaagtaacagta

SEQ ID NO: 153701 - DNA, 25 bp, Homo sapien
gatgtttaacagtaagtaacagtaa

SEQ ID NO: 153702 - DNA, 25 bp, Homo sapien
gtttaacagtaagtaacagtaaatg

SEQ ID NO: 153703 - DNA, 25 bp, Homo sapien
aagattcattttgggccgggctcag

SEQ ID NO: 153704 - DNA, 25 bp, Homo sapien
agattcattttgggccgggctcagt

SEQ ID NO: 153705 - DNA, 25 bp, Homo sapien
gattcattttgggccgggctcagtg

SEQ ID NO: 153706 - DNA, 25 bp, Homo sapien
gccgggagtggtgtcgggcgactgt

SEQ ID NO: 153707 - DNA, 25 bp, Homo sapien
ccgggagtggtgtcgggcgactgta

SEQ ID NO: 153708 - DNA, 25 bp, Homo sapien
gggagtggtgtcgggcgactgtagt

SEQ ID NO: 153709 - DNA, 25 bp, Homo sapien
aggaggttcgtgacattcggagcta

SEQ ID NO: 153710 - DNA, 25 bp, Homo sapien
attcggagctacctgacagagcagg

SEQ ID NO: 153711 - DNA, 25 bp, Homo sapien
aggtcaaccaggatctgcccaaaga

SEQ ID NO: 153712 - DNA, 25 bp, Homo sapien
atctgcccaaagaggtgttggctga

SEQ ID NO: 153713 - DNA, 25 bp, Homo sapien
aggccctggagagacgtgtgcacaa

SEQ ID NO: 153714 - DNA, 25 bp, Homo sapien
gtgacctgaggcctagtctagcaag

SEQ ID NO: 153715 - DNA, 25 bp, Homo sapien
gtctagcaagaggacatagcaccct

SEQ ID NO: 153716 - DNA, 25 bp, Homo sapien
gacatagcaccctcatctgggaata

SEQ ID NO: 153717 - DNA, 25 bp, Homo sapien
aatagggaaggcaccttgcagaaaa

SEQ ID NO: 153718 - DNA, 25 bp, Homo sapien
acatcttcaatgtgccatagacctt

SEQ ID NO: 153719 - DNA, 25 bp, Homo sapien
tagaccttcccacaaagactgtcca

SEQ ID NO: 153720 - DNA, 25 bp, Homo sapien
caagcccaccccttctttgtgtagg

SEQ ID NO: 153721 - DNA, 25 bp, Homo sapien
gggaccatggcctgttccgggacac

SEQ ID NO: 153722 - DNA, 25 bp, Homo sapien
ggcctgttccgggacactctgggca

SEQ ID NO: 153723 - DNA, 25 bp, Homo sapien
gggacatctccacccgatcctggag

SEQ ID NO: 153724 - DNA, 25 bp, Homo sapien
tccacccgatcctggagagctgtga

SEQ ID NO: 153725 - DNA, 25 bp, Homo sapien
agagctgtgaggatccattcagcct

SEQ ID NO: 153726 - DNA, 25 bp, Homo sapien
tgtgaggatccattcagcctgccag

SEQ ID NO: 153727 - DNA, 25 bp, Homo sapien
gatccattcagcctgccagctctgg

SEQ ID NO: 153728 - DNA, 25 bp, Homo sapien
ctggctggtcagagacaaggcagaa

SEQ ID NO: 153729 - DNA, 25 bp, Homo sapien
cagagacaaggcagaacttttggaa

SEQ ID NO: 153730 - DNA, 25 bp, Homo sapien
tgtgtgtatctgtgcgtgagtgtga

SEQ ID NO: 153731 - DNA, 25 bp, Homo sapien
aaagttaacattaggctgtggtgca

SEQ ID NO: 153732 - DNA, 25 bp, Homo sapien
aggctgtggtgcagtaaccatttaa

SEQ ID NO: 153733 - DNA, 25 bp, Homo sapien
aaccatttaatgtcgaggctctatt

SEQ ID NO: 153734 - DNA, 25 bp, Homo sapien
tgtcgaggctctatttcggaaatac

SEQ ID NO: 153735 - DNA, 25 bp, Homo sapien
atgttaaagtacgtggctgtcctct

SEQ ID NO: 153736 - DNA, 25 bp, Homo sapien
gtggctgtcctcttaagacactagt

SEQ ID NO: 153737 - DNA, 25 bp, Homo sapien
gagcaaagacttaatcatatcaact

SEQ ID NO: 153738 - DNA, 25 bp, Homo sapien
accatttcttatggaaaggtcctgt

SEQ ID NO: 153739 - DNA, 25 bp, Homo sapien
gccaagccatcacaggctctgcata

SEQ ID NO: 153740 - DNA, 25 bp, Homo sapien
atacacatgcactcagtgtggactg

SEQ ID NO: 153741 - DNA, 25 bp, Homo sapien
gtgtggactgggaagcattactttg

SEQ ID NO: 153742 - DNA, 25 bp, Homo sapien
agttgtgcatgtacccggctactta

SEQ ID NO: 153743 - DNA, 25 bp, Homo sapien
acccggctacttaggtatgcttagg

SEQ ID NO: 153744 - DNA, 25 bp, Homo sapien
ttcaggcctgctctcacagtgaaac

SEQ ID NO: 153745 - DNA, 25 bp, Homo sapien
gaaaccacttcaagacagggcagga

SEQ ID NO: 153746 - DNA, 25 bp, Homo sapien
gacagggcaggaagttaccttccct

SEQ ID NO: 153747 - DNA, 25 bp, Homo sapien
ctggtgcacacaccgaagtgctcga

SEQ ID NO: 153748 - DNA, 25 bp, Homo sapien
acacaccgaagtgctcgagggagag

SEQ ID NO: 153749 - DNA, 25 bp, Homo sapien
ttgctgcccgtgtccacacaggaat

SEQ ID NO: 153750 - DNA, 25 bp, Homo sapien
tgtccacacaggaatgtacactggt

SEQ ID NO: 153751 - DNA, 25 bp, Homo sapien
cacaggaatgtacactggtggcaga

SEQ ID NO: 153752 - DNA, 25 bp, Homo sapien
ggtggcagaaacatgcatttgccat

SEQ ID NO: 153753 - DNA, 25 bp, Homo sapien
tcagttgttcaaatcacgggatcca

SEQ ID NO: 153754 - DNA, 25 bp, Homo sapien
atcacgggatccattctggaacaga

SEQ ID NO: 153755 - DNA, 25 bp, Homo sapien
gaatgaagaagccactgcacctttt

SEQ ID NO: 153756 - DNA, 25 bp, Homo sapien
gaagccactgcaccttttggattgt

SEQ ID NO: 153757 - DNA, 25 bp, Homo sapien
tgttgagaatcccagccaagtttta

SEQ ID NO: 153758 - DNA, 25 bp, Homo sapien
tttacaaatctctgcctggatgctg

SEQ ID NO: 153759 - DNA, 25 bp, Homo sapien
gttaccttgttgagctccagtctat

SEQ ID NO: 153760 - DNA, 25 bp, Homo sapien
tccagtctatgagctcgtcagtagc

SEQ ID NO: 153761 - DNA, 25 bp, Homo sapien
gtcagtagcagtacaagccatcact

SEQ ID NO: 153762 - DNA, 25 bp, Homo sapien
gaacggcttcattaattactgtgat

SEQ ID NO: 153763 - DNA, 25 bp, Homo sapien
tgtgatatactttcatccgttttat

SEQ ID NO: 153764 - DNA, 25 bp, Homo sapien
gaatttaaatatgctctggtctggg

SEQ ID NO: 153765 - DNA, 25 bp, Homo sapien
gggtctctctgtgaaacacaatcct

SEQ ID NO: 153766 - DNA, 25 bp, Homo sapien
gggtaaagaccatacgttggaggat

SEQ ID NO: 153767 - DNA, 25 bp, Homo sapien
atgaggatgtcattcaaattgtgaa

SEQ ID NO: 153768 - DNA, 25 bp, Homo sapien
ctgccggacgaaccacaacagcgtt

SEQ ID NO: 153769 - DNA, 25 bp, Homo sapien
aacagcgttccccatgatcaagcac

SEQ ID NO: 153770 - DNA, 25 bp, Homo sapien
ggaggcacccaaactggaacttcat

SEQ ID NO: 153771 - DNA, 25 bp, Homo sapien
gaacttcatttgtcttaccttggtg

SEQ ID NO: 153772 - DNA, 25 bp, Homo sapien
atttgtcttaccttggtgtcacctt

SEQ ID NO: 153773 - DNA, 25 bp, Homo sapien
cttggtgtcaccttgtatgtcgaac

SEQ ID NO: 153774 - DNA, 25 bp, Homo sapien
gtcaccttgtatgtcgaactgcata

SEQ ID NO: 153775 - DNA, 25 bp, Homo sapien
tcaagttaagggacacgttagaaat

SEQ ID NO: 153776 - DNA, 25 bp, Homo sapien
ggacacgttagaaatagaacagctt

SEQ ID NO: 153777 - DNA, 25 bp, Homo sapien
agaacagcttaatatcactggcttc

SEQ ID NO: 153778 - DNA, 25 bp, Homo sapien
aaatgagctcgggtgactgcagatt

SEQ ID NO: 153779 - DNA, 25 bp, Homo sapien
agctcgggtgactgcagattatgat

SEQ ID NO: 153780 - DNA, 25 bp, Homo sapien
ggctttaattacaaacatgaggaat

SEQ ID NO: 153781 - DNA, 25 bp, Homo sapien
gaatgatggctaaggtgttccaagt

SEQ ID NO: 153782 - DNA, 25 bp, Homo sapien
ggtgttccaagtattccatctttta

SEQ ID NO: 153783 - DNA, 25 bp, Homo sapien
attgcttaattaattgcctcgctac

SEQ ID NO: 153784 - DNA, 25 bp, Homo sapien
aattaattgcctcgctaccccagga

SEQ ID NO: 153785 - DNA, 25 bp, Homo sapien
taccccaggattctcattctttgga

SEQ ID NO: 153786 - DNA, 25 bp, Homo sapien
ctgtggcgaagttacctggggatcc

SEQ ID NO: 153787 - DNA, 25 bp, Homo sapien
ccgtgctggcgggattgggcatggg

SEQ ID NO: 153788 - DNA, 25 bp, Homo sapien
gcgctgctcccaaagatttctgact

SEQ ID NO: 153789 - DNA, 25 bp, Homo sapien
ctgctcccaaagatttctgactcat

SEQ ID NO: 153790 - DNA, 25 bp, Homo sapien
gatttctgactcatctgccagctct

SEQ ID NO: 153791 - DNA, 25 bp, Homo sapien
tgactcatctgccagctctgtcctg

SEQ ID NO: 153792 - DNA, 25 bp, Homo sapien
tctgtcctgcatgcctggcgagctg

SEQ ID NO: 153793 - DNA, 25 bp, Homo sapien
agagccctgcgttctgtgcttctta

SEQ ID NO: 153794 - DNA, 25 bp, Homo sapien
tgcgttctgtgcttcttaccagagg

SEQ ID NO: 153795 - DNA, 25 bp, Homo sapien
gttctgtgcttcttaccagaggttt

SEQ ID NO: 153796 - DNA, 25 bp, Homo sapien
tctgtgcttcttaccagaggtttgc

SEQ ID NO: 153797 - DNA, 25 bp, Homo sapien
cgcagcgttactgcctgtgtatagt

SEQ ID NO: 153798 - DNA, 25 bp, Homo sapien
gcgttactgcctgtgtatagtataa

SEQ ID NO: 153799 - DNA, 25 bp, Homo sapien
gatgtataatataaggctccacaaa

SEQ ID NO: 153800 - DNA, 25 bp, Homo sapien
tataaggctccacaaatatatctgt

SEQ ID NO: 153801 - DNA, 25 bp, Homo sapien
tgtgtgcggtgaagggcggtcccca

SEQ ID NO: 153802 - DNA, 25 bp, Homo sapien
ccaccacctggttaagtctcgagtg

SEQ ID NO: 153803 - DNA, 25 bp, Homo sapien
aagtctcgagtgaatccagtggccc

SEQ ID NO: 153804 - DNA, 25 bp, Homo sapien
gagtgaatccagtggccccgtggca

SEQ ID NO: 153805 - DNA, 25 bp, Homo sapien
ttatgacatccatccatctgtggtg

SEQ ID NO: 153806 - DNA, 25 bp, Homo sapien
tccatccatctgtggtgaaccaagt

SEQ ID NO: 153807 - DNA, 25 bp, Homo sapien
ccaagtgaaggtggtgacttctggt

SEQ ID NO: 153808 - DNA, 25 bp, Homo sapien
gatttaccagactgtcttttcactg

SEQ ID NO: 153809 - DNA, 25 bp, Homo sapien
gtgggttttgtagaagttacacatt

SEQ ID NO: 153810 - DNA, 25 bp, Homo sapien
ttctatacaagtactcactcccttt

SEQ ID NO: 153811 - DNA, 25 bp, Homo sapien
caagtactcactccctttttatcaa

SEQ ID NO: 153812 - DNA, 25 bp, Homo sapien
aatctcacagtctacattgtgctac

SEQ ID NO: 153813 - DNA, 25 bp, Homo sapien
attgtgctacattatccagcttctt

SEQ ID NO: 153814 - DNA, 25 bp, Homo sapien
ccagcttctttggaacaatgtgtgc

SEQ ID NO: 153815 - DNA, 25 bp, Homo sapien
caatgtgtgctctgtatggtttttt

SEQ ID NO: 153816 - DNA, 25 bp, Homo sapien
gacaactaattaagcaactgacatt

SEQ ID NO: 153817 - DNA, 25 bp, Homo sapien
gcaactgacattgaactgagaattc

SEQ ID NO: 153818 - DNA, 25 bp, Homo sapien
aatttagttttgtggctgggcattc

SEQ ID NO: 153819 - DNA, 25 bp, Homo sapien
ggccctggacccgtcaggtgcctgt

SEQ ID NO: 153820 - DNA, 25 bp, Homo sapien
ccccgcttgccgtgtaatggttcag

SEQ ID NO: 153821 - DNA, 25 bp, Homo sapien
cttgccgtgtaatggttcagctaat

SEQ ID NO: 153822 - DNA, 25 bp, Homo sapien
gccgtgtaatggttcagctaatccc

SEQ ID NO: 153823 - DNA, 25 bp, Homo sapien
ggttcagctaatcccatggcgagat

SEQ ID NO: 153824 - DNA, 25 bp, Homo sapien
ttcagctaatcccatggcgagatgg

SEQ ID NO: 153825 - DNA, 25 bp, Homo sapien
gcagcagggccttcctgaccaacag

SEQ ID NO: 153826 - DNA, 25 bp, Homo sapien
ttgtgtgatcatgtatagacctcag

SEQ ID NO: 153827 - DNA, 25 bp, Homo sapien
gatcatgtatagacctcagaacgga

SEQ ID NO: 153828 - DNA, 25 bp, Homo sapien
tgtatagacctcagaacggaagata

SEQ ID NO: 153829 - DNA, 25 bp, Homo sapien
acctcagaacggaagataggactgt

SEQ ID NO: 153830 - DNA, 25 bp, Homo sapien
gggtgatgatcggagactacttact

SEQ ID NO: 153831 - DNA, 25 bp, Homo sapien
agactacttactttctccagtggac

SEQ ID NO: 153832 - DNA, 25 bp, Homo sapien
ttactttctccagtggacctgggaa

SEQ ID NO: 153833 - DNA, 25 bp, Homo sapien
tgggaaccctcaggtctctaggtga

SEQ ID NO: 153834 - DNA, 25 bp, Homo sapien
caggtctctaggtgagggtcttgat

SEQ ID NO: 153835 - DNA, 25 bp, Homo sapien
gtaggtcctaagactttacagtgta

SEQ ID NO: 153836 - DNA, 25 bp, Homo sapien
ttacagtgtaacatcctctctggtc

SEQ ID NO: 153837 - DNA, 25 bp, Homo sapien
taacatcctctctggtccttttctg

SEQ ID NO: 153838 - DNA, 25 bp, Homo sapien
gtgttcctagttttgtacagacttg

SEQ ID NO: 153839 - DNA, 25 bp, Homo sapien
ttcattttcattgttgtctccttcc

SEQ ID NO: 153840 - DNA, 25 bp, Homo sapien
tctgtgaaagtcctcatactgagaa

SEQ ID NO: 153841 - DNA, 25 bp, Homo sapien
aacagtggttgtgtggtaagatata

SEQ ID NO: 153842 - DNA, 25 bp, Homo sapien
gtgtggtaagatataggtgattttt

SEQ ID NO: 153843 - DNA, 25 bp, Homo sapien
ttctcattttttcaggacaaacgtt

SEQ ID NO: 153844 - DNA, 25 bp, Homo sapien
aatcacacaattttgaagaaaactg

SEQ ID NO: 153845 - DNA, 25 bp, Homo sapien
gaagaaaactgtcaatcagcttata

SEQ ID NO: 153846 - DNA, 25 bp, Homo sapien
aaaactgtcaatcagcttataacga

SEQ ID NO: 153847 - DNA, 25 bp, Homo sapien
ttttcaaatggtatatatgtatccc

SEQ ID NO: 153848 - DNA, 25 bp, Homo sapien
ggtatatatgtatcccattttgtaa

SEQ ID NO: 153849 - DNA, 25 bp, Homo sapien
aaagtatagacttcaaaggcataac

SEQ ID NO: 153850 - DNA, 25 bp, Homo sapien
gacttcaaaggcataacagtggttg

SEQ ID NO: 153851 - DNA, 25 bp, Homo sapien
aggcataacagtggttgtgtggtaa

SEQ ID NO: 153852 - DNA, 25 bp, Homo sapien
tttctgctgctctctgtcagagctc

SEQ ID NO: 153853 - DNA, 25 bp, Homo sapien
gctgctctctgtcagagctcttcat

SEQ ID NO: 153854 - DNA, 25 bp, Homo sapien
tgctctctgtcagagctcttcatgt

SEQ ID NO: 153855 - DNA, 25 bp, Homo sapien
tctctgtcagagctcttcatgtcct

SEQ ID NO: 153856 - DNA, 25 bp, Homo sapien
tgtcagagctcttcatgtcctcttt

SEQ ID NO: 153857 - DNA, 25 bp, Homo sapien
agagctcttcatgtcctctttccag

SEQ ID NO: 153858 - DNA, 25 bp, Homo sapien
tcttcatgtcctctttccagtccta

SEQ ID NO: 153859 - DNA, 25 bp, Homo sapien
atgtcctctttccagtcctacggag

SEQ ID NO: 153860 - DNA, 25 bp, Homo sapien
agctgacaccccagaagtgctctga

SEQ ID NO: 153861 - DNA, 25 bp, Homo sapien
ctgacaccccagaagtgctctgaac

SEQ ID NO: 153862 - DNA, 25 bp, Homo sapien
cccagaagtgctctgaaccccaatc

SEQ ID NO: 153863 - DNA, 25 bp, Homo sapien
tgaggtgctgcaggccagtgataat

SEQ ID NO: 153864 - DNA, 25 bp, Homo sapien
gctgcaggccagtgataatgcaata

SEQ ID NO: 153865 - DNA, 25 bp, Homo sapien
ataatgcaatagagtccctggacgg

SEQ ID NO: 153866 - DNA, 25 bp, Homo sapien
ggctgcaggagctgctactgtgcaa

SEQ ID NO: 153867 - DNA, 25 bp, Homo sapien
gcaggagctgctactgtgcaacaac

SEQ ID NO: 153868 - DNA, 25 bp, Homo sapien
aggagctgctactgtgcaacaaccg

SEQ ID NO: 153869 - DNA, 25 bp, Homo sapien
tgcagggtaacccgctgtgccaagc

SEQ ID NO: 153870 - DNA, 25 bp, Homo sapien
atcttggagcaactggctgaactgc

SEQ ID NO: 153871 - DNA, 25 bp, Homo sapien
cttggagcaactggctgaactgctg

SEQ ID NO: 153872 - DNA, 25 bp, Homo sapien
ctgaactgctgccttcagttagcag

SEQ ID NO: 153873 - DNA, 25 bp, Homo sapien
agttagcagcgtcctcacctaagag

SEQ ID NO: 153874 - DNA, 25 bp, Homo sapien
gttgctatttgatatcacactctac

SEQ ID NO: 153875 - DNA, 25 bp, Homo sapien
atttgatggtggttgctaagcagcc

SEQ ID NO: 153876 - DNA, 25 bp, Homo sapien
gctaagcagccattgcacagagcat

SEQ ID NO: 153877 - DNA, 25 bp, Homo sapien
gagcataagtctactgggtgccttt

SEQ ID NO: 153878 - DNA, 25 bp, Homo sapien
tactgggtgcctttacatgccagag

SEQ ID NO: 153879 - DNA, 25 bp, Homo sapien
acatgccagaggctgatgctgcact

SEQ ID NO: 153880 - DNA, 25 bp, Homo sapien
gctgatgctgcactgttgatgtcat

SEQ ID NO: 153881 - DNA, 25 bp, Homo sapien
ataatgcacatgctctaactgctca

SEQ ID NO: 153882 - DNA, 25 bp, Homo sapien
aaacttgatcaacgcgactgtattt

SEQ ID NO: 153883 - DNA, 25 bp, Homo sapien
ggttacttcttgtcaaacttgcctg

SEQ ID NO: 153884 - DNA, 25 bp, Homo sapien
aacttgcctggcagtgtttgttcaa

SEQ ID NO: 153885 - DNA, 25 bp, Homo sapien
gagcaccaagacagacagccgggat

SEQ ID NO: 153886 - DNA, 25 bp, Homo sapien
cagacagccgggataaacccctgaa

SEQ ID NO: 153887 - DNA, 25 bp, Homo sapien
aaacccctgaaggatgtgatcatcg

SEQ ID NO: 153888 - DNA, 25 bp, Homo sapien
atgtgatcatcgcagactgcggcaa

SEQ ID NO: 153889 - DNA, 25 bp, Homo sapien
gagtagggcacagggacatctttct

SEQ ID NO: 153890 - DNA, 25 bp, Homo sapien
gggacatctttctttgagtgaccgt

SEQ ID NO: 153891 - DNA, 25 bp, Homo sapien
agtgaccgtctgtgcaggccctgta

SEQ ID NO: 153892 - DNA, 25 bp, Homo sapien
tgtagtccgccacagggctctgagc

SEQ ID NO: 153893 - DNA, 25 bp, Homo sapien
cacaggcccatggactcacttttgt

SEQ ID NO: 153894 - DNA, 25 bp, Homo sapien
tgtaacaaactcctaccaacactga

SEQ ID NO: 153895 - DNA, 25 bp, Homo sapien
ctcctaccaacactgaccaataaaa

SEQ ID NO: 153896 - DNA, 25 bp, Homo sapien
aaatcactggcaaagggtacccctg

SEQ ID NO: 153897 - DNA, 25 bp, Homo sapien
ggtacccctgcaaacaactgtggtg

SEQ ID NO: 153898 - DNA, 25 bp, Homo sapien
tggcagggcttctaatgctcagggt

SEQ ID NO: 153899 - DNA, 25 bp, Homo sapien
agggcttctaatgctcagggttctg

SEQ ID NO: 153900 - DNA, 25 bp, Homo sapien
ttccggcaaggagaggcacacatgt

SEQ ID NO: 153901 - DNA, 25 bp, Homo sapien
aggcacacatgtgctgcagccgtgt

SEQ ID NO: 153902 - DNA, 25 bp, Homo sapien
acatgtgctgcagccgtgtgtgtgc

SEQ ID NO: 153903 - DNA, 25 bp, Homo sapien
tgtgtgcacgcacaggaagcctttc

SEQ ID NO: 153904 - DNA, 25 bp, Homo sapien
gcacaggaagcctttccacatatca

SEQ ID NO: 153905 - DNA, 25 bp, Homo sapien
agcctttccacatatcacctcattt

SEQ ID NO: 153906 - DNA, 25 bp, Homo sapien
ctacaaggtgccaagaaggttttat

SEQ ID NO: 153907 - DNA, 25 bp, Homo sapien
gaaccactgagtaaggggcgcccat

SEQ ID NO: 153908 - DNA, 25 bp, Homo sapien
ctatctccctgagcagcaactaagt

SEQ ID NO: 153909 - DNA, 25 bp, Homo sapien
atctccctgagcagcaactaagttt

SEQ ID NO: 153910 - DNA, 25 bp, Homo sapien
ctccctgagcagcaactaagtttag

SEQ ID NO: 153911 - DNA, 25 bp, Homo sapien
tgagcagcaactaagtttaggccca

SEQ ID NO: 153912 - DNA, 25 bp, Homo sapien
gcagcaactaagtttaggcccagct

SEQ ID NO: 153913 - DNA, 25 bp, Homo sapien
agcaactaagtttaggcccagctgc

SEQ ID NO: 153914 - DNA, 25 bp, Homo sapien
caactaagtttaggcccagctgcca

SEQ ID NO: 153915 - DNA, 25 bp, Homo sapien
tcaccagcagggtgcttcccatgtt

SEQ ID NO: 153916 - DNA, 25 bp, Homo sapien
accagcagggtgcttcccatgttga

SEQ ID NO: 153917 - DNA, 25 bp, Homo sapien
agcagggtgcttcccatgttgatga

SEQ ID NO: 153918 - DNA, 25 bp, Homo sapien
ggatcaagcatgaaaggcttttaaa

SEQ ID NO: 153919 - DNA, 25 bp, Homo sapien
gcttttaaattagatcatcccacag

SEQ ID NO: 153920 - DNA, 25 bp, Homo sapien
atcatcccacagacaatacgtttga

SEQ ID NO: 153921 - DNA, 25 bp, Homo sapien
aacctctttaagtattgattctgct

SEQ ID NO: 153922 - DNA, 25 bp, Homo sapien
gaagtacttgccagaagttgtggat

SEQ ID NO: 153923 - DNA, 25 bp, Homo sapien
gtggagaagcacactctggtcttgg

SEQ ID NO: 153924 - DNA, 25 bp, Homo sapien
aagcacactctggtcttggaattcc

SEQ ID NO: 153925 - DNA, 25 bp, Homo sapien
acactctggtcttggaattccattt

SEQ ID NO: 153926 - DNA, 25 bp, Homo sapien
ggtcttggaattccatttgaggatt

SEQ ID NO: 153927 - DNA, 25 bp, Homo sapien
aagtgtcatgtttataactattcag

SEQ ID NO: 153928 - DNA, 25 bp, Homo sapien
gtttgttgctggcttgttgtaaagc

SEQ ID NO: 153929 - DNA, 25 bp, Homo sapien
tccctggacggcgtcaccaacctac

SEQ ID NO: 153930 - DNA, 25 bp, Homo sapien
tggacggcgtcaccaacctaccccg

SEQ ID NO: 153931 - DNA, 25 bp, Homo sapien
gtcaccaacctaccccggctgcagg

SEQ ID NO: 153932 - DNA, 25 bp, Homo sapien
caggagctgctactgtgcaacaacc

SEQ ID NO: 153933 - DNA, 25 bp, Homo sapien
aggagctgctactgtgcaacaaccg

SEQ ID NO: 153934 - DNA, 25 bp, Homo sapien
agcctgcagtgctccagcctcttgc

SEQ ID NO: 153935 - DNA, 25 bp, Homo sapien
ctgcagggtaacccgctgtgccaag

SEQ ID NO: 153936 - DNA, 25 bp, Homo sapien
tgcagggtaacccgctgtgccaagc

SEQ ID NO: 153937 - DNA, 25 bp, Homo sapien
atcttggagcaactggctgaactgc

SEQ ID NO: 153938 - DNA, 25 bp, Homo sapien
tcttggagcaactggctgaactgct

SEQ ID NO: 153939 - DNA, 25 bp, Homo sapien
cttggagcaactggctgaactgctg

SEQ ID NO: 153940 - DNA, 25 bp, Homo sapien
atgcttgttgtttcacatgatacat

SEQ ID NO: 153941 - DNA, 25 bp, Homo sapien
atacatttagggtatgcagctcctt

SEQ ID NO: 153942 - DNA, 25 bp, Homo sapien
gtatgcagctccttttgtagttttt

SEQ ID NO: 153943 - DNA, 25 bp, Homo sapien
tttaatcaatgtgttctcttcggtg

SEQ ID NO: 153944 - DNA, 25 bp, Homo sapien
gttctcttcggtgatatatattgca

SEQ ID NO: 153945 - DNA, 25 bp, Homo sapien
gggtgaaaaccgtagcctttgcatt

SEQ ID NO: 153946 - DNA, 25 bp, Homo sapien
aaaaccgtagcctttgcattctcta

SEQ ID NO: 153947 - DNA, 25 bp, Homo sapien
gcctttgcattctctatagcctctg

SEQ ID NO: 153948 - DNA, 25 bp, Homo sapien
gcctctgcagagagatactaagcag

SEQ ID NO: 153949 - DNA, 25 bp, Homo sapien
gatactaagcagcaaaatcttggtg

SEQ ID NO: 153950 - DNA, 25 bp, Homo sapien
aaatcttggtgttgtgatgtacaga

SEQ ID NO: 153951 - DNA, 25 bp, Homo sapien
ttttccccagttgaggatccagatt

SEQ ID NO: 153952 - DNA, 25 bp, Homo sapien
ggatccagatttataacttctagaa

SEQ ID NO: 153953 - DNA, 25 bp, Homo sapien
ctagaaagccatttccagaaggttc

SEQ ID NO: 153954 - DNA, 25 bp, Homo sapien
agaaggttctatgtggcacacccct

SEQ ID NO: 153955 - DNA, 25 bp, Homo sapien
ctatgtggcacacccctaggaaagg

SEQ ID NO: 153956 - DNA, 25 bp, Homo sapien
ggcactaaatgcatgcaaaggattt

SEQ ID NO: 153957 - DNA, 25 bp, Homo sapien
actggttctgggttaatatctctac

SEQ ID NO: 153958 - DNA, 25 bp, Homo sapien
gggttaatatctctacatctgtctt

SEQ ID NO: 153959 - DNA, 25 bp, Homo sapien
ttgatgactcatttctcctaactcc

SEQ ID NO: 153960 - DNA, 25 bp, Homo sapien
tcctaactcccatttagtgcagggt

SEQ ID NO: 153961 - DNA, 25 bp, Homo sapien
agatgtattagaagtcctgactttc

SEQ ID NO: 153962 - DNA, 25 bp, Homo sapien
tgcgccgagccctgtctggtccatg

SEQ ID NO: 153963 - DNA, 25 bp, Homo sapien
tctggtccatgccagctgtggagcc

SEQ ID NO: 153964 - DNA, 25 bp, Homo sapien
gtccatgccagctgtggagcctgac

SEQ ID NO: 153965 - DNA, 25 bp, Homo sapien
gagcctgaccctgtccgtggcagag

SEQ ID NO: 153966 - DNA, 25 bp, Homo sapien
gtggcagagctaggcctgggctacg

SEQ ID NO: 153967 - DNA, 25 bp, Homo sapien
ctgggctacgcctcagaggagaagg

SEQ ID NO: 153968 - DNA, 25 bp, Homo sapien
gaggagaaggtcatcttccgctact

SEQ ID NO: 153969 - DNA, 25 bp, Homo sapien
gagaaggtcatcttccgctactgcg

SEQ ID NO: 153970 - DNA, 25 bp, Homo sapien
gaaggtcatcttccgctactgcgcc

SEQ ID NO: 153971 - DNA, 25 bp, Homo sapien
agggccagggccgagcccacggtgg

SEQ ID NO: 153972 - DNA, 25 bp, Homo sapien
tcgatgaccgccaccgctggcagcg

SEQ ID NO: 153973 - DNA, 25 bp, Homo sapien
tctttaccaaggcaactcaacacct

SEQ ID NO: 153974 - DNA, 25 bp, Homo sapien
tttctctgggcttgaaccgccactg

SEQ ID NO: 153975 - DNA, 25 bp, Homo sapien
gctcacgtgggctttacatacattg

SEQ ID NO: 153976 - DNA, 25 bp, Homo sapien
ggctttacatacattgaccttccat

SEQ ID NO: 153977 - DNA, 25 bp, Homo sapien
gaccttccattcactgcagtgggaa

SEQ ID NO: 153978 - DNA, 25 bp, Homo sapien
agggagaggttttctagtctgcaaa

SEQ ID NO: 153979 - DNA, 25 bp, Homo sapien
aaaccacatgtcataggcccttgag

SEQ ID NO: 153980 - DNA, 25 bp, Homo sapien
ggcccttgagggaaagctacttgat

SEQ ID NO: 153981 - DNA, 25 bp, Homo sapien
ttgaaaccgtgcttcagaatcccag

SEQ ID NO: 153982 - DNA, 25 bp, Homo sapien
ttcagaatcccagcacatagtaaaa

SEQ ID NO: 153983 - DNA, 25 bp, Homo sapien
atacctgtcaagaagctgtgaacac

SEQ ID NO: 153984 - DNA, 25 bp, Homo sapien
acatatttcatccaaatcaagctaa

SEQ ID NO: 153985 - DNA, 25 bp, Homo sapien
ttgattctgagagtacaggtcagta

SEQ ID NO: 153986 - DNA, 25 bp, Homo sapien
gagagtacaggtcagtaagcctcat

SEQ ID NO: 153987 - DNA, 25 bp, Homo sapien
gtacaggtcagtaagcctcattatt

SEQ ID NO: 153988 - DNA, 25 bp, Homo sapien
ggtcagtaagcctcattatttggaa

SEQ ID NO: 153989 - DNA, 25 bp, Homo sapien
gtaagcctcattatttggaatttga

SEQ ID NO: 153990 - DNA, 25 bp, Homo sapien
ttatcattttgcctaaaataggata

SEQ ID NO: 153991 - DNA, 25 bp, Homo sapien
ataagtagactgtttttatgtgtga

SEQ ID NO: 153992 - DNA, 25 bp, Homo sapien
ttatgtgtgaattatatttctacta

SEQ ID NO: 153993 - DNA, 25 bp, Homo sapien
actaaatgtttttgtatgactgtgt

SEQ ID NO: 153994 - DNA, 25 bp, Homo sapien
ttttgtatgactgtgttatacttga

SEQ ID NO: 153995 - DNA, 25 bp, Homo sapien
gaatttggaccccagcacagtggct

SEQ ID NO: 153996 - DNA, 25 bp, Homo sapien
aatttggaccccagcacagtggctc

SEQ ID NO: 153997 - DNA, 25 bp, Homo sapien
tggaaggatcacttagagctaggag

SEQ ID NO: 153998 - DNA, 25 bp, Homo sapien
aaggatcacttagagctaggagttt

SEQ ID NO: 153999 - DNA, 25 bp, Homo sapien
aggatcacttagagctaggagtttg

SEQ ID NO: 154000 - DNA, 25 bp, Homo sapien
atatagcaagacccctcactacaaa

SEQ ID NO: 154001 - DNA, 25 bp, Homo sapien
gcaagacccctcactacaaaaataa

SEQ ID NO: 154002 - DNA, 25 bp, Homo sapien
ggagttcgaagctgcagggacctct

SEQ ID NO: 154003 - DNA, 25 bp, Homo sapien
tgcagggacctctgattgcaccact

SEQ ID NO: 154004 - DNA, 25 bp, Homo sapien
gcagggacctctgattgcaccactg

SEQ ID NO: 154005 - DNA, 25 bp, Homo sapien
cagggacctctgattgcaccactgc

SEQ ID NO: 154006 - DNA, 25 bp, Homo sapien
tcacaccttgatttcactcccaccc

SEQ ID NO: 154007 - DNA, 25 bp, Homo sapien
cctctggcttcaaagcctaaccaag

SEQ ID NO: 154008 - DNA, 25 bp, Homo sapien
ctctggcttcaaagcctaaccaagg

SEQ ID NO: 154009 - DNA, 25 bp, Homo sapien
tctggcttcaaagcctaaccaaggc

SEQ ID NO: 154010 - DNA, 25 bp, Homo sapien
tggcttcaaagcctaaccaaggctg

SEQ ID NO: 154011 - DNA, 25 bp, Homo sapien
ggcttcaaagcctaaccaaggctgc

SEQ ID NO: 154012 - DNA, 25 bp, Homo sapien
gcttcaaagcctaaccaaggctgct

SEQ ID NO: 154013 - DNA, 25 bp, Homo sapien
cttcaaagcctaaccaaggctgctg

SEQ ID NO: 154014 - DNA, 25 bp, Homo sapien
ttcaaagcctaaccaaggctgctgg

SEQ ID NO: 154015 - DNA, 25 bp, Homo sapien
tcaaagcctaaccaaggctgctggg

SEQ ID NO: 154016 - DNA, 25 bp, Homo sapien
caaagcctaaccaaggctgctggga

SEQ ID NO: 154017 - DNA, 25 bp, Homo sapien
ggaccggttcaggaccatggtcaac

SEQ ID NO: 154018 - DNA, 25 bp, Homo sapien
atggtcaacgtccttggtgatgctt

SEQ ID NO: 154019 - DNA, 25 bp, Homo sapien
gagctggagcagatggatgtttcat

SEQ ID NO: 154020 - DNA, 25 bp, Homo sapien
atggatgtttcatctgaagtcaaca

SEQ ID NO: 154021 - DNA, 25 bp, Homo sapien
aacattgtgaatccctttgccttgg

SEQ ID NO: 154022 - DNA, 25 bp, Homo sapien
gccttggaatccacaatccttgaca

SEQ ID NO: 154023 - DNA, 25 bp, Homo sapien
atccttgacaacgaagactcagaca

SEQ ID NO: 154024 - DNA, 25 bp, Homo sapien
caagaagtcttatgtcaatggaggc

SEQ ID NO: 154025 - DNA, 25 bp, Homo sapien
tcaatggaggctttgcagtagacaa

SEQ ID NO: 154026 - DNA, 25 bp, Homo sapien
agacaagtctgacaccatctcattc

SEQ ID NO: 154027 - DNA, 25 bp, Homo sapien
agacctcacagttctagggcccctg

SEQ ID NO: 154028 - DNA, 25 bp, Homo sapien
gcatgtgttggcaaaggctgttaat

SEQ ID NO: 154029 - DNA, 25 bp, Homo sapien
tagtagttaagtgttaagactgctt

SEQ ID NO: 154030 - DNA, 25 bp, Homo sapien
gactgcttttctttaacgttttcat

SEQ ID NO: 154031 - DNA, 25 bp, Homo sapien
tgcttttctttaacgttttcatggt

SEQ ID NO: 154032 - DNA, 25 bp, Homo sapien
tttcatggtaatgcatatttagagc

SEQ ID NO: 154033 - DNA, 25 bp, Homo sapien
atatttagagcactgtatttttgtc

SEQ ID NO: 154034 - DNA, 25 bp, Homo sapien
taattctgtcacagcctgtatattt

SEQ ID NO: 154035 - DNA, 25 bp, Homo sapien
tcacagcctgtatattttagtcatt

SEQ ID NO: 154036 - DNA, 25 bp, Homo sapien
atctcttcatacaatagtgacttct

SEQ ID NO: 154037 - DNA, 25 bp, Homo sapien
gacttcttttttgactgatacagta

SEQ ID NO: 154038 - DNA, 25 bp, Homo sapien
tacaaggttattttgtacttgtctt

SEQ ID NO: 154039 - DNA, 25 bp, Homo sapien
aatacactgacacgctactgttggt

SEQ ID NO: 154040 - DNA, 25 bp, Homo sapien
ctgacacgctactgttggttaaatt

SEQ ID NO: 154041 - DNA, 25 bp, Homo sapien
atgttttacctgcagaaattctctc

SEQ ID NO: 154042 - DNA, 25 bp, Homo sapien
agaaattctctcacaaataacctgc

SEQ ID NO: 154043 - DNA, 25 bp, Homo sapien
acttgaaatgcatacccttttgaac

SEQ ID NO: 154044 - DNA, 25 bp, Homo sapien
gtttgctgcattttgcaaaatgtca

SEQ ID NO: 154045 - DNA, 25 bp, Homo sapien
gtcaattctctaaaaatgtgtccgt

SEQ ID NO: 154046 - DNA, 25 bp, Homo sapien
gtgtccgtatatttctgtacctgca

SEQ ID NO: 154047 - DNA, 25 bp, Homo sapien
tttctgtacctgcagtgtagtaaag

SEQ ID NO: 154048 - DNA, 25 bp, Homo sapien
tagacgaaaccccataattatagtg

SEQ ID NO: 154049 - DNA, 25 bp, Homo sapien
tggcatactgtcacttaggtttcaa

SEQ ID NO: 154050 - DNA, 25 bp, Homo sapien
cagggcagattgtaaacgtcgtctc

SEQ ID NO: 154051 - DNA, 25 bp, Homo sapien
agggcagattgtaaacgtcgtctca

SEQ ID NO: 154052 - DNA, 25 bp, Homo sapien
gggcagattgtaaacgtcgtctcaa

SEQ ID NO: 154053 - DNA, 25 bp, Homo sapien
ggcagattgtaaacgtcgtctcaaa

SEQ ID NO: 154054 - DNA, 25 bp, Homo sapien
gcagattgtaaacgtcgtctcaaaa

SEQ ID NO: 154055 - DNA, 25 bp, Homo sapien
cagattgtaaacgtcgtctcaaaaa

SEQ ID NO: 154056 - DNA, 25 bp, Homo sapien
gattgtaaacgtcgtctcaaaaatg

SEQ ID NO: 154057 - DNA, 25 bp, Homo sapien
ttgtaaacgtcgtctcaaaaatgaa

SEQ ID NO: 154058 - DNA, 25 bp, Homo sapien
aaaaatgaaatgctgccgggtgcgg

SEQ ID NO: 154059 - DNA, 25 bp, Homo sapien
aaatgaaatgctgccgggtgcggtg

SEQ ID NO: 154060 - DNA, 25 bp, Homo sapien
aaatgctgccgggtgcggtgactca

SEQ ID NO: 154061 - DNA, 25 bp, Homo sapien
ataactggtaccttatctactgtaa

SEQ ID NO: 154062 - DNA, 25 bp, Homo sapien
atgatgcacacatagatatattctt

SEQ ID NO: 154063 - DNA, 25 bp, Homo sapien
cttacaaattttgctgtattgctgt

SEQ ID NO: 154064 - DNA, 25 bp, Homo sapien
gctgttctctttgaggctctccaaa

SEQ ID NO: 154065 - DNA, 25 bp, Homo sapien
ggctctccaaagtcttgagttctgt

SEQ ID NO: 154066 - DNA, 25 bp, Homo sapien
gagttctgtatatggcctggtttct

SEQ ID NO: 154067 - DNA, 25 bp, Homo sapien
tatggcctggtttcttgtttttatt

SEQ ID NO: 154068 - DNA, 25 bp, Homo sapien
ttttggtgttgttcgattgtctttc

SEQ ID NO: 154069 - DNA, 25 bp, Homo sapien
gtgttgttcgattgtctttcattga

SEQ ID NO: 154070 - DNA, 25 bp, Homo sapien
gttttattggcaacgtatgctgctt

SEQ ID NO: 154071 - DNA, 25 bp, Homo sapien
ttggcaacgtatgctgctttttcat

SEQ ID NO: 154072 - DNA, 25 bp, Homo sapien
acacagcgatgcatctctctctaaa

SEQ ID NO: 154073 - DNA, 25 bp, Homo sapien
tctctctaaagctcagccacggctg

SEQ ID NO: 154074 - DNA, 25 bp, Homo sapien
gagacagaaggttttgtgccctgct

SEQ ID NO: 154075 - DNA, 25 bp, Homo sapien
ttgtgccctgctgtatcataaagca

SEQ ID NO: 154076 - DNA, 25 bp, Homo sapien
aaagcacacacttagcgctctggag

SEQ ID NO: 154077 - DNA, 25 bp, Homo sapien
acttagcgctctggagccggacggt

SEQ ID NO: 154078 - DNA, 25 bp, Homo sapien
ttccgcaggcctagaaacttccttc

SEQ ID NO: 154079 - DNA, 25 bp, Homo sapien
aagacttcatggcttacttgttcca

SEQ ID NO: 154080 - DNA, 25 bp, Homo sapien
tggcttacttgttccataactccaa

SEQ ID NO: 154081 - DNA, 25 bp, Homo sapien
actccaagtgagtctgtaatgtttg

SEQ ID NO: 154082 - DNA, 25 bp, Homo sapien
gaagcttgactgtaaccatgttttt

SEQ ID NO: 154083 - DNA, 25 bp, Homo sapien
gatacccaaatggtggtcttgtgca

SEQ ID NO: 154084 - DNA, 25 bp, Homo sapien
ggtggtcttgtgcacacccactgtg

SEQ ID NO: 154085 - DNA, 25 bp, Homo sapien
cctggcactcggacttgaaaagctt

SEQ ID NO: 154086 - DNA, 25 bp, Homo sapien
gaactccgagttctttctgagcctg

SEQ ID NO: 154087 - DNA, 25 bp, Homo sapien
tctgagcctgctggacatgaagagc

SEQ ID NO: 154088 - DNA, 25 bp, Homo sapien
agatgaccaccatgctctgtgtcag

SEQ ID NO: 154089 - DNA, 25 bp, Homo sapien
tcagccaggacgaagggagacatct

SEQ ID NO: 154090 - DNA, 25 bp, Homo sapien
agacatctgggtgccagggagcctt

SEQ ID NO: 154091 - DNA, 25 bp, Homo sapien
gagccttccgtccatacgcaacaag

SEQ ID NO: 154092 - DNA, 25 bp, Homo sapien
gcaacaaggactcctcgctgctgac

SEQ ID NO: 154093 - DNA, 25 bp, Homo sapien
ctgaccaggctctatgaatgtacat

SEQ ID NO: 154094 - DNA, 25 bp, Homo sapien
gagaccccgggcatcttcatcagca

SEQ ID NO: 154095 - DNA, 25 bp, Homo sapien
agaccccgggcatcttcatcagcat

SEQ ID NO: 154096 - DNA, 25 bp, Homo sapien
accccgggcatcttcatcagcatgg

SEQ ID NO: 154097 - DNA, 25 bp, Homo sapien
cccgggcatcttcatcagcatggat

SEQ ID NO: 154098 - DNA, 25 bp, Homo sapien
ccgggcatcttcatcagcatggatg

SEQ ID NO: 154099 - DNA, 25 bp, Homo sapien
cgggcatcttcatcagcatggatga

SEQ ID NO: 154100 - DNA, 25 bp, Homo sapien
gggcatcttcatcagcatggatgac

SEQ ID NO: 154101 - DNA, 25 bp, Homo sapien
ggcatcttcatcagcatggatgacg

SEQ ID NO: 154102 - DNA, 25 bp, Homo sapien
gcatcttcatcagcatggatgacga

SEQ ID NO: 154103 - DNA, 25 bp, Homo sapien
atcttcatcagcatggatgacgact

SEQ ID NO: 154104 - DNA, 25 bp, Homo sapien
cttcatcagcatggatgacgactcg

SEQ ID NO: 154105 - DNA, 25 bp, Homo sapien
tccttgctctgcaggcaccttagtg

SEQ ID NO: 154106 - DNA, 25 bp, Homo sapien
tgcaggcaccttagtggcttttttc

SEQ ID NO: 154107 - DNA, 25 bp, Homo sapien
gggtacatttccctgtgctgacgga

SEQ ID NO: 154108 - DNA, 25 bp, Homo sapien
atttccctgtgctgacggaagccaa

SEQ ID NO: 154109 - DNA, 25 bp, Homo sapien
tgtgctgacggaagccaacttggct

SEQ ID NO: 154110 - DNA, 25 bp, Homo sapien
aagccaacttggctttcccggactg

SEQ ID NO: 154111 - DNA, 25 bp, Homo sapien
tggctttcccggactgcaagcaggg

SEQ ID NO: 154112 - DNA, 25 bp, Homo sapien
gtacatagtgtaggtcagcgtgctt

SEQ ID NO: 154113 - DNA, 25 bp, Homo sapien
taggtcagcgtgcttagcctcctga

SEQ ID NO: 154114 - DNA, 25 bp, Homo sapien
tagcctcctgacctgaggctcctgt

SEQ ID NO: 154115 - DNA, 25 bp, Homo sapien
ctcctgtgctactttgccttttgca

SEQ ID NO: 154116 - DNA, 25 bp, Homo sapien
gaaaccgcatccaacagtccaaaag

SEQ ID NO: 154117 - DNA, 25 bp, Homo sapien
tccaacagtccaaaagcagtcttcc

SEQ ID NO: 154118 - DNA, 25 bp, Homo sapien
aaggccattcaaactgctatccgca

SEQ ID NO: 154119 - DNA, 25 bp, Homo sapien
taaagaggcaaacgcagtgctggct

SEQ ID NO: 154120 - DNA, 25 bp, Homo sapien
cagcagctcaaggaggttcatcaag

SEQ ID NO: 154121 - DNA, 25 bp, Homo sapien
caattggaacaacttcgtccggtca

SEQ ID NO: 154122 - DNA, 25 bp, Homo sapien
aacttcgtccggtcactgtgttgtg

SEQ ID NO: 154123 - DNA, 25 bp, Homo sapien
gacagtgggtgaccttgtctgccaa

SEQ ID NO: 154124 - DNA, 25 bp, Homo sapien
accttgtctgccaagatctttcttt

SEQ ID NO: 154125 - DNA, 25 bp, Homo sapien
gaatgttttgaacccaactacttgt

SEQ ID NO: 154126 - DNA, 25 bp, Homo sapien
gaacccaactacttgtcatagatgt

SEQ ID NO: 154127 - DNA, 25 bp, Homo sapien
gcgcccagccaatgtcctagagagt

SEQ ID NO: 154128 - DNA, 25 bp, Homo sapien
cgcccagccaatgtcctagagagtt

SEQ ID NO: 154129 - DNA, 25 bp, Homo sapien
gcccagccaatgtcctagagagttt

SEQ ID NO: 154130 - DNA, 25 bp, Homo sapien
cccagccaatgtcctagagagtttt

SEQ ID NO: 154131 - DNA, 25 bp, Homo sapien
ccagccaatgtcctagagagttttg

SEQ ID NO: 154132 - DNA, 25 bp, Homo sapien
cacctttactcttagaaatacggat

SEQ ID NO: 154133 - DNA, 25 bp, Homo sapien
ttactcttagaaatacggattcggc

SEQ ID NO: 154134 - DNA, 25 bp, Homo sapien
ttagaaatacggattcggcagcctt

SEQ ID NO: 154135 - DNA, 25 bp, Homo sapien
tagaaatacggattcggcagccttc

SEQ ID NO: 154136 - DNA, 25 bp, Homo sapien
aaagtttatccgtatgtcagaacgg

SEQ ID NO: 154137 - DNA, 25 bp, Homo sapien
gtttatccgtatgtcagaacggatt

SEQ ID NO: 154138 - DNA, 25 bp, Homo sapien
ctggacttgtccaattaatgaagtt

SEQ ID NO: 154139 - DNA, 25 bp, Homo sapien
gaagttgattcatattgcatcatag

SEQ ID NO: 154140 - DNA, 25 bp, Homo sapien
attgcatcatagtttgctttgttta

SEQ ID NO: 154141 - DNA, 25 bp, Homo sapien
gctttgtttaagcatcacattaaag

SEQ ID NO: 154142 - DNA, 25 bp, Homo sapien
ttatagctgtaggttttctgtgttt

SEQ ID NO: 154143 - DNA, 25 bp, Homo sapien
tagctatttaatactaattttccat

SEQ ID NO: 154144 - DNA, 25 bp, Homo sapien
tactaattttccataagctattttg

SEQ ID NO: 154145 - DNA, 25 bp, Homo sapien
tatatggactttcttgcaagcaaca

SEQ ID NO: 154146 - DNA, 25 bp, Homo sapien
ggactttcttgcaagcaacaagcta

SEQ ID NO: 154147 - DNA, 25 bp, Homo sapien
ttcttgcaagcaacaagctattttt

SEQ ID NO: 154148 - DNA, 25 bp, Homo sapien
tctcctaaattgttgtaattgcatt

SEQ ID NO: 154149 - DNA, 25 bp, Homo sapien
ggtcctggatcggtttcgccatcat

SEQ ID NO: 154150 - DNA, 25 bp, Homo sapien
gatcggtttcgccatcatgacgcag

SEQ ID NO: 154151 - DNA, 25 bp, Homo sapien
gtttcgccatcatgacgcagtgtct

SEQ ID NO: 154152 - DNA, 25 bp, Homo sapien
atcatgacgcagtgtctcccagtgg

SEQ ID NO: 154153 - DNA, 25 bp, Homo sapien
agtgtctcccagtggccctgttctc

SEQ ID NO: 154154 - DNA, 25 bp, Homo sapien
agatgaccatctgggccaagggcaa

SEQ ID NO: 154155 - DNA, 25 bp, Homo sapien
gaccatctgggccaagggcaagcac

SEQ ID NO: 154156 - DNA, 25 bp, Homo sapien
gggcaagcaccgcagctacctgaag

SEQ ID NO: 154157 - DNA, 25 bp, Homo sapien
gcaccgcagctacctgaaggagttc

SEQ ID NO: 154158 - DNA, 25 bp, Homo sapien
gctacctgaaggagttccgggacta

SEQ ID NO: 154159 - DNA, 25 bp, Homo sapien
cacagctctccagcacccggaataa

SEQ ID NO: 154160 - DNA, 25 bp, Homo sapien
tggctaacgtatggccccataggtc

SEQ ID NO: 154161 - DNA, 25 bp, Homo sapien
tggccccataggtcactgggtcata

SEQ ID NO: 154162 - DNA, 25 bp, Homo sapien
aggtcactgggtcatacagagagaa

SEQ ID NO: 154163 - DNA, 25 bp, Homo sapien
aagattcagttcagcctaaatcaaa

SEQ ID NO: 154164 - DNA, 25 bp, Homo sapien
atcaaaacttccaccttgtgttcac

SEQ ID NO: 154165 - DNA, 25 bp, Homo sapien
gtgttcacttcaaagatggcccaac

SEQ ID NO: 154166 - DNA, 25 bp, Homo sapien
tcagctcatgcctaacctatgtgtg

SEQ ID NO: 154167 - DNA, 25 bp, Homo sapien
ctatgtgtggctcagggaccagctt

SEQ ID NO: 154168 - DNA, 25 bp, Homo sapien
gaaaggaggtttgttctgctccccg

SEQ ID NO: 154169 - DNA, 25 bp, Homo sapien
tctggaccttccagggcccatgcag

SEQ ID NO: 154170 - DNA, 25 bp, Homo sapien
ggtagaggtcttttcaccgagctgc

SEQ ID NO: 154171 - DNA, 25 bp, Homo sapien
atttggatcttcaacggatactaga

SEQ ID NO: 154172 - DNA, 25 bp, Homo sapien
aagcacgtttagtactggattcagt

SEQ ID NO: 154173 - DNA, 25 bp, Homo sapien
ctggattcagtgaagttagaagcct

SEQ ID NO: 154174 - DNA, 25 bp, Homo sapien
gaagcctgaaacttttctcgtatgg

SEQ ID NO: 154175 - DNA, 25 bp, Homo sapien
gggtggtttttgcattaaatcctgg

SEQ ID NO: 154176 - DNA, 25 bp, Homo sapien
ctggggtccattttacaatccatta

SEQ ID NO: 154177 - DNA, 25 bp, Homo sapien
aatccattatttttgaccactgcta

SEQ ID NO: 154178 - DNA, 25 bp, Homo sapien
atttttgaccactgctatgtgttca

SEQ ID NO: 154179 - DNA, 25 bp, Homo sapien
gaccactgctatgtgttcaagtagt

SEQ ID NO: 154180 - DNA, 25 bp, Homo sapien
tgtgattgtttttatctggttacat

SEQ ID NO: 154181 - DNA, 25 bp, Homo sapien
atttctttgtctaatttaatatgtc

SEQ ID NO: 154182 - DNA, 25 bp, Homo sapien
gagaggacgtgagggaccaccccca

SEQ ID NO: 154183 - DNA, 25 bp, Homo sapien
acacagctgccgcagcatctcacac

SEQ ID NO: 154184 - DNA, 25 bp, Homo sapien
tctcacaccccgagggcctgaggag

SEQ ID NO: 154185 - DNA, 25 bp, Homo sapien
actcagggctccattctggagggca

SEQ ID NO: 154186 - DNA, 25 bp, Homo sapien
agggcaccacggtgacccgggccat

SEQ ID NO: 154187 - DNA, 25 bp, Homo sapien
ggtgacccgggccatctcagtattg

SEQ ID NO: 154188 - DNA, 25 bp, Homo sapien
gtgacccgggccatctcagtattgc

SEQ ID NO: 154189 - DNA, 25 bp, Homo sapien
ctcagtattgcctgtgggggccacc

SEQ ID NO: 154190 - DNA, 25 bp, Homo sapien
caagtgccttcgctctgtttttata

SEQ ID NO: 154191 - DNA, 25 bp, Homo sapien
agtgccttcgctctgtttttatacc

SEQ ID NO: 154192 - DNA, 25 bp, Homo sapien
cttcgctctgtttttataccctgaa

SEQ ID NO: 154193 - DNA, 25 bp, Homo sapien
gacaaatctacttgataatgtacct

SEQ ID NO: 154194 - DNA, 25 bp, Homo sapien
aatctacttgataatgtacctttat

SEQ ID NO: 154195 - DNA, 25 bp, Homo sapien
cctttatttgatctcaagttgtata

SEQ ID NO: 154196 - DNA, 25 bp, Homo sapien
ttgtgttactgcagtagtaatctta

SEQ ID NO: 154197 - DNA, 25 bp, Homo sapien
cttatgcacacggtgatttcatgtt

SEQ ID NO: 154198 - DNA, 25 bp, Homo sapien
gcacacggtgatttcatgttatata

SEQ ID NO: 154199 - DNA, 25 bp, Homo sapien
acggtgatttcatgttatatatgca

SEQ ID NO: 154200 - DNA, 25 bp, Homo sapien
atatatgcaaagtaggcaactgttt

SEQ ID NO: 154201 - DNA, 25 bp, Homo sapien
gcaactgttttcttagttacagaag

SEQ ID NO: 154202 - DNA, 25 bp, Homo sapien
tgttttcttagttacagaagtttca

SEQ ID NO: 154203 - DNA, 25 bp, Homo sapien
gatgtacagtttctgaaattgtttt

SEQ ID NO: 154204 - DNA, 25 bp, Homo sapien
agccacgtccagctggcgtcaataa

SEQ ID NO: 154205 - DNA, 25 bp, Homo sapien
gctggcgtcaataagcatctttggg

SEQ ID NO: 154206 - DNA, 25 bp, Homo sapien
aggaccagccatgagtggctcttat

SEQ ID NO: 154207 - DNA, 25 bp, Homo sapien
ccatgagtggctcttatggccaaag

SEQ ID NO: 154208 - DNA, 25 bp, Homo sapien
tgcaggccaagcaaacggctctggg

SEQ ID NO: 154209 - DNA, 25 bp, Homo sapien
gctctgggctggaatagccctacct

SEQ ID NO: 154210 - DNA, 25 bp, Homo sapien
aatagccctacctgagtgccctgtt

SEQ ID NO: 154211 - DNA, 25 bp, Homo sapien
gtgccctgtttgactccgccactat

SEQ ID NO: 154212 - DNA, 25 bp, Homo sapien
gccactatctgccatgtgagttggg

SEQ ID NO: 154213 - DNA, 25 bp, Homo sapien
agttgggcaaattgttgaccacctc

SEQ ID NO: 154214 - DNA, 25 bp, Homo sapien
gtaggaggttactttgttagagcaa

SEQ ID NO: 154215 - DNA, 25 bp, Homo sapien
tgctgttttcttccacactcacttg

SEQ ID NO: 154216 - DNA, 25 bp, Homo sapien
ctcacttgccagagggtcgaattgg

SEQ ID NO: 154217 - DNA, 25 bp, Homo sapien
gagggtcgaattggaagtcacatat

SEQ ID NO: 154218 - DNA, 25 bp, Homo sapien
gtcacatatatgtctatgaacggaa

SEQ ID NO: 154219 - DNA, 25 bp, Homo sapien
agataaattaacattgctgggtgga

SEQ ID NO: 154220 - DNA, 25 bp, Homo sapien
gggtggaaatattcagatgctgctt

SEQ ID NO: 154221 - DNA, 25 bp, Homo sapien
cagatgctgcttaaatacttcggta

SEQ ID NO: 154222 - DNA, 25 bp, Homo sapien
tacttcggtaaacactgggtaagat

SEQ ID NO: 154223 - DNA, 25 bp, Homo sapien
aacactgggtaagattcatggaact

SEQ ID NO: 154224 - DNA, 25 bp, Homo sapien
aagctgtatgaactgctttaccaaa

SEQ ID NO: 154225 - DNA, 25 bp, Homo sapien
gctttaccaaatatcactactgagg

SEQ ID NO: 154226 - DNA, 25 bp, Homo sapien
gcagggtcgctgagtcctccaggtc

SEQ ID NO: 154227 - DNA, 25 bp, Homo sapien
gctgagtcctccaggtcctgggcag

SEQ ID NO: 154228 - DNA, 25 bp, Homo sapien
gcagccttcatatttgccattgtgt

SEQ ID NO: 154229 - DNA, 25 bp, Homo sapien
caaccccaaaccatgcggagaatta

SEQ ID NO: 154230 - DNA, 25 bp, Homo sapien
cggagaattagagttcagctcagct

SEQ ID NO: 154231 - DNA, 25 bp, Homo sapien
gctcagctgggcatggagttaagat

SEQ ID NO: 154232 - DNA, 25 bp, Homo sapien
atggagttaagatccctcacaggac

SEQ ID NO: 154233 - DNA, 25 bp, Homo sapien
taagatccctcacaggacccagaag

SEQ ID NO: 154234 - DNA, 25 bp, Homo sapien
ggacccagaagctcaccaaaaacta

SEQ ID NO: 154235 - DNA, 25 bp, Homo sapien
ggcctggctcttgagaggtcccagt

SEQ ID NO: 154236 - DNA, 25 bp, Homo sapien
gaggtcccagtcagccatggagagc

SEQ ID NO: 154237 - DNA, 25 bp, Homo sapien
tataggccagctacaaggggtttaa

SEQ ID NO: 154238 - DNA, 25 bp, Homo sapien
gtgtcttgaaaactaagtattggag

SEQ ID NO: 154239 - DNA, 25 bp, Homo sapien
gaaaactaagtattggagtggattt

SEQ ID NO: 154240 - DNA, 25 bp, Homo sapien
ggattttcttctgctttcattgata

SEQ ID NO: 154241 - DNA, 25 bp, Homo sapien
gattttcttctgctttcattgatac

SEQ ID NO: 154242 - DNA, 25 bp, Homo sapien
attttcttctgctttcattgatact

SEQ ID NO: 154243 - DNA, 25 bp, Homo sapien
tttcttctgctttcattgatacttg

SEQ ID NO: 154244 - DNA, 25 bp, Homo sapien
tcttctgctttcattgatacttgtc

SEQ ID NO: 154245 - DNA, 25 bp, Homo sapien
cttctgctttcattgatacttgtca

SEQ ID NO: 154246 - DNA, 25 bp, Homo sapien
ctgctttcattgatacttgtcagaa

SEQ ID NO: 154247 - DNA, 25 bp, Homo sapien
gctttcattgatacttgtcagaaaa

SEQ ID NO: 154248 - DNA, 25 bp, Homo sapien
atgcagtctaaaatgcttcagtact

SEQ ID NO: 154249 - DNA, 25 bp, Homo sapien
gtacttgtgaaacacagctgttctt

SEQ ID NO: 154250 - DNA, 25 bp, Homo sapien
gctgttcttctgttctgcagacacg

SEQ ID NO: 154251 - DNA, 25 bp, Homo sapien
acacccaggcacttaagcacaagca

SEQ ID NO: 154252 - DNA, 25 bp, Homo sapien
acagctgtccactgggccattgtgg

SEQ ID NO: 154253 - DNA, 25 bp, Homo sapien
cattgtggtgtgagcttcagatggt

SEQ ID NO: 154254 - DNA, 25 bp, Homo sapien
atggtgaagcattctccccagtgta

SEQ ID NO: 154255 - DNA, 25 bp, Homo sapien
cttgtatccgatatctaacgcttta

SEQ ID NO: 154256 - DNA, 25 bp, Homo sapien
gatatctaacgctttaaatggctac

SEQ ID NO: 154257 - DNA, 25 bp, Homo sapien
ttaaatggctactttggtttctgtc

SEQ ID NO: 154258 - DNA, 25 bp, Homo sapien
ggtttctgtctgtaagttaagacct

SEQ ID NO: 154259 - DNA, 25 bp, Homo sapien
gtgaacttggaaccctcagctccgg

SEQ ID NO: 154260 - DNA, 25 bp, Homo sapien
tcagctccgggtgttctcggcagaa

SEQ ID NO: 154261 - DNA, 25 bp, Homo sapien
gtgggctccattctgtagcattgcc

SEQ ID NO: 154262 - DNA, 25 bp, Homo sapien
tgtagcattgccagcgttctcttca

SEQ ID NO: 154263 - DNA, 25 bp, Homo sapien
agcgttctcttcacgtctctaacaa

SEQ ID NO: 154264 - DNA, 25 bp, Homo sapien
gtctctaacaatcctttgcttttcc

SEQ ID NO: 154265 - DNA, 25 bp, Homo sapien
ttgcttttcctcactcacgtggaaa

SEQ ID NO: 154266 - DNA, 25 bp, Homo sapien
gaaatgtgaactgtcccggctctgt

SEQ ID NO: 154267 - DNA, 25 bp, Homo sapien
tttaagccatcgttcccctcctgaa

SEQ ID NO: 154268 - DNA, 25 bp, Homo sapien
gaacggttgccccttatttaatgct

SEQ ID NO: 154269 - DNA, 25 bp, Homo sapien
ggttgccccttatttaatgctgtaa

SEQ ID NO: 154270 - DNA, 25 bp, Homo sapien
tttctgcagcaaatcagggcttccc

SEQ ID NO: 154271 - DNA, 25 bp, Homo sapien
ctatcttgggcccattagttttggg

SEQ ID NO: 154272 - DNA, 25 bp, Homo sapien
gggcacagggcatagctatgacttt

SEQ ID NO: 154273 - DNA, 25 bp, Homo sapien
atgactttgctttctggttggagcc

SEQ ID NO: 154274 - DNA, 25 bp, Homo sapien
ctttctggttggagcctggccggaa

SEQ ID NO: 154275 - DNA, 25 bp, Homo sapien
gggtggttctgcttattcttcaagt

SEQ ID NO: 154276 - DNA, 25 bp, Homo sapien
ctgcttattcttcaagtttatctga

SEQ ID NO: 154277 - DNA, 25 bp, Homo sapien
gggagtgcatgatccccatgttgca

SEQ ID NO: 154278 - DNA, 25 bp, Homo sapien
gtgcatgatccccatgttgcaatat

SEQ ID NO: 154279 - DNA, 25 bp, Homo sapien
gttgcaatatggagtctctgccctg

SEQ ID NO: 154280 - DNA, 25 bp, Homo sapien
tatggagtctctgccctgagatctt

SEQ ID NO: 154281 - DNA, 25 bp, Homo sapien
gcaactttttcataggaagtccgga

SEQ ID NO: 154282 - DNA, 25 bp, Homo sapien
gtccggatgggaatattcacattaa

SEQ ID NO: 154283 - DNA, 25 bp, Homo sapien
tcacattaatcatttttgcagagac

SEQ ID NO: 154284 - DNA, 25 bp, Homo sapien
tttgcagagactttgctagatcctc

SEQ ID NO: 154285 - DNA, 25 bp, Homo sapien
agactttgctagatcctctcatatt

SEQ ID NO: 154286 - DNA, 25 bp, Homo sapien
agatcctctcatattttgtcttcct

SEQ ID NO: 154287 - DNA, 25 bp, Homo sapien
atattttgtcttcctcagggtggca

SEQ ID NO: 154288 - DNA, 25 bp, Homo sapien
ggtacagagagtgcctgattggaaa

SEQ ID NO: 154289 - DNA, 25 bp, Homo sapien
aagagacacaaatctctacctccca

SEQ ID NO: 154290 - DNA, 25 bp, Homo sapien
catgttaagctttgcaggacaggga

SEQ ID NO: 154291 - DNA, 25 bp, Homo sapien
aagaaagggtatgagacacggctag

SEQ ID NO: 154292 - DNA, 25 bp, Homo sapien
attccattccgagtggctgcctaca

SEQ ID NO: 154293 - DNA, 25 bp, Homo sapien
attccgagtggctgcctacaacaaa

SEQ ID NO: 154294 - DNA, 25 bp, Homo sapien
gtggctgcctacaacaaagccaaaa

SEQ ID NO: 154295 - DNA, 25 bp, Homo sapien
aaaaaagccatggacttctatgatc

SEQ ID NO: 154296 - DNA, 25 bp, Homo sapien
agcaaggcacaatgagtttgacttc

SEQ ID NO: 154297 - DNA, 25 bp, Homo sapien
ccccaaagcatggaaggtcctgaca

SEQ ID NO: 154298 - DNA, 25 bp, Homo sapien
aagcatggaaggtcctgacagatta

SEQ ID NO: 154299 - DNA, 25 bp, Homo sapien
ctgacagattattacaggtccctgg

SEQ ID NO: 154300 - DNA, 25 bp, Homo sapien
tccctggagaagaactaagcctttg

SEQ ID NO: 154301 - DNA, 25 bp, Homo sapien
agtgctctttgattaccttttctat

SEQ ID NO: 154302 - DNA, 25 bp, Homo sapien
tttgattaccttttctatttttatg

SEQ ID NO: 154303 - DNA, 25 bp, Homo sapien
agaactgccgctctcagtggacagg

SEQ ID NO: 154304 - DNA, 25 bp, Homo sapien
gctctcagtggacagggcatctgtt

SEQ ID NO: 154305 - DNA, 25 bp, Homo sapien
agggcatctgttatcctgaaccttg

SEQ ID NO: 154306 - DNA, 25 bp, Homo sapien
ctgttatcctgaaccttggcagaca

SEQ ID NO: 154307 - DNA, 25 bp, Homo sapien
cttggcagacacgtcttgttttcat

SEQ ID NO: 154308 - DNA, 25 bp, Homo sapien
tgcagtattgcagagtctagaggaa

SEQ ID NO: 154309 - DNA, 25 bp, Homo sapien
gtggcctcagccttaaacttttgtt

SEQ ID NO: 154310 - DNA, 25 bp, Homo sapien
tcagccttaaacttttgttcctact

SEQ ID NO: 154311 - DNA, 25 bp, Homo sapien
accctcagcgaactgggcagcacgg

SEQ ID NO: 154312 - DNA, 25 bp, Homo sapien
ggagggtttggctacccctgcccat

SEQ ID NO: 154313 - DNA, 25 bp, Homo sapien
gccaggtaccaccattgtaaggaaa

SEQ ID NO: 154314 - DNA, 25 bp, Homo sapien
ttttccacggatgagtcacaatctg

SEQ ID NO: 154315 - DNA, 25 bp, Homo sapien
aagaatcaaacttccatcctgaaaa

SEQ ID NO: 154316 - DNA, 25 bp, Homo sapien
atgtttcaaaaccacttgccatcct

SEQ ID NO: 154317 - DNA, 25 bp, Homo sapien
cacttgccatcctgttagattgcca

SEQ ID NO: 154318 - DNA, 25 bp, Homo sapien
tgtgaagtatatatcctccagcatt

SEQ ID NO: 154319 - DNA, 25 bp, Homo sapien
atatcctccagcattcagtccaggg

SEQ ID NO: 154320 - DNA, 25 bp, Homo sapien
gggagccacggaaaccatgttcttg

SEQ ID NO: 154321 - DNA, 25 bp, Homo sapien
gaaaccatgttcttgcttaagccat

SEQ ID NO: 154322 - DNA, 25 bp, Homo sapien
ggagacagatggagggtaccctatt

SEQ ID NO: 154323 - DNA, 25 bp, Homo sapien
gggtaccctatttacaactgagtca

SEQ ID NO: 154324 - DNA, 25 bp, Homo sapien
aactgagtcagccaagccactgatg

SEQ ID NO: 154325 - DNA, 25 bp, Homo sapien
tttggtagatcttcaatttggatat

SEQ ID NO: 154326 - DNA, 25 bp, Homo sapien
ggtagatcttcaatttggatatttg

SEQ ID NO: 154327 - DNA, 25 bp, Homo sapien
atcttcaatttggatatttggagga

SEQ ID NO: 154328 - DNA, 25 bp, Homo sapien
gatatttggaggagtgaacatcgtt

SEQ ID NO: 154329 - DNA, 25 bp, Homo sapien
aacatcgttgttttgctggagggaa

SEQ ID NO: 154330 - DNA, 25 bp, Homo sapien
acatcgttgttttgctggagggaag

SEQ ID NO: 154331 - DNA, 25 bp, Homo sapien
catcgttgttttgctggagggaaga

SEQ ID NO: 154332 - DNA, 25 bp, Homo sapien
tcgttgttttgctggagggaagatc

SEQ ID NO: 154333 - DNA, 25 bp, Homo sapien
gttgttttgctggagggaagatctt

SEQ ID NO: 154334 - DNA, 25 bp, Homo sapien
ttttgctggagggaagatcttgatg

SEQ ID NO: 154335 - DNA, 25 bp, Homo sapien
aaatttggtgcttataagagagagt

SEQ ID NO: 154336 - DNA, 25 bp, Homo sapien
tgggccaccacatggaatcactagc

SEQ ID NO: 154337 - DNA, 25 bp, Homo sapien
atggaatcactagcttcgggttgta

SEQ ID NO: 154338 - DNA, 25 bp, Homo sapien
cactagcttcgggttgtaaatgttt

SEQ ID NO: 154339 - DNA, 25 bp, Homo sapien
tagcttcgggttgtaaatgttttct

SEQ ID NO: 154340 - DNA, 25 bp, Homo sapien
tcctttgggatgttggaagctacag

SEQ ID NO: 154341 - DNA, 25 bp, Homo sapien
tggcacttctcaattcctctttata

SEQ ID NO: 154342 - DNA, 25 bp, Homo sapien
taaaactagctttttaagcagctgt

SEQ ID NO: 154343 - DNA, 25 bp, Homo sapien
tgaaataaatgctgagtgagcccca

SEQ ID NO: 154344 - DNA, 25 bp, Homo sapien
gcagttcccggcctcgtcaagtgaa

SEQ ID NO: 154345 - DNA, 25 bp, Homo sapien
ggcctcgtcaagtgaactcggcaga

SEQ ID NO: 154346 - DNA, 25 bp, Homo sapien
gtcaagtgaactcggcagaccctgg

SEQ ID NO: 154347 - DNA, 25 bp, Homo sapien
gggccctggcctggttctcaagtgt

SEQ ID NO: 154348 - DNA, 25 bp, Homo sapien
ccctggcctggttctcaagtgtttc

SEQ ID NO: 154349 - DNA, 25 bp, Homo sapien
ttctcaagtgtttcctagacagaga

SEQ ID NO: 154350 - DNA, 25 bp, Homo sapien
gtgtttcctagacagagaggcacct

SEQ ID NO: 154351 - DNA, 25 bp, Homo sapien
ttcctagacagagaggcacctgggt

SEQ ID NO: 154352 - DNA, 25 bp, Homo sapien
cagagaggcacctgggtcagtatta

SEQ ID NO: 154353 - DNA, 25 bp, Homo sapien
ggcacctgggtcagtattagtctat

SEQ ID NO: 154354 - DNA, 25 bp, Homo sapien
gtattagtctatttatcagaggtgt

SEQ ID NO: 154355 - DNA, 25 bp, Homo sapien
atctatgtatagtttttctcctttt

SEQ ID NO: 154356 - DNA, 25 bp, Homo sapien
gtttttgccttgtaaactagcgcca

SEQ ID NO: 154357 - DNA, 25 bp, Homo sapien
taaactagcgccaaggaactgcagc

SEQ ID NO: 154358 - DNA, 25 bp, Homo sapien
gccagagaggccagacaagccgaga

SEQ ID NO: 154359 - DNA, 25 bp, Homo sapien
aagccgagagccccttctgttgtgg

SEQ ID NO: 154360 - DNA, 25 bp, Homo sapien
cctgggtttgcaggcctgcacaggc

SEQ ID NO: 154361 - DNA, 25 bp, Homo sapien
ggagtcctcaggaccttaggacctt

SEQ ID NO: 154362 - DNA, 25 bp, Homo sapien
tcctcaggaccttaggaccttcatc

SEQ ID NO: 154363 - DNA, 25 bp, Homo sapien
cttcgggtcttcaggagtgggcctt

SEQ ID NO: 154364 - DNA, 25 bp, Homo sapien
gtgctggtgccatggactctgccca

SEQ ID NO: 154365 - DNA, 25 bp, Homo sapien
gccttcttgtttatgatcagctcca

SEQ ID NO: 154366 - DNA, 25 bp, Homo sapien
ttatgatcagctccagctacctggg

SEQ ID NO: 154367 - DNA, 25 bp, Homo sapien
cagctccagctacctgggcagttgt

SEQ ID NO: 154368 - DNA, 25 bp, Homo sapien
atgggaaggcccacagcccaaggga

SEQ ID NO: 154369 - DNA, 25 bp, Homo sapien
ctggaaacaagtgaccccagggcct

SEQ ID NO: 154370 - DNA, 25 bp, Homo sapien
tgtctcccttcttgggtagggcaga

SEQ ID NO: 154371 - DNA, 25 bp, Homo sapien
ccttcttgggtagggcagacatgcc

SEQ ID NO: 154372 - DNA, 25 bp, Homo sapien
agacatgccttggtgccggtcacac

SEQ ID NO: 154373 - DNA, 25 bp, Homo sapien
ggtcacactctacacggactgaggt

SEQ ID NO: 154374 - DNA, 25 bp, Homo sapien
gactgaggtgcctgctcaggtgcta

SEQ ID NO: 154375 - DNA, 25 bp, Homo sapien
tcaggtgctatgtcccaagagccat

SEQ ID NO: 154376 - DNA, 25 bp, Homo sapien
aaagggtagttcaaagagtctgtct

SEQ ID NO: 154377 - DNA, 25 bp, Homo sapien
gagtctgtcttgagatctgattttt

SEQ ID NO: 154378 - DNA, 25 bp, Homo sapien
tctggttatttatttccttagtgcc

SEQ ID NO: 154379 - DNA, 25 bp, Homo sapien
ttatttccttagtgccaggagggca

SEQ ID NO: 154380 - DNA, 25 bp, Homo sapien
gaacttcagaggcaagcaagtccta

SEQ ID NO: 154381 - DNA, 25 bp, Homo sapien
gaggcaagcaagtcctaacattgta

SEQ ID NO: 154382 - DNA, 25 bp, Homo sapien
aacattgtaatagctttatcgggaa

SEQ ID NO: 154383 - DNA, 25 bp, Homo sapien
ttatcgggaaacaaggccgacctag

SEQ ID NO: 154384 - DNA, 25 bp, Homo sapien
aaggccgacctagcaaataaaagag

SEQ ID NO: 154385 - DNA, 25 bp, Homo sapien
aaagagcagtagatttccaggaagc

SEQ ID NO: 154386 - DNA, 25 bp, Homo sapien
gatttccaggaagcacagtcctatg

SEQ ID NO: 154387 - DNA, 25 bp, Homo sapien
cagtcctatgcagatgacaatagtt

SEQ ID NO: 154388 - DNA, 25 bp, Homo sapien
tggagacatccgctaaaacatcaat

SEQ ID NO: 154389 - DNA, 25 bp, Homo sapien
atccaggagcaaattctgccagagg

SEQ ID NO: 154390 - DNA, 25 bp, Homo sapien
gagtagaccttaccgaacccacaca

SEQ ID NO: 154391 - DNA, 25 bp, Homo sapien
cagggcagattgtaaacgtcgtctc

SEQ ID NO: 154392 - DNA, 25 bp, Homo sapien
agggcagattgtaaacgtcgtctca

SEQ ID NO: 154393 - DNA, 25 bp, Homo sapien
gggcagattgtaaacgtcgtctcaa

SEQ ID NO: 154394 - DNA, 25 bp, Homo sapien
ggcagattgtaaacgtcgtctcaaa

SEQ ID NO: 154395 - DNA, 25 bp, Homo sapien
gcagattgtaaacgtcgtctcaaaa

SEQ ID NO: 154396 - DNA, 25 bp, Homo sapien
cagattgtaaacgtcgtctcaaaaa

SEQ ID NO: 154397 - DNA, 25 bp, Homo sapien
agattgtaaacgtcgtctcaaaaat

SEQ ID NO: 154398 - DNA, 25 bp, Homo sapien
gattgtaaacgtcgtctcaaaaatg

SEQ ID NO: 154399 - DNA, 25 bp, Homo sapien
ttgtaaacgtcgtctcaaaaatgaa

SEQ ID NO: 154400 - DNA, 25 bp, Homo sapien
aaaaatgaaatgctgccgggtgcgg

SEQ ID NO: 154401 - DNA, 25 bp, Homo sapien
aaatgaaatgctgccgggtgcggtg

SEQ ID NO: 154402 - DNA, 25 bp, Homo sapien
ctgcaggccttatccccgaagcaga

SEQ ID NO: 154403 - DNA, 25 bp, Homo sapien
gagacttctagctggacaacctaca

SEQ ID NO: 154404 - DNA, 25 bp, Homo sapien
ggacaacctacacaaaccttagcgt

SEQ ID NO: 154405 - DNA, 25 bp, Homo sapien
aaccttagcgtctagagtcactcta

SEQ ID NO: 154406 - DNA, 25 bp, Homo sapien
agagtcactctaaccttgctaagga

SEQ ID NO: 154407 - DNA, 25 bp, Homo sapien
aaggaaggatgcagagttccctaga

SEQ ID NO: 154408 - DNA, 25 bp, Homo sapien
gttccctagagagacttgcactgat

SEQ ID NO: 154409 - DNA, 25 bp, Homo sapien
ggtgacttctgctttggtccttcca

SEQ ID NO: 154410 - DNA, 25 bp, Homo sapien
aagtaaaccacctgtggcagcggct

SEQ ID NO: 154411 - DNA, 25 bp, Homo sapien
tgctacttctgcgtccataagggtc

SEQ ID NO: 154412 - DNA, 25 bp, Homo sapien
tccataagggtcctgcacgttgcct

SEQ ID NO: 154413 - DNA, 25 bp, Homo sapien
aaagaaagagcctgtacccgcgact

SEQ ID NO: 154414 - DNA, 25 bp, Homo sapien
tgtacccgcgactaactagactttt

SEQ ID NO: 154415 - DNA, 25 bp, Homo sapien
actagacttttcttgctgttgtgca

SEQ ID NO: 154416 - DNA, 25 bp, Homo sapien
gacttttcttgctgttgtgcaaagt

SEQ ID NO: 154417 - DNA, 25 bp, Homo sapien
gtgcaaagttcagtttcttctcagc

SEQ ID NO: 154418 - DNA, 25 bp, Homo sapien
tctcagcaacatcaaggatatatga

SEQ ID NO: 154419 - DNA, 25 bp, Homo sapien
gagatgcctggtggaacttattcgt

SEQ ID NO: 154420 - DNA, 25 bp, Homo sapien
gcctggtggaacttattcgtgctat

SEQ ID NO: 154421 - DNA, 25 bp, Homo sapien
tggaacttattcgtgctatcagggc

SEQ ID NO: 154422 - DNA, 25 bp, Homo sapien
ttattcgtgctatcagggcattgat

SEQ ID NO: 154423 - DNA, 25 bp, Homo sapien
tgcaaaattgcacatactcctctat

SEQ ID NO: 154424 - DNA, 25 bp, Homo sapien
actgcgctatgattaaaaccattca

SEQ ID NO: 154425 - DNA, 25 bp, Homo sapien
aaaccattcatatagagttagtctt

SEQ ID NO: 154426 - DNA, 25 bp, Homo sapien
gagttagtctttacaactactattc

SEQ ID NO: 154427 - DNA, 25 bp, Homo sapien
gtctttacaactactattctgttat

SEQ ID NO: 154428 - DNA, 25 bp, Homo sapien
taatctgacaacatttgtcctaagt

SEQ ID NO: 154429 - DNA, 25 bp, Homo sapien
acaacatttgtcctaagtaagataa

SEQ ID NO: 154430 - DNA, 25 bp, Homo sapien
aaattcttcaactccttttggcaag

SEQ ID NO: 154431 - DNA, 25 bp, Homo sapien
ttcaactccttttggcaagaaaact

SEQ ID NO: 154432 - DNA, 25 bp, Homo sapien
ccttttggcaagaaaactgtaacag

SEQ ID NO: 154433 - DNA, 25 bp, Homo sapien
tgaagacaacttaggttgctaacct

SEQ ID NO: 154434 - DNA, 25 bp, Homo sapien
aggttgctaacctagttcaaaatga

SEQ ID NO: 154435 - DNA, 25 bp, Homo sapien
ggaagctataaaggccatgtggata

SEQ ID NO: 154436 - DNA, 25 bp, Homo sapien
ggatattttggcacctactgttcaa

SEQ ID NO: 154437 - DNA, 25 bp, Homo sapien
tactgttcaagagttggctgccctt

SEQ ID NO: 154438 - DNA, 25 bp, Homo sapien
aaaggaggcgcagacatctttcctg

SEQ ID NO: 154439 - DNA, 25 bp, Homo sapien
acatctttcctgcatcttggctacc

SEQ ID NO: 154440 - DNA, 25 bp, Homo sapien
ttggctaccttcctaaccagctgtt

SEQ ID NO: 154441 - DNA, 25 bp, Homo sapien
taaccagctgttcagaaccttctga

SEQ ID NO: 154442 - DNA, 25 bp, Homo sapien
gaaagtctgtagtcttaaaactcta

SEQ ID NO: 154443 - DNA, 25 bp, Homo sapien
ttccaagcagcagtatttatagtaa

SEQ ID NO: 154444 - DNA, 25 bp, Homo sapien
aatgctaactcttgcatgtcaagaa

SEQ ID NO: 154445 - DNA, 25 bp, Homo sapien
aacattagtcttaggaattcttcaa

SEQ ID NO: 154446 - DNA, 25 bp, Homo sapien
gtgcagctcaggtggatttaatgtg

SEQ ID NO: 154447 - DNA, 25 bp, Homo sapien
gtgggtttaatatggcctgttgagt

SEQ ID NO: 154448 - DNA, 25 bp, Homo sapien
atgttgattttctttaagtaaccat

SEQ ID NO: 154449 - DNA, 25 bp, Homo sapien
aagtaaccatttctgttcttgctat

SEQ ID NO: 154450 - DNA, 25 bp, Homo sapien
ctgttcttgctataaatctatgtct

SEQ ID NO: 154451 - DNA, 25 bp, Homo sapien
atctatgtctatatgtctatgctta

SEQ ID NO: 154452 - DNA, 25 bp, Homo sapien
gtctatgcttaatttggatgatgaa

SEQ ID NO: 154453 - DNA, 25 bp, Homo sapien
gatgatgaaggcaacttggatttaa

SEQ ID NO: 154454 - DNA, 25 bp, Homo sapien
taagcagacgatagaccttccaaag

SEQ ID NO: 154455 - DNA, 25 bp, Homo sapien
tagaccttccaaagctataagtgaa

SEQ ID NO: 154456 - DNA, 25 bp, Homo sapien
atgacgcgtaattcacaggttacag

SEQ ID NO: 154457 - DNA, 25 bp, Homo sapien
cagaatacaacgcattgggctttag

SEQ ID NO: 154458 - DNA, 25 bp, Homo sapien
atacaacgcattgggctttagctgt

SEQ ID NO: 154459 - DNA, 25 bp, Homo sapien
aacgcattgggctttagctgttttt

SEQ ID NO: 154460 - DNA, 25 bp, Homo sapien
gagagcgatgcttggatttttgttt

SEQ ID NO: 154461 - DNA, 25 bp, Homo sapien
gagcgatgcttggatttttgtttcc

SEQ ID NO: 154462 - DNA, 25 bp, Homo sapien
tgtttcctattagaaaccaacagtt

SEQ ID NO: 154463 - DNA, 25 bp, Homo sapien
tttcatttcatttggagctaagatg

SEQ ID NO: 154464 - DNA, 25 bp, Homo sapien
catttggagctaagatgactaattt

SEQ ID NO: 154465 - DNA, 25 bp, Homo sapien
agctaagatgactaatttgatgatt

SEQ ID NO: 154466 - DNA, 25 bp, Homo sapien
tgatgattttcgatctcttttcccc

SEQ ID NO: 154467 - DNA, 25 bp, Homo sapien
tgattttcgatctcttttcccctgt

SEQ ID NO: 154468 - DNA, 25 bp, Homo sapien
cactgactcttcaaggacgtgccct

SEQ ID NO: 154469 - DNA, 25 bp, Homo sapien
actcttcaaggacgtgccctctttg

SEQ ID NO: 154470 - DNA, 25 bp, Homo sapien
aaggacgtgccctctttgctctcag

SEQ ID NO: 154471 - DNA, 25 bp, Homo sapien
ccctctttgctctcagaaccttggg

SEQ ID NO: 154472 - DNA, 25 bp, Homo sapien
gggtgcgtttcttttgcatgactgt

SEQ ID NO: 154473 - DNA, 25 bp, Homo sapien
gcgtttcttttgcatgactgtggcc

SEQ ID NO: 154474 - DNA, 25 bp, Homo sapien
tttcttttgcatgactgtggcctgt

SEQ ID NO: 154475 - DNA, 25 bp, Homo sapien
ttgcatgactgtggcctgttgctca

SEQ ID NO: 154476 - DNA, 25 bp, Homo sapien
atgactgtggcctgttgctcatgac

SEQ ID NO: 154477 - DNA, 25 bp, Homo sapien
tgtggcctgttgctcatgactttct

SEQ ID NO: 154478 - DNA, 25 bp, Homo sapien
ctgttgctcatgactttcttttgta

SEQ ID NO: 154479 - DNA, 25 bp, Homo sapien
aaaagccaactctgtagacaccttc

SEQ ID NO: 154480 - DNA, 25 bp, Homo sapien
gtagacaccttcagagtttagtttt

SEQ ID NO: 154481 - DNA, 25 bp, Homo sapien
ataattagacctttacattcctgaa

SEQ ID NO: 154482 - DNA, 25 bp, Homo sapien
tagacctttacattcctgaagataa

SEQ ID NO: 154483 - DNA, 25 bp, Homo sapien
gtaatcttttatcttattttgctca

SEQ ID NO: 154484 - DNA, 25 bp, Homo sapien
atactgatgttgtacactgttttac

SEQ ID NO: 154485 - DNA, 25 bp, Homo sapien
gttgtacactgttttacttaacatt

SEQ ID NO: 154486 - DNA, 25 bp, Homo sapien
ttttgggaagtaactgcctctgact

SEQ ID NO: 154487 - DNA, 25 bp, Homo sapien
ctgcctctgacttcaactcaagaaa

SEQ ID NO: 154488 - DNA, 25 bp, Homo sapien
agaaaacacttttttgttgctaatg

SEQ ID NO: 154489 - DNA, 25 bp, Homo sapien
gttgctaatgtaatcggtttttgta

SEQ ID NO: 154490 - DNA, 25 bp, Homo sapien
taggcagagccataatggactaaaa

SEQ ID NO: 154491 - DNA, 25 bp, Homo sapien
ttgactaagtttttataccagctta

SEQ ID NO: 154492 - DNA, 25 bp, Homo sapien
gtgtcatcttttcaaggcatttgtc

SEQ ID NO: 154493 - DNA, 25 bp, Homo sapien
atttggactgtctatatcataacta

SEQ ID NO: 154494 - DNA, 25 bp, Homo sapien
gatagtttggctataagtgctcaat

SEQ ID NO: 154495 - DNA, 25 bp, Homo sapien
aagtgctcaatagcttgaagcccaa

SEQ ID NO: 154496 - DNA, 25 bp, Homo sapien
gaagttggtatcgaaatttgttgtt

SEQ ID NO: 154497 - DNA, 25 bp, Homo sapien
tgtttaaacccaagtgctgcacaaa

SEQ ID NO: 154498 - DNA, 25 bp, Homo sapien
agtgctgcacaaaagcagatacttg

SEQ ID NO: 154499 - DNA, 25 bp, Homo sapien
gcagatacttgaggaaaacactatt

SEQ ID NO: 154500 - DNA, 25 bp, Homo sapien
cactatttccaaaagcacatgtatt

SEQ ID NO: 154501 - DNA, 25 bp, Homo sapien
aatcctttgctaatgacctggcttt

SEQ ID NO: 154502 - DNA, 25 bp, Homo sapien
atctgtctggcctgatgagaatgga

SEQ ID NO: 154503 - DNA, 25 bp, Homo sapien
gccacacacacagtaattgccattt

SEQ ID NO: 154504 - DNA, 25 bp, Homo sapien
atgactgtcaatgccgttactttaa

SEQ ID NO: 154505 - DNA, 25 bp, Homo sapien
atgttgtcatttttgcactggctac

SEQ ID NO: 154506 - DNA, 25 bp, Homo sapien
ttttgcactggctactgatgataca

SEQ ID NO: 154507 - DNA, 25 bp, Homo sapien
catgctgacattcatcaccgcaaag

SEQ ID NO: 154508 - DNA, 25 bp, Homo sapien
gatgatgattccagtctctggttcc

SEQ ID NO: 154509 - DNA, 25 bp, Homo sapien
agtctctggttcctttcctgagtca

SEQ ID NO: 154510 - DNA, 25 bp, Homo sapien
gagtcaggaacatttgttttctcca

SEQ ID NO: 154511 - DNA, 25 bp, Homo sapien
gttttctccaatttcctttcagact

SEQ ID NO: 154512 - DNA, 25 bp, Homo sapien
agagcaccaactgtgcatatgacag

SEQ ID NO: 154513 - DNA, 25 bp, Homo sapien
gagcaccaactgtgcatatgacagg

SEQ ID NO: 154514 - DNA, 25 bp, Homo sapien
agcaccaactgtgcatatgacagga

SEQ ID NO: 154515 - DNA, 25 bp, Homo sapien
gcaccaactgtgcatatgacaggat

SEQ ID NO: 154516 - DNA, 25 bp, Homo sapien
caccaactgtgcatatgacaggatt

SEQ ID NO: 154517 - DNA, 25 bp, Homo sapien
accaactgtgcatatgacaggattg

SEQ ID NO: 154518 - DNA, 25 bp, Homo sapien
ccaactgtgcatatgacaggattgt

SEQ ID NO: 154519 - DNA, 25 bp, Homo sapien
aactgtgcatatgacaggattgtgc

SEQ ID NO: 154520 - DNA, 25 bp, Homo sapien
ctgtgcatatgacaggattgtgctt

SEQ ID NO: 154521 - DNA, 25 bp, Homo sapien
tgtgcatatgacaggattgtgctta

SEQ ID NO: 154522 - DNA, 25 bp, Homo sapien
gtgcatatgacaggattgtgcttag

SEQ ID NO: 154523 - DNA, 25 bp, Homo sapien
gatggcccttctccggcaagacttc

SEQ ID NO: 154524 - DNA, 25 bp, Homo sapien
caggcacaaggctgcagcctatgat

SEQ ID NO: 154525 - DNA, 25 bp, Homo sapien
aaggctgcagcctatgatatcagtg

SEQ ID NO: 154526 - DNA, 25 bp, Homo sapien
tgcagcctatgatatcagtgaggat

SEQ ID NO: 154527 - DNA, 25 bp, Homo sapien
gaagaagactaatgtttcctccctc

SEQ ID NO: 154528 - DNA, 25 bp, Homo sapien
gaagactaatgtttcctccctcctt

SEQ ID NO: 154529 - DNA, 25 bp, Homo sapien
ctttctgtcccattaccttcagaag

SEQ ID NO: 154530 - DNA, 25 bp, Homo sapien
ttaccttcagaagctctctgttgaa

SEQ ID NO: 154531 - DNA, 25 bp, Homo sapien
cttcagaagctctctgttgaattcc

SEQ ID NO: 154532 - DNA, 25 bp, Homo sapien
aacactaaacctaaggacagctaca

SEQ ID NO: 154533 - DNA, 25 bp, Homo sapien
atcagcccgaagcagagccccagca

SEQ ID NO: 154534 - DNA, 25 bp, Homo sapien
gtaatcttttatcttattttgctca

SEQ ID NO: 154535 - DNA, 25 bp, Homo sapien
aatcttttatcttattttgctcaat

SEQ ID NO: 154536 - DNA, 25 bp, Homo sapien
aaaattgttcagaagatcaaagtgg

SEQ ID NO: 154537 - DNA, 25 bp, Homo sapien
gatcaaagtggtaaagacaatgtaa

SEQ ID NO: 154538 - DNA, 25 bp, Homo sapien
gttgtacactgttttacttaacatt

SEQ ID NO: 154539 - DNA, 25 bp, Homo sapien
aacattttgggaagtaactgcctct

SEQ ID NO: 154540 - DNA, 25 bp, Homo sapien
ttttgggaagtaactgcctctgact

SEQ ID NO: 154541 - DNA, 25 bp, Homo sapien
gaagtaactgcctctgacttcaact

SEQ ID NO: 154542 - DNA, 25 bp, Homo sapien
taactgcctctgacttcaactcaag

SEQ ID NO: 154543 - DNA, 25 bp, Homo sapien
ctgcctctgacttcaactcaagaaa

SEQ ID NO: 154544 - DNA, 25 bp, Homo sapien
gcctctgacttcaactcaagaaaac

SEQ ID NO: 154545 - DNA, 25 bp, Homo sapien
acttgagactcaccaatttctggcc

SEQ ID NO: 154546 - DNA, 25 bp, Homo sapien
gagactcaccaatttctggcctgtt

SEQ ID NO: 154547 - DNA, 25 bp, Homo sapien
tcaccaatttctggcctgttcagga

SEQ ID NO: 154548 - DNA, 25 bp, Homo sapien
aatttctggcctgttcaggagcctc

SEQ ID NO: 154549 - DNA, 25 bp, Homo sapien
tggcctgttcaggagcctcagataa

SEQ ID NO: 154550 - DNA, 25 bp, Homo sapien
gttcaggagcctcagataagtattt

SEQ ID NO: 154551 - DNA, 25 bp, Homo sapien
tgcccaaagctgtccttcctatggc

SEQ ID NO: 154552 - DNA, 25 bp, Homo sapien
tgtcagtccactgagtttccttcta

SEQ ID NO: 154553 - DNA, 25 bp, Homo sapien
agtccactgagtttccttctacgag

SEQ ID NO: 154554 - DNA, 25 bp, Homo sapien
tccactgagtttccttctacgagat

SEQ ID NO: 154555 - DNA, 25 bp, Homo sapien
cactgagtttccttctacgagatca

SEQ ID NO: 154556 - DNA, 25 bp, Homo sapien
caataatttaacaagctcagctctg

SEQ ID NO: 154557 - DNA, 25 bp, Homo sapien
gctcagctctgctttatctgagttt

SEQ ID NO: 154558 - DNA, 25 bp, Homo sapien
gctttatctgagtttagtggtccta

SEQ ID NO: 154559 - DNA, 25 bp, Homo sapien
ttagtggtcctaatatatatgtaga

SEQ ID NO: 154560 - DNA, 25 bp, Homo sapien
gggttgttcacctctgtacagacca

SEQ ID NO: 154561 - DNA, 25 bp, Homo sapien
ttcacctctgtacagaccatctgta

SEQ ID NO: 154562 - DNA, 25 bp, Homo sapien
cagaccatctgtatgttaggtgaca

SEQ ID NO: 154563 - DNA, 25 bp, Homo sapien
tatgggttataatcagggaaactaa

SEQ ID NO: 154564 - DNA, 25 bp, Homo sapien
gatttactttgtacatgttacaggc

SEQ ID NO: 154565 - DNA, 25 bp, Homo sapien
gtacatgttacaggcttgattggtg

SEQ ID NO: 154566 - DNA, 25 bp, Homo sapien
caggcttgattggtgtaaatctttt

SEQ ID NO: 154567 - DNA, 25 bp, Homo sapien
agaggccttcagtccccttaacgtg

SEQ ID NO: 154568 - DNA, 25 bp, Homo sapien
ttaacgtggctttccaacttcctga

SEQ ID NO: 154569 - DNA, 25 bp, Homo sapien
tccaacttcctgacgaggctacaaa

SEQ ID NO: 154570 - DNA, 25 bp, Homo sapien
tgacgaggctacaaaggctccgctc

SEQ ID NO: 154571 - DNA, 25 bp, Homo sapien
caaaggctccgctcacaaaagaaag

SEQ ID NO: 154572 - DNA, 25 bp, Homo sapien
gaaaacgaagcctccacgcgtggtt

SEQ ID NO: 154573 - DNA, 25 bp, Homo sapien
ggatgatgaatgtgacaccacccac

SEQ ID NO: 154574 - DNA, 25 bp, Homo sapien
gacaccacccacagaatgcattaga

SEQ ID NO: 154575 - DNA, 25 bp, Homo sapien
gctttgtcattttactctgatagga

SEQ ID NO: 154576 - DNA, 25 bp, Homo sapien
ggaatttttgttacctaactctgtg

SEQ ID NO: 154577 - DNA, 25 bp, Homo sapien
tacctaactctgtgcataacttatt

SEQ ID NO: 154578 - DNA, 25 bp, Homo sapien
tgcatagcagatggtttccacattt

SEQ ID NO: 154579 - DNA, 25 bp, Homo sapien
agatggtttccacatttagatcctg

SEQ ID NO: 154580 - DNA, 25 bp, Homo sapien
ggtttccacatttagatcctggttt

SEQ ID NO: 154581 - DNA, 25 bp, Homo sapien
gatcctggtttcataacttcctgta

SEQ ID NO: 154582 - DNA, 25 bp, Homo sapien
ggtttcataacttcctgtacttgaa

SEQ ID NO: 154583 - DNA, 25 bp, Homo sapien
ttcctgtacttgaagtctaaaagca

SEQ ID NO: 154584 - DNA, 25 bp, Homo sapien
cttccatgattttaaattgtgatcg

SEQ ID NO: 154585 - DNA, 25 bp, Homo sapien
ataggagggaacatgtcctaattct

SEQ ID NO: 154586 - DNA, 25 bp, Homo sapien
atgtcctaattcttctgtcctgaga

SEQ ID NO: 154587 - DNA, 25 bp, Homo sapien
gtcctaattcttctgtcctgagaag

SEQ ID NO: 154588 - DNA, 25 bp, Homo sapien
tactggtatttttacttaatctata

SEQ ID NO: 154589 - DNA, 25 bp, Homo sapien
ggactcggaagatgctgaaccaaac

SEQ ID NO: 154590 - DNA, 25 bp, Homo sapien
gatgctgaaccaaacttcgatgagg

SEQ ID NO: 154591 - DNA, 25 bp, Homo sapien
aaacttcgatgaggatggccaggat

SEQ ID NO: 154592 - DNA, 25 bp, Homo sapien
atggccaggatgagtacaatgagct

SEQ ID NO: 154593 - DNA, 25 bp, Homo sapien
atgagctgcacatgccagtgtgacc

SEQ ID NO: 154594 - DNA, 25 bp, Homo sapien
cagtgtgaccctgaagacagtgccc

SEQ ID NO: 154595 - DNA, 25 bp, Homo sapien
gagaccccaagaccttagggattga

SEQ ID NO: 154596 - DNA, 25 bp, Homo sapien
ttagggattgacacctgggcctcag

SEQ ID NO: 154597 - DNA, 25 bp, Homo sapien
ggacctagagatgtgcctggaacca

SEQ ID NO: 154598 - DNA, 25 bp, Homo sapien
gaaccactcctgatgccatggctag

SEQ ID NO: 154599 - DNA, 25 bp, Homo sapien
ctgatgccatggctagagtggcccc

SEQ ID NO: 154600 - DNA, 25 bp, Homo sapien
aaagctgtcacagagggtgcccagg

SEQ ID NO: 154601 - DNA, 25 bp, Homo sapien
caggcagtagaggaaccatccatat

SEQ ID NO: 154602 - DNA, 25 bp, Homo sapien
gctgaagcttctactaggatcccag

SEQ ID NO: 154603 - DNA, 25 bp, Homo sapien
agcttctactaggatcccagttttg

SEQ ID NO: 154604 - DNA, 25 bp, Homo sapien
aggatcccagttttgccgcagataa

SEQ ID NO: 154605 - DNA, 25 bp, Homo sapien
tgccgcagataattaatggacaact

SEQ ID NO: 154606 - DNA, 25 bp, Homo sapien
caactgtagtgcagtgatcctttac

SEQ ID NO: 154607 - DNA, 25 bp, Homo sapien
cagtgatcctttacaggtttatttc

SEQ ID NO: 154608 - DNA, 25 bp, Homo sapien
aaggttatactatgcctatttgaaa

SEQ ID NO: 154609 - DNA, 25 bp, Homo sapien
attagttatcaactttgcagtttga

SEQ ID NO: 154610 - DNA, 25 bp, Homo sapien
aactatgcagatgctcttaaaagca

SEQ ID NO: 154611 - DNA, 25 bp, Homo sapien
gggcacttctgccaagaaatggtta

SEQ ID NO: 154612 - DNA, 25 bp, Homo sapien
tggttatcagcaccagccgccatgg

SEQ ID NO: 154613 - DNA, 25 bp, Homo sapien
atggccaagcctgattgttccagct

SEQ ID NO: 154614 - DNA, 25 bp, Homo sapien
aagcctgattgttccagctccagag

SEQ ID NO: 154615 - DNA, 25 bp, Homo sapien
gattgttccagctccagagactaag

SEQ ID NO: 154616 - DNA, 25 bp, Homo sapien
gttgggttgggctcttatcttcatg

SEQ ID NO: 154617 - DNA, 25 bp, Homo sapien
ggttgggctcttatcttcatggagc

SEQ ID NO: 154618 - DNA, 25 bp, Homo sapien
tggagcttaggaaacgctcccactc

SEQ ID NO: 154619 - DNA, 25 bp, Homo sapien
ccatcgagggccagcacggctgagc

SEQ ID NO: 154620 - DNA, 25 bp, Homo sapien
cacggctgagcggtgaaaaaccgta

SEQ ID NO: 154621 - DNA, 25 bp, Homo sapien
aaaaccgtagccatagatcctgtcc

SEQ ID NO: 154622 - DNA, 25 bp, Homo sapien
ccaggcgggtctggtcaccatggtc

SEQ ID NO: 154623 - DNA, 25 bp, Homo sapien
accatggtcattgtgcttacgtcgg

SEQ ID NO: 154624 - DNA, 25 bp, Homo sapien
attgtgcttacgtcggtcggcttgc

SEQ ID NO: 154625 - DNA, 25 bp, Homo sapien
gtcggcttgcccacggaagacatca

SEQ ID NO: 154626 - DNA, 25 bp, Homo sapien
tggactggttccttgaccggcttcg

SEQ ID NO: 154627 - DNA, 25 bp, Homo sapien
gcttcgcacaatgaccaacgtactg

SEQ ID NO: 154628 - DNA, 25 bp, Homo sapien
gggactcaattggagcggccgtcat

SEQ ID NO: 154629 - DNA, 25 bp, Homo sapien
attggagcggccgtcatcgagcact

SEQ ID NO: 154630 - DNA, 25 bp, Homo sapien
atcgagcacttgtctcagcgggagc

SEQ ID NO: 154631 - DNA, 25 bp, Homo sapien
gggaaaccctacaagtccctcatgg

SEQ ID NO: 154632 - DNA, 25 bp, Homo sapien
tacaagtccctcatggcacaggaga

SEQ ID NO: 154633 - DNA, 25 bp, Homo sapien
attgtgatcaataatagtacctttg

SEQ ID NO: 154634 - DNA, 25 bp, Homo sapien
tgtctctctctgatgtactgtggat

SEQ ID NO: 154635 - DNA, 25 bp, Homo sapien
actttggaatggctttgtaataatc

SEQ ID NO: 154636 - DNA, 25 bp, Homo sapien
atggctttgtaataatcagtcttaa

SEQ ID NO: 154637 - DNA, 25 bp, Homo sapien
aaaatgttgacaagctctggttgct

SEQ ID NO: 154638 - DNA, 25 bp, Homo sapien
agctctggttgcttatttttagaaa

SEQ ID NO: 154639 - DNA, 25 bp, Homo sapien
ggattaatagcttttgacctcaagt

SEQ ID NO: 154640 - DNA, 25 bp, Homo sapien
tcaagtcttttgtcttctgagtgtt

SEQ ID NO: 154641 - DNA, 25 bp, Homo sapien
gtcttctgagtgttggagcttggct

SEQ ID NO: 154642 - DNA, 25 bp, Homo sapien
aatactgtacaatttctgaagatgg

SEQ ID NO: 154643 - DNA, 25 bp, Homo sapien
aagatggttattaacactgtgctgt

SEQ ID NO: 154644 - DNA, 25 bp, Homo sapien
ctgatgggcaaagaaggtgtccacg

SEQ ID NO: 154645 - DNA, 25 bp, Homo sapien
gcaaagaaggtgtccacggtggttt

SEQ ID NO: 154646 - DNA, 25 bp, Homo sapien
gtgtccacggtggtttgatcaacaa

SEQ ID NO: 154647 - DNA, 25 bp, Homo sapien
ccacggtggtttgatcaacaagaaa

SEQ ID NO: 154648 - DNA, 25 bp, Homo sapien
aaatgttatgaaatggcctcccacc

SEQ ID NO: 154649 - DNA, 25 bp, Homo sapien
ttcggcgttcccagtactgacctcg

SEQ ID NO: 154650 - DNA, 25 bp, Homo sapien
gcgttcccagtactgacctcgtctg

SEQ ID NO: 154651 - DNA, 25 bp, Homo sapien
cattaccccataccccttattgctg

SEQ ID NO: 154652 - DNA, 25 bp, Homo sapien
cttattgctgccaaaaccacatggg

SEQ ID NO: 154653 - DNA, 25 bp, Homo sapien
attgctgccaaaaccacatgggctg

SEQ ID NO: 154654 - DNA, 25 bp, Homo sapien
agggctggatggacagacacctccc

SEQ ID NO: 154655 - DNA, 25 bp, Homo sapien
attccaggggtgagcacagacagga

SEQ ID NO: 154656 - DNA, 25 bp, Homo sapien
ggccgtattaattagcctggctccc

SEQ ID NO: 154657 - DNA, 25 bp, Homo sapien
gccgtattaattagcctggctcccc

SEQ ID NO: 154658 - DNA, 25 bp, Homo sapien
cgtattaattagcctggctccccag

SEQ ID NO: 154659 - DNA, 25 bp, Homo sapien
tcctgtacccagtgttaccctcgtt

SEQ ID NO: 154660 - DNA, 25 bp, Homo sapien
ctgtacccagtgttaccctcgttat

SEQ ID NO: 154661 - DNA, 25 bp, Homo sapien
tgtacccagtgttaccctcgttatt

SEQ ID NO: 154662 - DNA, 25 bp, Homo sapien
gtcggactatgtaattgtaactata

SEQ ID NO: 154663 - DNA, 25 bp, Homo sapien
tcggactatgtaattgtaactatac

SEQ ID NO: 154664 - DNA, 25 bp, Homo sapien
ggactatgtaattgtaactatacct

SEQ ID NO: 154665 - DNA, 25 bp, Homo sapien
gactatgtaattgtaactatacctc

SEQ ID NO: 154666 - DNA, 25 bp, Homo sapien
agggatggaggctttacggccactt

SEQ ID NO: 154667 - DNA, 25 bp, Homo sapien
gccacttcccgttcggaataactga

SEQ ID NO: 154668 - DNA, 25 bp, Homo sapien
gaataactgaaatccccagcgatgg

SEQ ID NO: 154669 - DNA, 25 bp, Homo sapien
aaactctcgattgccgtttcaattg

SEQ ID NO: 154670 - DNA, 25 bp, Homo sapien
gtttcaattgtggaccggcgccgag

SEQ ID NO: 154671 - DNA, 25 bp, Homo sapien
tgacttcgcccggtggcaatagttc

SEQ ID NO: 154672 - DNA, 25 bp, Homo sapien
atagttccgggagaattggccattg

SEQ ID NO: 154673 - DNA, 25 bp, Homo sapien
attggccattggtaaaaagacttca

SEQ ID NO: 154674 - DNA, 25 bp, Homo sapien
aaagacttcatagggtcactggaat

SEQ ID NO: 154675 - DNA, 25 bp, Homo sapien
tcatagggtcactggaatgctttgt

SEQ ID NO: 154676 - DNA, 25 bp, Homo sapien
gcgggaggtgacatcatgaagtttt

SEQ ID NO: 154677 - DNA, 25 bp, Homo sapien
cattcccattacagtgactcggatg

SEQ ID NO: 154678 - DNA, 25 bp, Homo sapien
tacagtgactcggatgaggcaagtt

SEQ ID NO: 154679 - DNA, 25 bp, Homo sapien
gggagttgccggactcgcttctcag

SEQ ID NO: 154680 - DNA, 25 bp, Homo sapien
agccccagcttctgcgggagggtac

SEQ ID NO: 154681 - DNA, 25 bp, Homo sapien
tggacgctctgcacttctcgacttt

SEQ ID NO: 154682 - DNA, 25 bp, Homo sapien
tgcacttctcgactttcgaggacag

SEQ ID NO: 154683 - DNA, 25 bp, Homo sapien
tcgactttcgaggacagcgccctga

SEQ ID NO: 154684 - DNA, 25 bp, Homo sapien
aggacagcgccctgacagcgatgat

SEQ ID NO: 154685 - DNA, 25 bp, Homo sapien
gccctgacagcgatgatggcgcaaa

SEQ ID NO: 154686 - DNA, 25 bp, Homo sapien
caaaagaatttgtctccttctctcc

SEQ ID NO: 154687 - DNA, 25 bp, Homo sapien
ggagcatcttgcagccagtgcagga

SEQ ID NO: 154688 - DNA, 25 bp, Homo sapien
tttggggggcctcaaccctctcctg

SEQ ID NO: 154689 - DNA, 25 bp, Homo sapien
tcctggagcgcctgtgagatggtca

SEQ ID NO: 154690 - DNA, 25 bp, Homo sapien
ctggagcgcctgtgagatggtcagc

SEQ ID NO: 154691 - DNA, 25 bp, Homo sapien
gcgcctgtgagatggtcagcgtgga

SEQ ID NO: 154692 - DNA, 25 bp, Homo sapien
tgtgagatggtcagcgtggagcgca

SEQ ID NO: 154693 - DNA, 25 bp, Homo sapien
atggtcagcgtggagcgcaagtgct

SEQ ID NO: 154694 - DNA, 25 bp, Homo sapien
atgatgacgacctgggtggaaacct

SEQ ID NO: 154695 - DNA, 25 bp, Homo sapien
tgatgacgacctgggtggaaaccta

SEQ ID NO: 154696 - DNA, 25 bp, Homo sapien
gacctgggtggaaacctaccctgtg

SEQ ID NO: 154697 - DNA, 25 bp, Homo sapien
taccctgtgggcacccatgtccgag

SEQ ID NO: 154698 - DNA, 25 bp, Homo sapien
gagccccctggcatttctgcaatgc

SEQ ID NO: 154699 - DNA, 25 bp, Homo sapien
gaatatttcacacatcccttctttt

SEQ ID NO: 154700 - DNA, 25 bp, Homo sapien
tttcacacatcccttcttttgaatg

SEQ ID NO: 154701 - DNA, 25 bp, Homo sapien
tttgaatggcctctttgtgaccagc

SEQ ID NO: 154702 - DNA, 25 bp, Homo sapien
ttgtgaccagccagacctcaggtct

SEQ ID NO: 154703 - DNA, 25 bp, Homo sapien
gtcttcactctttcttctttgtaaa

SEQ ID NO: 154704 - DNA, 25 bp, Homo sapien
tcttctttgtaaaccatgtcatgtg

SEQ ID NO: 154705 - DNA, 25 bp, Homo sapien
agatttcctcagttagtgagcttgt

SEQ ID NO: 154706 - DNA, 25 bp, Homo sapien
gtgagcttgtgtctgcaaattgatt

SEQ ID NO: 154707 - DNA, 25 bp, Homo sapien
tcatgctgcatctatatctttttct

SEQ ID NO: 154708 - DNA, 25 bp, Homo sapien
tttcttgtttgagctgttactacat

SEQ ID NO: 154709 - DNA, 25 bp, Homo sapien
gctgttactacattgtacatggcat

SEQ ID NO: 154710 - DNA, 25 bp, Homo sapien
ctaaatgtctttttcacaatcatgt

SEQ ID NO: 154711 - DNA, 25 bp, Homo sapien
gggaaggcaatttcatactaaactg

SEQ ID NO: 154712 - DNA, 25 bp, Homo sapien
gaaggcaatttcatactaaactgat

SEQ ID NO: 154713 - DNA, 25 bp, Homo sapien
ggcaatttcatactaaactgattaa

SEQ ID NO: 154714 - DNA, 25 bp, Homo sapien
aatacatttataatctacaactgtt

SEQ ID NO: 154715 - DNA, 25 bp, Homo sapien
aatctacaactgtttgcacttacag

SEQ ID NO: 154716 - DNA, 25 bp, Homo sapien
ctacaactgtttgcacttacagctt

SEQ ID NO: 154717 - DNA, 25 bp, Homo sapien
acaactgtttgcacttacagctttt

SEQ ID NO: 154718 - DNA, 25 bp, Homo sapien
aactgtttgcacttacagctttttt

SEQ ID NO: 154719 - DNA, 25 bp, Homo sapien
gtttgcacttacagctttttttgta

SEQ ID NO: 154720 - DNA, 25 bp, Homo sapien
atttattgtctattttatatctgtt

SEQ ID NO: 154721 - DNA, 25 bp, Homo sapien
ttatttcacacgctgttctaatggc

SEQ ID NO: 154722 - DNA, 25 bp, Homo sapien
acacgctgttctaatggcacttatc

SEQ ID NO: 154723 - DNA, 25 bp, Homo sapien
cattagaatcttaccttgtgcagtc

SEQ ID NO: 154724 - DNA, 25 bp, Homo sapien
cttgtgcagtcatcagaaattccag

SEQ ID NO: 154725 - DNA, 25 bp, Homo sapien
gaaattccagcgtactataatgaaa

SEQ ID NO: 154726 - DNA, 25 bp, Homo sapien
taagaatatgctgacttcacttatt

SEQ ID NO: 154727 - DNA, 25 bp, Homo sapien
gctgacttcacttattagtcttagg

SEQ ID NO: 154728 - DNA, 25 bp, Homo sapien
tagtcttagggatttattttcaatt

SEQ ID NO: 154729 - DNA, 25 bp, Homo sapien
gggatattgtcatatcagcacatat

SEQ ID NO: 154730 - DNA, 25 bp, Homo sapien
atcagcacatattttctgtttggaa

SEQ ID NO: 154731 - DNA, 25 bp, Homo sapien
tggaaacacactgttgtttagttaa

SEQ ID NO: 154732 - DNA, 25 bp, Homo sapien
actgatgatttctgcataagtgtaa

SEQ ID NO: 154733 - DNA, 25 bp, Homo sapien
gtatttatgactttagttttcgaca

SEQ ID NO: 154734 - DNA, 25 bp, Homo sapien
tgactttagttttcgacattatttt

SEQ ID NO: 154735 - DNA, 25 bp, Homo sapien
gagtggcaacttaggattttagggt

SEQ ID NO: 154736 - DNA, 25 bp, Homo sapien
gattttagggtgatggctttggaaa

SEQ ID NO: 154737 - DNA, 25 bp, Homo sapien
gtactgaatgacagactattactac

SEQ ID NO: 154738 - DNA, 25 bp, Homo sapien
gacagactattactacgtttgccag

SEQ ID NO: 154739 - DNA, 25 bp, Homo sapien
gactattactacgtttgccagtttt

SEQ ID NO: 154740 - DNA, 25 bp, Homo sapien
aacagctttatttatgttcatgtcc

SEQ ID NO: 154741 - DNA, 25 bp, Homo sapien
ggaaacattacagcccttatctaga

SEQ ID NO: 154742 - DNA, 25 bp, Homo sapien
acagcccttatctagattatatgta

SEQ ID NO: 154743 - DNA, 25 bp, Homo sapien
ggagcttctcaggtgagagaccatc

SEQ ID NO: 154744 - DNA, 25 bp, Homo sapien
gaatttgtttgtagcatttgcatta

SEQ ID NO: 154745 - DNA, 25 bp, Homo sapien
atttgcattatgaaagcccgctagg

SEQ ID NO: 154746 - DNA, 25 bp, Homo sapien
caaaaggtcacctacattgaacgtg

SEQ ID NO: 154747 - DNA, 25 bp, Homo sapien
tacattgaacgtgatgtgctcaact

SEQ ID NO: 154748 - DNA, 25 bp, Homo sapien
gagctaaagggccatgttgtcagct

SEQ ID NO: 154749 - DNA, 25 bp, Homo sapien
catgttgtcagctgcaagtcacaga

SEQ ID NO: 154750 - DNA, 25 bp, Homo sapien
gcaagtcacagatactgctgatttt

SEQ ID NO: 154751 - DNA, 25 bp, Homo sapien
ggtcagatggattgctgggcatatt

SEQ ID NO: 154752 - DNA, 25 bp, Homo sapien
ttgtattgcttcttatgcctcacgg

SEQ ID NO: 154753 - DNA, 25 bp, Homo sapien
tcacggtgggcccttccatgtcact

SEQ ID NO: 154754 - DNA, 25 bp, Homo sapien
tcttctttctcatctactcgtctca

SEQ ID NO: 154755 - DNA, 25 bp, Homo sapien
tactcgtctcacactgagtggtgtt

SEQ ID NO: 154756 - DNA, 25 bp, Homo sapien
cacactgagtggtgttagtcactga

SEQ ID NO: 154757 - DNA, 25 bp, Homo sapien
agtcactgagtagaggtcacagaga

SEQ ID NO: 154758 - DNA, 25 bp, Homo sapien
ggagctagagggttgtgacccttca

SEQ ID NO: 154759 - DNA, 25 bp, Homo sapien
agggttgtgacccttcatacacaca

SEQ ID NO: 154760 - DNA, 25 bp, Homo sapien
ttgtgacccttcatacacacacgca

SEQ ID NO: 154761 - DNA, 25 bp, Homo sapien
aaagccttaagcagaagaatgtctt

SEQ ID NO: 154762 - DNA, 25 bp, Homo sapien
gaatgtcttagcatcatgagacgag

SEQ ID NO: 154763 - DNA, 25 bp, Homo sapien
agacgagaaatagactcttcctccc

SEQ ID NO: 154764 - DNA, 25 bp, Homo sapien
ctctttcacatatagcacagaaggt

SEQ ID NO: 154765 - DNA, 25 bp, Homo sapien
tgagctactgacaaactcaggcgga

SEQ ID NO: 154766 - DNA, 25 bp, Homo sapien
caaactcaggcggaggtgaccatgc

SEQ ID NO: 154767 - DNA, 25 bp, Homo sapien
gtgaccatgcccttcaccaaagctg

SEQ ID NO: 154768 - DNA, 25 bp, Homo sapien
gtcagagatgtgcttgcaaggtcca

SEQ ID NO: 154769 - DNA, 25 bp, Homo sapien
tccagggactgcgtggtctgccagc

SEQ ID NO: 154770 - DNA, 25 bp, Homo sapien
gtggtctgccagctgagatgctcct

SEQ ID NO: 154771 - DNA, 25 bp, Homo sapien
aggtgctgaccttgccacaggcaga

SEQ ID NO: 154772 - DNA, 25 bp, Homo sapien
cttgccacaggcagatgaatgtctt

SEQ ID NO: 154773 - DNA, 25 bp, Homo sapien
tgaatgtcttgaaagctcccgggcc

SEQ ID NO: 154774 - DNA, 25 bp, Homo sapien
cttcccaggaatccttgatctcatg

SEQ ID NO: 154775 - DNA, 25 bp, Homo sapien
ggaatccttgatctcatgactatta

SEQ ID NO: 154776 - DNA, 25 bp, Homo sapien
taaaacctcgtgcatggtggcagct

SEQ ID NO: 154777 - DNA, 25 bp, Homo sapien
ggtggcagctctaatttgaccaaaa

SEQ ID NO: 154778 - DNA, 25 bp, Homo sapien
gagattttgattatgcttgctggaa

SEQ ID NO: 154779 - DNA, 25 bp, Homo sapien
atgcttgctggaaatctaccctgtc

SEQ ID NO: 154780 - DNA, 25 bp, Homo sapien
gaaatctaccctgtcctgtgtgaga

SEQ ID NO: 154781 - DNA, 25 bp, Homo sapien
tgtaaactccttaattcaccgggct

SEQ ID NO: 154782 - DNA, 25 bp, Homo sapien
gggctcaactgctaccgaacagatt

SEQ ID NO: 154783 - DNA, 25 bp, Homo sapien
gattcatctagtggctacatcagca

SEQ ID NO: 154784 - DNA, 25 bp, Homo sapien
tacatcagcaccttgtgctttcaga

SEQ ID NO: 154785 - DNA, 25 bp, Homo sapien
cagatatctgtttcaatggcatttt

SEQ ID NO: 154786 - DNA, 25 bp, Homo sapien
tttgtggcatttgtctttaccgagt

SEQ ID NO: 154787 - DNA, 25 bp, Homo sapien
gttaatcacaagacatactggcagt

SEQ ID NO: 154788 - DNA, 25 bp, Homo sapien
actggcagtttcttagtggtgtaac

SEQ ID NO: 154789 - DNA, 25 bp, Homo sapien
gggttgctgactacatacccttcaa

SEQ ID NO: 154790 - DNA, 25 bp, Homo sapien
tgactacatacccttcaaccacgag

SEQ ID NO: 154791 - DNA, 25 bp, Homo sapien
catcacagccaatttcacacagtac

SEQ ID NO: 154792 - DNA, 25 bp, Homo sapien
tttcacacagtactaacgaagaggt

SEQ ID NO: 154793 - DNA, 25 bp, Homo sapien
aagaggtgggttcagcttctatcaa

SEQ ID NO: 154794 - DNA, 25 bp, Homo sapien
tgggttcagcttctatcaaacatct

SEQ ID NO: 154795 - DNA, 25 bp, Homo sapien
aagcgaatgcctgtgatgctaccat

SEQ ID NO: 154796 - DNA, 25 bp, Homo sapien
gtgatgctaccatattcctggtaaa

SEQ ID NO: 154797 - DNA, 25 bp, Homo sapien
catggagaaccactatgtagaataa

SEQ ID NO: 154798 - DNA, 25 bp, Homo sapien
aggctcttgggcttggagaacacgt

SEQ ID NO: 154799 - DNA, 25 bp, Homo sapien
tggagaacacgtgtgtctctgtgta

SEQ ID NO: 154800 - DNA, 25 bp, Homo sapien
ctgtgtgtctgcgtccgtgtctgtc

SEQ ID NO: 154801 - DNA, 25 bp, Homo sapien
gtgtctgtcagactgtctgcctgtc

SEQ ID NO: 154802 - DNA, 25 bp, Homo sapien
ctaggagctgggtctgaccgttgta

SEQ ID NO: 154803 - DNA, 25 bp, Homo sapien
gaccgttgtatggtttgacctgata

SEQ ID NO: 154804 - DNA, 25 bp, Homo sapien
tcctcctctgtgttttttccatgtc

SEQ ID NO: 154805 - DNA, 25 bp, Homo sapien
atgcccagtttttacccatcatgca

SEQ ID NO: 154806 - DNA, 25 bp, Homo sapien
catcatgcaccctgtacagttgcca

SEQ ID NO: 154807 - DNA, 25 bp, Homo sapien
tacagttgccacgttactgcctttt

SEQ ID NO: 154808 - DNA, 25 bp, Homo sapien
tatatttgacagaaaccaggtgcct

SEQ ID NO: 154809 - DNA, 25 bp, Homo sapien
gaacatccagaatgttaaccatgtg

SEQ ID NO: 154810 - DNA, 25 bp, Homo sapien
gagagaatatgtttaatccatgtat

SEQ ID NO: 154811 - DNA, 25 bp, Homo sapien
gaatatgtttaatccatgtattggt

SEQ ID NO: 154812 - DNA, 25 bp, Homo sapien
gtttaatccatgtattggtacttta

SEQ ID NO: 154813 - DNA, 25 bp, Homo sapien
tactttactgaaaaccaggttatat

SEQ ID NO: 154814 - DNA, 25 bp, Homo sapien
tgaaaaccaggttatattctaaaga

SEQ ID NO: 154815 - DNA, 25 bp, Homo sapien
gtgcttttgaacaagcctatttcca

SEQ ID NO: 154816 - DNA, 25 bp, Homo sapien
gcttttgaacaagcctatttccatt

SEQ ID NO: 154817 - DNA, 25 bp, Homo sapien
tttgaacaagcctatttccattttg

SEQ ID NO: 154818 - DNA, 25 bp, Homo sapien
tgaacaagcctatttccattttgaa

SEQ ID NO: 154819 - DNA, 25 bp, Homo sapien
aagtagatttcaggctaggtgcggt

SEQ ID NO: 154820 - DNA, 25 bp, Homo sapien
cgtggtggcagaggaggctatgatc

SEQ ID NO: 154821 - DNA, 25 bp, Homo sapien
gaggaggctatgatcgaggcggcta

SEQ ID NO: 154822 - DNA, 25 bp, Homo sapien
gaggctatgatcgaggcggctaccg

SEQ ID NO: 154823 - DNA, 25 bp, Homo sapien
ggctatgatcgaggcggctaccggg

SEQ ID NO: 154824 - DNA, 25 bp, Homo sapien
ggcggggaccgtggaggcttccgag

SEQ ID NO: 154825 - DNA, 25 bp, Homo sapien
acagaggtggctttggccctggcaa

SEQ ID NO: 154826 - DNA, 25 bp, Homo sapien
ctttggccctggcaagatggattcc

SEQ ID NO: 154827 - DNA, 25 bp, Homo sapien
gatcgcagggagaggccgtattaat

SEQ ID NO: 154828 - DNA, 25 bp, Homo sapien
gtattaattagcctggctccccagg

SEQ ID NO: 154829 - DNA, 25 bp, Homo sapien
tgtacccagtgttaccctcgttatt

SEQ ID NO: 154830 - DNA, 25 bp, Homo sapien
tgtaaccttccaattcctgatcacc

SEQ ID NO: 154831 - DNA, 25 bp, Homo sapien
tcctgcccaggactgcattgttttc

SEQ ID NO: 154832 - DNA, 25 bp, Homo sapien
gcccaggactgcattgttttctagc

SEQ ID NO: 154833 - DNA, 25 bp, Homo sapien
aggactgcattgttttctagccccg

SEQ ID NO: 154834 - DNA, 25 bp, Homo sapien
tgcattgttttctagccccgaggtg

SEQ ID NO: 154835 - DNA, 25 bp, Homo sapien
cagcgctctgggagccacgcctatg

SEQ ID NO: 154836 - DNA, 25 bp, Homo sapien
gtcacacaccagcactttatacact

SEQ ID NO: 154837 - DNA, 25 bp, Homo sapien
cagcactttatacacttctggctca

SEQ ID NO: 154838 - DNA, 25 bp, Homo sapien
actttatacacttctggctcacagg

SEQ ID NO: 154839 - DNA, 25 bp, Homo sapien
atacacttctggctcacaggaaagt

SEQ ID NO: 154840 - DNA, 25 bp, Homo sapien
ttctggctcacaggaaagtgtctgc

SEQ ID NO: 154841 - DNA, 25 bp, Homo sapien
ggctcacaggaaagtgtctgcagta

SEQ ID NO: 154842 - DNA, 25 bp, Homo sapien
tttggcatataggaagcacgctggt

SEQ ID NO: 154843 - DNA, 25 bp, Homo sapien
gcacgctggtgctaagtatttttta

SEQ ID NO: 154844 - DNA, 25 bp, Homo sapien
gtaagcaaagctgaactgtaaatct

SEQ ID NO: 154845 - DNA, 25 bp, Homo sapien
aatggatcttttatggccctatgat

SEQ ID NO: 154846 - DNA, 25 bp, Homo sapien
tatggccctatgatctatcctttac

SEQ ID NO: 154847 - DNA, 25 bp, Homo sapien
gccctatgatctatcctttacttga

SEQ ID NO: 154848 - DNA, 25 bp, Homo sapien
gatctatcctttacttgaaagcttt

SEQ ID NO: 154849 - DNA, 25 bp, Homo sapien
aaagtggaaaggtcattttgttgca

SEQ ID NO: 154850 - DNA, 25 bp, Homo sapien
tcattttgttgcatttccccatttc

SEQ ID NO: 154851 - DNA, 25 bp, Homo sapien
aaagaccaacaaatctcaagcccta

SEQ ID NO: 154852 - DNA, 25 bp, Homo sapien
ccctataaatggcttgtattgaact

SEQ ID NO: 154853 - DNA, 25 bp, Homo sapien
atatatctgtggagagtgtcacaca

SEQ ID NO: 154854 - DNA, 25 bp, Homo sapien
gagagtgtcacacagaaaatgaaat

SEQ ID NO: 154855 - DNA, 25 bp, Homo sapien
tctagggatccaatcagatgcagag

SEQ ID NO: 154856 - DNA, 25 bp, Homo sapien
ggatccaatcagatgcagagaatgt

SEQ ID NO: 154857 - DNA, 25 bp, Homo sapien
tggtcgtttttgatgctcgatgaat

SEQ ID NO: 154858 - DNA, 25 bp, Homo sapien
tgatgctcgatgaatgctgggaatt

SEQ ID NO: 154859 - DNA, 25 bp, Homo sapien
aggaatgtcttcacttatacttgga

SEQ ID NO: 154860 - DNA, 25 bp, Homo sapien
acttatacttggatttgctctcttc

SEQ ID NO: 154861 - DNA, 25 bp, Homo sapien
ccagaaggacgttcaacctccaaag

SEQ ID NO: 154862 - DNA, 25 bp, Homo sapien
aaggacgttcaacctccaaagcagc

SEQ ID NO: 154863 - DNA, 25 bp, Homo sapien
aagcagcaaccaatgatatatatct

SEQ ID NO: 154864 - DNA, 25 bp, Homo sapien
gaagctgcccaagaaacggaagaag

SEQ ID NO: 154865 - DNA, 25 bp, Homo sapien
aacggaagaagcacgtgccacggcc

SEQ ID NO: 154866 - DNA, 25 bp, Homo sapien
cggcgcagctggagtcacccatgta

SEQ ID NO: 154867 - DNA, 25 bp, Homo sapien
tggagtcacccatgtactgcaagtc

SEQ ID NO: 154868 - DNA, 25 bp, Homo sapien
gtcacccatgtactgcaagtctgag

SEQ ID NO: 154869 - DNA, 25 bp, Homo sapien
gacagcacctgcagtgataccagcc

SEQ ID NO: 154870 - DNA, 25 bp, Homo sapien
cagtggcctagggagtttccaaatg

SEQ ID NO: 154871 - DNA, 25 bp, Homo sapien
gtttccaaatggacctcagaccttg

SEQ ID NO: 154872 - DNA, 25 bp, Homo sapien
caaatggacctcagaccttgggatt

SEQ ID NO: 154873 - DNA, 25 bp, Homo sapien
ggacctcagaccttgggatttggca

SEQ ID NO: 154874 - DNA, 25 bp, Homo sapien
ttgggatttggcatgtgttttgtgt

SEQ ID NO: 154875 - DNA, 25 bp, Homo sapien
gcccagcttataagaatggtgttag

SEQ ID NO: 154876 - DNA, 25 bp, Homo sapien
catgctgtttatgaacggaaatcat

SEQ ID NO: 154877 - DNA, 25 bp, Homo sapien
gaaatcatgatttccctgtagaaag

SEQ ID NO: 154878 - DNA, 25 bp, Homo sapien
tcatgatttccctgtagaaagtgag

SEQ ID NO: 154879 - DNA, 25 bp, Homo sapien
taaatgtctttttcacaatcatgtg

SEQ ID NO: 154880 - DNA, 25 bp, Homo sapien
acaatcatgtgactgggaaggcaat

SEQ ID NO: 154881 - DNA, 25 bp, Homo sapien
tcatgtgactgggaaggcaatttca

SEQ ID NO: 154882 - DNA, 25 bp, Homo sapien
tgggaaggcaatttcatactaaact

SEQ ID NO: 154883 - DNA, 25 bp, Homo sapien
acaactgtttgcacttacagctttt

SEQ ID NO: 154884 - DNA, 25 bp, Homo sapien
ttttatatctgttttgctgtggcgt

SEQ ID NO: 154885 - DNA, 25 bp, Homo sapien
tatatctgttttgctgtggcgttgg

SEQ ID NO: 154886 - DNA, 25 bp, Homo sapien
aatcctgttctctgacatccgtgga

SEQ ID NO: 154887 - DNA, 25 bp, Homo sapien
acctatgcctcctataagtccagtt

SEQ ID NO: 154888 - DNA, 25 bp, Homo sapien
aagtccagttgaaatctcagcctcc

SEQ ID NO: 154889 - DNA, 25 bp, Homo sapien
aacattttcttctcgtgtgtggccc

SEQ ID NO: 154890 - DNA, 25 bp, Homo sapien
tccacttctccaacttctgtttaat

SEQ ID NO: 154891 - DNA, 25 bp, Homo sapien
gtttaatctgatcacggctcttttt

SEQ ID NO: 154892 - DNA, 25 bp, Homo sapien
ttaagccctggcagcattttggtcc

SEQ ID NO: 154893 - DNA, 25 bp, Homo sapien
tgctccttgcccatagtaaaacagc

SEQ ID NO: 154894 - DNA, 25 bp, Homo sapien
aaacagcttgaaatatcccatgcaa

SEQ ID NO: 154895 - DNA, 25 bp, Homo sapien
agtagtttcaagtgggcgactctgc

SEQ ID NO: 154896 - DNA, 25 bp, Homo sapien
ggcgactctgctctctatttaaaag

SEQ ID NO: 154897 - DNA, 25 bp, Homo sapien
ggtgctgcacgtgaacaagcctgac

SEQ ID NO: 154898 - DNA, 25 bp, Homo sapien
cttactgtggtaaatggtttgtgag

SEQ ID NO: 154899 - DNA, 25 bp, Homo sapien
aatggtttgtgagtactggaaaaga

SEQ ID NO: 154900 - DNA, 25 bp, Homo sapien
agataacctcctcaatgcttggcgg

SEQ ID NO: 154901 - DNA, 25 bp, Homo sapien
ataacctcctcaatgcttggcggac

SEQ ID NO: 154902 - DNA, 25 bp, Homo sapien
aatgcttggcggaccccctatggag

SEQ ID NO: 154903 - DNA, 25 bp, Homo sapien
attccagtccaaagagtcctcgtca

SEQ ID NO: 154904 - DNA, 25 bp, Homo sapien
aaagagtcctcgtcagtgcttagct

SEQ ID NO: 154905 - DNA, 25 bp, Homo sapien
agtcctcgtcagtgcttagctgtga

SEQ ID NO: 154906 - DNA, 25 bp, Homo sapien
ctctgtggatgataagtacatagtc

SEQ ID NO: 154907 - DNA, 25 bp, Homo sapien
ataagtacatagtcactggctcggg

SEQ ID NO: 154908 - DNA, 25 bp, Homo sapien
taaatactgtgcttactgtgaaata

SEQ ID NO: 154909 - DNA, 25 bp, Homo sapien
aaatactgtgcttactgtgaaatat

SEQ ID NO: 154910 - DNA, 25 bp, Homo sapien
tgtgaaatatatcagttggtgagcc

SEQ ID NO: 154911 - DNA, 25 bp, Homo sapien
gtgaaatatatcagttggtgagccg

SEQ ID NO: 154912 - DNA, 25 bp, Homo sapien
tgaaatatatcagttggtgagccgg

SEQ ID NO: 154913 - DNA, 25 bp, Homo sapien
gaaatatatcagttggtgagccggg

SEQ ID NO: 154914 - DNA, 25 bp, Homo sapien
aaatatatcagttggtgagccgggc

SEQ ID NO: 154915 - DNA, 25 bp, Homo sapien
aatatatcagttggtgagccgggcg

SEQ ID NO: 154916 - DNA, 25 bp, Homo sapien
atatatcagttggtgagccgggcgt

SEQ ID NO: 154917 - DNA, 25 bp, Homo sapien
atatcagttggtgagccgggcgtgg

SEQ ID NO: 154918 - DNA, 25 bp, Homo sapien
tatcagttggtgagccgggcgtggt

SEQ ID NO: 154919 - DNA, 25 bp, Homo sapien
tgcatacttgcacatcaaatcgatg

SEQ ID NO: 154920 - DNA, 25 bp, Homo sapien
gtacatagtttaacacgtggtcctt

SEQ ID NO: 154921 - DNA, 25 bp, Homo sapien
cacgtggtccttttgtgaaacctag

SEQ ID NO: 154922 - DNA, 25 bp, Homo sapien
gtccttttgtgaaacctagaactca

SEQ ID NO: 154923 - DNA, 25 bp, Homo sapien
tgaaacctagaactcagaggattgc

SEQ ID NO: 154924 - DNA, 25 bp, Homo sapien
tctttcagcctattttgagttaact

SEQ ID NO: 154925 - DNA, 25 bp, Homo sapien
gagttaacttcagtcctttcttagg

SEQ ID NO: 154926 - DNA, 25 bp, Homo sapien
acttcagtcctttcttagggaaatg

SEQ ID NO: 154927 - DNA, 25 bp, Homo sapien
tagggaaatgacagggcaaagcaat

SEQ ID NO: 154928 - DNA, 25 bp, Homo sapien
agcaatttttctgttggctttgggc

SEQ ID NO: 154929 - DNA, 25 bp, Homo sapien
gggctgtatttgtgcactaaatctt

SEQ ID NO: 154930 - DNA, 25 bp, Homo sapien
ggccatccaggtactaaggacccaa

SEQ ID NO: 154931 - DNA, 25 bp, Homo sapien
aggacccaaggcatacagattcaca

SEQ ID NO: 154932 - DNA, 25 bp, Homo sapien
aaattaactaatctttttgcctcag

SEQ ID NO: 154933 - DNA, 25 bp, Homo sapien
tgcctcagaataccaaaacaacaaa

SEQ ID NO: 154934 - DNA, 25 bp, Homo sapien
acaccaaactatctcattgcaattt

SEQ ID NO: 154935 - DNA, 25 bp, Homo sapien
agcagatttcagcaactatcctaaa

SEQ ID NO: 154936 - DNA, 25 bp, Homo sapien
gcaactatcctaaacaatgttattg

SEQ ID NO: 154937 - DNA, 25 bp, Homo sapien
attgtgttccattttaactgggata

SEQ ID NO: 154938 - DNA, 25 bp, Homo sapien
atacaaccatagaaaggcctctttg

SEQ ID NO: 154939 - DNA, 25 bp, Homo sapien
agaaaggcctctttgttacaaaatg

SEQ ID NO: 154940 - DNA, 25 bp, Homo sapien
aaagaaataactgctttgtttgcaa

SEQ ID NO: 154941 - DNA, 25 bp, Homo sapien
gaggaacaattctatccgaaggaac

SEQ ID NO: 154942 - DNA, 25 bp, Homo sapien
gaaggaacaattcttccctcatggt

SEQ ID NO: 154943 - DNA, 25 bp, Homo sapien
aattcttccctcatggtaccaaagg

SEQ ID NO: 154944 - DNA, 25 bp, Homo sapien
aaaggtgcaatttatgactccagaa

SEQ ID NO: 154945 - DNA, 25 bp, Homo sapien
aacacatcggaatcatgacagcaag

SEQ ID NO: 154946 - DNA, 25 bp, Homo sapien
gacagcaagataaccccaagacagt

SEQ ID NO: 154947 - DNA, 25 bp, Homo sapien
gacagtcttttatcaagttttgacg

SEQ ID NO: 154948 - DNA, 25 bp, Homo sapien
gttttgacggtttatgctgggcact

SEQ ID NO: 154949 - DNA, 25 bp, Homo sapien
tgggcactgccagactgaaccagag

SEQ ID NO: 154950 - DNA, 25 bp, Homo sapien
gatattcatattcaagcaacagcac

SEQ ID NO: 154951 - DNA, 25 bp, Homo sapien
gcaacagcactttctgtagtaataa

SEQ ID NO: 154952 - DNA, 25 bp, Homo sapien
taagaacgcgtatcacaatgtgact

SEQ ID NO: 154953 - DNA, 25 bp, Homo sapien
gcagagcagctctttttgaaggaca

SEQ ID NO: 154954 - DNA, 25 bp, Homo sapien
gcagctctttttgaaggacattata

SEQ ID NO: 154955 - DNA, 25 bp, Homo sapien
aaaacctcgtaatcaacttgactca

SEQ ID NO: 154956 - DNA, 25 bp, Homo sapien
acttgactcaagattgactctacag

SEQ ID NO: 154957 - DNA, 25 bp, Homo sapien
tcaagattgactctacagactcaga

SEQ ID NO: 154958 - DNA, 25 bp, Homo sapien
actcagaagatgatgctaacagtgt

SEQ ID NO: 154959 - DNA, 25 bp, Homo sapien
taaaatatgttggatgcactcgtca

SEQ ID NO: 154960 - DNA, 25 bp, Homo sapien
ggatgcactcgtcaaataattatgt

SEQ ID NO: 154961 - DNA, 25 bp, Homo sapien
gtgattcataaccaccagcttaatt

SEQ ID NO: 154962 - DNA, 25 bp, Homo sapien
aaccaccagcttaatttctgtgaat

SEQ ID NO: 154963 - DNA, 25 bp, Homo sapien
tctcttccccatcttgcattggagg

SEQ ID NO: 154964 - DNA, 25 bp, Homo sapien
catcttgcattggaggtcccagaaa

SEQ ID NO: 154965 - DNA, 25 bp, Homo sapien
acttctttccctgttgactttgctg

SEQ ID NO: 154966 - DNA, 25 bp, Homo sapien
tctttccctgttgactttgctgttt

SEQ ID NO: 154967 - DNA, 25 bp, Homo sapien
tttgtgtttttataactgtcaccag

SEQ ID NO: 154968 - DNA, 25 bp, Homo sapien
aactgtcaccagttagccactgttt

SEQ ID NO: 154969 - DNA, 25 bp, Homo sapien
tcaccagttagccactgtttaaatt

SEQ ID NO: 154970 - DNA, 25 bp, Homo sapien
atatattgttctgaggcgcctggcc

SEQ ID NO: 154971 - DNA, 25 bp, Homo sapien
tgcccacccttgtgttgtagtgaga

SEQ ID NO: 154972 - DNA, 25 bp, Homo sapien
cacccttgtgttgtagtgagaagct

SEQ ID NO: 154973 - DNA, 25 bp, Homo sapien
ttgtagtgagaagctgttgtcacga

SEQ ID NO: 154974 - DNA, 25 bp, Homo sapien
gaccgtgtgtgcaggccgctgttct

SEQ ID NO: 154975 - DNA, 25 bp, Homo sapien
aggccgctgttctcccaagctcggg

SEQ ID NO: 154976 - DNA, 25 bp, Homo sapien
ggcagccactgtcgccggacttggg

SEQ ID NO: 154977 - DNA, 25 bp, Homo sapien
gggtgaagacagtcactcatccgtg

SEQ ID NO: 154978 - DNA, 25 bp, Homo sapien
agacagtcactcatccgtgcaagct

SEQ ID NO: 154979 - DNA, 25 bp, Homo sapien
tccagaagggatgcaagctctccag

SEQ ID NO: 154980 - DNA, 25 bp, Homo sapien
gtggagtcaccactcgggacataga

SEQ ID NO: 154981 - DNA, 25 bp, Homo sapien
catagagggtggacagttcaggcct

SEQ ID NO: 154982 - DNA, 25 bp, Homo sapien
gtgtctgcctccttgggactgtgga

SEQ ID NO: 154983 - DNA, 25 bp, Homo sapien
actgtggagtgggtgccctcagtaa

SEQ ID NO: 154984 - DNA, 25 bp, Homo sapien
gggtgccctcagtaaagcgctttgt

SEQ ID NO: 154985 - DNA, 25 bp, Homo sapien
tttcctctctgcaaatggcttagct

SEQ ID NO: 154986 - DNA, 25 bp, Homo sapien
gggcaagacagactcattaaatatt

SEQ ID NO: 154987 - DNA, 25 bp, Homo sapien
agatatatcagtgttgtctcataga

SEQ ID NO: 154988 - DNA, 25 bp, Homo sapien
tcagtgttgtctcatagaactgcct

SEQ ID NO: 154989 - DNA, 25 bp, Homo sapien
agaactgcctggattccatttatgt

SEQ ID NO: 154990 - DNA, 25 bp, Homo sapien
ctgcctggattccatttatgttttt

SEQ ID NO: 154991 - DNA, 25 bp, Homo sapien
atgttttttctgattccatcctgtg

SEQ ID NO: 154992 - DNA, 25 bp, Homo sapien
ttcatccttgactcctttggtattt

SEQ ID NO: 154993 - DNA, 25 bp, Homo sapien
atccttgactcctttggtatttcac

SEQ ID NO: 154994 - DNA, 25 bp, Homo sapien
gactcctttggtatttcactgaatt

SEQ ID NO: 154995 - DNA, 25 bp, Homo sapien
actgaatttcaaacatttgtcagag

SEQ ID NO: 154996 - DNA, 25 bp, Homo sapien
ctgttgctggatcttgagtcccatt

SEQ ID NO: 154997 - DNA, 25 bp, Homo sapien
gttgctggatcttgagtcccattag

SEQ ID NO: 154998 - DNA, 25 bp, Homo sapien
ttgctggatcttgagtcccattagc

SEQ ID NO: 154999 - DNA, 25 bp, Homo sapien
cccattagctgtgagatgcctgtga

SEQ ID NO: 155000 - DNA, 25 bp, Homo sapien
attagctgtgagatgcctgtgagag

SEQ ID NO: 155001 - DNA, 25 bp, Homo sapien
tagctgtgagatgcctgtgagagcc

SEQ ID NO: 155002 - DNA, 25 bp, Homo sapien
gaccccgtccttagaatcttctgga

SEQ ID NO: 155003 - DNA, 25 bp, Homo sapien
cccgtccttagaatcttctggagga

SEQ ID NO: 155004 - DNA, 25 bp, Homo sapien
aatcttctggaggagcctccctccc

SEQ ID NO: 155005 - DNA, 25 bp, Homo sapien
actgctcctggagttctcatctgat

SEQ ID NO: 155006 - DNA, 25 bp, Homo sapien
gcctgctctctttccctacaactag

SEQ ID NO: 155007 - DNA, 25 bp, Homo sapien
gagttgatgaattcctgttaaaagc

SEQ ID NO: 155008 - DNA, 25 bp, Homo sapien
tcctgttaaaagctgttcttgtgtg

SEQ ID NO: 155009 - DNA, 25 bp, Homo sapien
aaaagctgttcttgtgtgttacatg

SEQ ID NO: 155010 - DNA, 25 bp, Homo sapien
gctgttcttgtgtgttacatgtaac

SEQ ID NO: 155011 - DNA, 25 bp, Homo sapien
gtgttacatgtaacagacacggtaa

SEQ ID NO: 155012 - DNA, 25 bp, Homo sapien
gacacggtaaatatttgtttacagt

SEQ ID NO: 155013 - DNA, 25 bp, Homo sapien
caaaccatgcatttaagtttaagtg

SEQ ID NO: 155014 - DNA, 25 bp, Homo sapien
gaagcaatgtgggtgctgactacta

SEQ ID NO: 155015 - DNA, 25 bp, Homo sapien
aatgtgggtgctgactactagtagt

SEQ ID NO: 155016 - DNA, 25 bp, Homo sapien
gggtgctgactactagtagtatcaa

SEQ ID NO: 155017 - DNA, 25 bp, Homo sapien
tatgttcaggattgttttgatacct

SEQ ID NO: 155018 - DNA, 25 bp, Homo sapien
aagctctccagaaggggtgtgatct

SEQ ID NO: 155019 - DNA, 25 bp, Homo sapien
gtggagtcaccactcgggacataga

SEQ ID NO: 155020 - DNA, 25 bp, Homo sapien
gtcaccactcgggacatagagggtg

SEQ ID NO: 155021 - DNA, 25 bp, Homo sapien
catagagggtggacagttcaggcct

SEQ ID NO: 155022 - DNA, 25 bp, Homo sapien
ggtggacagttcaggcctgtgtctg

SEQ ID NO: 155023 - DNA, 25 bp, Homo sapien
gtgtctgcctccttgggactgtgga

SEQ ID NO: 155024 - DNA, 25 bp, Homo sapien
gtctgcctccttgggactgtggagt

SEQ ID NO: 155025 - DNA, 25 bp, Homo sapien
actgtggagtgggtgccctcagtaa

SEQ ID NO: 155026 - DNA, 25 bp, Homo sapien
gagtgggtgccctcagtaaagcgct

SEQ ID NO: 155027 - DNA, 25 bp, Homo sapien
gtgggtgccctcagtaaagcgcttt

SEQ ID NO: 155028 - DNA, 25 bp, Homo sapien
gggtgccctcagtaaagcgctttgt

SEQ ID NO: 155029 - DNA, 25 bp, Homo sapien
tccccaggtcatgctgctgttgctg

SEQ ID NO: 155030 - DNA, 25 bp, Homo sapien
ctgctgttgctggactgaggaccac

SEQ ID NO: 155031 - DNA, 25 bp, Homo sapien
tgttgctggactgaggaccacactt

SEQ ID NO: 155032 - DNA, 25 bp, Homo sapien
gaacctgtgctctaagtgaatactt

SEQ ID NO: 155033 - DNA, 25 bp, Homo sapien
acttggaagtcgtttcaggacatgg

SEQ ID NO: 155034 - DNA, 25 bp, Homo sapien
ctgaggatcctcacaggagcagaca

SEQ ID NO: 155035 - DNA, 25 bp, Homo sapien
aggatcctcacaggagcagacagag

SEQ ID NO: 155036 - DNA, 25 bp, Homo sapien
aagcccaggctgaagagtttaactt

SEQ ID NO: 155037 - DNA, 25 bp, Homo sapien
tgaagagtttaactttgggcccaga

SEQ ID NO: 155038 - DNA, 25 bp, Homo sapien
gcccagaaactcaaccatcaatgga

SEQ ID NO: 155039 - DNA, 25 bp, Homo sapien
aaccatcaatggaaacagggcagtg

SEQ ID NO: 155040 - DNA, 25 bp, Homo sapien
tggggcgcaactggacatgccactc

SEQ ID NO: 155041 - DNA, 25 bp, Homo sapien
tcgtggcagtgatggcccctgcaga

SEQ ID NO: 155042 - DNA, 25 bp, Homo sapien
gcagaggcagcctgaggtcaccggg

SEQ ID NO: 155043 - DNA, 25 bp, Homo sapien
ggcagcctgaggtcaccgggcccga

SEQ ID NO: 155044 - DNA, 25 bp, Homo sapien
ttcctgtaggcgagggcccaagtct

SEQ ID NO: 155045 - DNA, 25 bp, Homo sapien
tcctgtaggcgagggcccaagtctg

SEQ ID NO: 155046 - DNA, 25 bp, Homo sapien
aagagtttctctccatcggccccat

SEQ ID NO: 155047 - DNA, 25 bp, Homo sapien
tttgcctcctaccagtgaacctcat

SEQ ID NO: 155048 - DNA, 25 bp, Homo sapien
tcctaccagtgaacctcatctttgt

SEQ ID NO: 155049 - DNA, 25 bp, Homo sapien
taccagtgaacctcatctttgtatg

SEQ ID NO: 155050 - DNA, 25 bp, Homo sapien
ccagtgaacctcatctttgtatgaa

SEQ ID NO: 155051 - DNA, 25 bp, Homo sapien
gggcaggaaggaacttcactctgct

SEQ ID NO: 155052 - DNA, 25 bp, Homo sapien
aggaaggaacttcactctgctgctt

SEQ ID NO: 155053 - DNA, 25 bp, Homo sapien
ggaaggaacttcactctgctgcttc

SEQ ID NO: 155054 - DNA, 25 bp, Homo sapien
aaggaacttcactctgctgcttccg

SEQ ID NO: 155055 - DNA, 25 bp, Homo sapien
ggaacttcactctgctgcttccgag

SEQ ID NO: 155056 - DNA, 25 bp, Homo sapien
gctgcttccgagaacctcggccgtg

SEQ ID NO: 155057 - DNA, 25 bp, Homo sapien
ttccgagaacctcggccgtgacatt

SEQ ID NO: 155058 - DNA, 25 bp, Homo sapien
cgagaacctcggccgtgacattcgg

SEQ ID NO: 155059 - DNA, 25 bp, Homo sapien
gggccgctgcgagaagttcacccac

SEQ ID NO: 155060 - DNA, 25 bp, Homo sapien
aaataattaaactcgcaggccaggc

SEQ ID NO: 155061 - DNA, 25 bp, Homo sapien
taattaaactcgcaggccaggcacg

SEQ ID NO: 155062 - DNA, 25 bp, Homo sapien
gattttttcatgctggtcatgacct

SEQ ID NO: 155063 - DNA, 25 bp, Homo sapien
catgctggtcatgacctgaaggaaa

SEQ ID NO: 155064 - DNA, 25 bp, Homo sapien
cgtataatgtatgtctggtgttttt

SEQ ID NO: 155065 - DNA, 25 bp, Homo sapien
gtctggtgtttttaacttgatcatg

SEQ ID NO: 155066 - DNA, 25 bp, Homo sapien
tgaggtgcaacttcttcacatactg

SEQ ID NO: 155067 - DNA, 25 bp, Homo sapien
atacctgtgaccactcttgggagtg

SEQ ID NO: 155068 - DNA, 25 bp, Homo sapien
gaccactcttgggagtgctgcagtc

SEQ ID NO: 155069 - DNA, 25 bp, Homo sapien
aactgttgtggcacaagttctcttg

SEQ ID NO: 155070 - DNA, 25 bp, Homo sapien
agagagatatatacacttttgattg

SEQ ID NO: 155071 - DNA, 25 bp, Homo sapien
tttgattgttttctagatgtctacc

SEQ ID NO: 155072 - DNA, 25 bp, Homo sapien
tagatgtctaccaataaatgcaatt

SEQ ID NO: 155073 - DNA, 25 bp, Homo sapien
acttgggcccaagtttcagaatagt

SEQ ID NO: 155074 - DNA, 25 bp, Homo sapien
gtttcagaatagtgttcccctatca

SEQ ID NO: 155075 - DNA, 25 bp, Homo sapien
tagtgttcccctatcaaggctgtga

SEQ ID NO: 155076 - DNA, 25 bp, Homo sapien
caaggctgtgactagatcaggcagg

SEQ ID NO: 155077 - DNA, 25 bp, Homo sapien
gatcaggcagggatccattccctgt

SEQ ID NO: 155078 - DNA, 25 bp, Homo sapien
ctaccttcaggccatttagagttgt

SEQ ID NO: 155079 - DNA, 25 bp, Homo sapien
aatttacaaagatccacggtgggct

SEQ ID NO: 155080 - DNA, 25 bp, Homo sapien
aaagatccacggtgggctccagctg

SEQ ID NO: 155081 - DNA, 25 bp, Homo sapien
gggccaagacactgcctaaggtgtg

SEQ ID NO: 155082 - DNA, 25 bp, Homo sapien
gggactggctgagattgcagcccat

SEQ ID NO: 155083 - DNA, 25 bp, Homo sapien
gcccatggtaggagctggaccaact

SEQ ID NO: 155084 - DNA, 25 bp, Homo sapien
gcaagagtgtgaaatctcagatact

SEQ ID NO: 155085 - DNA, 25 bp, Homo sapien
gatacttatgaaatctcacagatgt

SEQ ID NO: 155086 - DNA, 25 bp, Homo sapien
atctcacagatgtaaggactcaagt

SEQ ID NO: 155087 - DNA, 25 bp, Homo sapien
aatagggcaagaattcttatgctta

SEQ ID NO: 155088 - DNA, 25 bp, Homo sapien
aattcttatgcttatgagagccaag

SEQ ID NO: 155089 - DNA, 25 bp, Homo sapien
gcttatgagagccaagtagtcagtg

SEQ ID NO: 155090 - DNA, 25 bp, Homo sapien
gagagtagagctcaaaactggatta

SEQ ID NO: 155091 - DNA, 25 bp, Homo sapien
aactggattatcaccttagcaactt

SEQ ID NO: 155092 - DNA, 25 bp, Homo sapien
tatcaccttagcaacttagaatagt

SEQ ID NO: 155093 - DNA, 25 bp, Homo sapien
aagtatttaatttggatctggatct

SEQ ID NO: 155094 - DNA, 25 bp, Homo sapien
gatctggatctgttaagatatgcac

SEQ ID NO: 155095 - DNA, 25 bp, Homo sapien
ttccatcatcatgtcgtcgcagaag

SEQ ID NO: 155096 - DNA, 25 bp, Homo sapien
atcatcatgtcgtcgcagaaggcgc

SEQ ID NO: 155097 - DNA, 25 bp, Homo sapien
tcatgtcgtcgcagaaggcgctggt

SEQ ID NO: 155098 - DNA, 25 bp, Homo sapien
cgcagaaggcgctggtgtcaggcaa

SEQ ID NO: 155099 - DNA, 25 bp, Homo sapien
tgtcaggcaagccagcagagagctc

SEQ ID NO: 155100 - DNA, 25 bp, Homo sapien
agaagaaggcggtgactccagctcc

SEQ ID NO: 155101 - DNA, 25 bp, Homo sapien
ccataaagaggtgggagctgtcctc

SEQ ID NO: 155102 - DNA, 25 bp, Homo sapien
gggagctgtcctcggaccagcctta

SEQ ID NO: 155103 - DNA, 25 bp, Homo sapien
gaccagccttacctgtgacactgca

SEQ ID NO: 155104 - DNA, 25 bp, Homo sapien
cgactactttgcctccttggatttc

SEQ ID NO: 155105 - DNA, 25 bp, Homo sapien
gtgacctaatttatgacaaatacgt

SEQ ID NO: 155106 - DNA, 25 bp, Homo sapien
ggagtagggactaactatagcacaa

SEQ ID NO: 155107 - DNA, 25 bp, Homo sapien
gtaatatgtgccaatgctatttgtg

SEQ ID NO: 155108 - DNA, 25 bp, Homo sapien
gtgccaatgctatttgtgaaatgtt

SEQ ID NO: 155109 - DNA, 25 bp, Homo sapien
gtgaaatgtttggtctttctaaacg

SEQ ID NO: 155110 - DNA, 25 bp, Homo sapien
tggtctttctaaacgactaaaggat

SEQ ID NO: 155111 - DNA, 25 bp, Homo sapien
gttttgaaccaaatcctagagccag

SEQ ID NO: 155112 - DNA, 25 bp, Homo sapien
gaaccaaatcctagagccagctgat

SEQ ID NO: 155113 - DNA, 25 bp, Homo sapien
tcctagagccagctgataatattta

SEQ ID NO: 155114 - DNA, 25 bp, Homo sapien
ataagtggagattcctccttatgat

SEQ ID NO: 155115 - DNA, 25 bp, Homo sapien
gattcctccttatgatgtatgctag

SEQ ID NO: 155116 - DNA, 25 bp, Homo sapien
ggactttgtattttactgcatgttt

SEQ ID NO: 155117 - DNA, 25 bp, Homo sapien
gacgttgaagccatggcccgctacg

SEQ ID NO: 155118 - DNA, 25 bp, Homo sapien
aggacttccacccaagactgttggg

SEQ ID NO: 155119 - DNA, 25 bp, Homo sapien
agactgttgggtctgaccggctcca

SEQ ID NO: 155120 - DNA, 25 bp, Homo sapien
aggctagtcacagttaccgcgtgta

SEQ ID NO: 155121 - DNA, 25 bp, Homo sapien
gttaccgcgtgtactacaatgccgg

SEQ ID NO: 155122 - DNA, 25 bp, Homo sapien
tacatcgtggaccactccattgcca

SEQ ID NO: 155123 - DNA, 25 bp, Homo sapien
tgacggcctcttcacggattactac

SEQ ID NO: 155124 - DNA, 25 bp, Homo sapien
cacggattactacggccggagcaga

SEQ ID NO: 155125 - DNA, 25 bp, Homo sapien
gagcagatcggctgagcagatctca

SEQ ID NO: 155126 - DNA, 25 bp, Homo sapien
agatctcagacagtgtgcggcggca

SEQ ID NO: 155127 - DNA, 25 bp, Homo sapien
ttccgcagtgtcctgtcttgagcca

SEQ ID NO: 155128 - DNA, 25 bp, Homo sapien
gtgcccgtcatcgtgaacaatttcg

SEQ ID NO: 155129 - DNA, 25 bp, Homo sapien
aacaatttcgggatgtattactcct

SEQ ID NO: 155130 - DNA, 25 bp, Homo sapien
atgtattactccttagccatggcta

SEQ ID NO: 155131 - DNA, 25 bp, Homo sapien
gccatggctaagcagaaactaccaa

SEQ ID NO: 155132 - DNA, 25 bp, Homo sapien
aaaagaagcatattccgcggccacc

SEQ ID NO: 155133 - DNA, 25 bp, Homo sapien
taaatctgtcgtaaactctccacac

SEQ ID NO: 155134 - DNA, 25 bp, Homo sapien
tctccacaccacagtactcagagtg

SEQ ID NO: 155135 - DNA, 25 bp, Homo sapien
tcagagtgacacatgtccgctggcc

SEQ ID NO: 155136 - DNA, 25 bp, Homo sapien
tccgctggcccaggaagaaatttta

SEQ ID NO: 155137 - DNA, 25 bp, Homo sapien
cagagcaggtaggaaacctctcaga

SEQ ID NO: 155138 - DNA, 25 bp, Homo sapien
acctctcagaggcatgtcgatctga

SEQ ID NO: 155139 - DNA, 25 bp, Homo sapien
gagaagccagccagaagtcctggta

SEQ ID NO: 155140 - DNA, 25 bp, Homo sapien
gaagtcctggtagttacaagcaaag

SEQ ID NO: 155141 - DNA, 25 bp, Homo sapien
gaaacgggcacagcgaacatcctgg

SEQ ID NO: 155142 - DNA, 25 bp, Homo sapien
acagcgaacatcctggtgaagagca

SEQ ID NO: 155143 - DNA, 25 bp, Homo sapien
aaatgacagcagaagccatggcaca

SEQ ID NO: 155144 - DNA, 25 bp, Homo sapien
gaagccatggcacagacttgtatag

SEQ ID NO: 155145 - DNA, 25 bp, Homo sapien
aaaaaatgtacagagagcacccagg

SEQ ID NO: 155146 - DNA, 25 bp, Homo sapien
gagcacccaggaggtacacatacta

SEQ ID NO: 155147 - DNA, 25 bp, Homo sapien
ggaggtacacatactaaagtgacac

SEQ ID NO: 155148 - DNA, 25 bp, Homo sapien
gactgtatgtgacaattacctggga

SEQ ID NO: 155149 - DNA, 25 bp, Homo sapien
gtatgtgacaattacctgggaataa

SEQ ID NO: 155150 - DNA, 25 bp, Homo sapien
tttaatctttgtgacaggaaagccc

SEQ ID NO: 155151 - DNA, 25 bp, Homo sapien
ttccccttctgtgtcacagttcttg

SEQ ID NO: 155152 - DNA, 25 bp, Homo sapien
gtcacagttcttggtgactgtccca

SEQ ID NO: 155153 - DNA, 25 bp, Homo sapien
cagttcttggtgactgtcccaccgg

SEQ ID NO: 155154 - DNA, 25 bp, Homo sapien
tcagatgatctctccacggtagcac

SEQ ID NO: 155155 - DNA, 25 bp, Homo sapien
atgatctctccacggtagcacttga

SEQ ID NO: 155156 - DNA, 25 bp, Homo sapien
acggtagcacttgaccttttcgacg

SEQ ID NO: 155157 - DNA, 25 bp, Homo sapien
tagcacttgaccttttcgacgctta

SEQ ID NO: 155158 - DNA, 25 bp, Homo sapien
gcacttgaccttttcgacgcttaac

SEQ ID NO: 155159 - DNA, 25 bp, Homo sapien
gcaccacggcgtttttttacaacat

SEQ ID NO: 155160 - DNA, 25 bp, Homo sapien
tacaacattcaactttagtattttt

SEQ ID NO: 155161 - DNA, 25 bp, Homo sapien
tttgtcttttggattatctgtttac

SEQ ID NO: 155162 - DNA, 25 bp, Homo sapien
ggattatctgtttactgtctcatct

SEQ ID NO: 155163 - DNA, 25 bp, Homo sapien
atctgtttactgtctcatctgaact

SEQ ID NO: 155164 - DNA, 25 bp, Homo sapien
tactgtctcatctgaactgatccca

SEQ ID NO: 155165 - DNA, 25 bp, Homo sapien
gtctcatctgaactgatcccaggtg

SEQ ID NO: 155166 - DNA, 25 bp, Homo sapien
aactgatcccaggtgaacggtttat

SEQ ID NO: 155167 - DNA, 25 bp, Homo sapien
gatcccaggtgaacggtttattgcc

SEQ ID NO: 155168 - DNA, 25 bp, Homo sapien
ggtgaacggtttattgcctagattt

SEQ ID NO: 155169 - DNA, 25 bp, Homo sapien
acggtttattgcctagatttgtact

SEQ ID NO: 155170 - DNA, 25 bp, Homo sapien
ttattgcctagatttgtactcagag

SEQ ID NO: 155171 - DNA, 25 bp, Homo sapien
gcctagatttgtactcagaggaatt

SEQ ID NO: 155172 - DNA, 25 bp, Homo sapien
tttgacttgaaatgtttgcagatca

SEQ ID NO: 155173 - DNA, 25 bp, Homo sapien
gacttgaaatgtttgcagatcaact

SEQ ID NO: 155174 - DNA, 25 bp, Homo sapien
atgtttgcagatcaactataagcac

SEQ ID NO: 155175 - DNA, 25 bp, Homo sapien
gagataacttccaaaagagtgctgt

SEQ ID NO: 155176 - DNA, 25 bp, Homo sapien
taacttccaaaagagtgctgttttt

SEQ ID NO: 155177 - DNA, 25 bp, Homo sapien
ctttataaatgacaagtgctttgaa

SEQ ID NO: 155178 - DNA, 25 bp, Homo sapien
gcagaagtttatgtacagttgtata

SEQ ID NO: 155179 - DNA, 25 bp, Homo sapien
aatatgtttttcatgcagtttaaaa

SEQ ID NO: 155180 - DNA, 25 bp, Homo sapien
aaaatattccttctttgatgttgac

SEQ ID NO: 155181 - DNA, 25 bp, Homo sapien
atattccttctttgatgttgacatc

SEQ ID NO: 155182 - DNA, 25 bp, Homo sapien
attccttctttgatgttgacatcaa

SEQ ID NO: 155183 - DNA, 25 bp, Homo sapien
aaagaataactccaagtcttggcca

SEQ ID NO: 155184 - DNA, 25 bp, Homo sapien
aagaataactccaagtcttggccag

SEQ ID NO: 155185 - DNA, 25 bp, Homo sapien
agaataactccaagtcttggccagg

SEQ ID NO: 155186 - DNA, 25 bp, Homo sapien
gaataactccaagtcttggccaggc

SEQ ID NO: 155187 - DNA, 25 bp, Homo sapien
aataactccaagtcttggccaggcg

SEQ ID NO: 155188 - DNA, 25 bp, Homo sapien
ataactccaagtcttggccaggcgc

SEQ ID NO: 155189 - DNA, 25 bp, Homo sapien
taactccaagtcttggccaggcgca

SEQ ID NO: 155190 - DNA, 25 bp, Homo sapien
aactccaagtcttggccaggcgcag

SEQ ID NO: 155191 - DNA, 25 bp, Homo sapien
tgggtggatcatctaaggccgggag

SEQ ID NO: 155192 - DNA, 25 bp, Homo sapien
tggatcatctaaggccgggagttca

SEQ ID NO: 155193 - DNA, 25 bp, Homo sapien
gtagcgcatggctgtaatcctggct

SEQ ID NO: 155194 - DNA, 25 bp, Homo sapien
gatgcctgcatgctgggttctgcac

SEQ ID NO: 155195 - DNA, 25 bp, Homo sapien
catgctgggttctgcacagctggcc

SEQ ID NO: 155196 - DNA, 25 bp, Homo sapien
tggcctcccgcggttgggtcaacat

SEQ ID NO: 155197 - DNA, 25 bp, Homo sapien
tgggtcaacattgctggcctggaag

SEQ ID NO: 155198 - DNA, 25 bp, Homo sapien
agaagagacccaaccacttcctatt

SEQ ID NO: 155199 - DNA, 25 bp, Homo sapien
accacttcctattttttgaggctat

SEQ ID NO: 155200 - DNA, 25 bp, Homo sapien
gaggctatgaatatagtacctgaaa

SEQ ID NO: 155201 - DNA, 25 bp, Homo sapien
tacacattaaaacatcgcacaaaaa

SEQ ID NO: 155202 - DNA, 25 bp, Homo sapien
aaaaacgatgcatctaccgctcctt

SEQ ID NO: 155203 - DNA, 25 bp, Homo sapien
gcatctaccgctccttgggaaataa

SEQ ID NO: 155204 - DNA, 25 bp, Homo sapien
ctaccgctccttgggaaataatctg

SEQ ID NO: 155205 - DNA, 25 bp, Homo sapien
agctatctgaatggccaactcactt

SEQ ID NO: 155206 - DNA, 25 bp, Homo sapien
acttcttttcttacactcttggaca

SEQ ID NO: 155207 - DNA, 25 bp, Homo sapien
ggaccatgccacaaaaacttaccgt

SEQ ID NO: 155208 - DNA, 25 bp, Homo sapien
agtaatgcaatctgcctcccttttt

SEQ ID NO: 155209 - DNA, 25 bp, Homo sapien
agagtaccgggtgccagactgaact

SEQ ID NO: 155210 - DNA, 25 bp, Homo sapien
agactgaactgcttcctctttcctt

SEQ ID NO: 155211 - DNA, 25 bp, Homo sapien
cctctttccttcagctatctgtggg

SEQ ID NO: 155212 - DNA, 25 bp, Homo sapien
gggaccttgtttattctagagagaa

SEQ ID NO: 155213 - DNA, 25 bp, Homo sapien
ctcaaatttttcgtaccaggagatt

SEQ ID NO: 155214 - DNA, 25 bp, Homo sapien
ggagattttcttaccttcatttgct

SEQ ID NO: 155215 - DNA, 25 bp, Homo sapien
accttcatttgcttttatgctgcag

SEQ ID NO: 155216 - DNA, 25 bp, Homo sapien
attgccttaccggtccctgtcattg

SEQ ID NO: 155217 - DNA, 25 bp, Homo sapien
ggcccaatacttgcaagtgacaagc

SEQ ID NO: 155218 - DNA, 25 bp, Homo sapien
tgacaagctgtccaaagatcccatc

SEQ ID NO: 155219 - DNA, 25 bp, Homo sapien
catcctcccctgacctaaagaaaag

SEQ ID NO: 155220 - DNA, 25 bp, Homo sapien
agaagtgcctctaccattagtaagt

SEQ ID NO: 155221 - DNA, 25 bp, Homo sapien
gcctctaccattagtaagtctgatt

SEQ ID NO: 155222 - DNA, 25 bp, Homo sapien
aagtctgattacatggagatccagg

SEQ ID NO: 155223 - DNA, 25 bp, Homo sapien
agatccaggagggtgtaaataacag

SEQ ID NO: 155224 - DNA, 25 bp, Homo sapien
ttgaaaacagccaactgtaccttgg

SEQ ID NO: 155225 - DNA, 25 bp, Homo sapien
caactgtaccttggctaacacaaac

SEQ ID NO: 155226 - DNA, 25 bp, Homo sapien
gtaccttggctaacacaaactatgt

SEQ ID NO: 155227 - DNA, 25 bp, Homo sapien
agtgctgcctgcagtcagctcggcc

SEQ ID NO: 155228 - DNA, 25 bp, Homo sapien
gggaatgcagcattcatgctggtgt

SEQ ID NO: 155229 - DNA, 25 bp, Homo sapien
gcattcatgctggtgtgtcctggta

SEQ ID NO: 155230 - DNA, 25 bp, Homo sapien
tcatgctggtgtgtcctggtattgg

SEQ ID NO: 155231 - DNA, 25 bp, Homo sapien
aggataaatgtggccctgcctgctc

SEQ ID NO: 155232 - DNA, 25 bp, Homo sapien
tgcctgctcccaggtatacctagga

SEQ ID NO: 155233 - DNA, 25 bp, Homo sapien
tatacctaggaccacctggccagat

SEQ ID NO: 155234 - DNA, 25 bp, Homo sapien
agatccgctcccagacggccttgga

SEQ ID NO: 155235 - DNA, 25 bp, Homo sapien
agacggccttggactgcttgcattt

SEQ ID NO: 155236 - DNA, 25 bp, Homo sapien
ctgcttgcatttccccggagaaaaa

SEQ ID NO: 155237 - DNA, 25 bp, Homo sapien
taaatgggccatcctttcctgaaaa

SEQ ID NO: 155238 - DNA, 25 bp, Homo sapien
aagaatcttcttgatagctctccca

SEQ ID NO: 155239 - DNA, 25 bp, Homo sapien
gatagctctcccacaccatcagtgg

SEQ ID NO: 155240 - DNA, 25 bp, Homo sapien
atcagtggccctcataactggagta

SEQ ID NO: 155241 - DNA, 25 bp, Homo sapien
agagttcctggttgcttttcataag

SEQ ID NO: 155242 - DNA, 25 bp, Homo sapien
gttactttctttgtatctctgcaag

SEQ ID NO: 155243 - DNA, 25 bp, Homo sapien
tgcaagcagagatttctctttggtt

SEQ ID NO: 155244 - DNA, 25 bp, Homo sapien
gaggttgaagtgtctttggcccatt

SEQ ID NO: 155245 - DNA, 25 bp, Homo sapien
ttggcccatttgtaagtccccatcc

SEQ ID NO: 155246 - DNA, 25 bp, Homo sapien
aaatgatgtaattgcagctggtagg

SEQ ID NO: 155247 - DNA, 25 bp, Homo sapien
agctggtaggatgtctggtgcccaa

SEQ ID NO: 155248 - DNA, 25 bp, Homo sapien
tctggtgcccaatcccaggaagtga

SEQ ID NO: 155249 - DNA, 25 bp, Homo sapien
atacatctttgtgcgtagagccaaa

SEQ ID NO: 155250 - DNA, 25 bp, Homo sapien
acatctttgtgcgtagagccaaaaa

SEQ ID NO: 155251 - DNA, 25 bp, Homo sapien
gaatcaatgttccagttagctttaa

SEQ ID NO: 155252 - DNA, 25 bp, Homo sapien
gctttaaaaggtatacggtgctaat

SEQ ID NO: 155253 - DNA, 25 bp, Homo sapien
ggtatacggtgctaattagtaaaat

SEQ ID NO: 155254 - DNA, 25 bp, Homo sapien
ggcaatattttactgctagcttgca

SEQ ID NO: 155255 - DNA, 25 bp, Homo sapien
aatattttactgctagcttgcaaag

SEQ ID NO: 155256 - DNA, 25 bp, Homo sapien
attttactgctagcttgcaaagtta

SEQ ID NO: 155257 - DNA, 25 bp, Homo sapien
tactgctagcttgcaaagttatgag

SEQ ID NO: 155258 - DNA, 25 bp, Homo sapien
gctagcttgcaaagttatgagagtt

SEQ ID NO: 155259 - DNA, 25 bp, Homo sapien
gcttgcaaagttatgagagtttaaa

SEQ ID NO: 155260 - DNA, 25 bp, Homo sapien
gcatccaacatctgatctgctgaga

SEQ ID NO: 155261 - DNA, 25 bp, Homo sapien
gagatatgtctgatctatctctgct

SEQ ID NO: 155262 - DNA, 25 bp, Homo sapien
cgttgtttttgcctctgccatagag

SEQ ID NO: 155263 - DNA, 25 bp, Homo sapien
tgccatagagctcacctcattttgc

SEQ ID NO: 155264 - DNA, 25 bp, Homo sapien
ttttgttacctgtgagtgtgtctct

SEQ ID NO: 155265 - DNA, 25 bp, Homo sapien
gagtgtgtctctccctattagactg

SEQ ID NO: 155266 - DNA, 25 bp, Homo sapien
tagactgtaagcctctcgagggtga

SEQ ID NO: 155267 - DNA, 25 bp, Homo sapien
gagggtgaggcctagccttcttgtc

SEQ ID NO: 155268 - DNA, 25 bp, Homo sapien
ttcttgtctttgtaacccacagcag

SEQ ID NO: 155269 - DNA, 25 bp, Homo sapien
ctggtactgtgccttgcctattgta

SEQ ID NO: 155270 - DNA, 25 bp, Homo sapien
ccttgcctattgtaggtgcccaata

SEQ ID NO: 155271 - DNA, 25 bp, Homo sapien
ctataccatctacctgggcttcggg

SEQ ID NO: 155272 - DNA, 25 bp, Homo sapien
agaagagcctggtcctggtgaagct

SEQ ID NO: 155273 - DNA, 25 bp, Homo sapien
tcctggtgaagctggaaccctggct

SEQ ID NO: 155274 - DNA, 25 bp, Homo sapien
ggaaccctggctgtgccgagtgcac

SEQ ID NO: 155275 - DNA, 25 bp, Homo sapien
agtgcacctagagggcacgcagcgt

SEQ ID NO: 155276 - DNA, 25 bp, Homo sapien
cacgcagcgtgagggtgtgtcttcc

SEQ ID NO: 155277 - DNA, 25 bp, Homo sapien
tgtgtcttccctggatagcagcagc

SEQ ID NO: 155278 - DNA, 25 bp, Homo sapien
gcgccaacagcctctatgacgacat

SEQ ID NO: 155279 - DNA, 25 bp, Homo sapien
atgacgacatcgagtgcttccttat

SEQ ID NO: 155280 - DNA, 25 bp, Homo sapien
gagtgcttccttatggagctggagc

SEQ ID NO: 155281 - DNA, 25 bp, Homo sapien
ggagctggagcagcccgcctagaac

SEQ ID NO: 155282 - DNA, 25 bp, Homo sapien
tgatgctgggctggctccctcttgg

SEQ ID NO: 155283 - DNA, 25 bp, Homo sapien
tgaccttcctcgcagagaggccagg

SEQ ID NO: 155284 - DNA, 25 bp, Homo sapien
aggttgggaatgaggcttgctgaga

SEQ ID NO: 155285 - DNA, 25 bp, Homo sapien
gggctgtccagttcccagaaggcat

SEQ ID NO: 155286 - DNA, 25 bp, Homo sapien
gtccagttcccagaaggcatatcag

SEQ ID NO: 155287 - DNA, 25 bp, Homo sapien
gttcccagaaggcatatcagtctct

SEQ ID NO: 155288 - DNA, 25 bp, Homo sapien
gcatatcagtctctgagggcttcct

SEQ ID NO: 155289 - DNA, 25 bp, Homo sapien
gaggataggagttcacttcatcttc

SEQ ID NO: 155290 - DNA, 25 bp, Homo sapien
taggagttcacttcatcttctcagc

SEQ ID NO: 155291 - DNA, 25 bp, Homo sapien
catttctactctcccatggcttcat

SEQ ID NO: 155292 - DNA, 25 bp, Homo sapien
ccatggcttcatgcttctttcattt

SEQ ID NO: 155293 - DNA, 25 bp, Homo sapien
tttttggcatcctggcttgcctcca

SEQ ID NO: 155294 - DNA, 25 bp, Homo sapien
ttggcatcctggcttgcctccagtt

SEQ ID NO: 155295 - DNA, 25 bp, Homo sapien
atcctggcttgcctccagttttagg

SEQ ID NO: 155296 - DNA, 25 bp, Homo sapien
tttttcctgctagtgtagcttctga

SEQ ID NO: 155297 - DNA, 25 bp, Homo sapien
ttttcctgctagtgtagcttctgaa

SEQ ID NO: 155298 - DNA, 25 bp, Homo sapien
ttcctgctagtgtagcttctgaaag

SEQ ID NO: 155299 - DNA, 25 bp, Homo sapien
tgctagtgtagcttctgaaaggtgc

SEQ ID NO: 155300 - DNA, 25 bp, Homo sapien
gtgtagcttctgaaaggtgctttct

SEQ ID NO: 155301 - DNA, 25 bp, Homo sapien
gtagcttctgaaaggtgctttctcc

SEQ ID NO: 155302 - DNA, 25 bp, Homo sapien
gcttctgaaaggtgctttctccatt

SEQ ID NO: 155303 - DNA, 25 bp, Homo sapien
actacccatgcaattaaaaggtaca

SEQ ID NO: 155304 - DNA, 25 bp, Homo sapien
gtgttcccttggcaaatgaaagttt

SEQ ID NO: 155305 - DNA, 25 bp, Homo sapien
agaaccccaagcagatctgctcttg

SEQ ID NO: 155306 - DNA, 25 bp, Homo sapien
aagcagatctgctcttgcgatggcc

SEQ ID NO: 155307 - DNA, 25 bp, Homo sapien
ttgcgatggcctcaccatctgggag

SEQ ID NO: 155308 - DNA, 25 bp, Homo sapien
cccatcgctggcaagggccgaaagg

SEQ ID NO: 155309 - DNA, 25 bp, Homo sapien
ggccgaaaggagtcagcgcagcccc

SEQ ID NO: 155310 - DNA, 25 bp, Homo sapien
ctttgagcaggacctcaccttggct

SEQ ID NO: 155311 - DNA, 25 bp, Homo sapien
tgttgctgtcctccagggcgagcac

SEQ ID NO: 155312 - DNA, 25 bp, Homo sapien
gcgagcactttccacttccagaggg

SEQ ID NO: 155313 - DNA, 25 bp, Homo sapien
gagggactttgcctgcccagtcttt

SEQ ID NO: 155314 - DNA, 25 bp, Homo sapien
tgcccagtctttggagagctcagta

SEQ ID NO: 155315 - DNA, 25 bp, Homo sapien
ttgtttagtcttgtctcagatttta

SEQ ID NO: 155316 - DNA, 25 bp, Homo sapien
gtcttgtctcagattttattatgta

SEQ ID NO: 155317 - DNA, 25 bp, Homo sapien
gtaaatcccattattcaaagttgcc

SEQ ID NO: 155318 - DNA, 25 bp, Homo sapien
aatcccattattcaaagttgcctaa

SEQ ID NO: 155319 - DNA, 25 bp, Homo sapien
ttattcaaagttgcctaaatccatt

SEQ ID NO: 155320 - DNA, 25 bp, Homo sapien
tattggcttttctgatccagttttg

SEQ ID NO: 155321 - DNA, 25 bp, Homo sapien
ggcttttctgatccagttttgtttg

SEQ ID NO: 155322 - DNA, 25 bp, Homo sapien
ttctgatccagttttgtttggacca

SEQ ID NO: 155323 - DNA, 25 bp, Homo sapien
caaaaaccagtattgtacaaagtat

SEQ ID NO: 155324 - DNA, 25 bp, Homo sapien
actaaaatggtctgtggtgactttt

SEQ ID NO: 155325 - DNA, 25 bp, Homo sapien
gtctgtggtgacttttggataataa

SEQ ID NO: 155326 - DNA, 25 bp, Homo sapien
tgagctgccgcaggtccgtgccatg

SEQ ID NO: 155327 - DNA, 25 bp, Homo sapien
ccagtggtcctgtgactgctgagga

SEQ ID NO: 155328 - DNA, 25 bp, Homo sapien
actgctgaggaccaaggtggcatcc

SEQ ID NO: 155329 - DNA, 25 bp, Homo sapien
accaaggtggcatcctagggcagga

SEQ ID NO: 155330 - DNA, 25 bp, Homo sapien
tcctagggcaggatgaactggctct

SEQ ID NO: 155331 - DNA, 25 bp, Homo sapien
ggatgaactggctctgagcaccctg

SEQ ID NO: 155332 - DNA, 25 bp, Homo sapien
aagcccctgcttgctgaagcgtcag

SEQ ID NO: 155333 - DNA, 25 bp, Homo sapien
gcttgctgaagcgtcaggtgaccga

SEQ ID NO: 155334 - DNA, 25 bp, Homo sapien
tcaggtgaccgagttcagctccgta

SEQ ID NO: 155335 - DNA, 25 bp, Homo sapien
agttcagctccgtaaggtggcggca

SEQ ID NO: 155336 - DNA, 25 bp, Homo sapien
agctccgtaaggtggcggcacctga

SEQ ID NO: 155337 - DNA, 25 bp, Homo sapien
gaaaggcaccaagctaacatctgac

SEQ ID NO: 155338 - DNA, 25 bp, Homo sapien
agctaacatctgacgtccagacatg

SEQ ID NO: 155339 - DNA, 25 bp, Homo sapien
tccagacatgaagagatgccagtgc

SEQ ID NO: 155340 - DNA, 25 bp, Homo sapien
agatgccagtgccacgaggcaaatc

SEQ ID NO: 155341 - DNA, 25 bp, Homo sapien
cacgaggcaaatccaaattgtcttt

SEQ ID NO: 155342 - DNA, 25 bp, Homo sapien
tagaagaaagtgagttccttgctct

SEQ ID NO: 155343 - DNA, 25 bp, Homo sapien
ggagattatgtggttggccaataaa

SEQ ID NO: 155344 - DNA, 25 bp, Homo sapien
agatgacatttcaatctcagtgatt

SEQ ID NO: 155345 - DNA, 25 bp, Homo sapien
aatctcagtgatttatgcttgcttg

SEQ ID NO: 155346 - DNA, 25 bp, Homo sapien
tattttgtgctgaagacctctttta

SEQ ID NO: 155347 - DNA, 25 bp, Homo sapien
ctttccgggcaagtgaatgtcattt

SEQ ID NO: 155348 - DNA, 25 bp, Homo sapien
acccagtggaaggatctactgatag

SEQ ID NO: 155349 - DNA, 25 bp, Homo sapien
tggatctgctgccagcattagcctg

SEQ ID NO: 155350 - DNA, 25 bp, Homo sapien
gcattagcctggctcaatatctaat

SEQ ID NO: 155351 - DNA, 25 bp, Homo sapien
gcctggctcaatatctaatcaatgt

SEQ ID NO: 155352 - DNA, 25 bp, Homo sapien
tcaatgtcaggctttcctcggagac

SEQ ID NO: 155353 - DNA, 25 bp, Homo sapien
aatgtcaggctttcctcggagacgg

SEQ ID NO: 155354 - DNA, 25 bp, Homo sapien
ggagcagctagaacaatgcagattc

SEQ ID NO: 155355 - DNA, 25 bp, Homo sapien
gcagattcatccataatccctttct

SEQ ID NO: 155356 - DNA, 25 bp, Homo sapien
attcatccataatccctttctgctg

SEQ ID NO: 155357 - DNA, 25 bp, Homo sapien
gtgtagtttctgaacagtcagcgat

SEQ ID NO: 155358 - DNA, 25 bp, Homo sapien
ttctgaacagtcagcgattccaggt

SEQ ID NO: 155359 - DNA, 25 bp, Homo sapien
tatgtaaaggcgtgtttgcttaaac

SEQ ID NO: 155360 - DNA, 25 bp, Homo sapien
gtttgcttaaacaattttccatatt

SEQ ID NO: 155361 - DNA, 25 bp, Homo sapien
gatgcaaaacaaatctgcctttatg

SEQ ID NO: 155362 - DNA, 25 bp, Homo sapien
gatacacaacaggtgacttggtttt

SEQ ID NO: 155363 - DNA, 25 bp, Homo sapien
tggttttaggcccaaaggtagcagc

SEQ ID NO: 155364 - DNA, 25 bp, Homo sapien
taggcccaaaggtagcagcagcaac

SEQ ID NO: 155365 - DNA, 25 bp, Homo sapien
tagcagcagcaacattaataatgga

SEQ ID NO: 155366 - DNA, 25 bp, Homo sapien
tatgtatgttaatgccagtcaccag

SEQ ID NO: 155367 - DNA, 25 bp, Homo sapien
ccagtcaccagcaggctatttcaag

SEQ ID NO: 155368 - DNA, 25 bp, Homo sapien
ccagcaggctatttcaaggtcagaa

SEQ ID NO: 155369 - DNA, 25 bp, Homo sapien
gaagtaatgactccatacatattat

SEQ ID NO: 155370 - DNA, 25 bp, Homo sapien
agaggctgtttcctgcagcatgtat

SEQ ID NO: 155371 - DNA, 25 bp, Homo sapien
agcatgtatttccatggcccacaca

SEQ ID NO: 155372 - DNA, 25 bp, Homo sapien
cgaagagtctttgagctgaatgagc

SEQ ID NO: 155373 - DNA, 25 bp, Homo sapien
tgagccagagtgataatttcagtgc

SEQ ID NO: 155374 - DNA, 25 bp, Homo sapien
cagtgcaacgaactttctgctgaat

SEQ ID NO: 155375 - DNA, 25 bp, Homo sapien
gatgtcatgtcgtaagtccctctgt

SEQ ID NO: 155376 - DNA, 25 bp, Homo sapien
gtcgtaagtccctctgtatacttta

SEQ ID NO: 155377 - DNA, 25 bp, Homo sapien
tactttaaagctctctacagtcccc

SEQ ID NO: 155378 - DNA, 25 bp, Homo sapien
aacttttgtgcttagtgagtgcaac

SEQ ID NO: 155379 - DNA, 25 bp, Homo sapien
cttatttttcttggatgcgatgttc

SEQ ID NO: 155380 - DNA, 25 bp, Homo sapien
atgcgatgttcagaggctgtttcct

SEQ ID NO: 155381 - DNA, 25 bp, Homo sapien
gttctcccacttacactgttgacat

SEQ ID NO: 155382 - DNA, 25 bp, Homo sapien
acactgttgacatctattttctgaa

SEQ ID NO: 155383 - DNA, 25 bp, Homo sapien
gacatctattttctgaagtgtgttt

SEQ ID NO: 155384 - DNA, 25 bp, Homo sapien
ttattcagtgctaatcattgttttt

SEQ ID NO: 155385 - DNA, 25 bp, Homo sapien
aggctaagcagttgaaggttcccca

SEQ ID NO: 155386 - DNA, 25 bp, Homo sapien
aaggttccccaccattcagtgagag

SEQ ID NO: 155387 - DNA, 25 bp, Homo sapien
agcctctgctggtagcatgtcgcag

SEQ ID NO: 155388 - DNA, 25 bp, Homo sapien
atgtcgcagtttccatgtgtttcag

SEQ ID NO: 155389 - DNA, 25 bp, Homo sapien
ccatgtgtttcaggatcttcgggct

SEQ ID NO: 155390 - DNA, 25 bp, Homo sapien
ggatcttcgggctgtcgttagacag

SEQ ID NO: 155391 - DNA, 25 bp, Homo sapien
tgaagaacacttctcaacagtttcc

SEQ ID NO: 155392 - DNA, 25 bp, Homo sapien
ttcctgtgctccttgatcacctgag

SEQ ID NO: 155393 - DNA, 25 bp, Homo sapien
tgctccttgatcacctgagctgcct

SEQ ID NO: 155394 - DNA, 25 bp, Homo sapien
tcagattccatttggtcctctcctt

SEQ ID NO: 155395 - DNA, 25 bp, Homo sapien
tttaatcccaaatgtctgaatgttt

SEQ ID NO: 155396 - DNA, 25 bp, Homo sapien
atgtctgaatgttttgcagtgtgta

SEQ ID NO: 155397 - DNA, 25 bp, Homo sapien
ataatgtatactgcgcgttctcttc

SEQ ID NO: 155398 - DNA, 25 bp, Homo sapien
atactgcgcgttctcttcactggtt

SEQ ID NO: 155399 - DNA, 25 bp, Homo sapien
gttctcttcactggtttatctgcag

SEQ ID NO: 155400 - DNA, 25 bp, Homo sapien
cttcactggtttatctgcagaaatt

SEQ ID NO: 155401 - DNA, 25 bp, Homo sapien
tctctgggcttttttcggtgttaga

SEQ ID NO: 155402 - DNA, 25 bp, Homo sapien
gcttttttcggtgttagattcaaca

SEQ ID NO: 155403 - DNA, 25 bp, Homo sapien
agacagcagctttggtccggcaact

SEQ ID NO: 155404 - DNA, 25 bp, Homo sapien
agcagctttggtccggcaacttcaa

SEQ ID NO: 155405 - DNA, 25 bp, Homo sapien
tttggtccggcaacttcaacaacag

SEQ ID NO: 155406 - DNA, 25 bp, Homo sapien
gtccggcaacttcaacaacagctct

SEQ ID NO: 155407 - DNA, 25 bp, Homo sapien
gccacagcccagtaccaacatattt

SEQ ID NO: 155408 - DNA, 25 bp, Homo sapien
agcccagtaccaacatatttggacg

SEQ ID NO: 155409 - DNA, 25 bp, Homo sapien
atatttggacgctactgagccacct

SEQ ID NO: 155410 - DNA, 25 bp, Homo sapien
ttggacgctactgagccacctggag

SEQ ID NO: 155411 - DNA, 25 bp, Homo sapien
acctggaggaactgcttgtgcactg

SEQ ID NO: 155412 - DNA, 25 bp, Homo sapien
aactgcttgtgcactggatgtggcc

SEQ ID NO: 155413 - DNA, 25 bp, Homo sapien
gcttgtgcactggatgtggccccac

SEQ ID NO: 155414 - DNA, 25 bp, Homo sapien
gacaaaacaggtttgccttggcatc

SEQ ID NO: 155415 - DNA, 25 bp, Homo sapien
aaacaggtttgccttggcatcagag

SEQ ID NO: 155416 - DNA, 25 bp, Homo sapien
actacattttttcctcttccatact

SEQ ID NO: 155417 - DNA, 25 bp, Homo sapien
tttcctcttccatactggtagatgc

SEQ ID NO: 155418 - DNA, 25 bp, Homo sapien
tggtagatgcgaaatttatctgtgc

SEQ ID NO: 155419 - DNA, 25 bp, Homo sapien
ttatctgtgcatgaaagggtcactt

SEQ ID NO: 155420 - DNA, 25 bp, Homo sapien
gggtcacttctgtaatagtgcaaca

SEQ ID NO: 155421 - DNA, 25 bp, Homo sapien
gtaatttatgttcccaattgagtgt

SEQ ID NO: 155422 - DNA, 25 bp, Homo sapien
gttcccaattgagtgtgaatgtcca

SEQ ID NO: 155423 - DNA, 25 bp, Homo sapien
gaatgtccaagtaatggtgtatgta

SEQ ID NO: 155424 - DNA, 25 bp, Homo sapien
atgtaatggtacaggcaaatgtgac

SEQ ID NO: 155425 - DNA, 25 bp, Homo sapien
gaaaagttagtcaatcctgtcatat

SEQ ID NO: 155426 - DNA, 25 bp, Homo sapien
tactttccaactctccaaagctgaa

SEQ ID NO: 155427 - DNA, 25 bp, Homo sapien
ttgtcttttctggatgctcaagtac

SEQ ID NO: 155428 - DNA, 25 bp, Homo sapien
ctggatgctcaagtactcagagtta

SEQ ID NO: 155429 - DNA, 25 bp, Homo sapien
gtactcagagttacaaacccacttt

SEQ ID NO: 155430 - DNA, 25 bp, Homo sapien
actttttgtggaatatgcttggata

SEQ ID NO: 155431 - DNA, 25 bp, Homo sapien
ggataagagatgctgtatccctaat

SEQ ID NO: 155432 - DNA, 25 bp, Homo sapien
gctgtatccctaataagtctaaaat

SEQ ID NO: 155433 - DNA, 25 bp, Homo sapien
gattactattcaatttgattgccca

SEQ ID NO: 155434 - DNA, 25 bp, Homo sapien
gaacctggagatatattttctgagc

SEQ ID NO: 155435 - DNA, 25 bp, Homo sapien
attttctgagctcaagattctgtaa

SEQ ID NO: 155436 - DNA, 25 bp, Homo sapien
tgccaagtggtacccggaggtgcgg

SEQ ID NO: 155437 - DNA, 25 bp, Homo sapien
acacgcccatcctcctggtgggcac

SEQ ID NO: 155438 - DNA, 25 bp, Homo sapien
cgacaaggacaccattgagcggctg

SEQ ID NO: 155439 - DNA, 25 bp, Homo sapien
acaaggacaccattgagcggctgcg

SEQ ID NO: 155440 - DNA, 25 bp, Homo sapien
caaggacaccattgagcggctgcgg

SEQ ID NO: 155441 - DNA, 25 bp, Homo sapien
aggacaccattgagcggctgcggga

SEQ ID NO: 155442 - DNA, 25 bp, Homo sapien
gctgcgggacaagaagctggcaccc

SEQ ID NO: 155443 - DNA, 25 bp, Homo sapien
gcccgggagattggctctgtgaaat

SEQ ID NO: 155444 - DNA, 25 bp, Homo sapien
gggagattggctctgtgaaatacct

SEQ ID NO: 155445 - DNA, 25 bp, Homo sapien
gtttgacgaggcgatccgcgcggtg

SEQ ID NO: 155446 - DNA, 25 bp, Homo sapien
tgacgaggcgatccgcgcggtgctc

SEQ ID NO: 155447 - DNA, 25 bp, Homo sapien
agaacatttgactggcactgatttg

SEQ ID NO: 155448 - DNA, 25 bp, Homo sapien
gactggcactgatttgcaataagct

SEQ ID NO: 155449 - DNA, 25 bp, Homo sapien
agctcagaaactttcctactgtaag

SEQ ID NO: 155450 - DNA, 25 bp, Homo sapien
ctttcctactgtaagttctggtgta

SEQ ID NO: 155451 - DNA, 25 bp, Homo sapien
gtaagttctggtgtacatctgaggg

SEQ ID NO: 155452 - DNA, 25 bp, Homo sapien
aaaatccataaagtacttctgtaca

SEQ ID NO: 155453 - DNA, 25 bp, Homo sapien
acttctgtacagtattagattcaca

SEQ ID NO: 155454 - DNA, 25 bp, Homo sapien
gtattagattcacaattgccatata

SEQ ID NO: 155455 - DNA, 25 bp, Homo sapien
ttctacttgttaaatggagggcatt

SEQ ID NO: 155456 - DNA, 25 bp, Homo sapien
aatggagggcattttgtattgtttt

SEQ ID NO: 155457 - DNA, 25 bp, Homo sapien
gtttttcatggttgttaacattgtg

SEQ ID NO: 155458 - DNA, 25 bp, Homo sapien
gtatccttacaataatctgtacctg

SEQ ID NO: 155459 - DNA, 25 bp, Homo sapien
taatctgtacctggaacgaggcggt

SEQ ID NO: 155460 - DNA, 25 bp, Homo sapien
tacctggaacgaggcggtgatccct

SEQ ID NO: 155461 - DNA, 25 bp, Homo sapien
gaacgaggcggtgatccctccaaag

SEQ ID NO: 155462 - DNA, 25 bp, Homo sapien
ggtgatccctccaaagaaccagagc

SEQ ID NO: 155463 - DNA, 25 bp, Homo sapien
atccctccaaagaaccagagcgggt

SEQ ID NO: 155464 - DNA, 25 bp, Homo sapien
agagcgggtggttcactatgagatc

SEQ ID NO: 155465 - DNA, 25 bp, Homo sapien
cactatgagatctgaggaggcttcg

SEQ ID NO: 155466 - DNA, 25 bp, Homo sapien
atctgaggaggcttcgtgggctttt

SEQ ID NO: 155467 - DNA, 25 bp, Homo sapien
ttgggtcctctaactaggactccct

SEQ ID NO: 155468 - DNA, 25 bp, Homo sapien
ggactccctcattcctagaaattta

SEQ ID NO: 155469 - DNA, 25 bp, Homo sapien
gccgggagaggatgtcttttttaag

SEQ ID NO: 155470 - DNA, 25 bp, Homo sapien
ggatgtcttttttaaggctctgtgc

SEQ ID NO: 155471 - DNA, 25 bp, Homo sapien
tttttaaggctctgtgccttggtct

SEQ ID NO: 155472 - DNA, 25 bp, Homo sapien
cttcctcttggctgagatagcagag

SEQ ID NO: 155473 - DNA, 25 bp, Homo sapien
agtggcctggccgttcagcctgtct

SEQ ID NO: 155474 - DNA, 25 bp, Homo sapien
ggctcaggcccagcttattgtgtgc

SEQ ID NO: 155475 - DNA, 25 bp, Homo sapien
aggcccagcttattgtgtgcgctgc

SEQ ID NO: 155476 - DNA, 25 bp, Homo sapien
tattgtgtgcgctgcctggccaggc

SEQ ID NO: 155477 - DNA, 25 bp, Homo sapien
cttgccatgtgctgggtggtagatt

SEQ ID NO: 155478 - DNA, 25 bp, Homo sapien
gggtggtagatttcctcctcccagt

SEQ ID NO: 155479 - DNA, 25 bp, Homo sapien
gagagggcctctgcctgggacactg

SEQ ID NO: 155480 - DNA, 25 bp, Homo sapien
ttagaaggttactgaaagctctgcc

SEQ ID NO: 155481 - DNA, 25 bp, Homo sapien
tctgccttccggaatccctctaagt

SEQ ID NO: 155482 - DNA, 25 bp, Homo sapien
gaatccctctaagtctgcttgatag

SEQ ID NO: 155483 - DNA, 25 bp, Homo sapien
ctaagtctgcttgatagagtggata

SEQ ID NO: 155484 - DNA, 25 bp, Homo sapien
aaaattcaacctttacatctagaat

SEQ ID NO: 155485 - DNA, 25 bp, Homo sapien
aatttgcatctcattttgcctaaat

SEQ ID NO: 155486 - DNA, 25 bp, Homo sapien
ttgcctaaattggttctgtattcat

SEQ ID NO: 155487 - DNA, 25 bp, Homo sapien
tgtattcataaacactttccacata

SEQ ID NO: 155488 - DNA, 25 bp, Homo sapien
agattagtattacctgtggcacctt

SEQ ID NO: 155489 - DNA, 25 bp, Homo sapien
agtattacctgtggcaccttttaag

SEQ ID NO: 155490 - DNA, 25 bp, Homo sapien
gcttaagatacatagcctccctttt

SEQ ID NO: 155491 - DNA, 25 bp, Homo sapien
aggcctacagtcaaactccagagat

SEQ ID NO: 155492 - DNA, 25 bp, Homo sapien
gtcaaactccagagatgcccaagac

SEQ ID NO: 155493 - DNA, 25 bp, Homo sapien
cgcttccatagcgacggctgatgga

SEQ ID NO: 155494 - DNA, 25 bp, Homo sapien
acggctgatggaaccgcccctggta

SEQ ID NO: 155495 - DNA, 25 bp, Homo sapien
atggaaccgcccctggtacctgctg

SEQ ID NO: 155496 - DNA, 25 bp, Homo sapien
cttccccagaggctggtgtccagaa

SEQ ID NO: 155497 - DNA, 25 bp, Homo sapien
ggctggtgtccagaactcaggaatg

SEQ ID NO: 155498 - DNA, 25 bp, Homo sapien
ccagaactcaggaatgggcctggta

SEQ ID NO: 155499 - DNA, 25 bp, Homo sapien
caggccagactaactgggctcaagg

SEQ ID NO: 155500 - DNA, 25 bp, Homo sapien
aaggcgcagagattggagtgccctg

SEQ ID NO: 155501 - DNA, 25 bp, Homo sapien
tgccctgcggagttgcactctgggt

SEQ ID NO: 155502 - DNA, 25 bp, Homo sapien
caggaacaacttcatcacagtgttg

SEQ ID NO: 155503 - DNA, 25 bp, Homo sapien
ggaacaacttcatcacagtgttgat

SEQ ID NO: 155504 - DNA, 25 bp, Homo sapien
atcacagtgttgatgttggacacat

SEQ ID NO: 155505 - DNA, 25 bp, Homo sapien
cagtgttgatgttggacacatagat

SEQ ID NO: 155506 - DNA, 25 bp, Homo sapien
agagtaaacatcaatgctcagagtt

SEQ ID NO: 155507 - DNA, 25 bp, Homo sapien
gtaaacatcaatgctcagagttagc

SEQ ID NO: 155508 - DNA, 25 bp, Homo sapien
ctcagagttagcataatttggagct

SEQ ID NO: 155509 - DNA, 25 bp, Homo sapien
caagatgttatttttgtatactata

SEQ ID NO: 155510 - DNA, 25 bp, Homo sapien
atttttgtatactatatcacttaga

SEQ ID NO: 155511 - DNA, 25 bp, Homo sapien
gaaagagcaactgaagtcctagaaa

SEQ ID NO: 155512 - DNA, 25 bp, Homo sapien
aagagcaactgaagtcctagaaaat

SEQ ID NO: 155513 - DNA, 25 bp, Homo sapien
tgggtagaattgtagtcaggaaaac

SEQ ID NO: 155514 - DNA, 25 bp, Homo sapien
gcctggaagggtattcagcagctgt

SEQ ID NO: 155515 - DNA, 25 bp, Homo sapien
tcctgaaagactgaacgtgtttctt

SEQ ID NO: 155516 - DNA, 25 bp, Homo sapien
gaacgtgtttcttcatgacagctgc

SEQ ID NO: 155517 - DNA, 25 bp, Homo sapien
gtttcttcatgacagctgctcaaag

SEQ ID NO: 155518 - DNA, 25 bp, Homo sapien
gctgctcaaagcaggtttctgagat

SEQ ID NO: 155519 - DNA, 25 bp, Homo sapien
ggtttctgagatagctgaccgagct

SEQ ID NO: 155520 - DNA, 25 bp, Homo sapien
gctgaccgagctctggtaaatctct

SEQ ID NO: 155521 - DNA, 25 bp, Homo sapien
agctctggtaaatctctttgtcaaa

SEQ ID NO: 155522 - DNA, 25 bp, Homo sapien
tttgtcaaattacgaaaacttcagg

SEQ ID NO: 155523 - DNA, 25 bp, Homo sapien
gaaatcctatgcttccatgtacatt

SEQ ID NO: 155524 - DNA, 25 bp, Homo sapien
catgacccggatgaactcaatgcat

SEQ ID NO: 155525 - DNA, 25 bp, Homo sapien
gaactcaatgcatgatgactcttct

SEQ ID NO: 155526 - DNA, 25 bp, Homo sapien
atgactcttcttatcacacttgcaa

SEQ ID NO: 155527 - DNA, 25 bp, Homo sapien
atgcctttcaaacattgagactgct

SEQ ID NO: 155528 - DNA, 25 bp, Homo sapien
ttgagactgctagaaccaagcacta

SEQ ID NO: 155529 - DNA, 25 bp, Homo sapien
aaccaagcactaccagtatctccat

SEQ ID NO: 155530 - DNA, 25 bp, Homo sapien
gtatctccatccttaactgtccagt

SEQ ID NO: 155531 - DNA, 25 bp, Homo sapien
aactgtccagtccagtgatgtggga

SEQ ID NO: 155532 - DNA, 25 bp, Homo sapien
gatgtgggaagttaccttttataag

SEQ ID NO: 155533 - DNA, 25 bp, Homo sapien
gtgtaactgttctttgcagtgaaga

SEQ ID NO: 155534 - DNA, 25 bp, Homo sapien
agcgtttaatggtatctgttactcc

SEQ ID NO: 155535 - DNA, 25 bp, Homo sapien
gatttctctgggtcttcaattagaa

SEQ ID NO: 155536 - DNA, 25 bp, Homo sapien
tcaattagaatgtggctgggcccat

SEQ ID NO: 155537 - DNA, 25 bp, Homo sapien
gctgggcccatattggtttgtgtta

SEQ ID NO: 155538 - DNA, 25 bp, Homo sapien
ttgtgttaaatgctgtacttactac

SEQ ID NO: 155539 - DNA, 25 bp, Homo sapien
tgctgtacttactacaagaatcttt

SEQ ID NO: 155540 - DNA, 25 bp, Homo sapien
aagaatcttttttcaagcatgtaca

SEQ ID NO: 155541 - DNA, 25 bp, Homo sapien
gtattccactgtactcattcataag

SEQ ID NO: 155542 - DNA, 25 bp, Homo sapien
gtactcattcataaggtaggttttc

SEQ ID NO: 155543 - DNA, 25 bp, Homo sapien
ttacaaaactcacaccaggtactta

SEQ ID NO: 155544 - DNA, 25 bp, Homo sapien
aactcacaccaggtacttaaagatg

SEQ ID NO: 155545 - DNA, 25 bp, Homo sapien
ctgctttctaggtcagtccctgcag

SEQ ID NO: 155546 - DNA, 25 bp, Homo sapien
gaatacaccaaaaggaggcgctctt

SEQ ID NO: 155547 - DNA, 25 bp, Homo sapien
caaaaggaggcgctcttaataactc

SEQ ID NO: 155548 - DNA, 25 bp, Homo sapien
aattattattcttgccaacaaatgg

SEQ ID NO: 155549 - DNA, 25 bp, Homo sapien
ccaacaaatggctagaaaggactga

SEQ ID NO: 155550 - DNA, 25 bp, Homo sapien
atagattatatattgccagatgtta

SEQ ID NO: 155551 - DNA, 25 bp, Homo sapien
tattgccagatgttaatactgtaac

SEQ ID NO: 155552 - DNA, 25 bp, Homo sapien
tatttcttaaatccaaatttctctc

SEQ ID NO: 155553 - DNA, 25 bp, Homo sapien
agatttaattccctcaataacacca

SEQ ID NO: 155554 - DNA, 25 bp, Homo sapien
ttccctcaataacaccaatgttttg

SEQ ID NO: 155555 - DNA, 25 bp, Homo sapien
tgttttgtttcgttctgggtcataa

SEQ ID NO: 155556 - DNA, 25 bp, Homo sapien
tctgggtcataaaactttgttaagg

SEQ ID NO: 155557 - DNA, 25 bp, Homo sapien
actttcttgcatgaatcagatgtgt

SEQ ID NO: 155558 - DNA, 25 bp, Homo sapien
gaatcagatgtgtgttctcagtgaa

SEQ ID NO: 155559 - DNA, 25 bp, Homo sapien
gtgtgttctcagtgaaataactacc

SEQ ID NO: 155560 - DNA, 25 bp, Homo sapien
tgaaataactaccttccactctgga

SEQ ID NO: 155561 - DNA, 25 bp, Homo sapien
taccttccactctggaaccttattc

SEQ ID NO: 155562 - DNA, 25 bp, Homo sapien
tggaaccttattccagcagttgttc

SEQ ID NO: 155563 - DNA, 25 bp, Homo sapien
agcagttgttccagggagcttctac

SEQ ID NO: 155564 - DNA, 25 bp, Homo sapien
ttgttccagggagcttctacctgga

SEQ ID NO: 155565 - DNA, 25 bp, Homo sapien
gaatagactatctagaacttgagaa

SEQ ID NO: 155566 - DNA, 25 bp, Homo sapien
tttttgtttactggctttccttctg

SEQ ID NO: 155567 - DNA, 25 bp, Homo sapien
ttaaatacccatcttcattaaagta

SEQ ID NO: 155568 - DNA, 25 bp, Homo sapien
tgtacacatcatactgaactcttga

SEQ ID NO: 155569 - DNA, 25 bp, Homo sapien
gaactcttgatgagctgagcctcaa

SEQ ID NO: 155570 - DNA, 25 bp, Homo sapien
agctgagcctcaagtacctgtgtaa

SEQ ID NO: 155571 - DNA, 25 bp, Homo sapien
gtacctgtgtaaaagagctcccatc

SEQ ID NO: 155572 - DNA, 25 bp, Homo sapien
gctcccatctgatctgcagtcatta

SEQ ID NO: 155573 - DNA, 25 bp, Homo sapien
aaagcaaatattccctcaacatcag

SEQ ID NO: 155574 - DNA, 25 bp, Homo sapien
attccctcaacatcagaacaatgct

SEQ ID NO: 155575 - DNA, 25 bp, Homo sapien
acaatgctcaagtctttcaagccac

SEQ ID NO: 155576 - DNA, 25 bp, Homo sapien
gtctgagcagtcaaaggcaaattag

SEQ ID NO: 155577 - DNA, 25 bp, Homo sapien
aagggatgctagaaattcaactgaa

SEQ ID NO: 155578 - DNA, 25 bp, Homo sapien
gcaagtcaagtacgtattcagcatt

SEQ ID NO: 155579 - DNA, 25 bp, Homo sapien
aaatacgacagtacacacagtgact

SEQ ID NO: 155580 - DNA, 25 bp, Homo sapien
acagtgactattagccactgccaga

SEQ ID NO: 155581 - DNA, 25 bp, Homo sapien
gccactgccagaaacaggctgaaca

SEQ ID NO: 155582 - DNA, 25 bp, Homo sapien
ggagagttttagaaccagcacatcc

SEQ ID NO: 155583 - DNA, 25 bp, Homo sapien
ccagcacatccactggagatgctgg

SEQ ID NO: 155584 - DNA, 25 bp, Homo sapien
gacccctcccagtcaataaagtctg

SEQ ID NO: 155585 - DNA, 25 bp, Homo sapien
agtcaataaagtctggtgcctcatt

SEQ ID NO: 155586 - DNA, 25 bp, Homo sapien
tcagcctcatcatgaccctggagag

SEQ ID NO: 155587 - DNA, 25 bp, Homo sapien
gaccctggagagaccctgataccat

SEQ ID NO: 155588 - DNA, 25 bp, Homo sapien
agagaccctgataccatctgccagt

SEQ ID NO: 155589 - DNA, 25 bp, Homo sapien
agcttaggcactccttgccatcaac

SEQ ID NO: 155590 - DNA, 25 bp, Homo sapien
tgactctgcaaagctacatcaaggg

SEQ ID NO: 155591 - DNA, 25 bp, Homo sapien
aagctacatcaagggccagcagcga

SEQ ID NO: 155592 - DNA, 25 bp, Homo sapien
cccgggatcggtttctgtatgcgaa

SEQ ID NO: 155593 - DNA, 25 bp, Homo sapien
gtatgcgaagttgctaggcctgctg

SEQ ID NO: 155594 - DNA, 25 bp, Homo sapien
gctggctgagctccggagcattaat

SEQ ID NO: 155595 - DNA, 25 bp, Homo sapien
gagcattaatgaggcctacgggtac

SEQ ID NO: 155596 - DNA, 25 bp, Homo sapien
tacgggtaccaaatccagcacatcc

SEQ ID NO: 155597 - DNA, 25 bp, Homo sapien
gccatgatgccgctgctccaggaga

SEQ ID NO: 155598 - DNA, 25 bp, Homo sapien
ctccaggagatctgcagctgaggcc

SEQ ID NO: 155599 - DNA, 25 bp, Homo sapien
tggaacaccctggatacactggagt

SEQ ID NO: 155600 - DNA, 25 bp, Homo sapien
aatgctgggaccaaagattgggccg

SEQ ID NO: 155601 - DNA, 25 bp, Homo sapien
gaccctagtgaaaatacagcaggca

SEQ ID NO: 155602 - DNA, 25 bp, Homo sapien
acagcaggcagaactctccttggat

SEQ ID NO: 155603 - DNA, 25 bp, Homo sapien
cagaactctccttggataattcccc

SEQ ID NO: 155604 - DNA, 25 bp, Homo sapien
agaggtccccaaggattgggagcat

SEQ ID NO: 155605 - DNA, 25 bp, Homo sapien
ttgtgggcgaggaggcgtttccacc

SEQ ID NO: 155606 - DNA, 25 bp, Homo sapien
gcctatcagggcagggtgacctact

SEQ ID NO: 155607 - DNA, 25 bp, Homo sapien
agggcagggtgacctactccccatt

SEQ ID NO: 155608 - DNA, 25 bp, Homo sapien
acctactccccattgttctggaaat

SEQ ID NO: 155609 - DNA, 25 bp, Homo sapien
tggaaatctccaggctgctgggcag

SEQ ID NO: 155610 - DNA, 25 bp, Homo sapien
gaagtgaagtcatgagtgcccgatt

SEQ ID NO: 155611 - DNA, 25 bp, Homo sapien
gagtgcccgattcctcttagagaaa

SEQ ID NO: 155612 - DNA, 25 bp, Homo sapien
cagaagtgcaggcacctagggcccc

SEQ ID NO: 155613 - DNA, 25 bp, Homo sapien
ctgggagctctccttggaacccatt

SEQ ID NO: 155614 - DNA, 25 bp, Homo sapien
tgggagctctccttggaacccattc

SEQ ID NO: 155615 - DNA, 25 bp, Homo sapien
cttggaacccattcctgaaattatt

SEQ ID NO: 155616 - DNA, 25 bp, Homo sapien
ttggaacccattcctgaaattattt

SEQ ID NO: 155617 - DNA, 25 bp, Homo sapien
cgggctcccaccagggcctgggtgg

SEQ ID NO: 155618 - DNA, 25 bp, Homo sapien
gcgtggcctatccactcctcacatc

SEQ ID NO: 155619 - DNA, 25 bp, Homo sapien
agggccaccagcatccaggcggcca

SEQ ID NO: 155620 - DNA, 25 bp, Homo sapien
gtggctgggacaagggatccccctt

SEQ ID NO: 155621 - DNA, 25 bp, Homo sapien
tgggacaagggatcccccttccctg

SEQ ID NO: 155622 - DNA, 25 bp, Homo sapien
ccccttccctgtggttctattatat

SEQ ID NO: 155623 - DNA, 25 bp, Homo sapien
gcagaccttccagacctccccagtg

SEQ ID NO: 155624 - DNA, 25 bp, Homo sapien
cagaccttccagacctccccagtga

SEQ ID NO: 155625 - DNA, 25 bp, Homo sapien
agaccttccagacctccccagtgac

SEQ ID NO: 155626 - DNA, 25 bp, Homo sapien
gaccttccagacctccccagtgaca

SEQ ID NO: 155627 - DNA, 25 bp, Homo sapien
accttccagacctccccagtgacag

SEQ ID NO: 155628 - DNA, 25 bp, Homo sapien
ccttccagacctccccagtgacagc

SEQ ID NO: 155629 - DNA, 25 bp, Homo sapien
cttccagacctccccagtgacagcc

SEQ ID NO: 155630 - DNA, 25 bp, Homo sapien
agtgacagcctccccagtcatctag

SEQ ID NO: 155631 - DNA, 25 bp, Homo sapien
gtgacagcctccccagtcatctagg

SEQ ID NO: 155632 - DNA, 25 bp, Homo sapien
catcttcgggaccaggatttgcaca

SEQ ID NO: 155633 - DNA, 25 bp, Homo sapien
cttcgggaccaggatttgcacagaa

SEQ ID NO: 155634 - DNA, 25 bp, Homo sapien
cgggaccaggatttgcacagaagca

SEQ ID NO: 155635 - DNA, 25 bp, Homo sapien
atttgcacagaagcacatgcaccta

SEQ ID NO: 155636 - DNA, 25 bp, Homo sapien
agaagcacatgcacctacccataca

SEQ ID NO: 155637 - DNA, 25 bp, Homo sapien
agcattctcaggcaccagtccctgt

SEQ ID NO: 155638 - DNA, 25 bp, Homo sapien
aggcaccagtccctgtccggaatgc

SEQ ID NO: 155639 - DNA, 25 bp, Homo sapien
tggtggacccagggaacagccactc

SEQ ID NO: 155640 - DNA, 25 bp, Homo sapien
gtaacgggcacggatcacgatgtaa

SEQ ID NO: 155641 - DNA, 25 bp, Homo sapien
cgggcacggatcacgatgtaaatta

SEQ ID NO: 155642 - DNA, 25 bp, Homo sapien
ggatcacgatgtaaattattaagca

SEQ ID NO: 155643 - DNA, 25 bp, Homo sapien
atcctggtgaggaataacaagggcc

SEQ ID NO: 155644 - DNA, 25 bp, Homo sapien
gaggaataacaagggccgcagcagc

SEQ ID NO: 155645 - DNA, 25 bp, Homo sapien
taacaagggccgcagcagcacctac

SEQ ID NO: 155646 - DNA, 25 bp, Homo sapien
agggccgcagcagcacctacgaggt

SEQ ID NO: 155647 - DNA, 25 bp, Homo sapien
gcccacctgaagcagcaagtgagcg

SEQ ID NO: 155648 - DNA, 25 bp, Homo sapien
acctgaagcagcaagtgagcgggct

SEQ ID NO: 155649 - DNA, 25 bp, Homo sapien
acctgttctggctgaccttcgaggg

SEQ ID NO: 155650 - DNA, 25 bp, Homo sapien
ccctgagcaccgtgttcatgaatct

SEQ ID NO: 155651 - DNA, 25 bp, Homo sapien
gagcaccgtgttcatgaatctgcgc

SEQ ID NO: 155652 - DNA, 25 bp, Homo sapien
caccgtgttcatgaatctgcgcctg

SEQ ID NO: 155653 - DNA, 25 bp, Homo sapien
cgtgttcatgaatctgcgcctgcgg

SEQ ID NO: 155654 - DNA, 25 bp, Homo sapien
ggttatacaaaccatatacatctgg

SEQ ID NO: 155655 - DNA, 25 bp, Homo sapien
catctggttaccaaacataaatgct

SEQ ID NO: 155656 - DNA, 25 bp, Homo sapien
tgctgaacattccatattattatag

SEQ ID NO: 155657 - DNA, 25 bp, Homo sapien
gttaatgtcttaatccagcttgcaa

SEQ ID NO: 155658 - DNA, 25 bp, Homo sapien
gtcttaatccagcttgcaagtgaat

SEQ ID NO: 155659 - DNA, 25 bp, Homo sapien
aagcttcaaactaggtattctggga

SEQ ID NO: 155660 - DNA, 25 bp, Homo sapien
attctgggaatgatgtaatgctctg

SEQ ID NO: 155661 - DNA, 25 bp, Homo sapien
gtaatgctctgaatttagtatgata

SEQ ID NO: 155662 - DNA, 25 bp, Homo sapien
agtaatttctatttgcactgtgcct

SEQ ID NO: 155663 - DNA, 25 bp, Homo sapien
tgcactgtgcctttcaactccagaa

SEQ ID NO: 155664 - DNA, 25 bp, Homo sapien
tgtgcctttcaactccagaaacatt

SEQ ID NO: 155665 - DNA, 25 bp, Homo sapien
tatgctgtagctgaagccctgtttg

SEQ ID NO: 155666 - DNA, 25 bp, Homo sapien
atgctgtagctgaagccctgtttgt

SEQ ID NO: 155667 - DNA, 25 bp, Homo sapien
tgctgtagctgaagccctgtttgtc

SEQ ID NO: 155668 - DNA, 25 bp, Homo sapien
gctgtagctgaagccctgtttgtct

SEQ ID NO: 155669 - DNA, 25 bp, Homo sapien
gctgaagccctgtttgtcttttaaa

SEQ ID NO: 155670 - DNA, 25 bp, Homo sapien
tgtcttttaaacactagttggaagc

SEQ ID NO: 155671 - DNA, 25 bp, Homo sapien
ttttaaacactagttggaagctctc

SEQ ID NO: 155672 - DNA, 25 bp, Homo sapien
taaagactctgtaatgctcactccc

SEQ ID NO: 155673 - DNA, 25 bp, Homo sapien
aagactctgtaatgctcactcccct

SEQ ID NO: 155674 - DNA, 25 bp, Homo sapien
agagagcgaggacctctcctcctcg

SEQ ID NO: 155675 - DNA, 25 bp, Homo sapien
ctcctcctcgttcagttgcacttca

SEQ ID NO: 155676 - DNA, 25 bp, Homo sapien
ctatctcccacaaataagttcccat

SEQ ID NO: 155677 - DNA, 25 bp, Homo sapien
agttcccatttccttgtctaaagat

SEQ ID NO: 155678 - DNA, 25 bp, Homo sapien
cagtaactgccattttttgtctgtg

SEQ ID NO: 155679 - DNA, 25 bp, Homo sapien
cattgtgttttcttcgtggattgtt

SEQ ID NO: 155680 - DNA, 25 bp, Homo sapien
tggattgttttttctgcgggtcata

SEQ ID NO: 155681 - DNA, 25 bp, Homo sapien
gcgggtcatattcataccttctgat

SEQ ID NO: 155682 - DNA, 25 bp, Homo sapien
ccttctgatgaagttgtacaacacc

SEQ ID NO: 155683 - DNA, 25 bp, Homo sapien
gtacaacaccagcaacattataatg

SEQ ID NO: 155684 - DNA, 25 bp, Homo sapien
ttataatggccctgtagctctgaat

SEQ ID NO: 155685 - DNA, 25 bp, Homo sapien
aactgaaaggttgcactctagggtg

SEQ ID NO: 155686 - DNA, 25 bp, Homo sapien
gcactctagggtgaaccaagctata

SEQ ID NO: 155687 - DNA, 25 bp, Homo sapien
atagtggtgcttctttctgatctct

SEQ ID NO: 155688 - DNA, 25 bp, Homo sapien
tgcttctttctgatctctagtggag

SEQ ID NO: 155689 - DNA, 25 bp, Homo sapien
tgatctctagtggagatctctttga

SEQ ID NO: 155690 - DNA, 25 bp, Homo sapien
ctctttgactgctgtagtactaaag

SEQ ID NO: 155691 - DNA, 25 bp, Homo sapien
gctagagtgcttttagcctttttta

SEQ ID NO: 155692 - DNA, 25 bp, Homo sapien
attacatttgtaaccatgatacttt

SEQ ID NO: 155693 - DNA, 25 bp, Homo sapien
gatactttaattagaagcttagcct

SEQ ID NO: 155694 - DNA, 25 bp, Homo sapien
aagcttagccttgaaattgtgaact

SEQ ID NO: 155695 - DNA, 25 bp, Homo sapien
gaaattgtgaactcttggaaatgtt

SEQ ID NO: 155696 - DNA, 25 bp, Homo sapien
aaatgttattagtgaagttcgcaac

SEQ ID NO: 155697 - DNA, 25 bp, Homo sapien
gaagttcgcaactaaactaaacctg

SEQ ID NO: 155698 - DNA, 25 bp, Homo sapien
taaatactgtgcttactgtgaaata

SEQ ID NO: 155699 - DNA, 25 bp, Homo sapien
aaatactgtgcttactgtgaaatat

SEQ ID NO: 155700 - DNA, 25 bp, Homo sapien
gtgaaatatatcagttggtgagccg

SEQ ID NO: 155701 - DNA, 25 bp, Homo sapien
tgaaatatatcagttggtgagccgg

SEQ ID NO: 155702 - DNA, 25 bp, Homo sapien
gaaatatatcagttggtgagccggg

SEQ ID NO: 155703 - DNA, 25 bp, Homo sapien
aaatatatcagttggtgagccgggc

SEQ ID NO: 155704 - DNA, 25 bp, Homo sapien
aatatatcagttggtgagccgggcg

SEQ ID NO: 155705 - DNA, 25 bp, Homo sapien
atatatcagttggtgagccgggcgt

SEQ ID NO: 155706 - DNA, 25 bp, Homo sapien
atatcagttggtgagccgggcgtgg

SEQ ID NO: 155707 - DNA, 25 bp, Homo sapien
tatcagttggtgagccgggcgtggt

SEQ ID NO: 155708 - DNA, 25 bp, Homo sapien
cgtggtgaaagcctgtatctattaa

SEQ ID NO: 155709 - DNA, 25 bp, Homo sapien
cttccacaactgtaaatattgggct

SEQ ID NO: 155710 - DNA, 25 bp, Homo sapien
tgggctagatagaacaactttctct

SEQ ID NO: 155711 - DNA, 25 bp, Homo sapien
gaacaactttctctacattgtgttt

SEQ ID NO: 155712 - DNA, 25 bp, Homo sapien
tttaaaaggctccagggaatcctgc

SEQ ID NO: 155713 - DNA, 25 bp, Homo sapien
gggaatcctgcattctaattggcaa

SEQ ID NO: 155714 - DNA, 25 bp, Homo sapien
aattggcaagccctgtttgcctaat

SEQ ID NO: 155715 - DNA, 25 bp, Homo sapien
agccctgtttgcctaattaaattga

SEQ ID NO: 155716 - DNA, 25 bp, Homo sapien
gattgttacttcaattctatctgtt

SEQ ID NO: 155717 - DNA, 25 bp, Homo sapien
gggaaaatctcattttgctcatctt

SEQ ID NO: 155718 - DNA, 25 bp, Homo sapien
tttgctcatcttaccatattgcata

SEQ ID NO: 155719 - DNA, 25 bp, Homo sapien
agagttgtattcaatcttggcaata

SEQ ID NO: 155720 - DNA, 25 bp, Homo sapien
tctggctatagtactttgaaattat

SEQ ID NO: 155721 - DNA, 25 bp, Homo sapien
ctggctatagtactttgaaattatc

SEQ ID NO: 155722 - DNA, 25 bp, Homo sapien
ggctatagtactttgaaattatcac

SEQ ID NO: 155723 - DNA, 25 bp, Homo sapien
atagtactttgaaattatcacccat

SEQ ID NO: 155724 - DNA, 25 bp, Homo sapien
agtactttgaaattatcacccatat

SEQ ID NO: 155725 - DNA, 25 bp, Homo sapien
gtactttgaaattatcacccatata

SEQ ID NO: 155726 - DNA, 25 bp, Homo sapien
actttgaaattatcacccatataaa

SEQ ID NO: 155727 - DNA, 25 bp, Homo sapien
gaaattatcacccatataaaagagg

SEQ ID NO: 155728 - DNA, 25 bp, Homo sapien
attatcacccatataaaagagggac

SEQ ID NO: 155729 - DNA, 25 bp, Homo sapien
atcacccatataaaagagggacatg

SEQ ID NO: 155730 - DNA, 25 bp, Homo sapien
catataaaagagggacatggactat

SEQ ID NO: 155731 - DNA, 25 bp, Homo sapien
attaaccacacagcctgagcctggc

SEQ ID NO: 155732 - DNA, 25 bp, Homo sapien
agcctcggctgccagaggtgccttt

SEQ ID NO: 155733 - DNA, 25 bp, Homo sapien
cagaggtgcctttgctaggcccgga

SEQ ID NO: 155734 - DNA, 25 bp, Homo sapien
ctctgaggagacctcacccactcct

SEQ ID NO: 155735 - DNA, 25 bp, Homo sapien
tcctcgctcagtttgaccactgtaa

SEQ ID NO: 155736 - DNA, 25 bp, Homo sapien
ctcgctcagtttgaccactgtaagt

SEQ ID NO: 155737 - DNA, 25 bp, Homo sapien
gctcagtttgaccactgtaagtgcc

SEQ ID NO: 155738 - DNA, 25 bp, Homo sapien
agtttgaccactgtaagtgcctgca

SEQ ID NO: 155739 - DNA, 25 bp, Homo sapien
tttgaccactgtaagtgcctgcact

SEQ ID NO: 155740 - DNA, 25 bp, Homo sapien
tgaccactgtaagtgcctgcactct

SEQ ID NO: 155741 - DNA, 25 bp, Homo sapien
accactgtaagtgcctgcactctgt

SEQ ID NO: 155742 - DNA, 25 bp, Homo sapien
ttgacctgggtcttgaaagagtcgg

SEQ ID NO: 155743 - DNA, 25 bp, Homo sapien
aagagtcgggagtgacaagctcaga

SEQ ID NO: 155744 - DNA, 25 bp, Homo sapien
aagctcagagagcatgaactgatgc

SEQ ID NO: 155745 - DNA, 25 bp, Homo sapien
actgatgctggcatgaaggattcca

SEQ ID NO: 155746 - DNA, 25 bp, Homo sapien
gtggacacttggcaccagctctgag

SEQ ID NO: 155747 - DNA, 25 bp, Homo sapien
gccaccatgtgggtcagatgtactc

SEQ ID NO: 155748 - DNA, 25 bp, Homo sapien
accatgtgggtcagatgtactctct

SEQ ID NO: 155749 - DNA, 25 bp, Homo sapien
gtgggtcagatgtactctctgtcac

SEQ ID NO: 155750 - DNA, 25 bp, Homo sapien
gtcagatgtactctctgtcacatga

SEQ ID NO: 155751 - DNA, 25 bp, Homo sapien
gatgtactctctgtcacatgaggag

SEQ ID NO: 155752 - DNA, 25 bp, Homo sapien
tctctgtcacatgaggagagtgcta

SEQ ID NO: 155753 - DNA, 25 bp, Homo sapien
aagaatttcggacatctctgccaaa

SEQ ID NO: 155754 - DNA, 25 bp, Homo sapien
aaagtcttgtgacctgtagctgcca

SEQ ID NO: 155755 - DNA, 25 bp, Homo sapien
cctgtagctgccacgttttgaagag

SEQ ID NO: 155756 - DNA, 25 bp, Homo sapien
ttgaagagcttgagctgggtcccca

SEQ ID NO: 155757 - DNA, 25 bp, Homo sapien
gctttctgcttcaccatcattagga

SEQ ID NO: 155758 - DNA, 25 bp, Homo sapien
gtgaccattcctatataattcctgg

SEQ ID NO: 155759 - DNA, 25 bp, Homo sapien
taattcctggactggtgagattggt

SEQ ID NO: 155760 - DNA, 25 bp, Homo sapien
gtaggcctgtgaaatttgccctagt

SEQ ID NO: 155761 - DNA, 25 bp, Homo sapien
cctagttactaccattctcgttttg

SEQ ID NO: 155762 - DNA, 25 bp, Homo sapien
aagtcattgactttgctcgaggcac

SEQ ID NO: 155763 - DNA, 25 bp, Homo sapien
ttctccttttctgttgtcgagtaaa

SEQ ID NO: 155764 - DNA, 25 bp, Homo sapien
ctatttcttgcagtacatacgggaa

SEQ ID NO: 155765 - DNA, 25 bp, Homo sapien
gtacatacgggaaacaaacattcga

SEQ ID NO: 155766 - DNA, 25 bp, Homo sapien
cccaacttgatatggaccagctttt

SEQ ID NO: 155767 - DNA, 25 bp, Homo sapien
accagcttttgggacctgagtggga

SEQ ID NO: 155768 - DNA, 25 bp, Homo sapien
tgggacctgagtgggacctttacct

SEQ ID NO: 155769 - DNA, 25 bp, Homo sapien
agtgggacctttacctcatgaccat

SEQ ID NO: 155770 - DNA, 25 bp, Homo sapien
atagcttacaggcaaaggcagcacc

SEQ ID NO: 155771 - DNA, 25 bp, Homo sapien
gcagccaccacagtaataggcactg

SEQ ID NO: 155772 - DNA, 25 bp, Homo sapien
gtaataggcactgggtccagccttg

SEQ ID NO: 155773 - DNA, 25 bp, Homo sapien
gggtccagccttgatcagtgacagc

SEQ ID NO: 155774 - DNA, 25 bp, Homo sapien
tcagtgacagcgaaggaagttatct

SEQ ID NO: 155775 - DNA, 25 bp, Homo sapien
gggcaagacagactcattaaatatt

SEQ ID NO: 155776 - DNA, 25 bp, Homo sapien
agatatatcagtgttgtctcataga

SEQ ID NO: 155777 - DNA, 25 bp, Homo sapien
atatcagtgttgtctcatagaactg

SEQ ID NO: 155778 - DNA, 25 bp, Homo sapien
agaactgcctggattccatttatgt

SEQ ID NO: 155779 - DNA, 25 bp, Homo sapien
ctgcctggattccatttatgttttt

SEQ ID NO: 155780 - DNA, 25 bp, Homo sapien
atgttttttctgattccatcctgtg

SEQ ID NO: 155781 - DNA, 25 bp, Homo sapien
ttcatccttgactcctttggtattt

SEQ ID NO: 155782 - DNA, 25 bp, Homo sapien
atccttgactcctttggtatttcac

SEQ ID NO: 155783 - DNA, 25 bp, Homo sapien
gactcctttggtatttcactgaatt

SEQ ID NO: 155784 - DNA, 25 bp, Homo sapien
ctcctttggtatttcactgaatttc

SEQ ID NO: 155785 - DNA, 25 bp, Homo sapien
actgaatttcaaacatttgtcagag

SEQ ID NO: 155786 - DNA, 25 bp, Homo sapien
aatggacactggagtagaagtctct

SEQ ID NO: 155787 - DNA, 25 bp, Homo sapien
agatgctcccataatactctcagat

SEQ ID NO: 155788 - DNA, 25 bp, Homo sapien
gatgctcccataatactctcagata

SEQ ID NO: 155789 - DNA, 25 bp, Homo sapien
atgctcccataatactctcagatag

SEQ ID NO: 155790 - DNA, 25 bp, Homo sapien
tgctcccataatactctcagatagt

SEQ ID NO: 155791 - DNA, 25 bp, Homo sapien
gctcccataatactctcagatagtg

SEQ ID NO: 155792 - DNA, 25 bp, Homo sapien
ctcccataatactctcagatagtga

SEQ ID NO: 155793 - DNA, 25 bp, Homo sapien
cccataatactctcagatagtgaag

SEQ ID NO: 155794 - DNA, 25 bp, Homo sapien
cataatactctcagatagtgaagaa

SEQ ID NO: 155795 - DNA, 25 bp, Homo sapien
aaaataagaacacagaccaccagtg

SEQ ID NO: 155796 - DNA, 25 bp, Homo sapien
aaaagaagagagctgccaattaaag

SEQ ID NO: 155797 - DNA, 25 bp, Homo sapien
aactggtacaattctattcatggga

SEQ ID NO: 155798 - DNA, 25 bp, Homo sapien
acaattctattcatgggacgagtca

SEQ ID NO: 155799 - DNA, 25 bp, Homo sapien
atgggacgagtcatgcatcctgaaa

SEQ ID NO: 155800 - DNA, 25 bp, Homo sapien
gacgagtcatgcatcctgaaacaat

SEQ ID NO: 155801 - DNA, 25 bp, Homo sapien
gcatcctgaaacaatgaacacaagt

SEQ ID NO: 155802 - DNA, 25 bp, Homo sapien
acacaagtggacatgatttcgaaga

SEQ ID NO: 155803 - DNA, 25 bp, Homo sapien
gaaaacagtaactaagcacattatg

SEQ ID NO: 155804 - DNA, 25 bp, Homo sapien
gcacattatgtttgcaactggtata

SEQ ID NO: 155805 - DNA, 25 bp, Homo sapien
gtttgcaactggtatatatttagga

SEQ ID NO: 155806 - DNA, 25 bp, Homo sapien
cttgtcaaggaatgttatcagtatt

SEQ ID NO: 155807 - DNA, 25 bp, Homo sapien
attaagctaatggtcctgttatgtc

SEQ ID NO: 155808 - DNA, 25 bp, Homo sapien
aatcacgccattattcagaacctta

SEQ ID NO: 155809 - DNA, 25 bp, Homo sapien
gaaccttatcaatcagttggtggac

SEQ ID NO: 155810 - DNA, 25 bp, Homo sapien
tcagttggtggaccagagtgtcccc

SEQ ID NO: 155811 - DNA, 25 bp, Homo sapien
tcctgtgtcccgtataagtatgttc

SEQ ID NO: 155812 - DNA, 25 bp, Homo sapien
aagtatgttccaattagtgtcctta

SEQ ID NO: 155813 - DNA, 25 bp, Homo sapien
tagtgtccttatgattgaggcaaat

SEQ ID NO: 155814 - DNA, 25 bp, Homo sapien
gattgctgagtcttgtacatgcaga

SEQ ID NO: 155815 - DNA, 25 bp, Homo sapien
tttccaaatcagcttccgccagctg

SEQ ID NO: 155816 - DNA, 25 bp, Homo sapien
tccgccagctgggttgggatcactg

SEQ ID NO: 155817 - DNA, 25 bp, Homo sapien
aggaacttgtctccgagtactacgc

SEQ ID NO: 155818 - DNA, 25 bp, Homo sapien
agtactacgcgatggtctcaattcc

SEQ ID NO: 155819 - DNA, 25 bp, Homo sapien
tggctggaacttcacgggtgcccac

SEQ ID NO: 155820 - DNA, 25 bp, Homo sapien
gtgcccactcaggtcacttatggaa

SEQ ID NO: 155821 - DNA, 25 bp, Homo sapien
tcacttatggaaccccatgtccatt

SEQ ID NO: 155822 - DNA, 25 bp, Homo sapien
catgtccattggcatcagcttcatg

SEQ ID NO: 155823 - DNA, 25 bp, Homo sapien
tggcatcagcttcatgggcaactac

SEQ ID NO: 155824 - DNA, 25 bp, Homo sapien
atgggcaactacatggatcgggtgc

SEQ ID NO: 155825 - DNA, 25 bp, Homo sapien
gtctactggcctgcggtgtggctca

SEQ ID NO: 155826 - DNA, 25 bp, Homo sapien
gagccctgaggtccaactatgtgct

SEQ ID NO: 155827 - DNA, 25 bp, Homo sapien
actatgtgctcaaaggacaccggga

SEQ ID NO: 155828 - DNA, 25 bp, Homo sapien
gacaccgggatgtgcagcgtacact

SEQ ID NO: 155829 - DNA, 25 bp, Homo sapien
tgcagcgtacactctctccaggcaa

SEQ ID NO: 155830 - DNA, 25 bp, Homo sapien
agagctagttgcgtcccagggacca

SEQ ID NO: 155831 - DNA, 25 bp, Homo sapien
tgcgtcccagggaccaagagaaaga

SEQ ID NO: 155832 - DNA, 25 bp, Homo sapien
gaagcagatatccaaagggtgcagc

SEQ ID NO: 155833 - DNA, 25 bp, Homo sapien
ggtgtttacgagcagctgtgagtga

SEQ ID NO: 155834 - DNA, 25 bp, Homo sapien
tcactttggactgctgcttctctta

SEQ ID NO: 155835 - DNA, 25 bp, Homo sapien
tcttagctcctctgcctctgaaaag

SEQ ID NO: 155836 - DNA, 25 bp, Homo sapien
tagctcctctgcctctgaaaagctg

SEQ ID NO: 155837 - DNA, 25 bp, Homo sapien
gggttttctcattgtctttttgcat

SEQ ID NO: 155838 - DNA, 25 bp, Homo sapien
ctcattgtctttttgcatcagtact

SEQ ID NO: 155839 - DNA, 25 bp, Homo sapien
gtctttttgcatcagtactttgtat

SEQ ID NO: 155840 - DNA, 25 bp, Homo sapien
gcatcagtactttgtatgggatatt

SEQ ID NO: 155841 - DNA, 25 bp, Homo sapien
ccaccagaattttgctgacttcact

SEQ ID NO: 155842 - DNA, 25 bp, Homo sapien
ttttgctgacttcacttttgcaact

SEQ ID NO: 155843 - DNA, 25 bp, Homo sapien
aaataattggacacatgctcaaatt

SEQ ID NO: 155844 - DNA, 25 bp, Homo sapien
gatcttagcaacaaagcttcattag

SEQ ID NO: 155845 - DNA, 25 bp, Homo sapien
agcttcattagcattcttacaaaag

SEQ ID NO: 155846 - DNA, 25 bp, Homo sapien
cttacaaaagcatttaggacttcat

SEQ ID NO: 155847 - DNA, 25 bp, Homo sapien
ttgatcagtgggactgcttgattga

SEQ ID NO: 155848 - DNA, 25 bp, Homo sapien
gatgagaatcttattccagggacca

SEQ ID NO: 155849 - DNA, 25 bp, Homo sapien
ttccagggaccaacattaacacaac

SEQ ID NO: 155850 - DNA, 25 bp, Homo sapien
ttaacacaaccaatcaacacatcat

SEQ ID NO: 155851 - DNA, 25 bp, Homo sapien
atcatgttacagaactcttcaggaa

SEQ ID NO: 155852 - DNA, 25 bp, Homo sapien
ggaggactaattgcttccactttga

SEQ ID NO: 155853 - DNA, 25 bp, Homo sapien
tccactttgactggattgatcctta

SEQ ID NO: 155854 - DNA, 25 bp, Homo sapien
caggatccggaatccgcctggttta

SEQ ID NO: 155855 - DNA, 25 bp, Homo sapien
ggtttaaaaccttcatcctgatggc

SEQ ID NO: 155856 - DNA, 25 bp, Homo sapien
ccttcatcctgatggcagccattaa

SEQ ID NO: 155857 - DNA, 25 bp, Homo sapien
cagccattaatgtgactggcctaat

SEQ ID NO: 155858 - DNA, 25 bp, Homo sapien
attttctaccttatagttgctacag

SEQ ID NO: 155859 - DNA, 25 bp, Homo sapien
gttgctacagcagaaattcaggact

SEQ ID NO: 155860 - DNA, 25 bp, Homo sapien
aaacaacacacacgtctctgaagtg

SEQ ID NO: 155861 - DNA, 25 bp, Homo sapien
agagcacttgcagagcctgggacaa

SEQ ID NO: 155862 - DNA, 25 bp, Homo sapien
tgggacaacctccttattgaaggga

SEQ ID NO: 155863 - DNA, 25 bp, Homo sapien
tgttgccaacgtgcttctggggccc

SEQ ID NO: 155864 - DNA, 25 bp, Homo sapien
gtttgtgcaccccttggcgagccag

SEQ ID NO: 155865 - DNA, 25 bp, Homo sapien
tttgtgcaccccttggcgagccaga

SEQ ID NO: 155866 - DNA, 25 bp, Homo sapien
ttgtgcaccccttggcgagccagaa

SEQ ID NO: 155867 - DNA, 25 bp, Homo sapien
accccttggcgagccagaactggga

SEQ ID NO: 155868 - DNA, 25 bp, Homo sapien
cccttggcgagccagaactgggaac

SEQ ID NO: 155869 - DNA, 25 bp, Homo sapien
ccttggcgagccagaactgggaacc

SEQ ID NO: 155870 - DNA, 25 bp, Homo sapien
cttggcgagccagaactgggaaccc

SEQ ID NO: 155871 - DNA, 25 bp, Homo sapien
ttggcgagccagaactgggaacccc

SEQ ID NO: 155872 - DNA, 25 bp, Homo sapien
tggcgagccagaactgggaaccccg

SEQ ID NO: 155873 - DNA, 25 bp, Homo sapien
gcgagccagaactgggaaccccgcg

SEQ ID NO: 155874 - DNA, 25 bp, Homo sapien
gatttgaacatgtagtgtacgtgct

SEQ ID NO: 155875 - DNA, 25 bp, Homo sapien
ttgtgaactggtgggccgtatgtaa

SEQ ID NO: 155876 - DNA, 25 bp, Homo sapien
tggtgggccgtatgtaacagctgac

SEQ ID NO: 155877 - DNA, 25 bp, Homo sapien
gggccgtatgtaacagctgaccaac

SEQ ID NO: 155878 - DNA, 25 bp, Homo sapien
atgtaacagctgaccaacgtgaaga

SEQ ID NO: 155879 - DNA, 25 bp, Homo sapien
ccaacgtgaagatactggtacttga

SEQ ID NO: 155880 - DNA, 25 bp, Homo sapien
atactggtacttgatagcctcttaa

SEQ ID NO: 155881 - DNA, 25 bp, Homo sapien
tccaaattttaagctggaaagtcac

SEQ ID NO: 155882 - DNA, 25 bp, Homo sapien
aaagaattacaatacatggcttttt

SEQ ID NO: 155883 - DNA, 25 bp, Homo sapien
ttgtggtagtcctgttttcctaata

SEQ ID NO: 155884 - DNA, 25 bp, Homo sapien
tagtcctgttttcctaataactttg

SEQ ID NO: 155885 - DNA, 25 bp, Homo sapien
cagccagacggaaaggcggctgctt

SEQ ID NO: 155886 - DNA, 25 bp, Homo sapien
gaaaggcggctgcttgcctctccat

SEQ ID NO: 155887 - DNA, 25 bp, Homo sapien
aagctggagccccaactttgatcct

SEQ ID NO: 155888 - DNA, 25 bp, Homo sapien
ttgatcctccattggagtggcccaa

SEQ ID NO: 155889 - DNA, 25 bp, Homo sapien
ctccattggagtggcccaaatcttt

SEQ ID NO: 155890 - DNA, 25 bp, Homo sapien
aaatctttccatctagggcaagtcc

SEQ ID NO: 155891 - DNA, 25 bp, Homo sapien
gggcaagtcctgaaaggcccaaggc

SEQ ID NO: 155892 - DNA, 25 bp, Homo sapien
tccagcctggagaagggctaacatc

SEQ ID NO: 155893 - DNA, 25 bp, Homo sapien
tggagaagggctaacatcagctcat

SEQ ID NO: 155894 - DNA, 25 bp, Homo sapien
aacatcagctcattgtcaaggccac

SEQ ID NO: 155895 - DNA, 25 bp, Homo sapien
agaacagaaccgtgtctctgataaa

SEQ ID NO: 155896 - DNA, 25 bp, Homo sapien
gaggtaccctgcaaggtctggtgtc

SEQ ID NO: 155897 - DNA, 25 bp, Homo sapien
ttgcggccaacccaatgacccagga

SEQ ID NO: 155898 - DNA, 25 bp, Homo sapien
atgacccaggagtctacactcaagt

SEQ ID NO: 155899 - DNA, 25 bp, Homo sapien
acactcaagtgtgcaagttcaccaa

SEQ ID NO: 155900 - DNA, 25 bp, Homo sapien
gaaaaagcatcgctaacgccacact

SEQ ID NO: 155901 - DNA, 25 bp, Homo sapien
atcgctaacgccacactgagttaat

SEQ ID NO: 155902 - DNA, 25 bp, Homo sapien
gttaattaactgtgtgcttccaaca

SEQ ID NO: 155903 - DNA, 25 bp, Homo sapien
tgcttccaacagaaaatgcacagga

SEQ ID NO: 155904 - DNA, 25 bp, Homo sapien
tttgactttacctttcctcaaagat

SEQ ID NO: 155905 - DNA, 25 bp, Homo sapien
gatatatttaaacctcatgccctgt

SEQ ID NO: 155906 - DNA, 25 bp, Homo sapien
acctcatgccctgttgataaaccaa

SEQ ID NO: 155907 - DNA, 25 bp, Homo sapien
ttgtagctaaacatttcattgtccc

SEQ ID NO: 155908 - DNA, 25 bp, Homo sapien
ccccagtctgcaaaagaagcacaat

SEQ ID NO: 155909 - DNA, 25 bp, Homo sapien
agcacaattctattgctttgtcttg

SEQ ID NO: 155910 - DNA, 25 bp, Homo sapien
acaattctattgctttgtcttgctt

SEQ ID NO: 155911 - DNA, 25 bp, Homo sapien
ctttgtcttgcttatagtcattaaa

SEQ ID NO: 155912 - DNA, 25 bp, Homo sapien
gtcttgcttatagtcattaaatcat

SEQ ID NO: 155913 - DNA, 25 bp, Homo sapien
gacctaaatttgtacagtcccattg

SEQ ID NO: 155914 - DNA, 25 bp, Homo sapien
aaatttgtacagtcccattgtaagt

SEQ ID NO: 155915 - DNA, 25 bp, Homo sapien
gtacagtcccattgtaagtgttgtt

SEQ ID NO: 155916 - DNA, 25 bp, Homo sapien
gtcccattgtaagtgttgtttctaa

SEQ ID NO: 155917 - DNA, 25 bp, Homo sapien
ccattgtaagtgttgtttctaatta

SEQ ID NO: 155918 - DNA, 25 bp, Homo sapien
gaataaggtgtctgactggaagctg

SEQ ID NO: 155919 - DNA, 25 bp, Homo sapien
agctggagatacttcagaatggctt

SEQ ID NO: 155920 - DNA, 25 bp, Homo sapien
tttatggccaagtggctcccaatgc

SEQ ID NO: 155921 - DNA, 25 bp, Homo sapien
gtggctcccaatgcaaactacaatg

SEQ ID NO: 155922 - DNA, 25 bp, Homo sapien
tacaatgatgtagctccttttgagg

SEQ ID NO: 155923 - DNA, 25 bp, Homo sapien
ctccttttgaggtgcggctgtataa

SEQ ID NO: 155924 - DNA, 25 bp, Homo sapien
tgtaggagggacttatgaattgcat

SEQ ID NO: 155925 - DNA, 25 bp, Homo sapien
gggacaccatagacttgatattcaa

SEQ ID NO: 155926 - DNA, 25 bp, Homo sapien
attcaactctgagcatcaggttcta

SEQ ID NO: 155927 - DNA, 25 bp, Homo sapien
gggtatcattttactagcaaatccc

SEQ ID NO: 155928 - DNA, 25 bp, Homo sapien
ttactagcaaatccccaattcatct

SEQ ID NO: 155929 - DNA, 25 bp, Homo sapien
aggagagccaggagcatttaaaaat

SEQ ID NO: 155930 - DNA, 25 bp, Homo sapien
ggagagccaggagcatttaaaaatc

SEQ ID NO: 155931 - DNA, 25 bp, Homo sapien
gagagccaggagcatttaaaaatca

SEQ ID NO: 155932 - DNA, 25 bp, Homo sapien
gcatttaaaaatcagcatctgggcc

SEQ ID NO: 155933 - DNA, 25 bp, Homo sapien
catttaaaaatcagcatctgggcca

SEQ ID NO: 155934 - DNA, 25 bp, Homo sapien
atttaaaaatcagcatctgggccag

SEQ ID NO: 155935 - DNA, 25 bp, Homo sapien
tttaaaaatcagcatctgggccagg

SEQ ID NO: 155936 - DNA, 25 bp, Homo sapien
aaatcagcatctgggccaggcaaga

SEQ ID NO: 155937 - DNA, 25 bp, Homo sapien
aatcagcatctgggccaggcaagat

SEQ ID NO: 155938 - DNA, 25 bp, Homo sapien
atcagcatctgggccaggcaagatg

SEQ ID NO: 155939 - DNA, 25 bp, Homo sapien
agcatctgggccaggcaagatggct

SEQ ID NO: 155940 - DNA, 25 bp, Homo sapien
gtctctgcaatgctgtgggcacaaa

SEQ ID NO: 155941 - DNA, 25 bp, Homo sapien
agagtccctgtgcaaacacctagac

SEQ ID NO: 155942 - DNA, 25 bp, Homo sapien
aaacacctagactcacttcatggat

SEQ ID NO: 155943 - DNA, 25 bp, Homo sapien
ggattccaaagctctcagcttcatt

SEQ ID NO: 155944 - DNA, 25 bp, Homo sapien
ggttcaagggtcatggtcctcatca

SEQ ID NO: 155945 - DNA, 25 bp, Homo sapien
tcatcacacacatgtcatcagggcc

SEQ ID NO: 155946 - DNA, 25 bp, Homo sapien
cctgcactccacatgatgaggtcag

SEQ ID NO: 155947 - DNA, 25 bp, Homo sapien
tgaggtcagacccacacggtgcaaa

SEQ ID NO: 155948 - DNA, 25 bp, Homo sapien
caaatctttgggtcagtgagctcct

SEQ ID NO: 155949 - DNA, 25 bp, Homo sapien
aggaatagattaggcacccctcttc

SEQ ID NO: 155950 - DNA, 25 bp, Homo sapien
gcacccctcttccttaatgaaatgt

SEQ ID NO: 155951 - DNA, 25 bp, Homo sapien
gttgaagaggatcttccgactgctg

SEQ ID NO: 155952 - DNA, 25 bp, Homo sapien
ggagcagtggccctctatgaccaag

SEQ ID NO: 155953 - DNA, 25 bp, Homo sapien
ctctatgaccaagctgccagactat

SEQ ID NO: 155954 - DNA, 25 bp, Homo sapien
agactataagccctatccgatgtac

SEQ ID NO: 155955 - DNA, 25 bp, Homo sapien
acaacatccctggtgaacgtcgtgc

SEQ ID NO: 155956 - DNA, 25 bp, Homo sapien
tggtgaacgtcgtgcccaaactcaa

SEQ ID NO: 155957 - DNA, 25 bp, Homo sapien
gtgcccaaactcaatgccacaggga

SEQ ID NO: 155958 - DNA, 25 bp, Homo sapien
ccacagggagggatctgctgcagaa

SEQ ID NO: 155959 - DNA, 25 bp, Homo sapien
gaaccttctgaagtgtaaccctgtc

SEQ ID NO: 155960 - DNA, 25 bp, Homo sapien
aagtgtaaccctgtccagcgtatct

SEQ ID NO: 155961 - DNA, 25 bp, Homo sapien
gcgtatctcagcagaagaggccctg

SEQ ID NO: 155962 - DNA, 25 bp, Homo sapien
caggcaaaaacgtccccgaagccag

SEQ ID NO: 155963 - DNA, 25 bp, Homo sapien
gtccccgaagccagcagttgtagag

SEQ ID NO: 155964 - DNA, 25 bp, Homo sapien
gccagcagttgtagagactgttaca

SEQ ID NO: 155965 - DNA, 25 bp, Homo sapien
tgttacaacagccaagccacagcag

SEQ ID NO: 155966 - DNA, 25 bp, Homo sapien
gccaagccacagcagatacaagcgc

SEQ ID NO: 155967 - DNA, 25 bp, Homo sapien
acaagcgctgatggatgaagtgaca

SEQ ID NO: 155968 - DNA, 25 bp, Homo sapien
acattgtccgagaactgaaagcaca

SEQ ID NO: 155969 - DNA, 25 bp, Homo sapien
cagacaagaacgaggttgctgcgga

SEQ ID NO: 155970 - DNA, 25 bp, Homo sapien
aggtggcgaaactcttggatctaaa

SEQ ID NO: 155971 - DNA, 25 bp, Homo sapien
aaagtaaaagaccttggctcataga

SEQ ID NO: 155972 - DNA, 25 bp, Homo sapien
gaccttggctcatagaaagtcactt

SEQ ID NO: 155973 - DNA, 25 bp, Homo sapien
agggcaaagtggacgggagtggaca

SEQ ID NO: 155974 - DNA, 25 bp, Homo sapien
caaagtggacgggagtggacaggag

SEQ ID NO: 155975 - DNA, 25 bp, Homo sapien
aaagtggacgggagtggacaggagt

SEQ ID NO: 155976 - DNA, 25 bp, Homo sapien
aagtggacgggagtggacaggagtg

SEQ ID NO: 155977 - DNA, 25 bp, Homo sapien
agtggacgggagtggacaggagtgg

SEQ ID NO: 155978 - DNA, 25 bp, Homo sapien
gagtggatgcgataagatgtggttt

SEQ ID NO: 155979 - DNA, 25 bp, Homo sapien
agtggatgcgataagatgtggtttg

SEQ ID NO: 155980 - DNA, 25 bp, Homo sapien
tggatgcgataagatgtggtttgaa

SEQ ID NO: 155981 - DNA, 25 bp, Homo sapien
gatgcgataagatgtggtttgaagc

SEQ ID NO: 155982 - DNA, 25 bp, Homo sapien
atgcgataagatgtggtttgaagct

SEQ ID NO: 155983 - DNA, 25 bp, Homo sapien
tgcgataagatgtggtttgaagctg

SEQ ID NO: 155984 - DNA, 25 bp, Homo sapien
cgatctgaaaaaggagactcgagca

SEQ ID NO: 155985 - DNA, 25 bp, Homo sapien
gagactcgagcagatattaaagcaa

SEQ ID NO: 155986 - DNA, 25 bp, Homo sapien
agttattgcataccaatccttgttt

SEQ ID NO: 155987 - DNA, 25 bp, Homo sapien
accaatccttgtttgcaaatcaaaa

SEQ ID NO: 155988 - DNA, 25 bp, Homo sapien
atgttatttctgcattgttacctgc

SEQ ID NO: 155989 - DNA, 25 bp, Homo sapien
attgttacctgcatattactgaaag

SEQ ID NO: 155990 - DNA, 25 bp, Homo sapien
gaaacatgttggttttgtggagaga

SEQ ID NO: 155991 - DNA, 25 bp, Homo sapien
ggtagatactaacttcctccatgaa

SEQ ID NO: 155992 - DNA, 25 bp, Homo sapien
agatactaacttcctccatgaattt

SEQ ID NO: 155993 - DNA, 25 bp, Homo sapien
ctccatgaattttttgaggtattca

SEQ ID NO: 155994 - DNA, 25 bp, Homo sapien
atttcatacttgttgatgctatttg

SEQ ID NO: 155995 - DNA, 25 bp, Homo sapien
aatggaagattctggctccctactt

SEQ ID NO: 155996 - DNA, 25 bp, Homo sapien
attctggctccctacttggaaatga

SEQ ID NO: 155997 - DNA, 25 bp, Homo sapien
gagagctaagcagctcctggttgcc

SEQ ID NO: 155998 - DNA, 25 bp, Homo sapien
gctcctggttgcctggcaagatcaa

SEQ ID NO: 155999 - DNA, 25 bp, Homo sapien
gagggagttcatgcaacacctgaga

SEQ ID NO: 156000 - DNA, 25 bp, Homo sapien
gagaatctgattaatgcactgaata

SEQ ID NO: 156001 - DNA, 25 bp, Homo sapien
aagtctggattaagtgaccttgcag

SEQ ID NO: 156002 - DNA, 25 bp, Homo sapien
gtgaccttgcagaaagtctaactaa

SEQ ID NO: 156003 - DNA, 25 bp, Homo sapien
gagacaaatagttagcttctttttt

SEQ ID NO: 156004 - DNA, 25 bp, Homo sapien
gatagattttgttaccaagcagcat

SEQ ID NO: 156005 - DNA, 25 bp, Homo sapien
agcagcatttgataagaggtccact

SEQ ID NO: 156006 - DNA, 25 bp, Homo sapien
atgatgttattttggactagcttaa

SEQ ID NO: 156007 - DNA, 25 bp, Homo sapien
aagtttcctattccatactgttcat

SEQ ID NO: 156008 - DNA, 25 bp, Homo sapien
ctattctaaaggaggcaggagccaa

SEQ ID NO: 156009 - DNA, 25 bp, Homo sapien
ggagccaaggccaaaagtgaacgta

SEQ ID NO: 156010 - DNA, 25 bp, Homo sapien
taagggccagctggtattaactgat

SEQ ID NO: 156011 - DNA, 25 bp, Homo sapien
tattaactgataactttacctttgg

SEQ ID NO: 156012 - DNA, 25 bp, Homo sapien
ttgtttttctagtccctacctgtgt

SEQ ID NO: 156013 - DNA, 25 bp, Homo sapien
agtccctacctgtgtttaaattatg

SEQ ID NO: 156014 - DNA, 25 bp, Homo sapien
ggataactcgaaagacaggctcagg

SEQ ID NO: 156015 - DNA, 25 bp, Homo sapien
acaggctcaggtgaaggccgagtaa

SEQ ID NO: 156016 - DNA, 25 bp, Homo sapien
ggtgaaggccgagtaatgatttttt

SEQ ID NO: 156017 - DNA, 25 bp, Homo sapien
gaagcagggcactgaactctgggct

SEQ ID NO: 156018 - DNA, 25 bp, Homo sapien
agggcactgaactctgggctgcttc

SEQ ID NO: 156019 - DNA, 25 bp, Homo sapien
ggcacatcttcctaatctgttaatg

SEQ ID NO: 156020 - DNA, 25 bp, Homo sapien
gttaatggtcagtggtgtccccaag

SEQ ID NO: 156021 - DNA, 25 bp, Homo sapien
atggaaaccctcactcctggagatt

SEQ ID NO: 156022 - DNA, 25 bp, Homo sapien
ttcaagtgtacagccacagcaagga

SEQ ID NO: 156023 - DNA, 25 bp, Homo sapien
gcaaggagcccgacactgatttgat

SEQ ID NO: 156024 - DNA, 25 bp, Homo sapien
actgatttgatcgattctgtgacac

SEQ ID NO: 156025 - DNA, 25 bp, Homo sapien
ttctgtgacacaaaccccaccaatt

SEQ ID NO: 156026 - DNA, 25 bp, Homo sapien
cccaccaattgttaatgcaagtttt

SEQ ID NO: 156027 - DNA, 25 bp, Homo sapien
ggctgtatatacaatttaagctatt

SEQ ID NO: 156028 - DNA, 25 bp, Homo sapien
ttctggggcccctgtcactgccgct

SEQ ID NO: 156029 - DNA, 25 bp, Homo sapien
tctggggcccctgtcactgccgctg

SEQ ID NO: 156030 - DNA, 25 bp, Homo sapien
tcactgccgctggatgccgcgcaca

SEQ ID NO: 156031 - DNA, 25 bp, Homo sapien
cactgccgctggatgccgcgcacac

SEQ ID NO: 156032 - DNA, 25 bp, Homo sapien
actgccgctggatgccgcgcacaca

SEQ ID NO: 156033 - DNA, 25 bp, Homo sapien
ctgccgctggatgccgcgcacacag

SEQ ID NO: 156034 - DNA, 25 bp, Homo sapien
tggatgccgcgcacacaggcagagt

SEQ ID NO: 156035 - DNA, 25 bp, Homo sapien
ccccgcggggtgaccccttctcatg

SEQ ID NO: 156036 - DNA, 25 bp, Homo sapien
cccgcggggtgaccccttctcatgg

SEQ ID NO: 156037 - DNA, 25 bp, Homo sapien
ccgcggggtgaccccttctcatggg

SEQ ID NO: 156038 - DNA, 25 bp, Homo sapien
cgcggggtgaccccttctcatgggg

SEQ ID NO: 156039 - DNA, 25 bp, Homo sapien
gaacactgggcagcctcaccatgtt

SEQ ID NO: 156040 - DNA, 25 bp, Homo sapien
accatgttgccaacgtgcttctggg

SEQ ID NO: 156041 - DNA, 25 bp, Homo sapien
tgtcactgccgctggatgccgcgca

SEQ ID NO: 156042 - DNA, 25 bp, Homo sapien
tggatgccgcgcacacaggcagagt

SEQ ID NO: 156043 - DNA, 25 bp, Homo sapien
cgcacacaggcagagtgccttggca

SEQ ID NO: 156044 - DNA, 25 bp, Homo sapien
ttgtgcaccccttggcgagccagaa

SEQ ID NO: 156045 - DNA, 25 bp, Homo sapien
tggcgagccagaactgggaaccccg

SEQ ID NO: 156046 - DNA, 25 bp, Homo sapien
tgcctatttttaatcctgtctgttt

SEQ ID NO: 156047 - DNA, 25 bp, Homo sapien
aatcctgtctgtttgttgcacaatg

SEQ ID NO: 156048 - DNA, 25 bp, Homo sapien
ctgtctgtttgttgcacaatggaaa

SEQ ID NO: 156049 - DNA, 25 bp, Homo sapien
aatactgttgattccaggtttattt

SEQ ID NO: 156050 - DNA, 25 bp, Homo sapien
aatagggaccgcagcagggaccgca

SEQ ID NO: 156051 - DNA, 25 bp, Homo sapien
atagggaccgcagcagggaccgcag

SEQ ID NO: 156052 - DNA, 25 bp, Homo sapien
tagggaccgcagcagggaccgcagc

SEQ ID NO: 156053 - DNA, 25 bp, Homo sapien
agggaccgcagcagggaccgcagcc

SEQ ID NO: 156054 - DNA, 25 bp, Homo sapien
gggaccgcagcagggaccgcagccg

SEQ ID NO: 156055 - DNA, 25 bp, Homo sapien
ggaccgcagcagggaccgcagccgg

SEQ ID NO: 156056 - DNA, 25 bp, Homo sapien
gaccgcagcagggaccgcagccggg

SEQ ID NO: 156057 - DNA, 25 bp, Homo sapien
accgcagcagggaccgcagccgggg

SEQ ID NO: 156058 - DNA, 25 bp, Homo sapien
gctgtatttggagatcatgggctga

SEQ ID NO: 156059 - DNA, 25 bp, Homo sapien
gagatcatgggctgattccatgttc

SEQ ID NO: 156060 - DNA, 25 bp, Homo sapien
ttccatgttcttgggcaacagtcca

SEQ ID NO: 156061 - DNA, 25 bp, Homo sapien
ttgggcaacagtccagaagcatcag

SEQ ID NO: 156062 - DNA, 25 bp, Homo sapien
tccggcctgggatgtttctgaactt

SEQ ID NO: 156063 - DNA, 25 bp, Homo sapien
gttataggagacaggaggaacttct

SEQ ID NO: 156064 - DNA, 25 bp, Homo sapien
tcccctacaattccttttcacatat

SEQ ID NO: 156065 - DNA, 25 bp, Homo sapien
ttttcacatattcctttcttctccc

SEQ ID NO: 156066 - DNA, 25 bp, Homo sapien
tgaccttccaaaactctgctctcag

SEQ ID NO: 156067 - DNA, 25 bp, Homo sapien
gctctcaggctgaaatctggcatca

SEQ ID NO: 156068 - DNA, 25 bp, Homo sapien
ctggcatcatctcaggttccctgtc

SEQ ID NO: 156069 - DNA, 25 bp, Homo sapien
gctacatttctttccttctcagtga

SEQ ID NO: 156070 - DNA, 25 bp, Homo sapien
tttctttccttctcagtgacctgaa

SEQ ID NO: 156071 - DNA, 25 bp, Homo sapien
ttctcagtgacctgaagggtactct

SEQ ID NO: 156072 - DNA, 25 bp, Homo sapien
gacctgaagggtactctagctattg

SEQ ID NO: 156073 - DNA, 25 bp, Homo sapien
aagggtactctagctattgacagtc

SEQ ID NO: 156074 - DNA, 25 bp, Homo sapien
ggtactctagctattgacagtcttt

SEQ ID NO: 156075 - DNA, 25 bp, Homo sapien
ttgacagtctttactctcttcagtt

SEQ ID NO: 156076 - DNA, 25 bp, Homo sapien
acagtctttactctcttcagtttgc

SEQ ID NO: 156077 - DNA, 25 bp, Homo sapien
ctcttcagtttgctggaggtaactg

SEQ ID NO: 156078 - DNA, 25 bp, Homo sapien
aactgaagatgagagcaagaccctg

SEQ ID NO: 156079 - DNA, 25 bp, Homo sapien
tagtgagctacatttctttccttct

SEQ ID NO: 156080 - DNA, 25 bp, Homo sapien
atgccgcactggactccatcagcag

SEQ ID NO: 156081 - DNA, 25 bp, Homo sapien
agctggacaacctggatgcctgcct

SEQ ID NO: 156082 - DNA, 25 bp, Homo sapien
tggacaacctggatgcctgcctggg

SEQ ID NO: 156083 - DNA, 25 bp, Homo sapien
ccaccctggctctgaagaggtactt

SEQ ID NO: 156084 - DNA, 25 bp, Homo sapien
ctggctctgaagaggtacttccagg

SEQ ID NO: 156085 - DNA, 25 bp, Homo sapien
gagaagggatacagcgactgcgcct

SEQ ID NO: 156086 - DNA, 25 bp, Homo sapien
agcgactgcgcctgggaaaccgtca

SEQ ID NO: 156087 - DNA, 25 bp, Homo sapien
gactgcgcctgggaaaccgtcagac

SEQ ID NO: 156088 - DNA, 25 bp, Homo sapien
ctgcgcctgggaaaccgtcagactg

SEQ ID NO: 156089 - DNA, 25 bp, Homo sapien
cttctcttcattaatcagcttgcaa

SEQ ID NO: 156090 - DNA, 25 bp, Homo sapien
cattaatcagcttgcaagaaaggtt

SEQ ID NO: 156091 - DNA, 25 bp, Homo sapien
gatgcgggcagtgcctttgccgttc

SEQ ID NO: 156092 - DNA, 25 bp, Homo sapien
tgcgggcagtgcctttgccgttcac

SEQ ID NO: 156093 - DNA, 25 bp, Homo sapien
gcgggcagtgcctttgccgttcacg

SEQ ID NO: 156094 - DNA, 25 bp, Homo sapien
cgggcagtgcctttgccgttcacga

SEQ ID NO: 156095 - DNA, 25 bp, Homo sapien
gggcagtgcctttgccgttcacgac

SEQ ID NO: 156096 - DNA, 25 bp, Homo sapien
ggcagtgcctttgccgttcacgacc

SEQ ID NO: 156097 - DNA, 25 bp, Homo sapien
gcagtgcctttgccgttcacgacct

SEQ ID NO: 156098 - DNA, 25 bp, Homo sapien
agtgcctttgccgttcacgacctgg

SEQ ID NO: 156099 - DNA, 25 bp, Homo sapien
tgcctttgccgttcacgacctggag

SEQ ID NO: 156100 - DNA, 25 bp, Homo sapien
ttcacgacctggaggaggacacctg

SEQ ID NO: 156101 - DNA, 25 bp, Homo sapien
aggacacctggtatgcgactgggat

SEQ ID NO: 156102 - DNA, 25 bp, Homo sapien
cgacgtcttccagtaccgagagaaa

SEQ ID NO: 156103 - DNA, 25 bp, Homo sapien
agaaagcctatttctgccaggaccg

SEQ ID NO: 156104 - DNA, 25 bp, Homo sapien
aggaccgcttctactggcgcgtgag

SEQ ID NO: 156105 - DNA, 25 bp, Homo sapien
ctactggcgcgtgagttcccggagt

SEQ ID NO: 156106 - DNA, 25 bp, Homo sapien
ttcccggagtgagttgaaccaggtg

SEQ ID NO: 156107 - DNA, 25 bp, Homo sapien
tgaaccaggtggaccaagtgggcta

SEQ ID NO: 156108 - DNA, 25 bp, Homo sapien
agtgggctacgtgacctatgacatc

SEQ ID NO: 156109 - DNA, 25 bp, Homo sapien
tatgacatcctgcagtgccctgagg

SEQ ID NO: 156110 - DNA, 25 bp, Homo sapien
agtgccatgtaaatccccactggga

SEQ ID NO: 156111 - DNA, 25 bp, Homo sapien
gaaggagccagtttgccggatacaa

SEQ ID NO: 156112 - DNA, 25 bp, Homo sapien
caaactggtattctgttctggagga

SEQ ID NO: 156113 - DNA, 25 bp, Homo sapien
gcagcagtcctgaatggtgtttcat

SEQ ID NO: 156114 - DNA, 25 bp, Homo sapien
tgaagaagttcctagtttacagttc

SEQ ID NO: 156115 - DNA, 25 bp, Homo sapien
gtttacagttcttttacattacatt

SEQ ID NO: 156116 - DNA, 25 bp, Homo sapien
tacattacatttacaatagtgcttg

SEQ ID NO: 156117 - DNA, 25 bp, Homo sapien
tgcttgtacaagcttgccaaagata

SEQ ID NO: 156118 - DNA, 25 bp, Homo sapien
atatggatcgccagtctttacatcg

SEQ ID NO: 156119 - DNA, 25 bp, Homo sapien
cagtctttacatcgcactttcagtt

SEQ ID NO: 156120 - DNA, 25 bp, Homo sapien
tacatcgcactttcagttcctccat

SEQ ID NO: 156121 - DNA, 25 bp, Homo sapien
ggatcctgaagaaatcatatgttaa

SEQ ID NO: 156122 - DNA, 25 bp, Homo sapien
aaacatactttgacacctactgtgt

SEQ ID NO: 156123 - DNA, 25 bp, Homo sapien
atatcatcagatgtgccttgagaat

SEQ ID NO: 156124 - DNA, 25 bp, Homo sapien
gatgcaaagccggaccggtttctca

SEQ ID NO: 156125 - DNA, 25 bp, Homo sapien
ggaccggtttctcacggtggcctca

SEQ ID NO: 156126 - DNA, 25 bp, Homo sapien
tctcacggtggcctcatttcattga

SEQ ID NO: 156127 - DNA, 25 bp, Homo sapien
cacggtggcctcatttcattgaggg

SEQ ID NO: 156128 - DNA, 25 bp, Homo sapien
gatgaaggcagagtgtcaagtgact

SEQ ID NO: 156129 - DNA, 25 bp, Homo sapien
tcaagtgactgtgcagaggccaaac

SEQ ID NO: 156130 - DNA, 25 bp, Homo sapien
tgtgcagaggccaaacagagggacc

SEQ ID NO: 156131 - DNA, 25 bp, Homo sapien
gagggaccctggacattcttgggta

SEQ ID NO: 156132 - DNA, 25 bp, Homo sapien
ggacattcttgggtagtattctctc

SEQ ID NO: 156133 - DNA, 25 bp, Homo sapien
ttgggtagtattctctccctaacca

SEQ ID NO: 156134 - DNA, 25 bp, Homo sapien
ccatacacccactgggctatactag

SEQ ID NO: 156135 - DNA, 25 bp, Homo sapien
agcagcaatgctaaacctctgtttc

SEQ ID NO: 156136 - DNA, 25 bp, Homo sapien
gcagcaatgctaaacctctgtttca

SEQ ID NO: 156137 - DNA, 25 bp, Homo sapien
cagcaatgctaaacctctgtttcat

SEQ ID NO: 156138 - DNA, 25 bp, Homo sapien
agacacgccgtgcactcgttagatt

SEQ ID NO: 156139 - DNA, 25 bp, Homo sapien
gacacgccgtgcactcgttagattc

SEQ ID NO: 156140 - DNA, 25 bp, Homo sapien
acgccgtgcactcgttagattcctt

SEQ ID NO: 156141 - DNA, 25 bp, Homo sapien
gccgtgcactcgttagattcctttc

SEQ ID NO: 156142 - DNA, 25 bp, Homo sapien
cgtgcactcgttagattcctttctt

SEQ ID NO: 156143 - DNA, 25 bp, Homo sapien
gtgcactcgttagattcctttctta

SEQ ID NO: 156144 - DNA, 25 bp, Homo sapien
tgcactcgttagattcctttcttag

SEQ ID NO: 156145 - DNA, 25 bp, Homo sapien
tagaaaactcgttttctgctccctt

SEQ ID NO: 156146 - DNA, 25 bp, Homo sapien
gaaaaagaagactcagagagcaaga

SEQ ID NO: 156147 - DNA, 25 bp, Homo sapien
aaaaagaagactcagagagcaagag

SEQ ID NO: 156148 - DNA, 25 bp, Homo sapien
aaaagaagactcagagagcaagagg

SEQ ID NO: 156149 - DNA, 25 bp, Homo sapien
aaagaagactcagagagcaagagga

SEQ ID NO: 156150 - DNA, 25 bp, Homo sapien
aagaagactcagagagcaagaggaa

SEQ ID NO: 156151 - DNA, 25 bp, Homo sapien
agaagactcagagagcaagaggaat

SEQ ID NO: 156152 - DNA, 25 bp, Homo sapien
gaagactcagagagcaagaggaatt

SEQ ID NO: 156153 - DNA, 25 bp, Homo sapien
agactcagagagcaagaggaatttt

SEQ ID NO: 156154 - DNA, 25 bp, Homo sapien
gactcagagagcaagaggaattttg

SEQ ID NO: 156155 - DNA, 25 bp, Homo sapien
actcagagagcaagaggaattttgg

SEQ ID NO: 156156 - DNA, 25 bp, Homo sapien
ctcagagagcaagaggaattttggg

SEQ ID NO: 156157 - DNA, 25 bp, Homo sapien
gtggaggtgctgcaccacaccaagc

SEQ ID NO: 156158 - DNA, 25 bp, Homo sapien
tcaagttcgcctactgcggcaagtg

SEQ ID NO: 156159 - DNA, 25 bp, Homo sapien
actgcggcaagtggttcgtgagcac

SEQ ID NO: 156160 - DNA, 25 bp, Homo sapien
gcactgggaaagataaccttctcaa

SEQ ID NO: 156161 - DNA, 25 bp, Homo sapien
agataaccttctcaacgcctggagg

SEQ ID NO: 156162 - DNA, 25 bp, Homo sapien
ggaggacgccttatggagccagcat

SEQ ID NO: 156163 - DNA, 25 bp, Homo sapien
ccagtctaaagaatcctcgtctgtc

SEQ ID NO: 156164 - DNA, 25 bp, Homo sapien
aatcctcgtctgtcttgagttgtga

SEQ ID NO: 156165 - DNA, 25 bp, Homo sapien
gagttgtgacatttcagcggatgac

SEQ ID NO: 156166 - DNA, 25 bp, Homo sapien
tttcagcggatgacaaatacattgt

SEQ ID NO: 156167 - DNA, 25 bp, Homo sapien
atacattgtaacaggctctggtgac

SEQ ID NO: 156168 - DNA, 25 bp, Homo sapien
agctgggtctatcagctcgctggat

SEQ ID NO: 156169 - DNA, 25 bp, Homo sapien
atcagctcgctggattcagcaacga

SEQ ID NO: 156170 - DNA, 25 bp, Homo sapien
tcagcaacgacacaatcagaccagg

SEQ ID NO: 156171 - DNA, 25 bp, Homo sapien
gaccaggattatcactaccttggag

SEQ ID NO: 156172 - DNA, 25 bp, Homo sapien
aagttagctgaactctatggagaaa

SEQ ID NO: 156173 - DNA, 25 bp, Homo sapien
ggtcagttcttgcaaccttgtggaa

SEQ ID NO: 156174 - DNA, 25 bp, Homo sapien
gcaaccttgtggaatttgcttcctg

SEQ ID NO: 156175 - DNA, 25 bp, Homo sapien
gaatttgcttcctgagtaagtggat

SEQ ID NO: 156176 - DNA, 25 bp, Homo sapien
taagtggatatacaacctcagcaat

SEQ ID NO: 156177 - DNA, 25 bp, Homo sapien
gctcctgtagaaacaagtgcccttt

SEQ ID NO: 156178 - DNA, 25 bp, Homo sapien
aacaagtgcccttttcatgatcgaa

SEQ ID NO: 156179 - DNA, 25 bp, Homo sapien
tcctaatttagccaggacctgccaa

SEQ ID NO: 156180 - DNA, 25 bp, Homo sapien
aggacctgccaatgattccagacga

SEQ ID NO: 156181 - DNA, 25 bp, Homo sapien
tgattccagacgaccttttgttttc

SEQ ID NO: 156182 - DNA, 25 bp, Homo sapien
cgacgtttcctcgttttgaaagcag

SEQ ID NO: 156183 - DNA, 25 bp, Homo sapien
ctgatcaggcgcactgtctgaagca

SEQ ID NO: 156184 - DNA, 25 bp, Homo sapien
ggcgcactgtctgaagcaatcggtt

SEQ ID NO: 156185 - DNA, 25 bp, Homo sapien
tgaagcaatcggttccccagattac

SEQ ID NO: 156186 - DNA, 25 bp, Homo sapien
ggttccccagattacttgatattta

SEQ ID NO: 156187 - DNA, 25 bp, Homo sapien
taaaacaaatccctcatcctgacag

SEQ ID NO: 156188 - DNA, 25 bp, Homo sapien
caaatccctcatcctgacaggaaga

SEQ ID NO: 156189 - DNA, 25 bp, Homo sapien
tcggaggccctttccacgaaatcct

SEQ ID NO: 156190 - DNA, 25 bp, Homo sapien
cacaactttgtcgtggttcttaaat

SEQ ID NO: 156191 - DNA, 25 bp, Homo sapien
tatttctaagaagttgtttgaggca

SEQ ID NO: 156192 - DNA, 25 bp, Homo sapien
tgtttgaggcaaattaactgtatgt

SEQ ID NO: 156193 - DNA, 25 bp, Homo sapien
actgtatgtgtgtaggttatctttt

SEQ ID NO: 156194 - DNA, 25 bp, Homo sapien
actcttcagtgcaaattgtatctta

SEQ ID NO: 156195 - DNA, 25 bp, Homo sapien
caagtttacacttcatatagcattg

SEQ ID NO: 156196 - DNA, 25 bp, Homo sapien
tatagcattgataatcttcaggtga

SEQ ID NO: 156197 - DNA, 25 bp, Homo sapien
tcttcaggtgaacacttagtgatca

SEQ ID NO: 156198 - DNA, 25 bp, Homo sapien
aaaagctcactgctgatcgtagaaa

SEQ ID NO: 156199 - DNA, 25 bp, Homo sapien
ctgctgatcgtagaaaatttgcttt

SEQ ID NO: 156200 - DNA, 25 bp, Homo sapien
gtatctgggattattctttgaaaac

SEQ ID NO: 156201 - DNA, 25 bp, Homo sapien
taccacacatgtcaattccaaatca

SEQ ID NO: 156202 - DNA, 25 bp, Homo sapien
atgggtatcaccgtttttggcaaca

SEQ ID NO: 156203 - DNA, 25 bp, Homo sapien
gcaacaaatctcaaaaaccctacaa

SEQ ID NO: 156204 - DNA, 25 bp, Homo sapien
aagcatctttactaggagacgccaa

SEQ ID NO: 156205 - DNA, 25 bp, Homo sapien
ggagacgccaatattcatggacaca

SEQ ID NO: 156206 - DNA, 25 bp, Homo sapien
ggacacaccgaatctatgatttctg

SEQ ID NO: 156207 - DNA, 25 bp, Homo sapien
tatacaggacaaactagacggccgt

SEQ ID NO: 156208 - DNA, 25 bp, Homo sapien
tagacggccgtagaaaagatttata

SEQ ID NO: 156209 - DNA, 25 bp, Homo sapien
aagtaaggttctcatttagcagaca

SEQ ID NO: 156210 - DNA, 25 bp, Homo sapien
gcagacatcgcaacaagtaccttct

SEQ ID NO: 156211 - DNA, 25 bp, Homo sapien
aagtaccttctgtgaagtttcactg

SEQ ID NO: 156212 - DNA, 25 bp, Homo sapien
gtctatattagggaacaacaacagc

SEQ ID NO: 156213 - DNA, 25 bp, Homo sapien
gcaaattagacaaaacccagaaagc

SEQ ID NO: 156214 - DNA, 25 bp, Homo sapien
catgaggtggagttactgtgcccaa

SEQ ID NO: 156215 - DNA, 25 bp, Homo sapien
gtggagttactgtgcccaaagtcct

SEQ ID NO: 156216 - DNA, 25 bp, Homo sapien
agttactgtgcccaaagtcctcact

SEQ ID NO: 156217 - DNA, 25 bp, Homo sapien
agaccagtgcccctccagttcagtt

SEQ ID NO: 156218 - DNA, 25 bp, Homo sapien
ccctccagttcagttgtctatgtat

SEQ ID NO: 156219 - DNA, 25 bp, Homo sapien
gtctatgtattaccttccttacctt

SEQ ID NO: 156220 - DNA, 25 bp, Homo sapien
gtattaccttccttaccttcataat

SEQ ID NO: 156221 - DNA, 25 bp, Homo sapien
ggcttctgtacttctagtacttgag

SEQ ID NO: 156222 - DNA, 25 bp, Homo sapien
gaaattttacacttaacatagatgg

SEQ ID NO: 156223 - DNA, 25 bp, Homo sapien
cagaatatctttccaccatcagcca

SEQ ID NO: 156224 - DNA, 25 bp, Homo sapien
ccccttctgttacagtggatgatct

SEQ ID NO: 156225 - DNA, 25 bp, Homo sapien
gtggatgatctgaagaaccttttca

SEQ ID NO: 156226 - DNA, 25 bp, Homo sapien
aaccttttcatagaagctggatgtt

SEQ ID NO: 156227 - DNA, 25 bp, Homo sapien
gctggatgttcagtgaaggctttta

SEQ ID NO: 156228 - DNA, 25 bp, Homo sapien
aatggcgctcattcaattgggatct

SEQ ID NO: 156229 - DNA, 25 bp, Homo sapien
ggaagaagcaattcaggccctcatt

SEQ ID NO: 156230 - DNA, 25 bp, Homo sapien
attcaggccctcattgagcttcata

SEQ ID NO: 156231 - DNA, 25 bp, Homo sapien
gagcttcataaccatgaccttggag

SEQ ID NO: 156232 - DNA, 25 bp, Homo sapien
ggagaaaatcaccacctcagagttt

SEQ ID NO: 156233 - DNA, 25 bp, Homo sapien
cagagtttccttctcaaaatctaca

SEQ ID NO: 156234 - DNA, 25 bp, Homo sapien
gctacgcccgcactatggtggacaa

SEQ ID NO: 156235 - DNA, 25 bp, Homo sapien
cccgcactatggtggacaagctgct

SEQ ID NO: 156236 - DNA, 25 bp, Homo sapien
gacaagctgctgagctcacgctcgg

SEQ ID NO: 156237 - DNA, 25 bp, Homo sapien
gtctcaaggcctcctaatagctgcc

SEQ ID NO: 156238 - DNA, 25 bp, Homo sapien
atactggttggctcccgcggtgcca

SEQ ID NO: 156239 - DNA, 25 bp, Homo sapien
cgcggtgccatgtctgcagtgtgcc

SEQ ID NO: 156240 - DNA, 25 bp, Homo sapien
gtggctgggcagagctgcatcatcc

SEQ ID NO: 156241 - DNA, 25 bp, Homo sapien
agagctgcatcatccttgcaggtgg

SEQ ID NO: 156242 - DNA, 25 bp, Homo sapien
atttttgtacatgttcgggtgtggg

SEQ ID NO: 156243 - DNA, 25 bp, Homo sapien
acatgttcgggtgtgggttctacag

SEQ ID NO: 156244 - DNA, 25 bp, Homo sapien
tgtgggttctacagacttgtccccc

SEQ ID NO: 156245 - DNA, 25 bp, Homo sapien
gacctgggcttagacagtttggacc

SEQ ID NO: 156246 - DNA, 25 bp, Homo sapien
gaccaagtggagattatcatggcca

SEQ ID NO: 156247 - DNA, 25 bp, Homo sapien
gatgctgaaaagttaatgtgtccac

SEQ ID NO: 156248 - DNA, 25 bp, Homo sapien
aagtatcagaccctttggctttgct

SEQ ID NO: 156249 - DNA, 25 bp, Homo sapien
atcagaccctttggctttgctgaga

SEQ ID NO: 156250 - DNA, 25 bp, Homo sapien
gagaggactcagatgatagtgacga

SEQ ID NO: 156251 - DNA, 25 bp, Homo sapien
gatagtgacgaatgtctggcagtga

SEQ ID NO: 156252 - DNA, 25 bp, Homo sapien
gaggacacattttggcattcttgct

SEQ ID NO: 156253 - DNA, 25 bp, Homo sapien
tggcattcttgctgactctgacaga

SEQ ID NO: 156254 - DNA, 25 bp, Homo sapien
gactctgacagagtgattctgatgg

SEQ ID NO: 156255 - DNA, 25 bp, Homo sapien
gtgattctgatggacttgtatttaa

SEQ ID NO: 156256 - DNA, 25 bp, Homo sapien
accagaggaggccaaagtctatgaa

SEQ ID NO: 156257 - DNA, 25 bp, Homo sapien
gagaagcggattatctgtttctgag

SEQ ID NO: 156258 - DNA, 25 bp, Homo sapien
tctgagaggatgctttcctgttcat

SEQ ID NO: 156259 - DNA, 25 bp, Homo sapien
tggagcctcagcagcaaatgccact

SEQ ID NO: 156260 - DNA, 25 bp, Homo sapien
aaatgccactctgggcagtcttttg

SEQ ID NO: 156261 - DNA, 25 bp, Homo sapien
ggcagtcttttgtgtcagtgtctta

SEQ ID NO: 156262 - DNA, 25 bp, Homo sapien
gggactatcaggagtccactgcctc

SEQ ID NO: 156263 - DNA, 25 bp, Homo sapien
agccagcttcctgtgcagaaggtct

SEQ ID NO: 156264 - DNA, 25 bp, Homo sapien
agaaggtctggtcggcaaactccct

SEQ ID NO: 156265 - DNA, 25 bp, Homo sapien
taagtacccgctacaattctgcaga

SEQ ID NO: 156266 - DNA, 25 bp, Homo sapien
gtgtcttgcgagctgttgtagttac

SEQ ID NO: 156267 - DNA, 25 bp, Homo sapien
gagtagtcaatagggtcttcagcta

SEQ ID NO: 156268 - DNA, 25 bp, Homo sapien
cttcagctattaattgtagaggtga

SEQ ID NO: 156269 - DNA, 25 bp, Homo sapien
ccaacaaggagtttcatgtgcaaag

SEQ ID NO: 156270 - DNA, 25 bp, Homo sapien
attgctatttgggtggctcttatta

SEQ ID NO: 156271 - DNA, 25 bp, Homo sapien
gggtggctcttattaaactgtgtat

SEQ ID NO: 156272 - DNA, 25 bp, Homo sapien
ctgtgtattttgtacttatcactac

SEQ ID NO: 156273 - DNA, 25 bp, Homo sapien
tgtacttatcactacacgtatcccc

SEQ ID NO: 156274 - DNA, 25 bp, Homo sapien
ccccaaatgcttacatgggagtttg

SEQ ID NO: 156275 - DNA, 25 bp, Homo sapien
ttcacttccttggtgttagtactct

SEQ ID NO: 156276 - DNA, 25 bp, Homo sapien
gttagtactctattcacattcttat

SEQ ID NO: 156277 - DNA, 25 bp, Homo sapien
acattcttattgtaaccttcctcat

SEQ ID NO: 156278 - DNA, 25 bp, Homo sapien
tcttccctgctggtaaaatagaaac

SEQ ID NO: 156279 - DNA, 25 bp, Homo sapien
gtccttgggcccagttgggagctca

SEQ ID NO: 156280 - DNA, 25 bp, Homo sapien
ggcccagttgggagctcatatctaa

SEQ ID NO: 156281 - DNA, 25 bp, Homo sapien
gttgggagctcatatctaacacaga

SEQ ID NO: 156282 - DNA, 25 bp, Homo sapien
ctaacacagagacacattgcatcaa

SEQ ID NO: 156283 - DNA, 25 bp, Homo sapien
gagacacattgcatcaacttcaaga

SEQ ID NO: 156284 - DNA, 25 bp, Homo sapien
gggacaatttgtgcagctccaggat

SEQ ID NO: 156285 - DNA, 25 bp, Homo sapien
atggtgagtgccctgatgccccagc

SEQ ID NO: 156286 - DNA, 25 bp, Homo sapien
gctagcaggagctactgtgctcatc

SEQ ID NO: 156287 - DNA, 25 bp, Homo sapien
gtgctcatctaaagtgtttgcccca

SEQ ID NO: 156288 - DNA, 25 bp, Homo sapien
tcatctaaagtgtttgccccacttc

SEQ ID NO: 156289 - DNA, 25 bp, Homo sapien
gaatacaccaaaaggaggcgctctt

SEQ ID NO: 156290 - DNA, 25 bp, Homo sapien
tacaccaaaaggaggcgctcttaat

SEQ ID NO: 156291 - DNA, 25 bp, Homo sapien
caaaaggaggcgctcttaataactc

SEQ ID NO: 156292 - DNA, 25 bp, Homo sapien
aattattattcttgccaacaaatgg

SEQ ID NO: 156293 - DNA, 25 bp, Homo sapien
ccaacaaatggctagaaaggactga

SEQ ID NO: 156294 - DNA, 25 bp, Homo sapien
atagattatatattgccagatgtta

SEQ ID NO: 156295 - DNA, 25 bp, Homo sapien
tattgccagatgttaatactgtaac

SEQ ID NO: 156296 - DNA, 25 bp, Homo sapien
agatttaattccctcaataacacca

SEQ ID NO: 156297 - DNA, 25 bp, Homo sapien
ttccctcaataacaccaatgttttg

SEQ ID NO: 156298 - DNA, 25 bp, Homo sapien
tcaataacaccaatgttttgttttg

SEQ ID NO: 156299 - DNA, 25 bp, Homo sapien
tctgggtcataaaactttgttaagg

SEQ ID NO: 156300 - DNA, 25 bp, Homo sapien
tggcagaggaggctatgatcgaggc

SEQ ID NO: 156301 - DNA, 25 bp, Homo sapien
ggcagaggaggctatgatcgaggcg

SEQ ID NO: 156302 - DNA, 25 bp, Homo sapien
cagaggaggctatgatcgaggcggc

SEQ ID NO: 156303 - DNA, 25 bp, Homo sapien
agaggaggctatgatcgaggcggct

SEQ ID NO: 156304 - DNA, 25 bp, Homo sapien
gaggaggctatgatcgaggcggcta

SEQ ID NO: 156305 - DNA, 25 bp, Homo sapien
aggaggctatgatcgaggcggctac

SEQ ID NO: 156306 - DNA, 25 bp, Homo sapien
ggaggctatgatcgaggcggctacc

SEQ ID NO: 156307 - DNA, 25 bp, Homo sapien
gaggctatgatcgaggcggctaccg

SEQ ID NO: 156308 - DNA, 25 bp, Homo sapien
aggctatgatcgaggcggctaccgg

SEQ ID NO: 156309 - DNA, 25 bp, Homo sapien
ggctatgatcgaggcggctaccggg

SEQ ID NO: 156310 - DNA, 25 bp, Homo sapien
ggcggggaccgtggaggcttccgag

SEQ ID NO: 156311 - DNA, 25 bp, Homo sapien
agctcattcgtgtcaccctgtctgt

SEQ ID NO: 156312 - DNA, 25 bp, Homo sapien
tgtcaccctgtctgtgagtcattta

SEQ ID NO: 156313 - DNA, 25 bp, Homo sapien
accctgtctgtgagtcatttagata

SEQ ID NO: 156314 - DNA, 25 bp, Homo sapien
gatagaatagtcctccttgggtctc

SEQ ID NO: 156315 - DNA, 25 bp, Homo sapien
accacccctagctttgtgtgtagtg

SEQ ID NO: 156316 - DNA, 25 bp, Homo sapien
cccctagctttgtgtgtagtgtagt

SEQ ID NO: 156317 - DNA, 25 bp, Homo sapien
gtagtgtagtgattttctggctgtc

SEQ ID NO: 156318 - DNA, 25 bp, Homo sapien
attttctggctgtcactcatactca

SEQ ID NO: 156319 - DNA, 25 bp, Homo sapien
gtcactcatactcactgggcaccag

SEQ ID NO: 156320 - DNA, 25 bp, Homo sapien
acctcctggtggtgagccagtctgc

SEQ ID NO: 156321 - DNA, 25 bp, Homo sapien
tggtgagccagtctgcattcccacg

SEQ ID NO: 156322 - DNA, 25 bp, Homo sapien
agactgggaccagcgctagcctgag

SEQ ID NO: 156323 - DNA, 25 bp, Homo sapien
accagcgctagcctgaggagctcag

SEQ ID NO: 156324 - DNA, 25 bp, Homo sapien
gagctcagagcctaaggaaagactg

SEQ ID NO: 156325 - DNA, 25 bp, Homo sapien
acaagggtgactagaaccttcctgg

SEQ ID NO: 156326 - DNA, 25 bp, Homo sapien
ttcctgggactctggctatagtact

SEQ ID NO: 156327 - DNA, 25 bp, Homo sapien
ggacatggactataacgttgatttc

SEQ ID NO: 156328 - DNA, 25 bp, Homo sapien
attgctgtacattgcgtttttaacc

SEQ ID NO: 156329 - DNA, 25 bp, Homo sapien
gcgtttttaacctgcaagttctcag

SEQ ID NO: 156330 - DNA, 25 bp, Homo sapien
actccatcaaagtccctggctataa

SEQ ID NO: 156331 - DNA, 25 bp, Homo sapien
aagatctggattttacccactccat

SEQ ID NO: 156332 - DNA, 25 bp, Homo sapien
ttccttcttactgtgtcaattccta

SEQ ID NO: 156333 - DNA, 25 bp, Homo sapien
tgatgtctccgtcatgaaccaggtg

SEQ ID NO: 156334 - DNA, 25 bp, Homo sapien
ccgtcatgaaccaggtgtgccggga

SEQ ID NO: 156335 - DNA, 25 bp, Homo sapien
gggagcagtttgtccgcttgcacag

SEQ ID NO: 156336 - DNA, 25 bp, Homo sapien
atcctgcaggacctgtccagattcc

SEQ ID NO: 156337 - DNA, 25 bp, Homo sapien
agattcctggtcaagcggttctgct

SEQ ID NO: 156338 - DNA, 25 bp, Homo sapien
tggtcaagcggttctgctctgagcc

SEQ ID NO: 156339 - DNA, 25 bp, Homo sapien
tctgagccccagaagatcttggagg

SEQ ID NO: 156340 - DNA, 25 bp, Homo sapien
aggagacactgcaggcggtgcccaa

SEQ ID NO: 156341 - DNA, 25 bp, Homo sapien
ggagcaggtgaagcgttccacctac

SEQ ID NO: 156342 - DNA, 25 bp, Homo sapien
gttccacctacttcttcagctgaca

SEQ ID NO: 156343 - DNA, 25 bp, Homo sapien
gacaccccgtgagccttgtcagtgt

SEQ ID NO: 156344 - DNA, 25 bp, Homo sapien
tctcattgctgcacctgggaccata

SEQ ID NO: 156345 - DNA, 25 bp, Homo sapien
attgctgcacctgggaccataggat

SEQ ID NO: 156346 - DNA, 25 bp, Homo sapien
tgctgcacctgggaccataggatgg

SEQ ID NO: 156347 - DNA, 25 bp, Homo sapien
atagggagcccctcatgactgaggg

SEQ ID NO: 156348 - DNA, 25 bp, Homo sapien
gagcccctcatgactgagggcagaa

SEQ ID NO: 156349 - DNA, 25 bp, Homo sapien
tgctagaagtcagaacaggatggct

SEQ ID NO: 156350 - DNA, 25 bp, Homo sapien
tcccacaattttcccatgatgaggt

SEQ ID NO: 156351 - DNA, 25 bp, Homo sapien
tttcccatgatgaggtagcttctcc

SEQ ID NO: 156352 - DNA, 25 bp, Homo sapien
atgatgaggtagcttctccctgggc

SEQ ID NO: 156353 - DNA, 25 bp, Homo sapien
gatgaggtagcttctccctgggctc

SEQ ID NO: 156354 - DNA, 25 bp, Homo sapien
tcagagggtagtacagaagccctga

SEQ ID NO: 156355 - DNA, 25 bp, Homo sapien
aaagactttcctcttagtcgagcca

SEQ ID NO: 156356 - DNA, 25 bp, Homo sapien
agtcgagccaagttaagaatgttct

SEQ ID NO: 156357 - DNA, 25 bp, Homo sapien
gtgtgtttctgatctgatgcaagca

SEQ ID NO: 156358 - DNA, 25 bp, Homo sapien
gcaagcaagaaacactgggcttcta

SEQ ID NO: 156359 - DNA, 25 bp, Homo sapien
tgggcttctagaaccaggcaacttg

SEQ ID NO: 156360 - DNA, 25 bp, Homo sapien
aaccaggcaacttgggaactagact

SEQ ID NO: 156361 - DNA, 25 bp, Homo sapien
gaactagactcccaagctggactat

SEQ ID NO: 156362 - DNA, 25 bp, Homo sapien
gctggactatggctctactttcagg

SEQ ID NO: 156363 - DNA, 25 bp, Homo sapien
atggctctactttcaggccacatgg

SEQ ID NO: 156364 - DNA, 25 bp, Homo sapien
ggccacatggctaaagaaggtttca

SEQ ID NO: 156365 - DNA, 25 bp, Homo sapien
gacagagcagaactttcaccttcat

SEQ ID NO: 156366 - DNA, 25 bp, Homo sapien
ctgatgggcaaagaaggtgtccacg

SEQ ID NO: 156367 - DNA, 25 bp, Homo sapien
gcaaagaaggtgtccacggtggttt

SEQ ID NO: 156368 - DNA, 25 bp, Homo sapien
gtgtccacggtggtttgatcaacaa

SEQ ID NO: 156369 - DNA, 25 bp, Homo sapien
gtccacggtggtttgatcaacaaga

SEQ ID NO: 156370 - DNA, 25 bp, Homo sapien
ccacggtggtttgatcaacaagaaa

SEQ ID NO: 156371 - DNA, 25 bp, Homo sapien
ggtggtttgatcaacaagaaatgtt

SEQ ID NO: 156372 - DNA, 25 bp, Homo sapien
ttcggcgttcccagtactgacctcg

SEQ ID NO: 156373 - DNA, 25 bp, Homo sapien
gcgttcccagtactgacctcgtctg

SEQ ID NO: 156374 - DNA, 25 bp, Homo sapien
cattaccccataccccttattgctg

SEQ ID NO: 156375 - DNA, 25 bp, Homo sapien
cttattgctgccaaaaccacatggg

SEQ ID NO: 156376 - DNA, 25 bp, Homo sapien
attgctgccaaaaccacatgggctg

SEQ ID NO: 156377 - DNA, 25 bp, Homo sapien
aaggcagatgagcttcagaaacaaa

SEQ ID NO: 156378 - DNA, 25 bp, Homo sapien
gaagagctacaacgtcagcatgatc

SEQ ID NO: 156379 - DNA, 25 bp, Homo sapien
gtcagcatgatcaactggaggctca

SEQ ID NO: 156380 - DNA, 25 bp, Homo sapien
actggaggctcagaagctggaatat

SEQ ID NO: 156381 - DNA, 25 bp, Homo sapien
gaatatcatcaggtcatacagcaga

SEQ ID NO: 156382 - DNA, 25 bp, Homo sapien
tcaggtcatacagcagatggaacaa

SEQ ID NO: 156383 - DNA, 25 bp, Homo sapien
agccacacatttaaagtctgaagtc

SEQ ID NO: 156384 - DNA, 25 bp, Homo sapien
aagtctgaagtccaccagaacttgg

SEQ ID NO: 156385 - DNA, 25 bp, Homo sapien
cttggaagaaagctgttaactcaac

SEQ ID NO: 156386 - DNA, 25 bp, Homo sapien
gttaactcaacatctatttcatctt

SEQ ID NO: 156387 - DNA, 25 bp, Homo sapien
tttcatctttttagctcccttccct

SEQ ID NO: 156388 - DNA, 25 bp, Homo sapien
tccctggctgctgagttgcaggtgg

SEQ ID NO: 156389 - DNA, 25 bp, Homo sapien
agttgcaggtgggaactgtcatcac

SEQ ID NO: 156390 - DNA, 25 bp, Homo sapien
gtgggaactgtcatcacgcagtgct

SEQ ID NO: 156391 - DNA, 25 bp, Homo sapien
gaactgtcatcacgcagtgcttcag

SEQ ID NO: 156392 - DNA, 25 bp, Homo sapien
gtcatcacgcagtgcttcagagcct

SEQ ID NO: 156393 - DNA, 25 bp, Homo sapien
acgcagtgcttcagagcctcgggct

SEQ ID NO: 156394 - DNA, 25 bp, Homo sapien
tgcttcagagcctcgggctcaggtg

SEQ ID NO: 156395 - DNA, 25 bp, Homo sapien
tcccttgcgcctcagcagtttgcag

SEQ ID NO: 156396 - DNA, 25 bp, Homo sapien
tgttttcccttctgcgctaccttga

SEQ ID NO: 156397 - DNA, 25 bp, Homo sapien
cttctgcgctaccttgagtagttgg

SEQ ID NO: 156398 - DNA, 25 bp, Homo sapien
accttgagtagttggagcacttgat

SEQ ID NO: 156399 - DNA, 25 bp, Homo sapien
gaatgacagcagtcacacagttctg

SEQ ID NO: 156400 - DNA, 25 bp, Homo sapien
aatgacagcagtcacacagttctgt

SEQ ID NO: 156401 - DNA, 25 bp, Homo sapien
atgacagcagtcacacagttctgtg

SEQ ID NO: 156402 - DNA, 25 bp, Homo sapien
tgacagcagtcacacagttctgtgt

SEQ ID NO: 156403 - DNA, 25 bp, Homo sapien
gacagcagtcacacagttctgtgta

SEQ ID NO: 156404 - DNA, 25 bp, Homo sapien
cagcagtcacacagttctgtgtata

SEQ ID NO: 156405 - DNA, 25 bp, Homo sapien
gcagtcacacagttctgtgtatata

SEQ ID NO: 156406 - DNA, 25 bp, Homo sapien
agtcacacagttctgtgtatatagt

SEQ ID NO: 156407 - DNA, 25 bp, Homo sapien
tctgtgtatatagtttaagggtaag

SEQ ID NO: 156408 - DNA, 25 bp, Homo sapien
taagggtaagagtcttgtgttttat

SEQ ID NO: 156409 - DNA, 25 bp, Homo sapien
taagagatagtcaattcttgcctta

SEQ ID NO: 156410 - DNA, 25 bp, Homo sapien
ctgttgctggatcttgagtcccatt

SEQ ID NO: 156411 - DNA, 25 bp, Homo sapien
ttgctggatcttgagtcccattagc

SEQ ID NO: 156412 - DNA, 25 bp, Homo sapien
tggatcttgagtcccattagctgtg

SEQ ID NO: 156413 - DNA, 25 bp, Homo sapien
cccattagctgtgagatgcctgtga

SEQ ID NO: 156414 - DNA, 25 bp, Homo sapien
tagctgtgagatgcctgtgagagcc

SEQ ID NO: 156415 - DNA, 25 bp, Homo sapien
gtcagaagctcagagccttcttgga

SEQ ID NO: 156416 - DNA, 25 bp, Homo sapien
gagccttcttggaccctttaaagat

SEQ ID NO: 156417 - DNA, 25 bp, Homo sapien
gaccccgtccttagaatcttctgga

SEQ ID NO: 156418 - DNA, 25 bp, Homo sapien
cccgtccttagaatcttctggagga

SEQ ID NO: 156419 - DNA, 25 bp, Homo sapien
actgctcctggagttctcatctgat

SEQ ID NO: 156420 - DNA, 25 bp, Homo sapien
gagttctcatctgattccccaaggg

SEQ ID NO: 156421 - DNA, 25 bp, Homo sapien
gacccaagggtctcatcttattaac

SEQ ID NO: 156422 - DNA, 25 bp, Homo sapien
attaaccatttcttgcctctaaata

SEQ ID NO: 156423 - DNA, 25 bp, Homo sapien
gaaatcgtcagttctgttgttccca

SEQ ID NO: 156424 - DNA, 25 bp, Homo sapien
tcagttctgttgttcccaagtcaaa

SEQ ID NO: 156425 - DNA, 25 bp, Homo sapien
caaacagtgtttttgacttccagaa

SEQ ID NO: 156426 - DNA, 25 bp, Homo sapien
ttgacttccagaaagcttacaagct

SEQ ID NO: 156427 - DNA, 25 bp, Homo sapien
gccctggatgtcagcgaccactttc

SEQ ID NO: 156428 - DNA, 25 bp, Homo sapien
aaactacagtcttcaagggccttca

SEQ ID NO: 156429 - DNA, 25 bp, Homo sapien
ttcaagggccttcaccaacagcaaa

SEQ ID NO: 156430 - DNA, 25 bp, Homo sapien
gcaaaaaatctgtcactctaaggaa

SEQ ID NO: 156431 - DNA, 25 bp, Homo sapien
gagcaaacgctcctagacccaaggg

SEQ ID NO: 156432 - DNA, 25 bp, Homo sapien
tgatccgacccaggacactgagttg

SEQ ID NO: 156433 - DNA, 25 bp, Homo sapien
acactgagttggagctggatggcca

SEQ ID NO: 156434 - DNA, 25 bp, Homo sapien
agcaagtggtggtgccccagggcca

SEQ ID NO: 156435 - DNA, 25 bp, Homo sapien
agctccacattctcccagagcgagt

SEQ ID NO: 156436 - DNA, 25 bp, Homo sapien
gagcgagtacctcatctaccaggag

SEQ ID NO: 156437 - DNA, 25 bp, Homo sapien
aggagagccagtgtcgcctgcgcta

SEQ ID NO: 156438 - DNA, 25 bp, Homo sapien
gtcgcctgcgctacctgctggaggt

SEQ ID NO: 156439 - DNA, 25 bp, Homo sapien
gctacctgctggaggtccacctctg

SEQ ID NO: 156440 - DNA, 25 bp, Homo sapien
ggctggactgtgatcttcaatcatc

SEQ ID NO: 156441 - DNA, 25 bp, Homo sapien
tgtgatcttcaatcatcctgcccat

SEQ ID NO: 156442 - DNA, 25 bp, Homo sapien
tggtacccctatatcactccttttt

SEQ ID NO: 156443 - DNA, 25 bp, Homo sapien
aaaagatgccttttaccatgaattc

SEQ ID NO: 156444 - DNA, 25 bp, Homo sapien
gatgccttttaccatgaattcttga

SEQ ID NO: 156445 - DNA, 25 bp, Homo sapien
gccttttaccatgaattcttgagtt

SEQ ID NO: 156446 - DNA, 25 bp, Homo sapien
taccatgaattcttgagtttacatc

SEQ ID NO: 156447 - DNA, 25 bp, Homo sapien
tgaattcttgagtttacatcaataa

SEQ ID NO: 156448 - DNA, 25 bp, Homo sapien
aacatttcctcttataacttctgaa

SEQ ID NO: 156449 - DNA, 25 bp, Homo sapien
catttcctcttataacttctgaagt

SEQ ID NO: 156450 - DNA, 25 bp, Homo sapien
tttcctcttataacttctgaagtaa

SEQ ID NO: 156451 - DNA, 25 bp, Homo sapien
atttgtagagtcaatcatgtgttta

SEQ ID NO: 156452 - DNA, 25 bp, Homo sapien
gtagagtcaatcatgtgtttaaatt

SEQ ID NO: 156453 - DNA, 25 bp, Homo sapien
tttgtggtaacttctttgaagttat

SEQ ID NO: 156454 - DNA, 25 bp, Homo sapien
ggagctcttcagcactgaaaccgag

SEQ ID NO: 156455 - DNA, 25 bp, Homo sapien
tcagcactgaaaccgagtcacctgt

SEQ ID NO: 156456 - DNA, 25 bp, Homo sapien
tgaaaccgagtcacctgtgggctgt

SEQ ID NO: 156457 - DNA, 25 bp, Homo sapien
cgagtcacctgtgggctgtccaagt

SEQ ID NO: 156458 - DNA, 25 bp, Homo sapien
tgtgggctgtccaagtgacctggaa

SEQ ID NO: 156459 - DNA, 25 bp, Homo sapien
tggaagagggactccttgcctctcc

SEQ ID NO: 156460 - DNA, 25 bp, Homo sapien
ttttcctttcccatgaaccctggag

SEQ ID NO: 156461 - DNA, 25 bp, Homo sapien
catgaaccctggagggtggtcccca

SEQ ID NO: 156462 - DNA, 25 bp, Homo sapien
tccccaccagctctttggaagtgag

SEQ ID NO: 156463 - DNA, 25 bp, Homo sapien
gatgctgcggctggctttctgtcag

SEQ ID NO: 156464 - DNA, 25 bp, Homo sapien
gctggctttctgtcagcaggccggc

SEQ ID NO: 156465 - DNA, 25 bp, Homo sapien
aatcccaaggcagagattactcgat

SEQ ID NO: 156466 - DNA, 25 bp, Homo sapien
agagattactcgatttgtgcccact

SEQ ID NO: 156467 - DNA, 25 bp, Homo sapien
cactgagagtacgtcgggagaataa

SEQ ID NO: 156468 - DNA, 25 bp, Homo sapien
atgattctgctgtgcctcttgccaa

SEQ ID NO: 156469 - DNA, 25 bp, Homo sapien
ttgccaaagcagcacccaaatctgg

SEQ ID NO: 156470 - DNA, 25 bp, Homo sapien
aaatctggtccttctgttcctgtct

SEQ ID NO: 156471 - DNA, 25 bp, Homo sapien
gttcctgtctcagtacaaactaagg

SEQ ID NO: 156472 - DNA, 25 bp, Homo sapien
atgatgtctatgaggctttcatgaa

SEQ ID NO: 156473 - DNA, 25 bp, Homo sapien
gatggaagggctactgtgacagctt

SEQ ID NO: 156474 - DNA, 25 bp, Homo sapien
actgtgacagcttttgatgccagaa

SEQ ID NO: 156475 - DNA, 25 bp, Homo sapien
aggcttctgttcacaacagtggccc

SEQ ID NO: 156476 - DNA, 25 bp, Homo sapien
tttctccactgggtgccaagtccta

SEQ ID NO: 156477 - DNA, 25 bp, Homo sapien
tcctcctgggctatattcctgacaa

SEQ ID NO: 156478 - DNA, 25 bp, Homo sapien
tattcctgacaaaagttccatatag

SEQ ID NO: 156479 - DNA, 25 bp, Homo sapien
ttccatatagacaccaaggaggcgg

SEQ ID NO: 156480 - DNA, 25 bp, Homo sapien
tggctctgggtacctgcaagcagaa

SEQ ID NO: 156481 - DNA, 25 bp, Homo sapien
tgcaagcagaacttccaaagagagt

SEQ ID NO: 156482 - DNA, 25 bp, Homo sapien
gcaactctggctccaggcagaagga

SEQ ID NO: 156483 - DNA, 25 bp, Homo sapien
gcccggtgcagctgaggttcccgac

SEQ ID NO: 156484 - DNA, 25 bp, Homo sapien
aggttcccgacaccagaagctgttg

SEQ ID NO: 156485 - DNA, 25 bp, Homo sapien
gctgttgggagaaagcaatacgttt

SEQ ID NO: 156486 - DNA, 25 bp, Homo sapien
aatacgtttgtgcagaatctctatg

SEQ ID NO: 156487 - DNA, 25 bp, Homo sapien
gtcgtactatcttactgagccacag

SEQ ID NO: 156488 - DNA, 25 bp, Homo sapien
gccacagtgatgcatgcttttcggg

SEQ ID NO: 156489 - DNA, 25 bp, Homo sapien
agtattccagacaccaggcttcagg

SEQ ID NO: 156490 - DNA, 25 bp, Homo sapien
ggcttcaggcatggccatgagcaag

SEQ ID NO: 156491 - DNA, 25 bp, Homo sapien
gagcaagaccagcaaataacagctt

SEQ ID NO: 156492 - DNA, 25 bp, Homo sapien
tgaccccaatgtctgctgtttccaa

SEQ ID NO: 156493 - DNA, 25 bp, Homo sapien
atgtctgctgtttccaacactggtg

SEQ ID NO: 156494 - DNA, 25 bp, Homo sapien
cactggtgatttctaactacggccc

SEQ ID NO: 156495 - DNA, 25 bp, Homo sapien
gatttctaactacggcccacagcag

SEQ ID NO: 156496 - DNA, 25 bp, Homo sapien
gaataacaccatggcttcatcagag

SEQ ID NO: 156497 - DNA, 25 bp, Homo sapien
ggttgtagtacctctgggtgatgaa

SEQ ID NO: 156498 - DNA, 25 bp, Homo sapien
gcccagcttataagaatggtgttag

SEQ ID NO: 156499 - DNA, 25 bp, Homo sapien
cccagcttataagaatggtgttagg

SEQ ID NO: 156500 - DNA, 25 bp, Homo sapien
ttagggggatgagcatgctgtttat

SEQ ID NO: 156501 - DNA, 25 bp, Homo sapien
catgctgtttatgaacggaaatcat

SEQ ID NO: 156502 - DNA, 25 bp, Homo sapien
atgctgtttatgaacggaaatcatg

SEQ ID NO: 156503 - DNA, 25 bp, Homo sapien
gctgtttatgaacggaaatcatgat

SEQ ID NO: 156504 - DNA, 25 bp, Homo sapien
gaaatcatgatttccctgtagaaag

SEQ ID NO: 156505 - DNA, 25 bp, Homo sapien
aaatcatgatttccctgtagaaagt

SEQ ID NO: 156506 - DNA, 25 bp, Homo sapien
atcatgatttccctgtagaaagtga

SEQ ID NO: 156507 - DNA, 25 bp, Homo sapien
tcatgatttccctgtagaaagtgag

SEQ ID NO: 156508 - DNA, 25 bp, Homo sapien
tatctgttttgctgtggcgttgggg

SEQ ID NO: 156509 - DNA, 25 bp, Homo sapien
aaagccgctaatacgtttgccgatg

SEQ ID NO: 156510 - DNA, 25 bp, Homo sapien
tttgccgatgcgaagcaggcgacac

SEQ ID NO: 156511 - DNA, 25 bp, Homo sapien
gtaccgctgcggtcaaggctgcacg

SEQ ID NO: 156512 - DNA, 25 bp, Homo sapien
gcaactgcgccaactgatcaggcag

SEQ ID NO: 156513 - DNA, 25 bp, Homo sapien
atcaggcaggacaccaagcgtcggg

SEQ ID NO: 156514 - DNA, 25 bp, Homo sapien
agcggccaaaccagtgacgcaacgt

SEQ ID NO: 156515 - DNA, 25 bp, Homo sapien
gcaacgtccgacaactcaggcgaag

SEQ ID NO: 156516 - DNA, 25 bp, Homo sapien
aactcaggcgaagacagtaccggtt

SEQ ID NO: 156517 - DNA, 25 bp, Homo sapien
gacagtaccggttgttgaaaagcct

SEQ ID NO: 156518 - DNA, 25 bp, Homo sapien
gtcggccgagtaagccacatatcaa

SEQ ID NO: 156519 - DNA, 25 bp, Homo sapien
caaaagggtcacagctaatcatcaa

SEQ ID NO: 156520 - DNA, 25 bp, Homo sapien
gactgtatcaggatttcatttgcat

SEQ ID NO: 156521 - DNA, 25 bp, Homo sapien
gatttcatttgcatgttagtccaca

SEQ ID NO: 156522 - DNA, 25 bp, Homo sapien
tgttagtccacagagttgcccagaa

SEQ ID NO: 156523 - DNA, 25 bp, Homo sapien
cacagagttgcccagaaccctaaat

SEQ ID NO: 156524 - DNA, 25 bp, Homo sapien
gattaattattggtcattcctcata

SEQ ID NO: 156525 - DNA, 25 bp, Homo sapien
attggtcattcctcataagtgtagc

SEQ ID NO: 156526 - DNA, 25 bp, Homo sapien
gtcattcctcataagtgtagctgtt

SEQ ID NO: 156527 - DNA, 25 bp, Homo sapien
aagtgtagctgttgatgtgtgcgtc

SEQ ID NO: 156528 - DNA, 25 bp, Homo sapien
gctgttgatgtgtgcgtctgattat

SEQ ID NO: 156529 - DNA, 25 bp, Homo sapien
gatgtgtgcgtctgattattgcttt

SEQ ID NO: 156530 - DNA, 25 bp, Homo sapien
gtgcgtctgattattgcttttttaa

SEQ ID NO: 156531 - DNA, 25 bp, Homo sapien
tctggagaaggaaacgccggagacc

SEQ ID NO: 156532 - DNA, 25 bp, Homo sapien
gaaacgccggagacctcgggagact

SEQ ID NO: 156533 - DNA, 25 bp, Homo sapien
acctcgggagacttgtaggctgtgt

SEQ ID NO: 156534 - DNA, 25 bp, Homo sapien
gatgaaccctgaagcgcaccgcact

SEQ ID NO: 156535 - DNA, 25 bp, Homo sapien
actgtctgccccaatgtctaacaaa

SEQ ID NO: 156536 - DNA, 25 bp, Homo sapien
aatgtctaacaaaggccggaggcga

SEQ ID NO: 156537 - DNA, 25 bp, Homo sapien
taacaaaggccggaggcgactcttc

SEQ ID NO: 156538 - DNA, 25 bp, Homo sapien
ggaggcgactcttcctgcgaggtct

SEQ ID NO: 156539 - DNA, 25 bp, Homo sapien
gactcttcctgcgaggtctcagagc

SEQ ID NO: 156540 - DNA, 25 bp, Homo sapien
cgaggtctcagagcgctgtgtaacc

SEQ ID NO: 156541 - DNA, 25 bp, Homo sapien
cagagcgctgtgtaaccgcccaagg

SEQ ID NO: 156542 - DNA, 25 bp, Homo sapien
gaagatcctactgaggtgcctggtg

SEQ ID NO: 156543 - DNA, 25 bp, Homo sapien
ttttaagtgacctgaacctggcatc

SEQ ID NO: 156544 - DNA, 25 bp, Homo sapien
gaacctggcatcactacacgtggtg

SEQ ID NO: 156545 - DNA, 25 bp, Homo sapien
tacacgtggtggatgcagcattagt

SEQ ID NO: 156546 - DNA, 25 bp, Homo sapien
agcattagtggactgctctgtggcc

SEQ ID NO: 156547 - DNA, 25 bp, Homo sapien
ggcaaaacccttcgacaagttccag

SEQ ID NO: 156548 - DNA, 25 bp, Homo sapien
gcgtcttggatatttctccgtggat

SEQ ID NO: 156549 - DNA, 25 bp, Homo sapien
acagccatcagggaaagcttgtctt

SEQ ID NO: 156550 - DNA, 25 bp, Homo sapien
gtctttaaccgaactgtcacactga

SEQ ID NO: 156551 - DNA, 25 bp, Homo sapien
aggtgtgagctggaagcactgaacc

SEQ ID NO: 156552 - DNA, 25 bp, Homo sapien
ctcatcctcctggagggtgtggcta

SEQ ID NO: 156553 - DNA, 25 bp, Homo sapien
aagtaaagcacctcaattcattgac

SEQ ID NO: 156554 - DNA, 25 bp, Homo sapien
attcattgactttctagccatcttc

SEQ ID NO: 156555 - DNA, 25 bp, Homo sapien
gccatcttcctttgattagctaaca

SEQ ID NO: 156556 - DNA, 25 bp, Homo sapien
gctaacaaactgtcaggcagcatta

SEQ ID NO: 156557 - DNA, 25 bp, Homo sapien
gcctctgggagctatatacattgta

SEQ ID NO: 156558 - DNA, 25 bp, Homo sapien
tacattgtaaatgcaggccctagct

SEQ ID NO: 156559 - DNA, 25 bp, Homo sapien
atgcaggccctagctttggaacgag

SEQ ID NO: 156560 - DNA, 25 bp, Homo sapien
agattccaggagtcagggtagagaa

SEQ ID NO: 156561 - DNA, 25 bp, Homo sapien
gaatttctgagcaaatcggagatat

SEQ ID NO: 156562 - DNA, 25 bp, Homo sapien
gaatgggccaccatatttggcttac

SEQ ID NO: 156563 - DNA, 25 bp, Homo sapien
cttcctgtaatatttctttccaata

SEQ ID NO: 156564 - DNA, 25 bp, Homo sapien
ttgtagctaaacatttcattgtccc

SEQ ID NO: 156565 - DNA, 25 bp, Homo sapien
aacatttcattgtccccagtctgca

SEQ ID NO: 156566 - DNA, 25 bp, Homo sapien
ccccagtctgcaaaagaagcacaat

SEQ ID NO: 156567 - DNA, 25 bp, Homo sapien
agcacaattctattgctttgtcttg

SEQ ID NO: 156568 - DNA, 25 bp, Homo sapien
acaattctattgctttgtcttgctt

SEQ ID NO: 156569 - DNA, 25 bp, Homo sapien
ctttgtcttgcttatagtcattaaa

SEQ ID NO: 156570 - DNA, 25 bp, Homo sapien
gtcttgcttatagtcattaaatcat

SEQ ID NO: 156571 - DNA, 25 bp, Homo sapien
attgctgttacttctgctttcttta

SEQ ID NO: 156572 - DNA, 25 bp, Homo sapien
gacctaaatttgtacagtcccattg

SEQ ID NO: 156573 - DNA, 25 bp, Homo sapien
gtacagtcccattgtaagtgttgtt

SEQ ID NO: 156574 - DNA, 25 bp, Homo sapien
gtcccattgtaagtgttgtttctaa

SEQ ID NO: 156575 - DNA, 25 bp, Homo sapien
atgccgcactggactccatcagcag

SEQ ID NO: 156576 - DNA, 25 bp, Homo sapien
agctggacaacctggatgcctgcct

SEQ ID NO: 156577 - DNA, 25 bp, Homo sapien
tggacaacctggatgcctgcctggg

SEQ ID NO: 156578 - DNA, 25 bp, Homo sapien
caccctggctctgaagaggtacttc

SEQ ID NO: 156579 - DNA, 25 bp, Homo sapien
gaggtacttccagggcatccatgtc

SEQ ID NO: 156580 - DNA, 25 bp, Homo sapien
gggcatccatgtctacctgaaagag

SEQ ID NO: 156581 - DNA, 25 bp, Homo sapien
gagaagggatacagcgactgcgcct

SEQ ID NO: 156582 - DNA, 25 bp, Homo sapien
agcgactgcgcctgggaaaccgtca

SEQ ID NO: 156583 - DNA, 25 bp, Homo sapien
ctgcgcctgggaaaccgtcagactg

SEQ ID NO: 156584 - DNA, 25 bp, Homo sapien
cttctcttcattaatcagcttgcaa

SEQ ID NO: 156585 - DNA, 25 bp, Homo sapien
cattaatcagcttgcaagaaaggtt

SEQ ID NO: 156586 - DNA, 25 bp, Homo sapien
gtggactaggccctacacacagacc

SEQ ID NO: 156587 - DNA, 25 bp, Homo sapien
gcgcccctgggactaaagccaggaa

SEQ ID NO: 156588 - DNA, 25 bp, Homo sapien
aagccaggaacagggaccagctccc

SEQ ID NO: 156589 - DNA, 25 bp, Homo sapien
ggcagccaaccttagtccgtgccag

SEQ ID NO: 156590 - DNA, 25 bp, Homo sapien
tagtccgtgccagtacgccgtggaa

SEQ ID NO: 156591 - DNA, 25 bp, Homo sapien
gtccgtgccagtacgccgtggaaag

SEQ ID NO: 156592 - DNA, 25 bp, Homo sapien
acgccgtggaaaggcccgtatgagc

SEQ ID NO: 156593 - DNA, 25 bp, Homo sapien
tggaaaggcccgtatgagcggcccc

SEQ ID NO: 156594 - DNA, 25 bp, Homo sapien
gaaaggcccgtatgagcggccccgc

SEQ ID NO: 156595 - DNA, 25 bp, Homo sapien
gcccgtagatcatccccgagggcgg

SEQ ID NO: 156596 - DNA, 25 bp, Homo sapien
cagggtctgaaagggtgtttgggca

SEQ ID NO: 156597 - DNA, 25 bp, Homo sapien
tgccaagtggtacccggaggtgcgg

SEQ ID NO: 156598 - DNA, 25 bp, Homo sapien
cgacaaggacaccattgagcggctg

SEQ ID NO: 156599 - DNA, 25 bp, Homo sapien
acaaggacaccattgagcggctgcg

SEQ ID NO: 156600 - DNA, 25 bp, Homo sapien
caaggacaccattgagcggctgcgg

SEQ ID NO: 156601 - DNA, 25 bp, Homo sapien
ccattgagcggctgcgggacaagaa

SEQ ID NO: 156602 - DNA, 25 bp, Homo sapien
gctgcgggacaagaagctggcaccc

SEQ ID NO: 156603 - DNA, 25 bp, Homo sapien
gggacaagaagctggcacccatcac

SEQ ID NO: 156604 - DNA, 25 bp, Homo sapien
gcccgggagattggctctgtgaaat

SEQ ID NO: 156605 - DNA, 25 bp, Homo sapien
gggagattggctctgtgaaatacct

SEQ ID NO: 156606 - DNA, 25 bp, Homo sapien
gtttgacgaggcgatccgcgcggtg

SEQ ID NO: 156607 - DNA, 25 bp, Homo sapien
gggaagaagtgcaccgtcttctaga

SEQ ID NO: 156608 - DNA, 25 bp, Homo sapien
tttaggcttgaatatgatgctgaac

SEQ ID NO: 156609 - DNA, 25 bp, Homo sapien
aacaatcctgctttctcaagtacta

SEQ ID NO: 156610 - DNA, 25 bp, Homo sapien
agtactattctaacattgcgcttta

SEQ ID NO: 156611 - DNA, 25 bp, Homo sapien
agggatgatatttctaccacctcac

SEQ ID NO: 156612 - DNA, 25 bp, Homo sapien
accacctcactcatatttttagctg

SEQ ID NO: 156613 - DNA, 25 bp, Homo sapien
gattttcctggtatgtctgttattt

SEQ ID NO: 156614 - DNA, 25 bp, Homo sapien
atattgtgtaaaatgggtgctgcca

SEQ ID NO: 156615 - DNA, 25 bp, Homo sapien
gggtgctgccaaaattccaggccat

SEQ ID NO: 156616 - DNA, 25 bp, Homo sapien
attccaggccattttgcagggactc

SEQ ID NO: 156617 - DNA, 25 bp, Homo sapien
cagggactctgaagtgacctttagt

SEQ ID NO: 156618 - DNA, 25 bp, Homo sapien
tagtaatagtcttatgtgcagtaac

SEQ ID NO: 156619 - DNA, 25 bp, Homo sapien
gatttagtaagtgttctgcttccaa

SEQ ID NO: 156620 - DNA, 25 bp, Homo sapien
tctgcttccaacatctttcttttta

SEQ ID NO: 156621 - DNA, 25 bp, Homo sapien
tcctagtgtcttttttggcctttga

SEQ ID NO: 156622 - DNA, 25 bp, Homo sapien
tttggtaattgtagacctgtttcat

SEQ ID NO: 156623 - DNA, 25 bp, Homo sapien
acctgtttcataagctttgtaattc

SEQ ID NO: 156624 - DNA, 25 bp, Homo sapien
aagtgcttgttttacataactgata

SEQ ID NO: 156625 - DNA, 25 bp, Homo sapien
aatgttttctttgtgtgctgttagt

SEQ ID NO: 156626 - DNA, 25 bp, Homo sapien
gtgtgctgttagtattgattcaaat

SEQ ID NO: 156627 - DNA, 25 bp, Homo sapien
aatgtcagcagctttaagcctaata

SEQ ID NO: 156628 - DNA, 25 bp, Homo sapien
atacatcaaggagttatgctgacat

SEQ ID NO: 156629 - DNA, 25 bp, Homo sapien
tatgctgacataattctaaggagtt

SEQ ID NO: 156630 - DNA, 25 bp, Homo sapien
gttggtttatacaagcatgcgttgc

SEQ ID NO: 156631 - DNA, 25 bp, Homo sapien
catgcgttgcacttcttttttggga

SEQ ID NO: 156632 - DNA, 25 bp, Homo sapien
gttttgtgtgtagcctgactgtttt

SEQ ID NO: 156633 - DNA, 25 bp, Homo sapien
gggagttctcgatttgatccgcatc

SEQ ID NO: 156634 - DNA, 25 bp, Homo sapien
gcatcccctgtggtttctaagtgta

SEQ ID NO: 156635 - DNA, 25 bp, Homo sapien
gtctcagaactgttgcatggatcct

SEQ ID NO: 156636 - DNA, 25 bp, Homo sapien
catggatcctgtgtttgcaactggg

SEQ ID NO: 156637 - DNA, 25 bp, Homo sapien
gtggttgatagccagtcactgcctt

SEQ ID NO: 156638 - DNA, 25 bp, Homo sapien
gccagtcactgccttaagaacattt

SEQ ID NO: 156639 - DNA, 25 bp, Homo sapien
atgcaagatggccagcactgaactt

SEQ ID NO: 156640 - DNA, 25 bp, Homo sapien
agatatgacggtgtacttactgcct

SEQ ID NO: 156641 - DNA, 25 bp, Homo sapien
tatgtacctgggaaatttgccgatt

SEQ ID NO: 156642 - DNA, 25 bp, Homo sapien
atttgccgatttcctaagctgttgg

SEQ ID NO: 156643 - DNA, 25 bp, Homo sapien
ggatgtcttgagatgtattatgcaa

SEQ ID NO: 156644 - DNA, 25 bp, Homo sapien
tattatgcaaagtaccaactgagcc

SEQ ID NO: 156645 - DNA, 25 bp, Homo sapien
aacacagaactcagccttaagaaag

SEQ ID NO: 156646 - DNA, 25 bp, Homo sapien
gaataattatgtttacctcactggt

SEQ ID NO: 156647 - DNA, 25 bp, Homo sapien
gtttacctcactggtgcatttaaaa

SEQ ID NO: 156648 - DNA, 25 bp, Homo sapien
ggacttttgttcatgggagaacctc

SEQ ID NO: 156649 - DNA, 25 bp, Homo sapien
gaacctcgttgacatgcacagtttg

SEQ ID NO: 156650 - DNA, 25 bp, Homo sapien
gcaatcttatgttgatcgatgttaa

SEQ ID NO: 156651 - DNA, 25 bp, Homo sapien
tcgatgttaaacgtcacagcagtac

SEQ ID NO: 156652 - DNA, 25 bp, Homo sapien
cagctggcatgagaatatttttttt

SEQ ID NO: 156653 - DNA, 25 bp, Homo sapien
actatagaactcttcattgtcagca

SEQ ID NO: 156654 - DNA, 25 bp, Homo sapien
attgtcagcaaagcaaagagtcact

SEQ ID NO: 156655 - DNA, 25 bp, Homo sapien
gaacctcctgtacttaaacacgatt

SEQ ID NO: 156656 - DNA, 25 bp, Homo sapien
aaacacgattcgcaacgttctgtta

SEQ ID NO: 156657 - DNA, 25 bp, Homo sapien
cgattcgcaacgttctgttattttt

SEQ ID NO: 156658 - DNA, 25 bp, Homo sapien
gtattacatttttagaactcttctc

SEQ ID NO: 156659 - DNA, 25 bp, Homo sapien
gaactcttctctactataacagtca

SEQ ID NO: 156660 - DNA, 25 bp, Homo sapien
ttctctactataacagtcaatttct

SEQ ID NO: 156661 - DNA, 25 bp, Homo sapien
gtcaatttctgactcacagcagtga

SEQ ID NO: 156662 - DNA, 25 bp, Homo sapien
atttctgactcacagcagtgaacaa

SEQ ID NO: 156663 - DNA, 25 bp, Homo sapien
gactgtggaaatgccaaaccaagca

SEQ ID NO: 156664 - DNA, 25 bp, Homo sapien
ggaaccttgcaacggtatccaggga

SEQ ID NO: 156665 - DNA, 25 bp, Homo sapien
tatccagggactatgatgagaggcc

SEQ ID NO: 156666 - DNA, 25 bp, Homo sapien
tgatgagaggccagcacattatctt

SEQ ID NO: 156667 - DNA, 25 bp, Homo sapien
ttcatatgtcacctttgctacgcaa

SEQ ID NO: 156668 - DNA, 25 bp, Homo sapien
gctacgcaaggaaatttgttcagtt

SEQ ID NO: 156669 - DNA, 25 bp, Homo sapien
ttgttcagttcgtatacttcgtaag

SEQ ID NO: 156670 - DNA, 25 bp, Homo sapien
ggattggcttgaattccatggaatt

SEQ ID NO: 156671 - DNA, 25 bp, Homo sapien
gtagaaggtaactctttgcacataa

SEQ ID NO: 156672 - DNA, 25 bp, Homo sapien
aaacacaaacattcaaagcttaggg

SEQ ID NO: 156673 - DNA, 25 bp, Homo sapien
gcttagggataggtccttgggtcaa

SEQ ID NO: 156674 - DNA, 25 bp, Homo sapien
aaaaaggcaggcgcggccaaggcca

SEQ ID NO: 156675 - DNA, 25 bp, Homo sapien
caggagcggcgaagaagcccaagaa

SEQ ID NO: 156676 - DNA, 25 bp, Homo sapien
gagcgccaagaagaccccaaagaag

SEQ ID NO: 156677 - DNA, 25 bp, Homo sapien
gaaggcgaagaagccggctgcagct

SEQ ID NO: 156678 - DNA, 25 bp, Homo sapien
gcagctgctggagccaaaaaagcga

SEQ ID NO: 156679 - DNA, 25 bp, Homo sapien
aaaggcgaaagcagccaagccaaaa

SEQ ID NO: 156680 - DNA, 25 bp, Homo sapien
aaaaaaggcgcccaagagcccagcg

SEQ ID NO: 156681 - DNA, 25 bp, Homo sapien
aaggcgcccaagagcccagcgaagg

SEQ ID NO: 156682 - DNA, 25 bp, Homo sapien
ccagcgaaggccaaagcagttaaac

SEQ ID NO: 156683 - DNA, 25 bp, Homo sapien
caaagcagttaaacccaaggcggct

SEQ ID NO: 156684 - DNA, 25 bp, Homo sapien
gcggctaaaccaaagaccgccaagc

SEQ ID NO: 156685 - DNA, 25 bp, Homo sapien
aagctggtgctactgtttgatttgg

SEQ ID NO: 156686 - DNA, 25 bp, Homo sapien
gtgtgactattcatggctacctcag

SEQ ID NO: 156687 - DNA, 25 bp, Homo sapien
gatgggccacaactgtcttagactg

SEQ ID NO: 156688 - DNA, 25 bp, Homo sapien
tcttagactgctagctttctcctta

SEQ ID NO: 156689 - DNA, 25 bp, Homo sapien
taccgtcttgatcggaaagctcttc

SEQ ID NO: 156690 - DNA, 25 bp, Homo sapien
atcgctaatcagtcatttcttcatg

SEQ ID NO: 156691 - DNA, 25 bp, Homo sapien
gtacagaggtcagcacacattattt

SEQ ID NO: 156692 - DNA, 25 bp, Homo sapien
gtgtttccacacttaaattctctaa

SEQ ID NO: 156693 - DNA, 25 bp, Homo sapien
attcatggatggctcaagtctgcac

SEQ ID NO: 156694 - DNA, 25 bp, Homo sapien
aagtctgcacagagcaagtcctcac

SEQ ID NO: 156695 - DNA, 25 bp, Homo sapien
gagcaagtcctcactcttcaaggag

SEQ ID NO: 156696 - DNA, 25 bp, Homo sapien
ggatatggaatgtctcaaacggtga

SEQ ID NO: 156697 - DNA, 25 bp, Homo sapien
aaacggtgagcttcttcatttgtgt

SEQ ID NO: 156698 - DNA, 25 bp, Homo sapien
ttgtgtgctccgctttcagaagaag

SEQ ID NO: 156699 - DNA, 25 bp, Homo sapien
gaaggagctgctacccatggaggct

SEQ ID NO: 156700 - DNA, 25 bp, Homo sapien
catggaggctgggtgactgaccttt

SEQ ID NO: 156701 - DNA, 25 bp, Homo sapien
tgacctttgcttttctccagatggc

SEQ ID NO: 156702 - DNA, 25 bp, Homo sapien
ggcaaaatgcttatctctgctggag

SEQ ID NO: 156703 - DNA, 25 bp, Homo sapien
cctcacagaccttctacacaaatgg

SEQ ID NO: 156704 - DNA, 25 bp, Homo sapien
cttaagaaaatacacgtgtcccctg

SEQ ID NO: 156705 - DNA, 25 bp, Homo sapien
gtgtcccctgacttcaaaacatatg

SEQ ID NO: 156706 - DNA, 25 bp, Homo sapien
acatatgtgactgtggataatcttg

SEQ ID NO: 156707 - DNA, 25 bp, Homo sapien
gtttctattttttgctggtagtccg

SEQ ID NO: 156708 - DNA, 25 bp, Homo sapien
tttgctggtagtccgcatacccata

SEQ ID NO: 156709 - DNA, 25 bp, Homo sapien
tacccataccctctgtttttgaaag

SEQ ID NO: 156710 - DNA, 25 bp, Homo sapien
aaggcaaaggccaatcagtccccat

SEQ ID NO: 156711 - DNA, 25 bp, Homo sapien
aatcagtccccatttgtagcatggc

SEQ ID NO: 156712 - DNA, 25 bp, Homo sapien
tttgtagcatggcaccagggtctta

SEQ ID NO: 156713 - DNA, 25 bp, Homo sapien
agggtcttaggcctagtcctctcat

SEQ ID NO: 156714 - DNA, 25 bp, Homo sapien
accctccgagatggtcagtgtgtca

SEQ ID NO: 156715 - DNA, 25 bp, Homo sapien
gtcagtgtgtcatgggaagcccacc

SEQ ID NO: 156716 - DNA, 25 bp, Homo sapien
tcagtggtggccacgatgcggtaca

SEQ ID NO: 156717 - DNA, 25 bp, Homo sapien
tccttcccatctacgggtgttgtca

SEQ ID NO: 156718 - DNA, 25 bp, Homo sapien
agatcaggatggctcaggaacgctt

SEQ ID NO: 156719 - DNA, 25 bp, Homo sapien
tcaggaacgcttggatctggcagtt

SEQ ID NO: 156720 - DNA, 25 bp, Homo sapien
ggatctggcagttcaggcctacagt

SEQ ID NO: 156721 - DNA, 25 bp, Homo sapien
tacagtcaccaaaacaaccctcatg

SEQ ID NO: 156722 - DNA, 25 bp, Homo sapien
caaccctcatggtccccgggagaag

SEQ ID NO: 156723 - DNA, 25 bp, Homo sapien
gtccaaagctgggtccaacaaaagc

SEQ ID NO: 156724 - DNA, 25 bp, Homo sapien
gggtccaacaaaagcactgccagta

SEQ ID NO: 156725 - DNA, 25 bp, Homo sapien
agtacaccgaactgtccaatgctaa

SEQ ID NO: 156726 - DNA, 25 bp, Homo sapien
gtccaatgctaagatcgcctacaag

SEQ ID NO: 156727 - DNA, 25 bp, Homo sapien
ccaggaacagcagtatggcagccat

SEQ ID NO: 156728 - DNA, 25 bp, Homo sapien
agccatgaggagaacctcccagctg

SEQ ID NO: 156729 - DNA, 25 bp, Homo sapien
aaagtagatcaaaacttccagagat

SEQ ID NO: 156730 - DNA, 25 bp, Homo sapien
aacttccagagatcttaatggctat

SEQ ID NO: 156731 - DNA, 25 bp, Homo sapien
gaaatatcactcaccataatttaaa

SEQ ID NO: 156732 - DNA, 25 bp, Homo sapien
ggcaaatgtttggtagaactgtaat

SEQ ID NO: 156733 - DNA, 25 bp, Homo sapien
acaagtatatttgcgtgatggttac

SEQ ID NO: 156734 - DNA, 25 bp, Homo sapien
gcgtgatggttacactagaagccca

SEQ ID NO: 156735 - DNA, 25 bp, Homo sapien
ggttacactagaagcccagacttta

SEQ ID NO: 156736 - DNA, 25 bp, Homo sapien
agaagcccagactttacgactacac

SEQ ID NO: 156737 - DNA, 25 bp, Homo sapien
gcccagactttacgactacacaata

SEQ ID NO: 156738 - DNA, 25 bp, Homo sapien
agactttacgactacacaatatatt

SEQ ID NO: 156739 - DNA, 25 bp, Homo sapien
tgtatctaaactgtacttgtacccc

SEQ ID NO: 156740 - DNA, 25 bp, Homo sapien
agaatactgagtgccttcatttaac

SEQ ID NO: 156741 - DNA, 25 bp, Homo sapien
ctgagtgccttcatttaactaaagt

SEQ ID NO: 156742 - DNA, 25 bp, Homo sapien
gtcaatttgcacttctttataatcc

SEQ ID NO: 156743 - DNA, 25 bp, Homo sapien
tctttataatcctctggtttagaat

SEQ ID NO: 156744 - DNA, 25 bp, Homo sapien
attgttaaaaccttgataattgtca

SEQ ID NO: 156745 - DNA, 25 bp, Homo sapien
tgtcctgaacaggtcactagactct

SEQ ID NO: 156746 - DNA, 25 bp, Homo sapien
actagactctacattgggcagcctt

SEQ ID NO: 156747 - DNA, 25 bp, Homo sapien
agactctacattgggcagcctttaa

SEQ ID NO: 156748 - DNA, 25 bp, Homo sapien
cattgggcagcctttaaatatgatt

SEQ ID NO: 156749 - DNA, 25 bp, Homo sapien
gattctttgtaatgctaaatagcct

SEQ ID NO: 156750 - DNA, 25 bp, Homo sapien
ttttactgcaacttaatatttctat

SEQ ID NO: 156751 - DNA, 25 bp, Homo sapien
gttcctccagcgtagactacatttt

SEQ ID NO: 156752 - DNA, 25 bp, Homo sapien
gactacattttgtgaggatcaatga

SEQ ID NO: 156753 - DNA, 25 bp, Homo sapien
ttcttgaatggcatgctagtagcag

SEQ ID NO: 156754 - DNA, 25 bp, Homo sapien
aaggatgccgtgtgtgttgttgcca

SEQ ID NO: 156755 - DNA, 25 bp, Homo sapien
gttgttgccaacacttggaacacaa

SEQ ID NO: 156756 - DNA, 25 bp, Homo sapien
ggaacacaatgactggagacatagt

SEQ ID NO: 156757 - DNA, 25 bp, Homo sapien
ctggagacatagttgtgcatgcctg

SEQ ID NO: 156758 - DNA, 25 bp, Homo sapien
cctggcacaacatcaagcctgtgat

SEQ ID NO: 156759 - DNA, 25 bp, Homo sapien
aagcctgtgattgtgtttattgatg

SEQ ID NO: 156760 - DNA, 25 bp, Homo sapien
acaagtggtggctttgagggattct

SEQ ID NO: 156761 - DNA, 25 bp, Homo sapien
gagggattctgtatgccaagtggaa

SEQ ID NO: 156762 - DNA, 25 bp, Homo sapien
taccttccgcacaacaggtgactgg

SEQ ID NO: 156763 - DNA, 25 bp, Homo sapien
gcacactgcaaggaaatcttcacgg

SEQ ID NO: 156764 - DNA, 25 bp, Homo sapien
tggagtacagttcttgtgacacaat

SEQ ID NO: 156765 - DNA, 25 bp, Homo sapien
gttcttgtgacacaatagccaagat

SEQ ID NO: 156766 - DNA, 25 bp, Homo sapien
agatttccacagatgacatgaaaaa

SEQ ID NO: 156767 - DNA, 25 bp, Homo sapien
atgaaaaaggttggtgtcaccgtgg

SEQ ID NO: 156768 - DNA, 25 bp, Homo sapien
ggttgggccacagaagaagatcatc

SEQ ID NO: 156769 - DNA, 25 bp, Homo sapien
gaagatcatcagtagcattaaagct

SEQ ID NO: 156770 - DNA, 25 bp, Homo sapien
agaaacgcaatcaaagaatggccca

SEQ ID NO: 156771 - DNA, 25 bp, Homo sapien
caaagaatggcccagttcccgtgta

SEQ ID NO: 156772 - DNA, 25 bp, Homo sapien
aatggcccagttcccgtgtaaagca

SEQ ID NO: 156773 - DNA, 25 bp, Homo sapien
ttgtatatctaagactcatcctgat

SEQ ID NO: 156774 - DNA, 25 bp, Homo sapien
aagactcatcctgatttttactatc

SEQ ID NO: 156775 - DNA, 25 bp, Homo sapien
atcctgatttttactatcacacatg

SEQ ID NO: 156776 - DNA, 25 bp, Homo sapien
ttgtatctttctttctctaatgttg

SEQ ID NO: 156777 - DNA, 25 bp, Homo sapien
ctttctttctctaatgttgtatcat

SEQ ID NO: 156778 - DNA, 25 bp, Homo sapien
aatgttgtatcatactcttctaaaa

SEQ ID NO: 156779 - DNA, 25 bp, Homo sapien
aaacttgagtggctgtcttaaaaga

SEQ ID NO: 156780 - DNA, 25 bp, Homo sapien
attgtctgtctctatattgcttagt

SEQ ID NO: 156781 - DNA, 25 bp, Homo sapien
tataaacctgacctcctttatggtt

SEQ ID NO: 156782 - DNA, 25 bp, Homo sapien
gacctcctttatggttaatactatt

SEQ ID NO: 156783 - DNA, 25 bp, Homo sapien
ggatacagtacggatttgtccaaat

SEQ ID NO: 156784 - DNA, 25 bp, Homo sapien
gttggacctcgtaaagcactgtttc

SEQ ID NO: 156785 - DNA, 25 bp, Homo sapien
aaaagagtattcaccaagggcacga

SEQ ID NO: 156786 - DNA, 25 bp, Homo sapien
aagggcacgaattcgttcctggatg

SEQ ID NO: 156787 - DNA, 25 bp, Homo sapien
ccttttgataggcacgattggatca

SEQ ID NO: 156788 - DNA, 25 bp, Homo sapien
attggatcataaaccgttgcgggac

SEQ ID NO: 156789 - DNA, 25 bp, Homo sapien
accgttgcgggacagaagttagata

SEQ ID NO: 156790 - DNA, 25 bp, Homo sapien
gtcaacaaggactaccagttcacca

SEQ ID NO: 156791 - DNA, 25 bp, Homo sapien
aggactaccagttcaccatcctgga

SEQ ID NO: 156792 - DNA, 25 bp, Homo sapien
gtccgtcctgccttagattcacttt

SEQ ID NO: 156793 - DNA, 25 bp, Homo sapien
attcactttcggcagtatgggacag

SEQ ID NO: 156794 - DNA, 25 bp, Homo sapien
aaagtcgcttggtggcgttggacct

SEQ ID NO: 156795 - DNA, 25 bp, Homo sapien
ttactctcctcttctagcatttctt

SEQ ID NO: 156796 - DNA, 25 bp, Homo sapien
tattacagtccttcaagattccatt

SEQ ID NO: 156797 - DNA, 25 bp, Homo sapien
atttcttaacagtctccaatcccat

SEQ ID NO: 156798 - DNA, 25 bp, Homo sapien
tctctgcctttactatatgttgacc

SEQ ID NO: 156799 - DNA, 25 bp, Homo sapien
gttgaccattccaaagttcttatct

SEQ ID NO: 156800 - DNA, 25 bp, Homo sapien
gttcttatctctagctcagacatct

SEQ ID NO: 156801 - DNA, 25 bp, Homo sapien
atctactacagcactgtgatgcttt

SEQ ID NO: 156802 - DNA, 25 bp, Homo sapien
gatgctttatgcaactaactgttta

SEQ ID NO: 156803 - DNA, 25 bp, Homo sapien
ctgtttacatatctgtcccctgcta

SEQ ID NO: 156804 - DNA, 25 bp, Homo sapien
tctgtcccctgctactagattgtga

SEQ ID NO: 156805 - DNA, 25 bp, Homo sapien
cctagagtagtgcttggtgcatgat

SEQ ID NO: 156806 - DNA, 25 bp, Homo sapien
ttttgtctgctttagttctctttta

SEQ ID NO: 156807 - DNA, 25 bp, Homo sapien
ttattttctattcaccacacactca

SEQ ID NO: 156808 - DNA, 25 bp, Homo sapien
tcccagcttctcgtgtccagtgaaa

SEQ ID NO: 156809 - DNA, 25 bp, Homo sapien
tctcgtgtccagtgaaacccctgaa

SEQ ID NO: 156810 - DNA, 25 bp, Homo sapien
tgtccagtgaaacccctgaaccaag

SEQ ID NO: 156811 - DNA, 25 bp, Homo sapien
ccctgaaccaagatcactgaatttt

SEQ ID NO: 156812 - DNA, 25 bp, Homo sapien
ccaagatcactgaatttttgttttt

SEQ ID NO: 156813 - DNA, 25 bp, Homo sapien
tattcttggggggatcaaaccttag

SEQ ID NO: 156814 - DNA, 25 bp, Homo sapien
agctatatatttgtgttccttcagg

SEQ ID NO: 156815 - DNA, 25 bp, Homo sapien
tatatatttgtgttccttcagggaa

SEQ ID NO: 156816 - DNA, 25 bp, Homo sapien
tttgtgttccttcagggaaactggt

SEQ ID NO: 156817 - DNA, 25 bp, Homo sapien
agagctctttgacaggctcccaggc

SEQ ID NO: 156818 - DNA, 25 bp, Homo sapien
cctggacaagcatgtgcagtcacgg

SEQ ID NO: 156819 - DNA, 25 bp, Homo sapien
aagcatgtgcagtcacgggagctca

SEQ ID NO: 156820 - DNA, 25 bp, Homo sapien
gtgcagtcacgggagctcagctcag

SEQ ID NO: 156821 - DNA, 25 bp, Homo sapien
gcctgagctatttcccttgctagtg

SEQ ID NO: 156822 - DNA, 25 bp, Homo sapien
gagctatttcccttgctagtgtgca

SEQ ID NO: 156823 - DNA, 25 bp, Homo sapien
atttcccttgctagtgtgcagatat

SEQ ID NO: 156824 - DNA, 25 bp, Homo sapien
gtgcagatatttccctaacatgtcc

SEQ ID NO: 156825 - DNA, 25 bp, Homo sapien
cagatatttccctaacatgtccttt

SEQ ID NO: 156826 - DNA, 25 bp, Homo sapien
tatttccctaacatgtccttttttg

SEQ ID NO: 156827 - DNA, 25 bp, Homo sapien
ttgtatttgtttgtacggaccataa

SEQ ID NO: 156828 - DNA, 25 bp, Homo sapien
agaagatgtacaaggcgtgcctcaa

SEQ ID NO: 156829 - DNA, 25 bp, Homo sapien
gaagatgtacaaggcgtgcctcaag

SEQ ID NO: 156830 - DNA, 25 bp, Homo sapien
aagatgtacaaggcgtgcctcaagt

SEQ ID NO: 156831 - DNA, 25 bp, Homo sapien
agatgtacaaggcgtgcctcaagta

SEQ ID NO: 156832 - DNA, 25 bp, Homo sapien
gacacctcgctcacctgagcgacgc

SEQ ID NO: 156833 - DNA, 25 bp, Homo sapien
acacctcgctcacctgagcgacgca

SEQ ID NO: 156834 - DNA, 25 bp, Homo sapien
cacctcgctcacctgagcgacgcac

SEQ ID NO: 156835 - DNA, 25 bp, Homo sapien
acctcgctcacctgagcgacgcacc

SEQ ID NO: 156836 - DNA, 25 bp, Homo sapien
cctcgctcacctgagcgacgcaccg

SEQ ID NO: 156837 - DNA, 25 bp, Homo sapien
aagagtaaaactgtagcatagcttt

SEQ ID NO: 156838 - DNA, 25 bp, Homo sapien
gtagcatagcttttgtcacggtcac

SEQ ID NO: 156839 - DNA, 25 bp, Homo sapien
gcatagcttttgtcacggtcactag

SEQ ID NO: 156840 - DNA, 25 bp, Homo sapien
ttttgtcacggtcactagctgatcc

SEQ ID NO: 156841 - DNA, 25 bp, Homo sapien
acggtcactagctgatccctcaggt

SEQ ID NO: 156842 - DNA, 25 bp, Homo sapien
tcactagctgatccctcaggtctgc

SEQ ID NO: 156843 - DNA, 25 bp, Homo sapien
tcaggtctgctgcaaacacagcatg

SEQ ID NO: 156844 - DNA, 25 bp, Homo sapien
catggaggacacagatgactctttg

SEQ ID NO: 156845 - DNA, 25 bp, Homo sapien
agatgactctttggtgttggtcttt

SEQ ID NO: 156846 - DNA, 25 bp, Homo sapien
gaagtacactggaatttactgagaa

SEQ ID NO: 156847 - DNA, 25 bp, Homo sapien
acactggaatttactgagaaacttg

SEQ ID NO: 156848 - DNA, 25 bp, Homo sapien
ttgtgtttaaatctcaacgttccat

SEQ ID NO: 156849 - DNA, 25 bp, Homo sapien
gtgtttaaatctcaacgttccatta

SEQ ID NO: 156850 - DNA, 25 bp, Homo sapien
gtttaaatctcaacgttccattatt

SEQ ID NO: 156851 - DNA, 25 bp, Homo sapien
ttaaatctcaacgttccattatttt

SEQ ID NO: 156852 - DNA, 25 bp, Homo sapien
gtataccaaaataattgactctatt

SEQ ID NO: 156853 - DNA, 25 bp, Homo sapien
aattgactctattatctgaaatgaa

SEQ ID NO: 156854 - DNA, 25 bp, Homo sapien
ataaactgatgctatctcaacaata

SEQ ID NO: 156855 - DNA, 25 bp, Homo sapien
tgatgctatctcaacaataactgtt

SEQ ID NO: 156856 - DNA, 25 bp, Homo sapien
gctatctcaacaataactgttactt

SEQ ID NO: 156857 - DNA, 25 bp, Homo sapien
ttacttctgttttgtaaattgggat

SEQ ID NO: 156858 - DNA, 25 bp, Homo sapien
tcttacatctaatttgtagaaacag

SEQ ID NO: 156859 - DNA, 25 bp, Homo sapien
aagcccggcgcctcaaaggtggcta

SEQ ID NO: 156860 - DNA, 25 bp, Homo sapien
ggtggctacaaaaactaaggcaacg

SEQ ID NO: 156861 - DNA, 25 bp, Homo sapien
ggcaacgggtgcatctaaaaagctc

SEQ ID NO: 156862 - DNA, 25 bp, Homo sapien
gagcgtcaagactccgaaaaaggct

SEQ ID NO: 156863 - DNA, 25 bp, Homo sapien
aaagcctgcggcaacaaggaaatcc

SEQ ID NO: 156864 - DNA, 25 bp, Homo sapien
caaggaaatcctccaagaatccaaa

SEQ ID NO: 156865 - DNA, 25 bp, Homo sapien
gaaagtagctaaaagccctgctaaa

SEQ ID NO: 156866 - DNA, 25 bp, Homo sapien
gccctgctaaagctaaggctgtaaa

SEQ ID NO: 156867 - DNA, 25 bp, Homo sapien
ggctgtaaaacccaaggcggccaag

SEQ ID NO: 156868 - DNA, 25 bp, Homo sapien
gggtgacgaagccaaagactgccaa

SEQ ID NO: 156869 - DNA, 25 bp, Homo sapien
aagactgccaaacccaagaaagcgg

SEQ ID NO: 156870 - DNA, 25 bp, Homo sapien
aatgttccaaaagccataagcctga

SEQ ID NO: 156871 - DNA, 25 bp, Homo sapien
agccataagcctgaagattggccct

SEQ ID NO: 156872 - DNA, 25 bp, Homo sapien
tgaagattggccctgtgcacgcacg

SEQ ID NO: 156873 - DNA, 25 bp, Homo sapien
acaagctgtgtcttcttaactgccc

SEQ ID NO: 156874 - DNA, 25 bp, Homo sapien
aagctgtgtcttcttaactgcccaa

SEQ ID NO: 156875 - DNA, 25 bp, Homo sapien
tgtgtcttcttaactgcccaagtga

SEQ ID NO: 156876 - DNA, 25 bp, Homo sapien
tgtcttcttaactgcccaagtgaaa

SEQ ID NO: 156877 - DNA, 25 bp, Homo sapien
aagcaaccaagtccaggaaattaca

SEQ ID NO: 156878 - DNA, 25 bp, Homo sapien
gtccaggaaattacaatagctgtta

SEQ ID NO: 156879 - DNA, 25 bp, Homo sapien
tttttctgtctatcaaaactatttg

SEQ ID NO: 156880 - DNA, 25 bp, Homo sapien
caaaactatttgatccaagtgaaaa

SEQ ID NO: 156881 - DNA, 25 bp, Homo sapien
ggctgtcattcaaattggataggag

SEQ ID NO: 156882 - DNA, 25 bp, Homo sapien
gagagagcaggatccctggactccc

SEQ ID NO: 156883 - DNA, 25 bp, Homo sapien
actccttgactgtcacttgtaattg

SEQ ID NO: 156884 - DNA, 25 bp, Homo sapien
cttgactgtcacttgtaattgtata

SEQ ID NO: 156885 - DNA, 25 bp, Homo sapien
tttttgtgtttcttgctccatttcc

SEQ ID NO: 156886 - DNA, 25 bp, Homo sapien
ttgctccatttcctcatgctgtcat

SEQ ID NO: 156887 - DNA, 25 bp, Homo sapien
atttcctcatgctgtcatccttaaa

SEQ ID NO: 156888 - DNA, 25 bp, Homo sapien
tcatgctgtcatccttaaagtccat

SEQ ID NO: 156889 - DNA, 25 bp, Homo sapien
gggaaaatgctgaacaccattgtat

SEQ ID NO: 156890 - DNA, 25 bp, Homo sapien
agtttcttcaactgtcccagccatg

SEQ ID NO: 156891 - DNA, 25 bp, Homo sapien
gtcccagccatgttgtacatagata

SEQ ID NO: 156892 - DNA, 25 bp, Homo sapien
acactacaggccagggctgcggggc

SEQ ID NO: 156893 - DNA, 25 bp, Homo sapien
ggctggcgcaatcccagcccccttc

SEQ ID NO: 156894 - DNA, 25 bp, Homo sapien
ggccacggccttgggtccctgccct

SEQ ID NO: 156895 - DNA, 25 bp, Homo sapien
ggcccccactgtggagataagaagg

SEQ ID NO: 156896 - DNA, 25 bp, Homo sapien
gcccccactgtggagataagaaggg

SEQ ID NO: 156897 - DNA, 25 bp, Homo sapien
tggggttggggcctcacccctctgg

SEQ ID NO: 156898 - DNA, 25 bp, Homo sapien
tcacccctctggagggccggacagg

SEQ ID NO: 156899 - DNA, 25 bp, Homo sapien
cacccctctggagggccggacaggg

SEQ ID NO: 156900 - DNA, 25 bp, Homo sapien
cccctctggagggccggacagggag

SEQ ID NO: 156901 - DNA, 25 bp, Homo sapien
cctctggagggccggacagggaggt

SEQ ID NO: 156902 - DNA, 25 bp, Homo sapien
tggagggccggacagggaggtggaa

SEQ ID NO: 156903 - DNA, 25 bp, Homo sapien
acttctggcctttcctagctagaga

SEQ ID NO: 156904 - DNA, 25 bp, Homo sapien
gtaactcccatatctcctttaatga

SEQ ID NO: 156905 - DNA, 25 bp, Homo sapien
aatttcagcctacattgatgccaag

SEQ ID NO: 156906 - DNA, 25 bp, Homo sapien
tgatgccaagcttttttgccacaaa

SEQ ID NO: 156907 - DNA, 25 bp, Homo sapien
gaagattcttaccaagagtgggctt

SEQ ID NO: 156908 - DNA, 25 bp, Homo sapien
cttaccaagagtgggctttgtggaa

SEQ ID NO: 156909 - DNA, 25 bp, Homo sapien
aacagctggtactgatgttcacctt

SEQ ID NO: 156910 - DNA, 25 bp, Homo sapien
ttcacctttatatatgtactagcat

SEQ ID NO: 156911 - DNA, 25 bp, Homo sapien
tgtactagcattttccacgctgatg

SEQ ID NO: 156912 - DNA, 25 bp, Homo sapien
gcattttccacgctgatgtttatgt

SEQ ID NO: 156913 - DNA, 25 bp, Homo sapien
ccacgctgatgtttatgtactgtaa

SEQ ID NO: 156914 - DNA, 25 bp, Homo sapien
cagcttcaggtcacaaatcttctgg

SEQ ID NO: 156915 - DNA, 25 bp, Homo sapien
aatcttctggaataccttattgatg

SEQ ID NO: 156916 - DNA, 25 bp, Homo sapien
ttgatgtagaaattgcccgcagcga

SEQ ID NO: 156917 - DNA, 25 bp, Homo sapien
cagcgattgcagaaagcctttaagc

SEQ ID NO: 156918 - DNA, 25 bp, Homo sapien
gaaatctgcgccattcaagaaaact

SEQ ID NO: 156919 - DNA, 25 bp, Homo sapien
taagctgcagctttttggtaggagc

SEQ ID NO: 156920 - DNA, 25 bp, Homo sapien
tttggtaggagcacttccctggaat

SEQ ID NO: 156921 - DNA, 25 bp, Homo sapien
ttccctggaatggtgaattcactgt

SEQ ID NO: 156922 - DNA, 25 bp, Homo sapien
taatggtgttttgaggcatccctcc

SEQ ID NO: 156923 - DNA, 25 bp, Homo sapien
aacctctgtgactactttatccatg

SEQ ID NO: 156924 - DNA, 25 bp, Homo sapien
tggcaggtgggaggctcttcccaat

SEQ ID NO: 156925 - DNA, 25 bp, Homo sapien
gagcggttcaacgttatccagtgtg

SEQ ID NO: 156926 - DNA, 25 bp, Homo sapien
agtgagtcctccctggcatcctcgt

SEQ ID NO: 156927 - DNA, 25 bp, Homo sapien
ctccctggcatcctcgtgaaagtgc

SEQ ID NO: 156928 - DNA, 25 bp, Homo sapien
cctcgtgaaagtgcacacacttcat

SEQ ID NO: 156929 - DNA, 25 bp, Homo sapien
aagtgcacacacttcatggagggac

SEQ ID NO: 156930 - DNA, 25 bp, Homo sapien
atggagggactccttttcaataaga

SEQ ID NO: 156931 - DNA, 25 bp, Homo sapien
ggagggactccttttcaataagaat

SEQ ID NO: 156932 - DNA, 25 bp, Homo sapien
ggactccttttcaataagaattagg

SEQ ID NO: 156933 - DNA, 25 bp, Homo sapien
atttgagattttactctgtcgaatt

SEQ ID NO: 156934 - DNA, 25 bp, Homo sapien
gagattttactctgtcgaattttag

SEQ ID NO: 156935 - DNA, 25 bp, Homo sapien
ctgtcgaattttagagtatttgaag

SEQ ID NO: 156936 - DNA, 25 bp, Homo sapien
aacagattcccaaagtagtcctaat

SEQ ID NO: 156937 - DNA, 25 bp, Homo sapien
agcagtgtgtgacagtccagtttcc

SEQ ID NO: 156938 - DNA, 25 bp, Homo sapien
gtgacagtccagtttcctacacatt

SEQ ID NO: 156939 - DNA, 25 bp, Homo sapien
ttcctacacattctcacaaacattt

SEQ ID NO: 156940 - DNA, 25 bp, Homo sapien
gtgggtgtttagtgtaacttccttg

SEQ ID NO: 156941 - DNA, 25 bp, Homo sapien
aacttccttgtgtttgaatttgcat

SEQ ID NO: 156942 - DNA, 25 bp, Homo sapien
atctccttgatgagtaagcaccttt

SEQ ID NO: 156943 - DNA, 25 bp, Homo sapien
tttcatatacgtattaagccatttg

SEQ ID NO: 156944 - DNA, 25 bp, Homo sapien
taagccatttgaaatatcctctttg

SEQ ID NO: 156945 - DNA, 25 bp, Homo sapien
ctctttgaagaagttcccgtccatg

SEQ ID NO: 156946 - DNA, 25 bp, Homo sapien
gtccatggtttttgcccatttgtta

SEQ ID NO: 156947 - DNA, 25 bp, Homo sapien
taaccaagttggatacctgtgtata

SEQ ID NO: 156948 - DNA, 25 bp, Homo sapien
gttggatacctgtgtatagcttccc

SEQ ID NO: 156949 - DNA, 25 bp, Homo sapien
agcttcccaccttccatgagtgcag

SEQ ID NO: 156950 - DNA, 25 bp, Homo sapien
atgagtgcagcacacaggtagtgct

SEQ ID NO: 156951 - DNA, 25 bp, Homo sapien
gtgctggaaaaacgcatcagtttct

SEQ ID NO: 156952 - DNA, 25 bp, Homo sapien
atcagtttctgattcttggccatat

SEQ ID NO: 156953 - DNA, 25 bp, Homo sapien
gattcttggccatatcctaacatgc

SEQ ID NO: 156954 - DNA, 25 bp, Homo sapien
tatcctaacatgcaagggccaagca

SEQ ID NO: 156955 - DNA, 25 bp, Homo sapien
aagcaaaggcttcaaggctctgagc

SEQ ID NO: 156956 - DNA, 25 bp, Homo sapien
aaatgtaggtcctcgcaggagctct

SEQ ID NO: 156957 - DNA, 25 bp, Homo sapien
gggtttctatcactgtgacaacact

SEQ ID NO: 156958 - DNA, 25 bp, Homo sapien
ggtaactcccatatctcctttaatg

SEQ ID NO: 156959 - DNA, 25 bp, Homo sapien
gtaactcccatatctcctttaatga

SEQ ID NO: 156960 - DNA, 25 bp, Homo sapien
taactcccatatctcctttaatgac

SEQ ID NO: 156961 - DNA, 25 bp, Homo sapien
aactcccatatctcctttaatgaca

SEQ ID NO: 156962 - DNA, 25 bp, Homo sapien
actcccatatctcctttaatgacat

SEQ ID NO: 156963 - DNA, 25 bp, Homo sapien
tcccatatctcctttaatgacattg

SEQ ID NO: 156964 - DNA, 25 bp, Homo sapien
ccatatctcctttaatgacattgat

SEQ ID NO: 156965 - DNA, 25 bp, Homo sapien
tctcctttaatgacattgatttcta

SEQ ID NO: 156966 - DNA, 25 bp, Homo sapien
attgatgccaagcttttttgccaca

SEQ ID NO: 156967 - DNA, 25 bp, Homo sapien
ttgatgccaagcttttttgccacaa

SEQ ID NO: 156968 - DNA, 25 bp, Homo sapien
tgatgccaagcttttttgccacaaa

SEQ ID NO: 156969 - DNA, 25 bp, Homo sapien
acttaccaccactaaactgcgagag

SEQ ID NO: 156970 - DNA, 25 bp, Homo sapien
actgcgagagaagctaaacgtgttt

SEQ ID NO: 156971 - DNA, 25 bp, Homo sapien
tagctttttctacatcttactcctg

SEQ ID NO: 156972 - DNA, 25 bp, Homo sapien
atcttactcctgttgatgcagctaa

SEQ ID NO: 156973 - DNA, 25 bp, Homo sapien
gttgatgcagctaaggtacatttgt

SEQ ID NO: 156974 - DNA, 25 bp, Homo sapien
gacttttcagacaaaccctttgtat

SEQ ID NO: 156975 - DNA, 25 bp, Homo sapien
gagcatgctcacttttttatattaa

SEQ ID NO: 156976 - DNA, 25 bp, Homo sapien
gtgcccgctgcagtttcttgggaca

SEQ ID NO: 156977 - DNA, 25 bp, Homo sapien
cagtttcttgggacataggagcgca

SEQ ID NO: 156978 - DNA, 25 bp, Homo sapien
taggagcgcaaagaagctacagcct

SEQ ID NO: 156979 - DNA, 25 bp, Homo sapien
agaagctacagcctggacttaccac

SEQ ID NO: 156980 - DNA, 25 bp, Homo sapien
ccgtgggacgggatggttctggctg

SEQ ID NO: 156981 - DNA, 25 bp, Homo sapien
ggttctggctgtttgagattctcaa

SEQ ID NO: 156982 - DNA, 25 bp, Homo sapien
ttgagattctcaaaggagcgagcat

SEQ ID NO: 156983 - DNA, 25 bp, Homo sapien
tcaaaggagcgagcatgtcgtggac

SEQ ID NO: 156984 - DNA, 25 bp, Homo sapien
ggacacacacagactatttttagat

SEQ ID NO: 156985 - DNA, 25 bp, Homo sapien
ttgccttttgcaaccaggaacagca

SEQ ID NO: 156986 - DNA, 25 bp, Homo sapien
cagcaaatgcaaaaactctttgaga

SEQ ID NO: 156987 - DNA, 25 bp, Homo sapien
ggtgggaaggaaacaaccatgtcat

SEQ ID NO: 156988 - DNA, 25 bp, Homo sapien
acaaccatgtcatttcagaagttag

SEQ ID NO: 156989 - DNA, 25 bp, Homo sapien
ttctcagaatcccttaacagttgta

SEQ ID NO: 156990 - DNA, 25 bp, Homo sapien
atcccttaacagttgtatttaacag

SEQ ID NO: 156991 - DNA, 25 bp, Homo sapien
catggacaatgagaggcggccgcat

SEQ ID NO: 156992 - DNA, 25 bp, Homo sapien
ggccgcatttccctcaattttccta

SEQ ID NO: 156993 - DNA, 25 bp, Homo sapien
ctcaattttcctactctgcaagtgg

SEQ ID NO: 156994 - DNA, 25 bp, Homo sapien
tcctactctgcaagtggacgagaat

SEQ ID NO: 156995 - DNA, 25 bp, Homo sapien
agtggacgagaataagtctctttca

SEQ ID NO: 156996 - DNA, 25 bp, Homo sapien
ttactgaaaatgattcctggacatc

SEQ ID NO: 156997 - DNA, 25 bp, Homo sapien
tggacatcaccagtcctagctctta

SEQ ID NO: 156998 - DNA, 25 bp, Homo sapien
gtcctagctcttacacatagcaggg

SEQ ID NO: 156999 - DNA, 25 bp, Homo sapien
acacatacacgcaaatacactccag

SEQ ID NO: 157000 - DNA, 25 bp, Homo sapien
acgcaaatacactccagtttttgtt

SEQ ID NO: 157001 - DNA, 25 bp, Homo sapien
gaaattgtatctcagtctaaggtct

SEQ ID NO: 157002 - DNA, 25 bp, Homo sapien
cattctgtctttttccactgaagtg

SEQ ID NO: 157003 - DNA, 25 bp, Homo sapien
ttccactgaagtgtgacattttgtt

SEQ ID NO: 157004 - DNA, 25 bp, Homo sapien
gacattttgttagtacatttcagtg

SEQ ID NO: 157005 - DNA, 25 bp, Homo sapien
acatttcagtgtagtcattcatttc

SEQ ID NO: 157006 - DNA, 25 bp, Homo sapien
gtagtcattcatttctagctgtaca

SEQ ID NO: 157007 - DNA, 25 bp, Homo sapien
gaacatgtcttacatgggttgctgt

SEQ ID NO: 157008 - DNA, 25 bp, Homo sapien
catgggttgctgtatttagaattat

SEQ ID NO: 157009 - DNA, 25 bp, Homo sapien
ggaccttctgcatacctgtttagaa

SEQ ID NO: 157010 - DNA, 25 bp, Homo sapien
accaccatgacacagtttttatagt

SEQ ID NO: 157011 - DNA, 25 bp, Homo sapien
atagtgtctgtatatttgtgatgca

SEQ ID NO: 157012 - DNA, 25 bp, Homo sapien
gatgcaatggtcttgtaaaggtttt

SEQ ID NO: 157013 - DNA, 25 bp, Homo sapien
gaagctgtgcagtataaaactcaag

SEQ ID NO: 157014 - DNA, 25 bp, Homo sapien
ctacattaaggtacgagcaggtgat

SEQ ID NO: 157015 - DNA, 25 bp, Homo sapien
ttcaaaagtcttcccggacaaaatg

SEQ ID NO: 157016 - DNA, 25 bp, Homo sapien
aaatgaggacttggtacttactgga

SEQ ID NO: 157017 - DNA, 25 bp, Homo sapien
gtacttactggataccaggttgaca

SEQ ID NO: 157018 - DNA, 25 bp, Homo sapien
gatgacgagctgacgggcttttagc

SEQ ID NO: 157019 - DNA, 25 bp, Homo sapien
gggcttttagcagcatgtacccaaa

SEQ ID NO: 157020 - DNA, 25 bp, Homo sapien
gcatgtacccaaagtgttctgattc

SEQ ID NO: 157021 - DNA, 25 bp, Homo sapien
aagtgttctgattccttcaactggc

SEQ ID NO: 157022 - DNA, 25 bp, Homo sapien
attccttcaactggctactgagtca

SEQ ID NO: 157023 - DNA, 25 bp, Homo sapien
tactgagtcatgatccttgctgata

SEQ ID NO: 157024 - DNA, 25 bp, Homo sapien
gggctcactgaaggctcgaaggcac

SEQ ID NO: 157025 - DNA, 25 bp, Homo sapien
tgaaggctcgaaggcactgcacacc

SEQ ID NO: 157026 - DNA, 25 bp, Homo sapien
ggcactgcacaccttgtatattgtc

SEQ ID NO: 157027 - DNA, 25 bp, Homo sapien
gcacaccttgtatattgtcagtgaa

SEQ ID NO: 157028 - DNA, 25 bp, Homo sapien
gaacgttagttggttgtcagtgaac

SEQ ID NO: 157029 - DNA, 25 bp, Homo sapien
gaaactaagctacagtaccagtaat

SEQ ID NO: 157030 - DNA, 25 bp, Homo sapien
gtagaatcttgtttgtaggctgaat

SEQ ID NO: 157031 - DNA, 25 bp, Homo sapien
attgtcttttgtatctcagaaatta

SEQ ID NO: 157032 - DNA, 25 bp, Homo sapien
gaaacttgctacagacttacccgta

SEQ ID NO: 157033 - DNA, 25 bp, Homo sapien
gacttacccgtaatatttgtcaaga

SEQ ID NO: 157034 - DNA, 25 bp, Homo sapien
atttgtcaagatcatagctgacttt

SEQ ID NO: 157035 - DNA, 25 bp, Homo sapien
atcttctgagatggcttctgggtct

SEQ ID NO: 157036 - DNA, 25 bp, Homo sapien
ttctgggtctttccatggtcagaga

SEQ ID NO: 157037 - DNA, 25 bp, Homo sapien
gaagatctatagtccgtcctgaggt

SEQ ID NO: 157038 - DNA, 25 bp, Homo sapien
cgtcctgaggtctgtcaatgtcaca

SEQ ID NO: 157039 - DNA, 25 bp, Homo sapien
gggatcgtcgcctgctggctaagac

SEQ ID NO: 157040 - DNA, 25 bp, Homo sapien
tgggtgctacttctgattcattgtc

SEQ ID NO: 157041 - DNA, 25 bp, Homo sapien
ttcattgtccttgtccctgtcataa

SEQ ID NO: 157042 - DNA, 25 bp, Homo sapien
ctgtcataagtacctccctattgta

SEQ ID NO: 157043 - DNA, 25 bp, Homo sapien
gaaactgttgacttgagcttggcta

SEQ ID NO: 157044 - DNA, 25 bp, Homo sapien
gagcttggctaaatttcctgaaggt

SEQ ID NO: 157045 - DNA, 25 bp, Homo sapien
ggaccttagagttgctccaagtaaa

SEQ ID NO: 157046 - DNA, 25 bp, Homo sapien
gaccctccgtaaattgttgagcgct

SEQ ID NO: 157047 - DNA, 25 bp, Homo sapien
accctccgtaaattgttgagcgctc

SEQ ID NO: 157048 - DNA, 25 bp, Homo sapien
cctccgtaaattgttgagcgctctt

SEQ ID NO: 157049 - DNA, 25 bp, Homo sapien
tccgtaaattgttgagcgctcttcc

SEQ ID NO: 157050 - DNA, 25 bp, Homo sapien
cgtaaattgttgagcgctcttcccc

SEQ ID NO: 157051 - DNA, 25 bp, Homo sapien
gtaaattgttgagcgctcttcccct

SEQ ID NO: 157052 - DNA, 25 bp, Homo sapien
aattgttgagcgctcttccccttcc

SEQ ID NO: 157053 - DNA, 25 bp, Homo sapien
ttcccgaggtccgcagggagcctag

SEQ ID NO: 157054 - DNA, 25 bp, Homo sapien
gaggtccgcagggagcctagcgcct

SEQ ID NO: 157055 - DNA, 25 bp, Homo sapien
ggagcctagcgcctggctgtgtgtg

SEQ ID NO: 157056 - DNA, 25 bp, Homo sapien
cctggctgtgtgtgcggccgctcct

SEQ ID NO: 157057 - DNA, 25 bp, Homo sapien
ttcatggagccatcataaaaatatt

SEQ ID NO: 157058 - DNA, 25 bp, Homo sapien
ataccctgtagtgcaaaatgtcaat

SEQ ID NO: 157059 - DNA, 25 bp, Homo sapien
accctgtagtgcaaaatgtcaattt

SEQ ID NO: 157060 - DNA, 25 bp, Homo sapien
gcataaaaacctccagtactttggt

SEQ ID NO: 157061 - DNA, 25 bp, Homo sapien
ctccagtactttggttgacccttgt

SEQ ID NO: 157062 - DNA, 25 bp, Homo sapien
tactttggttgacccttgtatgtca

SEQ ID NO: 157063 - DNA, 25 bp, Homo sapien
ggttgacccttgtatgtcacagctc

SEQ ID NO: 157064 - DNA, 25 bp, Homo sapien
ttgacccttgtatgtcacagctctg

SEQ ID NO: 157065 - DNA, 25 bp, Homo sapien
gtcacagctctgctctatttattat

SEQ ID NO: 157066 - DNA, 25 bp, Homo sapien
gaaaaatatccattttattaccatt

SEQ ID NO: 157067 - DNA, 25 bp, Homo sapien
tattaccattttctatctttttcaa

SEQ ID NO: 157068 - DNA, 25 bp, Homo sapien
gagccaaggctctaggcaaggccag

SEQ ID NO: 157069 - DNA, 25 bp, Homo sapien
ggaaggtgaccgtcctggtcctcgt

SEQ ID NO: 157070 - DNA, 25 bp, Homo sapien
ctggtcctcgtcgtgctggccgtgt

SEQ ID NO: 157071 - DNA, 25 bp, Homo sapien
actggtcatcagtatgtcctacgtc

SEQ ID NO: 157072 - DNA, 25 bp, Homo sapien
gtcatcagtatgtcctacgtcatca

SEQ ID NO: 157073 - DNA, 25 bp, Homo sapien
tcagtatgtcctacgtcatcaccag

SEQ ID NO: 157074 - DNA, 25 bp, Homo sapien
tcacgtacgccaactcgtgcctgaa

SEQ ID NO: 157075 - DNA, 25 bp, Homo sapien
ttcctctacgcctttctagatgaca

SEQ ID NO: 157076 - DNA, 25 bp, Homo sapien
acgcctttctagatgacaacttccg

SEQ ID NO: 157077 - DNA, 25 bp, Homo sapien
tttctagatgacaacttccggaaga

SEQ ID NO: 157078 - DNA, 25 bp, Homo sapien
aacttccgcagcatattgcggtgct

SEQ ID NO: 157079 - DNA, 25 bp, Homo sapien
atggctgtgtttagaatgatctagt

SEQ ID NO: 157080 - DNA, 25 bp, Homo sapien
gtgtaattcatacatgagctgacat

SEQ ID NO: 157081 - DNA, 25 bp, Homo sapien
gagctgacatacgttgatactttga

SEQ ID NO: 157082 - DNA, 25 bp, Homo sapien
catacgttgatactttgacgagtaa

SEQ ID NO: 157083 - DNA, 25 bp, Homo sapien
gtacagtcaaatgttcattgatttc

SEQ ID NO: 157084 - DNA, 25 bp, Homo sapien
gttaatcctattttgctatgctttc

SEQ ID NO: 157085 - DNA, 25 bp, Homo sapien
gtaaattcactgtatctaatgatgt

SEQ ID NO: 157086 - DNA, 25 bp, Homo sapien
gttacagacttacgtatacccttgt

SEQ ID NO: 157087 - DNA, 25 bp, Homo sapien
cgtatacccttgtatacctgggaca

SEQ ID NO: 157088 - DNA, 25 bp, Homo sapien
gcaaaatattgtccttactcattca

SEQ ID NO: 157089 - DNA, 25 bp, Homo sapien
ttgtccttactcattcaagaattaa

SEQ ID NO: 157090 - DNA, 25 bp, Homo sapien
cacactctccttcagccatttgtct

SEQ ID NO: 157091 - DNA, 25 bp, Homo sapien
acactctccttcagccatttgtctg

SEQ ID NO: 157092 - DNA, 25 bp, Homo sapien
cactctccttcagccatttgtctgc

SEQ ID NO: 157093 - DNA, 25 bp, Homo sapien
actctccttcagccatttgtctgcc

SEQ ID NO: 157094 - DNA, 25 bp, Homo sapien
ctctccttcagccatttgtctgcct

SEQ ID NO: 157095 - DNA, 25 bp, Homo sapien
tctccttcagccatttgtctgcctt

SEQ ID NO: 157096 - DNA, 25 bp, Homo sapien
ctccttcagccatttgtctgccttc

SEQ ID NO: 157097 - DNA, 25 bp, Homo sapien
tccttcagccatttgtctgccttca

SEQ ID NO: 157098 - DNA, 25 bp, Homo sapien
ggataaaactgtgtaaaccacataa

SEQ ID NO: 157099 - DNA, 25 bp, Homo sapien
gatgattttgtaattcttatgacta

SEQ ID NO: 157100 - DNA, 25 bp, Homo sapien
gactaaattttcttttaagcatttg

SEQ ID NO: 157101 - DNA, 25 bp, Homo sapien
ctgtgtatgttttatatcaaatgcc

SEQ ID NO: 157102 - DNA, 25 bp, Homo sapien
atcaaatgccttcatgaatctttca

SEQ ID NO: 157103 - DNA, 25 bp, Homo sapien
gccttcatgaatctttcatacatat

SEQ ID NO: 157104 - DNA, 25 bp, Homo sapien
gtatgtgagtagtcttatgtaaagt

SEQ ID NO: 157105 - DNA, 25 bp, Homo sapien
taaaacccaatacttttgtccaatg

SEQ ID NO: 157106 - DNA, 25 bp, Homo sapien
aaacccaatacttttgtccaatgtg

SEQ ID NO: 157107 - DNA, 25 bp, Homo sapien
ccaatacttttgtccaatgtggttg

SEQ ID NO: 157108 - DNA, 25 bp, Homo sapien
acttttgtccaatgtggttggtcaa

SEQ ID NO: 157109 - DNA, 25 bp, Homo sapien
taatttggtgcacagacaagccctt

SEQ ID NO: 157110 - DNA, 25 bp, Homo sapien
ttgagaagccaaccaccagatgctg

SEQ ID NO: 157111 - DNA, 25 bp, Homo sapien
cccaagccatagtctctctcttatt

SEQ ID NO: 157112 - DNA, 25 bp, Homo sapien
tacgtactataaagcttttgttcac

SEQ ID NO: 157113 - DNA, 25 bp, Homo sapien
aaagcttttgttcacacacactctg

SEQ ID NO: 157114 - DNA, 25 bp, Homo sapien
gttcacacacactctgaagaatcct

SEQ ID NO: 157115 - DNA, 25 bp, Homo sapien
tgaagaatcctgtaagcccctgaat

SEQ ID NO: 157116 - DNA, 25 bp, Homo sapien
ctgtaagcccctgaattaagcagaa

SEQ ID NO: 157117 - DNA, 25 bp, Homo sapien
taagcagaaagtcttcatggctttt

SEQ ID NO: 157118 - DNA, 25 bp, Homo sapien
atggcttttctggtcttcggctgct

SEQ ID NO: 157119 - DNA, 25 bp, Homo sapien
ttcggctgctcagggttcatctgaa

SEQ ID NO: 157120 - DNA, 25 bp, Homo sapien
cgggcaagcgcctcacgggcctgat

SEQ ID NO: 157121 - DNA, 25 bp, Homo sapien
acgggcctgatgcagtcctcctgac

SEQ ID NO: 157122 - DNA, 25 bp, Homo sapien
gatgcagtcctcctgaccgttccta

SEQ ID NO: 157123 - DNA, 25 bp, Homo sapien
tgaccgttcctaccgcaggtccagg

SEQ ID NO: 157124 - DNA, 25 bp, Homo sapien
tccacatctgcggacagagtttcct

SEQ ID NO: 157125 - DNA, 25 bp, Homo sapien
tgcggacagagtttccttacgagga

SEQ ID NO: 157126 - DNA, 25 bp, Homo sapien
ttccttacgaggagacttggtcact

SEQ ID NO: 157127 - DNA, 25 bp, Homo sapien
acgaggagacttggtcactgtgaag

SEQ ID NO: 157128 - DNA, 25 bp, Homo sapien
ggtggaggctcctgtttacagccct

SEQ ID NO: 157129 - DNA, 25 bp, Homo sapien
tgtttacagccctctcttctttgta

SEQ ID NO: 157130 - DNA, 25 bp, Homo sapien
acagccctctcttctttgtacagtt

SEQ ID NO: 157131 - DNA, 25 bp, Homo sapien
ttcctcttctcattaccagtaaagg

SEQ ID NO: 157132 - DNA, 25 bp, Homo sapien
ggaatgatttctatgaacttgtctt

SEQ ID NO: 157133 - DNA, 25 bp, Homo sapien
tttagacctaaatcgcatcatgcca

SEQ ID NO: 157134 - DNA, 25 bp, Homo sapien
gcatcatgccaacttgtgactttga

SEQ ID NO: 157135 - DNA, 25 bp, Homo sapien
gtgactttgagactattcatcaaga

SEQ ID NO: 157136 - DNA, 25 bp, Homo sapien
gtagccatgacatagcttgagctat

SEQ ID NO: 157137 - DNA, 25 bp, Homo sapien
tgagctatagcctttaattccttac

SEQ ID NO: 157138 - DNA, 25 bp, Homo sapien
aattccttactttggctatgggtgg

SEQ ID NO: 157139 - DNA, 25 bp, Homo sapien
gttctgattttcttgtaacctggga

SEQ ID NO: 157140 - DNA, 25 bp, Homo sapien
ttgtaacctgggaaagccatgacct

SEQ ID NO: 157141 - DNA, 25 bp, Homo sapien
ttgtgcccgattctttcagattgct

SEQ ID NO: 157142 - DNA, 25 bp, Homo sapien
cagactataacccacgaaggctgtg

SEQ ID NO: 157143 - DNA, 25 bp, Homo sapien
ttgctttgggaaatgcgggtctgtt

SEQ ID NO: 157144 - DNA, 25 bp, Homo sapien
gctctcactgtttgcctgccaagtt

SEQ ID NO: 157145 - DNA, 25 bp, Homo sapien
tgccaagttcaccacgatgcacttg

SEQ ID NO: 157146 - DNA, 25 bp, Homo sapien
gatgcacttgccactgaactgcact

SEQ ID NO: 157147 - DNA, 25 bp, Homo sapien
tgaactgcactgaactttcctccgt

SEQ ID NO: 157148 - DNA, 25 bp, Homo sapien
ctttcctccgtgatcaaggtggtga

SEQ ID NO: 157149 - DNA, 25 bp, Homo sapien
gacggagcatgaagatggacacatc

SEQ ID NO: 157150 - DNA, 25 bp, Homo sapien
atgctggctcccaggattcctttat

SEQ ID NO: 157151 - DNA, 25 bp, Homo sapien
ccaggattcctttatcccaggagtt

SEQ ID NO: 157152 - DNA, 25 bp, Homo sapien
cctttatcccaggagtttcagcttg

SEQ ID NO: 157153 - DNA, 25 bp, Homo sapien
agaaagtaaatctggagcaacttaa

SEQ ID NO: 157154 - DNA, 25 bp, Homo sapien
aaaaatctttcagtagcacataaaa

SEQ ID NO: 157155 - DNA, 25 bp, Homo sapien
agcacataaaaagttcccctctggc

SEQ ID NO: 157156 - DNA, 25 bp, Homo sapien
cttttaccgtagtgtttatgtcttg

SEQ ID NO: 157157 - DNA, 25 bp, Homo sapien
taccgtagtgtttatgtcttgtttc

SEQ ID NO: 157158 - DNA, 25 bp, Homo sapien
cttcatagattccatcaacactcca

SEQ ID NO: 157159 - DNA, 25 bp, Homo sapien
atagattccatcaacactccagatt

SEQ ID NO: 157160 - DNA, 25 bp, Homo sapien
gattccatcaacactccagatttaa

SEQ ID NO: 157161 - DNA, 25 bp, Homo sapien
atcaacactccagatttaattatct

SEQ ID NO: 157162 - DNA, 25 bp, Homo sapien
ggcttcaactttgtatcagtatact

SEQ ID NO: 157163 - DNA, 25 bp, Homo sapien
accacaagagagagtgtagcaccca

SEQ ID NO: 157164 - DNA, 25 bp, Homo sapien
tatgcctttatttttggctagaaga

SEQ ID NO: 157165 - DNA, 25 bp, Homo sapien
agaagaattatttttagcctagatc

SEQ ID NO: 157166 - DNA, 25 bp, Homo sapien
agcctagatctaaccattttcatac

SEQ ID NO: 157167 - DNA, 25 bp, Homo sapien
tcatactcttaactgattgaaacag

SEQ ID NO: 157168 - DNA, 25 bp, Homo sapien
caaagaagtatcgagtgctatgcat

SEQ ID NO: 157169 - DNA, 25 bp, Homo sapien
gtgctatgcattgaaacttgttttt

SEQ ID NO: 157170 - DNA, 25 bp, Homo sapien
gatggcactatgtatattaatgtaa

SEQ ID NO: 157171 - DNA, 25 bp, Homo sapien
gttttcagtttgtaccgcctggtat

SEQ ID NO: 157172 - DNA, 25 bp, Homo sapien
agtttgtaccgcctggtatgtctgt

SEQ ID NO: 157173 - DNA, 25 bp, Homo sapien
ggtatgtctgtgtaagaagccaatt

SEQ ID NO: 157174 - DNA, 25 bp, Homo sapien
gtattgttacagtttcaggttattt

SEQ ID NO: 157175 - DNA, 25 bp, Homo sapien
gagacatcagatagtcacctcacta

SEQ ID NO: 157176 - DNA, 25 bp, Homo sapien
gatagtcacctcactaaggctctct

SEQ ID NO: 157177 - DNA, 25 bp, Homo sapien
gaggaagaggtctgtgtcactctaa

SEQ ID NO: 157178 - DNA, 25 bp, Homo sapien
cattgtctctgggttgcggcaagaa

SEQ ID NO: 157179 - DNA, 25 bp, Homo sapien
aagaacactatttaccctcagctat

SEQ ID NO: 157180 - DNA, 25 bp, Homo sapien
cctcagctattcttcagcttggtat

SEQ ID NO: 157181 - DNA, 25 bp, Homo sapien
gagtggacccttggcatttgccaac

SEQ ID NO: 157182 - DNA, 25 bp, Homo sapien
aacagctgtgtcaaccctttcattt

SEQ ID NO: 157183 - DNA, 25 bp, Homo sapien
actatatcttcgacagctacatccg

SEQ ID NO: 157184 - DNA, 25 bp, Homo sapien
tgtgcccttgcctgaaaaactatga

SEQ ID NO: 157185 - DNA, 25 bp, Homo sapien
gactttgggagtagcactgagacat

SEQ ID NO: 157186 - DNA, 25 bp, Homo sapien
agtgcccagggctgatatatattgg

SEQ ID NO: 157187 - DNA, 25 bp, Homo sapien
atattggaaatatcacccctgaagc

SEQ ID NO: 157188 - DNA, 25 bp, Homo sapien
atatcacccctgaagccatcgctgg

SEQ ID NO: 157189 - DNA, 25 bp, Homo sapien
acctcctgtggactgatgccccagg

SEQ ID NO: 157190 - DNA, 25 bp, Homo sapien
tgcaaccccaggtatccttcattat

SEQ ID NO: 157191 - DNA, 25 bp, Homo sapien
ggattgcccgtgaagactttggcct

SEQ ID NO: 157192 - DNA, 25 bp, Homo sapien
tggcctagcaaattgtgttggttat

SEQ ID NO: 157193 - DNA, 25 bp, Homo sapien
gtgttggttatgtgagtgttgtttt

SEQ ID NO: 157194 - DNA, 25 bp, Homo sapien
tcagagatgtacatgattgccaatc

SEQ ID NO: 157195 - DNA, 25 bp, Homo sapien
tgattgccaatctgcatttcttacc

SEQ ID NO: 157196 - DNA, 25 bp, Homo sapien
gcatttcttaccagtgtgaccacac

SEQ ID NO: 157197 - DNA, 25 bp, Homo sapien
ggctatatctgcggtgaaagcccgg

SEQ ID NO: 157198 - DNA, 25 bp, Homo sapien
tggaggatctacgtgacgcttctca

SEQ ID NO: 157199 - DNA, 25 bp, Homo sapien
ggatctacgtgacgcttctcagcac

SEQ ID NO: 157200 - DNA, 25 bp, Homo sapien
tgaactcctgtgtcgacccctttgt

SEQ ID NO: 157201 - DNA, 25 bp, Homo sapien
gggttccaagccgactttcatgagc

SEQ ID NO: 157202 - DNA, 25 bp, Homo sapien
caagccgactttcatgagctgctga

SEQ ID NO: 157203 - DNA, 25 bp, Homo sapien
gccgactttcatgagctgctgagga

SEQ ID NO: 157204 - DNA, 25 bp, Homo sapien
cgactttcatgagctgctgaggagg

SEQ ID NO: 157205 - DNA, 25 bp, Homo sapien
agcagagagcggaccgaccagctga

SEQ ID NO: 157206 - DNA, 25 bp, Homo sapien
gagcggaccgaccagctgaaagaaa

SEQ ID NO: 157207 - DNA, 25 bp, Homo sapien
gaaagaccagtgaacactcacaggg

SEQ ID NO: 157208 - DNA, 25 bp, Homo sapien
gtatagctatgtagcgctctgtaga

SEQ ID NO: 157209 - DNA, 25 bp, Homo sapien
gctctgtagagccatgtagatagcc

SEQ ID NO: 157210 - DNA, 25 bp, Homo sapien
gtagatagccactcacatgtgcgca

SEQ ID NO: 157211 - DNA, 25 bp, Homo sapien
tcacatgtgcgcacacgtgtgcggt

SEQ ID NO: 157212 - DNA, 25 bp, Homo sapien
acgtgtgcggtctagtttaatccca

SEQ ID NO: 157213 - DNA, 25 bp, Homo sapien
gcggtctagtttaatcccatgttga

SEQ ID NO: 157214 - DNA, 25 bp, Homo sapien
atgttgacaggatgcccaggtcacc

SEQ ID NO: 157215 - DNA, 25 bp, Homo sapien
gccttggcccgcaggctgtgcactg

SEQ ID NO: 157216 - DNA, 25 bp, Homo sapien
tgtgcactgcatggtctagggacgt

SEQ ID NO: 157217 - DNA, 25 bp, Homo sapien
atggtctagggacgttctctctcca

SEQ ID NO: 157218 - DNA, 25 bp, Homo sapien
gacctctcaccacacggaagtggaa

SEQ ID NO: 157219 - DNA, 25 bp, Homo sapien
tatgcctttatttttggctagaaga

SEQ ID NO: 157220 - DNA, 25 bp, Homo sapien
ttaaatgttagatggcactatgtat

SEQ ID NO: 157221 - DNA, 25 bp, Homo sapien
gatggcactatgtatattaatgtaa

SEQ ID NO: 157222 - DNA, 25 bp, Homo sapien
taatttactcaagttttcagtttgt

SEQ ID NO: 157223 - DNA, 25 bp, Homo sapien
gttttcagtttgtaccgcctggtat

SEQ ID NO: 157224 - DNA, 25 bp, Homo sapien
agtttgtaccgcctggtatgtctgt

SEQ ID NO: 157225 - DNA, 25 bp, Homo sapien
ggtatgtctgtgtaagaagccaatt

SEQ ID NO: 157226 - DNA, 25 bp, Homo sapien
tctgtgtaagaagccaatttttgtg

SEQ ID NO: 157227 - DNA, 25 bp, Homo sapien
gtgtattgttacagtttcaggttat

SEQ ID NO: 157228 - DNA, 25 bp, Homo sapien
ttgttacagtttcaggttatttata

SEQ ID NO: 157229 - DNA, 25 bp, Homo sapien
aactcaaataacgactatacttatg

SEQ ID NO: 157230 - DNA, 25 bp, Homo sapien
gctctccagggacgacagttccgtg

SEQ ID NO: 157231 - DNA, 25 bp, Homo sapien
tctccagggacgacagttccgtgtt

SEQ ID NO: 157232 - DNA, 25 bp, Homo sapien
cagggacgacagttccgtgttccgt

SEQ ID NO: 157233 - DNA, 25 bp, Homo sapien
gacgacagttccgtgttccgttgcc

SEQ ID NO: 157234 - DNA, 25 bp, Homo sapien
gacagttccgtgttccgttgccggg

SEQ ID NO: 157235 - DNA, 25 bp, Homo sapien
tccgtgttccgttgccgggcccagg

SEQ ID NO: 157236 - DNA, 25 bp, Homo sapien
tgcctggccttcgtcaacagctgcg

SEQ ID NO: 157237 - DNA, 25 bp, Homo sapien
atctacctcctgctggaccgctcat

SEQ ID NO: 157238 - DNA, 25 bp, Homo sapien
cgcctggcgcgaaggatcagctcag

SEQ ID NO: 157239 - DNA, 25 bp, Homo sapien
tggcgcgaaggatcagctcagcctc

SEQ ID NO: 157240 - DNA, 25 bp, Homo sapien
gcgcgaaggatcagctcagcctcct

SEQ ID NO: 157241 - DNA, 25 bp, Homo sapien
agttaaaacgtcacaaaggtgctgc

SEQ ID NO: 157242 - DNA, 25 bp, Homo sapien
acaaaggtgctgcttttacagggaa

SEQ ID NO: 157243 - DNA, 25 bp, Homo sapien
ggtgctgcttttacagggaagctta

SEQ ID NO: 157244 - DNA, 25 bp, Homo sapien
ttacagggaagcttattctgtttta

SEQ ID NO: 157245 - DNA, 25 bp, Homo sapien
gttgtggtctgatcagttaatttgt

SEQ ID NO: 157246 - DNA, 25 bp, Homo sapien
gtatgtagcagtgtatgctctcata

SEQ ID NO: 157247 - DNA, 25 bp, Homo sapien
caattactgacctatgctctaaaac

SEQ ID NO: 157248 - DNA, 25 bp, Homo sapien
ttactgacctatgctctaaaacatg

SEQ ID NO: 157249 - DNA, 25 bp, Homo sapien
gacctatgctctaaaacatgaatgc

SEQ ID NO: 157250 - DNA, 25 bp, Homo sapien
ctttgttacagacccaagctgtcca

SEQ ID NO: 157251 - DNA, 25 bp, Homo sapien
tgttacagacccaagctgtccattt

SEQ ID NO: 157252 - DNA, 25 bp, Homo sapien
aagtttgaatagcttctgtccctct

SEQ ID NO: 157253 - DNA, 25 bp, Homo sapien
gggtttttactgttacctgatcaat

SEQ ID NO: 157254 - DNA, 25 bp, Homo sapien
cctgatcaatgacagagccttctga

SEQ ID NO: 157255 - DNA, 25 bp, Homo sapien
gaggacattccaagacagtatacag

SEQ ID NO: 157256 - DNA, 25 bp, Homo sapien
acagtatacagtcctgtggtctcct

SEQ ID NO: 157257 - DNA, 25 bp, Homo sapien
gtggtctccttggaaatccgtctag

SEQ ID NO: 157258 - DNA, 25 bp, Homo sapien
cttggaaatccgtctagttaacatt

SEQ ID NO: 157259 - DNA, 25 bp, Homo sapien
gttaacatttcaagggcaataccgt

SEQ ID NO: 157260 - DNA, 25 bp, Homo sapien
taccgtgttggttttgactggatat

SEQ ID NO: 157261 - DNA, 25 bp, Homo sapien
gagttgagtgatagagctaaccctt

SEQ ID NO: 157262 - DNA, 25 bp, Homo sapien
atagagctaacccttatctgtaagt

SEQ ID NO: 157263 - DNA, 25 bp, Homo sapien
ttatgtgaacatgcgctgtgtgctg

SEQ ID NO: 157264 - DNA, 25 bp, Homo sapien
ctgtgtgctgcttgctttggaaact

SEQ ID NO: 157265 - DNA, 25 bp, Homo sapien
gctttggaaactgggcctgggtcca

SEQ ID NO: 157266 - DNA, 25 bp, Homo sapien
ggtccaggcctagggtgagctcact

SEQ ID NO: 157267 - DNA, 25 bp, Homo sapien
tagggtgagctcactgtccgtacaa

SEQ ID NO: 157268 - DNA, 25 bp, Homo sapien
agctcactgtccgtacaaacacaag

SEQ ID NO: 157269 - DNA, 25 bp, Homo sapien
tacaaacacaagatcagggctgagg

SEQ ID NO: 157270 - DNA, 25 bp, Homo sapien
gcatcagggcggaagccttaaagca

SEQ ID NO: 157271 - DNA, 25 bp, Homo sapien
cttaaagcagcagcgggtgtgccca

SEQ ID NO: 157272 - DNA, 25 bp, Homo sapien
aggcacccagatgattcctatggca

SEQ ID NO: 157273 - DNA, 25 bp, Homo sapien
gattcctatggcaccagccaggaaa

SEQ ID NO: 157274 - DNA, 25 bp, Homo sapien
ttggttaggctaaactggtgcatac

SEQ ID NO: 157275 - DNA, 25 bp, Homo sapien
actggtgcatactggcattggcctt

SEQ ID NO: 157276 - DNA, 25 bp, Homo sapien
gggagcacagacacaggataggact

SEQ ID NO: 157277 - DNA, 25 bp, Homo sapien
caggataggactccatttctttctt

SEQ ID NO: 157278 - DNA, 25 bp, Homo sapien
cattccttcatgtctaggataactt

SEQ ID NO: 157279 - DNA, 25 bp, Homo sapien
gtctaggataacttgctttcttctt

SEQ ID NO: 157280 - DNA, 25 bp, Homo sapien
ctggctcaagccctgaatttcttct

SEQ ID NO: 157281 - DNA, 25 bp, Homo sapien
gggttgagagctttctgccttagcc

SEQ ID NO: 157282 - DNA, 25 bp, Homo sapien
ttctgccttagcctaccatgtgaaa

SEQ ID NO: 157283 - DNA, 25 bp, Homo sapien
taccatgtgaaactctaccctgaag

SEQ ID NO: 157284 - DNA, 25 bp, Homo sapien
ggataggaagtagacctctttttct

SEQ ID NO: 157285 - DNA, 25 bp, Homo sapien
tggccagagtcctgatgcacatctt

SEQ ID NO: 157286 - DNA, 25 bp, Homo sapien
ccagagtcctgatgcacatcttcca

SEQ ID NO: 157287 - DNA, 25 bp, Homo sapien
agtggctcatacctcggatgtcacg

SEQ ID NO: 157288 - DNA, 25 bp, Homo sapien
atacctcggatgtcacgggcagcct

SEQ ID NO: 157289 - DNA, 25 bp, Homo sapien
tcacctacctgcacagtgtcgtcaa

SEQ ID NO: 157290 - DNA, 25 bp, Homo sapien
acagtgtcgtcaaccccgtggtata

SEQ ID NO: 157291 - DNA, 25 bp, Homo sapien
aaccccgtggtatactgcttctcca

SEQ ID NO: 157292 - DNA, 25 bp, Homo sapien
caccttcaggagctcctatcggagg

SEQ ID NO: 157293 - DNA, 25 bp, Homo sapien
agctcctatcggagggtcttccaca

SEQ ID NO: 157294 - DNA, 25 bp, Homo sapien
cacaccctccgaggcaaagggcagg

SEQ ID NO: 157295 - DNA, 25 bp, Homo sapien
agatttcaaccccagagactcctat

SEQ ID NO: 157296 - DNA, 25 bp, Homo sapien
agtgagtcctccctggcatcctcgt

SEQ ID NO: 157297 - DNA, 25 bp, Homo sapien
ctccctggcatcctcgtgaaagtgc

SEQ ID NO: 157298 - DNA, 25 bp, Homo sapien
cctcgtgaaagtgcacacacttcat

SEQ ID NO: 157299 - DNA, 25 bp, Homo sapien
aagtgcacacacttcatggagggac

SEQ ID NO: 157300 - DNA, 25 bp, Homo sapien
atggagggactccttttcaataaga

SEQ ID NO: 157301 - DNA, 25 bp, Homo sapien
ggagggactccttttcaataagaat

SEQ ID NO: 157302 - DNA, 25 bp, Homo sapien
ggactccttttcaataagaattagg

SEQ ID NO: 157303 - DNA, 25 bp, Homo sapien
atttgagattttactctgtcgaatt

SEQ ID NO: 157304 - DNA, 25 bp, Homo sapien
gagattttactctgtcgaattttag

SEQ ID NO: 157305 - DNA, 25 bp, Homo sapien
gattttactctgtcgaattttagag

SEQ ID NO: 157306 - DNA, 25 bp, Homo sapien
ctgtcgaattttagagtatttgaag

SEQ ID NO: 157307 - DNA, 25 bp, Homo sapien
aaaattgatacatttcctggaaagg

SEQ ID NO: 157308 - DNA, 25 bp, Homo sapien
aagccatcagaggagcttgtggaca

SEQ ID NO: 157309 - DNA, 25 bp, Homo sapien
gcttgtggacaggattatacatcat

SEQ ID NO: 157310 - DNA, 25 bp, Homo sapien
atacatcatacttcgttccaagaga

SEQ ID NO: 157311 - DNA, 25 bp, Homo sapien
aaattacacaacactgccagacgaa

SEQ ID NO: 157312 - DNA, 25 bp, Homo sapien
acactgccagacgaaattatgaacc

SEQ ID NO: 157313 - DNA, 25 bp, Homo sapien
ttatgaaccagaaattgtcgccctt

SEQ ID NO: 157314 - DNA, 25 bp, Homo sapien
gaaattgtcgcccttcatgagaaag

SEQ ID NO: 157315 - DNA, 25 bp, Homo sapien
aaaaatcactttacagtagccctga

SEQ ID NO: 157316 - DNA, 25 bp, Homo sapien
actgaagtttcgaactgagatctaa

SEQ ID NO: 157317 - DNA, 25 bp, Homo sapien
gagatctaagaaggtctttctttac

SEQ ID NO: 157318 - DNA, 25 bp, Homo sapien
gtcctctctatcctggatgagctca

SEQ ID NO: 157319 - DNA, 25 bp, Homo sapien
aacatttctcttgtgttcctgactc

SEQ ID NO: 157320 - DNA, 25 bp, Homo sapien
atttctcttgtgttcctgactcctt

SEQ ID NO: 157321 - DNA, 25 bp, Homo sapien
aagctctgctctcctcctctgtgag

SEQ ID NO: 157322 - DNA, 25 bp, Homo sapien
tacccgggaaagtacgtctagattg

SEQ ID NO: 157323 - DNA, 25 bp, Homo sapien
tacgtctagattgtgtggtttgcct

SEQ ID NO: 157324 - DNA, 25 bp, Homo sapien
tggtttgcctcattgtgctatttgc

SEQ ID NO: 157325 - DNA, 25 bp, Homo sapien
attgtgctatttgcccactttcctt

SEQ ID NO: 157326 - DNA, 25 bp, Homo sapien
gaaatatctgtgaaccttctttctg

SEQ ID NO: 157327 - DNA, 25 bp, Homo sapien
gaaccttctttctgttcagtcctaa

SEQ ID NO: 157328 - DNA, 25 bp, Homo sapien
ctttctgttcagtcctaaaattcga

SEQ ID NO: 157329 - DNA, 25 bp, Homo sapien
aaaggaccccgacgccaacagacag

SEQ ID NO: 157330 - DNA, 25 bp, Homo sapien
gacgccaacagacagtcaaacgctg

SEQ ID NO: 157331 - DNA, 25 bp, Homo sapien
caaacgctgatgttgcgggcagaaa

SEQ ID NO: 157332 - DNA, 25 bp, Homo sapien
ggtgacaattgtatactttctagga

SEQ ID NO: 157333 - DNA, 25 bp, Homo sapien
actttctaggacaagcacggcttct

SEQ ID NO: 157334 - DNA, 25 bp, Homo sapien
ggcttctcctttcggttcccatgga

SEQ ID NO: 157335 - DNA, 25 bp, Homo sapien
accccacctgcatgacgatttattt

SEQ ID NO: 157336 - DNA, 25 bp, Homo sapien
gacgatttatttgtatctgggaaaa

SEQ ID NO: 157337 - DNA, 25 bp, Homo sapien
aagagtcgactatacaaagatcaat

SEQ ID NO: 157338 - DNA, 25 bp, Homo sapien
aaagatcaatcaccaccacgaggac

SEQ ID NO: 157339 - DNA, 25 bp, Homo sapien
accaccacgaggacaagagggcaat

SEQ ID NO: 157340 - DNA, 25 bp, Homo sapien
tggctggccgaaacccttatgccct

SEQ ID NO: 157341 - DNA, 25 bp, Homo sapien
ccgaaacccttatgccctgctgggt

SEQ ID NO: 157342 - DNA, 25 bp, Homo sapien
gaggatgagtgctgagttccgccca

SEQ ID NO: 157343 - DNA, 25 bp, Homo sapien
ttccctcccagatactttcgttttg

SEQ ID NO: 157344 - DNA, 25 bp, Homo sapien
gatactttcgttttggactgacctg

SEQ ID NO: 157345 - DNA, 25 bp, Homo sapien
ctctgccaccccaattgtgaataaa

SEQ ID NO: 157346 - DNA, 25 bp, Homo sapien
aaagattgtttgctttgtagcccct

SEQ ID NO: 157347 - DNA, 25 bp, Homo sapien
agattgtttgctttgtagccccttc

SEQ ID NO: 157348 - DNA, 25 bp, Homo sapien
aactgaggtgagagcggctgttcca

SEQ ID NO: 157349 - DNA, 25 bp, Homo sapien
tgagagcggctgttccaggctaaca

SEQ ID NO: 157350 - DNA, 25 bp, Homo sapien
agcggctgttccaggctaacagctg

SEQ ID NO: 157351 - DNA, 25 bp, Homo sapien
gaacttgtgtgtgcctcctcaggta

SEQ ID NO: 157352 - DNA, 25 bp, Homo sapien
ctcctcaggtatggcagtgactcac

SEQ ID NO: 157353 - DNA, 25 bp, Homo sapien
gagtgcccttggctcactgtgttct

SEQ ID NO: 157354 - DNA, 25 bp, Homo sapien
cactgtgttctgcatggtttggatc

SEQ ID NO: 157355 - DNA, 25 bp, Homo sapien
tgtcctttcttctaaatcccaaccg

SEQ ID NO: 157356 - DNA, 25 bp, Homo sapien
aactggctgtaaccccaaatccaag

SEQ ID NO: 157357 - DNA, 25 bp, Homo sapien
aatccaagccattaactacacctga

SEQ ID NO: 157358 - DNA, 25 bp, Homo sapien
ttgtctgattaatcactggcccctt

SEQ ID NO: 157359 - DNA, 25 bp, Homo sapien
tggccccttgaagacagcagaatgt

SEQ ID NO: 157360 - DNA, 25 bp, Homo sapien
gcagaatgtccctttgcaatgagga

SEQ ID NO: 157361 - DNA, 25 bp, Homo sapien
gggaagcatttgactatctggaact

SEQ ID NO: 157362 - DNA, 25 bp, Homo sapien
ctcactgcccaggtcgatcaagtgg

SEQ ID NO: 157363 - DNA, 25 bp, Homo sapien
ggtcgatcaagtggcttttcctggg

SEQ ID NO: 157364 - DNA, 25 bp, Homo sapien
tcgatcaagtggcttttcctgggac

SEQ ID NO: 157365 - DNA, 25 bp, Homo sapien
cgatcaagtggcttttcctgggacc

SEQ ID NO: 157366 - DNA, 25 bp, Homo sapien
gatcaagtggcttttcctgggacct

SEQ ID NO: 157367 - DNA, 25 bp, Homo sapien
taggcgtgaggctgtggacattttc

SEQ ID NO: 157368 - DNA, 25 bp, Homo sapien
cgtgaggctgtggacattttcggaa

SEQ ID NO: 157369 - DNA, 25 bp, Homo sapien
gtgaggctgtggacattttcggaat

SEQ ID NO: 157370 - DNA, 25 bp, Homo sapien
gaggctgtggacattttcggaatgt

SEQ ID NO: 157371 - DNA, 25 bp, Homo sapien
ggctgtggacattttcggaatgttt

SEQ ID NO: 157372 - DNA, 25 bp, Homo sapien
tggacattttcggaatgttttggtt

SEQ ID NO: 157373 - DNA, 25 bp, Homo sapien
cagactgaattaattttaactgaaa

SEQ ID NO: 157374 - DNA, 25 bp, Homo sapien
ctcttatgttccaaggtacacaata

SEQ ID NO: 157375 - DNA, 25 bp, Homo sapien
ttatgttccaaggtacacaataggt

SEQ ID NO: 157376 - DNA, 25 bp, Homo sapien
atgttccaaggtacacaataggtaa

SEQ ID NO: 157377 - DNA, 25 bp, Homo sapien
gttccaaggtacacaataggtaaga

SEQ ID NO: 157378 - DNA, 25 bp, Homo sapien
gtacacaataggtaagattatgctc

SEQ ID NO: 157379 - DNA, 25 bp, Homo sapien
aatttggcttcatatctagactaac

SEQ ID NO: 157380 - DNA, 25 bp, Homo sapien
tttggcttcatatctagactaacac

SEQ ID NO: 157381 - DNA, 25 bp, Homo sapien
ttggcttcatatctagactaacaca

SEQ ID NO: 157382 - DNA, 25 bp, Homo sapien
ggcttcatatctagactaacacaaa

SEQ ID NO: 157383 - DNA, 25 bp, Homo sapien
atatctagactaacacaaaattaag

SEQ ID NO: 157384 - DNA, 25 bp, Homo sapien
tcctgccactgaaccaacggtggac

SEQ ID NO: 157385 - DNA, 25 bp, Homo sapien
aacggtggacagtgtagtcactcca

SEQ ID NO: 157386 - DNA, 25 bp, Homo sapien
gtgtagtcactccagaagctttttc

SEQ ID NO: 157387 - DNA, 25 bp, Homo sapien
tagtcactccagaagctttttcaga

SEQ ID NO: 157388 - DNA, 25 bp, Homo sapien
atcatcacgagcacccctgagacaa

SEQ ID NO: 157389 - DNA, 25 bp, Homo sapien
tccacctacggcataaaaacaccaa

SEQ ID NO: 157390 - DNA, 25 bp, Homo sapien
gaacacaacgcaggacttgctgaaa

SEQ ID NO: 157391 - DNA, 25 bp, Homo sapien
ggacttgctgaaaccaaattactac

SEQ ID NO: 157392 - DNA, 25 bp, Homo sapien
aaatgtgattttcacagattcagct

SEQ ID NO: 157393 - DNA, 25 bp, Homo sapien
cttctctccttacattttacattca

SEQ ID NO: 157394 - DNA, 25 bp, Homo sapien
ttacattcatgccacattcaatatt

SEQ ID NO: 157395 - DNA, 25 bp, Homo sapien
cccagcgttccaggcacatgaagag

SEQ ID NO: 157396 - DNA, 25 bp, Homo sapien
gaaagcattccaaagcctctgattg

SEQ ID NO: 157397 - DNA, 25 bp, Homo sapien
ttccaaagcctctgattgttgtttc

SEQ ID NO: 157398 - DNA, 25 bp, Homo sapien
ttttctcctcccgaaggaacagctg

SEQ ID NO: 157399 - DNA, 25 bp, Homo sapien
aggaacagctgattcatgctcctcc

SEQ ID NO: 157400 - DNA, 25 bp, Homo sapien
tgattcatgctcctcccgcaattgt

SEQ ID NO: 157401 - DNA, 25 bp, Homo sapien
cccgcaattgtcacgtctgtgattt

SEQ ID NO: 157402 - DNA, 25 bp, Homo sapien
tgatttatttggtgtttcgggcgtg

SEQ ID NO: 157403 - DNA, 25 bp, Homo sapien
cgctcatgggccctggtgtttgcac

SEQ ID NO: 157404 - DNA, 25 bp, Homo sapien
gtgtttgcaccgcactttgtaatca

SEQ ID NO: 157405 - DNA, 25 bp, Homo sapien
gcactttgtaatcagtcccgtggtt

SEQ ID NO: 157406 - DNA, 25 bp, Homo sapien
acctcctttgacgtcgtgtctcaga

SEQ ID NO: 157407 - DNA, 25 bp, Homo sapien
ctcctttgacgtcgtgtctcagatg

SEQ ID NO: 157408 - DNA, 25 bp, Homo sapien
tcctttgacgtcgtgtctcagatga

SEQ ID NO: 157409 - DNA, 25 bp, Homo sapien
cctttgacgtcgtgtctcagatgat

SEQ ID NO: 157410 - DNA, 25 bp, Homo sapien
ctttgacgtcgtgtctcagatgatg

SEQ ID NO: 157411 - DNA, 25 bp, Homo sapien
tgatgcgggcgcagatgaaccagat

SEQ ID NO: 157412 - DNA, 25 bp, Homo sapien
atgaaccagattcagtctgtggagg

SEQ ID NO: 157413 - DNA, 25 bp, Homo sapien
agccactcgccaggaggccacgggc

SEQ ID NO: 157414 - DNA, 25 bp, Homo sapien
acgggaagaaccaagcggtgccagc

SEQ ID NO: 157415 - DNA, 25 bp, Homo sapien
gggaagaaccaagcggtgccagcca

SEQ ID NO: 157416 - DNA, 25 bp, Homo sapien
aagaaccaagcggtgccagccacga

SEQ ID NO: 157417 - DNA, 25 bp, Homo sapien
gaagattcagctagttaggagccca

SEQ ID NO: 157418 - DNA, 25 bp, Homo sapien
ttcctaatctgtgtgtgccctgtaa

SEQ ID NO: 157419 - DNA, 25 bp, Homo sapien
tgtgccctgtaacctgactggttaa

SEQ ID NO: 157420 - DNA, 25 bp, Homo sapien
ggttaacagcagtcctttgtaaaca

SEQ ID NO: 157421 - DNA, 25 bp, Homo sapien
ttaaactctcctagtcaatatccac

SEQ ID NO: 157422 - DNA, 25 bp, Homo sapien
atccaccccatccaatttatcaagg

SEQ ID NO: 157423 - DNA, 25 bp, Homo sapien
ttttcagcctacagttatgttcagt

SEQ ID NO: 157424 - DNA, 25 bp, Homo sapien
acagttatgttcagtcacacacaca

SEQ ID NO: 157425 - DNA, 25 bp, Homo sapien
catacaaaatgttccttttgctttt

SEQ ID NO: 157426 - DNA, 25 bp, Homo sapien
aagtaatttttgactcccagatcag

SEQ ID NO: 157427 - DNA, 25 bp, Homo sapien
tttgactcccagatcagtcagagcc

SEQ ID NO: 157428 - DNA, 25 bp, Homo sapien
gtaatgtgtcacttgatttggaact

SEQ ID NO: 157429 - DNA, 25 bp, Homo sapien
gatttggaactattcaagcagtaaa

SEQ ID NO: 157430 - DNA, 25 bp, Homo sapien
cacctttactaaaacactttctctg

SEQ ID NO: 157431 - DNA, 25 bp, Homo sapien
cttgcccctcactgatcttgctttt

SEQ ID NO: 157432 - DNA, 25 bp, Homo sapien
ctgatcttgcttttccctggtctca

SEQ ID NO: 157433 - DNA, 25 bp, Homo sapien
tggtcaatattgtggtaatcgctaa

SEQ ID NO: 157434 - DNA, 25 bp, Homo sapien
tgtggtaatcgctaattgtactgat

SEQ ID NO: 157435 - DNA, 25 bp, Homo sapien
attgtactgattgtttaagtgtgca

SEQ ID NO: 157436 - DNA, 25 bp, Homo sapien
taagtgtgcattagttgtctctccc

SEQ ID NO: 157437 - DNA, 25 bp, Homo sapien
tgtctctccccagctagattgtaag

SEQ ID NO: 157438 - DNA, 25 bp, Homo sapien
cccaccctactccaaaagtaatgtg

SEQ ID NO: 157439 - DNA, 25 bp, Homo sapien
aaagtttattgcacttctttttgag

SEQ ID NO: 157440 - DNA, 25 bp, Homo sapien
gagtaaggcttttgtgtatttaatc

SEQ ID NO: 157441 - DNA, 25 bp, Homo sapien
gtatttaatcctaaaggtggctgta

SEQ ID NO: 157442 - DNA, 25 bp, Homo sapien
gctgtaatcatgaacctaggccacc

SEQ ID NO: 157443 - DNA, 25 bp, Homo sapien
aatcatgaacctaggccaccatggg

SEQ ID NO: 157444 - DNA, 25 bp, Homo sapien
tttctcattgcataatgtcacagtt

SEQ ID NO: 157445 - DNA, 25 bp, Homo sapien
cagttgcctcaaatgagcaccattt

SEQ ID NO: 157446 - DNA, 25 bp, Homo sapien
gatgtcaatttcatgaaaagcctga

SEQ ID NO: 157447 - DNA, 25 bp, Homo sapien
aaagcctgagtgtattgcatctctt

SEQ ID NO: 157448 - DNA, 25 bp, Homo sapien
gtattgcatctcttgatttaatcat

SEQ ID NO: 157449 - DNA, 25 bp, Homo sapien
gtgaaacttttcctagatgcaaatg

SEQ ID NO: 157450 - DNA, 25 bp, Homo sapien
cacgttatcttcattttgggaaact

SEQ ID NO: 157451 - DNA, 25 bp, Homo sapien
tcttcattttgggaaactaggttct

SEQ ID NO: 157452 - DNA, 25 bp, Homo sapien
atttatcctccctgttatactttgg

SEQ ID NO: 157453 - DNA, 25 bp, Homo sapien
gttatactttggagcacagcacagc

SEQ ID NO: 157454 - DNA, 25 bp, Homo sapien
ggctgcatttgtgcccaggtcagga

SEQ ID NO: 157455 - DNA, 25 bp, Homo sapien
gcatttgtgcccaggtcaggagcaa

SEQ ID NO: 157456 - DNA, 25 bp, Homo sapien
gcccaggtcaggagcaaattgaaaa

SEQ ID NO: 157457 - DNA, 25 bp, Homo sapien
gaaaatacttattctttcttatcga

SEQ ID NO: 157458 - DNA, 25 bp, Homo sapien
ttcttatcgaattttggagcctaat

SEQ ID NO: 157459 - DNA, 25 bp, Homo sapien
gagcctaatatagccaggagctgct

SEQ ID NO: 157460 - DNA, 25 bp, Homo sapien
agctgctgaatttgtgcccctggat

SEQ ID NO: 157461 - DNA, 25 bp, Homo sapien
atgcccacactacaggccagggctg

SEQ ID NO: 157462 - DNA, 25 bp, Homo sapien
acactacaggccagggctgcggggc

SEQ ID NO: 157463 - DNA, 25 bp, Homo sapien
ggctgcggggctggcgcaatcccag

SEQ ID NO: 157464 - DNA, 25 bp, Homo sapien
ggctggcgcaatcccagcccccttc

SEQ ID NO: 157465 - DNA, 25 bp, Homo sapien
ggccacggccttgggtccctgccct

SEQ ID NO: 157466 - DNA, 25 bp, Homo sapien
ggcccccactgtggagataagaagg

SEQ ID NO: 157467 - DNA, 25 bp, Homo sapien
gcccccactgtggagataagaaggg

SEQ ID NO: 157468 - DNA, 25 bp, Homo sapien
ggaggagcaggaggccctcatcctt

SEQ ID NO: 157469 - DNA, 25 bp, Homo sapien
aggccctcatccttctgctgccctg

SEQ ID NO: 157470 - DNA, 25 bp, Homo sapien
tcacccctctggagggccggacagg

SEQ ID NO: 157471 - DNA, 25 bp, Homo sapien
tggagggccggacagggaggtggaa

SEQ ID NO: 157472 - DNA, 25 bp, Homo sapien
gaatatctctgtgtcaaggccatga

SEQ ID NO: 157473 - DNA, 25 bp, Homo sapien
tatctctgtgtcaaggccatgatcc

SEQ ID NO: 157474 - DNA, 25 bp, Homo sapien
tctctgtgtcaaggccatgatcctg

SEQ ID NO: 157475 - DNA, 25 bp, Homo sapien
tgtgtcaaggccatgatcctgctca

SEQ ID NO: 157476 - DNA, 25 bp, Homo sapien
gtcaaggccatgatcctgctcaatt

SEQ ID NO: 157477 - DNA, 25 bp, Homo sapien
aaggccatgatcctgctcaattcca

SEQ ID NO: 157478 - DNA, 25 bp, Homo sapien
ccatgatcctgctcaattccagtat

SEQ ID NO: 157479 - DNA, 25 bp, Homo sapien
atgatcctgctcaattccagtatgt

SEQ ID NO: 157480 - DNA, 25 bp, Homo sapien
gatcctgctcaattccagtatgtac

SEQ ID NO: 157481 - DNA, 25 bp, Homo sapien
tgctcaattccagtatgtaccctct

SEQ ID NO: 157482 - DNA, 25 bp, Homo sapien
gctcaattccagtatgtaccctctg

SEQ ID NO: 157483 - DNA, 25 bp, Homo sapien
gctgatgatctactgcttggaacat

SEQ ID NO: 157484 - DNA, 25 bp, Homo sapien
ccatgatgctgaggctcctcaggga

SEQ ID NO: 157485 - DNA, 25 bp, Homo sapien
cagggagcagaggatgttcatgatc

SEQ ID NO: 157486 - DNA, 25 bp, Homo sapien
gttcatgatccagactatcgctcag

SEQ ID NO: 157487 - DNA, 25 bp, Homo sapien
ctatcgctcagtacaagtttgtcta

SEQ ID NO: 157488 - DNA, 25 bp, Homo sapien
ttgtctaccaagtcctcatccagtt

SEQ ID NO: 157489 - DNA, 25 bp, Homo sapien
aaactccagactcatttaatcaccc

SEQ ID NO: 157490 - DNA, 25 bp, Homo sapien
gacccagctccatcgcgctggagga

SEQ ID NO: 157491 - DNA, 25 bp, Homo sapien
gagagtcacctccagacaacatctg

SEQ ID NO: 157492 - DNA, 25 bp, Homo sapien
gctggcagcaaacaggctctctgaa

SEQ ID NO: 157493 - DNA, 25 bp, Homo sapien
gctctctgaagacagtagccaagat

SEQ ID NO: 157494 - DNA, 25 bp, Homo sapien
gggccccatggctttggctggccac

SEQ ID NO: 157495 - DNA, 25 bp, Homo sapien
tttggctggccactgagggtagggt

SEQ ID NO: 157496 - DNA, 25 bp, Homo sapien
cggcggcccaggtacgaagctgcaa

SEQ ID NO: 157497 - DNA, 25 bp, Homo sapien
caggtacgaagctgcaactctgcgc

SEQ ID NO: 157498 - DNA, 25 bp, Homo sapien
aactctgcgcgcagtgggcgagatc

SEQ ID NO: 157499 - DNA, 25 bp, Homo sapien
gcgcagtgggcgagatctcatcagc

SEQ ID NO: 157500 - DNA, 25 bp, Homo sapien
tgggcgagatctcatcagccccagg

SEQ ID NO: 157501 - DNA, 25 bp, Homo sapien
ttctggccgggcaccacagcactgg

SEQ ID NO: 157502 - DNA, 25 bp, Homo sapien
tcacctcttggttgatcctcttgta

SEQ ID NO: 157503 - DNA, 25 bp, Homo sapien
tggttgatcctcttgtactgggaga

SEQ ID NO: 157504 - DNA, 25 bp, Homo sapien
atcctcttgtactgggagaggtgcc

SEQ ID NO: 157505 - DNA, 25 bp, Homo sapien
acacaccacattgggaaaaccttct

SEQ ID NO: 157506 - DNA, 25 bp, Homo sapien
accttctgcctcattttgtgatgtg

SEQ ID NO: 157507 - DNA, 25 bp, Homo sapien
tctgcctcattttgtgatgtgtcac

SEQ ID NO: 157508 - DNA, 25 bp, Homo sapien
gtgtcacaggttaatgtggtgttac

SEQ ID NO: 157509 - DNA, 25 bp, Homo sapien
ggtgttactgtaggaattttcttga

SEQ ID NO: 157510 - DNA, 25 bp, Homo sapien
gaaggaactctgcagttaaatagtg

SEQ ID NO: 157511 - DNA, 25 bp, Homo sapien
taatgtttgcatttcctcaggtcct

SEQ ID NO: 157512 - DNA, 25 bp, Homo sapien
gtttgcatttcctcaggtcctttag

SEQ ID NO: 157513 - DNA, 25 bp, Homo sapien
ggtcctttagtctgttgttcttgaa

SEQ ID NO: 157514 - DNA, 25 bp, Homo sapien
tacctggtttgcttggcttacgtaa

SEQ ID NO: 157515 - DNA, 25 bp, Homo sapien
cctggtttgcttggcttacgtaaga

SEQ ID NO: 157516 - DNA, 25 bp, Homo sapien
gatcctcatgccgtttactgtaagg

SEQ ID NO: 157517 - DNA, 25 bp, Homo sapien
cgtcctggatatcgagcagttctcg

SEQ ID NO: 157518 - DNA, 25 bp, Homo sapien
cagttctcggcggtgaaagggatct

SEQ ID NO: 157519 - DNA, 25 bp, Homo sapien
aaagggatctacctggacaccgcag

SEQ ID NO: 157520 - DNA, 25 bp, Homo sapien
ggacaccgcagatgaagacttctat

SEQ ID NO: 157521 - DNA, 25 bp, Homo sapien
aagacttctatgctcggtttgctac

SEQ ID NO: 157522 - DNA, 25 bp, Homo sapien
gtttgctaccgggtgtgtctccatc

SEQ ID NO: 157523 - DNA, 25 bp, Homo sapien
cctgaccatggtccccagtgagaag

SEQ ID NO: 157524 - DNA, 25 bp, Homo sapien
aagtggaacccaagcaatgctgagc

SEQ ID NO: 157525 - DNA, 25 bp, Homo sapien
aggagcatgtgttagcgtctcgtcc

SEQ ID NO: 157526 - DNA, 25 bp, Homo sapien
gtctcgtcccacctggaattgtaat

SEQ ID NO: 157527 - DNA, 25 bp, Homo sapien
ttttgccacaaagaagattcttacc

SEQ ID NO: 157528 - DNA, 25 bp, Homo sapien
gattcttaccaagagtgggctttgt

SEQ ID NO: 157529 - DNA, 25 bp, Homo sapien
cttaccaagagtgggctttgtggaa

SEQ ID NO: 157530 - DNA, 25 bp, Homo sapien
ttcacctttatatatgtactagcat

SEQ ID NO: 157531 - DNA, 25 bp, Homo sapien
atatgtactagcattttccacgctg

SEQ ID NO: 157532 - DNA, 25 bp, Homo sapien
tgtactagcattttccacgctgatg

SEQ ID NO: 157533 - DNA, 25 bp, Homo sapien
actagcattttccacgctgatgttt

SEQ ID NO: 157534 - DNA, 25 bp, Homo sapien
gcattttccacgctgatgtttatgt

SEQ ID NO: 157535 - DNA, 25 bp, Homo sapien
attttccacgctgatgtttatgtac

SEQ ID NO: 157536 - DNA, 25 bp, Homo sapien
ttccacgctgatgtttatgtactgt

SEQ ID NO: 157537 - DNA, 25 bp, Homo sapien
cacgctgatgtttatgtactgtaaa

SEQ ID NO: 157538 - DNA, 25 bp, Homo sapien
caccccgagcgcacactgtgatgga

SEQ ID NO: 157539 - DNA, 25 bp, Homo sapien
tgtgatggaggagactgagctccct

SEQ ID NO: 157540 - DNA, 25 bp, Homo sapien
ggcgggcagctgacactaccagaga

SEQ ID NO: 157541 - DNA, 25 bp, Homo sapien
gctgacactaccagagagactcaag

SEQ ID NO: 157542 - DNA, 25 bp, Homo sapien
caagcaataattagaggtgggcaga

SEQ ID NO: 157543 - DNA, 25 bp, Homo sapien
ggcagagctgccctctcggcattac

SEQ ID NO: 157544 - DNA, 25 bp, Homo sapien
gcattacctcttctgcaggctctgc

SEQ ID NO: 157545 - DNA, 25 bp, Homo sapien
gcacctcactgccaggccattaaaa

SEQ ID NO: 157546 - DNA, 25 bp, Homo sapien
tcactgccaggccattaaaatcagc

SEQ ID NO: 157547 - DNA, 25 bp, Homo sapien
aggcaccctggctatagcttataca

SEQ ID NO: 157548 - DNA, 25 bp, Homo sapien
atagcttatacagtatctccccttg

SEQ ID NO: 157549 - DNA, 25 bp, Homo sapien
cacgtgtcctgtagttgcgtggact

SEQ ID NO: 157550 - DNA, 25 bp, Homo sapien
acgtgtcctgtagttgcgtggactc

SEQ ID NO: 157551 - DNA, 25 bp, Homo sapien
cgtgtcctgtagttgcgtggactct

SEQ ID NO: 157552 - DNA, 25 bp, Homo sapien
tgtcctgtagttgcgtggactctgc

SEQ ID NO: 157553 - DNA, 25 bp, Homo sapien
gtcctgtagttgcgtggactctgca

SEQ ID NO: 157554 - DNA, 25 bp, Homo sapien
tcctgtagttgcgtggactctgcac

SEQ ID NO: 157555 - DNA, 25 bp, Homo sapien
ctgtagttgcgtggactctgcacat

SEQ ID NO: 157556 - DNA, 25 bp, Homo sapien
tgtagttgcgtggactctgcacatg

SEQ ID NO: 157557 - DNA, 25 bp, Homo sapien
gtagttgcgtggactctgcacatgt

SEQ ID NO: 157558 - DNA, 25 bp, Homo sapien
tccctaagctccagggtccctgaat

SEQ ID NO: 157559 - DNA, 25 bp, Homo sapien
tccagggtccctgaatcttctgaaa

SEQ ID NO: 157560 - DNA, 25 bp, Homo sapien
aagcagctgggtgggcagaatgcag

SEQ ID NO: 157561 - DNA, 25 bp, Homo sapien
gggaggatcctttcactttccgctt

SEQ ID NO: 157562 - DNA, 25 bp, Homo sapien
gcttccccttctgatgcatggagga

SEQ ID NO: 157563 - DNA, 25 bp, Homo sapien
ttccccttctgatgcatggaggatg

SEQ ID NO: 157564 - DNA, 25 bp, Homo sapien
catggaggatggtgtgagcttttca

SEQ ID NO: 157565 - DNA, 25 bp, Homo sapien
agcaggcccggaaaggtacgcaggt

SEQ ID NO: 157566 - DNA, 25 bp, Homo sapien
aggtacgcaggtgacgccttagcag

SEQ ID NO: 157567 - DNA, 25 bp, Homo sapien
aggtgacgccttagcagccccgcag

SEQ ID NO: 157568 - DNA, 25 bp, Homo sapien
tagcagccccgcagctggtgctctg

SEQ ID NO: 157569 - DNA, 25 bp, Homo sapien
gggagacggtgttgcagagacgcaa

SEQ ID NO: 157570 - DNA, 25 bp, Homo sapien
tgcagagacgcaagggagaagaaat

SEQ ID NO: 157571 - DNA, 25 bp, Homo sapien
gagaagaaatccataacacccccac

SEQ ID NO: 157572 - DNA, 25 bp, Homo sapien
gttccgtcccaaacagagggccaca

SEQ ID NO: 157573 - DNA, 25 bp, Homo sapien
agagggccacacagataccccacgt

SEQ ID NO: 157574 - DNA, 25 bp, Homo sapien
acacagataccccacgttctatata

SEQ ID NO: 157575 - DNA, 25 bp, Homo sapien
acagataccccacgttctatataag

SEQ ID NO: 157576 - DNA, 25 bp, Homo sapien
gataccccacgttctatataaggag

SEQ ID NO: 157577 - DNA, 25 bp, Homo sapien
taccccacgttctatataaggagga

SEQ ID NO: 157578 - DNA, 25 bp, Homo sapien
ctgtgtagactcctgcttcttcaag

SEQ ID NO: 157579 - DNA, 25 bp, Homo sapien
tgtagactcctgcttcttcaagcac

SEQ ID NO: 157580 - DNA, 25 bp, Homo sapien
gttgctgtgacagccggtagagcct

SEQ ID NO: 157581 - DNA, 25 bp, Homo sapien
tgtgacagccggtagagcctctgcc

SEQ ID NO: 157582 - DNA, 25 bp, Homo sapien
ggcgtgggtcaaatcatagccaagt

SEQ ID NO: 157583 - DNA, 25 bp, Homo sapien
gccaagtgacttgtttacatgtgag

SEQ ID NO: 157584 - DNA, 25 bp, Homo sapien
tgagtgaaactgcacaaaggaacac

SEQ ID NO: 157585 - DNA, 25 bp, Homo sapien
tgcactttaacggtagttccggtgt

SEQ ID NO: 157586 - DNA, 25 bp, Homo sapien
acggtagttccggtgtcaacatgga

SEQ ID NO: 157587 - DNA, 25 bp, Homo sapien
gttccggtgtcaacatggacacgaa

SEQ ID NO: 157588 - DNA, 25 bp, Homo sapien
tggacacgaacaaaaccttacccag

SEQ ID NO: 157589 - DNA, 25 bp, Homo sapien
accttacccaggtgtttatactgtg

SEQ ID NO: 157590 - DNA, 25 bp, Homo sapien
ccaggtgtttatactgtgtgtgtgt

SEQ ID NO: 157591 - DNA, 25 bp, Homo sapien
accagattggccccgtgcggctgct

SEQ ID NO: 157592 - DNA, 25 bp, Homo sapien
tgcggctgctggcttctgtagaggc

SEQ ID NO: 157593 - DNA, 25 bp, Homo sapien
cagccaggagaggaggtgtcccttc

SEQ ID NO: 157594 - DNA, 25 bp, Homo sapien
gccaggagaggaggtgtcccttcct

SEQ ID NO: 157595 - DNA, 25 bp, Homo sapien
agacacagcgcgcttctctctggcc

SEQ ID NO: 157596 - DNA, 25 bp, Homo sapien
gctgtgttcagcttaggaacatacc

SEQ ID NO: 157597 - DNA, 25 bp, Homo sapien
ttcagcttaggaacataccgcctgt

SEQ ID NO: 157598 - DNA, 25 bp, Homo sapien
agcttaggaacataccgcctgtatc

SEQ ID NO: 157599 - DNA, 25 bp, Homo sapien
cttaggaacataccgcctgtatctg

SEQ ID NO: 157600 - DNA, 25 bp, Homo sapien
ggaacataccgcctgtatctgctgt

SEQ ID NO: 157601 - DNA, 25 bp, Homo sapien
gaacataccgcctgtatctgctgtc

SEQ ID NO: 157602 - DNA, 25 bp, Homo sapien
tatgcttttgttgaaaccacagctt

SEQ ID NO: 157603 - DNA, 25 bp, Homo sapien
tttgttgaaaccacagcttttgtgc

SEQ ID NO: 157604 - DNA, 25 bp, Homo sapien
gcttttgtgcccattgttttaactt

SEQ ID NO: 157605 - DNA, 25 bp, Homo sapien
gtgcccattgttttaacttgtgtga

SEQ ID NO: 157606 - DNA, 25 bp, Homo sapien
gtgtgaaacaatacaaagcccagaa

SEQ ID NO: 157607 - DNA, 25 bp, Homo sapien
gcatgagtaaattttgttcagggct

SEQ ID NO: 157608 - DNA, 25 bp, Homo sapien
tttgttcagggctactgtctgtatg

SEQ ID NO: 157609 - DNA, 25 bp, Homo sapien
gctactgtctgtatgtgcccagata

SEQ ID NO: 157610 - DNA, 25 bp, Homo sapien
gtatgtgcccagataaaattttcat

SEQ ID NO: 157611 - DNA, 25 bp, Homo sapien
aaattttcatgagagtagtttacaa

SEQ ID NO: 157612 - DNA, 25 bp, Homo sapien
aaattagttgtgctctgctattttc

SEQ ID NO: 157613 - DNA, 25 bp, Homo sapien
gcagaggagtttacctacaacccct

SEQ ID NO: 157614 - DNA, 25 bp, Homo sapien
cctacaaccccttcatgagagtgag

SEQ ID NO: 157615 - DNA, 25 bp, Homo sapien
agcagcacgcaggtgagacggaccc

SEQ ID NO: 157616 - DNA, 25 bp, Homo sapien
caggtgagacggacccggtgaccac

SEQ ID NO: 157617 - DNA, 25 bp, Homo sapien
aaggaccagttcaagatgccccggg

SEQ ID NO: 157618 - DNA, 25 bp, Homo sapien
gggattaggctcttttaggtaactg

SEQ ID NO: 157619 - DNA, 25 bp, Homo sapien
taggtaactggctttcctgctggtc

SEQ ID NO: 157620 - DNA, 25 bp, Homo sapien
tggtccgtgcgggaaattcagtctt

SEQ ID NO: 157621 - DNA, 25 bp, Homo sapien
gaaattcagtcttgatttaacctta

SEQ ID NO: 157622 - DNA, 25 bp, Homo sapien
ccttaattttacagcccttggcttg

SEQ ID NO: 157623 - DNA, 25 bp, Homo sapien
gcccttggcttgtgttatcggacat

SEQ ID NO: 157624 - DNA, 25 bp, Homo sapien
gattagacctatgtgtttgcaccca

SEQ ID NO: 157625 - DNA, 25 bp, Homo sapien
agacctatgtgtttgcacccatctt

SEQ ID NO: 157626 - DNA, 25 bp, Homo sapien
gcacccatctttgttggcgatctga

SEQ ID NO: 157627 - DNA, 25 bp, Homo sapien
atctttgttggcgatctgagtgcag

SEQ ID NO: 157628 - DNA, 25 bp, Homo sapien
atctgagtgcagtgtggcaagtgca

SEQ ID NO: 157629 - DNA, 25 bp, Homo sapien
gtcagatcgcgcaccttcaggtcgc

SEQ ID NO: 157630 - DNA, 25 bp, Homo sapien
aggtcgcgcaccttcgctgaaggaa

SEQ ID NO: 157631 - DNA, 25 bp, Homo sapien
ctgaaggaagatgacgcagagcttt

SEQ ID NO: 157632 - DNA, 25 bp, Homo sapien
gatgacgcagagctttatctgaaat

SEQ ID NO: 157633 - DNA, 25 bp, Homo sapien
gggcagctaaagttgacatgcgaat

SEQ ID NO: 157634 - DNA, 25 bp, Homo sapien
gacatgcgaataaattgatactgaa

SEQ ID NO: 157635 - DNA, 25 bp, Homo sapien
gccataaaaaggaacaagactgact

SEQ ID NO: 157636 - DNA, 25 bp, Homo sapien
ccataaaaaggaacaagactgactg

SEQ ID NO: 157637 - DNA, 25 bp, Homo sapien
cataaaaaggaacaagactgactgg

SEQ ID NO: 157638 - DNA, 25 bp, Homo sapien
taaaaaggaacaagactgactgggc

SEQ ID NO: 157639 - DNA, 25 bp, Homo sapien
aaaaaggaacaagactgactgggcg

SEQ ID NO: 157640 - DNA, 25 bp, Homo sapien
aaaaggaacaagactgactgggcgt

SEQ ID NO: 157641 - DNA, 25 bp, Homo sapien
aaaggaacaagactgactgggcgtg

SEQ ID NO: 157642 - DNA, 25 bp, Homo sapien
aaggaacaagactgactgggcgtgg

SEQ ID NO: 157643 - DNA, 25 bp, Homo sapien
aggaacaagactgactgggcgtggt

SEQ ID NO: 157644 - DNA, 25 bp, Homo sapien
ggaacaagactgactgggcgtggtg

SEQ ID NO: 157645 - DNA, 25 bp, Homo sapien
gattgcccgcgctcaggaggtcaag

SEQ ID NO: 157646 - DNA, 25 bp, Homo sapien
atactgcctcaatgtgtctctggct

SEQ ID NO: 157647 - DNA, 25 bp, Homo sapien
atgtgtctctggctgataccaacag

SEQ ID NO: 157648 - DNA, 25 bp, Homo sapien
ataccaacagcctggcagtggtcag

SEQ ID NO: 157649 - DNA, 25 bp, Homo sapien
tggtcagcacccagcttatcatgcc

SEQ ID NO: 157650 - DNA, 25 bp, Homo sapien
atcgtgggcatcttgctggtgttga

SEQ ID NO: 157651 - DNA, 25 bp, Homo sapien
atggctgtggtccttgcatctctga

SEQ ID NO: 157652 - DNA, 25 bp, Homo sapien
atataggcgcagacttatgaagcaa

SEQ ID NO: 157653 - DNA, 25 bp, Homo sapien
taccccagttgccacatagcagcag

SEQ ID NO: 157654 - DNA, 25 bp, Homo sapien
tagcagcagtcactggctgcgtcta

SEQ ID NO: 157655 - DNA, 25 bp, Homo sapien
ttctgctcttgtcccattggtgaga

SEQ ID NO: 157656 - DNA, 25 bp, Homo sapien
ttgtcccattggtgagaatagcccc

SEQ ID NO: 157657 - DNA, 25 bp, Homo sapien
ccccaggtctcagagagcaagcggt

SEQ ID NO: 157658 - DNA, 25 bp, Homo sapien
gagcaagcggtagccagaggtacca

SEQ ID NO: 157659 - DNA, 25 bp, Homo sapien
tagccagaggtaccagcttcgcctg

SEQ ID NO: 157660 - DNA, 25 bp, Homo sapien
gggcttcaagaacctcccatctatc

SEQ ID NO: 157661 - DNA, 25 bp, Homo sapien
ctatccccattcctgagacaggagt

SEQ ID NO: 157662 - DNA, 25 bp, Homo sapien
ttcctgagacaggagttacagtccc

SEQ ID NO: 157663 - DNA, 25 bp, Homo sapien
gagttacagtcccttttggccctca

SEQ ID NO: 157664 - DNA, 25 bp, Homo sapien
ccttttggccctcacatccaataaa

SEQ ID NO: 157665 - DNA, 25 bp, Homo sapien
aggatggagtcctagctgtgacctg

SEQ ID NO: 157666 - DNA, 25 bp, Homo sapien
tggagtcctagctgtgacctgtgcc

SEQ ID NO: 157667 - DNA, 25 bp, Homo sapien
gcgtgatccgagtgaagccccaggt

SEQ ID NO: 157668 - DNA, 25 bp, Homo sapien
agttgtttcagttggcaacgctgcc

SEQ ID NO: 157669 - DNA, 25 bp, Homo sapien
ggcaacgctgcccattcaattgaat

SEQ ID NO: 157670 - DNA, 25 bp, Homo sapien
gggacaaaattaacgattgccttca

SEQ ID NO: 157671 - DNA, 25 bp, Homo sapien
gattgccttcagtttgtgttgtgta

SEQ ID NO: 157672 - DNA, 25 bp, Homo sapien
tattttgatgtatgtggtcactaac

SEQ ID NO: 157673 - DNA, 25 bp, Homo sapien
tggtcactaacaggtcacttttatt

SEQ ID NO: 157674 - DNA, 25 bp, Homo sapien
gtaaaccttgcaaatatgtaacctg

SEQ ID NO: 157675 - DNA, 25 bp, Homo sapien
atgtaacctgtgttgcgcaaatgcc

SEQ ID NO: 157676 - DNA, 25 bp, Homo sapien
gtgttgcgcaaatgccgcataaatt

SEQ ID NO: 157677 - DNA, 25 bp, Homo sapien
tgtgatactgtggtcatatgcccgt

SEQ ID NO: 157678 - DNA, 25 bp, Homo sapien
ggtcatatgcccgtgtttgtcactt

SEQ ID NO: 157679 - DNA, 25 bp, Homo sapien
ttttgacccttttggattttatcag

SEQ ID NO: 157680 - DNA, 25 bp, Homo sapien
gacccttttggattttatcaggtgt

SEQ ID NO: 157681 - DNA, 25 bp, Homo sapien
ttggattttatcaggtgtaaacaaa

SEQ ID NO: 157682 - DNA, 25 bp, Homo sapien
aaagctgaacagttacttcaaagat

SEQ ID NO: 157683 - DNA, 25 bp, Homo sapien
tcaactctttgaccctccatgtgta

SEQ ID NO: 157684 - DNA, 25 bp, Homo sapien
tttgaccctccatgtgtaccataga

SEQ ID NO: 157685 - DNA, 25 bp, Homo sapien
tgaccctccatgtgtaccatagagg

SEQ ID NO: 157686 - DNA, 25 bp, Homo sapien
tttcactttgatgaggttggtaaat

SEQ ID NO: 157687 - DNA, 25 bp, Homo sapien
aatgtttttagatcttctggtaagc

SEQ ID NO: 157688 - DNA, 25 bp, Homo sapien
gatcttctggtaagcattatgtttg

SEQ ID NO: 157689 - DNA, 25 bp, Homo sapien
ggtaagcattatgtttgttaataca

SEQ ID NO: 157690 - DNA, 25 bp, Homo sapien
cagactgaattaattttaactgaaa

SEQ ID NO: 157691 - DNA, 25 bp, Homo sapien
ctcttatgttccaaggtacacaata

SEQ ID NO: 157692 - DNA, 25 bp, Homo sapien
tatgttccaaggtacacaataggta

SEQ ID NO: 157693 - DNA, 25 bp, Homo sapien
gttccaaggtacacaataggtaaga

SEQ ID NO: 157694 - DNA, 25 bp, Homo sapien
gtacacaataggtaagattatgctc

SEQ ID NO: 157695 - DNA, 25 bp, Homo sapien
gattatgctcaatattctcagaata

SEQ ID NO: 157696 - DNA, 25 bp, Homo sapien
aatttggcttcatatctagactaac

SEQ ID NO: 157697 - DNA, 25 bp, Homo sapien
ttggcttcatatctagactaacaca

SEQ ID NO: 157698 - DNA, 25 bp, Homo sapien
ggcttcatatctagactaacacaaa

SEQ ID NO: 157699 - DNA, 25 bp, Homo sapien
aatcttccataattgcttttgctca

SEQ ID NO: 157700 - DNA, 25 bp, Homo sapien
cttccataattgcttttgctcagta

SEQ ID NO: 157701 - DNA, 25 bp, Homo sapien
gtttggaaggactcatgaagcagct

SEQ ID NO: 157702 - DNA, 25 bp, Homo sapien
tgaagcagcttaatgccatcacagg

SEQ ID NO: 157703 - DNA, 25 bp, Homo sapien
caggctcagccttttaacatgtatt

SEQ ID NO: 157704 - DNA, 25 bp, Homo sapien
attttccgggaactttgcagcatac

SEQ ID NO: 157705 - DNA, 25 bp, Homo sapien
tgcagcataccaattacccataaac

SEQ ID NO: 157706 - DNA, 25 bp, Homo sapien
ataaacagcacacctgtgtccaaga

SEQ ID NO: 157707 - DNA, 25 bp, Homo sapien
gtgtccaagaactctaaccagtgta

SEQ ID NO: 157708 - DNA, 25 bp, Homo sapien
taaccagtgtacaggtcacccatca

SEQ ID NO: 157709 - DNA, 25 bp, Homo sapien
aggtcacccatcaggaccactcagt

SEQ ID NO: 157710 - DNA, 25 bp, Homo sapien
taagcattccttctttcacaggcat

SEQ ID NO: 157711 - DNA, 25 bp, Homo sapien
aatgatgattatgagttccctaaac

SEQ ID NO: 157712 - DNA, 25 bp, Homo sapien
ttttgacccttttggattttatcag

SEQ ID NO: 157713 - DNA, 25 bp, Homo sapien
gacccttttggattttatcaggtgt

SEQ ID NO: 157714 - DNA, 25 bp, Homo sapien
aaagctgaacagttacttcaaagat

SEQ ID NO: 157715 - DNA, 25 bp, Homo sapien
aagatttctgagctagcaggcatgt

SEQ ID NO: 157716 - DNA, 25 bp, Homo sapien
aaggctctgtcttcaactctttgac

SEQ ID NO: 157717 - DNA, 25 bp, Homo sapien
tcaactctttgaccctccatgtgta

SEQ ID NO: 157718 - DNA, 25 bp, Homo sapien
ttgaccctccatgtgtaccatagag

SEQ ID NO: 157719 - DNA, 25 bp, Homo sapien
tttcactttgatgaggttggtaaat

SEQ ID NO: 157720 - DNA, 25 bp, Homo sapien
aatgtttttagatcttctggtaagc

SEQ ID NO: 157721 - DNA, 25 bp, Homo sapien
gatcttctggtaagcattatgtttg

SEQ ID NO: 157722 - DNA, 25 bp, Homo sapien
ggtaagcattatgtttgttaataca

SEQ ID NO: 157723 - DNA, 25 bp, Homo sapien
agcttttgatgtggtgtcatagaat

SEQ ID NO: 157724 - DNA, 25 bp, Homo sapien
gttgtagatacaatcagctgctttg

SEQ ID NO: 157725 - DNA, 25 bp, Homo sapien
aatcagctgctttgttaccttaaaa

SEQ ID NO: 157726 - DNA, 25 bp, Homo sapien
ggtgatgtcctgtaaacactcagct

SEQ ID NO: 157727 - DNA, 25 bp, Homo sapien
aacactcagctgttcagattggaca

SEQ ID NO: 157728 - DNA, 25 bp, Homo sapien
ataactgacttagttcttcccttct

SEQ ID NO: 157729 - DNA, 25 bp, Homo sapien
cttgtagtttagtgtggttttctgt

SEQ ID NO: 157730 - DNA, 25 bp, Homo sapien
ttctgtttctaatttgctgctgata

SEQ ID NO: 157731 - DNA, 25 bp, Homo sapien
aacatgctgtgtaagctgtgtccta

SEQ ID NO: 157732 - DNA, 25 bp, Homo sapien
taagctgtgtcctagttcttgaaca

SEQ ID NO: 157733 - DNA, 25 bp, Homo sapien
cttgaacagtttatgcagtgctgct

SEQ ID NO: 157734 - DNA, 25 bp, Homo sapien
cagggcaatcctggggctaaatgag

SEQ ID NO: 157735 - DNA, 25 bp, Homo sapien
cagccccacccctgtaaatggaatt

SEQ ID NO: 157736 - DNA, 25 bp, Homo sapien
cacccctgtaaatggaatttaccag

SEQ ID NO: 157737 - DNA, 25 bp, Homo sapien
agggaatgaagtccctcactgagcc

SEQ ID NO: 157738 - DNA, 25 bp, Homo sapien
gaaaaagtgttagtgcttccaggcg

SEQ ID NO: 157739 - DNA, 25 bp, Homo sapien
aaaaagtgttagtgcttccaggcgg

SEQ ID NO: 157740 - DNA, 25 bp, Homo sapien
ttccaggcggcactgacagcctcag

SEQ ID NO: 157741 - DNA, 25 bp, Homo sapien
aggcggcactgacagcctcagtaac

SEQ ID NO: 157742 - DNA, 25 bp, Homo sapien
gcggcactgacagcctcagtaacaa

SEQ ID NO: 157743 - DNA, 25 bp, Homo sapien
ggcactgacagcctcagtaacaata

SEQ ID NO: 157744 - DNA, 25 bp, Homo sapien
ctgacagcctcagtaacaataaaaa

SEQ ID NO: 157745 - DNA, 25 bp, Homo sapien
gaagcatgggatcctggattttttg

SEQ ID NO: 157746 - DNA, 25 bp, Homo sapien
aagcatgggatcctggattttttgt

SEQ ID NO: 157747 - DNA, 25 bp, Homo sapien
agcatgggatcctggattttttgtt

SEQ ID NO: 157748 - DNA, 25 bp, Homo sapien
acacccggaatcttcttggtcctct

SEQ ID NO: 157749 - DNA, 25 bp, Homo sapien
cacccggaatcttcttggtcctctg

SEQ ID NO: 157750 - DNA, 25 bp, Homo sapien
acccggaatcttcttggtcctctgc

SEQ ID NO: 157751 - DNA, 25 bp, Homo sapien
ccggaatcttcttggtcctctgctg

SEQ ID NO: 157752 - DNA, 25 bp, Homo sapien
cggaatcttcttggtcctctgctga

SEQ ID NO: 157753 - DNA, 25 bp, Homo sapien
ggaatcttcttggtcctctgctgag

SEQ ID NO: 157754 - DNA, 25 bp, Homo sapien
gaatcttcttggtcctctgctgagg

SEQ ID NO: 157755 - DNA, 25 bp, Homo sapien
aatcttcttggtcctctgctgaggc

SEQ ID NO: 157756 - DNA, 25 bp, Homo sapien
ggcgcttgccccacggaggaatgca

SEQ ID NO: 157757 - DNA, 25 bp, Homo sapien
tgccccacggaggaatgcaaggcct

SEQ ID NO: 157758 - DNA, 25 bp, Homo sapien
cggaggaatgcaaggcctgcaccag

SEQ ID NO: 157759 - DNA, 25 bp, Homo sapien
ggctgtgtcaccatgctcaagtcgc

SEQ ID NO: 157760 - DNA, 25 bp, Homo sapien
accatgctcaagtcgcccaacagaa

SEQ ID NO: 157761 - DNA, 25 bp, Homo sapien
aagtcgcccaacagaaccacggcgg

SEQ ID NO: 157762 - DNA, 25 bp, Homo sapien
ccaacagaaccacggcggtgaagca

SEQ ID NO: 157763 - DNA, 25 bp, Homo sapien
agcagtgggagcagcgctggatcaa

SEQ ID NO: 157764 - DNA, 25 bp, Homo sapien
agcagagcttctgaggaagcccctg

SEQ ID NO: 157765 - DNA, 25 bp, Homo sapien
tgaggaagcccctgcctttgtccag

SEQ ID NO: 157766 - DNA, 25 bp, Homo sapien
aagcccctgcctttgtccagctggg

SEQ ID NO: 157767 - DNA, 25 bp, Homo sapien
gatgcatttttgagtttgtattagt

SEQ ID NO: 157768 - DNA, 25 bp, Homo sapien
caagattgtatgaaccgcatggtgc

SEQ ID NO: 157769 - DNA, 25 bp, Homo sapien
gaaccgcatggtgcttgcagtttta

SEQ ID NO: 157770 - DNA, 25 bp, Homo sapien
attgtggatatttgtcctgcatcag

SEQ ID NO: 157771 - DNA, 25 bp, Homo sapien
gtcctgcatcagaaacgagctttgg

SEQ ID NO: 157772 - DNA, 25 bp, Homo sapien
ggtttttacagattcaactgtgttg

SEQ ID NO: 157773 - DNA, 25 bp, Homo sapien
tgtgttgaaatcaaacctgccgcaa

SEQ ID NO: 157774 - DNA, 25 bp, Homo sapien
acctgccgcaacagaaattgttttt

SEQ ID NO: 157775 - DNA, 25 bp, Homo sapien
atttcaaaccctgcttatgatatga

SEQ ID NO: 157776 - DNA, 25 bp, Homo sapien
acctagtctattgtagttttattca

SEQ ID NO: 157777 - DNA, 25 bp, Homo sapien
gttttattcagactggtttctgttt

SEQ ID NO: 157778 - DNA, 25 bp, Homo sapien
aggctgtgcttatctcagagggtct

SEQ ID NO: 157779 - DNA, 25 bp, Homo sapien
tgggcctctttgctcgagacccacg

SEQ ID NO: 157780 - DNA, 25 bp, Homo sapien
ttgctcgagacccacgtttcgtggc

SEQ ID NO: 157781 - DNA, 25 bp, Homo sapien
gagattgcagatgcgtgtcgcctga

SEQ ID NO: 157782 - DNA, 25 bp, Homo sapien
cctgacgctggatgagatggacaat

SEQ ID NO: 157783 - DNA, 25 bp, Homo sapien
ctggatgagatggacaatgctgcca

SEQ ID NO: 157784 - DNA, 25 bp, Homo sapien
aatgctgccagtgacctgctggcac

SEQ ID NO: 157785 - DNA, 25 bp, Homo sapien
agggaaccagctctctctatagcga

SEQ ID NO: 157786 - DNA, 25 bp, Homo sapien
tctatagcgacgaggagtccatcct

SEQ ID NO: 157787 - DNA, 25 bp, Homo sapien
atcctctcccgcttcgatgaggagg

SEQ ID NO: 157788 - DNA, 25 bp, Homo sapien
agacgagatggcctgcgtccacgcc

SEQ ID NO: 157789 - DNA, 25 bp, Homo sapien
ttggccagcgctgccaaaggaggcc

SEQ ID NO: 157790 - DNA, 25 bp, Homo sapien
cagcgctgccaaaggaggccacgga

SEQ ID NO: 157791 - DNA, 25 bp, Homo sapien
aggagcaggagctcgtacctggcgt

SEQ ID NO: 157792 - DNA, 25 bp, Homo sapien
gtacctggcgtctgctgaccttcgt

SEQ ID NO: 157793 - DNA, 25 bp, Homo sapien
gggacggcaaccacactctgttcca

SEQ ID NO: 157794 - DNA, 25 bp, Homo sapien
gcaaccacactctgttccacaatag

SEQ ID NO: 157795 - DNA, 25 bp, Homo sapien
actctgttccacaatagccacgtga

SEQ ID NO: 157796 - DNA, 25 bp, Homo sapien
ctgttccacaatagccacgtgaacc

SEQ ID NO: 157797 - DNA, 25 bp, Homo sapien
gcaccatcatggctttgcctctgag

SEQ ID NO: 157798 - DNA, 25 bp, Homo sapien
accatcatggctttgcctctgaggc

SEQ ID NO: 157799 - DNA, 25 bp, Homo sapien
catggctttgcctctgaggcccctg

SEQ ID NO: 157800 - DNA, 25 bp, Homo sapien
gcataaaaacctccagtactttggt

SEQ ID NO: 157801 - DNA, 25 bp, Homo sapien
cctccagtactttggttgacccttg

SEQ ID NO: 157802 - DNA, 25 bp, Homo sapien
ctccagtactttggttgacccttgt

SEQ ID NO: 157803 - DNA, 25 bp, Homo sapien
tactttggttgacccttgtatgtca

SEQ ID NO: 157804 - DNA, 25 bp, Homo sapien
ggttgacccttgtatgtcacagctc

SEQ ID NO: 157805 - DNA, 25 bp, Homo sapien
gttgacccttgtatgtcacagctct

SEQ ID NO: 157806 - DNA, 25 bp, Homo sapien
ttgacccttgtatgtcacagctctg

SEQ ID NO: 157807 - DNA, 25 bp, Homo sapien
caaaataaccattttaacatttgat

SEQ ID NO: 157808 - DNA, 25 bp, Homo sapien
agaaaaatatccattttattaccat

SEQ ID NO: 157809 - DNA, 25 bp, Homo sapien
gaaaaatatccattttattaccatt

SEQ ID NO: 157810 - DNA, 25 bp, Homo sapien
gccaggcgtttttaccccagtggag

SEQ ID NO: 157811 - DNA, 25 bp, Homo sapien
ggtacctagtcaccaggatctccag

SEQ ID NO: 157812 - DNA, 25 bp, Homo sapien
gagcagagtcttctcatcgtttcac

SEQ ID NO: 157813 - DNA, 25 bp, Homo sapien
gtcttctcatcgtttcactggagga

SEQ ID NO: 157814 - DNA, 25 bp, Homo sapien
gtttcactggaggacaggtggctat

SEQ ID NO: 157815 - DNA, 25 bp, Homo sapien
cagctacgcacctggagatcctgaa

SEQ ID NO: 157816 - DNA, 25 bp, Homo sapien
gagatcctgaactgtcaagccactg

SEQ ID NO: 157817 - DNA, 25 bp, Homo sapien
aactgtcaagccactggcagcctca

SEQ ID NO: 157818 - DNA, 25 bp, Homo sapien
tcatgccaccacattcgccagaaat

SEQ ID NO: 157819 - DNA, 25 bp, Homo sapien
ttcgccagaaatgcagttgccctgt

SEQ ID NO: 157820 - DNA, 25 bp, Homo sapien
ccagaaatgcagttgccctgtccct

SEQ ID NO: 157821 - DNA, 25 bp, Homo sapien
ctgttcctggtttaaagcctttcag

SEQ ID NO: 157822 - DNA, 25 bp, Homo sapien
gggtttgtctttgatggtttctatc

SEQ ID NO: 157823 - DNA, 25 bp, Homo sapien
ggtttctatctgcaattatcgtcat

SEQ ID NO: 157824 - DNA, 25 bp, Homo sapien
tgttatagaaaacccacacccactg

SEQ ID NO: 157825 - DNA, 25 bp, Homo sapien
cacacccactgtcctgtaaactttt

SEQ ID NO: 157826 - DNA, 25 bp, Homo sapien
gtaaacttttctcagtgtccagact

SEQ ID NO: 157827 - DNA, 25 bp, Homo sapien
gtgtccagactttctgtaatcacat

SEQ ID NO: 157828 - DNA, 25 bp, Homo sapien
cattttaattgccacctcgtatttc

SEQ ID NO: 157829 - DNA, 25 bp, Homo sapien
cctcgtatttcacctctacatttga

SEQ ID NO: 157830 - DNA, 25 bp, Homo sapien
ctacatttgaaatctggcgtctgtt

SEQ ID NO: 157831 - DNA, 25 bp, Homo sapien
gcgtctgtttcaagccagtgtgttt

SEQ ID NO: 157832 - DNA, 25 bp, Homo sapien
gcacacgcgcgtactgcacgagtgt

SEQ ID NO: 157833 - DNA, 25 bp, Homo sapien
cgcgcgtactgcacgagtgtctgtg

SEQ ID NO: 157834 - DNA, 25 bp, Homo sapien
tggagccggaagacccggcccacaa

SEQ ID NO: 157835 - DNA, 25 bp, Homo sapien
cacgacctcgtctacttcgagaaat

SEQ ID NO: 157836 - DNA, 25 bp, Homo sapien
gtctacttcgagaaatcgcccaact

SEQ ID NO: 157837 - DNA, 25 bp, Homo sapien
agaaatcgcccaacttctgcacgta

SEQ ID NO: 157838 - DNA, 25 bp, Homo sapien
gcccaacttctgcacgtacagcgga

SEQ ID NO: 157839 - DNA, 25 bp, Homo sapien
ttctgcacgtacagcggacgcctgg

SEQ ID NO: 157840 - DNA, 25 bp, Homo sapien
cacgtacagcggacgcctgggcaca

SEQ ID NO: 157841 - DNA, 25 bp, Homo sapien
agggcgcgcctgtaacagctcgtcg

SEQ ID NO: 157842 - DNA, 25 bp, Homo sapien
ctggacggctgcgagctgctctgct

SEQ ID NO: 157843 - DNA, 25 bp, Homo sapien
aattccaggattgccacagattaca

SEQ ID NO: 157844 - DNA, 25 bp, Homo sapien
acagattacacaaaagagcccaaag

SEQ ID NO: 157845 - DNA, 25 bp, Homo sapien
gaacagatcatttcagtgggaccta

SEQ ID NO: 157846 - DNA, 25 bp, Homo sapien
catttcagtgggacctattaggaga

SEQ ID NO: 157847 - DNA, 25 bp, Homo sapien
tctgcagctgtgtaacaggaaccct

SEQ ID NO: 157848 - DNA, 25 bp, Homo sapien
gagctgcagagcctctaattcttca

SEQ ID NO: 157849 - DNA, 25 bp, Homo sapien
gagcctctaattcttcaatggaact

SEQ ID NO: 157850 - DNA, 25 bp, Homo sapien
ggaacttcaagtctggacgcttctt

SEQ ID NO: 157851 - DNA, 25 bp, Homo sapien
ggacgcttcttctcatcatgatcca

SEQ ID NO: 157852 - DNA, 25 bp, Homo sapien
cagatttcattatggcattttgtct

SEQ ID NO: 157853 - DNA, 25 bp, Homo sapien
gtctataaatcaggcacgacctcat

SEQ ID NO: 157854 - DNA, 25 bp, Homo sapien
gctgtcagcatcttgaaagctttca

SEQ ID NO: 157855 - DNA, 25 bp, Homo sapien
aagctttcatgacgaagaatcccca

SEQ ID NO: 157856 - DNA, 25 bp, Homo sapien
aagaatccccacaagcgcctgggct

SEQ ID NO: 157857 - DNA, 25 bp, Homo sapien
gcatcgcagaatggcgaggacgcca

SEQ ID NO: 157858 - DNA, 25 bp, Homo sapien
gaggacgccatcaagcagcacccat

SEQ ID NO: 157859 - DNA, 25 bp, Homo sapien
gcagcacccattcttcaaagagatt

SEQ ID NO: 157860 - DNA, 25 bp, Homo sapien
aagagattgactgggtgctcctgga

SEQ ID NO: 157861 - DNA, 25 bp, Homo sapien
tcaaaccacgcattaaaaccaaaag

SEQ ID NO: 157862 - DNA, 25 bp, Homo sapien
gggaagagccggtactcacccttgt

SEQ ID NO: 157863 - DNA, 25 bp, Homo sapien
gtactcacccttgtggacgaagcaa

SEQ ID NO: 157864 - DNA, 25 bp, Homo sapien
gaggaattcaaaggtttctcctact

SEQ ID NO: 157865 - DNA, 25 bp, Homo sapien
tcatggaaccctccttgcctggtgt

SEQ ID NO: 157866 - DNA, 25 bp, Homo sapien
gtgtccctgactcagggtggtccca

SEQ ID NO: 157867 - DNA, 25 bp, Homo sapien
aggcctggcacctactctttagaga

SEQ ID NO: 157868 - DNA, 25 bp, Homo sapien
tactctttagagagccccagcatct

SEQ ID NO: 157869 - DNA, 25 bp, Homo sapien
gagccccagcatctttgatgtggat

SEQ ID NO: 157870 - DNA, 25 bp, Homo sapien
tgtggattggagacaattgcctggt

SEQ ID NO: 157871 - DNA, 25 bp, Homo sapien
gacttggtgccacaaagaatgccac

SEQ ID NO: 157872 - DNA, 25 bp, Homo sapien
aatgccacagtggatacgccagcag

SEQ ID NO: 157873 - DNA, 25 bp, Homo sapien
gatacgccagcaggccacatggctg

SEQ ID NO: 157874 - DNA, 25 bp, Homo sapien
acatggctggccaagcaattattat

SEQ ID NO: 157875 - DNA, 25 bp, Homo sapien
tattattatggatcccttgggctgt

SEQ ID NO: 157876 - DNA, 25 bp, Homo sapien
tccaggaccaattggagttccaggc

SEQ ID NO: 157877 - DNA, 25 bp, Homo sapien
gagttccaggcccagcgggaccaaa

SEQ ID NO: 157878 - DNA, 25 bp, Homo sapien
gcagcaaaggagaccctgggatgac

SEQ ID NO: 157879 - DNA, 25 bp, Homo sapien
gagaccctgggatgacaggaccaac

SEQ ID NO: 157880 - DNA, 25 bp, Homo sapien
gatgacaggaccaacgggagcagct

SEQ ID NO: 157881 - DNA, 25 bp, Homo sapien
accaacgggagcagctgggcttcct

SEQ ID NO: 157882 - DNA, 25 bp, Homo sapien
ttcctggtttacatggaccacccgg

SEQ ID NO: 157883 - DNA, 25 bp, Homo sapien
gaagaaaggctctagagggcctaaa

SEQ ID NO: 157884 - DNA, 25 bp, Homo sapien
aaggagcgcctggattagatgcccc

SEQ ID NO: 157885 - DNA, 25 bp, Homo sapien
gcccattgggccaagatggctaccc

SEQ ID NO: 157886 - DNA, 25 bp, Homo sapien
gccaagatggctacccagtccaagg

SEQ ID NO: 157887 - DNA, 25 bp, Homo sapien
gaggagaccggcatctgcgtggtgc

SEQ ID NO: 157888 - DNA, 25 bp, Homo sapien
tggtgccagggagcggctttgggca

SEQ ID NO: 157889 - DNA, 25 bp, Homo sapien
taccacttccggatgaccattctgc

SEQ ID NO: 157890 - DNA, 25 bp, Homo sapien
ccccttggagaaactgcggctgctg

SEQ ID NO: 157891 - DNA, 25 bp, Homo sapien
aagctgagcaggttccatgccaagt

SEQ ID NO: 157892 - DNA, 25 bp, Homo sapien
catgccaagttcaccctcgagtact

SEQ ID NO: 157893 - DNA, 25 bp, Homo sapien
aagttcaccctcgagtactcctgag

SEQ ID NO: 157894 - DNA, 25 bp, Homo sapien
tgggtcgccctggactgtgtgctca

SEQ ID NO: 157895 - DNA, 25 bp, Homo sapien
ggctctggagcccactgtacttgct

SEQ ID NO: 157896 - DNA, 25 bp, Homo sapien
gagcccactgtacttgctcttgatg

SEQ ID NO: 157897 - DNA, 25 bp, Homo sapien
gtacttgctcttgatgcctggcggg

SEQ ID NO: 157898 - DNA, 25 bp, Homo sapien
gtagtgaagtgatttttaccacctg

SEQ ID NO: 157899 - DNA, 25 bp, Homo sapien
aagtgatttttaccacctgtgtttg

SEQ ID NO: 157900 - DNA, 25 bp, Homo sapien
atatttatatatgctgtggatgaaa

SEQ ID NO: 157901 - DNA, 25 bp, Homo sapien
aatgtgtatctgttgggatataatc

SEQ ID NO: 157902 - DNA, 25 bp, Homo sapien
aagagtccatgttttgtgacaacca

SEQ ID NO: 157903 - DNA, 25 bp, Homo sapien
gtgacaaccatctctaatagccaac

SEQ ID NO: 157904 - DNA, 25 bp, Homo sapien
ccatctctaatagccaactctttat

SEQ ID NO: 157905 - DNA, 25 bp, Homo sapien
ggaaccatgacgattgtagatattt

SEQ ID NO: 157906 - DNA, 25 bp, Homo sapien
ttgtacagtatagaaacctccgatt

SEQ ID NO: 157907 - DNA, 25 bp, Homo sapien
tagaaacctccgatttttgccttcg

SEQ ID NO: 157908 - DNA, 25 bp, Homo sapien
cctccgatttttgccttcgaatgca

SEQ ID NO: 157909 - DNA, 25 bp, Homo sapien
tgattgtaccaattttagaagagga

SEQ ID NO: 157910 - DNA, 25 bp, Homo sapien
tatcattttagacacatcaatcatg

SEQ ID NO: 157911 - DNA, 25 bp, Homo sapien
gacacatcaatcatgtatccatatt

SEQ ID NO: 157912 - DNA, 25 bp, Homo sapien
catgtatccatattatagcttcttt

SEQ ID NO: 157913 - DNA, 25 bp, Homo sapien
atagcttctttgtttagtataggtt

SEQ ID NO: 157914 - DNA, 25 bp, Homo sapien
gtttagtataggtttttgtatgctg

SEQ ID NO: 157915 - DNA, 25 bp, Homo sapien
ttgtatgctgggtttgccttttaaa

SEQ ID NO: 157916 - DNA, 25 bp, Homo sapien
gttattcataagctgtatattcacc

SEQ ID NO: 157917 - DNA, 25 bp, Homo sapien
agctgtatattcaccagtgtggcac

SEQ ID NO: 157918 - DNA, 25 bp, Homo sapien
tattcaccagtgtggcactcatggt

SEQ ID NO: 157919 - DNA, 25 bp, Homo sapien
cagtgtggcactcatggtttttaaa

SEQ ID NO: 157920 - DNA, 25 bp, Homo sapien
accccatgcccaatcagggtgcaag

SEQ ID NO: 157921 - DNA, 25 bp, Homo sapien
tgcccaatcagggtgcaaggagcaa

SEQ ID NO: 157922 - DNA, 25 bp, Homo sapien
caatcagggtgcaaggagcaaggac

SEQ ID NO: 157923 - DNA, 25 bp, Homo sapien
gggccaaggtcgctcatggtcactc

SEQ ID NO: 157924 - DNA, 25 bp, Homo sapien
caaggtcgctcatggtcactccctg

SEQ ID NO: 157925 - DNA, 25 bp, Homo sapien
acaacctgccagactaggctatcgg

SEQ ID NO: 157926 - DNA, 25 bp, Homo sapien
tgccagactaggctatcggtgctgc

SEQ ID NO: 157927 - DNA, 25 bp, Homo sapien
agactaggctatcggtgctgcttct

SEQ ID NO: 157928 - DNA, 25 bp, Homo sapien
actaggctatcggtgctgcttctgc

SEQ ID NO: 157929 - DNA, 25 bp, Homo sapien
taggctatcggtgctgcttctgccc

SEQ ID NO: 157930 - DNA, 25 bp, Homo sapien
ctgcaccccagaaaacctctttgtt

SEQ ID NO: 157931 - DNA, 25 bp, Homo sapien
aaactgtatgtacctccctcacttc

SEQ ID NO: 157932 - DNA, 25 bp, Homo sapien
tatcactgctttcctactctccttt

SEQ ID NO: 157933 - DNA, 25 bp, Homo sapien
tactctccttttatctcactctagt

SEQ ID NO: 157934 - DNA, 25 bp, Homo sapien
ttttatctcactctagtccaggtgc

SEQ ID NO: 157935 - DNA, 25 bp, Homo sapien
tcactctagtccaggtgccaagaat

SEQ ID NO: 157936 - DNA, 25 bp, Homo sapien
tctagtccaggtgccaagaatttcc

SEQ ID NO: 157937 - DNA, 25 bp, Homo sapien
caagaatttcccttctaccctctat

SEQ ID NO: 157938 - DNA, 25 bp, Homo sapien
ccctctattctcttgtgtctgtaag

SEQ ID NO: 157939 - DNA, 25 bp, Homo sapien
tggacccctttcctgctgggtggat

SEQ ID NO: 157940 - DNA, 25 bp, Homo sapien
acttcccacctctctgaatagtgtg

SEQ ID NO: 157941 - DNA, 25 bp, Homo sapien
acctctctgaatagtgtgtatgtgt

SEQ ID NO: 157942 - DNA, 25 bp, Homo sapien
agttcactgccatgttccgccggaa

SEQ ID NO: 157943 - DNA, 25 bp, Homo sapien
tcactgccatgttccgccggaaggc

SEQ ID NO: 157944 - DNA, 25 bp, Homo sapien
aacatgaacgacctcgtctctgagt

SEQ ID NO: 157945 - DNA, 25 bp, Homo sapien
gaacgacctcgtctctgagtatcag

SEQ ID NO: 157946 - DNA, 25 bp, Homo sapien
acctcgtctctgagtatcagcagta

SEQ ID NO: 157947 - DNA, 25 bp, Homo sapien
aggatgccaccgcagaagaggagga

SEQ ID NO: 157948 - DNA, 25 bp, Homo sapien
acctcaggcttctcagttcccttag

SEQ ID NO: 157949 - DNA, 25 bp, Homo sapien
ttctcagttcccttagccgtcttac

SEQ ID NO: 157950 - DNA, 25 bp, Homo sapien
ttcccttagccgtcttactcaactg

SEQ ID NO: 157951 - DNA, 25 bp, Homo sapien
tttcctctccctcagaatttgtgtt

SEQ ID NO: 157952 - DNA, 25 bp, Homo sapien
ctctccctcagaatttgtgtttgct

SEQ ID NO: 157953 - DNA, 25 bp, Homo sapien
agtctgacccttacagcctctgact

SEQ ID NO: 157954 - DNA, 25 bp, Homo sapien
ttacagcctctgacttaagctgcct

SEQ ID NO: 157955 - DNA, 25 bp, Homo sapien
gacttaagctgcctcaaggaatttt

SEQ ID NO: 157956 - DNA, 25 bp, Homo sapien
ttcccatgctttgtaggtgtctcat

SEQ ID NO: 157957 - DNA, 25 bp, Homo sapien
aggtgtctcatagctatcctgggca

SEQ ID NO: 157958 - DNA, 25 bp, Homo sapien
tctcatagctatcctgggcatcctt

SEQ ID NO: 157959 - DNA, 25 bp, Homo sapien
cctgggcatccttctttctagttca

SEQ ID NO: 157960 - DNA, 25 bp, Homo sapien
tttctagttcagctgccccacaggt

SEQ ID NO: 157961 - DNA, 25 bp, Homo sapien
gttcagctgccccacaggtgtgttt

SEQ ID NO: 157962 - DNA, 25 bp, Homo sapien
acaggtgtgtttcccatcccactgc

SEQ ID NO: 157963 - DNA, 25 bp, Homo sapien
actaacatgccctgttcagctactc

SEQ ID NO: 157964 - DNA, 25 bp, Homo sapien
gggagagcctcaaatcgtgtttaac

SEQ ID NO: 157965 - DNA, 25 bp, Homo sapien
aaatcgtgtttaaccgccatccact

SEQ ID NO: 157966 - DNA, 25 bp, Homo sapien
tccacgaggctcgtctggacgatga

SEQ ID NO: 157967 - DNA, 25 bp, Homo sapien
tctggacgatgagtgtgccttttac

SEQ ID NO: 157968 - DNA, 25 bp, Homo sapien
tctgcaccaaccctgtggctacatt

SEQ ID NO: 157969 - DNA, 25 bp, Homo sapien
ggctacattactcgaatggcaggat

SEQ ID NO: 157970 - DNA, 25 bp, Homo sapien
aggatgccctgtgtttcattccagt

SEQ ID NO: 157971 - DNA, 25 bp, Homo sapien
gtttcattccagttggttctgctgc

SEQ ID NO: 157972 - DNA, 25 bp, Homo sapien
gggctctccatgatgagacaaccac

SEQ ID NO: 157973 - DNA, 25 bp, Homo sapien
tccttttagcccttatttattgtcg

SEQ ID NO: 157974 - DNA, 25 bp, Homo sapien
atttattgtcggtctgcccatggga

SEQ ID NO: 157975 - DNA, 25 bp, Homo sapien
ggtagagaactacaacccgcggcag

SEQ ID NO: 157976 - DNA, 25 bp, Homo sapien
agagaactacaacccgcggcagcgc

SEQ ID NO: 157977 - DNA, 25 bp, Homo sapien
cgcaacctgatcatcgaggacgaga

SEQ ID NO: 157978 - DNA, 25 bp, Homo sapien
tggtggcgctgcagccgcctgcaga

SEQ ID NO: 157979 - DNA, 25 bp, Homo sapien
tccccggccagagactgtgtgcaga

SEQ ID NO: 157980 - DNA, 25 bp, Homo sapien
gtgcagaggagagcttcaccggccc

SEQ ID NO: 157981 - DNA, 25 bp, Homo sapien
cagaggagagcttcaccggcccagg

SEQ ID NO: 157982 - DNA, 25 bp, Homo sapien
tcatcacagctgctgtccccgagga

SEQ ID NO: 157983 - DNA, 25 bp, Homo sapien
tgctgtccccgaggactgtgacaca

SEQ ID NO: 157984 - DNA, 25 bp, Homo sapien
gtccccgaggactgtgacacatagc

SEQ ID NO: 157985 - DNA, 25 bp, Homo sapien
acatagcccattctggccaccagag

SEQ ID NO: 157986 - DNA, 25 bp, Homo sapien
agttcttcatgtagcactgcttttg

SEQ ID NO: 157987 - DNA, 25 bp, Homo sapien
gcttttggacagtgacccatgatat

SEQ ID NO: 157988 - DNA, 25 bp, Homo sapien
tgacccatgatatctgccttcgttt

SEQ ID NO: 157989 - DNA, 25 bp, Homo sapien
tcgtttgcccctctgactgttggaa

SEQ ID NO: 157990 - DNA, 25 bp, Homo sapien
tgactgttggaatcccacgcaccat

SEQ ID NO: 157991 - DNA, 25 bp, Homo sapien
cacgcaccattcagtaggattcaat

SEQ ID NO: 157992 - DNA, 25 bp, Homo sapien
gtggaaccattcaacattcacctca

SEQ ID NO: 157993 - DNA, 25 bp, Homo sapien
attcaacattcacctcattaaccta

SEQ ID NO: 157994 - DNA, 25 bp, Homo sapien
cctaacctcacttcaaatgtctgga

SEQ ID NO: 157995 - DNA, 25 bp, Homo sapien
gtagtgcttttgttaaagcccctat

SEQ ID NO: 157996 - DNA, 25 bp, Homo sapien
aaagcccctatatgggcagcatgga

SEQ ID NO: 157997 - DNA, 25 bp, Homo sapien
tcctcctgaccgagtgggccggcag

SEQ ID NO: 157998 - DNA, 25 bp, Homo sapien
tcctgaccgagtgggccggcaggag

SEQ ID NO: 157999 - DNA, 25 bp, Homo sapien
attttattatcttgtccaggacctg

SEQ ID NO: 158000 - DNA, 25 bp, Homo sapien
ttttattatcttgtccaggacctga

SEQ ID NO: 158001 - DNA, 25 bp, Homo sapien
ttattatcttgtccaggacctgaag

SEQ ID NO: 158002 - DNA, 25 bp, Homo sapien
attatcttgtccaggacctgaagtg

SEQ ID NO: 158003 - DNA, 25 bp, Homo sapien
tatcttgtccaggacctgaagtgtt

SEQ ID NO: 158004 - DNA, 25 bp, Homo sapien
gaaaattttgtgtatatcagggcag

SEQ ID NO: 158005 - DNA, 25 bp, Homo sapien
aattttgtgtatatcagggcagtat

SEQ ID NO: 158006 - DNA, 25 bp, Homo sapien
ttgtgtatatcagggcagtattttt

SEQ ID NO: 158007 - DNA, 25 bp, Homo sapien
atcagggcagtatttttttatgaac

SEQ ID NO: 158008 - DNA, 25 bp, Homo sapien
gatggtttcaattcagattgtcttg

SEQ ID NO: 158009 - DNA, 25 bp, Homo sapien
agattgtcttgcaacttcagtttta

SEQ ID NO: 158010 - DNA, 25 bp, Homo sapien
tgtgtgtatattgagaatcccttaa

SEQ ID NO: 158011 - DNA, 25 bp, Homo sapien
gagaatcccttaaaattaccagaca

SEQ ID NO: 158012 - DNA, 25 bp, Homo sapien
ttacgtttgttattcctagtggatg

SEQ ID NO: 158013 - DNA, 25 bp, Homo sapien
tgttattcctagtggatgactgttg

SEQ ID NO: 158014 - DNA, 25 bp, Homo sapien
gatgaagtatacttttcccctgtta

SEQ ID NO: 158015 - DNA, 25 bp, Homo sapien
aaacagtagttgtattcttctgtat

SEQ ID NO: 158016 - DNA, 25 bp, Homo sapien
gtatttctaggcacaaggttggttg

SEQ ID NO: 158017 - DNA, 25 bp, Homo sapien
aaggttggttgctaagaagcctata

SEQ ID NO: 158018 - DNA, 25 bp, Homo sapien
ggaatttcttttccttcattcatag

SEQ ID NO: 158019 - DNA, 25 bp, Homo sapien
ggatgagattgatgcagcccttgat

SEQ ID NO: 158020 - DNA, 25 bp, Homo sapien
attgatgcagcccttgattttaaaa

SEQ ID NO: 158021 - DNA, 25 bp, Homo sapien
acagttcataataatttctcttcga

SEQ ID NO: 158022 - DNA, 25 bp, Homo sapien
aatatgtttgagatttcggatagac

SEQ ID NO: 158023 - DNA, 25 bp, Homo sapien
tcggatagacttattggaatttaca

SEQ ID NO: 158024 - DNA, 25 bp, Homo sapien
tggaatttacaagacatacaacata

SEQ ID NO: 158025 - DNA, 25 bp, Homo sapien
aaagtgttgctgtaaatccaaaaga

SEQ ID NO: 158026 - DNA, 25 bp, Homo sapien
agaaattgcatctaagggactttgt

SEQ ID NO: 158027 - DNA, 25 bp, Homo sapien
tctaagggactttgttgaactttat

SEQ ID NO: 158028 - DNA, 25 bp, Homo sapien
gaactttatgctgaagattcttcaa

SEQ ID NO: 158029 - DNA, 25 bp, Homo sapien
ttcaagttgattcagtgtattactg

SEQ ID NO: 158030 - DNA, 25 bp, Homo sapien
ttgatgctcttggaacggacctttc

SEQ ID NO: 158031 - DNA, 25 bp, Homo sapien
gctcttggaacggacctttctgaac

SEQ ID NO: 158032 - DNA, 25 bp, Homo sapien
gaaccctagagccttcccagaggaa

SEQ ID NO: 158033 - DNA, 25 bp, Homo sapien
gaggaacgctactacagccatgtgc

SEQ ID NO: 158034 - DNA, 25 bp, Homo sapien
tacagccatgtgctctgggcacctt

SEQ ID NO: 158035 - DNA, 25 bp, Homo sapien
acgggctccgtagtcacattccggg

SEQ ID NO: 158036 - DNA, 25 bp, Homo sapien
gggctatccaatgcctgctccaggg

SEQ ID NO: 158037 - DNA, 25 bp, Homo sapien
aatgcctgctccagggccagggaca

SEQ ID NO: 158038 - DNA, 25 bp, Homo sapien
gatctgaagcttgggctgaggtcca

SEQ ID NO: 158039 - DNA, 25 bp, Homo sapien
agctcagcattgtggtgacagccct

SEQ ID NO: 158040 - DNA, 25 bp, Homo sapien
tgaggcctgtggctgacctctgacc

SEQ ID NO: 158041 - DNA, 25 bp, Homo sapien
gaggagaccggcatctgcgtggtgc

SEQ ID NO: 158042 - DNA, 25 bp, Homo sapien
tggtgccagggagcggctttgggca

SEQ ID NO: 158043 - DNA, 25 bp, Homo sapien
taccacttccggatgaccattctgc

SEQ ID NO: 158044 - DNA, 25 bp, Homo sapien
attctgccccccttggagaaactgc

SEQ ID NO: 158045 - DNA, 25 bp, Homo sapien
catgccaagttcaccctcgagtact

SEQ ID NO: 158046 - DNA, 25 bp, Homo sapien
aagttcaccctcgagtactcctgag

SEQ ID NO: 158047 - DNA, 25 bp, Homo sapien
tgggtcgccctggactgtgtgctca

SEQ ID NO: 158048 - DNA, 25 bp, Homo sapien
ggctctggagcccactgtacttgct

SEQ ID NO: 158049 - DNA, 25 bp, Homo sapien
gagcccactgtacttgctcttgatg

SEQ ID NO: 158050 - DNA, 25 bp, Homo sapien
actgtacttgctcttgatgcctggc

SEQ ID NO: 158051 - DNA, 25 bp, Homo sapien
gtacttgctcttgatgcctggcggg

SEQ ID NO: 158052 - DNA, 25 bp, Homo sapien
cagaaagctttggtcattgcccaga

SEQ ID NO: 158053 - DNA, 25 bp, Homo sapien
gtcattgcccagaacaacatcgaga

SEQ ID NO: 158054 - DNA, 25 bp, Homo sapien
catcctccgggaatttgtttccatt

SEQ ID NO: 158055 - DNA, 25 bp, Homo sapien
atgtagctacctagcacaccatctc

SEQ ID NO: 158056 - DNA, 25 bp, Homo sapien
tccctgctgcaggtttagaggacca

SEQ ID NO: 158057 - DNA, 25 bp, Homo sapien
gagttattactcaagtggcacctag

SEQ ID NO: 158058 - DNA, 25 bp, Homo sapien
tggcacctagaagggcaggagttcc

SEQ ID NO: 158059 - DNA, 25 bp, Homo sapien
aggagttcctttggtgacttcacag

SEQ ID NO: 158060 - DNA, 25 bp, Homo sapien
ttcacagtgaagtcttgccctctct

SEQ ID NO: 158061 - DNA, 25 bp, Homo sapien
ttgccctctctgtgggatatcacat

SEQ ID NO: 158062 - DNA, 25 bp, Homo sapien
gatatcacatcagtggttccaagat

SEQ ID NO: 158063 - DNA, 25 bp, Homo sapien
tggacaaggcccagcgctctgtcat

SEQ ID NO: 158064 - DNA, 25 bp, Homo sapien
agcgctctgtcatcaagcccatcag

SEQ ID NO: 158065 - DNA, 25 bp, Homo sapien
tcatcaagcccatcagcattgctgg

SEQ ID NO: 158066 - DNA, 25 bp, Homo sapien
gcttctacggtgaggagcccctgca

SEQ ID NO: 158067 - DNA, 25 bp, Homo sapien
atcgtggtgacctccacacctgctg

SEQ ID NO: 158068 - DNA, 25 bp, Homo sapien
tcttcacctatcctagcgtcctgga

SEQ ID NO: 158069 - DNA, 25 bp, Homo sapien
ctatcctagcgtcctggagcaggag

SEQ ID NO: 158070 - DNA, 25 bp, Homo sapien
cctagcgtcctggagcaggagtcac

SEQ ID NO: 158071 - DNA, 25 bp, Homo sapien
tgctccaaggctcaccgcagaagca

SEQ ID NO: 158072 - DNA, 25 bp, Homo sapien
aaggctcaccgcagaagcagtagca

SEQ ID NO: 158073 - DNA, 25 bp, Homo sapien
accaatcatcagactccttgaactc

SEQ ID NO: 158074 - DNA, 25 bp, Homo sapien
ggaccgcagtcagggtcacctggac

SEQ ID NO: 158075 - DNA, 25 bp, Homo sapien
gaccatggtgaacatgtgacctgca

SEQ ID NO: 158076 - DNA, 25 bp, Homo sapien
atgtgacctgcagatctggcatcag

SEQ ID NO: 158077 - DNA, 25 bp, Homo sapien
acctgcagatctggcatcagaggcc

SEQ ID NO: 158078 - DNA, 25 bp, Homo sapien
ggccagagttcaaatgtgactccac

SEQ ID NO: 158079 - DNA, 25 bp, Homo sapien
tgactccacctcttaaaagccgtga

SEQ ID NO: 158080 - DNA, 25 bp, Homo sapien
taaaagccgtgatttctagcagttg

SEQ ID NO: 158081 - DNA, 25 bp, Homo sapien
atttctagcagttgacttcacctct

SEQ ID NO: 158082 - DNA, 25 bp, Homo sapien
tagcagttgacttcacctctgtgtc

SEQ ID NO: 158083 - DNA, 25 bp, Homo sapien
tcacctctgtgtcggcctttaacaa

SEQ ID NO: 158084 - DNA, 25 bp, Homo sapien
ttaacaaaatcatagccatacagca

SEQ ID NO: 158085 - DNA, 25 bp, Homo sapien
gagagagccgaactggcagcttcct

SEQ ID NO: 158086 - DNA, 25 bp, Homo sapien
gaactggcagcttccttaggactga

SEQ ID NO: 158087 - DNA, 25 bp, Homo sapien
gcttccttaggactgacacaaacac

SEQ ID NO: 158088 - DNA, 25 bp, Homo sapien
actgctgaagcagggcagtaatcct

SEQ ID NO: 158089 - DNA, 25 bp, Homo sapien
cagtaatcctcatgagagcgacccc

SEQ ID NO: 158090 - DNA, 25 bp, Homo sapien
tccagtctgggacgtttctgcctcg

SEQ ID NO: 158091 - DNA, 25 bp, Homo sapien
tgcctcggccaagggtgtcagtatg

SEQ ID NO: 158092 - DNA, 25 bp, Homo sapien
cccaacagctacatgcctggctatt

SEQ ID NO: 158093 - DNA, 25 bp, Homo sapien
atgcctggctattctcactggtact

SEQ ID NO: 158094 - DNA, 25 bp, Homo sapien
tccacaccaggacacgatgcagaga

SEQ ID NO: 158095 - DNA, 25 bp, Homo sapien
acgatgcagagaccacagatgatgt

SEQ ID NO: 158096 - DNA, 25 bp, Homo sapien
gggcgacactaaaagcctgttgttc

SEQ ID NO: 158097 - DNA, 25 bp, Homo sapien
gacactaaaagcctgttgttcccat

SEQ ID NO: 158098 - DNA, 25 bp, Homo sapien
actaaaagcctgttgttcccatctg

SEQ ID NO: 158099 - DNA, 25 bp, Homo sapien
aaaagcctgttgttcccatctgcgc

SEQ ID NO: 158100 - DNA, 25 bp, Homo sapien
atctgcgccggcctccgtcatgaat

SEQ ID NO: 158101 - DNA, 25 bp, Homo sapien
gcctccgtcatgaatgccttccggg

SEQ ID NO: 158102 - DNA, 25 bp, Homo sapien
tcatgaatgccttccgggccgggcg

SEQ ID NO: 158103 - DNA, 25 bp, Homo sapien
cgaaagctgagaccctcgccacggg

SEQ ID NO: 158104 - DNA, 25 bp, Homo sapien
acacaccggtcaccgagacggctgg

SEQ ID NO: 158105 - DNA, 25 bp, Homo sapien
ccggtcaccgagacggctggacctg

SEQ ID NO: 158106 - DNA, 25 bp, Homo sapien
actggccctcccttgcaggtcggtt

SEQ ID NO: 158107 - DNA, 25 bp, Homo sapien
atttgtggccactcactttgtagga

SEQ ID NO: 158108 - DNA, 25 bp, Homo sapien
gccactcactttgtaggaaactcat

SEQ ID NO: 158109 - DNA, 25 bp, Homo sapien
ggaaactcatctccttcctgaggag

SEQ ID NO: 158110 - DNA, 25 bp, Homo sapien
accagtcccgtcgtgcagtcaggtg

SEQ ID NO: 158111 - DNA, 25 bp, Homo sapien
tgtgtctttccagaaggtcacgtgg

SEQ ID NO: 158112 - DNA, 25 bp, Homo sapien
gtcacgtggaaatgtctcgggactt

SEQ ID NO: 158113 - DNA, 25 bp, Homo sapien
gaaatgtctcgggacttgggtcccg

SEQ ID NO: 158114 - DNA, 25 bp, Homo sapien
ttttctcatcatccttgctttacca

SEQ ID NO: 158115 - DNA, 25 bp, Homo sapien
tcatccttgctttaccacaatgagc

SEQ ID NO: 158116 - DNA, 25 bp, Homo sapien
gtatctgaattcctgtaggcacacc

SEQ ID NO: 158117 - DNA, 25 bp, Homo sapien
taggcacaccctccatagggtatga

SEQ ID NO: 158118 - DNA, 25 bp, Homo sapien
gcgcggctgcttttggtggatctca

SEQ ID NO: 158119 - DNA, 25 bp, Homo sapien
tggtggatctcacctctttgaaagc

SEQ ID NO: 158120 - DNA, 25 bp, Homo sapien
agggcgtgacgcctaaagccgacat

SEQ ID NO: 158121 - DNA, 25 bp, Homo sapien
cgcctaaagccgacatttattcctt

SEQ ID NO: 158122 - DNA, 25 bp, Homo sapien
atttattcctttgccatcactctct

SEQ ID NO: 158123 - DNA, 25 bp, Homo sapien
atcactctctggcaaatgactacca

SEQ ID NO: 158124 - DNA, 25 bp, Homo sapien
aaatgactaccaagcaggcgccgta

SEQ ID NO: 158125 - DNA, 25 bp, Homo sapien
gactaccaagcaggcgccgtattcg

SEQ ID NO: 158126 - DNA, 25 bp, Homo sapien
gagcggcagcacatactgtacgcgg

SEQ ID NO: 158127 - DNA, 25 bp, Homo sapien
tactgtacgcggtggtggcctacga

SEQ ID NO: 158128 - DNA, 25 bp, Homo sapien
gtcatccagcgctgctggagaccca

SEQ ID NO: 158129 - DNA, 25 bp, Homo sapien
tcaagtaccccgagtggaaacagaa

SEQ ID NO: 158130 - DNA, 25 bp, Homo sapien
tgcctcacttcaagccgtggctgca

SEQ ID NO: 158131 - DNA, 25 bp, Homo sapien
tcaagccgtggctgcacccggagca

SEQ ID NO: 158132 - DNA, 25 bp, Homo sapien
ggctgcacccggagcagagcccgtt

SEQ ID NO: 158133 - DNA, 25 bp, Homo sapien
gttgccgagcctggcgctgtcggag

SEQ ID NO: 158134 - DNA, 25 bp, Homo sapien
tggcgctgtcggagctgtcggtgca

SEQ ID NO: 158135 - DNA, 25 bp, Homo sapien
tgtcggtgcagcatgcggactcact

SEQ ID NO: 158136 - DNA, 25 bp, Homo sapien
atgcggactcactggagaacatcga

SEQ ID NO: 158137 - DNA, 25 bp, Homo sapien
tcactggagaacatcgacgagagcg

SEQ ID NO: 158138 - DNA, 25 bp, Homo sapien
agaacatcgacgagagcgcggtggc

SEQ ID NO: 158139 - DNA, 25 bp, Homo sapien
ggcgagggcagcgacgacgacacct

SEQ ID NO: 158140 - DNA, 25 bp, Homo sapien
gccataaaaaggaacaagactgact

SEQ ID NO: 158141 - DNA, 25 bp, Homo sapien
taaaaaggaacaagactgactgggc

SEQ ID NO: 158142 - DNA, 25 bp, Homo sapien
aaaaaggaacaagactgactgggcg

SEQ ID NO: 158143 - DNA, 25 bp, Homo sapien
aaaaggaacaagactgactgggcgt

SEQ ID NO: 158144 - DNA, 25 bp, Homo sapien
aaaggaacaagactgactgggcgtg

SEQ ID NO: 158145 - DNA, 25 bp, Homo sapien
aaggaacaagactgactgggcgtgg

SEQ ID NO: 158146 - DNA, 25 bp, Homo sapien
aggaacaagactgactgggcgtggt

SEQ ID NO: 158147 - DNA, 25 bp, Homo sapien
ggaacaagactgactgggcgtggtg

SEQ ID NO: 158148 - DNA, 25 bp, Homo sapien
gattgcccgcgctcaggaggtcaag

SEQ ID NO: 158149 - DNA, 25 bp, Homo sapien
attgcccgcgctcaggaggtcaaga

SEQ ID NO: 158150 - DNA, 25 bp, Homo sapien
ttgcccgcgctcaggaggtcaagac

SEQ ID NO: 158151 - DNA, 25 bp, Homo sapien
aagatctgaaggtagcctccgtcat

SEQ ID NO: 158152 - DNA, 25 bp, Homo sapien
tccgtcatctcttctgggatacatg

SEQ ID NO: 158153 - DNA, 25 bp, Homo sapien
gtcatctcttctgggatacatggat

SEQ ID NO: 158154 - DNA, 25 bp, Homo sapien
gcattcttcccttaacaaatttaag

SEQ ID NO: 158155 - DNA, 25 bp, Homo sapien
tcaccttcttaaaaacctctttcag

SEQ ID NO: 158156 - DNA, 25 bp, Homo sapien
taaaaacctctttcagattaagctg

SEQ ID NO: 158157 - DNA, 25 bp, Homo sapien
gttacaagatggctggcatccctct

SEQ ID NO: 158158 - DNA, 25 bp, Homo sapien
tcctttctccccatatgcaatttgc

SEQ ID NO: 158159 - DNA, 25 bp, Homo sapien
atttgcttaatgtaacctcttcttt

SEQ ID NO: 158160 - DNA, 25 bp, Homo sapien
ttttgccatgtttccattctgccat

SEQ ID NO: 158161 - DNA, 25 bp, Homo sapien
atgtttccattctgccatcttgaat

SEQ ID NO: 158162 - DNA, 25 bp, Homo sapien
ttgatgacatctttgacggttctga

SEQ ID NO: 158163 - DNA, 25 bp, Homo sapien
ctttgacggttctgatgacgaagaa

SEQ ID NO: 158164 - DNA, 25 bp, Homo sapien
gccaggatattgtgaatcaagttct

SEQ ID NO: 158165 - DNA, 25 bp, Homo sapien
aagatggccaaagctccatcagctg

SEQ ID NO: 158166 - DNA, 25 bp, Homo sapien
aaagctccatcagctgctcgaagct

SEQ ID NO: 158167 - DNA, 25 bp, Homo sapien
agctgctcgaagcttaccatctgcc

SEQ ID NO: 158168 - DNA, 25 bp, Homo sapien
aagcttaccatctgcctctacttca

SEQ ID NO: 158169 - DNA, 25 bp, Homo sapien
ctctacttcaaaggctacaatctca

SEQ ID NO: 158170 - DNA, 25 bp, Homo sapien
gattgaacggcaactcaaggcttta

SEQ ID NO: 158171 - DNA, 25 bp, Homo sapien
gaagtcatactattttgcttactta

SEQ ID NO: 158172 - DNA, 25 bp, Homo sapien
agcacagtgcagatttcttttacaa

SEQ ID NO: 158173 - DNA, 25 bp, Homo sapien
agtggttcaacagctccggctggag

SEQ ID NO: 158174 - DNA, 25 bp, Homo sapien
cgcgtaaaagtttcccaggcagctg

SEQ ID NO: 158175 - DNA, 25 bp, Homo sapien
aaaagtttcccaggcagctgcagac

SEQ ID NO: 158176 - DNA, 25 bp, Homo sapien
gttctgtctgcagaatgctcaacat

SEQ ID NO: 158177 - DNA, 25 bp, Homo sapien
agaatgctcaacatgaccctctgct

SEQ ID NO: 158178 - DNA, 25 bp, Homo sapien
gaccctctgctgactggagtatctt

SEQ ID NO: 158179 - DNA, 25 bp, Homo sapien
gtatcttcaagtacaaatcccttca

SEQ ID NO: 158180 - DNA, 25 bp, Homo sapien
aatcccttcagaccccagaaagtct

SEQ ID NO: 158181 - DNA, 25 bp, Homo sapien
gagagctacatttgaagcctgtaca

SEQ ID NO: 158182 - DNA, 25 bp, Homo sapien
gcctgtacaaaagcttatccctgta

SEQ ID NO: 158183 - DNA, 25 bp, Homo sapien
atccctgtaacacatgtgccataat

SEQ ID NO: 158184 - DNA, 25 bp, Homo sapien
aatgctgtcctagatgtacttgggc

SEQ ID NO: 158185 - DNA, 25 bp, Homo sapien
atgtacttgggcatctcatccttca

SEQ ID NO: 158186 - DNA, 25 bp, Homo sapien
ttgggcatctcatccttcattattc

SEQ ID NO: 158187 - DNA, 25 bp, Homo sapien
gcatctcatccttcattattctctg

SEQ ID NO: 158188 - DNA, 25 bp, Homo sapien
cattattctctgcattccttccggg

SEQ ID NO: 158189 - DNA, 25 bp, Homo sapien
tgacaccctgagtccaaacccttgt

SEQ ID NO: 158190 - DNA, 25 bp, Homo sapien
ttgtgcctcccagttcttccaagtg

SEQ ID NO: 158191 - DNA, 25 bp, Homo sapien
cccagttcttccaagtgtctaacta

SEQ ID NO: 158192 - DNA, 25 bp, Homo sapien
tgtctaactagtcttcgctgcagcg

SEQ ID NO: 158193 - DNA, 25 bp, Homo sapien
ttcgctgcagcgtcagccaaagctg

SEQ ID NO: 158194 - DNA, 25 bp, Homo sapien
aaagctggcccctgaaccactgtgt

SEQ ID NO: 158195 - DNA, 25 bp, Homo sapien
atatagtgattgtgatggctgtggt

SEQ ID NO: 158196 - DNA, 25 bp, Homo sapien
aaatcatccactttcccgagaatct

SEQ ID NO: 158197 - DNA, 25 bp, Homo sapien
atcatccactttcccgagaatctag

SEQ ID NO: 158198 - DNA, 25 bp, Homo sapien
cactttcccgagaatctagggatta

SEQ ID NO: 158199 - DNA, 25 bp, Homo sapien
accatctgcaggagtgcctctgttg

SEQ ID NO: 158200 - DNA, 25 bp, Homo sapien
atctgcaggagtgcctctgttgtct

SEQ ID NO: 158201 - DNA, 25 bp, Homo sapien
caggagtgcctctgttgtcttatgg

SEQ ID NO: 158202 - DNA, 25 bp, Homo sapien
gggattatgctccactgtctagaga

SEQ ID NO: 158203 - DNA, 25 bp, Homo sapien
ggattatgctccactgtctagagac

SEQ ID NO: 158204 - DNA, 25 bp, Homo sapien
gtccttctagttgggatcaacattt

SEQ ID NO: 158205 - DNA, 25 bp, Homo sapien
cttctagttgggatcaacatttctc

SEQ ID NO: 158206 - DNA, 25 bp, Homo sapien
acggaacaggagtcataatctttct

SEQ ID NO: 158207 - DNA, 25 bp, Homo sapien
tgaactcctgtggtttttactgaaa

SEQ ID NO: 158208 - DNA, 25 bp, Homo sapien
gaaacttgtcagaaggcataggagt

SEQ ID NO: 158209 - DNA, 25 bp, Homo sapien
gtctagatttaaacagccaccaggc

SEQ ID NO: 158210 - DNA, 25 bp, Homo sapien
agccaccaggcagcttatcaaagca

SEQ ID NO: 158211 - DNA, 25 bp, Homo sapien
tatcaaagcaagagggcatccgttc

SEQ ID NO: 158212 - DNA, 25 bp, Homo sapien
agcaagagggcatccgttcacagga

SEQ ID NO: 158213 - DNA, 25 bp, Homo sapien
ctcccagcaattcccagtggcagtg

SEQ ID NO: 158214 - DNA, 25 bp, Homo sapien
gggacttccccttgtgtcaacagca

SEQ ID NO: 158215 - DNA, 25 bp, Homo sapien
tgtcaacagcatgctagggcccagc

SEQ ID NO: 158216 - DNA, 25 bp, Homo sapien
atgctagggcccagcaaactagagg

SEQ ID NO: 158217 - DNA, 25 bp, Homo sapien
tggctgtgggcaacatgagtgtctt

SEQ ID NO: 158218 - DNA, 25 bp, Homo sapien
tgagtgtcttactgagatccctacc

SEQ ID NO: 158219 - DNA, 25 bp, Homo sapien
tgtcttactgagatccctacctggg

SEQ ID NO: 158220 - DNA, 25 bp, Homo sapien
agaattcctcaactctagtgcctaa

SEQ ID NO: 158221 - DNA, 25 bp, Homo sapien
attcctcaactctagtgcctaaaga

SEQ ID NO: 158222 - DNA, 25 bp, Homo sapien
gtgcctaaagagtagggaatctcat

SEQ ID NO: 158223 - DNA, 25 bp, Homo sapien
ggaatctcatccatcacagatcgca

SEQ ID NO: 158224 - DNA, 25 bp, Homo sapien
catcacagatcgcatttcctaaggg

SEQ ID NO: 158225 - DNA, 25 bp, Homo sapien
ggtttctatccttccagaaaaattg

SEQ ID NO: 158226 - DNA, 25 bp, Homo sapien
gggctatgtatagtctgtatacgtt

SEQ ID NO: 158227 - DNA, 25 bp, Homo sapien
tatagtctgtatacgttttgaggag

SEQ ID NO: 158228 - DNA, 25 bp, Homo sapien
aaatcttttttcacttctcatggat

SEQ ID NO: 158229 - DNA, 25 bp, Homo sapien
cacttctcatggatagctgttatat

SEQ ID NO: 158230 - DNA, 25 bp, Homo sapien
ttgggttattaacccttgctccctg

SEQ ID NO: 158231 - DNA, 25 bp, Homo sapien
gcatggctcattagggtccaaatta

SEQ ID NO: 158232 - DNA, 25 bp, Homo sapien
ggctcattagggtccaaattataac

SEQ ID NO: 158233 - DNA, 25 bp, Homo sapien
cattagggtccaaattataactgat

SEQ ID NO: 158234 - DNA, 25 bp, Homo sapien
atttacattttcagcgatattactt

SEQ ID NO: 158235 - DNA, 25 bp, Homo sapien
gcgatattacttttaaatgcctgag

SEQ ID NO: 158236 - DNA, 25 bp, Homo sapien
aatgcctgagttcccatttaaaatc

SEQ ID NO: 158237 - DNA, 25 bp, Homo sapien
gcctgagttcccatttaaaatctaa

SEQ ID NO: 158238 - DNA, 25 bp, Homo sapien
aaaatctaactagacacctaatggg

SEQ ID NO: 158239 - DNA, 25 bp, Homo sapien
tcaccgcacagacaccaaatggatt

SEQ ID NO: 158240 - DNA, 25 bp, Homo sapien
aatggattgcttctgactccgagtc

SEQ ID NO: 158241 - DNA, 25 bp, Homo sapien
actgctctccagcatacatttctgg

SEQ ID NO: 158242 - DNA, 25 bp, Homo sapien
ttctggagcagccttagtccagttg

SEQ ID NO: 158243 - DNA, 25 bp, Homo sapien
ttagtccagttgctccgctgagtcc

SEQ ID NO: 158244 - DNA, 25 bp, Homo sapien
gcaagggccaagcacgctgttccag

SEQ ID NO: 158245 - DNA, 25 bp, Homo sapien
cacactgcttaatggccacatgcca

SEQ ID NO: 158246 - DNA, 25 bp, Homo sapien
agtgccaatccccagtctggacaga

SEQ ID NO: 158247 - DNA, 25 bp, Homo sapien
tctccagtactgctttcttcaaact

SEQ ID NO: 158248 - DNA, 25 bp, Homo sapien
aaactctcagaaatcctgatgacgt

SEQ ID NO: 158249 - DNA, 25 bp, Homo sapien
ctgatgacgtctggccacaattaag

SEQ ID NO: 158250 - DNA, 25 bp, Homo sapien
ggtttgtccgtaccctggaatgaca

SEQ ID NO: 158251 - DNA, 25 bp, Homo sapien
agaggataccggatgtcagctcccc

SEQ ID NO: 158252 - DNA, 25 bp, Homo sapien
tccccagcactgtccagaggatatt

SEQ ID NO: 158253 - DNA, 25 bp, Homo sapien
gtccagaggatatttccaaaatcat

SEQ ID NO: 158254 - DNA, 25 bp, Homo sapien
ttataaacctgaaaatcgccctaag

SEQ ID NO: 158255 - DNA, 25 bp, Homo sapien
aaaatcgccctaagttcagtgaact

SEQ ID NO: 158256 - DNA, 25 bp, Homo sapien
cagaaagagctcactatcatcaaga

SEQ ID NO: 158257 - DNA, 25 bp, Homo sapien
tcacatagtgacaggatggcgccaa

SEQ ID NO: 158258 - DNA, 25 bp, Homo sapien
atggcgccaaactcagccttcagga

SEQ ID NO: 158259 - DNA, 25 bp, Homo sapien
aaactcagccttcaggactctgtcc

SEQ ID NO: 158260 - DNA, 25 bp, Homo sapien
tgtcctccagcagagtaacattatt

SEQ ID NO: 158261 - DNA, 25 bp, Homo sapien
tcctactcctgccatgcattgaagg

SEQ ID NO: 158262 - DNA, 25 bp, Homo sapien
tactcctgccatgcattgaagggtc

SEQ ID NO: 158263 - DNA, 25 bp, Homo sapien
tcctgccatgcattgaagggtcaat

SEQ ID NO: 158264 - DNA, 25 bp, Homo sapien
atccctcagctaccctggatctttg

SEQ ID NO: 158265 - DNA, 25 bp, Homo sapien
gccgtagccctatctagggctgtgg

SEQ ID NO: 158266 - DNA, 25 bp, Homo sapien
ggaaggagcagactggttcctaact

SEQ ID NO: 158267 - DNA, 25 bp, Homo sapien
ggagcagactggttcctaactctct

SEQ ID NO: 158268 - DNA, 25 bp, Homo sapien
agcagactggttcctaactctctcc

SEQ ID NO: 158269 - DNA, 25 bp, Homo sapien
tcaaaagaatcttccctacaccctt

SEQ ID NO: 158270 - DNA, 25 bp, Homo sapien
ttttttgatttgtgcaacttgtaac

SEQ ID NO: 158271 - DNA, 25 bp, Homo sapien
gtgcaacttgtaactaggtgtttat

SEQ ID NO: 158272 - DNA, 25 bp, Homo sapien
acttgcgtggacagtcagggttcac

SEQ ID NO: 158273 - DNA, 25 bp, Homo sapien
ggacagtcagggttcacttgggctc

SEQ ID NO: 158274 - DNA, 25 bp, Homo sapien
agtcagggttcacttgggctctctc

SEQ ID NO: 158275 - DNA, 25 bp, Homo sapien
ttgggctctctctagctccccaatt

SEQ ID NO: 158276 - DNA, 25 bp, Homo sapien
cagctgcactttaaccctagaaggt

SEQ ID NO: 158277 - DNA, 25 bp, Homo sapien
ggcccatgaagaaagcccctcgttg

SEQ ID NO: 158278 - DNA, 25 bp, Homo sapien
gaagaaagcccctcgttgcccagca

SEQ ID NO: 158279 - DNA, 25 bp, Homo sapien
agcactgtctgcgtctgctcttctg

SEQ ID NO: 158280 - DNA, 25 bp, Homo sapien
tgcgtctgctcttctgtgcccaggg

SEQ ID NO: 158281 - DNA, 25 bp, Homo sapien
gacgcgggcttctggagcttgtcac

SEQ ID NO: 158282 - DNA, 25 bp, Homo sapien
accattggacagtctccctgatgga

SEQ ID NO: 158283 - DNA, 25 bp, Homo sapien
aagcaaaaatgtacctgtgactcaa

SEQ ID NO: 158284 - DNA, 25 bp, Homo sapien
tgtacctgtgactcaaatttagaaa

SEQ ID NO: 158285 - DNA, 25 bp, Homo sapien
ggctgaatatgcaggacagttggca

SEQ ID NO: 158286 - DNA, 25 bp, Homo sapien
agttggcagaactgaggcagagatt

SEQ ID NO: 158287 - DNA, 25 bp, Homo sapien
gagattggaccatgctgaggccgat

SEQ ID NO: 158288 - DNA, 25 bp, Homo sapien
ggaccatgctgaggccgataggcaa

SEQ ID NO: 158289 - DNA, 25 bp, Homo sapien
ggccgataggcaagaactccaagat

SEQ ID NO: 158290 - DNA, 25 bp, Homo sapien
ggcaagaactccaagatgaactcag

SEQ ID NO: 158291 - DNA, 25 bp, Homo sapien
agagctaaagctgcaaattctgaaa

SEQ ID NO: 158292 - DNA, 25 bp, Homo sapien
gctgcaaattctgaaatcatcaaag

SEQ ID NO: 158293 - DNA, 25 bp, Homo sapien
atctgtgtattactgacaaggtttt

SEQ ID NO: 158294 - DNA, 25 bp, Homo sapien
ggctggctctgagcattgccaatgg

SEQ ID NO: 158295 - DNA, 25 bp, Homo sapien
ctactcacctgactttgtatcctct

SEQ ID NO: 158296 - DNA, 25 bp, Homo sapien
tgactttgtatcctctccttttaga

SEQ ID NO: 158297 - DNA, 25 bp, Homo sapien
gtatcctctccttttagaggctttg

SEQ ID NO: 158298 - DNA, 25 bp, Homo sapien
tagaggctttgcattctgcacccag

SEQ ID NO: 158299 - DNA, 25 bp, Homo sapien
tgcacccagcttcactaacagtggg

SEQ ID NO: 158300 - DNA, 25 bp, Homo sapien
cagcttcactaacagtgggctgaaa

SEQ ID NO: 158301 - DNA, 25 bp, Homo sapien
gaaaacatccttgggttgagtgttt

SEQ ID NO: 158302 - DNA, 25 bp, Homo sapien
gaacagtagtgtccccatgaagtgc

SEQ ID NO: 158303 - DNA, 25 bp, Homo sapien
gtgtccccatgaagtgctagataat

SEQ ID NO: 158304 - DNA, 25 bp, Homo sapien
tttaactctaacacccttcagaaat

SEQ ID NO: 158305 - DNA, 25 bp, Homo sapien
aagaagaagccctgcctactgtgcc

SEQ ID NO: 158306 - DNA, 25 bp, Homo sapien
ggatcactcacttgtcttctatgaa

SEQ ID NO: 158307 - DNA, 25 bp, Homo sapien
gtcttctatgaagacggactcttca

SEQ ID NO: 158308 - DNA, 25 bp, Homo sapien
gacggactcttcatgaggttgaatt

SEQ ID NO: 158309 - DNA, 25 bp, Homo sapien
ggttgaatttcatgccagtttgtat

SEQ ID NO: 158310 - DNA, 25 bp, Homo sapien
gaggcaagacaaacacaggcgcttt

SEQ ID NO: 158311 - DNA, 25 bp, Homo sapien
aaacacaggcgctttgcaggctgct

SEQ ID NO: 158312 - DNA, 25 bp, Homo sapien
caggcgctttgcaggctgctctgag

SEQ ID NO: 158313 - DNA, 25 bp, Homo sapien
caggaggactggatttggtatgatc

SEQ ID NO: 158314 - DNA, 25 bp, Homo sapien
ggtatgatcaaatcctcaaggccac

SEQ ID NO: 158315 - DNA, 25 bp, Homo sapien
acctgggacaggtcgattgctggac

SEQ ID NO: 158316 - DNA, 25 bp, Homo sapien
cttggacacttaatgattgttggca

SEQ ID NO: 158317 - DNA, 25 bp, Homo sapien
agaaatgtgctgctgatctgggcct

SEQ ID NO: 158318 - DNA, 25 bp, Homo sapien
gtgctgctgatctgggcctgaataa

SEQ ID NO: 158319 - DNA, 25 bp, Homo sapien
tgggcctgaataagggttatcgaat

SEQ ID NO: 158320 - DNA, 25 bp, Homo sapien
tgaaggttcagatggtggacagtct

SEQ ID NO: 158321 - DNA, 25 bp, Homo sapien
agtctgtctatcacgttcatctcca

SEQ ID NO: 158322 - DNA, 25 bp, Homo sapien
tctatcacgttcatctccatgttct

SEQ ID NO: 158323 - DNA, 25 bp, Homo sapien
gttcttggaggtcggcaaatgcatt

SEQ ID NO: 158324 - DNA, 25 bp, Homo sapien
aaatgcattggcctcctggttaagc

SEQ ID NO: 158325 - DNA, 25 bp, Homo sapien
gcctcctggttaagcacgttttggg

SEQ ID NO: 158326 - DNA, 25 bp, Homo sapien
ggcaatttccagtatgttaagtaac

SEQ ID NO: 158327 - DNA, 25 bp, Homo sapien
ccctcacctttgtctacttatacaa

SEQ ID NO: 158328 - DNA, 25 bp, Homo sapien
aatgcggccatcagcttgggctatg

SEQ ID NO: 158329 - DNA, 25 bp, Homo sapien
tcaacccctttgtgtacatcgtgct

SEQ ID NO: 158330 - DNA, 25 bp, Homo sapien
gtacatcgtgctctgtgagacgttc

SEQ ID NO: 158331 - DNA, 25 bp, Homo sapien
tgagacgttccgcaaacgcttggtc

SEQ ID NO: 158332 - DNA, 25 bp, Homo sapien
caaacgcttggtcctgtcggtgaag

SEQ ID NO: 158333 - DNA, 25 bp, Homo sapien
tggtcctgtcggtgaagcctgcagc

SEQ ID NO: 158334 - DNA, 25 bp, Homo sapien
agcaacgctcagacggctgacgagg

SEQ ID NO: 158335 - DNA, 25 bp, Homo sapien
atctgtctggtcttctttgtgtgct

SEQ ID NO: 158336 - DNA, 25 bp, Homo sapien
tgtgtgctgggcaccctactatgtg

SEQ ID NO: 158337 - DNA, 25 bp, Homo sapien
tactatgtgctacagctgacccagt

SEQ ID NO: 158338 - DNA, 25 bp, Homo sapien
ggatttgaaccgagcagccaatctt

SEQ ID NO: 158339 - DNA, 25 bp, Homo sapien
tggagacgcagcagcctgtgtcctc

SEQ ID NO: 158340 - DNA, 25 bp, Homo sapien
tccagggcctctggtttgttgtatt

SEQ ID NO: 158341 - DNA, 25 bp, Homo sapien
atttcgctgtggaaaatgtcacgtt

SEQ ID NO: 158342 - DNA, 25 bp, Homo sapien
atgtcacgtttagtcaccttggagc

SEQ ID NO: 158343 - DNA, 25 bp, Homo sapien
ccactcacctggtcctgttgtttta

SEQ ID NO: 158344 - DNA, 25 bp, Homo sapien
tctcgcgcgcctattgatttgtttc

SEQ ID NO: 158345 - DNA, 25 bp, Homo sapien
gaggagagtacaccgttcactattg

SEQ ID NO: 158346 - DNA, 25 bp, Homo sapien
ttcactattgtagagtaacccctgt

SEQ ID NO: 158347 - DNA, 25 bp, Homo sapien
aacccctgtgactcaatattaccat

SEQ ID NO: 158348 - DNA, 25 bp, Homo sapien
agtgcgatgtcgttttgtgctattt

SEQ ID NO: 158349 - DNA, 25 bp, Homo sapien
ccttggagcaggatggctcctctaa

SEQ ID NO: 158350 - DNA, 25 bp, Homo sapien
ggctcctctaagaatctcacaggac

SEQ ID NO: 158351 - DNA, 25 bp, Homo sapien
agaatctcacaggacctcttagtct

SEQ ID NO: 158352 - DNA, 25 bp, Homo sapien
aggacctcttagtctctgccctata

SEQ ID NO: 158353 - DNA, 25 bp, Homo sapien
atactggtactgctgtaatgagcca

SEQ ID NO: 158354 - DNA, 25 bp, Homo sapien
tgagccaagtggcagctaaaagttg

SEQ ID NO: 158355 - DNA, 25 bp, Homo sapien
gggtgttctgcccagtcccgtcatt

SEQ ID NO: 158356 - DNA, 25 bp, Homo sapien
agtcccgtcattctgggctagaagg

SEQ ID NO: 158357 - DNA, 25 bp, Homo sapien
ttggctggccacaccaagcaggaag

SEQ ID NO: 158358 - DNA, 25 bp, Homo sapien
aagctgactcatcctaactaacagt

SEQ ID NO: 158359 - DNA, 25 bp, Homo sapien
ctaactaacagtcacgccgtgggat

SEQ ID NO: 158360 - DNA, 25 bp, Homo sapien
gacgctgcgctcagccgtggagtac

SEQ ID NO: 158361 - DNA, 25 bp, Homo sapien
tgcgctcagccgtggagtacatccg

SEQ ID NO: 158362 - DNA, 25 bp, Homo sapien
gctcagccgtggagtacatccgcgc

SEQ ID NO: 158363 - DNA, 25 bp, Homo sapien
tggccgagcacgacgccgtgcgcaa

SEQ ID NO: 158364 - DNA, 25 bp, Homo sapien
tgcgcaacgcgctggcgggagggct

SEQ ID NO: 158365 - DNA, 25 bp, Homo sapien
tactcgtcggacgacagcggctgcg

SEQ ID NO: 158366 - DNA, 25 bp, Homo sapien
gacagcggctgcgaaggcgcgctga

SEQ ID NO: 158367 - DNA, 25 bp, Homo sapien
gcgaaggcgcgctgagtcctgcgga

SEQ ID NO: 158368 - DNA, 25 bp, Homo sapien
tgagtcctgcggagcgcgagctact

SEQ ID NO: 158369 - DNA, 25 bp, Homo sapien
ctgcggagcgcgagctactcgactt

SEQ ID NO: 158370 - DNA, 25 bp, Homo sapien
gcggagcgcgagctactcgacttct

SEQ ID NO: 158371 - DNA, 25 bp, Homo sapien
ccgtgcggctgctggcttctgtaga

SEQ ID NO: 158372 - DNA, 25 bp, Homo sapien
tggcttctgtagaggctgcccagag

SEQ ID NO: 158373 - DNA, 25 bp, Homo sapien
cagccaggagaggaggtgtcccttc

SEQ ID NO: 158374 - DNA, 25 bp, Homo sapien
gccaggagaggaggtgtcccttcct

SEQ ID NO: 158375 - DNA, 25 bp, Homo sapien
agacacagcgcgcttctctctggcc

SEQ ID NO: 158376 - DNA, 25 bp, Homo sapien
tctctggcctttcccgaggcctgtg

SEQ ID NO: 158377 - DNA, 25 bp, Homo sapien
gtgcctcaggaagcagctgggccct

SEQ ID NO: 158378 - DNA, 25 bp, Homo sapien
gctgtgttcagcttaggaacatacc

SEQ ID NO: 158379 - DNA, 25 bp, Homo sapien
ttcagcttaggaacataccgcctgt

SEQ ID NO: 158380 - DNA, 25 bp, Homo sapien
gcttaggaacataccgcctgtatct

SEQ ID NO: 158381 - DNA, 25 bp, Homo sapien
gaacataccgcctgtatctgctgtc

SEQ ID NO: 158382 - DNA, 25 bp, Homo sapien
tacaacttcaccctgtttctgcaga

SEQ ID NO: 158383 - DNA, 25 bp, Homo sapien
tgtttctgcagacgctgtttcggac

SEQ ID NO: 158384 - DNA, 25 bp, Homo sapien
tgtttcggacccagatcatccggag

SEQ ID NO: 158385 - DNA, 25 bp, Homo sapien
agatcatccggagctgcgaggccaa

SEQ ID NO: 158386 - DNA, 25 bp, Homo sapien
tgcgaggccaaacagcagctagaat

SEQ ID NO: 158387 - DNA, 25 bp, Homo sapien
agcagctagaatacgccctgctcat

SEQ ID NO: 158388 - DNA, 25 bp, Homo sapien
gctttaacccggtgctctatgtctt

SEQ ID NO: 158389 - DNA, 25 bp, Homo sapien
ggtcaagttccgcacacacctgaaa

SEQ ID NO: 158390 - DNA, 25 bp, Homo sapien
acctgaaacatgttctccggcagtt

SEQ ID NO: 158391 - DNA, 25 bp, Homo sapien
agttctggttctgccggctgcaggc

SEQ ID NO: 158392 - DNA, 25 bp, Homo sapien
ctatgagggcgcctccttctactga

SEQ ID NO: 158393 - DNA, 25 bp, Homo sapien
agctgttttctttaggaaaatggct

SEQ ID NO: 158394 - DNA, 25 bp, Homo sapien
tgatcttttctaagtgtgtttcact

SEQ ID NO: 158395 - DNA, 25 bp, Homo sapien
tcactttttcatgggatgatggctt

SEQ ID NO: 158396 - DNA, 25 bp, Homo sapien
atgatggctttgttgcagctgagat

SEQ ID NO: 158397 - DNA, 25 bp, Homo sapien
ttgttgcagctgagattcatgtaac

SEQ ID NO: 158398 - DNA, 25 bp, Homo sapien
ggtaataatagtttcacataggaac

SEQ ID NO: 158399 - DNA, 25 bp, Homo sapien
taggaacagatgcaagttcactctg

SEQ ID NO: 158400 - DNA, 25 bp, Homo sapien
gatgcaagttcactctgttagttaa

SEQ ID NO: 158401 - DNA, 25 bp, Homo sapien
agttcactctgttagttaactggta

SEQ ID NO: 158402 - DNA, 25 bp, Homo sapien
ctgttagttaactggtagtctttgt

SEQ ID NO: 158403 - DNA, 25 bp, Homo sapien
ggtagtctttgttaaggtgattcaa

SEQ ID NO: 158404 - DNA, 25 bp, Homo sapien
agccatgccagctggcctttgtaag

SEQ ID NO: 158405 - DNA, 25 bp, Homo sapien
ggcctttgtaagtgcaggaaaccga

SEQ ID NO: 158406 - DNA, 25 bp, Homo sapien
gtagaaaatgtgaccctccaaatgg

SEQ ID NO: 158407 - DNA, 25 bp, Homo sapien
gtgaagtgcttggaacatactgttc

SEQ ID NO: 158408 - DNA, 25 bp, Homo sapien
atactgttcactcactctaaaggcg

SEQ ID NO: 158409 - DNA, 25 bp, Homo sapien
ctaaaggcgctgagactgtgctgtt

SEQ ID NO: 158410 - DNA, 25 bp, Homo sapien
ctgtgctgttgttctcgtttttata

SEQ ID NO: 158411 - DNA, 25 bp, Homo sapien
tcatccagatgtggctactgacata

SEQ ID NO: 158412 - DNA, 25 bp, Homo sapien
gctactgacatatctacacttcgca

SEQ ID NO: 158413 - DNA, 25 bp, Homo sapien
atatctacacttcgcaccggagtgt

SEQ ID NO: 158414 - DNA, 25 bp, Homo sapien
ctggaattgtggctatcctgattat

SEQ ID NO: 158415 - DNA, 25 bp, Homo sapien
tagagacccccggagtggataagga

SEQ ID NO: 158416 - DNA, 25 bp, Homo sapien
agggtgaaaaagaagagccgcagtc

SEQ ID NO: 158417 - DNA, 25 bp, Homo sapien
agccgcagtcggagaaggtgtcaaa

SEQ ID NO: 158418 - DNA, 25 bp, Homo sapien
ggtgtcaaagcaagggctgccagct

SEQ ID NO: 158419 - DNA, 25 bp, Homo sapien
agacaccttcactctgtccagagct

SEQ ID NO: 158420 - DNA, 25 bp, Homo sapien
ccttcactctgtccagagctgacaa

SEQ ID NO: 158421 - DNA, 25 bp, Homo sapien
tgacaacagatgatgccagacccct

SEQ ID NO: 158422 - DNA, 25 bp, Homo sapien
cagacccctgagcaggctaagcaaa

SEQ ID NO: 158423 - DNA, 25 bp, Homo sapien
taagcaaagccagcagccgagccag

SEQ ID NO: 158424 - DNA, 25 bp, Homo sapien
agccgagccaggtcagacgatctaa

SEQ ID NO: 158425 - DNA, 25 bp, Homo sapien
gccaggtcagacgatctaaccgtat

SEQ ID NO: 158426 - DNA, 25 bp, Homo sapien
ggttgggaccgttgtaactcctgat

SEQ ID NO: 158427 - DNA, 25 bp, Homo sapien
gaccgttgtaactcctgataatgat

SEQ ID NO: 158428 - DNA, 25 bp, Homo sapien
aaacttcagactgccttcagaactg

SEQ ID NO: 158429 - DNA, 25 bp, Homo sapien
tcagaactgtgaattgcttttattg

SEQ ID NO: 158430 - DNA, 25 bp, Homo sapien
gcttttattggtttgatgcacagca

SEQ ID NO: 158431 - DNA, 25 bp, Homo sapien
gatgcacagcaaaatacctggtttc

SEQ ID NO: 158432 - DNA, 25 bp, Homo sapien
tacctggtttccaaagaccccaatg

SEQ ID NO: 158433 - DNA, 25 bp, Homo sapien
gaaaatccttgtagtctttactctt

SEQ ID NO: 158434 - DNA, 25 bp, Homo sapien
tgtagtctttactcttctgtctgtt

SEQ ID NO: 158435 - DNA, 25 bp, Homo sapien
agttatgtagcccaccagctgattt

SEQ ID NO: 158436 - DNA, 25 bp, Homo sapien
agctgatttgcataaggttgggacc

SEQ ID NO: 158437 - DNA, 25 bp, Homo sapien
cagagccagagtcccaacactagtc

SEQ ID NO: 158438 - DNA, 25 bp, Homo sapien
caccaaagcgccacaaaaagactat

SEQ ID NO: 158439 - DNA, 25 bp, Homo sapien
aaaaagactatgaactcccaccact

SEQ ID NO: 158440 - DNA, 25 bp, Homo sapien
ctgccgctgccccaagaacagaaag

SEQ ID NO: 158441 - DNA, 25 bp, Homo sapien
tccagcaggtgtacaaaaccaagac

SEQ ID NO: 158442 - DNA, 25 bp, Homo sapien
acaaaaccaagacgcggagctcagg

SEQ ID NO: 158443 - DNA, 25 bp, Homo sapien
gaaatccaactaatgagaccgcact

SEQ ID NO: 158444 - DNA, 25 bp, Homo sapien
caactaatgagaccgcactccttgg

SEQ ID NO: 158445 - DNA, 25 bp, Homo sapien
actccttggcttgttcctgcgtgtt

SEQ ID NO: 158446 - DNA, 25 bp, Homo sapien
cctgcgtgtttcacccaaaggagaa

SEQ ID NO: 158447 - DNA, 25 bp, Homo sapien
gatgaagtcaatcttcttgcaggaa

SEQ ID NO: 158448 - DNA, 25 bp, Homo sapien
gagatattttccaacagcttttcgt

SEQ ID NO: 158449 - DNA, 25 bp, Homo sapien
tattttccaacagcttttcgtcttc

SEQ ID NO: 158450 - DNA, 25 bp, Homo sapien
ttccaacagcttttcgtcttcagtg

SEQ ID NO: 158451 - DNA, 25 bp, Homo sapien
aacagcttttcgtcttcagtgtctt

SEQ ID NO: 158452 - DNA, 25 bp, Homo sapien
agcttttcgtcttcagtgtcttaat

SEQ ID NO: 158453 - DNA, 25 bp, Homo sapien
cttttcgtcttcagtgtcttaatgt

SEQ ID NO: 158454 - DNA, 25 bp, Homo sapien
tgtcttaatgtggaagttaaccctt

SEQ ID NO: 158455 - DNA, 25 bp, Homo sapien
agttggcaaaaacagccttctagca

SEQ ID NO: 158456 - DNA, 25 bp, Homo sapien
aaaacagccttctagcacacttttt

SEQ ID NO: 158457 - DNA, 25 bp, Homo sapien
acagccttctagcacacttttttaa

SEQ ID NO: 158458 - DNA, 25 bp, Homo sapien
tgaataatggtagcctaaacttaat

SEQ ID NO: 158459 - DNA, 25 bp, Homo sapien
tttctcacacagaggcggccttctg

SEQ ID NO: 158460 - DNA, 25 bp, Homo sapien
ctgctgccaaaggaaaacgtacaaa

SEQ ID NO: 158461 - DNA, 25 bp, Homo sapien
acaaaaaagggcatggccaccgcca

SEQ ID NO: 158462 - DNA, 25 bp, Homo sapien
atggccaccgccaagcaaaggcttg

SEQ ID NO: 158463 - DNA, 25 bp, Homo sapien
ggaaagatcttgaagatccatcgga

SEQ ID NO: 158464 - DNA, 25 bp, Homo sapien
atcggaatgggaaactgctcctcta

SEQ ID NO: 158465 - DNA, 25 bp, Homo sapien
gaaactgctcctctaaggcttggaa

SEQ ID NO: 158466 - DNA, 25 bp, Homo sapien
actgctcctctaaggcttggaaagc

SEQ ID NO: 158467 - DNA, 25 bp, Homo sapien
gccaggatccttctgatatgctaag

SEQ ID NO: 158468 - DNA, 25 bp, Homo sapien
ttctgatatgctaaggacccccgga

SEQ ID NO: 158469 - DNA, 25 bp, Homo sapien
aggacggtggctgtgccgcctggcc

SEQ ID NO: 158470 - DNA, 25 bp, Homo sapien
cttcatgctttctattcaggactaa

SEQ ID NO: 158471 - DNA, 25 bp, Homo sapien
aggactaattcccttactgcaaatg

SEQ ID NO: 158472 - DNA, 25 bp, Homo sapien
tactgcaaatgtgttagctctaaca

SEQ ID NO: 158473 - DNA, 25 bp, Homo sapien
tgttagctctaacatctcccacaag

SEQ ID NO: 158474 - DNA, 25 bp, Homo sapien
catctcccacaagctaaaggaactt

SEQ ID NO: 158475 - DNA, 25 bp, Homo sapien
gtatattaacaaggacacatctgac

SEQ ID NO: 158476 - DNA, 25 bp, Homo sapien
acatctgacatcctgtgtttggtta

SEQ ID NO: 158477 - DNA, 25 bp, Homo sapien
gtttggttaaaatatacagcacatt

SEQ ID NO: 158478 - DNA, 25 bp, Homo sapien
aaagtggatccatcttgtatcatta

SEQ ID NO: 158479 - DNA, 25 bp, Homo sapien
gatccatcttgtatcattataggca

SEQ ID NO: 158480 - DNA, 25 bp, Homo sapien
gtatggttttatgtactgtacaagt

SEQ ID NO: 158481 - DNA, 25 bp, Homo sapien
gcagtactccattcctagcagttat

SEQ ID NO: 158482 - DNA, 25 bp, Homo sapien
tcctagcagttatcacaagctcaaa

SEQ ID NO: 158483 - DNA, 25 bp, Homo sapien
aagctcaaaagtctcatggccagga

SEQ ID NO: 158484 - DNA, 25 bp, Homo sapien
ggaggacttatttggaatggcccaa

SEQ ID NO: 158485 - DNA, 25 bp, Homo sapien
atggcccaaggaaaagagcaaacgt

SEQ ID NO: 158486 - DNA, 25 bp, Homo sapien
gagcaaacgtggccttttttgggct

SEQ ID NO: 158487 - DNA, 25 bp, Homo sapien
ttgggctaacttaagggcagccatt

SEQ ID NO: 158488 - DNA, 25 bp, Homo sapien
agggcagccattaatattaagctga

SEQ ID NO: 158489 - DNA, 25 bp, Homo sapien
attcctcctgttgatattgctgctt

SEQ ID NO: 158490 - DNA, 25 bp, Homo sapien
ggaagttccaacaatgactttattt

SEQ ID NO: 158491 - DNA, 25 bp, Homo sapien
gactttattttgcatcagcatagat

SEQ ID NO: 158492 - DNA, 25 bp, Homo sapien
agctgcaggcgctcgaggcgctttt

SEQ ID NO: 158493 - DNA, 25 bp, Homo sapien
gctcgaggcgcttttcgtgcagaac

SEQ ID NO: 158494 - DNA, 25 bp, Homo sapien
aggcgcttttcgtgcagaaccagta

SEQ ID NO: 158495 - DNA, 25 bp, Homo sapien
gcttttcgtgcagaaccagtatcct

SEQ ID NO: 158496 - DNA, 25 bp, Homo sapien
gtgcagaaccagtatcctgacgtga

SEQ ID NO: 158497 - DNA, 25 bp, Homo sapien
gaaccagtatcctgacgtgagtacg

SEQ ID NO: 158498 - DNA, 25 bp, Homo sapien
agtatcctgacgtgagtacgcgcga

SEQ ID NO: 158499 - DNA, 25 bp, Homo sapien
tcctgacgtgagtacgcgcgagcgc

SEQ ID NO: 158500 - DNA, 25 bp, Homo sapien
gagcgcgtggaggtctggttcaaga

SEQ ID NO: 158501 - DNA, 25 bp, Homo sapien
gccgggccaaatggcgacaccagaa

SEQ ID NO: 158502 - DNA, 25 bp, Homo sapien
cagaagcgcgcgtcggcttccgcga

SEQ ID NO: 158503 - DNA, 25 bp, Homo sapien
gatataattgtactgtgtttttaaa

SEQ ID NO: 158504 - DNA, 25 bp, Homo sapien
agacaaattttgcatattctctatt

SEQ ID NO: 158505 - DNA, 25 bp, Homo sapien
aaattttgcatattctctattttac

SEQ ID NO: 158506 - DNA, 25 bp, Homo sapien
ctctattttacttttctgccaaaat

SEQ ID NO: 158507 - DNA, 25 bp, Homo sapien
ttctgccaaaataaacctgttcttc

SEQ ID NO: 158508 - DNA, 25 bp, Homo sapien
tgccaaaataaacctgttcttcctt

SEQ ID NO: 158509 - DNA, 25 bp, Homo sapien
tacttaaaaaatcctgcccaaaatg

SEQ ID NO: 158510 - DNA, 25 bp, Homo sapien
aaaatcctgcccaaaatgtgaagct

SEQ ID NO: 158511 - DNA, 25 bp, Homo sapien
aatcctgcccaaaatgtgaagcttg

SEQ ID NO: 158512 - DNA, 25 bp, Homo sapien
aaaatgtgaagcttggttgactgat

SEQ ID NO: 158513 - DNA, 25 bp, Homo sapien
aaattgaatagtttatttctgtgaa

SEQ ID NO: 158514 - DNA, 25 bp, Homo sapien
atatagtgattgtgatggctgtggt

SEQ ID NO: 158515 - DNA, 25 bp, Homo sapien
aaatcatccactttcccgagaatct

SEQ ID NO: 158516 - DNA, 25 bp, Homo sapien
atcatccactttcccgagaatctag

SEQ ID NO: 158517 - DNA, 25 bp, Homo sapien
gagatcattctgaacgtccaagtgg

SEQ ID NO: 158518 - DNA, 25 bp, Homo sapien
gatgcatttcagagatagggaacct

SEQ ID NO: 158519 - DNA, 25 bp, Homo sapien
cactttcccgagaatctagggatta

SEQ ID NO: 158520 - DNA, 25 bp, Homo sapien
accatctgcaggagtgcctctgttg

SEQ ID NO: 158521 - DNA, 25 bp, Homo sapien
caggagtgcctctgttgtcttatgg

SEQ ID NO: 158522 - DNA, 25 bp, Homo sapien
gggattatgctccactgtctagaga

SEQ ID NO: 158523 - DNA, 25 bp, Homo sapien
gtccttctagttgggatcaacattt

SEQ ID NO: 158524 - DNA, 25 bp, Homo sapien
cttctagttgggatcaacatttctc

SEQ ID NO: 158525 - DNA, 25 bp, Homo sapien
gagcagatacttgaaccgactcaat

SEQ ID NO: 158526 - DNA, 25 bp, Homo sapien
acttgaaccgactcaattcctgtgt

SEQ ID NO: 158527 - DNA, 25 bp, Homo sapien
aaccgactcaattcctgtgtaaaga

SEQ ID NO: 158528 - DNA, 25 bp, Homo sapien
tcctgtgtaaagagcactttgtcct

SEQ ID NO: 158529 - DNA, 25 bp, Homo sapien
aaagagcactttgtcctgcttcacg

SEQ ID NO: 158530 - DNA, 25 bp, Homo sapien
gcttcacggacctccccaaagtgtg

SEQ ID NO: 158531 - DNA, 25 bp, Homo sapien
ccaaagtgtgcagagttctatatag

SEQ ID NO: 158532 - DNA, 25 bp, Homo sapien
gagttctatataggatgctggatta

SEQ ID NO: 158533 - DNA, 25 bp, Homo sapien
ggattagttcctttgatatttgtaa

SEQ ID NO: 158534 - DNA, 25 bp, Homo sapien
taaaaattcccccaagagccgcata

SEQ ID NO: 158535 - DNA, 25 bp, Homo sapien
agagccgcatatgaatctgcccttt

SEQ ID NO: 158536 - DNA, 25 bp, Homo sapien
tagcattgccattcctctactgcaa

SEQ ID NO: 158537 - DNA, 25 bp, Homo sapien
gtaaggtccagtgaaggcactttgt

SEQ ID NO: 158538 - DNA, 25 bp, Homo sapien
aaggcactttgtgtgtcagtacccc

SEQ ID NO: 158539 - DNA, 25 bp, Homo sapien
agtacccctgggaggtgccagtcat

SEQ ID NO: 158540 - DNA, 25 bp, Homo sapien
tcattgaatagataaggctgtgcct

SEQ ID NO: 158541 - DNA, 25 bp, Homo sapien
acttctctttagtcagggcatgctt

SEQ ID NO: 158542 - DNA, 25 bp, Homo sapien
gggcatgctttattagtgaggagaa

SEQ ID NO: 158543 - DNA, 25 bp, Homo sapien
ttgtactctttagatctcccatgtg

SEQ ID NO: 158544 - DNA, 25 bp, Homo sapien
gatctcccatgtgtaggtattgaaa

SEQ ID NO: 158545 - DNA, 25 bp, Homo sapien
gtttggaagcactgatcacctgtta

SEQ ID NO: 158546 - DNA, 25 bp, Homo sapien
actgatcacctgttagcattgccat

SEQ ID NO: 158547 - DNA, 25 bp, Homo sapien
tggacaaggcccagcgctctgtcat

SEQ ID NO: 158548 - DNA, 25 bp, Homo sapien
agcgctctgtcatcaagcccatcag

SEQ ID NO: 158549 - DNA, 25 bp, Homo sapien
tgtcatcaagcccatcagcattgct

SEQ ID NO: 158550 - DNA, 25 bp, Homo sapien
catcaagcccatcagcattgctggg

SEQ ID NO: 158551 - DNA, 25 bp, Homo sapien
atcgtggtgacctccacacctgctg

SEQ ID NO: 158552 - DNA, 25 bp, Homo sapien
tcttcacctatcctagcgtcctgga

SEQ ID NO: 158553 - DNA, 25 bp, Homo sapien
ctatcctagcgtcctggagcaggag

SEQ ID NO: 158554 - DNA, 25 bp, Homo sapien
cctagcgtcctggagcaggagtcac

SEQ ID NO: 158555 - DNA, 25 bp, Homo sapien
ggagcaggagtcacccgcatctccc

SEQ ID NO: 158556 - DNA, 25 bp, Homo sapien
tgctccaaggctcaccgcagaagca

SEQ ID NO: 158557 - DNA, 25 bp, Homo sapien
aaggctcaccgcagaagcagtagca

SEQ ID NO: 158558 - DNA, 25 bp, Homo sapien
tttggaatgcacacagcggctgcct

SEQ ID NO: 158559 - DNA, 25 bp, Homo sapien
gctgcctcctgatgtttgtatcata

SEQ ID NO: 158560 - DNA, 25 bp, Homo sapien
gtatcatagtcgtattgtgcaaaga

SEQ ID NO: 158561 - DNA, 25 bp, Homo sapien
gagtagccgattttagagttctttt

SEQ ID NO: 158562 - DNA, 25 bp, Homo sapien
gaaagggtcttccttctcattgctg

SEQ ID NO: 158563 - DNA, 25 bp, Homo sapien
attgctgcccgtttgtacatgggac

SEQ ID NO: 158564 - DNA, 25 bp, Homo sapien
tgggactgattctgtcgtgttcacc

SEQ ID NO: 158565 - DNA, 25 bp, Homo sapien
gtcgtgttcaccagagaaagcttga

SEQ ID NO: 158566 - DNA, 25 bp, Homo sapien
aagcttgaggccatggcgagatact

SEQ ID NO: 158567 - DNA, 25 bp, Homo sapien
gatactgcatgtttgctgttccaca

SEQ ID NO: 158568 - DNA, 25 bp, Homo sapien
aaagcagtggcttagctgccatctt

SEQ ID NO: 158569 - DNA, 25 bp, Homo sapien
ttagtgcaagaaacagacaggcttt

SEQ ID NO: 158570 - DNA, 25 bp, Homo sapien
gaaattttgcagtcttaattacagc

SEQ ID NO: 158571 - DNA, 25 bp, Homo sapien
gtcttaattacagctgcagaagcat

SEQ ID NO: 158572 - DNA, 25 bp, Homo sapien
tacagctgcagaagcatgggatcct

SEQ ID NO: 158573 - DNA, 25 bp, Homo sapien
gaagcatgggatcctggattttttg

SEQ ID NO: 158574 - DNA, 25 bp, Homo sapien
agcatgggatcctggattttttgtt

SEQ ID NO: 158575 - DNA, 25 bp, Homo sapien
gggatcctggattttttgttgcttt

SEQ ID NO: 158576 - DNA, 25 bp, Homo sapien
tgttgctttttagtttaatgggact

SEQ ID NO: 158577 - DNA, 25 bp, Homo sapien
acacccggaatcttcttggtcctct

SEQ ID NO: 158578 - DNA, 25 bp, Homo sapien
ggaatcttcttggtcctctgctgag

SEQ ID NO: 158579 - DNA, 25 bp, Homo sapien
aatcttcttggtcctctgctgaggc

SEQ ID NO: 158580 - DNA, 25 bp, Homo sapien
attactactgagtaagagctgggca

SEQ ID NO: 158581 - DNA, 25 bp, Homo sapien
gaaagatgtcatttgcaatagagca

SEQ ID NO: 158582 - DNA, 25 bp, Homo sapien
gcaatagagcagtccattttgtatt

SEQ ID NO: 158583 - DNA, 25 bp, Homo sapien
tatgctgaattttcactggacctgt

SEQ ID NO: 158584 - DNA, 25 bp, Homo sapien
gacctgtgatgtcatttcactgtga

SEQ ID NO: 158585 - DNA, 25 bp, Homo sapien
acatgttgtctgtttggtgtctttt

SEQ ID NO: 158586 - DNA, 25 bp, Homo sapien
tgtctttttgtgcacagattatgat

SEQ ID NO: 158587 - DNA, 25 bp, Homo sapien
tgtgttatcactctgcctgtgtata

SEQ ID NO: 158588 - DNA, 25 bp, Homo sapien
gtgtatagtcagatagtccatgcga

SEQ ID NO: 158589 - DNA, 25 bp, Homo sapien
gatagtccatgcgaaggctgtatat

SEQ ID NO: 158590 - DNA, 25 bp, Homo sapien
taagttaccagtttcaataaaggat

SEQ ID NO: 158591 - DNA, 25 bp, Homo sapien
atttgtctgaataaaggtgtcccac

SEQ ID NO: 158592 - DNA, 25 bp, Homo sapien
gaataaaggtgtcccactcactgtt

SEQ ID NO: 158593 - DNA, 25 bp, Homo sapien
tgttccaggaattcttgcagtgtag

SEQ ID NO: 158594 - DNA, 25 bp, Homo sapien
cttgcagtgtagaggtattcacaac

SEQ ID NO: 158595 - DNA, 25 bp, Homo sapien
caagcagggatttggcctgccatca

SEQ ID NO: 158596 - DNA, 25 bp, Homo sapien
ttggcctgccatcaattttatttaa

SEQ ID NO: 158597 - DNA, 25 bp, Homo sapien
tgcagtttgtcctcataaacgttgt

SEQ ID NO: 158598 - DNA, 25 bp, Homo sapien
gtcctcataaacgttgtaggttgaa

SEQ ID NO: 158599 - DNA, 25 bp, Homo sapien
agataaaaggtgatctatccatcca

SEQ ID NO: 158600 - DNA, 25 bp, Homo sapien
aaggacatctgatatgtgctgcaac

SEQ ID NO: 158601 - DNA, 25 bp, Homo sapien
atatgtgctgcaacatgggtgaatc

SEQ ID NO: 158602 - DNA, 25 bp, Homo sapien
caggcggcggccctgacgagtgggc

SEQ ID NO: 158603 - DNA, 25 bp, Homo sapien
acgagtgggcggacttcggcttcga

SEQ ID NO: 158604 - DNA, 25 bp, Homo sapien
aaggcccgcaagcagcccatcaagg

SEQ ID NO: 158605 - DNA, 25 bp, Homo sapien
agcccatcaaggaggagttcacgga

SEQ ID NO: 158606 - DNA, 25 bp, Homo sapien
ttcacggaggccgagatccactgag

SEQ ID NO: 158607 - DNA, 25 bp, Homo sapien
tcacggaggccgagatccactgagg

SEQ ID NO: 158608 - DNA, 25 bp, Homo sapien
ggccgagatccactgagggcctcgc

SEQ ID NO: 158609 - DNA, 25 bp, Homo sapien
gtgtgtccaaaactgcctcaggagg

SEQ ID NO: 158610 - DNA, 25 bp, Homo sapien
gtgtccaaaactgcctcaggaggca

SEQ ID NO: 158611 - DNA, 25 bp, Homo sapien
cctcaggaggcaggaccttcgggct

SEQ ID NO: 158612 - DNA, 25 bp, Homo sapien
aggaggcaggaccttcgggctgtgc

SEQ ID NO: 158613 - DNA, 25 bp, Homo sapien
gaaggagtacaacctgcatgacctc

SEQ ID NO: 158614 - DNA, 25 bp, Homo sapien
ccacctttagcctcatcaatggaaa

SEQ ID NO: 158615 - DNA, 25 bp, Homo sapien
aatggaaacatctgtcacgagcggt

SEQ ID NO: 158616 - DNA, 25 bp, Homo sapien
ctgtcacgagcggtatgtctagatt

SEQ ID NO: 158617 - DNA, 25 bp, Homo sapien
tctagattgacccttgattttgccc

SEQ ID NO: 158618 - DNA, 25 bp, Homo sapien
gagggacggttttgctttatggcta

SEQ ID NO: 158619 - DNA, 25 bp, Homo sapien
tttatggctagacaggaacccttgc

SEQ ID NO: 158620 - DNA, 25 bp, Homo sapien
gaacccttgcatccattgttgtgtc

SEQ ID NO: 158621 - DNA, 25 bp, Homo sapien
ttgttgtgtctgtgccctccaaaga

SEQ ID NO: 158622 - DNA, 25 bp, Homo sapien
tgtgccctccaaagagccttcagaa

SEQ ID NO: 158623 - DNA, 25 bp, Homo sapien
agccttcagaatgctcctgagtggt

SEQ ID NO: 158624 - DNA, 25 bp, Homo sapien
gcaatagatatatcaccatccagag

SEQ ID NO: 158625 - DNA, 25 bp, Homo sapien
agagctggcagttaacctgggcctt

SEQ ID NO: 158626 - DNA, 25 bp, Homo sapien
ttaacctgggcctttccgagagaca

SEQ ID NO: 158627 - DNA, 25 bp, Homo sapien
gggcctttccgagagacaggtgaaa

SEQ ID NO: 158628 - DNA, 25 bp, Homo sapien
gaaaatctcccagtttgagaatagt

SEQ ID NO: 158629 - DNA, 25 bp, Homo sapien
tggaggctcggtgcaaagtgactct

SEQ ID NO: 158630 - DNA, 25 bp, Homo sapien
aagtgactctgactccatcagccct

SEQ ID NO: 158631 - DNA, 25 bp, Homo sapien
ttttttcaccacaccatctgctgtt

SEQ ID NO: 158632 - DNA, 25 bp, Homo sapien
accatctgctgttcgtggatttcaa

SEQ ID NO: 158633 - DNA, 25 bp, Homo sapien
gctgttcgtggatttcaacctattg

SEQ ID NO: 158634 - DNA, 25 bp, Homo sapien
gatacagcaggttatagtctccgaa

SEQ ID NO: 158635 - DNA, 25 bp, Homo sapien
ggtgccctaccctgggatggtgaac

SEQ ID NO: 158636 - DNA, 25 bp, Homo sapien
gtgccctaccctgggatggtgaacc

SEQ ID NO: 158637 - DNA, 25 bp, Homo sapien
cctaccctgggatggtgaaccgcga

SEQ ID NO: 158638 - DNA, 25 bp, Homo sapien
ctaccctgggatggtgaaccgcgag

SEQ ID NO: 158639 - DNA, 25 bp, Homo sapien
atggtgaaccgcgaggtgctggacc

SEQ ID NO: 158640 - DNA, 25 bp, Homo sapien
ggtgaaccgcgaggtgctggaccag

SEQ ID NO: 158641 - DNA, 25 bp, Homo sapien
gagtccctgcacgacctcatgtgcc

SEQ ID NO: 158642 - DNA, 25 bp, Homo sapien
ctcatgtgccagtgctggcggaagg

SEQ ID NO: 158643 - DNA, 25 bp, Homo sapien
ccagtgctggcggaaggagcctgag

SEQ ID NO: 158644 - DNA, 25 bp, Homo sapien
ggaggactacttcacgtccaccgag

SEQ ID NO: 158645 - DNA, 25 bp, Homo sapien
gaggactacttcacgtccaccgagc

SEQ ID NO: 158646 - DNA, 25 bp, Homo sapien
aagctctgtccattccaagaaaaga

SEQ ID NO: 158647 - DNA, 25 bp, Homo sapien
aagagatgctccagacagcctacaa

SEQ ID NO: 158648 - DNA, 25 bp, Homo sapien
tacaacaagctccacacatggcagt

SEQ ID NO: 158649 - DNA, 25 bp, Homo sapien
acatggcagtcacggcgtctgatga

SEQ ID NO: 158650 - DNA, 25 bp, Homo sapien
acgtgaggtggccatgatgcttaca

SEQ ID NO: 158651 - DNA, 25 bp, Homo sapien
gatgcttacaggttttgtgagattg

SEQ ID NO: 158652 - DNA, 25 bp, Homo sapien
gagagaactatgacctgcagcaact

SEQ ID NO: 158653 - DNA, 25 bp, Homo sapien
tatgacctgcagcaactctggaaac

SEQ ID NO: 158654 - DNA, 25 bp, Homo sapien
ggaaacctggcctgacagacaagca

SEQ ID NO: 158655 - DNA, 25 bp, Homo sapien
gataagaaacatctgctccacgcca

SEQ ID NO: 158656 - DNA, 25 bp, Homo sapien
gagctgatgctattgtacttgcaca

SEQ ID NO: 158657 - DNA, 25 bp, Homo sapien
ggacaggtttttgtcgctttacatt

SEQ ID NO: 158658 - DNA, 25 bp, Homo sapien
ggtttttgtcgctttacattgcttc

SEQ ID NO: 158659 - DNA, 25 bp, Homo sapien
tacattgcttcctagtttacagcat

SEQ ID NO: 158660 - DNA, 25 bp, Homo sapien
ttcctagtttacagcatgatgcaaa

SEQ ID NO: 158661 - DNA, 25 bp, Homo sapien
tgcaaatgattttctaacttagtgt

SEQ ID NO: 158662 - DNA, 25 bp, Homo sapien
ttattttccatctttaacctcttag

SEQ ID NO: 158663 - DNA, 25 bp, Homo sapien
gaatttcagacgttcaaattgatca

SEQ ID NO: 158664 - DNA, 25 bp, Homo sapien
aaattgatcatcacaaatcctttaa

SEQ ID NO: 158665 - DNA, 25 bp, Homo sapien
aaatcctgccttctttgtgggggag

SEQ ID NO: 158666 - DNA, 25 bp, Homo sapien
gaaatggaacaagttgtgtttgtgt

SEQ ID NO: 158667 - DNA, 25 bp, Homo sapien
gtgtttgtgttagcatgtgggtgat

SEQ ID NO: 158668 - DNA, 25 bp, Homo sapien
gggcctgagccaaggaactttcctt

SEQ ID NO: 158669 - DNA, 25 bp, Homo sapien
actttccttctactgccttatagtg

SEQ ID NO: 158670 - DNA, 25 bp, Homo sapien
atagtgcttaaacattctccgcctc

SEQ ID NO: 158671 - DNA, 25 bp, Homo sapien
gcctccagggtgcagattcagagct

SEQ ID NO: 158672 - DNA, 25 bp, Homo sapien
gccagagtttcagtgatagccgtat

SEQ ID NO: 158673 - DNA, 25 bp, Homo sapien
gttaaacagaatctcacctcagtct

SEQ ID NO: 158674 - DNA, 25 bp, Homo sapien
gtcagcccggtgacctctaaggtat

SEQ ID NO: 158675 - DNA, 25 bp, Homo sapien
gacctctaaggtatcttctaaccta

SEQ ID NO: 158676 - DNA, 25 bp, Homo sapien
tatggtgcaaggtcagtgtgtctct

SEQ ID NO: 158677 - DNA, 25 bp, Homo sapien
gtgtctctgagatctatgtctgttg

SEQ ID NO: 158678 - DNA, 25 bp, Homo sapien
gtggcaatgtgagggtgatactctc

SEQ ID NO: 158679 - DNA, 25 bp, Homo sapien
gccaacgacccttacacagttagaa

SEQ ID NO: 158680 - DNA, 25 bp, Homo sapien
gaagcaaaggccctcttaatggatg

SEQ ID NO: 158681 - DNA, 25 bp, Homo sapien
catggtcctgtttcgaatcactagt

SEQ ID NO: 158682 - DNA, 25 bp, Homo sapien
tattttacatcctctggttgccata

SEQ ID NO: 158683 - DNA, 25 bp, Homo sapien
ggttgccatatatcatctacttctt

SEQ ID NO: 158684 - DNA, 25 bp, Homo sapien
atctacttcttgttggaaagctcca

SEQ ID NO: 158685 - DNA, 25 bp, Homo sapien
tggaaagctccactggccacagcaa

SEQ ID NO: 158686 - DNA, 25 bp, Homo sapien
accacctggcttgctattagtaaca

SEQ ID NO: 158687 - DNA, 25 bp, Homo sapien
tatagtctctccaacagtgtattcc

SEQ ID NO: 158688 - DNA, 25 bp, Homo sapien
gggctatgtgtacttcttgtgcaag

SEQ ID NO: 158689 - DNA, 25 bp, Homo sapien
tgcaagtcagactacagccaacgac

SEQ ID NO: 158690 - DNA, 25 bp, Homo sapien
tacaggccagggaacataagaccgc

SEQ ID NO: 158691 - DNA, 25 bp, Homo sapien
ataagaccgcaattctaagtttcta

SEQ ID NO: 158692 - DNA, 25 bp, Homo sapien
gtttctagataaacagcgatctcca

SEQ ID NO: 158693 - DNA, 25 bp, Homo sapien
cagcgatctccaagtcaagactgag

SEQ ID NO: 158694 - DNA, 25 bp, Homo sapien
gaatgtcagaactcaagtgaagggc

SEQ ID NO: 158695 - DNA, 25 bp, Homo sapien
aagtgaagggcaatcagggcagact

SEQ ID NO: 158696 - DNA, 25 bp, Homo sapien
cagactgcctggaggagtgatgcca

SEQ ID NO: 158697 - DNA, 25 bp, Homo sapien
agaggtttatgtagggcactgtgct

SEQ ID NO: 158698 - DNA, 25 bp, Homo sapien
gacacaacaatgactgaggcagcct

SEQ ID NO: 158699 - DNA, 25 bp, Homo sapien
gcagcctggccttgccttcacaggg

SEQ ID NO: 158700 - DNA, 25 bp, Homo sapien
ttcacagggctcaccatacacaagt

SEQ ID NO: 158701 - DNA, 25 bp, Homo sapien
actgcctccatgatagattttgccc

SEQ ID NO: 158702 - DNA, 25 bp, Homo sapien
tgcctccatgatagattttgcccca

SEQ ID NO: 158703 - DNA, 25 bp, Homo sapien
gcctccatgatagattttgccccag

SEQ ID NO: 158704 - DNA, 25 bp, Homo sapien
ctccatgatagattttgccccagct

SEQ ID NO: 158705 - DNA, 25 bp, Homo sapien
tccatgatagattttgccccagctg

SEQ ID NO: 158706 - DNA, 25 bp, Homo sapien
tagattttgccccagctggactctg

SEQ ID NO: 158707 - DNA, 25 bp, Homo sapien
tgcagctccacgtggaatccaggtg

SEQ ID NO: 158708 - DNA, 25 bp, Homo sapien
agctccacgtggaatccaggtgcct

SEQ ID NO: 158709 - DNA, 25 bp, Homo sapien
tccacgtggaatccaggtgcctgcc

SEQ ID NO: 158710 - DNA, 25 bp, Homo sapien
tctgggaaagtcaccaacccgcagc

SEQ ID NO: 158711 - DNA, 25 bp, Homo sapien
tgggaaagtcaccaacccgcagctt

SEQ ID NO: 158712 - DNA, 25 bp, Homo sapien
tttacccaactctgaacaaagccct

SEQ ID NO: 158713 - DNA, 25 bp, Homo sapien
aaggcctcatcctgcggagccttaa

SEQ ID NO: 158714 - DNA, 25 bp, Homo sapien
tcatcctgcggagccttaaacaacg

SEQ ID NO: 158715 - DNA, 25 bp, Homo sapien
gcggagccttaaacaacgcagtgag

SEQ ID NO: 158716 - DNA, 25 bp, Homo sapien
aaacaacgcagtgagacagacatct

SEQ ID NO: 158717 - DNA, 25 bp, Homo sapien
gagacagacatctatcatcccattt

SEQ ID NO: 158718 - DNA, 25 bp, Homo sapien
agacatctatcatcccattttacag

SEQ ID NO: 158719 - DNA, 25 bp, Homo sapien
agaggatgtatagcctggacacaga

SEQ ID NO: 158720 - DNA, 25 bp, Homo sapien
gtatagcctggacacagaggaagtt

SEQ ID NO: 158721 - DNA, 25 bp, Homo sapien
acacagaggaagttggctagaggcc

SEQ ID NO: 158722 - DNA, 25 bp, Homo sapien
agaatggaggcaacgccagaatcca

SEQ ID NO: 158723 - DNA, 25 bp, Homo sapien
agctgtgcctactcagacctccaga

SEQ ID NO: 158724 - DNA, 25 bp, Homo sapien
agacctccagagcatgggcaccggc

SEQ ID NO: 158725 - DNA, 25 bp, Homo sapien
cccttgtttgggtgtctgtacgaag

SEQ ID NO: 158726 - DNA, 25 bp, Homo sapien
gggtgtctgtacgaagccaatgatt

SEQ ID NO: 158727 - DNA, 25 bp, Homo sapien
tacgaagccaatgattacgaggaga

SEQ ID NO: 158728 - DNA, 25 bp, Homo sapien
tacgaggagattgtctttctcatgt

SEQ ID NO: 158729 - DNA, 25 bp, Homo sapien
tgtctttctcatgttcaccctgaag

SEQ ID NO: 158730 - DNA, 25 bp, Homo sapien
ttcccagctgagtacctgcctcagt

SEQ ID NO: 158731 - DNA, 25 bp, Homo sapien
cactcctggcagagggccgacctgg

SEQ ID NO: 158732 - DNA, 25 bp, Homo sapien
agagggccgacctgggtgcctacct

SEQ ID NO: 158733 - DNA, 25 bp, Homo sapien
gtcagagccggtactgctggccaag

SEQ ID NO: 158734 - DNA, 25 bp, Homo sapien
ggctattatttgacttgttgctggt

SEQ ID NO: 158735 - DNA, 25 bp, Homo sapien
atttgacttgttgctggtttggagt

SEQ ID NO: 158736 - DNA, 25 bp, Homo sapien
tggagtttatttgagtattgctgat

SEQ ID NO: 158737 - DNA, 25 bp, Homo sapien
ttcccttccactatgagctgctggc

SEQ ID NO: 158738 - DNA, 25 bp, Homo sapien
agctgctggcagtgggtttgtattc

SEQ ID NO: 158739 - DNA, 25 bp, Homo sapien
cagtgggtttgtattcggttcccag

SEQ ID NO: 158740 - DNA, 25 bp, Homo sapien
gcatgcctgtgggagtcatggacat

SEQ ID NO: 158741 - DNA, 25 bp, Homo sapien
gagctctttgtgaatgtgaggtgtt

SEQ ID NO: 158742 - DNA, 25 bp, Homo sapien
gtgaggtgttgctaaatatgttatt

SEQ ID NO: 158743 - DNA, 25 bp, Homo sapien
atgcaatagtaggactgctgacatt

SEQ ID NO: 158744 - DNA, 25 bp, Homo sapien
gtaggactgctgacattttgcagaa

SEQ ID NO: 158745 - DNA, 25 bp, Homo sapien
accattttatgtttaggcccaagtg

SEQ ID NO: 158746 - DNA, 25 bp, Homo sapien
tgtttaggcccaagtgaccttttag

SEQ ID NO: 158747 - DNA, 25 bp, Homo sapien
tttagtcatggcttatggaacaact

SEQ ID NO: 158748 - DNA, 25 bp, Homo sapien
ggaacaactatatttcaccctctat

SEQ ID NO: 158749 - DNA, 25 bp, Homo sapien
caccctctattatatgcattcacta

SEQ ID NO: 158750 - DNA, 25 bp, Homo sapien
aaaagcgagttgtttctatagtaga

SEQ ID NO: 158751 - DNA, 25 bp, Homo sapien
tatagtagaagctgatcccctgcct

SEQ ID NO: 158752 - DNA, 25 bp, Homo sapien
agctgatcccctgcctaataatgct

SEQ ID NO: 158753 - DNA, 25 bp, Homo sapien
atgctgtaatacacaactcttggat

SEQ ID NO: 158754 - DNA, 25 bp, Homo sapien
gaaaaacgtttagtgcctcaggttg

SEQ ID NO: 158755 - DNA, 25 bp, Homo sapien
agtgcctcaggttgtcacagactag

SEQ ID NO: 158756 - DNA, 25 bp, Homo sapien
accacgtctatctctgggggtcgca

SEQ ID NO: 158757 - DNA, 25 bp, Homo sapien
gggtcgcacgttgcgggcagagcgc

SEQ ID NO: 158758 - DNA, 25 bp, Homo sapien
cgggcagagcgcaaggcatacacca

SEQ ID NO: 158759 - DNA, 25 bp, Homo sapien
ggcagagcgcaaggcatacaccaga

SEQ ID NO: 158760 - DNA, 25 bp, Homo sapien
cagagcgcaaggcatacaccagaaa

SEQ ID NO: 158761 - DNA, 25 bp, Homo sapien
gagcgcaaggcatacaccagaaaac

SEQ ID NO: 158762 - DNA, 25 bp, Homo sapien
gcaaggcatacaccagaaaacgctg

SEQ ID NO: 158763 - DNA, 25 bp, Homo sapien
aaggcatacaccagaaaacgctgtc

SEQ ID NO: 158764 - DNA, 25 bp, Homo sapien
ggcatacaccagaaaacgctgtcct

SEQ ID NO: 158765 - DNA, 25 bp, Homo sapien
atacaccagaaaacgctgtcctgtg

SEQ ID NO: 158766 - DNA, 25 bp, Homo sapien
tacaccagaaaacgctgtcctgtgg

SEQ ID NO: 158767 - DNA, 25 bp, Homo sapien
gccgtttaaaagcatgattgggaaa

SEQ ID NO: 158768 - DNA, 25 bp, Homo sapien
gagtagattgattcaccctacccac

SEQ ID NO: 158769 - DNA, 25 bp, Homo sapien
tagattgattcaccctacccacagg

SEQ ID NO: 158770 - DNA, 25 bp, Homo sapien
caccaagccactgataccattttat

SEQ ID NO: 158771 - DNA, 25 bp, Homo sapien
gcatgagtatttgctaatgttgatt

SEQ ID NO: 158772 - DNA, 25 bp, Homo sapien
taatgttgattgaacctccctttcc

SEQ ID NO: 158773 - DNA, 25 bp, Homo sapien
tccctttccccataatgtgggcaga

SEQ ID NO: 158774 - DNA, 25 bp, Homo sapien
atgtgggcagatttggctcagctcc

SEQ ID NO: 158775 - DNA, 25 bp, Homo sapien
agctccttcatgagatcaggtcagt

SEQ ID NO: 158776 - DNA, 25 bp, Homo sapien
caggtcagtggtattgtttctgtca

SEQ ID NO: 158777 - DNA, 25 bp, Homo sapien
gtttctgtcaagagtgttttttctg

SEQ ID NO: 158778 - DNA, 25 bp, Homo sapien
gagaccccaacctcggctccagggt

SEQ ID NO: 158779 - DNA, 25 bp, Homo sapien
tggctggccgaaacccttatgccct

SEQ ID NO: 158780 - DNA, 25 bp, Homo sapien
ccgaaacccttatgccctgctgggt

SEQ ID NO: 158781 - DNA, 25 bp, Homo sapien
tgaggatgagtgctgagttccgccc

SEQ ID NO: 158782 - DNA, 25 bp, Homo sapien
ttccctcccagatactttcgttttg

SEQ ID NO: 158783 - DNA, 25 bp, Homo sapien
aaagattgtttgctttgtagcccct

SEQ ID NO: 158784 - DNA, 25 bp, Homo sapien
agattgtttgctttgtagccccttc

SEQ ID NO: 158785 - DNA, 25 bp, Homo sapien
aactgaggtgagagcggctgttcca

SEQ ID NO: 158786 - DNA, 25 bp, Homo sapien
gtgagagcggctgttccaggctaac

SEQ ID NO: 158787 - DNA, 25 bp, Homo sapien
gagagcggctgttccaggctaacag

SEQ ID NO: 158788 - DNA, 25 bp, Homo sapien
gcggctgttccaggctaacagctgt

SEQ ID NO: 158789 - DNA, 25 bp, Homo sapien
tggtgtgcttcggaccttacaacgt

SEQ ID NO: 158790 - DNA, 25 bp, Homo sapien
cttacaacgtgtcccacctggtggg

SEQ ID NO: 158791 - DNA, 25 bp, Homo sapien
gaaaaagcccctggtggcggtcaat

SEQ ID NO: 158792 - DNA, 25 bp, Homo sapien
tggcggtcaatagccgtggtgttca

SEQ ID NO: 158793 - DNA, 25 bp, Homo sapien
tagccgtggtgttcagttcactcaa

SEQ ID NO: 158794 - DNA, 25 bp, Homo sapien
tcagttcactcaacgccagtctgga

SEQ ID NO: 158795 - DNA, 25 bp, Homo sapien
ctgctcttctatttctcttcttcag

SEQ ID NO: 158796 - DNA, 25 bp, Homo sapien
tcttcttcagtggtgcgcagggcat

SEQ ID NO: 158797 - DNA, 25 bp, Homo sapien
ctccctgttgggacgcagaggcaaa

SEQ ID NO: 158798 - DNA, 25 bp, Homo sapien
gggatgccaagttcggacttcacta

SEQ ID NO: 158799 - DNA, 25 bp, Homo sapien
aagttcggacttcactacagagtag

SEQ ID NO: 158800 - DNA, 25 bp, Homo sapien
cacatgtgacacatatgcaccttgt

SEQ ID NO: 158801 - DNA, 25 bp, Homo sapien
tgtgtctgtacacgtgtcctgtagt

SEQ ID NO: 158802 - DNA, 25 bp, Homo sapien
atgtgtagcctgtgcatgtatgtct

SEQ ID NO: 158803 - DNA, 25 bp, Homo sapien
cctgtgcatgtatgtcttggacact

SEQ ID NO: 158804 - DNA, 25 bp, Homo sapien
tcttggacactgtacaaggtacccc

SEQ ID NO: 158805 - DNA, 25 bp, Homo sapien
gcctgggattgacagaagcttctgc

SEQ ID NO: 158806 - DNA, 25 bp, Homo sapien
aagcttctgcccacctacttttctt

SEQ ID NO: 158807 - DNA, 25 bp, Homo sapien
acttttctttcctcagatcatccag

SEQ ID NO: 158808 - DNA, 25 bp, Homo sapien
tttcctcagatcatccagaagttcc

SEQ ID NO: 158809 - DNA, 25 bp, Homo sapien
agggccaggactttatctaatacct

SEQ ID NO: 158810 - DNA, 25 bp, Homo sapien
ctttatctaatacctctgtgtgctc

SEQ ID NO: 158811 - DNA, 25 bp, Homo sapien
aatccaattggatacgacaacttgc

SEQ ID NO: 158812 - DNA, 25 bp, Homo sapien
cgacaacttgcacgtattttaatag

SEQ ID NO: 158813 - DNA, 25 bp, Homo sapien
gcacgtattttaatagcgtcataac

SEQ ID NO: 158814 - DNA, 25 bp, Homo sapien
tagcgtcataactagaactgaattt

SEQ ID NO: 158815 - DNA, 25 bp, Homo sapien
aatttctctactgtctcagtttaca

SEQ ID NO: 158816 - DNA, 25 bp, Homo sapien
aagtgagactttgagggtgtatatt

SEQ ID NO: 158817 - DNA, 25 bp, Homo sapien
gtgtatattttctgtgcagccactg

SEQ ID NO: 158818 - DNA, 25 bp, Homo sapien
gtgcagccactgttaagccatgtgt

SEQ ID NO: 158819 - DNA, 25 bp, Homo sapien
agccatgtgttccaaggcattttag

SEQ ID NO: 158820 - DNA, 25 bp, Homo sapien
catgtgttccaaggcattttagcgg

SEQ ID NO: 158821 - DNA, 25 bp, Homo sapien
gtgactcaagacttccagagcctca

SEQ ID NO: 158822 - DNA, 25 bp, Homo sapien
agtgatccgcagtgccaccagctct

SEQ ID NO: 158823 - DNA, 25 bp, Homo sapien
cgaccccacgtgttgagccacaaag

SEQ ID NO: 158824 - DNA, 25 bp, Homo sapien
acgtgttgagccacaaagagtctct

SEQ ID NO: 158825 - DNA, 25 bp, Homo sapien
tattgatggccggacacactcgttt

SEQ ID NO: 158826 - DNA, 25 bp, Homo sapien
tggctgctttcctggaagacgtttc

SEQ ID NO: 158827 - DNA, 25 bp, Homo sapien
tggaagacgtttcctttcttctgta

SEQ ID NO: 158828 - DNA, 25 bp, Homo sapien
gtaaaattaacacctgtctgaaaat

SEQ ID NO: 158829 - DNA, 25 bp, Homo sapien
attaacacctgtctgaaaatcaaaa

SEQ ID NO: 158830 - DNA, 25 bp, Homo sapien
tcctgtctccacagccgcgtttttt

SEQ ID NO: 158831 - DNA, 25 bp, Homo sapien
cccgacctctcagcgtttgaatgaa

SEQ ID NO: 158832 - DNA, 25 bp, Homo sapien
gtttgaatgaacagcgctcccacct

SEQ ID NO: 158833 - DNA, 25 bp, Homo sapien
ctgcagtaaacggacttttcattta

SEQ ID NO: 158834 - DNA, 25 bp, Homo sapien
attcaaacttccattcacatctgca

SEQ ID NO: 158835 - DNA, 25 bp, Homo sapien
acttccattcacatctgcatgatta

SEQ ID NO: 158836 - DNA, 25 bp, Homo sapien
gatggtaacaaaacctcatattgtc

SEQ ID NO: 158837 - DNA, 25 bp, Homo sapien
aaaacctcatattgtctttacatgt

SEQ ID NO: 158838 - DNA, 25 bp, Homo sapien
tgtctttacatgtttccaatggaaa

SEQ ID NO: 158839 - DNA, 25 bp, Homo sapien
cagtttattacgtttcacttgatta

SEQ ID NO: 158840 - DNA, 25 bp, Homo sapien
gtattaaaccatgtacgttgcagct

SEQ ID NO: 158841 - DNA, 25 bp, Homo sapien
accatgtacgttgcagcttaacaat

SEQ ID NO: 158842 - DNA, 25 bp, Homo sapien
aatctatgaatctttgtgagcaatt

SEQ ID NO: 158843 - DNA, 25 bp, Homo sapien
tgtgagcaattatgctcccaaatct

SEQ ID NO: 158844 - DNA, 25 bp, Homo sapien
gaattaaccctgtgtcctcagtcgc

SEQ ID NO: 158845 - DNA, 25 bp, Homo sapien
acagctccaacttttttgaatgacc

SEQ ID NO: 158846 - DNA, 25 bp, Homo sapien
tttttgaatgaccatctggttgaaa

SEQ ID NO: 158847 - DNA, 25 bp, Homo sapien
ctggttgaaaaatctttctcatata

SEQ ID NO: 158848 - DNA, 25 bp, Homo sapien
ttctcatataagtttaaccacactt

SEQ ID NO: 158849 - DNA, 25 bp, Homo sapien
accacactttgatttgggttcattt

SEQ ID NO: 158850 - DNA, 25 bp, Homo sapien
caggatccaaaatgtggcgtttttc

SEQ ID NO: 158851 - DNA, 25 bp, Homo sapien
aaatgtggcgtttttctaagaatga

SEQ ID NO: 158852 - DNA, 25 bp, Homo sapien
taagcttttaagcatcatgaagaac

SEQ ID NO: 158853 - DNA, 25 bp, Homo sapien
tatgttcacattaagatacgttcta

SEQ ID NO: 158854 - DNA, 25 bp, Homo sapien
caaggggtgacatcttaattcctaa

SEQ ID NO: 158855 - DNA, 25 bp, Homo sapien
gcattttccacccttaaccctgtgt

SEQ ID NO: 158856 - DNA, 25 bp, Homo sapien
ttccacccttaaccctgtgttcagg

SEQ ID NO: 158857 - DNA, 25 bp, Homo sapien
cccttaaccctgtgttcaggcactt

SEQ ID NO: 158858 - DNA, 25 bp, Homo sapien
atgaattgagccaggtttggtccgt

SEQ ID NO: 158859 - DNA, 25 bp, Homo sapien
aattgagccaggtttggtccgtggt

SEQ ID NO: 158860 - DNA, 25 bp, Homo sapien
gagccaggtttggtccgtggtgtcc

SEQ ID NO: 158861 - DNA, 25 bp, Homo sapien
taaaggctgagatgaagtggactga

SEQ ID NO: 158862 - DNA, 25 bp, Homo sapien
atgaagtggactgagtagaactgga

SEQ ID NO: 158863 - DNA, 25 bp, Homo sapien
ggacaagagttgacgtgagttcctg

SEQ ID NO: 158864 - DNA, 25 bp, Homo sapien
acgtgagttcctgggagtttccaga

SEQ ID NO: 158865 - DNA, 25 bp, Homo sapien
gagttcctgggagtttccagagatg

SEQ ID NO: 158866 - DNA, 25 bp, Homo sapien
agtgatccgcagtgccaccagctct

SEQ ID NO: 158867 - DNA, 25 bp, Homo sapien
gtgatccgcagtgccaccagctctg

SEQ ID NO: 158868 - DNA, 25 bp, Homo sapien
tctgcctcgcgaccccacgtgttga

SEQ ID NO: 158869 - DNA, 25 bp, Homo sapien
gtaaaattaacacctgtctgaaaat

SEQ ID NO: 158870 - DNA, 25 bp, Homo sapien
aaaattaacacctgtctgaaaatca

SEQ ID NO: 158871 - DNA, 25 bp, Homo sapien
aaattaacacctgtctgaaaatcaa

SEQ ID NO: 158872 - DNA, 25 bp, Homo sapien
attaacacctgtctgaaaatcaaaa

SEQ ID NO: 158873 - DNA, 25 bp, Homo sapien
taacacctgtctgaaaatcaaaaac

SEQ ID NO: 158874 - DNA, 25 bp, Homo sapien
gaatgaacagcgctcccacctccag

SEQ ID NO: 158875 - DNA, 25 bp, Homo sapien
tccagtcctggcatccgctgggggc

SEQ ID NO: 158876 - DNA, 25 bp, Homo sapien
gcatccgctgggggcgctgttcttt

SEQ ID NO: 158877 - DNA, 25 bp, Homo sapien
gtggccctccaggtggcagcactaa

SEQ ID NO: 158878 - DNA, 25 bp, Homo sapien
tggccctccaggtggcagcactaag

SEQ ID NO: 158879 - DNA, 25 bp, Homo sapien
ggccctccaggtggcagcactaagg

SEQ ID NO: 158880 - DNA, 25 bp, Homo sapien
cctccaggtggcagcactaaggaca

SEQ ID NO: 158881 - DNA, 25 bp, Homo sapien
ctccaggtggcagcactaaggacac

SEQ ID NO: 158882 - DNA, 25 bp, Homo sapien
tccaggtggcagcactaaggacacc

SEQ ID NO: 158883 - DNA, 25 bp, Homo sapien
caggtggcagcactaaggacacccc

SEQ ID NO: 158884 - DNA, 25 bp, Homo sapien
gacacccccccacaacaagagttag

SEQ ID NO: 158885 - DNA, 25 bp, Homo sapien
acaagagttagcagcgaggtcccca

SEQ ID NO: 158886 - DNA, 25 bp, Homo sapien
caagagttagcagcgaggtccccat

SEQ ID NO: 158887 - DNA, 25 bp, Homo sapien
agagttagcagcgaggtccccatga

SEQ ID NO: 158888 - DNA, 25 bp, Homo sapien
cccagttcttcatctgcaccataaa

SEQ ID NO: 158889 - DNA, 25 bp, Homo sapien
tggcaagcatgttgtgttcggtcac

SEQ ID NO: 158890 - DNA, 25 bp, Homo sapien
tgttcggtcacgtcaaagagggcat

SEQ ID NO: 158891 - DNA, 25 bp, Homo sapien
tcaaagagggcatggacgtcgtgaa

SEQ ID NO: 158892 - DNA, 25 bp, Homo sapien
agaatctttcggctctaagagtggg

SEQ ID NO: 158893 - DNA, 25 bp, Homo sapien
aagattgtcatcacagactgtggcc

SEQ ID NO: 158894 - DNA, 25 bp, Homo sapien
gactgtggccagttgagctaatctg

SEQ ID NO: 158895 - DNA, 25 bp, Homo sapien
ttgagctaatctgtggccagggtgc

SEQ ID NO: 158896 - DNA, 25 bp, Homo sapien
tgcaaatgtccatgcacccaggtgg

SEQ ID NO: 158897 - DNA, 25 bp, Homo sapien
gccaaggtgcctgaaacgatacgtg

SEQ ID NO: 158898 - DNA, 25 bp, Homo sapien
tgaaacgatacgtgtgcccactcca

SEQ ID NO: 158899 - DNA, 25 bp, Homo sapien
gttctatatgcaaacatgatgtctt

SEQ ID NO: 158900 - DNA, 25 bp, Homo sapien
ttctggccaacctgtatgatggctg

SEQ ID NO: 158901 - DNA, 25 bp, Homo sapien
gcaattgttgccatggtgaaactta

SEQ ID NO: 158902 - DNA, 25 bp, Homo sapien
gtgaaacttacacagtacctctccc

SEQ ID NO: 158903 - DNA, 25 bp, Homo sapien
agtacctctccctactatgtgagag

SEQ ID NO: 158904 - DNA, 25 bp, Homo sapien
actatgtgagaggatccaacggatc

SEQ ID NO: 158905 - DNA, 25 bp, Homo sapien
gttaaagctcaaatactgttttctt

SEQ ID NO: 158906 - DNA, 25 bp, Homo sapien
gaaccttaagtttgtaacgtgcagt

SEQ ID NO: 158907 - DNA, 25 bp, Homo sapien
cgtgcagtctgttatgagttcccta

SEQ ID NO: 158908 - DNA, 25 bp, Homo sapien
gtctgttatgagttccctaatatat

SEQ ID NO: 158909 - DNA, 25 bp, Homo sapien
gcaataatgcaaaagctgttctata

SEQ ID NO: 158910 - DNA, 25 bp, Homo sapien
ataacgcttgctatcaagactttgg

SEQ ID NO: 158911 - DNA, 25 bp, Homo sapien
acgcttgctatcaagactttggagg

SEQ ID NO: 158912 - DNA, 25 bp, Homo sapien
ttttttctgtcacactgattaaatt

SEQ ID NO: 158913 - DNA, 25 bp, Homo sapien
tgtcacactgattaaatttcttctg

SEQ ID NO: 158914 - DNA, 25 bp, Homo sapien
atttcttctgaaaagccgcacatat

SEQ ID NO: 158915 - DNA, 25 bp, Homo sapien
ctgaaaagccgcacatatagacaaa

SEQ ID NO: 158916 - DNA, 25 bp, Homo sapien
gacaaacagcaaatactcaacaggg

SEQ ID NO: 158917 - DNA, 25 bp, Homo sapien
acagcaaatactcaacagggttgtt

SEQ ID NO: 158918 - DNA, 25 bp, Homo sapien
tactcaacagggttgttaacctagg

SEQ ID NO: 158919 - DNA, 25 bp, Homo sapien
ttaacctaggtaacagttcagtagt

SEQ ID NO: 158920 - DNA, 25 bp, Homo sapien
aaagaatcttttagacatctggaag

SEQ ID NO: 158921 - DNA, 25 bp, Homo sapien
gatcttctgaatggattgctgtcat

SEQ ID NO: 158922 - DNA, 25 bp, Homo sapien
ggattgctgtcatggacacggacac

SEQ ID NO: 158923 - DNA, 25 bp, Homo sapien
atggacacggacacggatcttcatc

SEQ ID NO: 158924 - DNA, 25 bp, Homo sapien
acacggatcttcatctggttcattg

SEQ ID NO: 158925 - DNA, 25 bp, Homo sapien
tccaggtgtgctgtacattcttatt

SEQ ID NO: 158926 - DNA, 25 bp, Homo sapien
gtgctgtacattcttattttatttt

SEQ ID NO: 158927 - DNA, 25 bp, Homo sapien
ttattttcacaatagctctgtgatg

SEQ ID NO: 158928 - DNA, 25 bp, Homo sapien
ctctgtgatgtaaatgctatctcca

SEQ ID NO: 158929 - DNA, 25 bp, Homo sapien
gatgtaaatgctatctccatgagaa

SEQ ID NO: 158930 - DNA, 25 bp, Homo sapien
tcataaagggtgttttgttcctttg

SEQ ID NO: 158931 - DNA, 25 bp, Homo sapien
agacattaaatctcctcatttagtg

SEQ ID NO: 158932 - DNA, 25 bp, Homo sapien
gttcatggtgcagagaattttattc

SEQ ID NO: 158933 - DNA, 25 bp, Homo sapien
atttgacaatgaatctgctgcctga

SEQ ID NO: 158934 - DNA, 25 bp, Homo sapien
caatgaatctgctgcctgaaataaa

SEQ ID NO: 158935 - DNA, 25 bp, Homo sapien
aaggacaatgtacccaatcactctc

SEQ ID NO: 158936 - DNA, 25 bp, Homo sapien
aatcactctctgtattgctgtttcc

SEQ ID NO: 158937 - DNA, 25 bp, Homo sapien
gtattgctgtttccaactgttgttt

SEQ ID NO: 158938 - DNA, 25 bp, Homo sapien
gaccctatagtttactactttacat

SEQ ID NO: 158939 - DNA, 25 bp, Homo sapien
gtttactactttacatcggacacaa

SEQ ID NO: 158940 - DNA, 25 bp, Homo sapien
tacatcggacacaattcagaattca

SEQ ID NO: 158941 - DNA, 25 bp, Homo sapien
aaaactggtctgtcaggagaagtga

SEQ ID NO: 158942 - DNA, 25 bp, Homo sapien
agaagtgacttcagattctctgaag

SEQ ID NO: 158943 - DNA, 25 bp, Homo sapien
aatatattgaacttttgtactgaat

SEQ ID NO: 158944 - DNA, 25 bp, Homo sapien
gaaggcaatattaacctaatcacca

SEQ ID NO: 158945 - DNA, 25 bp, Homo sapien
ggcaatattaacctaatcaccatgt

SEQ ID NO: 158946 - DNA, 25 bp, Homo sapien
atattaacctaatcaccatgtaagc

SEQ ID NO: 158947 - DNA, 25 bp, Homo sapien
atcaccatgtaagcactctggatga

SEQ ID NO: 158948 - DNA, 25 bp, Homo sapien
caccatgtaagcactctggatgatg

SEQ ID NO: 158949 - DNA, 25 bp, Homo sapien
ccatgtaagcactctggatgatgga

SEQ ID NO: 158950 - DNA, 25 bp, Homo sapien
ggattccacaaaacttggttttatg

SEQ ID NO: 158951 - DNA, 25 bp, Homo sapien
cttctcttagattcttaattcatga

SEQ ID NO: 158952 - DNA, 25 bp, Homo sapien
gattcttaattcatgaggagggtgg

SEQ ID NO: 158953 - DNA, 25 bp, Homo sapien
ctattaaaatgcattcgttgtgttt

SEQ ID NO: 158954 - DNA, 25 bp, Homo sapien
cacatgctctggttgagataataaa

SEQ ID NO: 158955 - DNA, 25 bp, Homo sapien
aaaagtcgctcacagcagcgtaact

SEQ ID NO: 158956 - DNA, 25 bp, Homo sapien
gcagcgtaacttccagcttctggta

SEQ ID NO: 158957 - DNA, 25 bp, Homo sapien
ccagcttctggtaatcactcatgat

SEQ ID NO: 158958 - DNA, 25 bp, Homo sapien
gtggagcttttaggacgttctgaat

SEQ ID NO: 158959 - DNA, 25 bp, Homo sapien
aagaacatcgatcagtgctcagaga

SEQ ID NO: 158960 - DNA, 25 bp, Homo sapien
aaatgcagtgttagctccctgggat

SEQ ID NO: 158961 - DNA, 25 bp, Homo sapien
tccctgggattcaatgttcattaaa

SEQ ID NO: 158962 - DNA, 25 bp, Homo sapien
gccatagaaatgtaggtcctcagaa

SEQ ID NO: 158963 - DNA, 25 bp, Homo sapien
gtaggtcctcagaaagtgtataata

SEQ ID NO: 158964 - DNA, 25 bp, Homo sapien
aaacttatttctcatatcaacttag

SEQ ID NO: 158965 - DNA, 25 bp, Homo sapien
agctccgccattgagttccctggag

SEQ ID NO: 158966 - DNA, 25 bp, Homo sapien
gagacttggcagtggatcaacccag

SEQ ID NO: 158967 - DNA, 25 bp, Homo sapien
gaggccctggtggtagagatgtcct

SEQ ID NO: 158968 - DNA, 25 bp, Homo sapien
aggactgagcctctcgagaagacag

SEQ ID NO: 158969 - DNA, 25 bp, Homo sapien
gcctctcgagaagacagagctacct

SEQ ID NO: 158970 - DNA, 25 bp, Homo sapien
agagctacctgagggtgcccctgag

SEQ ID NO: 158971 - DNA, 25 bp, Homo sapien
ctgagctggccctggatacagagtt

SEQ ID NO: 158972 - DNA, 25 bp, Homo sapien
agctggccctggatacagagttgtc

SEQ ID NO: 158973 - DNA, 25 bp, Homo sapien
atggagacaggtgcaaggccaagat

SEQ ID NO: 158974 - DNA, 25 bp, Homo sapien
ggtgcaaggccaagatgtgatcgtt

SEQ ID NO: 158975 - DNA, 25 bp, Homo sapien
ccaagatgtgatcgttgaggctcag

SEQ ID NO: 158976 - DNA, 25 bp, Homo sapien
gcaaatgtcagaaattggtgtatta

SEQ ID NO: 158977 - DNA, 25 bp, Homo sapien
aattggtgtattagactatttatct

SEQ ID NO: 158978 - DNA, 25 bp, Homo sapien
gatcttctgaatggattgctgtcat

SEQ ID NO: 158979 - DNA, 25 bp, Homo sapien
ctgaatggattgctgtcatggacac

SEQ ID NO: 158980 - DNA, 25 bp, Homo sapien
ggattgctgtcatggacacggacac

SEQ ID NO: 158981 - DNA, 25 bp, Homo sapien
tgctgtcatggacacggacacggat

SEQ ID NO: 158982 - DNA, 25 bp, Homo sapien
atggacacggacacggatcttcatc

SEQ ID NO: 158983 - DNA, 25 bp, Homo sapien
acacggacacggatcttcatctggt

SEQ ID NO: 158984 - DNA, 25 bp, Homo sapien
ggacacggatcttcatctggttcat

SEQ ID NO: 158985 - DNA, 25 bp, Homo sapien
acacggatcttcatctggttcattg

SEQ ID NO: 158986 - DNA, 25 bp, Homo sapien
tatttatatgtgagggatggatggc

SEQ ID NO: 158987 - DNA, 25 bp, Homo sapien
ataaacattttgtcccttctgctgg

SEQ ID NO: 158988 - DNA, 25 bp, Homo sapien
gggcagatagtgaaacacattgtta

SEQ ID NO: 158989 - DNA, 25 bp, Homo sapien
aggagttcctggtcctttcactaag

SEQ ID NO: 158990 - DNA, 25 bp, Homo sapien
gttcctggtcctttcactaagaatt

SEQ ID NO: 158991 - DNA, 25 bp, Homo sapien
ggtcctttcactaagaatttccaca

SEQ ID NO: 158992 - DNA, 25 bp, Homo sapien
ttcactaagaatttccacatctttt

SEQ ID NO: 158993 - DNA, 25 bp, Homo sapien
cacatcttttatggtggaagtataa

SEQ ID NO: 158994 - DNA, 25 bp, Homo sapien
ggaagtataaataagcctatgaact

SEQ ID NO: 158995 - DNA, 25 bp, Homo sapien
gtactcattgtacattatagctaca

SEQ ID NO: 158996 - DNA, 25 bp, Homo sapien
acatatttgtggttaaggttagact

SEQ ID NO: 158997 - DNA, 25 bp, Homo sapien
aaggttagactatatgatccataca

SEQ ID NO: 158998 - DNA, 25 bp, Homo sapien
tcccctgagggcacactgaccgtgg

SEQ ID NO: 158999 - DNA, 25 bp, Homo sapien
tgagggcacactgaccgtggaggcc

SEQ ID NO: 159000 - DNA, 25 bp, Homo sapien
ccaagctagccacgcagtccaacga

SEQ ID NO: 159001 - DNA, 25 bp, Homo sapien
atcccagtcaccttcgagtcgcggg

SEQ ID NO: 159002 - DNA, 25 bp, Homo sapien
agtcaccttcgagtcgcgggcccag

SEQ ID NO: 159003 - DNA, 25 bp, Homo sapien
ggcccagaagctgcaaaatccgatg

SEQ ID NO: 159004 - DNA, 25 bp, Homo sapien
aaaatccgatgagactgccgccaag

SEQ ID NO: 159005 - DNA, 25 bp, Homo sapien
gagactgccgccaagtaaagcctta

SEQ ID NO: 159006 - DNA, 25 bp, Homo sapien
gccaagtaaagccttagcctggatg

SEQ ID NO: 159007 - DNA, 25 bp, Homo sapien
agtaaagccttagcctggatgccca

SEQ ID NO: 159008 - DNA, 25 bp, Homo sapien
gccacctgtgtgttcttttgataca

SEQ ID NO: 159009 - DNA, 25 bp, Homo sapien
gagcttggcgcctgacccaggatct

SEQ ID NO: 159010 - DNA, 25 bp, Homo sapien
gacccaggatctagaaggcactctg

SEQ ID NO: 159011 - DNA, 25 bp, Homo sapien
gatctagaaggcactctgggcaggc

SEQ ID NO: 159012 - DNA, 25 bp, Homo sapien
agagctggcaggtctgagtaaccct

SEQ ID NO: 159013 - DNA, 25 bp, Homo sapien
gtaaccctggtaacaattctcttca

SEQ ID NO: 159014 - DNA, 25 bp, Homo sapien
gtaacaattctcttcaccttatcaa

SEQ ID NO: 159015 - DNA, 25 bp, Homo sapien
tcttcaccttatcaaaacctgagct

SEQ ID NO: 159016 - DNA, 25 bp, Homo sapien
aacctgagctaaaaccaatgcatca

SEQ ID NO: 159017 - DNA, 25 bp, Homo sapien
atgcatcagctgatgatgacagcag

SEQ ID NO: 159018 - DNA, 25 bp, Homo sapien
ggctgaggacccaaagtcatttccc

SEQ ID NO: 159019 - DNA, 25 bp, Homo sapien
ccaggctggcggagaataaactgcc

SEQ ID NO: 159020 - DNA, 25 bp, Homo sapien
tatggatatatacccatgtctactg

SEQ ID NO: 159021 - DNA, 25 bp, Homo sapien
tagtgcttacaatttcattcaagtc

SEQ ID NO: 159022 - DNA, 25 bp, Homo sapien
gcttacaatttcattcaagtcctga

SEQ ID NO: 159023 - DNA, 25 bp, Homo sapien
acaatttcattcaagtcctgagtat

SEQ ID NO: 159024 - DNA, 25 bp, Homo sapien
ttcaagtcctgagtatgtgtcctgc

SEQ ID NO: 159025 - DNA, 25 bp, Homo sapien
caagtcctgagtatgtgtcctgctg

SEQ ID NO: 159026 - DNA, 25 bp, Homo sapien
gtatgtgtcctgctgttactccttc

SEQ ID NO: 159027 - DNA, 25 bp, Homo sapien
ttactccttctttggtagttgaaag

SEQ ID NO: 159028 - DNA, 25 bp, Homo sapien
ctccttctttggtagttgaaagttg

SEQ ID NO: 159029 - DNA, 25 bp, Homo sapien
ggaatggcgcatgctagtgtttgaa

SEQ ID NO: 159030 - DNA, 25 bp, Homo sapien
gaatggcgcatgctagtgtttgaat

SEQ ID NO: 159031 - DNA, 25 bp, Homo sapien
tgaggactcggacacctacctgcac

SEQ ID NO: 159032 - DNA, 25 bp, Homo sapien
gctttggcaccaaaggcctagccat

SEQ ID NO: 159033 - DNA, 25 bp, Homo sapien
gcctagccatcacttttgtgtctga

SEQ ID NO: 159034 - DNA, 25 bp, Homo sapien
ccatcacttttgtgtctgacgagaa

SEQ ID NO: 159035 - DNA, 25 bp, Homo sapien
aagttaatgtggcagaacttccaga

SEQ ID NO: 159036 - DNA, 25 bp, Homo sapien
ttccagaggaaatcgacatctccac

SEQ ID NO: 159037 - DNA, 25 bp, Homo sapien
gacatctccacatacatcgagcaga

SEQ ID NO: 159038 - DNA, 25 bp, Homo sapien
tacatcgagcagagccggtaaccac

SEQ ID NO: 159039 - DNA, 25 bp, Homo sapien
agccggtaaccaccacgtgccagag

SEQ ID NO: 159040 - DNA, 25 bp, Homo sapien
tttccaggcgccactgttgagaagc

SEQ ID NO: 159041 - DNA, 25 bp, Homo sapien
gcgccactgttgagaagctagagat

SEQ ID NO: 159042 - DNA, 25 bp, Homo sapien
ctccatctgcgttgatgctcagaat

SEQ ID NO: 159043 - DNA, 25 bp, Homo sapien
gatgctcagaatcgcctacctgtgc

SEQ ID NO: 159044 - DNA, 25 bp, Homo sapien
tcgcctacctgtgcctgcgtgtaaa

SEQ ID NO: 159045 - DNA, 25 bp, Homo sapien
tgtgcctgcgtgtaaaccacagcct

SEQ ID NO: 159046 - DNA, 25 bp, Homo sapien
ggacaacacggaggatatccagctt

SEQ ID NO: 159047 - DNA, 25 bp, Homo sapien
acggaggatatccagcttccccggt

SEQ ID NO: 159048 - DNA, 25 bp, Homo sapien
cccaggcagtgccttacctgtggtg

SEQ ID NO: 159049 - DNA, 25 bp, Homo sapien
tgccttacctgtggtgcccagaaaa

SEQ ID NO: 159050 - DNA, 25 bp, Homo sapien
gtgcccagaaaagtgcccctaggtt

SEQ ID NO: 159051 - DNA, 25 bp, Homo sapien
tgcccctaggttggtgggtctacag

SEQ ID NO: 159052 - DNA, 25 bp, Homo sapien
ggtgggtctacaggagcctcagcca

SEQ ID NO: 159053 - DNA, 25 bp, Homo sapien
tcgagctgtctgtcgctactacaat

SEQ ID NO: 159054 - DNA, 25 bp, Homo sapien
gctactacaataatgacctgctccg

SEQ ID NO: 159055 - DNA, 25 bp, Homo sapien
ataatgacctgctccgaaaccggtt

SEQ ID NO: 159056 - DNA, 25 bp, Homo sapien
gaaaccggttcatcggcctccagtt

SEQ ID NO: 159057 - DNA, 25 bp, Homo sapien
gttcttcttcaaaacaggttctgtg

SEQ ID NO: 159058 - DNA, 25 bp, Homo sapien
aaacaggttctgtgatctgcttcgc

SEQ ID NO: 159059 - DNA, 25 bp, Homo sapien
atctgcttcgccttagttttggctg

SEQ ID NO: 159060 - DNA, 25 bp, Homo sapien
tagttttggctgtcctgaggcagca

SEQ ID NO: 159061 - DNA, 25 bp, Homo sapien
agccctgccgtagagcagcaattgc

SEQ ID NO: 159062 - DNA, 25 bp, Homo sapien
gaagccagaggattcccgagtgtga

SEQ ID NO: 159063 - DNA, 25 bp, Homo sapien
aggattcccgagtgtgagctgtctt

SEQ ID NO: 159064 - DNA, 25 bp, Homo sapien
tcccctgagggcacactgaccgtgg

SEQ ID NO: 159065 - DNA, 25 bp, Homo sapien
cccctgagggcacactgaccgtgga

SEQ ID NO: 159066 - DNA, 25 bp, Homo sapien
cctgagggcacactgaccgtggagg

SEQ ID NO: 159067 - DNA, 25 bp, Homo sapien
ctgagggcacactgaccgtggaggc

SEQ ID NO: 159068 - DNA, 25 bp, Homo sapien
tgagggcacactgaccgtggaggcc

SEQ ID NO: 159069 - DNA, 25 bp, Homo sapien
agggcacactgaccgtggaggcccc

SEQ ID NO: 159070 - DNA, 25 bp, Homo sapien
ggcacactgaccgtggaggccccca

SEQ ID NO: 159071 - DNA, 25 bp, Homo sapien
atgcccaagctagccacgcagtcca

SEQ ID NO: 159072 - DNA, 25 bp, Homo sapien
ccaagctagccacgcagtccaacga

SEQ ID NO: 159073 - DNA, 25 bp, Homo sapien
atcccagtcaccttcgagtcgcggg

SEQ ID NO: 159074 - DNA, 25 bp, Homo sapien
cttcgagtcgcgggcccagcttggg

SEQ ID NO: 159075 - DNA, 25 bp, Homo sapien
tgtggcctttgaattttcctcattg

SEQ ID NO: 159076 - DNA, 25 bp, Homo sapien
ggcctttgaattttcctcattggaa

SEQ ID NO: 159077 - DNA, 25 bp, Homo sapien
gatcactgataaatatcttcatggt

SEQ ID NO: 159078 - DNA, 25 bp, Homo sapien
gatgcagagaagatctgctcggaat

SEQ ID NO: 159079 - DNA, 25 bp, Homo sapien
agatctgctcggaattgtagccata

SEQ ID NO: 159080 - DNA, 25 bp, Homo sapien
ctgctcggaattgtagccatatgtt

SEQ ID NO: 159081 - DNA, 25 bp, Homo sapien
gtagccatatgttacagatctcagc

SEQ ID NO: 159082 - DNA, 25 bp, Homo sapien
atatgttacagatctcagcaccgat

SEQ ID NO: 159083 - DNA, 25 bp, Homo sapien
gaactgtaaagctataatccccaga

SEQ ID NO: 159084 - DNA, 25 bp, Homo sapien
gctataatccccagaattaaagttt

SEQ ID NO: 159085 - DNA, 25 bp, Homo sapien
catagacgtttatttatgtgattaa

SEQ ID NO: 159086 - DNA, 25 bp, Homo sapien
catgcagaaagagatcaccgcgctg

SEQ ID NO: 159087 - DNA, 25 bp, Homo sapien
caggagtacgacgaggccggccctt

SEQ ID NO: 159088 - DNA, 25 bp, Homo sapien
cgcaaatgcttctaacacactccac

SEQ ID NO: 159089 - DNA, 25 bp, Homo sapien
tccagcacgcgacttctcaggacga

SEQ ID NO: 159090 - DNA, 25 bp, Homo sapien
gcacgcgacttctcaggacgacgaa

SEQ ID NO: 159091 - DNA, 25 bp, Homo sapien
gcgacttctcaggacgacgaatctt

SEQ ID NO: 159092 - DNA, 25 bp, Homo sapien
cttctcaggacgacgaatcttctca

SEQ ID NO: 159093 - DNA, 25 bp, Homo sapien
tctcaggacgacgaatcttctcaat

SEQ ID NO: 159094 - DNA, 25 bp, Homo sapien
caggacgacgaatcttctcaatggg

SEQ ID NO: 159095 - DNA, 25 bp, Homo sapien
cgacgaatcttctcaatgggggggc

SEQ ID NO: 159096 - DNA, 25 bp, Homo sapien
caccccgcagtcactttctttgtaa

SEQ ID NO: 159097 - DNA, 25 bp, Homo sapien
tcgacccgtacagttgagagccagg

SEQ ID NO: 159098 - DNA, 25 bp, Homo sapien
gtgggagctgctacctggcagtttc

SEQ ID NO: 159099 - DNA, 25 bp, Homo sapien
ggtcaccgagcctctggtgggacac

SEQ ID NO: 159100 - DNA, 25 bp, Homo sapien
aggagtgctctcaccacgaggctgc

SEQ ID NO: 159101 - DNA, 25 bp, Homo sapien
acgaggctgcttccgcagggaaccc

SEQ ID NO: 159102 - DNA, 25 bp, Homo sapien
gcgacttcgcatcagggaccgcatg

SEQ ID NO: 159103 - DNA, 25 bp, Homo sapien
gggaccgcatgctgatttgtactgc

SEQ ID NO: 159104 - DNA, 25 bp, Homo sapien
atgctgatttgtactgctctctgct

SEQ ID NO: 159105 - DNA, 25 bp, Homo sapien
gttttctatgttcttttcgagtgtg

SEQ ID NO: 159106 - DNA, 25 bp, Homo sapien
ggtgaatcgtattttacacagcggt

SEQ ID NO: 159107 - DNA, 25 bp, Homo sapien
tttacacagcggtcttatttatata

SEQ ID NO: 159108 - DNA, 25 bp, Homo sapien
gtggtgtttattgcaataaccgctt

SEQ ID NO: 159109 - DNA, 25 bp, Homo sapien
ataaccgcttggtttgcaacctctt

SEQ ID NO: 159110 - DNA, 25 bp, Homo sapien
gcaacctctttgctcaacagaacat

SEQ ID NO: 159111 - DNA, 25 bp, Homo sapien
agaacatatgttgcaagaccctccc

SEQ ID NO: 159112 - DNA, 25 bp, Homo sapien
ttttggcaaggctgacagagctctg

SEQ ID NO: 159113 - DNA, 25 bp, Homo sapien
cagagctctgggttgtgcacatttc

SEQ ID NO: 159114 - DNA, 25 bp, Homo sapien
gcacatttctttgcattccagctgt

SEQ ID NO: 159115 - DNA, 25 bp, Homo sapien
actctgtgcctttctacaactgatt

SEQ ID NO: 159116 - DNA, 25 bp, Homo sapien
agaggcacttccaccttggctggga

SEQ ID NO: 159117 - DNA, 25 bp, Homo sapien
gctgggaagactatggtgctgcctt

SEQ ID NO: 159118 - DNA, 25 bp, Homo sapien
tggtgctgccttgcttctgtatttc

SEQ ID NO: 159119 - DNA, 25 bp, Homo sapien
gtgtctcacactggcgtagaagttt

SEQ ID NO: 159120 - DNA, 25 bp, Homo sapien
ttttgtactgtaaagagacctacct

SEQ ID NO: 159121 - DNA, 25 bp, Homo sapien
acctacctcaggttgctggttgctg

SEQ ID NO: 159122 - DNA, 25 bp, Homo sapien
gtgggcgtggtcactgctgtcatca

SEQ ID NO: 159123 - DNA, 25 bp, Homo sapien
ctgctgtcatcagttgaatggtcag

SEQ ID NO: 159124 - DNA, 25 bp, Homo sapien
gaatggtcagcgttgcatgtcgtga

SEQ ID NO: 159125 - DNA, 25 bp, Homo sapien
cagcgttgcatgtcgtgaccaacta

SEQ ID NO: 159126 - DNA, 25 bp, Homo sapien
tgaccaactagacattctgtcgcct

SEQ ID NO: 159127 - DNA, 25 bp, Homo sapien
attctgtcgccttagcatgtttgct

SEQ ID NO: 159128 - DNA, 25 bp, Homo sapien
gcatgtttgctgaacaccttgtgga

SEQ ID NO: 159129 - DNA, 25 bp, Homo sapien
gaacaccttgtggaagcaaaaatct

SEQ ID NO: 159130 - DNA, 25 bp, Homo sapien
gcttctcttaaacactaaaaaggca

SEQ ID NO: 159131 - DNA, 25 bp, Homo sapien
gacctggtcgtcgtcttgactttgg

SEQ ID NO: 159132 - DNA, 25 bp, Homo sapien
ggtcgtcgtcttgactttggcaaat

SEQ ID NO: 159133 - DNA, 25 bp, Homo sapien
tttggcaaatgagccggagcccctt

SEQ ID NO: 159134 - DNA, 25 bp, Homo sapien
caaatgagccggagccccttgggca

SEQ ID NO: 159135 - DNA, 25 bp, Homo sapien
cttgggcaggtcacacaacctgtcc

SEQ ID NO: 159136 - DNA, 25 bp, Homo sapien
ggtcacacaacctgtcccagcgagg

SEQ ID NO: 159137 - DNA, 25 bp, Homo sapien
agcgagggacactgagtggcccttc

SEQ ID NO: 159138 - DNA, 25 bp, Homo sapien
gcccttcatgtacatccatggtgtg

SEQ ID NO: 159139 - DNA, 25 bp, Homo sapien
atccatggtgtgctggcttaaaatg

SEQ ID NO: 159140 - DNA, 25 bp, Homo sapien
aatcttgtaaatatactcctagtaa

SEQ ID NO: 159141 - DNA, 25 bp, Homo sapien
caatgctctggtggctagggatgta

SEQ ID NO: 159142 - DNA, 25 bp, Homo sapien
gtggctagggatgtactcatgctca

SEQ ID NO: 159143 - DNA, 25 bp, Homo sapien
ctcatgctcatatgtgtgcacgctt

SEQ ID NO: 159144 - DNA, 25 bp, Homo sapien
tatgtgtgcacgcttggacacccac

SEQ ID NO: 159145 - DNA, 25 bp, Homo sapien
tggacacctagccaccctgttgtgt

SEQ ID NO: 159146 - DNA, 25 bp, Homo sapien
cagttgagctgaatcttttccccag

SEQ ID NO: 159147 - DNA, 25 bp, Homo sapien
gtggaaagactgaggcttctgccta

SEQ ID NO: 159148 - DNA, 25 bp, Homo sapien
aggcttctgcctactgagcaaggtt

SEQ ID NO: 159149 - DNA, 25 bp, Homo sapien
aggttgggtgcttcatttgtgttca

SEQ ID NO: 159150 - DNA, 25 bp, Homo sapien
gggtgcttcatttgtgttcagtctg

SEQ ID NO: 159151 - DNA, 25 bp, Homo sapien
ttatgggaaagttagctcttcccag

SEQ ID NO: 159152 - DNA, 25 bp, Homo sapien
gacttttgagttaatcagcgtaagg

SEQ ID NO: 159153 - DNA, 25 bp, Homo sapien
gatttctaaagcaggcaatccctgt

SEQ ID NO: 159154 - DNA, 25 bp, Homo sapien
gcaatccctgtagccgcagagaata

SEQ ID NO: 159155 - DNA, 25 bp, Homo sapien
gcagagaataaacgccttcccaaaa

SEQ ID NO: 159156 - DNA, 25 bp, Homo sapien
ttcccaaaatggcaacttcccacag

SEQ ID NO: 159157 - DNA, 25 bp, Homo sapien
cacagccacatttcagacctgctga

SEQ ID NO: 159158 - DNA, 25 bp, Homo sapien
ggaatggcagtgaggtttcttcaat

SEQ ID NO: 159159 - DNA, 25 bp, Homo sapien
aggtttcttcaattagtctcagttc

SEQ ID NO: 159160 - DNA, 25 bp, Homo sapien
cttcaattagtctcagttctcttaa

SEQ ID NO: 159161 - DNA, 25 bp, Homo sapien
gaaagggaaattgcagctcctcagc

SEQ ID NO: 159162 - DNA, 25 bp, Homo sapien
gatggtagcgttggtgccaggccgt

SEQ ID NO: 159163 - DNA, 25 bp, Homo sapien
gagccctcctggtgggaagacagct

SEQ ID NO: 159164 - DNA, 25 bp, Homo sapien
ttcccaggagccatgcgtggcctgc

SEQ ID NO: 159165 - DNA, 25 bp, Homo sapien
atgcgtggcctgcagagtccattcc

SEQ ID NO: 159166 - DNA, 25 bp, Homo sapien
gcagagtccattccatcatgatgct

SEQ ID NO: 159167 - DNA, 25 bp, Homo sapien
atcatgatgctgtgcccgctatggg

SEQ ID NO: 159168 - DNA, 25 bp, Homo sapien
tgtgcccgctatgggctgtgtccat

SEQ ID NO: 159169 - DNA, 25 bp, Homo sapien
tgttatagcccctcaccgggacttg

SEQ ID NO: 159170 - DNA, 25 bp, Homo sapien
gggccctctggaatggcatcccatg

SEQ ID NO: 159171 - DNA, 25 bp, Homo sapien
ctggaatggcatcccatgagcttgt

SEQ ID NO: 159172 - DNA, 25 bp, Homo sapien
tgagcttgtggcctctatctgctac

SEQ ID NO: 159173 - DNA, 25 bp, Homo sapien
ggcctctatctgctaccatctgtgt

SEQ ID NO: 159174 - DNA, 25 bp, Homo sapien
caccctggatgcctcatggagaatt

SEQ ID NO: 159175 - DNA, 25 bp, Homo sapien
gaagcctccttaaggagccacagga

SEQ ID NO: 159176 - DNA, 25 bp, Homo sapien
acaggatggtacctggccccaaaag

SEQ ID NO: 159177 - DNA, 25 bp, Homo sapien
aacaggtgacttcattctttagagt

SEQ ID NO: 159178 - DNA, 25 bp, Homo sapien
gagtgaactttccaaacccagtcca

SEQ ID NO: 159179 - DNA, 25 bp, Homo sapien
aaacccagtccagctggaaacagct

SEQ ID NO: 159180 - DNA, 25 bp, Homo sapien
ctataatctgaaatgctggctcaaa

SEQ ID NO: 159181 - DNA, 25 bp, Homo sapien
gggaggttcccagattgcgtagcat

SEQ ID NO: 159182 - DNA, 25 bp, Homo sapien
gattgcgtagcattcagattgattt

SEQ ID NO: 159183 - DNA, 25 bp, Homo sapien
gatttgagcagctcctactgtgata

SEQ ID NO: 159184 - DNA, 25 bp, Homo sapien
agtgtatcccagatccacaatgtaa

SEQ ID NO: 159185 - DNA, 25 bp, Homo sapien
gactcatcctgaacagcatggcact

SEQ ID NO: 159186 - DNA, 25 bp, Homo sapien
cagcacaaacacaaggtcatggcca

SEQ ID NO: 159187 - DNA, 25 bp, Homo sapien
aaggtcatggccacactgtgacaca

SEQ ID NO: 159188 - DNA, 25 bp, Homo sapien
agcagccaacagctacaacagcctc

SEQ ID NO: 159189 - DNA, 25 bp, Homo sapien
aatccaggtacgcacagacaggttt

SEQ ID NO: 159190 - DNA, 25 bp, Homo sapien
ccaggtacgcacagacaggttttca

SEQ ID NO: 159191 - DNA, 25 bp, Homo sapien
ggttttcacataaatgcagcccatt

SEQ ID NO: 159192 - DNA, 25 bp, Homo sapien
tcacataaatgcagcccatttctcc

SEQ ID NO: 159193 - DNA, 25 bp, Homo sapien
gggtgttaatttatgcacttataag

SEQ ID NO: 159194 - DNA, 25 bp, Homo sapien
atgcacttataaggtgttttctgtg

SEQ ID NO: 159195 - DNA, 25 bp, Homo sapien
ctgtgtaaccattttataaagtgct

SEQ ID NO: 159196 - DNA, 25 bp, Homo sapien
gggttcgaggccttctatgcagccg

SEQ ID NO: 159197 - DNA, 25 bp, Homo sapien
gttcgaggccttctatgcagccgag

SEQ ID NO: 159198 - DNA, 25 bp, Homo sapien
tcgaggccttctatgcagccgagga

SEQ ID NO: 159199 - DNA, 25 bp, Homo sapien
gaggccttctatgcagccgaggaca

SEQ ID NO: 159200 - DNA, 25 bp, Homo sapien
aggccttctatgcagccgaggacat

SEQ ID NO: 159201 - DNA, 25 bp, Homo sapien
gccttctatgcagccgaggacattg

SEQ ID NO: 159202 - DNA, 25 bp, Homo sapien
agccgaggacattgacgagtgccag

SEQ ID NO: 159203 - DNA, 25 bp, Homo sapien
ccgaggacattgacgagtgccaggt

SEQ ID NO: 159204 - DNA, 25 bp, Homo sapien
gacattgacgagtgccaggtggccc

SEQ ID NO: 159205 - DNA, 25 bp, Homo sapien
acattgacgagtgccaggtggcccc

SEQ ID NO: 159206 - DNA, 25 bp, Homo sapien
tgacgagtgccaggtggccccggga

SEQ ID NO: 159207 - DNA, 25 bp, Homo sapien
atctggctggatctcgtggccttcc

SEQ ID NO: 159208 - DNA, 25 bp, Homo sapien
tcagactacccatgtctccacgaag

SEQ ID NO: 159209 - DNA, 25 bp, Homo sapien
catgtctccacgaaggcgtcctgga

SEQ ID NO: 159210 - DNA, 25 bp, Homo sapien
acgaaggcgtcctggagtcactccc

SEQ ID NO: 159211 - DNA, 25 bp, Homo sapien
gtgtgcttgctagctgggcaagaaa

SEQ ID NO: 159212 - DNA, 25 bp, Homo sapien
agaaagcagcagtggacctgcccca

SEQ ID NO: 159213 - DNA, 25 bp, Homo sapien
aaggccacacgtgcctggtcaggct

SEQ ID NO: 159214 - DNA, 25 bp, Homo sapien
gcctggtcaggctggcttctgatgt

SEQ ID NO: 159215 - DNA, 25 bp, Homo sapien
tcaggctggcttctgatgttcagtc

SEQ ID NO: 159216 - DNA, 25 bp, Homo sapien
tggcttctgatgttcagtcccctgg

SEQ ID NO: 159217 - DNA, 25 bp, Homo sapien
gttcagtcccctgggccgggacaga

SEQ ID NO: 159218 - DNA, 25 bp, Homo sapien
gttaactgtgcaaaattggctggct

SEQ ID NO: 159219 - DNA, 25 bp, Homo sapien
aaaattggctggctgcctctgttcc

SEQ ID NO: 159220 - DNA, 25 bp, Homo sapien
cctctgttcctactgtactgtaact

SEQ ID NO: 159221 - DNA, 25 bp, Homo sapien
gttcctactgtactgtaactttgat

SEQ ID NO: 159222 - DNA, 25 bp, Homo sapien
actgtaactttgatcatgtctgttc

SEQ ID NO: 159223 - DNA, 25 bp, Homo sapien
ctggtgtctgggtagtcatggattt

SEQ ID NO: 159224 - DNA, 25 bp, Homo sapien
tctgggtagtcatggatttctgctg

SEQ ID NO: 159225 - DNA, 25 bp, Homo sapien
gataaacaatccagcattacttagg

SEQ ID NO: 159226 - DNA, 25 bp, Homo sapien
attacttaggaaatgctacatgcgg

SEQ ID NO: 159227 - DNA, 25 bp, Homo sapien
gctacatgcggaatgtgcacgtttc

SEQ ID NO: 159228 - DNA, 25 bp, Homo sapien
catgcggaatgtgcacgtttccagg

SEQ ID NO: 159229 - DNA, 25 bp, Homo sapien
ctaagccttgcatgcaaaatttgaa

SEQ ID NO: 159230 - DNA, 25 bp, Homo sapien
attggcacccaaaacctacatggaa

SEQ ID NO: 159231 - DNA, 25 bp, Homo sapien
aacctacatggaatgtatgtctgga

SEQ ID NO: 159232 - DNA, 25 bp, Homo sapien
gtatgtctggagtatttcaaacttt

SEQ ID NO: 159233 - DNA, 25 bp, Homo sapien
acattgaaacataatttccttggaa

SEQ ID NO: 159234 - DNA, 25 bp, Homo sapien
ggaaaacaaaccataagcctgagga

SEQ ID NO: 159235 - DNA, 25 bp, Homo sapien
aagcctgaggaggtttttatcaact

SEQ ID NO: 159236 - DNA, 25 bp, Homo sapien
tatcaactggaatgctttatattag

SEQ ID NO: 159237 - DNA, 25 bp, Homo sapien
ttttcactgtacattcctcatttta

SEQ ID NO: 159238 - DNA, 25 bp, Homo sapien
ttacattcatttaacctgccgatta

SEQ ID NO: 159239 - DNA, 25 bp, Homo sapien
attcatttaacctgccgattattta

SEQ ID NO: 159240 - DNA, 25 bp, Homo sapien
tgccccattcttttaacgttgtagg

SEQ ID NO: 159241 - DNA, 25 bp, Homo sapien
ttttaacgttgtagggcctgcccat

SEQ ID NO: 159242 - DNA, 25 bp, Homo sapien
atggagcggaccctcctctttgggc

SEQ ID NO: 159243 - DNA, 25 bp, Homo sapien
gcctcgtgagcttttttgcttatca

SEQ ID NO: 159244 - DNA, 25 bp, Homo sapien
tgcttatcatgttccatttcgtgcc

SEQ ID NO: 159245 - DNA, 25 bp, Homo sapien
ccttcaagatgccatttggagggta

SEQ ID NO: 159246 - DNA, 25 bp, Homo sapien
tgcttcccactgtgactgggctatg

SEQ ID NO: 159247 - DNA, 25 bp, Homo sapien
tgggctatgggattctgactacctt

SEQ ID NO: 159248 - DNA, 25 bp, Homo sapien
gactaccttgcttacagattcatgg

SEQ ID NO: 159249 - DNA, 25 bp, Homo sapien
caaaacttgaaatgcaggacgccat

SEQ ID NO: 159250 - DNA, 25 bp, Homo sapien
gcaggacgccattaagtgtctgttt

SEQ ID NO: 159251 - DNA, 25 bp, Homo sapien
agaactccagagtcacctgtctcat

SEQ ID NO: 159252 - DNA, 25 bp, Homo sapien
tccagagtcacctgtctcatcggct

SEQ ID NO: 159253 - DNA, 25 bp, Homo sapien
tgtctcatcggctcccaacaagtgc

SEQ ID NO: 159254 - DNA, 25 bp, Homo sapien
atcggctcccaacaagtgcctcttt

SEQ ID NO: 159255 - DNA, 25 bp, Homo sapien
aagtgcctctttgtctatgatgtcc

SEQ ID NO: 159256 - DNA, 25 bp, Homo sapien
gaggcctggacccacccatctttgt

SEQ ID NO: 159257 - DNA, 25 bp, Homo sapien
ggccaggagctaagtgcctttttgt

SEQ ID NO: 159258 - DNA, 25 bp, Homo sapien
gctaagtgcctttttgtgtgcaacc

SEQ ID NO: 159259 - DNA, 25 bp, Homo sapien
gtgcctttttgtgtgcaaccactta

SEQ ID NO: 159260 - DNA, 25 bp, Homo sapien
ttttgtgtgcaaccacttacccttt

SEQ ID NO: 159261 - DNA, 25 bp, Homo sapien
tgcaaccacttaccctttctctgaa

SEQ ID NO: 159262 - DNA, 25 bp, Homo sapien
ttaagagttttaaccagctgctgca

SEQ ID NO: 159263 - DNA, 25 bp, Homo sapien
gatatagtaaatgcatctcccagag

SEQ ID NO: 159264 - DNA, 25 bp, Homo sapien
gcatctcccagagtaatattcactt

SEQ ID NO: 159265 - DNA, 25 bp, Homo sapien
gagtaatattcacttaacacattga

SEQ ID NO: 159266 - DNA, 25 bp, Homo sapien
aacacttgttatgagttaacttgga

SEQ ID NO: 159267 - DNA, 25 bp, Homo sapien
gagttaacttggattacattttgaa

SEQ ID NO: 159268 - DNA, 25 bp, Homo sapien
gaaatcagttcattccatgatgcat

SEQ ID NO: 159269 - DNA, 25 bp, Homo sapien
gttcattccatgatgcatattactg

SEQ ID NO: 159270 - DNA, 25 bp, Homo sapien
gatgcatattactggattagattaa

SEQ ID NO: 159271 - DNA, 25 bp, Homo sapien
agaaaagattaagggacgggcacat

SEQ ID NO: 159272 - DNA, 25 bp, Homo sapien
gattaagggacgggcacatttttca

SEQ ID NO: 159273 - DNA, 25 bp, Homo sapien
gagagatttcccatatttccatcag

SEQ ID NO: 159274 - DNA, 25 bp, Homo sapien
gagatttcccatatttccatcagag

SEQ ID NO: 159275 - DNA, 25 bp, Homo sapien
gatttcccatatttccatcagagta

SEQ ID NO: 159276 - DNA, 25 bp, Homo sapien
tttcccatatttccatcagagtaat

SEQ ID NO: 159277 - DNA, 25 bp, Homo sapien
cccatatttccatcagagtaataaa

SEQ ID NO: 159278 - DNA, 25 bp, Homo sapien
atatatgctgaattacttgtgaaga

SEQ ID NO: 159279 - DNA, 25 bp, Homo sapien
agaaattggttattatgcttactgt

SEQ ID NO: 159280 - DNA, 25 bp, Homo sapien
ttggttattatgcttactgttctaa

SEQ ID NO: 159281 - DNA, 25 bp, Homo sapien
ttatgcttactgttctaatctggtg

SEQ ID NO: 159282 - DNA, 25 bp, Homo sapien
atgcttactgttctaatctggtggt

SEQ ID NO: 159283 - DNA, 25 bp, Homo sapien
gcttactgttctaatctggtggtaa

SEQ ID NO: 159284 - DNA, 25 bp, Homo sapien
cactgttttggatgcatgttgaaag

SEQ ID NO: 159285 - DNA, 25 bp, Homo sapien
catttaataacctgtaaggcacgta

SEQ ID NO: 159286 - DNA, 25 bp, Homo sapien
tgtaaggcacgtaagtttaagcttt

SEQ ID NO: 159287 - DNA, 25 bp, Homo sapien
gaaaaatttgagacgcaataccaat

SEQ ID NO: 159288 - DNA, 25 bp, Homo sapien
gacgcaataccaatacttaggattt

SEQ ID NO: 159289 - DNA, 25 bp, Homo sapien
aatacttaggattttggtcttggtg

SEQ ID NO: 159290 - DNA, 25 bp, Homo sapien
aggattttggtcttggtgtttgtat

SEQ ID NO: 159291 - DNA, 25 bp, Homo sapien
tgtatgaaattctgaggccttgatt

SEQ ID NO: 159292 - DNA, 25 bp, Homo sapien
atgaaattctgaggccttgatttaa

SEQ ID NO: 159293 - DNA, 25 bp, Homo sapien
tgtattgtgatttccttttaggtat

SEQ ID NO: 159294 - DNA, 25 bp, Homo sapien
ttccttttaggtatattgcgctaag

SEQ ID NO: 159295 - DNA, 25 bp, Homo sapien
ttgcctcgggcagccttgtgggtac

SEQ ID NO: 159296 - DNA, 25 bp, Homo sapien
cgggcagccttgtgggtactctgca

SEQ ID NO: 159297 - DNA, 25 bp, Homo sapien
tggactctccggattgaccaagttc

SEQ ID NO: 159298 - DNA, 25 bp, Homo sapien
actctccggattgaccaagttcatc

SEQ ID NO: 159299 - DNA, 25 bp, Homo sapien
ggattgaccaagttcatcctgggct

SEQ ID NO: 159300 - DNA, 25 bp, Homo sapien
tcctgggctccattgggtctgccat

SEQ ID NO: 159301 - DNA, 25 bp, Homo sapien
attgggtctgccattgcggctgtca

SEQ ID NO: 159302 - DNA, 25 bp, Homo sapien
tgccattgcggctgtcattgcgagg

SEQ ID NO: 159303 - DNA, 25 bp, Homo sapien
ggctgtcattgcgaggttctactag

SEQ ID NO: 159304 - DNA, 25 bp, Homo sapien
cagcgaggagccaactatcccaaat

SEQ ID NO: 159305 - DNA, 25 bp, Homo sapien
gcgaggagccaactatcccaaatat

SEQ ID NO: 159306 - DNA, 25 bp, Homo sapien
cagaggatgtactcctggccatgat

SEQ ID NO: 159307 - DNA, 25 bp, Homo sapien
ggatgtactcctggccatgatcata

SEQ ID NO: 159308 - DNA, 25 bp, Homo sapien
tgtactcctggccatgatcatagcc

SEQ ID NO: 159309 - DNA, 25 bp, Homo sapien
cttcctcatcactcttgtagtatgg

SEQ ID NO: 159310 - DNA, 25 bp, Homo sapien
tcatcactcttgtagtatggaggag

SEQ ID NO: 159311 - DNA, 25 bp, Homo sapien
agtaaagacagtgaggcccaggcct

SEQ ID NO: 159312 - DNA, 25 bp, Homo sapien
gggcacgagcttctcaacaaccatg

SEQ ID NO: 159313 - DNA, 25 bp, Homo sapien
cacgagcttctcaacaaccatgtta

SEQ ID NO: 159314 - DNA, 25 bp, Homo sapien
tctcaacaaccatgttactccactt

SEQ ID NO: 159315 - DNA, 25 bp, Homo sapien
ccctggattgctgggaatggaagcc

SEQ ID NO: 159316 - DNA, 25 bp, Homo sapien
cagggttgggcatggcacaagttct

SEQ ID NO: 159317 - DNA, 25 bp, Homo sapien
ggctatggggacatgtgcccgacca

SEQ ID NO: 159318 - DNA, 25 bp, Homo sapien
gaagaaaagcagaacatcccaggag

SEQ ID NO: 159319 - DNA, 25 bp, Homo sapien
aacatcccaggagaaattgaaagaa

SEQ ID NO: 159320 - DNA, 25 bp, Homo sapien
atcctcaacagtgtaggctcaagaa

SEQ ID NO: 159321 - DNA, 25 bp, Homo sapien
aacagtgtaggctcaagaatgggca

SEQ ID NO: 159322 - DNA, 25 bp, Homo sapien
caagaatgggcagcacagactctct

SEQ ID NO: 159323 - DNA, 25 bp, Homo sapien
tgggcagcacagactctcttaataa

SEQ ID NO: 159324 - DNA, 25 bp, Homo sapien
ggcagcacagactctcttaataaga

SEQ ID NO: 159325 - DNA, 25 bp, Homo sapien
gcacagactctcttaataagaccaa

SEQ ID NO: 159326 - DNA, 25 bp, Homo sapien
ataagaccaatggtggctgttccac

SEQ ID NO: 159327 - DNA, 25 bp, Homo sapien
ggctgttccacagagaagtctagga

SEQ ID NO: 159328 - DNA, 25 bp, Homo sapien
attctgagcatggagaaaaatttca

SEQ ID NO: 159329 - DNA, 25 bp, Homo sapien
tttcaaattctggtataaacaaata

SEQ ID NO: 159330 - DNA, 25 bp, Homo sapien
tttttggtcatattgatttgggtca

SEQ ID NO: 159331 - DNA, 25 bp, Homo sapien
ggtcatattgatttgggtcatatat

SEQ ID NO: 159332 - DNA, 25 bp, Homo sapien
gatttgggtcatatatgattgacca

SEQ ID NO: 159333 - DNA, 25 bp, Homo sapien
gatatttctaaaatcctggtgcttt

SEQ ID NO: 159334 - DNA, 25 bp, Homo sapien
taaaatcctggtgctttttcattta

SEQ ID NO: 159335 - DNA, 25 bp, Homo sapien
tggaaattcgtggaagaggaaacta

SEQ ID NO: 159336 - DNA, 25 bp, Homo sapien
atggcactgagccttggtgtgatca

SEQ ID NO: 159337 - DNA, 25 bp, Homo sapien
ggcactgagccttggtgtgatcaaa

SEQ ID NO: 159338 - DNA, 25 bp, Homo sapien
actgagccttggtgtgatcaaaaaa

SEQ ID NO: 159339 - DNA, 25 bp, Homo sapien
gacacagtattttagggtgcatcca

SEQ ID NO: 159340 - DNA, 25 bp, Homo sapien
gggtgcatccagtataccattgagc

SEQ ID NO: 159341 - DNA, 25 bp, Homo sapien
accattgagcattgtaacctcagga

SEQ ID NO: 159342 - DNA, 25 bp, Homo sapien
ttattttgggttctgatatgtagca

SEQ ID NO: 159343 - DNA, 25 bp, Homo sapien
atatgtagcatggtattttccctaa

SEQ ID NO: 159344 - DNA, 25 bp, Homo sapien
gaactttcacacaagggtctgtaac

SEQ ID NO: 159345 - DNA, 25 bp, Homo sapien
gggtctgtaacaattgtatatctta

SEQ ID NO: 159346 - DNA, 25 bp, Homo sapien
tatcttacaatatttttccttgcat

SEQ ID NO: 159347 - DNA, 25 bp, Homo sapien
tgagccttgtatggagtgatgtttc

SEQ ID NO: 159348 - DNA, 25 bp, Homo sapien
gtgatgtttcatttacctgggttgt

SEQ ID NO: 159349 - DNA, 25 bp, Homo sapien
atttacctgggttgtgttaatgact

SEQ ID NO: 159350 - DNA, 25 bp, Homo sapien
atgctgccaacttctaaccgcaata

SEQ ID NO: 159351 - DNA, 25 bp, Homo sapien
ctgccaacttctaaccgcaatagtg

SEQ ID NO: 159352 - DNA, 25 bp, Homo sapien
gccaacttctaaccgcaatagtgac

SEQ ID NO: 159353 - DNA, 25 bp, Homo sapien
acttctaaccgcaatagtgactctg

SEQ ID NO: 159354 - DNA, 25 bp, Homo sapien
ttctaaccgcaatagtgactctgtg

SEQ ID NO: 159355 - DNA, 25 bp, Homo sapien
taaccgcaatagtgactctgtgctt

SEQ ID NO: 159356 - DNA, 25 bp, Homo sapien
accgcaatagtgactctgtgcttgt

SEQ ID NO: 159357 - DNA, 25 bp, Homo sapien
gcaatagtgactctgtgcttgtctg

SEQ ID NO: 159358 - DNA, 25 bp, Homo sapien
aatagtgactctgtgcttgtctgtt

SEQ ID NO: 159359 - DNA, 25 bp, Homo sapien
tagtgactctgtgcttgtctgttta

SEQ ID NO: 159360 - DNA, 25 bp, Homo sapien
gtgactctgtgcttgtctgtttagt

SEQ ID NO: 159361 - DNA, 25 bp, Homo sapien
ctcccctcaaagtctgcaactttaa

SEQ ID NO: 159362 - DNA, 25 bp, Homo sapien
tcccctcaaagtctgcaactttaag

SEQ ID NO: 159363 - DNA, 25 bp, Homo sapien
aaagtctgcaactttaagcagctct

SEQ ID NO: 159364 - DNA, 25 bp, Homo sapien
gtctgcaactttaagcagctcttgc

SEQ ID NO: 159365 - DNA, 25 bp, Homo sapien
ctgcaactttaagcagctcttgcta

SEQ ID NO: 159366 - DNA, 25 bp, Homo sapien
gcaactttaagcagctcttgctaat

SEQ ID NO: 159367 - DNA, 25 bp, Homo sapien
aactttaagcagctcttgctaatca

SEQ ID NO: 159368 - DNA, 25 bp, Homo sapien
tttaagcagctcttgctaatcagtg

SEQ ID NO: 159369 - DNA, 25 bp, Homo sapien
taagcagctcttgctaatcagtgtc

SEQ ID NO: 159370 - DNA, 25 bp, Homo sapien
agcagctcttgctaatcagtgtctc

SEQ ID NO: 159371 - DNA, 25 bp, Homo sapien
gcagctcttgctaatcagtgtctca

SEQ ID NO: 159372 - DNA, 25 bp, Homo sapien
ttggaatatgtcagaagtttctttt

SEQ ID NO: 159373 - DNA, 25 bp, Homo sapien
aagaaactgattttagctcatgtat

SEQ ID NO: 159374 - DNA, 25 bp, Homo sapien
gattttagctcatgtatattttata

SEQ ID NO: 159375 - DNA, 25 bp, Homo sapien
gaaaacacccttatgaattgatgac

SEQ ID NO: 159376 - DNA, 25 bp, Homo sapien
aacacccttatgaattgatgactat

SEQ ID NO: 159377 - DNA, 25 bp, Homo sapien
aattatattcactacttttgaacac

SEQ ID NO: 159378 - DNA, 25 bp, Homo sapien
cttttgaacacattctgctatgaat

SEQ ID NO: 159379 - DNA, 25 bp, Homo sapien
tgaacacattctgctatgaattatt

SEQ ID NO: 159380 - DNA, 25 bp, Homo sapien
aagccaaagctatatgttgtaactt

SEQ ID NO: 159381 - DNA, 25 bp, Homo sapien
gagaatagctttatcttggtttaac

SEQ ID NO: 159382 - DNA, 25 bp, Homo sapien
aatagctttatcttggtttaactct

SEQ ID NO: 159383 - DNA, 25 bp, Homo sapien
ctatgaatgagttacaggatgaact

SEQ ID NO: 159384 - DNA, 25 bp, Homo sapien
actgatgaccattcgacttagagaa

SEQ ID NO: 159385 - DNA, 25 bp, Homo sapien
ctgatgaccattcgacttagagaag

SEQ ID NO: 159386 - DNA, 25 bp, Homo sapien
tgatgaccattcgacttagagaagc

SEQ ID NO: 159387 - DNA, 25 bp, Homo sapien
gatgaccattcgacttagagaagct

SEQ ID NO: 159388 - DNA, 25 bp, Homo sapien
atgaccattcgacttagagaagctg

SEQ ID NO: 159389 - DNA, 25 bp, Homo sapien
tgaccattcgacttagagaagctga

SEQ ID NO: 159390 - DNA, 25 bp, Homo sapien
cttagagaagctgaaacacaagcag

SEQ ID NO: 159391 - DNA, 25 bp, Homo sapien
ggccaacatagcgagagcagctccg

SEQ ID NO: 159392 - DNA, 25 bp, Homo sapien
aacatagcgagagcagctccggtgg

SEQ ID NO: 159393 - DNA, 25 bp, Homo sapien
agagcagctccggtggcgggaggag

SEQ ID NO: 159394 - DNA, 25 bp, Homo sapien
gcttcgcgaaggctgtaggcacacc

SEQ ID NO: 159395 - DNA, 25 bp, Homo sapien
aaggctgtaggcacaccgcggccag

SEQ ID NO: 159396 - DNA, 25 bp, Homo sapien
aagaaaaaggtcagctccaccgaag

SEQ ID NO: 159397 - DNA, 25 bp, Homo sapien
gaaaaaggtcagctccaccgaaggg

SEQ ID NO: 159398 - DNA, 25 bp, Homo sapien
gcccaagaggagatcagcgcaattg

SEQ ID NO: 159399 - DNA, 25 bp, Homo sapien
aagaggagatcagcgcaattgtcag

SEQ ID NO: 159400 - DNA, 25 bp, Homo sapien
ggagatcagcgcaattgtcagctaa

SEQ ID NO: 159401 - DNA, 25 bp, Homo sapien
atcagcgcaattgtcagctaaacct

SEQ ID NO: 159402 - DNA, 25 bp, Homo sapien
ttctttgcaacagcagtgttctggg

SEQ ID NO: 159403 - DNA, 25 bp, Homo sapien
gcagtgttctgggtgataattttga

SEQ ID NO: 159404 - DNA, 25 bp, Homo sapien
aattttgaattgatacctgttcctt

SEQ ID NO: 159405 - DNA, 25 bp, Homo sapien
aattgatacctgttcctttttctgg

SEQ ID NO: 159406 - DNA, 25 bp, Homo sapien
aattgtctttccttatcattggtgg

SEQ ID NO: 159407 - DNA, 25 bp, Homo sapien
atcattggtgggaggcttggtagca

SEQ ID NO: 159408 - DNA, 25 bp, Homo sapien
cagaaaaattgaactacagcttgag

SEQ ID NO: 159409 - DNA, 25 bp, Homo sapien
gaactacagcttgagaacgtattct

SEQ ID NO: 159410 - DNA, 25 bp, Homo sapien
acagcttgagaacgtattctttttt

SEQ ID NO: 159411 - DNA, 25 bp, Homo sapien
tcctactttgttattgcaaattgag

SEQ ID NO: 159412 - DNA, 25 bp, Homo sapien
tgaggaatcacttttaactgtttta

SEQ ID NO: 159413 - DNA, 25 bp, Homo sapien
taccacacactgctgcatcttgggt

SEQ ID NO: 159414 - DNA, 25 bp, Homo sapien
actgctgcatcttgggtctcaggga

SEQ ID NO: 159415 - DNA, 25 bp, Homo sapien
tgcatcttgggtctcagggacccag

SEQ ID NO: 159416 - DNA, 25 bp, Homo sapien
gggacccagacagatggacttacat

SEQ ID NO: 159417 - DNA, 25 bp, Homo sapien
acagatggacttacatggagctggg

SEQ ID NO: 159418 - DNA, 25 bp, Homo sapien
ctcaacagggtccattgcctcttgc

SEQ ID NO: 159419 - DNA, 25 bp, Homo sapien
gcctccagaacttggagagcaggga

SEQ ID NO: 159420 - DNA, 25 bp, Homo sapien
gaagtgggcacccttgaggcctcca

SEQ ID NO: 159421 - DNA, 25 bp, Homo sapien
cagttccgtcattctcgttcctggg

SEQ ID NO: 159422 - DNA, 25 bp, Homo sapien
ccccactctgacctgttattaaagt

SEQ ID NO: 159423 - DNA, 25 bp, Homo sapien
attttgaatgccctctcgggccccg

SEQ ID NO: 159424 - DNA, 25 bp, Homo sapien
tggtgggtcccctccaggaaccaag

SEQ ID NO: 159425 - DNA, 25 bp, Homo sapien
gtcccctccaggaaccaaggagtgg

SEQ ID NO: 159426 - DNA, 25 bp, Homo sapien
gtggccctccaggtggcagcactaa

SEQ ID NO: 159427 - DNA, 25 bp, Homo sapien
ggccctccaggtggcagcactaagg

SEQ ID NO: 159428 - DNA, 25 bp, Homo sapien
cctccaggtggcagcactaaggaca

SEQ ID NO: 159429 - DNA, 25 bp, Homo sapien
ctccaggtggcagcactaaggacac

SEQ ID NO: 159430 - DNA, 25 bp, Homo sapien
caggtggcagcactaaggacacccc

SEQ ID NO: 159431 - DNA, 25 bp, Homo sapien
acaagagttagcagcgaggtcccca

SEQ ID NO: 159432 - DNA, 25 bp, Homo sapien
caagagttagcagcgaggtccccat

SEQ ID NO: 159433 - DNA, 25 bp, Homo sapien
agagttagcagcgaggtccccatga

SEQ ID NO: 159434 - DNA, 25 bp, Homo sapien
gtgtcttttgctaaatatgcccttt

SEQ ID NO: 159435 - DNA, 25 bp, Homo sapien
ggagccatctctagcgggcccttca

SEQ ID NO: 159436 - DNA, 25 bp, Homo sapien
ttcctctccatgctgcaatcactgt

SEQ ID NO: 159437 - DNA, 25 bp, Homo sapien
gcaatcactgtcctgggcttatggt

SEQ ID NO: 159438 - DNA, 25 bp, Homo sapien
ctgggcttatggtgcctatggacta

SEQ ID NO: 159439 - DNA, 25 bp, Homo sapien
actggactccagaaatgtgcatgca

SEQ ID NO: 159440 - DNA, 25 bp, Homo sapien
tgtgcatgcagatcagctgttgcct

SEQ ID NO: 159441 - DNA, 25 bp, Homo sapien
gcagatcagctgttgccttcaagat

SEQ ID NO: 159442 - DNA, 25 bp, Homo sapien
gataaactttcctgtcatgtgttag

SEQ ID NO: 159443 - DNA, 25 bp, Homo sapien
tattgttaaacttctgtgctgttcc

SEQ ID NO: 159444 - DNA, 25 bp, Homo sapien
gtgaatctccaaattttgtaccttg

SEQ ID NO: 159445 - DNA, 25 bp, Homo sapien
attttgtaccttgttctaagctaat

SEQ ID NO: 159446 - DNA, 25 bp, Homo sapien
tggtgagttccacatttctaaggaa

SEQ ID NO: 159447 - DNA, 25 bp, Homo sapien
aaatcaatcagtagctgtgcataca

SEQ ID NO: 159448 - DNA, 25 bp, Homo sapien
gctgtgcatacataggccacccctt

SEQ ID NO: 159449 - DNA, 25 bp, Homo sapien
accccttctgctgtggcgtatgtgc

SEQ ID NO: 159450 - DNA, 25 bp, Homo sapien
gcgtatgtgccagcattcttgcaat

SEQ ID NO: 159451 - DNA, 25 bp, Homo sapien
tcttgcaataaatatccgatgggaa

SEQ ID NO: 159452 - DNA, 25 bp, Homo sapien
atcagttcaagccaggcatatacaa

SEQ ID NO: 159453 - DNA, 25 bp, Homo sapien
aagccaggagctttggtaggcctca

SEQ ID NO: 159454 - DNA, 25 bp, Homo sapien
ggagctttggtaggcctcaacatgt

SEQ ID NO: 159455 - DNA, 25 bp, Homo sapien
ggcctcaacatgtggaagtgtattg

SEQ ID NO: 159456 - DNA, 25 bp, Homo sapien
gctcaggtgcattcacttccaagag

SEQ ID NO: 159457 - DNA, 25 bp, Homo sapien
aaagctttattcaagaacaggtgac

SEQ ID NO: 159458 - DNA, 25 bp, Homo sapien
agaacaggtgacatagttgaatttg

SEQ ID NO: 159459 - DNA, 25 bp, Homo sapien
acaaaatctcattcatttcgagcaa

SEQ ID NO: 159460 - DNA, 25 bp, Homo sapien
cattcatttcgagcaatgtgtcaga

SEQ ID NO: 159461 - DNA, 25 bp, Homo sapien
gaatgggaaactggtatatcccagt

SEQ ID NO: 159462 - DNA, 25 bp, Homo sapien
gtatatcccagttgtgaggaaaaat

SEQ ID NO: 159463 - DNA, 25 bp, Homo sapien
gaatcaatggcattactattagtaa

SEQ ID NO: 159464 - DNA, 25 bp, Homo sapien
aatgcacacctttttctgaatttac

SEQ ID NO: 159465 - DNA, 25 bp, Homo sapien
gcacacctttttctgaatttactat

SEQ ID NO: 159466 - DNA, 25 bp, Homo sapien
catttttcaagtactgttttactca

SEQ ID NO: 159467 - DNA, 25 bp, Homo sapien
ttcaagtactgttttactcattttt

SEQ ID NO: 159468 - DNA, 25 bp, Homo sapien
ctcttcctgtcttaccaaacagtgg

SEQ ID NO: 159469 - DNA, 25 bp, Homo sapien
ttcctgtcttaccaaacagtgggag

SEQ ID NO: 159470 - DNA, 25 bp, Homo sapien
gtcttaccaaacagtgggagggaat

SEQ ID NO: 159471 - DNA, 25 bp, Homo sapien
gtgggagggaattcctagctgtaaa

SEQ ID NO: 159472 - DNA, 25 bp, Homo sapien
gagggaattcctagctgtaaatata

SEQ ID NO: 159473 - DNA, 25 bp, Homo sapien
taaattttgcccttccatttctact

SEQ ID NO: 159474 - DNA, 25 bp, Homo sapien
caatgaaggatttcttattttcttg

SEQ ID NO: 159475 - DNA, 25 bp, Homo sapien
gaaaaatgagcttgtaaatactcca

SEQ ID NO: 159476 - DNA, 25 bp, Homo sapien
aatatataatgcaacaatgtgtgta

SEQ ID NO: 159477 - DNA, 25 bp, Homo sapien
caatgtgtgtatgttaatatctgat

SEQ ID NO: 159478 - DNA, 25 bp, Homo sapien
atatctgatactgtatctgggctga

SEQ ID NO: 159479 - DNA, 25 bp, Homo sapien
ggttcgaggccttctatgcagccga

SEQ ID NO: 159480 - DNA, 25 bp, Homo sapien
ttctatgcagccgaggacattgacg

SEQ ID NO: 159481 - DNA, 25 bp, Homo sapien
gacattgacgagtgccaggtggccc

SEQ ID NO: 159482 - DNA, 25 bp, Homo sapien
gagaggcgcccacctgcgaccacca

SEQ ID NO: 159483 - DNA, 25 bp, Homo sapien
actgccacaaccacctgggcggttt

SEQ ID NO: 159484 - DNA, 25 bp, Homo sapien
acctgggcggtttctactgctcctg

SEQ ID NO: 159485 - DNA, 25 bp, Homo sapien
gtttctactgctcctgccgcgcagg

SEQ ID NO: 159486 - DNA, 25 bp, Homo sapien
aggctacgtcctgcaccgtaacaag

SEQ ID NO: 159487 - DNA, 25 bp, Homo sapien
taacaagcgcacctgctcagagcag

SEQ ID NO: 159488 - DNA, 25 bp, Homo sapien
ttgggctgagatggctgtgccccaa

SEQ ID NO: 159489 - DNA, 25 bp, Homo sapien
ggctgagatggctgtgccccaactc

SEQ ID NO: 159490 - DNA, 25 bp, Homo sapien
gtctgttctgaacatagggacataa

SEQ ID NO: 159491 - DNA, 25 bp, Homo sapien
gccaagtatctttccagcatgtttc

SEQ ID NO: 159492 - DNA, 25 bp, Homo sapien
ttccagcatgtttctcccatttaga

SEQ ID NO: 159493 - DNA, 25 bp, Homo sapien
gaatatctagcatgtaaggcctttc

SEQ ID NO: 159494 - DNA, 25 bp, Homo sapien
ataagcccaatatcagctctttctc

SEQ ID NO: 159495 - DNA, 25 bp, Homo sapien
caatatcagctctttctctttgtat

SEQ ID NO: 159496 - DNA, 25 bp, Homo sapien
tttctctttgtatttcatctctttc

SEQ ID NO: 159497 - DNA, 25 bp, Homo sapien
atctctttctactctcctatttgta

SEQ ID NO: 159498 - DNA, 25 bp, Homo sapien
gtgttcctatcaaagtgtcgtatct

SEQ ID NO: 159499 - DNA, 25 bp, Homo sapien
gtatctgggagatgacctgccttat

SEQ ID NO: 159500 - DNA, 25 bp, Homo sapien
acctgccttatcctgttctataaca

SEQ ID NO: 159501 - DNA, 25 bp, Homo sapien
ttcgaatggcacaacactttctatt

SEQ ID NO: 159502 - DNA, 25 bp, Homo sapien
ggcacaacactttctatttcacaaa

SEQ ID NO: 159503 - DNA, 25 bp, Homo sapien
tcacaaaagaccaaaagccagaggc

SEQ ID NO: 159504 - DNA, 25 bp, Homo sapien
ggctctgtgctgatgaacagcctgg

SEQ ID NO: 159505 - DNA, 25 bp, Homo sapien
ctgtgctgatgaacagcctggctga

SEQ ID NO: 159506 - DNA, 25 bp, Homo sapien
cctggcaggtttagggcccatttgg

SEQ ID NO: 159507 - DNA, 25 bp, Homo sapien
tctgtctgggaatgagggagttaac

SEQ ID NO: 159508 - DNA, 25 bp, Homo sapien
gttaaccaagtttggtgcaggagca

SEQ ID NO: 159509 - DNA, 25 bp, Homo sapien
gccactgtagtgagcgtggagaaat

SEQ ID NO: 159510 - DNA, 25 bp, Homo sapien
aagggttaggacactgaccattcta

SEQ ID NO: 159511 - DNA, 25 bp, Homo sapien
gttaggacactgaccattctagaaa

SEQ ID NO: 159512 - DNA, 25 bp, Homo sapien
ctcgaggggagaagtcgcgccccca

SEQ ID NO: 159513 - DNA, 25 bp, Homo sapien
tcgaggggagaagtcgcgcccccag

SEQ ID NO: 159514 - DNA, 25 bp, Homo sapien
cgaggggagaagtcgcgcccccagg

SEQ ID NO: 159515 - DNA, 25 bp, Homo sapien
gaggggagaagtcgcgcccccaggg

SEQ ID NO: 159516 - DNA, 25 bp, Homo sapien
gggagaagtcgcgcccccagggaag

SEQ ID NO: 159517 - DNA, 25 bp, Homo sapien
ggagaagtcgcgcccccagggaagc

SEQ ID NO: 159518 - DNA, 25 bp, Homo sapien
gagaagtcgcgcccccagggaagcc

SEQ ID NO: 159519 - DNA, 25 bp, Homo sapien
agaagtcgcgcccccagggaagcca

SEQ ID NO: 159520 - DNA, 25 bp, Homo sapien
ctagatgcatggctggcacattgtt

SEQ ID NO: 159521 - DNA, 25 bp, Homo sapien
agatgcatggctggcacattgttgg

SEQ ID NO: 159522 - DNA, 25 bp, Homo sapien
gttggcactcaacaatggttgaatg

SEQ ID NO: 159523 - DNA, 25 bp, Homo sapien
gttagaatcaaatactcatttttca

SEQ ID NO: 159524 - DNA, 25 bp, Homo sapien
ctcatttttcattagatacagtagt

SEQ ID NO: 159525 - DNA, 25 bp, Homo sapien
gatacagtagtgtcatcactctttt

SEQ ID NO: 159526 - DNA, 25 bp, Homo sapien
gtgtcatcactcttttaagatcttg

SEQ ID NO: 159527 - DNA, 25 bp, Homo sapien
aataaaggtacttctggcgagccag

SEQ ID NO: 159528 - DNA, 25 bp, Homo sapien
tacttctggcgagccaggctgcaca

SEQ ID NO: 159529 - DNA, 25 bp, Homo sapien
catttgctttcctctgagattctaa

SEQ ID NO: 159530 - DNA, 25 bp, Homo sapien
gagattctaagagaaggcctttaat

SEQ ID NO: 159531 - DNA, 25 bp, Homo sapien
aaagctttattcaagaacaggtgac

SEQ ID NO: 159532 - DNA, 25 bp, Homo sapien
agctttattcaagaacaggtgacat

SEQ ID NO: 159533 - DNA, 25 bp, Homo sapien
agaacaggtgacatagttgaatttg

SEQ ID NO: 159534 - DNA, 25 bp, Homo sapien
acatagttgaatttgtttgtaaatc

SEQ ID NO: 159535 - DNA, 25 bp, Homo sapien
atctggatatcatccaacaaaatct

SEQ ID NO: 159536 - DNA, 25 bp, Homo sapien
aacaaaatctcattcatttcgagca

SEQ ID NO: 159537 - DNA, 25 bp, Homo sapien
caaaatctcattcatttcgagcaat

SEQ ID NO: 159538 - DNA, 25 bp, Homo sapien
aatctcattcatttcgagcaatgtg

SEQ ID NO: 159539 - DNA, 25 bp, Homo sapien
cattcatttcgagcaatgtgtcaga

SEQ ID NO: 159540 - DNA, 25 bp, Homo sapien
tttcgagcaatgtgtcagaatggga

SEQ ID NO: 159541 - DNA, 25 bp, Homo sapien
gaatgggaaactggtatatcccagt

SEQ ID NO: 159542 - DNA, 25 bp, Homo sapien
acagcccccctaccgacctggtgtg

SEQ ID NO: 159543 - DNA, 25 bp, Homo sapien
aaggcacagaacacctggggctgcg

SEQ ID NO: 159544 - DNA, 25 bp, Homo sapien
gcgggaacagcctgcgtacggctct

SEQ ID NO: 159545 - DNA, 25 bp, Homo sapien
ggaacagcctgcgtacggctctcat

SEQ ID NO: 159546 - DNA, 25 bp, Homo sapien
gaacagcctgcgtacggctctcatc

SEQ ID NO: 159547 - DNA, 25 bp, Homo sapien
aacagcctgcgtacggctctcatca

SEQ ID NO: 159548 - DNA, 25 bp, Homo sapien
acagcctgcgtacggctctcatcaa

SEQ ID NO: 159549 - DNA, 25 bp, Homo sapien
gtacggctctcatcaactccactgg

SEQ ID NO: 159550 - DNA, 25 bp, Homo sapien
tacggctctcatcaactccactggg

SEQ ID NO: 159551 - DNA, 25 bp, Homo sapien
aagaagtggccatgcgcaagctggt

SEQ ID NO: 159552 - DNA, 25 bp, Homo sapien
agaagtggccatgcgcaagctggtg

SEQ ID NO: 159553 - DNA, 25 bp, Homo sapien
gcaagtattgggtcttcaaacttca

SEQ ID NO: 159554 - DNA, 25 bp, Homo sapien
ttgggtcttcaaacttcaagtgcaa

SEQ ID NO: 159555 - DNA, 25 bp, Homo sapien
gcaatgtattatgaaaaccaatctg

SEQ ID NO: 159556 - DNA, 25 bp, Homo sapien
aaaccaatctgagccttgtatctct

SEQ ID NO: 159557 - DNA, 25 bp, Homo sapien
atctgagccttgtatctcttaaata

SEQ ID NO: 159558 - DNA, 25 bp, Homo sapien
ccgagagaagggttctccattcatt

SEQ ID NO: 159559 - DNA, 25 bp, Homo sapien
tctccattcatttcagtgctgcctg

SEQ ID NO: 159560 - DNA, 25 bp, Homo sapien
agtgctgcctggaggaaactcggca

SEQ ID NO: 159561 - DNA, 25 bp, Homo sapien
ctggaggaaactcggcaatgatttc

SEQ ID NO: 159562 - DNA, 25 bp, Homo sapien
tggaaccctcaaccttcgaaatact

SEQ ID NO: 159563 - DNA, 25 bp, Homo sapien
caaccttcgaaatactccagttttg

SEQ ID NO: 159564 - DNA, 25 bp, Homo sapien
ttgtgcacccactggcccatgagcc

SEQ ID NO: 159565 - DNA, 25 bp, Homo sapien
ctgctgtcctgtggccgtcctggag

SEQ ID NO: 159566 - DNA, 25 bp, Homo sapien
gtgatgctggtccctggccacctct

SEQ ID NO: 159567 - DNA, 25 bp, Homo sapien
tctacagccctgaactcttgagaca

SEQ ID NO: 159568 - DNA, 25 bp, Homo sapien
tacagccctgaactcttgagacaac

SEQ ID NO: 159569 - DNA, 25 bp, Homo sapien
agccctgaactcttgagacaactct

SEQ ID NO: 159570 - DNA, 25 bp, Homo sapien
tgaactcttgagacaactctctcca

SEQ ID NO: 159571 - DNA, 25 bp, Homo sapien
tcttgagacaactctctccagcaat

SEQ ID NO: 159572 - DNA, 25 bp, Homo sapien
agacaactctctccagcaatagctg

SEQ ID NO: 159573 - DNA, 25 bp, Homo sapien
agctttgcccaactgttgcttcttg

SEQ ID NO: 159574 - DNA, 25 bp, Homo sapien
ctttgcccaactgttgcttcttggg

SEQ ID NO: 159575 - DNA, 25 bp, Homo sapien
gagaggcgcccacctgcgaccacca

SEQ ID NO: 159576 - DNA, 25 bp, Homo sapien
agaggcgcccacctgcgaccaccac

SEQ ID NO: 159577 - DNA, 25 bp, Homo sapien
gaggcgcccacctgcgaccaccact

SEQ ID NO: 159578 - DNA, 25 bp, Homo sapien
aggcgcccacctgcgaccaccactg

SEQ ID NO: 159579 - DNA, 25 bp, Homo sapien
gcgcccacctgcgaccaccactgcc

SEQ ID NO: 159580 - DNA, 25 bp, Homo sapien
gcccacctgcgaccaccactgccac

SEQ ID NO: 159581 - DNA, 25 bp, Homo sapien
actgccacaaccacctgggcggttt

SEQ ID NO: 159582 - DNA, 25 bp, Homo sapien
tactgctcctgccgcgcaggctacg

SEQ ID NO: 159583 - DNA, 25 bp, Homo sapien
actgctcctgccgcgcaggctacgt

SEQ ID NO: 159584 - DNA, 25 bp, Homo sapien
ctgctcctgccgcgcaggctacgtc

SEQ ID NO: 159585 - DNA, 25 bp, Homo sapien
tgctcctgccgcgcaggctacgtcc

SEQ ID NO: 159586 - DNA, 25 bp, Homo sapien
gcagcgtggcgtgttgcacatttaa

SEQ ID NO: 159587 - DNA, 25 bp, Homo sapien
aactgtgtgatgtcccgttagtgag

SEQ ID NO: 159588 - DNA, 25 bp, Homo sapien
ccgttagtgagaccgagccatcgat

SEQ ID NO: 159589 - DNA, 25 bp, Homo sapien
cgagccatcgatgccctgaaaagga

SEQ ID NO: 159590 - DNA, 25 bp, Homo sapien
aaagggaagcttcggatgcattttc

SEQ ID NO: 159591 - DNA, 25 bp, Homo sapien
atgcattttccttgatccctgttgg

SEQ ID NO: 159592 - DNA, 25 bp, Homo sapien
ggttgcatactcagatagtcacggt

SEQ ID NO: 159593 - DNA, 25 bp, Homo sapien
cacggttattttgcttcttgcgaat

SEQ ID NO: 159594 - DNA, 25 bp, Homo sapien
ggaaaacatggctcttctgctccaa

SEQ ID NO: 159595 - DNA, 25 bp, Homo sapien
ggtcctggtgtgcatttgcacccta

SEQ ID NO: 159596 - DNA, 25 bp, Homo sapien
atttgcaccctaaagctgcttacgg

SEQ ID NO: 159597 - DNA, 25 bp, Homo sapien
gaaattttgacaatgacactcacag

SEQ ID NO: 159598 - DNA, 25 bp, Homo sapien
agaaaaaatgtcatcgaccctccca

SEQ ID NO: 159599 - DNA, 25 bp, Homo sapien
ctcccatctatgcacgacacataag

SEQ ID NO: 159600 - DNA, 25 bp, Homo sapien
gcacgacacataagaatccttcctt

SEQ ID NO: 159601 - DNA, 25 bp, Homo sapien
gaatccttccttggtcctggtacgg

SEQ ID NO: 159602 - DNA, 25 bp, Homo sapien
tacgggaggatcacattgcggtcag

SEQ ID NO: 159603 - DNA, 25 bp, Homo sapien
atcacattgcggtcagagctgctgg

SEQ ID NO: 159604 - DNA, 25 bp, Homo sapien
ggaggctacatttcacaaccctctt

SEQ ID NO: 159605 - DNA, 25 bp, Homo sapien
tatttccctaaaagtatctccatgg

SEQ ID NO: 159606 - DNA, 25 bp, Homo sapien
tatctccatggaatgaactgtgcaa

SEQ ID NO: 159607 - DNA, 25 bp, Homo sapien
gaactgtgcaaaatctgtaggaaac

SEQ ID NO: 159608 - DNA, 25 bp, Homo sapien
aacactacagagttcctgggaccgg

SEQ ID NO: 159609 - DNA, 25 bp, Homo sapien
gtgtttgtgtgggataaatactacc

SEQ ID NO: 159610 - DNA, 25 bp, Homo sapien
aaatactaccactgcaagtgactgc

SEQ ID NO: 159611 - DNA, 25 bp, Homo sapien
aagtgactgctgtccgctgcggaat

SEQ ID NO: 159612 - DNA, 25 bp, Homo sapien
gctgcggaatctgttcttggtggaa

SEQ ID NO: 159613 - DNA, 25 bp, Homo sapien
cttggtggaagcacaggtccgtgtc

SEQ ID NO: 159614 - DNA, 25 bp, Homo sapien
aagcacaggtccgtgtcgctgctgt

SEQ ID NO: 159615 - DNA, 25 bp, Homo sapien
tgtcgctgctgtggttgccgctgtc

SEQ ID NO: 159616 - DNA, 25 bp, Homo sapien
gctgtccgcggttcaacacggagtc

SEQ ID NO: 159617 - DNA, 25 bp, Homo sapien
gccccgcgggtttcagctgttggtc

SEQ ID NO: 159618 - DNA, 25 bp, Homo sapien
tttcagctgttggtcgttctgaggg

SEQ ID NO: 159619 - DNA, 25 bp, Homo sapien
gttgaatccgcagatgtggagcctg

SEQ ID NO: 159620 - DNA, 25 bp, Homo sapien
tatgaagggctgaccgtatactctc

SEQ ID NO: 159621 - DNA, 25 bp, Homo sapien
aagggctgaccgtatactctctgct

SEQ ID NO: 159622 - DNA, 25 bp, Homo sapien
tatactctctgctccttccagagta

SEQ ID NO: 159623 - DNA, 25 bp, Homo sapien
tctgctccttccagagtatctggca

SEQ ID NO: 159624 - DNA, 25 bp, Homo sapien
ggcatgtgatgagctcgccacaaac

SEQ ID NO: 159625 - DNA, 25 bp, Homo sapien
gatgagctcgccacaaacatttagt

SEQ ID NO: 159626 - DNA, 25 bp, Homo sapien
catttagtgattcgagtaaggctct

SEQ ID NO: 159627 - DNA, 25 bp, Homo sapien
aaggctctggttgatttacagtttc

SEQ ID NO: 159628 - DNA, 25 bp, Homo sapien
ttacagtttctactttcctgacact

SEQ ID NO: 159629 - DNA, 25 bp, Homo sapien
ctactttcctgacactctgttgctg

SEQ ID NO: 159630 - DNA, 25 bp, Homo sapien
atgcagaagaggctcccaggcccaa

SEQ ID NO: 159631 - DNA, 25 bp, Homo sapien
aggcccaagctctgtgtgacccaga

SEQ ID NO: 159632 - DNA, 25 bp, Homo sapien
tgcctgtcacccttcatctgggact

SEQ ID NO: 159633 - DNA, 25 bp, Homo sapien
ccttcatctgggacttgctgtcaaa

SEQ ID NO: 159634 - DNA, 25 bp, Homo sapien
gacttgctgtcaaaccctaggatag

SEQ ID NO: 159635 - DNA, 25 bp, Homo sapien
tgtcaaaccctaggatagtctcata

SEQ ID NO: 159636 - DNA, 25 bp, Homo sapien
tgggccagcctgctgctgtctgctt

SEQ ID NO: 159637 - DNA, 25 bp, Homo sapien
ctgctgctgtctgcttcagggccag

SEQ ID NO: 159638 - DNA, 25 bp, Homo sapien
aggctgggggttctcacaccttact

SEQ ID NO: 159639 - DNA, 25 bp, Homo sapien
gggcccactcgagtgcttgttctgg

SEQ ID NO: 159640 - DNA, 25 bp, Homo sapien
cactcgagtgcttgttctggtctca

SEQ ID NO: 159641 - DNA, 25 bp, Homo sapien
ggaatgagtctctctggaagaactt

SEQ ID NO: 159642 - DNA, 25 bp, Homo sapien
tgagtctctctggaagaacttcaag

SEQ ID NO: 159643 - DNA, 25 bp, Homo sapien
agaacttcaaggaacatcatcagct

SEQ ID NO: 159644 - DNA, 25 bp, Homo sapien
agtcagaggactgtgcaggaatcgt

SEQ ID NO: 159645 - DNA, 25 bp, Homo sapien
gactgtgcaggaatcgtgtccttcc

SEQ ID NO: 159646 - DNA, 25 bp, Homo sapien
gtgtccttcctgtgctctccagatg

SEQ ID NO: 159647 - DNA, 25 bp, Homo sapien
agaacattgcggtggcaggctactc

SEQ ID NO: 159648 - DNA, 25 bp, Homo sapien
attgcggtggcaggctactccactc

SEQ ID NO: 159649 - DNA, 25 bp, Homo sapien
tactccactcggctctgagaggagt

SEQ ID NO: 159650 - DNA, 25 bp, Homo sapien
gggtgtctaggtgatcatttggatc

SEQ ID NO: 159651 - DNA, 25 bp, Homo sapien
ctgccattctgccagactagcaatt

SEQ ID NO: 159652 - DNA, 25 bp, Homo sapien
attccaggactaattcttaatcggc

SEQ ID NO: 159653 - DNA, 25 bp, Homo sapien
ggactaattcttaatcggcattatt

SEQ ID NO: 159654 - DNA, 25 bp, Homo sapien
cggcattatttatacaagaggtcaa

SEQ ID NO: 159655 - DNA, 25 bp, Homo sapien
gtaacatttactagcgcaatactgc

SEQ ID NO: 159656 - DNA, 25 bp, Homo sapien
agcgcaatactgcacttgtaaatga

SEQ ID NO: 159657 - DNA, 25 bp, Homo sapien
gaattataaacgctcttctggaata

SEQ ID NO: 159658 - DNA, 25 bp, Homo sapien
aactgcttattcattctggacactg

SEQ ID NO: 159659 - DNA, 25 bp, Homo sapien
gatgttgaatcaactgatgccagca

SEQ ID NO: 159660 - DNA, 25 bp, Homo sapien
ttgatttgtgaacatactgccttat

SEQ ID NO: 159661 - DNA, 25 bp, Homo sapien
tactgccttatttaaagggtcctga

SEQ ID NO: 159662 - DNA, 25 bp, Homo sapien
aagggtcctgattgcttgtatttta

SEQ ID NO: 159663 - DNA, 25 bp, Homo sapien
ccccatgcagaagaggctcccaggc

SEQ ID NO: 159664 - DNA, 25 bp, Homo sapien
gcctgtcacccttcatctgggactt

SEQ ID NO: 159665 - DNA, 25 bp, Homo sapien
gacttgctgtcaaaccctaggatag

SEQ ID NO: 159666 - DNA, 25 bp, Homo sapien
cttgctgtcaaaccctaggatagtc

SEQ ID NO: 159667 - DNA, 25 bp, Homo sapien
tgctgtcaaaccctaggatagtctc

SEQ ID NO: 159668 - DNA, 25 bp, Homo sapien
gctgtcaaaccctaggatagtctca

SEQ ID NO: 159669 - DNA, 25 bp, Homo sapien
tgtcaaaccctaggatagtctcata

SEQ ID NO: 159670 - DNA, 25 bp, Homo sapien
tgaggctgggggttctcacacctta

SEQ ID NO: 159671 - DNA, 25 bp, Homo sapien
tcacaccttactccaccgggcacat

SEQ ID NO: 159672 - DNA, 25 bp, Homo sapien
cgggcacatcccaacctgcactggg

SEQ ID NO: 159673 - DNA, 25 bp, Homo sapien
agccgctcccttggcagctgcagcc

SEQ ID NO: 159674 - DNA, 25 bp, Homo sapien
aggagctcgaaaccagtccgggcca

SEQ ID NO: 159675 - DNA, 25 bp, Homo sapien
gggcaacctcagatgaccgactttt

SEQ ID NO: 159676 - DNA, 25 bp, Homo sapien
agatgaccgacttttccctttgagc

SEQ ID NO: 159677 - DNA, 25 bp, Homo sapien
ctctagctgagaaatggagatgtac

SEQ ID NO: 159678 - DNA, 25 bp, Homo sapien
ggagatgtactactctctcctttac

SEQ ID NO: 159679 - DNA, 25 bp, Homo sapien
tgtactactctctcctttaccttta

SEQ ID NO: 159680 - DNA, 25 bp, Homo sapien
ttacctttacctttaccacagtgca

SEQ ID NO: 159681 - DNA, 25 bp, Homo sapien
tacctttaccacagtgcagggctga

SEQ ID NO: 159682 - DNA, 25 bp, Homo sapien
gcagggctgactgaactgtcactgt

SEQ ID NO: 159683 - DNA, 25 bp, Homo sapien
gactgaactgtcactgtgagatatt

SEQ ID NO: 159684 - DNA, 25 bp, Homo sapien
aaagaattgttgttgggctgggcgc

SEQ ID NO: 159685 - DNA, 25 bp, Homo sapien
ctaacacctctcagatacactggac

SEQ ID NO: 159686 - DNA, 25 bp, Homo sapien
cagatacactggaccccgtaccggg

SEQ ID NO: 159687 - DNA, 25 bp, Homo sapien
cgtaccgggcgatgtaccagtacag

SEQ ID NO: 159688 - DNA, 25 bp, Homo sapien
gatgtaccagtacaggccccagaac

SEQ ID NO: 159689 - DNA, 25 bp, Homo sapien
gtacaggccccagaacgaagacgag

SEQ ID NO: 159690 - DNA, 25 bp, Homo sapien
acaggccccagaacgaagacgagct

SEQ ID NO: 159691 - DNA, 25 bp, Homo sapien
cccagaacgaagacgagctggagct

SEQ ID NO: 159692 - DNA, 25 bp, Homo sapien
acagggtggatgtcatgcagcagtg

SEQ ID NO: 159693 - DNA, 25 bp, Homo sapien
gtcatgcagcagtgtgacgatggct

SEQ ID NO: 159694 - DNA, 25 bp, Homo sapien
gtgtgacgatggctggtttgtgggt

SEQ ID NO: 159695 - DNA, 25 bp, Homo sapien
ttgtgggtgtctcccggaggaccca

SEQ ID NO: 159696 - DNA, 25 bp, Homo sapien
agatgctgggaactttgggactcac

SEQ ID NO: 159697 - DNA, 25 bp, Homo sapien
gatgctgggaactttgggactcact

SEQ ID NO: 159698 - DNA, 25 bp, Homo sapien
atgctgggaactttgggactcactt

SEQ ID NO: 159699 - DNA, 25 bp, Homo sapien
tgctgggaactttgggactcacttg

SEQ ID NO: 159700 - DNA, 25 bp, Homo sapien
gctgggaactttgggactcacttga

SEQ ID NO: 159701 - DNA, 25 bp, Homo sapien
actcacttgattctgcagtcgaaat

SEQ ID NO: 159702 - DNA, 25 bp, Homo sapien
cacttgattctgcagtcgaaataac

SEQ ID NO: 159703 - DNA, 25 bp, Homo sapien
ttctgcagtcgaaataactaatatc

SEQ ID NO: 159704 - DNA, 25 bp, Homo sapien
gcagtcgaaataactaatatcccta

SEQ ID NO: 159705 - DNA, 25 bp, Homo sapien
gtcgaaataactaatatccctacat

SEQ ID NO: 159706 - DNA, 25 bp, Homo sapien
gaaataactaatatccctacatttt

SEQ ID NO: 159707 - DNA, 25 bp, Homo sapien
acagcagagaaacacctctcaaatg

SEQ ID NO: 159708 - DNA, 25 bp, Homo sapien
aacacctctcaaatgtgagcagcat

SEQ ID NO: 159709 - DNA, 25 bp, Homo sapien
gagcagcatgggaagaacattgtac

SEQ ID NO: 159710 - DNA, 25 bp, Homo sapien
agaacattgtacagaattcattctc

SEQ ID NO: 159711 - DNA, 25 bp, Homo sapien
agttcacagtgtagaaaagccatac

SEQ ID NO: 159712 - DNA, 25 bp, Homo sapien
gaatcttgatatgcatcagagggtc

SEQ ID NO: 159713 - DNA, 25 bp, Homo sapien
gatatgtgctttagtcaggcctcaa

SEQ ID NO: 159714 - DNA, 25 bp, Homo sapien
gtgctttagtcaggcctcaagcctt

SEQ ID NO: 159715 - DNA, 25 bp, Homo sapien
ctcaagccttcgacttcatcagaat

SEQ ID NO: 159716 - DNA, 25 bp, Homo sapien
gccttcgacttcatcagaatgttca

SEQ ID NO: 159717 - DNA, 25 bp, Homo sapien
aaaccttagtgatgtgatggtgcaa

SEQ ID NO: 159718 - DNA, 25 bp, Homo sapien
ttttattcctggtaccactaccaca

SEQ ID NO: 159719 - DNA, 25 bp, Homo sapien
ggtaccactaccacaatttacaggg

SEQ ID NO: 159720 - DNA, 25 bp, Homo sapien
actaccacaatttacagggcaatat

SEQ ID NO: 159721 - DNA, 25 bp, Homo sapien
gggcaatatacctgatgtaatgaaa

SEQ ID NO: 159722 - DNA, 25 bp, Homo sapien
gctacaacagataaaagacctcagg

SEQ ID NO: 159723 - DNA, 25 bp, Homo sapien
aagacctcaggaatgtacatctaat

SEQ ID NO: 159724 - DNA, 25 bp, Homo sapien
acatctaattgacactacattgcat

SEQ ID NO: 159725 - DNA, 25 bp, Homo sapien
attaatcaatagctgcactttttgc

SEQ ID NO: 159726 - DNA, 25 bp, Homo sapien
gcactttttgcaaactgtggctatg

SEQ ID NO: 159727 - DNA, 25 bp, Homo sapien
tgtggctatgacagtcctgaacaag

SEQ ID NO: 159728 - DNA, 25 bp, Homo sapien
aagggtttcctgtttaagctgcagt

SEQ ID NO: 159729 - DNA, 25 bp, Homo sapien
aatgtctctgcatcacttgttaatg

SEQ ID NO: 159730 - DNA, 25 bp, Homo sapien
tcacttgttaatgctactggtctaa

SEQ ID NO: 159731 - DNA, 25 bp, Homo sapien
tggtctaacttcattcagtatgctt

SEQ ID NO: 159732 - DNA, 25 bp, Homo sapien
attcagtatgcttcattcaccgaac

SEQ ID NO: 159733 - DNA, 25 bp, Homo sapien
ttcattcaccgaactttgtgctcaa

SEQ ID NO: 159734 - DNA, 25 bp, Homo sapien
tttgtgctcaaaatgcgtatatacc

SEQ ID NO: 159735 - DNA, 25 bp, Homo sapien
ttatgttgtattcctccatttcact

SEQ ID NO: 159736 - DNA, 25 bp, Homo sapien
ggtagcttcatccaatatatcattc

SEQ ID NO: 159737 - DNA, 25 bp, Homo sapien
attacattttatgctgatcttcagt

SEQ ID NO: 159738 - DNA, 25 bp, Homo sapien
attcttccaggaaaactcagtcttc

SEQ ID NO: 159739 - DNA, 25 bp, Homo sapien
aactcagtcttccaactgcaataaa

SEQ ID NO: 159740 - DNA, 25 bp, Homo sapien
ttctgcagtcgaaataactaatatc

SEQ ID NO: 159741 - DNA, 25 bp, Homo sapien
tctgcagtcgaaataactaatatcc

SEQ ID NO: 159742 - DNA, 25 bp, Homo sapien
ctgcagtcgaaataactaatatccc

SEQ ID NO: 159743 - DNA, 25 bp, Homo sapien
tgcagtcgaaataactaatatccct

SEQ ID NO: 159744 - DNA, 25 bp, Homo sapien
gcagtcgaaataactaatatcccta

SEQ ID NO: 159745 - DNA, 25 bp, Homo sapien
cagtcgaaataactaatatccctac

SEQ ID NO: 159746 - DNA, 25 bp, Homo sapien
agtcgaaataactaatatccctaca

SEQ ID NO: 159747 - DNA, 25 bp, Homo sapien
gtcgaaataactaatatccctacat

SEQ ID NO: 159748 - DNA, 25 bp, Homo sapien
tcgaaataactaatatccctacatt

SEQ ID NO: 159749 - DNA, 25 bp, Homo sapien
cgaaataactaatatccctacattt

SEQ ID NO: 159750 - DNA, 25 bp, Homo sapien
gaaataactaatatccctacatttt

SEQ ID NO: 159751 - DNA, 25 bp, Homo sapien
aacctgaaagatatcatttgggtca

SEQ ID NO: 159752 - DNA, 25 bp, Homo sapien
atatcatttgggtcagagctcccct

SEQ ID NO: 159753 - DNA, 25 bp, Homo sapien
tcccctcccttcagattatgttaac

SEQ ID NO: 159754 - DNA, 25 bp, Homo sapien
gattatgttaactctgagtctgtcc

SEQ ID NO: 159755 - DNA, 25 bp, Homo sapien
gttaactctgagtctgtccaaatga

SEQ ID NO: 159756 - DNA, 25 bp, Homo sapien
gtctgtccaaatgagttcacttcca

SEQ ID NO: 159757 - DNA, 25 bp, Homo sapien
tgaccaagaattttatcggcattaa

SEQ ID NO: 159758 - DNA, 25 bp, Homo sapien
atcggcattaatttttcagtgtagt

SEQ ID NO: 159759 - DNA, 25 bp, Homo sapien
tgatgcatattgttacactactatt

SEQ ID NO: 159760 - DNA, 25 bp, Homo sapien
tacactactattaactaggcttcag

SEQ ID NO: 159761 - DNA, 25 bp, Homo sapien
taactaggcttcagtatatcagtgt

SEQ ID NO: 159762 - DNA, 25 bp, Homo sapien
gaccggtttaaagtcttcgcagatt

SEQ ID NO: 159763 - DNA, 25 bp, Homo sapien
gaagactacattaaatgccaggaga

SEQ ID NO: 159764 - DNA, 25 bp, Homo sapien
tgccaggagaaagtcagcgccttgt

SEQ ID NO: 159765 - DNA, 25 bp, Homo sapien
gtcagcgccttgtacaagaacccaa

SEQ ID NO: 159766 - DNA, 25 bp, Homo sapien
tggtgatccggaacatagccacctc

SEQ ID NO: 159767 - DNA, 25 bp, Homo sapien
aacatagccacctctggcaagttct

SEQ ID NO: 159768 - DNA, 25 bp, Homo sapien
agtgaccgcaccattgcccagtatg

SEQ ID NO: 159769 - DNA, 25 bp, Homo sapien
attgcccagtatgcccgggagatct

SEQ ID NO: 159770 - DNA, 25 bp, Homo sapien
gccagccccggatgaggccatctga

SEQ ID NO: 159771 - DNA, 25 bp, Homo sapien
aaccagcccttgagtctgtcacact

SEQ ID NO: 159772 - DNA, 25 bp, Homo sapien
agtctgtcacactctcttgggccag

SEQ ID NO: 159773 - DNA, 25 bp, Homo sapien
gaattttatcggcattaatttttca

SEQ ID NO: 159774 - DNA, 25 bp, Homo sapien
ttttatcggcattaatttttcagtg

SEQ ID NO: 159775 - DNA, 25 bp, Homo sapien
tttatcggcattaatttttcagtgt

SEQ ID NO: 159776 - DNA, 25 bp, Homo sapien
ttatcggcattaatttttcagtgta

SEQ ID NO: 159777 - DNA, 25 bp, Homo sapien
tatcggcattaatttttcagtgtag

SEQ ID NO: 159778 - DNA, 25 bp, Homo sapien
atcggcattaatttttcagtgtagt

SEQ ID NO: 159779 - DNA, 25 bp, Homo sapien
tcggcattaatttttcagtgtagtt

SEQ ID NO: 159780 - DNA, 25 bp, Homo sapien
cggcattaatttttcagtgtagttt

SEQ ID NO: 159781 - DNA, 25 bp, Homo sapien
ggcattaatttttcagtgtagtttg

SEQ ID NO: 159782 - DNA, 25 bp, Homo sapien
gcattaatttttcagtgtagtttgt

SEQ ID NO: 159783 - DNA, 25 bp, Homo sapien
taatttttcagtgtagtttgttgtt

SEQ ID NO: 159784 - DNA, 25 bp, Homo sapien
atgcattgttacaggaagtcccttg

SEQ ID NO: 159785 - DNA, 25 bp, Homo sapien
tgcattgttacaggaagtcccttgc

SEQ ID NO: 159786 - DNA, 25 bp, Homo sapien
gcattgttacaggaagtcccttgcc

SEQ ID NO: 159787 - DNA, 25 bp, Homo sapien
cattgttacaggaagtcccttgcca

SEQ ID NO: 159788 - DNA, 25 bp, Homo sapien
attgttacaggaagtcccttgccat

SEQ ID NO: 159789 - DNA, 25 bp, Homo sapien
ttgttacaggaagtcccttgccatc

SEQ ID NO: 159790 - DNA, 25 bp, Homo sapien
gttacaggaagtcccttgccatcct

SEQ ID NO: 159791 - DNA, 25 bp, Homo sapien
aggaagtcccttgccatcctaaaag

SEQ ID NO: 159792 - DNA, 25 bp, Homo sapien
aagtcccttgccatcctaaaagcca

SEQ ID NO: 159793 - DNA, 25 bp, Homo sapien
taaaagccaccccacttctctctaa

SEQ ID NO: 159794 - DNA, 25 bp, Homo sapien
tttgaatgatgagccttcgtgcccc

SEQ ID NO: 159795 - DNA, 25 bp, Homo sapien
gactgtttgagacaatgtgcacatc

SEQ ID NO: 159796 - DNA, 25 bp, Homo sapien
aaacgggctaattcttgctccattt

SEQ ID NO: 159797 - DNA, 25 bp, Homo sapien
tacgccatggttttgtttaggataa

SEQ ID NO: 159798 - DNA, 25 bp, Homo sapien
tgtattttatatgctgtggctcccc

SEQ ID NO: 159799 - DNA, 25 bp, Homo sapien
tttcttctagaaagctcccgggtct

SEQ ID NO: 159800 - DNA, 25 bp, Homo sapien
agctcccgggtcttggacaatccaa

SEQ ID NO: 159801 - DNA, 25 bp, Homo sapien
aactctgtccttcttaacaacctgg

SEQ ID NO: 159802 - DNA, 25 bp, Homo sapien
aacaacctggcttgcagtaagtaat

SEQ ID NO: 159803 - DNA, 25 bp, Homo sapien
tgtgtaatatacagcctctccaacg

SEQ ID NO: 159804 - DNA, 25 bp, Homo sapien
tctccaacggcgttttccggctagg

SEQ ID NO: 159805 - DNA, 25 bp, Homo sapien
ggctaggcctccgaagactgtttga

SEQ ID NO: 159806 - DNA, 25 bp, Homo sapien
gaccgcttcctgcagcgattccgaa

SEQ ID NO: 159807 - DNA, 25 bp, Homo sapien
tgcagcgattccgaagccagattga

SEQ ID NO: 159808 - DNA, 25 bp, Homo sapien
agcgattccgaagccagattgagac

SEQ ID NO: 159809 - DNA, 25 bp, Homo sapien
ggagctgggccgtgtgatgggagca

SEQ ID NO: 159810 - DNA, 25 bp, Homo sapien
tgatgggagcagtgacagccctttc

SEQ ID NO: 159811 - DNA, 25 bp, Homo sapien
gggagcagtgacagccctttctcag

SEQ ID NO: 159812 - DNA, 25 bp, Homo sapien
ctttctcaggccctgaatcgccatg

SEQ ID NO: 159813 - DNA, 25 bp, Homo sapien
tgaatcgccatgcagaggccctcaa

SEQ ID NO: 159814 - DNA, 25 bp, Homo sapien
tgcagaggccctcaagtgaccctag

SEQ ID NO: 159815 - DNA, 25 bp, Homo sapien
agaggccctcaagtgaccctaggga

SEQ ID NO: 159816 - DNA, 25 bp, Homo sapien
tgctgctcagcagaggatatgggtg

SEQ ID NO: 159817 - DNA, 25 bp, Homo sapien
ggagacagagtgaagcatcaaccta

SEQ ID NO: 159818 - DNA, 25 bp, Homo sapien
gagtgaagcatcaacctacttagaa

SEQ ID NO: 159819 - DNA, 25 bp, Homo sapien
aagcatcaacctacttagaagctga

SEQ ID NO: 159820 - DNA, 25 bp, Homo sapien
cctacttagaagctgaaacgtgggt

SEQ ID NO: 159821 - DNA, 25 bp, Homo sapien
gaagctgaaacgtgggtaaggattt

SEQ ID NO: 159822 - DNA, 25 bp, Homo sapien
aatagacagcaatcaaacgaagaca

SEQ ID NO: 159823 - DNA, 25 bp, Homo sapien
gccaaaccttggcatttttggtatt

SEQ ID NO: 159824 - DNA, 25 bp, Homo sapien
gtgtataagcttttaaggtctgact

SEQ ID NO: 159825 - DNA, 25 bp, Homo sapien
ataagcttttaaggtctgactgaca

SEQ ID NO: 159826 - DNA, 25 bp, Homo sapien
ggtctgactgacaaattctgtatta

SEQ ID NO: 159827 - DNA, 25 bp, Homo sapien
aattctgtattaaggtgtcatagct

SEQ ID NO: 159828 - DNA, 25 bp, Homo sapien
acctgctcaggttgttggtgctggg

SEQ ID NO: 159829 - DNA, 25 bp, Homo sapien
agctctcctggaacacatacccttc

SEQ ID NO: 159830 - DNA, 25 bp, Homo sapien
ggaacacatacccttccacatcctg

SEQ ID NO: 159831 - DNA, 25 bp, Homo sapien
tctgctgccctgcacatatgccatg

SEQ ID NO: 159832 - DNA, 25 bp, Homo sapien
tgcacatatgccatgccgtcatcct

SEQ ID NO: 159833 - DNA, 25 bp, Homo sapien
gcacatatgccatgccgtcatcctg

SEQ ID NO: 159834 - DNA, 25 bp, Homo sapien
atgccatgccgtcatcctgctgcag

SEQ ID NO: 159835 - DNA, 25 bp, Homo sapien
tttccccaagagcacccaacacagc

SEQ ID NO: 159836 - DNA, 25 bp, Homo sapien
tcaggacctgagtctaccctcagga

SEQ ID NO: 159837 - DNA, 25 bp, Homo sapien
gacctgagtctaccctcaggacctg

SEQ ID NO: 159838 - DNA, 25 bp, Homo sapien
cctgagtctaccctcaggacctggg

SEQ ID NO: 159839 - DNA, 25 bp, Homo sapien
cccaacatgaccacacgtgggtgct

SEQ ID NO: 159840 - DNA, 25 bp, Homo sapien
ccaacatgaccacacgtgggtgctg

SEQ ID NO: 159841 - DNA, 25 bp, Homo sapien
caacatgaccacacgtgggtgctga

SEQ ID NO: 159842 - DNA, 25 bp, Homo sapien
gcgccgtgcccaccggcatggtcct

SEQ ID NO: 159843 - DNA, 25 bp, Homo sapien
gacagcattacctcacccggcccca

SEQ ID NO: 159844 - DNA, 25 bp, Homo sapien
acagcattacctcacccggccccat

SEQ ID NO: 159845 - DNA, 25 bp, Homo sapien
tgttgccccggtccagccctgatgg

SEQ ID NO: 159846 - DNA, 25 bp, Homo sapien
gttgccccggtccagccctgatggc

SEQ ID NO: 159847 - DNA, 25 bp, Homo sapien
ttgccccggtccagccctgatggcg

SEQ ID NO: 159848 - DNA, 25 bp, Homo sapien
tgccccggtccagccctgatggcgc

SEQ ID NO: 159849 - DNA, 25 bp, Homo sapien
ggtccagccctgatggcgcgcgcct

SEQ ID NO: 159850 - DNA, 25 bp, Homo sapien
cctggtgtccttgaccgcatgatga

SEQ ID NO: 159851 - DNA, 25 bp, Homo sapien
aactggacaccaacagtgatggtca

SEQ ID NO: 159852 - DNA, 25 bp, Homo sapien
ggacaccaacagtgatggtcagcta

SEQ ID NO: 159853 - DNA, 25 bp, Homo sapien
ggtcagctagatttctcagaatttc

SEQ ID NO: 159854 - DNA, 25 bp, Homo sapien
agctagatttctcagaatttcttaa

SEQ ID NO: 159855 - DNA, 25 bp, Homo sapien
cttaatctgattggtggcctagcta

SEQ ID NO: 159856 - DNA, 25 bp, Homo sapien
tggcctagctatggcttgccatgac

SEQ ID NO: 159857 - DNA, 25 bp, Homo sapien
tcccttcccagaagcggacctgagg

SEQ ID NO: 159858 - DNA, 25 bp, Homo sapien
agaagcggacctgaggaccccttgg

SEQ ID NO: 159859 - DNA, 25 bp, Homo sapien
gaagcggacctgaggaccccttggc

SEQ ID NO: 159860 - DNA, 25 bp, Homo sapien
tgagcacactaaccacctcatgcag

SEQ ID NO: 159861 - DNA, 25 bp, Homo sapien
gacaggcctgggatatggccatcct

SEQ ID NO: 159862 - DNA, 25 bp, Homo sapien
gggccccagtgttggagcctcagga

SEQ ID NO: 159863 - DNA, 25 bp, Homo sapien
gaagaaccagcaaaagacagtccaa

SEQ ID NO: 159864 - DNA, 25 bp, Homo sapien
gacagtccaacgagacttatcgaga

SEQ ID NO: 159865 - DNA, 25 bp, Homo sapien
gagacttatcgagatgctgttcgaa

SEQ ID NO: 159866 - DNA, 25 bp, Homo sapien
tgctgttcgaagagtcatgtttgct

SEQ ID NO: 159867 - DNA, 25 bp, Homo sapien
catgtttgctcgatataaagaactc

SEQ ID NO: 159868 - DNA, 25 bp, Homo sapien
gacaagttccatgggatacaacctc

SEQ ID NO: 159869 - DNA, 25 bp, Homo sapien
tacaacctccctcttgttttgtttg

SEQ ID NO: 159870 - DNA, 25 bp, Homo sapien
ttgttactgttcttgctgctagaac

SEQ ID NO: 159871 - DNA, 25 bp, Homo sapien
gttcttgctgctagaacttttttaa

SEQ ID NO: 159872 - DNA, 25 bp, Homo sapien
cactaaacaggataaacttttgact

SEQ ID NO: 159873 - DNA, 25 bp, Homo sapien
ttttgactccccttttgttcatttg

SEQ ID NO: 159874 - DNA, 25 bp, Homo sapien
actccccttttgttcatttgtggat

SEQ ID NO: 159875 - DNA, 25 bp, Homo sapien
gttcatttgtggattaagtggtata

SEQ ID NO: 159876 - DNA, 25 bp, Homo sapien
acttaattttggcatttgactctta

SEQ ID NO: 159877 - DNA, 25 bp, Homo sapien
gattatgtaacctagctactttggg

SEQ ID NO: 159878 - DNA, 25 bp, Homo sapien
agctactttgggatggtcttagaat

SEQ ID NO: 159879 - DNA, 25 bp, Homo sapien
tgataacttgttccttttcctgact

SEQ ID NO: 159880 - DNA, 25 bp, Homo sapien
taacttgttccttttcctgactcct

SEQ ID NO: 159881 - DNA, 25 bp, Homo sapien
ctgactcctccttgcaaacaaaatg

SEQ ID NO: 159882 - DNA, 25 bp, Homo sapien
gatagttgacactttatcctgattt

SEQ ID NO: 159883 - DNA, 25 bp, Homo sapien
aaacgggctcgggtctgggcagcac

SEQ ID NO: 159884 - DNA, 25 bp, Homo sapien
gcagcacctctggtcaggagggtca

SEQ ID NO: 159885 - DNA, 25 bp, Homo sapien
agcacctctggtcaggagggtcacc

SEQ ID NO: 159886 - DNA, 25 bp, Homo sapien
acctctggtcaggagggtcaccctg

SEQ ID NO: 159887 - DNA, 25 bp, Homo sapien
ttggttggggcttcacagccacacc

SEQ ID NO: 159888 - DNA, 25 bp, Homo sapien
cccgctccacagagatacacagata

SEQ ID NO: 159889 - DNA, 25 bp, Homo sapien
cgctccacagagatacacagatata

SEQ ID NO: 159890 - DNA, 25 bp, Homo sapien
agatatatacacacagtggatggac

SEQ ID NO: 159891 - DNA, 25 bp, Homo sapien
atacacacagtggatggacggacaa

SEQ ID NO: 159892 - DNA, 25 bp, Homo sapien
cacacagtggatggacggacaagac

SEQ ID NO: 159893 - DNA, 25 bp, Homo sapien
cacagtggatggacggacaagacag

SEQ ID NO: 159894 - DNA, 25 bp, Homo sapien
tggcactgagaaacatgcaagatac

SEQ ID NO: 159895 - DNA, 25 bp, Homo sapien
gaaaatgttacaagctaagagttta

SEQ ID NO: 159896 - DNA, 25 bp, Homo sapien
tattgtttcctgagcataactccat

SEQ ID NO: 159897 - DNA, 25 bp, Homo sapien
gtttcctgagcataactccataagt

SEQ ID NO: 159898 - DNA, 25 bp, Homo sapien
aactccataagtaagaaatttctag

SEQ ID NO: 159899 - DNA, 25 bp, Homo sapien
aatttctagttcacagacatacaat

SEQ ID NO: 159900 - DNA, 25 bp, Homo sapien
tagttcacagacatacaatagcatt

SEQ ID NO: 159901 - DNA, 25 bp, Homo sapien
aatagcattgattcaccttgttttt

SEQ ID NO: 159902 - DNA, 25 bp, Homo sapien
aacctggttgttgtagtaagagctt

SEQ ID NO: 159903 - DNA, 25 bp, Homo sapien
gagctttgtttcaatatcactcttg

SEQ ID NO: 159904 - DNA, 25 bp, Homo sapien
tgtttcaatatcactcttgagtaaa

SEQ ID NO: 159905 - DNA, 25 bp, Homo sapien
aagaaagacatactcaatcctgatt

SEQ ID NO: 159906 - DNA, 25 bp, Homo sapien
gtatggaaacttcaccagacttttt

SEQ ID NO: 159907 - DNA, 25 bp, Homo sapien
ttcttctaaaatctggatgtcattg

SEQ ID NO: 159908 - DNA, 25 bp, Homo sapien
ggatgtcattgacgataatgtttat

SEQ ID NO: 159909 - DNA, 25 bp, Homo sapien
aaaatgtacatatacctggttgaaa

SEQ ID NO: 159910 - DNA, 25 bp, Homo sapien
aacactatacatacacaccaccata

SEQ ID NO: 159911 - DNA, 25 bp, Homo sapien
tacacaccaccatatatactagctg

SEQ ID NO: 159912 - DNA, 25 bp, Homo sapien
atatactagctgttaatcctatgga

SEQ ID NO: 159913 - DNA, 25 bp, Homo sapien
ctagctgttaatcctatggaatggg

SEQ ID NO: 159914 - DNA, 25 bp, Homo sapien
ggcatattttgcatctacaacttct

SEQ ID NO: 159915 - DNA, 25 bp, Homo sapien
attttgcatctacaacttctataat

SEQ ID NO: 159916 - DNA, 25 bp, Homo sapien
atgctggacccatgagcctcgctgg

SEQ ID NO: 159917 - DNA, 25 bp, Homo sapien
aatgggccccagacaagcctttggt

SEQ ID NO: 159918 - DNA, 25 bp, Homo sapien
gggaacagaacctccgcatcgtgta

SEQ ID NO: 159919 - DNA, 25 bp, Homo sapien
acctccgcatcgtgtagttttgtga

SEQ ID NO: 159920 - DNA, 25 bp, Homo sapien
tagttttgtgacataaggagacctc

SEQ ID NO: 159921 - DNA, 25 bp, Homo sapien
agacctcctacttgagctgtctgta

SEQ ID NO: 159922 - DNA, 25 bp, Homo sapien
gagctgtctgtaccccagaatcaaa

SEQ ID NO: 159923 - DNA, 25 bp, Homo sapien
tcagaatcctgcactcaaggtggca

SEQ ID NO: 159924 - DNA, 25 bp, Homo sapien
atgttcatgaactttaaacctggaa

SEQ ID NO: 159925 - DNA, 25 bp, Homo sapien
aaacctggaaacatgtccttactag

SEQ ID NO: 159926 - DNA, 25 bp, Homo sapien
atgtccttactaggtgttttatcaa

SEQ ID NO: 159927 - DNA, 25 bp, Homo sapien
gacttctgtgagtttagacctgccc

SEQ ID NO: 159928 - DNA, 25 bp, Homo sapien
accctgccactatgagctagtgctc

SEQ ID NO: 159929 - DNA, 25 bp, Homo sapien
ctagtgctcatgtgacttggaggca

SEQ ID NO: 159930 - DNA, 25 bp, Homo sapien
ttgatggaacacagatgggctgctt

SEQ ID NO: 159931 - DNA, 25 bp, Homo sapien
tgggctgcttgggaaagaaactttc

SEQ ID NO: 159932 - DNA, 25 bp, Homo sapien
aagaaactttcacctgagcttcacc

SEQ ID NO: 159933 - DNA, 25 bp, Homo sapien
tcacctgagcttcacctgaggtcag

SEQ ID NO: 159934 - DNA, 25 bp, Homo sapien
agactgcagtttcagaaaggtggaa

SEQ ID NO: 159935 - DNA, 25 bp, Homo sapien
atagtcattgtttatttcatggaaa

SEQ ID NO: 159936 - DNA, 25 bp, Homo sapien
aactgaagttctgctgagggctgag

SEQ ID NO: 159937 - DNA, 25 bp, Homo sapien
agggctgagcagcactggcattgaa

SEQ ID NO: 159938 - DNA, 25 bp, Homo sapien
ttgggtcaagtcttaatccctgcac

SEQ ID NO: 159939 - DNA, 25 bp, Homo sapien
taatccctgcacctgagttggtcct

SEQ ID NO: 159940 - DNA, 25 bp, Homo sapien
tgcccgtctggcaactggaaagaag

SEQ ID NO: 159941 - DNA, 25 bp, Homo sapien
tgattttaaccttttgccgctccgg

SEQ ID NO: 159942 - DNA, 25 bp, Homo sapien
gaacagcacaatcctgggcagccag

SEQ ID NO: 159943 - DNA, 25 bp, Homo sapien
gcagccagtggctcttgtagagaaa

SEQ ID NO: 159944 - DNA, 25 bp, Homo sapien
gaaaacttaggatacctctctcact

SEQ ID NO: 159945 - DNA, 25 bp, Homo sapien
ggccatgccagtgtgtcctctgggt

SEQ ID NO: 159946 - DNA, 25 bp, Homo sapien
tgggtcccctccaaaaatctggtca

SEQ ID NO: 159947 - DNA, 25 bp, Homo sapien
aatctggtcattcaaggatcccctc

SEQ ID NO: 159948 - DNA, 25 bp, Homo sapien
ctcccaaggctatgcttttctataa

SEQ ID NO: 159949 - DNA, 25 bp, Homo sapien
gcaacaaactgcaaaattgtccaat

SEQ ID NO: 159950 - DNA, 25 bp, Homo sapien
aaaattgtccaatcctgatctccgg

SEQ ID NO: 159951 - DNA, 25 bp, Homo sapien
gtccaatcctgatctccgggaggga

SEQ ID NO: 159952 - DNA, 25 bp, Homo sapien
gggagggacagatggccaatctctc

SEQ ID NO: 159953 - DNA, 25 bp, Homo sapien
ctcagggagcgaacgtggatgaaaa

SEQ ID NO: 159954 - DNA, 25 bp, Homo sapien
atgccagaccccattttatacttca

SEQ ID NO: 159955 - DNA, 25 bp, Homo sapien
ccagaccccattttatacttcactt

SEQ ID NO: 159956 - DNA, 25 bp, Homo sapien
acttcacttttctctacagtgttgt

SEQ ID NO: 159957 - DNA, 25 bp, Homo sapien
tttttatactttggccataccacag

SEQ ID NO: 159958 - DNA, 25 bp, Homo sapien
ttggccataccacagagctagattg

SEQ ID NO: 159959 - DNA, 25 bp, Homo sapien
gccataccacagagctagattgccc

SEQ ID NO: 159960 - DNA, 25 bp, Homo sapien
gaacattaaacttggagagtccgat

SEQ ID NO: 159961 - DNA, 25 bp, Homo sapien
gaagactgatattttcgatgagttt

SEQ ID NO: 159962 - DNA, 25 bp, Homo sapien
ttcctcctcagcattaaatgcttta

SEQ ID NO: 159963 - DNA, 25 bp, Homo sapien
tgacacattagacctacctcatttc

SEQ ID NO: 159964 - DNA, 25 bp, Homo sapien
attagacctacctcatttcgatgaa

SEQ ID NO: 159965 - DNA, 25 bp, Homo sapien
catttcgatgaatatctgtttgaga

SEQ ID NO: 159966 - DNA, 25 bp, Homo sapien
gaacttacaatgtgttcaggtagtg

SEQ ID NO: 159967 - DNA, 25 bp, Homo sapien
ggtagtgtttatacactggacttgt

SEQ ID NO: 159968 - DNA, 25 bp, Homo sapien
actggacttgtgtaattacttgtgt

SEQ ID NO: 159969 - DNA, 25 bp, Homo sapien
ttaacctttggttctgcccatgaag

SEQ ID NO: 159970 - DNA, 25 bp, Homo sapien
ggttctgcccatgaagcatgtaatc

SEQ ID NO: 159971 - DNA, 25 bp, Homo sapien
taatttgtttccagcatgaggtatc

SEQ ID NO: 159972 - DNA, 25 bp, Homo sapien
ttgtttccagcatgaggtatctaag

SEQ ID NO: 159973 - DNA, 25 bp, Homo sapien
ccagcatgaggtatctaaggattta

SEQ ID NO: 159974 - DNA, 25 bp, Homo sapien
atctaaggatttagaccagaggtct

SEQ ID NO: 159975 - DNA, 25 bp, Homo sapien
agaccagaggtctagattaatactc

SEQ ID NO: 159976 - DNA, 25 bp, Homo sapien
gaggtctagattaatactctatttt

SEQ ID NO: 159977 - DNA, 25 bp, Homo sapien
tttttgttactctcttccacatgtt

SEQ ID NO: 159978 - DNA, 25 bp, Homo sapien
tgttactctcttccacatgttactg

SEQ ID NO: 159979 - DNA, 25 bp, Homo sapien
tactctcttccacatgttactggat

SEQ ID NO: 159980 - DNA, 25 bp, Homo sapien
ctcttccacatgttactggataaat

SEQ ID NO: 159981 - DNA, 25 bp, Homo sapien
gatgacaatcagttatacagttata

SEQ ID NO: 159982 - DNA, 25 bp, Homo sapien
tgtggcccgtcctgtgacccatatt

SEQ ID NO: 159983 - DNA, 25 bp, Homo sapien
ctgtgacccatatttagccgtgttt

SEQ ID NO: 159984 - DNA, 25 bp, Homo sapien
agccgtgtttgggactccgtgtctt

SEQ ID NO: 159985 - DNA, 25 bp, Homo sapien
ggactccgtgtcttcaatggtttgt

SEQ ID NO: 159986 - DNA, 25 bp, Homo sapien
gttgccattacaactttgtctgggt

SEQ ID NO: 159987 - DNA, 25 bp, Homo sapien
agtttttgcagttcagtatccctct

SEQ ID NO: 159988 - DNA, 25 bp, Homo sapien
tgcagttcagtatccctctgtctat

SEQ ID NO: 159989 - DNA, 25 bp, Homo sapien
ctctgtctattcacacttcgtgtta

SEQ ID NO: 159990 - DNA, 25 bp, Homo sapien
gttagtggtaactcagtttgtcttt

SEQ ID NO: 159991 - DNA, 25 bp, Homo sapien
cagaagggatacgtcatttgttaat

SEQ ID NO: 159992 - DNA, 25 bp, Homo sapien
gtgagttaaacgagcttttctgtat

SEQ ID NO: 159993 - DNA, 25 bp, Homo sapien
ggagtgacccccatattttaatgca

SEQ ID NO: 159994 - DNA, 25 bp, Homo sapien
gcagtggtttctctggtcactcacg

SEQ ID NO: 159995 - DNA, 25 bp, Homo sapien
gtttctctggtcactcacggtccag

SEQ ID NO: 159996 - DNA, 25 bp, Homo sapien
ggtcactcacggtccagcactagca

SEQ ID NO: 159997 - DNA, 25 bp, Homo sapien
ccagcactagcacgcagcagtcggg

SEQ ID NO: 159998 - DNA, 25 bp, Homo sapien
aaatgctgtgggtatgagacggcct

SEQ ID NO: 159999 - DNA, 25 bp, Homo sapien
tatgagacggcctggattttgaagg

SEQ ID NO: 160000 - DNA, 25 bp, Homo sapien
ctggattttgaaggcgctgcatgaa

SEQ ID NO: 160001 - DNA, 25 bp, Homo sapien
ttttgaaggcgctgcatgaaaaaga

SEQ ID NO: 160002 - DNA, 25 bp, Homo sapien
gaatctgaatgcattttatgtatag

SEQ ID NO: 160003 - DNA, 25 bp, Homo sapien
atgttgaaatgatgctgttgggata

SEQ ID NO: 160004 - DNA, 25 bp, Homo sapien
aacagaccggagaggacagtggatt

SEQ ID NO: 160005 - DNA, 25 bp, Homo sapien
ggattgtttatactccagtgtacat

SEQ ID NO: 160006 - DNA, 25 bp, Homo sapien
tatactccagtgtacatagtgtaat

SEQ ID NO: 160007 - DNA, 25 bp, Homo sapien
gtagcgtgtttacatgtgtagccta

SEQ ID NO: 160008 - DNA, 25 bp, Homo sapien
gtagcctatgttgtggtccatcagc

SEQ ID NO: 160009 - DNA, 25 bp, Homo sapien
gtaggtggtatgtgacaccaaagcc

SEQ ID NO: 160010 - DNA, 25 bp, Homo sapien
aagccacctctgtcatttgttgtga
